United States Patent 11,369,692 (MATERIALS AND METHODS FOR TREATMENT OF DUCHENNE MUSCULAR DYSTROPHY) - sequence listing, part 40

SEQ ID NO: 1324301 - DNA, 22 bp, Artificial Sequence
  chemically synthesized
ggaatgcatttttatttatatg

SEQ ID NO: 1324302 - DNA, 22 bp, Artificial Sequence
  chemically synthesized
atttggttttacatataaataa

SEQ ID NO: 1324303 - DNA, 22 bp, Artificial Sequence
  chemically synthesized
aggaatgcatttttatttatat

SEQ ID NO: 1324304 - DNA, 22 bp, Artificial Sequence
  chemically synthesized
tttggttttacatataaataaa

SEQ ID NO: 1324305 - DNA, 22 bp, Artificial Sequence
  chemically synthesized
ggttttacatataaataaaaat

SEQ ID NO: 1324306 - DNA, 22 bp, Artificial Sequence
  chemically synthesized
gttttacatataaataaaaatg

SEQ ID NO: 1324307 - DNA, 22 bp, Artificial Sequence
  chemically synthesized
atatgcttaggaatgcattttt

SEQ ID NO: 1324308 - DNA, 22 bp, Artificial Sequence
  chemically synthesized
tacatataaataaaaatgcatt

SEQ ID NO: 1324309 - DNA, 22 bp, Artificial Sequence
  chemically synthesized
aatatgcttaggaatgcatttt

SEQ ID NO: 1324310 - DNA, 22 bp, Artificial Sequence
  chemically synthesized
acatataaataaaaatgcattc

SEQ ID NO: 1324311 - DNA, 22 bp, Artificial Sequence
  chemically synthesized
taatatgcttaggaatgcattt

SEQ ID NO: 1324312 - DNA, 22 bp, Artificial Sequence
  chemically synthesized
catataaataaaaatgcattcc

SEQ ID NO: 1324313 - DNA, 22 bp, Artificial Sequence
  chemically synthesized
tttaatatgcttaggaatgcat

SEQ ID NO: 1324314 - DNA, 22 bp, Artificial Sequence
  chemically synthesized
acaatacaagtgcctctttaat

SEQ ID NO: 1324315 - DNA, 22 bp, Artificial Sequence
  chemically synthesized
ctaagcatattaaagaggcact

SEQ ID NO: 1324316 - DNA, 22 bp, Artificial Sequence
  chemically synthesized
agcatattaaagaggcacttgt

SEQ ID NO: 1324317 - DNA, 22 bp, Artificial Sequence
  chemically synthesized
gtaggacattaacaatacaagt

SEQ ID NO: 1324318 - DNA, 22 bp, Artificial Sequence
  chemically synthesized
agtaggacattaacaatacaag

SEQ ID NO: 1324319 - DNA, 22 bp, Artificial Sequence
  chemically synthesized
tagtaggacattaacaatacaa

SEQ ID NO: 1324320 - DNA, 22 bp, Artificial Sequence
  chemically synthesized
aagaggcacttgtattgttaat

SEQ ID NO: 1324321 - DNA, 22 bp, Artificial Sequence
  chemically synthesized
gctttagtaggacattaacaat

SEQ ID NO: 1324322 - DNA, 22 bp, Artificial Sequence
  chemically synthesized
ctagctttagtaggacattaac

SEQ ID NO: 1324323 - DNA, 22 bp, Artificial Sequence
  chemically synthesized
cctagctttagtaggacattaa

SEQ ID NO: 1324324 - DNA, 22 bp, Artificial Sequence
  chemically synthesized
tcctagctttagtaggacatta

SEQ ID NO: 1324325 - DNA, 22 bp, Artificial Sequence
  chemically synthesized
gtattgttaatgtcctactaaa

SEQ ID NO: 1324326 - DNA, 22 bp, Artificial Sequence
  chemically synthesized
tattttcctagctttagtagga

SEQ ID NO: 1324327 - DNA, 22 bp, Artificial Sequence
  chemically synthesized
tattgttaatgtcctactaaag

SEQ ID NO: 1324328 - DNA, 22 bp, Artificial Sequence
  chemically synthesized
ttaatgtcctactaaagctagg

SEQ ID NO: 1324329 - DNA, 22 bp, Artificial Sequence
  chemically synthesized
atgtcctactaaagctaggaaa

SEQ ID NO: 1324330 - DNA, 22 bp, Artificial Sequence
  chemically synthesized
atccaaaaactgtattttccta

SEQ ID NO: 1324331 - DNA, 22 bp, Artificial Sequence
  chemically synthesized
ctaaagctaggaaaatacagtt

SEQ ID NO: 1324332 - DNA, 22 bp, Artificial Sequence
  chemically synthesized
gatctgatccaaaaactgtatt

SEQ ID NO: 1324333 - DNA, 22 bp, Artificial Sequence
  chemically synthesized
agatctgatccaaaaactgtat

SEQ ID NO: 1324334 - DNA, 22 bp, Artificial Sequence
  chemically synthesized
aagctaggaaaatacagttttt

SEQ ID NO: 1324335 - DNA, 22 bp, Artificial Sequence
  chemically synthesized
aatttagatctgatccaaaaac

SEQ ID NO: 1324336 - DNA, 22 bp, Artificial Sequence
  chemically synthesized
aaatttagatctgatccaaaaa

SEQ ID NO: 1324337 - DNA, 22 bp, Artificial Sequence
  chemically synthesized
ggaaaatacagtttttggatca

SEQ ID NO: 1324338 - DNA, 22 bp, Artificial Sequence
  chemically synthesized
gacttaaatttagatctgatcc

SEQ ID NO: 1324339 - DNA, 22 bp, Artificial Sequence
  chemically synthesized
ttggatcagatctaaatttaag

SEQ ID NO: 1324340 - DNA, 22 bp, Artificial Sequence
  chemically synthesized
tggatcagatctaaatttaagt

SEQ ID NO: 1324341 - DNA, 22 bp, Artificial Sequence
  chemically synthesized
ggatcagatctaaatttaagtc

SEQ ID NO: 1324342 - DNA, 22 bp, Artificial Sequence
  chemically synthesized
gatcagatctaaatttaagtct

SEQ ID NO: 1324343 - DNA, 22 bp, Artificial Sequence
  chemically synthesized
ggtggcagaatctagacttaaa

SEQ ID NO: 1324344 - DNA, 22 bp, Artificial Sequence
  chemically synthesized
ctaggtggcagaatctagactt

SEQ ID NO: 1324345 - DNA, 22 bp, Artificial Sequence
  chemically synthesized
cagctcctaggtggcagaatct

SEQ ID NO: 1324346 - DNA, 22 bp, Artificial Sequence
  chemically synthesized
aatttaagtctagattctgcca

SEQ ID NO: 1324347 - DNA, 22 bp, Artificial Sequence
  chemically synthesized
acagctcctaggtggcagaatc

SEQ ID NO: 1324348 - DNA, 22 bp, Artificial Sequence
  chemically synthesized
tacagctcctaggtggcagaat

SEQ ID NO: 1324349 - DNA, 22 bp, Artificial Sequence
  chemically synthesized
aagtctagattctgccacctag

SEQ ID NO: 1324350 - DNA, 22 bp, Artificial Sequence
  chemically synthesized
agtctagattctgccacctagg

SEQ ID NO: 1324351 - DNA, 22 bp, Artificial Sequence
  chemically synthesized
cacaagattttacagctcctag

SEQ ID NO: 1324352 - DNA, 22 bp, Artificial Sequence
  chemically synthesized
gattctgccacctaggagctgt

SEQ ID NO: 1324353 - DNA, 22 bp, Artificial Sequence
  chemically synthesized
acacaagattttacagctccta

SEQ ID NO: 1324354 - DNA, 22 bp, Artificial Sequence
  chemically synthesized
tgccacctaggagctgtaaaat

SEQ ID NO: 1324355 - DNA, 22 bp, Artificial Sequence
  chemically synthesized
ccacctaggagctgtaaaatct

SEQ ID NO: 1324356 - DNA, 22 bp, Artificial Sequence
  chemically synthesized
agtaatttacacaagattttac

SEQ ID NO: 1324357 - DNA, 22 bp, Artificial Sequence
  chemically synthesized
cagtaatttacacaagatttta

SEQ ID NO: 1324358 - DNA, 22 bp, Artificial Sequence
  chemically synthesized
tcagtaatttacacaagatttt

SEQ ID NO: 1324359 - DNA, 22 bp, Artificial Sequence
  chemically synthesized
ttcagtaatttacacaagattt

SEQ ID NO: 1324360 - DNA, 22 bp, Artificial Sequence
  chemically synthesized
ggagctgtaaaatcttgtgtaa

SEQ ID NO: 1324361 - DNA, 22 bp, Artificial Sequence
  chemically synthesized
taaaatcttgtgtaaattactg

SEQ ID NO: 1324362 - DNA, 22 bp, Artificial Sequence
  chemically synthesized
agagagatttttcagtaattta

SEQ ID NO: 1324363 - DNA, 22 bp, Artificial Sequence
  chemically synthesized
gtgtaaattactgaaaaatctc

SEQ ID NO: 1324364 - DNA, 22 bp, Artificial Sequence
  chemically synthesized
tgtaaattactgaaaaatctct

SEQ ID NO: 1324365 - DNA, 22 bp, Artificial Sequence
  chemically synthesized
ctgaaaaatctctctgaaccct

SEQ ID NO: 1324366 - DNA, 22 bp, Artificial Sequence
  chemically synthesized
aaaaatctctctgaaccctatt

SEQ ID NO: 1324367 - DNA, 22 bp, Artificial Sequence
  chemically synthesized
atcaatatagataatagggttc

SEQ ID NO: 1324368 - DNA, 22 bp, Artificial Sequence
  chemically synthesized
tctgaaccctattatctatatt

SEQ ID NO: 1324369 - DNA, 22 bp, Artificial Sequence
  chemically synthesized
tgcccattcatcaatatagata

SEQ ID NO: 1324370 - DNA, 22 bp, Artificial Sequence
  chemically synthesized
atgcccattcatcaatatagat

SEQ ID NO: 1324371 - DNA, 22 bp, Artificial Sequence
  chemically synthesized
tgaaccctattatctatattga

SEQ ID NO: 1324372 - DNA, 22 bp, Artificial Sequence
  chemically synthesized
ttatgcccattcatcaatatag

SEQ ID NO: 1324373 - DNA, 22 bp, Artificial Sequence
  chemically synthesized
aaccctattatctatattgatg

SEQ ID NO: 1324374 - DNA, 22 bp, Artificial Sequence
  chemically synthesized
tcttatgcccattcatcaatat

SEQ ID NO: 1324375 - DNA, 22 bp, Artificial Sequence
  chemically synthesized
ctcttatgcccattcatcaata

SEQ ID NO: 1324376 - DNA, 22 bp, Artificial Sequence
  chemically synthesized
ttatctatattgatgaatgggc

SEQ ID NO: 1324377 - DNA, 22 bp, Artificial Sequence
  chemically synthesized
tctatattgatgaatgggcata

SEQ ID NO: 1324378 - DNA, 22 bp, Artificial Sequence
  chemically synthesized
aagtagtttctcttatgcccat

SEQ ID NO: 1324379 - DNA, 22 bp, Artificial Sequence
  chemically synthesized
tattgatgaatgggcataagag

SEQ ID NO: 1324380 - DNA, 22 bp, Artificial Sequence
  chemically synthesized
gcctgaagtagtttctcttatg

SEQ ID NO: 1324381 - DNA, 22 bp, Artificial Sequence
  chemically synthesized
atgaatgggcataagagaaact

SEQ ID NO: 1324382 - DNA, 22 bp, Artificial Sequence
  chemically synthesized
tgggcgtgagccaccgcacctg

SEQ ID NO: 1324383 - DNA, 22 bp, Artificial Sequence
  chemically synthesized
cttcaggccaggtgcggtggct

SEQ ID NO: 1324384 - DNA, 22 bp, Artificial Sequence
  chemically synthesized
agattatgggcgtgagccaccg

SEQ ID NO: 1324385 - DNA, 22 bp, Artificial Sequence
  chemically synthesized
caggccaggtgcggtggctcac

SEQ ID NO: 1324386 - DNA, 22 bp, Artificial Sequence
  chemically synthesized
aggccaggtgcggtggctcacg

SEQ ID NO: 1324387 - DNA, 22 bp, Artificial Sequence
  chemically synthesized
ccaaagtgctgagattatgggc

SEQ ID NO: 1324388 - DNA, 22 bp, Artificial Sequence
  chemically synthesized
ggcctcccaaagtgctgagatt

SEQ ID NO: 1324389 - DNA, 22 bp, Artificial Sequence
  chemically synthesized
acgcccataatctcagcacttt

SEQ ID NO: 1324390 - DNA, 22 bp, Artificial Sequence
  chemically synthesized
agcactttgggaggccgaggca

SEQ ID NO: 1324391 - DNA, 22 bp, Artificial Sequence
  chemically synthesized
aggtgatccgcgtgcctcggcc

SEQ ID NO: 1324392 - DNA, 22 bp, Artificial Sequence
  chemically synthesized
acctcaggtgatccgcgtgcct

SEQ ID NO: 1324393 - DNA, 22 bp, Artificial Sequence
  chemically synthesized
tgggaggccgaggcacgcggat

SEQ ID NO: 1324394 - DNA, 22 bp, Artificial Sequence
  chemically synthesized
gggaggccgaggcacgcggatc

SEQ ID NO: 1324395 - DNA, 22 bp, Artificial Sequence
  chemically synthesized
ctgacctcaggtgatccgcgtg

SEQ ID NO: 1324396 - DNA, 22 bp, Artificial Sequence
  chemically synthesized
ggaggccgaggcacgcggatca

SEQ ID NO: 1324397 - DNA, 22 bp, Artificial Sequence
  chemically synthesized
gaactcctgacctcaggtgatc

SEQ ID NO: 1324398 - DNA, 22 bp, Artificial Sequence
  chemically synthesized
gtctcgaactcctgacctcagg

SEQ ID NO: 1324399 - DNA, 22 bp, Artificial Sequence
  chemically synthesized
gccaggctggtctcgaactcct

SEQ ID NO: 1324400 - DNA, 22 bp, Artificial Sequence
  chemically synthesized
aggtcaggagttcgagaccagc

SEQ ID NO: 1324401 - DNA, 22 bp, Artificial Sequence
  chemically synthesized
tacgttggccaggctggtctcg

SEQ ID NO: 1324402 - DNA, 22 bp, Artificial Sequence
  chemically synthesized
actatacgttggccaggctggt

SEQ ID NO: 1324403 - DNA, 22 bp, Artificial Sequence
  chemically synthesized
cactatacgttggccaggctgg

SEQ ID NO: 1324404 - DNA, 22 bp, Artificial Sequence
  chemically synthesized
gagaccagcctggccaacgtat

SEQ ID NO: 1324405 - DNA, 22 bp, Artificial Sequence
  chemically synthesized
gtagagacggggtttcactata

SEQ ID NO: 1324406 - DNA, 22 bp, Artificial Sequence
  chemically synthesized
agtagagacggggtttcactat

SEQ ID NO: 1324407 - DNA, 22 bp, Artificial Sequence
  chemically synthesized
tagtagagacggggtttcacta

SEQ ID NO: 1324408 - DNA, 22 bp, Artificial Sequence
  chemically synthesized
ttagtagagacggggtttcact

SEQ ID NO: 1324409 - DNA, 22 bp, Artificial Sequence
  chemically synthesized
tttagtagagacggggtttcac

SEQ ID NO: 1324410 - DNA, 22 bp, Artificial Sequence
  chemically synthesized
gccaacgtatagtgaaaccccg

SEQ ID NO: 1324411 - DNA, 22 bp, Artificial Sequence
  chemically synthesized
tattttttagtagagacggggt

SEQ ID NO: 1324412 - DNA, 22 bp, Artificial Sequence
  chemically synthesized
tgtattttttagtagagacggg

SEQ ID NO: 1324413 - DNA, 22 bp, Artificial Sequence
  chemically synthesized
ctgtattttttagtagagacgg

SEQ ID NO: 1324414 - DNA, 22 bp, Artificial Sequence
  chemically synthesized
atttctgtattttttagtagag

SEQ ID NO: 1324415 - DNA, 22 bp, Artificial Sequence
  chemically synthesized
tactaaaaaatacagaaattag

SEQ ID NO: 1324416 - DNA, 22 bp, Artificial Sequence
  chemically synthesized
ctaaaaaatacagaaattagct

SEQ ID NO: 1324417 - DNA, 22 bp, Artificial Sequence
  chemically synthesized
aaaaatacagaaattagctggg

SEQ ID NO: 1324418 - DNA, 22 bp, Artificial Sequence
  chemically synthesized
caggcatgtgccaccacgccca

SEQ ID NO: 1324419 - DNA, 22 bp, Artificial Sequence
  chemically synthesized
ggactacaggcatgtgccacca

SEQ ID NO: 1324420 - DNA, 22 bp, Artificial Sequence
  chemically synthesized
gctgggcgtggtggcacatgcc

SEQ ID NO: 1324421 - DNA, 22 bp, Artificial Sequence
  chemically synthesized
ggcgtggtggcacatgcctgta

SEQ ID NO: 1324422 - DNA, 22 bp, Artificial Sequence
  chemically synthesized
ccaagtagctgggactacaggc

SEQ ID NO: 1324423 - DNA, 22 bp, Artificial Sequence
  chemically synthesized
cccaagtagctgggactacagg

SEQ ID NO: 1324424 - DNA, 22 bp, Artificial Sequence
  chemically synthesized
gcttcccaagtagctgggacta

SEQ ID NO: 1324425 - DNA, 22 bp, Artificial Sequence
  chemically synthesized
agcttcccaagtagctgggact

SEQ ID NO: 1324426 - DNA, 22 bp, Artificial Sequence
  chemically synthesized
ccttagcttcccaagtagctgg

SEQ ID NO: 1324427 - DNA, 22 bp, Artificial Sequence
  chemically synthesized
ctgccttagcttcccaagtagc

SEQ ID NO: 1324428 - DNA, 22 bp, Artificial Sequence
  chemically synthesized
tcctgccttagcttcccaagta

SEQ ID NO: 1324429 - DNA, 22 bp, Artificial Sequence
  chemically synthesized
tagtcccagctacttgggaagc

SEQ ID NO: 1324430 - DNA, 22 bp, Artificial Sequence
  chemically synthesized
aagcgattctcctgccttagct

SEQ ID NO: 1324431 - DNA, 22 bp, Artificial Sequence
  chemically synthesized
gttcaagcgattctcctgcctt

SEQ ID NO: 1324432 - DNA, 22 bp, Artificial Sequence
  chemically synthesized
cttgggaagctaaggcaggaga

SEQ ID NO: 1324433 - DNA, 22 bp, Artificial Sequence
  chemically synthesized
gggaagctaaggcaggagaatc

SEQ ID NO: 1324434 - DNA, 22 bp, Artificial Sequence
  chemically synthesized
cctggttcaagcgattctcctg

SEQ ID NO: 1324435 - DNA, 22 bp, Artificial Sequence
  chemically synthesized
ggaagctaaggcaggagaatcg

SEQ ID NO: 1324436 - DNA, 22 bp, Artificial Sequence
  chemically synthesized
cgcctccctggttcaagcgatt

SEQ ID NO: 1324437 - DNA, 22 bp, Artificial Sequence
  chemically synthesized
aggcaggagaatcgcttgaacc

SEQ ID NO: 1324438 - DNA, 22 bp, Artificial Sequence
  chemically synthesized
caacctccgcctccctggttca

SEQ ID NO: 1324439 - DNA, 22 bp, Artificial Sequence
  chemically synthesized
cccgctgcaacctccgcctccc

SEQ ID NO: 1324440 - DNA, 22 bp, Artificial Sequence
  chemically synthesized
tgcccgctgcaacctccgcctc

SEQ ID NO: 1324441 - DNA, 22 bp, Artificial Sequence
  chemically synthesized
gaaccagggaggcggaggttgc

SEQ ID NO: 1324442 - DNA, 22 bp, Artificial Sequence
  chemically synthesized
aaccagggaggcggaggttgca

SEQ ID NO: 1324443 - DNA, 22 bp, Artificial Sequence
  chemically synthesized
gagtgcagtggcacgatctctg

SEQ ID NO: 1324444 - DNA, 22 bp, Artificial Sequence
  chemically synthesized
cagcgggcagagatcgtgccac

SEQ ID NO: 1324445 - DNA, 22 bp, Artificial Sequence
  chemically synthesized
cccaggctggagtgcagtggca

SEQ ID NO: 1324446 - DNA, 22 bp, Artificial Sequence
  chemically synthesized
ttgcccaggctggagtgcagtg

SEQ ID NO: 1324447 - DNA, 22 bp, Artificial Sequence
  chemically synthesized
tgttgcccaggctggagtgcag

SEQ ID NO: 1324448 - DNA, 22 bp, Artificial Sequence
  chemically synthesized
ctctgttgcccaggctggagtg

SEQ ID NO: 1324449 - DNA, 22 bp, Artificial Sequence
  chemically synthesized
gctctgttgcccaggctggagt

SEQ ID NO: 1324450 - DNA, 22 bp, Artificial Sequence
  chemically synthesized
cactccagcctgggcaacagag

SEQ ID NO: 1324451 - DNA, 22 bp, Artificial Sequence
  chemically synthesized
agagatggagtcttgctctgtt

SEQ ID NO: 1324452 - DNA, 22 bp, Artificial Sequence
  chemically synthesized
gagagatggagtcttgctctgt

SEQ ID NO: 1324453 - DNA, 22 bp, Artificial Sequence
  chemically synthesized
cagcctgggcaacagagcaaga

SEQ ID NO: 1324454 - DNA, 22 bp, Artificial Sequence
  chemically synthesized
tgagagatggagtcttgctctg

SEQ ID NO: 1324455 - DNA, 22 bp, Artificial Sequence
  chemically synthesized
ttgagagatggagtcttgctct

SEQ ID NO: 1324456 - DNA, 22 bp, Artificial Sequence
  chemically synthesized
tttgagagatggagtcttgctc

SEQ ID NO: 1324457 - DNA, 22 bp, Artificial Sequence
  chemically synthesized
ttttgagagatggagtcttgct

SEQ ID NO: 1324458 - DNA, 22 bp, Artificial Sequence
  chemically synthesized
tttttgagagatggagtcttgc

SEQ ID NO: 1324459 - DNA, 22 bp, Artificial Sequence
  chemically synthesized
tttttttgagagatggagtctt

SEQ ID NO: 1324460 - DNA, 22 bp, Artificial Sequence
  chemically synthesized
ggcaacagagcaagactccatc

SEQ ID NO: 1324461 - DNA, 22 bp, Artificial Sequence
  chemically synthesized
ctttttttgagagatggagtct

SEQ ID NO: 1324462 - DNA, 22 bp, Artificial Sequence
  chemically synthesized
tctttttttgagagatggagtc

SEQ ID NO: 1324463 - DNA, 22 bp, Artificial Sequence
  chemically synthesized
ttctttttttgagagatggagt

SEQ ID NO: 1324464 - DNA, 22 bp, Artificial Sequence
  chemically synthesized
ttttctttttttgagagatgga

SEQ ID NO: 1324465 - DNA, 22 bp, Artificial Sequence
  chemically synthesized
cttttctttttttgagagatgg

SEQ ID NO: 1324466 - DNA, 22 bp, Artificial Sequence
  chemically synthesized
tcttttctttttttgagagatg

SEQ ID NO: 1324467 - DNA, 22 bp, Artificial Sequence
  chemically synthesized
ttcttttctttttttgagagat

SEQ ID NO: 1324468 - DNA, 22 bp, Artificial Sequence
  chemically synthesized
ttttcttttctttttttgagag

SEQ ID NO: 1324469 - DNA, 22 bp, Artificial Sequence
  chemically synthesized
cttttcttttctttttttgaga

SEQ ID NO: 1324470 - DNA, 22 bp, Artificial Sequence
  chemically synthesized
ttcttttcttttctttttttga

SEQ ID NO: 1324471 - DNA, 22 bp, Artificial Sequence
  chemically synthesized
cttcttttcttttctttttttg

SEQ ID NO: 1324472 - DNA, 22 bp, Artificial Sequence
  chemically synthesized
tcttcttttcttttcttttttt

SEQ ID NO: 1324473 - DNA, 22 bp, Artificial Sequence
  chemically synthesized
ttcttcttttcttttctttttt

SEQ ID NO: 1324474 - DNA, 22 bp, Artificial Sequence
  chemically synthesized
tttcttcttttcttttcttttt

SEQ ID NO: 1324475 - DNA, 22 bp, Artificial Sequence
  chemically synthesized
ttttcttcttttcttttctttt

SEQ ID NO: 1324476 - DNA, 22 bp, Artificial Sequence
  chemically synthesized
catctctcaaaaaaagaaaaga

SEQ ID NO: 1324477 - DNA, 22 bp, Artificial Sequence
  chemically synthesized
tttttcttcttttcttttcttt

SEQ ID NO: 1324478 - DNA, 22 bp, Artificial Sequence
  chemically synthesized
ttttttcttcttttcttttctt

SEQ ID NO: 1324479 - DNA, 22 bp, Artificial Sequence
  chemically synthesized
tttttttcttcttttcttttct

SEQ ID NO: 1324480 - DNA, 22 bp, Artificial Sequence
  chemically synthesized
tttttttttcttcttttctttt

SEQ ID NO: 1324481 - DNA, 22 bp, Artificial Sequence
  chemically synthesized
ctttttttttcttcttttcttt

SEQ ID NO: 1324482 - DNA, 22 bp, Artificial Sequence
  chemically synthesized
tcaaaaaaagaaaagaaaagaa

SEQ ID NO: 1324483 - DNA, 22 bp, Artificial Sequence
  chemically synthesized
tctttttttttcttcttttctt

SEQ ID NO: 1324484 - DNA, 22 bp, Artificial Sequence
  chemically synthesized
aaaaaaagaaaagaaaagaaga

SEQ ID NO: 1324485 - DNA, 22 bp, Artificial Sequence
  chemically synthesized
tttctttttttttcttcttttc

SEQ ID NO: 1324486 - DNA, 22 bp, Artificial Sequence
  chemically synthesized
ctttctttttttttcttctttt

SEQ ID NO: 1324487 - DNA, 22 bp, Artificial Sequence
  chemically synthesized
tctttctttttttttcttcttt

SEQ ID NO: 1324488 - DNA, 22 bp, Artificial Sequence
  chemically synthesized
ttctttctttttttttcttctt

SEQ ID NO: 1324489 - DNA, 22 bp, Artificial Sequence
  chemically synthesized
aagtagtttttctttctttttt

SEQ ID NO: 1324490 - DNA, 22 bp, Artificial Sequence
  chemically synthesized
gaagtagtttttctttcttttt

SEQ ID NO: 1324491 - DNA, 22 bp, Artificial Sequence
  chemically synthesized
ccaaaagccatttgaagtagtt

SEQ ID NO: 1324492 - DNA, 22 bp, Artificial Sequence
  chemically synthesized
cccaaaagccatttgaagtagt

SEQ ID NO: 1324493 - DNA, 22 bp, Artificial Sequence
  chemically synthesized
ttcccaaaagccatttgaagta

SEQ ID NO: 1324494 - DNA, 22 bp, Artificial Sequence
  chemically synthesized
gttcttcccaaaagccatttga

SEQ ID NO: 1324495 - DNA, 22 bp, Artificial Sequence
  chemically synthesized
tcacattagttcttcccaaaag

SEQ ID NO: 1324496 - DNA, 22 bp, Artificial Sequence
  chemically synthesized
cttcaaatggcttttgggaaga

SEQ ID NO: 1324497 - DNA, 22 bp, Artificial Sequence
  chemically synthesized
caaatggcttttgggaagaact

SEQ ID NO: 1324498 - DNA, 22 bp, Artificial Sequence
  chemically synthesized
aaatggcttttgggaagaacta

SEQ ID NO: 1324499 - DNA, 22 bp, Artificial Sequence
  chemically synthesized
aacacacactatcacattagtt

SEQ ID NO: 1324500 - DNA, 22 bp, Artificial Sequence
  chemically synthesized
ttgggaagaactaatgtgatag

SEQ ID NO: 1324501 - DNA, 22 bp, Artificial Sequence
  chemically synthesized
tgggaagaactaatgtgatagt

SEQ ID NO: 1324502 - DNA, 22 bp, Artificial Sequence
  chemically synthesized
gggaagaactaatgtgatagtg

SEQ ID NO: 1324503 - DNA, 22 bp, Artificial Sequence
  chemically synthesized
ggaagaactaatgtgatagtgt

SEQ ID NO: 1324504 - DNA, 22 bp, Artificial Sequence
  chemically synthesized
cgcattcaacacacactatcac

SEQ ID NO: 1324505 - DNA, 22 bp, Artificial Sequence
  chemically synthesized
atgtgatagtgtgtgttgaatg

SEQ ID NO: 1324506 - DNA, 22 bp, Artificial Sequence
  chemically synthesized
tcaggcactacgcattcaacac

SEQ ID NO: 1324507 - DNA, 22 bp, Artificial Sequence
  chemically synthesized
tgcactatcaggcactacgcat

SEQ ID NO: 1324508 - DNA, 22 bp, Artificial Sequence
  chemically synthesized
attatgcactatcaggcactac

SEQ ID NO: 1324509 - DNA, 22 bp, Artificial Sequence
  chemically synthesized
ttaattatgcactatcaggcac

SEQ ID NO: 1324510 - DNA, 22 bp, Artificial Sequence
  chemically synthesized
attaattatgcactatcaggca

SEQ ID NO: 1324511 - DNA, 22 bp, Artificial Sequence
  chemically synthesized
aatgcgtagtgcctgatagtgc

SEQ ID NO: 1324512 - DNA, 22 bp, Artificial Sequence
  chemically synthesized
atagtgcataattaataaatgt

SEQ ID NO: 1324513 - DNA, 22 bp, Artificial Sequence
  chemically synthesized
gaaaagggaataaacatttatt

SEQ ID NO: 1324514 - DNA, 22 bp, Artificial Sequence
  chemically synthesized
agaaaagggaataaacatttat

SEQ ID NO: 1324515 - DNA, 22 bp, Artificial Sequence
  chemically synthesized
tagaaaagggaataaacattta

SEQ ID NO: 1324516 - DNA, 22 bp, Artificial Sequence
  chemically synthesized
attttagaaaagggaataaaca

SEQ ID NO: 1324517 - DNA, 22 bp, Artificial Sequence
  chemically synthesized
ctcattttagaaaagggaataa

SEQ ID NO: 1324518 - DNA, 22 bp, Artificial Sequence
  chemically synthesized
cctcattttagaaaagggaata

SEQ ID NO: 1324519 - DNA, 22 bp, Artificial Sequence
  chemically synthesized
ataaatgtttattcccttttct

SEQ ID NO: 1324520 - DNA, 22 bp, Artificial Sequence
  chemically synthesized
cttcctcattttagaaaaggga

SEQ ID NO: 1324521 - DNA, 22 bp, Artificial Sequence
  chemically synthesized
acttcctcattttagaaaaggg

SEQ ID NO: 1324522 - DNA, 22 bp, Artificial Sequence
  chemically synthesized
tttacttcctcattttagaaaa

SEQ ID NO: 1324523 - DNA, 22 bp, Artificial Sequence
  chemically synthesized
attcccttttctaaaatgagga

SEQ ID NO: 1324524 - DNA, 22 bp, Artificial Sequence
  chemically synthesized
ttcccttttctaaaatgaggaa

SEQ ID NO: 1324525 - DNA, 22 bp, Artificial Sequence
  chemically synthesized
ccatattatttacttcctcatt

SEQ ID NO: 1324526 - DNA, 22 bp, Artificial Sequence
  chemically synthesized
accatattatttacttcctcat

SEQ ID NO: 1324527 - DNA, 22 bp, Artificial Sequence
  chemically synthesized
ccttttctaaaatgaggaagta

SEQ ID NO: 1324528 - DNA, 22 bp, Artificial Sequence
  chemically synthesized
ttctaaaatgaggaagtaaata

SEQ ID NO: 1324529 - DNA, 22 bp, Artificial Sequence
  chemically synthesized
tctaaaatgaggaagtaaataa

SEQ ID NO: 1324530 - DNA, 22 bp, Artificial Sequence
  chemically synthesized
ctaaaatgaggaagtaaataat

SEQ ID NO: 1324531 - DNA, 22 bp, Artificial Sequence
  chemically synthesized
taaaatgaggaagtaaataata

SEQ ID NO: 1324532 - DNA, 22 bp, Artificial Sequence
  chemically synthesized
aaatgaggaagtaaataatatg

SEQ ID NO: 1324533 - DNA, 22 bp, Artificial Sequence
  chemically synthesized
aaaaagagaaaaaatgtcattt

SEQ ID NO: 1324534 - DNA, 22 bp, Artificial Sequence
  chemically synthesized
aaaaaagagaaaaaatgtcatt

SEQ ID NO: 1324535 - DNA, 22 bp, Artificial Sequence
  chemically synthesized
tgaatataatttaaaaaagaga

SEQ ID NO: 1324536 - DNA, 22 bp, Artificial Sequence
  chemically synthesized
gtgaatataatttaaaaaagag

SEQ ID NO: 1324537 - DNA, 22 bp, Artificial Sequence
  chemically synthesized
ccttgtgaatataatttaaaaa

SEQ ID NO: 1324538 - DNA, 22 bp, Artificial Sequence
  chemically synthesized
tttctcttttttaaattatatt

SEQ ID NO: 1324539 - DNA, 22 bp, Artificial Sequence
  chemically synthesized
ttctcttttttaaattatattc

SEQ ID NO: 1324540 - DNA, 22 bp, Artificial Sequence
  chemically synthesized
tctcttttttaaattatattca

SEQ ID NO: 1324541 - DNA, 22 bp, Artificial Sequence
  chemically synthesized
ctcttttttaaattatattcac

SEQ ID NO: 1324542 - DNA, 22 bp, Artificial Sequence
  chemically synthesized
tcttttttaaattatattcaca

SEQ ID NO: 1324543 - DNA, 22 bp, Artificial Sequence
  chemically synthesized
ttttttaaattatattcacaag

SEQ ID NO: 1324544 - DNA, 22 bp, Artificial Sequence
  chemically synthesized
ttttaaattatattcacaaggt

SEQ ID NO: 1324545 - DNA, 22 bp, Artificial Sequence
  chemically synthesized
tttaaattatattcacaaggta

SEQ ID NO: 1324546 - DNA, 22 bp, Artificial Sequence
  chemically synthesized
ttaaattatattcacaaggtag

SEQ ID NO: 1324547 - DNA, 22 bp, Artificial Sequence
  chemically synthesized
taaattatattcacaaggtaga

SEQ ID NO: 1324548 - DNA, 22 bp, Artificial Sequence
  chemically synthesized
aaattatattcacaaggtagac

SEQ ID NO: 1324549 - DNA, 22 bp, Artificial Sequence
  chemically synthesized
aattatattcacaaggtagact

SEQ ID NO: 1324550 - DNA, 22 bp, Artificial Sequence
  chemically synthesized
atatagagggaaacaagtctac

SEQ ID NO: 1324551 - DNA, 22 bp, Artificial Sequence
  chemically synthesized
tattcacaaggtagacttgttt

SEQ ID NO: 1324552 - DNA, 22 bp, Artificial Sequence
  chemically synthesized
ctgatatagagggaaacaagtc

SEQ ID NO: 1324553 - DNA, 22 bp, Artificial Sequence
  chemically synthesized
actgatatagagggaaacaagt

SEQ ID NO: 1324554 - DNA, 22 bp, Artificial Sequence
  chemically synthesized
acaaggtagacttgtttccctc

SEQ ID NO: 1324555 - DNA, 22 bp, Artificial Sequence
  chemically synthesized
aaaataaacaagcttactgata

SEQ ID NO: 1324556 - DNA, 22 bp, Artificial Sequence
  chemically synthesized
gtttccctctatatcagtaagc

SEQ ID NO: 1324557 - DNA, 22 bp, Artificial Sequence
  chemically synthesized
aaaaataaacaagcttactgat

SEQ ID NO: 1324558 - DNA, 22 bp, Artificial Sequence
  chemically synthesized
tttccctctatatcagtaagct

SEQ ID NO: 1324559 - DNA, 22 bp, Artificial Sequence
  chemically synthesized
ccctctatatcagtaagcttgt

SEQ ID NO: 1324560 - DNA, 22 bp, Artificial Sequence
  chemically synthesized
cctctatatcagtaagcttgtt

SEQ ID NO: 1324561 - DNA, 22 bp, Artificial Sequence
  chemically synthesized
tatatcagtaagcttgtttatt

SEQ ID NO: 1324562 - DNA, 22 bp, Artificial Sequence
  chemically synthesized
agccagtttaaaaataaacaag

SEQ ID NO: 1324563 - DNA, 22 bp, Artificial Sequence
  chemically synthesized
gagccagtttaaaaataaacaa

SEQ ID NO: 1324564 - DNA, 22 bp, Artificial Sequence
  chemically synthesized
tatcagtaagcttgtttatttt

SEQ ID NO: 1324565 - DNA, 22 bp, Artificial Sequence
  chemically synthesized
ccttgagccagtttaaaaataa

SEQ ID NO: 1324566 - DNA, 22 bp, Artificial Sequence
  chemically synthesized
aattgccttgagccagtttaaa

SEQ ID NO: 1324567 - DNA, 22 bp, Artificial Sequence
  chemically synthesized
caattgccttgagccagtttaa

SEQ ID NO: 1324568 - DNA, 22 bp, Artificial Sequence
  chemically synthesized
gtttatttttaaactggctcaa

SEQ ID NO: 1324569 - DNA, 22 bp, Artificial Sequence
  chemically synthesized
tttatttttaaactggctcaag

SEQ ID NO: 1324570 - DNA, 22 bp, Artificial Sequence
  chemically synthesized
atttttaaactggctcaaggca

SEQ ID NO: 1324571 - DNA, 22 bp, Artificial Sequence
  chemically synthesized
tttttaaactggctcaaggcaa

SEQ ID NO: 1324572 - DNA, 22 bp, Artificial Sequence
  chemically synthesized
aaatatcttcaattgccttgag

SEQ ID NO: 1324573 - DNA, 22 bp, Artificial Sequence
  chemically synthesized
ttaaactggctcaaggcaattg

SEQ ID NO: 1324574 - DNA, 22 bp, Artificial Sequence
  chemically synthesized
taaactggctcaaggcaattga

SEQ ID NO: 1324575 - DNA, 22 bp, Artificial Sequence
  chemically synthesized
tctgaaatatcttcaattgcct

SEQ ID NO: 1324576 - DNA, 22 bp, Artificial Sequence
  chemically synthesized
aaactggctcaaggcaattgaa

SEQ ID NO: 1324577 - DNA, 22 bp, Artificial Sequence
  chemically synthesized
aactggctcaaggcaattgaag

SEQ ID NO: 1324578 - DNA, 22 bp, Artificial Sequence
  chemically synthesized
ttatctgaaatatcttcaattg

SEQ ID NO: 1324579 - DNA, 22 bp, Artificial Sequence
  chemically synthesized
tgttatctgaaatatcttcaat

SEQ ID NO: 1324580 - DNA, 22 bp, Artificial Sequence
  chemically synthesized
ctgttatctgaaatatcttcaa

SEQ ID NO: 1324581 - DNA, 22 bp, Artificial Sequence
  chemically synthesized
gctcaaggcaattgaagatatt

SEQ ID NO: 1324582 - DNA, 22 bp, Artificial Sequence
  chemically synthesized
acttctgttatctgaaatatct

SEQ ID NO: 1324583 - DNA, 22 bp, Artificial Sequence
  chemically synthesized
aaggcaattgaagatatttcag

SEQ ID NO: 1324584 - DNA, 22 bp, Artificial Sequence
  chemically synthesized
aagatatttcagataacagaag

SEQ ID NO: 1324585 - DNA, 22 bp, Artificial Sequence
  chemically synthesized
cagataacagaagttaaccttt

SEQ ID NO: 1324586 - DNA, 22 bp, Artificial Sequence
  chemically synthesized
agataacagaagttaacctttc

SEQ ID NO: 1324587 - DNA, 22 bp, Artificial Sequence
  chemically synthesized
aataccaagaggatggaaaggt

SEQ ID NO: 1324588 - DNA, 22 bp, Artificial Sequence
  chemically synthesized
gaataccaagaggatggaaagg

SEQ ID NO: 1324589 - DNA, 22 bp, Artificial Sequence
  chemically synthesized
acctttccatcctcttggtatt

SEQ ID NO: 1324590 - DNA, 22 bp, Artificial Sequence
  chemically synthesized
tccatcctcttggtattcaaat

SEQ ID NO: 1324591 - DNA, 22 bp, Artificial Sequence
  chemically synthesized
ccatcctcttggtattcaaatt

SEQ ID NO: 1324592 - DNA, 22 bp, Artificial Sequence
  chemically synthesized
catcctcttggtattcaaattc

SEQ ID NO: 1324593 - DNA, 22 bp, Artificial Sequence
  chemically synthesized
tcaaaggagaaagaatttgaat

SEQ ID NO: 1324594 - DNA, 22 bp, Artificial Sequence
  chemically synthesized
atcaaaggagaaagaatttgaa

SEQ ID NO: 1324595 - DNA, 22 bp, Artificial Sequence
  chemically synthesized
tatcaaaggagaaagaatttga

SEQ ID NO: 1324596 - DNA, 22 bp, Artificial Sequence
  chemically synthesized
ttggtattcaaattctttctcc

SEQ ID NO: 1324597 - DNA, 22 bp, Artificial Sequence
  chemically synthesized
ggtattcaaattctttctcctt

SEQ ID NO: 1324598 - DNA, 22 bp, Artificial Sequence
  chemically synthesized
aaagttttatcaaaggagaaag

SEQ ID NO: 1324599 - DNA, 22 bp, Artificial Sequence
  chemically synthesized
gtattcaaattctttctccttt

SEQ ID NO: 1324600 - DNA, 22 bp, Artificial Sequence
  chemically synthesized
gaaagttttatcaaaggagaaa

SEQ ID NO: 1324601 - DNA, 22 bp, Artificial Sequence
  chemically synthesized
tgaaagttttatcaaaggagaa

SEQ ID NO: 1324602 - DNA, 22 bp, Artificial Sequence
  chemically synthesized
tttgaaagttttatcaaaggag

SEQ ID NO: 1324603 - DNA, 22 bp, Artificial Sequence
  chemically synthesized
ctttgaaagttttatcaaagga

SEQ ID NO: 1324604 - DNA, 22 bp, Artificial Sequence
  chemically synthesized
aaattctttctcctttgataaa

SEQ ID NO: 1324605 - DNA, 22 bp, Artificial Sequence
  chemically synthesized
tttctcctttgataaaactttc

SEQ ID NO: 1324606 - DNA, 22 bp, Artificial Sequence
  chemically synthesized
aaaaccttctttgaaagtttta

SEQ ID NO: 1324607 - DNA, 22 bp, Artificial Sequence
  chemically synthesized
tctcctttgataaaactttcaa

SEQ ID NO: 1324608 - DNA, 22 bp, Artificial Sequence
  chemically synthesized
ctcctttgataaaactttcaaa

SEQ ID NO: 1324609 - DNA, 22 bp, Artificial Sequence
  chemically synthesized
tcctttgataaaactttcaaag

SEQ ID NO: 1324610 - DNA, 22 bp, Artificial Sequence
  chemically synthesized
ctttgataaaactttcaaagaa

SEQ ID NO: 1324611 - DNA, 22 bp, Artificial Sequence
  chemically synthesized
tgataaaactttcaaagaaggt

SEQ ID NO: 1324612 - DNA, 22 bp, Artificial Sequence
  chemically synthesized
gataaaactttcaaagaaggtt

SEQ ID NO: 1324613 - DNA, 22 bp, Artificial Sequence
  chemically synthesized
ataaaactttcaaagaaggttt

SEQ ID NO: 1324614 - DNA, 22 bp, Artificial Sequence
  chemically synthesized
gaataaacattgaaaaccttct

SEQ ID NO: 1324615 - DNA, 22 bp, Artificial Sequence
  chemically synthesized
ggaataaacattgaaaaccttc

SEQ ID NO: 1324616 - DNA, 22 bp, Artificial Sequence
  chemically synthesized
tcaaagaaggttttcaatgttt

SEQ ID NO: 1324617 - DNA, 22 bp, Artificial Sequence
  chemically synthesized
caaagaaggttttcaatgttta

SEQ ID NO: 1324618 - DNA, 22 bp, Artificial Sequence
  chemically synthesized
aaagaaggttttcaatgtttat

SEQ ID NO: 1324619 - DNA, 22 bp, Artificial Sequence
  chemically synthesized
aaatcatttggaataaacattg

SEQ ID NO: 1324620 - DNA, 22 bp, Artificial Sequence
  chemically synthesized
gaaatcatttggaataaacatt

SEQ ID NO: 1324621 - DNA, 22 bp, Artificial Sequence
  chemically synthesized
tcaatgtttattccaaatgatt

SEQ ID NO: 1324622 - DNA, 22 bp, Artificial Sequence
  chemically synthesized
caatgtttattccaaatgattt

SEQ ID NO: 1324623 - DNA, 22 bp, Artificial Sequence
  chemically synthesized
aatgtttattccaaatgatttc

SEQ ID NO: 1324624 - DNA, 22 bp, Artificial Sequence
  chemically synthesized
taacgtcaacttgaaatcattt

SEQ ID NO: 1324625 - DNA, 22 bp, Artificial Sequence
  chemically synthesized
ataacgtcaacttgaaatcatt

SEQ ID NO: 1324626 - DNA, 22 bp, Artificial Sequence
  chemically synthesized
aacttataacgtcaacttgaaa

SEQ ID NO: 1324627 - DNA, 22 bp, Artificial Sequence
  chemically synthesized
attccaaatgatttcaagttga

SEQ ID NO: 1324628 - DNA, 22 bp, Artificial Sequence
  chemically synthesized
gaacttataacgtcaacttgaa

SEQ ID NO: 1324629 - DNA, 22 bp, Artificial Sequence
  chemically synthesized
ttccaaatgatttcaagttgac

SEQ ID NO: 1324630 - DNA, 22 bp, Artificial Sequence
  chemically synthesized
caaatgatttcaagttgacgtt

SEQ ID NO: 1324631 - DNA, 22 bp, Artificial Sequence
  chemically synthesized
atttgaacttataacgtcaact

SEQ ID NO: 1324632 - DNA, 22 bp, Artificial Sequence
  chemically synthesized
aatttgaacttataacgtcaac

SEQ ID NO: 1324633 - DNA, 22 bp, Artificial Sequence
  chemically synthesized
taatttgaacttataacgtcaa

SEQ ID NO: 1324634 - DNA, 22 bp, Artificial Sequence
  chemically synthesized
aaactttaatttgaacttataa

SEQ ID NO: 1324635 - DNA, 22 bp, Artificial Sequence
  chemically synthesized
caagttgacgttataagttcaa

SEQ ID NO: 1324636 - DNA, 22 bp, Artificial Sequence
  chemically synthesized
aagttgacgttataagttcaaa

SEQ ID NO: 1324637 - DNA, 22 bp, Artificial Sequence
  chemically synthesized
aattcaaactttaatttgaact

SEQ ID NO: 1324638 - DNA, 22 bp, Artificial Sequence
  chemically synthesized
gaattcaaactttaatttgaac

SEQ ID NO: 1324639 - DNA, 22 bp, Artificial Sequence
  chemically synthesized
acgttataagttcaaattaaag

SEQ ID NO: 1324640 - DNA, 22 bp, Artificial Sequence
  chemically synthesized
gatttgaattcaaactttaatt

SEQ ID NO: 1324641 - DNA, 22 bp, Artificial Sequence
  chemically synthesized
ggatttgaattcaaactttaat

SEQ ID NO: 1324642 - DNA, 22 bp, Artificial Sequence
  chemically synthesized
taagttcaaattaaagtttgaa

SEQ ID NO: 1324643 - DNA, 22 bp, Artificial Sequence
  chemically synthesized
ggaagtttggatttgaattcaa

SEQ ID NO: 1324644 - DNA, 22 bp, Artificial Sequence
  chemically synthesized
aggaagtttggatttgaattca

SEQ ID NO: 1324645 - DNA, 22 bp, Artificial Sequence
  chemically synthesized
aaattaaagtttgaattcaaat

SEQ ID NO: 1324646 - DNA, 22 bp, Artificial Sequence
  chemically synthesized
aagtttgaattcaaatccaaac

SEQ ID NO: 1324647 - DNA, 22 bp, Artificial Sequence
  chemically synthesized
gaaaagtttaggaagtttggat

SEQ ID NO: 1324648 - DNA, 22 bp, Artificial Sequence
  chemically synthesized
agaaaagtttaggaagtttgga

SEQ ID NO: 1324649 - DNA, 22 bp, Artificial Sequence
  chemically synthesized
gaattcaaatccaaacttccta

SEQ ID NO: 1324650 - DNA, 22 bp, Artificial Sequence
  chemically synthesized
aattcaaatccaaacttcctaa

SEQ ID NO: 1324651 - DNA, 22 bp, Artificial Sequence
  chemically synthesized
tcttagaaaagtttaggaagtt

SEQ ID NO: 1324652 - DNA, 22 bp, Artificial Sequence
  chemically synthesized
ctgtcttagaaaagtttaggaa

SEQ ID NO: 1324653 - DNA, 22 bp, Artificial Sequence
  chemically synthesized
actgtcttagaaaagtttagga

SEQ ID NO: 1324654 - DNA, 22 bp, Artificial Sequence
  chemically synthesized
aaatccaaacttcctaaacttt

SEQ ID NO: 1324655 - DNA, 22 bp, Artificial Sequence
  chemically synthesized
tactgtcttagaaaagtttagg

SEQ ID NO: 1324656 - DNA, 22 bp, Artificial Sequence
  chemically synthesized
ttttactgtcttagaaaagttt

SEQ ID NO: 1324657 - DNA, 22 bp, Artificial Sequence
  chemically synthesized
cctaaacttttctaagacagta

SEQ ID NO: 1324658 - DNA, 22 bp, Artificial Sequence
  chemically synthesized
ctaaacttttctaagacagtaa

SEQ ID NO: 1324659 - DNA, 22 bp, Artificial Sequence
  chemically synthesized
aacttttctaagacagtaaaat

SEQ ID NO: 1324660 - DNA, 22 bp, Artificial Sequence
  chemically synthesized
aagaacaatggttattttactg

SEQ ID NO: 1324661 - DNA, 22 bp, Artificial Sequence
  chemically synthesized
ttctaagacagtaaaataacca

SEQ ID NO: 1324662 - DNA, 22 bp, Artificial Sequence
  chemically synthesized
tctaagacagtaaaataaccat

SEQ ID NO: 1324663 - DNA, 22 bp, Artificial Sequence
  chemically synthesized
ctaagacagtaaaataaccatt

SEQ ID NO: 1324664 - DNA, 22 bp, Artificial Sequence
  chemically synthesized
taagacagtaaaataaccattg

SEQ ID NO: 1324665 - DNA, 22 bp, Artificial Sequence
  chemically synthesized
agacagtaaaataaccattgtt

SEQ ID NO: 1324666 - DNA, 22 bp, Artificial Sequence
  chemically synthesized
tgaagtccgtgagcctaaagaa

SEQ ID NO: 1324667 - DNA, 22 bp, Artificial Sequence
  chemically synthesized
ttctttaggctcacggacttca

SEQ ID NO: 1324668 - DNA, 22 bp, Artificial Sequence
  chemically synthesized
tttaggctcacggacttcatag

SEQ ID NO: 1324669 - DNA, 22 bp, Artificial Sequence
  chemically synthesized
taggctcacggacttcatagac

SEQ ID NO: 1324670 - DNA, 22 bp, Artificial Sequence
  chemically synthesized
aggctcacggacttcatagact

SEQ ID NO: 1324671 - DNA, 22 bp, Artificial Sequence
  chemically synthesized
ggctcacggacttcatagactg

SEQ ID NO: 1324672 - DNA, 22 bp, Artificial Sequence
  chemically synthesized
acggacttcatagactgtcacg

SEQ ID NO: 1324673 - DNA, 22 bp, Artificial Sequence
  chemically synthesized
aaataaataaaacgtgacagtc

SEQ ID NO: 1324674 - DNA, 22 bp, Artificial Sequence
  chemically synthesized
catagactgtcacgttttattt

SEQ ID NO: 1324675 - DNA, 22 bp, Artificial Sequence
  chemically synthesized
atagactgtcacgttttattta

SEQ ID NO: 1324676 - DNA, 22 bp, Artificial Sequence
  chemically synthesized
tcacgttttatttatttcaggt

SEQ ID NO: 1324677 - DNA, 22 bp, Artificial Sequence
  chemically synthesized
tggcaaacaacaaacctgaaat

SEQ ID NO: 1324678 - DNA, 22 bp, Artificial Sequence
  chemically synthesized
ttgtggcaaacaacaaacctga

SEQ ID NO: 1324679 - DNA, 22 bp, Artificial Sequence
  chemically synthesized
tatttatttcaggtttgttgtt

SEQ ID NO: 1324680 - DNA, 22 bp, Artificial Sequence
  chemically synthesized
atttatttcaggtttgttgttt

SEQ ID NO: 1324681 - DNA, 22 bp, Artificial Sequence
  chemically synthesized
tttatttcaggtttgttgtttg

SEQ ID NO: 1324682 - DNA, 22 bp, Artificial Sequence
  chemically synthesized
atttcaggtttgttgtttgcca

SEQ ID NO: 1324683 - DNA, 22 bp, Artificial Sequence
  chemically synthesized
tttcaggtttgttgtttgccac

SEQ ID NO: 1324684 - DNA, 22 bp, Artificial Sequence
  chemically synthesized
caggtttgttgtttgccacaat

SEQ ID NO: 1324685 - DNA, 22 bp, Artificial Sequence
  chemically synthesized
aggtttgttgtttgccacaata

SEQ ID NO: 1324686 - DNA, 22 bp, Artificial Sequence
  chemically synthesized
aaagagaagaatgtctattgtg

SEQ ID NO: 1324687 - DNA, 22 bp, Artificial Sequence
  chemically synthesized
caaagagaagaatgtctattgt

SEQ ID NO: 1324688 - DNA, 22 bp, Artificial Sequence
  chemically synthesized
gttgtttgccacaatagacatt

SEQ ID NO: 1324689 - DNA, 22 bp, Artificial Sequence
  chemically synthesized
ttgtttgccacaatagacattc

SEQ ID NO: 1324690 - DNA, 22 bp, Artificial Sequence
  chemically synthesized
tttcaaagagaagaatgtctat

SEQ ID NO: 1324691 - DNA, 22 bp, Artificial Sequence
  chemically synthesized
atttcaaagagaagaatgtcta

SEQ ID NO: 1324692 - DNA, 22 bp, Artificial Sequence
  chemically synthesized
tatttcaaagagaagaatgtct

SEQ ID NO: 1324693 - DNA, 22 bp, Artificial Sequence
  chemically synthesized
tttgccacaatagacattcttc

SEQ ID NO: 1324694 - DNA, 22 bp, Artificial Sequence
  chemically synthesized
ttttatttcaaagagaagaatg

SEQ ID NO: 1324695 - DNA, 22 bp, Artificial Sequence
  chemically synthesized
gccacaatagacattcttctct

SEQ ID NO: 1324696 - DNA, 22 bp, Artificial Sequence
  chemically synthesized
ccacaatagacattcttctctt

SEQ ID NO: 1324697 - DNA, 22 bp, Artificial Sequence
  chemically synthesized
ttctctttgaaataaaataata

SEQ ID NO: 1324698 - DNA, 22 bp, Artificial Sequence
  chemically synthesized
ctctttgaaataaaataatatt

SEQ ID NO: 1324699 - DNA, 22 bp, Artificial Sequence
  chemically synthesized
tctttgaaataaaataatattt

SEQ ID NO: 1324700 - DNA, 22 bp, Artificial Sequence
  chemically synthesized
tttgaaataaaataatatttcc

SEQ ID NO: 1324701 - DNA, 22 bp, Artificial Sequence
  chemically synthesized
tgaaataaaataatatttcctc

SEQ ID NO: 1324702 - DNA, 22 bp, Artificial Sequence
  chemically synthesized
aaggaataaatagaggaaatat

SEQ ID NO: 1324703 - DNA, 22 bp, Artificial Sequence
  chemically synthesized
gaaataaaataatatttcctct

SEQ ID NO: 1324704 - DNA, 22 bp, Artificial Sequence
  chemically synthesized
aaataaaataatatttcctcta

SEQ ID NO: 1324705 - DNA, 22 bp, Artificial Sequence
  chemically synthesized
tctcaaggaataaatagaggaa

SEQ ID NO: 1324706 - DNA, 22 bp, Artificial Sequence
  chemically synthesized
gagttatctcaaggaataaata

SEQ ID NO: 1324707 - DNA, 22 bp, Artificial Sequence
  chemically synthesized
agagttatctcaaggaataaat

SEQ ID NO: 1324708 - DNA, 22 bp, Artificial Sequence
  chemically synthesized
tagagttatctcaaggaataaa

SEQ ID NO: 1324709 - DNA, 22 bp, Artificial Sequence
  chemically synthesized
cctctatttattccttgagata

SEQ ID NO: 1324710 - DNA, 22 bp, Artificial Sequence
  chemically synthesized
ctctatttattccttgagataa

SEQ ID NO: 1324711 - DNA, 22 bp, Artificial Sequence
  chemically synthesized
tatttattccttgagataactc

SEQ ID NO: 1324712 - DNA, 22 bp, Artificial Sequence
  chemically synthesized
tttattccttgagataactcta

SEQ ID NO: 1324713 - DNA, 22 bp, Artificial Sequence
  chemically synthesized
atgaataaattttagagttatc

SEQ ID NO: 1324714 - DNA, 22 bp, Artificial Sequence
  chemically synthesized
aatgaataaattttagagttat

SEQ ID NO: 1324715 - DNA, 22 bp, Artificial Sequence
  chemically synthesized
taatgaataaattttagagtta

SEQ ID NO: 1324716 - DNA, 22 bp, Artificial Sequence
  chemically synthesized
attccttgagataactctaaaa

SEQ ID NO: 1324717 - DNA, 22 bp, Artificial Sequence
  chemically synthesized
ttaatgaataaattttagagtt

SEQ ID NO: 1324718 - DNA, 22 bp, Artificial Sequence
  chemically synthesized
ttccttgagataactctaaaat

SEQ ID NO: 1324719 - DNA, 22 bp, Artificial Sequence
  chemically synthesized
ttttaatgaataaattttagag

SEQ ID NO: 1324720 - DNA, 22 bp, Artificial Sequence
  chemically synthesized
cttgagataactctaaaattta

SEQ ID NO: 1324721 - DNA, 22 bp, Artificial Sequence
  chemically synthesized
gagataactctaaaatttattc

SEQ ID NO: 1324722 - DNA, 22 bp, Artificial Sequence
  chemically synthesized
agataactctaaaatttattca

SEQ ID NO: 1324723 - DNA, 22 bp, Artificial Sequence
  chemically synthesized
aaggacgattcttttaatgaat

SEQ ID NO: 1324724 - DNA, 22 bp, Artificial Sequence
  chemically synthesized
aaaggacgattcttttaatgaa

SEQ ID NO: 1324725 - DNA, 22 bp, Artificial Sequence
  chemically synthesized
taaaatttattcattaaaagaa

SEQ ID NO: 1324726 - DNA, 22 bp, Artificial Sequence
  chemically synthesized
aaatttattcattaaaagaatc

SEQ ID NO: 1324727 - DNA, 22 bp, Artificial Sequence
  chemically synthesized
tacttaaaggacgattctttta

SEQ ID NO: 1324728 - DNA, 22 bp, Artificial Sequence
  chemically synthesized
attcattaaaagaatcgtcctt

SEQ ID NO: 1324729 - DNA, 22 bp, Artificial Sequence
  chemically synthesized
ttcattaaaagaatcgtccttt

SEQ ID NO: 1324730 - DNA, 22 bp, Artificial Sequence
  chemically synthesized
caaaattatacttaaaggacga

SEQ ID NO: 1324731 - DNA, 22 bp, Artificial Sequence
  chemically synthesized
ccaaaattatacttaaaggacg

SEQ ID NO: 1324732 - DNA, 22 bp, Artificial Sequence
  chemically synthesized
attaaaagaatcgtcctttaag

SEQ ID NO: 1324733 - DNA, 22 bp, Artificial Sequence
  chemically synthesized
tccaaaattatacttaaaggac

SEQ ID NO: 1324734 - DNA, 22 bp, Artificial Sequence
  chemically synthesized
ttccaaaattatacttaaagga

SEQ ID NO: 1324735 - DNA, 22 bp, Artificial Sequence
  chemically synthesized
tttccaaaattatacttaaagg

SEQ ID NO: 1324736 - DNA, 22 bp, Artificial Sequence
  chemically synthesized
ttttccaaaattatacttaaag

SEQ ID NO: 1324737 - DNA, 22 bp, Artificial Sequence
  chemically synthesized
aaagaatcgtcctttaagtata

SEQ ID NO: 1324738 - DNA, 22 bp, Artificial Sequence
  chemically synthesized
tttttccaaaattatacttaaa

SEQ ID NO: 1324739 - DNA, 22 bp, Artificial Sequence
  chemically synthesized
tttttttccaaaattatactta

SEQ ID NO: 1324740 - DNA, 22 bp, Artificial Sequence
  chemically synthesized
ctttttttccaaaattatactt

SEQ ID NO: 1324741 - DNA, 22 bp, Artificial Sequence
  chemically synthesized
gaagtttctttttttccaaaat

SEQ ID NO: 1324742 - DNA, 22 bp, Artificial Sequence
  chemically synthesized
ggaagtttctttttttccaaaa

SEQ ID NO: 1324743 - DNA, 22 bp, Artificial Sequence
  chemically synthesized
tggaagtttctttttttccaaa

SEQ ID NO: 1324744 - DNA, 22 bp, Artificial Sequence
  chemically synthesized
taagtataattttggaaaaaaa

SEQ ID NO: 1324745 - DNA, 22 bp, Artificial Sequence
  chemically synthesized
tttggaagtttctttttttcca

SEQ ID NO: 1324746 - DNA, 22 bp, Artificial Sequence
  chemically synthesized
aagtataattttggaaaaaaag

SEQ ID NO: 1324747 - DNA, 22 bp, Artificial Sequence
  chemically synthesized
agtataattttggaaaaaaaga

SEQ ID NO: 1324748 - DNA, 22 bp, Artificial Sequence
  chemically synthesized
ctctttggaagtttcttttttt

SEQ ID NO: 1324749 - DNA, 22 bp, Artificial Sequence
  chemically synthesized
tggaaaaaaagaaacttccaaa

SEQ ID NO: 1324750 - DNA, 22 bp, Artificial Sequence
  chemically synthesized
ggaaaaaaagaaacttccaaag

SEQ ID NO: 1324751 - DNA, 22 bp, Artificial Sequence
  chemically synthesized
gaaaaaaagaaacttccaaaga

SEQ ID NO: 1324752 - DNA, 22 bp, Artificial Sequence
  chemically synthesized
gggtaatatctcctctttggaa

SEQ ID NO: 1324753 - DNA, 22 bp, Artificial Sequence
  chemically synthesized
tggggtaatatctcctctttgg

SEQ ID NO: 1324754 - DNA, 22 bp, Artificial Sequence
  chemically synthesized
ctggggtaatatctcctctttg

SEQ ID NO: 1324755 - DNA, 22 bp, Artificial Sequence
  chemically synthesized
ccaaagaggagatattacccca

SEQ ID NO: 1324756 - DNA, 22 bp, Artificial Sequence
  chemically synthesized
caaagaggagatattaccccag

SEQ ID NO: 1324757 - DNA, 22 bp, Artificial Sequence
  chemically synthesized
ccccagaaggctggtttttttt

SEQ ID NO: 1324758 - DNA, 22 bp, Artificial Sequence
  chemically synthesized
aaaaaaaaaaaaaacaaaaaaa

SEQ ID NO: 1324759 - DNA, 22 bp, Artificial Sequence
  chemically synthesized
aaaaaaaaaaaaaaacaaaaaa

SEQ ID NO: 1324760 - DNA, 22 bp, Artificial Sequence
  chemically synthesized
gttttttttgtttttttttttt

SEQ ID NO: 1324761 - DNA, 22 bp, Artificial Sequence
  chemically synthesized
tttttgttttttttttttttta

SEQ ID NO: 1324762 - DNA, 22 bp, Artificial Sequence
  chemically synthesized
aagtggaatacttaaaaaaaaa

SEQ ID NO: 1324763 - DNA, 22 bp, Artificial Sequence
  chemically synthesized
ttttgtttttttttttttttaa

SEQ ID NO: 1324764 - DNA, 22 bp, Artificial Sequence
  chemically synthesized
aaagtggaatacttaaaaaaaa

SEQ ID NO: 1324765 - DNA, 22 bp, Artificial Sequence
  chemically synthesized
tttgtttttttttttttttaag

SEQ ID NO: 1324766 - DNA, 22 bp, Artificial Sequence
  chemically synthesized
taaagtggaatacttaaaaaaa

SEQ ID NO: 1324767 - DNA, 22 bp, Artificial Sequence
  chemically synthesized
ttgtttttttttttttttaagt

SEQ ID NO: 1324768 - DNA, 22 bp, Artificial Sequence
  chemically synthesized
ttaaagtggaatacttaaaaaa

SEQ ID NO: 1324769 - DNA, 22 bp, Artificial Sequence
  chemically synthesized
tgtttttttttttttttaagta

SEQ ID NO: 1324770 - DNA, 22 bp, Artificial Sequence
  chemically synthesized
gtttttttttttttttaagtat

SEQ ID NO: 1324771 - DNA, 22 bp, Artificial Sequence
  chemically synthesized
tttttttttttttttaagtatt

SEQ ID NO: 1324772 - DNA, 22 bp, Artificial Sequence
  chemically synthesized
agtttttaaagtggaatactta

SEQ ID NO: 1324773 - DNA, 22 bp, Artificial Sequence
  chemically synthesized
ttttttttttttaagtattcca

SEQ ID NO: 1324774 - DNA, 22 bp, Artificial Sequence
  chemically synthesized
tttttttttttaagtattccac

SEQ ID NO: 1324775 - DNA, 22 bp, Artificial Sequence
  chemically synthesized
ttttttttttaagtattccact

SEQ ID NO: 1324776 - DNA, 22 bp, Artificial Sequence
  chemically synthesized
tttttttttaagtattccactt

SEQ ID NO: 1324777 - DNA, 22 bp, Artificial Sequence
  chemically synthesized
ttttttttaagtattccacttt

SEQ ID NO: 1324778 - DNA, 22 bp, Artificial Sequence
  chemically synthesized
tttttttaagtattccacttta

SEQ ID NO: 1324779 - DNA, 22 bp, Artificial Sequence
  chemically synthesized
ttttttaagtattccactttaa

SEQ ID NO: 1324780 - DNA, 22 bp, Artificial Sequence
  chemically synthesized
tttttaagtattccactttaaa

SEQ ID NO: 1324781 - DNA, 22 bp, Artificial Sequence
  chemically synthesized
ttttaagtattccactttaaaa

SEQ ID NO: 1324782 - DNA, 22 bp, Artificial Sequence
  chemically synthesized
taacacctgagtttttaaagtg

SEQ ID NO: 1324783 - DNA, 22 bp, Artificial Sequence
  chemically synthesized
tttaagtattccactttaaaaa

SEQ ID NO: 1324784 - DNA, 22 bp, Artificial Sequence
  chemically synthesized
ttaagtattccactttaaaaac

SEQ ID NO: 1324785 - DNA, 22 bp, Artificial Sequence
  chemically synthesized
taagtattccactttaaaaact

SEQ ID NO: 1324786 - DNA, 22 bp, Artificial Sequence
  chemically synthesized
aagtattccactttaaaaactc

SEQ ID NO: 1324787 - DNA, 22 bp, Artificial Sequence
  chemically synthesized
agtattccactttaaaaactca

SEQ ID NO: 1324788 - DNA, 22 bp, Artificial Sequence
  chemically synthesized
agtgaactgtaacacctgagtt

SEQ ID NO: 1324789 - DNA, 22 bp, Artificial Sequence
  chemically synthesized
cactttaaaaactcaggtgtta

SEQ ID NO: 1324790 - DNA, 22 bp, Artificial Sequence
  chemically synthesized
tgctcagtgaactgtaacacct

SEQ ID NO: 1324791 - DNA, 22 bp, Artificial Sequence
  chemically synthesized
taaaaactcaggtgttacagtt

SEQ ID NO: 1324792 - DNA, 22 bp, Artificial Sequence
  chemically synthesized
aaaaactcaggtgttacagttc

SEQ ID NO: 1324793 - DNA, 22 bp, Artificial Sequence
  chemically synthesized
aaaactcaggtgttacagttca

SEQ ID NO: 1324794 - DNA, 22 bp, Artificial Sequence
  chemically synthesized
aggtgttacagttcactgagca

SEQ ID NO: 1324795 - DNA, 22 bp, Artificial Sequence
  chemically synthesized
ccagaaatccaatacattatgc

SEQ ID NO: 1324796 - DNA, 22 bp, Artificial Sequence
  chemically synthesized
cagttcactgagcataatgtat

SEQ ID NO: 1324797 - DNA, 22 bp, Artificial Sequence
  chemically synthesized
attcccagaaatccaatacatt

SEQ ID NO: 1324798 - DNA, 22 bp, Artificial Sequence
  chemically synthesized
aattcccagaaatccaatacat

SEQ ID NO: 1324799 - DNA, 22 bp, Artificial Sequence
  chemically synthesized
taattcccagaaatccaataca

SEQ ID NO: 1324800 - DNA, 22 bp, Artificial Sequence
  chemically synthesized
actgagcataatgtattggatt

SEQ ID NO: 1324801 - DNA, 22 bp, Artificial Sequence
  chemically synthesized
cctttaattcccagaaatccaa

SEQ ID NO: 1324802 - DNA, 22 bp, Artificial Sequence
  chemically synthesized
agcataatgtattggatttctg

SEQ ID NO: 1324803 - DNA, 22 bp, Artificial Sequence
  chemically synthesized
tcaaataacattgcctttaatt

SEQ ID NO: 1324804 - DNA, 22 bp, Artificial Sequence
  chemically synthesized
gtcaaataacattgcctttaat

SEQ ID NO: 1324805 - DNA, 22 bp, Artificial Sequence
  chemically synthesized
gatttctgggaattaaaggcaa

SEQ ID NO: 1324806 - DNA, 22 bp, Artificial Sequence
  chemically synthesized
tgtcaaataacattgcctttaa

SEQ ID NO: 1324807 - DNA, 22 bp, Artificial Sequence
  chemically synthesized
ctgggaattaaaggcaatgtta

SEQ ID NO: 1324808 - DNA, 22 bp, Artificial Sequence
  chemically synthesized
tgggaattaaaggcaatgttat

SEQ ID NO: 1324809 - DNA, 22 bp, Artificial Sequence
  chemically synthesized
gaactttgtcaaataacattgc

SEQ ID NO: 1324810 - DNA, 22 bp, Artificial Sequence
  chemically synthesized
ggaattaaaggcaatgttattt

SEQ ID NO: 1324811 - DNA, 22 bp, Artificial Sequence
  chemically synthesized
attagaactttgtcaaataaca

SEQ ID NO: 1324812 - DNA, 22 bp, Artificial Sequence
  chemically synthesized
aaggcaatgttatttgacaaag

SEQ ID NO: 1324813 - DNA, 22 bp, Artificial Sequence
  chemically synthesized
tacaaccagttaattagaactt

SEQ ID NO: 1324814 - DNA, 22 bp, Artificial Sequence
  chemically synthesized
actgtacaaccagttaattaga

SEQ ID NO: 1324815 - DNA, 22 bp, Artificial Sequence
  chemically synthesized
tttgacaaagttctaattaact

SEQ ID NO: 1324816 - DNA, 22 bp, Artificial Sequence
  chemically synthesized
aactgtacaaccagttaattag

SEQ ID NO: 1324817 - DNA, 22 bp, Artificial Sequence
  chemically synthesized
taactgtacaaccagttaatta

SEQ ID NO: 1324818 - DNA, 22 bp, Artificial Sequence
  chemically synthesized
gacaaagttctaattaactggt

SEQ ID NO: 1324819 - DNA, 22 bp, Artificial Sequence
  chemically synthesized
acaaagttctaattaactggtt

SEQ ID NO: 1324820 - DNA, 22 bp, Artificial Sequence
  chemically synthesized
taattaactggttgtacagtta

SEQ ID NO: 1324821 - DNA, 22 bp, Artificial Sequence
  chemically synthesized
aagaaaaaaattttaactgtac

SEQ ID NO: 1324822 - DNA, 22 bp, Artificial Sequence
  chemically synthesized
attaactggttgtacagttaaa

SEQ ID NO: 1324823 - DNA, 22 bp, Artificial Sequence
  chemically synthesized
gaagaaaaaaattttaactgta

SEQ ID NO: 1324824 - DNA, 22 bp, Artificial Sequence
  chemically synthesized
actggttgtacagttaaaattt

SEQ ID NO: 1324825 - DNA, 22 bp, Artificial Sequence
  chemically synthesized
gttgtacagttaaaattttttt

SEQ ID NO: 1324826 - DNA, 22 bp, Artificial Sequence
  chemically synthesized
tacagttaaaatttttttcttc

SEQ ID NO: 1324827 - DNA, 22 bp, Artificial Sequence
  chemically synthesized
atgagaaaatttgaagaaaaaa

SEQ ID NO: 1324828 - DNA, 22 bp, Artificial Sequence
  chemically synthesized
tctgatgagaaaatttgaagaa

SEQ ID NO: 1324829 - DNA, 22 bp, Artificial Sequence
  chemically synthesized
aaatttttttcttcaaattttc

SEQ ID NO: 1324830 - DNA, 22 bp, Artificial Sequence
  chemically synthesized
agaggttatctgatgagaaaat

SEQ ID NO: 1324831 - DNA, 22 bp, Artificial Sequence
  chemically synthesized
gagaggttatctgatgagaaaa

SEQ ID NO: 1324832 - DNA, 22 bp, Artificial Sequence
  chemically synthesized
ttttcttcaaattttctcatca

SEQ ID NO: 1324833 - DNA, 22 bp, Artificial Sequence
  chemically synthesized
tttcttcaaattttctcatcag

SEQ ID NO: 1324834 - DNA, 22 bp, Artificial Sequence
  chemically synthesized
ttcttcaaattttctcatcaga

SEQ ID NO: 1324835 - DNA, 22 bp, Artificial Sequence
  chemically synthesized
tcttcaaattttctcatcagat

SEQ ID NO: 1324836 - DNA, 22 bp, Artificial Sequence
  chemically synthesized
cttcaaattttctcatcagata

SEQ ID NO: 1324837 - DNA, 22 bp, Artificial Sequence
  chemically synthesized
ttcaaattttctcatcagataa

SEQ ID NO: 1324838 - DNA, 22 bp, Artificial Sequence
  chemically synthesized
caaattttctcatcagataacc

SEQ ID NO: 1324839 - DNA, 22 bp, Artificial Sequence
  chemically synthesized
aaattttctcatcagataacct

SEQ ID NO: 1324840 - DNA, 22 bp, Artificial Sequence
  chemically synthesized
atgagaaaatatttgagaggtt

SEQ ID NO: 1324841 - DNA, 22 bp, Artificial Sequence
  chemically synthesized
tctcatcagataacctctcaaa

SEQ ID NO: 1324842 - DNA, 22 bp, Artificial Sequence
  chemically synthesized
gatgagaaaatatttgagaggt

SEQ ID NO: 1324843 - DNA, 22 bp, Artificial Sequence
  chemically synthesized
ctcatcagataacctctcaaat

SEQ ID NO: 1324844 - DNA, 22 bp, Artificial Sequence
  chemically synthesized
tcatcagataacctctcaaata

SEQ ID NO: 1324845 - DNA, 22 bp, Artificial Sequence
  chemically synthesized
tttgatgagaaaatatttgaga

SEQ ID NO: 1324846 - DNA, 22 bp, Artificial Sequence
  chemically synthesized
atcagataacctctcaaatatt

SEQ ID NO: 1324847 - DNA, 22 bp, Artificial Sequence
  chemically synthesized
agaagttatttgatgagaaaat

SEQ ID NO: 1324848 - DNA, 22 bp, Artificial Sequence
  chemically synthesized
taagaagttatttgatgagaaa

SEQ ID NO: 1324849 - DNA, 22 bp, Artificial Sequence
  chemically synthesized
ctaagaagttatttgatgagaa

SEQ ID NO: 1324850 - DNA, 22 bp, Artificial Sequence
  chemically synthesized
tcaaatattttctcatcaaata

SEQ ID NO: 1324851 - DNA, 22 bp, Artificial Sequence
  chemically synthesized
aaatattttctcatcaaataac

SEQ ID NO: 1324852 - DNA, 22 bp, Artificial Sequence
  chemically synthesized
catttctaagaagttatttgat

SEQ ID NO: 1324853 - DNA, 22 bp, Artificial Sequence
  chemically synthesized
tctcatcaaataacttcttaga

SEQ ID NO: 1324854 - DNA, 22 bp, Artificial Sequence
  chemically synthesized
ctcatcaaataacttcttagaa

SEQ ID NO: 1324855 - DNA, 22 bp, Artificial Sequence
  chemically synthesized
tcatcaaataacttcttagaaa

SEQ ID NO: 1324856 - DNA, 22 bp, Artificial Sequence
  chemically synthesized
atcaaataacttcttagaaatg

SEQ ID NO: 1324857 - DNA, 22 bp, Artificial Sequence
  chemically synthesized
aaataaaacctccatttctaag

SEQ ID NO: 1324858 - DNA, 22 bp, Artificial Sequence
  chemically synthesized
aaaataaaacctccatttctaa

SEQ ID NO: 1324859 - DNA, 22 bp, Artificial Sequence
  chemically synthesized
taaaataaaacctccatttcta

SEQ ID NO: 1324860 - DNA, 22 bp, Artificial Sequence
  chemically synthesized
ttaaaataaaacctccatttct

SEQ ID NO: 1324861 - DNA, 22 bp, Artificial Sequence
  chemically synthesized
tttaaaataaaacctccatttc

SEQ ID NO: 1324862 - DNA, 22 bp, Artificial Sequence
  chemically synthesized
ttttaaaataaaacctccattt

SEQ ID NO: 1324863 - DNA, 22 bp, Artificial Sequence
  chemically synthesized
tcttttttaaaataaaacctcc

SEQ ID NO: 1324864 - DNA, 22 bp, Artificial Sequence
  chemically synthesized
cttagaaatggaggttttattt

SEQ ID NO: 1324865 - DNA, 22 bp, Artificial Sequence
  chemically synthesized
ttagaaatggaggttttatttt

SEQ ID NO: 1324866 - DNA, 22 bp, Artificial Sequence
  chemically synthesized
agaaatggaggttttattttaa

SEQ ID NO: 1324867 - DNA, 22 bp, Artificial Sequence
  chemically synthesized
gaaatggaggttttattttaaa

SEQ ID NO: 1324868 - DNA, 22 bp, Artificial Sequence
  chemically synthesized
aatgtaacactgtcttttttaa

SEQ ID NO: 1324869 - DNA, 22 bp, Artificial Sequence
  chemically synthesized
gcattaaatgtaacactgtctt

SEQ ID NO: 1324870 - DNA, 22 bp, Artificial Sequence
  chemically synthesized
tattttaaaaaagacagtgtta

SEQ ID NO: 1324871 - DNA, 22 bp, Artificial Sequence
  chemically synthesized
attttaaaaaagacagtgttac

SEQ ID NO: 1324872 - DNA, 22 bp, Artificial Sequence
  chemically synthesized
ttttaaaaaagacagtgttaca

SEQ ID NO: 1324873 - DNA, 22 bp, Artificial Sequence
  chemically synthesized
taaaaaagacagtgttacattt

SEQ ID NO: 1324874 - DNA, 22 bp, Artificial Sequence
  chemically synthesized
aatcctagcattaaatgtaaca

SEQ ID NO: 1324875 - DNA, 22 bp, Artificial Sequence
  chemically synthesized
aaaaaagacagtgttacattta

SEQ ID NO: 1324876 - DNA, 22 bp, Artificial Sequence
  chemically synthesized
caatcctagcattaaatgtaac

SEQ ID NO: 1324877 - DNA, 22 bp, Artificial Sequence
  chemically synthesized
aaaaagacagtgttacatttaa

SEQ ID NO: 1324878 - DNA, 22 bp, Artificial Sequence
  chemically synthesized
ggaagatttcaatcctagcatt

SEQ ID NO: 1324879 - DNA, 22 bp, Artificial Sequence
  chemically synthesized
aggaagatttcaatcctagcat

SEQ ID NO: 1324880 - DNA, 22 bp, Artificial Sequence
  chemically synthesized
taggaagatttcaatcctagca

SEQ ID NO: 1324881 - DNA, 22 bp, Artificial Sequence
  chemically synthesized
catttaatgctaggattgaaat

SEQ ID NO: 1324882 - DNA, 22 bp, Artificial Sequence
  chemically synthesized
ccactttaggaagatttcaatc

SEQ ID NO: 1324883 - DNA, 22 bp, Artificial Sequence
  chemically synthesized
tcccactttaggaagatttcaa

SEQ ID NO: 1324884 - DNA, 22 bp, Artificial Sequence
  chemically synthesized
aatgctaggattgaaatcttcc

SEQ ID NO: 1324885 - DNA, 22 bp, Artificial Sequence
  chemically synthesized
atgctaggattgaaatcttcct

SEQ ID NO: 1324886 - DNA, 22 bp, Artificial Sequence
  chemically synthesized
ttctcccactttaggaagattt

SEQ ID NO: 1324887 - DNA, 22 bp, Artificial Sequence
  chemically synthesized
attctcccactttaggaagatt

SEQ ID NO: 1324888 - DNA, 22 bp, Artificial Sequence
  chemically synthesized
tttattctcccactttaggaag

SEQ ID NO: 1324889 - DNA, 22 bp, Artificial Sequence
  chemically synthesized
ggattgaaatcttcctaaagtg

SEQ ID NO: 1324890 - DNA, 22 bp, Artificial Sequence
  chemically synthesized
ttatttattctcccactttagg

SEQ ID NO: 1324891 - DNA, 22 bp, Artificial Sequence
  chemically synthesized
aaatcttcctaaagtgggagaa

SEQ ID NO: 1324892 - DNA, 22 bp, Artificial Sequence
  chemically synthesized
cctaaagtgggagaataaataa

SEQ ID NO: 1324893 - DNA, 22 bp, Artificial Sequence
  chemically synthesized
ctaaagtgggagaataaataat

SEQ ID NO: 1324894 - DNA, 22 bp, Artificial Sequence
  chemically synthesized
aagtgggagaataaataataat

SEQ ID NO: 1324895 - DNA, 22 bp, Artificial Sequence
  chemically synthesized
agagaaatacatcattattatt

SEQ ID NO: 1324896 - DNA, 22 bp, Artificial Sequence
  chemically synthesized
tagtggaatcaataaagcattc

SEQ ID NO: 1324897 - DNA, 22 bp, Artificial Sequence
  chemically synthesized
ctctgaatgctttattgattcc

SEQ ID NO: 1324898 - DNA, 22 bp, Artificial Sequence
  chemically synthesized
tctgaatgctttattgattcca

SEQ ID NO: 1324899 - DNA, 22 bp, Artificial Sequence
  chemically synthesized
tgaatgctttattgattccact

SEQ ID NO: 1324900 - DNA, 22 bp, Artificial Sequence
  chemically synthesized
aatgctttattgattccactac

SEQ ID NO: 1324901 - DNA, 22 bp, Artificial Sequence
  chemically synthesized
tattgattccactacaatttgt

SEQ ID NO: 1324902 - DNA, 22 bp, Artificial Sequence
  chemically synthesized
attgattccactacaatttgtc

SEQ ID NO: 1324903 - DNA, 22 bp, Artificial Sequence
  chemically synthesized
ttgattccactacaatttgtcc

SEQ ID NO: 1324904 - DNA, 22 bp, Artificial Sequence
  chemically synthesized
attccactacaatttgtccatg

SEQ ID NO: 1324905 - DNA, 22 bp, Artificial Sequence
  chemically synthesized
cactacaatttgtccatgtgtt

SEQ ID NO: 1324906 - DNA, 22 bp, Artificial Sequence
  chemically synthesized
caatttgtccatgtgttaccat

SEQ ID NO: 1324907 - DNA, 22 bp, Artificial Sequence
  chemically synthesized
gtccatgtgttaccatgtgtta

SEQ ID NO: 1324908 - DNA, 22 bp, Artificial Sequence
  chemically synthesized
tccatgtgttaccatgtgttac

SEQ ID NO: 1324909 - DNA, 22 bp, Artificial Sequence
  chemically synthesized
ccatgtgttaccatacttggta

SEQ ID NO: 1324910 - DNA, 22 bp, Artificial Sequence
  chemically synthesized
gatatgaaataatataccaagt

SEQ ID NO: 1324911 - DNA, 22 bp, Artificial Sequence
  chemically synthesized
tggatatgaaataatataccaa

SEQ ID NO: 1324912 - DNA, 22 bp, Artificial Sequence
  chemically synthesized
ccatacttggtatattatttca

SEQ ID NO: 1324913 - DNA, 22 bp, Artificial Sequence
  chemically synthesized
aatggactctggatatgaaata

SEQ ID NO: 1324914 - DNA, 22 bp, Artificial Sequence
  chemically synthesized
ggtatattatttcatatccaga

SEQ ID NO: 1324915 - DNA, 22 bp, Artificial Sequence
  chemically synthesized
gtatattatttcatatccagag

SEQ ID NO: 1324916 - DNA, 22 bp, Artificial Sequence
  chemically synthesized
taagactgaatggactctggat

SEQ ID NO: 1324917 - DNA, 22 bp, Artificial Sequence
  chemically synthesized
ataagactgaatggactctgga

SEQ ID NO: 1324918 - DNA, 22 bp, Artificial Sequence
  chemically synthesized
ttataagactgaatggactctg

SEQ ID NO: 1324919 - DNA, 22 bp, Artificial Sequence
  chemically synthesized
tttcatatccagagtccattca

SEQ ID NO: 1324920 - DNA, 22 bp, Artificial Sequence
  chemically synthesized
catatccagagtccattcagtc

SEQ ID NO: 1324921 - DNA, 22 bp, Artificial Sequence
  chemically synthesized
atatccagagtccattcagtct

SEQ ID NO: 1324922 - DNA, 22 bp, Artificial Sequence
  chemically synthesized
ataagctcttataagactgaat

SEQ ID NO: 1324923 - DNA, 22 bp, Artificial Sequence
  chemically synthesized
aataagctcttataagactgaa

SEQ ID NO: 1324924 - DNA, 22 bp, Artificial Sequence
  chemically synthesized
gtatgtatttaataagctctta

SEQ ID NO: 1324925 - DNA, 22 bp, Artificial Sequence
  chemically synthesized
agtcttataagagcttattaaa

SEQ ID NO: 1324926 - DNA, 22 bp, Artificial Sequence
  chemically synthesized
atatgtattagtatgtatttaa

SEQ ID NO: 1324927 - DNA, 22 bp, Artificial Sequence
  chemically synthesized
ataagagcttattaaatacata

SEQ ID NO: 1324928 - DNA, 22 bp, Artificial Sequence
  chemically synthesized
gatatgtattagtatgtattta

SEQ ID NO: 1324929 - DNA, 22 bp, Artificial Sequence
  chemically synthesized
taagagcttattaaatacatac

SEQ ID NO: 1324930 - DNA, 22 bp, Artificial Sequence
  chemically synthesized
taatttgatatgtattagtatg

SEQ ID NO: 1324931 - DNA, 22 bp, Artificial Sequence
  chemically synthesized
ataatttgatatgtattagtat

SEQ ID NO: 1324932 - DNA, 22 bp, Artificial Sequence
  chemically synthesized
attaaatacatactaatacata

SEQ ID NO: 1324933 - DNA, 22 bp, Artificial Sequence
  chemically synthesized
ttaaatacatactaatacatat

SEQ ID NO: 1324934 - DNA, 22 bp, Artificial Sequence
  chemically synthesized
atttataatttgatatgtatta

SEQ ID NO: 1324935 - DNA, 22 bp, Artificial Sequence
  chemically synthesized
aatacatactaatacatatcaa

SEQ ID NO: 1324936 - DNA, 22 bp, Artificial Sequence
  chemically synthesized
attcatttataatttgatatgt

SEQ ID NO: 1324937 - DNA, 22 bp, Artificial Sequence
  chemically synthesized
atacatatcaaattataaatga

SEQ ID NO: 1324938 - DNA, 22 bp, Artificial Sequence
  chemically synthesized
taaatgaatcagtgggcattct

SEQ ID NO: 1324939 - DNA, 22 bp, Artificial Sequence
  chemically synthesized
tacattttacatcgtatatatg

SEQ ID NO: 1324940 - DNA, 22 bp, Artificial Sequence
  chemically synthesized
cattttacatcgtatatatgta

SEQ ID NO: 1324941 - DNA, 22 bp, Artificial Sequence
  chemically synthesized
tatgtagatatatatgtacata

SEQ ID NO: 1324942 - DNA, 22 bp, Artificial Sequence
  chemically synthesized
tacatcgtatatatgtacatat

SEQ ID NO: 1324943 - DNA, 22 bp, Artificial Sequence
  chemically synthesized
atatgtagatatatatgtacat

SEQ ID NO: 1324944 - DNA, 22 bp, Artificial Sequence
  chemically synthesized
acatcgtatatatgtacatata

SEQ ID NO: 1324945 - DNA, 22 bp, Artificial Sequence
  chemically synthesized
catcgtatatatgtacatatat

SEQ ID NO: 1324946 - DNA, 22 bp, Artificial Sequence
  chemically synthesized
agcatttatatgtagatatata

SEQ ID NO: 1324947 - DNA, 22 bp, Artificial Sequence
  chemically synthesized
gagcatttatatgtagatatat

SEQ ID NO: 1324948 - DNA, 22 bp, Artificial Sequence
  chemically synthesized
aatgcttgagcatttatatgta

SEQ ID NO: 1324949 - DNA, 22 bp, Artificial Sequence
  chemically synthesized
acaactaaatgcttgagcattt

SEQ ID NO: 1324950 - DNA, 22 bp, Artificial Sequence
  chemically synthesized
aacaactaaatgcttgagcatt

SEQ ID NO: 1324951 - DNA, 22 bp, Artificial Sequence
  chemically synthesized
acttaacaactaaatgcttgag

SEQ ID NO: 1324952 - DNA, 22 bp, Artificial Sequence
  chemically synthesized
catataaatgctcaagcattta

SEQ ID NO: 1324953 - DNA, 22 bp, Artificial Sequence
  chemically synthesized
aagcatttagttgttaagtgaa

SEQ ID NO: 1324954 - DNA, 22 bp, Artificial Sequence
  chemically synthesized
ccaatgaaaagcgttcacttaa

SEQ ID NO: 1324955 - DNA, 22 bp, Artificial Sequence
  chemically synthesized
gccaatgaaaagcgttcactta

SEQ ID NO: 1324956 - DNA, 22 bp, Artificial Sequence
  chemically synthesized
ttgccaatgaaaagcgttcact

SEQ ID NO: 1324957 - DNA, 22 bp, Artificial Sequence
  chemically synthesized
cttgccaatgaaaagcgttcac

SEQ ID NO: 1324958 - DNA, 22 bp, Artificial Sequence
  chemically synthesized
tcttgccaatgaaaagcgttca

SEQ ID NO: 1324959 - DNA, 22 bp, Artificial Sequence
  chemically synthesized
ttcttgccaatgaaaagcgttc

SEQ ID NO: 1324960 - DNA, 22 bp, Artificial Sequence
  chemically synthesized
agttgttaagtgaacgcttttc

SEQ ID NO: 1324961 - DNA, 22 bp, Artificial Sequence
  chemically synthesized
gttgttaagtgaacgcttttca

SEQ ID NO: 1324962 - DNA, 22 bp, Artificial Sequence
  chemically synthesized
ttaagtgaacgcttttcattgg

SEQ ID NO: 1324963 - DNA, 22 bp, Artificial Sequence
  chemically synthesized
agtgaacgcttttcattggcaa

SEQ ID NO: 1324964 - DNA, 22 bp, Artificial Sequence
  chemically synthesized
aacatcaagtaagtttttcttg

SEQ ID NO: 1324965 - DNA, 22 bp, Artificial Sequence
  chemically synthesized
ttcattggcaagaaaaacttac

SEQ ID NO: 1324966 - DNA, 22 bp, Artificial Sequence
  chemically synthesized
tcattggcaagaaaaacttact

SEQ ID NO: 1324967 - DNA, 22 bp, Artificial Sequence
  chemically synthesized
cattggcaagaaaaacttactt

SEQ ID NO: 1324968 - DNA, 22 bp, Artificial Sequence
  chemically synthesized
attggcaagaaaaacttacttg

SEQ ID NO: 1324969 - DNA, 22 bp, Artificial Sequence
  chemically synthesized
aaccaattaaacatcaagtaag

SEQ ID NO: 1324970 - DNA, 22 bp, Artificial Sequence
  chemically synthesized
gcaagaaaaacttacttgatgt

SEQ ID NO: 1324971 - DNA, 22 bp, Artificial Sequence
  chemically synthesized
acttgatgtttaattggttcag

SEQ ID NO: 1324972 - DNA, 22 bp, Artificial Sequence
  chemically synthesized
cttgatgtttaattggttcagg

SEQ ID NO: 1324973 - DNA, 22 bp, Artificial Sequence
  chemically synthesized
gatgtttaattggttcaggttg

SEQ ID NO: 1324974 - DNA, 22 bp, Artificial Sequence
  chemically synthesized
atgtttaattggttcaggttgc

SEQ ID NO: 1324975 - DNA, 22 bp, Artificial Sequence
  chemically synthesized
agtatgtgcatgagatgcaacc

SEQ ID NO: 1324976 - DNA, 22 bp, Artificial Sequence
  chemically synthesized
aagtatgtgcatgagatgcaac

SEQ ID NO: 1324977 - DNA, 22 bp, Artificial Sequence
  chemically synthesized
aattggttcaggttgcatctca

SEQ ID NO: 1324978 - DNA, 22 bp, Artificial Sequence
  chemically synthesized
attggttcaggttgcatctcat

SEQ ID NO: 1324979 - DNA, 22 bp, Artificial Sequence
  chemically synthesized
gttcaggttgcatctcatgcac

SEQ ID NO: 1324980 - DNA, 22 bp, Artificial Sequence
  chemically synthesized
cgggtttaagtatgtgcatgag

SEQ ID NO: 1324981 - DNA, 22 bp, Artificial Sequence
  chemically synthesized
acgggtttaagtatgtgcatga

SEQ ID NO: 1324982 - DNA, 22 bp, Artificial Sequence
  chemically synthesized
aggttgcatctcatgcacatac

SEQ ID NO: 1324983 - DNA, 22 bp, Artificial Sequence
  chemically synthesized
ccatttacgggtttaagtatgt

SEQ ID NO: 1324984 - DNA, 22 bp, Artificial Sequence
  chemically synthesized
gccatttacgggtttaagtatg

SEQ ID NO: 1324985 - DNA, 22 bp, Artificial Sequence
  chemically synthesized
catctcatgcacatacttaaac

SEQ ID NO: 1324986 - DNA, 22 bp, Artificial Sequence
  chemically synthesized
atgcacatacttaaacccgtaa

SEQ ID NO: 1324987 - DNA, 22 bp, Artificial Sequence
  chemically synthesized
cataccacttgccatttacggg

SEQ ID NO: 1324988 - DNA, 22 bp, Artificial Sequence
  chemically synthesized
ccataccacttgccatttacgg

SEQ ID NO: 1324989 - DNA, 22 bp, Artificial Sequence
  chemically synthesized
tatgcttccataccacttgcca

SEQ ID NO: 1324990 - DNA, 22 bp, Artificial Sequence
  chemically synthesized
aaacccgtaaatggcaagtggt

SEQ ID NO: 1324991 - DNA, 22 bp, Artificial Sequence
  chemically synthesized
atatgcttccataccacttgcc

SEQ ID NO: 1324992 - DNA, 22 bp, Artificial Sequence
  chemically synthesized
aacccgtaaatggcaagtggta

SEQ ID NO: 1324993 - DNA, 22 bp, Artificial Sequence
  chemically synthesized
gcttatatgcttccataccact

SEQ ID NO: 1324994 - DNA, 22 bp, Artificial Sequence
  chemically synthesized
attcgcttatatgcttccatac

SEQ ID NO: 1324995 - DNA, 22 bp, Artificial Sequence
  chemically synthesized
aattcgcttatatgcttccata

SEQ ID NO: 1324996 - DNA, 22 bp, Artificial Sequence
  chemically synthesized
taattcgcttatatgcttccat

SEQ ID NO: 1324997 - DNA, 22 bp, Artificial Sequence
  chemically synthesized
tcacagaaaatgaatcatactt

SEQ ID NO: 1324998 - DNA, 22 bp, Artificial Sequence
  chemically synthesized
gtcacagaaaatgaatcatact

SEQ ID NO: 1324999 - DNA, 22 bp, Artificial Sequence
  chemically synthesized
ccccttgtcacagaaaatgaat

SEQ ID NO: 1325000 - DNA, 22 bp, Artificial Sequence
  chemically synthesized
aagtatgattcattttctgtga

SEQ ID NO: 1325001 - DNA, 22 bp, Artificial Sequence
  chemically synthesized
attttctgtgacaaggggtagt

SEQ ID NO: 1325002 - DNA, 22 bp, Artificial Sequence
  chemically synthesized
agtaaagaaatgagactacccc

SEQ ID NO: 1325003 - DNA, 22 bp, Artificial Sequence
  chemically synthesized
cagtaaagaaatgagactaccc

SEQ ID NO: 1325004 - DNA, 22 bp, Artificial Sequence
  chemically synthesized
tctgtgacaaggggtagtctca

SEQ ID NO: 1325005 - DNA, 22 bp, Artificial Sequence
  chemically synthesized
ctgtgacaaggggtagtctcat

SEQ ID NO: 1325006 - DNA, 22 bp, Artificial Sequence
  chemically synthesized
tgtgacaaggggtagtctcatt

SEQ ID NO: 1325007 - DNA, 22 bp, Artificial Sequence
  chemically synthesized
tgacaaggggtagtctcatttc

SEQ ID NO: 1325008 - DNA, 22 bp, Artificial Sequence
  chemically synthesized
acagtagtcttcagtaaagaaa

SEQ ID NO: 1325009 - DNA, 22 bp, Artificial Sequence
  chemically synthesized
cacagtagtcttcagtaaagaa

SEQ ID NO: 1325010 - DNA, 22 bp, Artificial Sequence
  chemically synthesized
acaatttcacagtagtcttcag

SEQ ID NO: 1325011 - DNA, 22 bp, Artificial Sequence
  chemically synthesized
atttctttactgaagactactg

SEQ ID NO: 1325012 - DNA, 22 bp, Artificial Sequence
  chemically synthesized
ctttactgaagactactgtgaa

SEQ ID NO: 1325013 - DNA, 22 bp, Artificial Sequence
  chemically synthesized
catcctcacaatttcacagtag

SEQ ID NO: 1325014 - DNA, 22 bp, Artificial Sequence
  chemically synthesized
tttactgaagactactgtgaaa

SEQ ID NO: 1325015 - DNA, 22 bp, Artificial Sequence
  chemically synthesized
tactgaagactactgtgaaatt

SEQ ID NO: 1325016 - DNA, 22 bp, Artificial Sequence
  chemically synthesized
actgaagactactgtgaaattg

SEQ ID NO: 1325017 - DNA, 22 bp, Artificial Sequence
  chemically synthesized
ctgaagactactgtgaaattgt

SEQ ID NO: 1325018 - DNA, 22 bp, Artificial Sequence
  chemically synthesized
agatctccatcctcacaatttc

SEQ ID NO: 1325019 - DNA, 22 bp, Artificial Sequence
  chemically synthesized
aagactactgtgaaattgtgag

SEQ ID NO: 1325020 - DNA, 22 bp, Artificial Sequence
  chemically synthesized
ctcagatctccatcctcacaat

SEQ ID NO: 1325021 - DNA, 22 bp, Artificial Sequence
  chemically synthesized
gctcagatctccatcctcacaa

SEQ ID NO: 1325022 - DNA, 22 bp, Artificial Sequence
  chemically synthesized
tgctcagatctccatcctcaca

SEQ ID NO: 1325023 - DNA, 22 bp, Artificial Sequence
  chemically synthesized
ctgtgaaattgtgaggatggag

SEQ ID NO: 1325024 - DNA, 22 bp, Artificial Sequence
  chemically synthesized
attttgctcagatctccatcct

SEQ ID NO: 1325025 - DNA, 22 bp, Artificial Sequence
  chemically synthesized
tgaaattgtgaggatggagatc

SEQ ID NO: 1325026 - DNA, 22 bp, Artificial Sequence
  chemically synthesized
tgattttgctcagatctccatc

SEQ ID NO: 1325027 - DNA, 22 bp, Artificial Sequence
  chemically synthesized
tgaggatggagatctgagcaaa

SEQ ID NO: 1325028 - DNA, 22 bp, Artificial Sequence
  chemically synthesized
caatagaactctgattttgctc

SEQ ID NO: 1325029 - DNA, 22 bp, Artificial Sequence
  chemically synthesized
tgtccattccaatagaactctg

SEQ ID NO: 1325030 - DNA, 22 bp, Artificial Sequence
  chemically synthesized
ctgtgtccattccaatagaact

SEQ ID NO: 1325031 - DNA, 22 bp, Artificial Sequence
  chemically synthesized
agcaaaatcagagttctattgg

SEQ ID NO: 1325032 - DNA, 22 bp, Artificial Sequence
  chemically synthesized
attcctgtgtccattccaatag

SEQ ID NO: 1325033 - DNA, 22 bp, Artificial Sequence
  chemically synthesized
ccagataggctcattcctgtgt

SEQ ID NO: 1325034 - DNA, 22 bp, Artificial Sequence
  chemically synthesized
tattggaatggacacaggaatg

SEQ ID NO: 1325035 - DNA, 22 bp, Artificial Sequence
  chemically synthesized
ttggaatggacacaggaatgag

SEQ ID NO: 1325036 - DNA, 22 bp, Artificial Sequence
  chemically synthesized
gaatggacacaggaatgagcct

SEQ ID NO: 1325037 - DNA, 22 bp, Artificial Sequence
  chemically synthesized
atcacctaccagataggctcat

SEQ ID NO: 1325038 - DNA, 22 bp, Artificial Sequence
  chemically synthesized
aatcacctaccagataggctca

SEQ ID NO: 1325039 - DNA, 22 bp, Artificial Sequence
  chemically synthesized
taacagataccttaatcaccta

SEQ ID NO: 1325040 - DNA, 22 bp, Artificial Sequence
  chemically synthesized
tctggtaggtgattaaggtatc

SEQ ID NO: 1325041 - DNA, 22 bp, Artificial Sequence
  chemically synthesized
gtaggtgattaaggtatctgtt

SEQ ID NO: 1325042 - DNA, 22 bp, Artificial Sequence
  chemically synthesized
tgtatcaagttgtaacagatac

SEQ ID NO: 1325043 - DNA, 22 bp, Artificial Sequence
  chemically synthesized
ttgtgtatcaagttgtaacaga

SEQ ID NO: 1325044 - DNA, 22 bp, Artificial Sequence
  chemically synthesized
gttgtgtatcaagttgtaacag

SEQ ID NO: 1325045 - DNA, 22 bp, Artificial Sequence
  chemically synthesized
ttgttgtgtatcaagttgtaac

SEQ ID NO: 1325046 - DNA, 22 bp, Artificial Sequence
  chemically synthesized
cttgttgtgtatcaagttgtaa

SEQ ID NO: 1325047 - DNA, 22 bp, Artificial Sequence
  chemically synthesized
aggtatctgttacaacttgata

SEQ ID NO: 1325048 - DNA, 22 bp, Artificial Sequence
  chemically synthesized
gatttcttgttgtgtatcaagt

SEQ ID NO: 1325049 - DNA, 22 bp, Artificial Sequence
  chemically synthesized
ctggatttcttgttgtgtatca

SEQ ID NO: 1325050 - DNA, 22 bp, Artificial Sequence
  chemically synthesized
ttacaacttgatacacaacaag

SEQ ID NO: 1325051 - DNA, 22 bp, Artificial Sequence
  chemically synthesized
atattactggatttcttgttgt

SEQ ID NO: 1325052 - DNA, 22 bp, Artificial Sequence
  chemically synthesized
caacttgatacacaacaagaaa

SEQ ID NO: 1325053 - DNA, 22 bp, Artificial Sequence
  chemically synthesized
gatacacaacaagaaatccagt

SEQ ID NO: 1325054 - DNA, 22 bp, Artificial Sequence
  chemically synthesized
ccaattaatattactggatttc

SEQ ID NO: 1325055 - DNA, 22 bp, Artificial Sequence
  chemically synthesized
atacacaacaagaaatccagta

SEQ ID NO: 1325056 - DNA, 22 bp, Artificial Sequence
  chemically synthesized
accaattaatattactggattt

SEQ ID NO: 1325057 - DNA, 22 bp, Artificial Sequence
  chemically synthesized
gaagaatgtcttaccaattaat

SEQ ID NO: 1325058 - DNA, 22 bp, Artificial Sequence
  chemically synthesized
atatcgtgatgctagaagaatg

SEQ ID NO: 1325059 - DNA, 22 bp, Artificial Sequence
  chemically synthesized
aatatcgtgatgctagaagaat

SEQ ID NO: 1325060 - DNA, 22 bp, Artificial Sequence
  chemically synthesized
attggtaagacattcttctagc

SEQ ID NO: 1325061 - DNA, 22 bp, Artificial Sequence
  chemically synthesized
gtaagacattcttctagcatca

SEQ ID NO: 1325062 - DNA, 22 bp, Artificial Sequence
  chemically synthesized
gacgtatttaatatcgtgatgc

SEQ ID NO: 1325063 - DNA, 22 bp, Artificial Sequence
  chemically synthesized
tggacgtatttaatatcgtgat

SEQ ID NO: 1325064 - DNA, 22 bp, Artificial Sequence
  chemically synthesized
ttctagcatcacgatattaaat

SEQ ID NO: 1325065 - DNA, 22 bp, Artificial Sequence
  chemically synthesized
ctagcatcacgatattaaatac

SEQ ID NO: 1325066 - DNA, 22 bp, Artificial Sequence
  chemically synthesized
tagcatcacgatattaaatacg

SEQ ID NO: 1325067 - DNA, 22 bp, Artificial Sequence
  chemically synthesized
taggaattctggacgtatttaa

SEQ ID NO: 1325068 - DNA, 22 bp, Artificial Sequence
  chemically synthesized
gcatcacgatattaaatacgtc

SEQ ID NO: 1325069 - DNA, 22 bp, Artificial Sequence
  chemically synthesized
ataggaattctggacgtattta

SEQ ID NO: 1325070 - DNA, 22 bp, Artificial Sequence
  chemically synthesized
tataggaattctggacgtattt

SEQ ID NO: 1325071 - DNA, 22 bp, Artificial Sequence
  chemically synthesized
atgtacagattttataggaatt

SEQ ID NO: 1325072 - DNA, 22 bp, Artificial Sequence
  chemically synthesized
aatacgtccagaattcctataa

SEQ ID NO: 1325073 - DNA, 22 bp, Artificial Sequence
  chemically synthesized
aatgtacagattttataggaat

SEQ ID NO: 1325074 - DNA, 22 bp, Artificial Sequence
  chemically synthesized
acttaatgtacagattttatag

SEQ ID NO: 1325075 - DNA, 22 bp, Artificial Sequence
  chemically synthesized
aaagaaattaacttaatgtaca

SEQ ID NO: 1325076 - DNA, 22 bp, Artificial Sequence
  chemically synthesized
gaaagaaattaacttaatgtac

SEQ ID NO: 1325077 - DNA, 22 bp, Artificial Sequence
  chemically synthesized
ctataaaatctgtacattaagt

SEQ ID NO: 1325078 - DNA, 22 bp, Artificial Sequence
  chemically synthesized
tgaaagaaattaacttaatgta

SEQ ID NO: 1325079 - DNA, 22 bp, Artificial Sequence
  chemically synthesized
ttgaaagaaattaacttaatgt

SEQ ID NO: 1325080 - DNA, 22 bp, Artificial Sequence
  chemically synthesized
taaaatctgtacattaagttaa

SEQ ID NO: 1325081 - DNA, 22 bp, Artificial Sequence
  chemically synthesized
atttttgaaagaaattaactta

SEQ ID NO: 1325082 - DNA, 22 bp, Artificial Sequence
  chemically synthesized
tacattaagttaatttctttca

SEQ ID NO: 1325083 - DNA, 22 bp, Artificial Sequence
  chemically synthesized
gaaccaaaagttaatttttgaa

SEQ ID NO: 1325084 - DNA, 22 bp, Artificial Sequence
  chemically synthesized
agttaatttctttcaaaaatta

SEQ ID NO: 1325085 - DNA, 22 bp, Artificial Sequence
  chemically synthesized
tagaaccaaaagttaatttttg

SEQ ID NO: 1325086 - DNA, 22 bp, Artificial Sequence
  chemically synthesized
atttctttcaaaaattaacttt

SEQ ID NO: 1325087 - DNA, 22 bp, Artificial Sequence
  chemically synthesized
ctttcaaaaattaacttttggt

SEQ ID NO: 1325088 - DNA, 22 bp, Artificial Sequence
  chemically synthesized
tttcaaaaattaacttttggtt

SEQ ID NO: 1325089 - DNA, 22 bp, Artificial Sequence
  chemically synthesized
tcaaaaattaacttttggttct

SEQ ID NO: 1325090 - DNA, 22 bp, Artificial Sequence
  chemically synthesized
caaaaattaacttttggttcta

SEQ ID NO: 1325091 - DNA, 22 bp, Artificial Sequence
  chemically synthesized
aaaaattaacttttggttctag

SEQ ID NO: 1325092 - DNA, 22 bp, Artificial Sequence
  chemically synthesized
acttttggttctagagtacttt

SEQ ID NO: 1325093 - DNA, 22 bp, Artificial Sequence
  chemically synthesized
tggaaacacatcaaagtactct

SEQ ID NO: 1325094 - DNA, 22 bp, Artificial Sequence
  chemically synthesized
ttggttctagagtactttgatg

SEQ ID NO: 1325095 - DNA, 22 bp, Artificial Sequence
  chemically synthesized
tggttctagagtactttgatgt

SEQ ID NO: 1325096 - DNA, 22 bp, Artificial Sequence
  chemically synthesized
ggttctagagtactttgatgtg

SEQ ID NO: 1325097 - DNA, 22 bp, Artificial Sequence
  chemically synthesized
gttctagagtactttgatgtgt

SEQ ID NO: 1325098 - DNA, 22 bp, Artificial Sequence
  chemically synthesized
tagagtactttgatgtgtttcc

SEQ ID NO: 1325099 - DNA, 22 bp, Artificial Sequence
  chemically synthesized
acaggtcagttatggaaacaca

SEQ ID NO: 1325100 - DNA, 22 bp, Artificial Sequence
  chemically synthesized
gagtactttgatgtgtttccat

SEQ ID NO: 1325101 - DNA, 22 bp, Artificial Sequence
  chemically synthesized
tgatgtgtttccataactgacc

SEQ ID NO: 1325102 - DNA, 22 bp, Artificial Sequence
  chemically synthesized
agaggcctgacaggtcagttat

SEQ ID NO: 1325103 - DNA, 22 bp, Artificial Sequence
  chemically synthesized
gatgtgtttccataactgacct

SEQ ID NO: 1325104 - DNA, 22 bp, Artificial Sequence
  chemically synthesized
atgtgtttccataactgacctg

SEQ ID NO: 1325105 - DNA, 22 bp, Artificial Sequence
  chemically synthesized
ggctcagaggcctgacaggtca

SEQ ID NO: 1325106 - DNA, 22 bp, Artificial Sequence
  chemically synthesized
gggctcagaggcctgacaggtc

SEQ ID NO: 1325107 - DNA, 22 bp, Artificial Sequence
  chemically synthesized
ccataactgacctgtcaggcct

SEQ ID NO: 1325108 - DNA, 22 bp, Artificial Sequence
  chemically synthesized
gcttgggctcagaggcctgaca

SEQ ID NO: 1325109 - DNA, 22 bp, Artificial Sequence
  chemically synthesized
cataactgacctgtcaggcctc

SEQ ID NO: 1325110 - DNA, 22 bp, Artificial Sequence
  chemically synthesized
agcttgggctcagaggcctgac

SEQ ID NO: 1325111 - DNA, 22 bp, Artificial Sequence
  chemically synthesized
acctgtcaggcctctgagccca

SEQ ID NO: 1325112 - DNA, 22 bp, Artificial Sequence
  chemically synthesized
tcaggcctctgagcccaagcta

SEQ ID NO: 1325113 - DNA, 22 bp, Artificial Sequence
  chemically synthesized
tgagcccaagctaagccatcat

SEQ ID NO: 1325114 - DNA, 22 bp, Artificial Sequence
  chemically synthesized
agcccaagctaagccatcatat

SEQ ID NO: 1325115 - DNA, 22 bp, Artificial Sequence
  chemically synthesized
agccatcatatcccctgtgacc

SEQ ID NO: 1325116 - DNA, 22 bp, Artificial Sequence
  chemically synthesized
ggcgtatacatgcaggtcacag

SEQ ID NO: 1325117 - DNA, 22 bp, Artificial Sequence
  chemically synthesized
aggccatctgggcgtatacatg

SEQ ID NO: 1325118 - DNA, 22 bp, Artificial Sequence
  chemically synthesized
caggccatctgggcgtatacat

SEQ ID NO: 1325119 - DNA, 22 bp, Artificial Sequence
  chemically synthesized
cttcaggccatctgggcgtata

SEQ ID NO: 1325120 - DNA, 22 bp, Artificial Sequence
  chemically synthesized
tgacctgcatgtatacgcccag

SEQ ID NO: 1325121 - DNA, 22 bp, Artificial Sequence
  chemically synthesized
agttacttcaggccatctgggc

SEQ ID NO: 1325122 - DNA, 22 bp, Artificial Sequence
  chemically synthesized
cagttacttcaggccatctggg

SEQ ID NO: 1325123 - DNA, 22 bp, Artificial Sequence
  chemically synthesized
catgtatacgcccagatggcct

SEQ ID NO: 1325124 - DNA, 22 bp, Artificial Sequence
  chemically synthesized
ttcagttacttcaggccatctg

SEQ ID NO: 1325125 - DNA, 22 bp, Artificial Sequence
  chemically synthesized
tgattcttcagttacttcaggc

SEQ ID NO: 1325126 - DNA, 22 bp, Artificial Sequence
  chemically synthesized
gtgattcttcagttacttcagg

SEQ ID NO: 1325127 - DNA, 22 bp, Artificial Sequence
  chemically synthesized
tgtgattcttcagttacttcag

SEQ ID NO: 1325128 - DNA, 22 bp, Artificial Sequence
  chemically synthesized
ttgtgattcttcagttacttca

SEQ ID NO: 1325129 - DNA, 22 bp, Artificial Sequence
  chemically synthesized
ttttgtgattcttcagttactt

SEQ ID NO: 1325130 - DNA, 22 bp, Artificial Sequence
  chemically synthesized
cttttgtgattcttcagttact

SEQ ID NO: 1325131 - DNA, 22 bp, Artificial Sequence
  chemically synthesized
acttcttttgtgattcttcagt

SEQ ID NO: 1325132 - DNA, 22 bp, Artificial Sequence
  chemically synthesized
cacttcttttgtgattcttcag

SEQ ID NO: 1325133 - DNA, 22 bp, Artificial Sequence
  chemically synthesized
tcacttcttttgtgattcttca

SEQ ID NO: 1325134 - DNA, 22 bp, Artificial Sequence
  chemically synthesized
aagtaactgaagaatcacaaaa

SEQ ID NO: 1325135 - DNA, 22 bp, Artificial Sequence
  chemically synthesized
aagaatcacaaaagaagtgaaa

SEQ ID NO: 1325136 - DNA, 22 bp, Artificial Sequence
  chemically synthesized
aggcaggaacaggccattttca

SEQ ID NO: 1325137 - DNA, 22 bp, Artificial Sequence
  chemically synthesized
tggtggaatgtcatcagttaag

SEQ ID NO: 1325138 - DNA, 22 bp, Artificial Sequence
  chemically synthesized
gtggtggaatgtcatcagttaa

SEQ ID NO: 1325139 - DNA, 22 bp, Artificial Sequence
  chemically synthesized
tgtggtggaatgtcatcagtta

SEQ ID NO: 1325140 - DNA, 22 bp, Artificial Sequence
  chemically synthesized
ttgtggtggaatgtcatcagtt

SEQ ID NO: 1325141 - DNA, 22 bp, Artificial Sequence
  chemically synthesized
ttcctgccttaactgatgacat

SEQ ID NO: 1325142 - DNA, 22 bp, Artificial Sequence
  chemically synthesized
ttttgtggtggaatgtcatcag

SEQ ID NO: 1325143 - DNA, 22 bp, Artificial Sequence
  chemically synthesized
cttttgtggtggaatgtcatca

SEQ ID NO: 1325144 - DNA, 22 bp, Artificial Sequence
  chemically synthesized
ctgccttaactgatgacattcc

SEQ ID NO: 1325145 - DNA, 22 bp, Artificial Sequence
  chemically synthesized
ccttaactgatgacattccacc

SEQ ID NO: 1325146 - DNA, 22 bp, Artificial Sequence
  chemically synthesized
cacttcttttgtggtggaatgt

SEQ ID NO: 1325147 - DNA, 22 bp, Artificial Sequence
  chemically synthesized
ccacttcttttgtggtggaatg

SEQ ID NO: 1325148 - DNA, 22 bp, Artificial Sequence
  chemically synthesized
aactgatgacattccaccacaa

SEQ ID NO: 1325149 - DNA, 22 bp, Artificial Sequence
  chemically synthesized
actgatgacattccaccacaaa

SEQ ID NO: 1325150 - DNA, 22 bp, Artificial Sequence
  chemically synthesized
atgacattccaccacaaaagaa

SEQ ID NO: 1325151 - DNA, 22 bp, Artificial Sequence
  chemically synthesized
caccacaaaagaagtggaaatg

SEQ ID NO: 1325152 - DNA, 22 bp, Artificial Sequence
  chemically synthesized
aggcaggaacaggccatttcca

SEQ ID NO: 1325153 - DNA, 22 bp, Artificial Sequence
  chemically synthesized
acaaggtaatgtcatcagttaa

SEQ ID NO: 1325154 - DNA, 22 bp, Artificial Sequence
  chemically synthesized
cacaaggtaatgtcatcagtta

SEQ ID NO: 1325155 - DNA, 22 bp, Artificial Sequence
  chemically synthesized
ttcctgccttaactgatgacat

SEQ ID NO: 1325156 - DNA, 22 bp, Artificial Sequence
  chemically synthesized
ctgccttaactgatgacattac

SEQ ID NO: 1325157 - DNA, 22 bp, Artificial Sequence
  chemically synthesized
ccttaactgatgacattacctt

SEQ ID NO: 1325158 - DNA, 22 bp, Artificial Sequence
  chemically synthesized
aactgatgacattaccttgtga

SEQ ID NO: 1325159 - DNA, 22 bp, Artificial Sequence
  chemically synthesized
actgatgacattaccttgtgaa

SEQ ID NO: 1325160 - DNA, 22 bp, Artificial Sequence
  chemically synthesized
atgacattaccttgtgaaattc

SEQ ID NO: 1325161 - DNA, 22 bp, Artificial Sequence
  chemically synthesized
ccttgtgaaattccttctcctg

SEQ ID NO: 1325162 - DNA, 22 bp, Artificial Sequence
  chemically synthesized
agccaggatgagccaggagaag

SEQ ID NO: 1325163 - DNA, 22 bp, Artificial Sequence
  chemically synthesized
gagccaggatgagccaggagaa

SEQ ID NO: 1325164 - DNA, 22 bp, Artificial Sequence
  chemically synthesized
tgagccaggatgagccaggaga

SEQ ID NO: 1325165 - DNA, 22 bp, Artificial Sequence
  chemically synthesized
gtgaaattccttctcctggctc

SEQ ID NO: 1325166 - DNA, 22 bp, Artificial Sequence
  chemically synthesized
ttgagccaggatgagccaggag

SEQ ID NO: 1325167 - DNA, 22 bp, Artificial Sequence
  chemically synthesized
tgaaattccttctcctggctca

SEQ ID NO: 1325168 - DNA, 22 bp, Artificial Sequence
  chemically synthesized
tttgagccaggatgagccagga

SEQ ID NO: 1325169 - DNA, 22 bp, Artificial Sequence
  chemically synthesized
cttctcctggctcatcctggct

SEQ ID NO: 1325170 - DNA, 22 bp, Artificial Sequence
  chemically synthesized
ctcctggctcatcctggctcaa

SEQ ID NO: 1325171 - DNA, 22 bp, Artificial Sequence
  chemically synthesized
tcctggctcatcctggctcaaa

SEQ ID NO: 1325172 - DNA, 22 bp, Artificial Sequence
  chemically synthesized
agtgggggagctttttgagcca

SEQ ID NO: 1325173 - DNA, 22 bp, Artificial Sequence
  chemically synthesized
ctggctcatcctggctcaaaaa

SEQ ID NO: 1325174 - DNA, 22 bp, Artificial Sequence
  chemically synthesized
gctcatcctggctcaaaaagct

SEQ ID NO: 1325175 - DNA, 22 bp, Artificial Sequence
  chemically synthesized
atcctggctcaaaaagctcccc

SEQ ID NO: 1325176 - DNA, 22 bp, Artificial Sequence
  chemically synthesized
gctcaaaaagctcccccactga

SEQ ID NO: 1325177 - DNA, 22 bp, Artificial Sequence
  chemically synthesized
aaaaagctcccccactgagcac

SEQ ID NO: 1325178 - DNA, 22 bp, Artificial Sequence
  chemically synthesized
ccccactgagcaccttgtgacc

SEQ ID NO: 1325179 - DNA, 22 bp, Artificial Sequence
  chemically synthesized
gtgggcaggagtgggggtcaca

SEQ ID NO: 1325180 - DNA, 22 bp, Artificial Sequence
  chemically synthesized
tggtgggcaggagtgggggtca

SEQ ID NO: 1325181 - DNA, 22 bp, Artificial Sequence
  chemically synthesized
tctggtgggcaggagtgggggt

SEQ ID NO: 1325182 - DNA, 22 bp, Artificial Sequence
  chemically synthesized
agcaccttgtgacccccactcc

SEQ ID NO: 1325183 - DNA, 22 bp, Artificial Sequence
  chemically synthesized
ttctctggtgggcaggagtggg

SEQ ID NO: 1325184 - DNA, 22 bp, Artificial Sequence
  chemically synthesized
gtgacccccactcctgcccacc

SEQ ID NO: 1325185 - DNA, 22 bp, Artificial Sequence
  chemically synthesized
tgacccccactcctgcccacca

SEQ ID NO: 1325186 - DNA, 22 bp, Artificial Sequence
  chemically synthesized
caaagaggggttgttctctggt

SEQ ID NO: 1325187 - DNA, 22 bp, Artificial Sequence
  chemically synthesized
ctgcccaccagagaacaacccc

SEQ ID NO: 1325188 - DNA, 22 bp, Artificial Sequence
  chemically synthesized
cccaccagagaacaacccctct

SEQ ID NO: 1325189 - DNA, 22 bp, Artificial Sequence
  chemically synthesized
ggtaggtaaaggaaaattacaa

SEQ ID NO: 1325190 - DNA, 22 bp, Artificial Sequence
  chemically synthesized
cggtaggtaaaggaaaattaca

SEQ ID NO: 1325191 - DNA, 22 bp, Artificial Sequence
  chemically synthesized
tcggtaggtaaaggaaaattac

SEQ ID NO: 1325192 - DNA, 22 bp, Artificial Sequence
  chemically synthesized
taagctttcggtaggtaaagga

SEQ ID NO: 1325193 - DNA, 22 bp, Artificial Sequence
  chemically synthesized
ataagctttcggtaggtaaagg

SEQ ID NO: 1325194 - DNA, 22 bp, Artificial Sequence
  chemically synthesized
tttgtaattttcctttacctac

SEQ ID NO: 1325195 - DNA, 22 bp, Artificial Sequence
  chemically synthesized
tataagctttcggtaggtaaag

SEQ ID NO: 1325196 - DNA, 22 bp, Artificial Sequence
  chemically synthesized
tgtaattttcctttacctaccg

SEQ ID NO: 1325197 - DNA, 22 bp, Artificial Sequence
  chemically synthesized
gtaattttcctttacctaccga

SEQ ID NO: 1325198 - DNA, 22 bp, Artificial Sequence
  chemically synthesized
taattttcctttacctaccgaa

SEQ ID NO: 1325199 - DNA, 22 bp, Artificial Sequence
  chemically synthesized
tcctttacctaccgaaagctta

SEQ ID NO: 1325200 - DNA, 22 bp, Artificial Sequence
  chemically synthesized
cctttacctaccgaaagcttat

SEQ ID NO: 1325201 - DNA, 22 bp, Artificial Sequence
  chemically synthesized
ctttacctaccgaaagcttata

SEQ ID NO: 1325202 - DNA, 22 bp, Artificial Sequence
  chemically synthesized
tacctaccgaaagcttataaaa

SEQ ID NO: 1325203 - DNA, 22 bp, Artificial Sequence
  chemically synthesized
acctaccgaaagcttataaaac

SEQ ID NO: 1325204 - DNA, 22 bp, Artificial Sequence
  chemically synthesized
cctaccgaaagcttataaaacg

SEQ ID NO: 1325205 - DNA, 22 bp, Artificial Sequence
  chemically synthesized
ccgaaagcttataaaacggccc

SEQ ID NO: 1325206 - DNA, 22 bp, Artificial Sequence
  chemically synthesized
ataaaacggccccacccctatc

SEQ ID NO: 1325207 - DNA, 22 bp, Artificial Sequence
  chemically synthesized
taaaacggccccacccctatct

SEQ ID NO: 1325208 - DNA, 22 bp, Artificial Sequence
  chemically synthesized
agtccgaaaagagagtcaggga

SEQ ID NO: 1325209 - DNA, 22 bp, Artificial Sequence
  chemically synthesized
tctcccttccctgactctcttt

SEQ ID NO: 1325210 - DNA, 22 bp, Artificial Sequence
  chemically synthesized
ccttccctgactctcttttcgg

SEQ ID NO: 1325211 - DNA, 22 bp, Artificial Sequence
  chemically synthesized
ccctgactctcttttcggactc

SEQ ID NO: 1325212 - DNA, 22 bp, Artificial Sequence
  chemically synthesized
cctgactctcttttcggactca

SEQ ID NO: 1325213 - DNA, 22 bp, Artificial Sequence
  chemically synthesized
ggtgcaggcgggctgagtccga

SEQ ID NO: 1325214 - DNA, 22 bp, Artificial Sequence
  chemically synthesized
actctcttttcggactcagccc

SEQ ID NO: 1325215 - DNA, 22 bp, Artificial Sequence
  chemically synthesized
tcttttcggactcagcccgcct

SEQ ID NO: 1325216 - DNA, 22 bp, Artificial Sequence
  chemically synthesized
atcacctgggtgcaggcgggct

SEQ ID NO: 1325217 - DNA, 22 bp, Artificial Sequence
  chemically synthesized
ttttcggactcagcccgcctgc

SEQ ID NO: 1325218 - DNA, 22 bp, Artificial Sequence
  chemically synthesized
aatcacctgggtgcaggcgggc

SEQ ID NO: 1325219 - DNA, 22 bp, Artificial Sequence
  chemically synthesized
taatcacctgggtgcaggcggg

SEQ ID NO: 1325220 - DNA, 22 bp, Artificial Sequence
  chemically synthesized
ttcggactcagcccgcctgcac

SEQ ID NO: 1325221 - DNA, 22 bp, Artificial Sequence
  chemically synthesized
ttaatcacctgggtgcaggcgg

SEQ ID NO: 1325222 - DNA, 22 bp, Artificial Sequence
  chemically synthesized
tcggactcagcccgcctgcacc

SEQ ID NO: 1325223 - DNA, 22 bp, Artificial Sequence
  chemically synthesized
tttaatcacctgggtgcaggcg

SEQ ID NO: 1325224 - DNA, 22 bp, Artificial Sequence
  chemically synthesized
cggactcagcccgcctgcaccc

SEQ ID NO: 1325225 - DNA, 22 bp, Artificial Sequence
  chemically synthesized
ggactcagcccgcctgcaccca

SEQ ID NO: 1325226 - DNA, 22 bp, Artificial Sequence
  chemically synthesized
agcccgcctgcacccaggtgat

SEQ ID NO: 1325227 - DNA, 22 bp, Artificial Sequence
  chemically synthesized
tgtgagcaataaagctttttaa

SEQ ID NO: 1325228 - DNA, 22 bp, Artificial Sequence
  chemically synthesized
cacccaggtgattaaaaagctt

SEQ ID NO: 1325229 - DNA, 22 bp, Artificial Sequence
  chemically synthesized
gtgtgagcaataaagcttttta

SEQ ID NO: 1325230 - DNA, 22 bp, Artificial Sequence
  chemically synthesized
tgtgtgagcaataaagcttttt

SEQ ID NO: 1325231 - DNA, 22 bp, Artificial Sequence
  chemically synthesized
aaaagctttattgctcacacaa

SEQ ID NO: 1325232 - DNA, 22 bp, Artificial Sequence
  chemically synthesized
tattgctcacacaaagcctgtt

SEQ ID NO: 1325233 - DNA, 22 bp, Artificial Sequence
  chemically synthesized
attgctcacacaaagcctgttt

SEQ ID NO: 1325234 - DNA, 22 bp, Artificial Sequence
  chemically synthesized
ttgctcacacaaagcctgtttg

SEQ ID NO: 1325235 - DNA, 22 bp, Artificial Sequence
  chemically synthesized
ctcacacaaagcctgtttggtg

SEQ ID NO: 1325236 - DNA, 22 bp, Artificial Sequence
  chemically synthesized
acacaaagcctgtttggtggtc

SEQ ID NO: 1325237 - DNA, 22 bp, Artificial Sequence
  chemically synthesized
agtcgcgtccgtgtgaagagac

SEQ ID NO: 1325238 - DNA, 22 bp, Artificial Sequence
  chemically synthesized
cagtcgcgtccgtgtgaagaga

SEQ ID NO: 1325239 - DNA, 22 bp, Artificial Sequence
  chemically synthesized
tttggtggtctcttcacacgga

SEQ ID NO: 1325240 - DNA, 22 bp, Artificial Sequence
  chemically synthesized
ggtggtctcttcacacggacgc

SEQ ID NO: 1325241 - DNA, 22 bp, Artificial Sequence
  chemically synthesized
gtggtctcttcacacggacgcg

SEQ ID NO: 1325242 - DNA, 22 bp, Artificial Sequence
  chemically synthesized
atgggtcatttcagtcgcgtcc

SEQ ID NO: 1325243 - DNA, 22 bp, Artificial Sequence
  chemically synthesized
taatgggtcatttcagtcgcgt

SEQ ID NO: 1325244 - DNA, 22 bp, Artificial Sequence
  chemically synthesized
ctaatgggtcatttcagtcgcg

SEQ ID NO: 1325245 - DNA, 22 bp, Artificial Sequence
  chemically synthesized
tctaatgggtcatttcagtcgc

SEQ ID NO: 1325246 - DNA, 22 bp, Artificial Sequence
  chemically synthesized
ttcacacggacgcgactgaaat

SEQ ID NO: 1325247 - DNA, 22 bp, Artificial Sequence
  chemically synthesized
ttctaatgggtcatttcagtcg

SEQ ID NO: 1325248 - DNA, 22 bp, Artificial Sequence
  chemically synthesized
cacacggacgcgactgaaatga

SEQ ID NO: 1325249 - DNA, 22 bp, Artificial Sequence
  chemically synthesized
acacggacgcgactgaaatgac

SEQ ID NO: 1325250 - DNA, 22 bp, Artificial Sequence
  chemically synthesized
aaatgacccattagaaaagcat

SEQ ID NO: 1325251 - DNA, 22 bp, Artificial Sequence
  chemically synthesized
aaaaaatgcaagacataagtaa

SEQ ID NO: 1325252 - DNA, 22 bp, Artificial Sequence
  chemically synthesized
gaaaagcatacttacttatgtc

SEQ ID NO: 1325253 - DNA, 22 bp, Artificial Sequence
  chemically synthesized
tagctcaaaaaatgcaagacat

SEQ ID NO: 1325254 - DNA, 22 bp, Artificial Sequence
  chemically synthesized
aaaattatagctcaaaaaatgc

SEQ ID NO: 1325255 - DNA, 22 bp, Artificial Sequence
  chemically synthesized
acttatgtcttgcattttttga

SEQ ID NO: 1325256 - DNA, 22 bp, Artificial Sequence
  chemically synthesized
aaaaattatagctcaaaaaatg

SEQ ID NO: 1325257 - DNA, 22 bp, Artificial Sequence
  chemically synthesized
cttatgtcttgcattttttgag

SEQ ID NO: 1325258 - DNA, 22 bp, Artificial Sequence
  chemically synthesized
taaaaattatagctcaaaaaat

SEQ ID NO: 1325259 - DNA, 22 bp, Artificial Sequence
  chemically synthesized
ttaaaaattatagctcaaaaaa

SEQ ID NO: 1325260 - DNA, 22 bp, Artificial Sequence
  chemically synthesized
tttaaaaattatagctcaaaaa

SEQ ID NO: 1325261 - DNA, 22 bp, Artificial Sequence
  chemically synthesized
atgtcttgcattttttgagcta

SEQ ID NO: 1325262 - DNA, 22 bp, Artificial Sequence
  chemically synthesized
tgtcttgcattttttgagctat

SEQ ID NO: 1325263 - DNA, 22 bp, Artificial Sequence
  chemically synthesized
cattttttaaaaattatagctc

SEQ ID NO: 1325264 - DNA, 22 bp, Artificial Sequence
  chemically synthesized
acattttttaaaaattatagct

SEQ ID NO: 1325265 - DNA, 22 bp, Artificial Sequence
  chemically synthesized
gcattttttgagctataatttt

SEQ ID NO: 1325266 - DNA, 22 bp, Artificial Sequence
  chemically synthesized
cattttttgagctataattttt

SEQ ID NO: 1325267 - DNA, 22 bp, Artificial Sequence
  chemically synthesized
agtttacattttttaaaaatta

SEQ ID NO: 1325268 - DNA, 22 bp, Artificial Sequence
  chemically synthesized
tgagtttacattttttaaaaat

SEQ ID NO: 1325269 - DNA, 22 bp, Artificial Sequence
  chemically synthesized
tttgagctataatttttaaaaa

SEQ ID NO: 1325270 - DNA, 22 bp, Artificial Sequence
  chemically synthesized
ctgagtttacattttttaaaaa

SEQ ID NO: 1325271 - DNA, 22 bp, Artificial Sequence
  chemically synthesized
ttgagctataatttttaaaaaa

SEQ ID NO: 1325272 - DNA, 22 bp, Artificial Sequence
  chemically synthesized
tgagctataatttttaaaaaat

SEQ ID NO: 1325273 - DNA, 22 bp, Artificial Sequence
  chemically synthesized
gagctataatttttaaaaaatg

SEQ ID NO: 1325274 - DNA, 22 bp, Artificial Sequence
  chemically synthesized
agctataatttttaaaaaatgt

SEQ ID NO: 1325275 - DNA, 22 bp, Artificial Sequence
  chemically synthesized
taatttttaaaaaatgtaaact

SEQ ID NO: 1325276 - DNA, 22 bp, Artificial Sequence
  chemically synthesized
catacatttctgagtttacatt

SEQ ID NO: 1325277 - DNA, 22 bp, Artificial Sequence
  chemically synthesized
ttaaaaaatgtaaactcagaaa

SEQ ID NO: 1325278 - DNA, 22 bp, Artificial Sequence
  chemically synthesized
taaaaaatgtaaactcagaaat

SEQ ID NO: 1325279 - DNA, 22 bp, Artificial Sequence
  chemically synthesized
gtgattccatacatttctgagt

SEQ ID NO: 1325280 - DNA, 22 bp, Artificial Sequence
  chemically synthesized
aaaaaatgtaaactcagaaatg

SEQ ID NO: 1325281 - DNA, 22 bp, Artificial Sequence
  chemically synthesized
agtgattccatacatttctgag

SEQ ID NO: 1325282 - DNA, 22 bp, Artificial Sequence
  chemically synthesized
aaaaatgtaaactcagaaatgt

SEQ ID NO: 1325283 - DNA, 22 bp, Artificial Sequence
  chemically synthesized
tagtgattccatacatttctga

SEQ ID NO: 1325284 - DNA, 22 bp, Artificial Sequence
  chemically synthesized
ttagtgattccatacatttctg

SEQ ID NO: 1325285 - DNA, 22 bp, Artificial Sequence
  chemically synthesized
tttagtgattccatacatttct

SEQ ID NO: 1325286 - DNA, 22 bp, Artificial Sequence
  chemically synthesized
ttttagtgattccatacatttc

SEQ ID NO: 1325287 - DNA, 22 bp, Artificial Sequence
  chemically synthesized
taatttttttagtgattccata

SEQ ID NO: 1325288 - DNA, 22 bp, Artificial Sequence
  chemically synthesized
tataatttttttagtgattcca

SEQ ID NO: 1325289 - DNA, 22 bp, Artificial Sequence
  chemically synthesized
ctataatttttttagtgattcc

SEQ ID NO: 1325290 - DNA, 22 bp, Artificial Sequence
  chemically synthesized
tctataatttttttagtgattc

SEQ ID NO: 1325291 - DNA, 22 bp, Artificial Sequence
  chemically synthesized
agaaatgtatggaatcactaaa

SEQ ID NO: 1325292 - DNA, 22 bp, Artificial Sequence
  chemically synthesized
tgagatcccattttctataatt

SEQ ID NO: 1325293 - DNA, 22 bp, Artificial Sequence
  chemically synthesized
aaaaaattatagaaaatgggat

SEQ ID NO: 1325294 - DNA, 22 bp, Artificial Sequence
  chemically synthesized
caaagacataactgtgagatcc

SEQ ID NO: 1325295 - DNA, 22 bp, Artificial Sequence
  chemically synthesized
tagaaaatgggatctcacagtt

SEQ ID NO: 1325296 - DNA, 22 bp, Artificial Sequence
  chemically synthesized
atgtgcatgagttacaaagaca

SEQ ID NO: 1325297 - DNA, 22 bp, Artificial Sequence
  chemically synthesized
aatgtgcatgagttacaaagac

SEQ ID NO: 1325298 - DNA, 22 bp, Artificial Sequence
  chemically synthesized
taatgtgcatgagttacaaaga

SEQ ID NO: 1325299 - DNA, 22 bp, Artificial Sequence
  chemically synthesized
ttaatgtgcatgagttacaaag

SEQ ID NO: 1325300 - DNA, 22 bp, Artificial Sequence
  chemically synthesized
acagttatgtctttgtaactca

SEQ ID NO: 1325301 - DNA, 22 bp, Artificial Sequence
  chemically synthesized
cttttaatgtgcatgagttaca

SEQ ID NO: 1325302 - DNA, 22 bp, Artificial Sequence
  chemically synthesized
tgtctttgtaactcatgcacat

SEQ ID NO: 1325303 - DNA, 22 bp, Artificial Sequence
  chemically synthesized
ggattgcttttaatgtgcatga

SEQ ID NO: 1325304 - DNA, 22 bp, Artificial Sequence
  chemically synthesized
gggattgcttttaatgtgcatg

SEQ ID NO: 1325305 - DNA, 22 bp, Artificial Sequence
  chemically synthesized
tttgggattgcttttaatgtgc

SEQ ID NO: 1325306 - DNA, 22 bp, Artificial Sequence
  chemically synthesized
atttgggattgcttttaatgtg

SEQ ID NO: 1325307 - DNA, 22 bp, Artificial Sequence
  chemically synthesized
tgtaactcatgcacattaaaag

SEQ ID NO: 1325308 - DNA, 22 bp, Artificial Sequence
  chemically synthesized
tatttgggattgcttttaatgt

SEQ ID NO: 1325309 - DNA, 22 bp, Artificial Sequence
  chemically synthesized
gtaactcatgcacattaaaagc

SEQ ID NO: 1325310 - DNA, 22 bp, Artificial Sequence
  chemically synthesized
ttatttgggattgcttttaatg

SEQ ID NO: 1325311 - DNA, 22 bp, Artificial Sequence
  chemically synthesized
taactcatgcacattaaaagca

SEQ ID NO: 1325312 - DNA, 22 bp, Artificial Sequence
  chemically synthesized
tttttatttgggattgctttta

SEQ ID NO: 1325313 - DNA, 22 bp, Artificial Sequence
  chemically synthesized
atgcacattaaaagcaatccca

SEQ ID NO: 1325314 - DNA, 22 bp, Artificial Sequence
  chemically synthesized
tcattatttttatttgggattg

SEQ ID NO: 1325315 - DNA, 22 bp, Artificial Sequence
  chemically synthesized
atcattatttttatttgggatt

SEQ ID NO: 1325316 - DNA, 22 bp, Artificial Sequence
  chemically synthesized
gatttatcattatttttatttg

SEQ ID NO: 1325317 - DNA, 22 bp, Artificial Sequence
  chemically synthesized
aaagcaatcccaaataaaaata

SEQ ID NO: 1325318 - DNA, 22 bp, Artificial Sequence
  chemically synthesized
tgctagatttatcattattttt

SEQ ID NO: 1325319 - DNA, 22 bp, Artificial Sequence
  chemically synthesized
ttatgctagatttatcattatt

SEQ ID NO: 1325320 - DNA, 22 bp, Artificial Sequence
  chemically synthesized
attatgctagatttatcattat

SEQ ID NO: 1325321 - DNA, 22 bp, Artificial Sequence
  chemically synthesized
aagaaataatgatttattatgc

SEQ ID NO: 1325322 - DNA, 22 bp, Artificial Sequence
  chemically synthesized
aaagaaataatgatttattatg

SEQ ID NO: 1325323 - DNA, 22 bp, Artificial Sequence
  chemically synthesized
gcataataaatcattatttctt

SEQ ID NO: 1325324 - DNA, 22 bp, Artificial Sequence
  chemically synthesized
ggaaaaatatatttaaagaaat

SEQ ID NO: 1325325 - DNA, 22 bp, Artificial Sequence
  chemically synthesized
aggaaaaatatatttaaagaaa

SEQ ID NO: 1325326 - DNA, 22 bp, Artificial Sequence
  chemically synthesized
ttaggaaaaatatatttaaaga

SEQ ID NO: 1325327 - DNA, 22 bp, Artificial Sequence
  chemically synthesized
ttcttaggaaaaatatatttaa

SEQ ID NO: 1325328 - DNA, 22 bp, Artificial Sequence
  chemically synthesized
tgttcttaggaaaaatatattt

SEQ ID NO: 1325329 - DNA, 22 bp, Artificial Sequence
  chemically synthesized
tttctttaaatatatttttcct

SEQ ID NO: 1325330 - DNA, 22 bp, Artificial Sequence
  chemically synthesized
tcgttctgttcttaggaaaaat

SEQ ID NO: 1325331 - DNA, 22 bp, Artificial Sequence
  chemically synthesized
ctttaaatatatttttcctaag

SEQ ID NO: 1325332 - DNA, 22 bp, Artificial Sequence
  chemically synthesized
tttaaatatatttttcctaaga

SEQ ID NO: 1325333 - DNA, 22 bp, Artificial Sequence
  chemically synthesized
taaatatatttttcctaagaac

SEQ ID NO: 1325334 - DNA, 22 bp, Artificial Sequence
  chemically synthesized
agttatcgttctgttcttagga

SEQ ID NO: 1325335 - DNA, 22 bp, Artificial Sequence
  chemically synthesized
aaatatatttttcctaagaaca

SEQ ID NO: 1325336 - DNA, 22 bp, Artificial Sequence
  chemically synthesized
gagttatcgttctgttcttagg

SEQ ID NO: 1325337 - DNA, 22 bp, Artificial Sequence
  chemically synthesized
aatatatttttcctaagaacag

SEQ ID NO: 1325338 - DNA, 22 bp, Artificial Sequence
  chemically synthesized
aatttgagttatcgttctgttc

SEQ ID NO: 1325339 - DNA, 22 bp, Artificial Sequence
  chemically synthesized
aaatttgagttatcgttctgtt

SEQ ID NO: 1325340 - DNA, 22 bp, Artificial Sequence
  chemically synthesized
ttcctaagaacagaacgataac

SEQ ID NO: 1325341 - DNA, 22 bp, Artificial Sequence
  chemically synthesized
tcctaagaacagaacgataact

SEQ ID NO: 1325342 - DNA, 22 bp, Artificial Sequence
  chemically synthesized
cctaagaacagaacgataactc

SEQ ID NO: 1325343 - DNA, 22 bp, Artificial Sequence
  chemically synthesized
ctaagaacagaacgataactca

SEQ ID NO: 1325344 - DNA, 22 bp, Artificial Sequence
  chemically synthesized
gaacacttaaatttgagttatc

SEQ ID NO: 1325345 - DNA, 22 bp, Artificial Sequence
  chemically synthesized
ggaacacttaaatttgagttat

SEQ ID NO: 1325346 - DNA, 22 bp, Artificial Sequence
  chemically synthesized
agaacagaacgataactcaaat

SEQ ID NO: 1325347 - DNA, 22 bp, Artificial Sequence
  chemically synthesized
tcagtttggaacacttaaattt

SEQ ID NO: 1325348 - DNA, 22 bp, Artificial Sequence
  chemically synthesized
atcagtttggaacacttaaatt

SEQ ID NO: 1325349 - DNA, 22 bp, Artificial Sequence
  chemically synthesized
aggacttatcagtttggaacac

SEQ ID NO: 1325350 - DNA, 22 bp, Artificial Sequence
  chemically synthesized
aaatttaagtgttccaaactga

SEQ ID NO: 1325351 - DNA, 22 bp, Artificial Sequence
  chemically synthesized
ccctgaggacttatcagtttgg

SEQ ID NO: 1325352 - DNA, 22 bp, Artificial Sequence
  chemically synthesized
aagtgttccaaactgataagtc

SEQ ID NO: 1325353 - DNA, 22 bp, Artificial Sequence
  chemically synthesized
agtgttccaaactgataagtcc

SEQ ID NO: 1325354 - DNA, 22 bp, Artificial Sequence
  chemically synthesized
gtgttcccctgaggacttatca

SEQ ID NO: 1325355 - DNA, 22 bp, Artificial Sequence
  chemically synthesized
agtgttcccctgaggacttatc

SEQ ID NO: 1325356 - DNA, 22 bp, Artificial Sequence
  chemically synthesized
tagtgttcccctgaggacttat

SEQ ID NO: 1325357 - DNA, 22 bp, Artificial Sequence
  chemically synthesized
ttagtgttcccctgaggactta

SEQ ID NO: 1325358 - DNA, 22 bp, Artificial Sequence
  chemically synthesized
caaactgataagtcctcagggg

SEQ ID NO: 1325359 - DNA, 22 bp, Artificial Sequence
  chemically synthesized
acttttagtgttcccctgagga

SEQ ID NO: 1325360 - DNA, 22 bp, Artificial Sequence
  chemically synthesized
tcacttttagtgttcccctgag

SEQ ID NO: 1325361 - DNA, 22 bp, Artificial Sequence
  chemically synthesized
ctctcacttttagtgttcccct

SEQ ID NO: 1325362 - DNA, 22 bp, Artificial Sequence
  chemically synthesized
ataagtcctcaggggaacacta

SEQ ID NO: 1325363 - DNA, 22 bp, Artificial Sequence
  chemically synthesized
aattactctcacttttagtgtt

SEQ ID NO: 1325364 - DNA, 22 bp, Artificial Sequence
  chemically synthesized
aaattactctcacttttagtgt

SEQ ID NO: 1325365 - DNA, 22 bp, Artificial Sequence
  chemically synthesized
taaattactctcacttttagtg

SEQ ID NO: 1325366 - DNA, 22 bp, Artificial Sequence
  chemically synthesized
ttaaattactctcacttttagt

SEQ ID NO: 1325367 - DNA, 22 bp, Artificial Sequence
  chemically synthesized
cttttaaattactctcactttt

SEQ ID NO: 1325368 - DNA, 22 bp, Artificial Sequence
  chemically synthesized
aggggaacactaaaagtgagag

SEQ ID NO: 1325369 - DNA, 22 bp, Artificial Sequence
  chemically synthesized
tacttttaaattactctcactt

SEQ ID NO: 1325370 - DNA, 22 bp, Artificial Sequence
  chemically synthesized
atattctacttttaaattactc

SEQ ID NO: 1325371 - DNA, 22 bp, Artificial Sequence
  chemically synthesized
ctgatattctacttttaaatta

SEQ ID NO: 1325372 - DNA, 22 bp, Artificial Sequence
  chemically synthesized
aaagtgagagtaatttaaaagt

SEQ ID NO: 1325373 - DNA, 22 bp, Artificial Sequence
  chemically synthesized
aaatctactgatattctacttt

SEQ ID NO: 1325374 - DNA, 22 bp, Artificial Sequence
  chemically synthesized
ctaaaatctactgatattctac

SEQ ID NO: 1325375 - DNA, 22 bp, Artificial Sequence
  chemically synthesized
gctaaaatctactgatattcta

SEQ ID NO: 1325376 - DNA, 22 bp, Artificial Sequence
  chemically synthesized
tgctaaaatctactgatattct

SEQ ID NO: 1325377 - DNA, 22 bp, Artificial Sequence
  chemically synthesized
ttgctaaaatctactgatattc

SEQ ID NO: 1325378 - DNA, 22 bp, Artificial Sequence
  chemically synthesized
ttttgctaaaatctactgatat

SEQ ID NO: 1325379 - DNA, 22 bp, Artificial Sequence
  chemically synthesized
cttttgctaaaatctactgata

SEQ ID NO: 1325380 - DNA, 22 bp, Artificial Sequence
  chemically synthesized
tcttttgctaaaatctactgat

SEQ ID NO: 1325381 - DNA, 22 bp, Artificial Sequence
  chemically synthesized
aaaagtagaatatcagtagatt

SEQ ID NO: 1325382 - DNA, 22 bp, Artificial Sequence
  chemically synthesized
ttcttttgctaaaatctactga

SEQ ID NO: 1325383 - DNA, 22 bp, Artificial Sequence
  chemically synthesized
aaagtagaatatcagtagattt

SEQ ID NO: 1325384 - DNA, 22 bp, Artificial Sequence
  chemically synthesized
tcaatttttcttttgctaaaat

SEQ ID NO: 1325385 - DNA, 22 bp, Artificial Sequence
  chemically synthesized
atgagcactatcaatttttctt

SEQ ID NO: 1325386 - DNA, 22 bp, Artificial Sequence
  chemically synthesized
ctaatgagcactatcaattttt

SEQ ID NO: 1325387 - DNA, 22 bp, Artificial Sequence
  chemically synthesized
tagcaaaagaaaaattgatagt

SEQ ID NO: 1325388 - DNA, 22 bp, Artificial Sequence
  chemically synthesized
agcaaaagaaaaattgatagtg

SEQ ID NO: 1325389 - DNA, 22 bp, Artificial Sequence
  chemically synthesized
gcaaaagaaaaattgatagtgc

SEQ ID NO: 1325390 - DNA, 22 bp, Artificial Sequence
  chemically synthesized
tataaattcctaatgagcacta

SEQ ID NO: 1325391 - DNA, 22 bp, Artificial Sequence
  chemically synthesized
aataaattatataaattcctaa

SEQ ID NO: 1325392 - DNA, 22 bp, Artificial Sequence
  chemically synthesized
atagtgctcattaggaatttat

SEQ ID NO: 1325393 - DNA, 22 bp, Artificial Sequence
  chemically synthesized
tgattcaataaattatataaat

SEQ ID NO: 1325394 - DNA, 22 bp, Artificial Sequence
  chemically synthesized
attaggaatttatataatttat

SEQ ID NO: 1325395 - DNA, 22 bp, Artificial Sequence
  chemically synthesized
ggaatttatataatttattgaa

SEQ ID NO: 1325396 - DNA, 22 bp, Artificial Sequence
  chemically synthesized
atataatttattgaatcataat

SEQ ID NO: 1325397 - DNA, 22 bp, Artificial Sequence
  chemically synthesized
tataatttattgaatcataatt

SEQ ID NO: 1325398 - DNA, 22 bp, Artificial Sequence
  chemically synthesized
tgtaaatcaatagtgtaattat

SEQ ID NO: 1325399 - DNA, 22 bp, Artificial Sequence
  chemically synthesized
ttatgtaaatcaatagtgtaat

SEQ ID NO: 1325400 - DNA, 22 bp, Artificial Sequence
  chemically synthesized
attgaatcataattacactatt

SEQ ID NO: 1325401 - DNA, 22 bp, Artificial Sequence
  chemically synthesized
ttgaatcataattacactattg

SEQ ID NO: 1325402 - DNA, 22 bp, Artificial Sequence
  chemically synthesized
aatcataattacactattgatt

SEQ ID NO: 1325403 - DNA, 22 bp, Artificial Sequence
  chemically synthesized
tgaaaggagtctgttatgtaaa

SEQ ID NO: 1325404 - DNA, 22 bp, Artificial Sequence
  chemically synthesized
cactattgatttacataacaga

SEQ ID NO: 1325405 - DNA, 22 bp, Artificial Sequence
  chemically synthesized
cctgtgaaaggagtctgttatg

SEQ ID NO: 1325406 - DNA, 22 bp, Artificial Sequence
  chemically synthesized
acctgtgaaaggagtctgttat

SEQ ID NO: 1325407 - DNA, 22 bp, Artificial Sequence
  chemically synthesized
ttgatttacataacagactcct

SEQ ID NO: 1325408 - DNA, 22 bp, Artificial Sequence
  chemically synthesized
atttacataacagactcctttc

SEQ ID NO: 1325409 - DNA, 22 bp, Artificial Sequence
  chemically synthesized
acataacagactcctttcacag

SEQ ID NO: 1325410 - DNA, 22 bp, Artificial Sequence
  chemically synthesized
cataacagactcctttcacagg

SEQ ID NO: 1325411 - DNA, 22 bp, Artificial Sequence
  chemically synthesized
ggagaaagtttacctgtgaaag

SEQ ID NO: 1325412 - DNA, 22 bp, Artificial Sequence
  chemically synthesized
taggagaaagtttacctgtgaa

SEQ ID NO: 1325413 - DNA, 22 bp, Artificial Sequence
  chemically synthesized
ctttcacaggtaaactttctcc

SEQ ID NO: 1325414 - DNA, 22 bp, Artificial Sequence
  chemically synthesized
tcacaggtaaactttctcctag

SEQ ID NO: 1325415 - DNA, 22 bp, Artificial Sequence
  chemically synthesized
cacaggtaaactttctcctaga

SEQ ID NO: 1325416 - DNA, 22 bp, Artificial Sequence
  chemically synthesized
acaggtaaactttctcctagag

SEQ ID NO: 1325417 - DNA, 22 bp, Artificial Sequence
  chemically synthesized
taaaatatgacaaaactctagg

SEQ ID NO: 1325418 - DNA, 22 bp, Artificial Sequence
  chemically synthesized
gtaaaatatgacaaaactctag

SEQ ID NO: 1325419 - DNA, 22 bp, Artificial Sequence
  chemically synthesized
gaatttgtaaaatatgacaaaa

SEQ ID NO: 1325420 - DNA, 22 bp, Artificial Sequence
  chemically synthesized
agaatttgtaaaatatgacaaa

SEQ ID NO: 1325421 - DNA, 22 bp, Artificial Sequence
  chemically synthesized
tctcctagagttttgtcatatt

SEQ ID NO: 1325422 - DNA, 22 bp, Artificial Sequence
  chemically synthesized
ctcctagagttttgtcatattt

SEQ ID NO: 1325423 - DNA, 22 bp, Artificial Sequence
  chemically synthesized
tcctagagttttgtcatatttt

SEQ ID NO: 1325424 - DNA, 22 bp, Artificial Sequence
  chemically synthesized
atttagaatttgtaaaatatga

SEQ ID NO: 1325425 - DNA, 22 bp, Artificial Sequence
  chemically synthesized
ctagagttttgtcatattttac

SEQ ID NO: 1325426 - DNA, 22 bp, Artificial Sequence
  chemically synthesized
gagttttgtcatattttacaaa

SEQ ID NO: 1325427 - DNA, 22 bp, Artificial Sequence
  chemically synthesized
actcatttagaatttgtaaaat

SEQ ID NO: 1325428 - DNA, 22 bp, Artificial Sequence
  chemically synthesized
tgtcatattttacaaattctaa

SEQ ID NO: 1325429 - DNA, 22 bp, Artificial Sequence
  chemically synthesized
gtcatattttacaaattctaaa

SEQ ID NO: 1325430 - DNA, 22 bp, Artificial Sequence
  chemically synthesized
tcatattttacaaattctaaat

SEQ ID NO: 1325431 - DNA, 22 bp, Artificial Sequence
  chemically synthesized
agtgggctaactcatttagaat

SEQ ID NO: 1325432 - DNA, 22 bp, Artificial Sequence
  chemically synthesized
aagtgggctaactcatttagaa

SEQ ID NO: 1325433 - DNA, 22 bp, Artificial Sequence
  chemically synthesized
tacaaattctaaatgagttagc

SEQ ID NO: 1325434 - DNA, 22 bp, Artificial Sequence
  chemically synthesized
acaaattctaaatgagttagcc

SEQ ID NO: 1325435 - DNA, 22 bp, Artificial Sequence
  chemically synthesized
caaattctaaatgagttagccc

SEQ ID NO: 1325436 - DNA, 22 bp, Artificial Sequence
  chemically synthesized
agaaacaaacatttaagtgggc

SEQ ID NO: 1325437 - DNA, 22 bp, Artificial Sequence
  chemically synthesized
taaatgagttagcccacttaaa

SEQ ID NO: 1325438 - DNA, 22 bp, Artificial Sequence
  chemically synthesized
aagaaacaaacatttaagtggg

SEQ ID NO: 1325439 - DNA, 22 bp, Artificial Sequence
  chemically synthesized
taagaaacaaacatttaagtgg

SEQ ID NO: 1325440 - DNA, 22 bp, Artificial Sequence
  chemically synthesized
aatgagttagcccacttaaatg

SEQ ID NO: 1325441 - DNA, 22 bp, Artificial Sequence
  chemically synthesized
gaaaattttaagaaacaaacat

SEQ ID NO: 1325442 - DNA, 22 bp, Artificial Sequence
  chemically synthesized
gcccacttaaatgtttgtttct

SEQ ID NO: 1325443 - DNA, 22 bp, Artificial Sequence
  chemically synthesized
tgctagaaaattttaagaaaca

SEQ ID NO: 1325444 - DNA, 22 bp, Artificial Sequence
  chemically synthesized
tgtgctagaaaattttaagaaa

SEQ ID NO: 1325445 - DNA, 22 bp, Artificial Sequence
  chemically synthesized
ctgtgctagaaaattttaagaa

SEQ ID NO: 1325446 - DNA, 22 bp, Artificial Sequence
  chemically synthesized
tctgtgctagaaaattttaaga

SEQ ID NO: 1325447 - DNA, 22 bp, Artificial Sequence
  chemically synthesized
aaatgtttgtttcttaaaattt

SEQ ID NO: 1325448 - DNA, 22 bp, Artificial Sequence
  chemically synthesized
ttctgtgctagaaaattttaag

SEQ ID NO: 1325449 - DNA, 22 bp, Artificial Sequence
  chemically synthesized
aatgtttgtttcttaaaatttt

SEQ ID NO: 1325450 - DNA, 22 bp, Artificial Sequence
  chemically synthesized
gtttcttaaaattttctagcac

SEQ ID NO: 1325451 - DNA, 22 bp, Artificial Sequence
  chemically synthesized
acatatttttctgtgctagaaa

SEQ ID NO: 1325452 - DNA, 22 bp, Artificial Sequence
  chemically synthesized
tttcttaaaattttctagcaca

SEQ ID NO: 1325453 - DNA, 22 bp, Artificial Sequence
  chemically synthesized
ttaacatatttttctgtgctag

SEQ ID NO: 1325454 - DNA, 22 bp, Artificial Sequence
  chemically synthesized
cttaaaattttctagcacagaa

SEQ ID NO: 1325455 - DNA, 22 bp, Artificial Sequence
  chemically synthesized
ttaaaattttctagcacagaaa

SEQ ID NO: 1325456 - DNA, 22 bp, Artificial Sequence
  chemically synthesized
aaaattttctagcacagaaaaa

SEQ ID NO: 1325457 - DNA, 22 bp, Artificial Sequence
  chemically synthesized
aaattttctagcacagaaaaat

SEQ ID NO: 1325458 - DNA, 22 bp, Artificial Sequence
  chemically synthesized
aaacgttattaacatatttttc

SEQ ID NO: 1325459 - DNA, 22 bp, Artificial Sequence
  chemically synthesized
aaaacgttattaacatattttt

SEQ ID NO: 1325460 - DNA, 22 bp, Artificial Sequence
  chemically synthesized
taaaacgttattaacatatttt

SEQ ID NO: 1325461 - DNA, 22 bp, Artificial Sequence
  chemically synthesized
tctagcacagaaaaatatgtta

SEQ ID NO: 1325462 - DNA, 22 bp, Artificial Sequence
  chemically synthesized
ctagcacagaaaaatatgttaa

SEQ ID NO: 1325463 - DNA, 22 bp, Artificial Sequence
  chemically synthesized
tagcacagaaaaatatgttaat

SEQ ID NO: 1325464 - DNA, 22 bp, Artificial Sequence
  chemically synthesized
ttttaaaacgttattaacatat

SEQ ID NO: 1325465 - DNA, 22 bp, Artificial Sequence
  chemically synthesized
gcacagaaaaatatgttaataa

SEQ ID NO: 1325466 - DNA, 22 bp, Artificial Sequence
  chemically synthesized
ttattttaaaacgttattaaca

SEQ ID NO: 1325467 - DNA, 22 bp, Artificial Sequence
  chemically synthesized
cattattattttaaaacgttat

SEQ ID NO: 1325468 - DNA, 22 bp, Artificial Sequence
  chemically synthesized
ataacgttttaaaataataatg

SEQ ID NO: 1325469 - DNA, 22 bp, Artificial Sequence
  chemically synthesized
aaaagaaacacactacattatt

SEQ ID NO: 1325470 - DNA, 22 bp, Artificial Sequence
  chemically synthesized
ttcaaaagaaacacactacatt

SEQ ID NO: 1325471 - DNA, 22 bp, Artificial Sequence
  chemically synthesized
attcaaaagaaacacactacat

SEQ ID NO: 1325472 - DNA, 22 bp, Artificial Sequence
  chemically synthesized
tattcaaaagaaacacactaca

SEQ ID NO: 1325473 - DNA, 22 bp, Artificial Sequence
  chemically synthesized
taaaataataatgtagtgtgtt

SEQ ID NO: 1325474 - DNA, 22 bp, Artificial Sequence
  chemically synthesized
aaaataataatgtagtgtgttt

SEQ ID NO: 1325475 - DNA, 22 bp, Artificial Sequence
  chemically synthesized
tttattcaaaagaaacacacta

SEQ ID NO: 1325476 - DNA, 22 bp, Artificial Sequence
  chemically synthesized
aaataataatgtagtgtgtttc

SEQ ID NO: 1325477 - DNA, 22 bp, Artificial Sequence
  chemically synthesized
catgatagtctctttattcaaa

SEQ ID NO: 1325478 - DNA, 22 bp, Artificial Sequence
  chemically synthesized
tacatgatagtctctttattca

SEQ ID NO: 1325479 - DNA, 22 bp, Artificial Sequence
  chemically synthesized
ctacatgatagtctctttattc

SEQ ID NO: 1325480 - DNA, 22 bp, Artificial Sequence
  chemically synthesized
cttttgaataaagagactatca

SEQ ID NO: 1325481 - DNA, 22 bp, Artificial Sequence
  chemically synthesized
acagtttctacatgatagtctc

SEQ ID NO: 1325482 - DNA, 22 bp, Artificial Sequence
  chemically synthesized
ttttgaataaagagactatcat

SEQ ID NO: 1325483 - DNA, 22 bp, Artificial Sequence
  chemically synthesized
ttgaataaagagactatcatgt

SEQ ID NO: 1325484 - DNA, 22 bp, Artificial Sequence
  chemically synthesized
tgaataaagagactatcatgta

SEQ ID NO: 1325485 - DNA, 22 bp, Artificial Sequence
  chemically synthesized
gaataaagagactatcatgtag

SEQ ID NO: 1325486 - DNA, 22 bp, Artificial Sequence
  chemically synthesized
aataaagagactatcatgtaga

SEQ ID NO: 1325487 - DNA, 22 bp, Artificial Sequence
  chemically synthesized
agaggcctgacagtttctacat

SEQ ID NO: 1325488 - DNA, 22 bp, Artificial Sequence
  chemically synthesized
ggctcagaggcctgacagtttc

SEQ ID NO: 1325489 - DNA, 22 bp, Artificial Sequence
  chemically synthesized
gggctcagaggcctgacagttt

SEQ ID NO: 1325490 - DNA, 22 bp, Artificial Sequence
  chemically synthesized
tcatgtagaaactgtcaggcct

SEQ ID NO: 1325491 - DNA, 22 bp, Artificial Sequence
  chemically synthesized
gcttgggctcagaggcctgaca

SEQ ID NO: 1325492 - DNA, 22 bp, Artificial Sequence
  chemically synthesized
agcttgggctcagaggcctgac

SEQ ID NO: 1325493 - DNA, 22 bp, Artificial Sequence
  chemically synthesized
tcaggcctctgagcccaagcta

SEQ ID NO: 1325494 - DNA, 22 bp, Artificial Sequence
  chemically synthesized
tgagcccaagctaagccatcat

SEQ ID NO: 1325495 - DNA, 22 bp, Artificial Sequence
  chemically synthesized
agcccaagctaagccatcatat

SEQ ID NO: 1325496 - DNA, 22 bp, Artificial Sequence
  chemically synthesized
agccatcatatcccctgtgatc

SEQ ID NO: 1325497 - DNA, 22 bp, Artificial Sequence
  chemically synthesized
gatgtgtacgtgcagatcacag

SEQ ID NO: 1325498 - DNA, 22 bp, Artificial Sequence
  chemically synthesized
tgatctgcacgtacacatccag

SEQ ID NO: 1325499 - DNA, 22 bp, Artificial Sequence
  chemically synthesized
aggcaggaaccggcaatctgga

SEQ ID NO: 1325500 - DNA, 22 bp, Artificial Sequence
  chemically synthesized
cacgtacacatccagattgccg

SEQ ID NO: 1325501 - DNA, 22 bp, Artificial Sequence
  chemically synthesized
tggtggaatgtcatcagttaag

SEQ ID NO: 1325502 - DNA, 22 bp, Artificial Sequence
  chemically synthesized
ccggttcctgccttaactgatg

SEQ ID NO: 1325503 - DNA, 22 bp, Artificial Sequence
  chemically synthesized
gtggtggaatgtcatcagttaa

SEQ ID NO: 1325504 - DNA, 22 bp, Artificial Sequence
  chemically synthesized
tgtggtggaatgtcatcagtta

SEQ ID NO: 1325505 - DNA, 22 bp, Artificial Sequence
  chemically synthesized
ttgtggtggaatgtcatcagtt

SEQ ID NO: 1325506 - DNA, 22 bp, Artificial Sequence
  chemically synthesized
ttttgtggtggaatgtcatcag

SEQ ID NO: 1325507 - DNA, 22 bp, Artificial Sequence
  chemically synthesized
cttttgtggtggaatgtcatca

SEQ ID NO: 1325508 - DNA, 22 bp, Artificial Sequence
  chemically synthesized
ctgccttaactgatgacattcc

SEQ ID NO: 1325509 - DNA, 22 bp, Artificial Sequence
  chemically synthesized
acttcttttgtggtggaatgtc

SEQ ID NO: 1325510 - DNA, 22 bp, Artificial Sequence
  chemically synthesized
ccttaactgatgacattccacc

SEQ ID NO: 1325511 - DNA, 22 bp, Artificial Sequence
  chemically synthesized
cacttcttttgtggtggaatgt

SEQ ID NO: 1325512 - DNA, 22 bp, Artificial Sequence
  chemically synthesized
tcacttcttttgtggtggaatg

SEQ ID NO: 1325513 - DNA, 22 bp, Artificial Sequence
  chemically synthesized
aactgatgacattccaccacaa

SEQ ID NO: 1325514 - DNA, 22 bp, Artificial Sequence
  chemically synthesized
actgatgacattccaccacaaa

SEQ ID NO: 1325515 - DNA, 22 bp, Artificial Sequence
  chemically synthesized
atgacattccaccacaaaagaa

SEQ ID NO: 1325516 - DNA, 22 bp, Artificial Sequence
  chemically synthesized
caccacaaaagaagtgaaaatg

SEQ ID NO: 1325517 - DNA, 22 bp, Artificial Sequence
  chemically synthesized
aggcaggaacaggccattttca

SEQ ID NO: 1325518 - DNA, 22 bp, Artificial Sequence
  chemically synthesized
acaagacaatgtcatcagttaa

SEQ ID NO: 1325519 - DNA, 22 bp, Artificial Sequence
  chemically synthesized
cacaagacaatgtcatcagtta

SEQ ID NO: 1325520 - DNA, 22 bp, Artificial Sequence
  chemically synthesized
ttcctgccttaactgatgacat

SEQ ID NO: 1325521 - DNA, 22 bp, Artificial Sequence
  chemically synthesized
ctgccttaactgatgacattgt

SEQ ID NO: 1325522 - DNA, 22 bp, Artificial Sequence
  chemically synthesized
ccttaactgatgacattgtctt

SEQ ID NO: 1325523 - DNA, 22 bp, Artificial Sequence
  chemically synthesized
aactgatgacattgtcttgtga

SEQ ID NO: 1325524 - DNA, 22 bp, Artificial Sequence
  chemically synthesized
actgatgacattgtcttgtgaa

SEQ ID NO: 1325525 - DNA, 22 bp, Artificial Sequence
  chemically synthesized
atgacattgtcttgtgaaattc

SEQ ID NO: 1325526 - DNA, 22 bp, Artificial Sequence
  chemically synthesized
tcttgtgaaattccttctcctg

SEQ ID NO: 1325527 - DNA, 22 bp, Artificial Sequence
  chemically synthesized
agccaggatgagccaggagaag

SEQ ID NO: 1325528 - DNA, 22 bp, Artificial Sequence
  chemically synthesized
gagccaggatgagccaggagaa

SEQ ID NO: 1325529 - DNA, 22 bp, Artificial Sequence
  chemically synthesized
tgagccaggatgagccaggaga

SEQ ID NO: 1325530 - DNA, 22 bp, Artificial Sequence
  chemically synthesized
gtgaaattccttctcctggctc

SEQ ID NO: 1325531 - DNA, 22 bp, Artificial Sequence
  chemically synthesized
ttgagccaggatgagccaggag

SEQ ID NO: 1325532 - DNA, 22 bp, Artificial Sequence
  chemically synthesized
tgaaattccttctcctggctca

SEQ ID NO: 1325533 - DNA, 22 bp, Artificial Sequence
  chemically synthesized
cttctcctggctcatcctggct

SEQ ID NO: 1325534 - DNA, 22 bp, Artificial Sequence
  chemically synthesized
ctcctggctcatcctggctcaa

SEQ ID NO: 1325535 - DNA, 22 bp, Artificial Sequence
  chemically synthesized
tcctggctcatcctggctcaaa

SEQ ID NO: 1325536 - DNA, 22 bp, Artificial Sequence
  chemically synthesized
agtgggggagcttttgagccag

SEQ ID NO: 1325537 - DNA, 22 bp, Artificial Sequence
  chemically synthesized
ctggctcatcctggctcaaaag

SEQ ID NO: 1325538 - DNA, 22 bp, Artificial Sequence
  chemically synthesized
gctcatcctggctcaaaagctc

SEQ ID NO: 1325539 - DNA, 22 bp, Artificial Sequence
  chemically synthesized
atcctggctcaaaagctccccc

SEQ ID NO: 1325540 - DNA, 22 bp, Artificial Sequence
  chemically synthesized
gctcaaaagctcccccactgag

SEQ ID NO: 1325541 - DNA, 22 bp, Artificial Sequence
  chemically synthesized
aaaagctcccccactgagtacc

SEQ ID NO: 1325542 - DNA, 22 bp, Artificial Sequence
  chemically synthesized
ccccactgagtaccttgtgacc

SEQ ID NO: 1325543 - DNA, 22 bp, Artificial Sequence
  chemically synthesized
gcaggcaggagtgggggtcaca

SEQ ID NO: 1325544 - DNA, 22 bp, Artificial Sequence
  chemically synthesized
tggcaggcaggagtgggggtca

SEQ ID NO: 1325545 - DNA, 22 bp, Artificial Sequence
  chemically synthesized
tctggcaggcaggagtgggggt

SEQ ID NO: 1325546 - DNA, 22 bp, Artificial Sequence
  chemically synthesized
agtaccttgtgacccccactcc

SEQ ID NO: 1325547 - DNA, 22 bp, Artificial Sequence
  chemically synthesized
ttctctggcaggcaggagtggg

SEQ ID NO: 1325548 - DNA, 22 bp, Artificial Sequence
  chemically synthesized
gtgacccccactcctgcctgcc

SEQ ID NO: 1325549 - DNA, 22 bp, Artificial Sequence
  chemically synthesized
tgacccccactcctgcctgcca

SEQ ID NO: 1325550 - DNA, 22 bp, Artificial Sequence
  chemically synthesized
ctgcctgccagagaacaacccc

SEQ ID NO: 1325551 - DNA, 22 bp, Artificial Sequence
  chemically synthesized
cctgccagagaacaacccccct

SEQ ID NO: 1325552 - DNA, 22 bp, Artificial Sequence
  chemically synthesized
ccagagaacaaccccccttttt

SEQ ID NO: 1325553 - DNA, 22 bp, Artificial Sequence
  chemically synthesized
ggtagataaaggaaaaaggggg

SEQ ID NO: 1325554 - DNA, 22 bp, Artificial Sequence
  chemically synthesized
gggtagataaaggaaaaagggg

SEQ ID NO: 1325555 - DNA, 22 bp, Artificial Sequence
  chemically synthesized
taggatttgggtagataaagga

SEQ ID NO: 1325556 - DNA, 22 bp, Artificial Sequence
  chemically synthesized
ataggatttgggtagataaagg

SEQ ID NO: 1325557 - DNA, 22 bp, Artificial Sequence
  chemically synthesized
tataggatttgggtagataaag

SEQ ID NO: 1325558 - DNA, 22 bp, Artificial Sequence
  chemically synthesized
tttcctttatctacccaaatcc

SEQ ID NO: 1325559 - DNA, 22 bp, Artificial Sequence
  chemically synthesized
ttcctttatctacccaaatcct

SEQ ID NO: 1325560 - DNA, 22 bp, Artificial Sequence
  chemically synthesized
tcctttatctacccaaatccta

SEQ ID NO: 1325561 - DNA, 22 bp, Artificial Sequence
  chemically synthesized
cctttatctacccaaatcctat

SEQ ID NO: 1325562 - DNA, 22 bp, Artificial Sequence
  chemically synthesized
ctttatctacccaaatcctata

SEQ ID NO: 1325563 - DNA, 22 bp, Artificial Sequence
  chemically synthesized
tatctacccaaatcctataaaa

SEQ ID NO: 1325564 - DNA, 22 bp, Artificial Sequence
  chemically synthesized
atctacccaaatcctataaaac

SEQ ID NO: 1325565 - DNA, 22 bp, Artificial Sequence
  chemically synthesized
tctacccaaatcctataaaacg

SEQ ID NO: 1325566 - DNA, 22 bp, Artificial Sequence
  chemically synthesized
cccaaatcctataaaacggccc

SEQ ID NO: 1325567 - DNA, 22 bp, Artificial Sequence
  chemically synthesized
taaaacggccccacccctatct

SEQ ID NO: 1325568 - DNA, 22 bp, Artificial Sequence
  chemically synthesized
agtccgaaaagagagtcagcga

SEQ ID NO: 1325569 - DNA, 22 bp, Artificial Sequence
  chemically synthesized
tctcccttcgctgactctcttt

SEQ ID NO: 1325570 - DNA, 22 bp, Artificial Sequence
  chemically synthesized
ccttcgctgactctcttttcgg

SEQ ID NO: 1325571 - DNA, 22 bp, Artificial Sequence
  chemically synthesized
cgctgactctcttttcggactc

SEQ ID NO: 1325572 - DNA, 22 bp, Artificial Sequence
  chemically synthesized
gctgactctcttttcggactca

SEQ ID NO: 1325573 - DNA, 22 bp, Artificial Sequence
  chemically synthesized
ggtgcaggtgggctgagtccga

SEQ ID NO: 1325574 - DNA, 22 bp, Artificial Sequence
  chemically synthesized
actctcttttcggactcagccc

SEQ ID NO: 1325575 - DNA, 22 bp, Artificial Sequence
  chemically synthesized
acctgggtgcaggtgggctgag

SEQ ID NO: 1325576 - DNA, 22 bp, Artificial Sequence
  chemically synthesized
cacctgggtgcaggtgggctga

SEQ ID NO: 1325577 - DNA, 22 bp, Artificial Sequence
  chemically synthesized
tcttttcggactcagcccacct

SEQ ID NO: 1325578 - DNA, 22 bp, Artificial Sequence
  chemically synthesized
ttttcggactcagcccacctgc

SEQ ID NO: 1325579 - DNA, 22 bp, Artificial Sequence
  chemically synthesized
tttcacctgggtgcaggtgggc

SEQ ID NO: 1325580 - DNA, 22 bp, Artificial Sequence
  chemically synthesized
atttcacctgggtgcaggtggg

SEQ ID NO: 1325581 - DNA, 22 bp, Artificial Sequence
  chemically synthesized
ttcggactcagcccacctgcac

SEQ ID NO: 1325582 - DNA, 22 bp, Artificial Sequence
  chemically synthesized
tcggactcagcccacctgcacc

SEQ ID NO: 1325583 - DNA, 22 bp, Artificial Sequence
  chemically synthesized
cggactcagcccacctgcaccc

SEQ ID NO: 1325584 - DNA, 22 bp, Artificial Sequence
  chemically synthesized
tttatttcacctgggtgcaggt

SEQ ID NO: 1325585 - DNA, 22 bp, Artificial Sequence
  chemically synthesized
ggactcagcccacctgcaccca

SEQ ID NO: 1325586 - DNA, 22 bp, Artificial Sequence
  chemically synthesized
agcccacctgcacccaggtgaa

SEQ ID NO: 1325587 - DNA, 22 bp, Artificial Sequence
  chemically synthesized
cacccaggtgaaataaacagct

SEQ ID NO: 1325588 - DNA, 22 bp, Artificial Sequence
  chemically synthesized
tgtgagccataaagctgtttat

SEQ ID NO: 1325589 - DNA, 22 bp, Artificial Sequence
  chemically synthesized
gtgtgagccataaagctgttta

SEQ ID NO: 1325590 - DNA, 22 bp, Artificial Sequence
  chemically synthesized
tgtgtgagccataaagctgttt

SEQ ID NO: 1325591 - DNA, 22 bp, Artificial Sequence
  chemically synthesized
tatggctcacacaaagcctgtt

SEQ ID NO: 1325592 - DNA, 22 bp, Artificial Sequence
  chemically synthesized
atggctcacacaaagcctgttt

SEQ ID NO: 1325593 - DNA, 22 bp, Artificial Sequence
  chemically synthesized
tggctcacacaaagcctgtttg

SEQ ID NO: 1325594 - DNA, 22 bp, Artificial Sequence
  chemically synthesized
acacaaagcctgtttggtggtc

SEQ ID NO: 1325595 - DNA, 22 bp, Artificial Sequence
  chemically synthesized
atacgcgtccgtgtgaagagac

SEQ ID NO: 1325596 - DNA, 22 bp, Artificial Sequence
  chemically synthesized
catacgcgtccgtgtgaagaga

SEQ ID NO: 1325597 - DNA, 22 bp, Artificial Sequence
  chemically synthesized
tcatacgcgtccgtgtgaagag

SEQ ID NO: 1325598 - DNA, 22 bp, Artificial Sequence
  chemically synthesized
tttcatacgcgtccgtgtgaag

SEQ ID NO: 1325599 - DNA, 22 bp, Artificial Sequence
  chemically synthesized
tttggtggtctcttcacacgga

SEQ ID NO: 1325600 - DNA, 22 bp, Artificial Sequence
  chemically synthesized
ctttcatacgcgtccgtgtgaa

SEQ ID NO: 1325601 - DNA, 22 bp, Artificial Sequence
  chemically synthesized
ggtggtctcttcacacggacgc

SEQ ID NO: 1325602 - DNA, 22 bp, Artificial Sequence
  chemically synthesized
gtggtctcttcacacggacgcg

SEQ ID NO: 1325603 - DNA, 22 bp, Artificial Sequence
  chemically synthesized
aatgtttctttcatacgcgtcc

SEQ ID NO: 1325604 - DNA, 22 bp, Artificial Sequence
  chemically synthesized
ttcacacggacgcgtatgaaag

SEQ ID NO: 1325605 - DNA, 22 bp, Artificial Sequence
  chemically synthesized
cacacggacgcgtatgaaagaa

SEQ ID NO: 1325606 - DNA, 22 bp, Artificial Sequence
  chemically synthesized
acacggacgcgtatgaaagaaa

SEQ ID NO: 1325607 - DNA, 22 bp, Artificial Sequence
  chemically synthesized
agaatggttaaatgtttctttc

SEQ ID NO: 1325608 - DNA, 22 bp, Artificial Sequence
  chemically synthesized
aattaagaatggttaaatgttt

SEQ ID NO: 1325609 - DNA, 22 bp, Artificial Sequence
  chemically synthesized
gaattaagaatggttaaatgtt

SEQ ID NO: 1325610 - DNA, 22 bp, Artificial Sequence
  chemically synthesized
tgtttgaattaagaatggttaa

SEQ ID NO: 1325611 - DNA, 22 bp, Artificial Sequence
  chemically synthesized
ggcgtctgtgtttgaattaaga

SEQ ID NO: 1325612 - DNA, 22 bp, Artificial Sequence
  chemically synthesized
gggcgtctgtgtttgaattaag

SEQ ID NO: 1325613 - DNA, 22 bp, Artificial Sequence
  chemically synthesized
cttgggcgtctgtgtttgaatt

SEQ ID NO: 1325614 - DNA, 22 bp, Artificial Sequence
  chemically synthesized
acttgggcgtctgtgtttgaat

SEQ ID NO: 1325615 - DNA, 22 bp, Artificial Sequence
  chemically synthesized
aaccattcttaattcaaacaca

SEQ ID NO: 1325616 - DNA, 22 bp, Artificial Sequence
  chemically synthesized
accattcttaattcaaacacag

SEQ ID NO: 1325617 - DNA, 22 bp, Artificial Sequence
  chemically synthesized
ttacttgggcgtctgtgtttga

SEQ ID NO: 1325618 - DNA, 22 bp, Artificial Sequence
  chemically synthesized
cttacttgggcgtctgtgtttg

SEQ ID NO: 1325619 - DNA, 22 bp, Artificial Sequence
  chemically synthesized
tcttacttgggcgtctgtgttt

SEQ ID NO: 1325620 - DNA, 22 bp, Artificial Sequence
  chemically synthesized
ttcttacttgggcgtctgtgtt

SEQ ID NO: 1325621 - DNA, 22 bp, Artificial Sequence
  chemically synthesized
ttaattcaaacacagacgccca

SEQ ID NO: 1325622 - DNA, 22 bp, Artificial Sequence
  chemically synthesized
acttttcttacttgggcgtctg

SEQ ID NO: 1325623 - DNA, 22 bp, Artificial Sequence
  chemically synthesized
aattcaaacacagacgcccaag

SEQ ID NO: 1325624 - DNA, 22 bp, Artificial Sequence
  chemically synthesized
attcaaacacagacgcccaagt

SEQ ID NO: 1325625 - DNA, 22 bp, Artificial Sequence
  chemically synthesized
aaacacagacgcccaagtaaga

SEQ ID NO: 1325626 - DNA, 22 bp, Artificial Sequence
  chemically synthesized
taaattcacttttcttacttgg

SEQ ID NO: 1325627 - DNA, 22 bp, Artificial Sequence
  chemically synthesized
ataaattcacttttcttacttg

SEQ ID NO: 1325628 - DNA, 22 bp, Artificial Sequence
  chemically synthesized
tataaattcacttttcttactt

SEQ ID NO: 1325629 - DNA, 22 bp, Artificial Sequence
  chemically synthesized
cccaattttataaattcacttt

SEQ ID NO: 1325630 - DNA, 22 bp, Artificial Sequence
  chemically synthesized
acccaattttataaattcactt

SEQ ID NO: 1325631 - DNA, 22 bp, Artificial Sequence
  chemically synthesized
tacccaattttataaattcact

SEQ ID NO: 1325632 - DNA, 22 bp, Artificial Sequence
  chemically synthesized
tgaattttacccaattttataa

SEQ ID NO: 1325633 - DNA, 22 bp, Artificial Sequence
  chemically synthesized
gtgaattttacccaattttata

SEQ ID NO: 1325634 - DNA, 22 bp, Artificial Sequence
  chemically synthesized
agcttgtgaattttacccaatt

SEQ ID NO: 1325635 - DNA, 22 bp, Artificial Sequence
  chemically synthesized
ataattcagcttgtgaatttta

SEQ ID NO: 1325636 - DNA, 22 bp, Artificial Sequence
  chemically synthesized
ataaaattgggtaaaattcaca

SEQ ID NO: 1325637 - DNA, 22 bp, Artificial Sequence
  chemically synthesized
taaaattgggtaaaattcacaa

SEQ ID NO: 1325638 - DNA, 22 bp, Artificial Sequence
  chemically synthesized
tgaactaataattcagcttgtg

SEQ ID NO: 1325639 - DNA, 22 bp, Artificial Sequence
  chemically synthesized
gtgaactaataattcagcttgt

SEQ ID NO: 1325640 - DNA, 22 bp, Artificial Sequence
  chemically synthesized
ggtaaaattcacaagctgaatt

SEQ ID NO: 1325641 - DNA, 22 bp, Artificial Sequence
  chemically synthesized
agtttgtgaactaataattcag

SEQ ID NO: 1325642 - DNA, 22 bp, Artificial Sequence
  chemically synthesized
cagtttgtgaactaataattca

SEQ ID NO: 1325643 - DNA, 22 bp, Artificial Sequence
  chemically synthesized
acaagctgaattattagttcac

SEQ ID NO: 1325644 - DNA, 22 bp, Artificial Sequence
  chemically synthesized
atatttcagtttgtgaactaat

SEQ ID NO: 1325645 - DNA, 22 bp, Artificial Sequence
  chemically synthesized
ctgatatttcagtttgtgaact

SEQ ID NO: 1325646 - DNA, 22 bp, Artificial Sequence
  chemically synthesized
ttactgatatttcagtttgtga

SEQ ID NO: 1325647 - DNA, 22 bp, Artificial Sequence
  chemically synthesized
aattattagttcacaaactgaa

SEQ ID NO: 1325648 - DNA, 22 bp, Artificial Sequence
  chemically synthesized
ggttattactgatatttcagtt

SEQ ID NO: 1325649 - DNA, 22 bp, Artificial Sequence
  chemically synthesized
aggttattactgatatttcagt

SEQ ID NO: 1325650 - DNA, 22 bp, Artificial Sequence
  chemically synthesized
ttagttcacaaactgaaatatc

SEQ ID NO: 1325651 - DNA, 22 bp, Artificial Sequence
  chemically synthesized
taggttattactgatatttcag

SEQ ID NO: 1325652 - DNA, 22 bp, Artificial Sequence
  chemically synthesized
gttcacaaactgaaatatcagt

SEQ ID NO: 1325653 - DNA, 22 bp, Artificial Sequence
  chemically synthesized
ttttaggttattactgatattt

SEQ ID NO: 1325654 - DNA, 22 bp, Artificial Sequence
  chemically synthesized
acaaactgaaatatcagtaata

SEQ ID NO: 1325655 - DNA, 22 bp, Artificial Sequence
  chemically synthesized
aaatatcagtaataacctaaaa

SEQ ID NO: 1325656 - DNA, 22 bp, Artificial Sequence
  chemically synthesized
agaataaacactattttaggtt

SEQ ID NO: 1325657 - DNA, 22 bp, Artificial Sequence
  chemically synthesized
gagaataaacactattttaggt

SEQ ID NO: 1325658 - DNA, 22 bp, Artificial Sequence
  chemically synthesized
tgagaataaacactattttagg

SEQ ID NO: 1325659 - DNA, 22 bp, Artificial Sequence
  chemically synthesized
tctttgagaataaacactattt

SEQ ID NO: 1325660 - DNA, 22 bp, Artificial Sequence
  chemically synthesized
acattgtctttgagaataaaca

SEQ ID NO: 1325661 - DNA, 22 bp, Artificial Sequence
  chemically synthesized
cacattgtctttgagaataaac

SEQ ID NO: 1325662 - DNA, 22 bp, Artificial Sequence
  chemically synthesized
tcacattgtctttgagaataaa

SEQ ID NO: 1325663 - DNA, 22 bp, Artificial Sequence
  chemically synthesized
aaatagtgtttattctcaaaga

SEQ ID NO: 1325664 - DNA, 22 bp, Artificial Sequence
  chemically synthesized
atgagagttttcacattgtctt

SEQ ID NO: 1325665 - DNA, 22 bp, Artificial Sequence
  chemically synthesized
attctcaaagacaatgtgaaaa

SEQ ID NO: 1325666 - DNA, 22 bp, Artificial Sequence
  chemically synthesized
ttctcaaagacaatgtgaaaac

SEQ ID NO: 1325667 - DNA, 22 bp, Artificial Sequence
  chemically synthesized
atgcctaatgagagttttcaca

SEQ ID NO: 1325668 - DNA, 22 bp, Artificial Sequence
  chemically synthesized
tcaaagacaatgtgaaaactct

SEQ ID NO: 1325669 - DNA, 22 bp, Artificial Sequence
  chemically synthesized
taatgcctaatgagagttttca

SEQ ID NO: 1325670 - DNA, 22 bp, Artificial Sequence
  chemically synthesized
aaagacaatgtgaaaactctca

SEQ ID NO: 1325671 - DNA, 22 bp, Artificial Sequence
  chemically synthesized
aaaagtagattctaatgcctaa

SEQ ID NO: 1325672 - DNA, 22 bp, Artificial Sequence
  chemically synthesized
gaaaagtagattctaatgccta

SEQ ID NO: 1325673 - DNA, 22 bp, Artificial Sequence
  chemically synthesized
agtttgaaaagtagattctaat

SEQ ID NO: 1325674 - DNA, 22 bp, Artificial Sequence
  chemically synthesized
gagtttgaaaagtagattctaa

SEQ ID NO: 1325675 - DNA, 22 bp, Artificial Sequence
  chemically synthesized
tgagtttgaaaagtagattcta

SEQ ID NO: 1325676 - DNA, 22 bp, Artificial Sequence
  chemically synthesized
tcattaggcattagaatctact

SEQ ID NO: 1325677 - DNA, 22 bp, Artificial Sequence
  chemically synthesized
ttgagtttgaaaagtagattct

SEQ ID NO: 1325678 - DNA, 22 bp, Artificial Sequence
  chemically synthesized
attaggcattagaatctacttt

SEQ ID NO: 1325679 - DNA, 22 bp, Artificial Sequence
  chemically synthesized
acttttgagtttgaaaagtaga

SEQ ID NO: 1325680 - DNA, 22 bp, Artificial Sequence
  chemically synthesized
ggcattagaatctacttttcaa

SEQ ID NO: 1325681 - DNA, 22 bp, Artificial Sequence
  chemically synthesized
gaatctacttttcaaactcaaa

SEQ ID NO: 1325682 - DNA, 22 bp, Artificial Sequence
  chemically synthesized
caaggagattcacttttgagtt

SEQ ID NO: 1325683 - DNA, 22 bp, Artificial Sequence
  chemically synthesized
cttttcaaactcaaaagtgaat

SEQ ID NO: 1325684 - DNA, 22 bp, Artificial Sequence
  chemically synthesized
ataattacaaggagattcactt

SEQ ID NO: 1325685 - DNA, 22 bp, Artificial Sequence
  chemically synthesized
ttcaaactcaaaagtgaatctc

SEQ ID NO: 1325686 - DNA, 22 bp, Artificial Sequence
  chemically synthesized
tcaaactcaaaagtgaatctcc

SEQ ID NO: 1325687 - DNA, 22 bp, Artificial Sequence
  chemically synthesized
tgataattacaaggagattcac

SEQ ID NO: 1325688 - DNA, 22 bp, Artificial Sequence
  chemically synthesized
caaactcaaaagtgaatctcct

SEQ ID NO: 1325689 - DNA, 22 bp, Artificial Sequence
  chemically synthesized
aaactcaaaagtgaatctcctt

SEQ ID NO: 1325690 - DNA, 22 bp, Artificial Sequence
  chemically synthesized
gctctgataattacaaggagat

SEQ ID NO: 1325691 - DNA, 22 bp, Artificial Sequence
  chemically synthesized
agctctgataattacaaggaga

SEQ ID NO: 1325692 - DNA, 22 bp, Artificial Sequence
  chemically synthesized
aaaagtgaatctccttgtaatt

SEQ ID NO: 1325693 - DNA, 22 bp, Artificial Sequence
  chemically synthesized
catatatttagctctgataatt

SEQ ID NO: 1325694 - DNA, 22 bp, Artificial Sequence
  chemically synthesized
acatatatttagctctgataat

SEQ ID NO: 1325695 - DNA, 22 bp, Artificial Sequence
  chemically synthesized
tttacatatatttagctctgat

SEQ ID NO: 1325696 - DNA, 22 bp, Artificial Sequence
  chemically synthesized
gtttacatatatttagctctga

SEQ ID NO: 1325697 - DNA, 22 bp, Artificial Sequence
  chemically synthesized
tgtttacatatatttagctctg

SEQ ID NO: 1325698 - DNA, 22 bp, Artificial Sequence
  chemically synthesized
cttgtaattatcagagctaaat

SEQ ID NO: 1325699 - DNA, 22 bp, Artificial Sequence
  chemically synthesized
ctttgtttacatatatttagct

SEQ ID NO: 1325700 - DNA, 22 bp, Artificial Sequence
  chemically synthesized
gtaattatcagagctaaatata

SEQ ID NO: 1325701 - DNA, 22 bp, Artificial Sequence
  chemically synthesized
taattatcagagctaaatatat

SEQ ID NO: 1325702 - DNA, 22 bp, Artificial Sequence
  chemically synthesized
tcagagctaaatatatgtaaac

SEQ ID NO: 1325703 - DNA, 22 bp, Artificial Sequence
  chemically synthesized
aatcagttactttgtttacata

SEQ ID NO: 1325704 - DNA, 22 bp, Artificial Sequence
  chemically synthesized
actaaatcagttactttgttta

SEQ ID NO: 1325705 - DNA, 22 bp, Artificial Sequence
  chemically synthesized
aactaaatcagttactttgttt

SEQ ID NO: 1325706 - DNA, 22 bp, Artificial Sequence
  chemically synthesized
taactaaatcagttactttgtt

SEQ ID NO: 1325707 - DNA, 22 bp, Artificial Sequence
  chemically synthesized
aatatatgtaaacaaagtaact

SEQ ID NO: 1325708 - DNA, 22 bp, Artificial Sequence
  chemically synthesized
atcactttaactaaatcagtta

SEQ ID NO: 1325709 - DNA, 22 bp, Artificial Sequence
  chemically synthesized
aatcactttaactaaatcagtt

SEQ ID NO: 1325710 - DNA, 22 bp, Artificial Sequence
  chemically synthesized
atttagttaaagtgattaaact

SEQ ID NO: 1325711 - DNA, 22 bp, Artificial Sequence
  chemically synthesized
agttaaagtgattaaacttttt

SEQ ID NO: 1325712 - DNA, 22 bp, Artificial Sequence
  chemically synthesized
gttaaagtgattaaactttttt

SEQ ID NO: 1325713 - DNA, 22 bp, Artificial Sequence
  chemically synthesized
ggggagaatgggaaaaaagttt

SEQ ID NO: 1325714 - DNA, 22 bp, Artificial Sequence
  chemically synthesized
aagtgattaaacttttttccca

SEQ ID NO: 1325715 - DNA, 22 bp, Artificial Sequence
  chemically synthesized
actgggggagaatgggaaaaaa

SEQ ID NO: 1325716 - DNA, 22 bp, Artificial Sequence
  chemically synthesized
aactgggggagaatgggaaaaa

SEQ ID NO: 1325717 - DNA, 22 bp, Artificial Sequence
  chemically synthesized
taactgggggagaatgggaaaa

SEQ ID NO: 1325718 - DNA, 22 bp, Artificial Sequence
  chemically synthesized
attttaactgggggagaatggg

SEQ ID NO: 1325719 - DNA, 22 bp, Artificial Sequence
  chemically synthesized
aacttttttcccattctccccc

SEQ ID NO: 1325720 - DNA, 22 bp, Artificial Sequence
  chemically synthesized
ttcattttaactgggggagaat

SEQ ID NO: 1325721 - DNA, 22 bp, Artificial Sequence
  chemically synthesized
ttttcccattctcccccagtta

SEQ ID NO: 1325722 - DNA, 22 bp, Artificial Sequence
  chemically synthesized
tttcccattctcccccagttaa

SEQ ID NO: 1325723 - DNA, 22 bp, Artificial Sequence
  chemically synthesized
ttcccattctcccccagttaaa

SEQ ID NO: 1325724 - DNA, 22 bp, Artificial Sequence
  chemically synthesized
gccactgttcattttaactggg

SEQ ID NO: 1325725 - DNA, 22 bp, Artificial Sequence
  chemically synthesized
tcccattctcccccagttaaaa

SEQ ID NO: 1325726 - DNA, 22 bp, Artificial Sequence
  chemically synthesized
agccactgttcattttaactgg

SEQ ID NO: 1325727 - DNA, 22 bp, Artificial Sequence
  chemically synthesized
cccattctcccccagttaaaat

SEQ ID NO: 1325728 - DNA, 22 bp, Artificial Sequence
  chemically synthesized
tagccactgttcattttaactg

SEQ ID NO: 1325729 - DNA, 22 bp, Artificial Sequence
  chemically synthesized
ccattctcccccagttaaaatg

SEQ ID NO: 1325730 - DNA, 22 bp, Artificial Sequence
  chemically synthesized
ttagccactgttcattttaact

SEQ ID NO: 1325731 - DNA, 22 bp, Artificial Sequence
  chemically synthesized
tcccccagttaaaatgaacagt

SEQ ID NO: 1325732 - DNA, 22 bp, Artificial Sequence
  chemically synthesized
ccccagttaaaatgaacagtgg

SEQ ID NO: 1325733 - DNA, 22 bp, Artificial Sequence
  chemically synthesized
agataataatttttagccactg

SEQ ID NO: 1325734 - DNA, 22 bp, Artificial Sequence
  chemically synthesized
aagataataatttttagccact

SEQ ID NO: 1325735 - DNA, 22 bp, Artificial Sequence
  chemically synthesized
taagataataatttttagccac

SEQ ID NO: 1325736 - DNA, 22 bp, Artificial Sequence
  chemically synthesized
aaatgaacagtggctaaaaatt

SEQ ID NO: 1325737 - DNA, 22 bp, Artificial Sequence
  chemically synthesized
tggataaacctttaagataata

SEQ ID NO: 1325738 - DNA, 22 bp, Artificial Sequence
  chemically synthesized
gaactatggataaacctttaag

SEQ ID NO: 1325739 - DNA, 22 bp, Artificial Sequence
  chemically synthesized
aaaattattatcttaaaggttt

SEQ ID NO: 1325740 - DNA, 22 bp, Artificial Sequence
  chemically synthesized
caattggaactatggataaacc

SEQ ID NO: 1325741 - DNA, 22 bp, Artificial Sequence
  chemically synthesized
ttatcttaaaggtttatccata

SEQ ID NO: 1325742 - DNA, 22 bp, Artificial Sequence
  chemically synthesized
tcttaaaggtttatccatagtt

SEQ ID NO: 1325743 - DNA, 22 bp, Artificial Sequence
  chemically synthesized
aaatgttgcaattggaactatg

SEQ ID NO: 1325744 - DNA, 22 bp, Artificial Sequence
  chemically synthesized
aaaggtttatccatagttccaa

SEQ ID NO: 1325745 - DNA, 22 bp, Artificial Sequence
  chemically synthesized
aaaatgttgcaattggaactat

SEQ ID NO: 1325746 - DNA, 22 bp, Artificial Sequence
  chemically synthesized
aaggtttatccatagttccaat

SEQ ID NO: 1325747 - DNA, 22 bp, Artificial Sequence
  chemically synthesized
taaaatgttgcaattggaacta

SEQ ID NO: 1325748 - DNA, 22 bp, Artificial Sequence
  chemically synthesized
atccatagttccaattgcaaca

SEQ ID NO: 1325749 - DNA, 22 bp, Artificial Sequence
  chemically synthesized
tccatagttccaattgcaacat

SEQ ID NO: 1325750 - DNA, 22 bp, Artificial Sequence
  chemically synthesized
tgtaggaatagacgttttaaaa

SEQ ID NO: 1325751 - DNA, 22 bp, Artificial Sequence
  chemically synthesized
caattgcaacattttaaaacgt

SEQ ID NO: 1325752 - DNA, 22 bp, Artificial Sequence
  chemically synthesized
caacattttaaaacgtctattc

SEQ ID NO: 1325753 - DNA, 22 bp, Artificial Sequence
  chemically synthesized
caatggtctatgtaggaataga

SEQ ID NO: 1325754 - DNA, 22 bp, Artificial Sequence
  chemically synthesized
ttccaatggtctatgtaggaat

SEQ ID NO: 1325755 - DNA, 22 bp, Artificial Sequence
  chemically synthesized
taaaacgtctattcctacatag

SEQ ID NO: 1325756 - DNA, 22 bp, Artificial Sequence
  chemically synthesized
tattccaatggtctatgtagga

SEQ ID NO: 1325757 - DNA, 22 bp, Artificial Sequence
  chemically synthesized
aaaacgtctattcctacataga

SEQ ID NO: 1325758 - DNA, 22 bp, Artificial Sequence
  chemically synthesized
aaacgtctattcctacatagac

SEQ ID NO: 1325759 - DNA, 22 bp, Artificial Sequence
  chemically synthesized
ttctattccaatggtctatgta

SEQ ID NO: 1325760 - DNA, 22 bp, Artificial Sequence
  chemically synthesized
tattctattccaatggtctatg

SEQ ID NO: 1325761 - DNA, 22 bp, Artificial Sequence
  chemically synthesized
tctattctattccaatggtcta

SEQ ID NO: 1325762 - DNA, 22 bp, Artificial Sequence
  chemically synthesized
ctctattctattccaatggtct

SEQ ID NO: 1325763 - DNA, 22 bp, Artificial Sequence
  chemically synthesized
ttcctacatagaccattggaat

SEQ ID NO: 1325764 - DNA, 22 bp, Artificial Sequence
  chemically synthesized
gcttctctattctattccaatg

SEQ ID NO: 1325765 - DNA, 22 bp, Artificial Sequence
  chemically synthesized
ctacatagaccattggaataga

SEQ ID NO: 1325766 - DNA, 22 bp, Artificial Sequence
  chemically synthesized
tggcttctctattctattccaa

SEQ ID NO: 1325767 - DNA, 22 bp, Artificial Sequence
  chemically synthesized
ctggcttctctattctattcca

SEQ ID NO: 1325768 - DNA, 22 bp, Artificial Sequence
  chemically synthesized
catagaccattggaatagaata

SEQ ID NO: 1325769 - DNA, 22 bp, Artificial Sequence
  chemically synthesized
acttctggcttctctattctat

SEQ ID NO: 1325770 - DNA, 22 bp, Artificial Sequence
  chemically synthesized
cacttctggcttctctattcta

SEQ ID NO: 1325771 - DNA, 22 bp, Artificial Sequence
  chemically synthesized
gcttcacttctggcttctctat

SEQ ID NO: 1325772 - DNA, 22 bp, Artificial Sequence
  chemically synthesized
ggcttcacttctggcttctcta

SEQ ID NO: 1325773 - DNA, 22 bp, Artificial Sequence
  chemically synthesized
gaatagaatagagaagccagaa

SEQ ID NO: 1325774 - DNA, 22 bp, Artificial Sequence
  chemically synthesized
agtatttggcttcacttctggc

SEQ ID NO: 1325775 - DNA, 22 bp, Artificial Sequence
  chemically synthesized
aagtatttggcttcacttctgg

SEQ ID NO: 1325776 - DNA, 22 bp, Artificial Sequence
  chemically synthesized
taagtatttggcttcacttctg

SEQ ID NO: 1325777 - DNA, 22 bp, Artificial Sequence
  chemically synthesized
gttttaagtatttggcttcact

SEQ ID NO: 1325778 - DNA, 22 bp, Artificial Sequence
  chemically synthesized
aaggtaaattggttttaagtat

SEQ ID NO: 1325779 - DNA, 22 bp, Artificial Sequence
  chemically synthesized
ttgaaggtaaattggttttaag

SEQ ID NO: 1325780 - DNA, 22 bp, Artificial Sequence
  chemically synthesized
gttgaaggtaaattggttttaa

SEQ ID NO: 1325781 - DNA, 22 bp, Artificial Sequence
  chemically synthesized
tgttgaaggtaaattggtttta

SEQ ID NO: 1325782 - DNA, 22 bp, Artificial Sequence
  chemically synthesized
tatgctttgttgaaggtaaatt

SEQ ID NO: 1325783 - DNA, 22 bp, Artificial Sequence
  chemically synthesized
gtatgctttgttgaaggtaaat

SEQ ID NO: 1325784 - DNA, 22 bp, Artificial Sequence
  chemically synthesized
tgtatgctttgttgaaggtaaa

SEQ ID NO: 1325785 - DNA, 22 bp, Artificial Sequence
  chemically synthesized
ttgtatgctttgttgaaggtaa

SEQ ID NO: 1325786 - DNA, 22 bp, Artificial Sequence
  chemically synthesized
aaaaccaatttaccttcaacaa

SEQ ID NO: 1325787 - DNA, 22 bp, Artificial Sequence
  chemically synthesized
aaaccaatttaccttcaacaaa

SEQ ID NO: 1325788 - DNA, 22 bp, Artificial Sequence
  chemically synthesized
tgtttttgtatgctttgttgaa

SEQ ID NO: 1325789 - DNA, 22 bp, Artificial Sequence
  chemically synthesized
atgtttttgtatgctttgttga

SEQ ID NO: 1325790 - DNA, 22 bp, Artificial Sequence
  chemically synthesized
accttcaacaaagcatacaaaa

SEQ ID NO: 1325791 - DNA, 22 bp, Artificial Sequence
  chemically synthesized
cccaatttatgtttttgtatgc

SEQ ID NO: 1325792 - DNA, 22 bp, Artificial Sequence
  chemically synthesized
ccttcaacaaagcatacaaaaa

SEQ ID NO: 1325793 - DNA, 22 bp, Artificial Sequence
  chemically synthesized
gcccaatttatgtttttgtatg

SEQ ID NO: 1325794 - DNA, 22 bp, Artificial Sequence
  chemically synthesized
tgcccaatttatgtttttgtat

SEQ ID NO: 1325795 - DNA, 22 bp, Artificial Sequence
  chemically synthesized
caacaaagcatacaaaaacata

SEQ ID NO: 1325796 - DNA, 22 bp, Artificial Sequence
  chemically synthesized
aacaaagcatacaaaaacataa

SEQ ID NO: 1325797 - DNA, 22 bp, Artificial Sequence
  chemically synthesized
tcctttgcccaatttatgtttt

SEQ ID NO: 1325798 - DNA, 22 bp, Artificial Sequence
  chemically synthesized
aataggctgtcctttgcccaat

SEQ ID NO: 1325799 - DNA, 22 bp, Artificial Sequence
  chemically synthesized
ttgaataggctgtcctttgccc

SEQ ID NO: 1325800 - DNA, 22 bp, Artificial Sequence
  chemically synthesized
attgaataggctgtcctttgcc

SEQ ID NO: 1325801 - DNA, 22 bp, Artificial Sequence
  chemically synthesized
ggcaaaggacagcctattcaat

SEQ ID NO: 1325802 - DNA, 22 bp, Artificial Sequence
  chemically synthesized
ccagcaccatttattgaatagg

SEQ ID NO: 1325803 - DNA, 22 bp, Artificial Sequence
  chemically synthesized
cccagcaccatttattgaatag

SEQ ID NO: 1325804 - DNA, 22 bp, Artificial Sequence
  chemically synthesized
tcccagcaccatttattgaata

SEQ ID NO: 1325805 - DNA, 22 bp, Artificial Sequence
  chemically synthesized
tcccattttcccagcaccattt

SEQ ID NO: 1325806 - DNA, 22 bp, Artificial Sequence
  chemically synthesized
ttcaataaatggtgctgggaaa

SEQ ID NO: 1325807 - DNA, 22 bp, Artificial Sequence
  chemically synthesized
aataaatggtgctgggaaaatg

SEQ ID NO: 1325808 - DNA, 22 bp, Artificial Sequence
  chemically synthesized
cacatgtggttgtcccattttc

SEQ ID NO: 1325809 - DNA, 22 bp, Artificial Sequence
  chemically synthesized
ccacatgtggttgtcccatttt

SEQ ID NO: 1325810 - DNA, 22 bp, Artificial Sequence
  chemically synthesized
ttccacatgtggttgtcccatt

SEQ ID NO: 1325811 - DNA, 22 bp, Artificial Sequence
  chemically synthesized
attcttccacatgtggttgtcc

SEQ ID NO: 1325812 - DNA, 22 bp, Artificial Sequence
  chemically synthesized
cattcttccacatgtggttgtc

SEQ ID NO: 1325813 - DNA, 22 bp, Artificial Sequence
  chemically synthesized
ggaaaatgggacaaccacatgt

SEQ ID NO: 1325814 - DNA, 22 bp, Artificial Sequence
  chemically synthesized
tatatggtaggagatagggatc

SEQ ID NO: 1325815 - DNA, 22 bp, Artificial Sequence
  chemically synthesized
gtatatggtaggagatagggat

SEQ ID NO: 1325816 - DNA, 22 bp, Artificial Sequence
  chemically synthesized
tgtatatggtaggagataggga

SEQ ID NO: 1325817 - DNA, 22 bp, Artificial Sequence
  chemically synthesized
ttgtatatggtaggagataggg

SEQ ID NO: 1325818 - DNA, 22 bp, Artificial Sequence
  chemically synthesized
atttttgtatatggtaggagat

SEQ ID NO: 1325819 - DNA, 22 bp, Artificial Sequence
  chemically synthesized
gatccctatctcctaccatata

SEQ ID NO: 1325820 - DNA, 22 bp, Artificial Sequence
  chemically synthesized
agctaatttttgtatatggtag

SEQ ID NO: 1325821 - DNA, 22 bp, Artificial Sequence
  chemically synthesized
gagctaatttttgtatatggta

SEQ ID NO: 1325822 - DNA, 22 bp, Artificial Sequence
  chemically synthesized
cttgagctaatttttgtatatg

SEQ ID NO: 1325823 - DNA, 22 bp, Artificial Sequence
  chemically synthesized
tctcctaccatatacaaaaatt

SEQ ID NO: 1325824 - DNA, 22 bp, Artificial Sequence
  chemically synthesized
atcctccttgagctaatttttg

SEQ ID NO: 1325825 - DNA, 22 bp, Artificial Sequence
  chemically synthesized
aatcctccttgagctaattttt

SEQ ID NO: 1325826 - DNA, 22 bp, Artificial Sequence
  chemically synthesized
ctaccatatacaaaaattagct

SEQ ID NO: 1325827 - DNA, 22 bp, Artificial Sequence
  chemically synthesized
taatcctccttgagctaatttt

SEQ ID NO: 1325828 - DNA, 22 bp, Artificial Sequence
  chemically synthesized
ccatatacaaaaattagctcaa

SEQ ID NO: 1325829 - DNA, 22 bp, Artificial Sequence
  chemically synthesized
agtctttaatcctccttgagct

SEQ ID NO: 1325830 - DNA, 22 bp, Artificial Sequence
  chemically synthesized
aagtctttaatcctccttgagc

SEQ ID NO: 1325831 - DNA, 22 bp, Artificial Sequence
  chemically synthesized
gacttaagtctttaatcctcct

SEQ ID NO: 1325832 - DNA, 22 bp, Artificial Sequence
  chemically synthesized
agacttaagtctttaatcctcc

SEQ ID NO: 1325833 - DNA, 22 bp, Artificial Sequence
  chemically synthesized
gctcaaggaggattaaagactt

SEQ ID NO: 1325834 - DNA, 22 bp, Artificial Sequence
  chemically synthesized
aggtcttagacttaagtcttta

SEQ ID NO: 1325835 - DNA, 22 bp, Artificial Sequence
  chemically synthesized
caggtcttagacttaagtcttt

SEQ ID NO: 1325836 - DNA, 22 bp, Artificial Sequence
  chemically synthesized
aaggaggattaaagacttaagt

SEQ ID NO: 1325837 - DNA, 22 bp, Artificial Sequence
  chemically synthesized
tggtttcaggtcttagacttaa

SEQ ID NO: 1325838 - DNA, 22 bp, Artificial Sequence
  chemically synthesized
atggtttcaggtcttagactta

SEQ ID NO: 1325839 - DNA, 22 bp, Artificial Sequence
  chemically synthesized
tatggtttcaggtcttagactt

SEQ ID NO: 1325840 - DNA, 22 bp, Artificial Sequence
  chemically synthesized
aagacttaagtctaagacctga

SEQ ID NO: 1325841 - DNA, 22 bp, Artificial Sequence
  chemically synthesized
aggagttttatggtttcaggtc

SEQ ID NO: 1325842 - DNA, 22 bp, Artificial Sequence
  chemically synthesized
gaggagttttatggtttcaggt

SEQ ID NO: 1325843 - DNA, 22 bp, Artificial Sequence
  chemically synthesized
tgaggagttttatggtttcagg

SEQ ID NO: 1325844 - DNA, 22 bp, Artificial Sequence
  chemically synthesized
aagtctaagacctgaaaccata

SEQ ID NO: 1325845 - DNA, 22 bp, Artificial Sequence
  chemically synthesized
tttgaggagttttatggtttca

SEQ ID NO: 1325846 - DNA, 22 bp, Artificial Sequence
  chemically synthesized
agtctaagacctgaaaccataa

SEQ ID NO: 1325847 - DNA, 22 bp, Artificial Sequence
  chemically synthesized
ctttgaggagttttatggtttc

SEQ ID NO: 1325848 - DNA, 22 bp, Artificial Sequence
  chemically synthesized
tctttgaggagttttatggttt

SEQ ID NO: 1325849 - DNA, 22 bp, Artificial Sequence
  chemically synthesized
agacctgaaaccataaaactcc

SEQ ID NO: 1325850 - DNA, 22 bp, Artificial Sequence
  chemically synthesized
ggttttctttgaggagttttat

SEQ ID NO: 1325851 - DNA, 22 bp, Artificial Sequence
  chemically synthesized
ctaggttttctttgaggagttt

SEQ ID NO: 1325852 - DNA, 22 bp, Artificial Sequence
  chemically synthesized
cctaggttttctttgaggagtt

SEQ ID NO: 1325853 - DNA, 22 bp, Artificial Sequence
  chemically synthesized
tcctaggttttctttgaggagt

SEQ ID NO: 1325854 - DNA, 22 bp, Artificial Sequence
  chemically synthesized
ttcctaggttttctttgaggag

SEQ ID NO: 1325855 - DNA, 22 bp, Artificial Sequence
  chemically synthesized
aaaccataaaactcctcaaaga

SEQ ID NO: 1325856 - DNA, 22 bp, Artificial Sequence
  chemically synthesized
ctcaaagaaaacctaggaaaaa

SEQ ID NO: 1325857 - DNA, 22 bp, Artificial Sequence
  chemically synthesized
aaagaaaacctaggaaaaactc

SEQ ID NO: 1325858 - DNA, 22 bp, Artificial Sequence
  chemically synthesized
ggccaatgtccaggagagtttt

SEQ ID NO: 1325859 - DNA, 22 bp, Artificial Sequence
  chemically synthesized
cctaggccaatgtccaggagag

SEQ ID NO: 1325860 - DNA, 22 bp, Artificial Sequence
  chemically synthesized
acctaggccaatgtccaggaga

SEQ ID NO: 1325861 - DNA, 22 bp, Artificial Sequence
  chemically synthesized
tacctaggccaatgtccaggag

SEQ ID NO: 1325862 - DNA, 22 bp, Artificial Sequence
  chemically synthesized
tttacctaggccaatgtccagg

SEQ ID NO: 1325863 - DNA, 22 bp, Artificial Sequence
  chemically synthesized
ggaaaaactctcctggacattg

SEQ ID NO: 1325864 - DNA, 22 bp, Artificial Sequence
  chemically synthesized
tcctggacattggcctaggtaa

SEQ ID NO: 1325865 - DNA, 22 bp, Artificial Sequence
  chemically synthesized
gtcataaattctttacctaggc

SEQ ID NO: 1325866 - DNA, 22 bp, Artificial Sequence
  chemically synthesized
ggtcataaattctttacctagg

SEQ ID NO: 1325867 - DNA, 22 bp, Artificial Sequence
  chemically synthesized
ctggacattggcctaggtaaag

SEQ ID NO: 1325868 - DNA, 22 bp, Artificial Sequence
  chemically synthesized
gacattggcctaggtaaagaat

SEQ ID NO: 1325869 - DNA, 22 bp, Artificial Sequence
  chemically synthesized
aggtcttggtcataaattcttt

SEQ ID NO: 1325870 - DNA, 22 bp, Artificial Sequence
  chemically synthesized
gaggtcttggtcataaattctt

SEQ ID NO: 1325871 - DNA, 22 bp, Artificial Sequence
  chemically synthesized
tgaggtcttggtcataaattct

SEQ ID NO: 1325872 - DNA, 22 bp, Artificial Sequence
  chemically synthesized
ttgaggtcttggtcataaattc

SEQ ID NO: 1325873 - DNA, 22 bp, Artificial Sequence
  chemically synthesized
gcctaggtaaagaatttatgac

SEQ ID NO: 1325874 - DNA, 22 bp, Artificial Sequence
  chemically synthesized
cttttgaggtcttggtcataaa

SEQ ID NO: 1325875 - DNA, 22 bp, Artificial Sequence
  chemically synthesized
gcttttgaggtcttggtcataa

SEQ ID NO: 1325876 - DNA, 22 bp, Artificial Sequence
  chemically synthesized
ggtaaagaatttatgaccaaga

SEQ ID NO: 1325877 - DNA, 22 bp, Artificial Sequence
  chemically synthesized
catttgcttttgaggtcttggt

SEQ ID NO: 1325878 - DNA, 22 bp, Artificial Sequence
  chemically synthesized
ttgcatttgcttttgaggtctt

SEQ ID NO: 1325879 - DNA, 22 bp, Artificial Sequence
  chemically synthesized
gttgcatttgcttttgaggtct

SEQ ID NO: 1325880 - DNA, 22 bp, Artificial Sequence
  chemically synthesized
tgttgcatttgcttttgaggtc

SEQ ID NO: 1325881 - DNA, 22 bp, Artificial Sequence
  chemically synthesized
ttgttgcatttgcttttgaggt

SEQ ID NO: 1325882 - DNA, 22 bp, Artificial Sequence
  chemically synthesized
atgaccaagacctcaaaagcaa

SEQ ID NO: 1325883 - DNA, 22 bp, Artificial Sequence
  chemically synthesized
tttttgttgcatttgcttttga

SEQ ID NO: 1325884 - DNA, 22 bp, Artificial Sequence
  chemically synthesized
tgaccaagacctcaaaagcaaa

SEQ ID NO: 1325885 - DNA, 22 bp, Artificial Sequence
  chemically synthesized
atttttgttgcatttgcttttg

SEQ ID NO: 1325886 - DNA, 22 bp, Artificial Sequence
  chemically synthesized
tatttttgttgcatttgctttt

SEQ ID NO: 1325887 - DNA, 22 bp, Artificial Sequence
  chemically synthesized
ttatttttgttgcatttgcttt

SEQ ID NO: 1325888 - DNA, 22 bp, Artificial Sequence
  chemically synthesized
tttttatttttgttgcatttgc

SEQ ID NO: 1325889 - DNA, 22 bp, Artificial Sequence
  chemically synthesized
atttttatttttgttgcatttg

SEQ ID NO: 1325890 - DNA, 22 bp, Artificial Sequence
  chemically synthesized
tttatttttatttttgttgcat

SEQ ID NO: 1325891 - DNA, 22 bp, Artificial Sequence
  chemically synthesized
gtttatttttatttttgttgca

SEQ ID NO: 1325892 - DNA, 22 bp, Artificial Sequence
  chemically synthesized
aaaagcaaatgcaacaaaaata

SEQ ID NO: 1325893 - DNA, 22 bp, Artificial Sequence
  chemically synthesized
gatcccatttgtttatttttat

SEQ ID NO: 1325894 - DNA, 22 bp, Artificial Sequence
  chemically synthesized
agatcccatttgtttattttta

SEQ ID NO: 1325895 - DNA, 22 bp, Artificial Sequence
  chemically synthesized
cttagatcccatttgtttattt

SEQ ID NO: 1325896 - DNA, 22 bp, Artificial Sequence
  chemically synthesized
acttagatcccatttgtttatt

SEQ ID NO: 1325897 - DNA, 22 bp, Artificial Sequence
  chemically synthesized
gtttacttagatcccatttgtt

SEQ ID NO: 1325898 - DNA, 22 bp, Artificial Sequence
  chemically synthesized
agtttacttagatcccatttgt

SEQ ID NO: 1325899 - DNA, 22 bp, Artificial Sequence
  chemically synthesized
tagtttacttagatcccatttg

SEQ ID NO: 1325900 - DNA, 22 bp, Artificial Sequence
  chemically synthesized
ttagtttacttagatcccattt

SEQ ID NO: 1325901 - DNA, 22 bp, Artificial Sequence
  chemically synthesized
tttagtttacttagatcccatt

SEQ ID NO: 1325902 - DNA, 22 bp, Artificial Sequence
  chemically synthesized
tgcagaagctttttagtttact

SEQ ID NO: 1325903 - DNA, 22 bp, Artificial Sequence
  chemically synthesized
ctgtgcagaagctttttagttt

SEQ ID NO: 1325904 - DNA, 22 bp, Artificial Sequence
  chemically synthesized
gctgtgcagaagctttttagtt

SEQ ID NO: 1325905 - DNA, 22 bp, Artificial Sequence
  chemically synthesized
tgctgtgcagaagctttttagt

SEQ ID NO: 1325906 - DNA, 22 bp, Artificial Sequence
  chemically synthesized
ttgctgtgcagaagctttttag

SEQ ID NO: 1325907 - DNA, 22 bp, Artificial Sequence
  chemically synthesized
ttttgctgtgcagaagcttttt

SEQ ID NO: 1325908 - DNA, 22 bp, Artificial Sequence
  chemically synthesized
cttttgctgtgcagaagctttt

SEQ ID NO: 1325909 - DNA, 22 bp, Artificial Sequence
  chemically synthesized
agtaaactaaaaagcttctgca

SEQ ID NO: 1325910 - DNA, 22 bp, Artificial Sequence
  chemically synthesized
tttcttttgctgtgcagaagct

SEQ ID NO: 1325911 - DNA, 22 bp, Artificial Sequence
  chemically synthesized
atggttatttcttttgctgtgc

SEQ ID NO: 1325912 - DNA, 22 bp, Artificial Sequence
  chemically synthesized
aaaagcttctgcacagcaaaag

SEQ ID NO: 1325913 - DNA, 22 bp, Artificial Sequence
  chemically synthesized
cgttgatggttatttcttttgc

SEQ ID NO: 1325914 - DNA, 22 bp, Artificial Sequence
  chemically synthesized
acgttgatggttatttcttttg

SEQ ID NO: 1325915 - DNA, 22 bp, Artificial Sequence
  chemically synthesized
tttacgttgatggttatttctt

SEQ ID NO: 1325916 - DNA, 22 bp, Artificial Sequence
  chemically synthesized
ctgcacagcaaaagaaataacc

SEQ ID NO: 1325917 - DNA, 22 bp, Artificial Sequence
  chemically synthesized
tgcacagcaaaagaaataacca

SEQ ID NO: 1325918 - DNA, 22 bp, Artificial Sequence
  chemically synthesized
tgtttacgttgatggttatttc

SEQ ID NO: 1325919 - DNA, 22 bp, Artificial Sequence
  chemically synthesized
ctgtttacgttgatggttattt

SEQ ID NO: 1325920 - DNA, 22 bp, Artificial Sequence
  chemically synthesized
cacagcaaaagaaataaccatc

SEQ ID NO: 1325921 - DNA, 22 bp, Artificial Sequence
  chemically synthesized
tctgtttacgttgatggttatt

SEQ ID NO: 1325922 - DNA, 22 bp, Artificial Sequence
  chemically synthesized
tcggttttctgtttacgttgat

SEQ ID NO: 1325923 - DNA, 22 bp, Artificial Sequence
  chemically synthesized
tgtcggttttctgtttacgttg

SEQ ID NO: 1325924 - DNA, 22 bp, Artificial Sequence
  chemically synthesized
cattctgtcggttttctgttta

SEQ ID NO: 1325925 - DNA, 22 bp, Artificial Sequence
  chemically synthesized
ccattctgtcggttttctgttt

SEQ ID NO: 1325926 - DNA, 22 bp, Artificial Sequence
  chemically synthesized
tccattctgtcggttttctgtt

SEQ ID NO: 1325927 - DNA, 22 bp, Artificial Sequence
  chemically synthesized
ttccattctgtcggttttctgt

SEQ ID NO: 1325928 - DNA, 22 bp, Artificial Sequence
  chemically synthesized
tttccattctgtcggttttctg

SEQ ID NO: 1325929 - DNA, 22 bp, Artificial Sequence
  chemically synthesized
ttttccattctgtcggttttct

SEQ ID NO: 1325930 - DNA, 22 bp, Artificial Sequence
  chemically synthesized
caaatatttttttccattctgt

SEQ ID NO: 1325931 - DNA, 22 bp, Artificial Sequence
  chemically synthesized
gcaaatatttttttccattctg

SEQ ID NO: 1325932 - DNA, 22 bp, Artificial Sequence
  chemically synthesized
tcagatgcagtttgcaaatatt

SEQ ID NO: 1325933 - DNA, 22 bp, Artificial Sequence
  chemically synthesized
gtcagttgtcagatgcagtttg

SEQ ID NO: 1325934 - DNA, 22 bp, Artificial Sequence
  chemically synthesized
tagatattggtcagttgtcaga

SEQ ID NO: 1325935 - DNA, 22 bp, Artificial Sequence
  chemically synthesized
gcaaactgcatctgacaactga

SEQ ID NO: 1325936 - DNA, 22 bp, Artificial Sequence
  chemically synthesized
caaactgcatctgacaactgac

SEQ ID NO: 1325937 - DNA, 22 bp, Artificial Sequence
  chemically synthesized
taggttgtagatattggtcagt

SEQ ID NO: 1325938 - DNA, 22 bp, Artificial Sequence
  chemically synthesized
gtaggttgtagatattggtcag

SEQ ID NO: 1325939 - DNA, 22 bp, Artificial Sequence
  chemically synthesized
tgtaggttgtagatattggtca

SEQ ID NO: 1325940 - DNA, 22 bp, Artificial Sequence
  chemically synthesized
catctgacaactgaccaatatc

SEQ ID NO: 1325941 - DNA, 22 bp, Artificial Sequence
  chemically synthesized
tttgtaggttgtagatattggt

SEQ ID NO: 1325942 - DNA, 22 bp, Artificial Sequence
  chemically synthesized
acaactgaccaatatctacaac

SEQ ID NO: 1325943 - DNA, 22 bp, Artificial Sequence
  chemically synthesized
agttctttgtaggttgtagata

SEQ ID NO: 1325944 - DNA, 22 bp, Artificial Sequence
  chemically synthesized
gagttctttgtaggttgtagat

SEQ ID NO: 1325945 - DNA, 22 bp, Artificial Sequence
  chemically synthesized
cttgagttctttgtaggttgta

SEQ ID NO: 1325946 - DNA, 22 bp, Artificial Sequence
  chemically synthesized
gcttgagttctttgtaggttgt

SEQ ID NO: 1325947 - DNA, 22 bp, Artificial Sequence
  chemically synthesized
accaatatctacaacctacaaa

SEQ ID NO: 1325948 - DNA, 22 bp, Artificial Sequence
  chemically synthesized
atttgcttgagttctttgtagg

SEQ ID NO: 1325949 - DNA, 22 bp, Artificial Sequence
  chemically synthesized
ctgatttgcttgagttctttgt

SEQ ID NO: 1325950 - DNA, 22 bp, Artificial Sequence
  chemically synthesized
gctgatttgcttgagttctttg

SEQ ID NO: 1325951 - DNA, 22 bp, Artificial Sequence
  chemically synthesized
ttgctgatttgcttgagttctt

SEQ ID NO: 1325952 - DNA, 22 bp, Artificial Sequence
  chemically synthesized
cttgctgatttgcttgagttct

SEQ ID NO: 1325953 - DNA, 22 bp, Artificial Sequence
  chemically synthesized
caacctacaaagaactcaagca

SEQ ID NO: 1325954 - DNA, 22 bp, Artificial Sequence
  chemically synthesized
ttcttgctgatttgcttgagtt

SEQ ID NO: 1325955 - DNA, 22 bp, Artificial Sequence
  chemically synthesized
cttcttgctgatttgcttgagt

SEQ ID NO: 1325956 - DNA, 22 bp, Artificial Sequence
  chemically synthesized
tcttcttgctgatttgcttgag

SEQ ID NO: 1325957 - DNA, 22 bp, Artificial Sequence
  chemically synthesized
ttttcttcttgctgatttgctt

SEQ ID NO: 1325958 - DNA, 22 bp, Artificial Sequence
  chemically synthesized
caaagaactcaagcaaatcagc

SEQ ID NO: 1325959 - DNA, 22 bp, Artificial Sequence
  chemically synthesized
aagagattgttttcttcttgct

SEQ ID NO: 1325960 - DNA, 22 bp, Artificial Sequence
  chemically synthesized
aaagagattgttttcttcttgc

SEQ ID NO: 1325961 - DNA, 22 bp, Artificial Sequence
  chemically synthesized
taaagagattgttttcttcttg

SEQ ID NO: 1325962 - DNA, 22 bp, Artificial Sequence
  chemically synthesized
aagcaaatcagcaagaagaaaa

SEQ ID NO: 1325963 - DNA, 22 bp, Artificial Sequence
  chemically synthesized
ttaaagagattgttttcttctt

SEQ ID NO: 1325964 - DNA, 22 bp, Artificial Sequence
  chemically synthesized
tttaaagagattgttttcttct

SEQ ID NO: 1325965 - DNA, 22 bp, Artificial Sequence
  chemically synthesized
caagctttttaaagagattgtt

SEQ ID NO: 1325966 - DNA, 22 bp, Artificial Sequence
  chemically synthesized
ccaagctttttaaagagattgt

SEQ ID NO: 1325967 - DNA, 22 bp, Artificial Sequence
  chemically synthesized
tcgtttccaagctttttaaaga

SEQ ID NO: 1325968 - DNA, 22 bp, Artificial Sequence
  chemically synthesized
gtcgtttccaagctttttaaag

SEQ ID NO: 1325969 - DNA, 22 bp, Artificial Sequence
  chemically synthesized
ttgtcgtttccaagctttttaa

SEQ ID NO: 1325970 - DNA, 22 bp, Artificial Sequence
  chemically synthesized
tttaaaaagcttggaaacgaca

SEQ ID NO: 1325971 - DNA, 22 bp, Artificial Sequence
  chemically synthesized
taaaaagcttggaaacgacaag

SEQ ID NO: 1325972 - DNA, 22 bp, Artificial Sequence
  chemically synthesized
aaaaagcttggaaacgacaaga

SEQ ID NO: 1325973 - DNA, 22 bp, Artificial Sequence
  chemically synthesized
agaaatgtatattcttgtcgtt

SEQ ID NO: 1325974 - DNA, 22 bp, Artificial Sequence
  chemically synthesized
aaaagcttggaaacgacaagaa

SEQ ID NO: 1325975 - DNA, 22 bp, Artificial Sequence
  chemically synthesized
gagaaatgtatattcttgtcgt

SEQ ID NO: 1325976 - DNA, 22 bp, Artificial Sequence
  chemically synthesized
tgagaaatgtatattcttgtcg

SEQ ID NO: 1325977 - DNA, 22 bp, Artificial Sequence
  chemically synthesized
ttgagaaatgtatattcttgtc

SEQ ID NO: 1325978 - DNA, 22 bp, Artificial Sequence
  chemically synthesized
ttttgagaaatgtatattcttg

SEQ ID NO: 1325979 - DNA, 22 bp, Artificial Sequence
  chemically synthesized
cttttgagaaatgtatattctt

SEQ ID NO: 1325980 - DNA, 22 bp, Artificial Sequence
  chemically synthesized
ggaaacgacaagaatatacatt

SEQ ID NO: 1325981 - DNA, 22 bp, Artificial Sequence
  chemically synthesized
gaaacgacaagaatatacattt

SEQ ID NO: 1325982 - DNA, 22 bp, Artificial Sequence
  chemically synthesized
tatatcttcttttgagaaatgt

SEQ ID NO: 1325983 - DNA, 22 bp, Artificial Sequence
  chemically synthesized
gtatatcttcttttgagaaatg

SEQ ID NO: 1325984 - DNA, 22 bp, Artificial Sequence
  chemically synthesized
atcatttgtatatcttcttttg

SEQ ID NO: 1325985 - DNA, 22 bp, Artificial Sequence
  chemically synthesized
ttgatcatttgtatatcttctt

SEQ ID NO: 1325986 - DNA, 22 bp, Artificial Sequence
  chemically synthesized
gttgatcatttgtatatcttct

SEQ ID NO: 1325987 - DNA, 22 bp, Artificial Sequence
  chemically synthesized
ctcaaaagaagatatacaaatg

SEQ ID NO: 1325988 - DNA, 22 bp, Artificial Sequence
  chemically synthesized
tcaaaagaagatatacaaatga

SEQ ID NO: 1325989 - DNA, 22 bp, Artificial Sequence
  chemically synthesized
atgtatttgttgatcatttgta

SEQ ID NO: 1325990 - DNA, 22 bp, Artificial Sequence
  chemically synthesized
aaaagaagatatacaaatgatc

SEQ ID NO: 1325991 - DNA, 22 bp, Artificial Sequence
  chemically synthesized
catgtatttgttgatcatttgt

SEQ ID NO: 1325992 - DNA, 22 bp, Artificial Sequence
  chemically synthesized
tcatgtatttgttgatcatttg

SEQ ID NO: 1325993 - DNA, 22 bp, Artificial Sequence
  chemically synthesized
ttcatgtatttgttgatcattt

SEQ ID NO: 1325994 - DNA, 22 bp, Artificial Sequence
  chemically synthesized
tttcatgtatttgttgatcatt

SEQ ID NO: 1325995 - DNA, 22 bp, Artificial Sequence
  chemically synthesized
agtattttttcatgtatttgtt

SEQ ID NO: 1325996 - DNA, 22 bp, Artificial Sequence
  chemically synthesized
gtgatgttaagtattttttcat

SEQ ID NO: 1325997 - DNA, 22 bp, Artificial Sequence
  chemically synthesized
atgattagtgatgttaagtatt

SEQ ID NO: 1325998 - DNA, 22 bp, Artificial Sequence
  chemically synthesized
ccctgatgattagtgatgttaa

SEQ ID NO: 1325999 - DNA, 22 bp, Artificial Sequence
  chemically synthesized
cattcccctgatgattagtgat

SEQ ID NO: 1326000 - DNA, 22 bp, Artificial Sequence
  chemically synthesized
gcattcccctgatgattagtga

SEQ ID NO: 1326001 - DNA, 22 bp, Artificial Sequence
  chemically synthesized
atttgcattcccctgatgatta

SEQ ID NO: 1326002 - DNA, 22 bp, Artificial Sequence
  chemically synthesized
aatttgcattcccctgatgatt

SEQ ID NO: 1326003 - DNA, 22 bp, Artificial Sequence
  chemically synthesized
taatttgcattcccctgatgat

SEQ ID NO: 1326004 - DNA, 22 bp, Artificial Sequence
  chemically synthesized
aacatcactaatcatcagggga

SEQ ID NO: 1326005 - DNA, 22 bp, Artificial Sequence
  chemically synthesized
acatcactaatcatcaggggaa

SEQ ID NO: 1326006 - DNA, 22 bp, Artificial Sequence
  chemically synthesized
tggttttaatttgcattcccct

SEQ ID NO: 1326007 - DNA, 22 bp, Artificial Sequence
  chemically synthesized
attgtggttttaatttgcattc

SEQ ID NO: 1326008 - DNA, 22 bp, Artificial Sequence
  chemically synthesized
atcatcaggggaatgcaaatta

SEQ ID NO: 1326009 - DNA, 22 bp, Artificial Sequence
  chemically synthesized
agataaggaagtatctcattgt

SEQ ID NO: 1326010 - DNA, 22 bp, Artificial Sequence
  chemically synthesized
gctaagataaggaagtatctca

SEQ ID NO: 1326011 - DNA, 22 bp, Artificial Sequence
  chemically synthesized
tggctaagataaggaagtatct

SEQ ID NO: 1326012 - DNA, 22 bp, Artificial Sequence
  chemically synthesized
aaaccacaatgagatacttcct

SEQ ID NO: 1326013 - DNA, 22 bp, Artificial Sequence
  chemically synthesized
ataatggccattctggctaaga

SEQ ID NO: 1326014 - DNA, 22 bp, Artificial Sequence
  chemically synthesized
aataatggccattctggctaag

SEQ ID NO: 1326015 - DNA, 22 bp, Artificial Sequence
  chemically synthesized
taataatggccattctggctaa

SEQ ID NO: 1326016 - DNA, 22 bp, Artificial Sequence
  chemically synthesized
ttaataatggccattctggcta

SEQ ID NO: 1326017 - DNA, 22 bp, Artificial Sequence
  chemically synthesized
tttaataatggccattctggct

SEQ ID NO: 1326018 - DNA, 22 bp, Artificial Sequence
  chemically synthesized
ccttatcttagccagaatggcc

SEQ ID NO: 1326019 - DNA, 22 bp, Artificial Sequence
  chemically synthesized
cttatcttagccagaatggcca

SEQ ID NO: 1326020 - DNA, 22 bp, Artificial Sequence
  chemically synthesized
actttttaataatggccattct

SEQ ID NO: 1326021 - DNA, 22 bp, Artificial Sequence
  chemically synthesized
gactttttaataatggccattc

SEQ ID NO: 1326022 - DNA, 22 bp, Artificial Sequence
  chemically synthesized
tgactttttaataatggccatt

SEQ ID NO: 1326023 - DNA, 22 bp, Artificial Sequence
  chemically synthesized
atcttagccagaatggccatta

SEQ ID NO: 1326024 - DNA, 22 bp, Artificial Sequence
  chemically synthesized
ttgactttttaataatggccat

SEQ ID NO: 1326025 - DNA, 22 bp, Artificial Sequence
  chemically synthesized
tcttagccagaatggccattat

SEQ ID NO: 1326026 - DNA, 22 bp, Artificial Sequence
  chemically synthesized
tttgactttttaataatggcca

SEQ ID NO: 1326027 - DNA, 22 bp, Artificial Sequence
  chemically synthesized
ttttttgactttttaataatgg

SEQ ID NO: 1326028 - DNA, 22 bp, Artificial Sequence
  chemically synthesized
agccagaatggccattattaaa

SEQ ID NO: 1326029 - DNA, 22 bp, Artificial Sequence
  chemically synthesized
gccagaatggccattattaaaa

SEQ ID NO: 1326030 - DNA, 22 bp, Artificial Sequence
  chemically synthesized
ttgttttttgactttttaataa

SEQ ID NO: 1326031 - DNA, 22 bp, Artificial Sequence
  chemically synthesized
attgttttttgactttttaata

SEQ ID NO: 1326032 - DNA, 22 bp, Artificial Sequence
  chemically synthesized
ttaaaaagtcaaaaaacaataa

SEQ ID NO: 1326033 - DNA, 22 bp, Artificial Sequence
  chemically synthesized
tccatgccaacgtttattgttt

SEQ ID NO: 1326034 - DNA, 22 bp, Artificial Sequence
  chemically synthesized
gtccatgccaacgtttattgtt

SEQ ID NO: 1326035 - DNA, 22 bp, Artificial Sequence
  chemically synthesized
aaaagtcaaaaaacaataaacg

SEQ ID NO: 1326036 - DNA, 22 bp, Artificial Sequence
  chemically synthesized
tcttgtccatgccaacgtttat

SEQ ID NO: 1326037 - DNA, 22 bp, Artificial Sequence
  chemically synthesized
atcttgtccatgccaacgttta

SEQ ID NO: 1326038 - DNA, 22 bp, Artificial Sequence
  chemically synthesized
tatcttgtccatgccaacgttt

SEQ ID NO: 1326039 - DNA, 22 bp, Artificial Sequence
  chemically synthesized
ttatcttgtccatgccaacgtt

SEQ ID NO: 1326040 - DNA, 22 bp, Artificial Sequence
  chemically synthesized
tttatcttgtccatgccaacgt

SEQ ID NO: 1326041 - DNA, 22 bp, Artificial Sequence
  chemically synthesized
tttttatcttgtccatgccaac

SEQ ID NO: 1326042 - DNA, 22 bp, Artificial Sequence
  chemically synthesized
tctttttatcttgtccatgcca

SEQ ID NO: 1326043 - DNA, 22 bp, Artificial Sequence
  chemically synthesized
gcatggacaagataaaaagaga

SEQ ID NO: 1326044 - DNA, 22 bp, Artificial Sequence
  chemically synthesized
caccagcagtatataagtgttc

SEQ ID NO: 1326045 - DNA, 22 bp, Artificial Sequence
  chemically synthesized
ccaccagcagtatataagtgtt

SEQ ID NO: 1326046 - DNA, 22 bp, Artificial Sequence
  chemically synthesized
cacttccaccagcagtatataa

SEQ ID NO: 1326047 - DNA, 22 bp, Artificial Sequence
  chemically synthesized
acacttccaccagcagtatata

SEQ ID NO: 1326048 - DNA, 22 bp, Artificial Sequence
  chemically synthesized
atttacacttccaccagcagta

SEQ ID NO: 1326049 - DNA, 22 bp, Artificial Sequence
  chemically synthesized
atatactgctggtggaagtgta

SEQ ID NO: 1326050 - DNA, 22 bp, Artificial Sequence
  chemically synthesized
tatactgctggtggaagtgtaa

SEQ ID NO: 1326051 - DNA, 22 bp, Artificial Sequence
  chemically synthesized
cagagaggtattaatttacact

SEQ ID NO: 1326052 - DNA, 22 bp, Artificial Sequence
  chemically synthesized
ccagagaggtattaatttacac

SEQ ID NO: 1326053 - DNA, 22 bp, Artificial Sequence
  chemically synthesized
tccagagaggtattaatttaca

SEQ ID NO: 1326054 - DNA, 22 bp, Artificial Sequence
  chemically synthesized
ctggtggaagtgtaaattaata

SEQ ID NO: 1326055 - DNA, 22 bp, Artificial Sequence
  chemically synthesized
ttttccagagaggtattaattt

SEQ ID NO: 1326056 - DNA, 22 bp, Artificial Sequence
  chemically synthesized
gtggaagtgtaaattaatacct

SEQ ID NO: 1326057 - DNA, 22 bp, Artificial Sequence
  chemically synthesized
catactgttttccagagaggta

SEQ ID NO: 1326058 - DNA, 22 bp, Artificial Sequence
  chemically synthesized
agaaatctccatactgttttcc

SEQ ID NO: 1326059 - DNA, 22 bp, Artificial Sequence
  chemically synthesized
gagaaatctccatactgttttc

SEQ ID NO: 1326060 - DNA, 22 bp, Artificial Sequence
  chemically synthesized
atacctctctggaaaacagtat

SEQ ID NO: 1326061 - DNA, 22 bp, Artificial Sequence
  chemically synthesized
tgagaaatctccatactgtttt

SEQ ID NO: 1326062 - DNA, 22 bp, Artificial Sequence
  chemically synthesized
tttgagaaatctccatactgtt

SEQ ID NO: 1326063 - DNA, 22 bp, Artificial Sequence
  chemically synthesized
gttctttgagaaatctccatac

SEQ ID NO: 1326064 - DNA, 22 bp, Artificial Sequence
  chemically synthesized
tctggaaaacagtatggagatt

SEQ ID NO: 1326065 - DNA, 22 bp, Artificial Sequence
  chemically synthesized
tagttctttgagaaatctccat

SEQ ID NO: 1326066 - DNA, 22 bp, Artificial Sequence
  chemically synthesized
tggaaaacagtatggagatttc

SEQ ID NO: 1326067 - DNA, 22 bp, Artificial Sequence
  chemically synthesized
ctagttctttgagaaatctcca

SEQ ID NO: 1326068 - DNA, 22 bp, Artificial Sequence
  chemically synthesized
gaaaacagtatggagatttctc

SEQ ID NO: 1326069 - DNA, 22 bp, Artificial Sequence
  chemically synthesized
cttctagttctttgagaaatct

SEQ ID NO: 1326070 - DNA, 22 bp, Artificial Sequence
  chemically synthesized
aatggtatacctacttctagtt

SEQ ID NO: 1326071 - DNA, 22 bp, Artificial Sequence
  chemically synthesized
ctcaaagaactagaagtaggta

SEQ ID NO: 1326072 - DNA, 22 bp, Artificial Sequence
  chemically synthesized
tcaaagaactagaagtaggtat

SEQ ID NO: 1326073 - DNA, 22 bp, Artificial Sequence
  chemically synthesized
aaagaactagaagtaggtatac

SEQ ID NO: 1326074 - DNA, 22 bp, Artificial Sequence
  chemically synthesized
gtggattgaatggtatacctac

SEQ ID NO: 1326075 - DNA, 22 bp, Artificial Sequence
  chemically synthesized
ggattcgtggattgaatggtat

SEQ ID NO: 1326076 - DNA, 22 bp, Artificial Sequence
  chemically synthesized
gaagtaggtataccattcaatc

SEQ ID NO: 1326077 - DNA, 22 bp, Artificial Sequence
  chemically synthesized
gtagatatgcagtattaggatt

SEQ ID NO: 1326078 - DNA, 22 bp, Artificial Sequence
  chemically synthesized
ggtagatatgcagtattaggat

SEQ ID NO: 1326079 - DNA, 22 bp, Artificial Sequence
  chemically synthesized
tggtagatatgcagtattagga

SEQ ID NO: 1326080 - DNA, 22 bp, Artificial Sequence
  chemically synthesized
aatccacgaatcctaatactgc

SEQ ID NO: 1326081 - DNA, 22 bp, Artificial Sequence
  chemically synthesized
ttttggtagatatgcagtatta

SEQ ID NO: 1326082 - DNA, 22 bp, Artificial Sequence
  chemically synthesized
attttggtagatatgcagtatt

SEQ ID NO: 1326083 - DNA, 22 bp, Artificial Sequence
  chemically synthesized
tattttggtagatatgcagtat

SEQ ID NO: 1326084 - DNA, 22 bp, Artificial Sequence
  chemically synthesized
ttattttggtagatatgcagta

SEQ ID NO: 1326085 - DNA, 22 bp, Artificial Sequence
  chemically synthesized
tttttattttggtagatatgca

SEQ ID NO: 1326086 - DNA, 22 bp, Artificial Sequence
  chemically synthesized
atttttattttggtagatatgc

SEQ ID NO: 1326087 - DNA, 22 bp, Artificial Sequence
  chemically synthesized
atactgcatatctaccaaaata

SEQ ID NO: 1326088 - DNA, 22 bp, Artificial Sequence
  chemically synthesized
atatagtgacttatttttattt

SEQ ID NO: 1326089 - DNA, 22 bp, Artificial Sequence
  chemically synthesized
catatctaccaaaataaaaata

SEQ ID NO: 1326090 - DNA, 22 bp, Artificial Sequence
  chemically synthesized
catatagtgacttatttttatt

SEQ ID NO: 1326091 - DNA, 22 bp, Artificial Sequence
  chemically synthesized
tcatatagtgacttatttttat

SEQ ID NO: 1326092 - DNA, 22 bp, Artificial Sequence
  chemically synthesized
ttcatatagtgacttattttta

SEQ ID NO: 1326093 - DNA, 22 bp, Artificial Sequence
  chemically synthesized
tttcatatagtgacttattttt

SEQ ID NO: 1326094 - DNA, 22 bp, Artificial Sequence
  chemically synthesized
ccaaaataaaaataagtcacta

SEQ ID NO: 1326095 - DNA, 22 bp, Artificial Sequence
  chemically synthesized
tatgaaaaaggcacctgcatac

SEQ ID NO: 1326096 - DNA, 22 bp, Artificial Sequence
  chemically synthesized
caataaacatatgtatgcaggt

SEQ ID NO: 1326097 - DNA, 22 bp, Artificial Sequence
  chemically synthesized
tgctgcaataaacatatgtatg

SEQ ID NO: 1326098 - DNA, 22 bp, Artificial Sequence
  chemically synthesized
tgaattgtgctgcaataaacat

SEQ ID NO: 1326099 - DNA, 22 bp, Artificial Sequence
  chemically synthesized
catacatatgtttattgcagca

SEQ ID NO: 1326100 - DNA, 22 bp, Artificial Sequence
  chemically synthesized
cgattgtgaattgtgctgcaat

SEQ ID NO: 1326101 - DNA, 22 bp, Artificial Sequence
  chemically synthesized
gcgattgtgaattgtgctgcaa

SEQ ID NO: 1326102 - DNA, 22 bp, Artificial Sequence
  chemically synthesized
tgcgattgtgaattgtgctgca

SEQ ID NO: 1326103 - DNA, 22 bp, Artificial Sequence
  chemically synthesized
tatctttgcgattgtgaattgt

SEQ ID NO: 1326104 - DNA, 22 bp, Artificial Sequence
  chemically synthesized
tatatctttgcgattgtgaatt

SEQ ID NO: 1326105 - DNA, 22 bp, Artificial Sequence
  chemically synthesized
attgcagcacaattcacaatcg

SEQ ID NO: 1326106 - DNA, 22 bp, Artificial Sequence
  chemically synthesized
ttgcagcacaattcacaatcgc

SEQ ID NO: 1326107 - DNA, 22 bp, Artificial Sequence
  chemically synthesized
cagcacaattcacaatcgcaaa

SEQ ID NO: 1326108 - DNA, 22 bp, Artificial Sequence
  chemically synthesized
aggtggattctatatctttgcg

SEQ ID NO: 1326109 - DNA, 22 bp, Artificial Sequence
  chemically synthesized
taaggtggattctatatctttg

SEQ ID NO: 1326110 - DNA, 22 bp, Artificial Sequence
  chemically synthesized
acaatcgcaaagatatagaatc

SEQ ID NO: 1326111 - DNA, 22 bp, Artificial Sequence
  chemically synthesized
tccactctaaggtggattctat

SEQ ID NO: 1326112 - DNA, 22 bp, Artificial Sequence
  chemically synthesized
atccactctaaggtggattcta

SEQ ID NO: 1326113 - DNA, 22 bp, Artificial Sequence
  chemically synthesized
tatccactctaaggtggattct

SEQ ID NO: 1326114 - DNA, 22 bp, Artificial Sequence
  chemically synthesized
tttatccactctaaggtggatt

SEQ ID NO: 1326115 - DNA, 22 bp, Artificial Sequence
  chemically synthesized
ctttatccactctaaggtggat

SEQ ID NO: 1326116 - DNA, 22 bp, Artificial Sequence
  chemically synthesized
tctttatccactctaaggtgga

SEQ ID NO: 1326117 - DNA, 22 bp, Artificial Sequence
  chemically synthesized
acattttctttatccactctaa

SEQ ID NO: 1326118 - DNA, 22 bp, Artificial Sequence
  chemically synthesized
agagtggataaagaaaatgtga

SEQ ID NO: 1326119 - DNA, 22 bp, Artificial Sequence
  chemically synthesized
gagtggataaagaaaatgtgag

SEQ ID NO: 1326120 - DNA, 22 bp, Artificial Sequence
  chemically synthesized
tggtgtgtgtgtgtgtgtgtgt

SEQ ID NO: 1326121 - DNA, 22 bp, Artificial Sequence
  chemically synthesized
tatggtgtgtgtgtgtgtgtgt

SEQ ID NO: 1326122 - DNA, 22 bp, Artificial Sequence
  chemically synthesized
agtagtattctatggtgtgtgt

SEQ ID NO: 1326123 - DNA, 22 bp, Artificial Sequence
  chemically synthesized
tatggctgagtagtattctatg

SEQ ID NO: 1326124 - DNA, 22 bp, Artificial Sequence
  chemically synthesized
atatggctgagtagtattctat

SEQ ID NO: 1326125 - DNA, 22 bp, Artificial Sequence
  chemically synthesized
tttatatggctgagtagtattc

SEQ ID NO: 1326126 - DNA, 22 bp, Artificial Sequence
  chemically synthesized
attgtttatatggctgagtagt

SEQ ID NO: 1326127 - DNA, 22 bp, Artificial Sequence
  chemically synthesized
cattgtttatatggctgagtag

SEQ ID NO: 1326128 - DNA, 22 bp, Artificial Sequence
  chemically synthesized
tttcattgtttatatggctgag

SEQ ID NO: 1326129 - DNA, 22 bp, Artificial Sequence
  chemically synthesized
ctcagccatataaacaatgaaa

SEQ ID NO: 1326130 - DNA, 22 bp, Artificial Sequence
  chemically synthesized
cagaagacgttatttcattgtt

SEQ ID NO: 1326131 - DNA, 22 bp, Artificial Sequence
  chemically synthesized
agccatataaacaatgaaataa

SEQ ID NO: 1326132 - DNA, 22 bp, Artificial Sequence
  chemically synthesized
ctgcagaagacgttatttcatt

SEQ ID NO: 1326133 - DNA, 22 bp, Artificial Sequence
  chemically synthesized
catccaagttgctgcagaagac

SEQ ID NO: 1326134 - DNA, 22 bp, Artificial Sequence
  chemically synthesized
cagttccatccaagttgctgca

SEQ ID NO: 1326135 - DNA, 22 bp, Artificial Sequence
  chemically synthesized
ctgcagcaacttggatggaact

SEQ ID NO: 1326136 - DNA, 22 bp, Artificial Sequence
  chemically synthesized
tgcagcaacttggatggaactg

SEQ ID NO: 1326137 - DNA, 22 bp, Artificial Sequence
  chemically synthesized
gaataataacctccagttccat

SEQ ID NO: 1326138 - DNA, 22 bp, Artificial Sequence
  chemically synthesized
cagcaacttggatggaactgga

SEQ ID NO: 1326139 - DNA, 22 bp, Artificial Sequence
  chemically synthesized
agaataataacctccagttcca

SEQ ID NO: 1326140 - DNA, 22 bp, Artificial Sequence
  chemically synthesized
acttagaataataacctccagt

SEQ ID NO: 1326141 - DNA, 22 bp, Artificial Sequence
  chemically synthesized
cacttagaataataacctccag

SEQ ID NO: 1326142 - DNA, 22 bp, Artificial Sequence
  chemically synthesized
cttcacttagaataataacctc

SEQ ID NO: 1326143 - DNA, 22 bp, Artificial Sequence
  chemically synthesized
ggatggaactggaggttattat

SEQ ID NO: 1326144 - DNA, 22 bp, Artificial Sequence
  chemically synthesized
gatggaactggaggttattatt

SEQ ID NO: 1326145 - DNA, 22 bp, Artificial Sequence
  chemically synthesized
agttacttcacttagaataata

SEQ ID NO: 1326146 - DNA, 22 bp, Artificial Sequence
  chemically synthesized
tgagttacttcacttagaataa

SEQ ID NO: 1326147 - DNA, 22 bp, Artificial Sequence
  chemically synthesized
ctgagttacttcacttagaata

SEQ ID NO: 1326148 - DNA, 22 bp, Artificial Sequence
  chemically synthesized
gaggttattattctaagtgaag

SEQ ID NO: 1326149 - DNA, 22 bp, Artificial Sequence
  chemically synthesized
catttctgagttacttcactta

SEQ ID NO: 1326150 - DNA, 22 bp, Artificial Sequence
  chemically synthesized
ccatttctgagttacttcactt

SEQ ID NO: 1326151 - DNA, 22 bp, Artificial Sequence
  chemically synthesized
tccatttctgagttacttcact

SEQ ID NO: 1326152 - DNA, 22 bp, Artificial Sequence
  chemically synthesized
ttattctaagtgaagtaactca

SEQ ID NO: 1326153 - DNA, 22 bp, Artificial Sequence
  chemically synthesized
attttccatttctgagttactt

SEQ ID NO: 1326154 - DNA, 22 bp, Artificial Sequence
  chemically synthesized
gattttccatttctgagttact

SEQ ID NO: 1326155 - DNA, 22 bp, Artificial Sequence
  chemically synthesized
ttctaagtgaagtaactcagaa

SEQ ID NO: 1326156 - DNA, 22 bp, Artificial Sequence
  chemically synthesized
taagtgaagtaactcagaaatg

SEQ ID NO: 1326157 - DNA, 22 bp, Artificial Sequence
  chemically synthesized
agtgaagtaactcagaaatgga

SEQ ID NO: 1326158 - DNA, 22 bp, Artificial Sequence
  chemically synthesized
agaaatggaaaatcaaatactg

SEQ ID NO: 1326159 - DNA, 22 bp, Artificial Sequence
  chemically synthesized
taagtgagaacacacagtattt

SEQ ID NO: 1326160 - DNA, 22 bp, Artificial Sequence
  chemically synthesized
ccattataagtgagaacacaca

SEQ ID NO: 1326161 - DNA, 22 bp, Artificial Sequence
  chemically synthesized
gttcccattataagtgagaaca

SEQ ID NO: 1326162 - DNA, 22 bp, Artificial Sequence
  chemically synthesized
ataagttagttcccattataag

SEQ ID NO: 1326163 - DNA, 22 bp, Artificial Sequence
  chemically synthesized
tgtgttctcacttataatggga

SEQ ID NO: 1326164 - DNA, 22 bp, Artificial Sequence
  chemically synthesized
catactcataagttagttccca

SEQ ID NO: 1326165 - DNA, 22 bp, Artificial Sequence
  chemically synthesized
gcatactcataagttagttccc

SEQ ID NO: 1326166 - DNA, 22 bp, Artificial Sequence
  chemically synthesized
tcacttataatgggaactaact

SEQ ID NO: 1326167 - DNA, 22 bp, Artificial Sequence
  chemically synthesized
tgcatactcataagttagttcc

SEQ ID NO: 1326168 - DNA, 22 bp, Artificial Sequence
  chemically synthesized
acttataatgggaactaactta

SEQ ID NO: 1326169 - DNA, 22 bp, Artificial Sequence
  chemically synthesized
ataatgggaactaacttatgag

SEQ ID NO: 1326170 - DNA, 22 bp, Artificial Sequence
  chemically synthesized
taatgggaactaacttatgagt

SEQ ID NO: 1326171 - DNA, 22 bp, Artificial Sequence
  chemically synthesized
tatgcctttgcatactcataag

SEQ ID NO: 1326172 - DNA, 22 bp, Artificial Sequence
  chemically synthesized
tgtatgcctttgcatactcata

SEQ ID NO: 1326173 - DNA, 22 bp, Artificial Sequence
  chemically synthesized
tatcactctgtatgcctttgca

SEQ ID NO: 1326174 - DNA, 22 bp, Artificial Sequence
  chemically synthesized
acttatgagtatgcaaaggcat

SEQ ID NO: 1326175 - DNA, 22 bp, Artificial Sequence
  chemically synthesized
atatcactctgtatgcctttgc

SEQ ID NO: 1326176 - DNA, 22 bp, Artificial Sequence
  chemically synthesized
atgagtatgcaaaggcatacag

SEQ ID NO: 1326177 - DNA, 22 bp, Artificial Sequence
  chemically synthesized
tgagtatgcaaaggcatacaga

SEQ ID NO: 1326178 - DNA, 22 bp, Artificial Sequence
  chemically synthesized
aagtcccttatatcactctgta

SEQ ID NO: 1326179 - DNA, 22 bp, Artificial Sequence
  chemically synthesized
tgaagtcccttatatcactctg

SEQ ID NO: 1326180 - DNA, 22 bp, Artificial Sequence
  chemically synthesized
agtctctgaagtcccttatatc

SEQ ID NO: 1326181 - DNA, 22 bp, Artificial Sequence
  chemically synthesized
tgagtctctgaagtcccttata

SEQ ID NO: 1326182 - DNA, 22 bp, Artificial Sequence
  chemically synthesized
ctgagtctctgaagtcccttat

SEQ ID NO: 1326183 - DNA, 22 bp, Artificial Sequence
  chemically synthesized
cacttctgagtctctgaagtcc

SEQ ID NO: 1326184 - DNA, 22 bp, Artificial Sequence
  chemically synthesized
ccaccccctccacttctgagtc

SEQ ID NO: 1326185 - DNA, 22 bp, Artificial Sequence
  chemically synthesized
attcccaccccctccacttctg

SEQ ID NO: 1326186 - DNA, 22 bp, Artificial Sequence
  chemically synthesized
cagagactcagaagtggagggg

SEQ ID NO: 1326187 - DNA, 22 bp, Artificial Sequence
  chemically synthesized
agagactcagaagtggaggggg

SEQ ID NO: 1326188 - DNA, 22 bp, Artificial Sequence
  chemically synthesized
tccctcattcccaccccctcca

SEQ ID NO: 1326189 - DNA, 22 bp, Artificial Sequence
  chemically synthesized
atccctcattcccaccccctcc

SEQ ID NO: 1326190 - DNA, 22 bp, Artificial Sequence
  chemically synthesized
tatccctcattcccaccccctc

SEQ ID NO: 1326191 - DNA, 22 bp, Artificial Sequence
  chemically synthesized
ttatccctcattcccaccccct

SEQ ID NO: 1326192 - DNA, 22 bp, Artificial Sequence
  chemically synthesized
tttatccctcattcccaccccc

SEQ ID NO: 1326193 - DNA, 22 bp, Artificial Sequence
  chemically synthesized
agaagtggagggggtgggaatg

SEQ ID NO: 1326194 - DNA, 22 bp, Artificial Sequence
  chemically synthesized
tacccaatatgtagttttttat

SEQ ID NO: 1326195 - DNA, 22 bp, Artificial Sequence
  chemically synthesized
catattgggtacaacgtacact

SEQ ID NO: 1326196 - DNA, 22 bp, Artificial Sequence
  chemically synthesized
agccgtcacccgagtagtgtac

SEQ ID NO: 1326197 - DNA, 22 bp, Artificial Sequence
  chemically synthesized
ttgagccgtcacccgagtagtg

SEQ ID NO: 1326198 - DNA, 22 bp, Artificial Sequence
  chemically synthesized
ggtacaacgtacactactcggg

SEQ ID NO: 1326199 - DNA, 22 bp, Artificial Sequence
  chemically synthesized
attgagccgtcacccgagtagt

SEQ ID NO: 1326200 - DNA, 22 bp, Artificial Sequence
  chemically synthesized
tattgagccgtcacccgagtag

SEQ ID NO: 1326201 - DNA, 22 bp, Artificial Sequence
  chemically synthesized
ctcgggtgacggctcaataaaa

SEQ ID NO: 1326202 - DNA, 22 bp, Artificial Sequence
  chemically synthesized
gggtgacggctcaataaaatcc

SEQ ID NO: 1326203 - DNA, 22 bp, Artificial Sequence
  chemically synthesized
tataatggtgaagtccgggatt

SEQ ID NO: 1326204 - DNA, 22 bp, Artificial Sequence
  chemically synthesized
aataaaatcccggacttcacca

SEQ ID NO: 1326205 - DNA, 22 bp, Artificial Sequence
  chemically synthesized
cgtgtatgaattgtataatggt

SEQ ID NO: 1326206 - DNA, 22 bp, Artificial Sequence
  chemically synthesized
acgtgtatgaattgtataatgg

SEQ ID NO: 1326207 - DNA, 22 bp, Artificial Sequence
  chemically synthesized
cttacgtgtatgaattgtataa

SEQ ID NO: 1326208 - DNA, 22 bp, Artificial Sequence
  chemically synthesized
gcttacgtgtatgaattgtata

SEQ ID NO: 1326209 - DNA, 22 bp, Artificial Sequence
  chemically synthesized
tgcttacgtgtatgaattgtat

SEQ ID NO: 1326210 - DNA, 22 bp, Artificial Sequence
  chemically synthesized
ttgcttacgtgtatgaattgta

SEQ ID NO: 1326211 - DNA, 22 bp, Artificial Sequence
  chemically synthesized
caccattatacaattcatacac

SEQ ID NO: 1326212 - DNA, 22 bp, Artificial Sequence
  chemically synthesized
accattatacaattcatacacg

SEQ ID NO: 1326213 - DNA, 22 bp, Artificial Sequence
  chemically synthesized
aagtggtttttgcttacgtgta

SEQ ID NO: 1326214 - DNA, 22 bp, Artificial Sequence
  chemically synthesized
caagtggtttttgcttacgtgt

SEQ ID NO: 1326215 - DNA, 22 bp, Artificial Sequence
  chemically synthesized
tacaattcatacacgtaagcaa

SEQ ID NO: 1326216 - DNA, 22 bp, Artificial Sequence
  chemically synthesized
gggtttcaagtggtttttgctt

SEQ ID NO: 1326217 - DNA, 22 bp, Artificial Sequence
  chemically synthesized
agggtttcaagtggtttttgct

SEQ ID NO: 1326218 - DNA, 22 bp, Artificial Sequence
  chemically synthesized
tagggtttcaagtggtttttgc

SEQ ID NO: 1326219 - DNA, 22 bp, Artificial Sequence
  chemically synthesized
atacacgtaagcaaaaaccact

SEQ ID NO: 1326220 - DNA, 22 bp, Artificial Sequence
  chemically synthesized
aatagctttagggtttcaagtg

SEQ ID NO: 1326221 - DNA, 22 bp, Artificial Sequence
  chemically synthesized
caatagctttagggtttcaagt

SEQ ID NO: 1326222 - DNA, 22 bp, Artificial Sequence
  chemically synthesized
tacttcaatagctttagggttt

SEQ ID NO: 1326223 - DNA, 22 bp, Artificial Sequence
  chemically synthesized
ttgtacttcaatagctttaggg

SEQ ID NO: 1326224 - DNA, 22 bp, Artificial Sequence
  chemically synthesized
gttgtacttcaatagctttagg

SEQ ID NO: 1326225 - DNA, 22 bp, Artificial Sequence
  chemically synthesized
tgttgtacttcaatagctttag

SEQ ID NO: 1326226 - DNA, 22 bp, Artificial Sequence
  chemically synthesized
ttttgttgtacttcaatagctt

SEQ ID NO: 1326227 - DNA, 22 bp, Artificial Sequence
  chemically synthesized
attttgttgtacttcaatagct

SEQ ID NO: 1326228 - DNA, 22 bp, Artificial Sequence
  chemically synthesized
tattttgttgtacttcaatagc

SEQ ID NO: 1326229 - DNA, 22 bp, Artificial Sequence
  chemically synthesized
gaaaccctaaagctattgaagt

SEQ ID NO: 1326230 - DNA, 22 bp, Artificial Sequence
  chemically synthesized
ttattttgttgtacttcaatag

SEQ ID NO: 1326231 - DNA, 22 bp, Artificial Sequence
  chemically synthesized
aaaccctaaagctattgaagta

SEQ ID NO: 1326232 - DNA, 22 bp, Artificial Sequence
  chemically synthesized
tttattttgttgtacttcaata

SEQ ID NO: 1326233 - DNA, 22 bp, Artificial Sequence
  chemically synthesized
ttttttattttgttgtacttca

SEQ ID NO: 1326234 - DNA, 22 bp, Artificial Sequence
  chemically synthesized
attttttattttgttgtacttc

SEQ ID NO: 1326235 - DNA, 22 bp, Artificial Sequence
  chemically synthesized
tattttttattttgttgtactt

SEQ ID NO: 1326236 - DNA, 22 bp, Artificial Sequence
  chemically synthesized
aagctattgaagtacaacaaaa

SEQ ID NO: 1326237 - DNA, 22 bp, Artificial Sequence
  chemically synthesized
ttgaagtacaacaaaataaaaa

SEQ ID NO: 1326238 - DNA, 22 bp, Artificial Sequence
  chemically synthesized
aagtacaacaaaataaaaaata

SEQ ID NO: 1326239 - DNA, 22 bp, Artificial Sequence
  chemically synthesized
gaatatacattttattttttat

SEQ ID NO: 1326240 - DNA, 22 bp, Artificial Sequence
  chemically synthesized
ttggaatatacattttattttt

SEQ ID NO: 1326241 - DNA, 22 bp, Artificial Sequence
  chemically synthesized
attggaatatacattttatttt

SEQ ID NO: 1326242 - DNA, 22 bp, Artificial Sequence
  chemically synthesized
ttattggaatatacattttatt

SEQ ID NO: 1326243 - DNA, 22 bp, Artificial Sequence
  chemically synthesized
ctcttattggaatatacatttt

SEQ ID NO: 1326244 - DNA, 22 bp, Artificial Sequence
  chemically synthesized
cctcttattggaatatacattt

SEQ ID NO: 1326245 - DNA, 22 bp, Artificial Sequence
  chemically synthesized
caaacttcctcttattggaata

SEQ ID NO: 1326246 - DNA, 22 bp, Artificial Sequence
  chemically synthesized
caataagaggaagtttgtagtc

SEQ ID NO: 1326247 - DNA, 22 bp, Artificial Sequence
  chemically synthesized
agcaataagaatataagactac

SEQ ID NO: 1326248 - DNA, 22 bp, Artificial Sequence
  chemically synthesized
ctgagcaataagaatataagac

SEQ ID NO: 1326249 - DNA, 22 bp, Artificial Sequence
  chemically synthesized
gctgagcaataagaatataaga

SEQ ID NO: 1326250 - DNA, 22 bp, Artificial Sequence
  chemically synthesized
gtagtcttatattcttattgct

SEQ ID NO: 1326251 - DNA, 22 bp, Artificial Sequence
  chemically synthesized
tagtcttatattcttattgctc

SEQ ID NO: 1326252 - DNA, 22 bp, Artificial Sequence
  chemically synthesized
atgtacaatttgctgagcaata

SEQ ID NO: 1326253 - DNA, 22 bp, Artificial Sequence
  chemically synthesized
aatgtacaatttgctgagcaat

SEQ ID NO: 1326254 - DNA, 22 bp, Artificial Sequence
  chemically synthesized
atattcttattgctcagcaaat

SEQ ID NO: 1326255 - DNA, 22 bp, Artificial Sequence
  chemically synthesized
tattcttattgctcagcaaatt

SEQ ID NO: 1326256 - DNA, 22 bp, Artificial Sequence
  chemically synthesized
ttattgctcagcaaattgtaca

SEQ ID NO: 1326257 - DNA, 22 bp, Artificial Sequence
  chemically synthesized
aatatgcccttaatgtacaatt

SEQ ID NO: 1326258 - DNA, 22 bp, Artificial Sequence
  chemically synthesized
attgctcagcaaattgtacatt

SEQ ID NO: 1326259 - DNA, 22 bp, Artificial Sequence
  chemically synthesized
ttgctcagcaaattgtacatta

SEQ ID NO: 1326260 - DNA, 22 bp, Artificial Sequence
  chemically synthesized
ctcagcaaattgtacattaagg

SEQ ID NO: 1326261 - DNA, 22 bp, Artificial Sequence
  chemically synthesized
agcaaattgtacattaagggca

SEQ ID NO: 1326262 - DNA, 22 bp, Artificial Sequence
  chemically synthesized
tggaatattcaatatgccctta

SEQ ID NO: 1326263 - DNA, 22 bp, Artificial Sequence
  chemically synthesized
atggaatattcaatatgccctt

SEQ ID NO: 1326264 - DNA, 22 bp, Artificial Sequence
  chemically synthesized
tatggaatattcaatatgccct

SEQ ID NO: 1326265 - DNA, 22 bp, Artificial Sequence
  chemically synthesized
tacattaagggcatattgaata

SEQ ID NO: 1326266 - DNA, 22 bp, Artificial Sequence
  chemically synthesized
agggcatattgaatattccata

SEQ ID NO: 1326267 - DNA, 22 bp, Artificial Sequence
  chemically synthesized
gtgaaaaatattttatggaata

SEQ ID NO: 1326268 - DNA, 22 bp, Artificial Sequence
  chemically synthesized
aattagtgaaaaatattttatg

SEQ ID NO: 1326269 - DNA, 22 bp, Artificial Sequence
  chemically synthesized
aatattccataaaatatttttc

SEQ ID NO: 1326270 - DNA, 22 bp, Artificial Sequence
  chemically synthesized
gtaattaaattagtgaaaaata

SEQ ID NO: 1326271 - DNA, 22 bp, Artificial Sequence
  chemically synthesized
ctagtaattaaattagtgaaaa

SEQ ID NO: 1326272 - DNA, 22 bp, Artificial Sequence
  chemically synthesized
cataaaatatttttcactaatt

SEQ ID NO: 1326273 - DNA, 22 bp, Artificial Sequence
  chemically synthesized
catgattactagtaattaaatt

SEQ ID NO: 1326274 - DNA, 22 bp, Artificial Sequence
  chemically synthesized
acatgattactagtaattaaat

SEQ ID NO: 1326275 - DNA, 22 bp, Artificial Sequence
  chemically synthesized
tacatgattactagtaattaaa

SEQ ID NO: 1326276 - DNA, 22 bp, Artificial Sequence
  chemically synthesized
ttcactaatttaattactagta

SEQ ID NO: 1326277 - DNA, 22 bp, Artificial Sequence
  chemically synthesized
gctttacatgattactagtaat

SEQ ID NO: 1326278 - DNA, 22 bp, Artificial Sequence
  chemically synthesized
tcactaatttaattactagtaa

SEQ ID NO: 1326279 - DNA, 22 bp, Artificial Sequence
  chemically synthesized
ggctttacatgattactagtaa

SEQ ID NO: 1326280 - DNA, 22 bp, Artificial Sequence
  chemically synthesized
cactaatttaattactagtaat

SEQ ID NO: 1326281 - DNA, 22 bp, Artificial Sequence
  chemically synthesized
tggctttacatgattactagta

SEQ ID NO: 1326282 - DNA, 22 bp, Artificial Sequence
  chemically synthesized
actaatttaattactagtaatc

SEQ ID NO: 1326283 - DNA, 22 bp, Artificial Sequence
  chemically synthesized
atttaattactagtaatcatgt

SEQ ID NO: 1326284 - DNA, 22 bp, Artificial Sequence
  chemically synthesized
tgttttggctttacatgattac

SEQ ID NO: 1326285 - DNA, 22 bp, Artificial Sequence
  chemically synthesized
atgttttggctttacatgatta

SEQ ID NO: 1326286 - DNA, 22 bp, Artificial Sequence
  chemically synthesized
aattactagtaatcatgtaaag

SEQ ID NO: 1326287 - DNA, 22 bp, Artificial Sequence
  chemically synthesized
attactagtaatcatgtaaagc

SEQ ID NO: 1326288 - DNA, 22 bp, Artificial Sequence
  chemically synthesized
ctagtaatcatgtaaagccaaa

SEQ ID NO: 1326289 - DNA, 22 bp, Artificial Sequence
  chemically synthesized
tgaatgtttatgttttggcttt

SEQ ID NO: 1326290 - DNA, 22 bp, Artificial Sequence
  chemically synthesized
gtaatcatgtaaagccaaaaca

SEQ ID NO: 1326291 - DNA, 22 bp, Artificial Sequence
  chemically synthesized
acagggcttcctggtgatctat

SEQ ID NO: 1326292 - DNA, 22 bp, Artificial Sequence
  chemically synthesized
cctggtgatctatttcctcata

SEQ ID NO: 1326293 - DNA, 22 bp, Artificial Sequence
  chemically synthesized
ctggtgatctatttcctcatat

SEQ ID NO: 1326294 - DNA, 22 bp, Artificial Sequence
  chemically synthesized
gtgatctatttcctcatatttt

SEQ ID NO: 1326295 - DNA, 22 bp, Artificial Sequence
  chemically synthesized
tttcctcatattttttcctcct

SEQ ID NO: 1326296 - DNA, 22 bp, Artificial Sequence
  chemically synthesized
tgaggcaaataatgaggaggaa

SEQ ID NO: 1326297 - DNA, 22 bp, Artificial Sequence
  chemically synthesized
cctcatattttttcctcctcat

SEQ ID NO: 1326298 - DNA, 22 bp, Artificial Sequence
  chemically synthesized
ctcatattttttcctcctcatt

SEQ ID NO: 1326299 - DNA, 22 bp, Artificial Sequence
  chemically synthesized
atattttttcctcctcattatt

SEQ ID NO: 1326300 - DNA, 22 bp, Artificial Sequence
  chemically synthesized
aaaacattatgaggcaaataat

SEQ ID NO: 1326301 - DNA, 22 bp, Artificial Sequence
  chemically synthesized
tttcctcctcattatttgcctc

SEQ ID NO: 1326302 - DNA, 22 bp, Artificial Sequence
  chemically synthesized
ttcctcctcattatttgcctca

SEQ ID NO: 1326303 - DNA, 22 bp, Artificial Sequence
  chemically synthesized
tcctcctcattatttgcctcat

SEQ ID NO: 1326304 - DNA, 22 bp, Artificial Sequence
  chemically synthesized
cctcctcattatttgcctcata

SEQ ID NO: 1326305 - DNA, 22 bp, Artificial Sequence
  chemically synthesized
ctcctcattatttgcctcataa

SEQ ID NO: 1326306 - DNA, 22 bp, Artificial Sequence
  chemically synthesized
ctcattatttgcctcataatgt

SEQ ID NO: 1326307 - DNA, 22 bp, Artificial Sequence
  chemically synthesized
attatttgcctcataatgtttt

SEQ ID NO: 1326308 - DNA, 22 bp, Artificial Sequence
  chemically synthesized
tttgcctcataatgttttgaac

SEQ ID NO: 1326309 - DNA, 22 bp, Artificial Sequence
  chemically synthesized
aagacagtggatgtgttcaaaa

SEQ ID NO: 1326310 - DNA, 22 bp, Artificial Sequence
  chemically synthesized
gcctcataatgttttgaacaca

SEQ ID NO: 1326311 - DNA, 22 bp, Artificial Sequence
  chemically synthesized
cctcataatgttttgaacacat

SEQ ID NO: 1326312 - DNA, 22 bp, Artificial Sequence
  chemically synthesized
ttgaagacagtggatgtgttca

SEQ ID NO: 1326313 - DNA, 22 bp, Artificial Sequence
  chemically synthesized
attgaagacagtggatgtgttc

SEQ ID NO: 1326314 - DNA, 22 bp, Artificial Sequence
  chemically synthesized
ataatgttttgaacacatccac

SEQ ID NO: 1326315 - DNA, 22 bp, Artificial Sequence
  chemically synthesized
tgaacacatccactgtcttcaa

SEQ ID NO: 1326316 - DNA, 22 bp, Artificial Sequence
  chemically synthesized
gaacacatccactgtcttcaat

SEQ ID NO: 1326317 - DNA, 22 bp, Artificial Sequence
  chemically synthesized
taagggaagcttattgaagaca

SEQ ID NO: 1326318 - DNA, 22 bp, Artificial Sequence
  chemically synthesized
aacacatccactgtcttcaata

SEQ ID NO: 1326319 - DNA, 22 bp, Artificial Sequence
  chemically synthesized
atgttgtaagggaagcttattg

SEQ ID NO: 1326320 - DNA, 22 bp, Artificial Sequence
  chemically synthesized
gatgttgtaagggaagcttatt

SEQ ID NO: 1326321 - DNA, 22 bp, Artificial Sequence
  chemically synthesized
tcttcaataagcttcccttaca

SEQ ID NO: 1326322 - DNA, 22 bp, Artificial Sequence
  chemically synthesized
caataagcttcccttacaacat

SEQ ID NO: 1326323 - DNA, 22 bp, Artificial Sequence
  chemically synthesized
aataagcttcccttacaacatc

SEQ ID NO: 1326324 - DNA, 22 bp, Artificial Sequence
  chemically synthesized
cccttacaacatcaaatgtgat

SEQ ID NO: 1326325 - DNA, 22 bp, Artificial Sequence
  chemically synthesized
ccttacaacatcaaatgtgatt

SEQ ID NO: 1326326 - DNA, 22 bp, Artificial Sequence
  chemically synthesized
acaacatcaaatgtgatttcac

SEQ ID NO: 1326327 - DNA, 22 bp, Artificial Sequence
  chemically synthesized
caacatcaaatgtgatttcacc

SEQ ID NO: 1326328 - DNA, 22 bp, Artificial Sequence
  chemically synthesized
gaagtgaataggggaaaatagg

SEQ ID NO: 1326329 - DNA, 22 bp, Artificial Sequence
  chemically synthesized
ttggaagtgaataggggaaaat

SEQ ID NO: 1326330 - DNA, 22 bp, Artificial Sequence
  chemically synthesized
tgttggaagtgaataggggaaa

SEQ ID NO: 1326331 - DNA, 22 bp, Artificial Sequence
  chemically synthesized
cacctattttcccctattcact

SEQ ID NO: 1326332 - DNA, 22 bp, Artificial Sequence
  chemically synthesized
acctattttcccctattcactt

SEQ ID NO: 1326333 - DNA, 22 bp, Artificial Sequence
  chemically synthesized
aaatctctgttggaagtgaata

SEQ ID NO: 1326334 - DNA, 22 bp, Artificial Sequence
  chemically synthesized
ttttcccctattcacttccaac

SEQ ID NO: 1326335 - DNA, 22 bp, Artificial Sequence
  chemically synthesized
tcccctattcacttccaacaga

SEQ ID NO: 1326336 - DNA, 22 bp, Artificial Sequence
  chemically synthesized
cccctattcacttccaacagag

SEQ ID NO: 1326337 - DNA, 22 bp, Artificial Sequence
  chemically synthesized
ccctattcacttccaacagaga

SEQ ID NO: 1326338 - DNA, 22 bp, Artificial Sequence
  chemically synthesized
ataaccaactaaaatctctgtt

SEQ ID NO: 1326339 - DNA, 22 bp, Artificial Sequence
  chemically synthesized
ttcacttccaacagagatttta

SEQ ID NO: 1326340 - DNA, 22 bp, Artificial Sequence
  chemically synthesized
acttccaacagagattttagtt

SEQ ID NO: 1326341 - DNA, 22 bp, Artificial Sequence
  chemically synthesized
ccaacagagattttagttggtt

SEQ ID NO: 1326342 - DNA, 22 bp, Artificial Sequence
  chemically synthesized
caacagagattttagttggtta

SEQ ID NO: 1326343 - DNA, 22 bp, Artificial Sequence
  chemically synthesized
tcagccacaacaggatctgata

SEQ ID NO: 1326344 - DNA, 22 bp, Artificial Sequence
  chemically synthesized
tagttggttatcagatcctgtt

SEQ ID NO: 1326345 - DNA, 22 bp, Artificial Sequence
  chemically synthesized
agttggttatcagatcctgttg

SEQ ID NO: 1326346 - DNA, 22 bp, Artificial Sequence
  chemically synthesized
gttggttatcagatcctgttgt

SEQ ID NO: 1326347 - DNA, 22 bp, Artificial Sequence
  chemically synthesized
atgcctgtcagccacaacagga

SEQ ID NO: 1326348 - DNA, 22 bp, Artificial Sequence
  chemically synthesized
taatgcctgtcagccacaacag

SEQ ID NO: 1326349 - DNA, 22 bp, Artificial Sequence
  chemically synthesized
gttatcagatcctgttgtggct

SEQ ID NO: 1326350 - DNA, 22 bp, Artificial Sequence
  chemically synthesized
ctaatgcctgtcagccacaaca

SEQ ID NO: 1326351 - DNA, 22 bp, Artificial Sequence
  chemically synthesized
tttctaatgcctgtcagccaca

SEQ ID NO: 1326352 - DNA, 22 bp, Artificial Sequence
  chemically synthesized
tcagatcctgttgtggctgaca

SEQ ID NO: 1326353 - DNA, 22 bp, Artificial Sequence
  chemically synthesized
tatttctaatgcctgtcagcca

SEQ ID NO: 1326354 - DNA, 22 bp, Artificial Sequence
  chemically synthesized
ctatttctaatgcctgtcagcc

SEQ ID NO: 1326355 - DNA, 22 bp, Artificial Sequence
  chemically synthesized
tctatttctaatgcctgtcagc

SEQ ID NO: 1326356 - DNA, 22 bp, Artificial Sequence
  chemically synthesized
ttgtggctgacaggcattagaa

SEQ ID NO: 1326357 - DNA, 22 bp, Artificial Sequence
  chemically synthesized
ataattttctatttctaatgcc

SEQ ID NO: 1326358 - DNA, 22 bp, Artificial Sequence
  chemically synthesized
gataattttctatttctaatgc

SEQ ID NO: 1326359 - DNA, 22 bp, Artificial Sequence
  chemically synthesized
tggctgacaggcattagaaata

SEQ ID NO: 1326360 - DNA, 22 bp, Artificial Sequence
  chemically synthesized
acaggcattagaaatagaaaat

SEQ ID NO: 1326361 - DNA, 22 bp, Artificial Sequence
  chemically synthesized
aagtaacttgataattttctat

SEQ ID NO: 1326362 - DNA, 22 bp, Artificial Sequence
  chemically synthesized
atggcctcaagtaacttgataa

SEQ ID NO: 1326363 - DNA, 22 bp, Artificial Sequence
  chemically synthesized
gaaatagaaaattatcaagtta

SEQ ID NO: 1326364 - DNA, 22 bp, Artificial Sequence
  chemically synthesized
catggcctcaagtaacttgata

SEQ ID NO: 1326365 - DNA, 22 bp, Artificial Sequence
  chemically synthesized
aatttcatggcctcaagtaact

SEQ ID NO: 1326366 - DNA, 22 bp, Artificial Sequence
  chemically synthesized
gccctcaatttcatggcctcaa

SEQ ID NO: 1326367 - DNA, 22 bp, Artificial Sequence
  chemically synthesized
ggccctcaatttcatggcctca

SEQ ID NO: 1326368 - DNA, 22 bp, Artificial Sequence
  chemically synthesized
tcaagttacttgaggccatgaa

SEQ ID NO: 1326369 - DNA, 22 bp, Artificial Sequence
  chemically synthesized
tgtttggccctcaatttcatgg

SEQ ID NO: 1326370 - DNA, 22 bp, Artificial Sequence
  chemically synthesized
cttgaggccatgaaattgaggg

SEQ ID NO: 1326371 - DNA, 22 bp, Artificial Sequence
  chemically synthesized
gaggccatgaaattgagggcca

SEQ ID NO: 1326372 - DNA, 22 bp, Artificial Sequence
  chemically synthesized
gaaatctgtgtttggccctcaa

SEQ ID NO: 1326373 - DNA, 22 bp, Artificial Sequence
  chemically synthesized
aggccatgaaattgagggccaa

SEQ ID NO: 1326374 - DNA, 22 bp, Artificial Sequence
  chemically synthesized
ggaaatctgtgtttggccctca

SEQ ID NO: 1326375 - DNA, 22 bp, Artificial Sequence
  chemically synthesized
tggaaatctgtgtttggccctc

SEQ ID NO: 1326376 - DNA, 22 bp, Artificial Sequence
  chemically synthesized
ttggaaatctgtgtttggccct

SEQ ID NO: 1326377 - DNA, 22 bp, Artificial Sequence
  chemically synthesized
tttggaaatctgtgtttggccc

SEQ ID NO: 1326378 - DNA, 22 bp, Artificial Sequence
  chemically synthesized
agggccaaacacagatttccaa

SEQ ID NO: 1326379 - DNA, 22 bp, Artificial Sequence
  chemically synthesized
ccaaaaagcttgctgttttcga

SEQ ID NO: 1326380 - DNA, 22 bp, Artificial Sequence
  chemically synthesized
caaaaagcttgctgttttcgat

SEQ ID NO: 1326381 - DNA, 22 bp, Artificial Sequence
  chemically synthesized
aagacataaccatatcgaaaac

SEQ ID NO: 1326382 - DNA, 22 bp, Artificial Sequence
  chemically synthesized
gctgttttcgatatggttatgt

SEQ ID NO: 1326383 - DNA, 22 bp, Artificial Sequence
  chemically synthesized
ctgttttcgatatggttatgtc

SEQ ID NO: 1326384 - DNA, 22 bp, Artificial Sequence
  chemically synthesized
ttttcgatatggttatgtcttc

SEQ ID NO: 1326385 - DNA, 22 bp, Artificial Sequence
  chemically synthesized
tcgatatggttatgtcttcagc

SEQ ID NO: 1326386 - DNA, 22 bp, Artificial Sequence
  chemically synthesized
cgatatggttatgtcttcagcc

SEQ ID NO: 1326387 - DNA, 22 bp, Artificial Sequence
  chemically synthesized
gatatggttatgtcttcagccc

SEQ ID NO: 1326388 - DNA, 22 bp, Artificial Sequence
  chemically synthesized
gcatgacaggatgtgggctgaa

SEQ ID NO: 1326389 - DNA, 22 bp, Artificial Sequence
  chemically synthesized
ccctagcatgacaggatgtggg

SEQ ID NO: 1326390 - DNA, 22 bp, Artificial Sequence
  chemically synthesized
tgtcttcagcccacatcctgtc

SEQ ID NO: 1326391 - DNA, 22 bp, Artificial Sequence
  chemically synthesized
cagcccacatcctgtcatgcta

SEQ ID NO: 1326392 - DNA, 22 bp, Artificial Sequence
  chemically synthesized
agcccacatcctgtcatgctag

SEQ ID NO: 1326393 - DNA, 22 bp, Artificial Sequence
  chemically synthesized
taaatggaaaactgccctagca

SEQ ID NO: 1326394 - DNA, 22 bp, Artificial Sequence
  chemically synthesized
tgtaaatggaaaactgccctag

SEQ ID NO: 1326395 - DNA, 22 bp, Artificial Sequence
  chemically synthesized
ctgtaaatggaaaactgcccta

SEQ ID NO: 1326396 - DNA, 22 bp, Artificial Sequence
  chemically synthesized
cttctgtaaatggaaaactgcc

SEQ ID NO: 1326397 - DNA, 22 bp, Artificial Sequence
  chemically synthesized
gcttctgtaaatggaaaactgc

SEQ ID NO: 1326398 - DNA, 22 bp, Artificial Sequence
  chemically synthesized
tcatgctagggcagttttccat

SEQ ID NO: 1326399 - DNA, 22 bp, Artificial Sequence
  chemically synthesized
cagccacttgcttctgtaaatg

SEQ ID NO: 1326400 - DNA, 22 bp, Artificial Sequence
  chemically synthesized
gggcagttttccatttacagaa

SEQ ID NO: 1326401 - DNA, 22 bp, Artificial Sequence
  chemically synthesized
acagccacttgcttctgtaaat

SEQ ID NO: 1326402 - DNA, 22 bp, Artificial Sequence
  chemically synthesized
tccatttacagaagcaagtggc

SEQ ID NO: 1326403 - DNA, 22 bp, Artificial Sequence
  chemically synthesized
ccatttacagaagcaagtggct

SEQ ID NO: 1326404 - DNA, 22 bp, Artificial Sequence
  chemically synthesized
catttacagaagcaagtggctg

SEQ ID NO: 1326405 - DNA, 22 bp, Artificial Sequence
  chemically synthesized
ccacaaaaccttacagccactt

SEQ ID NO: 1326406 - DNA, 22 bp, Artificial Sequence
  chemically synthesized
acagaagcaagtggctgtaagg

SEQ ID NO: 1326407 - DNA, 22 bp, Artificial Sequence
  chemically synthesized
actaccacaaaaccttacagcc

SEQ ID NO: 1326408 - DNA, 22 bp, Artificial Sequence
  chemically synthesized
cagaagcaagtggctgtaaggt

SEQ ID NO: 1326409 - DNA, 22 bp, Artificial Sequence
  chemically synthesized
cctgactaccacaaaaccttac

SEQ ID NO: 1326410 - DNA, 22 bp, Artificial Sequence
  chemically synthesized
tgacatctacctgactaccaca

SEQ ID NO: 1326411 - DNA, 22 bp, Artificial Sequence
  chemically synthesized
taaggttttgtggtagtcaggt

SEQ ID NO: 1326412 - DNA, 22 bp, Artificial Sequence
  chemically synthesized
cgctgtgacatctacctgacta

SEQ ID NO: 1326413 - DNA, 22 bp, Artificial Sequence
  chemically synthesized
gcgctgtgacatctacctgact

SEQ ID NO: 1326414 - DNA, 22 bp, Artificial Sequence
  chemically synthesized
tttgcgctgtgacatctacctg

SEQ ID NO: 1326415 - DNA, 22 bp, Artificial Sequence
  chemically synthesized
tgtggtagtcaggtagatgtca

SEQ ID NO: 1326416 - DNA, 22 bp, Artificial Sequence
  chemically synthesized
ctgtttgcgctgtgacatctac

SEQ ID NO: 1326417 - DNA, 22 bp, Artificial Sequence
  chemically synthesized
gtggtagtcaggtagatgtcac

SEQ ID NO: 1326418 - DNA, 22 bp, Artificial Sequence
  chemically synthesized
tggtagtcaggtagatgtcaca

SEQ ID NO: 1326419 - DNA, 22 bp, Artificial Sequence
  chemically synthesized
attcctgtttgcgctgtgacat

SEQ ID NO: 1326420 - DNA, 22 bp, Artificial Sequence
  chemically synthesized
agttaattcctgtttgcgctgt

SEQ ID NO: 1326421 - DNA, 22 bp, Artificial Sequence
  chemically synthesized
tacgtattgagttaattcctgt

SEQ ID NO: 1326422 - DNA, 22 bp, Artificial Sequence
  chemically synthesized
atacgtattgagttaattcctg

SEQ ID NO: 1326423 - DNA, 22 bp, Artificial Sequence
  chemically synthesized
tatacgtattgagttaattcct

SEQ ID NO: 1326424 - DNA, 22 bp, Artificial Sequence
  chemically synthesized
ttatacgtattgagttaattcc

SEQ ID NO: 1326425 - DNA, 22 bp, Artificial Sequence
  chemically synthesized
ttttatacgtattgagttaatt

SEQ ID NO: 1326426 - DNA, 22 bp, Artificial Sequence
  chemically synthesized
tcttttatacgtattgagttaa

SEQ ID NO: 1326427 - DNA, 22 bp, Artificial Sequence
  chemically synthesized
ctcttttatacgtattgagtta

SEQ ID NO: 1326428 - DNA, 22 bp, Artificial Sequence
  chemically synthesized
tctcttttatacgtattgagtt

SEQ ID NO: 1326429 - DNA, 22 bp, Artificial Sequence
  chemically synthesized
gaaagctttctcttttatacgt

SEQ ID NO: 1326430 - DNA, 22 bp, Artificial Sequence
  chemically synthesized
cgaaagctttctcttttatacg

SEQ ID NO: 1326431 - DNA, 22 bp, Artificial Sequence
  chemically synthesized
tcgaaagctttctcttttatac

SEQ ID NO: 1326432 - DNA, 22 bp, Artificial Sequence
  chemically synthesized
ttcgaaagctttctcttttata

SEQ ID NO: 1326433 - DNA, 22 bp, Artificial Sequence
  chemically synthesized
actcaatacgtataaaagagaa

SEQ ID NO: 1326434 - DNA, 22 bp, Artificial Sequence
  chemically synthesized
ttttcgaaagctttctctttta

SEQ ID NO: 1326435 - DNA, 22 bp, Artificial Sequence
  chemically synthesized
cttttcgaaagctttctctttt

SEQ ID NO: 1326436 - DNA, 22 bp, Artificial Sequence
  chemically synthesized
aatacgtataaaagagaaagct

SEQ ID NO: 1326437 - DNA, 22 bp, Artificial Sequence
  chemically synthesized
aacttcttttcgaaagctttct

SEQ ID NO: 1326438 - DNA, 22 bp, Artificial Sequence
  chemically synthesized
aaacttcttttcgaaagctttc

SEQ ID NO: 1326439 - DNA, 22 bp, Artificial Sequence
  chemically synthesized
cacccggccttaaacttctttt

SEQ ID NO: 1326440 - DNA, 22 bp, Artificial Sequence
  chemically synthesized
agtcactgcacccggccttaaa

SEQ ID NO: 1326441 - DNA, 22 bp, Artificial Sequence
  chemically synthesized
tcgaaaagaagtttaaggccgg

SEQ ID NO: 1326442 - DNA, 22 bp, Artificial Sequence
  chemically synthesized
cgaaaagaagtttaaggccggg

SEQ ID NO: 1326443 - DNA, 22 bp, Artificial Sequence
  chemically synthesized
gaaaagaagtttaaggccgggt

SEQ ID NO: 1326444 - DNA, 22 bp, Artificial Sequence
  chemically synthesized
caggcgttgagtcactgcaccc

SEQ ID NO: 1326445 - DNA, 22 bp, Artificial Sequence
  chemically synthesized
aaggccgggtgcagtgactcaa

SEQ ID NO: 1326446 - DNA, 22 bp, Artificial Sequence
  chemically synthesized
ggattacaggcgttgagtcact

SEQ ID NO: 1326447 - DNA, 22 bp, Artificial Sequence
  chemically synthesized
aggccgggtgcagtgactcaac

SEQ ID NO: 1326448 - DNA, 22 bp, Artificial Sequence
  chemically synthesized
cgaaagtgctgggattacaggc

SEQ ID NO: 1326449 - DNA, 22 bp, Artificial Sequence
  chemically synthesized
cctccgaaagtgctgggattac

SEQ ID NO: 1326450 - DNA, 22 bp, Artificial Sequence
  chemically synthesized
tgcctccgaaagtgctgggatt

SEQ ID NO: 1326451 - DNA, 22 bp, Artificial Sequence
  chemically synthesized
aacgcctgtaatcccagcactt

SEQ ID NO: 1326452 - DNA, 22 bp, Artificial Sequence
  chemically synthesized
taatcccagcactttcggaggc

SEQ ID NO: 1326453 - DNA, 22 bp, Artificial Sequence
  chemically synthesized
aggtgatccgcccacctctgcc

SEQ ID NO: 1326454 - DNA, 22 bp, Artificial Sequence
  chemically synthesized
acctcaggtgatccgcccacct

SEQ ID NO: 1326455 - DNA, 22 bp, Artificial Sequence
  chemically synthesized
tcggaggcagaggtgggcggat

SEQ ID NO: 1326456 - DNA, 22 bp, Artificial Sequence
  chemically synthesized
cggaggcagaggtgggcggatc

SEQ ID NO: 1326457 - DNA, 22 bp, Artificial Sequence
  chemically synthesized
ctgacctcaggtgatccgccca

SEQ ID NO: 1326458 - DNA, 22 bp, Artificial Sequence
  chemically synthesized
ggaggcagaggtgggcggatca

SEQ ID NO: 1326459 - DNA, 22 bp, Artificial Sequence
  chemically synthesized
aactcctgacctcaggtgatcc

SEQ ID NO: 1326460 - DNA, 22 bp, Artificial Sequence
  chemically synthesized
gaactcctgacctcaggtgatc

SEQ ID NO: 1326461 - DNA, 22 bp, Artificial Sequence
  chemically synthesized
gtcttgaactcctgacctcagg

SEQ ID NO: 1326462 - DNA, 22 bp, Artificial Sequence
  chemically synthesized
gccaggctggtcttgaactcct

SEQ ID NO: 1326463 - DNA, 22 bp, Artificial Sequence
  chemically synthesized
aggtcaggagttcaagaccagc

SEQ ID NO: 1326464 - DNA, 22 bp, Artificial Sequence
  chemically synthesized
accatgttggccaggctggtct

SEQ ID NO: 1326465 - DNA, 22 bp, Artificial Sequence
  chemically synthesized
caccatgttggccaggctggtc

SEQ ID NO: 1326466 - DNA, 22 bp, Artificial Sequence
  chemically synthesized
aagaccagcctggccaacatgg

SEQ ID NO: 1326467 - DNA, 22 bp, Artificial Sequence
  chemically synthesized
gtagagacggggtttcaccatg

SEQ ID NO: 1326468 - DNA, 22 bp, Artificial Sequence
  chemically synthesized
agtagagacggggtttcaccat

SEQ ID NO: 1326469 - DNA, 22 bp, Artificial Sequence
  chemically synthesized
tagtagagacggggtttcacca

SEQ ID NO: 1326470 - DNA, 22 bp, Artificial Sequence
  chemically synthesized
ttagtagagacggggtttcacc

SEQ ID NO: 1326471 - DNA, 22 bp, Artificial Sequence
  chemically synthesized
gccaacatggtgaaaccccgtc

SEQ ID NO: 1326472 - DNA, 22 bp, Artificial Sequence
  chemically synthesized
tatttttagtagagacggggtt

SEQ ID NO: 1326473 - DNA, 22 bp, Artificial Sequence
  chemically synthesized
gtatttttagtagagacggggt

SEQ ID NO: 1326474 - DNA, 22 bp, Artificial Sequence
  chemically synthesized
tgtatttttagtagagacgggg

SEQ ID NO: 1326475 - DNA, 22 bp, Artificial Sequence
  chemically synthesized
ttgtatttttagtagagacggg

SEQ ID NO: 1326476 - DNA, 22 bp, Artificial Sequence
  chemically synthesized
atttttgtatttttagtagaga

SEQ ID NO: 1326477 - DNA, 22 bp, Artificial Sequence
  chemically synthesized
tactaaaaatacaaaaattagc

SEQ ID NO: 1326478 - DNA, 22 bp, Artificial Sequence
  chemically synthesized
ctaaaaatacaaaaattagctg

SEQ ID NO: 1326479 - DNA, 22 bp, Artificial Sequence
  chemically synthesized
aaaatacaaaaattagctggct

SEQ ID NO: 1326480 - DNA, 22 bp, Artificial Sequence
  chemically synthesized
caggcatccgccaccacagcca

SEQ ID NO: 1326481 - DNA, 22 bp, Artificial Sequence
  chemically synthesized
ggattacaggcatccgccacca

SEQ ID NO: 1326482 - DNA, 22 bp, Artificial Sequence
  chemically synthesized
gctggctgtggtggcggatgcc

SEQ ID NO: 1326483 - DNA, 22 bp, Artificial Sequence
  chemically synthesized
gctgtggtggcggatgcctgta

SEQ ID NO: 1326484 - DNA, 22 bp, Artificial Sequence
  chemically synthesized
ccgagtagctgggattacaggc

SEQ ID NO: 1326485 - DNA, 22 bp, Artificial Sequence
  chemically synthesized
tggtggcggatgcctgtaatcc

SEQ ID NO: 1326486 - DNA, 22 bp, Artificial Sequence
  chemically synthesized
agcctcccgagtagctgggatt

SEQ ID NO: 1326487 - DNA, 22 bp, Artificial Sequence
  chemically synthesized
cctcagcctcccgagtagctgg

SEQ ID NO: 1326488 - DNA, 22 bp, Artificial Sequence
  chemically synthesized
tgcctcagcctcccgagtagct

SEQ ID NO: 1326489 - DNA, 22 bp, Artificial Sequence
  chemically synthesized
ctgcctcagcctcccgagtagc

SEQ ID NO: 1326490 - DNA, 22 bp, Artificial Sequence
  chemically synthesized
ttctgcctcagcctcccgagta

SEQ ID NO: 1326491 - DNA, 22 bp, Artificial Sequence
  chemically synthesized
taatcccagctactcgggaggc

SEQ ID NO: 1326492 - DNA, 22 bp, Artificial Sequence
  chemically synthesized
aagagattcttctgcctcagcc

SEQ ID NO: 1326493 - DNA, 22 bp, Artificial Sequence
  chemically synthesized
ctcgggaggctgaggcagaaga

SEQ ID NO: 1326494 - DNA, 22 bp, Artificial Sequence
  chemically synthesized
agttaaagagattcttctgcct

SEQ ID NO: 1326495 - DNA, 22 bp, Artificial Sequence
  chemically synthesized
gggaggctgaggcagaagaatc

SEQ ID NO: 1326496 - DNA, 22 bp, Artificial Sequence
  chemically synthesized
ctgagttaaagagattcttctg

SEQ ID NO: 1326497 - DNA, 22 bp, Artificial Sequence
  chemically synthesized
cgcctcctgagttaaagagatt

SEQ ID NO: 1326498 - DNA, 22 bp, Artificial Sequence
  chemically synthesized
aggcagaagaatctctttaact

SEQ ID NO: 1326499 - DNA, 22 bp, Artificial Sequence
  chemically synthesized
caacctccgcctcctgagttaa

SEQ ID NO: 1326500 - DNA, 22 bp, Artificial Sequence
  chemically synthesized
actgcaacctccgcctcctgag

SEQ ID NO: 1326501 - DNA, 22 bp, Artificial Sequence
  chemically synthesized
ggctcactgcaacctccgcctc

SEQ ID NO: 1326502 - DNA, 22 bp, Artificial Sequence
  chemically synthesized
tttaactcaggaggcggaggtt

SEQ ID NO: 1326503 - DNA, 22 bp, Artificial Sequence
  chemically synthesized
taactcaggaggcggaggttgc

SEQ ID NO: 1326504 - DNA, 22 bp, Artificial Sequence
  chemically synthesized
aactcaggaggcggaggttgca

SEQ ID NO: 1326505 - DNA, 22 bp, Artificial Sequence
  chemically synthesized
actcaggaggcggaggttgcag

SEQ ID NO: 1326506 - DNA, 22 bp, Artificial Sequence
  chemically synthesized
aggaggcggaggttgcagtgag

SEQ ID NO: 1326507 - DNA, 22 bp, Artificial Sequence
  chemically synthesized
gagtgcaatgatgccatctcgg

SEQ ID NO: 1326508 - DNA, 22 bp, Artificial Sequence
  chemically synthesized
cagtgagccgagatggcatcat

SEQ ID NO: 1326509 - DNA, 22 bp, Artificial Sequence
  chemically synthesized
ccgaggctggagtgcaatgatg

SEQ ID NO: 1326510 - DNA, 22 bp, Artificial Sequence
  chemically synthesized
ttgccgaggctggagtgcaatg

SEQ ID NO: 1326511 - DNA, 22 bp, Artificial Sequence
  chemically synthesized
gttgccgaggctggagtgcaat

SEQ ID NO: 1326512 - DNA, 22 bp, Artificial Sequence
  chemically synthesized
ttgttgccgaggctggagtgca

SEQ ID NO: 1326513 - DNA, 22 bp, Artificial Sequence
  chemically synthesized
gctcttgttgccgaggctggag

SEQ ID NO: 1326514 - DNA, 22 bp, Artificial Sequence
  chemically synthesized
cgctcttgttgccgaggctgga

SEQ ID NO: 1326515 - DNA, 22 bp, Artificial Sequence
  chemically synthesized
cactccagcctcggcaacaaga

SEQ ID NO: 1326516 - DNA, 22 bp, Artificial Sequence
  chemically synthesized
cagcctcggcaacaagagcgaa

SEQ ID NO: 1326517 - DNA, 22 bp, Artificial Sequence
  chemically synthesized
ggcaacaagagcgaagctctgt

SEQ ID NO: 1326518 - DNA, 22 bp, Artificial Sequence
  chemically synthesized
ggggggggggggggacagagct

SEQ ID NO: 1326519 - DNA, 22 bp, Artificial Sequence
  chemically synthesized
tgtgtgttgggggggggggggg

SEQ ID NO: 1326520 - DNA, 22 bp, Artificial Sequence
  chemically synthesized
gtgtgtgttggggggggggggg

SEQ ID NO: 1326521 - DNA, 22 bp, Artificial Sequence
  chemically synthesized
tgtgtgtgttgggggggggggg

SEQ ID NO: 1326522 - DNA, 22 bp, Artificial Sequence
  chemically synthesized
ttgtgtgtgttggggggggggg

SEQ ID NO: 1326523 - DNA, 22 bp, Artificial Sequence
  chemically synthesized
tttgtgtgtgttgggggggggg

SEQ ID NO: 1326524 - DNA, 22 bp, Artificial Sequence
  chemically synthesized
ttttgtgtgtgttggggggggg

SEQ ID NO: 1326525 - DNA, 22 bp, Artificial Sequence
  chemically synthesized
tttttgtgtgtgttgggggggg

SEQ ID NO: 1326526 - DNA, 22 bp, Artificial Sequence
  chemically synthesized
tgtcccccccccccccccaaca

SEQ ID NO: 1326527 - DNA, 22 bp, Artificial Sequence
  chemically synthesized
ttttttttgtgtgtgttggggg

SEQ ID NO: 1326528 - DNA, 22 bp, Artificial Sequence
  chemically synthesized
tcccccccccccccccaacaca

SEQ ID NO: 1326529 - DNA, 22 bp, Artificial Sequence
  chemically synthesized
ctgttttttttgtgtgtgttgg

SEQ ID NO: 1326530 - DNA, 22 bp, Artificial Sequence
  chemically synthesized
ttgctgttttttttgtgtgtgt

SEQ ID NO: 1326531 - DNA, 22 bp, Artificial Sequence
  chemically synthesized
ttgttgctgttttttttgtgtg

SEQ ID NO: 1326532 - DNA, 22 bp, Artificial Sequence
  chemically synthesized
ttgttgttgctgttttttttgt

SEQ ID NO: 1326533 - DNA, 22 bp, Artificial Sequence
  chemically synthesized
gttgttgttgctgttttttttg

SEQ ID NO: 1326534 - DNA, 22 bp, Artificial Sequence
  chemically synthesized
tgttgttgttgctgtttttttt

SEQ ID NO: 1326535 - DNA, 22 bp, Artificial Sequence
  chemically synthesized
ttgttgttgttgctgttttttt

SEQ ID NO: 1326536 - DNA, 22 bp, Artificial Sequence
  chemically synthesized
tttgttgttgttgctgtttttt

SEQ ID NO: 1326537 - DNA, 22 bp, Artificial Sequence
  chemically synthesized
ttttttgttgttgttgctgttt

SEQ ID NO: 1326538 - DNA, 22 bp, Artificial Sequence
  chemically synthesized
gttttttgttgttgttgctgtt

SEQ ID NO: 1326539 - DNA, 22 bp, Artificial Sequence
  chemically synthesized
tgttttttgttgttgttgctgt

SEQ ID NO: 1326540 - DNA, 22 bp, Artificial Sequence
  chemically synthesized
tacacaaactttgttttttgtt

SEQ ID NO: 1326541 - DNA, 22 bp, Artificial Sequence
  chemically synthesized
gcatgtattatacacaaacttt

SEQ ID NO: 1326542 - DNA, 22 bp, Artificial Sequence
  chemically synthesized
ggcatgtattatacacaaactt

SEQ ID NO: 1326543 - DNA, 22 bp, Artificial Sequence
  chemically synthesized
ttggcatgtattatacacaaac

SEQ ID NO: 1326544 - DNA, 22 bp, Artificial Sequence
  chemically synthesized
ccctcttggcatgtattataca

SEQ ID NO: 1326545 - DNA, 22 bp, Artificial Sequence
  chemically synthesized
ctaccctcttggcatgtattat

SEQ ID NO: 1326546 - DNA, 22 bp, Artificial Sequence
  chemically synthesized
ttcctaccctcttggcatgtat

SEQ ID NO: 1326547 - DNA, 22 bp, Artificial Sequence
  chemically synthesized
attcctaccctcttggcatgta

SEQ ID NO: 1326548 - DNA, 22 bp, Artificial Sequence
  chemically synthesized
tattcctaccctcttggcatgt

SEQ ID NO: 1326549 - DNA, 22 bp, Artificial Sequence
  chemically synthesized
gtgtataatacatgccaagagg

SEQ ID NO: 1326550 - DNA, 22 bp, Artificial Sequence
  chemically synthesized
tgtataatacatgccaagaggg

SEQ ID NO: 1326551 - DNA, 22 bp, Artificial Sequence
  chemically synthesized
acagcaaatggtattttattcc

SEQ ID NO: 1326552 - DNA, 22 bp, Artificial Sequence
  chemically synthesized
gacagcaaatggtattttattc

SEQ ID NO: 1326553 - DNA, 22 bp, Artificial Sequence
  chemically synthesized
gaaatatatcttgacagcaaat

SEQ ID NO: 1326554 - DNA, 22 bp, Artificial Sequence
  chemically synthesized
agaaatatatcttgacagcaaa

SEQ ID NO: 1326555 - DNA, 22 bp, Artificial Sequence
  chemically synthesized
tttagaaatatatcttgacagc

SEQ ID NO: 1326556 - DNA, 22 bp, Artificial Sequence
  chemically synthesized
gtttagaaatatatcttgacag

SEQ ID NO: 1326557 - DNA, 22 bp, Artificial Sequence
  chemically synthesized
ataaacttgtttagaaatatat

SEQ ID NO: 1326558 - DNA, 22 bp, Artificial Sequence
  chemically synthesized
gctgtcaagatatatttctaaa

SEQ ID NO: 1326559 - DNA, 22 bp, Artificial Sequence
  chemically synthesized
ctaataaacttgtttagaaata

SEQ ID NO: 1326560 - DNA, 22 bp, Artificial Sequence
  chemically synthesized
ctgtcaagatatatttctaaac

SEQ ID NO: 1326561 - DNA, 22 bp, Artificial Sequence
  chemically synthesized
cctaataaacttgtttagaaat

SEQ ID NO: 1326562 - DNA, 22 bp, Artificial Sequence
  chemically synthesized
tcaagatatatttctaaacaag

SEQ ID NO: 1326563 - DNA, 22 bp, Artificial Sequence
  chemically synthesized
ccttcctaataaacttgtttag

SEQ ID NO: 1326564 - DNA, 22 bp, Artificial Sequence
  chemically synthesized
ctgccttcctaataaacttgtt

SEQ ID NO: 1326565 - DNA, 22 bp, Artificial Sequence
  chemically synthesized
ctactgccttcctaataaactt

SEQ ID NO: 1326566 - DNA, 22 bp, Artificial Sequence
  chemically synthesized
ctaaacaagtttattaggaagg

SEQ ID NO: 1326567 - DNA, 22 bp, Artificial Sequence
  chemically synthesized
taaacaagtttattaggaaggc

SEQ ID NO: 1326568 - DNA, 22 bp, Artificial Sequence
  chemically synthesized
atatctgctactgccttcctaa

SEQ ID NO: 1326569 - DNA, 22 bp, Artificial Sequence
  chemically synthesized
catatctgctactgccttccta

SEQ ID NO: 1326570 - DNA, 22 bp, Artificial Sequence
  chemically synthesized
aacaagtttattaggaaggcag

SEQ ID NO: 1326571 - DNA, 22 bp, Artificial Sequence
  chemically synthesized
tcatatctgctactgccttcct

SEQ ID NO: 1326572 - DNA, 22 bp, Artificial Sequence
  chemically synthesized
ttcatatctgctactgccttcc

SEQ ID NO: 1326573 - DNA, 22 bp, Artificial Sequence
  chemically synthesized
tttcatatctgctactgccttc

SEQ ID NO: 1326574 - DNA, 22 bp, Artificial Sequence
  chemically synthesized
ttttcatatctgctactgcctt

SEQ ID NO: 1326575 - DNA, 22 bp, Artificial Sequence
  chemically synthesized
tttttcatatctgctactgcct

SEQ ID NO: 1326576 - DNA, 22 bp, Artificial Sequence
  chemically synthesized
ttttttcatatctgctactgcc

SEQ ID NO: 1326577 - DNA, 22 bp, Artificial Sequence
  chemically synthesized
tttttttttcatatctgctact

SEQ ID NO: 1326578 - DNA, 22 bp, Artificial Sequence
  chemically synthesized
attaggaaggcagtagcagata

SEQ ID NO: 1326579 - DNA, 22 bp, Artificial Sequence
  chemically synthesized
ttaggaaggcagtagcagatat

SEQ ID NO: 1326580 - DNA, 22 bp, Artificial Sequence
  chemically synthesized
ggaaggcagtagcagatatgaa

SEQ ID NO: 1326581 - DNA, 22 bp, Artificial Sequence
  chemically synthesized
tcctatttttttttcatatctg

SEQ ID NO: 1326582 - DNA, 22 bp, Artificial Sequence
  chemically synthesized
cagtgccctatcctattttttt

SEQ ID NO: 1326583 - DNA, 22 bp, Artificial Sequence
  chemically synthesized
ccagtgccctatcctatttttt

SEQ ID NO: 1326584 - DNA, 22 bp, Artificial Sequence
  chemically synthesized
tttccagtgccctatcctattt

SEQ ID NO: 1326585 - DNA, 22 bp, Artificial Sequence
  chemically synthesized
ttatttccagtgccctatccta

SEQ ID NO: 1326586 - DNA, 22 bp, Artificial Sequence
  chemically synthesized
attatttccagtgccctatcct

SEQ ID NO: 1326587 - DNA, 22 bp, Artificial Sequence
  chemically synthesized
aatttattatttccagtgccct

SEQ ID NO: 1326588 - DNA, 22 bp, Artificial Sequence
  chemically synthesized
aaatttattatttccagtgccc

SEQ ID NO: 1326589 - DNA, 22 bp, Artificial Sequence
  chemically synthesized
atttaaatttattatttccagt

SEQ ID NO: 1326590 - DNA, 22 bp, Artificial Sequence
  chemically synthesized
aaaaaatgctgatttaaattta

SEQ ID NO: 1326591 - DNA, 22 bp, Artificial Sequence
  chemically synthesized
aaaaaaatgctgatttaaattt

SEQ ID NO: 1326592 - DNA, 22 bp, Artificial Sequence
  chemically synthesized
gaaataataaatttaaatcagc

SEQ ID NO: 1326593 - DNA, 22 bp, Artificial Sequence
  chemically synthesized
aatttaaaaaaatgctgattta

SEQ ID NO: 1326594 - DNA, 22 bp, Artificial Sequence
  chemically synthesized
taaatttaaaaaaatgctgatt

SEQ ID NO: 1326595 - DNA, 22 bp, Artificial Sequence
  chemically synthesized
ctaaatttaaaaaaatgctgat

SEQ ID NO: 1326596 - DNA, 22 bp, Artificial Sequence
  chemically synthesized
tgaatttctaaatttaaaaaaa

SEQ ID NO: 1326597 - DNA, 22 bp, Artificial Sequence
  chemically synthesized
aaatcagcatttttttaaattt

SEQ ID NO: 1326598 - DNA, 22 bp, Artificial Sequence
  chemically synthesized
aatcagcatttttttaaattta

SEQ ID NO: 1326599 - DNA, 22 bp, Artificial Sequence
  chemically synthesized
gagattatgaatttctaaattt

SEQ ID NO: 1326600 - DNA, 22 bp, Artificial Sequence
  chemically synthesized
gttggagattatgaatttctaa

SEQ ID NO: 1326601 - DNA, 22 bp, Artificial Sequence
  chemically synthesized
ttggttggagattatgaatttc

SEQ ID NO: 1326602 - DNA, 22 bp, Artificial Sequence
  chemically synthesized
ttttaaatttagaaattcataa

SEQ ID NO: 1326603 - DNA, 22 bp, Artificial Sequence
  chemically synthesized
tttaaatttagaaattcataat

SEQ ID NO: 1326604 - DNA, 22 bp, Artificial Sequence
  chemically synthesized
tgttggttggagattatgaatt

SEQ ID NO: 1326605 - DNA, 22 bp, Artificial Sequence
  chemically synthesized
ttaaatttagaaattcataatc

SEQ ID NO: 1326606 - DNA, 22 bp, Artificial Sequence
  chemically synthesized
taaatttagaaattcataatct

SEQ ID NO: 1326607 - DNA, 22 bp, Artificial Sequence
  chemically synthesized
aaatttagaaattcataatctc

SEQ ID NO: 1326608 - DNA, 22 bp, Artificial Sequence
  chemically synthesized
aatttagaaattcataatctcc

SEQ ID NO: 1326609 - DNA, 22 bp, Artificial Sequence
  chemically synthesized
gttctgttggttggagattatg

SEQ ID NO: 1326610 - DNA, 22 bp, Artificial Sequence
  chemically synthesized
agaaattcataatctccaacca

SEQ ID NO: 1326611 - DNA, 22 bp, Artificial Sequence
  chemically synthesized
gaaattcataatctccaaccaa

SEQ ID NO: 1326612 - DNA, 22 bp, Artificial Sequence
  chemically synthesized
agtattagttctgttggttgga

SEQ ID NO: 1326613 - DNA, 22 bp, Artificial Sequence
  chemically synthesized
aagtattagttctgttggttgg

SEQ ID NO: 1326614 - DNA, 22 bp, Artificial Sequence
  chemically synthesized
ataatctccaaccaacagaact

SEQ ID NO: 1326615 - DNA, 22 bp, Artificial Sequence
  chemically synthesized
tacttaagtattagttctgttg

SEQ ID NO: 1326616 - DNA, 22 bp, Artificial Sequence
  chemically synthesized
caaccaacagaactaatactta

SEQ ID NO: 1326617 - DNA, 22 bp, Artificial Sequence
  chemically synthesized
ccatggaaattatacttaagta

SEQ ID NO: 1326618 - DNA, 22 bp, Artificial Sequence
  chemically synthesized
atacttaagtataatttccatg

SEQ ID NO: 1326619 - DNA, 22 bp, Artificial Sequence
  chemically synthesized
aataatcattaccatggaaatt

SEQ ID NO: 1326620 - DNA, 22 bp, Artificial Sequence
  chemically synthesized
aaataatcattaccatggaaat

SEQ ID NO: 1326621 - DNA, 22 bp, Artificial Sequence
  chemically synthesized
taaataatcattaccatggaaa

SEQ ID NO: 1326622 - DNA, 22 bp, Artificial Sequence
  chemically synthesized
aagtataatttccatggtaatg

SEQ ID NO: 1326623 - DNA, 22 bp, Artificial Sequence
  chemically synthesized
agtataatttccatggtaatga

SEQ ID NO: 1326624 - DNA, 22 bp, Artificial Sequence
  chemically synthesized
ccatggtaatgattatttaaaa

SEQ ID NO: 1326625 - DNA, 22 bp, Artificial Sequence
  chemically synthesized
catggtaatgattatttaaaac

SEQ ID NO: 1326626 - DNA, 22 bp, Artificial Sequence
  chemically synthesized
atagtcaatatggggttttaaa

SEQ ID NO: 1326627 - DNA, 22 bp, Artificial Sequence
  chemically synthesized
taaattcatagtcaatatgggg

SEQ ID NO: 1326628 - DNA, 22 bp, Artificial Sequence
  chemically synthesized
tttaaaaccccatattgactat

SEQ ID NO: 1326629 - DNA, 22 bp, Artificial Sequence
  chemically synthesized
aaaaccccatattgactatgaa

SEQ ID NO: 1326630 - DNA, 22 bp, Artificial Sequence
  chemically synthesized
aaaccccatattgactatgaat

SEQ ID NO: 1326631 - DNA, 22 bp, Artificial Sequence
  chemically synthesized
catatggaatcaccatctataa

SEQ ID NO: 1326632 - DNA, 22 bp, Artificial Sequence
  chemically synthesized
gcatatggaatcaccatctata

SEQ ID NO: 1326633 - DNA, 22 bp, Artificial Sequence
  chemically synthesized
tgcatatggaatcaccatctat

SEQ ID NO: 1326634 - DNA, 22 bp, Artificial Sequence
  chemically synthesized
actatgaatttatagatggtga

SEQ ID NO: 1326635 - DNA, 22 bp, Artificial Sequence
  chemically synthesized
ttgcatatggaatcaccatcta

SEQ ID NO: 1326636 - DNA, 22 bp, Artificial Sequence
  chemically synthesized
tttgcatatggaatcaccatct

SEQ ID NO: 1326637 - DNA, 22 bp, Artificial Sequence
  chemically synthesized
ttttgcatatggaatcaccatc

SEQ ID NO: 1326638 - DNA, 22 bp, Artificial Sequence
  chemically synthesized
tgaatttatagatggtgattcc

SEQ ID NO: 1326639 - DNA, 22 bp, Artificial Sequence
  chemically synthesized
cttttttgcatatggaatcacc

SEQ ID NO: 1326640 - DNA, 22 bp, Artificial Sequence
  chemically synthesized
gcttttttgcatatggaatcac

SEQ ID NO: 1326641 - DNA, 22 bp, Artificial Sequence
  chemically synthesized
atagatggtgattccatatgca

SEQ ID NO: 1326642 - DNA, 22 bp, Artificial Sequence
  chemically synthesized
tagatggtgattccatatgcaa

SEQ ID NO: 1326643 - DNA, 22 bp, Artificial Sequence
  chemically synthesized
taaatgcaagtttgcttttttg

SEQ ID NO: 1326644 - DNA, 22 bp, Artificial Sequence
  chemically synthesized
ttataaatgcaagtttgctttt

SEQ ID NO: 1326645 - DNA, 22 bp, Artificial Sequence
  chemically synthesized
tattataaatgcaagtttgctt

SEQ ID NO: 1326646 - DNA, 22 bp, Artificial Sequence
  chemically synthesized
catatgcaaaaaagcaaacttg

SEQ ID NO: 1326647 - DNA, 22 bp, Artificial Sequence
  chemically synthesized
ctattataaatgcaagtttgct

SEQ ID NO: 1326648 - DNA, 22 bp, Artificial Sequence
  chemically synthesized
atttctattataaatgcaagtt

SEQ ID NO: 1326649 - DNA, 22 bp, Artificial Sequence
  chemically synthesized
tcatttctattataaatgcaag

SEQ ID NO: 1326650 - DNA, 22 bp, Artificial Sequence
  chemically synthesized
ttctcatttctattataaatgc

SEQ ID NO: 1326651 - DNA, 22 bp, Artificial Sequence
  chemically synthesized
gttctcatttctattataaatg

SEQ ID NO: 1326652 - DNA, 22 bp, Artificial Sequence
  chemically synthesized
tgttctcatttctattataaat

SEQ ID NO: 1326653 - DNA, 22 bp, Artificial Sequence
  chemically synthesized
ctttgttctcatttctattata

SEQ ID NO: 1326654 - DNA, 22 bp, Artificial Sequence
  chemically synthesized
ttgctttgttctcatttctatt

SEQ ID NO: 1326655 - DNA, 22 bp, Artificial Sequence
  chemically synthesized
tgttgctttgttctcatttcta

SEQ ID NO: 1326656 - DNA, 22 bp, Artificial Sequence
  chemically synthesized
gcatttataatagaaatgagaa

SEQ ID NO: 1326657 - DNA, 22 bp, Artificial Sequence
  chemically synthesized
catttataatagaaatgagaac

SEQ ID NO: 1326658 - DNA, 22 bp, Artificial Sequence
  chemically synthesized
cacattctgttgctttgttctc

SEQ ID NO: 1326659 - DNA, 22 bp, Artificial Sequence
  chemically synthesized
ataatagaaatgagaacaaagc

SEQ ID NO: 1326660 - DNA, 22 bp, Artificial Sequence
  chemically synthesized
taatagaaatgagaacaaagca

SEQ ID NO: 1326661 - DNA, 22 bp, Artificial Sequence
  chemically synthesized
aacatattacacattctgttgc

SEQ ID NO: 1326662 - DNA, 22 bp, Artificial Sequence
  chemically synthesized
caacatattacacattctgttg

SEQ ID NO: 1326663 - DNA, 22 bp, Artificial Sequence
  chemically synthesized
cttcaacatattacacattctg

SEQ ID NO: 1326664 - DNA, 22 bp, Artificial Sequence
  chemically synthesized
atgactccttcaacatattaca

SEQ ID NO: 1326665 - DNA, 22 bp, Artificial Sequence
  chemically synthesized
aagttaatgactccttcaacat

SEQ ID NO: 1326666 - DNA, 22 bp, Artificial Sequence
  chemically synthesized
cactaaagttaatgactccttc

SEQ ID NO: 1326667 - DNA, 22 bp, Artificial Sequence
  chemically synthesized
tcctccactaaagttaatgact

SEQ ID NO: 1326668 - DNA, 22 bp, Artificial Sequence
  chemically synthesized
actgtcctccactaaagttaat

SEQ ID NO: 1326669 - DNA, 22 bp, Artificial Sequence
  chemically synthesized
gactgtcctccactaaagttaa

SEQ ID NO: 1326670 - DNA, 22 bp, Artificial Sequence
  chemically synthesized
aaggagtcattaactttagtgg

SEQ ID NO: 1326671 - DNA, 22 bp, Artificial Sequence
  chemically synthesized
ggaacttgactgtcctccacta

SEQ ID NO: 1326672 - DNA, 22 bp, Artificial Sequence
  chemically synthesized
aggaacttgactgtcctccact

SEQ ID NO: 1326673 - DNA, 22 bp, Artificial Sequence
  chemically synthesized
taggaacttgactgtcctccac

SEQ ID NO: 1326674 - DNA, 22 bp, Artificial Sequence
  chemically synthesized
actttagtggaggacagtcaag

SEQ ID NO: 1326675 - DNA, 22 bp, Artificial Sequence
  chemically synthesized
tagtggaggacagtcaagttcc

SEQ ID NO: 1326676 - DNA, 22 bp, Artificial Sequence
  chemically synthesized
agtggaggacagtcaagttcct

SEQ ID NO: 1326677 - DNA, 22 bp, Artificial Sequence
  chemically synthesized
gtggaggacagtcaagttccta

SEQ ID NO: 1326678 - DNA, 22 bp, Artificial Sequence
  chemically synthesized
aatgaatgaataaataaatgaa

SEQ ID NO: 1326679 - DNA, 22 bp, Artificial Sequence
  chemically synthesized
ctgaatgaatgaataaataaat

SEQ ID NO: 1326680 - DNA, 22 bp, Artificial Sequence
  chemically synthesized
gctgaatgaatgaataaataaa

SEQ ID NO: 1326681 - DNA, 22 bp, Artificial Sequence
  chemically synthesized
ctaaagattcatttatttattc

SEQ ID NO: 1326682 - DNA, 22 bp, Artificial Sequence
  chemically synthesized
tgctgaatgaatgaataaataa

SEQ ID NO: 1326683 - DNA, 22 bp, Artificial Sequence
  chemically synthesized
ttgctgaatgaatgaataaata

SEQ ID NO: 1326684 - DNA, 22 bp, Artificial Sequence
  chemically synthesized
tttgctgaatgaatgaataaat

SEQ ID NO: 1326685 - DNA, 22 bp, Artificial Sequence
  chemically synthesized
aagattcatttatttattcatt

SEQ ID NO: 1326686 - DNA, 22 bp, Artificial Sequence
  chemically synthesized
ttttgctgaatgaatgaataaa

SEQ ID NO: 1326687 - DNA, 22 bp, Artificial Sequence
  chemically synthesized
tttttttgctgaatgaatgaat

SEQ ID NO: 1326688 - DNA, 22 bp, Artificial Sequence
  chemically synthesized
tatttttttgctgaatgaatga

SEQ ID NO: 1326689 - DNA, 22 bp, Artificial Sequence
  chemically synthesized
atttatttattcattcattcag

SEQ ID NO: 1326690 - DNA, 22 bp, Artificial Sequence
  chemically synthesized
atttattcattcattcagcaaa

SEQ ID NO: 1326691 - DNA, 22 bp, Artificial Sequence
  chemically synthesized
tttattcattcattcagcaaaa

SEQ ID NO: 1326692 - DNA, 22 bp, Artificial Sequence
  chemically synthesized
aataattctatttttttgctga

SEQ ID NO: 1326693 - DNA, 22 bp, Artificial Sequence
  chemically synthesized
attcattcattcagcaaaaaaa

SEQ ID NO: 1326694 - DNA, 22 bp, Artificial Sequence
  chemically synthesized
ttcattcattcagcaaaaaaat

SEQ ID NO: 1326695 - DNA, 22 bp, Artificial Sequence
  chemically synthesized
aactaaataattctattttttt

SEQ ID NO: 1326696 - DNA, 22 bp, Artificial Sequence
  chemically synthesized
attcattcagcaaaaaaataga

SEQ ID NO: 1326697 - DNA, 22 bp, Artificial Sequence
  chemically synthesized
attcagcaaaaaaatagaatta

SEQ ID NO: 1326698 - DNA, 22 bp, Artificial Sequence
  chemically synthesized
taacctgaactaaataattcta

SEQ ID NO: 1326699 - DNA, 22 bp, Artificial Sequence
  chemically synthesized
agcaaaaaaatagaattattta

SEQ ID NO: 1326700 - DNA, 22 bp, Artificial Sequence
  chemically synthesized
gaattataacctgaactaaata

SEQ ID NO: 1326701 - DNA, 22 bp, Artificial Sequence
  chemically synthesized
taaagaatctggaattataacc

SEQ ID NO: 1326702 - DNA, 22 bp, Artificial Sequence
  chemically synthesized
ataaagaatctggaattataac

SEQ ID NO: 1326703 - DNA, 22 bp, Artificial Sequence
  chemically synthesized
tttagttcaggttataattcca

SEQ ID NO: 1326704 - DNA, 22 bp, Artificial Sequence
  chemically synthesized
atttataaagaatctggaatta

SEQ ID NO: 1326705 - DNA, 22 bp, Artificial Sequence
  chemically synthesized
agttcaggttataattccagat

SEQ ID NO: 1326706 - DNA, 22 bp, Artificial Sequence
  chemically synthesized
gttcaggttataattccagatt

SEQ ID NO: 1326707 - DNA, 22 bp, Artificial Sequence
  chemically synthesized
ttaatttataaagaatctggaa

SEQ ID NO: 1326708 - DNA, 22 bp, Artificial Sequence
  chemically synthesized
aggttataattccagattcttt

SEQ ID NO: 1326709 - DNA, 22 bp, Artificial Sequence
  chemically synthesized
taattccagattctttataaat

SEQ ID NO: 1326710 - DNA, 22 bp, Artificial Sequence
  chemically synthesized
aagtcattattaatttataaag

SEQ ID NO: 1326711 - DNA, 22 bp, Artificial Sequence
  chemically synthesized
aaagtcattattaatttataaa

SEQ ID NO: 1326712 - DNA, 22 bp, Artificial Sequence
  chemically synthesized
cagattctttataaattaataa

SEQ ID NO: 1326713 - DNA, 22 bp, Artificial Sequence
  chemically synthesized
acatgcatttaaagtcattatt

SEQ ID NO: 1326714 - DNA, 22 bp, Artificial Sequence
  chemically synthesized
tttataaattaataatgacttt

SEQ ID NO: 1326715 - DNA, 22 bp, Artificial Sequence
  chemically synthesized
tataaattaataatgactttaa

SEQ ID NO: 1326716 - DNA, 22 bp, Artificial Sequence
  chemically synthesized
ataaattaataatgactttaaa

SEQ ID NO: 1326717 - DNA, 22 bp, Artificial Sequence
  chemically synthesized
taaattaataatgactttaaat

SEQ ID NO: 1326718 - DNA, 22 bp, Artificial Sequence
  chemically synthesized
tgaaattcacatgcatttaaag

SEQ ID NO: 1326719 - DNA, 22 bp, Artificial Sequence
  chemically synthesized
ataatgactttaaatgcatgtg

SEQ ID NO: 1326720 - DNA, 22 bp, Artificial Sequence
  chemically synthesized
taaatgcatgtgaatttcatag

SEQ ID NO: 1326721 - DNA, 22 bp, Artificial Sequence
  chemically synthesized
aaatgcatgtgaatttcatagt

SEQ ID NO: 1326722 - DNA, 22 bp, Artificial Sequence
  chemically synthesized
aatgcatgtgaatttcatagta

SEQ ID NO: 1326723 - DNA, 22 bp, Artificial Sequence
  chemically synthesized
gataaaaaaatatacagtacta

SEQ ID NO: 1326724 - DNA, 22 bp, Artificial Sequence
  chemically synthesized
ctagataaaaaaatatacagta

SEQ ID NO: 1326725 - DNA, 22 bp, Artificial Sequence
  chemically synthesized
catagtactgtatattttttta

SEQ ID NO: 1326726 - DNA, 22 bp, Artificial Sequence
  chemically synthesized
atagtactgtatatttttttat

SEQ ID NO: 1326727 - DNA, 22 bp, Artificial Sequence
  chemically synthesized
aggaaaaatattcctagataaa

SEQ ID NO: 1326728 - DNA, 22 bp, Artificial Sequence
  chemically synthesized
aaggaaaaatattcctagataa

SEQ ID NO: 1326729 - DNA, 22 bp, Artificial Sequence
  chemically synthesized
tatatttttttatctaggaata

SEQ ID NO: 1326730 - DNA, 22 bp, Artificial Sequence
  chemically synthesized
ttttatctaggaatatttttcc

SEQ ID NO: 1326731 - DNA, 22 bp, Artificial Sequence
  chemically synthesized
tttatctaggaatatttttcct

SEQ ID NO: 1326732 - DNA, 22 bp, Artificial Sequence
  chemically synthesized
ttatctaggaatatttttcctt

SEQ ID NO: 1326733 - DNA, 22 bp, Artificial Sequence
  chemically synthesized
tatctaggaatatttttcctta

SEQ ID NO: 1326734 - DNA, 22 bp, Artificial Sequence
  chemically synthesized
atctaggaatatttttccttaa

SEQ ID NO: 1326735 - DNA, 22 bp, Artificial Sequence
  chemically synthesized
tctaggaatatttttccttaaa

SEQ ID NO: 1326736 - DNA, 22 bp, Artificial Sequence
  chemically synthesized
ggagaatagtatcatttaagga

SEQ ID NO: 1326737 - DNA, 22 bp, Artificial Sequence
  chemically synthesized
ggaatatttttccttaaatgat

SEQ ID NO: 1326738 - DNA, 22 bp, Artificial Sequence
  chemically synthesized
aattcggagaatagtatcattt

SEQ ID NO: 1326739 - DNA, 22 bp, Artificial Sequence
  chemically synthesized
ttaaattcggagaatagtatca

SEQ ID NO: 1326740 - DNA, 22 bp, Artificial Sequence
  chemically synthesized
attaaattcggagaatagtatc

SEQ ID NO: 1326741 - DNA, 22 bp, Artificial Sequence
  chemically synthesized
tattaaattcggagaatagtat

SEQ ID NO: 1326742 - DNA, 22 bp, Artificial Sequence
  chemically synthesized
ttccttaaatgatactattctc

SEQ ID NO: 1326743 - DNA, 22 bp, Artificial Sequence
  chemically synthesized
tccttaaatgatactattctcc

SEQ ID NO: 1326744 - DNA, 22 bp, Artificial Sequence
  chemically synthesized
ccttaaatgatactattctccg

SEQ ID NO: 1326745 - DNA, 22 bp, Artificial Sequence
  chemically synthesized
cttaaatgatactattctccga

SEQ ID NO: 1326746 - DNA, 22 bp, Artificial Sequence
  chemically synthesized
aaatgatactattctccgaatt

SEQ ID NO: 1326747 - DNA, 22 bp, Artificial Sequence
  chemically synthesized
aatgatactattctccgaattt

SEQ ID NO: 1326748 - DNA, 22 bp, Artificial Sequence
  chemically synthesized
ttctccgaatttaataaagtac

SEQ ID NO: 1326749 - DNA, 22 bp, Artificial Sequence
  chemically synthesized
tcagtagaaatggtactttatt

SEQ ID NO: 1326750 - DNA, 22 bp, Artificial Sequence
  chemically synthesized
tccgaatttaataaagtaccat

SEQ ID NO: 1326751 - DNA, 22 bp, Artificial Sequence
  chemically synthesized
cgaatttaataaagtaccattt

SEQ ID NO: 1326752 - DNA, 22 bp, Artificial Sequence
  chemically synthesized
aataaagtaccatttctactga

SEQ ID NO: 1326753 - DNA, 22 bp, Artificial Sequence
  chemically synthesized
ataaagtaccatttctactgat

SEQ ID NO: 1326754 - DNA, 22 bp, Artificial Sequence
  chemically synthesized
aaagtcataatctatcagtaga

SEQ ID NO: 1326755 - DNA, 22 bp, Artificial Sequence
  chemically synthesized
aaaagtcataatctatcagtag

SEQ ID NO: 1326756 - DNA, 22 bp, Artificial Sequence
  chemically synthesized
taaaagtcataatctatcagta

SEQ ID NO: 1326757 - DNA, 22 bp, Artificial Sequence
  chemically synthesized
ttaaaagtcataatctatcagt

SEQ ID NO: 1326758 - DNA, 22 bp, Artificial Sequence
  chemically synthesized
tttaaaagtcataatctatcag

SEQ ID NO: 1326759 - DNA, 22 bp, Artificial Sequence
  chemically synthesized
ctactgatagattatgactttt

SEQ ID NO: 1326760 - DNA, 22 bp, Artificial Sequence
  chemically synthesized
tactgatagattatgactttta

SEQ ID NO: 1326761 - DNA, 22 bp, Artificial Sequence
  chemically synthesized
taaaccaattttttaaaagtca

SEQ ID NO: 1326762 - DNA, 22 bp, Artificial Sequence
  chemically synthesized
ctgatagattatgacttttaaa

SEQ ID NO: 1326763 - DNA, 22 bp, Artificial Sequence
  chemically synthesized
atagattatgacttttaaaaaa

SEQ ID NO: 1326764 - DNA, 22 bp, Artificial Sequence
  chemically synthesized
attataaaccaattttttaaaa

SEQ ID NO: 1326765 - DNA, 22 bp, Artificial Sequence
  chemically synthesized
aattataaaccaattttttaaa

SEQ ID NO: 1326766 - DNA, 22 bp, Artificial Sequence
  chemically synthesized
cttaattataaaccaatttttt

SEQ ID NO: 1326767 - DNA, 22 bp, Artificial Sequence
  chemically synthesized
ccttaattataaaccaattttt

SEQ ID NO: 1326768 - DNA, 22 bp, Artificial Sequence
  chemically synthesized
tccttaattataaaccaatttt

SEQ ID NO: 1326769 - DNA, 22 bp, Artificial Sequence
  chemically synthesized
tgacttttaaaaaattggttta

SEQ ID NO: 1326770 - DNA, 22 bp, Artificial Sequence
  chemically synthesized
atattttccttaattataaacc

SEQ ID NO: 1326771 - DNA, 22 bp, Artificial Sequence
  chemically synthesized
ttaaaaaattggtttataatta

SEQ ID NO: 1326772 - DNA, 22 bp, Artificial Sequence
  chemically synthesized
taaaaaattggtttataattaa

SEQ ID NO: 1326773 - DNA, 22 bp, Artificial Sequence
  chemically synthesized
ttcatattttccttaattataa

SEQ ID NO: 1326774 - DNA, 22 bp, Artificial Sequence
  chemically synthesized
aaaaaattggtttataattaag

SEQ ID NO: 1326775 - DNA, 22 bp, Artificial Sequence
  chemically synthesized
attcatattttccttaattata

SEQ ID NO: 1326776 - DNA, 22 bp, Artificial Sequence
  chemically synthesized
aaaaattggtttataattaagg

SEQ ID NO: 1326777 - DNA, 22 bp, Artificial Sequence
  chemically synthesized
tattcatattttccttaattat

SEQ ID NO: 1326778 - DNA, 22 bp, Artificial Sequence
  chemically synthesized
ttattcatattttccttaatta

SEQ ID NO: 1326779 - DNA, 22 bp, Artificial Sequence
  chemically synthesized
tttattcatattttccttaatt

SEQ ID NO: 1326780 - DNA, 22 bp, Artificial Sequence
  chemically synthesized
tcctttttattcatattttcct

SEQ ID NO: 1326781 - DNA, 22 bp, Artificial Sequence
  chemically synthesized
gtttataattaaggaaaatatg

SEQ ID NO: 1326782 - DNA, 22 bp, Artificial Sequence
  chemically synthesized
gtcctttttattcatattttcc

SEQ ID NO: 1326783 - DNA, 22 bp, Artificial Sequence
  chemically synthesized
ataattaaggaaaatatgaata

SEQ ID NO: 1326784 - DNA, 22 bp, Artificial Sequence
  chemically synthesized
taattaaggaaaatatgaataa

SEQ ID NO: 1326785 - DNA, 22 bp, Artificial Sequence
  chemically synthesized
aggaaaatatgaataaaaagga

SEQ ID NO: 1326786 - DNA, 22 bp, Artificial Sequence
  chemically synthesized
atgaatcaatcagcttgtcctt

SEQ ID NO: 1326787 - DNA, 22 bp, Artificial Sequence
  chemically synthesized
aatgaatcaatcagcttgtcct

SEQ ID NO: 1326788 - DNA, 22 bp, Artificial Sequence
  chemically synthesized
ttaatgaatcaatcagcttgtc

SEQ ID NO: 1326789 - DNA, 22 bp, Artificial Sequence
  chemically synthesized
cctcttaatgaatcaatcagct

SEQ ID NO: 1326790 - DNA, 22 bp, Artificial Sequence
  chemically synthesized
gcctcttaatgaatcaatcagc

SEQ ID NO: 1326791 - DNA, 22 bp, Artificial Sequence
  chemically synthesized
tgcctcttaatgaatcaatcag

SEQ ID NO: 1326792 - DNA, 22 bp, Artificial Sequence
  chemically synthesized
gcataattttgcctcttaatga

SEQ ID NO: 1326793 - DNA, 22 bp, Artificial Sequence
  chemically synthesized
attgattcattaagaggcaaaa

SEQ ID NO: 1326794 - DNA, 22 bp, Artificial Sequence
  chemically synthesized
attcattaagaggcaaaattat

SEQ ID NO: 1326795 - DNA, 22 bp, Artificial Sequence
  chemically synthesized
atacaatatctagcataatttt

SEQ ID NO: 1326796 - DNA, 22 bp, Artificial Sequence
  chemically synthesized
attaagaggcaaaattatgcta

SEQ ID NO: 1326797 - DNA, 22 bp, Artificial Sequence
  chemically synthesized
ttgatacaatatctagcataat

SEQ ID NO: 1326798 - DNA, 22 bp, Artificial Sequence
  chemically synthesized
agaggcaaaattatgctagata

SEQ ID NO: 1326799 - DNA, 22 bp, Artificial Sequence
  chemically synthesized
tgctagatattgtatcaacaat

SEQ ID NO: 1326800 - DNA, 22 bp, Artificial Sequence
  chemically synthesized
gtaaaacaatatattgttgata

SEQ ID NO: 1326801 - DNA, 22 bp, Artificial Sequence
  chemically synthesized
ttagtaaaacaatatattgttg

SEQ ID NO: 1326802 - DNA, 22 bp, Artificial Sequence
  chemically synthesized
gatattgtatcaacaatatatt

SEQ ID NO: 1326803 - DNA, 22 bp, Artificial Sequence
  chemically synthesized
ttgttagtaaaacaatatattg

SEQ ID NO: 1326804 - DNA, 22 bp, Artificial Sequence
  chemically synthesized
attgttagtaaaacaatatatt

SEQ ID NO: 1326805 - DNA, 22 bp, Artificial Sequence
  chemically synthesized
tattgttagtaaaacaatatat

SEQ ID NO: 1326806 - DNA, 22 bp, Artificial Sequence
  chemically synthesized
tatcaacaatatattgttttac

SEQ ID NO: 1326807 - DNA, 22 bp, Artificial Sequence
  chemically synthesized
gttttattgttagtaaaacaat

SEQ ID NO: 1326808 - DNA, 22 bp, Artificial Sequence
  chemically synthesized
atggaaacattagttttattgt

SEQ ID NO: 1326809 - DNA, 22 bp, Artificial Sequence
  chemically synthesized
ttttactaacaataaaactaat

SEQ ID NO: 1326810 - DNA, 22 bp, Artificial Sequence
  chemically synthesized
gttaatggaaacattagtttta

SEQ ID NO: 1326811 - DNA, 22 bp, Artificial Sequence
  chemically synthesized
agttaatggaaacattagtttt

SEQ ID NO: 1326812 - DNA, 22 bp, Artificial Sequence
  chemically synthesized
tagttaatggaaacattagttt

SEQ ID NO: 1326813 - DNA, 22 bp, Artificial Sequence
  chemically synthesized
tactaacaataaaactaatgtt

SEQ ID NO: 1326814 - DNA, 22 bp, Artificial Sequence
  chemically synthesized
actaacaataaaactaatgttt

SEQ ID NO: 1326815 - DNA, 22 bp, Artificial Sequence
  chemically synthesized
ctaacaataaaactaatgtttc

SEQ ID NO: 1326816 - DNA, 22 bp, Artificial Sequence
  chemically synthesized
ttttagttaatggaaacattag

SEQ ID NO: 1326817 - DNA, 22 bp, Artificial Sequence
  chemically synthesized
attttagttaatggaaacatta

SEQ ID NO: 1326818 - DNA, 22 bp, Artificial Sequence
  chemically synthesized
acaataaaactaatgtttccat

SEQ ID NO: 1326819 - DNA, 22 bp, Artificial Sequence
  chemically synthesized
tttattttagttaatggaaaca

SEQ ID NO: 1326820 - DNA, 22 bp, Artificial Sequence
  chemically synthesized
attatttattttagttaatgga

SEQ ID NO: 1326821 - DNA, 22 bp, Artificial Sequence
  chemically synthesized
taattatttattttagttaatg

SEQ ID NO: 1326822 - DNA, 22 bp, Artificial Sequence
  chemically synthesized
atgtttccattaactaaaataa

SEQ ID NO: 1326823 - DNA, 22 bp, Artificial Sequence
  chemically synthesized
ccattaactaaaataaataatt

SEQ ID NO: 1326824 - DNA, 22 bp, Artificial Sequence
  chemically synthesized
cattaactaaaataaataatta

SEQ ID NO: 1326825 - DNA, 22 bp, Artificial Sequence
  chemically synthesized
actaaaataaataattagaatg

SEQ ID NO: 1326826 - DNA, 22 bp, Artificial Sequence
  chemically synthesized
aaaaatggtagtcattctaatt

SEQ ID NO: 1326827 - DNA, 22 bp, Artificial Sequence
  chemically synthesized
caaaaatggtagtcattctaat

SEQ ID NO: 1326828 - DNA, 22 bp, Artificial Sequence
  chemically synthesized
aaataaataattagaatgacta

SEQ ID NO: 1326829 - DNA, 22 bp, Artificial Sequence
  chemically synthesized
cgtatttcaaaaatggtagtca

SEQ ID NO: 1326830 - DNA, 22 bp, Artificial Sequence
  chemically synthesized
tacgtatttcaaaaatggtagt

SEQ ID NO: 1326831 - DNA, 22 bp, Artificial Sequence
  chemically synthesized
ttctacgtatttcaaaaatggt

SEQ ID NO: 1326832 - DNA, 22 bp, Artificial Sequence
  chemically synthesized
gttctacgtatttcaaaaatgg

SEQ ID NO: 1326833 - DNA, 22 bp, Artificial Sequence
  chemically synthesized
gaatgactaccatttttgaaat

SEQ ID NO: 1326834 - DNA, 22 bp, Artificial Sequence
  chemically synthesized
tttgttctacgtatttcaaaaa

SEQ ID NO: 1326835 - DNA, 22 bp, Artificial Sequence
  chemically synthesized
ttatttgttctacgtatttcaa

SEQ ID NO: 1326836 - DNA, 22 bp, Artificial Sequence
  chemically synthesized
gttatttgttctacgtatttca

SEQ ID NO: 1326837 - DNA, 22 bp, Artificial Sequence
  chemically synthesized
ccatttttgaaatacgtagaac

SEQ ID NO: 1326838 - DNA, 22 bp, Artificial Sequence
  chemically synthesized
aaatttgttatttgttctacgt

SEQ ID NO: 1326839 - DNA, 22 bp, Artificial Sequence
  chemically synthesized
ttgaaatacgtagaacaaataa

SEQ ID NO: 1326840 - DNA, 22 bp, Artificial Sequence
  chemically synthesized
tgaaatacgtagaacaaataac

SEQ ID NO: 1326841 - DNA, 22 bp, Artificial Sequence
  chemically synthesized
gaaatacgtagaacaaataaca

SEQ ID NO: 1326842 - DNA, 22 bp, Artificial Sequence
  chemically synthesized
aaatacgtagaacaaataacaa

SEQ ID NO: 1326843 - DNA, 22 bp, Artificial Sequence
  chemically synthesized
aatgcactaaaatttgttattt

SEQ ID NO: 1326844 - DNA, 22 bp, Artificial Sequence
  chemically synthesized
aaatagggattaaatgcactaa

SEQ ID NO: 1326845 - DNA, 22 bp, Artificial Sequence
  chemically synthesized
ataaaattaaaatagggattaa

SEQ ID NO: 1326846 - DNA, 22 bp, Artificial Sequence
  chemically synthesized
tagtgcatttaatccctatttt

SEQ ID NO: 1326847 - DNA, 22 bp, Artificial Sequence
  chemically synthesized
agtgcatttaatccctatttta

SEQ ID NO: 1326848 - DNA, 22 bp, Artificial Sequence
  chemically synthesized
gtgcatttaatccctattttaa

SEQ ID NO: 1326849 - DNA, 22 bp, Artificial Sequence
  chemically synthesized
aaaaaaaaacctaataaaatta

SEQ ID NO: 1326850 - DNA, 22 bp, Artificial Sequence
  chemically synthesized
aatccctattttaattttatta

SEQ ID NO: 1326851 - DNA, 22 bp, Artificial Sequence
  chemically synthesized
atccctattttaattttattag

SEQ ID NO: 1326852 - DNA, 22 bp, Artificial Sequence
  chemically synthesized
ttttaattttattaggtttttt

SEQ ID NO: 1326853 - DNA, 22 bp, Artificial Sequence
  chemically synthesized
taattttattaggttttttttt

SEQ ID NO: 1326854 - DNA, 22 bp, Artificial Sequence
  chemically synthesized
aattttattaggtttttttttc

SEQ ID NO: 1326855 - DNA, 22 bp, Artificial Sequence
  chemically synthesized
attttattaggtttttttttca

SEQ ID NO: 1326856 - DNA, 22 bp, Artificial Sequence
  chemically synthesized
tatgtaaagtagaactgaaaaa

SEQ ID NO: 1326857 - DNA, 22 bp, Artificial Sequence
  chemically synthesized
tattaggtttttttttcagttc

SEQ ID NO: 1326858 - DNA, 22 bp, Artificial Sequence
  chemically synthesized
gtatgtaaagtagaactgaaaa

SEQ ID NO: 1326859 - DNA, 22 bp, Artificial Sequence
  chemically synthesized
attaggtttttttttcagttct

SEQ ID NO: 1326860 - DNA, 22 bp, Artificial Sequence
  chemically synthesized
ttaggtttttttttcagttcta

SEQ ID NO: 1326861 - DNA, 22 bp, Artificial Sequence
  chemically synthesized
cttgtatgtaaagtagaactga

SEQ ID NO: 1326862 - DNA, 22 bp, Artificial Sequence
  chemically synthesized
gcttgtatgtaaagtagaactg

SEQ ID NO: 1326863 - DNA, 22 bp, Artificial Sequence
  chemically synthesized
ggtttttttttcagttctactt

SEQ ID NO: 1326864 - DNA, 22 bp, Artificial Sequence
  chemically synthesized
ttttttcagttctactttacat

SEQ ID NO: 1326865 - DNA, 22 bp, Artificial Sequence
  chemically synthesized
tttttcagttctactttacata

SEQ ID NO: 1326866 - DNA, 22 bp, Artificial Sequence
  chemically synthesized
ttttcagttctactttacatac

SEQ ID NO: 1326867 - DNA, 22 bp, Artificial Sequence
  chemically synthesized
tttcagttctactttacataca

SEQ ID NO: 1326868 - DNA, 22 bp, Artificial Sequence
  chemically synthesized
agcatgtttgcttgtatgtaaa

SEQ ID NO: 1326869 - DNA, 22 bp, Artificial Sequence
  chemically synthesized
ttcagttctactttacatacaa

SEQ ID NO: 1326870 - DNA, 22 bp, Artificial Sequence
  chemically synthesized
tcagttctactttacatacaag

SEQ ID NO: 1326871 - DNA, 22 bp, Artificial Sequence
  chemically synthesized
cagttctactttacatacaagc

SEQ ID NO: 1326872 - DNA, 22 bp, Artificial Sequence
  chemically synthesized
agttctactttacatacaagca

SEQ ID NO: 1326873 - DNA, 22 bp, Artificial Sequence
  chemically synthesized
gctcagcatgtttgcttgtatg

SEQ ID NO: 1326874 - DNA, 22 bp, Artificial Sequence
  chemically synthesized
agctcagcatgtttgcttgtat

SEQ ID NO: 1326875 - DNA, 22 bp, Artificial Sequence
  chemically synthesized
tactttacatacaagcaaacat

SEQ ID NO: 1326876 - DNA, 22 bp, Artificial Sequence
  chemically synthesized
gcttagctcagcatgtttgctt

SEQ ID NO: 1326877 - DNA, 22 bp, Artificial Sequence
  chemically synthesized
ctttacatacaagcaaacatgc

SEQ ID NO: 1326878 - DNA, 22 bp, Artificial Sequence
  chemically synthesized
tacatacaagcaaacatgctga

SEQ ID NO: 1326879 - DNA, 22 bp, Artificial Sequence
  chemically synthesized
tattagcttagctcagcatgtt

SEQ ID NO: 1326880 - DNA, 22 bp, Artificial Sequence
  chemically synthesized
acatacaagcaaacatgctgag

SEQ ID NO: 1326881 - DNA, 22 bp, Artificial Sequence
  chemically synthesized
gtattagcttagctcagcatgt

SEQ ID NO: 1326882 - DNA, 22 bp, Artificial Sequence
  chemically synthesized
catacaagcaaacatgctgagc

SEQ ID NO: 1326883 - DNA, 22 bp, Artificial Sequence
  chemically synthesized
tgtattagcttagctcagcatg

SEQ ID NO: 1326884 - DNA, 22 bp, Artificial Sequence
  chemically synthesized
ttttgtattagcttagctcagc

SEQ ID NO: 1326885 - DNA, 22 bp, Artificial Sequence
  chemically synthesized
agctaagctaatacaaaataat

SEQ ID NO: 1326886 - DNA, 22 bp, Artificial Sequence
  chemically synthesized
agctaatacaaaataatacatt

SEQ ID NO: 1326887 - DNA, 22 bp, Artificial Sequence
  chemically synthesized
atacaaaataatacattttctg

SEQ ID NO: 1326888 - DNA, 22 bp, Artificial Sequence
  chemically synthesized
aaaaaacagaagacaaacaaca

SEQ ID NO: 1326889 - DNA, 22 bp, Artificial Sequence
  chemically synthesized
tctgttgctgttgtttgtcttc

SEQ ID NO: 1326890 - DNA, 22 bp, Artificial Sequence
  chemically synthesized
ctgttgctgttgtttgtcttct

SEQ ID NO: 1326891 - DNA, 22 bp, Artificial Sequence
  chemically synthesized
gtctcaaaaaacagaagacaaa

SEQ ID NO: 1326892 - DNA, 22 bp, Artificial Sequence
  chemically synthesized
tgttgctgttgtttgtcttctg

SEQ ID NO: 1326893 - DNA, 22 bp, Artificial Sequence
  chemically synthesized
cgtctcaaaaaacagaagacaa

SEQ ID NO: 1326894 - DNA, 22 bp, Artificial Sequence
  chemically synthesized
ttgctgttgtttgtcttctgtt

SEQ ID NO: 1326895 - DNA, 22 bp, Artificial Sequence
  chemically synthesized
ctgttgtttgtcttctgttttt

SEQ ID NO: 1326896 - DNA, 22 bp, Artificial Sequence
  chemically synthesized
ttgtttgtcttctgttttttga

SEQ ID NO: 1326897 - DNA, 22 bp, Artificial Sequence
  chemically synthesized
tttgtcttctgttttttgagac

SEQ ID NO: 1326898 - DNA, 22 bp, Artificial Sequence
  chemically synthesized
gtcttctgttttttgagacgaa

SEQ ID NO: 1326899 - DNA, 22 bp, Artificial Sequence
  chemically synthesized
tcttctgttttttgagacgaag

SEQ ID NO: 1326900 - DNA, 22 bp, Artificial Sequence
  chemically synthesized
ctgttttttgagacgaagtatc

SEQ ID NO: 1326901 - DNA, 22 bp, Artificial Sequence
  chemically synthesized
tgttttttgagacgaagtatcc

SEQ ID NO: 1326902 - DNA, 22 bp, Artificial Sequence
  chemically synthesized
ttttttgagacgaagtatccct

SEQ ID NO: 1326903 - DNA, 22 bp, Artificial Sequence
  chemically synthesized
tttgagacgaagtatccctctg

SEQ ID NO: 1326904 - DNA, 22 bp, Artificial Sequence
  chemically synthesized
ggtgacaggtgacagagggata

SEQ ID NO: 1326905 - DNA, 22 bp, Artificial Sequence
  chemically synthesized
ttgagacgaagtatccctctgt

SEQ ID NO: 1326906 - DNA, 22 bp, Artificial Sequence
  chemically synthesized
tgagacgaagtatccctctgtc

SEQ ID NO: 1326907 - DNA, 22 bp, Artificial Sequence
  chemically synthesized
gagacgaagtatccctctgtca

SEQ ID NO: 1326908 - DNA, 22 bp, Artificial Sequence
  chemically synthesized
agacgaagtatccctctgtcac

SEQ ID NO: 1326909 - DNA, 22 bp, Artificial Sequence
  chemically synthesized
cagcctaggtgacaggtgacag

SEQ ID NO: 1326910 - DNA, 22 bp, Artificial Sequence
  chemically synthesized
cactacagcctaggtgacaggt

SEQ ID NO: 1326911 - DNA, 22 bp, Artificial Sequence
  chemically synthesized
tgtcacctgtcacctaggctgt

SEQ ID NO: 1326912 - DNA, 22 bp, Artificial Sequence
  chemically synthesized
tcacctgtcacctaggctgtag

SEQ ID NO: 1326913 - DNA, 22 bp, Artificial Sequence
  chemically synthesized
tcacctaggctgtagtgcagtg

SEQ ID NO: 1326914 - DNA, 22 bp, Artificial Sequence
  chemically synthesized
ggctgtagtgcagtggcatgat

SEQ ID NO: 1326915 - DNA, 22 bp, Artificial Sequence
  chemically synthesized
cagtgagccaagatcatgccac

SEQ ID NO: 1326916 - DNA, 22 bp, Artificial Sequence
  chemically synthesized
tagtgcagtggcatgatcttgg

SEQ ID NO: 1326917 - DNA, 22 bp, Artificial Sequence
  chemically synthesized
aaaccgagaggcagaggttaca

SEQ ID NO: 1326918 - DNA, 22 bp, Artificial Sequence
  chemically synthesized
gaaaccgagaggcagaggttac

SEQ ID NO: 1326919 - DNA, 22 bp, Artificial Sequence
  chemically synthesized
ggctcactgtaacctctgcctc

SEQ ID NO: 1326920 - DNA, 22 bp, Artificial Sequence
  chemically synthesized
gctcactgtaacctctgcctct

SEQ ID NO: 1326921 - DNA, 22 bp, Artificial Sequence
  chemically synthesized
actgtaacctctgcctctcggt

SEQ ID NO: 1326922 - DNA, 22 bp, Artificial Sequence
  chemically synthesized
taacctctgcctctcggtttca

SEQ ID NO: 1326923 - DNA, 22 bp, Artificial Sequence
  chemically synthesized
aggcaaaagaatcccttgaaac

SEQ ID NO: 1326924 - DNA, 22 bp, Artificial Sequence
  chemically synthesized
tgcctctcggtttcaagggatt

SEQ ID NO: 1326925 - DNA, 22 bp, Artificial Sequence
  chemically synthesized
cctctcggtttcaagggattct

SEQ ID NO: 1326926 - DNA, 22 bp, Artificial Sequence
  chemically synthesized
tcggtttcaagggattcttttg

SEQ ID NO: 1326927 - DNA, 22 bp, Artificial Sequence
  chemically synthesized
gggggtgctgaggcaaaagaat

SEQ ID NO: 1326928 - DNA, 22 bp, Artificial Sequence
  chemically synthesized
ggtttcaagggattcttttgcc

SEQ ID NO: 1326929 - DNA, 22 bp, Artificial Sequence
  chemically synthesized
ctcgggggtgctgaggcaaaag

SEQ ID NO: 1326930 - DNA, 22 bp, Artificial Sequence
  chemically synthesized
caagggattcttttgcctcagc

SEQ ID NO: 1326931 - DNA, 22 bp, Artificial Sequence
  chemically synthesized
aagggattcttttgcctcagca

SEQ ID NO: 1326932 - DNA, 22 bp, Artificial Sequence
  chemically synthesized
atcccagctactcgggggtgct

SEQ ID NO: 1326933 - DNA, 22 bp, Artificial Sequence
  chemically synthesized
aatcccagctactcgggggtgc

SEQ ID NO: 1326934 - DNA, 22 bp, Artificial Sequence
  chemically synthesized
taatcccagctactcgggggtg

SEQ ID NO: 1326935 - DNA, 22 bp, Artificial Sequence
  chemically synthesized
ttttgcctcagcacccccgagt

SEQ ID NO: 1326936 - DNA, 22 bp, Artificial Sequence
  chemically synthesized
ttgcctcagcacccccgagtag

SEQ ID NO: 1326937 - DNA, 22 bp, Artificial Sequence
  chemically synthesized
tgcctcagcacccccgagtagc

SEQ ID NO: 1326938 - DNA, 22 bp, Artificial Sequence
  chemically synthesized
gcctcagcacccccgagtagct

SEQ ID NO: 1326939 - DNA, 22 bp, Artificial Sequence
  chemically synthesized
cctcagcacccccgagtagctg

SEQ ID NO: 1326940 - DNA, 22 bp, Artificial Sequence
  chemically synthesized
agcacccccgagtagctgggat

SEQ ID NO: 1326941 - DNA, 22 bp, Artificial Sequence
  chemically synthesized
gtggcacatgcctttaatccca

SEQ ID NO: 1326942 - DNA, 22 bp, Artificial Sequence
  chemically synthesized
gccggcctggtggcacatgcct

SEQ ID NO: 1326943 - DNA, 22 bp, Artificial Sequence
  chemically synthesized
ggattaaaggcatgtgccacca

SEQ ID NO: 1326944 - DNA, 22 bp, Artificial Sequence
  chemically synthesized
aaggcatgtgccaccaggccgg

SEQ ID NO: 1326945 - DNA, 22 bp, Artificial Sequence
  chemically synthesized
aaaatacaaaaattagccggcc

SEQ ID NO: 1326946 - DNA, 22 bp, Artificial Sequence
  chemically synthesized
tactaaaaatacaaaaattagc

SEQ ID NO: 1326947 - DNA, 22 bp, Artificial Sequence
  chemically synthesized
atttttgtatttttagtacaga

SEQ ID NO: 1326948 - DNA, 22 bp, Artificial Sequence
  chemically synthesized
ttgtatttttagtacagacggg

SEQ ID NO: 1326949 - DNA, 22 bp, Artificial Sequence
  chemically synthesized
tgtatttttagtacagacgggg

SEQ ID NO: 1326950 - DNA, 22 bp, Artificial Sequence
  chemically synthesized
gtatttttagtacagacggggt

SEQ ID NO: 1326951 - DNA, 22 bp, Artificial Sequence
  chemically synthesized
tatttttagtacagacggggtt

SEQ ID NO: 1326952 - DNA, 22 bp, Artificial Sequence
  chemically synthesized
gccaacatagtgaaaccccgtc

SEQ ID NO: 1326953 - DNA, 22 bp, Artificial Sequence
  chemically synthesized
ttagtacagacggggtttcact

SEQ ID NO: 1326954 - DNA, 22 bp, Artificial Sequence
  chemically synthesized
tagtacagacggggtttcacta

SEQ ID NO: 1326955 - DNA, 22 bp, Artificial Sequence
  chemically synthesized
agtacagacggggtttcactat

SEQ ID NO: 1326956 - DNA, 22 bp, Artificial Sequence
  chemically synthesized
gtacagacggggtttcactatg

SEQ ID NO: 1326957 - DNA, 22 bp, Artificial Sequence
  chemically synthesized
agccagcctggccaacatagtg

SEQ ID NO: 1326958 - DNA, 22 bp, Artificial Sequence
  chemically synthesized
gagccagcctggccaacatagt

SEQ ID NO: 1326959 - DNA, 22 bp, Artificial Sequence
  chemically synthesized
cactatgttggccaggctggct

SEQ ID NO: 1326960 - DNA, 22 bp, Artificial Sequence
  chemically synthesized
actatgttggccaggctggctc

SEQ ID NO: 1326961 - DNA, 22 bp, Artificial Sequence
  chemically synthesized
agatcaggagtttgagccagcc

SEQ ID NO: 1326962 - DNA, 22 bp, Artificial Sequence
  chemically synthesized
tgttggccaggctggctcaaac

SEQ ID NO: 1326963 - DNA, 22 bp, Artificial Sequence
  chemically synthesized
gccaggctggctcaaactcctg

SEQ ID NO: 1326964 - DNA, 22 bp, Artificial Sequence
  chemically synthesized
gctcaaactcctgatctcaggt

SEQ ID NO: 1326965 - DNA, 22 bp, Artificial Sequence
  chemically synthesized
aggcggtccgatcacctgagat

SEQ ID NO: 1326966 - DNA, 22 bp, Artificial Sequence
  chemically synthesized
aaactcctgatctcaggtgatc

SEQ ID NO: 1326967 - DNA, 22 bp, Artificial Sequence
  chemically synthesized
gcaggctgaggcggtccgatca

SEQ ID NO: 1326968 - DNA, 22 bp, Artificial Sequence
  chemically synthesized
ctgatctcaggtgatcggaccg

SEQ ID NO: 1326969 - DNA, 22 bp, Artificial Sequence
  chemically synthesized
ggcaggctgaggcggtccgatc

SEQ ID NO: 1326970 - DNA, 22 bp, Artificial Sequence
  chemically synthesized
tggcaggctgaggcggtccgat

SEQ ID NO: 1326971 - DNA, 22 bp, Artificial Sequence
  chemically synthesized
atctcaggtgatcggaccgcct

SEQ ID NO: 1326972 - DNA, 22 bp, Artificial Sequence
  chemically synthesized
aggtgatcggaccgcctcagcc

SEQ ID NO: 1326973 - DNA, 22 bp, Artificial Sequence
  chemically synthesized
taatcccagcactttggcaggc

SEQ ID NO: 1326974 - DNA, 22 bp, Artificial Sequence
  chemically synthesized
agcctgccaaagtgctgggatt

SEQ ID NO: 1326975 - DNA, 22 bp, Artificial Sequence
  chemically synthesized
ccaaagtgctgggattacaggc

SEQ ID NO: 1326976 - DNA, 22 bp, Artificial Sequence
  chemically synthesized
ggcccagcacggtggatcatgc

SEQ ID NO: 1326977 - DNA, 22 bp, Artificial Sequence
  chemically synthesized
tgggcccagcacggtggatcat

SEQ ID NO: 1326978 - DNA, 22 bp, Artificial Sequence
  chemically synthesized
ggattacaggcatgatccaccg

SEQ ID NO: 1326979 - DNA, 22 bp, Artificial Sequence
  chemically synthesized
ttctgggcccagcacggtggat

SEQ ID NO: 1326980 - DNA, 22 bp, Artificial Sequence
  chemically synthesized
caggcatgatccaccgtgctgg

SEQ ID NO: 1326981 - DNA, 22 bp, Artificial Sequence
  chemically synthesized
aatgtgttattctgggcccagc

SEQ ID NO: 1326982 - DNA, 22 bp, Artificial Sequence
  chemically synthesized
aaatgtgttattctgggcccag

SEQ ID NO: 1326983 - DNA, 22 bp, Artificial Sequence
  chemically synthesized
ttaaatgtgttattctgggccc

SEQ ID NO: 1326984 - DNA, 22 bp, Artificial Sequence
  chemically synthesized
cttaaatgtgttattctgggcc

SEQ ID NO: 1326985 - DNA, 22 bp, Artificial Sequence
  chemically synthesized
ggcccagaataacacatttaag

SEQ ID NO: 1326986 - DNA, 22 bp, Artificial Sequence
  chemically synthesized
aagaagtgattttggctggccg

SEQ ID NO: 1326987 - DNA, 22 bp, Artificial Sequence
  chemically synthesized
agaagtgattttggctggccgc

SEQ ID NO: 1326988 - DNA, 22 bp, Artificial Sequence
  chemically synthesized
caggggtgagccaccgcggcca

SEQ ID NO: 1326989 - DNA, 22 bp, Artificial Sequence
  chemically synthesized
ggattacaggggtgagccaccg

SEQ ID NO: 1326990 - DNA, 22 bp, Artificial Sequence
  chemically synthesized
tggctggccgcggtggctcacc

SEQ ID NO: 1326991 - DNA, 22 bp, Artificial Sequence
  chemically synthesized
ggctggccgcggtggctcaccc

SEQ ID NO: 1326992 - DNA, 22 bp, Artificial Sequence
  chemically synthesized
gctggccgcggtggctcacccc

SEQ ID NO: 1326993 - DNA, 22 bp, Artificial Sequence
  chemically synthesized
gccgcggtggctcacccctgta

SEQ ID NO: 1326994 - DNA, 22 bp, Artificial Sequence
  chemically synthesized
acaaagggctgggattacaggg

SEQ ID NO: 1326995 - DNA, 22 bp, Artificial Sequence
  chemically synthesized
ggcctcacaaagggctgggatt

SEQ ID NO: 1326996 - DNA, 22 bp, Artificial Sequence
  chemically synthesized
ctgggcctcacaaagggctggg

SEQ ID NO: 1326997 - DNA, 22 bp, Artificial Sequence
  chemically synthesized
acccctgtaatcccagcccttt

SEQ ID NO: 1326998 - DNA, 22 bp, Artificial Sequence
  chemically synthesized
taatcccagccctttgtgaggc

SEQ ID NO: 1326999 - DNA, 22 bp, Artificial Sequence
  chemically synthesized
aggtaatccgccctcctgggcc

SEQ ID NO: 1327000 - DNA, 22 bp, Artificial Sequence
  chemically synthesized
acctcaggtaatccgccctcct

SEQ ID NO: 1327001 - DNA, 22 bp, Artificial Sequence
  chemically synthesized
tgtgaggcccaggagggcggat

SEQ ID NO: 1327002 - DNA, 22 bp, Artificial Sequence
  chemically synthesized
gtgaggcccaggagggcggatt

SEQ ID NO: 1327003 - DNA, 22 bp, Artificial Sequence
  chemically synthesized
ctgacctcaggtaatccgccct

SEQ ID NO: 1327004 - DNA, 22 bp, Artificial Sequence
  chemically synthesized
tgaggcccaggagggcggatta

SEQ ID NO: 1327005 - DNA, 22 bp, Artificial Sequence
  chemically synthesized
aaactcctgacctcaggtaatc

SEQ ID NO: 1327006 - DNA, 22 bp, Artificial Sequence
  chemically synthesized
gtctcaaactcctgacctcagg

SEQ ID NO: 1327007 - DNA, 22 bp, Artificial Sequence
  chemically synthesized
gccaggctggtctcaaactcct

SEQ ID NO: 1327008 - DNA, 22 bp, Artificial Sequence
  chemically synthesized
cctgaggtcaggagtttgagac

SEQ ID NO: 1327009 - DNA, 22 bp, Artificial Sequence
  chemically synthesized
aggtcaggagtttgagaccagc

SEQ ID NO: 1327010 - DNA, 22 bp, Artificial Sequence
  chemically synthesized
accatgttggccaggctggtct

SEQ ID NO: 1327011 - DNA, 22 bp, Artificial Sequence
  chemically synthesized
caccatgttggccaggctggtc

SEQ ID NO: 1327012 - DNA, 22 bp, Artificial Sequence
  chemically synthesized
gagaccagcctggccaacatgg

SEQ ID NO: 1327013 - DNA, 22 bp, Artificial Sequence
  chemically synthesized
agaccagcctggccaacatggt

SEQ ID NO: 1327014 - DNA, 22 bp, Artificial Sequence
  chemically synthesized
tagtagagacgaggtttcacca

SEQ ID NO: 1327015 - DNA, 22 bp, Artificial Sequence
  chemically synthesized
gtagtagagacgaggtttcacc

SEQ ID NO: 1327016 - DNA, 22 bp, Artificial Sequence
  chemically synthesized
gccaacatggtgaaacctcgtc

SEQ ID NO: 1327017 - DNA, 22 bp, Artificial Sequence
  chemically synthesized
tatttgtagtagagacgaggtt

SEQ ID NO: 1327018 - DNA, 22 bp, Artificial Sequence
  chemically synthesized
gtatttgtagtagagacgaggt

SEQ ID NO: 1327019 - DNA, 22 bp, Artificial Sequence
  chemically synthesized
tgtatttgtagtagagacgagg

SEQ ID NO: 1327020 - DNA, 22 bp, Artificial Sequence
  chemically synthesized
ttgtatttgtagtagagacgag

SEQ ID NO: 1327021 - DNA, 22 bp, Artificial Sequence
  chemically synthesized
tttgtatttgtagtagagacga

SEQ ID NO: 1327022 - DNA, 22 bp, Artificial Sequence
  chemically synthesized
gataattttttgtatttgtagt

SEQ ID NO: 1327023 - DNA, 22 bp, Artificial Sequence
  chemically synthesized
gtctctactacaaatacaaaaa

SEQ ID NO: 1327024 - DNA, 22 bp, Artificial Sequence
  chemically synthesized
tactacaaatacaaaaaattat

SEQ ID NO: 1327025 - DNA, 22 bp, Artificial Sequence
  chemically synthesized
caccatgcctggataatttttt

SEQ ID NO: 1327026 - DNA, 22 bp, Artificial Sequence
  chemically synthesized
ctacaaatacaaaaaattatcc

SEQ ID NO: 1327027 - DNA, 22 bp, Artificial Sequence
  chemically synthesized
caaatacaaaaaattatccagg

SEQ ID NO: 1327028 - DNA, 22 bp, Artificial Sequence
  chemically synthesized
gccctccaccatgcctggataa

SEQ ID NO: 1327029 - DNA, 22 bp, Artificial Sequence
  chemically synthesized
atgagtagttggccctccacca

SEQ ID NO: 1327030 - DNA, 22 bp, Artificial Sequence
  chemically synthesized
tccaggcatggtggagggccaa

SEQ ID NO: 1327031 - DNA, 22 bp, Artificial Sequence
  chemically synthesized
agcctcatgagtagttggccct

SEQ ID NO: 1327032 - DNA, 22 bp, Artificial Sequence
  chemically synthesized
cctcagcctcatgagtagttgg

SEQ ID NO: 1327033 - DNA, 22 bp, Artificial Sequence
  chemically synthesized
ctgcctcagcctcatgagtagt

SEQ ID NO: 1327034 - DNA, 22 bp, Artificial Sequence
  chemically synthesized
tcctgcctcagcctcatgagta

SEQ ID NO: 1327035 - DNA, 22 bp, Artificial Sequence
  chemically synthesized
aagcaattctcctgcctcagcc

SEQ ID NO: 1327036 - DNA, 22 bp, Artificial Sequence
  chemically synthesized
ctcatgaggctgaggcaggaga

SEQ ID NO: 1327037 - DNA, 22 bp, Artificial Sequence
  chemically synthesized
atgaggctgaggcaggagaatt

SEQ ID NO: 1327038 - DNA, 22 bp, Artificial Sequence
  chemically synthesized
ccaggttcaagcaattctcctg

SEQ ID NO: 1327039 - DNA, 22 bp, Artificial Sequence
  chemically synthesized
cacctcccaggttcaagcaatt

SEQ ID NO: 1327040 - DNA, 22 bp, Artificial Sequence
  chemically synthesized
aggcaggagaattgcttgaacc

SEQ ID NO: 1327041 - DNA, 22 bp, Artificial Sequence
  chemically synthesized
caacctccacctcccaggttca

SEQ ID NO: 1327042 - DNA, 22 bp, Artificial Sequence
  chemically synthesized
actgcaacctccacctcccagg

SEQ ID NO: 1327043 - DNA, 22 bp, Artificial Sequence
  chemically synthesized
ggctcactgcaacctccacctc

SEQ ID NO: 1327044 - DNA, 22 bp, Artificial Sequence
  chemically synthesized
cttgaacctgggaggtggaggt

SEQ ID NO: 1327045 - DNA, 22 bp, Artificial Sequence
  chemically synthesized
gaacctgggaggtggaggttgc

SEQ ID NO: 1327046 - DNA, 22 bp, Artificial Sequence
  chemically synthesized
aacctgggaggtggaggttgca

SEQ ID NO: 1327047 - DNA, 22 bp, Artificial Sequence
  chemically synthesized
ggaggtggaggttgcagtgagc

SEQ ID NO: 1327048 - DNA, 22 bp, Artificial Sequence
  chemically synthesized
gagtgcaacggcgcgatctcgg

SEQ ID NO: 1327049 - DNA, 22 bp, Artificial Sequence
  chemically synthesized
cagtgagccgagatcgcgccgt

SEQ ID NO: 1327050 - DNA, 22 bp, Artificial Sequence
  chemically synthesized
cccaggctggagtgcaacggcg

SEQ ID NO: 1327051 - DNA, 22 bp, Artificial Sequence
  chemically synthesized
ttgcccaggctggagtgcaacg

SEQ ID NO: 1327052 - DNA, 22 bp, Artificial Sequence
  chemically synthesized
gttgcccaggctggagtgcaac

SEQ ID NO: 1327053 - DNA, 22 bp, Artificial Sequence
  chemically synthesized
ttgttgcccaggctggagtgca

SEQ ID NO: 1327054 - DNA, 22 bp, Artificial Sequence
  chemically synthesized
actcttgttgcccaggctggag

SEQ ID NO: 1327055 - DNA, 22 bp, Artificial Sequence
  chemically synthesized
cactcttgttgcccaggctgga

SEQ ID NO: 1327056 - DNA, 22 bp, Artificial Sequence
  chemically synthesized
cactccagcctgggcaacaaga

SEQ ID NO: 1327057 - DNA, 22 bp, Artificial Sequence
  chemically synthesized
cgaaacggagtttcactcttgt

SEQ ID NO: 1327058 - DNA, 22 bp, Artificial Sequence
  chemically synthesized
cagcctgggcaacaagagtgaa

SEQ ID NO: 1327059 - DNA, 22 bp, Artificial Sequence
  chemically synthesized
ccgaaacggagtttcactcttg

SEQ ID NO: 1327060 - DNA, 22 bp, Artificial Sequence
  chemically synthesized
tccgaaacggagtttcactctt

SEQ ID NO: 1327061 - DNA, 22 bp, Artificial Sequence
  chemically synthesized
ttccgaaacggagtttcactct

SEQ ID NO: 1327062 - DNA, 22 bp, Artificial Sequence
  chemically synthesized
tttccgaaacggagtttcactc

SEQ ID NO: 1327063 - DNA, 22 bp, Artificial Sequence
  chemically synthesized
ttttccgaaacggagtttcact

SEQ ID NO: 1327064 - DNA, 22 bp, Artificial Sequence
  chemically synthesized
tttttccgaaacggagtttcac

SEQ ID NO: 1327065 - DNA, 22 bp, Artificial Sequence
  chemically synthesized
ttttttccgaaacggagtttca

SEQ ID NO: 1327066 - DNA, 22 bp, Artificial Sequence
  chemically synthesized
ggcaacaagagtgaaactccgt

SEQ ID NO: 1327067 - DNA, 22 bp, Artificial Sequence
  chemically synthesized
tttttttccgaaacggagtttc

SEQ ID NO: 1327068 - DNA, 22 bp, Artificial Sequence
  chemically synthesized
ttttttttccgaaacggagttt

SEQ ID NO: 1327069 - DNA, 22 bp, Artificial Sequence
  chemically synthesized
tttttttttccgaaacggagtt

SEQ ID NO: 1327070 - DNA, 22 bp, Artificial Sequence
  chemically synthesized
ttttttttttccgaaacggagt

SEQ ID NO: 1327071 - DNA, 22 bp, Artificial Sequence
  chemically synthesized
tttttttttttccgaaacggag

SEQ ID NO: 1327072 - DNA, 22 bp, Artificial Sequence
  chemically synthesized
ttttttttttttccgaaacgga

SEQ ID NO: 1327073 - DNA, 22 bp, Artificial Sequence
  chemically synthesized
tttttttttttttccgaaacgg

SEQ ID NO: 1327074 - DNA, 22 bp, Artificial Sequence
  chemically synthesized
tttttttttttttttccgaaac

SEQ ID NO: 1327075 - DNA, 22 bp, Artificial Sequence
  chemically synthesized
ctttttttttttttttccgaaa

SEQ ID NO: 1327076 - DNA, 22 bp, Artificial Sequence
  chemically synthesized
ttctttttttttttttttccga

SEQ ID NO: 1327077 - DNA, 22 bp, Artificial Sequence
  chemically synthesized
cttctttttttttttttttccg

SEQ ID NO: 1327078 - DNA, 22 bp, Artificial Sequence
  chemically synthesized
ttcttctttttttttttttttc

SEQ ID NO: 1327079 - DNA, 22 bp, Artificial Sequence
  chemically synthesized
tcttcttctttttttttttttt

SEQ ID NO: 1327080 - DNA, 22 bp, Artificial Sequence
  chemically synthesized
tctcttcttctttttttttttt

SEQ ID NO: 1327081 - DNA, 22 bp, Artificial Sequence
  chemically synthesized
cgtttcggaaaaaaaaaaaaaa

SEQ ID NO: 1327082 - DNA, 22 bp, Artificial Sequence
  chemically synthesized
tctctcttcttctttttttttt

SEQ ID NO: 1327083 - DNA, 22 bp, Artificial Sequence
  chemically synthesized
ctctctcttcttcttttttttt

SEQ ID NO: 1327084 - DNA, 22 bp, Artificial Sequence
  chemically synthesized
cggaaaaaaaaaaaaaaagaag

SEQ ID NO: 1327085 - DNA, 22 bp, Artificial Sequence
  chemically synthesized
ggaaaaaaaaaaaaaaagaaga

SEQ ID NO: 1327086 - DNA, 22 bp, Artificial Sequence
  chemically synthesized
aatcacttctctctcttcttct

SEQ ID NO: 1327087 - DNA, 22 bp, Artificial Sequence
  chemically synthesized
aaatcacttctctctcttcttc

SEQ ID NO: 1327088 - DNA, 22 bp, Artificial Sequence
  chemically synthesized
ggtttaaatcacttctctctct

SEQ ID NO: 1327089 - DNA, 22 bp, Artificial Sequence
  chemically synthesized
aggtttaaatcacttctctctc

SEQ ID NO: 1327090 - DNA, 22 bp, Artificial Sequence
  chemically synthesized
aacagacttaggtttaaatcac

SEQ ID NO: 1327091 - DNA, 22 bp, Artificial Sequence
  chemically synthesized
aaattgaacagacttaggttta

SEQ ID NO: 1327092 - DNA, 22 bp, Artificial Sequence
  chemically synthesized
aaaattgaacagacttaggttt

SEQ ID NO: 1327093 - DNA, 22 bp, Artificial Sequence
  chemically synthesized
taaaattgaacagacttaggtt

SEQ ID NO: 1327094 - DNA, 22 bp, Artificial Sequence
  chemically synthesized
caagttttaaaattgaacagac

SEQ ID NO: 1327095 - DNA, 22 bp, Artificial Sequence
  chemically synthesized
aaacctaagtctgttcaatttt

SEQ ID NO: 1327096 - DNA, 22 bp, Artificial Sequence
  chemically synthesized
aacctaagtctgttcaatttta

SEQ ID NO: 1327097 - DNA, 22 bp, Artificial Sequence
  chemically synthesized
agattacaagttttaaaattga

SEQ ID NO: 1327098 - DNA, 22 bp, Artificial Sequence
  chemically synthesized
aagattacaagttttaaaattg

SEQ ID NO: 1327099 - DNA, 22 bp, Artificial Sequence
  chemically synthesized
tttaagattacaagttttaaaa

SEQ ID NO: 1327100 - DNA, 22 bp, Artificial Sequence
  chemically synthesized
agtctgttcaattttaaaactt

SEQ ID NO: 1327101 - DNA, 22 bp, Artificial Sequence
  chemically synthesized
atttaagattacaagttttaaa

SEQ ID NO: 1327102 - DNA, 22 bp, Artificial Sequence
  chemically synthesized
tatttaagattacaagttttaa

SEQ ID NO: 1327103 - DNA, 22 bp, Artificial Sequence
  chemically synthesized
ttatttaagattacaagtttta

SEQ ID NO: 1327104 - DNA, 22 bp, Artificial Sequence
  chemically synthesized
ttcaattttaaaacttgtaatc

SEQ ID NO: 1327105 - DNA, 22 bp, Artificial Sequence
  chemically synthesized
aattttaaaacttgtaatctta

SEQ ID NO: 1327106 - DNA, 22 bp, Artificial Sequence
  chemically synthesized
aatataatttttatttaagatt

SEQ ID NO: 1327107 - DNA, 22 bp, Artificial Sequence
  chemically synthesized
taaaacttgtaatcttaaataa

SEQ ID NO: 1327108 - DNA, 22 bp, Artificial Sequence
  chemically synthesized
taaatataatttttatttaaga

SEQ ID NO: 1327109 - DNA, 22 bp, Artificial Sequence
  chemically synthesized
aaaacttgtaatcttaaataaa

SEQ ID NO: 1327110 - DNA, 22 bp, Artificial Sequence
  chemically synthesized
aaacttgtaatcttaaataaaa

SEQ ID NO: 1327111 - DNA, 22 bp, Artificial Sequence
  chemically synthesized
taattctaaatataatttttat

SEQ ID NO: 1327112 - DNA, 22 bp, Artificial Sequence
  chemically synthesized
gtaatcttaaataaaaattata

SEQ ID NO: 1327113 - DNA, 22 bp, Artificial Sequence
  chemically synthesized
taatcttaaataaaaattatat

SEQ ID NO: 1327114 - DNA, 22 bp, Artificial Sequence
  chemically synthesized
atactataattctaaatataat

SEQ ID NO: 1327115 - DNA, 22 bp, Artificial Sequence
  chemically synthesized
aaataaaaattatatttagaat

SEQ ID NO: 1327116 - DNA, 22 bp, Artificial Sequence
  chemically synthesized
aataaaaattatatttagaatt

SEQ ID NO: 1327117 - DNA, 22 bp, Artificial Sequence
  chemically synthesized
gccaataaaattgatactataa

SEQ ID NO: 1327118 - DNA, 22 bp, Artificial Sequence
  chemically synthesized
tatttagaattatagtatcaat

SEQ ID NO: 1327119 - DNA, 22 bp, Artificial Sequence
  chemically synthesized
actggccaataaaattgatact

SEQ ID NO: 1327120 - DNA, 22 bp, Artificial Sequence
  chemically synthesized
aactggccaataaaattgatac

SEQ ID NO: 1327121 - DNA, 22 bp, Artificial Sequence
  chemically synthesized
taactggccaataaaattgata

SEQ ID NO: 1327122 - DNA, 22 bp, Artificial Sequence
  chemically synthesized
agaattatagtatcaattttat

SEQ ID NO: 1327123 - DNA, 22 bp, Artificial Sequence
  chemically synthesized
gaattatagtatcaattttatt

SEQ ID NO: 1327124 - DNA, 22 bp, Artificial Sequence
  chemically synthesized
aaattttaactggccaataaaa

SEQ ID NO: 1327125 - DNA, 22 bp, Artificial Sequence
  chemically synthesized
tagtatcaattttattggccag

SEQ ID NO: 1327126 - DNA, 22 bp, Artificial Sequence
  chemically synthesized
ttaaaattttaactggccaata

SEQ ID NO: 1327127 - DNA, 22 bp, Artificial Sequence
  chemically synthesized
attaaaattttaactggccaat

SEQ ID NO: 1327128 - DNA, 22 bp, Artificial Sequence
  chemically synthesized
tattaaaattttaactggccaa

SEQ ID NO: 1327129 - DNA, 22 bp, Artificial Sequence
  chemically synthesized
ctttattaaaattttaactggc

SEQ ID NO: 1327130 - DNA, 22 bp, Artificial Sequence
  chemically synthesized
tattggccagttaaaattttaa

SEQ ID NO: 1327131 - DNA, 22 bp, Artificial Sequence
  chemically synthesized
attggccagttaaaattttaat

SEQ ID NO: 1327132 - DNA, 22 bp, Artificial Sequence
  chemically synthesized
ttggccagttaaaattttaata

SEQ ID NO: 1327133 - DNA, 22 bp, Artificial Sequence
  chemically synthesized
gccagttaaaattttaataaag

SEQ ID NO: 1327134 - DNA, 22 bp, Artificial Sequence
  chemically synthesized
catatatatctactttattaaa

SEQ ID NO: 1327135 - DNA, 22 bp, Artificial Sequence
  chemically synthesized
aaattttaataaagtagatata

SEQ ID NO: 1327136 - DNA, 22 bp, Artificial Sequence
  chemically synthesized
atagtacaaattgcatatatat

SEQ ID NO: 1327137 - DNA, 22 bp, Artificial Sequence
  chemically synthesized
taataaagtagatatatatgca

SEQ ID NO: 1327138 - DNA, 22 bp, Artificial Sequence
  chemically synthesized
aataaagtagatatatatgcaa

SEQ ID NO: 1327139 - DNA, 22 bp, Artificial Sequence
  chemically synthesized
ataaagtagatatatatgcaat

SEQ ID NO: 1327140 - DNA, 22 bp, Artificial Sequence
  chemically synthesized
tagctgatagtacaaattgcat

SEQ ID NO: 1327141 - DNA, 22 bp, Artificial Sequence
  chemically synthesized
gtactatcagctatagatggct

SEQ ID NO: 1327142 - DNA, 22 bp, Artificial Sequence
  chemically synthesized
tactatcagctatagatggctt

SEQ ID NO: 1327143 - DNA, 22 bp, Artificial Sequence
  chemically synthesized
aaatgtggtcaaacaagccatc

SEQ ID NO: 1327144 - DNA, 22 bp, Artificial Sequence
  chemically synthesized
tcagctatagatggcttgtttg

SEQ ID NO: 1327145 - DNA, 22 bp, Artificial Sequence
  chemically synthesized
tagatggcttgtttgaccacat

SEQ ID NO: 1327146 - DNA, 22 bp, Artificial Sequence
  chemically synthesized
gtttgaccacattttaatgtgt

SEQ ID NO: 1327147 - DNA, 22 bp, Artificial Sequence
  chemically synthesized
tttgaccacattttaatgtgtt

SEQ ID NO: 1327148 - DNA, 22 bp, Artificial Sequence
  chemically synthesized
aatgaaaatatgtaacacatta

SEQ ID NO: 1327149 - DNA, 22 bp, Artificial Sequence
  chemically synthesized
gaccacattttaatgtgttaca

SEQ ID NO: 1327150 - DNA, 22 bp, Artificial Sequence
  chemically synthesized
accacattttaatgtgttacat

SEQ ID NO: 1327151 - DNA, 22 bp, Artificial Sequence
  chemically synthesized
tactaaatgaaaatatgtaaca

SEQ ID NO: 1327152 - DNA, 22 bp, Artificial Sequence
  chemically synthesized
taatgtgttacatattttcatt

SEQ ID NO: 1327153 - DNA, 22 bp, Artificial Sequence
  chemically synthesized
aatgtgttacatattttcattt

SEQ ID NO: 1327154 - DNA, 22 bp, Artificial Sequence
  chemically synthesized
atgtgttacatattttcattta

SEQ ID NO: 1327155 - DNA, 22 bp, Artificial Sequence
  chemically synthesized
caggatgaactatactaaatga

SEQ ID NO: 1327156 - DNA, 22 bp, Artificial Sequence
  chemically synthesized
catattttcatttagtatagtt

SEQ ID NO: 1327157 - DNA, 22 bp, Artificial Sequence
  chemically synthesized
atattccaggatgaactatact

SEQ ID NO: 1327158 - DNA, 22 bp, Artificial Sequence
  chemically synthesized
aatattccaggatgaactatac

SEQ ID NO: 1327159 - DNA, 22 bp, Artificial Sequence
  chemically synthesized
tcatttagtatagttcatcctg

SEQ ID NO: 1327160 - DNA, 22 bp, Artificial Sequence
  chemically synthesized
catttagtatagttcatcctgg

SEQ ID NO: 1327161 - DNA, 22 bp, Artificial Sequence
  chemically synthesized
atttagtatagttcatcctgga

SEQ ID NO: 1327162 - DNA, 22 bp, Artificial Sequence
  chemically synthesized
gggaacttaatattccaggatg

SEQ ID NO: 1327163 - DNA, 22 bp, Artificial Sequence
  chemically synthesized
agtatagttcatcctggaatat

SEQ ID NO: 1327164 - DNA, 22 bp, Artificial Sequence
  chemically synthesized
gtatagttcatcctggaatatt

SEQ ID NO: 1327165 - DNA, 22 bp, Artificial Sequence
  chemically synthesized
atctagggaacttaatattcca

SEQ ID NO: 1327166 - DNA, 22 bp, Artificial Sequence
  chemically synthesized
atcctggaatattaagttccct

SEQ ID NO: 1327167 - DNA, 22 bp, Artificial Sequence
  chemically synthesized
aaaagtggttgatctagggaac

SEQ ID NO: 1327168 - DNA, 22 bp, Artificial Sequence
  chemically synthesized
gaatattaagttccctagatca

SEQ ID NO: 1327169 - DNA, 22 bp, Artificial Sequence
  chemically synthesized
agttccctagatcaaccacttt

SEQ ID NO: 1327170 - DNA, 22 bp, Artificial Sequence
  chemically synthesized
cctagatcaaccactttttaat

SEQ ID NO: 1327171 - DNA, 22 bp, Artificial Sequence
  chemically synthesized
gatcaaccactttttaatatat

SEQ ID NO: 1327172 - DNA, 22 bp, Artificial Sequence
  chemically synthesized
aaaacaatagcatgagtatata

SEQ ID NO: 1327173 - DNA, 22 bp, Artificial Sequence
  chemically synthesized
caaaacaatagcatgagtatat

SEQ ID NO: 1327174 - DNA, 22 bp, Artificial Sequence
  chemically synthesized
tcaaaacaatagcatgagtata

SEQ ID NO: 1327175 - DNA, 22 bp, Artificial Sequence
  chemically synthesized
attttcaaaacaatagcatgag

SEQ ID NO: 1327176 - DNA, 22 bp, Artificial Sequence
  chemically synthesized
tttaatatatactcatgctatt

SEQ ID NO: 1327177 - DNA, 22 bp, Artificial Sequence
  chemically synthesized
ttaatatatactcatgctattg

SEQ ID NO: 1327178 - DNA, 22 bp, Artificial Sequence
  chemically synthesized
taattttcaaaacaatagcatg

SEQ ID NO: 1327179 - DNA, 22 bp, Artificial Sequence
  chemically synthesized
taatatatactcatgctattgt

SEQ ID NO: 1327180 - DNA, 22 bp, Artificial Sequence
  chemically synthesized
aatatatactcatgctattgtt

SEQ ID NO: 1327181 - DNA, 22 bp, Artificial Sequence
  chemically synthesized
atatatactcatgctattgttt

SEQ ID NO: 1327182 - DNA, 22 bp, Artificial Sequence
  chemically synthesized
tctctaattttcaaaacaatag

SEQ ID NO: 1327183 - DNA, 22 bp, Artificial Sequence
  chemically synthesized
aacagttatctctaattttcaa

SEQ ID NO: 1327184 - DNA, 22 bp, Artificial Sequence
  chemically synthesized
atgctattgttttgaaaattag

SEQ ID NO: 1327185 - DNA, 22 bp, Artificial Sequence
  chemically synthesized
aagctaaacagttatctctaat

SEQ ID NO: 1327186 - DNA, 22 bp, Artificial Sequence
  chemically synthesized
ttgttttgaaaattagagataa

SEQ ID NO: 1327187 - DNA, 22 bp, Artificial Sequence
  chemically synthesized
ttttgaaaattagagataactg

SEQ ID NO: 1327188 - DNA, 22 bp, Artificial Sequence
  chemically synthesized
tgttaaagctaaacagttatct

SEQ ID NO: 1327189 - DNA, 22 bp, Artificial Sequence
  chemically synthesized
atgttaaagctaaacagttatc

SEQ ID NO: 1327190 - DNA, 22 bp, Artificial Sequence
  chemically synthesized
tgaaaattagagataactgttt

SEQ ID NO: 1327191 - DNA, 22 bp, Artificial Sequence
  chemically synthesized
gaaaattagagataactgttta

SEQ ID NO: 1327192 - DNA, 22 bp, Artificial Sequence
  chemically synthesized
aaaattagagataactgtttag

SEQ ID NO: 1327193 - DNA, 22 bp, Artificial Sequence
  chemically synthesized
aagccttatgttaaagctaaac

SEQ ID NO: 1327194 - DNA, 22 bp, Artificial Sequence
  chemically synthesized
gagataactgtttagctttaac

SEQ ID NO: 1327195 - DNA, 22 bp, Artificial Sequence
  chemically synthesized
accagtctaaagccttatgtta

SEQ ID NO: 1327196 - DNA, 22 bp, Artificial Sequence
  chemically synthesized
tttagctttaacataaggcttt

SEQ ID NO: 1327197 - DNA, 22 bp, Artificial Sequence
  chemically synthesized
gttaaccagtctaaagccttat

SEQ ID NO: 1327198 - DNA, 22 bp, Artificial Sequence
  chemically synthesized
agctttaacataaggctttaga

SEQ ID NO: 1327199 - DNA, 22 bp, Artificial Sequence
  chemically synthesized
ctagttaaccagtctaaagcct

SEQ ID NO: 1327200 - DNA, 22 bp, Artificial Sequence
  chemically synthesized
gctttaacataaggctttagac

SEQ ID NO: 1327201 - DNA, 22 bp, Artificial Sequence
  chemically synthesized
taacataaggctttagactggt

SEQ ID NO: 1327202 - DNA, 22 bp, Artificial Sequence
  chemically synthesized
aacataaggctttagactggtt

SEQ ID NO: 1327203 - DNA, 22 bp, Artificial Sequence
  chemically synthesized
acataaggctttagactggtta

SEQ ID NO: 1327204 - DNA, 22 bp, Artificial Sequence
  chemically synthesized
aatggacactactagttaacca

SEQ ID NO: 1327205 - DNA, 22 bp, Artificial Sequence
  chemically synthesized
tagactggttaactagtagtgt

SEQ ID NO: 1327206 - DNA, 22 bp, Artificial Sequence
  chemically synthesized
agactggttaactagtagtgtc

SEQ ID NO: 1327207 - DNA, 22 bp, Artificial Sequence
  chemically synthesized
gactggttaactagtagtgtcc

SEQ ID NO: 1327208 - DNA, 22 bp, Artificial Sequence
  chemically synthesized
gttaactagtagtgtccattca

SEQ ID NO: 1327209 - DNA, 22 bp, Artificial Sequence
  chemically synthesized
actagtagtgtccattcaggtc

SEQ ID NO: 1327210 - DNA, 22 bp, Artificial Sequence
  chemically synthesized
gtagtgtccattcaggtccctg

SEQ ID NO: 1327211 - DNA, 22 bp, Artificial Sequence
  chemically synthesized
aaacagaaaccagcagggacct

SEQ ID NO: 1327212 - DNA, 22 bp, Artificial Sequence
  chemically synthesized
caaacagaaaccagcagggacc

SEQ ID NO: 1327213 - DNA, 22 bp, Artificial Sequence
  chemically synthesized
atttcaaacagaaaccagcagg

SEQ ID NO: 1327214 - DNA, 22 bp, Artificial Sequence
  chemically synthesized
gatttcaaacagaaaccagcag

SEQ ID NO: 1327215 - DNA, 22 bp, Artificial Sequence
  chemically synthesized
gccttgatttcaaacagaaacc

SEQ ID NO: 1327216 - DNA, 22 bp, Artificial Sequence
  chemically synthesized
aggtccctgctggtttctgttt

SEQ ID NO: 1327217 - DNA, 22 bp, Artificial Sequence
  chemically synthesized
ttggccttgatttcaaacagaa

SEQ ID NO: 1327218 - DNA, 22 bp, Artificial Sequence
  chemically synthesized
ttattggccttgatttcaaaca

SEQ ID NO: 1327219 - DNA, 22 bp, Artificial Sequence
  chemically synthesized
ctggtttctgtttgaaatcaag

SEQ ID NO: 1327220 - DNA, 22 bp, Artificial Sequence
  chemically synthesized
gtttctgtttgaaatcaaggcc

SEQ ID NO: 1327221 - DNA, 22 bp, Artificial Sequence
  chemically synthesized
agaccgttattattggccttga

SEQ ID NO: 1327222 - DNA, 22 bp, Artificial Sequence
  chemically synthesized
aagaccgttattattggccttg

SEQ ID NO: 1327223 - DNA, 22 bp, Artificial Sequence
  chemically synthesized
ctgtttgaaatcaaggccaata

SEQ ID NO: 1327224 - DNA, 22 bp, Artificial Sequence
  chemically synthesized
taagaccgttattattggcctt

SEQ ID NO: 1327225 - DNA, 22 bp, Artificial Sequence
  chemically synthesized
tgtttgaaatcaaggccaataa

SEQ ID NO: 1327226 - DNA, 22 bp, Artificial Sequence
  chemically synthesized
tttaagaccgttattattggcc

SEQ ID NO: 1327227 - DNA, 22 bp, Artificial Sequence
  chemically synthesized
tttgaaatcaaggccaataata

SEQ ID NO: 1327228 - DNA, 22 bp, Artificial Sequence
  chemically synthesized
gaaatcaaggccaataataacg

SEQ ID NO: 1327229 - DNA, 22 bp, Artificial Sequence
  chemically synthesized
aaatcaaggccaataataacgg

SEQ ID NO: 1327230 - DNA, 22 bp, Artificial Sequence
  chemically synthesized
caataatcctctttaagaccgt

SEQ ID NO: 1327231 - DNA, 22 bp, Artificial Sequence
  chemically synthesized
ccaataatcctctttaagaccg

SEQ ID NO: 1327232 - DNA, 22 bp, Artificial Sequence
  chemically synthesized
tccaataatcctctttaagacc

SEQ ID NO: 1327233 - DNA, 22 bp, Artificial Sequence
  chemically synthesized
ttccaataatcctctttaagac

SEQ ID NO: 1327234 - DNA, 22 bp, Artificial Sequence
  chemically synthesized
acttttccaataatcctcttta

SEQ ID NO: 1327235 - DNA, 22 bp, Artificial Sequence
  chemically synthesized
aacttttccaataatcctcttt

SEQ ID NO: 1327236 - DNA, 22 bp, Artificial Sequence
  chemically synthesized
acatcttaacttttccaataat

SEQ ID NO: 1327237 - DNA, 22 bp, Artificial Sequence
  chemically synthesized
aaagaggattattggaaaagtt

SEQ ID NO: 1327238 - DNA, 22 bp, Artificial Sequence
  chemically synthesized
aagaggattattggaaaagtta

SEQ ID NO: 1327239 - DNA, 22 bp, Artificial Sequence
  chemically synthesized
agcaagaaggttcacatcttaa

SEQ ID NO: 1327240 - DNA, 22 bp, Artificial Sequence
  chemically synthesized
ttggaaaagttaagatgtgaac

SEQ ID NO: 1327241 - DNA, 22 bp, Artificial Sequence
  chemically synthesized
ttgagcaagaaggttcacatct

SEQ ID NO: 1327242 - DNA, 22 bp, Artificial Sequence
  chemically synthesized
gttgagcaagaaggttcacatc

SEQ ID NO: 1327243 - DNA, 22 bp, Artificial Sequence
  chemically synthesized
tgttgagcaagaaggttcacat

SEQ ID NO: 1327244 - DNA, 22 bp, Artificial Sequence
  chemically synthesized
gaaaagttaagatgtgaacctt

SEQ ID NO: 1327245 - DNA, 22 bp, Artificial Sequence
  chemically synthesized
tttgttgagcaagaaggttcac

SEQ ID NO: 1327246 - DNA, 22 bp, Artificial Sequence
  chemically synthesized
cattctttgttgagcaagaagg

SEQ ID NO: 1327247 - DNA, 22 bp, Artificial Sequence
  chemically synthesized
gcattctttgttgagcaagaag

SEQ ID NO: 1327248 - DNA, 22 bp, Artificial Sequence
  chemically synthesized
agatgtgaaccttcttgctcaa

SEQ ID NO: 1327249 - DNA, 22 bp, Artificial Sequence
  chemically synthesized
cttgcattctttgttgagcaag

SEQ ID NO: 1327250 - DNA, 22 bp, Artificial Sequence
  chemically synthesized
gcttgcattctttgttgagcaa

SEQ ID NO: 1327251 - DNA, 22 bp, Artificial Sequence
  chemically synthesized
tgcttgcattctttgttgagca

SEQ ID NO: 1327252 - DNA, 22 bp, Artificial Sequence
  chemically synthesized
agacaattttgcttgcattctt

SEQ ID NO: 1327253 - DNA, 22 bp, Artificial Sequence
  chemically synthesized
cttgctcaacaaagaatgcaag

SEQ ID NO: 1327254 - DNA, 22 bp, Artificial Sequence
  chemically synthesized
ttgctcaacaaagaatgcaagc

SEQ ID NO: 1327255 - DNA, 22 bp, Artificial Sequence
  chemically synthesized
gctcaacaaagaatgcaagcaa

SEQ ID NO: 1327256 - DNA, 22 bp, Artificial Sequence
  chemically synthesized
ctcaacaaagaatgcaagcaaa

SEQ ID NO: 1327257 - DNA, 22 bp, Artificial Sequence
  chemically synthesized
gattaagacaattttgcttgca

SEQ ID NO: 1327258 - DNA, 22 bp, Artificial Sequence
  chemically synthesized
tagattaagacaattttgcttg

SEQ ID NO: 1327259 - DNA, 22 bp, Artificial Sequence
  chemically synthesized
aacaaagaatgcaagcaaaatt

SEQ ID NO: 1327260 - DNA, 22 bp, Artificial Sequence
  chemically synthesized
ttctagattaagacaattttgc

SEQ ID NO: 1327261 - DNA, 22 bp, Artificial Sequence
  chemically synthesized
aaactgttctagattaagacaa

SEQ ID NO: 1327262 - DNA, 22 bp, Artificial Sequence
  chemically synthesized
caaactgttctagattaagaca

SEQ ID NO: 1327263 - DNA, 22 bp, Artificial Sequence
  chemically synthesized
tcaaactgttctagattaagac

SEQ ID NO: 1327264 - DNA, 22 bp, Artificial Sequence
  chemically synthesized
agatagtgttttcaaactgttc

SEQ ID NO: 1327265 - DNA, 22 bp, Artificial Sequence
  chemically synthesized
tcttaatctagaacagtttgaa

SEQ ID NO: 1327266 - DNA, 22 bp, Artificial Sequence
  chemically synthesized
aatctagaacagtttgaaaaca

SEQ ID NO: 1327267 - DNA, 22 bp, Artificial Sequence
  chemically synthesized
atctagaacagtttgaaaacac

SEQ ID NO: 1327268 - DNA, 22 bp, Artificial Sequence
  chemically synthesized
atagactaagatagtgttttca

SEQ ID NO: 1327269 - DNA, 22 bp, Artificial Sequence
  chemically synthesized
gaacagtttgaaaacactatct

SEQ ID NO: 1327270 - DNA, 22 bp, Artificial Sequence
  chemically synthesized
gaaaacactatcttagtctatt

SEQ ID NO: 1327271 - DNA, 22 bp, Artificial Sequence
  chemically synthesized
aaaaaatacactaatagactaa

SEQ ID NO: 1327272 - DNA, 22 bp, Artificial Sequence
  chemically synthesized
aaaacactatcttagtctatta

SEQ ID NO: 1327273 - DNA, 22 bp, Artificial Sequence
  chemically synthesized
tcttagtctattagtgtatttt

SEQ ID NO: 1327274 - DNA, 22 bp, Artificial Sequence
  chemically synthesized
agtctattagtgtattttttca

SEQ ID NO: 1327275 - DNA, 22 bp, Artificial Sequence
  chemically synthesized
gtctattagtgtattttttcag

SEQ ID NO: 1327276 - DNA, 22 bp, Artificial Sequence
  chemically synthesized
ttagtgtattttttcagtccgg

SEQ ID NO: 1327277 - DNA, 22 bp, Artificial Sequence
  chemically synthesized
gtgtattttttcagtccggttt

SEQ ID NO: 1327278 - DNA, 22 bp, Artificial Sequence
  chemically synthesized
aagaagcagaagaaacaaaccg

SEQ ID NO: 1327279 - DNA, 22 bp, Artificial Sequence
  chemically synthesized
aaagaagcagaagaaacaaacc

SEQ ID NO: 1327280 - DNA, 22 bp, Artificial Sequence
  chemically synthesized
tttcagtccggtttgtttcttc

SEQ ID NO: 1327281 - DNA, 22 bp, Artificial Sequence
  chemically synthesized
ttcagtccggtttgtttcttct

SEQ ID NO: 1327282 - DNA, 22 bp, Artificial Sequence
  chemically synthesized
tcagtccggtttgtttcttctg

SEQ ID NO: 1327283 - DNA, 22 bp, Artificial Sequence
  chemically synthesized
cagtccggtttgtttcttctgc

SEQ ID NO: 1327284 - DNA, 22 bp, Artificial Sequence
  chemically synthesized
tgatttaaagaagcagaagaaa

SEQ ID NO: 1327285 - DNA, 22 bp, Artificial Sequence
  chemically synthesized
agtccggtttgtttcttctgct

SEQ ID NO: 1327286 - DNA, 22 bp, Artificial Sequence
  chemically synthesized
gtttcttctgcttctttaaatc

SEQ ID NO: 1327287 - DNA, 22 bp, Artificial Sequence
  chemically synthesized
tttcttctgcttctttaaatca

SEQ ID NO: 1327288 - DNA, 22 bp, Artificial Sequence
  chemically synthesized
cttctgcttctttaaatcatag

SEQ ID NO: 1327289 - DNA, 22 bp, Artificial Sequence
  chemically synthesized
ttctgcttctttaaatcatagt

SEQ ID NO: 1327290 - DNA, 22 bp, Artificial Sequence
  chemically synthesized
atccagaaaaacaactatgatt

SEQ ID NO: 1327291 - DNA, 22 bp, Artificial Sequence
  chemically synthesized
ctgcttctttaaatcatagttg

SEQ ID NO: 1327292 - DNA, 22 bp, Artificial Sequence
  chemically synthesized
tgcttctttaaatcatagttgt

SEQ ID NO: 1327293 - DNA, 22 bp, Artificial Sequence
  chemically synthesized
cttctttaaatcatagttgttt

SEQ ID NO: 1327294 - DNA, 22 bp, Artificial Sequence
  chemically synthesized
ctttaaatcatagttgtttttc

SEQ ID NO: 1327295 - DNA, 22 bp, Artificial Sequence
  chemically synthesized
tttaaatcatagttgtttttct

SEQ ID NO: 1327296 - DNA, 22 bp, Artificial Sequence
  chemically synthesized
taaatcatagttgtttttctgg

SEQ ID NO: 1327297 - DNA, 22 bp, Artificial Sequence
  chemically synthesized
aaatcatagttgtttttctgga

SEQ ID NO: 1327298 - DNA, 22 bp, Artificial Sequence
  chemically synthesized
taatgaagttcatccagaaaaa

SEQ ID NO: 1327299 - DNA, 22 bp, Artificial Sequence
  chemically synthesized
aatcatagttgtttttctggat

SEQ ID NO: 1327300 - DNA, 22 bp, Artificial Sequence
  chemically synthesized
cagattataatgaagttcatcc

SEQ ID NO: 1327301 - DNA, 22 bp, Artificial Sequence
  chemically synthesized
ccagattataatgaagttcatc

SEQ ID NO: 1327302 - DNA, 22 bp, Artificial Sequence
  chemically synthesized
tttttctggatgaacttcatta

SEQ ID NO: 1327303 - DNA, 22 bp, Artificial Sequence
  chemically synthesized
ttctggatgaacttcattataa

SEQ ID NO: 1327304 - DNA, 22 bp, Artificial Sequence
  chemically synthesized
tctggatgaacttcattataat

SEQ ID NO: 1327305 - DNA, 22 bp, Artificial Sequence
  chemically synthesized
ctggatgaacttcattataatc

SEQ ID NO: 1327306 - DNA, 22 bp, Artificial Sequence
  chemically synthesized
tggatgaacttcattataatct

SEQ ID NO: 1327307 - DNA, 22 bp, Artificial Sequence
  chemically synthesized
gatgaacttcattataatctgg

SEQ ID NO: 1327308 - DNA, 22 bp, Artificial Sequence
  chemically synthesized
cattataatctggaaattcaca

SEQ ID NO: 1327309 - DNA, 22 bp, Artificial Sequence
  chemically synthesized
attataatctggaaattcacat

SEQ ID NO: 1327310 - DNA, 22 bp, Artificial Sequence
  chemically synthesized
ggagaaatgtcaatgtgaattt

SEQ ID NO: 1327311 - DNA, 22 bp, Artificial Sequence
  chemically synthesized
tgggagaaatgtcaatgtgaat

SEQ ID NO: 1327312 - DNA, 22 bp, Artificial Sequence
  chemically synthesized
ctgggagaaatgtcaatgtgaa

SEQ ID NO: 1327313 - DNA, 22 bp, Artificial Sequence
  chemically synthesized
taatctggaaattcacattgac

SEQ ID NO: 1327314 - DNA, 22 bp, Artificial Sequence
  chemically synthesized
tctgggagaaatgtcaatgtga

SEQ ID NO: 1327315 - DNA, 22 bp, Artificial Sequence
  chemically synthesized
gctttctgggagaaatgtcaat

SEQ ID NO: 1327316 - DNA, 22 bp, Artificial Sequence
  chemically synthesized
ggctttctgggagaaatgtcaa

SEQ ID NO: 1327317 - DNA, 22 bp, Artificial Sequence
  chemically synthesized
gaaattcacattgacatttctc

SEQ ID NO: 1327318 - DNA, 22 bp, Artificial Sequence
  chemically synthesized
tttggctttctgggagaaatgt

SEQ ID NO: 1327319 - DNA, 22 bp, Artificial Sequence
  chemically synthesized
atttggctttctgggagaaatg

SEQ ID NO: 1327320 - DNA, 22 bp, Artificial Sequence
  chemically synthesized
tatttggctttctgggagaaat

SEQ ID NO: 1327321 - DNA, 22 bp, Artificial Sequence
  chemically synthesized
acattgacatttctcccagaaa

SEQ ID NO: 1327322 - DNA, 22 bp, Artificial Sequence
  chemically synthesized
acatttctcccagaaagccaaa

SEQ ID NO: 1327323 - DNA, 22 bp, Artificial Sequence
  chemically synthesized
aatgtgtgctttatttggcttt

SEQ ID NO: 1327324 - DNA, 22 bp, Artificial Sequence
  chemically synthesized
taaatgtgtgctttatttggct

SEQ ID NO: 1327325 - DNA, 22 bp, Artificial Sequence
  chemically synthesized
ctaaatgtgtgctttatttggc

SEQ ID NO: 1327326 - DNA, 22 bp, Artificial Sequence
  chemically synthesized
tctaaatgtgtgctttatttgg

SEQ ID NO: 1327327 - DNA, 22 bp, Artificial Sequence
  chemically synthesized
ctcccagaaagccaaataaagc

SEQ ID NO: 1327328 - DNA, 22 bp, Artificial Sequence
  chemically synthesized
tcccagaaagccaaataaagca

SEQ ID NO: 1327329 - DNA, 22 bp, Artificial Sequence
  chemically synthesized
ccagaaagccaaataaagcaca

SEQ ID NO: 1327330 - DNA, 22 bp, Artificial Sequence
  chemically synthesized
ggctttctaaatgtgtgcttta

SEQ ID NO: 1327331 - DNA, 22 bp, Artificial Sequence
  chemically synthesized
aggctttctaaatgtgtgcttt

SEQ ID NO: 1327332 - DNA, 22 bp, Artificial Sequence
  chemically synthesized
tacttaggctttctaaatgtgt

SEQ ID NO: 1327333 - DNA, 22 bp, Artificial Sequence
  chemically synthesized
gatgctgtacttaggctttcta

SEQ ID NO: 1327334 - DNA, 22 bp, Artificial Sequence
  chemically synthesized
agatgctgtacttaggctttct

SEQ ID NO: 1327335 - DNA, 22 bp, Artificial Sequence
  chemically synthesized
tagatgctgtacttaggctttc

SEQ ID NO: 1327336 - DNA, 22 bp, Artificial Sequence
  chemically synthesized
agaaagcctaagtacagcatct

SEQ ID NO: 1327337 - DNA, 22 bp, Artificial Sequence
  chemically synthesized
gaaagcctaagtacagcatcta

SEQ ID NO: 1327338 - DNA, 22 bp, Artificial Sequence
  chemically synthesized
taatggtcaaggaagctttaga

SEQ ID NO: 1327339 - DNA, 22 bp, Artificial Sequence
  chemically synthesized
agtacagcatctaaagcttcct

SEQ ID NO: 1327340 - DNA, 22 bp, Artificial Sequence
  chemically synthesized
agttataatggtcaaggaagct

SEQ ID NO: 1327341 - DNA, 22 bp, Artificial Sequence
  chemically synthesized
ttcagttataatggtcaaggaa

SEQ ID NO: 1327342 - DNA, 22 bp, Artificial Sequence
  chemically synthesized
ttattcagttataatggtcaag

SEQ ID NO: 1327343 - DNA, 22 bp, Artificial Sequence
  chemically synthesized
aagcttccttgaccattataac

SEQ ID NO: 1327344 - DNA, 22 bp, Artificial Sequence
  chemically synthesized
cacggctgttattcagttataa

SEQ ID NO: 1327345 - DNA, 22 bp, Artificial Sequence
  chemically synthesized
ccttgaccattataactgaata

SEQ ID NO: 1327346 - DNA, 22 bp, Artificial Sequence
  chemically synthesized
cttgaccattataactgaataa

SEQ ID NO: 1327347 - DNA, 22 bp, Artificial Sequence
  chemically synthesized
cactacacggctgttattcagt

SEQ ID NO: 1327348 - DNA, 22 bp, Artificial Sequence
  chemically synthesized
gaccattataactgaataacag

SEQ ID NO: 1327349 - DNA, 22 bp, Artificial Sequence
  chemically synthesized
accattataactgaataacagc

SEQ ID NO: 1327350 - DNA, 22 bp, Artificial Sequence
  chemically synthesized
gcactacactacacggctgtta

SEQ ID NO: 1327351 - DNA, 22 bp, Artificial Sequence
  chemically synthesized
agcactacactacacggctgtt

SEQ ID NO: 1327352 - DNA, 22 bp, Artificial Sequence
  chemically synthesized
tagcactacactacacggctgt

SEQ ID NO: 1327353 - DNA, 22 bp, Artificial Sequence
  chemically synthesized
ttagcactacactacacggctg

SEQ ID NO: 1327354 - DNA, 22 bp, Artificial Sequence
  chemically synthesized
taactgaataacagccgtgtag

SEQ ID NO: 1327355 - DNA, 22 bp, Artificial Sequence
  chemically synthesized
tttagcactacactacacggct

SEQ ID NO: 1327356 - DNA, 22 bp, Artificial Sequence
  chemically synthesized
ttttagcactacactacacggc

SEQ ID NO: 1327357 - DNA, 22 bp, Artificial Sequence
  chemically synthesized
tttttagcactacactacacgg

SEQ ID NO: 1327358 - DNA, 22 bp, Artificial Sequence
  chemically synthesized
ttttttagcactacactacacg

SEQ ID NO: 1327359 - DNA, 22 bp, Artificial Sequence
  chemically synthesized
tttttttagcactacactacac

SEQ ID NO: 1327360 - DNA, 22 bp, Artificial Sequence
  chemically synthesized
ttttttttagcactacactaca

SEQ ID NO: 1327361 - DNA, 22 bp, Artificial Sequence
  chemically synthesized
aataacagccgtgtagtgtagt

SEQ ID NO: 1327362 - DNA, 22 bp, Artificial Sequence
  chemically synthesized
tttttttttagcactacactac

SEQ ID NO: 1327363 - DNA, 22 bp, Artificial Sequence
  chemically synthesized
gaataattttttttttttagca

SEQ ID NO: 1327364 - DNA, 22 bp, Artificial Sequence
  chemically synthesized
aaccatgtaactggaataattt

SEQ ID NO: 1327365 - DNA, 22 bp, Artificial Sequence
  chemically synthesized
aaaaaaaaaaattattccagtt

SEQ ID NO: 1327366 - DNA, 22 bp, Artificial Sequence
  chemically synthesized
aagagactgaaccatgtaactg

SEQ ID NO: 1327367 - DNA, 22 bp, Artificial Sequence
  chemically synthesized
taaatctcaagagactgaacca

SEQ ID NO: 1327368 - DNA, 22 bp, Artificial Sequence
  chemically synthesized
ttccagttacatggttcagtct

SEQ ID NO: 1327369 - DNA, 22 bp, Artificial Sequence
  chemically synthesized
cagttacatggttcagtctctt

SEQ ID NO: 1327370 - DNA, 22 bp, Artificial Sequence
  chemically synthesized
cctgtaaatctcaagagactga

SEQ ID NO: 1327371 - DNA, 22 bp, Artificial Sequence
  chemically synthesized
gctacctgtaaatctcaagaga

SEQ ID NO: 1327372 - DNA, 22 bp, Artificial Sequence
  chemically synthesized
catggttcagtctcttgagatt

SEQ ID NO: 1327373 - DNA, 22 bp, Artificial Sequence
  chemically synthesized
agtctcttgagatttacaggta

SEQ ID NO: 1327374 - DNA, 22 bp, Artificial Sequence
  chemically synthesized
tgggccataattggctacctgt

SEQ ID NO: 1327375 - DNA, 22 bp, Artificial Sequence
  chemically synthesized
ttgagatttacaggtagccaat

SEQ ID NO: 1327376 - DNA, 22 bp, Artificial Sequence
  chemically synthesized
gagatttacaggtagccaatta

SEQ ID NO: 1327377 - DNA, 22 bp, Artificial Sequence
  chemically synthesized
gcctgtgggccataattggcta

SEQ ID NO: 1327378 - DNA, 22 bp, Artificial Sequence
  chemically synthesized
agatttacaggtagccaattat

SEQ ID NO: 1327379 - DNA, 22 bp, Artificial Sequence
  chemically synthesized
tctggcctgtgggccataattg

SEQ ID NO: 1327380 - DNA, 22 bp, Artificial Sequence
  chemically synthesized
gtctggcctgtgggccataatt

SEQ ID NO: 1327381 - DNA, 22 bp, Artificial Sequence
  chemically synthesized
acaggtagccaattatggccca

SEQ ID NO: 1327382 - DNA, 22 bp, Artificial Sequence
  chemically synthesized
caggtagccaattatggcccac

SEQ ID NO: 1327383 - DNA, 22 bp, Artificial Sequence
  chemically synthesized
tggcccacaggccagacaagtg

SEQ ID NO: 1327384 - DNA, 22 bp, Artificial Sequence
  chemically synthesized
agacaacgatcagtcacttgtc

SEQ ID NO: 1327385 - DNA, 22 bp, Artificial Sequence
  chemically synthesized
cagacaacgatcagtcacttgt

SEQ ID NO: 1327386 - DNA, 22 bp, Artificial Sequence
  chemically synthesized
tcagacaacgatcagtcacttg

SEQ ID NO: 1327387 - DNA, 22 bp, Artificial Sequence
  chemically synthesized
ttttcagacaacgatcagtcac

SEQ ID NO: 1327388 - DNA, 22 bp, Artificial Sequence
  chemically synthesized
gtcgttgttttcagacaacgat

SEQ ID NO: 1327389 - DNA, 22 bp, Artificial Sequence
  chemically synthesized
cgtcgttgttttcagacaacga

SEQ ID NO: 1327390 - DNA, 22 bp, Artificial Sequence
  chemically synthesized
cccacttcgtcgttgttttcag

SEQ ID NO: 1327391 - DNA, 22 bp, Artificial Sequence
  chemically synthesized
atcgttgtctgaaaacaacgac

SEQ ID NO: 1327392 - DNA, 22 bp, Artificial Sequence
  chemically synthesized
acctccccacttcgtcgttgtt

SEQ ID NO: 1327393 - DNA, 22 bp, Artificial Sequence
  chemically synthesized
cacctccccacttcgtcgttgt

SEQ ID NO: 1327394 - DNA, 22 bp, Artificial Sequence
  chemically synthesized
tcacctccccacttcgtcgttg

SEQ ID NO: 1327395 - DNA, 22 bp, Artificial Sequence
  chemically synthesized
ttcacctccccacttcgtcgtt

SEQ ID NO: 1327396 - DNA, 22 bp, Artificial Sequence
  chemically synthesized
tttcacctccccacttcgtcgt

SEQ ID NO: 1327397 - DNA, 22 bp, Artificial Sequence
  chemically synthesized
tctgaaaacaacgacgaagtgg

SEQ ID NO: 1327398 - DNA, 22 bp, Artificial Sequence
  chemically synthesized
aaaacaacgacgaagtggggag

SEQ ID NO: 1327399 - DNA, 22 bp, Artificial Sequence
  chemically synthesized
taaggggaaaaaaaaccgtaaa

SEQ ID NO: 1327400 - DNA, 22 bp, Artificial Sequence
  chemically synthesized
cctgtaaggggaaaaaaaaccg

SEQ ID NO: 1327401 - DNA, 22 bp, Artificial Sequence
  chemically synthesized
acggttttttttccccttacag

SEQ ID NO: 1327402 - DNA, 22 bp, Artificial Sequence
  chemically synthesized
cggttttttttccccttacagg

SEQ ID NO: 1327403 - DNA, 22 bp, Artificial Sequence
  chemically synthesized
aaacaacatctacctgtaaggg

SEQ ID NO: 1327404 - DNA, 22 bp, Artificial Sequence
  chemically synthesized
caaacaacatctacctgtaagg

SEQ ID NO: 1327405 - DNA, 22 bp, Artificial Sequence
  chemically synthesized
tttcaaacaacatctacctgta

SEQ ID NO: 1327406 - DNA, 22 bp, Artificial Sequence
  chemically synthesized
tttttccccttacaggtagatg

SEQ ID NO: 1327407 - DNA, 22 bp, Artificial Sequence
  chemically synthesized
ttttccccttacaggtagatgt

SEQ ID NO: 1327408 - DNA, 22 bp, Artificial Sequence
  chemically synthesized
tttccccttacaggtagatgtt

SEQ ID NO: 1327409 - DNA, 22 bp, Artificial Sequence
  chemically synthesized
attatttcaaacaacatctacc

SEQ ID NO: 1327410 - DNA, 22 bp, Artificial Sequence
  chemically synthesized
ttccccttacaggtagatgttg

SEQ ID NO: 1327411 - DNA, 22 bp, Artificial Sequence
  chemically synthesized
tccccttacaggtagatgttgt

SEQ ID NO: 1327412 - DNA, 22 bp, Artificial Sequence
  chemically synthesized
ccccttacaggtagatgttgtt

SEQ ID NO: 1327413 - DNA, 22 bp, Artificial Sequence
  chemically synthesized
cccttacaggtagatgttgttt

SEQ ID NO: 1327414 - DNA, 22 bp, Artificial Sequence
  chemically synthesized
aatctcattatttcaaacaaca

SEQ ID NO: 1327415 - DNA, 22 bp, Artificial Sequence
  chemically synthesized
aaatctcattatttcaaacaac

SEQ ID NO: 1327416 - DNA, 22 bp, Artificial Sequence
  chemically synthesized
taaatctcattatttcaaacaa

SEQ ID NO: 1327417 - DNA, 22 bp, Artificial Sequence
  chemically synthesized
acaggtagatgttgtttgaaat

SEQ ID NO: 1327418 - DNA, 22 bp, Artificial Sequence
  chemically synthesized
caggtagatgttgtttgaaata

SEQ ID NO: 1327419 - DNA, 22 bp, Artificial Sequence
  chemically synthesized
gcgttttaaatctcattatttc

SEQ ID NO: 1327420 - DNA, 22 bp, Artificial Sequence
  chemically synthesized
cattagcgttttaaatctcatt

SEQ ID NO: 1327421 - DNA, 22 bp, Artificial Sequence
  chemically synthesized
tgcattagcgttttaaatctca

SEQ ID NO: 1327422 - DNA, 22 bp, Artificial Sequence
  chemically synthesized
tttgaaataatgagatttaaaa

SEQ ID NO: 1327423 - DNA, 22 bp, Artificial Sequence
  chemically synthesized
gaaataatgagatttaaaacgc

SEQ ID NO: 1327424 - DNA, 22 bp, Artificial Sequence
  chemically synthesized
aaataatgagatttaaaacgct

SEQ ID NO: 1327425 - DNA, 22 bp, Artificial Sequence
  chemically synthesized
aaaacgctaatgcagagctttg

SEQ ID NO: 1327426 - DNA, 22 bp, Artificial Sequence
  chemically synthesized
aaacgctaatgcagagctttga

SEQ ID NO: 1327427 - DNA, 22 bp, Artificial Sequence
  chemically synthesized
atgcagagctttgatctcttct

SEQ ID NO: 1327428 - DNA, 22 bp, Artificial Sequence
  chemically synthesized
tgatctcttctttgatgtttct

SEQ ID NO: 1327429 - DNA, 22 bp, Artificial Sequence
  chemically synthesized
gatctcttctttgatgtttctt

SEQ ID NO: 1327430 - DNA, 22 bp, Artificial Sequence
  chemically synthesized
atctcttctttgatgtttcttg

SEQ ID NO: 1327431 - DNA, 22 bp, Artificial Sequence
  chemically synthesized
atatagacaacaggcaagaaac

SEQ ID NO: 1327432 - DNA, 22 bp, Artificial Sequence
  chemically synthesized
catatagacaacaggcaagaaa

SEQ ID NO: 1327433 - DNA, 22 bp, Artificial Sequence
  chemically synthesized
ttctttgatgtttcttgcctgt

SEQ ID NO: 1327434 - DNA, 22 bp, Artificial Sequence
  chemically synthesized
ctttgatgtttcttgcctgttg

SEQ ID NO: 1327435 - DNA, 22 bp, Artificial Sequence
  chemically synthesized
tttgatgtttcttgcctgttgt

SEQ ID NO: 1327436 - DNA, 22 bp, Artificial Sequence
  chemically synthesized
tatttcatatagacaacaggca

SEQ ID NO: 1327437 - DNA, 22 bp, Artificial Sequence
  chemically synthesized
tgatgtttcttgcctgttgtct

SEQ ID NO: 1327438 - DNA, 22 bp, Artificial Sequence
  chemically synthesized
gatgtttcttgcctgttgtcta

SEQ ID NO: 1327439 - DNA, 22 bp, Artificial Sequence
  chemically synthesized
atgtttcttgcctgttgtctat

SEQ ID NO: 1327440 - DNA, 22 bp, Artificial Sequence
  chemically synthesized
actatatttcatatagacaaca

SEQ ID NO: 1327441 - DNA, 22 bp, Artificial Sequence
  chemically synthesized
actgactatatttcatatagac

SEQ ID NO: 1327442 - DNA, 22 bp, Artificial Sequence
  chemically synthesized
aactgactatatttcatataga

SEQ ID NO: 1327443 - DNA, 22 bp, Artificial Sequence
  chemically synthesized
cttgcctgttgtctatatgaaa

SEQ ID NO: 1327444 - DNA, 22 bp, Artificial Sequence
  chemically synthesized
taactgactatatttcatatag

SEQ ID NO: 1327445 - DNA, 22 bp, Artificial Sequence
  chemically synthesized
ttgcctgttgtctatatgaaat

SEQ ID NO: 1327446 - DNA, 22 bp, Artificial Sequence
  chemically synthesized
gcctgttgtctatatgaaatat

SEQ ID NO: 1327447 - DNA, 22 bp, Artificial Sequence
  chemically synthesized
ttttaactgactatatttcata

SEQ ID NO: 1327448 - DNA, 22 bp, Artificial Sequence
  chemically synthesized
cctgttgtctatatgaaatata

SEQ ID NO: 1327449 - DNA, 22 bp, Artificial Sequence
  chemically synthesized
attttaactgactatatttcat

SEQ ID NO: 1327450 - DNA, 22 bp, Artificial Sequence
  chemically synthesized
tattttaactgactatatttca

SEQ ID NO: 1327451 - DNA, 22 bp, Artificial Sequence
  chemically synthesized
ttattttaactgactatatttc

SEQ ID NO: 1327452 - DNA, 22 bp, Artificial Sequence
  chemically synthesized
tttattttaactgactatattt

SEQ ID NO: 1327453 - DNA, 22 bp, Artificial Sequence
  chemically synthesized
ttgtctatatgaaatatagtca

SEQ ID NO: 1327454 - DNA, 22 bp, Artificial Sequence
  chemically synthesized
tctatatgaaatatagtcagtt

SEQ ID NO: 1327455 - DNA, 22 bp, Artificial Sequence
  chemically synthesized
gctttttattttaactgactat

SEQ ID NO: 1327456 - DNA, 22 bp, Artificial Sequence
  chemically synthesized
tggctttttattttaactgact

SEQ ID NO: 1327457 - DNA, 22 bp, Artificial Sequence
  chemically synthesized
tatgaaatatagtcagttaaaa

SEQ ID NO: 1327458 - DNA, 22 bp, Artificial Sequence
  chemically synthesized
tctggctttttattttaactga

SEQ ID NO: 1327459 - DNA, 22 bp, Artificial Sequence
  chemically synthesized
ttctctggctttttattttaac

SEQ ID NO: 1327460 - DNA, 22 bp, Artificial Sequence
  chemically synthesized
gtgagtagaaactattctctgg

SEQ ID NO: 1327461 - DNA, 22 bp, Artificial Sequence
  chemically synthesized
aaataaaaagccagagaatagt

SEQ ID NO: 1327462 - DNA, 22 bp, Artificial Sequence
  chemically synthesized
atcattagtgagtagaaactat

SEQ ID NO: 1327463 - DNA, 22 bp, Artificial Sequence
  chemically synthesized
ttaatcattagtgagtagaaac

SEQ ID NO: 1327464 - DNA, 22 bp, Artificial Sequence
  chemically synthesized
attaatcattagtgagtagaaa

SEQ ID NO: 1327465 - DNA, 22 bp, Artificial Sequence
  chemically synthesized
tattaatcattagtgagtagaa

SEQ ID NO: 1327466 - DNA, 22 bp, Artificial Sequence
  chemically synthesized
ttattaatcattagtgagtaga

SEQ ID NO: 1327467 - DNA, 22 bp, Artificial Sequence
  chemically synthesized
ccaagcagtttttattaatcat

SEQ ID NO: 1327468 - DNA, 22 bp, Artificial Sequence
  chemically synthesized
gccaagcagtttttattaatca

SEQ ID NO: 1327469 - DNA, 22 bp, Artificial Sequence
  chemically synthesized
ctactcactaatgattaataaa

SEQ ID NO: 1327470 - DNA, 22 bp, Artificial Sequence
  chemically synthesized
tactcactaatgattaataaaa

SEQ ID NO: 1327471 - DNA, 22 bp, Artificial Sequence
  chemically synthesized
ctcactaatgattaataaaaac

SEQ ID NO: 1327472 - DNA, 22 bp, Artificial Sequence
  chemically synthesized
catttgccaagcagtttttatt

SEQ ID NO: 1327473 - DNA, 22 bp, Artificial Sequence
  chemically synthesized
actaatgattaataaaaactgc

SEQ ID NO: 1327474 - DNA, 22 bp, Artificial Sequence
  chemically synthesized
atgattaataaaaactgcttgg

SEQ ID NO: 1327475 - DNA, 22 bp, Artificial Sequence
  chemically synthesized
ataaaaactgcttggcaaatgc

SEQ ID NO: 1327476 - DNA, 22 bp, Artificial Sequence
  chemically synthesized
tcaatgtgcaagattgcatttg

SEQ ID NO: 1327477 - DNA, 22 bp, Artificial Sequence
  chemically synthesized
gtcaatgtgcaagattgcattt

SEQ ID NO: 1327478 - DNA, 22 bp, Artificial Sequence
  chemically synthesized
atttgtcaatgtgcaagattgc

SEQ ID NO: 1327479 - DNA, 22 bp, Artificial Sequence
  chemically synthesized
catttgtcaatgtgcaagattg

SEQ ID NO: 1327480 - DNA, 22 bp, Artificial Sequence
  chemically synthesized
cttggcaaatgcaatcttgcac

SEQ ID NO: 1327481 - DNA, 22 bp, Artificial Sequence
  chemically synthesized
tcatttgtcaatgtgcaagatt

SEQ ID NO: 1327482 - DNA, 22 bp, Artificial Sequence
  chemically synthesized
ggcaaatgcaatcttgcacatt

SEQ ID NO: 1327483 - DNA, 22 bp, Artificial Sequence
  chemically synthesized
ttttcatttgtcaatgtgcaag

SEQ ID NO: 1327484 - DNA, 22 bp, Artificial Sequence
  chemically synthesized
gcaaatgcaatcttgcacattg

SEQ ID NO: 1327485 - DNA, 22 bp, Artificial Sequence
  chemically synthesized
tgttttcatttgtcaatgtgca

SEQ ID NO: 1327486 - DNA, 22 bp, Artificial Sequence
  chemically synthesized
ttctgttttcatttgtcaatgt

SEQ ID NO: 1327487 - DNA, 22 bp, Artificial Sequence
  chemically synthesized
ggcatcctattctgttttcatt

SEQ ID NO: 1327488 - DNA, 22 bp, Artificial Sequence
  chemically synthesized
gcacattgacaaatgaaaacag

SEQ ID NO: 1327489 - DNA, 22 bp, Artificial Sequence
  chemically synthesized
cacattgacaaatgaaaacaga

SEQ ID NO: 1327490 - DNA, 22 bp, Artificial Sequence
  chemically synthesized
ttgggcatcctattctgttttc

SEQ ID NO: 1327491 - DNA, 22 bp, Artificial Sequence
  chemically synthesized
acaaatgaaaacagaataggat

SEQ ID NO: 1327492 - DNA, 22 bp, Artificial Sequence
  chemically synthesized
aaccattgttgggcatcctatt

SEQ ID NO: 1327493 - DNA, 22 bp, Artificial Sequence
  chemically synthesized
aaaccattgttgggcatcctat

SEQ ID NO: 1327494 - DNA, 22 bp, Artificial Sequence
  chemically synthesized
taaaccattgttgggcatccta

SEQ ID NO: 1327495 - DNA, 22 bp, Artificial Sequence
  chemically synthesized
ttaaaccattgttgggcatcct

SEQ ID NO: 1327496 - DNA, 22 bp, Artificial Sequence
  chemically synthesized
tttaaaccattgttgggcatcc

SEQ ID NO: 1327497 - DNA, 22 bp, Artificial Sequence
  chemically synthesized
ttttaaaccattgttgggcatc

SEQ ID NO: 1327498 - DNA, 22 bp, Artificial Sequence
  chemically synthesized
tttttaaaccattgttgggcat

SEQ ID NO: 1327499 - DNA, 22 bp, Artificial Sequence
  chemically synthesized
ttttttaaaccattgttgggca

SEQ ID NO: 1327500 - DNA, 22 bp, Artificial Sequence
  chemically synthesized
tttttttaaaccattgttgggc

SEQ ID NO: 1327501 - DNA, 22 bp, Artificial Sequence
  chemically synthesized
ttttttttaaaccattgttggg

SEQ ID NO: 1327502 - DNA, 22 bp, Artificial Sequence
  chemically synthesized
tttttttttaaaccattgttgg

SEQ ID NO: 1327503 - DNA, 22 bp, Artificial Sequence
  chemically synthesized
ttttttttttaaaccattgttg

SEQ ID NO: 1327504 - DNA, 22 bp, Artificial Sequence
  chemically synthesized
aaaaaaaaaaaaggtttttttg

SEQ ID NO: 1327505 - DNA, 22 bp, Artificial Sequence
  chemically synthesized
aaaaaaaaaaaggtttttttgt

SEQ ID NO: 1327506 - DNA, 22 bp, Artificial Sequence
  chemically synthesized
tggcaatgtaaacaaacaaaga

SEQ ID NO: 1327507 - DNA, 22 bp, Artificial Sequence
  chemically synthesized
ttttgtttgtttctttgtttgt

SEQ ID NO: 1327508 - DNA, 22 bp, Artificial Sequence
  chemically synthesized
tttgtttgtttctttgtttgtt

SEQ ID NO: 1327509 - DNA, 22 bp, Artificial Sequence
  chemically synthesized
ttgtttgtttctttgtttgttt

SEQ ID NO: 1327510 - DNA, 22 bp, Artificial Sequence
  chemically synthesized
tgtttgtttctttgtttgttta

SEQ ID NO: 1327511 - DNA, 22 bp, Artificial Sequence
  chemically synthesized
gtttgtttctttgtttgtttac

SEQ ID NO: 1327512 - DNA, 22 bp, Artificial Sequence
  chemically synthesized
tttgtttctttgtttgtttaca

SEQ ID NO: 1327513 - DNA, 22 bp, Artificial Sequence
  chemically synthesized
gtttctttgtttgtttacattg

SEQ ID NO: 1327514 - DNA, 22 bp, Artificial Sequence
  chemically synthesized
tttctttgtttgtttacattgc

SEQ ID NO: 1327515 - DNA, 22 bp, Artificial Sequence
  chemically synthesized
ctttgtttgtttacattgccac

SEQ ID NO: 1327516 - DNA, 22 bp, Artificial Sequence
  chemically synthesized
tttgtttgtttacattgccaca

SEQ ID NO: 1327517 - DNA, 22 bp, Artificial Sequence
  chemically synthesized
tgtttgtttacattgccacagt

SEQ ID NO: 1327518 - DNA, 22 bp, Artificial Sequence
  chemically synthesized
gtttgtttacattgccacagta

SEQ ID NO: 1327519 - DNA, 22 bp, Artificial Sequence
  chemically synthesized
tttgtttacattgccacagtac

SEQ ID NO: 1327520 - DNA, 22 bp, Artificial Sequence
  chemically synthesized
gtttacattgccacagtacact

SEQ ID NO: 1327521 - DNA, 22 bp, Artificial Sequence
  chemically synthesized
tttacattgccacagtacactg

SEQ ID NO: 1327522 - DNA, 22 bp, Artificial Sequence
  chemically synthesized
acattgccacagtacactgctc

SEQ ID NO: 1327523 - DNA, 22 bp, Artificial Sequence
  chemically synthesized
cattgccacagtacactgctct

SEQ ID NO: 1327524 - DNA, 22 bp, Artificial Sequence
  chemically synthesized
cagggtcagggaacaaagagca

SEQ ID NO: 1327525 - DNA, 22 bp, Artificial Sequence
  chemically synthesized
ccacagtacactgctctttgtt

SEQ ID NO: 1327526 - DNA, 22 bp, Artificial Sequence
  chemically synthesized
gcagggtcagggaacaaagagc

SEQ ID NO: 1327527 - DNA, 22 bp, Artificial Sequence
  chemically synthesized
ctctttgttccctgaccctgca

SEQ ID NO: 1327528 - DNA, 22 bp, Artificial Sequence
  chemically synthesized
tttgttccctgaccctgcaagc

SEQ ID NO: 1327529 - DNA, 22 bp, Artificial Sequence
  chemically synthesized
tgttccctgaccctgcaagctc

SEQ ID NO: 1327530 - DNA, 22 bp, Artificial Sequence
  chemically synthesized
gttccctgaccctgcaagctct

SEQ ID NO: 1327531 - DNA, 22 bp, Artificial Sequence
  chemically synthesized
ttccctgaccctgcaagctctc

SEQ ID NO: 1327532 - DNA, 22 bp, Artificial Sequence
  chemically synthesized
cctgaccctgcaagctctcacc

SEQ ID NO: 1327533 - DNA, 22 bp, Artificial Sequence
  chemically synthesized
accctgcaagctctcaccgggt

SEQ ID NO: 1327534 - DNA, 22 bp, Artificial Sequence
  chemically synthesized
caagctctcaccgggtgacttc

SEQ ID NO: 1327535 - DNA, 22 bp, Artificial Sequence
  chemically synthesized
tcaccgggtgacttcgactttg

SEQ ID NO: 1327536 - DNA, 22 bp, Artificial Sequence
  chemically synthesized
accgggtgacttcgactttgca

SEQ ID NO: 1327537 - DNA, 22 bp, Artificial Sequence
  chemically synthesized
aaaaagagaaaagtaggtgcaa

SEQ ID NO: 1327538 - DNA, 22 bp, Artificial Sequence
  chemically synthesized
taaaaaagagaaaagtaggtgc

SEQ ID NO: 1327539 - DNA, 22 bp, Artificial Sequence
  chemically synthesized
cgactttgcacctacttttctc

SEQ ID NO: 1327540 - DNA, 22 bp, Artificial Sequence
  chemically synthesized
gactttgcacctacttttctct

SEQ ID NO: 1327541 - DNA, 22 bp, Artificial Sequence
  chemically synthesized
tgcacctacttttctctttttt

SEQ ID NO: 1327542 - DNA, 22 bp, Artificial Sequence
  chemically synthesized
gcacctacttttctctttttta

SEQ ID NO: 1327543 - DNA, 22 bp, Artificial Sequence
  chemically synthesized
cacctacttttctcttttttag

SEQ ID NO: 1327544 - DNA, 22 bp, Artificial Sequence
  chemically synthesized
cttttctcttttttagaatgcc

SEQ ID NO: 1327545 - DNA, 22 bp, Artificial Sequence
  chemically synthesized
ttctcttttttagaatgccctc

SEQ ID NO: 1327546 - DNA, 22 bp, Artificial Sequence
  chemically synthesized
tctcttttttagaatgccctct

SEQ ID NO: 1327547 - DNA, 22 bp, Artificial Sequence
  chemically synthesized
ctcttttttagaatgccctctc

SEQ ID NO: 1327548 - DNA, 22 bp, Artificial Sequence
  chemically synthesized
tcttttttagaatgccctctct

SEQ ID NO: 1327549 - DNA, 22 bp, Artificial Sequence
  chemically synthesized
gtggtaacatgtgagagagggc

SEQ ID NO: 1327550 - DNA, 22 bp, Artificial Sequence
  chemically synthesized
ttttttagaatgccctctctca

SEQ ID NO: 1327551 - DNA, 22 bp, Artificial Sequence
  chemically synthesized
tagtggtaacatgtgagagagg

SEQ ID NO: 1327552 - DNA, 22 bp, Artificial Sequence
  chemically synthesized
ttttagaatgccctctctcaca

SEQ ID NO: 1327553 - DNA, 22 bp, Artificial Sequence
  chemically synthesized
tttagaatgccctctctcacat

SEQ ID NO: 1327554 - DNA, 22 bp, Artificial Sequence
  chemically synthesized
tctagtggtaacatgtgagaga

SEQ ID NO: 1327555 - DNA, 22 bp, Artificial Sequence
  chemically synthesized
ttagaatgccctctctcacatg

SEQ ID NO: 1327556 - DNA, 22 bp, Artificial Sequence
  chemically synthesized
ctctagtggtaacatgtgagag

SEQ ID NO: 1327557 - DNA, 22 bp, Artificial Sequence
  chemically synthesized
tagaatgccctctctcacatgt

SEQ ID NO: 1327558 - DNA, 22 bp, Artificial Sequence
  chemically synthesized
agaatgccctctctcacatgtt

SEQ ID NO: 1327559 - DNA, 22 bp, Artificial Sequence
  chemically synthesized
gaatgccctctctcacatgtta

SEQ ID NO: 1327560 - DNA, 22 bp, Artificial Sequence
  chemically synthesized
tttctctagtggtaacatgtga

SEQ ID NO: 1327561 - DNA, 22 bp, Artificial Sequence
  chemically synthesized
tctcacatgttaccactagaga

SEQ ID NO: 1327562 - DNA, 22 bp, Artificial Sequence
  chemically synthesized
tcacatgttaccactagagaaa

SEQ ID NO: 1327563 - DNA, 22 bp, Artificial Sequence
  chemically synthesized
acatgttaccactagagaaaca

SEQ ID NO: 1327564 - DNA, 22 bp, Artificial Sequence
  chemically synthesized
aagcacacgtgattgtttctct

SEQ ID NO: 1327565 - DNA, 22 bp, Artificial Sequence
  chemically synthesized
gaagcacacgtgattgtttctc

SEQ ID NO: 1327566 - DNA, 22 bp, Artificial Sequence
  chemically synthesized
gccttgaagcacacgtgattgt

SEQ ID NO: 1327567 - DNA, 22 bp, Artificial Sequence
  chemically synthesized
ccactagagaaacaatcacgtg

SEQ ID NO: 1327568 - DNA, 22 bp, Artificial Sequence
  chemically synthesized
ggccttgaagcacacgtgattg

SEQ ID NO: 1327569 - DNA, 22 bp, Artificial Sequence
  chemically synthesized
atttggccttgaagcacacgtg

SEQ ID NO: 1327570 - DNA, 22 bp, Artificial Sequence
  chemically synthesized
gatttggccttgaagcacacgt

SEQ ID NO: 1327571 - DNA, 22 bp, Artificial Sequence
  chemically synthesized
gagaaacaatcacgtgtgcttc

SEQ ID NO: 1327572 - DNA, 22 bp, Artificial Sequence
  chemically synthesized
tgatttggccttgaagcacacg

SEQ ID NO: 1327573 - DNA, 22 bp, Artificial Sequence
  chemically synthesized
ttgatttggccttgaagcacac

SEQ ID NO: 1327574 - DNA, 22 bp, Artificial Sequence
  chemically synthesized
aagaggaaatttttgatttggc

SEQ ID NO: 1327575 - DNA, 22 bp, Artificial Sequence
  chemically synthesized
caaggccaaatcaaaaatttcc

SEQ ID NO: 1327576 - DNA, 22 bp, Artificial Sequence
  chemically synthesized
aaggccaaatcaaaaatttcct

SEQ ID NO: 1327577 - DNA, 22 bp, Artificial Sequence
  chemically synthesized
agtccaaaggactgaagaggaa

SEQ ID NO: 1327578 - DNA, 22 bp, Artificial Sequence
  chemically synthesized
tcagtccaaaggactgaagagg

SEQ ID NO: 1327579 - DNA, 22 bp, Artificial Sequence
  chemically synthesized
tctcagtccaaaggactgaaga

SEQ ID NO: 1327580 - DNA, 22 bp, Artificial Sequence
  chemically synthesized
cctcttcagtcctttggactga

SEQ ID NO: 1327581 - DNA, 22 bp, Artificial Sequence
  chemically synthesized
ggcataactctctcagtccaaa

SEQ ID NO: 1327582 - DNA, 22 bp, Artificial Sequence
  chemically synthesized
ctcttcagtcctttggactgag

SEQ ID NO: 1327583 - DNA, 22 bp, Artificial Sequence
  chemically synthesized
ttcagtcctttggactgagaga

SEQ ID NO: 1327584 - DNA, 22 bp, Artificial Sequence
  chemically synthesized
cagtcctttggactgagagagt

SEQ ID NO: 1327585 - DNA, 22 bp, Artificial Sequence
  chemically synthesized
agtcctttggactgagagagtt

SEQ ID NO: 1327586 - DNA, 22 bp, Artificial Sequence
  chemically synthesized
tgaaattgggcataactctctc

SEQ ID NO: 1327587 - DNA, 22 bp, Artificial Sequence
  chemically synthesized
tggactgagagagttatgccca

SEQ ID NO: 1327588 - DNA, 22 bp, Artificial Sequence
  chemically synthesized
ggactgagagagttatgcccaa

SEQ ID NO: 1327589 - DNA, 22 bp, Artificial Sequence
  chemically synthesized
gactgagagagttatgcccaat

SEQ ID NO: 1327590 - DNA, 22 bp, Artificial Sequence
  chemically synthesized
taccatatgctgtgaaattggg

SEQ ID NO: 1327591 - DNA, 22 bp, Artificial Sequence
  chemically synthesized
agagagttatgcccaatttcac

SEQ ID NO: 1327592 - DNA, 22 bp, Artificial Sequence
  chemically synthesized
gtaccatatgctgtgaaattgg

SEQ ID NO: 1327593 - DNA, 22 bp, Artificial Sequence
  chemically synthesized
tgcccaatttcacagcatatgg

SEQ ID NO: 1327594 - DNA, 22 bp, Artificial Sequence
  chemically synthesized
cacagcatatggtacaagcctc

SEQ ID NO: 1327595 - DNA, 22 bp, Artificial Sequence
  chemically synthesized
acagcatatggtacaagcctct

SEQ ID NO: 1327596 - DNA, 22 bp, Artificial Sequence
  chemically synthesized
tgttatttttctgtaccatggt

SEQ ID NO: 1327597 - DNA, 22 bp, Artificial Sequence
  chemically synthesized
ttatttttctgtaccatggtat

SEQ ID NO: 1327598 - DNA, 22 bp, Artificial Sequence
  chemically synthesized
tttttctgtaccatggtattat

SEQ ID NO: 1327599 - DNA, 22 bp, Artificial Sequence
  chemically synthesized
ttctgtaccatggtattatatg

SEQ ID NO: 1327600 - DNA, 22 bp, Artificial Sequence
  chemically synthesized
tctgtaccatggtattatatgt

SEQ ID NO: 1327601 - DNA, 22 bp, Artificial Sequence
  chemically synthesized
ctgtaccatggtattatatgta

SEQ ID NO: 1327602 - DNA, 22 bp, Artificial Sequence
  chemically synthesized
tgtaccatggtattatatgtac

SEQ ID NO: 1327603 - DNA, 22 bp, Artificial Sequence
  chemically synthesized
taccatggtattatatgtactt

SEQ ID NO: 1327604 - DNA, 22 bp, Artificial Sequence
  chemically synthesized
gaagagacacaggcaagtacat

SEQ ID NO: 1327605 - DNA, 22 bp, Artificial Sequence
  chemically synthesized
tatgtacttgcctgtgtctctt

SEQ ID NO: 1327606 - DNA, 22 bp, Artificial Sequence
  chemically synthesized
aggaccccatatctagaagaga

SEQ ID NO: 1327607 - DNA, 22 bp, Artificial Sequence
  chemically synthesized
gcctgtgtctcttctagatatg

SEQ ID NO: 1327608 - DNA, 22 bp, Artificial Sequence
  chemically synthesized
cctgtgtctcttctagatatgg

SEQ ID NO: 1327609 - DNA, 22 bp, Artificial Sequence
  chemically synthesized
tgtctcttctagatatggggtc

SEQ ID NO: 1327610 - DNA, 22 bp, Artificial Sequence
  chemically synthesized
ttctagatatggggtccttaac

SEQ ID NO: 1327611 - DNA, 22 bp, Artificial Sequence
  chemically synthesized
ctagatatggggtccttaacta

SEQ ID NO: 1327612 - DNA, 22 bp, Artificial Sequence
  chemically synthesized
tagatatggggtccttaactat

SEQ ID NO: 1327613 - DNA, 22 bp, Artificial Sequence
  chemically synthesized
gatatggggtccttaactattt

SEQ ID NO: 1327614 - DNA, 22 bp, Artificial Sequence
  chemically synthesized
aactatttttgtgctatggatc

SEQ ID NO: 1327615 - DNA, 22 bp, Artificial Sequence
  chemically synthesized
actatttttgtgctatggatcc

SEQ ID NO: 1327616 - DNA, 22 bp, Artificial Sequence
  chemically synthesized
accagatgccaaagggatccat

SEQ ID NO: 1327617 - DNA, 22 bp, Artificial Sequence
  chemically synthesized
caccagatgccaaagggatcca

SEQ ID NO: 1327618 - DNA, 22 bp, Artificial Sequence
  chemically synthesized
tttttgtgctatggatcccttt

SEQ ID NO: 1327619 - DNA, 22 bp, Artificial Sequence
  chemically synthesized
ttgtgctatggatccctttggc

SEQ ID NO: 1327620 - DNA, 22 bp, Artificial Sequence
  chemically synthesized
tgtgctatggatccctttggca

SEQ ID NO: 1327621 - DNA, 22 bp, Artificial Sequence
  chemically synthesized
gtgctatggatccctttggcat

SEQ ID NO: 1327622 - DNA, 22 bp, Artificial Sequence
  chemically synthesized
tgctatggatccctttggcatc

SEQ ID NO: 1327623 - DNA, 22 bp, Artificial Sequence
  chemically synthesized
catatgcttcaccagatgccaa

SEQ ID NO: 1327624 - DNA, 22 bp, Artificial Sequence
  chemically synthesized
tggatccctttggcatctggtg

SEQ ID NO: 1327625 - DNA, 22 bp, Artificial Sequence
  chemically synthesized
ggaagtgttccatatgcttcac

SEQ ID NO: 1327626 - DNA, 22 bp, Artificial Sequence
  chemically synthesized
tggcatctggtgaagcatatgg

SEQ ID NO: 1327627 - DNA, 22 bp, Artificial Sequence
  chemically synthesized
ggcatctggtgaagcatatgga

SEQ ID NO: 1327628 - DNA, 22 bp, Artificial Sequence
  chemically synthesized
gcatctggtgaagcatatggaa

SEQ ID NO: 1327629 - DNA, 22 bp, Artificial Sequence
  chemically synthesized
aaaacagtctgggaagtgttcc

SEQ ID NO: 1327630 - DNA, 22 bp, Artificial Sequence
  chemically synthesized
gtgaagcatatggaacacttcc

SEQ ID NO: 1327631 - DNA, 22 bp, Artificial Sequence
  chemically synthesized
gaaaacagtctgggaagtgttc

SEQ ID NO: 1327632 - DNA, 22 bp, Artificial Sequence
  chemically synthesized
cacatttgaaaacagtctggga

SEQ ID NO: 1327633 - DNA, 22 bp, Artificial Sequence
  chemically synthesized
gcacatttgaaaacagtctggg

SEQ ID NO: 1327634 - DNA, 22 bp, Artificial Sequence
  chemically synthesized
tgcacatttgaaaacagtctgg

SEQ ID NO: 1327635 - DNA, 22 bp, Artificial Sequence
  chemically synthesized
attttgcacatttgaaaacagt

SEQ ID NO: 1327636 - DNA, 22 bp, Artificial Sequence
  chemically synthesized
cattttgcacatttgaaaacag

SEQ ID NO: 1327637 - DNA, 22 bp, Artificial Sequence
  chemically synthesized
tcattttgcacatttgaaaaca

SEQ ID NO: 1327638 - DNA, 22 bp, Artificial Sequence
  chemically synthesized
gttttcattttgcacatttgaa

SEQ ID NO: 1327639 - DNA, 22 bp, Artificial Sequence
  chemically synthesized
cccagactgttttcaaatgtgc

SEQ ID NO: 1327640 - DNA, 22 bp, Artificial Sequence
  chemically synthesized
agttttcattttgcacatttga

SEQ ID NO: 1327641 - DNA, 22 bp, Artificial Sequence
  chemically synthesized
ccagactgttttcaaatgtgca

SEQ ID NO: 1327642 - DNA, 22 bp, Artificial Sequence
  chemically synthesized
tagttttcattttgcacatttg

SEQ ID NO: 1327643 - DNA, 22 bp, Artificial Sequence
  chemically synthesized
ttagttttcattttgcacattt

SEQ ID NO: 1327644 - DNA, 22 bp, Artificial Sequence
  chemically synthesized
ttttcaaatgtgcaaaatgaaa

SEQ ID NO: 1327645 - DNA, 22 bp, Artificial Sequence
  chemically synthesized
tatgcttttagttttcattttg

SEQ ID NO: 1327646 - DNA, 22 bp, Artificial Sequence
  chemically synthesized
atatgcttttagttttcatttt

SEQ ID NO: 1327647 - DNA, 22 bp, Artificial Sequence
  chemically synthesized
tatatgcttttagttttcattt

SEQ ID NO: 1327648 - DNA, 22 bp, Artificial Sequence
  chemically synthesized
tcaaatgtgcaaaatgaaaact

SEQ ID NO: 1327649 - DNA, 22 bp, Artificial Sequence
  chemically synthesized
ttatatgcttttagttttcatt

SEQ ID NO: 1327650 - DNA, 22 bp, Artificial Sequence
  chemically synthesized
caaatgtgcaaaatgaaaacta

SEQ ID NO: 1327651 - DNA, 22 bp, Artificial Sequence
  chemically synthesized
tttatatgcttttagttttcat

SEQ ID NO: 1327652 - DNA, 22 bp, Artificial Sequence
  chemically synthesized
aaatgtgcaaaatgaaaactaa

SEQ ID NO: 1327653 - DNA, 22 bp, Artificial Sequence
  chemically synthesized
ttttttatatgcttttagtttt

SEQ ID NO: 1327654 - DNA, 22 bp, Artificial Sequence
  chemically synthesized
gttttttatatgcttttagttt

SEQ ID NO: 1327655 - DNA, 22 bp, Artificial Sequence
  chemically synthesized
tgttttttatatgcttttagtt

SEQ ID NO: 1327656 - DNA, 22 bp, Artificial Sequence
  chemically synthesized
ctttgttttttatatgctttta

SEQ ID NO: 1327657 - DNA, 22 bp, Artificial Sequence
  chemically synthesized
cctttgttttttatatgctttt

SEQ ID NO: 1327658 - DNA, 22 bp, Artificial Sequence
  chemically synthesized
atttcctttgttttttatatgc

SEQ ID NO: 1327659 - DNA, 22 bp, Artificial Sequence
  chemically synthesized
aaagcatataaaaaacaaagga

SEQ ID NO: 1327660 - DNA, 22 bp, Artificial Sequence
  chemically synthesized
caatataattaatttcctttgt

SEQ ID NO: 1327661 - DNA, 22 bp, Artificial Sequence
  chemically synthesized
caattgcaatataattaatttc

SEQ ID NO: 1327662 - DNA, 22 bp, Artificial Sequence
  chemically synthesized
acaattgcaatataattaattt

SEQ ID NO: 1327663 - DNA, 22 bp, Artificial Sequence
  chemically synthesized
tacaattgcaatataattaatt

SEQ ID NO: 1327664 - DNA, 22 bp, Artificial Sequence
  chemically synthesized
agtattttacaattgcaatata

SEQ ID NO: 1327665 - DNA, 22 bp, Artificial Sequence
  chemically synthesized
tattcagtattttacaattgca

SEQ ID NO: 1327666 - DNA, 22 bp, Artificial Sequence
  chemically synthesized
attatattgcaattgtaaaata

SEQ ID NO: 1327667 - DNA, 22 bp, Artificial Sequence
  chemically synthesized
tattgcaattgtaaaatactga

SEQ ID NO: 1327668 - DNA, 22 bp, Artificial Sequence
  chemically synthesized
caattgtaaaatactgaatata

SEQ ID NO: 1327669 - DNA, 22 bp, Artificial Sequence
  chemically synthesized
atagcatataatagtattatat

SEQ ID NO: 1327670 - DNA, 22 bp, Artificial Sequence
  chemically synthesized
taaaatactgaatataatacta

SEQ ID NO: 1327671 - DNA, 22 bp, Artificial Sequence
  chemically synthesized
atgtattaatagcatataatag

SEQ ID NO: 1327672 - DNA, 22 bp, Artificial Sequence
  chemically synthesized
aatataatactattatatgcta

SEQ ID NO: 1327673 - DNA, 22 bp, Artificial Sequence
  chemically synthesized
taactaatgtattaatagcata

SEQ ID NO: 1327674 - DNA, 22 bp, Artificial Sequence
  chemically synthesized
ataactaatgtattaatagcat

SEQ ID NO: 1327675 - DNA, 22 bp, Artificial Sequence
  chemically synthesized
tgcttataactaatgtattaat

SEQ ID NO: 1327676 - DNA, 22 bp, Artificial Sequence
  chemically synthesized
ttatatgctattaatacattag

SEQ ID NO: 1327677 - DNA, 22 bp, Artificial Sequence
  chemically synthesized
ttatgcttataactaatgtatt

SEQ ID NO: 1327678 - DNA, 22 bp, Artificial Sequence
  chemically synthesized
tatgctattaatacattagtta

SEQ ID NO: 1327679 - DNA, 22 bp, Artificial Sequence
  chemically synthesized
attattatgcttataactaatg

SEQ ID NO: 1327680 - DNA, 22 bp, Artificial Sequence
  chemically synthesized
tattaattattatgcttataac

SEQ ID NO: 1327681 - DNA, 22 bp, Artificial Sequence
  chemically synthesized
ttaatacattagttataagcat

SEQ ID NO: 1327682 - DNA, 22 bp, Artificial Sequence
  chemically synthesized
gtattaattattatgcttataa

SEQ ID NO: 1327683 - DNA, 22 bp, Artificial Sequence
  chemically synthesized
atacattagttataagcataat

SEQ ID NO: 1327684 - DNA, 22 bp, Artificial Sequence
  chemically synthesized
atttgtattaattattatgctt

SEQ ID NO: 1327685 - DNA, 22 bp, Artificial Sequence
  chemically synthesized
aatttgtattaattattatgct

SEQ ID NO: 1327686 - DNA, 22 bp, Artificial Sequence
  chemically synthesized
taatttgtattaattattatgc

SEQ ID NO: 1327687 - DNA, 22 bp, Artificial Sequence
  chemically synthesized
ttaatttgtattaattattatg

SEQ ID NO: 1327688 - DNA, 22 bp, Artificial Sequence
  chemically synthesized
cttttaatttgtattaattatt

SEQ ID NO: 1327689 - DNA, 22 bp, Artificial Sequence
  chemically synthesized
gttataagcataataattaata

SEQ ID NO: 1327690 - DNA, 22 bp, Artificial Sequence
  chemically synthesized
taagcataataattaatacaaa

SEQ ID NO: 1327691 - DNA, 22 bp, Artificial Sequence
  chemically synthesized
atcactacttttaatttgtatt

SEQ ID NO: 1327692 - DNA, 22 bp, Artificial Sequence
  chemically synthesized
gtatactaatcactacttttaa

SEQ ID NO: 1327693 - DNA, 22 bp, Artificial Sequence
  chemically synthesized
atacaaattaaaagtagtgatt

SEQ ID NO: 1327694 - DNA, 22 bp, Artificial Sequence
  chemically synthesized
aaagtagtgattagtatactaa

SEQ ID NO: 1327695 - DNA, 22 bp, Artificial Sequence
  chemically synthesized
atatataccagtggttagtata

SEQ ID NO: 1327696 - DNA, 22 bp, Artificial Sequence
  chemically synthesized
gtatactaaccactggtatata

SEQ ID NO: 1327697 - DNA, 22 bp, Artificial Sequence
  chemically synthesized
aaaaatcatatgttaatatata

SEQ ID NO: 1327698 - DNA, 22 bp, Artificial Sequence
  chemically synthesized
gaaaaatcatatgttaatatat

SEQ ID NO: 1327699 - DNA, 22 bp, Artificial Sequence
  chemically synthesized
accactggtatatattaacata

SEQ ID NO: 1327700 - DNA, 22 bp, Artificial Sequence
  chemically synthesized
gatatcttgaaaaatcatatgt

SEQ ID NO: 1327701 - DNA, 22 bp, Artificial Sequence
  chemically synthesized
ggatatcttgaaaaatcatatg

SEQ ID NO: 1327702 - DNA, 22 bp, Artificial Sequence
  chemically synthesized
gtatatattaacatatgatttt

SEQ ID NO: 1327703 - DNA, 22 bp, Artificial Sequence
  chemically synthesized
tggatatcttgaaaaatcatat

SEQ ID NO: 1327704 - DNA, 22 bp, Artificial Sequence
  chemically synthesized
ttttggatatcttgaaaaatca

SEQ ID NO: 1327705 - DNA, 22 bp, Artificial Sequence
  chemically synthesized
gttgttttggatatcttgaaaa

SEQ ID NO: 1327706 - DNA, 22 bp, Artificial Sequence
  chemically synthesized
acatatgatttttcaagatatc

SEQ ID NO: 1327707 - DNA, 22 bp, Artificial Sequence
  chemically synthesized
tatcaaatcctagttgttttgg

SEQ ID NO: 1327708 - DNA, 22 bp, Artificial Sequence
  chemically synthesized
atatcaaatcctagttgttttg

SEQ ID NO: 1327709 - DNA, 22 bp, Artificial Sequence
  chemically synthesized
ttcaagatatccaaaacaacta

SEQ ID NO: 1327710 - DNA, 22 bp, Artificial Sequence
  chemically synthesized
tatatcaaatcctagttgtttt

SEQ ID NO: 1327711 - DNA, 22 bp, Artificial Sequence
  chemically synthesized
tcaagatatccaaaacaactag

SEQ ID NO: 1327712 - DNA, 22 bp, Artificial Sequence
  chemically synthesized
ttatatcaaatcctagttgttt

SEQ ID NO: 1327713 - DNA, 22 bp, Artificial Sequence
  chemically synthesized
caagatatccaaaacaactagg

SEQ ID NO: 1327714 - DNA, 22 bp, Artificial Sequence
  chemically synthesized
aagatatccaaaacaactagga

SEQ ID NO: 1327715 - DNA, 22 bp, Artificial Sequence
  chemically synthesized
ccaatatttttatatcaaatcc

SEQ ID NO: 1327716 - DNA, 22 bp, Artificial Sequence
  chemically synthesized
ttaccaatatttttatatcaaa

SEQ ID NO: 1327717 - DNA, 22 bp, Artificial Sequence
  chemically synthesized
attaccaatatttttatatcaa

SEQ ID NO: 1327718 - DNA, 22 bp, Artificial Sequence
  chemically synthesized
tgaatttattaccaatattttt

SEQ ID NO: 1327719 - DNA, 22 bp, Artificial Sequence
  chemically synthesized
ggatttgatataaaaatattgg

SEQ ID NO: 1327720 - DNA, 22 bp, Artificial Sequence
  chemically synthesized
gatataaaaatattggtaataa

SEQ ID NO: 1327721 - DNA, 22 bp, Artificial Sequence
  chemically synthesized
atataaaaatattggtaataaa

SEQ ID NO: 1327722 - DNA, 22 bp, Artificial Sequence
  chemically synthesized
gcaatatctgtgaatttattac

SEQ ID NO: 1327723 - DNA, 22 bp, Artificial Sequence
  chemically synthesized
gtaataaattcacagatattgc

SEQ ID NO: 1327724 - DNA, 22 bp, Artificial Sequence
  chemically synthesized
acagatattgctaataccgttc

SEQ ID NO: 1327725 - DNA, 22 bp, Artificial Sequence
  chemically synthesized
tgaagataagcaacacagaacg

SEQ ID NO: 1327726 - DNA, 22 bp, Artificial Sequence
  chemically synthesized
atgaagataagcaacacagaac

SEQ ID NO: 1327727 - DNA, 22 bp, Artificial Sequence
  chemically synthesized
tatgaagataagcaacacagaa

SEQ ID NO: 1327728 - DNA, 22 bp, Artificial Sequence
  chemically synthesized
ctaataccgttctgtgttgctt

SEQ ID NO: 1327729 - DNA, 22 bp, Artificial Sequence
  chemically synthesized
cctttatgaagataagcaacac

SEQ ID NO: 1327730 - DNA, 22 bp, Artificial Sequence
  chemically synthesized
ccctttatgaagataagcaaca

SEQ ID NO: 1327731 - DNA, 22 bp, Artificial Sequence
  chemically synthesized
ataccgttctgtgttgcttatc

SEQ ID NO: 1327732 - DNA, 22 bp, Artificial Sequence
  chemically synthesized
tccctttatgaagataagcaac

SEQ ID NO: 1327733 - DNA, 22 bp, Artificial Sequence
  chemically synthesized
tttccctttatgaagataagca

SEQ ID NO: 1327734 - DNA, 22 bp, Artificial Sequence
  chemically synthesized
ctttccctttatgaagataagc

SEQ ID NO: 1327735 - DNA, 22 bp, Artificial Sequence
  chemically synthesized
catttctttccctttatgaaga

SEQ ID NO: 1327736 - DNA, 22 bp, Artificial Sequence
  chemically synthesized
tgtgttgcttatcttcataaag

SEQ ID NO: 1327737 - DNA, 22 bp, Artificial Sequence
  chemically synthesized
gcatttctttccctttatgaag

SEQ ID NO: 1327738 - DNA, 22 bp, Artificial Sequence
  chemically synthesized
tgttgcttatcttcataaaggg

SEQ ID NO: 1327739 - DNA, 22 bp, Artificial Sequence
  chemically synthesized
cttatcttcataaagggaaaga

SEQ ID NO: 1327740 - DNA, 22 bp, Artificial Sequence
  chemically synthesized
aaaatttgcatttctttccctt

SEQ ID NO: 1327741 - DNA, 22 bp, Artificial Sequence
  chemically synthesized
atcttcataaagggaaagaaat

SEQ ID NO: 1327742 - DNA, 22 bp, Artificial Sequence
  chemically synthesized
tcttcataaagggaaagaaatg

SEQ ID NO: 1327743 - DNA, 22 bp, Artificial Sequence
  chemically synthesized
taactgaaaatttgcatttctt

SEQ ID NO: 1327744 - DNA, 22 bp, Artificial Sequence
  chemically synthesized
cataaagggaaagaaatgcaaa

SEQ ID NO: 1327745 - DNA, 22 bp, Artificial Sequence
  chemically synthesized
ataaagggaaagaaatgcaaat

SEQ ID NO: 1327746 - DNA, 22 bp, Artificial Sequence
  chemically synthesized
acctgtaactgaaaatttgcat

SEQ ID NO: 1327747 - DNA, 22 bp, Artificial Sequence
  chemically synthesized
actaacctgtaactgaaaattt

SEQ ID NO: 1327748 - DNA, 22 bp, Artificial Sequence
  chemically synthesized
cactaacctgtaactgaaaatt

SEQ ID NO: 1327749 - DNA, 22 bp, Artificial Sequence
  chemically synthesized
tcactaacctgtaactgaaaat

SEQ ID NO: 1327750 - DNA, 22 bp, Artificial Sequence
  chemically synthesized
ttttcactaacctgtaactgaa

SEQ ID NO: 1327751 - DNA, 22 bp, Artificial Sequence
  chemically synthesized
attttcactaacctgtaactga

SEQ ID NO: 1327752 - DNA, 22 bp, Artificial Sequence
  chemically synthesized
tattttcactaacctgtaactg

SEQ ID NO: 1327753 - DNA, 22 bp, Artificial Sequence
  chemically synthesized
catctttattttcactaacctg

SEQ ID NO: 1327754 - DNA, 22 bp, Artificial Sequence
  chemically synthesized
tcagttacaggttagtgaaaat

SEQ ID NO: 1327755 - DNA, 22 bp, Artificial Sequence
  chemically synthesized
cagttacaggttagtgaaaata

SEQ ID NO: 1327756 - DNA, 22 bp, Artificial Sequence
  chemically synthesized
agttacaggttagtgaaaataa

SEQ ID NO: 1327757 - DNA, 22 bp, Artificial Sequence
  chemically synthesized
caggttagtgaaaataaagatg

SEQ ID NO: 1327758 - DNA, 22 bp, Artificial Sequence
  chemically synthesized
gtgaaaataaagatgtaatttt

SEQ ID NO: 1327759 - DNA, 22 bp, Artificial Sequence
  chemically synthesized
gggtccatgaaccatgatagga

SEQ ID NO: 1327760 - DNA, 22 bp, Artificial Sequence
  chemically synthesized
atctggggtccatgaaccatga

SEQ ID NO: 1327761 - DNA, 22 bp, Artificial Sequence
  chemically synthesized
aatctggggtccatgaaccatg

SEQ ID NO: 1327762 - DNA, 22 bp, Artificial Sequence
  chemically synthesized
ttttcctatcatggttcatgga

SEQ ID NO: 1327763 - DNA, 22 bp, Artificial Sequence
  chemically synthesized
tttcctatcatggttcatggac

SEQ ID NO: 1327764 - DNA, 22 bp, Artificial Sequence
  chemically synthesized
ttcctatcatggttcatggacc

SEQ ID NO: 1327765 - DNA, 22 bp, Artificial Sequence
  chemically synthesized
tcctatcatggttcatggaccc

SEQ ID NO: 1327766 - DNA, 22 bp, Artificial Sequence
  chemically synthesized
cctatcatggttcatggacccc

SEQ ID NO: 1327767 - DNA, 22 bp, Artificial Sequence
  chemically synthesized
ctatcatggttcatggacccca

SEQ ID NO: 1327768 - DNA, 22 bp, Artificial Sequence
  chemically synthesized
tcatggttcatggaccccagat

SEQ ID NO: 1327769 - DNA, 22 bp, Artificial Sequence
  chemically synthesized
atggaccccagattaaggacac

SEQ ID NO: 1327770 - DNA, 22 bp, Artificial Sequence
  chemically synthesized
aagccatacagtcaaaatacag

SEQ ID NO: 1327771 - DNA, 22 bp, Artificial Sequence
  chemically synthesized
gaagccatacagtcaaaataca

SEQ ID NO: 1327772 - DNA, 22 bp, Artificial Sequence
  chemically synthesized
aggacactgtattttgactgta

SEQ ID NO: 1327773 - DNA, 22 bp, Artificial Sequence
  chemically synthesized
cccttgaagccatacagtcaaa

SEQ ID NO: 1327774 - DNA, 22 bp, Artificial Sequence
  chemically synthesized
tgcccttgaagccatacagtca

SEQ ID NO: 1327775 - DNA, 22 bp, Artificial Sequence
  chemically synthesized
tattttgactgtatggcttcaa

SEQ ID NO: 1327776 - DNA, 22 bp, Artificial Sequence
  chemically synthesized
tgactgtatggcttcaagggca

SEQ ID NO: 1327777 - DNA, 22 bp, Artificial Sequence
  chemically synthesized
gactgtatggcttcaagggcag

SEQ ID NO: 1327778 - DNA, 22 bp, Artificial Sequence
  chemically synthesized
actgtatggcttcaagggcaga

SEQ ID NO: 1327779 - DNA, 22 bp, Artificial Sequence
  chemically synthesized
tatggcttcaagggcagagttt

SEQ ID NO: 1327780 - DNA, 22 bp, Artificial Sequence
  chemically synthesized
caagggcagagtttttatttgt

SEQ ID NO: 1327781 - DNA, 22 bp, Artificial Sequence
  chemically synthesized
aagggcagagtttttatttgtt

SEQ ID NO: 1327782 - DNA, 22 bp, Artificial Sequence
  chemically synthesized
aagacacaaagatgaacaaata

SEQ ID NO: 1327783 - DNA, 22 bp, Artificial Sequence
  chemically synthesized
tactaaagacacaaagatgaac

SEQ ID NO: 1327784 - DNA, 22 bp, Artificial Sequence
  chemically synthesized
tgtactaaagacacaaagatga

SEQ ID NO: 1327785 - DNA, 22 bp, Artificial Sequence
  chemically synthesized
ttctgtactaaagacacaaaga

SEQ ID NO: 1327786 - DNA, 22 bp, Artificial Sequence
  chemically synthesized
ttatttgttcatctttgtgtct

SEQ ID NO: 1327787 - DNA, 22 bp, Artificial Sequence
  chemically synthesized
tatttgttcatctttgtgtctt

SEQ ID NO: 1327788 - DNA, 22 bp, Artificial Sequence
  chemically synthesized
tgttctgtactaaagacacaaa

SEQ ID NO: 1327789 - DNA, 22 bp, Artificial Sequence
  chemically synthesized
atttgttcatctttgtgtcttt

SEQ ID NO: 1327790 - DNA, 22 bp, Artificial Sequence
  chemically synthesized
tttgttcatctttgtgtcttta

SEQ ID NO: 1327791 - DNA, 22 bp, Artificial Sequence
  chemically synthesized
gttcatctttgtgtctttagta

SEQ ID NO: 1327792 - DNA, 22 bp, Artificial Sequence
  chemically synthesized
ttcatctttgtgtctttagtac

SEQ ID NO: 1327793 - DNA, 22 bp, Artificial Sequence
  chemically synthesized
atctttgtgtctttagtacaga

SEQ ID NO: 1327794 - DNA, 22 bp, Artificial Sequence
  chemically synthesized
tgcccatggttctgttctgtac

SEQ ID NO: 1327795 - DNA, 22 bp, Artificial Sequence
  chemically synthesized
tgtgtctttagtacagaacaga

SEQ ID NO: 1327796 - DNA, 22 bp, Artificial Sequence
  chemically synthesized
gtgtctttagtacagaacagaa

SEQ ID NO: 1327797 - DNA, 22 bp, Artificial Sequence
  chemically synthesized
tgtctttagtacagaacagaac

SEQ ID NO: 1327798 - DNA, 22 bp, Artificial Sequence
  chemically synthesized
gattgtgcccatggttctgttc

SEQ ID NO: 1327799 - DNA, 22 bp, Artificial Sequence
  chemically synthesized
ggattgtgcccatggttctgtt

SEQ ID NO: 1327800 - DNA, 22 bp, Artificial Sequence
  chemically synthesized
tagtacagaacagaaccatggg

SEQ ID NO: 1327801 - DNA, 22 bp, Artificial Sequence
  chemically synthesized
agtacagaacagaaccatgggc

SEQ ID NO: 1327802 - DNA, 22 bp, Artificial Sequence
  chemically synthesized
gtacagaacagaaccatgggca

SEQ ID NO: 1327803 - DNA, 22 bp, Artificial Sequence
  chemically synthesized
aataggcttggattgtgcccat

SEQ ID NO: 1327804 - DNA, 22 bp, Artificial Sequence
  chemically synthesized
ggccaccattcaataggcttgg

SEQ ID NO: 1327805 - DNA, 22 bp, Artificial Sequence
  chemically synthesized
aatacacaattcggccaccatt

SEQ ID NO: 1327806 - DNA, 22 bp, Artificial Sequence
  chemically synthesized
aacgttcaatacacaattcggc

SEQ ID NO: 1327807 - DNA, 22 bp, Artificial Sequence
  chemically synthesized
gaacgttcaatacacaattcgg

SEQ ID NO: 1327808 - DNA, 22 bp, Artificial Sequence
  chemically synthesized
ttgaatggtggccgaattgtgt

SEQ ID NO: 1327809 - DNA, 22 bp, Artificial Sequence
  chemically synthesized
aatggtggccgaattgtgtatt

SEQ ID NO: 1327810 - DNA, 22 bp, Artificial Sequence
  chemically synthesized
acatttgaacgttcaatacaca

SEQ ID NO: 1327811 - DNA, 22 bp, Artificial Sequence
  chemically synthesized
tgtattgaacgttcaaatgtca

SEQ ID NO: 1327812 - DNA, 22 bp, Artificial Sequence
  chemically synthesized
aacgttcaaatgtcagttctat

SEQ ID NO: 1327813 - DNA, 22 bp, Artificial Sequence
  chemically synthesized
aaatgtcagttctatcactgcc

SEQ ID NO: 1327814 - DNA, 22 bp, Artificial Sequence
  chemically synthesized
tgatgtgataagggcagtgata

SEQ ID NO: 1327815 - DNA, 22 bp, Artificial Sequence
  chemically synthesized
gtgatgtgataagggcagtgat

SEQ ID NO: 1327816 - DNA, 22 bp, Artificial Sequence
  chemically synthesized
ttgtgatgtgataagggcagtg

SEQ ID NO: 1327817 - DNA, 22 bp, Artificial Sequence
  chemically synthesized
tcttgtgatgtgataagggcag

SEQ ID NO: 1327818 - DNA, 22 bp, Artificial Sequence
  chemically synthesized
tctcttgtgatgtgataagggc

SEQ ID NO: 1327819 - DNA, 22 bp, Artificial Sequence
  chemically synthesized
ctctcttgtgatgtgataaggg

SEQ ID NO: 1327820 - DNA, 22 bp, Artificial Sequence
  chemically synthesized
tatcactgcccttatcacatca

SEQ ID NO: 1327821 - DNA, 22 bp, Artificial Sequence
  chemically synthesized
tcactgcccttatcacatcaca

SEQ ID NO: 1327822 - DNA, 22 bp, Artificial Sequence
  chemically synthesized
cccttatcacatcacaagagag

SEQ ID NO: 1327823 - DNA, 22 bp, Artificial Sequence
  chemically synthesized
atgaacatcaaatttctctctt

SEQ ID NO: 1327824 - DNA, 22 bp, Artificial Sequence
  chemically synthesized
aatgaacatcaaatttctctct

SEQ ID NO: 1327825 - DNA, 22 bp, Artificial Sequence
  chemically synthesized
atcacatcacaagagagaaatt

SEQ ID NO: 1327826 - DNA, 22 bp, Artificial Sequence
  chemically synthesized
taatgaacatcaaatttctctc

SEQ ID NO: 1327827 - DNA, 22 bp, Artificial Sequence
  chemically synthesized
tcacatcacaagagagaaattt

SEQ ID NO: 1327828 - DNA, 22 bp, Artificial Sequence
  chemically synthesized
attttaatgaacatcaaatttc

SEQ ID NO: 1327829 - DNA, 22 bp, Artificial Sequence
  chemically synthesized
ttaattttaatgaacatcaaat

SEQ ID NO: 1327830 - DNA, 22 bp, Artificial Sequence
  chemically synthesized
aaattattaattttaatgaaca

SEQ ID NO: 1327831 - DNA, 22 bp, Artificial Sequence
  chemically synthesized
aaaattattaattttaatgaac

SEQ ID NO: 1327832 - DNA, 22 bp, Artificial Sequence
  chemically synthesized
taaaattattaattttaatgaa

SEQ ID NO: 1327833 - DNA, 22 bp, Artificial Sequence
  chemically synthesized
ttaaaattattaattttaatga

SEQ ID NO: 1327834 - DNA, 22 bp, Artificial Sequence
  chemically synthesized
tttaaaattattaattttaatg

SEQ ID NO: 1327835 - DNA, 22 bp, Artificial Sequence
  chemically synthesized
gatgttcattaaaattaataat

SEQ ID NO: 1327836 - DNA, 22 bp, Artificial Sequence
  chemically synthesized
atgttcattaaaattaataatt

SEQ ID NO: 1327837 - DNA, 22 bp, Artificial Sequence
  chemically synthesized
aaatgttttttaaaattattaa

SEQ ID NO: 1327838 - DNA, 22 bp, Artificial Sequence
  chemically synthesized
attaaaatgttttttaaaatta

SEQ ID NO: 1327839 - DNA, 22 bp, Artificial Sequence
  chemically synthesized
attaaaattaataattttaaaa

SEQ ID NO: 1327840 - DNA, 22 bp, Artificial Sequence
  chemically synthesized
aattaaaatgttttttaaaatt

SEQ ID NO: 1327841 - DNA, 22 bp, Artificial Sequence
  chemically synthesized
taattaaaatgttttttaaaat

SEQ ID NO: 1327842 - DNA, 22 bp, Artificial Sequence
  chemically synthesized
aaattaataattttaaaaaaca

SEQ ID NO: 1327843 - DNA, 22 bp, Artificial Sequence
  chemically synthesized
ataattttaaaaaacattttaa

SEQ ID NO: 1327844 - DNA, 22 bp, Artificial Sequence
  chemically synthesized
taataaatattttaattaaaat

SEQ ID NO: 1327845 - DNA, 22 bp, Artificial Sequence
  chemically synthesized
taaaaaacattttaattaaaat

SEQ ID NO: 1327846 - DNA, 22 bp, Artificial Sequence
  chemically synthesized
attataataaatattttaatta

SEQ ID NO: 1327847 - DNA, 22 bp, Artificial Sequence
  chemically synthesized
aaaaaacattttaattaaaata

SEQ ID NO: 1327848 - DNA, 22 bp, Artificial Sequence
  chemically synthesized
aattataataaatattttaatt

SEQ ID NO: 1327849 - DNA, 22 bp, Artificial Sequence
  chemically synthesized
aaaaacattttaattaaaatat

SEQ ID NO: 1327850 - DNA, 22 bp, Artificial Sequence
  chemically synthesized
taattataataaatattttaat

SEQ ID NO: 1327851 - DNA, 22 bp, Artificial Sequence
  chemically synthesized
tcagattttaattataataaat

SEQ ID NO: 1327852 - DNA, 22 bp, Artificial Sequence
  chemically synthesized
atcagattttaattataataaa

SEQ ID NO: 1327853 - DNA, 22 bp, Artificial Sequence
  chemically synthesized
taattaaaatatttattataat

SEQ ID NO: 1327854 - DNA, 22 bp, Artificial Sequence
  chemically synthesized
aattaaaatatttattataatt

SEQ ID NO: 1327855 - DNA, 22 bp, Artificial Sequence
  chemically synthesized
attaaaatatttattataatta

SEQ ID NO: 1327856 - DNA, 22 bp, Artificial Sequence
  chemically synthesized
aaatatttattataattaaaat

SEQ ID NO: 1327857 - DNA, 22 bp, Artificial Sequence
  chemically synthesized
acaagtttatcagattttaatt

SEQ ID NO: 1327858 - DNA, 22 bp, Artificial Sequence
  chemically synthesized
attataattaaaatctgataaa

SEQ ID NO: 1327859 - DNA, 22 bp, Artificial Sequence
  chemically synthesized
ttataattaaaatctgataaac

SEQ ID NO: 1327860 - DNA, 22 bp, Artificial Sequence
  chemically synthesized
taattaaaatctgataaacttg

SEQ ID NO: 1327861 - DNA, 22 bp, Artificial Sequence
  chemically synthesized
aaatctgataaacttgtcaatg

SEQ ID NO: 1327862 - DNA, 22 bp, Artificial Sequence
  chemically synthesized
ataaacttgtcaatgggtatga

SEQ ID NO: 1327863 - DNA, 22 bp, Artificial Sequence
  chemically synthesized
gtcaatgggtatgatacgtggc

SEQ ID NO: 1327864 - DNA, 22 bp, Artificial Sequence
  chemically synthesized
tcaatgggtatgatacgtggca

SEQ ID NO: 1327865 - DNA, 22 bp, Artificial Sequence
  chemically synthesized
tgtataagcaaaagaatataca

SEQ ID NO: 1327866 - DNA, 22 bp, Artificial Sequence
  chemically synthesized
aagcatctgtgtataagcaaaa

SEQ ID NO: 1327867 - DNA, 22 bp, Artificial Sequence
  chemically synthesized
caagcatctgtgtataagcaaa

SEQ ID NO: 1327868 - DNA, 22 bp, Artificial Sequence
  chemically synthesized
tcaagcatctgtgtataagcaa

SEQ ID NO: 1327869 - DNA, 22 bp, Artificial Sequence
  chemically synthesized
tgtatattcttttgcttataca

SEQ ID NO: 1327870 - DNA, 22 bp, Artificial Sequence
  chemically synthesized
attttcaagcatctgtgtataa

SEQ ID NO: 1327871 - DNA, 22 bp, Artificial Sequence
  chemically synthesized
aattttcaagcatctgtgtata

SEQ ID NO: 1327872 - DNA, 22 bp, Artificial Sequence
  chemically synthesized
taattttcaagcatctgtgtat

SEQ ID NO: 1327873 - DNA, 22 bp, Artificial Sequence
  chemically synthesized
ttttgcttatacacagatgctt

SEQ ID NO: 1327874 - DNA, 22 bp, Artificial Sequence
  chemically synthesized
attttaattttcaagcatctgt

SEQ ID NO: 1327875 - DNA, 22 bp, Artificial Sequence
  chemically synthesized
aattttaattttcaagcatctg

SEQ ID NO: 1327876 - DNA, 22 bp, Artificial Sequence
  chemically synthesized
ttgcttatacacagatgcttga

SEQ ID NO: 1327877 - DNA, 22 bp, Artificial Sequence
  chemically synthesized
taattttaattttcaagcatct

SEQ ID NO: 1327878 - DNA, 22 bp, Artificial Sequence
  chemically synthesized
tgcttatacacagatgcttgaa

SEQ ID NO: 1327879 - DNA, 22 bp, Artificial Sequence
  chemically synthesized
ttaattttaattttcaagcatc

SEQ ID NO: 1327880 - DNA, 22 bp, Artificial Sequence
  chemically synthesized
gcttatacacagatgcttgaaa

SEQ ID NO: 1327881 - DNA, 22 bp, Artificial Sequence
  chemically synthesized
tttaattttaattttcaagcat

SEQ ID NO: 1327882 - DNA, 22 bp, Artificial Sequence
  chemically synthesized
cttatacacagatgcttgaaaa

SEQ ID NO: 1327883 - DNA, 22 bp, Artificial Sequence
  chemically synthesized
atacacagatgcttgaaaatta

SEQ ID NO: 1327884 - DNA, 22 bp, Artificial Sequence
  chemically synthesized
tacacagatgcttgaaaattaa

SEQ ID NO: 1327885 - DNA, 22 bp, Artificial Sequence
  chemically synthesized
cagtagctttttaattttaatt

SEQ ID NO: 1327886 - DNA, 22 bp, Artificial Sequence
  chemically synthesized
gttgcagtagctttttaatttt

SEQ ID NO: 1327887 - DNA, 22 bp, Artificial Sequence
  chemically synthesized
agttgcagtagctttttaattt

SEQ ID NO: 1327888 - DNA, 22 bp, Artificial Sequence
  chemically synthesized
gaaaattaaaattaaaaagcta

SEQ ID NO: 1327889 - DNA, 22 bp, Artificial Sequence
  chemically synthesized
aaaattaaaattaaaaagctac

SEQ ID NO: 1327890 - DNA, 22 bp, Artificial Sequence
  chemically synthesized
agtgcttagttgcagtagcttt

SEQ ID NO: 1327891 - DNA, 22 bp, Artificial Sequence
  chemically synthesized
ctgagtgcttagttgcagtagc

SEQ ID NO: 1327892 - DNA, 22 bp, Artificial Sequence
  chemically synthesized
aaattaaaaagctactgcaact

SEQ ID NO: 1327893 - DNA, 22 bp, Artificial Sequence
  chemically synthesized
aaaagctactgcaactaagcac

SEQ ID NO: 1327894 - DNA, 22 bp, Artificial Sequence
  chemically synthesized
ctgcaactaagcactcagcaat

SEQ ID NO: 1327895 - DNA, 22 bp, Artificial Sequence
  chemically synthesized
caactaagcactcagcaattgt

SEQ ID NO: 1327896 - DNA, 22 bp, Artificial Sequence
  chemically synthesized
agcactcagcaattgtcatatt

SEQ ID NO: 1327897 - DNA, 22 bp, Artificial Sequence
  chemically synthesized
gggaaaagtggagaaaaatatg

SEQ ID NO: 1327898 - DNA, 22 bp, Artificial Sequence
  chemically synthesized
agggaaaagtggagaaaaatat

SEQ ID NO: 1327899 - DNA, 22 bp, Artificial Sequence
  chemically synthesized
agcaattgtcatatttttctcc

SEQ ID NO: 1327900 - DNA, 22 bp, Artificial Sequence
  chemically synthesized
acttagggaaaagtggagaaaa

SEQ ID NO: 1327901 - DNA, 22 bp, Artificial Sequence
  chemically synthesized
ttgacttagggaaaagtggaga

SEQ ID NO: 1327902 - DNA, 22 bp, Artificial Sequence
  chemically synthesized
tcatatttttctccacttttcc

SEQ ID NO: 1327903 - DNA, 22 bp, Artificial Sequence
  chemically synthesized
cctattgacttagggaaaagtg

SEQ ID NO: 1327904 - DNA, 22 bp, Artificial Sequence
  chemically synthesized
ttctccacttttccctaagtca

SEQ ID NO: 1327905 - DNA, 22 bp, Artificial Sequence
  chemically synthesized
atggttgcctattgacttaggg

SEQ ID NO: 1327906 - DNA, 22 bp, Artificial Sequence
  chemically synthesized
tctccacttttccctaagtcaa

SEQ ID NO: 1327907 - DNA, 22 bp, Artificial Sequence
  chemically synthesized
catggttgcctattgacttagg

SEQ ID NO: 1327908 - DNA, 22 bp, Artificial Sequence
  chemically synthesized
ctccacttttccctaagtcaat

SEQ ID NO: 1327909 - DNA, 22 bp, Artificial Sequence
  chemically synthesized
tccacttttccctaagtcaata

SEQ ID NO: 1327910 - DNA, 22 bp, Artificial Sequence
  chemically synthesized
cacttttccctaagtcaatagg

SEQ ID NO: 1327911 - DNA, 22 bp, Artificial Sequence
  chemically synthesized
tcaacttcatggttgcctattg

SEQ ID NO: 1327912 - DNA, 22 bp, Artificial Sequence
  chemically synthesized
ttccctaagtcaataggcaacc

SEQ ID NO: 1327913 - DNA, 22 bp, Artificial Sequence
  chemically synthesized
tccctaagtcaataggcaacca

SEQ ID NO: 1327914 - DNA, 22 bp, Artificial Sequence
  chemically synthesized
ccctaagtcaataggcaaccat

SEQ ID NO: 1327915 - DNA, 22 bp, Artificial Sequence
  chemically synthesized
cctaagtcaataggcaaccatg

SEQ ID NO: 1327916 - DNA, 22 bp, Artificial Sequence
  chemically synthesized
agtcaataggcaaccatgaagt

SEQ ID NO: 1327917 - DNA, 22 bp, Artificial Sequence
  chemically synthesized
tcagcaacattgtcaacttcat

SEQ ID NO: 1327918 - DNA, 22 bp, Artificial Sequence
  chemically synthesized
agtatgacaatgttatcagcaa

SEQ ID NO: 1327919 - DNA, 22 bp, Artificial Sequence
  chemically synthesized
acaatgttgctgataacattgt

SEQ ID NO: 1327920 - DNA, 22 bp, Artificial Sequence
  chemically synthesized
ctgataacattgtcatactcaa

SEQ ID NO: 1327921 - DNA, 22 bp, Artificial Sequence
  chemically synthesized
tgggaaatgatgttgagtatga

SEQ ID NO: 1327922 - DNA, 22 bp, Artificial Sequence
  chemically synthesized
gtgggaaatgatgttgagtatg

SEQ ID NO: 1327923 - DNA, 22 bp, Artificial Sequence
  chemically synthesized
tgtgggaaatgatgttgagtat

SEQ ID NO: 1327924 - DNA, 22 bp, Artificial Sequence
  chemically synthesized
ataacattgtcatactcaacat

SEQ ID NO: 1327925 - DNA, 22 bp, Artificial Sequence
  chemically synthesized
agctttgtgggaaatgatgttg

SEQ ID NO: 1327926 - DNA, 22 bp, Artificial Sequence
  chemically synthesized
aagctttgtgggaaatgatgtt

SEQ ID NO: 1327927 - DNA, 22 bp, Artificial Sequence
  chemically synthesized
tcatactcaacatcatttccca

SEQ ID NO: 1327928 - DNA, 22 bp, Artificial Sequence
  chemically synthesized
tagaggtttaagctttgtggga

SEQ ID NO: 1327929 - DNA, 22 bp, Artificial Sequence
  chemically synthesized
tgtagaggtttaagctttgtgg

SEQ ID NO: 1327930 - DNA, 22 bp, Artificial Sequence
  chemically synthesized
aacatcatttcccacaaagctt

SEQ ID NO: 1327931 - DNA, 22 bp, Artificial Sequence
  chemically synthesized
ctgtagaggtttaagctttgtg

SEQ ID NO: 1327932 - DNA, 22 bp, Artificial Sequence
  chemically synthesized
agtttctgtagaggtttaagct

SEQ ID NO: 1327933 - DNA, 22 bp, Artificial Sequence
  chemically synthesized
ctgagtttctgtagaggtttaa

SEQ ID NO: 1327934 - DNA, 22 bp, Artificial Sequence
  chemically synthesized
cccacaaagcttaaacctctac

SEQ ID NO: 1327935 - DNA, 22 bp, Artificial Sequence
  chemically synthesized
ccacaaagcttaaacctctaca

SEQ ID NO: 1327936 - DNA, 22 bp, Artificial Sequence
  chemically synthesized
tagggactgctgagtttctgta

SEQ ID NO: 1327937 - DNA, 22 bp, Artificial Sequence
  chemically synthesized
aaacctctacagaaactcagca

SEQ ID NO: 1327938 - DNA, 22 bp, Artificial Sequence
  chemically synthesized
aacctctacagaaactcagcag

SEQ ID NO: 1327939 - DNA, 22 bp, Artificial Sequence
  chemically synthesized
tacagaaactcagcagtcccta

SEQ ID NO: 1327940 - DNA, 22 bp, Artificial Sequence
  chemically synthesized
aaggatgtgttgtagggactgc

SEQ ID NO: 1327941 - DNA, 22 bp, Artificial Sequence
  chemically synthesized
caaggatgtgttgtagggactg

SEQ ID NO: 1327942 - DNA, 22 bp, Artificial Sequence
  chemically synthesized
cagaaactcagcagtccctaca

SEQ ID NO: 1327943 - DNA, 22 bp, Artificial Sequence
  chemically synthesized
ttcaaggatgtgttgtagggac

SEQ ID NO: 1327944 - DNA, 22 bp, Artificial Sequence
  chemically synthesized
attcttcaaggatgtgttgtag

SEQ ID NO: 1327945 - DNA, 22 bp, Artificial Sequence
  chemically synthesized
tcattcttcaaggatgtgttgt

SEQ ID NO: 1327946 - DNA, 22 bp, Artificial Sequence
  chemically synthesized
agcagtccctacaacacatcct

SEQ ID NO: 1327947 - DNA, 22 bp, Artificial Sequence
  chemically synthesized
acacccctctcattcttcaagg

SEQ ID NO: 1327948 - DNA, 22 bp, Artificial Sequence
  chemically synthesized
ttgacacccctctcattcttca

SEQ ID NO: 1327949 - DNA, 22 bp, Artificial Sequence
  chemically synthesized
caacacatccttgaagaatgag

SEQ ID NO: 1327950 - DNA, 22 bp, Artificial Sequence
  chemically synthesized
aaattattgacacccctctcat

SEQ ID NO: 1327951 - DNA, 22 bp, Artificial Sequence
  chemically synthesized
gaagaatgagaggggtgtcaat

SEQ ID NO: 1327952 - DNA, 22 bp, Artificial Sequence
  chemically synthesized
aagaatgagaggggtgtcaata

SEQ ID NO: 1327953 - DNA, 22 bp, Artificial Sequence
  chemically synthesized
agcagctgaaattattgacacc

SEQ ID NO: 1327954 - DNA, 22 bp, Artificial Sequence
  chemically synthesized
gagcagctgaaattattgacac

SEQ ID NO: 1327955 - DNA, 22 bp, Artificial Sequence
  chemically synthesized
catttgagcagctgaaattatt

SEQ ID NO: 1327956 - DNA, 22 bp, Artificial Sequence
  chemically synthesized
ccatttgagcagctgaaattat

SEQ ID NO: 1327957 - DNA, 22 bp, Artificial Sequence
  chemically synthesized
atgtcagagccttccatttgag

SEQ ID NO: 1327958 - DNA, 22 bp, Artificial Sequence
  chemically synthesized
gatgtcagagccttccatttga

SEQ ID NO: 1327959 - DNA, 22 bp, Artificial Sequence
  chemically synthesized
cttgatgtcagagccttccatt

SEQ ID NO: 1327960 - DNA, 22 bp, Artificial Sequence
  chemically synthesized
cagctgctcaaatggaaggctc

SEQ ID NO: 1327961 - DNA, 22 bp, Artificial Sequence
  chemically synthesized
agctgctcaaatggaaggctct

SEQ ID NO: 1327962 - DNA, 22 bp, Artificial Sequence
  chemically synthesized
atattccttgatgtcagagcct

SEQ ID NO: 1327963 - DNA, 22 bp, Artificial Sequence
  chemically synthesized
aatattccttgatgtcagagcc

SEQ ID NO: 1327964 - DNA, 22 bp, Artificial Sequence
  chemically synthesized
ctcaaatggaaggctctgacat

SEQ ID NO: 1327965 - DNA, 22 bp, Artificial Sequence
  chemically synthesized
aaatggaaggctctgacatcaa

SEQ ID NO: 1327966 - DNA, 22 bp, Artificial Sequence
  chemically synthesized
aatgtgccacttaatattcctt

SEQ ID NO: 1327967 - DNA, 22 bp, Artificial Sequence
  chemically synthesized
caatgtgccacttaatattcct

SEQ ID NO: 1327968 - DNA, 22 bp, Artificial Sequence
  chemically synthesized
tgacatcaaggaatattaagtg

SEQ ID NO: 1327969 - DNA, 22 bp, Artificial Sequence
  chemically synthesized
ccttcaatgtgccacttaatat

SEQ ID NO: 1327970 - DNA, 22 bp, Artificial Sequence
  chemically synthesized
acatcaaggaatattaagtggc

SEQ ID NO: 1327971 - DNA, 22 bp, Artificial Sequence
  chemically synthesized
atagtagaattcccttcaatgt

SEQ ID NO: 1327972 - DNA, 22 bp, Artificial Sequence
  chemically synthesized
aatagtagaattcccttcaatg

SEQ ID NO: 1327973 - DNA, 22 bp, Artificial Sequence
  chemically synthesized
cttaatagtagaattcccttca

SEQ ID NO: 1327974 - DNA, 22 bp, Artificial Sequence
  chemically synthesized
agtggcacattgaagggaattc

SEQ ID NO: 1327975 - DNA, 22 bp, Artificial Sequence
  chemically synthesized
attacttaatagtagaattccc

SEQ ID NO: 1327976 - DNA, 22 bp, Artificial Sequence
  chemically synthesized
cattacttaatagtagaattcc

SEQ ID NO: 1327977 - DNA, 22 bp, Artificial Sequence
  chemically synthesized
accttcattacttaatagtaga

SEQ ID NO: 1327978 - DNA, 22 bp, Artificial Sequence
  chemically synthesized
ctcaccttcattacttaatagt

SEQ ID NO: 1327979 - DNA, 22 bp, Artificial Sequence
  chemically synthesized
aagggaattctactattaagta

SEQ ID NO: 1327980 - DNA, 22 bp, Artificial Sequence
  chemically synthesized
cctcaccttcattacttaatag

SEQ ID NO: 1327981 - DNA, 22 bp, Artificial Sequence
  chemically synthesized
tcctcaccttcattacttaata

SEQ ID NO: 1327982 - DNA, 22 bp, Artificial Sequence
  chemically synthesized
ttttcctcaccttcattactta

SEQ ID NO: 1327983 - DNA, 22 bp, Artificial Sequence
  chemically synthesized
tactattaagtaatgaaggtga

SEQ ID NO: 1327984 - DNA, 22 bp, Artificial Sequence
  chemically synthesized
ctattaagtaatgaaggtgagg

SEQ ID NO: 1327985 - DNA, 22 bp, Artificial Sequence
  chemically synthesized
agaaattgttttcctcaccttc

SEQ ID NO: 1327986 - DNA, 22 bp, Artificial Sequence
  chemically synthesized
ttaagtaatgaaggtgaggaaa

SEQ ID NO: 1327987 - DNA, 22 bp, Artificial Sequence
  chemically synthesized
agtaatgaaggtgaggaaaaca

SEQ ID NO: 1327988 - DNA, 22 bp, Artificial Sequence
  chemically synthesized
gtataacaaagaaataaccgtg

SEQ ID NO: 1327989 - DNA, 22 bp, Artificial Sequence
  chemically synthesized
agtataacaaagaaataaccgt

SEQ ID NO: 1327990 - DNA, 22 bp, Artificial Sequence
  chemically synthesized
ttagtataacaaagaaataacc

SEQ ID NO: 1327991 - DNA, 22 bp, Artificial Sequence
  chemically synthesized
ctcaatccacggttatttcttt

SEQ ID NO: 1327992 - DNA, 22 bp, Artificial Sequence
  chemically synthesized
tcaatccacggttatttctttg

SEQ ID NO: 1327993 - DNA, 22 bp, Artificial Sequence
  chemically synthesized
aatccacggttatttctttgtt

SEQ ID NO: 1327994 - DNA, 22 bp, Artificial Sequence
  chemically synthesized
ggcacggttcttagtataacaa

SEQ ID NO: 1327995 - DNA, 22 bp, Artificial Sequence
  chemically synthesized
tttctttgttatactaagaacc

SEQ ID NO: 1327996 - DNA, 22 bp, Artificial Sequence
  chemically synthesized
ctttgttatactaagaaccgtg

SEQ ID NO: 1327997 - DNA, 22 bp, Artificial Sequence
  chemically synthesized
tttgttatactaagaaccgtgc

SEQ ID NO: 1327998 - DNA, 22 bp, Artificial Sequence
  chemically synthesized
cataagtattgggcacggttct

SEQ ID NO: 1327999 - DNA, 22 bp, Artificial Sequence
  chemically synthesized
tgttatactaagaaccgtgccc

SEQ ID NO: 1328000 - DNA, 22 bp, Artificial Sequence
  chemically synthesized
gttatactaagaaccgtgccca

SEQ ID NO: 1328001 - DNA, 22 bp, Artificial Sequence
  chemically synthesized
ttccataagtattgggcacggt

SEQ ID NO: 1328002 - DNA, 22 bp, Artificial Sequence
  chemically synthesized
ttatactaagaaccgtgcccaa

SEQ ID NO: 1328003 - DNA, 22 bp, Artificial Sequence
  chemically synthesized
gttccataagtattgggcacgg

SEQ ID NO: 1328004 - DNA, 22 bp, Artificial Sequence
  chemically synthesized
tgttccataagtattgggcacg

SEQ ID NO: 1328005 - DNA, 22 bp, Artificial Sequence
  chemically synthesized
tactaagaaccgtgcccaatac

SEQ ID NO: 1328006 - DNA, 22 bp, Artificial Sequence
  chemically synthesized
ttttgttccataagtattgggc

SEQ ID NO: 1328007 - DNA, 22 bp, Artificial Sequence
  chemically synthesized
attttgttccataagtattggg

SEQ ID NO: 1328008 - DNA, 22 bp, Artificial Sequence
  chemically synthesized
agaaccgtgcccaatacttatg

SEQ ID NO: 1328009 - DNA, 22 bp, Artificial Sequence
  chemically synthesized
atggaacaaaataagcctatca

SEQ ID NO: 1328010 - DNA, 22 bp, Artificial Sequence
  chemically synthesized
tggaacaaaataagcctatcat

SEQ ID NO: 1328011 - DNA, 22 bp, Artificial Sequence
  chemically synthesized
ataggagacgtccaaatgatag

SEQ ID NO: 1328012 - DNA, 22 bp, Artificial Sequence
  chemically synthesized
aggctgataggagacgtccaaa

SEQ ID NO: 1328013 - DNA, 22 bp, Artificial Sequence
  chemically synthesized
caggctgataggagacgtccaa

SEQ ID NO: 1328014 - DNA, 22 bp, Artificial Sequence
  chemically synthesized
tcatttggacgtctcctatcag

SEQ ID NO: 1328015 - DNA, 22 bp, Artificial Sequence
  chemically synthesized
ggacgtctcctatcagcctgaa

SEQ ID NO: 1328016 - DNA, 22 bp, Artificial Sequence
  chemically synthesized
gacgtctcctatcagcctgaag

SEQ ID NO: 1328017 - DNA, 22 bp, Artificial Sequence
  chemically synthesized
tatgacatcaggcttcaggctg

SEQ ID NO: 1328018 - DNA, 22 bp, Artificial Sequence
  chemically synthesized
atatgacatcaggcttcaggct

SEQ ID NO: 1328019 - DNA, 22 bp, Artificial Sequence
  chemically synthesized
gtttatatgacatcaggcttca

SEQ ID NO: 1328020 - DNA, 22 bp, Artificial Sequence
  chemically synthesized
ctatcagcctgaagcctgatgt

SEQ ID NO: 1328021 - DNA, 22 bp, Artificial Sequence
  chemically synthesized
ttggtttatatgacatcaggct

SEQ ID NO: 1328022 - DNA, 22 bp, Artificial Sequence
  chemically synthesized
tcagcctgaagcctgatgtcat

SEQ ID NO: 1328023 - DNA, 22 bp, Artificial Sequence
  chemically synthesized
aagcctgatgtcatataaacca

SEQ ID NO: 1328024 - DNA, 22 bp, Artificial Sequence
  chemically synthesized
aatcacagattattggtttata

SEQ ID NO: 1328025 - DNA, 22 bp, Artificial Sequence
  chemically synthesized
atgtcatataaaccaataatct

SEQ ID NO: 1328026 - DNA, 22 bp, Artificial Sequence
  chemically synthesized
aaaaattcaatcacagattatt

SEQ ID NO: 1328027 - DNA, 22 bp, Artificial Sequence
  chemically synthesized
aaagctgaaaaattcaatcaca

SEQ ID NO: 1328028 - DNA, 22 bp, Artificial Sequence
  chemically synthesized
tgattgaatttttcagctttca

SEQ ID NO: 1328029 - DNA, 22 bp, Artificial Sequence
  chemically synthesized
aaaataaaacactgaaagctga

SEQ ID NO: 1328030 - DNA, 22 bp, Artificial Sequence
  chemically synthesized
tgctaaaaataaaacactgaaa

SEQ ID NO: 1328031 - DNA, 22 bp, Artificial Sequence
  chemically synthesized
aatttttcagctttcagtgttt

SEQ ID NO: 1328032 - DNA, 22 bp, Artificial Sequence
  chemically synthesized
ttcagctttcagtgttttattt

SEQ ID NO: 1328033 - DNA, 22 bp, Artificial Sequence
  chemically synthesized
tcagctttcagtgttttatttt

SEQ ID NO: 1328034 - DNA, 22 bp, Artificial Sequence
  chemically synthesized
cagctttcagtgttttattttt

SEQ ID NO: 1328035 - DNA, 22 bp, Artificial Sequence
  chemically synthesized
agctttcagtgttttattttta

SEQ ID NO: 1328036 - DNA, 22 bp, Artificial Sequence
  chemically synthesized
tcagtgttttatttttagcata

SEQ ID NO: 1328037 - DNA, 22 bp, Artificial Sequence
  chemically synthesized
cagtgttttatttttagcataa

SEQ ID NO: 1328038 - DNA, 22 bp, Artificial Sequence
  chemically synthesized
agtgttttatttttagcataat

SEQ ID NO: 1328039 - DNA, 22 bp, Artificial Sequence
  chemically synthesized
tatttttagcataatatttggt

SEQ ID NO: 1328040 - DNA, 22 bp, Artificial Sequence
  chemically synthesized
atttttagcataatatttggta

SEQ ID NO: 1328041 - DNA, 22 bp, Artificial Sequence
  chemically synthesized
tttttagcataatatttggtat

SEQ ID NO: 1328042 - DNA, 22 bp, Artificial Sequence
  chemically synthesized
ttagcataatatttggtattgc

SEQ ID NO: 1328043 - DNA, 22 bp, Artificial Sequence
  chemically synthesized
tagcataatatttggtattgcc

SEQ ID NO: 1328044 - DNA, 22 bp, Artificial Sequence
  chemically synthesized
agcataatatttggtattgcca

SEQ ID NO: 1328045 - DNA, 22 bp, Artificial Sequence
  chemically synthesized
gcataatatttggtattgccat

SEQ ID NO: 1328046 - DNA, 22 bp, Artificial Sequence
  chemically synthesized
aacagaataataagtcacgtat

SEQ ID NO: 1328047 - DNA, 22 bp, Artificial Sequence
  chemically synthesized
ggtattgccatacgtgacttat

SEQ ID NO: 1328048 - DNA, 22 bp, Artificial Sequence
  chemically synthesized
gtattgccatacgtgacttatt

SEQ ID NO: 1328049 - DNA, 22 bp, Artificial Sequence
  chemically synthesized
aattgaacagaataataagtca

SEQ ID NO: 1328050 - DNA, 22 bp, Artificial Sequence
  chemically synthesized
attaaattgaacagaataataa

SEQ ID NO: 1328051 - DNA, 22 bp, Artificial Sequence
  chemically synthesized
ccatacgtgacttattattctg

SEQ ID NO: 1328052 - DNA, 22 bp, Artificial Sequence
  chemically synthesized
gattaaattgaacagaataata

SEQ ID NO: 1328053 - DNA, 22 bp, Artificial Sequence
  chemically synthesized
atttgattaaattgaacagaat

SEQ ID NO: 1328054 - DNA, 22 bp, Artificial Sequence
  chemically synthesized
taatttgattaaattgaacaga

SEQ ID NO: 1328055 - DNA, 22 bp, Artificial Sequence
  chemically synthesized
tctaatttgattaaattgaaca

SEQ ID NO: 1328056 - DNA, 22 bp, Artificial Sequence
  chemically synthesized
ttctctaatttgattaaattga

SEQ ID NO: 1328057 - DNA, 22 bp, Artificial Sequence
  chemically synthesized
attctctaatttgattaaattg

SEQ ID NO: 1328058 - DNA, 22 bp, Artificial Sequence
  chemically synthesized
attattctgttcaatttaatca

SEQ ID NO: 1328059 - DNA, 22 bp, Artificial Sequence
  chemically synthesized
ttattctgttcaatttaatcaa

SEQ ID NO: 1328060 - DNA, 22 bp, Artificial Sequence
  chemically synthesized
tttattctctaatttgattaaa

SEQ ID NO: 1328061 - DNA, 22 bp, Artificial Sequence
  chemically synthesized
gtttattctctaatttgattaa

SEQ ID NO: 1328062 - DNA, 22 bp, Artificial Sequence
  chemically synthesized
ttctgttcaatttaatcaaatt

SEQ ID NO: 1328063 - DNA, 22 bp, Artificial Sequence
  chemically synthesized
tgtttattctctaatttgatta

SEQ ID NO: 1328064 - DNA, 22 bp, Artificial Sequence
  chemically synthesized
tgttcaatttaatcaaattaga

SEQ ID NO: 1328065 - DNA, 22 bp, Artificial Sequence
  chemically synthesized
ttcaatttaatcaaattagaga

SEQ ID NO: 1328066 - DNA, 22 bp, Artificial Sequence
  chemically synthesized
tcgttttgtttattctctaatt

SEQ ID NO: 1328067 - DNA, 22 bp, Artificial Sequence
  chemically synthesized
gtcgttttgtttattctctaat

SEQ ID NO: 1328068 - DNA, 22 bp, Artificial Sequence
  chemically synthesized
aatttaatcaaattagagaata

SEQ ID NO: 1328069 - DNA, 22 bp, Artificial Sequence
  chemically synthesized
tgtttgtcgttttgtttattct

SEQ ID NO: 1328070 - DNA, 22 bp, Artificial Sequence
  chemically synthesized
aatcaaattagagaataaacaa

SEQ ID NO: 1328071 - DNA, 22 bp, Artificial Sequence
  chemically synthesized
atcaaattagagaataaacaaa

SEQ ID NO: 1328072 - DNA, 22 bp, Artificial Sequence
  chemically synthesized
agagaaattatgtttgtcgttt

SEQ ID NO: 1328073 - DNA, 22 bp, Artificial Sequence
  chemically synthesized
gagaataaacaaaacgacaaac

SEQ ID NO: 1328074 - DNA, 22 bp, Artificial Sequence
  chemically synthesized
aaaaaagaaaaacacacacgca

SEQ ID NO: 1328075 - DNA, 22 bp, Artificial Sequence
  chemically synthesized
ctcttaatgtgcgtgtgtgttt

SEQ ID NO: 1328076 - DNA, 22 bp, Artificial Sequence
  chemically synthesized
tcttaatgtgcgtgtgtgtttt

SEQ ID NO: 1328077 - DNA, 22 bp, Artificial Sequence
  chemically synthesized
gtctcaaaaaagaaaaacacac

SEQ ID NO: 1328078 - DNA, 22 bp, Artificial Sequence
  chemically synthesized
ttaatgtgcgtgtgtgtttttc

SEQ ID NO: 1328079 - DNA, 22 bp, Artificial Sequence
  chemically synthesized
cgtctcaaaaaagaaaaacaca

SEQ ID NO: 1328080 - DNA, 22 bp, Artificial Sequence
  chemically synthesized
aatgtgcgtgtgtgtttttctt

SEQ ID NO: 1328081 - DNA, 22 bp, Artificial Sequence
  chemically synthesized
atgtgcgtgtgtgtttttcttt

SEQ ID NO: 1328082 - DNA, 22 bp, Artificial Sequence
  chemically synthesized
ttcttttttgagacgaagtttc

SEQ ID NO: 1328083 - DNA, 22 bp, Artificial Sequence
  chemically synthesized
ggcaacaagaatgaaacttcgt

SEQ ID NO: 1328084 - DNA, 22 bp, Artificial Sequence
  chemically synthesized
tcttttttgagacgaagtttca

SEQ ID NO: 1328085 - DNA, 22 bp, Artificial Sequence
  chemically synthesized
cttttttgagacgaagtttcat

SEQ ID NO: 1328086 - DNA, 22 bp, Artificial Sequence
  chemically synthesized
ttttttgagacgaagtttcatt

SEQ ID NO: 1328087 - DNA, 22 bp, Artificial Sequence
  chemically synthesized
ttttgagacgaagtttcattct

SEQ ID NO: 1328088 - DNA, 22 bp, Artificial Sequence
  chemically synthesized
tttgagacgaagtttcattctt

SEQ ID NO: 1328089 - DNA, 22 bp, Artificial Sequence
  chemically synthesized
ttgagacgaagtttcattcttg

SEQ ID NO: 1328090 - DNA, 22 bp, Artificial Sequence
  chemically synthesized
tgagacgaagtttcattcttgt

SEQ ID NO: 1328091 - DNA, 22 bp, Artificial Sequence
  chemically synthesized
gagacgaagtttcattcttgtt

SEQ ID NO: 1328092 - DNA, 22 bp, Artificial Sequence
  chemically synthesized
agacgaagtttcattcttgttg

SEQ ID NO: 1328093 - DNA, 22 bp, Artificial Sequence
  chemically synthesized
gaatcgagcctgggcaacaaga

SEQ ID NO: 1328094 - DNA, 22 bp, Artificial Sequence
  chemically synthesized
cattcttgttgcccaggctcga

SEQ ID NO: 1328095 - DNA, 22 bp, Artificial Sequence
  chemically synthesized
attcttgttgcccaggctcgat

SEQ ID NO: 1328096 - DNA, 22 bp, Artificial Sequence
  chemically synthesized
tgccatcgcactcgaatcgagc

SEQ ID NO: 1328097 - DNA, 22 bp, Artificial Sequence
  chemically synthesized
ttgttgcccaggctcgattcga

SEQ ID NO: 1328098 - DNA, 22 bp, Artificial Sequence
  chemically synthesized
gttgcccaggctcgattcgagt

SEQ ID NO: 1328099 - DNA, 22 bp, Artificial Sequence
  chemically synthesized
ttgcccaggctcgattcgagtg

SEQ ID NO: 1328100 - DNA, 22 bp, Artificial Sequence
  chemically synthesized
cccaggctcgattcgagtgcga

SEQ ID NO: 1328101 - DNA, 22 bp, Artificial Sequence
  chemically synthesized
gattcgagtgcgatggcatagt

SEQ ID NO: 1328102 - DNA, 22 bp, Artificial Sequence
  chemically synthesized
cagtgagccaacactatgccat

SEQ ID NO: 1328103 - DNA, 22 bp, Artificial Sequence
  chemically synthesized
gagtgcgatggcatagtgttgg

SEQ ID NO: 1328104 - DNA, 22 bp, Artificial Sequence
  chemically synthesized
aaccccagaggcagaggttgca

SEQ ID NO: 1328105 - DNA, 22 bp, Artificial Sequence
  chemically synthesized
gaaccccagaggcagaggttgc

SEQ ID NO: 1328106 - DNA, 22 bp, Artificial Sequence
  chemically synthesized
gctcactgcaacctctgcctct

SEQ ID NO: 1328107 - DNA, 22 bp, Artificial Sequence
  chemically synthesized
actgcaacctctgcctctgggg

SEQ ID NO: 1328108 - DNA, 22 bp, Artificial Sequence
  chemically synthesized
caacctctgcctctggggttca

SEQ ID NO: 1328109 - DNA, 22 bp, Artificial Sequence
  chemically synthesized
agtcaggagaatcccttgaacc

SEQ ID NO: 1328110 - DNA, 22 bp, Artificial Sequence
  chemically synthesized
tgcctctggggttcaagggatt

SEQ ID NO: 1328111 - DNA, 22 bp, Artificial Sequence
  chemically synthesized
cctctggggttcaagggattct

SEQ ID NO: 1328112 - DNA, 22 bp, Artificial Sequence
  chemically synthesized
ggaggctgagtcaggagaatcc

SEQ ID NO: 1328113 - DNA, 22 bp, Artificial Sequence
  chemically synthesized
tggggttcaagggattctcctg

SEQ ID NO: 1328114 - DNA, 22 bp, Artificial Sequence
  chemically synthesized
gggaggctgagtcaggagaatc

SEQ ID NO: 1328115 - DNA, 22 bp, Artificial Sequence
  chemically synthesized
gggttcaagggattctcctgac

SEQ ID NO: 1328116 - DNA, 22 bp, Artificial Sequence
  chemically synthesized
cttgggaggctgagtcaggaga

SEQ ID NO: 1328117 - DNA, 22 bp, Artificial Sequence
  chemically synthesized
aagggattctcctgactcagcc

SEQ ID NO: 1328118 - DNA, 22 bp, Artificial Sequence
  chemically synthesized
taatcccagttacttgggaggc

SEQ ID NO: 1328119 - DNA, 22 bp, Artificial Sequence
  chemically synthesized
tcctgactcagcctcccaagta

SEQ ID NO: 1328120 - DNA, 22 bp, Artificial Sequence
  chemically synthesized
ctgactcagcctcccaagtaac

SEQ ID NO: 1328121 - DNA, 22 bp, Artificial Sequence
  chemically synthesized
actcagcctcccaagtaactgg

SEQ ID NO: 1328122 - DNA, 22 bp, Artificial Sequence
  chemically synthesized
agcctcccaagtaactgggatt

SEQ ID NO: 1328123 - DNA, 22 bp, Artificial Sequence
  chemically synthesized
ccaagtaactgggattacaggt

SEQ ID NO: 1328124 - DNA, 22 bp, Artificial Sequence
  chemically synthesized
ggattacaggtgcctgccacca

SEQ ID NO: 1328125 - DNA, 22 bp, Artificial Sequence
  chemically synthesized
caggtgcctgccaccacgcccg

SEQ ID NO: 1328126 - DNA, 22 bp, Artificial Sequence
  chemically synthesized
aaaatagaaaaaaaatcagccg

SEQ ID NO: 1328127 - DNA, 22 bp, Artificial Sequence
  chemically synthesized
ccaccacgcccggctgattttt

SEQ ID NO: 1328128 - DNA, 22 bp, Artificial Sequence
  chemically synthesized
ctaaaaatagaaaaaaaatcag

SEQ ID NO: 1328129 - DNA, 22 bp, Artificial Sequence
  chemically synthesized
tactaaaaatagaaaaaaaatc

SEQ ID NO: 1328130 - DNA, 22 bp, Artificial Sequence
  chemically synthesized
attttttttctatttttagtag

SEQ ID NO: 1328131 - DNA, 22 bp, Artificial Sequence
  chemically synthesized
tttttctatttttagtagagac

SEQ ID NO: 1328132 - DNA, 22 bp, Artificial Sequence
  chemically synthesized
ttttctatttttagtagagacc

SEQ ID NO: 1328133 - DNA, 22 bp, Artificial Sequence
  chemically synthesized
tttctatttttagtagagaccg

SEQ ID NO: 1328134 - DNA, 22 bp, Artificial Sequence
  chemically synthesized
ttctatttttagtagagaccgg

SEQ ID NO: 1328135 - DNA, 22 bp, Artificial Sequence
  chemically synthesized
tctatttttagtagagaccggg

SEQ ID NO: 1328136 - DNA, 22 bp, Artificial Sequence
  chemically synthesized
ctatttttagtagagaccgggg

SEQ ID NO: 1328137 - DNA, 22 bp, Artificial Sequence
  chemically synthesized
tatttttagtagagaccggggt

SEQ ID NO: 1328138 - DNA, 22 bp, Artificial Sequence
  chemically synthesized
tttttagtagagaccggggttt

SEQ ID NO: 1328139 - DNA, 22 bp, Artificial Sequence
  chemically synthesized
gccaacatggtgaaaccccggt

SEQ ID NO: 1328140 - DNA, 22 bp, Artificial Sequence
  chemically synthesized
ttagtagagaccggggtttcac

SEQ ID NO: 1328141 - DNA, 22 bp, Artificial Sequence
  chemically synthesized
tagtagagaccggggtttcacc

SEQ ID NO: 1328142 - DNA, 22 bp, Artificial Sequence
  chemically synthesized
agtagagaccggggtttcacca

SEQ ID NO: 1328143 - DNA, 22 bp, Artificial Sequence
  chemically synthesized
gtagagaccggggtttcaccat

SEQ ID NO: 1328144 - DNA, 22 bp, Artificial Sequence
  chemically synthesized
agaccagcctggccaacatggt

SEQ ID NO: 1328145 - DNA, 22 bp, Artificial Sequence
  chemically synthesized
gagaccagcctggccaacatgg

SEQ ID NO: 1328146 - DNA, 22 bp, Artificial Sequence
  chemically synthesized
caccatgttggccaggctggtc

SEQ ID NO: 1328147 - DNA, 22 bp, Artificial Sequence
  chemically synthesized
accatgttggccaggctggtct

SEQ ID NO: 1328148 - DNA, 22 bp, Artificial Sequence
  chemically synthesized
aggtcaggagtttgagaccagc

SEQ ID NO: 1328149 - DNA, 22 bp, Artificial Sequence
  chemically synthesized
gaggtcaggagtttgagaccag

SEQ ID NO: 1328150 - DNA, 22 bp, Artificial Sequence
  chemically synthesized
gccaggctggtctcaaactcct

SEQ ID NO: 1328151 - DNA, 22 bp, Artificial Sequence
  chemically synthesized
gtctcaaactcctgacctcaag

SEQ ID NO: 1328152 - DNA, 22 bp, Artificial Sequence
  chemically synthesized
aaactcctgacctcaagtgatt

SEQ ID NO: 1328153 - DNA, 22 bp, Artificial Sequence
  chemically synthesized
ggaggccgaggcaggtgaatca

SEQ ID NO: 1328154 - DNA, 22 bp, Artificial Sequence
  chemically synthesized
ctgacctcaagtgattcacctg

SEQ ID NO: 1328155 - DNA, 22 bp, Artificial Sequence
  chemically synthesized
gggaggccgaggcaggtgaatc

SEQ ID NO: 1328156 - DNA, 22 bp, Artificial Sequence
  chemically synthesized
tgggaggccgaggcaggtgaat

SEQ ID NO: 1328157 - DNA, 22 bp, Artificial Sequence
  chemically synthesized
acctcaagtgattcacctgcct

SEQ ID NO: 1328158 - DNA, 22 bp, Artificial Sequence
  chemically synthesized
aagtgattcacctgcctcggcc

SEQ ID NO: 1328159 - DNA, 22 bp, Artificial Sequence
  chemically synthesized
taatcccagcactttgggaggc

SEQ ID NO: 1328160 - DNA, 22 bp, Artificial Sequence
  chemically synthesized
acctgcctcggcctcccaaagt

SEQ ID NO: 1328161 - DNA, 22 bp, Artificial Sequence
  chemically synthesized
cctcggcctcccaaagtgctgg

SEQ ID NO: 1328162 - DNA, 22 bp, Artificial Sequence
  chemically synthesized
acgcctgtaatcccagcacttt

SEQ ID NO: 1328163 - DNA, 22 bp, Artificial Sequence
  chemically synthesized
ggcctcccaaagtgctgggatt

SEQ ID NO: 1328164 - DNA, 22 bp, Artificial Sequence
  chemically synthesized
gctcacgcctgtaatcccagca

SEQ ID NO: 1328165 - DNA, 22 bp, Artificial Sequence
  chemically synthesized
ccaaagtgctgggattacaggc

SEQ ID NO: 1328166 - DNA, 22 bp, Artificial Sequence
  chemically synthesized
agccaagcatgctggctcacgc

SEQ ID NO: 1328167 - DNA, 22 bp, Artificial Sequence
  chemically synthesized
ggattacaggcgtgagccagca

SEQ ID NO: 1328168 - DNA, 22 bp, Artificial Sequence
  chemically synthesized
caggcgtgagccagcatgcttg

SEQ ID NO: 1328169 - DNA, 22 bp, Artificial Sequence
  chemically synthesized
aaacacattaagccaagcatgc

SEQ ID NO: 1328170 - DNA, 22 bp, Artificial Sequence
  chemically synthesized
tgtcattaaaacacattaagcc

SEQ ID NO: 1328171 - DNA, 22 bp, Artificial Sequence
  chemically synthesized
gaattatgtcattaaaacacat

SEQ ID NO: 1328172 - DNA, 22 bp, Artificial Sequence
  chemically synthesized
ttggaattatgtcattaaaaca

SEQ ID NO: 1328173 - DNA, 22 bp, Artificial Sequence
  chemically synthesized
ggcttaatgtgttttaatgaca

SEQ ID NO: 1328174 - DNA, 22 bp, Artificial Sequence
  chemically synthesized
gcttaatgtgttttaatgacat

SEQ ID NO: 1328175 - DNA, 22 bp, Artificial Sequence
  chemically synthesized
aatgtgttttaatgacataatt

SEQ ID NO: 1328176 - DNA, 22 bp, Artificial Sequence
  chemically synthesized
tatggttgttggaattatgtca

SEQ ID NO: 1328177 - DNA, 22 bp, Artificial Sequence
  chemically synthesized
atgtgttttaatgacataattc

SEQ ID NO: 1328178 - DNA, 22 bp, Artificial Sequence
  chemically synthesized
taatgacataattccaacaacc

SEQ ID NO: 1328179 - DNA, 22 bp, Artificial Sequence
  chemically synthesized
atatagttatatggttgttgga

SEQ ID NO: 1328180 - DNA, 22 bp, Artificial Sequence
  chemically synthesized
aatgacataattccaacaacca

SEQ ID NO: 1328181 - DNA, 22 bp, Artificial Sequence
  chemically synthesized
atgacataattccaacaaccat

SEQ ID NO: 1328182 - DNA, 22 bp, Artificial Sequence
  chemically synthesized
tactaatatagttatatggttg

SEQ ID NO: 1328183 - DNA, 22 bp, Artificial Sequence
  chemically synthesized
gtactaatatagttatatggtt

SEQ ID NO: 1328184 - DNA, 22 bp, Artificial Sequence
  chemically synthesized
tgtactaatatagttatatggt

SEQ ID NO: 1328185 - DNA, 22 bp, Artificial Sequence
  chemically synthesized
ttgtactaatatagttatatgg

SEQ ID NO: 1328186 - DNA, 22 bp, Artificial Sequence
  chemically synthesized
tttgtactaatatagttatatg

SEQ ID NO: 1328187 - DNA, 22 bp, Artificial Sequence
  chemically synthesized
ctttttgtactaatatagttat

SEQ ID NO: 1328188 - DNA, 22 bp, Artificial Sequence
  chemically synthesized
caacaaccatataactatatta

SEQ ID NO: 1328189 - DNA, 22 bp, Artificial Sequence
  chemically synthesized
atgtagttgctttttgtactaa

SEQ ID NO: 1328190 - DNA, 22 bp, Artificial Sequence
  chemically synthesized
catgtagttgctttttgtacta

SEQ ID NO: 1328191 - DNA, 22 bp, Artificial Sequence
  chemically synthesized
tttcatgtagttgctttttgta

SEQ ID NO: 1328192 - DNA, 22 bp, Artificial Sequence
  chemically synthesized
atttcatgtagttgctttttgt

SEQ ID NO: 1328193 - DNA, 22 bp, Artificial Sequence
  chemically synthesized
tatttcatgtagttgctttttg

SEQ ID NO: 1328194 - DNA, 22 bp, Artificial Sequence
  chemically synthesized
ttatttcatgtagttgcttttt

SEQ ID NO: 1328195 - DNA, 22 bp, Artificial Sequence
  chemically synthesized
tattagtacaaaaagcaactac

SEQ ID NO: 1328196 - DNA, 22 bp, Artificial Sequence
  chemically synthesized
agatttttatttcatgtagttg

SEQ ID NO: 1328197 - DNA, 22 bp, Artificial Sequence
  chemically synthesized
gtacaaaaagcaactacatgaa

SEQ ID NO: 1328198 - DNA, 22 bp, Artificial Sequence
  chemically synthesized
gcaaacaattgagatttttatt

SEQ ID NO: 1328199 - DNA, 22 bp, Artificial Sequence
  chemically synthesized
ggcaaacaattgagatttttat

SEQ ID NO: 1328200 - DNA, 22 bp, Artificial Sequence
  chemically synthesized
catgaaataaaaatctcaattg

SEQ ID NO: 1328201 - DNA, 22 bp, Artificial Sequence
  chemically synthesized
tatccatttggcaaacaattga

SEQ ID NO: 1328202 - DNA, 22 bp, Artificial Sequence
  chemically synthesized
gtatccatttggcaaacaattg

SEQ ID NO: 1328203 - DNA, 22 bp, Artificial Sequence
  chemically synthesized
tttgtatccatttggcaaacaa

SEQ ID NO: 1328204 - DNA, 22 bp, Artificial Sequence
  chemically synthesized
aattgtttgccaaatggataca

SEQ ID NO: 1328205 - DNA, 22 bp, Artificial Sequence
  chemically synthesized
tttgccaaatggatacaaataa

SEQ ID NO: 1328206 - DNA, 22 bp, Artificial Sequence
  chemically synthesized
gccaaatggatacaaataatat

SEQ ID NO: 1328207 - DNA, 22 bp, Artificial Sequence
  chemically synthesized
ccaaatggatacaaataatata

SEQ ID NO: 1328208 - DNA, 22 bp, Artificial Sequence
  chemically synthesized
tatataatatatgtaatatata

SEQ ID NO: 1328209 - DNA, 22 bp, Artificial Sequence
  chemically synthesized
tatgcatgttatatataatata

SEQ ID NO: 1328210 - DNA, 22 bp, Artificial Sequence
  chemically synthesized
ttatatgcatgttatatataat

SEQ ID NO: 1328211 - DNA, 22 bp, Artificial Sequence
  chemically synthesized
attatatgcatgttatatataa

SEQ ID NO: 1328212 - DNA, 22 bp, Artificial Sequence
  chemically synthesized
tattatatgcatgttatatata

SEQ ID NO: 1328213 - DNA, 22 bp, Artificial Sequence
  chemically synthesized
catatattatatataacatgca

SEQ ID NO: 1328214 - DNA, 22 bp, Artificial Sequence
  chemically synthesized
tgtattttattatatgcatgtt

SEQ ID NO: 1328215 - DNA, 22 bp, Artificial Sequence
  chemically synthesized
ctgtgtattttattatatgcat

SEQ ID NO: 1328216 - DNA, 22 bp, Artificial Sequence
  chemically synthesized
tatataacatgcatataataaa

SEQ ID NO: 1328217 - DNA, 22 bp, Artificial Sequence
  chemically synthesized
atcatgggtaaccaaaaccatg

SEQ ID NO: 1328218 - DNA, 22 bp, Artificial Sequence
  chemically synthesized
cctcttatccatggttttggtt

SEQ ID NO: 1328219 - DNA, 22 bp, Artificial Sequence
  chemically synthesized
cagttgatcatgggtaaccaaa

SEQ ID NO: 1328220 - DNA, 22 bp, Artificial Sequence
  chemically synthesized
ttatccatggttttggttaccc

SEQ ID NO: 1328221 - DNA, 22 bp, Artificial Sequence
  chemically synthesized
atccatggttttggttacccat

SEQ ID NO: 1328222 - DNA, 22 bp, Artificial Sequence
  chemically synthesized
tccatggttttggttacccatg

SEQ ID NO: 1328223 - DNA, 22 bp, Artificial Sequence
  chemically synthesized
gactgcagttgatcatgggtaa

SEQ ID NO: 1328224 - DNA, 22 bp, Artificial Sequence
  chemically synthesized
ggactgcagttgatcatgggta

SEQ ID NO: 1328225 - DNA, 22 bp, Artificial Sequence
  chemically synthesized
tggactgcagttgatcatgggt

SEQ ID NO: 1328226 - DNA, 22 bp, Artificial Sequence
  chemically synthesized
ttggactgcagttgatcatggg

SEQ ID NO: 1328227 - DNA, 22 bp, Artificial Sequence
  chemically synthesized
tttttggactgcagttgatcat

SEQ ID NO: 1328228 - DNA, 22 bp, Artificial Sequence
  chemically synthesized
tggttacccatgatcaactgca

SEQ ID NO: 1328229 - DNA, 22 bp, Artificial Sequence
  chemically synthesized
ggttacccatgatcaactgcag

SEQ ID NO: 1328230 - DNA, 22 bp, Artificial Sequence
  chemically synthesized
gttacccatgatcaactgcagt

SEQ ID NO: 1328231 - DNA, 22 bp, Artificial Sequence
  chemically synthesized
atctatttttggactgcagttg

SEQ ID NO: 1328232 - DNA, 22 bp, Artificial Sequence
  chemically synthesized
cccatgatcaactgcagtccaa

SEQ ID NO: 1328233 - DNA, 22 bp, Artificial Sequence
  chemically synthesized
tactcatctatttttggactgc

SEQ ID NO: 1328234 - DNA, 22 bp, Artificial Sequence
  chemically synthesized
tactgtactcatctatttttgg

SEQ ID NO: 1328235 - DNA, 22 bp, Artificial Sequence
  chemically synthesized
ttgtactgtactcatctatttt

SEQ ID NO: 1328236 - DNA, 22 bp, Artificial Sequence
  chemically synthesized
attgtactgtactcatctattt

SEQ ID NO: 1328237 - DNA, 22 bp, Artificial Sequence
  chemically synthesized
cagtccaaaaatagatgagtac

SEQ ID NO: 1328238 - DNA, 22 bp, Artificial Sequence
  chemically synthesized
aaaatatcttattgtactgtac

SEQ ID NO: 1328239 - DNA, 22 bp, Artificial Sequence
  chemically synthesized
tcaaaatatcttattgtactgt

SEQ ID NO: 1328240 - DNA, 22 bp, Artificial Sequence
  chemically synthesized
tctctcaaaatatcttattgta

SEQ ID NO: 1328241 - DNA, 22 bp, Artificial Sequence
  chemically synthesized
tatctctcaaaatatcttattg

SEQ ID NO: 1328242 - DNA, 22 bp, Artificial Sequence
  chemically synthesized
tgtgaatgtggtctctatctct

SEQ ID NO: 1328243 - DNA, 22 bp, Artificial Sequence
  chemically synthesized
tgagagatagagaccacattca

SEQ ID NO: 1328244 - DNA, 22 bp, Artificial Sequence
  chemically synthesized
gagagatagagaccacattcac

SEQ ID NO: 1328245 - DNA, 22 bp, Artificial Sequence
  chemically synthesized
agagatagagaccacattcaca

SEQ ID NO: 1328246 - DNA, 22 bp, Artificial Sequence
  chemically synthesized
tgataaaagttatgtgaatgtg

SEQ ID NO: 1328247 - DNA, 22 bp, Artificial Sequence
  chemically synthesized
taacaatatactgtgataaaag

SEQ ID NO: 1328248 - DNA, 22 bp, Artificial Sequence
  chemically synthesized
acataacttttatcacagtata

SEQ ID NO: 1328249 - DNA, 22 bp, Artificial Sequence
  chemically synthesized
gaacaattataacaatatactg

SEQ ID NO: 1328250 - DNA, 22 bp, Artificial Sequence
  chemically synthesized
ttatcacagtatattgttataa

SEQ ID NO: 1328251 - DNA, 22 bp, Artificial Sequence
  chemically synthesized
atattagaacaattataacaat

SEQ ID NO: 1328252 - DNA, 22 bp, Artificial Sequence
  chemically synthesized
tatcacagtatattgttataat

SEQ ID NO: 1328253 - DNA, 22 bp, Artificial Sequence
  chemically synthesized
atcacagtatattgttataatt

SEQ ID NO: 1328254 - DNA, 22 bp, Artificial Sequence
  chemically synthesized
tcacagtatattgttataattg

SEQ ID NO: 1328255 - DNA, 22 bp, Artificial Sequence
  chemically synthesized
acaacaataactaatattagaa

SEQ ID NO: 1328256 - DNA, 22 bp, Artificial Sequence
  chemically synthesized
ttataattgttctaatattagt

SEQ ID NO: 1328257 - DNA, 22 bp, Artificial Sequence
  chemically synthesized
taattgttctaatattagttat

SEQ ID NO: 1328258 - DNA, 22 bp, Artificial Sequence
  chemically synthesized
ttctaatattagttattgttgt

SEQ ID NO: 1328259 - DNA, 22 bp, Artificial Sequence
  chemically synthesized
taatattagttattgttgttaa

SEQ ID NO: 1328260 - DNA, 22 bp, Artificial Sequence
  chemically synthesized
atattagttattgttgttaatc

SEQ ID NO: 1328261 - DNA, 22 bp, Artificial Sequence
  chemically synthesized
ggaaccataagagattaacaac

SEQ ID NO: 1328262 - DNA, 22 bp, Artificial Sequence
  chemically synthesized
gttattgttgttaatctcttat

SEQ ID NO: 1328263 - DNA, 22 bp, Artificial Sequence
  chemically synthesized
ttgttgttaatctcttatggtt

SEQ ID NO: 1328264 - DNA, 22 bp, Artificial Sequence
  chemically synthesized
atatatacattaggaaccataa

SEQ ID NO: 1328265 - DNA, 22 bp, Artificial Sequence
  chemically synthesized
ttgttaatctcttatggttcct

SEQ ID NO: 1328266 - DNA, 22 bp, Artificial Sequence
  chemically synthesized
aatatatacattaggaaccata

SEQ ID NO: 1328267 - DNA, 22 bp, Artificial Sequence
  chemically synthesized
ttaatctcttatggttcctaat

SEQ ID NO: 1328268 - DNA, 22 bp, Artificial Sequence
  chemically synthesized
atctcttatggttcctaatgta

SEQ ID NO: 1328269 - DNA, 22 bp, Artificial Sequence
  chemically synthesized
ttatggttcctaatgtatatat

SEQ ID NO: 1328270 - DNA, 22 bp, Artificial Sequence
  chemically synthesized
atggttcctaatgtatatatta

SEQ ID NO: 1328271 - DNA, 22 bp, Artificial Sequence
  chemically synthesized
tggttcctaatgtatatattaa

SEQ ID NO: 1328272 - DNA, 22 bp, Artificial Sequence
  chemically synthesized
ctaatgtatatattaaactttg

SEQ ID NO: 1328273 - DNA, 22 bp, Artificial Sequence
  chemically synthesized
atgtatatattaaactttgtta

SEQ ID NO: 1328274 - DNA, 22 bp, Artificial Sequence
  chemically synthesized
tatacatacacatataacaaag

SEQ ID NO: 1328275 - DNA, 22 bp, Artificial Sequence
  chemically synthesized
atatacatacacatataacaaa

SEQ ID NO: 1328276 - DNA, 22 bp, Artificial Sequence
  chemically synthesized
ttatatacatacacatataaca

SEQ ID NO: 1328277 - DNA, 22 bp, Artificial Sequence
  chemically synthesized
cttatatacatacacatataac

SEQ ID NO: 1328278 - DNA, 22 bp, Artificial Sequence
  chemically synthesized
tgtttcttatatacatacacat

SEQ ID NO: 1328279 - DNA, 22 bp, Artificial Sequence
  chemically synthesized
aactttgttatatgtgtatgta

SEQ ID NO: 1328280 - DNA, 22 bp, Artificial Sequence
  chemically synthesized
tgttatatgtgtatgtatataa

SEQ ID NO: 1328281 - DNA, 22 bp, Artificial Sequence
  chemically synthesized
gttatatgtgtatgtatataag

SEQ ID NO: 1328282 - DNA, 22 bp, Artificial Sequence
  chemically synthesized
ttatatgtgtatgtatataaga

SEQ ID NO: 1328283 - DNA, 22 bp, Artificial Sequence
  chemically synthesized
tatgtgtatgtatataagaaac

SEQ ID NO: 1328284 - DNA, 22 bp, Artificial Sequence
  chemically synthesized
tgtatatattatgtttcttata

SEQ ID NO: 1328285 - DNA, 22 bp, Artificial Sequence
  chemically synthesized
atgtatatattatgtttcttat

SEQ ID NO: 1328286 - DNA, 22 bp, Artificial Sequence
  chemically synthesized
tggataataccaaaccttatgt

SEQ ID NO: 1328287 - DNA, 22 bp, Artificial Sequence
  chemically synthesized
aaactgtggataataccaaacc

SEQ ID NO: 1328288 - DNA, 22 bp, Artificial Sequence
  chemically synthesized
gtggatgcctgaaactgtggat

SEQ ID NO: 1328289 - DNA, 22 bp, Artificial Sequence
  chemically synthesized
ggtattatccacagtttcaggc

SEQ ID NO: 1328290 - DNA, 22 bp, Artificial Sequence
  chemically synthesized
gtattatccacagtttcaggca

SEQ ID NO: 1328291 - DNA, 22 bp, Artificial Sequence
  chemically synthesized
agacccctggtggatgcctgaa

SEQ ID NO: 1328292 - DNA, 22 bp, Artificial Sequence
  chemically synthesized
taagacccctggtggatgcctg

SEQ ID NO: 1328293 - DNA, 22 bp, Artificial Sequence
  chemically synthesized
tccacagtttcaggcatccacc

SEQ ID NO: 1328294 - DNA, 22 bp, Artificial Sequence
  chemically synthesized
caggcatccaccaggggtctta

SEQ ID NO: 1328295 - DNA, 22 bp, Artificial Sequence
  chemically synthesized
aggcatccaccaggggtcttag

SEQ ID NO: 1328296 - DNA, 22 bp, Artificial Sequence
  chemically synthesized
tagggatacgtgttctaagacc

SEQ ID NO: 1328297 - DNA, 22 bp, Artificial Sequence
  chemically synthesized
tctgtagggatacgtgttctaa

SEQ ID NO: 1328298 - DNA, 22 bp, Artificial Sequence
  chemically synthesized
atctgtagggatacgtgttcta

SEQ ID NO: 1328299 - DNA, 22 bp, Artificial Sequence
  chemically synthesized
cccttatctgtagggatacgtg

SEQ ID NO: 1328300 - DNA, 22 bp, Artificial Sequence
  chemically synthesized
atctccccttatctgtagggat

SEQ ID NO: 1328301 - DNA, 22 bp, Artificial Sequence
  chemically synthesized
agaacacgtatccctacagata

SEQ ID NO: 1328302 - DNA, 22 bp, Artificial Sequence
  chemically synthesized
gaacacgtatccctacagataa

SEQ ID NO: 1328303 - DNA, 22 bp, Artificial Sequence
  chemically synthesized
taatggtagaaataattaatct

SEQ ID NO: 1328304 - DNA, 22 bp, Artificial Sequence
  chemically synthesized
cagataaggggagattaattat

SEQ ID NO: 1328305 - DNA, 22 bp, Artificial Sequence
  chemically synthesized
tgtaatggtagaaataattaat

SEQ ID NO: 1328306 - DNA, 22 bp, Artificial Sequence
  chemically synthesized
attctgtaatggtagaaataat

SEQ ID NO: 1328307 - DNA, 22 bp, Artificial Sequence
  chemically synthesized
aattctgtaatggtagaaataa

SEQ ID NO: 1328308 - DNA, 22 bp, Artificial Sequence
  chemically synthesized
taattctgtaatggtagaaata

SEQ ID NO: 1328309 - DNA, 22 bp, Artificial Sequence
  chemically synthesized
attttaattctgtaatggtaga

SEQ ID NO: 1328310 - DNA, 22 bp, Artificial Sequence
  chemically synthesized
attatttctaccattacagaat

SEQ ID NO: 1328311 - DNA, 22 bp, Artificial Sequence
  chemically synthesized
tttctaccattacagaattaaa

SEQ ID NO: 1328312 - DNA, 22 bp, Artificial Sequence
  chemically synthesized
acacagactcattttaattctg

SEQ ID NO: 1328313 - DNA, 22 bp, Artificial Sequence
  chemically synthesized
ctaccattacagaattaaaatg

SEQ ID NO: 1328314 - DNA, 22 bp, Artificial Sequence
  chemically synthesized
taccattacagaattaaaatga

SEQ ID NO: 1328315 - DNA, 22 bp, Artificial Sequence
  chemically synthesized
ccattacagaattaaaatgagt

SEQ ID NO: 1328316 - DNA, 22 bp, Artificial Sequence
  chemically synthesized
cagaattaaaatgagtctgtgt

SEQ ID NO: 1328317 - DNA, 22 bp, Artificial Sequence
  chemically synthesized
aataggaagattaacacagact

SEQ ID NO: 1328318 - DNA, 22 bp, Artificial Sequence
  chemically synthesized
gaataggaagattaacacagac

SEQ ID NO: 1328319 - DNA, 22 bp, Artificial Sequence
  chemically synthesized
tgaataggaagattaacacaga

SEQ ID NO: 1328320 - DNA, 22 bp, Artificial Sequence
  chemically synthesized
ttgaataggaagattaacacag

SEQ ID NO: 1328321 - DNA, 22 bp, Artificial Sequence
  chemically synthesized
aaatgagtctgtgttaatcttc

SEQ ID NO: 1328322 - DNA, 22 bp, Artificial Sequence
  chemically synthesized
gaaataatttttgaataggaag

SEQ ID NO: 1328323 - DNA, 22 bp, Artificial Sequence
  chemically synthesized
tgttaatcttcctattcaaaaa

SEQ ID NO: 1328324 - DNA, 22 bp, Artificial Sequence
  chemically synthesized
aattagaaataatttttgaata

SEQ ID NO: 1328325 - DNA, 22 bp, Artificial Sequence
  chemically synthesized
tgaattagaaataatttttgaa

SEQ ID NO: 1328326 - DNA, 22 bp, Artificial Sequence
  chemically synthesized
tctgaattagaaataatttttg

SEQ ID NO: 1328327 - DNA, 22 bp, Artificial Sequence
  chemically synthesized
atcttcctattcaaaaattatt

SEQ ID NO: 1328328 - DNA, 22 bp, Artificial Sequence
  chemically synthesized
ctctgaattagaaataattttt

SEQ ID NO: 1328329 - DNA, 22 bp, Artificial Sequence
  chemically synthesized
cctattcaaaaattatttctaa

SEQ ID NO: 1328330 - DNA, 22 bp, Artificial Sequence
  chemically synthesized
aatttctctgaattagaaataa

SEQ ID NO: 1328331 - DNA, 22 bp, Artificial Sequence
  chemically synthesized
ctattcaaaaattatttctaat

SEQ ID NO: 1328332 - DNA, 22 bp, Artificial Sequence
  chemically synthesized
gaatttctctgaattagaaata

SEQ ID NO: 1328333 - DNA, 22 bp, Artificial Sequence
  chemically synthesized
tgaatttctctgaattagaaat

SEQ ID NO: 1328334 - DNA, 22 bp, Artificial Sequence
  chemically synthesized
ttcaaaaattatttctaattca

SEQ ID NO: 1328335 - DNA, 22 bp, Artificial Sequence
  chemically synthesized
tttgaatttctctgaattagaa

SEQ ID NO: 1328336 - DNA, 22 bp, Artificial Sequence
  chemically synthesized
tctttgaatttctctgaattag

SEQ ID NO: 1328337 - DNA, 22 bp, Artificial Sequence
  chemically synthesized
aaaaattatttctaattcagag

SEQ ID NO: 1328338 - DNA, 22 bp, Artificial Sequence
  chemically synthesized
tagactctctttgaatttctct

SEQ ID NO: 1328339 - DNA, 22 bp, Artificial Sequence
  chemically synthesized
tttctaattcagagaaattcaa

SEQ ID NO: 1328340 - DNA, 22 bp, Artificial Sequence
  chemically synthesized
ctaattcagagaaattcaaaga

SEQ ID NO: 1328341 - DNA, 22 bp, Artificial Sequence
  chemically synthesized
taattcagagaaattcaaagag

SEQ ID NO: 1328342 - DNA, 22 bp, Artificial Sequence
  chemically synthesized
attcagagaaattcaaagagag

SEQ ID NO: 1328343 - DNA, 22 bp, Artificial Sequence
  chemically synthesized
agagaaattcaaagagagtcta

SEQ ID NO: 1328344 - DNA, 22 bp, Artificial Sequence
  chemically synthesized
aaagagagtctataacgctatg

SEQ ID NO: 1328345 - DNA, 22 bp, Artificial Sequence
  chemically synthesized
atgtcaataaaccgcatagcgt

SEQ ID NO: 1328346 - DNA, 22 bp, Artificial Sequence
  chemically synthesized
aatgtcaataaaccgcatagcg

SEQ ID NO: 1328347 - DNA, 22 bp, Artificial Sequence
  chemically synthesized
taatgtcaataaaccgcatagc

SEQ ID NO: 1328348 - DNA, 22 bp, Artificial Sequence
  chemically synthesized
atgtctttaatgtcaataaacc

SEQ ID NO: 1328349 - DNA, 22 bp, Artificial Sequence
  chemically synthesized
taacgctatgcggtttattgac

SEQ ID NO: 1328350 - DNA, 22 bp, Artificial Sequence
  chemically synthesized
ttaatgtctttaatgtcaataa

SEQ ID NO: 1328351 - DNA, 22 bp, Artificial Sequence
  chemically synthesized
actattaatgtctttaatgtca

SEQ ID NO: 1328352 - DNA, 22 bp, Artificial Sequence
  chemically synthesized
tgcggtttattgacattaaaga

SEQ ID NO: 1328353 - DNA, 22 bp, Artificial Sequence
  chemically synthesized
aagcaattaactattaatgtct

SEQ ID NO: 1328354 - DNA, 22 bp, Artificial Sequence
  chemically synthesized
attgacattaaagacattaata

SEQ ID NO: 1328355 - DNA, 22 bp, Artificial Sequence
  chemically synthesized
caagcaattaactattaatgtc

SEQ ID NO: 1328356 - DNA, 22 bp, Artificial Sequence
  chemically synthesized
ttgacattaaagacattaatag

SEQ ID NO: 1328357 - DNA, 22 bp, Artificial Sequence
  chemically synthesized
ttcaagcaattaactattaatg

SEQ ID NO: 1328358 - DNA, 22 bp, Artificial Sequence
  chemically synthesized
cttcaagcaattaactattaat

SEQ ID NO: 1328359 - DNA, 22 bp, Artificial Sequence
  chemically synthesized
acattaaagacattaatagtta

SEQ ID NO: 1328360 - DNA, 22 bp, Artificial Sequence
  chemically synthesized
ttcttcaagcaattaactatta

SEQ ID NO: 1328361 - DNA, 22 bp, Artificial Sequence
  chemically synthesized
cttcttcaagcaattaactatt

SEQ ID NO: 1328362 - DNA, 22 bp, Artificial Sequence
  chemically synthesized
tcttcttcaagcaattaactat

SEQ ID NO: 1328363 - DNA, 22 bp, Artificial Sequence
  chemically synthesized
aagacattaatagttaattgct

SEQ ID NO: 1328364 - DNA, 22 bp, Artificial Sequence
  chemically synthesized
ttttcttcttcaagcaattaac

SEQ ID NO: 1328365 - DNA, 22 bp, Artificial Sequence
  chemically synthesized
atagttaattgcttgaagaaga

SEQ ID NO: 1328366 - DNA, 22 bp, Artificial Sequence
  chemically synthesized
aaaaagtctattttcttcttca

SEQ ID NO: 1328367 - DNA, 22 bp, Artificial Sequence
  chemically synthesized
ctgaaaaagtctattttcttct

SEQ ID NO: 1328368 - DNA, 22 bp, Artificial Sequence
  chemically synthesized
attgcttgaagaagaaaataga

SEQ ID NO: 1328369 - DNA, 22 bp, Artificial Sequence
  chemically synthesized
ttactgaaaaagtctattttct

SEQ ID NO: 1328370 - DNA, 22 bp, Artificial Sequence
  chemically synthesized
ttattactgaaaaagtctattt

SEQ ID NO: 1328371 - DNA, 22 bp, Artificial Sequence
  chemically synthesized
cttgaagaagaaaatagacttt

SEQ ID NO: 1328372 - DNA, 22 bp, Artificial Sequence
  chemically synthesized
ttattattactgaaaaagtcta

SEQ ID NO: 1328373 - DNA, 22 bp, Artificial Sequence
  chemically synthesized
gaagaagaaaatagactttttc

SEQ ID NO: 1328374 - DNA, 22 bp, Artificial Sequence
  chemically synthesized
gttattattactgaaaaagtct

SEQ ID NO: 1328375 - DNA, 22 bp, Artificial Sequence
  chemically synthesized
aagaagaaaatagactttttca

SEQ ID NO: 1328376 - DNA, 22 bp, Artificial Sequence
  chemically synthesized
caaatttgttattattactgaa

SEQ ID NO: 1328377 - DNA, 22 bp, Artificial Sequence
  chemically synthesized
tgctgcaaatttgttattatta

SEQ ID NO: 1328378 - DNA, 22 bp, Artificial Sequence
  chemically synthesized
tttcagtaataataacaaattt

SEQ ID NO: 1328379 - DNA, 22 bp, Artificial Sequence
  chemically synthesized
caattatgctgcaaatttgtta

SEQ ID NO: 1328380 - DNA, 22 bp, Artificial Sequence
  chemically synthesized
ttcagtaataataacaaatttg

SEQ ID NO: 1328381 - DNA, 22 bp, Artificial Sequence
  chemically synthesized
ccaattatgctgcaaatttgtt

SEQ ID NO: 1328382 - DNA, 22 bp, Artificial Sequence
  chemically synthesized
tcagtaataataacaaatttgc

SEQ ID NO: 1328383 - DNA, 22 bp, Artificial Sequence
  chemically synthesized
cagtaataataacaaatttgca

SEQ ID NO: 1328384 - DNA, 22 bp, Artificial Sequence
  chemically synthesized
agtaataataacaaatttgcag

SEQ ID NO: 1328385 - DNA, 22 bp, Artificial Sequence
  chemically synthesized
gcagcataattggaagtgtacc

SEQ ID NO: 1328386 - DNA, 22 bp, Artificial Sequence
  chemically synthesized
cagcataattggaagtgtaccg

SEQ ID NO: 1328387 - DNA, 22 bp, Artificial Sequence
  chemically synthesized
aaagggggataggacggtacac

SEQ ID NO: 1328388 - DNA, 22 bp, Artificial Sequence
  chemically synthesized
tagttcaaagggggataggacg

SEQ ID NO: 1328389 - DNA, 22 bp, Artificial Sequence
  chemically synthesized
atagttcaaagggggataggac

SEQ ID NO: 1328390 - DNA, 22 bp, Artificial Sequence
  chemically synthesized
tatagttcaaagggggatagga

SEQ ID NO: 1328391 - DNA, 22 bp, Artificial Sequence
  chemically synthesized
gaagtgtaccgtcctatccccc

SEQ ID NO: 1328392 - DNA, 22 bp, Artificial Sequence
  chemically synthesized
ttttatagttcaaagggggata

SEQ ID NO: 1328393 - DNA, 22 bp, Artificial Sequence
  chemically synthesized
ccaaaatattattttatagttc

SEQ ID NO: 1328394 - DNA, 22 bp, Artificial Sequence
  chemically synthesized
accaaaatattattttatagtt

SEQ ID NO: 1328395 - DNA, 22 bp, Artificial Sequence
  chemically synthesized
taccaaaatattattttatagt

SEQ ID NO: 1328396 - DNA, 22 bp, Artificial Sequence
  chemically synthesized
tccccctttgaactataaaata

SEQ ID NO: 1328397 - DNA, 22 bp, Artificial Sequence
  chemically synthesized
tgaactataaaataatattttg

SEQ ID NO: 1328398 - DNA, 22 bp, Artificial Sequence
  chemically synthesized
accatattttaccaaaatatta

SEQ ID NO: 1328399 - DNA, 22 bp, Artificial Sequence
  chemically synthesized
gaactataaaataatattttgg

SEQ ID NO: 1328400 - DNA, 22 bp, Artificial Sequence
  chemically synthesized
caccatattttaccaaaatatt

SEQ ID NO: 1328401 - DNA, 22 bp, Artificial Sequence
  chemically synthesized
aactataaaataatattttggt

SEQ ID NO: 1328402 - DNA, 22 bp, Artificial Sequence
  chemically synthesized
taaaataatattttggtaaaat

SEQ ID NO: 1328403 - DNA, 22 bp, Artificial Sequence
  chemically synthesized
taaggatccttcaccatatttt

SEQ ID NO: 1328404 - DNA, 22 bp, Artificial Sequence
  chemically synthesized
tggtaaaatatggtgaaggatc

SEQ ID NO: 1328405 - DNA, 22 bp, Artificial Sequence
  chemically synthesized
ggtaaaatatggtgaaggatcc

SEQ ID NO: 1328406 - DNA, 22 bp, Artificial Sequence
  chemically synthesized
gtaaaatatggtgaaggatcct

SEQ ID NO: 1328407 - DNA, 22 bp, Artificial Sequence
  chemically synthesized
tgatcaagatacactgtaagga

SEQ ID NO: 1328408 - DNA, 22 bp, Artificial Sequence
  chemically synthesized
aggaggactatgatcaagatac

SEQ ID NO: 1328409 - DNA, 22 bp, Artificial Sequence
  chemically synthesized
taactcaggaggactatgatca

SEQ ID NO: 1328410 - DNA, 22 bp, Artificial Sequence
  chemically synthesized
acagtgtatcttgatcatagtc

SEQ ID NO: 1328411 - DNA, 22 bp, Artificial Sequence
  chemically synthesized
cagtgtatcttgatcatagtcc

SEQ ID NO: 1328412 - DNA, 22 bp, Artificial Sequence
  chemically synthesized
gatcatagtcctcctgagttat

SEQ ID NO: 1328413 - DNA, 22 bp, Artificial Sequence
  chemically synthesized
atcatagtcctcctgagttata

SEQ ID NO: 1328414 - DNA, 22 bp, Artificial Sequence
  chemically synthesized
gtataataatgtagataattat

SEQ ID NO: 1328415 - DNA, 22 bp, Artificial Sequence
  chemically synthesized
agtataataatgtagataatta

SEQ ID NO: 1328416 - DNA, 22 bp, Artificial Sequence
  chemically synthesized
tagtataataatgtagataatt

SEQ ID NO: 1328417 - DNA, 22 bp, Artificial Sequence
  chemically synthesized
ctgagttataattatctacatt

SEQ ID NO: 1328418 - DNA, 22 bp, Artificial Sequence
  chemically synthesized
agttataattatctacattatt

SEQ ID NO: 1328419 - DNA, 22 bp, Artificial Sequence
  chemically synthesized
taattatctacattattatact

SEQ ID NO: 1328420 - DNA, 22 bp, Artificial Sequence
  chemically synthesized
tctacattattatactaaaatt

SEQ ID NO: 1328421 - DNA, 22 bp, Artificial Sequence
  chemically synthesized
tgaggaagagccacaattttag

SEQ ID NO: 1328422 - DNA, 22 bp, Artificial Sequence
  chemically synthesized
atgaggaagagccacaatttta

SEQ ID NO: 1328423 - DNA, 22 bp, Artificial Sequence
  chemically synthesized
cattattatactaaaattgtgg

SEQ ID NO: 1328424 - DNA, 22 bp, Artificial Sequence
  chemically synthesized
ttatactaaaattgtggctctt

SEQ ID NO: 1328425 - DNA, 22 bp, Artificial Sequence
  chemically synthesized
atatcttatgaggaagagccac

SEQ ID NO: 1328426 - DNA, 22 bp, Artificial Sequence
  chemically synthesized
tactaaaattgtggctcttcct

SEQ ID NO: 1328427 - DNA, 22 bp, Artificial Sequence
  chemically synthesized
aaattgtggctcttcctcataa

SEQ ID NO: 1328428 - DNA, 22 bp, Artificial Sequence
  chemically synthesized
tggctcttcctcataagatatt

SEQ ID NO: 1328429 - DNA, 22 bp, Artificial Sequence
  chemically synthesized
atatagtgaatatattaatatc

SEQ ID NO: 1328430 - DNA, 22 bp, Artificial Sequence
  chemically synthesized
catatagtgaatatattaatat

SEQ ID NO: 1328431 - DNA, 22 bp, Artificial Sequence
  chemically synthesized
ttcctcataagatattaatata

SEQ ID NO: 1328432 - DNA, 22 bp, Artificial Sequence
  chemically synthesized
cctcataagatattaatatatt

SEQ ID NO: 1328433 - DNA, 22 bp, Artificial Sequence
  chemically synthesized
ctcataagatattaatatattc

SEQ ID NO: 1328434 - DNA, 22 bp, Artificial Sequence
  chemically synthesized
atttcatatagtgaatatatta

SEQ ID NO: 1328435 - DNA, 22 bp, Artificial Sequence
  chemically synthesized
ataagatattaatatattcact

SEQ ID NO: 1328436 - DNA, 22 bp, Artificial Sequence
  chemically synthesized
gttaatttcatatagtgaatat

SEQ ID NO: 1328437 - DNA, 22 bp, Artificial Sequence
  chemically synthesized
tgcaattagttaatttcatata

SEQ ID NO: 1328438 - DNA, 22 bp, Artificial Sequence
  chemically synthesized
atatattcactatatgaaatta

SEQ ID NO: 1328439 - DNA, 22 bp, Artificial Sequence
  chemically synthesized
gagctatgcaattagttaattt

SEQ ID NO: 1328440 - DNA, 22 bp, Artificial Sequence
  chemically synthesized
ttggagctatgcaattagttaa

SEQ ID NO: 1328441 - DNA, 22 bp, Artificial Sequence
  chemically synthesized
actatatgaaattaactaattg

SEQ ID NO: 1328442 - DNA, 22 bp, Artificial Sequence
  chemically synthesized
attggagctatgcaattagtta

SEQ ID NO: 1328443 - DNA, 22 bp, Artificial Sequence
  chemically synthesized
tattggagctatgcaattagtt

SEQ ID NO: 1328444 - DNA, 22 bp, Artificial Sequence
  chemically synthesized
tatgaaattaactaattgcata

SEQ ID NO: 1328445 - DNA, 22 bp, Artificial Sequence
  chemically synthesized
atattttattggagctatgcaa

SEQ ID NO: 1328446 - DNA, 22 bp, Artificial Sequence
  chemically synthesized
actaattgcatagctccaataa

SEQ ID NO: 1328447 - DNA, 22 bp, Artificial Sequence
  chemically synthesized
aataagttaatattttattgga

SEQ ID NO: 1328448 - DNA, 22 bp, Artificial Sequence
  chemically synthesized
attgcatagctccaataaaata

SEQ ID NO: 1328449 - DNA, 22 bp, Artificial Sequence
  chemically synthesized
catagctccaataaaatattaa

SEQ ID NO: 1328450 - DNA, 22 bp, Artificial Sequence
  chemically synthesized
acagttgaataagttaatattt

SEQ ID NO: 1328451 - DNA, 22 bp, Artificial Sequence
  chemically synthesized
aacagttgaataagttaatatt

SEQ ID NO: 1328452 - DNA, 22 bp, Artificial Sequence
  chemically synthesized
taacagttgaataagttaatat

SEQ ID NO: 1328453 - DNA, 22 bp, Artificial Sequence
  chemically synthesized
ctttaacagttgaataagttaa

SEQ ID NO: 1328454 - DNA, 22 bp, Artificial Sequence
  chemically synthesized
actttaacagttgaataagtta

SEQ ID NO: 1328455 - DNA, 22 bp, Artificial Sequence
  chemically synthesized
caataaaatattaacttattca

SEQ ID NO: 1328456 - DNA, 22 bp, Artificial Sequence
  chemically synthesized
ttactttaacagttgaataagt

SEQ ID NO: 1328457 - DNA, 22 bp, Artificial Sequence
  chemically synthesized
gccgatattcttactttaacag

SEQ ID NO: 1328458 - DNA, 22 bp, Artificial Sequence
  chemically synthesized
acttattcaactgttaaagtaa

SEQ ID NO: 1328459 - DNA, 22 bp, Artificial Sequence
  chemically synthesized
attcaactgttaaagtaagaat

SEQ ID NO: 1328460 - DNA, 22 bp, Artificial Sequence
  chemically synthesized
ttcaactgttaaagtaagaata

SEQ ID NO: 1328461 - DNA, 22 bp, Artificial Sequence
  chemically synthesized
aactgttaaagtaagaatatcg

SEQ ID NO: 1328462 - DNA, 22 bp, Artificial Sequence
  chemically synthesized
ttaaagtaagaatatcggccag

SEQ ID NO: 1328463 - DNA, 22 bp, Artificial Sequence
  chemically synthesized
aagtaagaatatcggccaggcg

SEQ ID NO: 1328464 - DNA, 22 bp, Artificial Sequence
  chemically synthesized
caggcacgagccaccgcgcctg

SEQ ID NO: 1328465 - DNA, 22 bp, Artificial Sequence
  chemically synthesized
ggattacaggcacgagccaccg

SEQ ID NO: 1328466 - DNA, 22 bp, Artificial Sequence
  chemically synthesized
ccaaagtgctgggattacaggc

SEQ ID NO: 1328467 - DNA, 22 bp, Artificial Sequence
  chemically synthesized
gtgcctgtaatcccagcacttt

SEQ ID NO: 1328468 - DNA, 22 bp, Artificial Sequence
  chemically synthesized
tgtcagcctcccaaagtgctgg

SEQ ID NO: 1328469 - DNA, 22 bp, Artificial Sequence
  chemically synthesized
ctgtgtcagcctcccaaagtgc

SEQ ID NO: 1328470 - DNA, 22 bp, Artificial Sequence
  chemically synthesized
tcctgtgtcagcctcccaaagt

SEQ ID NO: 1328471 - DNA, 22 bp, Artificial Sequence
  chemically synthesized
taatcccagcactttgggaggc

SEQ ID NO: 1328472 - DNA, 22 bp, Artificial Sequence
  chemically synthesized
aagtgattctcctgtgtcagcc

SEQ ID NO: 1328473 - DNA, 22 bp, Artificial Sequence
  chemically synthesized
tgggaggctgacacaggagaat

SEQ ID NO: 1328474 - DNA, 22 bp, Artificial Sequence
  chemically synthesized
gggaggctgacacaggagaatc

SEQ ID NO: 1328475 - DNA, 22 bp, Artificial Sequence
  chemically synthesized
ccaggttcaagtgattctcctg

SEQ ID NO: 1328476 - DNA, 22 bp, Artificial Sequence
  chemically synthesized
ggaggctgacacaggagaatca

SEQ ID NO: 1328477 - DNA, 22 bp, Artificial Sequence
  chemically synthesized
cctcccaggttcaagtgattct

SEQ ID NO: 1328478 - DNA, 22 bp, Artificial Sequence
  chemically synthesized
tgcctcccaggttcaagtgatt

SEQ ID NO: 1328479 - DNA, 22 bp, Artificial Sequence
  chemically synthesized
acacaggagaatcacttgaacc

SEQ ID NO: 1328480 - DNA, 22 bp, Artificial Sequence
  chemically synthesized
caacctctgcctcccaggttca

SEQ ID NO: 1328481 - DNA, 22 bp, Artificial Sequence
  chemically synthesized
actgcaacctctgcctcccagg

SEQ ID NO: 1328482 - DNA, 22 bp, Artificial Sequence
  chemically synthesized
gctcactgcaacctctgcctcc

SEQ ID NO: 1328483 - DNA, 22 bp, Artificial Sequence
  chemically synthesized
ggctcactgcaacctctgcctc

SEQ ID NO: 1328484 - DNA, 22 bp, Artificial Sequence
  chemically synthesized
gaacctgggaggcagaggttgc

SEQ ID NO: 1328485 - DNA, 22 bp, Artificial Sequence
  chemically synthesized
aacctgggaggcagaggttgca

SEQ ID NO: 1328486 - DNA, 22 bp, Artificial Sequence
  chemically synthesized
ggaggcagaggttgcagtgagc

SEQ ID NO: 1328487 - DNA, 22 bp, Artificial Sequence
  chemically synthesized
gagtgcaatggcgcagtcttgg

SEQ ID NO: 1328488 - DNA, 22 bp, Artificial Sequence
  chemically synthesized
cagtgagccaagactgcgccat

SEQ ID NO: 1328489 - DNA, 22 bp, Artificial Sequence
  chemically synthesized
cccaaactggagtgcaatggcg

SEQ ID NO: 1328490 - DNA, 22 bp, Artificial Sequence
  chemically synthesized
ttgcccaaactggagtgcaatg

SEQ ID NO: 1328491 - DNA, 22 bp, Artificial Sequence
  chemically synthesized
actgttgcccaaactggagtgc

SEQ ID NO: 1328492 - DNA, 22 bp, Artificial Sequence
  chemically synthesized
cgccattgcactccagtttggg

SEQ ID NO: 1328493 - DNA, 22 bp, Artificial Sequence
  chemically synthesized
agatggagtctcactgttgccc

SEQ ID NO: 1328494 - DNA, 22 bp, Artificial Sequence
  chemically synthesized
cactccagtttgggcaacagtg

SEQ ID NO: 1328495 - DNA, 22 bp, Artificial Sequence
  chemically synthesized
gagatggagtctcactgttgcc

SEQ ID NO: 1328496 - DNA, 22 bp, Artificial Sequence
  chemically synthesized
tgagatggagtctcactgttgc

SEQ ID NO: 1328497 - DNA, 22 bp, Artificial Sequence
  chemically synthesized
ttgagatggagtctcactgttg

SEQ ID NO: 1328498 - DNA, 22 bp, Artificial Sequence
  chemically synthesized
tttgagatggagtctcactgtt

SEQ ID NO: 1328499 - DNA, 22 bp, Artificial Sequence
  chemically synthesized
ttttgagatggagtctcactgt

SEQ ID NO: 1328500 - DNA, 22 bp, Artificial Sequence
  chemically synthesized
cagtttgggcaacagtgagact

SEQ ID NO: 1328501 - DNA, 22 bp, Artificial Sequence
  chemically synthesized
tttttttgagatggagtctcac

SEQ ID NO: 1328502 - DNA, 22 bp, Artificial Sequence
  chemically synthesized
atttttttgagatggagtctca

SEQ ID NO: 1328503 - DNA, 22 bp, Artificial Sequence
  chemically synthesized
gggcaacagtgagactccatct

SEQ ID NO: 1328504 - DNA, 22 bp, Artificial Sequence
  chemically synthesized
tttatttttttgagatggagtc

SEQ ID NO: 1328505 - DNA, 22 bp, Artificial Sequence
  chemically synthesized
ggcaacagtgagactccatctc

SEQ ID NO: 1328506 - DNA, 22 bp, Artificial Sequence
  chemically synthesized
atttatttttttgagatggagt

SEQ ID NO: 1328507 - DNA, 22 bp, Artificial Sequence
  chemically synthesized
tatttatttttttgagatggag

SEQ ID NO: 1328508 - DNA, 22 bp, Artificial Sequence
  chemically synthesized
ttttatttatttttttgagatg

SEQ ID NO: 1328509 - DNA, 22 bp, Artificial Sequence
  chemically synthesized
attttatttatttttttgagat

SEQ ID NO: 1328510 - DNA, 22 bp, Artificial Sequence
  chemically synthesized
tttattttatttatttttttga

SEQ ID NO: 1328511 - DNA, 22 bp, Artificial Sequence
  chemically synthesized
atttattttatttatttttttg

SEQ ID NO: 1328512 - DNA, 22 bp, Artificial Sequence
  chemically synthesized
tatttattttatttattttttt

SEQ ID NO: 1328513 - DNA, 22 bp, Artificial Sequence
  chemically synthesized
ctttatttattttatttatttt

SEQ ID NO: 1328514 - DNA, 22 bp, Artificial Sequence
  chemically synthesized
actttatttattttatttattt

SEQ ID NO: 1328515 - DNA, 22 bp, Artificial Sequence
  chemically synthesized
tactttatttattttatttatt

SEQ ID NO: 1328516 - DNA, 22 bp, Artificial Sequence
  chemically synthesized
catctcaaaaaaataaataaaa

SEQ ID NO: 1328517 - DNA, 22 bp, Artificial Sequence
  chemically synthesized
ttactttatttattttatttat

SEQ ID NO: 1328518 - DNA, 22 bp, Artificial Sequence
  chemically synthesized
aaaaaaataaataaaataaata

SEQ ID NO: 1328519 - DNA, 22 bp, Artificial Sequence
  chemically synthesized
atatttttactttatttatttt

SEQ ID NO: 1328520 - DNA, 22 bp, Artificial Sequence
  chemically synthesized
tatgcaattaatatttttactt

SEQ ID NO: 1328521 - DNA, 22 bp, Artificial Sequence
  chemically synthesized
gtatgcaattaatatttttact

SEQ ID NO: 1328522 - DNA, 22 bp, Artificial Sequence
  chemically synthesized
tgtatgcaattaatatttttac

SEQ ID NO: 1328523 - DNA, 22 bp, Artificial Sequence
  chemically synthesized
ttgtatgcaattaatattttta

SEQ ID NO: 1328524 - DNA, 22 bp, Artificial Sequence
  chemically synthesized
tttgtatgcaattaatattttt

SEQ ID NO: 1328525 - DNA, 22 bp, Artificial Sequence
  chemically synthesized
ttttgtatgcaattaatatttt

SEQ ID NO: 1328526 - DNA, 22 bp, Artificial Sequence
  chemically synthesized
ttttttgtatgcaattaatatt

SEQ ID NO: 1328527 - DNA, 22 bp, Artificial Sequence
  chemically synthesized
cttttttgtatgcaattaatat

SEQ ID NO: 1328528 - DNA, 22 bp, Artificial Sequence
  chemically synthesized
attgcatacaaaaaagaaatat

SEQ ID NO: 1328529 - DNA, 22 bp, Artificial Sequence
  chemically synthesized
catacaaaaaagaaatatgctg

SEQ ID NO: 1328530 - DNA, 22 bp, Artificial Sequence
  chemically synthesized
atacaatggacggtatccagca

SEQ ID NO: 1328531 - DNA, 22 bp, Artificial Sequence
  chemically synthesized
ctaatacaatggacggtatcca

SEQ ID NO: 1328532 - DNA, 22 bp, Artificial Sequence
  chemically synthesized
aaattgctaatacaatggacgg

SEQ ID NO: 1328533 - DNA, 22 bp, Artificial Sequence
  chemically synthesized
gaaattgctaatacaatggacg

SEQ ID NO: 1328534 - DNA, 22 bp, Artificial Sequence
  chemically synthesized
gccttgaaattgctaatacaat

SEQ ID NO: 1328535 - DNA, 22 bp, Artificial Sequence
  chemically synthesized
agccttgaaattgctaatacaa

SEQ ID NO: 1328536 - DNA, 22 bp, Artificial Sequence
  chemically synthesized
gataccgtccattgtattagca

SEQ ID NO: 1328537 - DNA, 22 bp, Artificial Sequence
  chemically synthesized
tattagcaatttcaaggctaaa

SEQ ID NO: 1328538 - DNA, 22 bp, Artificial Sequence
  chemically synthesized
gcaatttcaaggctaaacatta

SEQ ID NO: 1328539 - DNA, 22 bp, Artificial Sequence
  chemically synthesized
aaaaaaaaaaaaaaaagtaatg

SEQ ID NO: 1328540 - DNA, 22 bp, Artificial Sequence
  chemically synthesized
caaggctaaacattactttttt

SEQ ID NO: 1328541 - DNA, 22 bp, Artificial Sequence
  chemically synthesized
aaggctaaacattacttttttt

SEQ ID NO: 1328542 - DNA, 22 bp, Artificial Sequence
  chemically synthesized
catctcaaaaaaaaaaaaaaaa

SEQ ID NO: 1328543 - DNA, 22 bp, Artificial Sequence
  chemically synthesized
aacattactttttttttttttt

SEQ ID NO: 1328544 - DNA, 22 bp, Artificial Sequence
  chemically synthesized
cttttttttttttttttgagat

SEQ ID NO: 1328545 - DNA, 22 bp, Artificial Sequence
  chemically synthesized
ttttttttttttttgagatgga

SEQ ID NO: 1328546 - DNA, 22 bp, Artificial Sequence
  chemically synthesized
tttttttttttttgagatggaa

SEQ ID NO: 1328547 - DNA, 22 bp, Artificial Sequence
  chemically synthesized
ttttttttttttgagatggaat

SEQ ID NO: 1328548 - DNA, 22 bp, Artificial Sequence
  chemically synthesized
tttttttttttgagatggaatt

SEQ ID NO: 1328549 - DNA, 22 bp, Artificial Sequence
  chemically synthesized
ttttttttttgagatggaattt

SEQ ID NO: 1328550 - DNA, 22 bp, Artificial Sequence
  chemically synthesized
tttttttttgagatggaatttt

SEQ ID NO: 1328551 - DNA, 22 bp, Artificial Sequence
  chemically synthesized
ggcgacaagagcaaaattccat

SEQ ID NO: 1328552 - DNA, 22 bp, Artificial Sequence
  chemically synthesized
ttttttttgagatggaattttg

SEQ ID NO: 1328553 - DNA, 22 bp, Artificial Sequence
  chemically synthesized
tttttttgagatggaattttgc

SEQ ID NO: 1328554 - DNA, 22 bp, Artificial Sequence
  chemically synthesized
ttttttgagatggaattttgct

SEQ ID NO: 1328555 - DNA, 22 bp, Artificial Sequence
  chemically synthesized
tttttgagatggaattttgctc

SEQ ID NO: 1328556 - DNA, 22 bp, Artificial Sequence
  chemically synthesized
ttttgagatggaattttgctct

SEQ ID NO: 1328557 - DNA, 22 bp, Artificial Sequence
  chemically synthesized
tttgagatggaattttgctctt

SEQ ID NO: 1328558 - DNA, 22 bp, Artificial Sequence
  chemically synthesized
ttgagatggaattttgctcttg

SEQ ID NO: 1328559 - DNA, 22 bp, Artificial Sequence
  chemically synthesized
cagcctgggcgacaagagcaaa

SEQ ID NO: 1328560 - DNA, 22 bp, Artificial Sequence
  chemically synthesized
tgagatggaattttgctcttgt

SEQ ID NO: 1328561 - DNA, 22 bp, Artificial Sequence
  chemically synthesized
gagatggaattttgctcttgtc

SEQ ID NO: 1328562 - DNA, 22 bp, Artificial Sequence
  chemically synthesized
agatggaattttgctcttgtcg

SEQ ID NO: 1328563 - DNA, 22 bp, Artificial Sequence
  chemically synthesized
cactccagcctgggcgacaaga

SEQ ID NO: 1328564 - DNA, 22 bp, Artificial Sequence
  chemically synthesized
agccgctgcactccagcctggg

SEQ ID NO: 1328565 - DNA, 22 bp, Artificial Sequence
  chemically synthesized
tgctcttgtcgcccaggctgga

SEQ ID NO: 1328566 - DNA, 22 bp, Artificial Sequence
  chemically synthesized
gctcttgtcgcccaggctggag

SEQ ID NO: 1328567 - DNA, 22 bp, Artificial Sequence
  chemically synthesized
ctcttgtcgcccaggctggagt

SEQ ID NO: 1328568 - DNA, 22 bp, Artificial Sequence
  chemically synthesized
ttgtcgcccaggctggagtgca

SEQ ID NO: 1328569 - DNA, 22 bp, Artificial Sequence
  chemically synthesized
gtcgcccaggctggagtgcagc

SEQ ID NO: 1328570 - DNA, 22 bp, Artificial Sequence
  chemically synthesized
tcgcccaggctggagtgcagcg

SEQ ID NO: 1328571 - DNA, 22 bp, Artificial Sequence
  chemically synthesized
gagtgcagcggctcaatctcgg

SEQ ID NO: 1328572 - DNA, 22 bp, Artificial Sequence
  chemically synthesized
ggaggcagaggtcgcagtgagc

SEQ ID NO: 1328573 - DNA, 22 bp, Artificial Sequence
  chemically synthesized
gggaggcagaggtcgcagtgag

SEQ ID NO: 1328574 - DNA, 22 bp, Artificial Sequence
  chemically synthesized
aatctcggctcactgcgacctc

SEQ ID NO: 1328575 - DNA, 22 bp, Artificial Sequence
  chemically synthesized
aacttgggaggcagaggtcgca

SEQ ID NO: 1328576 - DNA, 22 bp, Artificial Sequence
  chemically synthesized
gaacttgggaggcagaggtcgc

SEQ ID NO: 1328577 - DNA, 22 bp, Artificial Sequence
  chemically synthesized
ttgaacttgggaggcagaggtc

SEQ ID NO: 1328578 - DNA, 22 bp, Artificial Sequence
  chemically synthesized
ggctcactgcgacctctgcctc

SEQ ID NO: 1328579 - DNA, 22 bp, Artificial Sequence
  chemically synthesized
actgcgacctctgcctcccaag

SEQ ID NO: 1328580 - DNA, 22 bp, Artificial Sequence
  chemically synthesized
cgacctctgcctcccaagttca

SEQ ID NO: 1328581 - DNA, 22 bp, Artificial Sequence
  chemically synthesized
aggcaggagaatctcttgaact

SEQ ID NO: 1328582 - DNA, 22 bp, Artificial Sequence
  chemically synthesized
tgcctcccaagttcaagagatt

SEQ ID NO: 1328583 - DNA, 22 bp, Artificial Sequence
  chemically synthesized
cctcccaagttcaagagattct

SEQ ID NO: 1328584 - DNA, 22 bp, Artificial Sequence
  chemically synthesized
ccaagttcaagagattctcctg

SEQ ID NO: 1328585 - DNA, 22 bp, Artificial Sequence
  chemically synthesized
gggaggctgaggcaggagaatc

SEQ ID NO: 1328586 - DNA, 22 bp, Artificial Sequence
  chemically synthesized
ctagggaggctgaggcaggaga

SEQ ID NO: 1328587 - DNA, 22 bp, Artificial Sequence
  chemically synthesized
aagagattctcctgcctcagcc

SEQ ID NO: 1328588 - DNA, 22 bp, Artificial Sequence
  chemically synthesized
cagctactagggaggctgaggc

SEQ ID NO: 1328589 - DNA, 22 bp, Artificial Sequence
  chemically synthesized
ttccagctactagggaggctga

SEQ ID NO: 1328590 - DNA, 22 bp, Artificial Sequence
  chemically synthesized
ttattccagctactagggaggc

SEQ ID NO: 1328591 - DNA, 22 bp, Artificial Sequence
  chemically synthesized
tcctgcctcagcctccctagta

SEQ ID NO: 1328592 - DNA, 22 bp, Artificial Sequence
  chemically synthesized
ctgcctcagcctccctagtagc

SEQ ID NO: 1328593 - DNA, 22 bp, Artificial Sequence
  chemically synthesized
cctcagcctccctagtagctgg

SEQ ID NO: 1328594 - DNA, 22 bp, Artificial Sequence
  chemically synthesized
agcctccctagtagctggaata

SEQ ID NO: 1328595 - DNA, 22 bp, Artificial Sequence
  chemically synthesized
cctagtagctggaataacaggc

SEQ ID NO: 1328596 - DNA, 22 bp, Artificial Sequence
  chemically synthesized
gtagctggaataacaggcgccc

SEQ ID NO: 1328597 - DNA, 22 bp, Artificial Sequence
  chemically synthesized
gccaggcatggtggcgggcgcc

SEQ ID NO: 1328598 - DNA, 22 bp, Artificial Sequence
  chemically synthesized
gaataacaggcgcccgccacca

SEQ ID NO: 1328599 - DNA, 22 bp, Artificial Sequence
  chemically synthesized
aaaatacaaagaaaattagcca

SEQ ID NO: 1328600 - DNA, 22 bp, Artificial Sequence
  chemically synthesized
ctaaaaatacaaagaaaattag

SEQ ID NO: 1328601 - DNA, 22 bp, Artificial Sequence
  chemically synthesized
tactaaaaatacaaagaaaatt

SEQ ID NO: 1328602 - DNA, 22 bp, Artificial Sequence
  chemically synthesized
gctaattttctttgtattttta

SEQ ID NO: 1328603 - DNA, 22 bp, Artificial Sequence
  chemically synthesized
attttctttgtatttttagtag

SEQ ID NO: 1328604 - DNA, 22 bp, Artificial Sequence
  chemically synthesized
tctttgtatttttagtagagac

SEQ ID NO: 1328605 - DNA, 22 bp, Artificial Sequence
  chemically synthesized
ctttgtatttttagtagagacg

SEQ ID NO: 1328606 - DNA, 22 bp, Artificial Sequence
  chemically synthesized
tttgtatttttagtagagacgg

SEQ ID NO: 1328607 - DNA, 22 bp, Artificial Sequence
  chemically synthesized
tgtatttttagtagagacgggg

SEQ ID NO: 1328608 - DNA, 22 bp, Artificial Sequence
  chemically synthesized
gtatttttagtagagacggggt

SEQ ID NO: 1328609 - DNA, 22 bp, Artificial Sequence
  chemically synthesized
tatttttagtagagacggggtt

SEQ ID NO: 1328610 - DNA, 22 bp, Artificial Sequence
  chemically synthesized
gccaacatggtgaaaccccgtc

SEQ ID NO: 1328611 - DNA, 22 bp, Artificial Sequence
  chemically synthesized
ttagtagagacggggtttcacc

SEQ ID NO: 1328612 - DNA, 22 bp, Artificial Sequence
  chemically synthesized
tagtagagacggggtttcacca

SEQ ID NO: 1328613 - DNA, 22 bp, Artificial Sequence
  chemically synthesized
agtagagacggggtttcaccat

SEQ ID NO: 1328614 - DNA, 22 bp, Artificial Sequence
  chemically synthesized
gtagagacggggtttcaccatg

SEQ ID NO: 1328615 - DNA, 22 bp, Artificial Sequence
  chemically synthesized
agaccagcctggccaacatggt

SEQ ID NO: 1328616 - DNA, 22 bp, Artificial Sequence
  chemically synthesized
gagaccagcctggccaacatgg

SEQ ID NO: 1328617 - DNA, 22 bp, Artificial Sequence
  chemically synthesized
caccatgttggccaggctggtc

SEQ ID NO: 1328618 - DNA, 22 bp, Artificial Sequence
  chemically synthesized
accatgttggccaggctggtct

SEQ ID NO: 1328619 - DNA, 22 bp, Artificial Sequence
  chemically synthesized
aggtcaggagtttgagaccagc

SEQ ID NO: 1328620 - DNA, 22 bp, Artificial Sequence
  chemically synthesized
gccaggctggtctcaaactcct

SEQ ID NO: 1328621 - DNA, 22 bp, Artificial Sequence
  chemically synthesized
gtctcaaactcctgacctcagg

SEQ ID NO: 1328622 - DNA, 22 bp, Artificial Sequence
  chemically synthesized
aggcgtgcggatcacctgaggt

SEQ ID NO: 1328623 - DNA, 22 bp, Artificial Sequence
  chemically synthesized
aaactcctgacctcaggtgatc

SEQ ID NO: 1328624 - DNA, 22 bp, Artificial Sequence
  chemically synthesized
ggcggctgaggcgtgcggatca

SEQ ID NO: 1328625 - DNA, 22 bp, Artificial Sequence
  chemically synthesized
ctgacctcaggtgatccgcacg

SEQ ID NO: 1328626 - DNA, 22 bp, Artificial Sequence
  chemically synthesized
gggcggctgaggcgtgcggatc

SEQ ID NO: 1328627 - DNA, 22 bp, Artificial Sequence
  chemically synthesized
tgggcggctgaggcgtgcggat

SEQ ID NO: 1328628 - DNA, 22 bp, Artificial Sequence
  chemically synthesized
acctcaggtgatccgcacgcct

SEQ ID NO: 1328629 - DNA, 22 bp, Artificial Sequence
  chemically synthesized
aggtgatccgcacgcctcagcc

SEQ ID NO: 1328630 - DNA, 22 bp, Artificial Sequence
  chemically synthesized
taatcccagcactttgggcggc

SEQ ID NO: 1328631 - DNA, 22 bp, Artificial Sequence
  chemically synthesized
atgcctgtaatcccagcacttt

SEQ ID NO: 1328632 - DNA, 22 bp, Artificial Sequence
  chemically synthesized
agccgcccaaagtgctgggatt

SEQ ID NO: 1328633 - DNA, 22 bp, Artificial Sequence
  chemically synthesized
aggccgggcacggtggctcatg

SEQ ID NO: 1328634 - DNA, 22 bp, Artificial Sequence
  chemically synthesized
ggattacaggcatgagccaccg

SEQ ID NO: 1328635 - DNA, 22 bp, Artificial Sequence
  chemically synthesized
caggcatgagccaccgtgcccg

SEQ ID NO: 1328636 - DNA, 22 bp, Artificial Sequence
  chemically synthesized
agatcgaaagtaatgttgaggc

SEQ ID NO: 1328637 - DNA, 22 bp, Artificial Sequence
  chemically synthesized
gagatcgaaagtaatgttgagg

SEQ ID NO: 1328638 - DNA, 22 bp, Artificial Sequence
  chemically synthesized
cagtcttgagatcgaaagtaat

SEQ ID NO: 1328639 - DNA, 22 bp, Artificial Sequence
  chemically synthesized
ccagtcttgagatcgaaagtaa

SEQ ID NO: 1328640 - DNA, 22 bp, Artificial Sequence
  chemically synthesized
cacttccagtcttgagatcgaa

SEQ ID NO: 1328641 - DNA, 22 bp, Artificial Sequence
  chemically synthesized
aacattactttcgatctcaaga

SEQ ID NO: 1328642 - DNA, 22 bp, Artificial Sequence
  chemically synthesized
agtactgcacttccagtcttga

SEQ ID NO: 1328643 - DNA, 22 bp, Artificial Sequence
  chemically synthesized
ctttcgatctcaagactggaag

SEQ ID NO: 1328644 - DNA, 22 bp, Artificial Sequence
  chemically synthesized
ttgagtactgcacttccagtct

SEQ ID NO: 1328645 - DNA, 22 bp, Artificial Sequence
  chemically synthesized
gttgagtactgcacttccagtc

SEQ ID NO: 1328646 - DNA, 22 bp, Artificial Sequence
  chemically synthesized
tgttgagtactgcacttccagt

SEQ ID NO: 1328647 - DNA, 22 bp, Artificial Sequence
  chemically synthesized
tcgatctcaagactggaagtgc

SEQ ID NO: 1328648 - DNA, 22 bp, Artificial Sequence
  chemically synthesized
cgatctcaagactggaagtgca

SEQ ID NO: 1328649 - DNA, 22 bp, Artificial Sequence
  chemically synthesized
gatctcaagactggaagtgcag

SEQ ID NO: 1328650 - DNA, 22 bp, Artificial Sequence
  chemically synthesized
ctttgttgagtactgcacttcc

SEQ ID NO: 1328651 - DNA, 22 bp, Artificial Sequence
  chemically synthesized
aagactggaagtgcagtactca

SEQ ID NO: 1328652 - DNA, 22 bp, Artificial Sequence
  chemically synthesized
cccaattactttgttgagtact

SEQ ID NO: 1328653 - DNA, 22 bp, Artificial Sequence
  chemically synthesized
ccccaattactttgttgagtac

SEQ ID NO: 1328654 - DNA, 22 bp, Artificial Sequence
  chemically synthesized
tccccaattactttgttgagta

SEQ ID NO: 1328655 - DNA, 22 bp, Artificial Sequence
  chemically synthesized
ttccccaattactttgttgagt

SEQ ID NO: 1328656 - DNA, 22 bp, Artificial Sequence
  chemically synthesized
tttccccaattactttgttgag

SEQ ID NO: 1328657 - DNA, 22 bp, Artificial Sequence
  chemically synthesized
gaagtgcagtactcaacaaagt

SEQ ID NO: 1328658 - DNA, 22 bp, Artificial Sequence
  chemically synthesized
ttttccccaattactttgttga

SEQ ID NO: 1328659 - DNA, 22 bp, Artificial Sequence
  chemically synthesized
tttttttccccaattactttgt

SEQ ID NO: 1328660 - DNA, 22 bp, Artificial Sequence
  chemically synthesized
aacaaagtaattggggaaaaaa

SEQ ID NO: 1328661 - DNA, 22 bp, Artificial Sequence
  chemically synthesized
catcaaaaactatttttttccc

SEQ ID NO: 1328662 - DNA, 22 bp, Artificial Sequence
  chemically synthesized
acatcaaaaactatttttttcc

SEQ ID NO: 1328663 - DNA, 22 bp, Artificial Sequence
  chemically synthesized
tacatcaaaaactatttttttc

SEQ ID NO: 1328664 - DNA, 22 bp, Artificial Sequence
  chemically synthesized
ttacatcaaaaactattttttt

SEQ ID NO: 1328665 - DNA, 22 bp, Artificial Sequence
  chemically synthesized
aaatttttacatcaaaaactat

SEQ ID NO: 1328666 - DNA, 22 bp, Artificial Sequence
  chemically synthesized
taaaatttttacatcaaaaact

SEQ ID NO: 1328667 - DNA, 22 bp, Artificial Sequence
  chemically synthesized
gggaaaaaaatagtttttgatg

SEQ ID NO: 1328668 - DNA, 22 bp, Artificial Sequence
  chemically synthesized
aaagatcaagaactctaaaatt

SEQ ID NO: 1328669 - DNA, 22 bp, Artificial Sequence
  chemically synthesized
ttgatgtaaaaattttagagtt

SEQ ID NO: 1328670 - DNA, 22 bp, Artificial Sequence
  chemically synthesized
tgatgtaaaaattttagagttc

SEQ ID NO: 1328671 - DNA, 22 bp, Artificial Sequence
  chemically synthesized
gatgtaaaaattttagagttct

SEQ ID NO: 1328672 - DNA, 22 bp, Artificial Sequence
  chemically synthesized
attcaaagatcaagaactctaa

SEQ ID NO: 1328673 - DNA, 22 bp, Artificial Sequence
  chemically synthesized
atgtaaaaattttagagttctt

SEQ ID NO: 1328674 - DNA, 22 bp, Artificial Sequence
  chemically synthesized
cattcaaagatcaagaactcta

SEQ ID NO: 1328675 - DNA, 22 bp, Artificial Sequence
  chemically synthesized
tagagttcttgatctttgaatg

SEQ ID NO: 1328676 - DNA, 22 bp, Artificial Sequence
  chemically synthesized
ggagaccaacttcattcaaaga

SEQ ID NO: 1328677 - DNA, 22 bp, Artificial Sequence
  chemically synthesized
agagttcttgatctttgaatga

SEQ ID NO: 1328678 - DNA, 22 bp, Artificial Sequence
  chemically synthesized
gagttcttgatctttgaatgaa

SEQ ID NO: 1328679 - DNA, 22 bp, Artificial Sequence
  chemically synthesized
ttgggagaccaacttcattcaa

SEQ ID NO: 1328680 - DNA, 22 bp, Artificial Sequence
  chemically synthesized
attgggagaccaacttcattca

SEQ ID NO: 1328681 - DNA, 22 bp, Artificial Sequence
  chemically synthesized
ttgatctttgaatgaagttggt

SEQ ID NO: 1328682 - DNA, 22 bp, Artificial Sequence
  chemically synthesized
gatctttgaatgaagttggtct

SEQ ID NO: 1328683 - DNA, 22 bp, Artificial Sequence
  chemically synthesized
aaatttattgggagaccaactt

SEQ ID NO: 1328684 - DNA, 22 bp, Artificial Sequence
  chemically synthesized
atctttgaatgaagttggtctc

SEQ ID NO: 1328685 - DNA, 22 bp, Artificial Sequence
  chemically synthesized
gaaatttattgggagaccaact

SEQ ID NO: 1328686 - DNA, 22 bp, Artificial Sequence
  chemically synthesized
gtttgaaatttattgggagacc

SEQ ID NO: 1328687 - DNA, 22 bp, Artificial Sequence
  chemically synthesized
tgaatgaagttggtctcccaat

SEQ ID NO: 1328688 - DNA, 22 bp, Artificial Sequence
  chemically synthesized
gaatgaagttggtctcccaata

SEQ ID NO: 1328689 - DNA, 22 bp, Artificial Sequence
  chemically synthesized
aatgaagttggtctcccaataa

SEQ ID NO: 1328690 - DNA, 22 bp, Artificial Sequence
  chemically synthesized
ttcgtttgaaatttattgggag

SEQ ID NO: 1328691 - DNA, 22 bp, Artificial Sequence
  chemically synthesized
attcgtttgaaatttattggga

SEQ ID NO: 1328692 - DNA, 22 bp, Artificial Sequence
  chemically synthesized
ttattcgtttgaaatttattgg

SEQ ID NO: 1328693 - DNA, 22 bp, Artificial Sequence
  chemically synthesized
cttattcgtttgaaatttattg

SEQ ID NO: 1328694 - DNA, 22 bp, Artificial Sequence
  chemically synthesized
gtctcccaataaatttcaaacg

SEQ ID NO: 1328695 - DNA, 22 bp, Artificial Sequence
  chemically synthesized
atgtttcttattcgtttgaaat

SEQ ID NO: 1328696 - DNA, 22 bp, Artificial Sequence
  chemically synthesized
ccaataaatttcaaacgaataa

SEQ ID NO: 1328697 - DNA, 22 bp, Artificial Sequence
  chemically synthesized
caaacgaataagaaacattaga

SEQ ID NO: 1328698 - DNA, 22 bp, Artificial Sequence
  chemically synthesized
aaacgaataagaaacattagat

SEQ ID NO: 1328699 - DNA, 22 bp, Artificial Sequence
  chemically synthesized
gagccagaaggaaacaaatcta

SEQ ID NO: 1328700 - DNA, 22 bp, Artificial Sequence
  chemically synthesized
tatactagagccagaaggaaac

SEQ ID NO: 1328701 - DNA, 22 bp, Artificial Sequence
  chemically synthesized
ctatatactagagccagaagga

SEQ ID NO: 1328702 - DNA, 22 bp, Artificial Sequence
  chemically synthesized
cctatatactagagccagaagg

SEQ ID NO: 1328703 - DNA, 22 bp, Artificial Sequence
  chemically synthesized
tcctatatactagagccagaag

SEQ ID NO: 1328704 - DNA, 22 bp, Artificial Sequence
  chemically synthesized
gatttgtttccttctggctcta

SEQ ID NO: 1328705 - DNA, 22 bp, Artificial Sequence
  chemically synthesized
gtttccttctggctctagtata

SEQ ID NO: 1328706 - DNA, 22 bp, Artificial Sequence
  chemically synthesized
tttccttctggctctagtatat

SEQ ID NO: 1328707 - DNA, 22 bp, Artificial Sequence
  chemically synthesized
caaatgtctttcctatatacta

SEQ ID NO: 1328708 - DNA, 22 bp, Artificial Sequence
  chemically synthesized
ccttctggctctagtatatagg

SEQ ID NO: 1328709 - DNA, 22 bp, Artificial Sequence
  chemically synthesized
gcaaatgtctttcctatatact

SEQ ID NO: 1328710 - DNA, 22 bp, Artificial Sequence
  chemically synthesized
cttctggctctagtatatagga

SEQ ID NO: 1328711 - DNA, 22 bp, Artificial Sequence
  chemically synthesized
tgcaaatgtctttcctatatac

SEQ ID NO: 1328712 - DNA, 22 bp, Artificial Sequence
  chemically synthesized
ctggctctagtatataggaaag

SEQ ID NO: 1328713 - DNA, 22 bp, Artificial Sequence
  chemically synthesized
ctttgcaaatgtctttcctata

SEQ ID NO: 1328714 - DNA, 22 bp, Artificial Sequence
  chemically synthesized
tggctctagtatataggaaaga

SEQ ID NO: 1328715 - DNA, 22 bp, Artificial Sequence
  chemically synthesized
gctctagtatataggaaagaca

SEQ ID NO: 1328716 - DNA, 22 bp, Artificial Sequence
  chemically synthesized
tagtatataggaaagacatttg

SEQ ID NO: 1328717 - DNA, 22 bp, Artificial Sequence
  chemically synthesized
gtatataggaaagacatttgca

SEQ ID NO: 1328718 - DNA, 22 bp, Artificial Sequence
  chemically synthesized
gaatacctgctttgcaaatgtc

SEQ ID NO: 1328719 - DNA, 22 bp, Artificial Sequence
  chemically synthesized
ggaatacctgctttgcaaatgt

SEQ ID NO: 1328720 - DNA, 22 bp, Artificial Sequence
  chemically synthesized
tggaatacctgctttgcaaatg

SEQ ID NO: 1328721 - DNA, 22 bp, Artificial Sequence
  chemically synthesized
atattttggaatacctgctttg

SEQ ID NO: 1328722 - DNA, 22 bp, Artificial Sequence
  chemically synthesized
cctcatattttggaatacctgc

SEQ ID NO: 1328723 - DNA, 22 bp, Artificial Sequence
  chemically synthesized
gcctcatattttggaatacctg

SEQ ID NO: 1328724 - DNA, 22 bp, Artificial Sequence
  chemically synthesized
tgcctcatattttggaatacct

SEQ ID NO: 1328725 - DNA, 22 bp, Artificial Sequence
  chemically synthesized
gcaaagcaggtattccaaaata

SEQ ID NO: 1328726 - DNA, 22 bp, Artificial Sequence
  chemically synthesized
caaagcaggtattccaaaatat

SEQ ID NO: 1328727 - DNA, 22 bp, Artificial Sequence
  chemically synthesized
caaaatatgaggcaaaatcatc

SEQ ID NO: 1328728 - DNA, 22 bp, Artificial Sequence
  chemically synthesized
ggggggggggcaagaatgatga

SEQ ID NO: 1328729 - DNA, 22 bp, Artificial Sequence
  chemically synthesized
gggggggggggcaagaatgatg

SEQ ID NO: 1328730 - DNA, 22 bp, Artificial Sequence
  chemically synthesized
tgggggggggggcaagaatgat

SEQ ID NO: 1328731 - DNA, 22 bp, Artificial Sequence
  chemically synthesized
ttgggggggggggcaagaatga

SEQ ID NO: 1328732 - DNA, 22 bp, Artificial Sequence
  chemically synthesized
tttgggggggggggcaagaatg

SEQ ID NO: 1328733 - DNA, 22 bp, Artificial Sequence
  chemically synthesized
ttttgggggggggggcaagaat

SEQ ID NO: 1328734 - DNA, 22 bp, Artificial Sequence
  chemically synthesized
gaagatttttttgggggggggg

SEQ ID NO: 1328735 - DNA, 22 bp, Artificial Sequence
  chemically synthesized
ctagaagatttttttggggggg

SEQ ID NO: 1328736 - DNA, 22 bp, Artificial Sequence
  chemically synthesized
ttgcccccccccccaaaaaaat

SEQ ID NO: 1328737 - DNA, 22 bp, Artificial Sequence
  chemically synthesized
gcccccccccccaaaaaaatct

SEQ ID NO: 1328738 - DNA, 22 bp, Artificial Sequence
  chemically synthesized
cccccccccccaaaaaaatctt

SEQ ID NO: 1328739 - DNA, 22 bp, Artificial Sequence
  chemically synthesized
caacagttgctagaagattttt

SEQ ID NO: 1328740 - DNA, 22 bp, Artificial Sequence
  chemically synthesized
tgttacaacagttgctagaaga

SEQ ID NO: 1328741 - DNA, 22 bp, Artificial Sequence
  chemically synthesized
tgtgttacaacagttgctagaa

SEQ ID NO: 1328742 - DNA, 22 bp, Artificial Sequence
  chemically synthesized
taatggctctgtgttacaacag

SEQ ID NO: 1328743 - DNA, 22 bp, Artificial Sequence
  chemically synthesized
ctagcaactgttgtaacacaga

SEQ ID NO: 1328744 - DNA, 22 bp, Artificial Sequence
  chemically synthesized
cattataatggctctgtgttac

SEQ ID NO: 1328745 - DNA, 22 bp, Artificial Sequence
  chemically synthesized
tagcaactgttgtaacacagag

SEQ ID NO: 1328746 - DNA, 22 bp, Artificial Sequence
  chemically synthesized
gcaactgttgtaacacagagcc

SEQ ID NO: 1328747 - DNA, 22 bp, Artificial Sequence
  chemically synthesized
attacattataatggctctgtg

SEQ ID NO: 1328748 - DNA, 22 bp, Artificial Sequence
  chemically synthesized
tctaattacattataatggctc

SEQ ID NO: 1328749 - DNA, 22 bp, Artificial Sequence
  chemically synthesized
ttgtaacacagagccattataa

SEQ ID NO: 1328750 - DNA, 22 bp, Artificial Sequence
  chemically synthesized
taacacagagccattataatgt

SEQ ID NO: 1328751 - DNA, 22 bp, Artificial Sequence
  chemically synthesized
gtctgtctaattacattataat

SEQ ID NO: 1328752 - DNA, 22 bp, Artificial Sequence
  chemically synthesized
agtctgtctaattacattataa

SEQ ID NO: 1328753 - DNA, 22 bp, Artificial Sequence
  chemically synthesized
ttagtctgtctaattacattat

SEQ ID NO: 1328754 - DNA, 22 bp, Artificial Sequence
  chemically synthesized
gttcttagtctgtctaattaca

SEQ ID NO: 1328755 - DNA, 22 bp, Artificial Sequence
  chemically synthesized
gcatctggttcttagtctgtct

SEQ ID NO: 1328756 - DNA, 22 bp, Artificial Sequence
  chemically synthesized
agcatctggttcttagtctgtc

SEQ ID NO: 1328757 - DNA, 22 bp, Artificial Sequence
  chemically synthesized
taatgtaattagacagactaag

SEQ ID NO: 1328758 - DNA, 22 bp, Artificial Sequence
  chemically synthesized
cttagcatctggttcttagtct

SEQ ID NO: 1328759 - DNA, 22 bp, Artificial Sequence
  chemically synthesized
ccttagcatctggttcttagtc

SEQ ID NO: 1328760 - DNA, 22 bp, Artificial Sequence
  chemically synthesized
cttccttagcatctggttctta

SEQ ID NO: 1328761 - DNA, 22 bp, Artificial Sequence
  chemically synthesized
gcttccttagcatctggttctt

SEQ ID NO: 1328762 - DNA, 22 bp, Artificial Sequence
  chemically synthesized
tgcttccttagcatctggttct

SEQ ID NO: 1328763 - DNA, 22 bp, Artificial Sequence
  chemically synthesized
gacagactaagaaccagatgct

SEQ ID NO: 1328764 - DNA, 22 bp, Artificial Sequence
  chemically synthesized
tattttgcttccttagcatctg

SEQ ID NO: 1328765 - DNA, 22 bp, Artificial Sequence
  chemically synthesized
atattttgcttccttagcatct

SEQ ID NO: 1328766 - DNA, 22 bp, Artificial Sequence
  chemically synthesized
tatattttgcttccttagcatc

SEQ ID NO: 1328767 - DNA, 22 bp, Artificial Sequence
  chemically synthesized
ttatattttgcttccttagcat

SEQ ID NO: 1328768 - DNA, 22 bp, Artificial Sequence
  chemically synthesized
agaaccagatgctaaggaagca

SEQ ID NO: 1328769 - DNA, 22 bp, Artificial Sequence
  chemically synthesized
atcttttatattttgcttcctt

SEQ ID NO: 1328770 - DNA, 22 bp, Artificial Sequence
  chemically synthesized
catcttttatattttgcttcct

SEQ ID NO: 1328771 - DNA, 22 bp, Artificial Sequence
  chemically synthesized
aggaagcaaaatataaaagatg

SEQ ID NO: 1328772 - DNA, 22 bp, Artificial Sequence
  chemically synthesized
accaaaataatatcatgcttca

SEQ ID NO: 1328773 - DNA, 22 bp, Artificial Sequence
  chemically synthesized
attaaccaaaataatatcatgc

SEQ ID NO: 1328774 - DNA, 22 bp, Artificial Sequence
  chemically synthesized
aattcattaaccaaaataatat

SEQ ID NO: 1328775 - DNA, 22 bp, Artificial Sequence
  chemically synthesized
gaattaaattcattaaccaaaa

SEQ ID NO: 1328776 - DNA, 22 bp, Artificial Sequence
  chemically synthesized
ggaattaaattcattaaccaaa

SEQ ID NO: 1328777 - DNA, 22 bp, Artificial Sequence
  chemically synthesized
taacatttggaattaaattcat

SEQ ID NO: 1328778 - DNA, 22 bp, Artificial Sequence
  chemically synthesized
ttttggttaatgaatttaattc

SEQ ID NO: 1328779 - DNA, 22 bp, Artificial Sequence
  chemically synthesized
ctgtaacatttggaattaaatt

SEQ ID NO: 1328780 - DNA, 22 bp, Artificial Sequence
  chemically synthesized
tggttaatgaatttaattccaa

SEQ ID NO: 1328781 - DNA, 22 bp, Artificial Sequence
  chemically synthesized
ggttaatgaatttaattccaaa

SEQ ID NO: 1328782 - DNA, 22 bp, Artificial Sequence
  chemically synthesized
gttaatgaatttaattccaaat

SEQ ID NO: 1328783 - DNA, 22 bp, Artificial Sequence
  chemically synthesized
atgaatttaattccaaatgtta

SEQ ID NO: 1328784 - DNA, 22 bp, Artificial Sequence
  chemically synthesized
aattccaaatgttacaggagtg

SEQ ID NO: 1328785 - DNA, 22 bp, Artificial Sequence
  chemically synthesized
attccaaatgttacaggagtga

SEQ ID NO: 1328786 - DNA, 22 bp, Artificial Sequence
  chemically synthesized
caaatgttacaggagtgattca

SEQ ID NO: 1328787 - DNA, 22 bp, Artificial Sequence
  chemically synthesized
ggaaaaaaaaagtccatgaatc

SEQ ID NO: 1328788 - DNA, 22 bp, Artificial Sequence
  chemically synthesized
gggaaaaaaaaagtccatgaat

SEQ ID NO: 1328789 - DNA, 22 bp, Artificial Sequence
  chemically synthesized
tgggaaaaaaaaagtccatgaa

SEQ ID NO: 1328790 - DNA, 22 bp, Artificial Sequence
  chemically synthesized
ttgggaaaaaaaaagtccatga

SEQ ID NO: 1328791 - DNA, 22 bp, Artificial Sequence
  chemically synthesized
caggagtgattcatggactttt

SEQ ID NO: 1328792 - DNA, 22 bp, Artificial Sequence
  chemically synthesized
atcttttgggaaaaaaaaagtc

SEQ ID NO: 1328793 - DNA, 22 bp, Artificial Sequence
  chemically synthesized
atggactttttttttcccaaaa

SEQ ID NO: 1328794 - DNA, 22 bp, Artificial Sequence
  chemically synthesized
tttttttcccaaaagatcagtt

SEQ ID NO: 1328795 - DNA, 22 bp, Artificial Sequence
  chemically synthesized
ttttttcccaaaagatcagttg

SEQ ID NO: 1328796 - DNA, 22 bp, Artificial Sequence
  chemically synthesized
tttttcccaaaagatcagttgt

SEQ ID NO: 1328797 - DNA, 22 bp, Artificial Sequence
  chemically synthesized
ttttcccaaaagatcagttgtc

SEQ ID NO: 1328798 - DNA, 22 bp, Artificial Sequence
  chemically synthesized
tttcccaaaagatcagttgtca

SEQ ID NO: 1328799 - DNA, 22 bp, Artificial Sequence
  chemically synthesized
ttcccaaaagatcagttgtcac

SEQ ID NO: 1328800 - DNA, 22 bp, Artificial Sequence
  chemically synthesized
tcccaaaagatcagttgtcaca

SEQ ID NO: 1328801 - DNA, 22 bp, Artificial Sequence
  chemically synthesized
cccaaaagatcagttgtcacat

SEQ ID NO: 1328802 - DNA, 22 bp, Artificial Sequence
  chemically synthesized
ccaaaagatcagttgtcacatg

SEQ ID NO: 1328803 - DNA, 22 bp, Artificial Sequence
  chemically synthesized
aaatgcaatatgtacatgtgac

SEQ ID NO: 1328804 - DNA, 22 bp, Artificial Sequence
  chemically synthesized
tcacatgtacatattgcatttt

SEQ ID NO: 1328805 - DNA, 22 bp, Artificial Sequence
  chemically synthesized
cataaacatcatgttaaaatgc

SEQ ID NO: 1328806 - DNA, 22 bp, Artificial Sequence
  chemically synthesized
gattacataaacatcatgttaa

SEQ ID NO: 1328807 - DNA, 22 bp, Artificial Sequence
  chemically synthesized
attagattacataaacatcatg

SEQ ID NO: 1328808 - DNA, 22 bp, Artificial Sequence
  chemically synthesized
tcattagattacataaacatca

SEQ ID NO: 1328809 - DNA, 22 bp, Artificial Sequence
  chemically synthesized
ctcattagattacataaacatc

SEQ ID NO: 1328810 - DNA, 22 bp, Artificial Sequence
  chemically synthesized
cattttaacatgatgtttatgt

SEQ ID NO: 1328811 - DNA, 22 bp, Artificial Sequence
  chemically synthesized
tctcattagattacataaacat

SEQ ID NO: 1328812 - DNA, 22 bp, Artificial Sequence
  chemically synthesized
ttctcattagattacataaaca

SEQ ID NO: 1328813 - DNA, 22 bp, Artificial Sequence
  chemically synthesized
cttttctcattagattacataa

SEQ ID NO: 1328814 - DNA, 22 bp, Artificial Sequence
  chemically synthesized
taacatgatgtttatgtaatct

SEQ ID NO: 1328815 - DNA, 22 bp, Artificial Sequence
  chemically synthesized
acttttctcattagattacata

SEQ ID NO: 1328816 - DNA, 22 bp, Artificial Sequence
  chemically synthesized
aacatgatgtttatgtaatcta

SEQ ID NO: 1328817 - DNA, 22 bp, Artificial Sequence
  chemically synthesized
acatgatgtttatgtaatctaa

SEQ ID NO: 1328818 - DNA, 22 bp, Artificial Sequence
  chemically synthesized
catgagaatttacttttctcat

SEQ ID NO: 1328819 - DNA, 22 bp, Artificial Sequence
  chemically synthesized
atgtaatctaatgagaaaagta

SEQ ID NO: 1328820 - DNA, 22 bp, Artificial Sequence
  chemically synthesized
tgtaatctaatgagaaaagtaa

SEQ ID NO: 1328821 - DNA, 22 bp, Artificial Sequence
  chemically synthesized
atattacatgagaatttacttt

SEQ ID NO: 1328822 - DNA, 22 bp, Artificial Sequence
  chemically synthesized
atgagaaaagtaaattctcatg

SEQ ID NO: 1328823 - DNA, 22 bp, Artificial Sequence
  chemically synthesized
gaaacatctaatattacatgag

SEQ ID NO: 1328824 - DNA, 22 bp, Artificial Sequence
  chemically synthesized
cgaaacatctaatattacatga

SEQ ID NO: 1328825 - DNA, 22 bp, Artificial Sequence
  chemically synthesized
tccatttcgaaacatctaatat

SEQ ID NO: 1328826 - DNA, 22 bp, Artificial Sequence
  chemically synthesized
atccatttcgaaacatctaata

SEQ ID NO: 1328827 - DNA, 22 bp, Artificial Sequence
  chemically synthesized
tcatgtaatattagatgtttcg

SEQ ID NO: 1328828 - DNA, 22 bp, Artificial Sequence
  chemically synthesized
atgtaatattagatgtttcgaa

SEQ ID NO: 1328829 - DNA, 22 bp, Artificial Sequence
  chemically synthesized
cagtttatccatttcgaaacat

SEQ ID NO: 1328830 - DNA, 22 bp, Artificial Sequence
  chemically synthesized
gatgtttcgaaatggataaact

SEQ ID NO: 1328831 - DNA, 22 bp, Artificial Sequence
  chemically synthesized
cccgtggaagtgtctgcagttt

SEQ ID NO: 1328832 - DNA, 22 bp, Artificial Sequence
  chemically synthesized
cgaaatggataaactgcagaca

SEQ ID NO: 1328833 - DNA, 22 bp, Artificial Sequence
  chemically synthesized
gaaatggataaactgcagacac

SEQ ID NO: 1328834 - DNA, 22 bp, Artificial Sequence
  chemically synthesized
atctacccgtggaagtgtctgc

SEQ ID NO: 1328835 - DNA, 22 bp, Artificial Sequence
  chemically synthesized
ttcatctacccgtggaagtgtc

SEQ ID NO: 1328836 - DNA, 22 bp, Artificial Sequence
  chemically synthesized
acgaattattcatctacccgtg

SEQ ID NO: 1328837 - DNA, 22 bp, Artificial Sequence
  chemically synthesized
cagacacttccacgggtagatg

SEQ ID NO: 1328838 - DNA, 22 bp, Artificial Sequence
  chemically synthesized
ttgacgaattattcatctaccc

SEQ ID NO: 1328839 - DNA, 22 bp, Artificial Sequence
  chemically synthesized
tcactattgacgaattattcat

SEQ ID NO: 1328840 - DNA, 22 bp, Artificial Sequence
  chemically synthesized
atcactattgacgaattattca

SEQ ID NO: 1328841 - DNA, 22 bp, Artificial Sequence
  chemically synthesized
ccacgggtagatgaataattcg

SEQ ID NO: 1328842 - DNA, 22 bp, Artificial Sequence
  chemically synthesized
cacgggtagatgaataattcgt

SEQ ID NO: 1328843 - DNA, 22 bp, Artificial Sequence
  chemically synthesized
acttatcactattgacgaatta

SEQ ID NO: 1328844 - DNA, 22 bp, Artificial Sequence
  chemically synthesized
aagattaacttatcactattga

SEQ ID NO: 1328845 - DNA, 22 bp, Artificial Sequence
  chemically synthesized
aaagattaacttatcactattg

SEQ ID NO: 1328846 - DNA, 22 bp, Artificial Sequence
  chemically synthesized
gtcaatagtgataagttaatct

SEQ ID NO: 1328847 - DNA, 22 bp, Artificial Sequence
  chemically synthesized
aggggtaagtttaaagattaac

SEQ ID NO: 1328848 - DNA, 22 bp, Artificial Sequence
  chemically synthesized
gaggggtaagtttaaagattaa

SEQ ID NO: 1328849 - DNA, 22 bp, Artificial Sequence
  chemically synthesized
tgaggggtaagtttaaagatta

SEQ ID NO: 1328850 - DNA, 22 bp, Artificial Sequence
  chemically synthesized
accattttgaggggtaagttta

SEQ ID NO: 1328851 - DNA, 22 bp, Artificial Sequence
  chemically synthesized
aaccattttgaggggtaagttt

SEQ ID NO: 1328852 - DNA, 22 bp, Artificial Sequence
  chemically synthesized
ttaaccattttgaggggtaagt

SEQ ID NO: 1328853 - DNA, 22 bp, Artificial Sequence
  chemically synthesized
atctttaaacttacccctcaaa

SEQ ID NO: 1328854 - DNA, 22 bp, Artificial Sequence
  chemically synthesized
actcttaaccattttgaggggt

SEQ ID NO: 1328855 - DNA, 22 bp, Artificial Sequence
  chemically synthesized
taaacttacccctcaaaatggt

SEQ ID NO: 1328856 - DNA, 22 bp, Artificial Sequence
  chemically synthesized
aaacttacccctcaaaatggtt

SEQ ID NO: 1328857 - DNA, 22 bp, Artificial Sequence
  chemically synthesized
aacttacccctcaaaatggtta

SEQ ID NO: 1328858 - DNA, 22 bp, Artificial Sequence
  chemically synthesized
acccctcaaaatggttaagagt

SEQ ID NO: 1328859 - DNA, 22 bp, Artificial Sequence
  chemically synthesized
tagtataacctaactcttaacc

SEQ ID NO: 1328860 - DNA, 22 bp, Artificial Sequence
  chemically synthesized
cccctcaaaatggttaagagtt

SEQ ID NO: 1328861 - DNA, 22 bp, Artificial Sequence
  chemically synthesized
atagtataacctaactcttaac

SEQ ID NO: 1328862 - DNA, 22 bp, Artificial Sequence
  chemically synthesized
catttatagtataacctaactc

SEQ ID NO: 1328863 - DNA, 22 bp, Artificial Sequence
  chemically synthesized
aaaatggttaagagttaggtta

SEQ ID NO: 1328864 - DNA, 22 bp, Artificial Sequence
  chemically synthesized
tattacatttatagtataacct

SEQ ID NO: 1328865 - DNA, 22 bp, Artificial Sequence
  chemically synthesized
agagttaggttatactataaat

SEQ ID NO: 1328866 - DNA, 22 bp, Artificial Sequence
  chemically synthesized
tggaattatattacatttatag

SEQ ID NO: 1328867 - DNA, 22 bp, Artificial Sequence
  chemically synthesized
atggaattatattacatttata

SEQ ID NO: 1328868 - DNA, 22 bp, Artificial Sequence
  chemically synthesized
tatggaattatattacatttat

SEQ ID NO: 1328869 - DNA, 22 bp, Artificial Sequence
  chemically synthesized
ttatggaattatattacattta

SEQ ID NO: 1328870 - DNA, 22 bp, Artificial Sequence
  chemically synthesized
ggttatactataaatgtaatat

SEQ ID NO: 1328871 - DNA, 22 bp, Artificial Sequence
  chemically synthesized
tttttatggaattatattacat

SEQ ID NO: 1328872 - DNA, 22 bp, Artificial Sequence
  chemically synthesized
tactataaatgtaatataattc

SEQ ID NO: 1328873 - DNA, 22 bp, Artificial Sequence
  chemically synthesized
gttatttttatggaattatatt

SEQ ID NO: 1328874 - DNA, 22 bp, Artificial Sequence
  chemically synthesized
ggttatttttatggaattatat

SEQ ID NO: 1328875 - DNA, 22 bp, Artificial Sequence
  chemically synthesized
taaatgtaatataattccataa

SEQ ID NO: 1328876 - DNA, 22 bp, Artificial Sequence
  chemically synthesized
tcttggttatttttatggaatt

SEQ ID NO: 1328877 - DNA, 22 bp, Artificial Sequence
  chemically synthesized
gtcttggttatttttatggaat

SEQ ID NO: 1328878 - DNA, 22 bp, Artificial Sequence
  chemically synthesized
tgtcttggttatttttatggaa

SEQ ID NO: 1328879 - DNA, 22 bp, Artificial Sequence
  chemically synthesized
ttgtcttggttatttttatgga

SEQ ID NO: 1328880 - DNA, 22 bp, Artificial Sequence
  chemically synthesized
tttgtcttggttatttttatgg

SEQ ID NO: 1328881 - DNA, 22 bp, Artificial Sequence
  chemically synthesized
aagtattttttgtcttggttat

SEQ ID NO: 1328882 - DNA, 22 bp, Artificial Sequence
  chemically synthesized
taaagtattttttgtcttggtt

SEQ ID NO: 1328883 - DNA, 22 bp, Artificial Sequence
  chemically synthesized
ctaaagtattttttgtcttggt

SEQ ID NO: 1328884 - DNA, 22 bp, Artificial Sequence
  chemically synthesized
cataaaaataaccaagacaaaa

SEQ ID NO: 1328885 - DNA, 22 bp, Artificial Sequence
  chemically synthesized
aatatttctaaagtattttttg

SEQ ID NO: 1328886 - DNA, 22 bp, Artificial Sequence
  chemically synthesized
caatatttctaaagtatttttt

SEQ ID NO: 1328887 - DNA, 22 bp, Artificial Sequence
  chemically synthesized
tcaatatttctaaagtattttt

SEQ ID NO: 1328888 - DNA, 22 bp, Artificial Sequence
  chemically synthesized
tattttcaatatttctaaagta

SEQ ID NO: 1328889 - DNA, 22 bp, Artificial Sequence
  chemically synthesized
tagaaatattgaaaatataata

SEQ ID NO: 1328890 - DNA, 22 bp, Artificial Sequence
  chemically synthesized
gaggaaaacaaatattatattt

SEQ ID NO: 1328891 - DNA, 22 bp, Artificial Sequence
  chemically synthesized
agaaatattgaaaatataatat

SEQ ID NO: 1328892 - DNA, 22 bp, Artificial Sequence
  chemically synthesized
gaaatattgaaaatataatatt

SEQ ID NO: 1328893 - DNA, 22 bp, Artificial Sequence
  chemically synthesized
aggatattagaggaaaacaaat

SEQ ID NO: 1328894 - DNA, 22 bp, Artificial Sequence
  chemically synthesized
aaaatataatatttgttttcct

SEQ ID NO: 1328895 - DNA, 22 bp, Artificial Sequence
  chemically synthesized
gttttcctctaatatcctcaat

SEQ ID NO: 1328896 - DNA, 22 bp, Artificial Sequence
  chemically synthesized
ttttcctctaatatcctcaatc

SEQ ID NO: 1328897 - DNA, 22 bp, Artificial Sequence
  chemically synthesized
cacaataataccagattgagga

SEQ ID NO: 1328898 - DNA, 22 bp, Artificial Sequence
  chemically synthesized
tcctctaatatcctcaatctgg

SEQ ID NO: 1328899 - DNA, 22 bp, Artificial Sequence
  chemically synthesized
cctctaatatcctcaatctggt

SEQ ID NO: 1328900 - DNA, 22 bp, Artificial Sequence
  chemically synthesized
ctctaatatcctcaatctggta

SEQ ID NO: 1328901 - DNA, 22 bp, Artificial Sequence
  chemically synthesized
gaattacacaataataccagat

SEQ ID NO: 1328902 - DNA, 22 bp, Artificial Sequence
  chemically synthesized
taatatcctcaatctggtatta

SEQ ID NO: 1328903 - DNA, 22 bp, Artificial Sequence
  chemically synthesized
atatcctcaatctggtattatt

SEQ ID NO: 1328904 - DNA, 22 bp, Artificial Sequence
  chemically synthesized
ccatatattcgaattacacaat

SEQ ID NO: 1328905 - DNA, 22 bp, Artificial Sequence
  chemically synthesized
aatctggtattattgtgtaatt

SEQ ID NO: 1328906 - DNA, 22 bp, Artificial Sequence
  chemically synthesized
gtattattgtgtaattcgaata

SEQ ID NO: 1328907 - DNA, 22 bp, Artificial Sequence
  chemically synthesized
ttgtgtaattcgaatatatggc

SEQ ID NO: 1328908 - DNA, 22 bp, Artificial Sequence
  chemically synthesized
tgtaattcgaatatatggcaat

SEQ ID NO: 1328909 - DNA, 22 bp, Artificial Sequence
  chemically synthesized
gaatatatggcaatattattat

SEQ ID NO: 1328910 - DNA, 22 bp, Artificial Sequence
  chemically synthesized
aaaaaaaaaaaaaaataataat

SEQ ID NO: 1328911 - DNA, 22 bp, Artificial Sequence
  chemically synthesized
tctcaaaaaaaaaaaaaaataa

SEQ ID NO: 1328912 - DNA, 22 bp, Artificial Sequence
  chemically synthesized
tgtctcaaaaaaaaaaaaaaat

SEQ ID NO: 1328913 - DNA, 22 bp, Artificial Sequence
  chemically synthesized
ttattatttttttttttttttg

SEQ ID NO: 1328914 - DNA, 22 bp, Artificial Sequence
  chemically synthesized
ttatttttttttttttttgaga

SEQ ID NO: 1328915 - DNA, 22 bp, Artificial Sequence
  chemically synthesized
tttttttttttttttgagacag

SEQ ID NO: 1328916 - DNA, 22 bp, Artificial Sequence
  chemically synthesized
ttttttttttttgagacagaat

SEQ ID NO: 1328917 - DNA, 22 bp, Artificial Sequence
  chemically synthesized
tttttttttttgagacagaatc

SEQ ID NO: 1328918 - DNA, 22 bp, Artificial Sequence
  chemically synthesized
ttttttttttgagacagaatct

SEQ ID NO: 1328919 - DNA, 22 bp, Artificial Sequence
  chemically synthesized
ggcaaaaaagtgagattctgtc

SEQ ID NO: 1328920 - DNA, 22 bp, Artificial Sequence
  chemically synthesized
tttttttttgagacagaatctc

SEQ ID NO: 1328921 - DNA, 22 bp, Artificial Sequence
  chemically synthesized
ttttttttgagacagaatctca

SEQ ID NO: 1328922 - DNA, 22 bp, Artificial Sequence
  chemically synthesized
tttttttgagacagaatctcac

SEQ ID NO: 1328923 - DNA, 22 bp, Artificial Sequence
  chemically synthesized
ttttttgagacagaatctcact

SEQ ID NO: 1328924 - DNA, 22 bp, Artificial Sequence
  chemically synthesized
tttttgagacagaatctcactt

SEQ ID NO: 1328925 - DNA, 22 bp, Artificial Sequence
  chemically synthesized
ttttgagacagaatctcacttt

SEQ ID NO: 1328926 - DNA, 22 bp, Artificial Sequence
  chemically synthesized
tttgagacagaatctcactttt

SEQ ID NO: 1328927 - DNA, 22 bp, Artificial Sequence
  chemically synthesized
cagcctgggcaaaaaagtgaga

SEQ ID NO: 1328928 - DNA, 22 bp, Artificial Sequence
  chemically synthesized
ttgagacagaatctcacttttt

SEQ ID NO: 1328929 - DNA, 22 bp, Artificial Sequence
  chemically synthesized
tgagacagaatctcactttttt

SEQ ID NO: 1328930 - DNA, 22 bp, Artificial Sequence
  chemically synthesized
gagacagaatctcacttttttg

SEQ ID NO: 1328931 - DNA, 22 bp, Artificial Sequence
  chemically synthesized
agacagaatctcacttttttgc

SEQ ID NO: 1328932 - DNA, 22 bp, Artificial Sequence
  chemically synthesized
cactccagcctgggcaaaaaag

SEQ ID NO: 1328933 - DNA, 22 bp, Artificial Sequence
  chemically synthesized
acttttttgcccaggctggagt

SEQ ID NO: 1328934 - DNA, 22 bp, Artificial Sequence
  chemically synthesized
ttttgcccaggctggagtgcag

SEQ ID NO: 1328935 - DNA, 22 bp, Artificial Sequence
  chemically synthesized
tttgcccaggctggagtgcagt

SEQ ID NO: 1328936 - DNA, 22 bp, Artificial Sequence
  chemically synthesized
ttgcccaggctggagtgcagtg

SEQ ID NO: 1328937 - DNA, 22 bp, Artificial Sequence
  chemically synthesized
tgcccaggctggagtgcagtgg

SEQ ID NO: 1328938 - DNA, 22 bp, Artificial Sequence
  chemically synthesized
gcccaggctggagtgcagtggc

SEQ ID NO: 1328939 - DNA, 22 bp, Artificial Sequence
  chemically synthesized
cccaggctggagtgcagtggca

SEQ ID NO: 1328940 - DNA, 22 bp, Artificial Sequence
  chemically synthesized
cagtaagccaagaacatgccac

SEQ ID NO: 1328941 - DNA, 22 bp, Artificial Sequence
  chemically synthesized
gagtgcagtggcatgttcttgg

SEQ ID NO: 1328942 - DNA, 22 bp, Artificial Sequence
  chemically synthesized
aacccgggaggtggaggctgca

SEQ ID NO: 1328943 - DNA, 22 bp, Artificial Sequence
  chemically synthesized
gaacccgggaggtggaggctgc

SEQ ID NO: 1328944 - DNA, 22 bp, Artificial Sequence
  chemically synthesized
ttggcttactgcagcctccacc

SEQ ID NO: 1328945 - DNA, 22 bp, Artificial Sequence
  chemically synthesized
ggcttactgcagcctccacctc

SEQ ID NO: 1328946 - DNA, 22 bp, Artificial Sequence
  chemically synthesized
gcttactgcagcctccacctcc

SEQ ID NO: 1328947 - DNA, 22 bp, Artificial Sequence
  chemically synthesized
actgcagcctccacctcccggg

SEQ ID NO: 1328948 - DNA, 22 bp, Artificial Sequence
  chemically synthesized
ctgcagcctccacctcccgggt

SEQ ID NO: 1328949 - DNA, 22 bp, Artificial Sequence
  chemically synthesized
cagcctccacctcccgggttca

SEQ ID NO: 1328950 - DNA, 22 bp, Artificial Sequence
  chemically synthesized
agacaggagaatcgcttgaacc

SEQ ID NO: 1328951 - DNA, 22 bp, Artificial Sequence
  chemically synthesized
cacctcccgggttcaagcgatt

SEQ ID NO: 1328952 - DNA, 22 bp, Artificial Sequence
  chemically synthesized
ccgggttcaagcgattctcctg

SEQ ID NO: 1328953 - DNA, 22 bp, Artificial Sequence
  chemically synthesized
gggaggctgagacaggagaatc

SEQ ID NO: 1328954 - DNA, 22 bp, Artificial Sequence
  chemically synthesized
ctcgggaggctgagacaggaga

SEQ ID NO: 1328955 - DNA, 22 bp, Artificial Sequence
  chemically synthesized
aagcgattctcctgtctcagcc

SEQ ID NO: 1328956 - DNA, 22 bp, Artificial Sequence
  chemically synthesized
agctactcgggaggctgagaca

SEQ ID NO: 1328957 - DNA, 22 bp, Artificial Sequence
  chemically synthesized
taatctcagctactcgggaggc

SEQ ID NO: 1328958 - DNA, 22 bp, Artificial Sequence
  chemically synthesized
tcctgtctcagcctcccgagta

SEQ ID NO: 1328959 - DNA, 22 bp, Artificial Sequence
  chemically synthesized
ctgtctcagcctcccgagtagc

SEQ ID NO: 1328960 - DNA, 22 bp, Artificial Sequence
  chemically synthesized
tctcagcctcccgagtagctga

SEQ ID NO: 1328961 - DNA, 22 bp, Artificial Sequence
  chemically synthesized
agcctcccgagtagctgagatt

SEQ ID NO: 1328962 - DNA, 22 bp, Artificial Sequence
  chemically synthesized
ccgagtagctgagattacagat

SEQ ID NO: 1328963 - DNA, 22 bp, Artificial Sequence
  chemically synthesized
gccaggcgtggtggtgggcatc

SEQ ID NO: 1328964 - DNA, 22 bp, Artificial Sequence
  chemically synthesized
agccaggcgtggtggtgggcat

SEQ ID NO: 1328965 - DNA, 22 bp, Artificial Sequence
  chemically synthesized
agattacagatgcccaccacca

SEQ ID NO: 1328966 - DNA, 22 bp, Artificial Sequence
  chemically synthesized
cagatgcccaccaccacgcctg

SEQ ID NO: 1328967 - DNA, 22 bp, Artificial Sequence
  chemically synthesized
aaaatacaaaatttagccaggc

SEQ ID NO: 1328968 - DNA, 22 bp, Artificial Sequence
  chemically synthesized
ctaaaaatacaaaatttagcca

SEQ ID NO: 1328969 - DNA, 22 bp, Artificial Sequence
  chemically synthesized
tactaaaaatacaaaatttagc

SEQ ID NO: 1328970 - DNA, 22 bp, Artificial Sequence
  chemically synthesized
gctaaattttgtatttttagta

SEQ ID NO: 1328971 - DNA, 22 bp, Artificial Sequence
  chemically synthesized
aattttgtatttttagtagaga

SEQ ID NO: 1328972 - DNA, 22 bp, Artificial Sequence
  chemically synthesized
tgtatttttagtagagacgggg

SEQ ID NO: 1328973 - DNA, 22 bp, Artificial Sequence
  chemically synthesized
gtatttttagtagagacggggt

SEQ ID NO: 1328974 - DNA, 22 bp, Artificial Sequence
  chemically synthesized
tatttttagtagagacggggtt

SEQ ID NO: 1328975 - DNA, 22 bp, Artificial Sequence
  chemically synthesized
gccaacatggtgaaaccccgtc

SEQ ID NO: 1328976 - DNA, 22 bp, Artificial Sequence
  chemically synthesized
ttagtagagacggggtttcacc

SEQ ID NO: 1328977 - DNA, 22 bp, Artificial Sequence
  chemically synthesized
tagtagagacggggtttcacca

SEQ ID NO: 1328978 - DNA, 22 bp, Artificial Sequence
  chemically synthesized
agtagagacggggtttcaccat

SEQ ID NO: 1328979 - DNA, 22 bp, Artificial Sequence
  chemically synthesized
gtagagacggggtttcaccatg

SEQ ID NO: 1328980 - DNA, 22 bp, Artificial Sequence
  chemically synthesized
gagaccagcctggccaacatgg

SEQ ID NO: 1328981 - DNA, 22 bp, Artificial Sequence
  chemically synthesized
caccatgttggccaggctggtc

SEQ ID NO: 1328982 - DNA, 22 bp, Artificial Sequence
  chemically synthesized
accatgttggccaggctggtct

SEQ ID NO: 1328983 - DNA, 22 bp, Artificial Sequence
  chemically synthesized
aggtcaggagttcgagaccagc

SEQ ID NO: 1328984 - DNA, 22 bp, Artificial Sequence
  chemically synthesized
gccaggctggtctcgaactcct

SEQ ID NO: 1328985 - DNA, 22 bp, Artificial Sequence
  chemically synthesized
gtctcgaactcctgacctcagg

SEQ ID NO: 1328986 - DNA, 22 bp, Artificial Sequence
  chemically synthesized
aggcaggcggatcacctgaggt

SEQ ID NO: 1328987 - DNA, 22 bp, Artificial Sequence
  chemically synthesized
gaactcctgacctcaggtgatc

SEQ ID NO: 1328988 - DNA, 22 bp, Artificial Sequence
  chemically synthesized
ggagtctgaggcaggcggatca

SEQ ID NO: 1328989 - DNA, 22 bp, Artificial Sequence
  chemically synthesized
ctgacctcaggtgatccgcctg

SEQ ID NO: 1328990 - DNA, 22 bp, Artificial Sequence
  chemically synthesized
gggagtctgaggcaggcggatc

SEQ ID NO: 1328991 - DNA, 22 bp, Artificial Sequence
  chemically synthesized
tgggagtctgaggcaggcggat

SEQ ID NO: 1328992 - DNA, 22 bp, Artificial Sequence
  chemically synthesized
acctcaggtgatccgcctgcct

SEQ ID NO: 1328993 - DNA, 22 bp, Artificial Sequence
  chemically synthesized
aggtgatccgcctgcctcagac

SEQ ID NO: 1328994 - DNA, 22 bp, Artificial Sequence
  chemically synthesized
taatatcagcactttgggagtc

SEQ ID NO: 1328995 - DNA, 22 bp, Artificial Sequence
  chemically synthesized
cctcagactcccaaagtgctga

SEQ ID NO: 1328996 - DNA, 22 bp, Artificial Sequence
  chemically synthesized
acacctgtaatatcagcacttt

SEQ ID NO: 1328997 - DNA, 22 bp, Artificial Sequence
  chemically synthesized
agactcccaaagtgctgatatt

SEQ ID NO: 1328998 - DNA, 22 bp, Artificial Sequence
  chemically synthesized
ccaaagtgctgatattacaggt

SEQ ID NO: 1328999 - DNA, 22 bp, Artificial Sequence
  chemically synthesized
gccgggcacggtggtggctcac

SEQ ID NO: 1329000 - DNA, 22 bp, Artificial Sequence
  chemically synthesized
atattacaggtgtgagccacca

SEQ ID NO: 1329001 - DNA, 22 bp, Artificial Sequence
  chemically synthesized
ctggccgggcacggtggtggct

SEQ ID NO: 1329002 - DNA, 22 bp, Artificial Sequence
  chemically synthesized
gctggccgggcacggtggtggc

SEQ ID NO: 1329003 - DNA, 22 bp, Artificial Sequence
  chemically synthesized
tgctggccgggcacggtggtgg

SEQ ID NO: 1329004 - DNA, 22 bp, Artificial Sequence
  chemically synthesized
caggtgtgagccaccaccgtgc

SEQ ID NO: 1329005 - DNA, 22 bp, Artificial Sequence
  chemically synthesized
ttttgctggccgggcacggtgg

SEQ ID NO: 1329006 - DNA, 22 bp, Artificial Sequence
  chemically synthesized
agaattattttgctggccgggc

SEQ ID NO: 1329007 - DNA, 22 bp, Artificial Sequence
  chemically synthesized
aagaattattttgctggccggg

SEQ ID NO: 1329008 - DNA, 22 bp, Artificial Sequence
  chemically synthesized
taagaattattttgctggccgg

SEQ ID NO: 1329009 - DNA, 22 bp, Artificial Sequence
  chemically synthesized
aattttaagaattattttgctg

SEQ ID NO: 1329010 - DNA, 22 bp, Artificial Sequence
  chemically synthesized
agttgaattttaagaattattt

SEQ ID NO: 1329011 - DNA, 22 bp, Artificial Sequence
  chemically synthesized
aagttgaattttaagaattatt

SEQ ID NO: 1329012 - DNA, 22 bp, Artificial Sequence
  chemically synthesized
taagttgaattttaagaattat

SEQ ID NO: 1329013 - DNA, 22 bp, Artificial Sequence
  chemically synthesized
ttaagttgaattttaagaatta

SEQ ID NO: 1329014 - DNA, 22 bp, Artificial Sequence
  chemically synthesized
gagtaatttttaagttgaattt

SEQ ID NO: 1329015 - DNA, 22 bp, Artificial Sequence
  chemically synthesized
ggagtaatttttaagttgaatt

SEQ ID NO: 1329016 - DNA, 22 bp, Artificial Sequence
  chemically synthesized
ttggagtaatttttaagttgaa

SEQ ID NO: 1329017 - DNA, 22 bp, Artificial Sequence
  chemically synthesized
cttggagtaatttttaagttga

SEQ ID NO: 1329018 - DNA, 22 bp, Artificial Sequence
  chemically synthesized
ttaaaattcaacttaaaaatta

SEQ ID NO: 1329019 - DNA, 22 bp, Artificial Sequence
  chemically synthesized
aaaattcaacttaaaaattact

SEQ ID NO: 1329020 - DNA, 22 bp, Artificial Sequence
  chemically synthesized
cacatttcttggagtaattttt

SEQ ID NO: 1329021 - DNA, 22 bp, Artificial Sequence
  chemically synthesized
aaattcaacttaaaaattactc

SEQ ID NO: 1329022 - DNA, 22 bp, Artificial Sequence
  chemically synthesized
cctacacatttcttggagtaat

SEQ ID NO: 1329023 - DNA, 22 bp, Artificial Sequence
  chemically synthesized
acctacacatttcttggagtaa

SEQ ID NO: 1329024 - DNA, 22 bp, Artificial Sequence
  chemically synthesized
tacctacacatttcttggagta

SEQ ID NO: 1329025 - DNA, 22 bp, Artificial Sequence
  chemically synthesized
aacttaaaaattactccaagaa

SEQ ID NO: 1329026 - DNA, 22 bp, Artificial Sequence
  chemically synthesized
ttacctacacatttcttggagt

SEQ ID NO: 1329027 - DNA, 22 bp, Artificial Sequence
  chemically synthesized
acttttacctacacatttcttg

SEQ ID NO: 1329028 - DNA, 22 bp, Artificial Sequence
  chemically synthesized
aaaaattactccaagaaatgtg

SEQ ID NO: 1329029 - DNA, 22 bp, Artificial Sequence
  chemically synthesized
gacttttacctacacatttctt

SEQ ID NO: 1329030 - DNA, 22 bp, Artificial Sequence
  chemically synthesized
aaaattactccaagaaatgtgt

SEQ ID NO: 1329031 - DNA, 22 bp, Artificial Sequence
  chemically synthesized
tgacttttacctacacatttct

SEQ ID NO: 1329032 - DNA, 22 bp, Artificial Sequence
  chemically synthesized
ctccaagaaatgtgtaggtaaa

SEQ ID NO: 1329033 - DNA, 22 bp, Artificial Sequence
  chemically synthesized
aagtgttttgacttttacctac

SEQ ID NO: 1329034 - DNA, 22 bp, Artificial Sequence
  chemically synthesized
caagaaatgtgtaggtaaaagt

SEQ ID NO: 1329035 - DNA, 22 bp, Artificial Sequence
  chemically synthesized
ctaaagtgttttgacttttacc

SEQ ID NO: 1329036 - DNA, 22 bp, Artificial Sequence
  chemically synthesized
actaaagtgttttgacttttac

SEQ ID NO: 1329037 - DNA, 22 bp, Artificial Sequence
  chemically synthesized
taaatggaaatacaaaatgtgg

SEQ ID NO: 1329038 - DNA, 22 bp, Artificial Sequence
  chemically synthesized
ctataaatggaaatacaaaatg

SEQ ID NO: 1329039 - DNA, 22 bp, Artificial Sequence
  chemically synthesized
tagtaaatccacattttgtatt

SEQ ID NO: 1329040 - DNA, 22 bp, Artificial Sequence
  chemically synthesized
agtaaatccacattttgtattt

SEQ ID NO: 1329041 - DNA, 22 bp, Artificial Sequence
  chemically synthesized
gtaaatccacattttgtatttc

SEQ ID NO: 1329042 - DNA, 22 bp, Artificial Sequence
  chemically synthesized
gaggttactataaatggaaata

SEQ ID NO: 1329043 - DNA, 22 bp, Artificial Sequence
  chemically synthesized
tgtatttccatttatagtaacc

SEQ ID NO: 1329044 - DNA, 22 bp, Artificial Sequence
  chemically synthesized
gtatttccatttatagtaacct

SEQ ID NO: 1329045 - DNA, 22 bp, Artificial Sequence
  chemically synthesized
tatttccatttatagtaacctc

SEQ ID NO: 1329046 - DNA, 22 bp, Artificial Sequence
  chemically synthesized
aaaataatgagcactagaggtt

SEQ ID NO: 1329047 - DNA, 22 bp, Artificial Sequence
  chemically synthesized
ccatttatagtaacctctagtg

SEQ ID NO: 1329048 - DNA, 22 bp, Artificial Sequence
  chemically synthesized
caaaataatgagcactagaggt

SEQ ID NO: 1329049 - DNA, 22 bp, Artificial Sequence
  chemically synthesized
catttatagtaacctctagtgc

SEQ ID NO: 1329050 - DNA, 22 bp, Artificial Sequence
  chemically synthesized
tcttcaaaataatgagcactag

SEQ ID NO: 1329051 - DNA, 22 bp, Artificial Sequence
  chemically synthesized
atcttcaaaataatgagcacta

SEQ ID NO: 1329052 - DNA, 22 bp, Artificial Sequence
  chemically synthesized
atagtaacctctagtgctcatt

SEQ ID NO: 1329053 - DNA, 22 bp, Artificial Sequence
  chemically synthesized
tatcttcaaaataatgagcact

SEQ ID NO: 1329054 - DNA, 22 bp, Artificial Sequence
  chemically synthesized
tagtaacctctagtgctcatta

SEQ ID NO: 1329055 - DNA, 22 bp, Artificial Sequence
  chemically synthesized
tagtgctcattattttgaagat

SEQ ID NO: 1329056 - DNA, 22 bp, Artificial Sequence
  chemically synthesized
gtgctcattattttgaagataa

SEQ ID NO: 1329057 - DNA, 22 bp, Artificial Sequence
  chemically synthesized
tataagaaagttttatcttcaa

SEQ ID NO: 1329058 - DNA, 22 bp, Artificial Sequence
  chemically synthesized
ctgtataagaaagttttatctt

SEQ ID NO: 1329059 - DNA, 22 bp, Artificial Sequence
  chemically synthesized
actgtataagaaagttttatct

SEQ ID NO: 1329060 - DNA, 22 bp, Artificial Sequence
  chemically synthesized
attattttgaagataaaacttt

SEQ ID NO: 1329061 - DNA, 22 bp, Artificial Sequence
  chemically synthesized
ttttgaagataaaactttctta

SEQ ID NO: 1329062 - DNA, 22 bp, Artificial Sequence
  chemically synthesized
aaaagcttactgtataagaaag

SEQ ID NO: 1329063 - DNA, 22 bp, Artificial Sequence
  chemically synthesized
tgaagataaaactttcttatac

SEQ ID NO: 1329064 - DNA, 22 bp, Artificial Sequence
  chemically synthesized
aaaaagcttactgtataagaaa

SEQ ID NO: 1329065 - DNA, 22 bp, Artificial Sequence
  chemically synthesized
gaagataaaactttcttataca

SEQ ID NO: 1329066 - DNA, 22 bp, Artificial Sequence
  chemically synthesized
taaaaagcttactgtataagaa

SEQ ID NO: 1329067 - DNA, 22 bp, Artificial Sequence
  chemically synthesized
aagataaaactttcttatacag

SEQ ID NO: 1329068 - DNA, 22 bp, Artificial Sequence
  chemically synthesized
acattttaaaaagcttactgta

SEQ ID NO: 1329069 - DNA, 22 bp, Artificial Sequence
  chemically synthesized
gtctcacattttaaaaagctta

SEQ ID NO: 1329070 - DNA, 22 bp, Artificial Sequence
  chemically synthesized
ggtctcacattttaaaaagctt

SEQ ID NO: 1329071 - DNA, 22 bp, Artificial Sequence
  chemically synthesized
tcttatacagtaagctttttaa

SEQ ID NO: 1329072 - DNA, 22 bp, Artificial Sequence
  chemically synthesized
cttatacagtaagctttttaaa

SEQ ID NO: 1329073 - DNA, 22 bp, Artificial Sequence
  chemically synthesized
ttatacagtaagctttttaaaa

SEQ ID NO: 1329074 - DNA, 22 bp, Artificial Sequence
  chemically synthesized
atttggtctcacattttaaaaa

SEQ ID NO: 1329075 - DNA, 22 bp, Artificial Sequence
  chemically synthesized
atacagtaagctttttaaaatg

SEQ ID NO: 1329076 - DNA, 22 bp, Artificial Sequence
  chemically synthesized
gatttggtctcacattttaaaa

SEQ ID NO: 1329077 - DNA, 22 bp, Artificial Sequence
  chemically synthesized
tacagtaagctttttaaaatgt

SEQ ID NO: 1329078 - DNA, 22 bp, Artificial Sequence
  chemically synthesized
tttgatttggtctcacatttta

SEQ ID NO: 1329079 - DNA, 22 bp, Artificial Sequence
  chemically synthesized
ttgtttgatttggtctcacatt

SEQ ID NO: 1329080 - DNA, 22 bp, Artificial Sequence
  chemically synthesized
gttgtttgatttggtctcacat

SEQ ID NO: 1329081 - DNA, 22 bp, Artificial Sequence
  chemically synthesized
ttgttgtttgatttggtctcac

SEQ ID NO: 1329082 - DNA, 22 bp, Artificial Sequence
  chemically synthesized
tttaaaatgtgagaccaaatca

SEQ ID NO: 1329083 - DNA, 22 bp, Artificial Sequence
  chemically synthesized
ttaaaatgtgagaccaaatcaa

SEQ ID NO: 1329084 - DNA, 22 bp, Artificial Sequence
  chemically synthesized
cgctcttgttgtttgatttggt

SEQ ID NO: 1329085 - DNA, 22 bp, Artificial Sequence
  chemically synthesized
taaaatgtgagaccaaatcaaa

SEQ ID NO: 1329086 - DNA, 22 bp, Artificial Sequence
  chemically synthesized
aaaatgtgagaccaaatcaaac

SEQ ID NO: 1329087 - DNA, 22 bp, Artificial Sequence
  chemically synthesized
aaatgtgagaccaaatcaaaca

SEQ ID NO: 1329088 - DNA, 22 bp, Artificial Sequence
  chemically synthesized
attacgctcttgttgtttgatt

SEQ ID NO: 1329089 - DNA, 22 bp, Artificial Sequence
  chemically synthesized
cattacgctcttgttgtttgat

SEQ ID NO: 1329090 - DNA, 22 bp, Artificial Sequence
  chemically synthesized
tcattacgctcttgttgtttga

SEQ ID NO: 1329091 - DNA, 22 bp, Artificial Sequence
  chemically synthesized
ttcattacgctcttgttgtttg

SEQ ID NO: 1329092 - DNA, 22 bp, Artificial Sequence
  chemically synthesized
tcgtttttcattacgctcttgt

SEQ ID NO: 1329093 - DNA, 22 bp, Artificial Sequence
  chemically synthesized
tatcgtttttcattacgctctt

SEQ ID NO: 1329094 - DNA, 22 bp, Artificial Sequence
  chemically synthesized
ctatcgtttttcattacgctct

SEQ ID NO: 1329095 - DNA, 22 bp, Artificial Sequence
  chemically synthesized
cttctatcgtttttcattacgc

SEQ ID NO: 1329096 - DNA, 22 bp, Artificial Sequence
  chemically synthesized
ccttctatcgtttttcattacg

SEQ ID NO: 1329097 - DNA, 22 bp, Artificial Sequence
  chemically synthesized
tccttctatcgtttttcattac

SEQ ID NO: 1329098 - DNA, 22 bp, Artificial Sequence
  chemically synthesized
ttttccttctatcgtttttcat

SEQ ID NO: 1329099 - DNA, 22 bp, Artificial Sequence
  chemically synthesized
gttgttttccttctatcgtttt

SEQ ID NO: 1329100 - DNA, 22 bp, Artificial Sequence
  chemically synthesized
agttgttttccttctatcgttt

SEQ ID NO: 1329101 - DNA, 22 bp, Artificial Sequence
  chemically synthesized
tagttgttttccttctatcgtt

SEQ ID NO: 1329102 - DNA, 22 bp, Artificial Sequence
  chemically synthesized
ttttagttgttttccttctatc

SEQ ID NO: 1329103 - DNA, 22 bp, Artificial Sequence
  chemically synthesized
attttagttgttttccttctat

SEQ ID NO: 1329104 - DNA, 22 bp, Artificial Sequence
  chemically synthesized
ttattttagttgttttccttct

SEQ ID NO: 1329105 - DNA, 22 bp, Artificial Sequence
  chemically synthesized
ggaggttcttattttagttgtt

SEQ ID NO: 1329106 - DNA, 22 bp, Artificial Sequence
  chemically synthesized
agctaggaggttcttattttag

SEQ ID NO: 1329107 - DNA, 22 bp, Artificial Sequence
  chemically synthesized
gaataaatctgagctaggaggt

SEQ ID NO: 1329108 - DNA, 22 bp, Artificial Sequence
  chemically synthesized
agaataaatctgagctaggagg

SEQ ID NO: 1329109 - DNA, 22 bp, Artificial Sequence
  chemically synthesized
tagaataaatctgagctaggag

SEQ ID NO: 1329110 - DNA, 22 bp, Artificial Sequence
  chemically synthesized
ttagaataaatctgagctagga

SEQ ID NO: 1329111 - DNA, 22 bp, Artificial Sequence
  chemically synthesized
aaataagaacctcctagctcag

SEQ ID NO: 1329112 - DNA, 22 bp, Artificial Sequence
  chemically synthesized
tttagaataaatctgagctagg

SEQ ID NO: 1329113 - DNA, 22 bp, Artificial Sequence
  chemically synthesized
aactttttagaataaatctgag

SEQ ID NO: 1329114 - DNA, 22 bp, Artificial Sequence
  chemically synthesized
caactttttagaataaatctga

SEQ ID NO: 1329115 - DNA, 22 bp, Artificial Sequence
  chemically synthesized
tcaactttttagaataaatctg

SEQ ID NO: 1329116 - DNA, 22 bp, Artificial Sequence
  chemically synthesized
ttttcaactttttagaataaat

SEQ ID NO: 1329117 - DNA, 22 bp, Artificial Sequence
  chemically synthesized
attttcaactttttagaataaa

SEQ ID NO: 1329118 - DNA, 22 bp, Artificial Sequence
  chemically synthesized
ctagctcagatttattctaaaa

SEQ ID NO: 1329119 - DNA, 22 bp, Artificial Sequence
  chemically synthesized
gctcagatttattctaaaaagt

SEQ ID NO: 1329120 - DNA, 22 bp, Artificial Sequence
  chemically synthesized
tatttattttcaactttttaga

SEQ ID NO: 1329121 - DNA, 22 bp, Artificial Sequence
  chemically synthesized
agatttattctaaaaagttgaa

SEQ ID NO: 1329122 - DNA, 22 bp, Artificial Sequence
  chemically synthesized
cattatatttattttcaacttt

SEQ ID NO: 1329123 - DNA, 22 bp, Artificial Sequence
  chemically synthesized
tacattatatttattttcaact

SEQ ID NO: 1329124 - DNA, 22 bp, Artificial Sequence
  chemically synthesized
ctacattatatttattttcaac

SEQ ID NO: 1329125 - DNA, 22 bp, Artificial Sequence
  chemically synthesized
attctaaaaagttgaaaataaa

SEQ ID NO: 1329126 - DNA, 22 bp, Artificial Sequence
  chemically synthesized
ttctaaaaagttgaaaataaat

SEQ ID NO: 1329127 - DNA, 22 bp, Artificial Sequence
  chemically synthesized
taaaaagttgaaaataaatata

SEQ ID NO: 1329128 - DNA, 22 bp, Artificial Sequence
  chemically synthesized
aaaagttgaaaataaatataat

SEQ ID NO: 1329129 - DNA, 22 bp, Artificial Sequence
  chemically synthesized
ataataataacttctacattat

SEQ ID NO: 1329130 - DNA, 22 bp, Artificial Sequence
  chemically synthesized
cataataataacttctacatta

SEQ ID NO: 1329131 - DNA, 22 bp, Artificial Sequence
  chemically synthesized
tcataataataacttctacatt

SEQ ID NO: 1329132 - DNA, 22 bp, Artificial Sequence
  chemically synthesized
aaaataaatataatgtagaagt

SEQ ID NO: 1329133 - DNA, 22 bp, Artificial Sequence
  chemically synthesized
tgttttcataataataacttct

SEQ ID NO: 1329134 - DNA, 22 bp, Artificial Sequence
  chemically synthesized
atgttttcataataataacttc

SEQ ID NO: 1329135 - DNA, 22 bp, Artificial Sequence
  chemically synthesized
tttatgttttcataataataac

SEQ ID NO: 1329136 - DNA, 22 bp, Artificial Sequence
  chemically synthesized
ttatttatgttttcataataat

SEQ ID NO: 1329137 - DNA, 22 bp, Artificial Sequence
  chemically synthesized
ttattatgaaaacataaataat

SEQ ID NO: 1329138 - DNA, 22 bp, Artificial Sequence
  chemically synthesized
tgaaaaaatattattatttatg

SEQ ID NO: 1329139 - DNA, 22 bp, Artificial Sequence
  chemically synthesized
ttatgaaaacataaataataat

SEQ ID NO: 1329140 - DNA, 22 bp, Artificial Sequence
  chemically synthesized
tctatgaaaaaatattattatt

SEQ ID NO: 1329141 - DNA, 22 bp, Artificial Sequence
  chemically synthesized
tgaaaacataaataataatatt

SEQ ID NO: 1329142 - DNA, 22 bp, Artificial Sequence
  chemically synthesized
ctatctatgaaaaaatattatt

SEQ ID NO: 1329143 - DNA, 22 bp, Artificial Sequence
  chemically synthesized
gtgttactatctatgaaaaaat

SEQ ID NO: 1329144 - DNA, 22 bp, Artificial Sequence
  chemically synthesized
agagtaaagctagtgttactat

SEQ ID NO: 1329145 - DNA, 22 bp, Artificial Sequence
  chemically synthesized
cagagtaaagctagtgttacta

SEQ ID NO: 1329146 - DNA, 22 bp, Artificial Sequence
  chemically synthesized
tcagagtaaagctagtgttact

SEQ ID NO: 1329147 - DNA, 22 bp, Artificial Sequence
  chemically synthesized
tttcatagatagtaacactagc

SEQ ID NO: 1329148 - DNA, 22 bp, Artificial Sequence
  chemically synthesized
ttcatagatagtaacactagct

SEQ ID NO: 1329149 - DNA, 22 bp, Artificial Sequence
  chemically synthesized
ctttcagagtaaagctagtgtt

SEQ ID NO: 1329150 - DNA, 22 bp, Artificial Sequence
  chemically synthesized
tcatagatagtaacactagctt

SEQ ID NO: 1329151 - DNA, 22 bp, Artificial Sequence
  chemically synthesized
catagatagtaacactagcttt

SEQ ID NO: 1329152 - DNA, 22 bp, Artificial Sequence
  chemically synthesized
tactttcagagtaaagctagtg

SEQ ID NO: 1329153 - DNA, 22 bp, Artificial Sequence
  chemically synthesized
atagatagtaacactagcttta

SEQ ID NO: 1329154 - DNA, 22 bp, Artificial Sequence
  chemically synthesized
atgaagcacagattctactttc

SEQ ID NO: 1329155 - DNA, 22 bp, Artificial Sequence
  chemically synthesized
gctttactctgaaagtagaatc

SEQ ID NO: 1329156 - DNA, 22 bp, Artificial Sequence
  chemically synthesized
ttaatgaagcacagattctact

SEQ ID NO: 1329157 - DNA, 22 bp, Artificial Sequence
  chemically synthesized
tactctgaaagtagaatctgtg

SEQ ID NO: 1329158 - DNA, 22 bp, Artificial Sequence
  chemically synthesized
actctgaaagtagaatctgtgc

SEQ ID NO: 1329159 - DNA, 22 bp, Artificial Sequence
  chemically synthesized
ctctgaaagtagaatctgtgct

SEQ ID NO: 1329160 - DNA, 22 bp, Artificial Sequence
  chemically synthesized
tgaaagtagaatctgtgcttca

SEQ ID NO: 1329161 - DNA, 22 bp, Artificial Sequence
  chemically synthesized
aaagtagaatctgtgcttcatt

SEQ ID NO: 1329162 - DNA, 22 bp, Artificial Sequence
  chemically synthesized
aacacaggcactattaatgaag

SEQ ID NO: 1329163 - DNA, 22 bp, Artificial Sequence
  chemically synthesized
tgcttcattaatagtgcctgtg

SEQ ID NO: 1329164 - DNA, 22 bp, Artificial Sequence
  chemically synthesized
tcaaagtgttaaacacaggcac

SEQ ID NO: 1329165 - DNA, 22 bp, Artificial Sequence
  chemically synthesized
cattaatagtgcctgtgtttaa

SEQ ID NO: 1329166 - DNA, 22 bp, Artificial Sequence
  chemically synthesized
attaatagtgcctgtgtttaac

SEQ ID NO: 1329167 - DNA, 22 bp, Artificial Sequence
  chemically synthesized
atagtgcctgtgtttaacactt

SEQ ID NO: 1329168 - DNA, 22 bp, Artificial Sequence
  chemically synthesized
tatggtgagttatcaaagtgtt

SEQ ID NO: 1329169 - DNA, 22 bp, Artificial Sequence
  chemically synthesized
tgtatggtgagttatcaaagtg

SEQ ID NO: 1329170 - DNA, 22 bp, Artificial Sequence
  chemically synthesized
ctgtatggtgagttatcaaagt

SEQ ID NO: 1329171 - DNA, 22 bp, Artificial Sequence
  chemically synthesized
tgtttaacactttgataactca

SEQ ID NO: 1329172 - DNA, 22 bp, Artificial Sequence
  chemically synthesized
tacttctgtatggtgagttatc

SEQ ID NO: 1329173 - DNA, 22 bp, Artificial Sequence
  chemically synthesized
aacactttgataactcaccata

SEQ ID NO: 1329174 - DNA, 22 bp, Artificial Sequence
  chemically synthesized
acactttgataactcaccatac

SEQ ID NO: 1329175 - DNA, 22 bp, Artificial Sequence
  chemically synthesized
aggctatacttctgtatggtga

SEQ ID NO: 1329176 - DNA, 22 bp, Artificial Sequence
  chemically synthesized
tgataactcaccatacagaagt

SEQ ID NO: 1329177 - DNA, 22 bp, Artificial Sequence
  chemically synthesized
gataactcaccatacagaagta

SEQ ID NO: 1329178 - DNA, 22 bp, Artificial Sequence
  chemically synthesized
ataactcaccatacagaagtat

SEQ ID NO: 1329179 - DNA, 22 bp, Artificial Sequence
  chemically synthesized
ggaacactgaggctatacttct

SEQ ID NO: 1329180 - DNA, 22 bp, Artificial Sequence
  chemically synthesized
accatacagaagtatagcctca

SEQ ID NO: 1329181 - DNA, 22 bp, Artificial Sequence
  chemically synthesized
ggaacaggaatctgggaacact

SEQ ID NO: 1329182 - DNA, 22 bp, Artificial Sequence
  chemically synthesized
atccctaggaacaggaatctgg

SEQ ID NO: 1329183 - DNA, 22 bp, Artificial Sequence
  chemically synthesized
agtgttcccagattcctgttcc

SEQ ID NO: 1329184 - DNA, 22 bp, Artificial Sequence
  chemically synthesized
ccagattcctgttcctagggat

SEQ ID NO: 1329185 - DNA, 22 bp, Artificial Sequence
  chemically synthesized
atgtgatcattcatccctagga

SEQ ID NO: 1329186 - DNA, 22 bp, Artificial Sequence
  chemically synthesized
ctaatgtgatcattcatcccta

SEQ ID NO: 1329187 - DNA, 22 bp, Artificial Sequence
  chemically synthesized
cctaatgtgatcattcatccct

SEQ ID NO: 1329188 - DNA, 22 bp, Artificial Sequence
  chemically synthesized
ctgttcctagggatgaatgatc

SEQ ID NO: 1329189 - DNA, 22 bp, Artificial Sequence
  chemically synthesized
ttcctagggatgaatgatcaca

SEQ ID NO: 1329190 - DNA, 22 bp, Artificial Sequence
  chemically synthesized
ctagggatgaatgatcacatta

SEQ ID NO: 1329191 - DNA, 22 bp, Artificial Sequence
  chemically synthesized
gggatgaatgatcacattagga

SEQ ID NO: 1329192 - DNA, 22 bp, Artificial Sequence
  chemically synthesized
acaggaatgtaccttcctaatg

SEQ ID NO: 1329193 - DNA, 22 bp, Artificial Sequence
  chemically synthesized
gccaaattaacaggaatgtacc

SEQ ID NO: 1329194 - DNA, 22 bp, Artificial Sequence
  chemically synthesized
agccaaattaacaggaatgtac

SEQ ID NO: 1329195 - DNA, 22 bp, Artificial Sequence
  chemically synthesized
ggaaggtacattcctgttaatt

SEQ ID NO: 1329196 - DNA, 22 bp, Artificial Sequence
  chemically synthesized
gcagatttagccaaattaacag

SEQ ID NO: 1329197 - DNA, 22 bp, Artificial Sequence
  chemically synthesized
ggctggcagatttagccaaatt

SEQ ID NO: 1329198 - DNA, 22 bp, Artificial Sequence
  chemically synthesized
gggctggcagatttagccaaat

SEQ ID NO: 1329199 - DNA, 22 bp, Artificial Sequence
  chemically synthesized
ctgttaatttggctaaatctgc

SEQ ID NO: 1329200 - DNA, 22 bp, Artificial Sequence
  chemically synthesized
tgatttgggctggcagatttag

SEQ ID NO: 1329201 - DNA, 22 bp, Artificial Sequence
  chemically synthesized
atgatttgggctggcagattta

SEQ ID NO: 1329202 - DNA, 22 bp, Artificial Sequence
  chemically synthesized
tatgatttgggctggcagattt

SEQ ID NO: 1329203 - DNA, 22 bp, Artificial Sequence
  chemically synthesized
ttaatttggctaaatctgccag

SEQ ID NO: 1329204 - DNA, 22 bp, Artificial Sequence
  chemically synthesized
atttggctaaatctgccagccc

SEQ ID NO: 1329205 - DNA, 22 bp, Artificial Sequence
  chemically synthesized
ggctaaatctgccagcccaaat

SEQ ID NO: 1329206 - DNA, 22 bp, Artificial Sequence
  chemically synthesized
gctaaatctgccagcccaaatc

SEQ ID NO: 1329207 - DNA, 22 bp, Artificial Sequence
  chemically synthesized
ggagaactttatgatttgggct

SEQ ID NO: 1329208 - DNA, 22 bp, Artificial Sequence
  chemically synthesized
aggagaactttatgatttgggc

SEQ ID NO: 1329209 - DNA, 22 bp, Artificial Sequence
  chemically synthesized
taggagaactttatgatttggg

SEQ ID NO: 1329210 - DNA, 22 bp, Artificial Sequence
  chemically synthesized
aatctgccagcccaaatcataa

SEQ ID NO: 1329211 - DNA, 22 bp, Artificial Sequence
  chemically synthesized
ccagcccaaatcataaagttct

SEQ ID NO: 1329212 - DNA, 22 bp, Artificial Sequence
  chemically synthesized
agatagagcatctttaggagaa

SEQ ID NO: 1329213 - DNA, 22 bp, Artificial Sequence
  chemically synthesized
gagatagagcatctttaggaga

SEQ ID NO: 1329214 - DNA, 22 bp, Artificial Sequence
  chemically synthesized
ttgagatagagcatctttagga

SEQ ID NO: 1329215 - DNA, 22 bp, Artificial Sequence
  chemically synthesized
ctcttgagatagagcatcttta

SEQ ID NO: 1329216 - DNA, 22 bp, Artificial Sequence
  chemically synthesized
gctcttgagatagagcatcttt

SEQ ID NO: 1329217 - DNA, 22 bp, Artificial Sequence
  chemically synthesized
agtgtttgctcttgagatagag

SEQ ID NO: 1329218 - DNA, 22 bp, Artificial Sequence
  chemically synthesized
tcctaaagatgctctatctcaa

SEQ ID NO: 1329219 - DNA, 22 bp, Artificial Sequence
  chemically synthesized
ctaaagatgctctatctcaaga

SEQ ID NO: 1329220 - DNA, 22 bp, Artificial Sequence
  chemically synthesized
ctaagtgtttgctcttgagata

SEQ ID NO: 1329221 - DNA, 22 bp, Artificial Sequence
  chemically synthesized
cctaagtgtttgctcttgagat

SEQ ID NO: 1329222 - DNA, 22 bp, Artificial Sequence
  chemically synthesized
tcctaagtgtttgctcttgaga

SEQ ID NO: 1329223 - DNA, 22 bp, Artificial Sequence
  chemically synthesized
aagatgctctatctcaagagca

SEQ ID NO: 1329224 - DNA, 22 bp, Artificial Sequence
  chemically synthesized
acaattttcctaagtgtttgct

SEQ ID NO: 1329225 - DNA, 22 bp, Artificial Sequence
  chemically synthesized
tatctcaagagcaaacacttag

SEQ ID NO: 1329226 - DNA, 22 bp, Artificial Sequence
  chemically synthesized
tctcaagagcaaacacttagga

SEQ ID NO: 1329227 - DNA, 22 bp, Artificial Sequence
  chemically synthesized
aagagcaaacacttaggaaaat

SEQ ID NO: 1329228 - DNA, 22 bp, Artificial Sequence
  chemically synthesized
taaacattaacaattttcctaa

SEQ ID NO: 1329229 - DNA, 22 bp, Artificial Sequence
  chemically synthesized
ttataaacattaacaattttcc

SEQ ID NO: 1329230 - DNA, 22 bp, Artificial Sequence
  chemically synthesized
gttataaacattaacaattttc

SEQ ID NO: 1329231 - DNA, 22 bp, Artificial Sequence
  chemically synthesized
ccttgttataaacattaacaat

SEQ ID NO: 1329232 - DNA, 22 bp, Artificial Sequence
  chemically synthesized
attgccttgttataaacattaa

SEQ ID NO: 1329233 - DNA, 22 bp, Artificial Sequence
  chemically synthesized
aggaaaattgttaatgtttata

SEQ ID NO: 1329234 - DNA, 22 bp, Artificial Sequence
  chemically synthesized
ggaaaattgttaatgtttataa

SEQ ID NO: 1329235 - DNA, 22 bp, Artificial Sequence
  chemically synthesized
ttaatgtttataacaaggcaat

SEQ ID NO: 1329236 - DNA, 22 bp, Artificial Sequence
  chemically synthesized
aatgagatgttgattgccttgt

SEQ ID NO: 1329237 - DNA, 22 bp, Artificial Sequence
  chemically synthesized
aaatgagatgttgattgccttg

SEQ ID NO: 1329238 - DNA, 22 bp, Artificial Sequence
  chemically synthesized
atgtttataacaaggcaatcaa

SEQ ID NO: 1329239 - DNA, 22 bp, Artificial Sequence
  chemically synthesized
aatatttaaatgagatgttgat

SEQ ID NO: 1329240 - DNA, 22 bp, Artificial Sequence
  chemically synthesized
ataacaaggcaatcaacatctc

SEQ ID NO: 1329241 - DNA, 22 bp, Artificial Sequence
  chemically synthesized
taacaaggcaatcaacatctca

SEQ ID NO: 1329242 - DNA, 22 bp, Artificial Sequence
  chemically synthesized
tgaatatttaaatgagatgttg

SEQ ID NO: 1329243 - DNA, 22 bp, Artificial Sequence
  chemically synthesized
ctgaatatttaaatgagatgtt

SEQ ID NO: 1329244 - DNA, 22 bp, Artificial Sequence
  chemically synthesized
atttaaatattcagaaattgat

SEQ ID NO: 1329245 - DNA, 22 bp, Artificial Sequence
  chemically synthesized
aaatattcagaaattgatcctt

SEQ ID NO: 1329246 - DNA, 22 bp, Artificial Sequence
  chemically synthesized
aatattcagaaattgatccttc

SEQ ID NO: 1329247 - DNA, 22 bp, Artificial Sequence
  chemically synthesized
aaagtatgaagtggaaggatca

SEQ ID NO: 1329248 - DNA, 22 bp, Artificial Sequence
  chemically synthesized
actgaaagtatgaagtggaagg

SEQ ID NO: 1329249 - DNA, 22 bp, Artificial Sequence
  chemically synthesized
agaaattgatccttccacttca

SEQ ID NO: 1329250 - DNA, 22 bp, Artificial Sequence
  chemically synthesized
atcctaactgaaagtatgaagt

SEQ ID NO: 1329251 - DNA, 22 bp, Artificial Sequence
  chemically synthesized
atccttccacttcatactttca

SEQ ID NO: 1329252 - DNA, 22 bp, Artificial Sequence
  chemically synthesized
aatgctcatcctaactgaaagt

SEQ ID NO: 1329253 - DNA, 22 bp, Artificial Sequence
  chemically synthesized
caatgctcatcctaactgaaag

SEQ ID NO: 1329254 - DNA, 22 bp, Artificial Sequence
  chemically synthesized
tcaatgctcatcctaactgaaa

SEQ ID NO: 1329255 - DNA, 22 bp, Artificial Sequence
  chemically synthesized
ccacttcatactttcagttagg

SEQ ID NO: 1329256 - DNA, 22 bp, Artificial Sequence
  chemically synthesized
cacttcatactttcagttagga

SEQ ID NO: 1329257 - DNA, 22 bp, Artificial Sequence
  chemically synthesized
catactttcagttaggatgagc

SEQ ID NO: 1329258 - DNA, 22 bp, Artificial Sequence
  chemically synthesized
catgttttcaatgctcatccta

SEQ ID NO: 1329259 - DNA, 22 bp, Artificial Sequence
  chemically synthesized
atactttcagttaggatgagca

SEQ ID NO: 1329260 - DNA, 22 bp, Artificial Sequence
  chemically synthesized
ctacatgttttcaatgctcatc

SEQ ID NO: 1329261 - DNA, 22 bp, Artificial Sequence
  chemically synthesized
actacatgttttcaatgctcat

SEQ ID NO: 1329262 - DNA, 22 bp, Artificial Sequence
  chemically synthesized
tactacatgttttcaatgctca

SEQ ID NO: 1329263 - DNA, 22 bp, Artificial Sequence
  chemically synthesized
tcagttaggatgagcattgaaa

SEQ ID NO: 1329264 - DNA, 22 bp, Artificial Sequence
  chemically synthesized
cagttaggatgagcattgaaaa

SEQ ID NO: 1329265 - DNA, 22 bp, Artificial Sequence
  chemically synthesized
agttaggatgagcattgaaaac

SEQ ID NO: 1329266 - DNA, 22 bp, Artificial Sequence
  chemically synthesized
tgctttactacatgttttcaat

SEQ ID NO: 1329267 - DNA, 22 bp, Artificial Sequence
  chemically synthesized
ggatgagcattgaaaacatgta

SEQ ID NO: 1329268 - DNA, 22 bp, Artificial Sequence
  chemically synthesized
aggttgtgctttactacatgtt

SEQ ID NO: 1329269 - DNA, 22 bp, Artificial Sequence
  chemically synthesized
tgaatgctgaggttgtgcttta

SEQ ID NO: 1329270 - DNA, 22 bp, Artificial Sequence
  chemically synthesized
aaaacatgtagtaaagcacaac

SEQ ID NO: 1329271 - DNA, 22 bp, Artificial Sequence
  chemically synthesized
attatgaatgctgaggttgtgc

SEQ ID NO: 1329272 - DNA, 22 bp, Artificial Sequence
  chemically synthesized
tcatattcattatgaatgctga

SEQ ID NO: 1329273 - DNA, 22 bp, Artificial Sequence
  chemically synthesized
atcatattcattatgaatgctg

SEQ ID NO: 1329274 - DNA, 22 bp, Artificial Sequence
  chemically synthesized
ttatcatattcattatgaatgc

SEQ ID NO: 1329275 - DNA, 22 bp, Artificial Sequence
  chemically synthesized
ttcttatcatattcattatgaa

SEQ ID NO: 1329276 - DNA, 22 bp, Artificial Sequence
  chemically synthesized
gttcttatcatattcattatga

SEQ ID NO: 1329277 - DNA, 22 bp, Artificial Sequence
  chemically synthesized
agcattcataatgaatatgata

SEQ ID NO: 1329278 - DNA, 22 bp, Artificial Sequence
  chemically synthesized
ataatgaatatgataagaacaa

SEQ ID NO: 1329279 - DNA, 22 bp, Artificial Sequence
  chemically synthesized
gtagtaaacatgaatgagaaaa

SEQ ID NO: 1329280 - DNA, 22 bp, Artificial Sequence
  chemically synthesized
ggtagtaaacatgaatgagaaa

SEQ ID NO: 1329281 - DNA, 22 bp, Artificial Sequence
  chemically synthesized
aacagatgtttggtagtaaaca

SEQ ID NO: 1329282 - DNA, 22 bp, Artificial Sequence
  chemically synthesized
ttctcattcatgtttactacca

SEQ ID NO: 1329283 - DNA, 22 bp, Artificial Sequence
  chemically synthesized
tctcattcatgtttactaccaa

SEQ ID NO: 1329284 - DNA, 22 bp, Artificial Sequence
  chemically synthesized
ttcaacagatgtttggtagtaa

SEQ ID NO: 1329285 - DNA, 22 bp, Artificial Sequence
  chemically synthesized
ctcattcatgtttactaccaaa

SEQ ID NO: 1329286 - DNA, 22 bp, Artificial Sequence
  chemically synthesized
attcaacagatgtttggtagta

SEQ ID NO: 1329287 - DNA, 22 bp, Artificial Sequence
  chemically synthesized
tcattcatgtttactaccaaac

SEQ ID NO: 1329288 - DNA, 22 bp, Artificial Sequence
  chemically synthesized
attcatgtttactaccaaacat

SEQ ID NO: 1329289 - DNA, 22 bp, Artificial Sequence
  chemically synthesized
atgtttactaccaaacatctgt

SEQ ID NO: 1329290 - DNA, 22 bp, Artificial Sequence
  chemically synthesized
agtagtttattcaacagatgtt

SEQ ID NO: 1329291 - DNA, 22 bp, Artificial Sequence
  chemically synthesized
actaccaaacatctgttgaata

SEQ ID NO: 1329292 - DNA, 22 bp, Artificial Sequence
  chemically synthesized
ctaccaaacatctgttgaataa

SEQ ID NO: 1329293 - DNA, 22 bp, Artificial Sequence
  chemically synthesized
ccaaacatctgttgaataaact

SEQ ID NO: 1329294 - DNA, 22 bp, Artificial Sequence
  chemically synthesized
taaggattaagtagtttattca

SEQ ID NO: 1329295 - DNA, 22 bp, Artificial Sequence
  chemically synthesized
gtaaggattaagtagtttattc

SEQ ID NO: 1329296 - DNA, 22 bp, Artificial Sequence
  chemically synthesized
tgtttgtaaggattaagtagtt

SEQ ID NO: 1329297 - DNA, 22 bp, Artificial Sequence
  chemically synthesized
gttatgtttgtaaggattaagt

SEQ ID NO: 1329298 - DNA, 22 bp, Artificial Sequence
  chemically synthesized
ttgaataaactacttaatcctt

SEQ ID NO: 1329299 - DNA, 22 bp, Artificial Sequence
  chemically synthesized
aataaactacttaatccttaca

SEQ ID NO: 1329300 - DNA, 22 bp, Artificial Sequence
  chemically synthesized
aaaataatctggttatgtttgt

SEQ ID NO: 1329301 - DNA, 22 bp, Artificial Sequence
  chemically synthesized
cttaatccttacaaacataacc

SEQ ID NO: 1329302 - DNA, 22 bp, Artificial Sequence
  chemically synthesized
ctgaaaataatctggttatgtt

SEQ ID NO: 1329303 - DNA, 22 bp, Artificial Sequence
  chemically synthesized
aatccttacaaacataaccaga

SEQ ID NO: 1329304 - DNA, 22 bp, Artificial Sequence
  chemically synthesized
atccttacaaacataaccagat

SEQ ID NO: 1329305 - DNA, 22 bp, Artificial Sequence
  chemically synthesized
ttgctgaaaataatctggttat

SEQ ID NO: 1329306 - DNA, 22 bp, Artificial Sequence
  chemically synthesized
tattgttgctgaaaataatctg

SEQ ID NO: 1329307 - DNA, 22 bp, Artificial Sequence
  chemically synthesized
acaaacataaccagattatttt

SEQ ID NO: 1329308 - DNA, 22 bp, Artificial Sequence
  chemically synthesized
gtattgttgctgaaaataatct

SEQ ID NO: 1329309 - DNA, 22 bp, Artificial Sequence
  chemically synthesized
caaacataaccagattattttc

SEQ ID NO: 1329310 - DNA, 22 bp, Artificial Sequence
  chemically synthesized
tagagtttgtattgttgctgaa

SEQ ID NO: 1329311 - DNA, 22 bp, Artificial Sequence
  chemically synthesized
tcactatagagtttgtattgtt

SEQ ID NO: 1329312 - DNA, 22 bp, Artificial Sequence
  chemically synthesized
ttatcactatagagtttgtatt

SEQ ID NO: 1329313 - DNA, 22 bp, Artificial Sequence
  chemically synthesized
ttttcagcaacaatacaaactc

SEQ ID NO: 1329314 - DNA, 22 bp, Artificial Sequence
  chemically synthesized
tcagcaacaatacaaactctat

SEQ ID NO: 1329315 - DNA, 22 bp, Artificial Sequence
  chemically synthesized
cagcaacaatacaaactctata

SEQ ID NO: 1329316 - DNA, 22 bp, Artificial Sequence
  chemically synthesized
agcaacaatacaaactctatag

SEQ ID NO: 1329317 - DNA, 22 bp, Artificial Sequence
  chemically synthesized
aagaaagtaaaggaccagctgt

SEQ ID NO: 1329318 - DNA, 22 bp, Artificial Sequence
  chemically synthesized
tatagtgataacagctggtcct

SEQ ID NO: 1329319 - DNA, 22 bp, Artificial Sequence
  chemically synthesized
tagtgataacagctggtccttt

SEQ ID NO: 1329320 - DNA, 22 bp, Artificial Sequence
  chemically synthesized
gtcctttactttcttcagggat

SEQ ID NO: 1329321 - DNA, 22 bp, Artificial Sequence
  chemically synthesized
tactttcttcagggatatacac

SEQ ID NO: 1329322 - DNA, 22 bp, Artificial Sequence
  chemically synthesized
actttcttcagggatatacact

SEQ ID NO: 1329323 - DNA, 22 bp, Artificial Sequence
  chemically synthesized
ctttcttcagggatatacactc

SEQ ID NO: 1329324 - DNA, 22 bp, Artificial Sequence
  chemically synthesized
tcttcagggatatacactccac

SEQ ID NO: 1329325 - DNA, 22 bp, Artificial Sequence
  chemically synthesized
cttcagggatatacactccaca

SEQ ID NO: 1329326 - DNA, 22 bp, Artificial Sequence
  chemically synthesized
ttcagggatatacactccacat

SEQ ID NO: 1329327 - DNA, 22 bp, Artificial Sequence
  chemically synthesized
cagggatatacactccacatat

SEQ ID NO: 1329328 - DNA, 22 bp, Artificial Sequence
  chemically synthesized
agggatatacactccacatata

SEQ ID NO: 1329329 - DNA, 22 bp, Artificial Sequence
  chemically synthesized
agaagaaatgaaatatatgtgg

SEQ ID NO: 1329330 - DNA, 22 bp, Artificial Sequence
  chemically synthesized
gagaagaaatgaaatatatgtg

SEQ ID NO: 1329331 - DNA, 22 bp, Artificial Sequence
  chemically synthesized
acttgagaagaaatgaaatata

SEQ ID NO: 1329332 - DNA, 22 bp, Artificial Sequence
  chemically synthesized
aacttgagaagaaatgaaatat

SEQ ID NO: 1329333 - DNA, 22 bp, Artificial Sequence
  chemically synthesized
tcacttaacttgagaagaaatg

SEQ ID NO: 1329334 - DNA, 22 bp, Artificial Sequence
  chemically synthesized
cacatatatttcatttcttctc

SEQ ID NO: 1329335 - DNA, 22 bp, Artificial Sequence
  chemically synthesized
gtcacttaacttgagaagaaat

SEQ ID NO: 1329336 - DNA, 22 bp, Artificial Sequence
  chemically synthesized
tgtcacttaacttgagaagaaa

SEQ ID NO: 1329337 - DNA, 22 bp, Artificial Sequence
  chemically synthesized
ttgtcacttaacttgagaagaa

SEQ ID NO: 1329338 - DNA, 22 bp, Artificial Sequence
  chemically synthesized
tttgtcacttaacttgagaaga

SEQ ID NO: 1329339 - DNA, 22 bp, Artificial Sequence
  chemically synthesized
gctttttgtcacttaacttgag

SEQ ID NO: 1329340 - DNA, 22 bp, Artificial Sequence
  chemically synthesized
agctttttgtcacttaacttga

SEQ ID NO: 1329341 - DNA, 22 bp, Artificial Sequence
  chemically synthesized
tagctttttgtcacttaacttg

SEQ ID NO: 1329342 - DNA, 22 bp, Artificial Sequence
  chemically synthesized
catttcttctcaagttaagtga

SEQ ID NO: 1329343 - DNA, 22 bp, Artificial Sequence
  chemically synthesized
atttcttctcaagttaagtgac

SEQ ID NO: 1329344 - DNA, 22 bp, Artificial Sequence
  chemically synthesized
cttctcaagttaagtgacaaaa

SEQ ID NO: 1329345 - DNA, 22 bp, Artificial Sequence
  chemically synthesized
ttctcaagttaagtgacaaaaa

SEQ ID NO: 1329346 - DNA, 22 bp, Artificial Sequence
  chemically synthesized
ctcaagttaagtgacaaaaagc

SEQ ID NO: 1329347 - DNA, 22 bp, Artificial Sequence
  chemically synthesized
tcaagttaagtgacaaaaagct

SEQ ID NO: 1329348 - DNA, 22 bp, Artificial Sequence
  chemically synthesized
aagttaagtgacaaaaagctaa

SEQ ID NO: 1329349 - DNA, 22 bp, Artificial Sequence
  chemically synthesized
catcacaatccattttagcttt

SEQ ID NO: 1329350 - DNA, 22 bp, Artificial Sequence
  chemically synthesized
agtgacaaaaagctaaaatgga

SEQ ID NO: 1329351 - DNA, 22 bp, Artificial Sequence
  chemically synthesized
actgcatcacaatccattttag

SEQ ID NO: 1329352 - DNA, 22 bp, Artificial Sequence
  chemically synthesized
gactgcatcacaatccatttta

SEQ ID NO: 1329353 - DNA, 22 bp, Artificial Sequence
  chemically synthesized
tgactgcatcacaatccatttt

SEQ ID NO: 1329354 - DNA, 22 bp, Artificial Sequence
  chemically synthesized
gtggctttgactgcatcacaat

SEQ ID NO: 1329355 - DNA, 22 bp, Artificial Sequence
  chemically synthesized
aaatggattgtgatgcagtcaa

SEQ ID NO: 1329356 - DNA, 22 bp, Artificial Sequence
  chemically synthesized
tgtcattcgtggctttgactgc

SEQ ID NO: 1329357 - DNA, 22 bp, Artificial Sequence
  chemically synthesized
tgatgcagtcaaagccacgaat

SEQ ID NO: 1329358 - DNA, 22 bp, Artificial Sequence
  chemically synthesized
tggtagaaaactgtgtcattcg

SEQ ID NO: 1329359 - DNA, 22 bp, Artificial Sequence
  chemically synthesized
tctatggtagaaaactgtgtca

SEQ ID NO: 1329360 - DNA, 22 bp, Artificial Sequence
  chemically synthesized
gtctatggtagaaaactgtgtc

SEQ ID NO: 1329361 - DNA, 22 bp, Artificial Sequence
  chemically synthesized
tccccttgtctatggtagaaaa

SEQ ID NO: 1329362 - DNA, 22 bp, Artificial Sequence
  chemically synthesized
tctaccatagacaaggggataa

SEQ ID NO: 1329363 - DNA, 22 bp, Artificial Sequence
  chemically synthesized
ctaccatagacaaggggataat

SEQ ID NO: 1329364 - DNA, 22 bp, Artificial Sequence
  chemically synthesized
taccatagacaaggggataatt

SEQ ID NO: 1329365 - DNA, 22 bp, Artificial Sequence
  chemically synthesized
aaagaaaaaaaaaattatcccc

SEQ ID NO: 1329366 - DNA, 22 bp, Artificial Sequence
  chemically synthesized
ccatagacaaggggataatttt

SEQ ID NO: 1329367 - DNA, 22 bp, Artificial Sequence
  chemically synthesized
cattgaaagaaaaaaaaaatta

SEQ ID NO: 1329368 - DNA, 22 bp, Artificial Sequence
  chemically synthesized
acattgaaagaaaaaaaaaatt

SEQ ID NO: 1329369 - DNA, 22 bp, Artificial Sequence
  chemically synthesized
tggcttacattgaaagaaaaaa

SEQ ID NO: 1329370 - DNA, 22 bp, Artificial Sequence
  chemically synthesized
gtggcttacattgaaagaaaaa

SEQ ID NO: 1329371 - DNA, 22 bp, Artificial Sequence
  chemically synthesized
cacttgtggcttacattgaaag

SEQ ID NO: 1329372 - DNA, 22 bp, Artificial Sequence
  chemically synthesized
tttttttctttcaatgtaagcc

SEQ ID NO: 1329373 - DNA, 22 bp, Artificial Sequence
  chemically synthesized
ttttttctttcaatgtaagcca

SEQ ID NO: 1329374 - DNA, 22 bp, Artificial Sequence
  chemically synthesized
tttttctttcaatgtaagccac

SEQ ID NO: 1329375 - DNA, 22 bp, Artificial Sequence
  chemically synthesized
ttttctttcaatgtaagccaca

SEQ ID NO: 1329376 - DNA, 22 bp, Artificial Sequence
  chemically synthesized
tttctttcaatgtaagccacaa

SEQ ID NO: 1329377 - DNA, 22 bp, Artificial Sequence
  chemically synthesized
ttctttcaatgtaagccacaag

SEQ ID NO: 1329378 - DNA, 22 bp, Artificial Sequence
  chemically synthesized
tctttcaatgtaagccacaagt

SEQ ID NO: 1329379 - DNA, 22 bp, Artificial Sequence
  chemically synthesized
ctttcaatgtaagccacaagtg

SEQ ID NO: 1329380 - DNA, 22 bp, Artificial Sequence
  chemically synthesized
tttcaatgtaagccacaagtgt

SEQ ID NO: 1329381 - DNA, 22 bp, Artificial Sequence
  chemically synthesized
tcaatgtaagccacaagtgtaa

SEQ ID NO: 1329382 - DNA, 22 bp, Artificial Sequence
  chemically synthesized
caatgtaagccacaagtgtaat

SEQ ID NO: 1329383 - DNA, 22 bp, Artificial Sequence
  chemically synthesized
ggagatccccccattacacttg

SEQ ID NO: 1329384 - DNA, 22 bp, Artificial Sequence
  chemically synthesized
aatgtaagccacaagtgtaatg

SEQ ID NO: 1329385 - DNA, 22 bp, Artificial Sequence
  chemically synthesized
aggagatccccccattacactt

SEQ ID NO: 1329386 - DNA, 22 bp, Artificial Sequence
  chemically synthesized
gtttaggagatccccccattac

SEQ ID NO: 1329387 - DNA, 22 bp, Artificial Sequence
  chemically synthesized
cgtttaggagatccccccatta

SEQ ID NO: 1329388 - DNA, 22 bp, Artificial Sequence
  chemically synthesized
tcgtttaggagatccccccatt

SEQ ID NO: 1329389 - DNA, 22 bp, Artificial Sequence
  chemically synthesized
ccataatgcctttcgtttagga

SEQ ID NO: 1329390 - DNA, 22 bp, Artificial Sequence
  chemically synthesized
cccctaccataatgcctttcgt

SEQ ID NO: 1329391 - DNA, 22 bp, Artificial Sequence
  chemically synthesized
ctaaacgaaaggcattatggta

SEQ ID NO: 1329392 - DNA, 22 bp, Artificial Sequence
  chemically synthesized
aacgaaaggcattatggtaggg

SEQ ID NO: 1329393 - DNA, 22 bp, Artificial Sequence
  chemically synthesized
aaaaggaacctccccctaccat

SEQ ID NO: 1329394 - DNA, 22 bp, Artificial Sequence
  chemically synthesized
gaaaaggaacctccccctacca

SEQ ID NO: 1329395 - DNA, 22 bp, Artificial Sequence
  chemically synthesized
ggcgtggtcttgaaaaggaacc

SEQ ID NO: 1329396 - DNA, 22 bp, Artificial Sequence
  chemically synthesized
tggtagggggaggttccttttc

SEQ ID NO: 1329397 - DNA, 22 bp, Artificial Sequence
  chemically synthesized
aggcgtggtcttgaaaaggaac

SEQ ID NO: 1329398 - DNA, 22 bp, Artificial Sequence
  chemically synthesized
tcagtagtttaggcgtggtctt

SEQ ID NO: 1329399 - DNA, 22 bp, Artificial Sequence
  chemically synthesized
atcagtagtttaggcgtggtct

SEQ ID NO: 1329400 - DNA, 22 bp, Artificial Sequence
  chemically synthesized
cttttcaagaccacgcctaaac

SEQ ID NO: 1329401 - DNA, 22 bp, Artificial Sequence
  chemically synthesized
ttcaagaccacgcctaaactac

SEQ ID NO: 1329402 - DNA, 22 bp, Artificial Sequence
  chemically synthesized
tcatatttatcagtagtttagg

SEQ ID NO: 1329403 - DNA, 22 bp, Artificial Sequence
  chemically synthesized
tcaagaccacgcctaaactact

SEQ ID NO: 1329404 - DNA, 22 bp, Artificial Sequence
  chemically synthesized
atcatatttatcagtagtttag

SEQ ID NO: 1329405 - DNA, 22 bp, Artificial Sequence
  chemically synthesized
caagaccacgcctaaactactg

SEQ ID NO: 1329406 - DNA, 22 bp, Artificial Sequence
  chemically synthesized
aagaccacgcctaaactactga

SEQ ID NO: 1329407 - DNA, 22 bp, Artificial Sequence
  chemically synthesized
caaccatatatttatcatattt

SEQ ID NO: 1329408 - DNA, 22 bp, Artificial Sequence
  chemically synthesized
acaaccatatatttatcatatt

SEQ ID NO: 1329409 - DNA, 22 bp, Artificial Sequence
  chemically synthesized
aactactgataaatatgataaa

SEQ ID NO: 1329410 - DNA, 22 bp, Artificial Sequence
  chemically synthesized
tacaaccatatatttatcatat

SEQ ID NO: 1329411 - DNA, 22 bp, Artificial Sequence
  chemically synthesized
ttacaaccatatatttatcata

SEQ ID NO: 1329412 - DNA, 22 bp, Artificial Sequence
  chemically synthesized
ctgataaatatgataaatatat

SEQ ID NO: 1329413 - DNA, 22 bp, Artificial Sequence
  chemically synthesized
tcttttacaaccatatatttat

SEQ ID NO: 1329414 - DNA, 22 bp, Artificial Sequence
  chemically synthesized
ataaatatgataaatatatggt

SEQ ID NO: 1329415 - DNA, 22 bp, Artificial Sequence
  chemically synthesized
gaaaaaaaaaaaaagaaatgtt

SEQ ID NO: 1329416 - DNA, 22 bp, Artificial Sequence
  chemically synthesized
taaaagacaacatttctttttt

SEQ ID NO: 1329417 - DNA, 22 bp, Artificial Sequence
  chemically synthesized
catctcgaaaaaaaaaaaaaga

SEQ ID NO: 1329418 - DNA, 22 bp, Artificial Sequence
  chemically synthesized
ctttttttttttttcgagatgg

SEQ ID NO: 1329419 - DNA, 22 bp, Artificial Sequence
  chemically synthesized
tttttttttttttcgagatgga

SEQ ID NO: 1329420 - DNA, 22 bp, Artificial Sequence
  chemically synthesized
tttttttttttcgagatggagt

SEQ ID NO: 1329421 - DNA, 22 bp, Artificial Sequence
  chemically synthesized
ttttttttttcgagatggagtc

SEQ ID NO: 1329422 - DNA, 22 bp, Artificial Sequence
  chemically synthesized
tttttttttcgagatggagtct

SEQ ID NO: 1329423 - DNA, 22 bp, Artificial Sequence
  chemically synthesized
ggccacagagcgagactccatc

SEQ ID NO: 1329424 - DNA, 22 bp, Artificial Sequence
  chemically synthesized
ttttttttcgagatggagtctc

SEQ ID NO: 1329425 - DNA, 22 bp, Artificial Sequence
  chemically synthesized
tttttttcgagatggagtctcg

SEQ ID NO: 1329426 - DNA, 22 bp, Artificial Sequence
  chemically synthesized
ttttttcgagatggagtctcgc

SEQ ID NO: 1329427 - DNA, 22 bp, Artificial Sequence
  chemically synthesized
tttttcgagatggagtctcgct

SEQ ID NO: 1329428 - DNA, 22 bp, Artificial Sequence
  chemically synthesized
ttttcgagatggagtctcgctc

SEQ ID NO: 1329429 - DNA, 22 bp, Artificial Sequence
  chemically synthesized
tttcgagatggagtctcgctct

SEQ ID NO: 1329430 - DNA, 22 bp, Artificial Sequence
  chemically synthesized
ttcgagatggagtctcgctctg

SEQ ID NO: 1329431 - DNA, 22 bp, Artificial Sequence
  chemically synthesized
cagcctgggccacagagcgaga

SEQ ID NO: 1329432 - DNA, 22 bp, Artificial Sequence
  chemically synthesized
tcgagatggagtctcgctctgt

SEQ ID NO: 1329433 - DNA, 22 bp, Artificial Sequence
  chemically synthesized
cgagatggagtctcgctctgtg

SEQ ID NO: 1329434 - DNA, 22 bp, Artificial Sequence
  chemically synthesized
gagatggagtctcgctctgtgg

SEQ ID NO: 1329435 - DNA, 22 bp, Artificial Sequence
  chemically synthesized
agctccagcctgggccacagag

SEQ ID NO: 1329436 - DNA, 22 bp, Artificial Sequence
  chemically synthesized
gctctgtggcccaggctggagc

SEQ ID NO: 1329437 - DNA, 22 bp, Artificial Sequence
  chemically synthesized
tgtggcccaggctggagctcag

SEQ ID NO: 1329438 - DNA, 22 bp, Artificial Sequence
  chemically synthesized
tggcccaggctggagctcagtg

SEQ ID NO: 1329439 - DNA, 22 bp, Artificial Sequence
  chemically synthesized
cagtgagccgagaccacgccac

SEQ ID NO: 1329440 - DNA, 22 bp, Artificial Sequence
  chemically synthesized
gcagtgagccgagaccacgcca

SEQ ID NO: 1329441 - DNA, 22 bp, Artificial Sequence
  chemically synthesized
gagctcagtggcgtggtctcgg

SEQ ID NO: 1329442 - DNA, 22 bp, Artificial Sequence
  chemically synthesized
agtggcgtggtctcggctcact

SEQ ID NO: 1329443 - DNA, 22 bp, Artificial Sequence
  chemically synthesized
ggctcactgcaagctccgcctc

SEQ ID NO: 1329444 - DNA, 22 bp, Artificial Sequence
  chemically synthesized
actgcaagctccgcctcctggg

SEQ ID NO: 1329445 - DNA, 22 bp, Artificial Sequence
  chemically synthesized
caagctccgcctcctgggttca

SEQ ID NO: 1329446 - DNA, 22 bp, Artificial Sequence
  chemically synthesized
aggcaggagaatggcgtgaacc

SEQ ID NO: 1329447 - DNA, 22 bp, Artificial Sequence
  chemically synthesized
cgcctcctgggttcacgccatt

SEQ ID NO: 1329448 - DNA, 22 bp, Artificial Sequence
  chemically synthesized
ctgggttcacgccattctcctg

SEQ ID NO: 1329449 - DNA, 22 bp, Artificial Sequence
  chemically synthesized
aggaggctgaggcaggagaatg

SEQ ID NO: 1329450 - DNA, 22 bp, Artificial Sequence
  chemically synthesized
ggttcacgccattctcctgcct

SEQ ID NO: 1329451 - DNA, 22 bp, Artificial Sequence
  chemically synthesized
ctcaggaggctgaggcaggaga

SEQ ID NO: 1329452 - DNA, 22 bp, Artificial Sequence
  chemically synthesized
acgccattctcctgcctcagcc

SEQ ID NO: 1329453 - DNA, 22 bp, Artificial Sequence
  chemically synthesized
tagtcccagctactcaggaggc

SEQ ID NO: 1329454 - DNA, 22 bp, Artificial Sequence
  chemically synthesized
tcctgcctcagcctcctgagta

SEQ ID NO: 1329455 - DNA, 22 bp, Artificial Sequence
  chemically synthesized
ctgcctcagcctcctgagtagc

SEQ ID NO: 1329456 - DNA, 22 bp, Artificial Sequence
  chemically synthesized
cctcagcctcctgagtagctgg

SEQ ID NO: 1329457 - DNA, 22 bp, Artificial Sequence
  chemically synthesized
cgggcgcctgtagtcccagcta

SEQ ID NO: 1329458 - DNA, 22 bp, Artificial Sequence
  chemically synthesized
agcctcctgagtagctgggact

SEQ ID NO: 1329459 - DNA, 22 bp, Artificial Sequence
  chemically synthesized
ctgagtagctgggactacaggc

SEQ ID NO: 1329460 - DNA, 22 bp, Artificial Sequence
  chemically synthesized
agtagctgggactacaggcgcc

SEQ ID NO: 1329461 - DNA, 22 bp, Artificial Sequence
  chemically synthesized
gccgggcgtggttgcgggcgcc

SEQ ID NO: 1329462 - DNA, 22 bp, Artificial Sequence
  chemically synthesized
ggactacaggcgcccgcaacca

SEQ ID NO: 1329463 - DNA, 22 bp, Artificial Sequence
  chemically synthesized
caggcgcccgcaaccacgcccg

SEQ ID NO: 1329464 - DNA, 22 bp, Artificial Sequence
  chemically synthesized
aaaatacaaaaaattagccggg

SEQ ID NO: 1329465 - DNA, 22 bp, Artificial Sequence
  chemically synthesized
ctaaaaatacaaaaaattagcc

SEQ ID NO: 1329466 - DNA, 22 bp, Artificial Sequence
  chemically synthesized
attttttgtatttttagtagat

SEQ ID NO: 1329467 - DNA, 22 bp, Artificial Sequence
  chemically synthesized
tttgtatttttagtagatacgg

SEQ ID NO: 1329468 - DNA, 22 bp, Artificial Sequence
  chemically synthesized
ttgtatttttagtagatacggg

SEQ ID NO: 1329469 - DNA, 22 bp, Artificial Sequence
  chemically synthesized
tgtatttttagtagatacgggg

SEQ ID NO: 1329470 - DNA, 22 bp, Artificial Sequence
  chemically synthesized
gtatttttagtagatacggggt

SEQ ID NO: 1329471 - DNA, 22 bp, Artificial Sequence
  chemically synthesized
tatttttagtagatacggggtt

SEQ ID NO: 1329472 - DNA, 22 bp, Artificial Sequence
  chemically synthesized
acacagtgatacaaaccccgta

SEQ ID NO: 1329473 - DNA, 22 bp, Artificial Sequence
  chemically synthesized
ttagtagatacggggtttgtat

SEQ ID NO: 1329474 - DNA, 22 bp, Artificial Sequence
  chemically synthesized
gctaacacagtgatacaaaccc

SEQ ID NO: 1329475 - DNA, 22 bp, Artificial Sequence
  chemically synthesized
tagtagatacggggtttgtatc

SEQ ID NO: 1329476 - DNA, 22 bp, Artificial Sequence
  chemically synthesized
agtagatacggggtttgtatca

SEQ ID NO: 1329477 - DNA, 22 bp, Artificial Sequence
  chemically synthesized
gtagatacggggtttgtatcac

SEQ ID NO: 1329478 - DNA, 22 bp, Artificial Sequence
  chemically synthesized
gtatcactgtgttagccaggat

SEQ ID NO: 1329479 - DNA, 22 bp, Artificial Sequence
  chemically synthesized
tatcactgtgttagccaggatg

SEQ ID NO: 1329480 - DNA, 22 bp, Artificial Sequence
  chemically synthesized
tgttagccaggatggtctcgat

SEQ ID NO: 1329481 - DNA, 22 bp, Artificial Sequence
  chemically synthesized
gccaggatggtctcgatctcct

SEQ ID NO: 1329482 - DNA, 22 bp, Artificial Sequence
  chemically synthesized
ggaggccggcggatcacgaggt

SEQ ID NO: 1329483 - DNA, 22 bp, Artificial Sequence
  chemically synthesized
gggaggccggcggatcacgagg

SEQ ID NO: 1329484 - DNA, 22 bp, Artificial Sequence
  chemically synthesized
tgggaggccggcggatcacgag

SEQ ID NO: 1329485 - DNA, 22 bp, Artificial Sequence
  chemically synthesized
gatctcctgacctcgtgatccg

SEQ ID NO: 1329486 - DNA, 22 bp, Artificial Sequence
  chemically synthesized
ctgacctcgtgatccgccggcc

SEQ ID NO: 1329487 - DNA, 22 bp, Artificial Sequence
  chemically synthesized
acctcgtgatccgccggcctcc

SEQ ID NO: 1329488 - DNA, 22 bp, Artificial Sequence
  chemically synthesized
taatcccagcactttgggaggc

SEQ ID NO: 1329489 - DNA, 22 bp, Artificial Sequence
  chemically synthesized
gtgatccgccggcctcccaaag

SEQ ID NO: 1329490 - DNA, 22 bp, Artificial Sequence
  chemically synthesized
acgcctgtaatcccagcacttt

SEQ ID NO: 1329491 - DNA, 22 bp, Artificial Sequence
  chemically synthesized
ccaaagtgctgggattacaggc

SEQ ID NO: 1329492 - DNA, 22 bp, Artificial Sequence
  chemically synthesized
gccgggcgcagtggctcacgcc

SEQ ID NO: 1329493 - DNA, 22 bp, Artificial Sequence
  chemically synthesized
ggccgggcgcagtggctcacgc

SEQ ID NO: 1329494 - DNA, 22 bp, Artificial Sequence
  chemically synthesized
tggccgggcgcagtggctcacg

SEQ ID NO: 1329495 - DNA, 22 bp, Artificial Sequence
  chemically synthesized
ttggccgggcgcagtggctcac

SEQ ID NO: 1329496 - DNA, 22 bp, Artificial Sequence
  chemically synthesized
ggattacaggcgtgagccactg

SEQ ID NO: 1329497 - DNA, 22 bp, Artificial Sequence
  chemically synthesized
ttttggccgggcgcagtggctc

SEQ ID NO: 1329498 - DNA, 22 bp, Artificial Sequence
  chemically synthesized
cttttggccgggcgcagtggct

SEQ ID NO: 1329499 - DNA, 22 bp, Artificial Sequence
  chemically synthesized
tcttttggccgggcgcagtggc

SEQ ID NO: 1329500 - DNA, 22 bp, Artificial Sequence
  chemically synthesized
caggcgtgagccactgcgcccg

SEQ ID NO: 1329501 - DNA, 22 bp, Artificial Sequence
  chemically synthesized
atagaaacgttttcttttggcc

SEQ ID NO: 1329502 - DNA, 22 bp, Artificial Sequence
  chemically synthesized
tgttcatagaaacgttttcttt

SEQ ID NO: 1329503 - DNA, 22 bp, Artificial Sequence
  chemically synthesized
cgcccggccaaaagaaaacgtt

SEQ ID NO: 1329504 - DNA, 22 bp, Artificial Sequence
  chemically synthesized
tataagtaatactgtgttcata

SEQ ID NO: 1329505 - DNA, 22 bp, Artificial Sequence
  chemically synthesized
aatattgtataagtaatactgt

SEQ ID NO: 1329506 - DNA, 22 bp, Artificial Sequence
  chemically synthesized
aaatattgtataagtaatactg

SEQ ID NO: 1329507 - DNA, 22 bp, Artificial Sequence
  chemically synthesized
taaatattgtataagtaatact

SEQ ID NO: 1329508 - DNA, 22 bp, Artificial Sequence
  chemically synthesized
ttaaatattgtataagtaatac

SEQ ID NO: 1329509 - DNA, 22 bp, Artificial Sequence
  chemically synthesized
ctatgaacacagtattacttat

SEQ ID NO: 1329510 - DNA, 22 bp, Artificial Sequence
  chemically synthesized
tatgaacacagtattacttata

SEQ ID NO: 1329511 - DNA, 22 bp, Artificial Sequence
  chemically synthesized
tgaacacagtattacttataca

SEQ ID NO: 1329512 - DNA, 22 bp, Artificial Sequence
  chemically synthesized
cttatacaatatttaaaaacat

SEQ ID NO: 1329513 - DNA, 22 bp, Artificial Sequence
  chemically synthesized
agcatcaaataatatgttttta

SEQ ID NO: 1329514 - DNA, 22 bp, Artificial Sequence
  chemically synthesized
atacaatatttaaaaacatatt

SEQ ID NO: 1329515 - DNA, 22 bp, Artificial Sequence
  chemically synthesized
tacaatatttaaaaacatatta

SEQ ID NO: 1329516 - DNA, 22 bp, Artificial Sequence
  chemically synthesized
taaaacattgagcatcaaataa

SEQ ID NO: 1329517 - DNA, 22 bp, Artificial Sequence
  chemically synthesized
ataaaacattgagcatcaaata

SEQ ID NO: 1329518 - DNA, 22 bp, Artificial Sequence
  chemically synthesized
aaaaacatattatttgatgctc

SEQ ID NO: 1329519 - DNA, 22 bp, Artificial Sequence
  chemically synthesized
aaaacatattatttgatgctca

SEQ ID NO: 1329520 - DNA, 22 bp, Artificial Sequence
  chemically synthesized
tttataaaacattgagcatcaa

SEQ ID NO: 1329521 - DNA, 22 bp, Artificial Sequence
  chemically synthesized
aatcattgtttataaaacattg

SEQ ID NO: 1329522 - DNA, 22 bp, Artificial Sequence
  chemically synthesized
gaatcattgtttataaaacatt

SEQ ID NO: 1329523 - DNA, 22 bp, Artificial Sequence
  chemically synthesized
tgaatcattgtttataaaacat

SEQ ID NO: 1329524 - DNA, 22 bp, Artificial Sequence
  chemically synthesized
tttgatgctcaatgttttataa

SEQ ID NO: 1329525 - DNA, 22 bp, Artificial Sequence
  chemically synthesized
ttgaatcattgtttataaaaca

SEQ ID NO: 1329526 - DNA, 22 bp, Artificial Sequence
  chemically synthesized
gatgctcaatgttttataaaca

SEQ ID NO: 1329527 - DNA, 22 bp, Artificial Sequence
  chemically synthesized
atgctcaatgttttataaacaa

SEQ ID NO: 1329528 - DNA, 22 bp, Artificial Sequence
  chemically synthesized
catttttgaatcattgtttata

SEQ ID NO: 1329529 - DNA, 22 bp, Artificial Sequence
  chemically synthesized
tgcatttttgaatcattgttta

SEQ ID NO: 1329530 - DNA, 22 bp, Artificial Sequence
  chemically synthesized
aatgttttataaacaatgattc

SEQ ID NO: 1329531 - DNA, 22 bp, Artificial Sequence
  chemically synthesized
acccagctctgcatttttgaat

SEQ ID NO: 1329532 - DNA, 22 bp, Artificial Sequence
  chemically synthesized
tataaacaatgattcaaaaatg

SEQ ID NO: 1329533 - DNA, 22 bp, Artificial Sequence
  chemically synthesized
ataaacaatgattcaaaaatgc

SEQ ID NO: 1329534 - DNA, 22 bp, Artificial Sequence
  chemically synthesized
taaacaatgattcaaaaatgca

SEQ ID NO: 1329535 - DNA, 22 bp, Artificial Sequence
  chemically synthesized
aaaaatgcagagctgggtgagc

SEQ ID NO: 1329536 - DNA, 22 bp, Artificial Sequence
  chemically synthesized
caggcatgagccgccgtgctca

SEQ ID NO: 1329537 - DNA, 22 bp, Artificial Sequence
  chemically synthesized
ggattacaggcatgagccgccg

SEQ ID NO: 1329538 - DNA, 22 bp, Artificial Sequence
  chemically synthesized
ggtgagcacggcggctcatgcc

SEQ ID NO: 1329539 - DNA, 22 bp, Artificial Sequence
  chemically synthesized
ccaaagtgctgggattacaggc

SEQ ID NO: 1329540 - DNA, 22 bp, Artificial Sequence
  chemically synthesized
ggcctcccaaagtgctgggatt

SEQ ID NO: 1329541 - DNA, 22 bp, Artificial Sequence
  chemically synthesized
atgcctgtaatcccagcacttt

SEQ ID NO: 1329542 - DNA, 22 bp, Artificial Sequence
  chemically synthesized
tcctcggcctcccaaagtgctg

SEQ ID NO: 1329543 - DNA, 22 bp, Artificial Sequence
  chemically synthesized
tgtcctcggcctcccaaagtgc

SEQ ID NO: 1329544 - DNA, 22 bp, Artificial Sequence
  chemically synthesized
taatcccagcactttgggaggc

SEQ ID NO: 1329545 - DNA, 22 bp, Artificial Sequence
  chemically synthesized
aggtgatcctctgtcctcggcc

SEQ ID NO: 1329546 - DNA, 22 bp, Artificial Sequence
  chemically synthesized
acctcaggtgatcctctgtcct

SEQ ID NO: 1329547 - DNA, 22 bp, Artificial Sequence
  chemically synthesized
tgggaggccgaggacagaggat

SEQ ID NO: 1329548 - DNA, 22 bp, Artificial Sequence
  chemically synthesized
gggaggccgaggacagaggatc

SEQ ID NO: 1329549 - DNA, 22 bp, Artificial Sequence
  chemically synthesized
ctgacctcaggtgatcctctgt

SEQ ID NO: 1329550 - DNA, 22 bp, Artificial Sequence
  chemically synthesized
ggaggccgaggacagaggatca

SEQ ID NO: 1329551 - DNA, 22 bp, Artificial Sequence
  chemically synthesized
gaactgctgacctcaggtgatc

SEQ ID NO: 1329552 - DNA, 22 bp, Artificial Sequence
  chemically synthesized
gtctcgaactgctgacctcagg

SEQ ID NO: 1329553 - DNA, 22 bp, Artificial Sequence
  chemically synthesized
aggtcagcagttcgagaccagc

SEQ ID NO: 1329554 - DNA, 22 bp, Artificial Sequence
  chemically synthesized
accatgtgggccaggctggtct

SEQ ID NO: 1329555 - DNA, 22 bp, Artificial Sequence
  chemically synthesized
caccatgtgggccaggctggtc

SEQ ID NO: 1329556 - DNA, 22 bp, Artificial Sequence
  chemically synthesized
gagaccagcctggcccacatgg

SEQ ID NO: 1329557 - DNA, 22 bp, Artificial Sequence
  chemically synthesized
gtagagatgggtttcaccatgt

SEQ ID NO: 1329558 - DNA, 22 bp, Artificial Sequence
  chemically synthesized
agtagagatgggtttcaccatg

SEQ ID NO: 1329559 - DNA, 22 bp, Artificial Sequence
  chemically synthesized
tagtagagatgggtttcaccat

SEQ ID NO: 1329560 - DNA, 22 bp, Artificial Sequence
  chemically synthesized
ttagtagagatgggtttcacca

SEQ ID NO: 1329561 - DNA, 22 bp, Artificial Sequence
  chemically synthesized
gcccacatggtgaaacccatct

SEQ ID NO: 1329562 - DNA, 22 bp, Artificial Sequence
  chemically synthesized
tatttttagtagagatgggttt

SEQ ID NO: 1329563 - DNA, 22 bp, Artificial Sequence
  chemically synthesized
gtatttttagtagagatgggtt

SEQ ID NO: 1329564 - DNA, 22 bp, Artificial Sequence
  chemically synthesized
tgtatttttagtagagatgggt

SEQ ID NO: 1329565 - DNA, 22 bp, Artificial Sequence
  chemically synthesized
ttgtatttttagtagagatggg

SEQ ID NO: 1329566 - DNA, 22 bp, Artificial Sequence
  chemically synthesized
gccaatttttgtatttttagta

SEQ ID NO: 1329567 - DNA, 22 bp, Artificial Sequence
  chemically synthesized
tactaaaaatacaaaaattggc

SEQ ID NO: 1329568 - DNA, 22 bp, Artificial Sequence
  chemically synthesized
ctaaaaatacaaaaattggcca

SEQ ID NO: 1329569 - DNA, 22 bp, Artificial Sequence
  chemically synthesized
aaaatacaaaaattggccaggc

SEQ ID NO: 1329570 - DNA, 22 bp, Artificial Sequence
  chemically synthesized
gtgcacgccaccatgcctggcc

SEQ ID NO: 1329571 - DNA, 22 bp, Artificial Sequence
  chemically synthesized
ctggtgcacgccaccatgcctg

SEQ ID NO: 1329572 - DNA, 22 bp, Artificial Sequence
  chemically synthesized
gccaggcatggtggcgtgcacc

SEQ ID NO: 1329573 - DNA, 22 bp, Artificial Sequence
  chemically synthesized
ccgaatagcagggattactggt

SEQ ID NO: 1329574 - DNA, 22 bp, Artificial Sequence
  chemically synthesized
agcctcccgaatagcagggatt

SEQ ID NO: 1329575 - DNA, 22 bp, Artificial Sequence
  chemically synthesized
cctcagcctcccgaatagcagg

SEQ ID NO: 1329576 - DNA, 22 bp, Artificial Sequence
  chemically synthesized
tgcctcagcctcccgaatagca

SEQ ID NO: 1329577 - DNA, 22 bp, Artificial Sequence
  chemically synthesized
ctgcctcagcctcccgaatagc

SEQ ID NO: 1329578 - DNA, 22 bp, Artificial Sequence
  chemically synthesized
tctgcctcagcctcccgaatag

SEQ ID NO: 1329579 - DNA, 22 bp, Artificial Sequence
  chemically synthesized
ttctgcctcagcctcccgaata

SEQ ID NO: 1329580 - DNA, 22 bp, Artificial Sequence
  chemically synthesized
aagcgatttttctgcctcagcc

SEQ ID NO: 1329581 - DNA, 22 bp, Artificial Sequence
  chemically synthesized
ctattcgggaggctgaggcaga

SEQ ID NO: 1329582 - DNA, 22 bp, Artificial Sequence
  chemically synthesized
ttcgggaggctgaggcagaaaa

SEQ ID NO: 1329583 - DNA, 22 bp, Artificial Sequence
  chemically synthesized
ggttcaagcgatttttctgcct

SEQ ID NO: 1329584 - DNA, 22 bp, Artificial Sequence
  chemically synthesized
gggaggctgaggcagaaaaatc

SEQ ID NO: 1329585 - DNA, 22 bp, Artificial Sequence
  chemically synthesized
ctgggttcaagcgatttttctg

SEQ ID NO: 1329586 - DNA, 22 bp, Artificial Sequence
  chemically synthesized
cctcctgggttcaagcgatttt

SEQ ID NO: 1329587 - DNA, 22 bp, Artificial Sequence
  chemically synthesized
tgcctcctgggttcaagcgatt

SEQ ID NO: 1329588 - DNA, 22 bp, Artificial Sequence
  chemically synthesized
aggcagaaaaatcgcttgaacc

SEQ ID NO: 1329589 - DNA, 22 bp, Artificial Sequence
  chemically synthesized
caacctctgcctcctgggttca

SEQ ID NO: 1329590 - DNA, 22 bp, Artificial Sequence
  chemically synthesized
actgcaacctctgcctcctggg

SEQ ID NO: 1329591 - DNA, 22 bp, Artificial Sequence
  chemically synthesized
ggctcactgcaacctctgcctc

SEQ ID NO: 1329592 - DNA, 22 bp, Artificial Sequence
  chemically synthesized
gaacccaggaggcagaggttgc

SEQ ID NO: 1329593 - DNA, 22 bp, Artificial Sequence
  chemically synthesized
aacccaggaggcagaggttgca

SEQ ID NO: 1329594 - DNA, 22 bp, Artificial Sequence
  chemically synthesized
cagtgcagtggcaccatctcgg

SEQ ID NO: 1329595 - DNA, 22 bp, Artificial Sequence
  chemically synthesized
cagtgagccgagatggtgccac

SEQ ID NO: 1329596 - DNA, 22 bp, Artificial Sequence
  chemically synthesized
gcaggctgcagtgcagtggcac

SEQ ID NO: 1329597 - DNA, 22 bp, Artificial Sequence
  chemically synthesized
tctcgcaggctgcagtgcagtg

SEQ ID NO: 1329598 - DNA, 22 bp, Artificial Sequence
  chemically synthesized
tgtctcgcaggctgcagtgcag

SEQ ID NO: 1329599 - DNA, 22 bp, Artificial Sequence
  chemically synthesized
actctgtctcgcaggctgcagt

SEQ ID NO: 1329600 - DNA, 22 bp, Artificial Sequence
  chemically synthesized
cactctgtctcgcaggctgcag

SEQ ID NO: 1329601 - DNA, 22 bp, Artificial Sequence
  chemically synthesized
ggtttcactctgtctcgcaggc

SEQ ID NO: 1329602 - DNA, 22 bp, Artificial Sequence
  chemically synthesized
cactgcagcctgcgagacagag

SEQ ID NO: 1329603 - DNA, 22 bp, Artificial Sequence
  chemically synthesized
agactgggtttcactctgtctc

SEQ ID NO: 1329604 - DNA, 22 bp, Artificial Sequence
  chemically synthesized
gagactgggtttcactctgtct

SEQ ID NO: 1329605 - DNA, 22 bp, Artificial Sequence
  chemically synthesized
tgagactgggtttcactctgtc

SEQ ID NO: 1329606 - DNA, 22 bp, Artificial Sequence
  chemically synthesized
ttgagactgggtttcactctgt

SEQ ID NO: 1329607 - DNA, 22 bp, Artificial Sequence
  chemically synthesized
cagcctgcgagacagagtgaaa

SEQ ID NO: 1329608 - DNA, 22 bp, Artificial Sequence
  chemically synthesized
tttgagactgggtttcactctg

SEQ ID NO: 1329609 - DNA, 22 bp, Artificial Sequence
  chemically synthesized
ttttgagactgggtttcactct

SEQ ID NO: 1329610 - DNA, 22 bp, Artificial Sequence
  chemically synthesized
gtttttttgagactgggtttca

SEQ ID NO: 1329611 - DNA, 22 bp, Artificial Sequence
  chemically synthesized
ggtttttttgagactgggtttc

SEQ ID NO: 1329612 - DNA, 22 bp, Artificial Sequence
  chemically synthesized
cgagacagagtgaaacccagtc

SEQ ID NO: 1329613 - DNA, 22 bp, Artificial Sequence
  chemically synthesized
tggtttttttgagactgggttt

SEQ ID NO: 1329614 - DNA, 22 bp, Artificial Sequence
  chemically synthesized
ttttggtttttttgagactggg

SEQ ID NO: 1329615 - DNA, 22 bp, Artificial Sequence
  chemically synthesized
tcgttgttttggtttttttgag

SEQ ID NO: 1329616 - DNA, 22 bp, Artificial Sequence
  chemically synthesized
gtcgttgttttggtttttttga

SEQ ID NO: 1329617 - DNA, 22 bp, Artificial Sequence
  chemically synthesized
tgtcgttgttttggtttttttg

SEQ ID NO: 1329618 - DNA, 22 bp, Artificial Sequence
  chemically synthesized
ttgtcgttgttttggttttttt

SEQ ID NO: 1329619 - DNA, 22 bp, Artificial Sequence
  chemically synthesized
tttgtcgttgttttggtttttt

SEQ ID NO: 1329620 - DNA, 22 bp, Artificial Sequence
  chemically synthesized
tggttttttgtcgttgttttgg

SEQ ID NO: 1329621 - DNA, 22 bp, Artificial Sequence
  chemically synthesized
aaaaaaaccaaaacaacgacaa

SEQ ID NO: 1329622 - DNA, 22 bp, Artificial Sequence
  chemically synthesized
tgcccggccagccctgtggttt

SEQ ID NO: 1329623 - DNA, 22 bp, Artificial Sequence
  chemically synthesized
caggtgtgagccactgtgcccg

SEQ ID NO: 1329624 - DNA, 22 bp, Artificial Sequence
  chemically synthesized
ggattacaggtgtgagccactg

SEQ ID NO: 1329625 - DNA, 22 bp, Artificial Sequence
  chemically synthesized
gccgggcacagtggctcacacc

SEQ ID NO: 1329626 - DNA, 22 bp, Artificial Sequence
  chemically synthesized
ccaaagtgctgggattacaggt

SEQ ID NO: 1329627 - DNA, 22 bp, Artificial Sequence
  chemically synthesized
cccaaagtgctgggattacagg

SEQ ID NO: 1329628 - DNA, 22 bp, Artificial Sequence
  chemically synthesized
agcttcccaaagtgctgggatt

SEQ ID NO: 1329629 - DNA, 22 bp, Artificial Sequence
  chemically synthesized
acacctgtaatcccagcacttt

SEQ ID NO: 1329630 - DNA, 22 bp, Artificial Sequence
  chemically synthesized
cctcagcttcccaaagtgctgg

SEQ ID NO: 1329631 - DNA, 22 bp, Artificial Sequence
  chemically synthesized
taatcccagcactttgggaagc

SEQ ID NO: 1329632 - DNA, 22 bp, Artificial Sequence
  chemically synthesized
aggtgacccacctgcctcagct

SEQ ID NO: 1329633 - DNA, 22 bp, Artificial Sequence
  chemically synthesized
tgggaagctgaggcaggtgggt

SEQ ID NO: 1329634 - DNA, 22 bp, Artificial Sequence
  chemically synthesized
gggaagctgaggcaggtgggtc

SEQ ID NO: 1329635 - DNA, 22 bp, Artificial Sequence
  chemically synthesized
ccgagctcaggtgacccacctg

SEQ ID NO: 1329636 - DNA, 22 bp, Artificial Sequence
  chemically synthesized
ggaagctgaggcaggtgggtca

SEQ ID NO: 1329637 - DNA, 22 bp, Artificial Sequence
  chemically synthesized
aaactcccgagctcaggtgacc

SEQ ID NO: 1329638 - DNA, 22 bp, Artificial Sequence
  chemically synthesized
aggcaggtgggtcacctgagct

SEQ ID NO: 1329639 - DNA, 22 bp, Artificial Sequence
  chemically synthesized
atctcaaactcccgagctcagg

SEQ ID NO: 1329640 - DNA, 22 bp, Artificial Sequence
  chemically synthesized
aggctgatctcaaactcccgag

SEQ ID NO: 1329641 - DNA, 22 bp, Artificial Sequence
  chemically synthesized
tcactcaggctgatctcaaact

SEQ ID NO: 1329642 - DNA, 22 bp, Artificial Sequence
  chemically synthesized
atcactcaggctgatctcaaac

SEQ ID NO: 1329643 - DNA, 22 bp, Artificial Sequence
  chemically synthesized
agctcgggagtttgagatcagc

SEQ ID NO: 1329644 - DNA, 22 bp, Artificial Sequence
  chemically synthesized
ccttatcactcaggctgatctc

SEQ ID NO: 1329645 - DNA, 22 bp, Artificial Sequence
  chemically synthesized
gccttatcactcaggctgatct

SEQ ID NO: 1329646 - DNA, 22 bp, Artificial Sequence
  chemically synthesized
tgccttatcactcaggctgatc

SEQ ID NO: 1329647 - DNA, 22 bp, Artificial Sequence
  chemically synthesized
gggagtttgagatcagcctgag

SEQ ID NO: 1329648 - DNA, 22 bp, Artificial Sequence
  chemically synthesized
gagatcagcctgagtgataagg

SEQ ID NO: 1329649 - DNA, 22 bp, Artificial Sequence
  chemically synthesized
agatcagcctgagtgataaggc

SEQ ID NO: 1329650 - DNA, 22 bp, Artificial Sequence
  chemically synthesized
tagagatggggttttgccttat

SEQ ID NO: 1329651 - DNA, 22 bp, Artificial Sequence
  chemically synthesized
gtagagatggggttttgcctta

SEQ ID NO: 1329652 - DNA, 22 bp, Artificial Sequence
  chemically synthesized
tgtagagatggggttttgcctt

SEQ ID NO: 1329653 - DNA, 22 bp, Artificial Sequence
  chemically synthesized
ttgtagagatggggttttgcct

SEQ ID NO: 1329654 - DNA, 22 bp, Artificial Sequence
  chemically synthesized
tttgtagagatggggttttgcc

SEQ ID NO: 1329655 - DNA, 22 bp, Artificial Sequence
  chemically synthesized
agtgataaggcaaaaccccatc

SEQ ID NO: 1329656 - DNA, 22 bp, Artificial Sequence
  chemically synthesized
gtactttttgtagagatggggt

SEQ ID NO: 1329657 - DNA, 22 bp, Artificial Sequence
  chemically synthesized
cgtactttttgtagagatgggg

SEQ ID NO: 1329658 - DNA, 22 bp, Artificial Sequence
  chemically synthesized
tcgtactttttgtagagatggg

SEQ ID NO: 1329659 - DNA, 22 bp, Artificial Sequence
  chemically synthesized
attttcgtactttttgtagaga

SEQ ID NO: 1329660 - DNA, 22 bp, Artificial Sequence
  chemically synthesized
caccacacccagctaattttcg

SEQ ID NO: 1329661 - DNA, 22 bp, Artificial Sequence
  chemically synthesized
tacaaaaagtacgaaaattagc

SEQ ID NO: 1329662 - DNA, 22 bp, Artificial Sequence
  chemically synthesized
caaaaagtacgaaaattagctg

SEQ ID NO: 1329663 - DNA, 22 bp, Artificial Sequence
  chemically synthesized
ccagcgctccaccacacccagc

SEQ ID NO: 1329664 - DNA, 22 bp, Artificial Sequence
  chemically synthesized
ggactaccagcgctccaccaca

SEQ ID NO: 1329665 - DNA, 22 bp, Artificial Sequence
  chemically synthesized
gctgggtgtggtggagcgctgg

SEQ ID NO: 1329666 - DNA, 22 bp, Artificial Sequence
  chemically synthesized
ggtgtggtggagcgctggtagt

SEQ ID NO: 1329667 - DNA, 22 bp, Artificial Sequence
  chemically synthesized
ccgagtagctgggactaccagc

SEQ ID NO: 1329668 - DNA, 22 bp, Artificial Sequence
  chemically synthesized
agcctcccgagtagctgggact

SEQ ID NO: 1329669 - DNA, 22 bp, Artificial Sequence
  chemically synthesized
ccacctcagcctcccgagtagc

SEQ ID NO: 1329670 - DNA, 22 bp, Artificial Sequence
  chemically synthesized
gtagtcccagctactcgggagg

SEQ ID NO: 1329671 - DNA, 22 bp, Artificial Sequence
  chemically synthesized
aagtgatcctcccacctcagcc

SEQ ID NO: 1329672 - DNA, 22 bp, Artificial Sequence
  chemically synthesized
ctcgggaggctgaggtgggagg

SEQ ID NO: 1329673 - DNA, 22 bp, Artificial Sequence
  chemically synthesized
agttcaagtgatcctcccacct

SEQ ID NO: 1329674 - DNA, 22 bp, Artificial Sequence
  chemically synthesized
gggaggctgaggtgggaggatc

SEQ ID NO: 1329675 - DNA, 22 bp, Artificial Sequence
  chemically synthesized
ctgagttcaagtgatcctccca

SEQ ID NO: 1329676 - DNA, 22 bp, Artificial Sequence
  chemically synthesized
acctcctgagttcaagtgatcc

SEQ ID NO: 1329677 - DNA, 22 bp, Artificial Sequence
  chemically synthesized
gacctcctgagttcaagtgatc

SEQ ID NO: 1329678 - DNA, 22 bp, Artificial Sequence
  chemically synthesized
aggtgggaggatcacttgaact

SEQ ID NO: 1329679 - DNA, 22 bp, Artificial Sequence
  chemically synthesized
aacccttgacctcctgagttca

SEQ ID NO: 1329680 - DNA, 22 bp, Artificial Sequence
  chemically synthesized
actgaacccttgacctcctgag

SEQ ID NO: 1329681 - DNA, 22 bp, Artificial Sequence
  chemically synthesized
gaactcaggaggtcaagggttc

SEQ ID NO: 1329682 - DNA, 22 bp, Artificial Sequence
  chemically synthesized
aactcaggaggtcaagggttca

SEQ ID NO: 1329683 - DNA, 22 bp, Artificial Sequence
  chemically synthesized
aggaggtcaagggttcagtcag

SEQ ID NO: 1329684 - DNA, 22 bp, Artificial Sequence
  chemically synthesized
agtcagccatgatcgaccactg

SEQ ID NO: 1329685 - DNA, 22 bp, Artificial Sequence
  chemically synthesized
tcatccaggatggagtgcagtg

SEQ ID NO: 1329686 - DNA, 22 bp, Artificial Sequence
  chemically synthesized
tgtcatccaggatggagtgcag

SEQ ID NO: 1329687 - DNA, 22 bp, Artificial Sequence
  chemically synthesized
tctgtcatccaggatggagtgc

SEQ ID NO: 1329688 - DNA, 22 bp, Artificial Sequence
  chemically synthesized
ctctgtcatccaggatggagtg

SEQ ID NO: 1329689 - DNA, 22 bp, Artificial Sequence
  chemically synthesized
tctctgtcatccaggatggagt

SEQ ID NO: 1329690 - DNA, 22 bp, Artificial Sequence
  chemically synthesized
ttctctgtcatccaggatggag

SEQ ID NO: 1329691 - DNA, 22 bp, Artificial Sequence
  chemically synthesized
tttctctgtcatccaggatgga

SEQ ID NO: 1329692 - DNA, 22 bp, Artificial Sequence
  chemically synthesized
ttttctctgtcatccaggatgg

SEQ ID NO: 1329693 - DNA, 22 bp, Artificial Sequence
  chemically synthesized
tttttctctgtcatccaggatg

SEQ ID NO: 1329694 - DNA, 22 bp, Artificial Sequence
  chemically synthesized
cattttttttctctgtcatcca

SEQ ID NO: 1329695 - DNA, 22 bp, Artificial Sequence
  chemically synthesized
cactccatcctggatgacagag

SEQ ID NO: 1329696 - DNA, 22 bp, Artificial Sequence
  chemically synthesized
tgcattttttttctctgtcatc

SEQ ID NO: 1329697 - DNA, 22 bp, Artificial Sequence
  chemically synthesized
catcctggatgacagagaaaaa

SEQ ID NO: 1329698 - DNA, 22 bp, Artificial Sequence
  chemically synthesized
agtagctctgcattttttttct

SEQ ID NO: 1329699 - DNA, 22 bp, Artificial Sequence
  chemically synthesized
gatgacagagaaaaaaaatgca

SEQ ID NO: 1329700 - DNA, 22 bp, Artificial Sequence
  chemically synthesized
taaatacctcagtagctctgca

SEQ ID NO: 1329701 - DNA, 22 bp, Artificial Sequence
  chemically synthesized
gtaaatacctcagtagctctgc

SEQ ID NO: 1329702 - DNA, 22 bp, Artificial Sequence
  chemically synthesized
tgtaaatacctcagtagctctg

SEQ ID NO: 1329703 - DNA, 22 bp, Artificial Sequence
  chemically synthesized
tttgtaaatacctcagtagctc

SEQ ID NO: 1329704 - DNA, 22 bp, Artificial Sequence
  chemically synthesized
ctttgtaaatacctcagtagct

SEQ ID NO: 1329705 - DNA, 22 bp, Artificial Sequence
  chemically synthesized
tatttctttgtaaatacctcag

SEQ ID NO: 1329706 - DNA, 22 bp, Artificial Sequence
  chemically synthesized
atatttctttgtaaatacctca

SEQ ID NO: 1329707 - DNA, 22 bp, Artificial Sequence
  chemically synthesized
tatatttctttgtaaatacctc

SEQ ID NO: 1329708 - DNA, 22 bp, Artificial Sequence
  chemically synthesized
tgctttatatttctttgtaaat

SEQ ID NO: 1329709 - DNA, 22 bp, Artificial Sequence
  chemically synthesized
ctgaggtatttacaaagaaata

SEQ ID NO: 1329710 - DNA, 22 bp, Artificial Sequence
  chemically synthesized
aggtatttacaaagaaatataa

SEQ ID NO: 1329711 - DNA, 22 bp, Artificial Sequence
  chemically synthesized
agagcacgtgctgtgctttata

SEQ ID NO: 1329712 - DNA, 22 bp, Artificial Sequence
  chemically synthesized
acaaagaaatataaagcacagc

SEQ ID NO: 1329713 - DNA, 22 bp, Artificial Sequence
  chemically synthesized
ctgagagcacgtgctgtgcttt

SEQ ID NO: 1329714 - DNA, 22 bp, Artificial Sequence
  chemically synthesized
caaagaaatataaagcacagca

SEQ ID NO: 1329715 - DNA, 22 bp, Artificial Sequence
  chemically synthesized
cctgagagcacgtgctgtgctt

SEQ ID NO: 1329716 - DNA, 22 bp, Artificial Sequence
  chemically synthesized
tagatttcctgagagcacgtgc

SEQ ID NO: 1329717 - DNA, 22 bp, Artificial Sequence
  chemically synthesized
atagatttcctgagagcacgtg

SEQ ID NO: 1329718 - DNA, 22 bp, Artificial Sequence
  chemically synthesized
tatagatttcctgagagcacgt

SEQ ID NO: 1329719 - DNA, 22 bp, Artificial Sequence
  chemically synthesized
ttatagatttcctgagagcacg

SEQ ID NO: 1329720 - DNA, 22 bp, Artificial Sequence
  chemically synthesized
tttatagatttcctgagagcac

SEQ ID NO: 1329721 - DNA, 22 bp, Artificial Sequence
  chemically synthesized
ttttatagatttcctgagagca

SEQ ID NO: 1329722 - DNA, 22 bp, Artificial Sequence
  chemically synthesized
acttttttatagatttcctgag

SEQ ID NO: 1329723 - DNA, 22 bp, Artificial Sequence
  chemically synthesized
aacttttttatagatttcctga

SEQ ID NO: 1329724 - DNA, 22 bp, Artificial Sequence
  chemically synthesized
taacttttttatagatttcctg

SEQ ID NO: 1329725 - DNA, 22 bp, Artificial Sequence
  chemically synthesized
ttaacttttttatagatttcct

SEQ ID NO: 1329726 - DNA, 22 bp, Artificial Sequence
  chemically synthesized
tttaacttttttatagatttcc

SEQ ID NO: 1329727 - DNA, 22 bp, Artificial Sequence
  chemically synthesized
cataactttttaacttttttat

SEQ ID NO: 1329728 - DNA, 22 bp, Artificial Sequence
  chemically synthesized
tcaggaaatctataaaaaagtt

SEQ ID NO: 1329729 - DNA, 22 bp, Artificial Sequence
  chemically synthesized
aggaaatctataaaaaagttaa

SEQ ID NO: 1329730 - DNA, 22 bp, Artificial Sequence
  chemically synthesized
attccataactttttaactttt

SEQ ID NO: 1329731 - DNA, 22 bp, Artificial Sequence
  chemically synthesized
gattccataactttttaacttt

SEQ ID NO: 1329732 - DNA, 22 bp, Artificial Sequence
  chemically synthesized
tgattccataactttttaactt

SEQ ID NO: 1329733 - DNA, 22 bp, Artificial Sequence
  chemically synthesized
actttgattccataacttttta

SEQ ID NO: 1329734 - DNA, 22 bp, Artificial Sequence
  chemically synthesized
taaaaaagttaaaaagttatgg

SEQ ID NO: 1329735 - DNA, 22 bp, Artificial Sequence
  chemically synthesized
tggattaactttgattccataa

SEQ ID NO: 1329736 - DNA, 22 bp, Artificial Sequence
  chemically synthesized
ctgtggattaactttgattcca

SEQ ID NO: 1329737 - DNA, 22 bp, Artificial Sequence
  chemically synthesized
cctgtggattaactttgattcc

SEQ ID NO: 1329738 - DNA, 22 bp, Artificial Sequence
  chemically synthesized
aaaagttatggaatcaaagtta

SEQ ID NO: 1329739 - DNA, 22 bp, Artificial Sequence
  chemically synthesized
tttcctgtggattaactttgat

SEQ ID NO: 1329740 - DNA, 22 bp, Artificial Sequence
  chemically synthesized
attatttcctgtggattaactt

SEQ ID NO: 1329741 - DNA, 22 bp, Artificial Sequence
  chemically synthesized
ctaattatttcctgtggattaa

SEQ ID NO: 1329742 - DNA, 22 bp, Artificial Sequence
  chemically synthesized
tggaatcaaagttaatccacag

SEQ ID NO: 1329743 - DNA, 22 bp, Artificial Sequence
  chemically synthesized
gctaattatttcctgtggatta

SEQ ID NO: 1329744 - DNA, 22 bp, Artificial Sequence
  chemically synthesized
cttgctaattatttcctgtgga

SEQ ID NO: 1329745 - DNA, 22 bp, Artificial Sequence
  chemically synthesized
atccacaggaaataattagcaa

SEQ ID NO: 1329746 - DNA, 22 bp, Artificial Sequence
  chemically synthesized
tcgacataattgcttgctaatt

SEQ ID NO: 1329747 - DNA, 22 bp, Artificial Sequence
  chemically synthesized
cccagttatcgacataattgct

SEQ ID NO: 1329748 - DNA, 22 bp, Artificial Sequence
  chemically synthesized
tacccagttatcgacataattg

SEQ ID NO: 1329749 - DNA, 22 bp, Artificial Sequence
  chemically synthesized
ctacccagttatcgacataatt

SEQ ID NO: 1329750 - DNA, 22 bp, Artificial Sequence
  chemically synthesized
tttctacccagttatcgacata

SEQ ID NO: 1329751 - DNA, 22 bp, Artificial Sequence
  chemically synthesized
gcaagcaattatgtcgataact

SEQ ID NO: 1329752 - DNA, 22 bp, Artificial Sequence
  chemically synthesized
cacatagttatttctacccagt

SEQ ID NO: 1329753 - DNA, 22 bp, Artificial Sequence
  chemically synthesized
ttccacatagttatttctaccc

SEQ ID NO: 1329754 - DNA, 22 bp, Artificial Sequence
  chemically synthesized
tgtcgataactgggtagaaata

SEQ ID NO: 1329755 - DNA, 22 bp, Artificial Sequence
  chemically synthesized
gttccacatagttatttctacc

SEQ ID NO: 1329756 - DNA, 22 bp, Artificial Sequence
  chemically synthesized
tgttccacatagttatttctac

SEQ ID NO: 1329757 - DNA, 22 bp, Artificial Sequence
  chemically synthesized
ttgttccacatagttatttcta

SEQ ID NO: 1329758 - DNA, 22 bp, Artificial Sequence
  chemically synthesized
tgaacttttgttccacatagtt

SEQ ID NO: 1329759 - DNA, 22 bp, Artificial Sequence
  chemically synthesized
tatgaacttttgttccacatag

SEQ ID NO: 1329760 - DNA, 22 bp, Artificial Sequence
  chemically synthesized
ggtagaaataactatgtggaac

SEQ ID NO: 1329761 - DNA, 22 bp, Artificial Sequence
  chemically synthesized
ctatgaacttttgttccacata

SEQ ID NO: 1329762 - DNA, 22 bp, Artificial Sequence
  chemically synthesized
tctatgaacttttgttccacat

SEQ ID NO: 1329763 - DNA, 22 bp, Artificial Sequence
  chemically synthesized
ttctatgaacttttgttccaca

SEQ ID NO: 1329764 - DNA, 22 bp, Artificial Sequence
  chemically synthesized
tttctatgaacttttgttccac

SEQ ID NO: 1329765 - DNA, 22 bp, Artificial Sequence
  chemically synthesized
ttttctatgaacttttgttcca

SEQ ID NO: 1329766 - DNA, 22 bp, Artificial Sequence
  chemically synthesized
ttttttctatgaacttttgttc

SEQ ID NO: 1329767 - DNA, 22 bp, Artificial Sequence
  chemically synthesized
tgtggaacaaaagttcatagaa

SEQ ID NO: 1329768 - DNA, 22 bp, Artificial Sequence
  chemically synthesized
aaacacctcttttttctatgaa

SEQ ID NO: 1329769 - DNA, 22 bp, Artificial Sequence
  chemically synthesized
gaaacacctcttttttctatga

SEQ ID NO: 1329770 - DNA, 22 bp, Artificial Sequence
  chemically synthesized
acggcttgaaacacctcttttt

SEQ ID NO: 1329771 - DNA, 22 bp, Artificial Sequence
  chemically synthesized
taacggcttgaaacacctcttt

SEQ ID NO: 1329772 - DNA, 22 bp, Artificial Sequence
  chemically synthesized
tctaacggcttgaaacacctct

SEQ ID NO: 1329773 - DNA, 22 bp, Artificial Sequence
  chemically synthesized
ctctaacggcttgaaacacctc

SEQ ID NO: 1329774 - DNA, 22 bp, Artificial Sequence
  chemically synthesized
tctctaacggcttgaaacacct

SEQ ID NO: 1329775 - DNA, 22 bp, Artificial Sequence
  chemically synthesized
atagaaaaaagaggtgtttcaa

SEQ ID NO: 1329776 - DNA, 22 bp, Artificial Sequence
  chemically synthesized
ccacaacactttctctaacggc

SEQ ID NO: 1329777 - DNA, 22 bp, Artificial Sequence
  chemically synthesized
gttaccacaacactttctctaa

SEQ ID NO: 1329778 - DNA, 22 bp, Artificial Sequence
  chemically synthesized
caagccgttagagaaagtgttg

SEQ ID NO: 1329779 - DNA, 22 bp, Artificial Sequence
  chemically synthesized
aagccgttagagaaagtgttgt

SEQ ID NO: 1329780 - DNA, 22 bp, Artificial Sequence
  chemically synthesized
aagtcctagttaccacaacact

SEQ ID NO: 1329781 - DNA, 22 bp, Artificial Sequence
  chemically synthesized
aattcaagtcctagttaccaca

SEQ ID NO: 1329782 - DNA, 22 bp, Artificial Sequence
  chemically synthesized
gagaaagtgttgtggtaactag

SEQ ID NO: 1329783 - DNA, 22 bp, Artificial Sequence
  chemically synthesized
aaaaattcaattcaagtcctag

SEQ ID NO: 1329784 - DNA, 22 bp, Artificial Sequence
  chemically synthesized
caaaaattcaattcaagtccta

SEQ ID NO: 1329785 - DNA, 22 bp, Artificial Sequence
  chemically synthesized
tggtaactaggacttgaattga

SEQ ID NO: 1329786 - DNA, 22 bp, Artificial Sequence
  chemically synthesized
ccatcttcaaaaattcaattca

SEQ ID NO: 1329787 - DNA, 22 bp, Artificial Sequence
  chemically synthesized
ggacttgaattgaatttttgaa

SEQ ID NO: 1329788 - DNA, 22 bp, Artificial Sequence
  chemically synthesized
aagcattcccatcttcaaaaat

SEQ ID NO: 1329789 - DNA, 22 bp, Artificial Sequence
  chemically synthesized
taaagcattcccatcttcaaaa

SEQ ID NO: 1329790 - DNA, 22 bp, Artificial Sequence
  chemically synthesized
gaattgaatttttgaagatggg

SEQ ID NO: 1329791 - DNA, 22 bp, Artificial Sequence
  chemically synthesized
aattgaatttttgaagatggga

SEQ ID NO: 1329792 - DNA, 22 bp, Artificial Sequence
  chemically synthesized
gttctaaagcattcccatcttc

SEQ ID NO: 1329793 - DNA, 22 bp, Artificial Sequence
  chemically synthesized
ggttctaaagcattcccatctt

SEQ ID NO: 1329794 - DNA, 22 bp, Artificial Sequence
  chemically synthesized
tggttctaaagcattcccatct

SEQ ID NO: 1329795 - DNA, 22 bp, Artificial Sequence
  chemically synthesized
ttggttctaaagcattcccatc

SEQ ID NO: 1329796 - DNA, 22 bp, Artificial Sequence
  chemically synthesized
aatttttgaagatgggaatgct

SEQ ID NO: 1329797 - DNA, 22 bp, Artificial Sequence
  chemically synthesized
ttgaagatgggaatgctttaga

SEQ ID NO: 1329798 - DNA, 22 bp, Artificial Sequence
  chemically synthesized
tgaagatgggaatgctttagaa

SEQ ID NO: 1329799 - DNA, 22 bp, Artificial Sequence
  chemically synthesized
gaagatgggaatgctttagaac

SEQ ID NO: 1329800 - DNA, 22 bp, Artificial Sequence
  chemically synthesized
catcgacttttggttctaaagc

SEQ ID NO: 1329801 - DNA, 22 bp, Artificial Sequence
  chemically synthesized
aagatgggaatgctttagaacc

SEQ ID NO: 1329802 - DNA, 22 bp, Artificial Sequence
  chemically synthesized
ctccatcgacttttggttctaa

SEQ ID NO: 1329803 - DNA, 22 bp, Artificial Sequence
  chemically synthesized
cctccatcgacttttggttcta

SEQ ID NO: 1329804 - DNA, 22 bp, Artificial Sequence
  chemically synthesized
tcctccatcgacttttggttct

SEQ ID NO: 1329805 - DNA, 22 bp, Artificial Sequence
  chemically synthesized
ttcctccatcgacttttggttc

SEQ ID NO: 1329806 - DNA, 22 bp, Artificial Sequence
  chemically synthesized
tttcctccatcgacttttggtt

SEQ ID NO: 1329807 - DNA, 22 bp, Artificial Sequence
  chemically synthesized
gaatctttttcctccatcgact

SEQ ID NO: 1329808 - DNA, 22 bp, Artificial Sequence
  chemically synthesized
tagaaccaaaagtcgatggagg

SEQ ID NO: 1329809 - DNA, 22 bp, Artificial Sequence
  chemically synthesized
tggaatctttttcctccatcga

SEQ ID NO: 1329810 - DNA, 22 bp, Artificial Sequence
  chemically synthesized
agaaccaaaagtcgatggagga

SEQ ID NO: 1329811 - DNA, 22 bp, Artificial Sequence
  chemically synthesized
ctggaatctttttcctccatcg

SEQ ID NO: 1329812 - DNA, 22 bp, Artificial Sequence
  chemically synthesized
gaaccaaaagtcgatggaggaa

SEQ ID NO: 1329813 - DNA, 22 bp, Artificial Sequence
  chemically synthesized
tctggaatctttttcctccatc

SEQ ID NO: 1329814 - DNA, 22 bp, Artificial Sequence
  chemically synthesized
cccctttctggaatctttttcc

SEQ ID NO: 1329815 - DNA, 22 bp, Artificial Sequence
  chemically synthesized
attccccctttctggaatcttt

SEQ ID NO: 1329816 - DNA, 22 bp, Artificial Sequence
  chemically synthesized
gtctgattccccctttctggaa

SEQ ID NO: 1329817 - DNA, 22 bp, Artificial Sequence
  chemically synthesized
tagtctgattccccctttctgg

SEQ ID NO: 1329818 - DNA, 22 bp, Artificial Sequence
  chemically synthesized
ctagtctgattccccctttctg

SEQ ID NO: 1329819 - DNA, 22 bp, Artificial Sequence
  chemically synthesized
tctagtctgattccccctttct

SEQ ID NO: 1329820 - DNA, 22 bp, Artificial Sequence
  chemically synthesized
ttctagtctgattccccctttc

SEQ ID NO: 1329821 - DNA, 22 bp, Artificial Sequence
  chemically synthesized
cttttctagtctgattccccct

SEQ ID NO: 1329822 - DNA, 22 bp, Artificial Sequence
  chemically synthesized
gcttttctagtctgattccccc

SEQ ID NO: 1329823 - DNA, 22 bp, Artificial Sequence
  chemically synthesized
ttgcttttctagtctgattccc

SEQ ID NO: 1329824 - DNA, 22 bp, Artificial Sequence
  chemically synthesized
ttcttgcttttctagtctgatt

SEQ ID NO: 1329825 - DNA, 22 bp, Artificial Sequence
  chemically synthesized
cagaaagggggaatcagactag

SEQ ID NO: 1329826 - DNA, 22 bp, Artificial Sequence
  chemically synthesized
attcttgcttttctagtctgat

SEQ ID NO: 1329827 - DNA, 22 bp, Artificial Sequence
  chemically synthesized
atttattcttgcttttctagtc

SEQ ID NO: 1329828 - DNA, 22 bp, Artificial Sequence
  chemically synthesized
tacaggccagctcatttattct

SEQ ID NO: 1329829 - DNA, 22 bp, Artificial Sequence
  chemically synthesized
ctatacaggccagctcatttat

SEQ ID NO: 1329830 - DNA, 22 bp, Artificial Sequence
  chemically synthesized
gaaaagcaagaataaatgagct

SEQ ID NO: 1329831 - DNA, 22 bp, Artificial Sequence
  chemically synthesized
tcctatacaggccagctcattt

SEQ ID NO: 1329832 - DNA, 22 bp, Artificial Sequence
  chemically synthesized
tctcctatacaggccagctcat

SEQ ID NO: 1329833 - DNA, 22 bp, Artificial Sequence
  chemically synthesized
tctctcctatacaggccagctc

SEQ ID NO: 1329834 - DNA, 22 bp, Artificial Sequence
  chemically synthesized
cataaaatattctctctcctat

SEQ ID NO: 1329835 - DNA, 22 bp, Artificial Sequence
  chemically synthesized
tgcataaaatattctctctcct

SEQ ID NO: 1329836 - DNA, 22 bp, Artificial Sequence
  chemically synthesized
gcctgtataggagagagaatat

SEQ ID NO: 1329837 - DNA, 22 bp, Artificial Sequence
  chemically synthesized
tatactctgcataaaatattct

SEQ ID NO: 1329838 - DNA, 22 bp, Artificial Sequence
  chemically synthesized
tataggagagagaatattttat

SEQ ID NO: 1329839 - DNA, 22 bp, Artificial Sequence
  chemically synthesized
tctatatactctgcataaaata

SEQ ID NO: 1329840 - DNA, 22 bp, Artificial Sequence
  chemically synthesized
atctatatactctgcataaaat

SEQ ID NO: 1329841 - DNA, 22 bp, Artificial Sequence
  chemically synthesized
tatctatatactctgcataaaa

SEQ ID NO: 1329842 - DNA, 22 bp, Artificial Sequence
  chemically synthesized
ctttatctatatactctgcata

SEQ ID NO: 1329843 - DNA, 22 bp, Artificial Sequence
  chemically synthesized
tgttactttatctatatactct

SEQ ID NO: 1329844 - DNA, 22 bp, Artificial Sequence
  chemically synthesized
aactgtgttactttatctatat

SEQ ID NO: 1329845 - DNA, 22 bp, Artificial Sequence
  chemically synthesized
gaactgtgttactttatctata

SEQ ID NO: 1329846 - DNA, 22 bp, Artificial Sequence
  chemically synthesized
tatgcagagtatatagataaag

SEQ ID NO: 1329847 - DNA, 22 bp, Artificial Sequence
  chemically synthesized
atgcagagtatatagataaagt

SEQ ID NO: 1329848 - DNA, 22 bp, Artificial Sequence
  chemically synthesized
tgcagagtatatagataaagta

SEQ ID NO: 1329849 - DNA, 22 bp, Artificial Sequence
  chemically synthesized
agggtttgaactgtgttacttt

SEQ ID NO: 1329850 - DNA, 22 bp, Artificial Sequence
  chemically synthesized
aagggtttgaactgtgttactt

SEQ ID NO: 1329851 - DNA, 22 bp, Artificial Sequence
  chemically synthesized
taagggtttgaactgtgttact

SEQ ID NO: 1329852 - DNA, 22 bp, Artificial Sequence
  chemically synthesized
ttaagggtttgaactgtgttac

SEQ ID NO: 1329853 - DNA, 22 bp, Artificial Sequence
  chemically synthesized
tacacttttaagggtttgaact

SEQ ID NO: 1329854 - DNA, 22 bp, Artificial Sequence
  chemically synthesized
gctatacacttttaagggtttg

SEQ ID NO: 1329855 - DNA, 22 bp, Artificial Sequence
  chemically synthesized
tgctggctatacacttttaagg

SEQ ID NO: 1329856 - DNA, 22 bp, Artificial Sequence
  chemically synthesized
aaacccttaaaagtgtatagcc

SEQ ID NO: 1329857 - DNA, 22 bp, Artificial Sequence
  chemically synthesized
gcagaaaactatgctggctata

SEQ ID NO: 1329858 - DNA, 22 bp, Artificial Sequence
  chemically synthesized
aaaagtgtatagccagcatagt

SEQ ID NO: 1329859 - DNA, 22 bp, Artificial Sequence
  chemically synthesized
aaagtgtatagccagcatagtt

SEQ ID NO: 1329860 - DNA, 22 bp, Artificial Sequence
  chemically synthesized
agagcagtatgaatcctggcag

SEQ ID NO: 1329861 - DNA, 22 bp, Artificial Sequence
  chemically synthesized
gagagcagtatgaatcctggca

SEQ ID NO: 1329862 - DNA, 22 bp, Artificial Sequence
  chemically synthesized
atttgagagcagtatgaatcct

SEQ ID NO: 1329863 - DNA, 22 bp, Artificial Sequence
  chemically synthesized
tgatttgagagcagtatgaatc

SEQ ID NO: 1329864 - DNA, 22 bp, Artificial Sequence
  chemically synthesized
ctgatttgagagcagtatgaat

SEQ ID NO: 1329865 - DNA, 22 bp, Artificial Sequence
  chemically synthesized
tctgccaggattcatactgctc

SEQ ID NO: 1329866 - DNA, 22 bp, Artificial Sequence
  chemically synthesized
ctgccaggattcatactgctct

SEQ ID NO: 1329867 - DNA, 22 bp, Artificial Sequence
  chemically synthesized
tgccaggattcatactgctctc

SEQ ID NO: 1329868 - DNA, 22 bp, Artificial Sequence
  chemically synthesized
ccaggattcatactgctctcaa

SEQ ID NO: 1329869 - DNA, 22 bp, Artificial Sequence
  chemically synthesized
gtagagtatcttctgatttgag

SEQ ID NO: 1329870 - DNA, 22 bp, Artificial Sequence
  chemically synthesized
atactgctctcaaatcagaaga

SEQ ID NO: 1329871 - DNA, 22 bp, Artificial Sequence
  chemically synthesized
aatctagtagagtatcttctga

SEQ ID NO: 1329872 - DNA, 22 bp, Artificial Sequence
  chemically synthesized
aaatctagtagagtatcttctg

SEQ ID NO: 1329873 - DNA, 22 bp, Artificial Sequence
  chemically synthesized
ttaaatctagtagagtatcttc

SEQ ID NO: 1329874 - DNA, 22 bp, Artificial Sequence
  chemically synthesized
ctctcaaatcagaagatactct

SEQ ID NO: 1329875 - DNA, 22 bp, Artificial Sequence
  chemically synthesized
tcaaatcagaagatactctact

SEQ ID NO: 1329876 - DNA, 22 bp, Artificial Sequence
  chemically synthesized
aaatcagaagatactctactag

SEQ ID NO: 1329877 - DNA, 22 bp, Artificial Sequence
  chemically synthesized
tgtaattcttaaatctagtaga

SEQ ID NO: 1329878 - DNA, 22 bp, Artificial Sequence
  chemically synthesized
actatgtaattcttaaatctag

SEQ ID NO: 1329879 - DNA, 22 bp, Artificial Sequence
  chemically synthesized
attgactatgtaattcttaaat

SEQ ID NO: 1329880 - DNA, 22 bp, Artificial Sequence
  chemically synthesized
agctgattgactatgtaattct

SEQ ID NO: 1329881 - DNA, 22 bp, Artificial Sequence
  chemically synthesized
tactagatttaagaattacata

SEQ ID NO: 1329882 - DNA, 22 bp, Artificial Sequence
  chemically synthesized
cagctgattgactatgtaattc

SEQ ID NO: 1329883 - DNA, 22 bp, Artificial Sequence
  chemically synthesized
tcagctgattgactatgtaatt

SEQ ID NO: 1329884 - DNA, 22 bp, Artificial Sequence
  chemically synthesized
ctagatttaagaattacatagt

SEQ ID NO: 1329885 - DNA, 22 bp, Artificial Sequence
  chemically synthesized
gatttaagaattacatagtcaa

SEQ ID NO: 1329886 - DNA, 22 bp, Artificial Sequence
  chemically synthesized
caaggctttcagctgattgact

SEQ ID NO: 1329887 - DNA, 22 bp, Artificial Sequence
  chemically synthesized
aagaattacatagtcaatcagc

SEQ ID NO: 1329888 - DNA, 22 bp, Artificial Sequence
  chemically synthesized
agaattacatagtcaatcagct

SEQ ID NO: 1329889 - DNA, 22 bp, Artificial Sequence
  chemically synthesized
catagtcaatcagctgaaagcc

SEQ ID NO: 1329890 - DNA, 22 bp, Artificial Sequence
  chemically synthesized
tgtagccgaaagttccaaggct

SEQ ID NO: 1329891 - DNA, 22 bp, Artificial Sequence
  chemically synthesized
atgactatgtagccgaaagttc

SEQ ID NO: 1329892 - DNA, 22 bp, Artificial Sequence
  chemically synthesized
aatgactatgtagccgaaagtt

SEQ ID NO: 1329893 - DNA, 22 bp, Artificial Sequence
  chemically synthesized
taatgactatgtagccgaaagt

SEQ ID NO: 1329894 - DNA, 22 bp, Artificial Sequence
  chemically synthesized
aaagccttggaactttcggcta

SEQ ID NO: 1329895 - DNA, 22 bp, Artificial Sequence
  chemically synthesized
ttaatgactatgtagccgaaag

SEQ ID NO: 1329896 - DNA, 22 bp, Artificial Sequence
  chemically synthesized
ggaactttcggctacatagtca

SEQ ID NO: 1329897 - DNA, 22 bp, Artificial Sequence
  chemically synthesized
gaactttcggctacatagtcat

SEQ ID NO: 1329898 - DNA, 22 bp, Artificial Sequence
  chemically synthesized
taatagtagtgtttttaatgac

SEQ ID NO: 1329899 - DNA, 22 bp, Artificial Sequence
  chemically synthesized
tcggctacatagtcattaaaaa

SEQ ID NO: 1329900 - DNA, 22 bp, Artificial Sequence
  chemically synthesized
cggctacatagtcattaaaaac

SEQ ID NO: 1329901 - DNA, 22 bp, Artificial Sequence
  chemically synthesized
ggctacatagtcattaaaaaca

SEQ ID NO: 1329902 - DNA, 22 bp, Artificial Sequence
  chemically synthesized
agctataatagtagtgttttta

SEQ ID NO: 1329903 - DNA, 22 bp, Artificial Sequence
  chemically synthesized
catagtcattaaaaacactact

SEQ ID NO: 1329904 - DNA, 22 bp, Artificial Sequence
  chemically synthesized
gtgaaattgagctataatagta

SEQ ID NO: 1329905 - DNA, 22 bp, Artificial Sequence
  chemically synthesized
aaaacactactattatagctca

SEQ ID NO: 1329906 - DNA, 22 bp, Artificial Sequence
  chemically synthesized
ctattatagctcaatttcacca

SEQ ID NO: 1329907 - DNA, 22 bp, Artificial Sequence
  chemically synthesized
ttatagctcaatttcaccaggc

SEQ ID NO: 1329908 - DNA, 22 bp, Artificial Sequence
  chemically synthesized
tagctcaatttcaccaggccac

SEQ ID NO: 1329909 - DNA, 22 bp, Artificial Sequence
  chemically synthesized
aatttcaccaggccacattata

SEQ ID NO: 1329910 - DNA, 22 bp, Artificial Sequence
  chemically synthesized
aaaaatatatatatatataatg

SEQ ID NO: 1329911 - DNA, 22 bp, Artificial Sequence
  chemically synthesized
caccaggccacattatatatat

SEQ ID NO: 1329912 - DNA, 22 bp, Artificial Sequence
  chemically synthesized
accaggccacattatatatata

SEQ ID NO: 1329913 - DNA, 22 bp, Artificial Sequence
  chemically synthesized
tgttaaaaaatatatatatata

SEQ ID NO: 1329914 - DNA, 22 bp, Artificial Sequence
  chemically synthesized
tgtacattatgttaaaaaatat

SEQ ID NO: 1329915 - DNA, 22 bp, Artificial Sequence
  chemically synthesized
tatatatatatattttttaaca

SEQ ID NO: 1329916 - DNA, 22 bp, Artificial Sequence
  chemically synthesized
tatatatgtattgtgtacatta

SEQ ID NO: 1329917 - DNA, 22 bp, Artificial Sequence
  chemically synthesized
tttaacataatgtacacaatac

SEQ ID NO: 1329918 - DNA, 22 bp, Artificial Sequence
  chemically synthesized
ttaacataatgtacacaataca

SEQ ID NO: 1329919 - DNA, 22 bp, Artificial Sequence
  chemically synthesized
taacataatgtacacaatacat

SEQ ID NO: 1329920 - DNA, 22 bp, Artificial Sequence
  chemically synthesized
aacataatgtacacaatacata

SEQ ID NO: 1329921 - DNA, 22 bp, Artificial Sequence
  chemically synthesized
acataatgtacacaatacatat

SEQ ID NO: 1329922 - DNA, 22 bp, Artificial Sequence
  chemically synthesized
gcaaaattgtatatatgtattg

SEQ ID NO: 1329923 - DNA, 22 bp, Artificial Sequence
  chemically synthesized
attggcaaaattgtatatatgt

SEQ ID NO: 1329924 - DNA, 22 bp, Artificial Sequence
  chemically synthesized
aattggcaaaattgtatatatg

SEQ ID NO: 1329925 - DNA, 22 bp, Artificial Sequence
  chemically synthesized
aaaaacaagtttaattggcaaa

SEQ ID NO: 1329926 - DNA, 22 bp, Artificial Sequence
  chemically synthesized
gaaaaacaagtttaattggcaa

SEQ ID NO: 1329927 - DNA, 22 bp, Artificial Sequence
  chemically synthesized
tgaaaaacaagtttaattggca

SEQ ID NO: 1329928 - DNA, 22 bp, Artificial Sequence
  chemically synthesized
ttgaaaaacaagtttaattggc

SEQ ID NO: 1329929 - DNA, 22 bp, Artificial Sequence
  chemically synthesized
tttgaaaaacaagtttaattgg

SEQ ID NO: 1329930 - DNA, 22 bp, Artificial Sequence
  chemically synthesized
ctttttgaaaaacaagtttaat

SEQ ID NO: 1329931 - DNA, 22 bp, Artificial Sequence
  chemically synthesized
tgccaattaaacttgtttttca

SEQ ID NO: 1329932 - DNA, 22 bp, Artificial Sequence
  chemically synthesized
gccaattaaacttgtttttcaa

SEQ ID NO: 1329933 - DNA, 22 bp, Artificial Sequence
  chemically synthesized
ccaattaaacttgtttttcaaa

SEQ ID NO: 1329934 - DNA, 22 bp, Artificial Sequence
  chemically synthesized
gataaaatgagttactttttga

SEQ ID NO: 1329935 - DNA, 22 bp, Artificial Sequence
  chemically synthesized
agataaaatgagttactttttg

SEQ ID NO: 1329936 - DNA, 22 bp, Artificial Sequence
  chemically synthesized
aacttgtttttcaaaaagtaac

SEQ ID NO: 1329937 - DNA, 22 bp, Artificial Sequence
  chemically synthesized
tagataaaatgagttacttttt

SEQ ID NO: 1329938 - DNA, 22 bp, Artificial Sequence
  chemically synthesized
tttagataaaatgagttacttt

SEQ ID NO: 1329939 - DNA, 22 bp, Artificial Sequence
  chemically synthesized
ctttagataaaatgagttactt

SEQ ID NO: 1329940 - DNA, 22 bp, Artificial Sequence
  chemically synthesized
gtttttcaaaaagtaactcatt

SEQ ID NO: 1329941 - DNA, 22 bp, Artificial Sequence
  chemically synthesized
tttttcaaaaagtaactcattt

SEQ ID NO: 1329942 - DNA, 22 bp, Artificial Sequence
  chemically synthesized
acttctttagataaaatgagtt

SEQ ID NO: 1329943 - DNA, 22 bp, Artificial Sequence
  chemically synthesized
aacttctttagataaaatgagt

SEQ ID NO: 1329944 - DNA, 22 bp, Artificial Sequence
  chemically synthesized
ttcaaaaagtaactcattttat

SEQ ID NO: 1329945 - DNA, 22 bp, Artificial Sequence
  chemically synthesized
tcaaaaagtaactcattttatc

SEQ ID NO: 1329946 - DNA, 22 bp, Artificial Sequence
  chemically synthesized
caaaaagtaactcattttatct

SEQ ID NO: 1329947 - DNA, 22 bp, Artificial Sequence
  chemically synthesized
aaaaagtaactcattttatcta

SEQ ID NO: 1329948 - DNA, 22 bp, Artificial Sequence
  chemically synthesized
atgagcttaacttctttagata

SEQ ID NO: 1329949 - DNA, 22 bp, Artificial Sequence
  chemically synthesized
gatgagcttaacttctttagat

SEQ ID NO: 1329950 - DNA, 22 bp, Artificial Sequence
  chemically synthesized
tgatgagcttaacttctttaga

SEQ ID NO: 1329951 - DNA, 22 bp, Artificial Sequence
  chemically synthesized
ctttgatgagcttaacttcttt

SEQ ID NO: 1329952 - DNA, 22 bp, Artificial Sequence
  chemically synthesized
gctttgatgagcttaacttctt

SEQ ID NO: 1329953 - DNA, 22 bp, Artificial Sequence
  chemically synthesized
tgctttgatgagcttaacttct

SEQ ID NO: 1329954 - DNA, 22 bp, Artificial Sequence
  chemically synthesized
attttatctaaagaagttaagc

SEQ ID NO: 1329955 - DNA, 22 bp, Artificial Sequence
  chemically synthesized
tatctaaagaagttaagctcat

SEQ ID NO: 1329956 - DNA, 22 bp, Artificial Sequence
  chemically synthesized
cactttgctttgatgagcttaa

SEQ ID NO: 1329957 - DNA, 22 bp, Artificial Sequence
  chemically synthesized
atctaaagaagttaagctcatc

SEQ ID NO: 1329958 - DNA, 22 bp, Artificial Sequence
  chemically synthesized
tctaaagaagttaagctcatca

SEQ ID NO: 1329959 - DNA, 22 bp, Artificial Sequence
  chemically synthesized
ttccactttgctttgatgagct

SEQ ID NO: 1329960 - DNA, 22 bp, Artificial Sequence
  chemically synthesized
aagaagttaagctcatcaaagc

SEQ ID NO: 1329961 - DNA, 22 bp, Artificial Sequence
  chemically synthesized
ccactgttccactttgctttga

SEQ ID NO: 1329962 - DNA, 22 bp, Artificial Sequence
  chemically synthesized
gctaccactgttccactttgct

SEQ ID NO: 1329963 - DNA, 22 bp, Artificial Sequence
  chemically synthesized
agctcatcaaagcaaagtggaa

SEQ ID NO: 1329964 - DNA, 22 bp, Artificial Sequence
  chemically synthesized
ctggctaccactgttccacttt

SEQ ID NO: 1329965 - DNA, 22 bp, Artificial Sequence
  chemically synthesized
atcaaagcaaagtggaacagtg

SEQ ID NO: 1329966 - DNA, 22 bp, Artificial Sequence
  chemically synthesized
catccccagttactggctacca

SEQ ID NO: 1329967 - DNA, 22 bp, Artificial Sequence
  chemically synthesized
ccatccccagttactggctacc

SEQ ID NO: 1329968 - DNA, 22 bp, Artificial Sequence
  chemically synthesized
tccatccccagttactggctac

SEQ ID NO: 1329969 - DNA, 22 bp, Artificial Sequence
  chemically synthesized
ttccatccccagttactggcta

SEQ ID NO: 1329970 - DNA, 22 bp, Artificial Sequence
  chemically synthesized
tttccatccccagttactggct

SEQ ID NO: 1329971 - DNA, 22 bp, Artificial Sequence
  chemically synthesized
ttttccatccccagttactggc

SEQ ID NO: 1329972 - DNA, 22 bp, Artificial Sequence
  chemically synthesized
cccatttttttccatccccagt

SEQ ID NO: 1329973 - DNA, 22 bp, Artificial Sequence
  chemically synthesized
ccccatttttttccatccccag

SEQ ID NO: 1329974 - DNA, 22 bp, Artificial Sequence
  chemically synthesized
gaccagcatttccccatttttt

SEQ ID NO: 1329975 - DNA, 22 bp, Artificial Sequence
  chemically synthesized
cgaccagcatttccccattttt

SEQ ID NO: 1329976 - DNA, 22 bp, Artificial Sequence
  chemically synthesized
gggatggaaaaaaatggggaaa

SEQ ID NO: 1329977 - DNA, 22 bp, Artificial Sequence
  chemically synthesized
tccttcgaccagcatttcccca

SEQ ID NO: 1329978 - DNA, 22 bp, Artificial Sequence
  chemically synthesized
tatccttcgaccagcatttccc

SEQ ID NO: 1329979 - DNA, 22 bp, Artificial Sequence
  chemically synthesized
ctatccttcgaccagcatttcc

SEQ ID NO: 1329980 - DNA, 22 bp, Artificial Sequence
  chemically synthesized
agagtttctatccttcgaccag

SEQ ID NO: 1329981 - DNA, 22 bp, Artificial Sequence
  chemically synthesized
taactgagagtttctatccttc

SEQ ID NO: 1329982 - DNA, 22 bp, Artificial Sequence
  chemically synthesized
ataactgagagtttctatcctt

SEQ ID NO: 1329983 - DNA, 22 bp, Artificial Sequence
  chemically synthesized
atcttataactgagagtttcta

SEQ ID NO: 1329984 - DNA, 22 bp, Artificial Sequence
  chemically synthesized
gtcgaaggatagaaactctcag

SEQ ID NO: 1329985 - DNA, 22 bp, Artificial Sequence
  chemically synthesized
ctcatcttataactgagagttt

SEQ ID NO: 1329986 - DNA, 22 bp, Artificial Sequence
  chemically synthesized
actcatcttataactgagagtt

SEQ ID NO: 1329987 - DNA, 22 bp, Artificial Sequence
  chemically synthesized
gatccccagagcttactcatct

SEQ ID NO: 1329988 - DNA, 22 bp, Artificial Sequence
  chemically synthesized
tcagttataagatgagtaagct

SEQ ID NO: 1329989 - DNA, 22 bp, Artificial Sequence
  chemically synthesized
agttataagatgagtaagctct

SEQ ID NO: 1329990 - DNA, 22 bp, Artificial Sequence
  chemically synthesized
tacattagatccccagagctta

SEQ ID NO: 1329991 - DNA, 22 bp, Artificial Sequence
  chemically synthesized
taagatgagtaagctctgggga

SEQ ID NO: 1329992 - DNA, 22 bp, Artificial Sequence
  chemically synthesized
tagtcaacatgctgtacattag

SEQ ID NO: 1329993 - DNA, 22 bp, Artificial Sequence
  chemically synthesized
actatagtcaacatgctgtaca

SEQ ID NO: 1329994 - DNA, 22 bp, Artificial Sequence
  chemically synthesized
tggggatctaatgtacagcatg

SEQ ID NO: 1329995 - DNA, 22 bp, Artificial Sequence
  chemically synthesized
gggatctaatgtacagcatgtt

SEQ ID NO: 1329996 - DNA, 22 bp, Artificial Sequence
  chemically synthesized
ttaactatagtcaacatgctgt

SEQ ID NO: 1329997 - DNA, 22 bp, Artificial Sequence
  chemically synthesized
atgtacagcatgttgactatag

SEQ ID NO: 1329998 - DNA, 22 bp, Artificial Sequence
  chemically synthesized
aagtaacaatagagtactatta

SEQ ID NO: 1329999 - DNA, 22 bp, Artificial Sequence
  chemically synthesized
caagtaacaatagagtactatt

SEQ ID NO: 1330000 - DNA, 22 bp, Artificial Sequence
  chemically synthesized
actatagttaatagtactctat

SEQ ID NO: 1330001 - DNA, 22 bp, Artificial Sequence
  chemically synthesized
tagttaatagtactctattgtt

SEQ ID NO: 1330002 - DNA, 22 bp, Artificial Sequence
  chemically synthesized
gcaaatttcaagtaacaataga

SEQ ID NO: 1330003 - DNA, 22 bp, Artificial Sequence
  chemically synthesized
agcaaatttcaagtaacaatag

SEQ ID NO: 1330004 - DNA, 22 bp, Artificial Sequence
  chemically synthesized
ttagcaaatttcaagtaacaat

SEQ ID NO: 1330005 - DNA, 22 bp, Artificial Sequence
  chemically synthesized
atagtactctattgttacttga

SEQ ID NO: 1330006 - DNA, 22 bp, Artificial Sequence
  chemically synthesized
tcttagcaaatttcaagtaaca

SEQ ID NO: 1330007 - DNA, 22 bp, Artificial Sequence
  chemically synthesized
agatctctcttagcaaatttca

SEQ ID NO: 1330008 - DNA, 22 bp, Artificial Sequence
  chemically synthesized
aagatctctcttagcaaatttc

SEQ ID NO: 1330009 - DNA, 22 bp, Artificial Sequence
  chemically synthesized
tattgttacttgaaatttgcta

SEQ ID NO: 1330010 - DNA, 22 bp, Artificial Sequence
  chemically synthesized
ttgttacttgaaatttgctaag

SEQ ID NO: 1330011 - DNA, 22 bp, Artificial Sequence
  chemically synthesized
ttacttgaaatttgctaagaga

SEQ ID NO: 1330012 - DNA, 22 bp, Artificial Sequence
  chemically synthesized
cttgaaatttgctaagagagat

SEQ ID NO: 1330013 - DNA, 22 bp, Artificial Sequence
  chemically synthesized
gaaatttgctaagagagatctt

SEQ ID NO: 1330014 - DNA, 22 bp, Artificial Sequence
  chemically synthesized
aaatttgctaagagagatctta

SEQ ID NO: 1330015 - DNA, 22 bp, Artificial Sequence
  chemically synthesized
tgatgagaacacttaagatctc

SEQ ID NO: 1330016 - DNA, 22 bp, Artificial Sequence
  chemically synthesized
atgatgagaacacttaagatct

SEQ ID NO: 1330017 - DNA, 22 bp, Artificial Sequence
  chemically synthesized
tatgatgagaacacttaagatc

SEQ ID NO: 1330018 - DNA, 22 bp, Artificial Sequence
  chemically synthesized
ttatgatgagaacacttaagat

SEQ ID NO: 1330019 - DNA, 22 bp, Artificial Sequence
  chemically synthesized
tttatgatgagaacacttaaga

SEQ ID NO: 1330020 - DNA, 22 bp, Artificial Sequence
  chemically synthesized
gctaagagagatcttaagtgtt

SEQ ID NO: 1330021 - DNA, 22 bp, Artificial Sequence
  chemically synthesized
ctaagagagatcttaagtgttc

SEQ ID NO: 1330022 - DNA, 22 bp, Artificial Sequence
  chemically synthesized
agagagatcttaagtgttctca

SEQ ID NO: 1330023 - DNA, 22 bp, Artificial Sequence
  chemically synthesized
taattttttatgatgagaacac

SEQ ID NO: 1330024 - DNA, 22 bp, Artificial Sequence
  chemically synthesized
ccattataattttttatgatga

SEQ ID NO: 1330025 - DNA, 22 bp, Artificial Sequence
  chemically synthesized
aagtgttctcatcataaaaaat

SEQ ID NO: 1330026 - DNA, 22 bp, Artificial Sequence
  chemically synthesized
agtgttctcatcataaaaaatt

SEQ ID NO: 1330027 - DNA, 22 bp, Artificial Sequence
  chemically synthesized
acatagttgccattataatttt

SEQ ID NO: 1330028 - DNA, 22 bp, Artificial Sequence
  chemically synthesized
tcatcataaaaaattataatgg

SEQ ID NO: 1330029 - DNA, 22 bp, Artificial Sequence
  chemically synthesized
atcataaaaaattataatggca

SEQ ID NO: 1330030 - DNA, 22 bp, Artificial Sequence
  chemically synthesized
acctcacatagttgccattata

SEQ ID NO: 1330031 - DNA, 22 bp, Artificial Sequence
  chemically synthesized
cacctcacatagttgccattat

SEQ ID NO: 1330032 - DNA, 22 bp, Artificial Sequence
  chemically synthesized
atatatccttcacctcacatag

SEQ ID NO: 1330033 - DNA, 22 bp, Artificial Sequence
  chemically synthesized
taatggcaactatgtgaggtga

SEQ ID NO: 1330034 - DNA, 22 bp, Artificial Sequence
  chemically synthesized
attaatatatccttcacctcac

SEQ ID NO: 1330035 - DNA, 22 bp, Artificial Sequence
  chemically synthesized
tgtgaggtgaaggatatattaa

SEQ ID NO: 1330036 - DNA, 22 bp, Artificial Sequence
  chemically synthesized
tcacaatcaagttaattaatat

SEQ ID NO: 1330037 - DNA, 22 bp, Artificial Sequence
  chemically synthesized
aaatgattatcacaatcaagtt

SEQ ID NO: 1330038 - DNA, 22 bp, Artificial Sequence
  chemically synthesized
tgaaatgattatcacaatcaag

SEQ ID NO: 1330039 - DNA, 22 bp, Artificial Sequence
  chemically synthesized
attaacttgattgtgataatca

SEQ ID NO: 1330040 - DNA, 22 bp, Artificial Sequence
  chemically synthesized
acttgattgtgataatcatttc

SEQ ID NO: 1330041 - DNA, 22 bp, Artificial Sequence
  chemically synthesized
atacatatacattctgaaatga

SEQ ID NO: 1330042 - DNA, 22 bp, Artificial Sequence
  chemically synthesized
gattgtgataatcatttcagaa

SEQ ID NO: 1330043 - DNA, 22 bp, Artificial Sequence
  chemically synthesized
gatacatatacattctgaaatg

SEQ ID NO: 1330044 - DNA, 22 bp, Artificial Sequence
  chemically synthesized
attgtgataatcatttcagaat

SEQ ID NO: 1330045 - DNA, 22 bp, Artificial Sequence
  chemically synthesized
tgataatcatttcagaatgtat

SEQ ID NO: 1330046 - DNA, 22 bp, Artificial Sequence
  chemically synthesized
cagaatgtatatgtatcaaatc

SEQ ID NO: 1330047 - DNA, 22 bp, Artificial Sequence
  chemically synthesized
agaatgtatatgtatcaaatca

SEQ ID NO: 1330048 - DNA, 22 bp, Artificial Sequence
  chemically synthesized
aaggtgtacaatatgatgattt

SEQ ID NO: 1330049 - DNA, 22 bp, Artificial Sequence
  chemically synthesized
ggtatattcaaggtgtacaata

SEQ ID NO: 1330050 - DNA, 22 bp, Artificial Sequence
  chemically synthesized
acaaatggcgattgggtatatt

SEQ ID NO: 1330051 - DNA, 22 bp, Artificial Sequence
  chemically synthesized
tacaccttgaatatacccaatc

SEQ ID NO: 1330052 - DNA, 22 bp, Artificial Sequence
  chemically synthesized
gaatatacccaatcgccatttg

SEQ ID NO: 1330053 - DNA, 22 bp, Artificial Sequence
  chemically synthesized
aggtataattgacaaatggcga

SEQ ID NO: 1330054 - DNA, 22 bp, Artificial Sequence
  chemically synthesized
aatatacccaatcgccatttgt

SEQ ID NO: 1330055 - DNA, 22 bp, Artificial Sequence
  chemically synthesized
ttgaggtataattgacaaatgg

SEQ ID NO: 1330056 - DNA, 22 bp, Artificial Sequence
  chemically synthesized
attgaggtataattgacaaatg

SEQ ID NO: 1330057 - DNA, 22 bp, Artificial Sequence
  chemically synthesized
tattgaggtataattgacaaat

SEQ ID NO: 1330058 - DNA, 22 bp, Artificial Sequence
  chemically synthesized
ccccagctttattgaggtataa

SEQ ID NO: 1330059 - DNA, 22 bp, Artificial Sequence
  chemically synthesized
cccccagctttattgaggtata

SEQ ID NO: 1330060 - DNA, 22 bp, Artificial Sequence
  chemically synthesized
tcccccagctttattgaggtat

SEQ ID NO: 1330061 - DNA, 22 bp, Artificial Sequence
  chemically synthesized
ttcccccagctttattgaggta

SEQ ID NO: 1330062 - DNA, 22 bp, Artificial Sequence
  chemically synthesized
gtcaattatacctcaataaagc

SEQ ID NO: 1330063 - DNA, 22 bp, Artificial Sequence
  chemically synthesized
tcaattatacctcaataaagct

SEQ ID NO: 1330064 - DNA, 22 bp, Artificial Sequence
  chemically synthesized
tacctcaataaagctgggggaa

SEQ ID NO: 1330065 - DNA, 22 bp, Artificial Sequence
  chemically synthesized
aataaagctgggggaaaaggta

SEQ ID NO: 1330066 - DNA, 22 bp, Artificial Sequence
  chemically synthesized
ggggaaaaggtacctcatattt

SEQ ID NO: 1330067 - DNA, 22 bp, Artificial Sequence
  chemically synthesized
taacaataaaatgtaataataa

SEQ ID NO: 1330068 - DNA, 22 bp, Artificial Sequence
  chemically synthesized
atatttattattacattttatt

SEQ ID NO: 1330069 - DNA, 22 bp, Artificial Sequence
  chemically synthesized
attattacattttattgttata

SEQ ID NO: 1330070 - DNA, 22 bp, Artificial Sequence
  chemically synthesized
ttattacattttattgttataa

SEQ ID NO: 1330071 - DNA, 22 bp, Artificial Sequence
  chemically synthesized
ttacattttattgttataacac

SEQ ID NO: 1330072 - DNA, 22 bp, Artificial Sequence
  chemically synthesized
cattttattgttataacacata

SEQ ID NO: 1330073 - DNA, 22 bp, Artificial Sequence
  chemically synthesized
tattgttataacacatatattt

SEQ ID NO: 1330074 - DNA, 22 bp, Artificial Sequence
  chemically synthesized
attgttataacacatatatttt

SEQ ID NO: 1330075 - DNA, 22 bp, Artificial Sequence
  chemically synthesized
ttgttataacacatatatttta

SEQ ID NO: 1330076 - DNA, 22 bp, Artificial Sequence
  chemically synthesized
ttataacacatatattttatct

SEQ ID NO: 1330077 - DNA, 22 bp, Artificial Sequence
  chemically synthesized
aagggtcaaatgagataaaata

SEQ ID NO: 1330078 - DNA, 22 bp, Artificial Sequence
  chemically synthesized
caagggtcaaatgagataaaat

SEQ ID NO: 1330079 - DNA, 22 bp, Artificial Sequence
  chemically synthesized
taacacatatattttatctcat

SEQ ID NO: 1330080 - DNA, 22 bp, Artificial Sequence
  chemically synthesized
cttcaagggtcaaatgagataa

SEQ ID NO: 1330081 - DNA, 22 bp, Artificial Sequence
  chemically synthesized
agttacttcaagggtcaaatga

SEQ ID NO: 1330082 - DNA, 22 bp, Artificial Sequence
  chemically synthesized
ggttcagttacttcaagggtca

SEQ ID NO: 1330083 - DNA, 22 bp, Artificial Sequence
  chemically synthesized
aggttcagttacttcaagggtc

SEQ ID NO: 1330084 - DNA, 22 bp, Artificial Sequence
  chemically synthesized
taggttcagttacttcaagggt

SEQ ID NO: 1330085 - DNA, 22 bp, Artificial Sequence
  chemically synthesized
tatctcatttgacccttgaagt

SEQ ID NO: 1330086 - DNA, 22 bp, Artificial Sequence
  chemically synthesized
ttaggttcagttacttcaaggg

SEQ ID NO: 1330087 - DNA, 22 bp, Artificial Sequence
  chemically synthesized
atctcatttgacccttgaagta

SEQ ID NO: 1330088 - DNA, 22 bp, Artificial Sequence
  chemically synthesized
tttaggttcagttacttcaagg

SEQ ID NO: 1330089 - DNA, 22 bp, Artificial Sequence
  chemically synthesized
tctcatttgacccttgaagtaa

SEQ ID NO: 1330090 - DNA, 22 bp, Artificial Sequence
  chemically synthesized
ctttttaggttcagttacttca

SEQ ID NO: 1330091 - DNA, 22 bp, Artificial Sequence
  chemically synthesized
atttgacccttgaagtaactga

SEQ ID NO: 1330092 - DNA, 22 bp, Artificial Sequence
  chemically synthesized
gacccttgaagtaactgaacct

SEQ ID NO: 1330093 - DNA, 22 bp, Artificial Sequence
  chemically synthesized
acccttgaagtaactgaaccta

SEQ ID NO: 1330094 - DNA, 22 bp, Artificial Sequence
  chemically synthesized
aaaatactgctttttaggttca

SEQ ID NO: 1330095 - DNA, 22 bp, Artificial Sequence
  chemically synthesized
gaagtaactgaacctaaaaagc

SEQ ID NO: 1330096 - DNA, 22 bp, Artificial Sequence
  chemically synthesized
aagtaactgaacctaaaaagca

SEQ ID NO: 1330097 - DNA, 22 bp, Artificial Sequence
  chemically synthesized
atatctaaaaatactgcttttt

SEQ ID NO: 1330098 - DNA, 22 bp, Artificial Sequence
  chemically synthesized
catatctaaaaatactgctttt

SEQ ID NO: 1330099 - DNA, 22 bp, Artificial Sequence
  chemically synthesized
tcatatctaaaaatactgcttt

SEQ ID NO: 1330100 - DNA, 22 bp, Artificial Sequence
  chemically synthesized
aacctaaaaagcagtattttta

SEQ ID NO: 1330101 - DNA, 22 bp, Artificial Sequence
  chemically synthesized
agttttcatatctaaaaatact

SEQ ID NO: 1330102 - DNA, 22 bp, Artificial Sequence
  chemically synthesized
aaaagcagtatttttagatatg

SEQ ID NO: 1330103 - DNA, 22 bp, Artificial Sequence
  chemically synthesized
aatgggcctcagttttcatatc

SEQ ID NO: 1330104 - DNA, 22 bp, Artificial Sequence
  chemically synthesized
atcctcaatgggcctcagtttt

SEQ ID NO: 1330105 - DNA, 22 bp, Artificial Sequence
  chemically synthesized
ttagatatgaaaactgaggccc

SEQ ID NO: 1330106 - DNA, 22 bp, Artificial Sequence
  chemically synthesized
tagatatgaaaactgaggccca

SEQ ID NO: 1330107 - DNA, 22 bp, Artificial Sequence
  chemically synthesized
agatatgaaaactgaggcccat

SEQ ID NO: 1330108 - DNA, 22 bp, Artificial Sequence
  chemically synthesized
gatatgaaaactgaggcccatt

SEQ ID NO: 1330109 - DNA, 22 bp, Artificial Sequence
  chemically synthesized
agaatcattaatcctcaatggg

SEQ ID NO: 1330110 - DNA, 22 bp, Artificial Sequence
  chemically synthesized
gagaatcattaatcctcaatgg

SEQ ID NO: 1330111 - DNA, 22 bp, Artificial Sequence
  chemically synthesized
tgagaatcattaatcctcaatg

SEQ ID NO: 1330112 - DNA, 22 bp, Artificial Sequence
  chemically synthesized
tggctttgagaatcattaatcc

SEQ ID NO: 1330113 - DNA, 22 bp, Artificial Sequence
  chemically synthesized
aggcccattgaggattaatgat

SEQ ID NO: 1330114 - DNA, 22 bp, Artificial Sequence
  chemically synthesized
ccctgtggctttgagaatcatt

SEQ ID NO: 1330115 - DNA, 22 bp, Artificial Sequence
  chemically synthesized
accctgtggctttgagaatcat

SEQ ID NO: 1330116 - DNA, 22 bp, Artificial Sequence
  chemically synthesized
cttaccctgtggctttgagaat

SEQ ID NO: 1330117 - DNA, 22 bp, Artificial Sequence
  chemically synthesized
aggattaatgattctcaaagcc

SEQ ID NO: 1330118 - DNA, 22 bp, Artificial Sequence
  chemically synthesized
ctgcttaccctgtggctttgag

SEQ ID NO: 1330119 - DNA, 22 bp, Artificial Sequence
  chemically synthesized
actgcttaccctgtggctttga

SEQ ID NO: 1330120 - DNA, 22 bp, Artificial Sequence
  chemically synthesized
tactgcttaccctgtggctttg

SEQ ID NO: 1330121 - DNA, 22 bp, Artificial Sequence
  chemically synthesized
atgattctcaaagccacagggt

SEQ ID NO: 1330122 - DNA, 22 bp, Artificial Sequence
  chemically synthesized
taactttactgcttaccctgtg

SEQ ID NO: 1330123 - DNA, 22 bp, Artificial Sequence
  chemically synthesized
tcaaagccacagggtaagcagt

SEQ ID NO: 1330124 - DNA, 22 bp, Artificial Sequence
  chemically synthesized
aaagccacagggtaagcagtaa

SEQ ID NO: 1330125 - DNA, 22 bp, Artificial Sequence
  chemically synthesized
taatcaggacacatgagaggag

SEQ ID NO: 1330126 - DNA, 22 bp, Artificial Sequence
  chemically synthesized
gtaatcaggacacatgagagga

SEQ ID NO: 1330127 - DNA, 22 bp, Artificial Sequence
  chemically synthesized
caactcctctcatgtgtcctga

SEQ ID NO: 1330128 - DNA, 22 bp, Artificial Sequence
  chemically synthesized
ggtaatgatttgtaatcaggac

SEQ ID NO: 1330129 - DNA, 22 bp, Artificial Sequence
  chemically synthesized
ctctcatgtgtcctgattacaa

SEQ ID NO: 1330130 - DNA, 22 bp, Artificial Sequence
  chemically synthesized
tcatgtgtcctgattacaaatc

SEQ ID NO: 1330131 - DNA, 22 bp, Artificial Sequence
  chemically synthesized
atgtgtcctgattacaaatcat

SEQ ID NO: 1330132 - DNA, 22 bp, Artificial Sequence
  chemically synthesized
cagacgttaggtaatgatttgt

SEQ ID NO: 1330133 - DNA, 22 bp, Artificial Sequence
  chemically synthesized
attacaaatcattacctaacgt

SEQ ID NO: 1330134 - DNA, 22 bp, Artificial Sequence
  chemically synthesized
caaatcattacctaacgtctgt

SEQ ID NO: 1330135 - DNA, 22 bp, Artificial Sequence
  chemically synthesized
gatgatgcaaggaaattacaga

SEQ ID NO: 1330136 - DNA, 22 bp, Artificial Sequence
  chemically synthesized
tcgatgatgcaaggaaattaca

SEQ ID NO: 1330137 - DNA, 22 bp, Artificial Sequence
  chemically synthesized
cctaacgtctgtaatttccttg

SEQ ID NO: 1330138 - DNA, 22 bp, Artificial Sequence
  chemically synthesized
aggttctcgatgatgcaaggaa

SEQ ID NO: 1330139 - DNA, 22 bp, Artificial Sequence
  chemically synthesized
acgtctgtaatttccttgcatc

SEQ ID NO: 1330140 - DNA, 22 bp, Artificial Sequence
  chemically synthesized
caggttctcgatgatgcaagga

SEQ ID NO: 1330141 - DNA, 22 bp, Artificial Sequence
  chemically synthesized
taatttccttgcatcatcgaga

SEQ ID NO: 1330142 - DNA, 22 bp, Artificial Sequence
  chemically synthesized
tgataaaagtttcaggttctcg

SEQ ID NO: 1330143 - DNA, 22 bp, Artificial Sequence
  chemically synthesized
ccttgcatcatcgagaacctga

SEQ ID NO: 1330144 - DNA, 22 bp, Artificial Sequence
  chemically synthesized
atgataaaagtttcaggttctc

SEQ ID NO: 1330145 - DNA, 22 bp, Artificial Sequence
  chemically synthesized
cttgcatcatcgagaacctgaa

SEQ ID NO: 1330146 - DNA, 22 bp, Artificial Sequence
  chemically synthesized
tatgataaaagtttcaggttct

SEQ ID NO: 1330147 - DNA, 22 bp, Artificial Sequence
  chemically synthesized
ttatgataaaagtttcaggttc

SEQ ID NO: 1330148 - DNA, 22 bp, Artificial Sequence
  chemically synthesized
gcatcatcgagaacctgaaact

SEQ ID NO: 1330149 - DNA, 22 bp, Artificial Sequence
  chemically synthesized
catcatcgagaacctgaaactt

SEQ ID NO: 1330150 - DNA, 22 bp, Artificial Sequence
  chemically synthesized
gaaatgtttttatgataaaagt

SEQ ID NO: 1330151 - DNA, 22 bp, Artificial Sequence
  chemically synthesized
ctagaaatgtttttatgataaa

SEQ ID NO: 1330152 - DNA, 22 bp, Artificial Sequence
  chemically synthesized
cctagaaatgtttttatgataa

SEQ ID NO: 1330153 - DNA, 22 bp, Artificial Sequence
  chemically synthesized
aaacttttatcataaaaacatt

SEQ ID NO: 1330154 - DNA, 22 bp, Artificial Sequence
  chemically synthesized
ttatcataaaaacatttctagg

SEQ ID NO: 1330155 - DNA, 22 bp, Artificial Sequence
  chemically synthesized
tatcataaaaacatttctagga

SEQ ID NO: 1330156 - DNA, 22 bp, Artificial Sequence
  chemically synthesized
atcataaaaacatttctaggaa

SEQ ID NO: 1330157 - DNA, 22 bp, Artificial Sequence
  chemically synthesized
tcataaaaacatttctaggaaa

SEQ ID NO: 1330158 - DNA, 22 bp, Artificial Sequence
  chemically synthesized
gcgtatggtaccagatttccta

SEQ ID NO: 1330159 - DNA, 22 bp, Artificial Sequence
  chemically synthesized
attagcgtatggtaccagattt

SEQ ID NO: 1330160 - DNA, 22 bp, Artificial Sequence
  chemically synthesized
ctaggaaatctggtaccatacg

SEQ ID NO: 1330161 - DNA, 22 bp, Artificial Sequence
  chemically synthesized
taggaaatctggtaccatacgc

SEQ ID NO: 1330162 - DNA, 22 bp, Artificial Sequence
  chemically synthesized
catagttgattagcgtatggta

SEQ ID NO: 1330163 - DNA, 22 bp, Artificial Sequence
  chemically synthesized
ccatagttgattagcgtatggt

SEQ ID NO: 1330164 - DNA, 22 bp, Artificial Sequence
  chemically synthesized
ggaaatctggtaccatacgcta

SEQ ID NO: 1330165 - DNA, 22 bp, Artificial Sequence
  chemically synthesized
tccatagttgattagcgtatgg

SEQ ID NO: 1330166 - DNA, 22 bp, Artificial Sequence
  chemically synthesized
tttccatagttgattagcgtat

SEQ ID NO: 1330167 - DNA, 22 bp, Artificial Sequence
  chemically synthesized
ctttccatagttgattagcgta

SEQ ID NO: 1330168 - DNA, 22 bp, Artificial Sequence
  chemically synthesized
tctttccatagttgattagcgt

SEQ ID NO: 1330169 - DNA, 22 bp, Artificial Sequence
  chemically synthesized
gtaccatacgctaatcaactat

SEQ ID NO: 1330170 - DNA, 22 bp, Artificial Sequence
  chemically synthesized
aaaatggattttctttccatag

SEQ ID NO: 1330171 - DNA, 22 bp, Artificial Sequence
  chemically synthesized
aaaaatggattttctttccata

SEQ ID NO: 1330172 - DNA, 22 bp, Artificial Sequence
  chemically synthesized
taaaaatggattttctttccat

SEQ ID NO: 1330173 - DNA, 22 bp, Artificial Sequence
  chemically synthesized
ctttaaaaatggattttctttc

SEQ ID NO: 1330174 - DNA, 22 bp, Artificial Sequence
  chemically synthesized
atcaactatggaaagaaaatcc

SEQ ID NO: 1330175 - DNA, 22 bp, Artificial Sequence
  chemically synthesized
agatactcctttaaaaatggat

SEQ ID NO: 1330176 - DNA, 22 bp, Artificial Sequence
  chemically synthesized
tggaaagaaaatccatttttaa

SEQ ID NO: 1330177 - DNA, 22 bp, Artificial Sequence
  chemically synthesized
caacaagttgagatactccttt

SEQ ID NO: 1330178 - DNA, 22 bp, Artificial Sequence
  chemically synthesized
ttaaaggagtatctcaacttgt

SEQ ID NO: 1330179 - DNA, 22 bp, Artificial Sequence
  chemically synthesized
taaaggagtatctcaacttgtt

SEQ ID NO: 1330180 - DNA, 22 bp, Artificial Sequence
  chemically synthesized
tgtgcaaattgcaacaagttga

SEQ ID NO: 1330181 - DNA, 22 bp, Artificial Sequence
  chemically synthesized
aaaggagtatctcaacttgttg

SEQ ID NO: 1330182 - DNA, 22 bp, Artificial Sequence
  chemically synthesized
atgtgcaaattgcaacaagttg

SEQ ID NO: 1330183 - DNA, 22 bp, Artificial Sequence
  chemically synthesized
aaggagtatctcaacttgttgc

SEQ ID NO: 1330184 - DNA, 22 bp, Artificial Sequence
  chemically synthesized
tatgtgcaaattgcaacaagtt

SEQ ID NO: 1330185 - DNA, 22 bp, Artificial Sequence
  chemically synthesized
ttatgtgcaaattgcaacaagt

SEQ ID NO: 1330186 - DNA, 22 bp, Artificial Sequence
  chemically synthesized
aacttgttgcaatttgcacata

SEQ ID NO: 1330187 - DNA, 22 bp, Artificial Sequence
  chemically synthesized
gttgcaatttgcacataaaaat

SEQ ID NO: 1330188 - DNA, 22 bp, Artificial Sequence
  chemically synthesized
ttgcaatttgcacataaaaata

SEQ ID NO: 1330189 - DNA, 22 bp, Artificial Sequence
  chemically synthesized
caatttgcacataaaaatatcc

SEQ ID NO: 1330190 - DNA, 22 bp, Artificial Sequence
  chemically synthesized
gcacataaaaatatcctttgtc

SEQ ID NO: 1330191 - DNA, 22 bp, Artificial Sequence
  chemically synthesized
cacataaaaatatcctttgtct

SEQ ID NO: 1330192 - DNA, 22 bp, Artificial Sequence
  chemically synthesized
tcccgtagtatatgagacaaag

SEQ ID NO: 1330193 - DNA, 22 bp, Artificial Sequence
  chemically synthesized
gtcccgtagtatatgagacaaa

SEQ ID NO: 1330194 - DNA, 22 bp, Artificial Sequence
  chemically synthesized
tgtcccgtagtatatgagacaa

SEQ ID NO: 1330195 - DNA, 22 bp, Artificial Sequence
  chemically synthesized
ttttgtcccgtagtatatgaga

SEQ ID NO: 1330196 - DNA, 22 bp, Artificial Sequence
  chemically synthesized
tgttttgtcccgtagtatatga

SEQ ID NO: 1330197 - DNA, 22 bp, Artificial Sequence
  chemically synthesized
ctgttttgtcccgtagtatatg

SEQ ID NO: 1330198 - DNA, 22 bp, Artificial Sequence
  chemically synthesized
cttctgttttgtcccgtagtat

SEQ ID NO: 1330199 - DNA, 22 bp, Artificial Sequence
  chemically synthesized
tgcttctgttttgtcccgtagt

SEQ ID NO: 1330200 - DNA, 22 bp, Artificial Sequence
  chemically synthesized
ctgcttctgttttgtcccgtag

SEQ ID NO: 1330201 - DNA, 22 bp, Artificial Sequence
  chemically synthesized
tgtctcatatactacgggacaa

SEQ ID NO: 1330202 - DNA, 22 bp, Artificial Sequence
  chemically synthesized
gtctcatatactacgggacaaa

SEQ ID NO: 1330203 - DNA, 22 bp, Artificial Sequence
  chemically synthesized
tctcatatactacgggacaaaa

SEQ ID NO: 1330204 - DNA, 22 bp, Artificial Sequence
  chemically synthesized
tttctgcttctgttttgtcccg

SEQ ID NO: 1330205 - DNA, 22 bp, Artificial Sequence
  chemically synthesized
atatactacgggacaaaacaga

SEQ ID NO: 1330206 - DNA, 22 bp, Artificial Sequence
  chemically synthesized
attgtttctgcttctgttttgt

SEQ ID NO: 1330207 - DNA, 22 bp, Artificial Sequence
  chemically synthesized
cattgtttctgcttctgttttg

SEQ ID NO: 1330208 - DNA, 22 bp, Artificial Sequence
  chemically synthesized
tttcattgtttctgcttctgtt

SEQ ID NO: 1330209 - DNA, 22 bp, Artificial Sequence
  chemically synthesized
cgggacaaaacagaagcagaaa

SEQ ID NO: 1330210 - DNA, 22 bp, Artificial Sequence
  chemically synthesized
atggtgaacctatttcattgtt

SEQ ID NO: 1330211 - DNA, 22 bp, Artificial Sequence
  chemically synthesized
taatggtgaacctatttcattg

SEQ ID NO: 1330212 - DNA, 22 bp, Artificial Sequence
  chemically synthesized
gtcagatctctaatggtgaacc

SEQ ID NO: 1330213 - DNA, 22 bp, Artificial Sequence
  chemically synthesized
aagactagtcagatctctaatg

SEQ ID NO: 1330214 - DNA, 22 bp, Artificial Sequence
  chemically synthesized
caagactagtcagatctctaat

SEQ ID NO: 1330215 - DNA, 22 bp, Artificial Sequence
  chemically synthesized
catttcaagactagtcagatct

SEQ ID NO: 1330216 - DNA, 22 bp, Artificial Sequence
  chemically synthesized
accattagagatctgactagtc

SEQ ID NO: 1330217 - DNA, 22 bp, Artificial Sequence
  chemically synthesized
tctacatttcaagactagtcag

SEQ ID NO: 1330218 - DNA, 22 bp, Artificial Sequence
  chemically synthesized
aattgtctacatttcaagacta

SEQ ID NO: 1330219 - DNA, 22 bp, Artificial Sequence
  chemically synthesized
gagatctgactagtcttgaaat

SEQ ID NO: 1330220 - DNA, 22 bp, Artificial Sequence
  chemically synthesized
atgacctgaattgtctacattt

SEQ ID NO: 1330221 - DNA, 22 bp, Artificial Sequence
  chemically synthesized
actagtcttgaaatgtagacaa

SEQ ID NO: 1330222 - DNA, 22 bp, Artificial Sequence
  chemically synthesized
gtcttgaaatgtagacaattca

SEQ ID NO: 1330223 - DNA, 22 bp, Artificial Sequence
  chemically synthesized
catgactaatgacctgaattgt

SEQ ID NO: 1330224 - DNA, 22 bp, Artificial Sequence
  chemically synthesized
gaaatgtagacaattcaggtca

SEQ ID NO: 1330225 - DNA, 22 bp, Artificial Sequence
  chemically synthesized
aaatgtagacaattcaggtcat

SEQ ID NO: 1330226 - DNA, 22 bp, Artificial Sequence
  chemically synthesized
ggactccatgactaatgacctg

SEQ ID NO: 1330227 - DNA, 22 bp, Artificial Sequence
  chemically synthesized
aggactccatgactaatgacct

SEQ ID NO: 1330228 - DNA, 22 bp, Artificial Sequence
  chemically synthesized
cccttaggactccatgactaat

SEQ ID NO: 1330229 - DNA, 22 bp, Artificial Sequence
  chemically synthesized
ccccttaggactccatgactaa

SEQ ID NO: 1330230 - DNA, 22 bp, Artificial Sequence
  chemically synthesized
tccccttaggactccatgacta

SEQ ID NO: 1330231 - DNA, 22 bp, Artificial Sequence
  chemically synthesized
ttccccttaggactccatgact

SEQ ID NO: 1330232 - DNA, 22 bp, Artificial Sequence
  chemically synthesized
tttccccttaggactccatgac

SEQ ID NO: 1330233 - DNA, 22 bp, Artificial Sequence
  chemically synthesized
aggtcattagtcatggagtcct

SEQ ID NO: 1330234 - DNA, 22 bp, Artificial Sequence
  chemically synthesized
gtcatggagtcctaaggggaaa

SEQ ID NO: 1330235 - DNA, 22 bp, Artificial Sequence
  chemically synthesized
gtgtggaatcaggcatgctttt

SEQ ID NO: 1330236 - DNA, 22 bp, Artificial Sequence
  chemically synthesized
ctagtgtggaatcaggcatgct

SEQ ID NO: 1330237 - DNA, 22 bp, Artificial Sequence
  chemically synthesized
actagtgtggaatcaggcatgc

SEQ ID NO: 1330238 - DNA, 22 bp, Artificial Sequence
  chemically synthesized
tactagtgtggaatcaggcatg

SEQ ID NO: 1330239 - DNA, 22 bp, Artificial Sequence
  chemically synthesized
aggggaaaaagcatgcctgatt

SEQ ID NO: 1330240 - DNA, 22 bp, Artificial Sequence
  chemically synthesized
gctttactagtgtggaatcagg

SEQ ID NO: 1330241 - DNA, 22 bp, Artificial Sequence
  chemically synthesized
tggctttactagtgtggaatca

SEQ ID NO: 1330242 - DNA, 22 bp, Artificial Sequence
  chemically synthesized
ctggctttactagtgtggaatc

SEQ ID NO: 1330243 - DNA, 22 bp, Artificial Sequence
  chemically synthesized
gatagcttctggctttactagt

SEQ ID NO: 1330244 - DNA, 22 bp, Artificial Sequence
  chemically synthesized
attccacactagtaaagccaga

SEQ ID NO: 1330245 - DNA, 22 bp, Artificial Sequence
  chemically synthesized
cacactagtaaagccagaagct

SEQ ID NO: 1330246 - DNA, 22 bp, Artificial Sequence
  chemically synthesized
gtaaagccagaagctatctaat

SEQ ID NO: 1330247 - DNA, 22 bp, Artificial Sequence
  chemically synthesized
agccaagtataggatgtaaatt

SEQ ID NO: 1330248 - DNA, 22 bp, Artificial Sequence
  chemically synthesized
atatcctcagccaagtatagga

SEQ ID NO: 1330249 - DNA, 22 bp, Artificial Sequence
  chemically synthesized
tctaatttacatcctatacttg

SEQ ID NO: 1330250 - DNA, 22 bp, Artificial Sequence
  chemically synthesized
atttacatcctatacttggctg

SEQ ID NO: 1330251 - DNA, 22 bp, Artificial Sequence
  chemically synthesized
acatcctatacttggctgagga

SEQ ID NO: 1330252 - DNA, 22 bp, Artificial Sequence
  chemically synthesized
catcctatacttggctgaggat

SEQ ID NO: 1330253 - DNA, 22 bp, Artificial Sequence
  chemically synthesized
aacacatctgatatcctcagcc

SEQ ID NO: 1330254 - DNA, 22 bp, Artificial Sequence
  chemically synthesized
agcctgaacacatctgatatcc

SEQ ID NO: 1330255 - DNA, 22 bp, Artificial Sequence
  chemically synthesized
tacttggctgaggatatcagat

SEQ ID NO: 1330256 - DNA, 22 bp, Artificial Sequence
  chemically synthesized
ttcagcctgaacacatctgata

SEQ ID NO: 1330257 - DNA, 22 bp, Artificial Sequence
  chemically synthesized
gttcagcctgaacacatctgat

SEQ ID NO: 1330258 - DNA, 22 bp, Artificial Sequence
  chemically synthesized
ggctgaggatatcagatgtgtt

SEQ ID NO: 1330259 - DNA, 22 bp, Artificial Sequence
  chemically synthesized
gctgaggatatcagatgtgttc

SEQ ID NO: 1330260 - DNA, 22 bp, Artificial Sequence
  chemically synthesized
aacttgttcagcctgaacacat

SEQ ID NO: 1330261 - DNA, 22 bp, Artificial Sequence
  chemically synthesized
gaacttgttcagcctgaacaca

SEQ ID NO: 1330262 - DNA, 22 bp, Artificial Sequence
  chemically synthesized
aggatatcagatgtgttcaggc

SEQ ID NO: 1330263 - DNA, 22 bp, Artificial Sequence
  chemically synthesized
aggctgaacaagttcaagactc

SEQ ID NO: 1330264 - DNA, 22 bp, Artificial Sequence
  chemically synthesized
aaaaaaaaaaaaaaaagagtct

SEQ ID NO: 1330265 - DNA, 22 bp, Artificial Sequence
  chemically synthesized
aacaagttcaagactctttttt

SEQ ID NO: 1330266 - DNA, 22 bp, Artificial Sequence
  chemically synthesized
cgtctcaaaaaaaaaaaaaaaa

SEQ ID NO: 1330267 - DNA, 22 bp, Artificial Sequence
  chemically synthesized
aagactcttttttttttttttt

SEQ ID NO: 1330268 - DNA, 22 bp, Artificial Sequence
  chemically synthesized
ttttttttttttttttgagacg

SEQ ID NO: 1330269 - DNA, 22 bp, Artificial Sequence
  chemically synthesized
ttttttttttttttgagacgga

SEQ ID NO: 1330270 - DNA, 22 bp, Artificial Sequence
  chemically synthesized
tttttttttttttgagacggag

SEQ ID NO: 1330271 - DNA, 22 bp, Artificial Sequence
  chemically synthesized
ttttttttttttgagacggagt

SEQ ID NO: 1330272 - DNA, 22 bp, Artificial Sequence
  chemically synthesized
tttttttttttgagacggagtc

SEQ ID NO: 1330273 - DNA, 22 bp, Artificial Sequence
  chemically synthesized
ttttttttttgagacggagtct

SEQ ID NO: 1330274 - DNA, 22 bp, Artificial Sequence
  chemically synthesized
ggcgacagagcgagactccgtc

SEQ ID NO: 1330275 - DNA, 22 bp, Artificial Sequence
  chemically synthesized
tttttttttgagacggagtctc

SEQ ID NO: 1330276 - DNA, 22 bp, Artificial Sequence
  chemically synthesized
ttttttttgagacggagtctcg

SEQ ID NO: 1330277 - DNA, 22 bp, Artificial Sequence
  chemically synthesized
tttttttgagacggagtctcgc

SEQ ID NO: 1330278 - DNA, 22 bp, Artificial Sequence
  chemically synthesized
ttttttgagacggagtctcgct

SEQ ID NO: 1330279 - DNA, 22 bp, Artificial Sequence
  chemically synthesized
tttttgagacggagtctcgctc

SEQ ID NO: 1330280 - DNA, 22 bp, Artificial Sequence
  chemically synthesized
ttttgagacggagtctcgctct

SEQ ID NO: 1330281 - DNA, 22 bp, Artificial Sequence
  chemically synthesized
tttgagacggagtctcgctctg

SEQ ID NO: 1330282 - DNA, 22 bp, Artificial Sequence
  chemically synthesized
cagcctgggcgacagagcgaga

SEQ ID NO: 1330283 - DNA, 22 bp, Artificial Sequence
  chemically synthesized
ttgagacggagtctcgctctgt

SEQ ID NO: 1330284 - DNA, 22 bp, Artificial Sequence
  chemically synthesized
tgagacggagtctcgctctgtc

SEQ ID NO: 1330285 - DNA, 22 bp, Artificial Sequence
  chemically synthesized
gagacggagtctcgctctgtcg

SEQ ID NO: 1330286 - DNA, 22 bp, Artificial Sequence
  chemically synthesized
agacggagtctcgctctgtcgc

SEQ ID NO: 1330287 - DNA, 22 bp, Artificial Sequence
  chemically synthesized
cactccagcctgggcgacagag

SEQ ID NO: 1330288 - DNA, 22 bp, Artificial Sequence
  chemically synthesized
gctctgtcgcccaggctggagt

SEQ ID NO: 1330289 - DNA, 22 bp, Artificial Sequence
  chemically synthesized
tgtcgcccaggctggagtgcag

SEQ ID NO: 1330290 - DNA, 22 bp, Artificial Sequence
  chemically synthesized
tcgcccaggctggagtgcagtg

SEQ ID NO: 1330291 - DNA, 22 bp, Artificial Sequence
  chemically synthesized
cagtgagccgagatcgcgccac

SEQ ID NO: 1330292 - DNA, 22 bp, Artificial Sequence
  chemically synthesized
gcagtgagccgagatcgcgcca

SEQ ID NO: 1330293 - DNA, 22 bp, Artificial Sequence
  chemically synthesized
gagtgcagtggcgcgatctcgg

SEQ ID NO: 1330294 - DNA, 22 bp, Artificial Sequence
  chemically synthesized
ggctcactgcaagctccgcctc

SEQ ID NO: 1330295 - DNA, 22 bp, Artificial Sequence
  chemically synthesized
actgcaagctccgcctcccggg

SEQ ID NO: 1330296 - DNA, 22 bp, Artificial Sequence
  chemically synthesized
caagctccgcctcccgggttca

SEQ ID NO: 1330297 - DNA, 22 bp, Artificial Sequence
  chemically synthesized
aggcaggagaatggcgtgaacc

SEQ ID NO: 1330298 - DNA, 22 bp, Artificial Sequence
  chemically synthesized
cgcctcccgggttcacgccatt

SEQ ID NO: 1330299 - DNA, 22 bp, Artificial Sequence
  chemically synthesized
ccgggttcacgccattctcctg

SEQ ID NO: 1330300 - DNA, 22 bp, Artificial Sequence
  chemically synthesized
gggaggctgaggcaggagaatg

SEQ ID NO: 1330301 - DNA, 22 bp, Artificial Sequence
  chemically synthesized
ctcgggaggctgaggcaggaga

SEQ ID NO: 1330302 - DNA, 22 bp, Artificial Sequence
  chemically synthesized
acgccattctcctgcctcagcc

SEQ ID NO: 1330303 - DNA, 22 bp, Artificial Sequence
  chemically synthesized
tagtcccagctactcgggaggc

SEQ ID NO: 1330304 - DNA, 22 bp, Artificial Sequence
  chemically synthesized
tcctgcctcagcctcccgagta

SEQ ID NO: 1330305 - DNA, 22 bp, Artificial Sequence
  chemically synthesized
ctgcctcagcctcccgagtagc

SEQ ID NO: 1330306 - DNA, 22 bp, Artificial Sequence
  chemically synthesized
cctcagcctcccgagtagctgg

SEQ ID NO: 1330307 - DNA, 22 bp, Artificial Sequence
  chemically synthesized
agcctcccgagtagctgggact

SEQ ID NO: 1330308 - DNA, 22 bp, Artificial Sequence
  chemically synthesized
ccgagtagctgggactacaggc

SEQ ID NO: 1330309 - DNA, 22 bp, Artificial Sequence
  chemically synthesized
gccgggcgtggtagcgggcgcc

SEQ ID NO: 1330310 - DNA, 22 bp, Artificial Sequence
  chemically synthesized
ggactacaggcgcccgctacca

SEQ ID NO: 1330311 - DNA, 22 bp, Artificial Sequence
  chemically synthesized
caggcgcccgctaccacgcccg

SEQ ID NO: 1330312 - DNA, 22 bp, Artificial Sequence
  chemically synthesized
aaaatacaaaaaattagccggg

SEQ ID NO: 1330313 - DNA, 22 bp, Artificial Sequence
  chemically synthesized
cactaaaaatacaaaaaattag

SEQ ID NO: 1330314 - DNA, 22 bp, Artificial Sequence
  chemically synthesized
ccacgcccggctaattttttgt

SEQ ID NO: 1330315 - DNA, 22 bp, Artificial Sequence
  chemically synthesized
attttttgtatttttagtggag

SEQ ID NO: 1330316 - DNA, 22 bp, Artificial Sequence
  chemically synthesized
tttgtatttttagtggagacgg

SEQ ID NO: 1330317 - DNA, 22 bp, Artificial Sequence
  chemically synthesized
ttgtatttttagtggagacggg

SEQ ID NO: 1330318 - DNA, 22 bp, Artificial Sequence
  chemically synthesized
acacggtgaaaccccgtctcca

SEQ ID NO: 1330319 - DNA, 22 bp, Artificial Sequence
  chemically synthesized
tgtatttttagtggagacgggg

SEQ ID NO: 1330320 - DNA, 22 bp, Artificial Sequence
  chemically synthesized
gtatttttagtggagacggggt

SEQ ID NO: 1330321 - DNA, 22 bp, Artificial Sequence
  chemically synthesized
tatttttagtggagacggggtt

SEQ ID NO: 1330322 - DNA, 22 bp, Artificial Sequence
  chemically synthesized
gctaacacggtgaaaccccgtc

SEQ ID NO: 1330323 - DNA, 22 bp, Artificial Sequence
  chemically synthesized
ttagtggagacggggtttcacc

SEQ ID NO: 1330324 - DNA, 22 bp, Artificial Sequence
  chemically synthesized
tagtggagacggggtttcaccg

SEQ ID NO: 1330325 - DNA, 22 bp, Artificial Sequence
  chemically synthesized
agtggagacggggtttcaccgt

SEQ ID NO: 1330326 - DNA, 22 bp, Artificial Sequence
  chemically synthesized
gtggagacggggtttcaccgtg

SEQ ID NO: 1330327 - DNA, 22 bp, Artificial Sequence
  chemically synthesized
caccgtgttagccaggatggtc

SEQ ID NO: 1330328 - DNA, 22 bp, Artificial Sequence
  chemically synthesized
accgtgttagccaggatggtct

SEQ ID NO: 1330329 - DNA, 22 bp, Artificial Sequence
  chemically synthesized
gccaggatggtctcgatctcct

SEQ ID NO: 1330330 - DNA, 22 bp, Artificial Sequence
  chemically synthesized
gatctcctgacctcgtgatccg

SEQ ID NO: 1330331 - DNA, 22 bp, Artificial Sequence
  chemically synthesized
ggaggccgaggcgggcggatca

SEQ ID NO: 1330332 - DNA, 22 bp, Artificial Sequence
  chemically synthesized
gggaggccgaggcgggcggatc

SEQ ID NO: 1330333 - DNA, 22 bp, Artificial Sequence
  chemically synthesized
tgggaggccgaggcgggcggat

SEQ ID NO: 1330334 - DNA, 22 bp, Artificial Sequence
  chemically synthesized
ctgacctcgtgatccgcccgcc

SEQ ID NO: 1330335 - DNA, 22 bp, Artificial Sequence
  chemically synthesized
acctcgtgatccgcccgcctcg

SEQ ID NO: 1330336 - DNA, 22 bp, Artificial Sequence
  chemically synthesized
gtgatccgcccgcctcggcctc

SEQ ID NO: 1330337 - DNA, 22 bp, Artificial Sequence
  chemically synthesized
taatcccagcactttgggaggc

SEQ ID NO: 1330338 - DNA, 22 bp, Artificial Sequence
  chemically synthesized
acgcctgtaatcccagcacttt

SEQ ID NO: 1330339 - DNA, 22 bp, Artificial Sequence
  chemically synthesized
ggcctcccaaagtgctgggatt

SEQ ID NO: 1330340 - DNA, 22 bp, Artificial Sequence
  chemically synthesized
ccaaagtgctgggattacaggc

SEQ ID NO: 1330341 - DNA, 22 bp, Artificial Sequence
  chemically synthesized
gccgggcgcggtggctcacgcc

SEQ ID NO: 1330342 - DNA, 22 bp, Artificial Sequence
  chemically synthesized
ggccgggcgcggtggctcacgc

SEQ ID NO: 1330343 - DNA, 22 bp, Artificial Sequence
  chemically synthesized
ggattacaggcgtgagccaccg

SEQ ID NO: 1330344 - DNA, 22 bp, Artificial Sequence
  chemically synthesized
caggcgtgagccaccgcgcccg

SEQ ID NO: 1330345 - DNA, 22 bp, Artificial Sequence
  chemically synthesized
aagcaagagtcttggccgggcg

SEQ ID NO: 1330346 - DNA, 22 bp, Artificial Sequence
  chemically synthesized
ctcaagcaagagtcttggccgg

SEQ ID NO: 1330347 - DNA, 22 bp, Artificial Sequence
  chemically synthesized
aattactcaagcaagagtcttg

SEQ ID NO: 1330348 - DNA, 22 bp, Artificial Sequence
  chemically synthesized
aaattactcaagcaagagtctt

SEQ ID NO: 1330349 - DNA, 22 bp, Artificial Sequence
  chemically synthesized
taaattactcaagcaagagtct

SEQ ID NO: 1330350 - DNA, 22 bp, Artificial Sequence
  chemically synthesized
tgtcacatccctttaaattact

SEQ ID NO: 1330351 - DNA, 22 bp, Artificial Sequence
  chemically synthesized
ttgcttgagtaatttaaaggga

SEQ ID NO: 1330352 - DNA, 22 bp, Artificial Sequence
  chemically synthesized
agactgtgtcacatccctttaa

SEQ ID NO: 1330353 - DNA, 22 bp, Artificial Sequence
  chemically synthesized
gcttgagtaatttaaagggatg

SEQ ID NO: 1330354 - DNA, 22 bp, Artificial Sequence
  chemically synthesized
cttgagtaatttaaagggatgt

SEQ ID NO: 1330355 - DNA, 22 bp, Artificial Sequence
  chemically synthesized
ttcagactgtgtcacatccctt

SEQ ID NO: 1330356 - DNA, 22 bp, Artificial Sequence
  chemically synthesized
gagtaatttaaagggatgtgac

SEQ ID NO: 1330357 - DNA, 22 bp, Artificial Sequence
  chemically synthesized
agtaatttaaagggatgtgaca

SEQ ID NO: 1330358 - DNA, 22 bp, Artificial Sequence
  chemically synthesized
ctattcagactgtgtcacatcc

SEQ ID NO: 1330359 - DNA, 22 bp, Artificial Sequence
  chemically synthesized
aaagggatgtgacacagtctga

SEQ ID NO: 1330360 - DNA, 22 bp, Artificial Sequence
  chemically synthesized
aagggatgtgacacagtctgaa

SEQ ID NO: 1330361 - DNA, 22 bp, Artificial Sequence
  chemically synthesized
aataaccaattactattcagac

SEQ ID NO: 1330362 - DNA, 22 bp, Artificial Sequence
  chemically synthesized
ttaaataaccaattactattca

SEQ ID NO: 1330363 - DNA, 22 bp, Artificial Sequence
  chemically synthesized
caggcaggattattaaataacc

SEQ ID NO: 1330364 - DNA, 22 bp, Artificial Sequence
  chemically synthesized
aatagtaattggttatttaata

SEQ ID NO: 1330365 - DNA, 22 bp, Artificial Sequence
  chemically synthesized
ccactgcaggcaggattattaa

SEQ ID NO: 1330366 - DNA, 22 bp, Artificial Sequence
  chemically synthesized
tgttgccactgcaggcaggatt

SEQ ID NO: 1330367 - DNA, 22 bp, Artificial Sequence
  chemically synthesized
atgttgccactgcaggcaggat

SEQ ID NO: 1330368 - DNA, 22 bp, Artificial Sequence
  chemically synthesized
gttatttaataatcctgcctgc

SEQ ID NO: 1330369 - DNA, 22 bp, Artificial Sequence
  chemically synthesized
tttaataatcctgcctgcagtg

SEQ ID NO: 1330370 - DNA, 22 bp, Artificial Sequence
  chemically synthesized
aataatcctgcctgcagtggca

SEQ ID NO: 1330371 - DNA, 22 bp, Artificial Sequence
  chemically synthesized
ataatcctgcctgcagtggcaa

SEQ ID NO: 1330372 - DNA, 22 bp, Artificial Sequence
  chemically synthesized
agagtaaagcaagcttatgttg

SEQ ID NO: 1330373 - DNA, 22 bp, Artificial Sequence
  chemically synthesized
aagagtaaagcaagcttatgtt

SEQ ID NO: 1330374 - DNA, 22 bp, Artificial Sequence
  chemically synthesized
cctgcagtggcaacataagctt

SEQ ID NO: 1330375 - DNA, 22 bp, Artificial Sequence
  chemically synthesized
cagtggcaacataagcttgctt

SEQ ID NO: 1330376 - DNA, 22 bp, Artificial Sequence
  chemically synthesized
tccagtgcttaagagtaaagca

SEQ ID NO: 1330377 - DNA, 22 bp, Artificial Sequence
  chemically synthesized
tcctatccagtgcttaagagta

SEQ ID NO: 1330378 - DNA, 22 bp, Artificial Sequence
  chemically synthesized
gtcctatccagtgcttaagagt

SEQ ID NO: 1330379 - DNA, 22 bp, Artificial Sequence
  chemically synthesized
gctttactcttaagcactggat

SEQ ID NO: 1330380 - DNA, 22 bp, Artificial Sequence
  chemically synthesized
ctttactcttaagcactggata

SEQ ID NO: 1330381 - DNA, 22 bp, Artificial Sequence
  chemically synthesized
tactcttaagcactggatagga

SEQ ID NO: 1330382 - DNA, 22 bp, Artificial Sequence
  chemically synthesized
actcttaagcactggataggac

SEQ ID NO: 1330383 - DNA, 22 bp, Artificial Sequence
  chemically synthesized
ctcttaagcactggataggaca

SEQ ID NO: 1330384 - DNA, 22 bp, Artificial Sequence
  chemically synthesized
agtaagacagtttgtcctatcc

SEQ ID NO: 1330385 - DNA, 22 bp, Artificial Sequence
  chemically synthesized
ttaagcactggataggacaaac

SEQ ID NO: 1330386 - DNA, 22 bp, Artificial Sequence
  chemically synthesized
aagcactggataggacaaactg

SEQ ID NO: 1330387 - DNA, 22 bp, Artificial Sequence
  chemically synthesized
agcactggataggacaaactgt

SEQ ID NO: 1330388 - DNA, 22 bp, Artificial Sequence
  chemically synthesized
ggactgagtaagacagtttgtc

SEQ ID NO: 1330389 - DNA, 22 bp, Artificial Sequence
  chemically synthesized
ctaggactgagtaagacagttt

SEQ ID NO: 1330390 - DNA, 22 bp, Artificial Sequence
  chemically synthesized
cctaggactgagtaagacagtt

SEQ ID NO: 1330391 - DNA, 22 bp, Artificial Sequence
  chemically synthesized
tcctaggactgagtaagacagt

SEQ ID NO: 1330392 - DNA, 22 bp, Artificial Sequence
  chemically synthesized
ttcctaggactgagtaagacag

SEQ ID NO: 1330393 - DNA, 22 bp, Artificial Sequence
  chemically synthesized
gataggacaaactgtcttactc

SEQ ID NO: 1330394 - DNA, 22 bp, Artificial Sequence
  chemically synthesized
ttttcctaggactgagtaagac

SEQ ID NO: 1330395 - DNA, 22 bp, Artificial Sequence
  chemically synthesized
cttttcctaggactgagtaaga

SEQ ID NO: 1330396 - DNA, 22 bp, Artificial Sequence
  chemically synthesized
tcttactcagtcctaggaaaag

SEQ ID NO: 1330397 - DNA, 22 bp, Artificial Sequence
  chemically synthesized
agatgaacgtttcttttcctag

SEQ ID NO: 1330398 - DNA, 22 bp, Artificial Sequence
  chemically synthesized
ttcagatgaacgtttcttttcc

SEQ ID NO: 1330399 - DNA, 22 bp, Artificial Sequence
  chemically synthesized
actcagtcctaggaaaagaaac

SEQ ID NO: 1330400 - DNA, 22 bp, Artificial Sequence
  chemically synthesized
gttcagatgaacgtttcttttc

SEQ ID NO: 1330401 - DNA, 22 bp, Artificial Sequence
  chemically synthesized
ctcagtcctaggaaaagaaacg

SEQ ID NO: 1330402 - DNA, 22 bp, Artificial Sequence
  chemically synthesized
tgttcagatgaacgtttctttt

SEQ ID NO: 1330403 - DNA, 22 bp, Artificial Sequence
  chemically synthesized
ttgttcagatgaacgtttcttt

SEQ ID NO: 1330404 - DNA, 22 bp, Artificial Sequence
  chemically synthesized
agtcctaggaaaagaaacgttc

SEQ ID NO: 1330405 - DNA, 22 bp, Artificial Sequence
  chemically synthesized
aatcttttgttcagatgaacgt

SEQ ID NO: 1330406 - DNA, 22 bp, Artificial Sequence
  chemically synthesized
aaatcttttgttcagatgaacg

SEQ ID NO: 1330407 - DNA, 22 bp, Artificial Sequence
  chemically synthesized
taaatcttttgttcagatgaac

SEQ ID NO: 1330408 - DNA, 22 bp, Artificial Sequence
  chemically synthesized
ggaaaagaaacgttcatctgaa

SEQ ID NO: 1330409 - DNA, 22 bp, Artificial Sequence
  chemically synthesized
acatcaggtcgactttaaatct

SEQ ID NO: 1330410 - DNA, 22 bp, Artificial Sequence
  chemically synthesized
atctgaacaaaagatttaaagt

SEQ ID NO: 1330411 - DNA, 22 bp, Artificial Sequence
  chemically synthesized
cacatcaggtcgactttaaatc

SEQ ID NO: 1330412 - DNA, 22 bp, Artificial Sequence
  chemically synthesized
aacaaaagatttaaagtcgacc

SEQ ID NO: 1330413 - DNA, 22 bp, Artificial Sequence
  chemically synthesized
aggatttcacatcaggtcgact

SEQ ID NO: 1330414 - DNA, 22 bp, Artificial Sequence
  chemically synthesized
caggatttcacatcaggtcgac

SEQ ID NO: 1330415 - DNA, 22 bp, Artificial Sequence
  chemically synthesized
aaagtcgacctgatgtgaaatc

SEQ ID NO: 1330416 - DNA, 22 bp, Artificial Sequence
  chemically synthesized
aagtcgacctgatgtgaaatcc

SEQ ID NO: 1330417 - DNA, 22 bp, Artificial Sequence
  chemically synthesized
aaaatgtatttcaggatttcac

SEQ ID NO: 1330418 - DNA, 22 bp, Artificial Sequence
  chemically synthesized
caaaatgtatttcaggatttca

SEQ ID NO: 1330419 - DNA, 22 bp, Artificial Sequence
  chemically synthesized
tcaaaatgtatttcaggatttc

SEQ ID NO: 1330420 - DNA, 22 bp, Artificial Sequence
  chemically synthesized
attttcaaaatgtatttcagga

SEQ ID NO: 1330421 - DNA, 22 bp, Artificial Sequence
  chemically synthesized
atgtgaaatcctgaaatacatt

SEQ ID NO: 1330422 - DNA, 22 bp, Artificial Sequence
  chemically synthesized
atccattcattttcaaaatgta

SEQ ID NO: 1330423 - DNA, 22 bp, Artificial Sequence
  chemically synthesized
tcgctaatccattcattttcaa

SEQ ID NO: 1330424 - DNA, 22 bp, Artificial Sequence
  chemically synthesized
atcgctaatccattcattttca

SEQ ID NO: 1330425 - DNA, 22 bp, Artificial Sequence
  chemically synthesized
tatcgctaatccattcattttc

SEQ ID NO: 1330426 - DNA, 22 bp, Artificial Sequence
  chemically synthesized
aaatacattttgaaaatgaatg

SEQ ID NO: 1330427 - DNA, 22 bp, Artificial Sequence
  chemically synthesized
attttatcgctaatccattcat

SEQ ID NO: 1330428 - DNA, 22 bp, Artificial Sequence
  chemically synthesized
attaattttatcgctaatccat

SEQ ID NO: 1330429 - DNA, 22 bp, Artificial Sequence
  chemically synthesized
tcattaattttatcgctaatcc

SEQ ID NO: 1330430 - DNA, 22 bp, Artificial Sequence
  chemically synthesized
tgaaaatgaatggattagcgat

SEQ ID NO: 1330431 - DNA, 22 bp, Artificial Sequence
  chemically synthesized
ctcattaattttatcgctaatc

SEQ ID NO: 1330432 - DNA, 22 bp, Artificial Sequence
  chemically synthesized
gaaaatgaatggattagcgata

SEQ ID NO: 1330433 - DNA, 22 bp, Artificial Sequence
  chemically synthesized
aaaatgaatggattagcgataa

SEQ ID NO: 1330434 - DNA, 22 bp, Artificial Sequence
  chemically synthesized
gtcttctcattaattttatcgc

SEQ ID NO: 1330435 - DNA, 22 bp, Artificial Sequence
  chemically synthesized
agtcttctcattaattttatcg

SEQ ID NO: 1330436 - DNA, 22 bp, Artificial Sequence
  chemically synthesized
tagtcttctcattaattttatc

SEQ ID NO: 1330437 - DNA, 22 bp, Artificial Sequence
  chemically synthesized
agagactttagtcttctcatta

SEQ ID NO: 1330438 - DNA, 22 bp, Artificial Sequence
  chemically synthesized
cagagactttagtcttctcatt

SEQ ID NO: 1330439 - DNA, 22 bp, Artificial Sequence
  chemically synthesized
gcgataaaattaatgagaagac

SEQ ID NO: 1330440 - DNA, 22 bp, Artificial Sequence
  chemically synthesized
atttcagagactttagtcttct

SEQ ID NO: 1330441 - DNA, 22 bp, Artificial Sequence
  chemically synthesized
catttcagagactttagtcttc

SEQ ID NO: 1330442 - DNA, 22 bp, Artificial Sequence
  chemically synthesized
atgagaagactaaagtctctga

SEQ ID NO: 1330443 - DNA, 22 bp, Artificial Sequence
  chemically synthesized
tcacatgccaaaaatgtttcat

SEQ ID NO: 1330444 - DNA, 22 bp, Artificial Sequence
  chemically synthesized
aagtctctgaaatgaaacattt

SEQ ID NO: 1330445 - DNA, 22 bp, Artificial Sequence
  chemically synthesized
tgaaatgaaacatttttggcat

SEQ ID NO: 1330446 - DNA, 22 bp, Artificial Sequence
  chemically synthesized
aaatgaaacatttttggcatgt

SEQ ID NO: 1330447 - DNA, 22 bp, Artificial Sequence
  chemically synthesized
aggggagcatatcaggttatca

SEQ ID NO: 1330448 - DNA, 22 bp, Artificial Sequence
  chemically synthesized
gaggggagcatatcaggttatc

SEQ ID NO: 1330449 - DNA, 22 bp, Artificial Sequence
  chemically synthesized
tgaggggagcatatcaggttat

SEQ ID NO: 1330450 - DNA, 22 bp, Artificial Sequence
  chemically synthesized
ttgaggggagcatatcaggtta

SEQ ID NO: 1330451 - DNA, 22 bp, Artificial Sequence
  chemically synthesized
ttggcatgtgataacctgatat

SEQ ID NO: 1330452 - DNA, 22 bp, Artificial Sequence
  chemically synthesized
tggcatgtgataacctgatatg

SEQ ID NO: 1330453 - DNA, 22 bp, Artificial Sequence
  chemically synthesized
ggcatgtgataacctgatatgc

SEQ ID NO: 1330454 - DNA, 22 bp, Artificial Sequence
  chemically synthesized
gcatgtgataacctgatatgct

SEQ ID NO: 1330455 - DNA, 22 bp, Artificial Sequence
  chemically synthesized
caagggacttttgaggggagca

SEQ ID NO: 1330456 - DNA, 22 bp, Artificial Sequence
  chemically synthesized
attccaagggacttttgagggg

SEQ ID NO: 1330457 - DNA, 22 bp, Artificial Sequence
  chemically synthesized
atatgctcccctcaaaagtccc

SEQ ID NO: 1330458 - DNA, 22 bp, Artificial Sequence
  chemically synthesized
ggctaattccaagggacttttg

SEQ ID NO: 1330459 - DNA, 22 bp, Artificial Sequence
  chemically synthesized
ccctcaaaagtcccttggaatt

SEQ ID NO: 1330460 - DNA, 22 bp, Artificial Sequence
  chemically synthesized
agatagctaggctaattccaag

SEQ ID NO: 1330461 - DNA, 22 bp, Artificial Sequence
  chemically synthesized
aaaagtcccttggaattagcct

SEQ ID NO: 1330462 - DNA, 22 bp, Artificial Sequence
  chemically synthesized
tgctgagatagctaggctaatt

SEQ ID NO: 1330463 - DNA, 22 bp, Artificial Sequence
  chemically synthesized
ggaattagcctagctatctcag

SEQ ID NO: 1330464 - DNA, 22 bp, Artificial Sequence
  chemically synthesized
gaattagcctagctatctcagc

SEQ ID NO: 1330465 - DNA, 22 bp, Artificial Sequence
  chemically synthesized
gcctagctatctcagcatagct

SEQ ID NO: 1330466 - DNA, 22 bp, Artificial Sequence
  chemically synthesized
gctatctcagcatagcttttct

SEQ ID NO: 1330467 - DNA, 22 bp, Artificial Sequence
  chemically synthesized
tctcagcatagcttttcttaca

SEQ ID NO: 1330468 - DNA, 22 bp, Artificial Sequence
  chemically synthesized
atgtaatacccatgatgtaaga

SEQ ID NO: 1330469 - DNA, 22 bp, Artificial Sequence
  chemically synthesized
agcatagcttttcttacatcat

SEQ ID NO: 1330470 - DNA, 22 bp, Artificial Sequence
  chemically synthesized
gctaatgtaatacccatgatgt

SEQ ID NO: 1330471 - DNA, 22 bp, Artificial Sequence
  chemically synthesized
ggctaatgtaatacccatgatg

SEQ ID NO: 1330472 - DNA, 22 bp, Artificial Sequence
  chemically synthesized
gcttggctaatgtaatacccat

SEQ ID NO: 1330473 - DNA, 22 bp, Artificial Sequence
  chemically synthesized
ttcttacatcatgggtattaca

SEQ ID NO: 1330474 - DNA, 22 bp, Artificial Sequence
  chemically synthesized
tcttacatcatgggtattacat

SEQ ID NO: 1330475 - DNA, 22 bp, Artificial Sequence
  chemically synthesized
cttacatcatgggtattacatt

SEQ ID NO: 1330476 - DNA, 22 bp, Artificial Sequence
  chemically synthesized
ttacatcatgggtattacatta

SEQ ID NO: 1330477 - DNA, 22 bp, Artificial Sequence
  chemically synthesized
acatcatgggtattacattagc

SEQ ID NO: 1330478 - DNA, 22 bp, Artificial Sequence
  chemically synthesized
catcatgggtattacattagcc

SEQ ID NO: 1330479 - DNA, 22 bp, Artificial Sequence
  chemically synthesized
cattagccaagccaacttgtct

SEQ ID NO: 1330480 - DNA, 22 bp, Artificial Sequence
  chemically synthesized
gccaagccaacttgtctatttg

SEQ ID NO: 1330481 - DNA, 22 bp, Artificial Sequence
  chemically synthesized
gtctatttgtccttgtctcaca

SEQ ID NO: 1330482 - DNA, 22 bp, Artificial Sequence
  chemically synthesized
tctatttgtccttgtctcacat

SEQ ID NO: 1330483 - DNA, 22 bp, Artificial Sequence
  chemically synthesized
agggtgaaaagtgatgtgagac

SEQ ID NO: 1330484 - DNA, 22 bp, Artificial Sequence
  chemically synthesized
tttgtccttgtctcacatcact

SEQ ID NO: 1330485 - DNA, 22 bp, Artificial Sequence
  chemically synthesized
gtccttgtctcacatcactttt

SEQ ID NO: 1330486 - DNA, 22 bp, Artificial Sequence
  chemically synthesized
tccttgtctcacatcacttttc

SEQ ID NO: 1330487 - DNA, 22 bp, Artificial Sequence
  chemically synthesized
gtctcacatcacttttcaccct

SEQ ID NO: 1330488 - DNA, 22 bp, Artificial Sequence
  chemically synthesized
tctcacatcacttttcaccctc

SEQ ID NO: 1330489 - DNA, 22 bp, Artificial Sequence
  chemically synthesized
acatcacttttcaccctcaact

SEQ ID NO: 1330490 - DNA, 22 bp, Artificial Sequence
  chemically synthesized
gcataaatggagtaaaagttga

SEQ ID NO: 1330491 - DNA, 22 bp, Artificial Sequence
  chemically synthesized
ttcaccctcaacttttactcca

SEQ ID NO: 1330492 - DNA, 22 bp, Artificial Sequence
  chemically synthesized
tcaccctcaacttttactccat

SEQ ID NO: 1330493 - DNA, 22 bp, Artificial Sequence
  chemically synthesized
caccctcaacttttactccatt

SEQ ID NO: 1330494 - DNA, 22 bp, Artificial Sequence
  chemically synthesized
accctcaacttttactccattt

SEQ ID NO: 1330495 - DNA, 22 bp, Artificial Sequence
  chemically synthesized
aacttttactccatttatgcca

SEQ ID NO: 1330496 - DNA, 22 bp, Artificial Sequence
  chemically synthesized
tggataaggagattggcataaa

SEQ ID NO: 1330497 - DNA, 22 bp, Artificial Sequence
  chemically synthesized
ctgtggataaggagattggcat

SEQ ID NO: 1330498 - DNA, 22 bp, Artificial Sequence
  chemically synthesized
ttactccatttatgccaatctc

SEQ ID NO: 1330499 - DNA, 22 bp, Artificial Sequence
  chemically synthesized
gctgtggataaggagattggca

SEQ ID NO: 1330500 - DNA, 22 bp, Artificial Sequence
  chemically synthesized
tactccatttatgccaatctcc

SEQ ID NO: 1330501 - DNA, 22 bp, Artificial Sequence
  chemically synthesized
actccatttatgccaatctcct

SEQ ID NO: 1330502 - DNA, 22 bp, Artificial Sequence
  chemically synthesized
ctccatttatgccaatctcctt

SEQ ID NO: 1330503 - DNA, 22 bp, Artificial Sequence
  chemically synthesized
catttatgccaatctccttatc

SEQ ID NO: 1330504 - DNA, 22 bp, Artificial Sequence
  chemically synthesized
atgccaatctccttatccacag

SEQ ID NO: 1330505 - DNA, 22 bp, Artificial Sequence
  chemically synthesized
tgccaatctccttatccacagc

SEQ ID NO: 1330506 - DNA, 22 bp, Artificial Sequence
  chemically synthesized
cttatccacagcaagatgctac

SEQ ID NO: 1330507 - DNA, 22 bp, Artificial Sequence
  chemically synthesized
atccacagcaagatgctacttt

SEQ ID NO: 1330508 - DNA, 22 bp, Artificial Sequence
  chemically synthesized
tccacagcaagatgctactttg

SEQ ID NO: 1330509 - DNA, 22 bp, Artificial Sequence
  chemically synthesized
agaaaggccaaaaagtcaaagt

SEQ ID NO: 1330510 - DNA, 22 bp, Artificial Sequence
  chemically synthesized
ctttgactttttggcctttctc

SEQ ID NO: 1330511 - DNA, 22 bp, Artificial Sequence
  chemically synthesized
tgactttttggcctttctcagc

SEQ ID NO: 1330512 - DNA, 22 bp, Artificial Sequence
  chemically synthesized
gactttttggcctttctcagca

SEQ ID NO: 1330513 - DNA, 22 bp, Artificial Sequence
  chemically synthesized
actttttggcctttctcagcat

SEQ ID NO: 1330514 - DNA, 22 bp, Artificial Sequence
  chemically synthesized
tttggcctttctcagcatgctt

SEQ ID NO: 1330515 - DNA, 22 bp, Artificial Sequence
  chemically synthesized
ttggcctttctcagcatgcttc

SEQ ID NO: 1330516 - DNA, 22 bp, Artificial Sequence
  chemically synthesized
cacagtggtgaagaagcatgct

SEQ ID NO: 1330517 - DNA, 22 bp, Artificial Sequence
  chemically synthesized
tggcctttctcagcatgcttct

SEQ ID NO: 1330518 - DNA, 22 bp, Artificial Sequence
  chemically synthesized
ccacagtggtgaagaagcatgc

SEQ ID NO: 1330519 - DNA, 22 bp, Artificial Sequence
  chemically synthesized
ggcctttctcagcatgcttctt

SEQ ID NO: 1330520 - DNA, 22 bp, Artificial Sequence
  chemically synthesized
gcctttctcagcatgcttcttc

SEQ ID NO: 1330521 - DNA, 22 bp, Artificial Sequence
  chemically synthesized
ttccacagtggtgaagaagcat

SEQ ID NO: 1330522 - DNA, 22 bp, Artificial Sequence
  chemically synthesized
tctcagcatgcttcttcaccac

SEQ ID NO: 1330523 - DNA, 22 bp, Artificial Sequence
  chemically synthesized
ctcagcatgcttcttcaccact

SEQ ID NO: 1330524 - DNA, 22 bp, Artificial Sequence
  chemically synthesized
tcagcatgcttcttcaccactg

SEQ ID NO: 1330525 - DNA, 22 bp, Artificial Sequence
  chemically synthesized
ggaagctcttccacagtggtga

SEQ ID NO: 1330526 - DNA, 22 bp, Artificial Sequence
  chemically synthesized
agcatgcttcttcaccactgtg

SEQ ID NO: 1330527 - DNA, 22 bp, Artificial Sequence
  chemically synthesized
tactgggaagctcttccacagt

SEQ ID NO: 1330528 - DNA, 22 bp, Artificial Sequence
  chemically synthesized
cttcaccactgtggaagagctt

SEQ ID NO: 1330529 - DNA, 22 bp, Artificial Sequence
  chemically synthesized
ttcaccactgtggaagagcttc

SEQ ID NO: 1330530 - DNA, 22 bp, Artificial Sequence
  chemically synthesized
caccactgtggaagagcttccc

SEQ ID NO: 1330531 - DNA, 22 bp, Artificial Sequence
  chemically synthesized
accactgtggaagagcttccca

SEQ ID NO: 1330532 - DNA, 22 bp, Artificial Sequence
  chemically synthesized
tggaagagcttcccagtacaac

SEQ ID NO: 1330533 - DNA, 22 bp, Artificial Sequence
  chemically synthesized
gcagtagtagtagttgtactgg

SEQ ID NO: 1330534 - DNA, 22 bp, Artificial Sequence
  chemically synthesized
tggttggcagtagtagtagttg

SEQ ID NO: 1330535 - DNA, 22 bp, Artificial Sequence
  chemically synthesized
cccagtacaactactactactg

SEQ ID NO: 1330536 - DNA, 22 bp, Artificial Sequence
  chemically synthesized
ccagtacaactactactactgc

SEQ ID NO: 1330537 - DNA, 22 bp, Artificial Sequence
  chemically synthesized
ctactactgccaaccacaacct

SEQ ID NO: 1330538 - DNA, 22 bp, Artificial Sequence
  chemically synthesized
gtgtcagatatggaggttgtgg

SEQ ID NO: 1330539 - DNA, 22 bp, Artificial Sequence
  chemically synthesized
agtgtcagatatggaggttgtg

SEQ ID NO: 1330540 - DNA, 22 bp, Artificial Sequence
  chemically synthesized
ctactgccaaccacaacctcca

SEQ ID NO: 1330541 - DNA, 22 bp, Artificial Sequence
  chemically synthesized
ctgccaaccacaacctccatat

SEQ ID NO: 1330542 - DNA, 22 bp, Artificial Sequence
  chemically synthesized
ccaaccacaacctccatatctg

SEQ ID NO: 1330543 - DNA, 22 bp, Artificial Sequence
  chemically synthesized
gtaggcaaggatttagtgtcag

SEQ ID NO: 1330544 - DNA, 22 bp, Artificial Sequence
  chemically synthesized
agtaggcaaggatttagtgtca

SEQ ID NO: 1330545 - DNA, 22 bp, Artificial Sequence
  chemically synthesized
catatctgacactaaatccttg

SEQ ID NO: 1330546 - DNA, 22 bp, Artificial Sequence
  chemically synthesized
acactaaatccttgcctactaa

SEQ ID NO: 1330547 - DNA, 22 bp, Artificial Sequence
  chemically synthesized
aagataatgagcagtttagtag

SEQ ID NO: 1330548 - DNA, 22 bp, Artificial Sequence
  chemically synthesized
aaagataatgagcagtttagta

SEQ ID NO: 1330549 - DNA, 22 bp, Artificial Sequence
  chemically synthesized
taaagataatgagcagtttagt

SEQ ID NO: 1330550 - DNA, 22 bp, Artificial Sequence
  chemically synthesized
aatccttgcctactaaactgct

SEQ ID NO: 1330551 - DNA, 22 bp, Artificial Sequence
  chemically synthesized
gcctactaaactgctcattatc

SEQ ID NO: 1330552 - DNA, 22 bp, Artificial Sequence
  chemically synthesized
cctactaaactgctcattatct

SEQ ID NO: 1330553 - DNA, 22 bp, Artificial Sequence
  chemically synthesized
ctaaactgctcattatctttaa

SEQ ID NO: 1330554 - DNA, 22 bp, Artificial Sequence
  chemically synthesized
aactgctcattatctttaaaat

SEQ ID NO: 1330555 - DNA, 22 bp, Artificial Sequence
  chemically synthesized
ctcattatctttaaaattggca

SEQ ID NO: 1330556 - DNA, 22 bp, Artificial Sequence
  chemically synthesized
attatctttaaaattggcatca

SEQ ID NO: 1330557 - DNA, 22 bp, Artificial Sequence
  chemically synthesized
tctttaaaattggcatcactca

SEQ ID NO: 1330558 - DNA, 22 bp, Artificial Sequence
  chemically synthesized
taaaattggcatcactcacttc

SEQ ID NO: 1330559 - DNA, 22 bp, Artificial Sequence
  chemically synthesized
aaaattggcatcactcacttct

SEQ ID NO: 1330560 - DNA, 22 bp, Artificial Sequence
  chemically synthesized
aaattggcatcactcacttcta

SEQ ID NO: 1330561 - DNA, 22 bp, Artificial Sequence
  chemically synthesized
gcatcactcacttctacttcac

SEQ ID NO: 1330562 - DNA, 22 bp, Artificial Sequence
  chemically synthesized
gatatcgaacagtggatgtgtg

SEQ ID NO: 1330563 - DNA, 22 bp, Artificial Sequence
  chemically synthesized
acttctacttcacacatccact

SEQ ID NO: 1330564 - DNA, 22 bp, Artificial Sequence
  chemically synthesized
gctggatatcgaacagtggatg

SEQ ID NO: 1330565 - DNA, 22 bp, Artificial Sequence
  chemically synthesized
ggctggatatcgaacagtggat

SEQ ID NO: 1330566 - DNA, 22 bp, Artificial Sequence
  chemically synthesized
ctacttcacacatccactgttc

SEQ ID NO: 1330567 - DNA, 22 bp, Artificial Sequence
  chemically synthesized
tacttcacacatccactgttcg

SEQ ID NO: 1330568 - DNA, 22 bp, Artificial Sequence
  chemically synthesized
cttcacacatccactgttcgat

SEQ ID NO: 1330569 - DNA, 22 bp, Artificial Sequence
  chemically synthesized
cacacatccactgttcgatatc

SEQ ID NO: 1330570 - DNA, 22 bp, Artificial Sequence
  chemically synthesized
acacatccactgttcgatatcc

SEQ ID NO: 1330571 - DNA, 22 bp, Artificial Sequence
  chemically synthesized
ttcgatatccagccaagcctgg

SEQ ID NO: 1330572 - DNA, 22 bp, Artificial Sequence
  chemically synthesized
gatatccagccaagcctggact

SEQ ID NO: 1330573 - DNA, 22 bp, Artificial Sequence
  chemically synthesized
aagtgatcagtcagagtccagg

SEQ ID NO: 1330574 - DNA, 22 bp, Artificial Sequence
  chemically synthesized
tatgtagcactgaagtgatcag

SEQ ID NO: 1330575 - DNA, 22 bp, Artificial Sequence
  chemically synthesized
gtatgtagcactgaagtgatca

SEQ ID NO: 1330576 - DNA, 22 bp, Artificial Sequence
  chemically synthesized
tgtatgtagcactgaagtgatc

SEQ ID NO: 1330577 - DNA, 22 bp, Artificial Sequence
  chemically synthesized
gactctgactgatcacttcagt

SEQ ID NO: 1330578 - DNA, 22 bp, Artificial Sequence
  chemically synthesized
tgactgatcacttcagtgctac

SEQ ID NO: 1330579 - DNA, 22 bp, Artificial Sequence
  chemically synthesized
actgatcacttcagtgctacat

SEQ ID NO: 1330580 - DNA, 22 bp, Artificial Sequence
  chemically synthesized
aggtgtctttgtatgtagcact

SEQ ID NO: 1330581 - DNA, 22 bp, Artificial Sequence
  chemically synthesized
atcacttcagtgctacatacaa

SEQ ID NO: 1330582 - DNA, 22 bp, Artificial Sequence
  chemically synthesized
cagtgctacatacaaagacacc

SEQ ID NO: 1330583 - DNA, 22 bp, Artificial Sequence
  chemically synthesized
agtgctacatacaaagacacct

SEQ ID NO: 1330584 - DNA, 22 bp, Artificial Sequence
  chemically synthesized
aaggaagtaaagtctaaggtgt

SEQ ID NO: 1330585 - DNA, 22 bp, Artificial Sequence
  chemically synthesized
catacaaagacaccttagactt

SEQ ID NO: 1330586 - DNA, 22 bp, Artificial Sequence
  chemically synthesized
aataaagttcaaggaagtaaag

SEQ ID NO: 1330587 - DNA, 22 bp, Artificial Sequence
  chemically synthesized
agactttacttccttgaacttt

SEQ ID NO: 1330588 - DNA, 22 bp, Artificial Sequence
  chemically synthesized
gactttacttccttgaacttta

SEQ ID NO: 1330589 - DNA, 22 bp, Artificial Sequence
  chemically synthesized
tacttccttgaactttattgaa

SEQ ID NO: 1330590 - DNA, 22 bp, Artificial Sequence
  chemically synthesized
acttccttgaactttattgaac

SEQ ID NO: 1330591 - DNA, 22 bp, Artificial Sequence
  chemically synthesized
cttccttgaactttattgaaca

SEQ ID NO: 1330592 - DNA, 22 bp, Artificial Sequence
  chemically synthesized
aaggaagtaaagatgttcaata

SEQ ID NO: 1330593 - DNA, 22 bp, Artificial Sequence
  chemically synthesized
ccttgaactttattgaacatct

SEQ ID NO: 1330594 - DNA, 22 bp, Artificial Sequence
  chemically synthesized
cttgaactttattgaacatctt

SEQ ID NO: 1330595 - DNA, 22 bp, Artificial Sequence
  chemically synthesized
gaactttattgaacatctttac

SEQ ID NO: 1330596 - DNA, 22 bp, Artificial Sequence
  chemically synthesized
aactttattgaacatctttact

SEQ ID NO: 1330597 - DNA, 22 bp, Artificial Sequence
  chemically synthesized
tattgaacatctttacttcctt

SEQ ID NO: 1330598 - DNA, 22 bp, Artificial Sequence
  chemically synthesized
attgaacatctttacttccttg

SEQ ID NO: 1330599 - DNA, 22 bp, Artificial Sequence
  chemically synthesized
ttgaacatctttacttccttga

SEQ ID NO: 1330600 - DNA, 22 bp, Artificial Sequence
  chemically synthesized
tatatacaatgtgttcaaggaa

SEQ ID NO: 1330601 - DNA, 22 bp, Artificial Sequence
  chemically synthesized
aacatctttacttccttgaaca

SEQ ID NO: 1330602 - DNA, 22 bp, Artificial Sequence
  chemically synthesized
ttatatatacaatgtgttcaag

SEQ ID NO: 1330603 - DNA, 22 bp, Artificial Sequence
  chemically synthesized
tattatatatacaatgtgttca

SEQ ID NO: 1330604 - DNA, 22 bp, Artificial Sequence
  chemically synthesized
tctattatatatacaatgtgtt

SEQ ID NO: 1330605 - DNA, 22 bp, Artificial Sequence
  chemically synthesized
ctctattatatatacaatgtgt

SEQ ID NO: 1330606 - DNA, 22 bp, Artificial Sequence
  chemically synthesized
tacttccttgaacacattgtat

SEQ ID NO: 1330607 - DNA, 22 bp, Artificial Sequence
  chemically synthesized
acttccttgaacacattgtata

SEQ ID NO: 1330608 - DNA, 22 bp, Artificial Sequence
  chemically synthesized
cttccttgaacacattgtatat

SEQ ID NO: 1330609 - DNA, 22 bp, Artificial Sequence
  chemically synthesized
cttctctattatatatacaatg

SEQ ID NO: 1330610 - DNA, 22 bp, Artificial Sequence
  chemically synthesized
ccttgaacacattgtatatata

SEQ ID NO: 1330611 - DNA, 22 bp, Artificial Sequence
  chemically synthesized
cttgaacacattgtatatataa

SEQ ID NO: 1330612 - DNA, 22 bp, Artificial Sequence
  chemically synthesized
gaacacattgtatatataatag

SEQ ID NO: 1330613 - DNA, 22 bp, Artificial Sequence
  chemically synthesized
aacacattgtatatataataga

SEQ ID NO: 1330614 - DNA, 22 bp, Artificial Sequence
  chemically synthesized
tatgcctccttctctattatat

SEQ ID NO: 1330615 - DNA, 22 bp, Artificial Sequence
  chemically synthesized
tatatataatagagaaggaggc

SEQ ID NO: 1330616 - DNA, 22 bp, Artificial Sequence
  chemically synthesized
acatatgtcatgttatatgcct

SEQ ID NO: 1330617 - DNA, 22 bp, Artificial Sequence
  chemically synthesized
gacatatgtcatgttatatgcc

SEQ ID NO: 1330618 - DNA, 22 bp, Artificial Sequence
  chemically synthesized
tgacatatgtcatgttatatgc

SEQ ID NO: 1330619 - DNA, 22 bp, Artificial Sequence
  chemically synthesized
ttgacatatgtcatgttatatg

SEQ ID NO: 1330620 - DNA, 22 bp, Artificial Sequence
  chemically synthesized
tatgtgtgtgtgtgtatatata

SEQ ID NO: 1330621 - DNA, 22 bp, Artificial Sequence
  chemically synthesized
atatgtgtgtgtgtgtatatat

SEQ ID NO: 1330622 - DNA, 22 bp, Artificial Sequence
  chemically synthesized
tatatgtgtgtgtgtgtatata

SEQ ID NO: 1330623 - DNA, 22 bp, Artificial Sequence
  chemically synthesized
tatatatatatatacacacaca

SEQ ID NO: 1330624 - DNA, 22 bp, Artificial Sequence
  chemically synthesized
attttatatgtgtgtgtgtgta

SEQ ID NO: 1330625 - DNA, 22 bp, Artificial Sequence
  chemically synthesized
atatatatatatacacacacac

SEQ ID NO: 1330626 - DNA, 22 bp, Artificial Sequence
  chemically synthesized
tatatatatatacacacacaca

SEQ ID NO: 1330627 - DNA, 22 bp, Artificial Sequence
  chemically synthesized
agctcattttatatgtgtgtgt

SEQ ID NO: 1330628 - DNA, 22 bp, Artificial Sequence
  chemically synthesized
gagctcattttatatgtgtgtg

SEQ ID NO: 1330629 - DNA, 22 bp, Artificial Sequence
  chemically synthesized
cttgagctcattttatatgtgt

SEQ ID NO: 1330630 - DNA, 22 bp, Artificial Sequence
  chemically synthesized
ccttgagctcattttatatgtg

SEQ ID NO: 1330631 - DNA, 22 bp, Artificial Sequence
  chemically synthesized
cttccttgagctcattttatat

SEQ ID NO: 1330632 - DNA, 22 bp, Artificial Sequence
  chemically synthesized
acttccttgagctcattttata

SEQ ID NO: 1330633 - DNA, 22 bp, Artificial Sequence
  chemically synthesized
tacttccttgagctcattttat

SEQ ID NO: 1330634 - DNA, 22 bp, Artificial Sequence
  chemically synthesized
tttacttccttgagctcatttt

SEQ ID NO: 1330635 - DNA, 22 bp, Artificial Sequence
  chemically synthesized
caattctttacttccttgagct

SEQ ID NO: 1330636 - DNA, 22 bp, Artificial Sequence
  chemically synthesized
acaattctttacttccttgagc

SEQ ID NO: 1330637 - DNA, 22 bp, Artificial Sequence
  chemically synthesized
aaggaagtaaagaattgtaagt

SEQ ID NO: 1330638 - DNA, 22 bp, Artificial Sequence
  chemically synthesized
gagaaagaagacaatacttaca

SEQ ID NO: 1330639 - DNA, 22 bp, Artificial Sequence
  chemically synthesized
taagtattgtcttctttctcca

SEQ ID NO: 1330640 - DNA, 22 bp, Artificial Sequence
  chemically synthesized
gcaaagaggagtaggtattgga

SEQ ID NO: 1330641 - DNA, 22 bp, Artificial Sequence
  chemically synthesized
agcaaagaggagtaggtattgg

SEQ ID NO: 1330642 - DNA, 22 bp, Artificial Sequence
  chemically synthesized
tcttctttctccaatacctact

SEQ ID NO: 1330643 - DNA, 22 bp, Artificial Sequence
  chemically synthesized
ctttctccaatacctactcctc

SEQ ID NO: 1330644 - DNA, 22 bp, Artificial Sequence
  chemically synthesized
tttctccaatacctactcctct

SEQ ID NO: 1330645 - DNA, 22 bp, Artificial Sequence
  chemically synthesized
atgccttagcaaagaggagtag

SEQ ID NO: 1330646 - DNA, 22 bp, Artificial Sequence
  chemically synthesized
tctccaatacctactcctcttt

SEQ ID NO: 1330647 - DNA, 22 bp, Artificial Sequence
  chemically synthesized
ctccaatacctactcctctttg

SEQ ID NO: 1330648 - DNA, 22 bp, Artificial Sequence
  chemically synthesized
tccaatacctactcctctttgc

SEQ ID NO: 1330649 - DNA, 22 bp, Artificial Sequence
  chemically synthesized
caatacctactcctctttgcta

SEQ ID NO: 1330650 - DNA, 22 bp, Artificial Sequence
  chemically synthesized
ctcctctttgctaaggcatcag

SEQ ID NO: 1330651 - DNA, 22 bp, Artificial Sequence
  chemically synthesized
ctctttgctaaggcatcagatg

SEQ ID NO: 1330652 - DNA, 22 bp, Artificial Sequence
  chemically synthesized
tttgctaaggcatcagatgatg

SEQ ID NO: 1330653 - DNA, 22 bp, Artificial Sequence
  chemically synthesized
agtcacaaacaacatcatctga

SEQ ID NO: 1330654 - DNA, 22 bp, Artificial Sequence
  chemically synthesized
tgctaaggcatcagatgatgtt

SEQ ID NO: 1330655 - DNA, 22 bp, Artificial Sequence
  chemically synthesized
gctaaggcatcagatgatgttg

SEQ ID NO: 1330656 - DNA, 22 bp, Artificial Sequence
  chemically synthesized
ctgagtcacaaacaacatcatc

SEQ ID NO: 1330657 - DNA, 22 bp, Artificial Sequence
  chemically synthesized
ctaaggcatcagatgatgttgt

SEQ ID NO: 1330658 - DNA, 22 bp, Artificial Sequence
  chemically synthesized
actgagtcacaaacaacatcat

SEQ ID NO: 1330659 - DNA, 22 bp, Artificial Sequence
  chemically synthesized
aggcatcagatgatgttgtttg

SEQ ID NO: 1330660 - DNA, 22 bp, Artificial Sequence
  chemically synthesized
atggtggataatagtgatttac

SEQ ID NO: 1330661 - DNA, 22 bp, Artificial Sequence
  chemically synthesized
tttgtgactcagtaaatcacta

SEQ ID NO: 1330662 - DNA, 22 bp, Artificial Sequence
  chemically synthesized
gtgactcagtaaatcactatta

SEQ ID NO: 1330663 - DNA, 22 bp, Artificial Sequence
  chemically synthesized
tgactcagtaaatcactattat

SEQ ID NO: 1330664 - DNA, 22 bp, Artificial Sequence
  chemically synthesized
agttgatggtggataatagtga

SEQ ID NO: 1330665 - DNA, 22 bp, Artificial Sequence
  chemically synthesized
agtaaatcactattatccacca

SEQ ID NO: 1330666 - DNA, 22 bp, Artificial Sequence
  chemically synthesized
ttatccaccatcaactgaacca

SEQ ID NO: 1330667 - DNA, 22 bp, Artificial Sequence
  chemically synthesized
tccaccatcaactgaaccatgc

SEQ ID NO: 1330668 - DNA, 22 bp, Artificial Sequence
  chemically synthesized
atgggaaagagtaacagcatgg

SEQ ID NO: 1330669 - DNA, 22 bp, Artificial Sequence
  chemically synthesized
aaccatgctgttactctttccc

SEQ ID NO: 1330670 - DNA, 22 bp, Artificial Sequence
  chemically synthesized
cggaataaactaatgggaaaga

SEQ ID NO: 1330671 - DNA, 22 bp, Artificial Sequence
  chemically synthesized
gcggaataaactaatgggaaag

SEQ ID NO: 1330672 - DNA, 22 bp, Artificial Sequence
  chemically synthesized
ttactctttcccattagtttat

SEQ ID NO: 1330673 - DNA, 22 bp, Artificial Sequence
  chemically synthesized
ctctttcccattagtttattcc

SEQ ID NO: 1330674 - DNA, 22 bp, Artificial Sequence
  chemically synthesized
atatgtatttgcggaataaact

SEQ ID NO: 1330675 - DNA, 22 bp, Artificial Sequence
  chemically synthesized
aatatgtatttgcggaataaac

SEQ ID NO: 1330676 - DNA, 22 bp, Artificial Sequence
  chemically synthesized
tttcccattagtttattccgca

SEQ ID NO: 1330677 - DNA, 22 bp, Artificial Sequence
  chemically synthesized
tcccattagtttattccgcaaa

SEQ ID NO: 1330678 - DNA, 22 bp, Artificial Sequence
  chemically synthesized
cccattagtttattccgcaaat

SEQ ID NO: 1330679 - DNA, 22 bp, Artificial Sequence
  chemically synthesized
ccattagtttattccgcaaata

SEQ ID NO: 1330680 - DNA, 22 bp, Artificial Sequence
  chemically synthesized
gtttattccgcaaatacatatt

SEQ ID NO: 1330681 - DNA, 22 bp, Artificial Sequence
  chemically synthesized
attccgcaaatacatattaagc

SEQ ID NO: 1330682 - DNA, 22 bp, Artificial Sequence
  chemically synthesized
ttccgcaaatacatattaagct

SEQ ID NO: 1330683 - DNA, 22 bp, Artificial Sequence
  chemically synthesized
cgcaaatacatattaagctact

SEQ ID NO: 1330684 - DNA, 22 bp, Artificial Sequence
  chemically synthesized
tcagtcacgcagtagtagctta

SEQ ID NO: 1330685 - DNA, 22 bp, Artificial Sequence
  chemically synthesized
acatgcatattgtcagtcacgc

SEQ ID NO: 1330686 - DNA, 22 bp, Artificial Sequence
  chemically synthesized
agctactactgcgtgactgaca

SEQ ID NO: 1330687 - DNA, 22 bp, Artificial Sequence
  chemically synthesized
ctactgcgtgactgacaatatg

SEQ ID NO: 1330688 - DNA, 22 bp, Artificial Sequence
  chemically synthesized
ctgcgtgactgacaatatgcat

SEQ ID NO: 1330689 - DNA, 22 bp, Artificial Sequence
  chemically synthesized
aatatacactaacatgcatatt

SEQ ID NO: 1330690 - DNA, 22 bp, Artificial Sequence
  chemically synthesized
cgtgactgacaatatgcatgtt

SEQ ID NO: 1330691 - DNA, 22 bp, Artificial Sequence
  chemically synthesized
acaatatgcatgttagtgtata

SEQ ID NO: 1330692 - DNA, 22 bp, Artificial Sequence
  chemically synthesized
atcgccactgaatatacactaa

SEQ ID NO: 1330693 - DNA, 22 bp, Artificial Sequence
  chemically synthesized
gatcgccactgaatatacacta

SEQ ID NO: 1330694 - DNA, 22 bp, Artificial Sequence
  chemically synthesized
ccttgatcgccactgaatatac

SEQ ID NO: 1330695 - DNA, 22 bp, Artificial Sequence
  chemically synthesized
actgccttgatcgccactgaat

SEQ ID NO: 1330696 - DNA, 22 bp, Artificial Sequence
  chemically synthesized
taactgccttgatcgccactga

SEQ ID NO: 1330697 - DNA, 22 bp, Artificial Sequence
  chemically synthesized
gtgtatattcagtggcgatcaa

SEQ ID NO: 1330698 - DNA, 22 bp, Artificial Sequence
  chemically synthesized
atccatcctctaactgccttga

SEQ ID NO: 1330699 - DNA, 22 bp, Artificial Sequence
  chemically synthesized
ctcatccatcctctaactgcct

SEQ ID NO: 1330700 - DNA, 22 bp, Artificial Sequence
  chemically synthesized
agtggcgatcaaggcagttaga

SEQ ID NO: 1330701 - DNA, 22 bp, Artificial Sequence
  chemically synthesized
tcctcatccatcctctaactgc

SEQ ID NO: 1330702 - DNA, 22 bp, Artificial Sequence
  chemically synthesized
gaatgctctcctcatccatcct

SEQ ID NO: 1330703 - DNA, 22 bp, Artificial Sequence
  chemically synthesized
ctggaatgctctcctcatccat

SEQ ID NO: 1330704 - DNA, 22 bp, Artificial Sequence
  chemically synthesized
cctggaatgctctcctcatcca

SEQ ID NO: 1330705 - DNA, 22 bp, Artificial Sequence
  chemically synthesized
ttcctggaatgctctcctcatc

SEQ ID NO: 1330706 - DNA, 22 bp, Artificial Sequence
  chemically synthesized
cctcttcctggaatgctctcct

SEQ ID NO: 1330707 - DNA, 22 bp, Artificial Sequence
  chemically synthesized
gaggatggatgaggagagcatt

SEQ ID NO: 1330708 - DNA, 22 bp, Artificial Sequence
  chemically synthesized
ttgcctcttcctggaatgctct

SEQ ID NO: 1330709 - DNA, 22 bp, Artificial Sequence
  chemically synthesized
ctattgcctcttcctggaatgc

SEQ ID NO: 1330710 - DNA, 22 bp, Artificial Sequence
  chemically synthesized
tactgctattgcctcttcctgg

SEQ ID NO: 1330711 - DNA, 22 bp, Artificial Sequence
  chemically synthesized
tgtactgctattgcctcttcct

SEQ ID NO: 1330712 - DNA, 22 bp, Artificial Sequence
  chemically synthesized
caggaagaggcaatagcagtac

SEQ ID NO: 1330713 - DNA, 22 bp, Artificial Sequence
  chemically synthesized
aaatgccagtctctgtactgct

SEQ ID NO: 1330714 - DNA, 22 bp, Artificial Sequence
  chemically synthesized
tcaaatgccagtctctgtactg

SEQ ID NO: 1330715 - DNA, 22 bp, Artificial Sequence
  chemically synthesized
ctcaaatgccagtctctgtact

SEQ ID NO: 1330716 - DNA, 22 bp, Artificial Sequence
  chemically synthesized
ccatttctcaaatgccagtctc

SEQ ID NO: 1330717 - DNA, 22 bp, Artificial Sequence
  chemically synthesized
ctgccatttctcaaatgccagt

SEQ ID NO: 1330718 - DNA, 22 bp, Artificial Sequence
  chemically synthesized
acctgctgccatttctcaaatg

SEQ ID NO: 1330719 - DNA, 22 bp, Artificial Sequence
  chemically synthesized
agccatactgacctgctgccat

SEQ ID NO: 1330720 - DNA, 22 bp, Artificial Sequence
  chemically synthesized
gcatttgagaaatggcagcagg

SEQ ID NO: 1330721 - DNA, 22 bp, Artificial Sequence
  chemically synthesized
cagccatactgacctgctgcca

SEQ ID NO: 1330722 - DNA, 22 bp, Artificial Sequence
  chemically synthesized
catttcagccatactgacctgc

SEQ ID NO: 1330723 - DNA, 22 bp, Artificial Sequence
  chemically synthesized
gagaaatggcagcaggtcagta

SEQ ID NO: 1330724 - DNA, 22 bp, Artificial Sequence
  chemically synthesized
agaaatggcagcaggtcagtat

SEQ ID NO: 1330725 - DNA, 22 bp, Artificial Sequence
  chemically synthesized
ctgcatttcagccatactgacc

SEQ ID NO: 1330726 - DNA, 22 bp, Artificial Sequence
  chemically synthesized
gctgcatttcagccatactgac

SEQ ID NO: 1330727 - DNA, 22 bp, Artificial Sequence
  chemically synthesized
cagtcttgctgcatttcagcca

SEQ ID NO: 1330728 - DNA, 22 bp, Artificial Sequence
  chemically synthesized
tgcagtcttgctgcatttcagc

SEQ ID NO: 1330729 - DNA, 22 bp, Artificial Sequence
  chemically synthesized
ctgcagtcttgctgcatttcag

SEQ ID NO: 1330730 - DNA, 22 bp, Artificial Sequence
  chemically synthesized
ttctgcagtcttgctgcatttc

SEQ ID NO: 1330731 - DNA, 22 bp, Artificial Sequence
  chemically synthesized
cttctgcagtcttgctgcattt

SEQ ID NO: 1330732 - DNA, 22 bp, Artificial Sequence
  chemically synthesized
tcttctgcagtcttgctgcatt

SEQ ID NO: 1330733 - DNA, 22 bp, Artificial Sequence
  chemically synthesized
ttcttctgcagtcttgctgcat

SEQ ID NO: 1330734 - DNA, 22 bp, Artificial Sequence
  chemically synthesized
cttttcttctgcagtcttgctg

SEQ ID NO: 1330735 - DNA, 22 bp, Artificial Sequence
  chemically synthesized
ccttttcttctgcagtcttgct

SEQ ID NO: 1330736 - DNA, 22 bp, Artificial Sequence
  chemically synthesized
ttccttttcttctgcagtcttg

SEQ ID NO: 1330737 - DNA, 22 bp, Artificial Sequence
  chemically synthesized
cttccttttcttctgcagtctt

SEQ ID NO: 1330738 - DNA, 22 bp, Artificial Sequence
  chemically synthesized
tcttccttttcttctgcagtct

SEQ ID NO: 1330739 - DNA, 22 bp, Artificial Sequence
  chemically synthesized
ttcttccttttcttctgcagtc

SEQ ID NO: 1330740 - DNA, 22 bp, Artificial Sequence
  chemically synthesized
aaatgcagcaagactgcagaag

SEQ ID NO: 1330741 - DNA, 22 bp, Artificial Sequence
  chemically synthesized
atttttcttccttttcttctgc

SEQ ID NO: 1330742 - DNA, 22 bp, Artificial Sequence
  chemically synthesized
catttttcttccttttcttctg

SEQ ID NO: 1330743 - DNA, 22 bp, Artificial Sequence
  chemically synthesized
cagaagaaaaggaagaaaaatg

SEQ ID NO: 1330744 - DNA, 22 bp, Artificial Sequence
  chemically synthesized
ccaagaaccacacttcattttt

SEQ ID NO: 1330745 - DNA, 22 bp, Artificial Sequence
  chemically synthesized
accaagaaccacacttcatttt

SEQ ID NO: 1330746 - DNA, 22 bp, Artificial Sequence
  chemically synthesized
taccaagaaccacacttcattt

SEQ ID NO: 1330747 - DNA, 22 bp, Artificial Sequence
  chemically synthesized
atgcgtccaatatctttaccaa

SEQ ID NO: 1330748 - DNA, 22 bp, Artificial Sequence
  chemically synthesized
tgatgcgtccaatatctttacc

SEQ ID NO: 1330749 - DNA, 22 bp, Artificial Sequence
  chemically synthesized
ctctgatgcgtccaatatcttt

SEQ ID NO: 1330750 - DNA, 22 bp, Artificial Sequence
  chemically synthesized
ctgctctgatgcgtccaatatc

SEQ ID NO: 1330751 - DNA, 22 bp, Artificial Sequence
  chemically synthesized
ttggtaaagatattggacgcat

SEQ ID NO: 1330752 - DNA, 22 bp, Artificial Sequence
  chemically synthesized
gttactgctctgatgcgtccaa

SEQ ID NO: 1330753 - DNA, 22 bp, Artificial Sequence
  chemically synthesized
ggtaaagatattggacgcatca

SEQ ID NO: 1330754 - DNA, 22 bp, Artificial Sequence
  chemically synthesized
gtaaagatattggacgcatcag

SEQ ID NO: 1330755 - DNA, 22 bp, Artificial Sequence
  chemically synthesized
aaattcgttactgctctgatgc

SEQ ID NO: 1330756 - DNA, 22 bp, Artificial Sequence
  chemically synthesized
attaaaattcgttactgctctg

SEQ ID NO: 1330757 - DNA, 22 bp, Artificial Sequence
  chemically synthesized
tgattaaaattcgttactgctc

SEQ ID NO: 1330758 - DNA, 22 bp, Artificial Sequence
  chemically synthesized
gacgcatcagagcagtaacgaa

SEQ ID NO: 1330759 - DNA, 22 bp, Artificial Sequence
  chemically synthesized
tgtcaatctctgattaaaattc

SEQ ID NO: 1330760 - DNA, 22 bp, Artificial Sequence
  chemically synthesized
taatcagagattgacacaacct

SEQ ID NO: 1330761 - DNA, 22 bp, Artificial Sequence
  chemically synthesized
aaaacataaaccaggttgtgtc

SEQ ID NO: 1330762 - DNA, 22 bp, Artificial Sequence
  chemically synthesized
aatcagagattgacacaacctg

SEQ ID NO: 1330763 - DNA, 22 bp, Artificial Sequence
  chemically synthesized
aaaaacataaaccaggttgtgt

SEQ ID NO: 1330764 - DNA, 22 bp, Artificial Sequence
  chemically synthesized
atcagagattgacacaacctgg

SEQ ID NO: 1330765 - DNA, 22 bp, Artificial Sequence
  chemically synthesized
taaaaacataaaccaggttgtg

SEQ ID NO: 1330766 - DNA, 22 bp, Artificial Sequence
  chemically synthesized
ttaaaaacataaaccaggttgt

SEQ ID NO: 1330767 - DNA, 22 bp, Artificial Sequence
  chemically synthesized
agcttttaaaaacataaaccag

SEQ ID NO: 1330768 - DNA, 22 bp, Artificial Sequence
  chemically synthesized
acacaacctggtttatgttttt

SEQ ID NO: 1330769 - DNA, 22 bp, Artificial Sequence
  chemically synthesized
aaggttgagcttttaaaaacat

SEQ ID NO: 1330770 - DNA, 22 bp, Artificial Sequence
  chemically synthesized
gtttatgtttttaaaagctcaa

SEQ ID NO: 1330771 - DNA, 22 bp, Artificial Sequence
  chemically synthesized
catggcctaaaggttgagcttt

SEQ ID NO: 1330772 - DNA, 22 bp, Artificial Sequence
  chemically synthesized
tacatggcctaaaggttgagct

SEQ ID NO: 1330773 - DNA, 22 bp, Artificial Sequence
  chemically synthesized
atgtttttaaaagctcaacctt

SEQ ID NO: 1330774 - DNA, 22 bp, Artificial Sequence
  chemically synthesized
tgtttttaaaagctcaaccttt

SEQ ID NO: 1330775 - DNA, 22 bp, Artificial Sequence
  chemically synthesized
ttaaaagctcaacctttaggcc

SEQ ID NO: 1330776 - DNA, 22 bp, Artificial Sequence
  chemically synthesized
catactctacatggcctaaagg

SEQ ID NO: 1330777 - DNA, 22 bp, Artificial Sequence
  chemically synthesized
taaaagctcaacctttaggcca

SEQ ID NO: 1330778 - DNA, 22 bp, Artificial Sequence
  chemically synthesized
aaaagctcaacctttaggccat

SEQ ID NO: 1330779 - DNA, 22 bp, Artificial Sequence
  chemically synthesized
aaagctcaacctttaggccatg

SEQ ID NO: 1330780 - DNA, 22 bp, Artificial Sequence
  chemically synthesized
actccatactctacatggccta

SEQ ID NO: 1330781 - DNA, 22 bp, Artificial Sequence
  chemically synthesized
ctcactccatactctacatggc

SEQ ID NO: 1330782 - DNA, 22 bp, Artificial Sequence
  chemically synthesized
tactcactccatactctacatg

SEQ ID NO: 1330783 - DNA, 22 bp, Artificial Sequence
  chemically synthesized
aacctttaggccatgtagagta

SEQ ID NO: 1330784 - DNA, 22 bp, Artificial Sequence
  chemically synthesized
ctactcactccatactctacat

SEQ ID NO: 1330785 - DNA, 22 bp, Artificial Sequence
  chemically synthesized
tctactcactccatactctaca

SEQ ID NO: 1330786 - DNA, 22 bp, Artificial Sequence
  chemically synthesized
ttctactcactccatactctac

SEQ ID NO: 1330787 - DNA, 22 bp, Artificial Sequence
  chemically synthesized
taggccatgtagagtatggagt

SEQ ID NO: 1330788 - DNA, 22 bp, Artificial Sequence
  chemically synthesized
aggccatgtagagtatggagtg

SEQ ID NO: 1330789 - DNA, 22 bp, Artificial Sequence
  chemically synthesized
tccttttctactcactccatac

SEQ ID NO: 1330790 - DNA, 22 bp, Artificial Sequence
  chemically synthesized
ggccatgtagagtatggagtga

SEQ ID NO: 1330791 - DNA, 22 bp, Artificial Sequence
  chemically synthesized
gtccttttctactcactccata

SEQ ID NO: 1330792 - DNA, 22 bp, Artificial Sequence
  chemically synthesized
tgtccttttctactcactccat

SEQ ID NO: 1330793 - DNA, 22 bp, Artificial Sequence
  chemically synthesized
ttgtccttttctactcactcca

SEQ ID NO: 1330794 - DNA, 22 bp, Artificial Sequence
  chemically synthesized
tgcttttgtccttttctactca

SEQ ID NO: 1330795 - DNA, 22 bp, Artificial Sequence
  chemically synthesized
gtgcttttgtccttttctactc

SEQ ID NO: 1330796 - DNA, 22 bp, Artificial Sequence
  chemically synthesized
ccacttgtgcttttgtcctttt

SEQ ID NO: 1330797 - DNA, 22 bp, Artificial Sequence
  chemically synthesized
gccacttgtgcttttgtccttt

SEQ ID NO: 1330798 - DNA, 22 bp, Artificial Sequence
  chemically synthesized
tgccacttgtgcttttgtcctt

SEQ ID NO: 1330799 - DNA, 22 bp, Artificial Sequence
  chemically synthesized
atctttgccacttgtgcttttg

SEQ ID NO: 1330800 - DNA, 22 bp, Artificial Sequence
  chemically synthesized
caataatcccccaactcatctt

SEQ ID NO: 1330801 - DNA, 22 bp, Artificial Sequence
  chemically synthesized
gatactacaataatcccccaac

SEQ ID NO: 1330802 - DNA, 22 bp, Artificial Sequence
  chemically synthesized
agatactacaataatcccccaa

SEQ ID NO: 1330803 - DNA, 22 bp, Artificial Sequence
  chemically synthesized
cccttagatactacaataatcc

SEQ ID NO: 1330804 - DNA, 22 bp, Artificial Sequence
  chemically synthesized
acccttagatactacaataatc

SEQ ID NO: 1330805 - DNA, 22 bp, Artificial Sequence
  chemically synthesized
atttacccttagatactacaat

SEQ ID NO: 1330806 - DNA, 22 bp, Artificial Sequence
  chemically synthesized
ggggattattgtagtatctaag

SEQ ID NO: 1330807 - DNA, 22 bp, Artificial Sequence
  chemically synthesized
gtctaatttacccttagatact

SEQ ID NO: 1330808 - DNA, 22 bp, Artificial Sequence
  chemically synthesized
catcctagtctaatttaccctt

SEQ ID NO: 1330809 - DNA, 22 bp, Artificial Sequence
  chemically synthesized
ttgtagtatctaagggtaaatt

SEQ ID NO: 1330810 - DNA, 22 bp, Artificial Sequence
  chemically synthesized
ccatcctagtctaatttaccct

SEQ ID NO: 1330811 - DNA, 22 bp, Artificial Sequence
  chemically synthesized
tagtatctaagggtaaattaga

SEQ ID NO: 1330812 - DNA, 22 bp, Artificial Sequence
  chemically synthesized
tttccatcctagtctaatttac

SEQ ID NO: 1330813 - DNA, 22 bp, Artificial Sequence
  chemically synthesized
gtttccatcctagtctaattta

SEQ ID NO: 1330814 - DNA, 22 bp, Artificial Sequence
  chemically synthesized
tgtttccatcctagtctaattt

SEQ ID NO: 1330815 - DNA, 22 bp, Artificial Sequence
  chemically synthesized
agggtaaattagactaggatgg

SEQ ID NO: 1330816 - DNA, 22 bp, Artificial Sequence
  chemically synthesized
gactaggatggaaacaaaatat

SEQ ID NO: 1330817 - DNA, 22 bp, Artificial Sequence
  chemically synthesized
ggatggaaacaaaatatatgga

SEQ ID NO: 1330818 - DNA, 22 bp, Artificial Sequence
  chemically synthesized
atggaacagcagagaaaatgga

SEQ ID NO: 1330819 - DNA, 22 bp, Artificial Sequence
  chemically synthesized
tctctgctgttccatgagcctt

SEQ ID NO: 1330820 - DNA, 22 bp, Artificial Sequence
  chemically synthesized
ctctgctgttccatgagccttt

SEQ ID NO: 1330821 - DNA, 22 bp, Artificial Sequence
  chemically synthesized
tctgctgttccatgagcctttt

SEQ ID NO: 1330822 - DNA, 22 bp, Artificial Sequence
  chemically synthesized
tgctgttccatgagccttttct

SEQ ID NO: 1330823 - DNA, 22 bp, Artificial Sequence
  chemically synthesized
ctgttccatgagccttttcttc

SEQ ID NO: 1330824 - DNA, 22 bp, Artificial Sequence
  chemically synthesized
ttccatgagccttttcttcact

SEQ ID NO: 1330825 - DNA, 22 bp, Artificial Sequence
  chemically synthesized
catgagccttttcttcacttac

SEQ ID NO: 1330826 - DNA, 22 bp, Artificial Sequence
  chemically synthesized
ttcttcacttactgggctatct

SEQ ID NO: 1330827 - DNA, 22 bp, Artificial Sequence
  chemically synthesized
tcttcacttactgggctatctg

SEQ ID NO: 1330828 - DNA, 22 bp, Artificial Sequence
  chemically synthesized
tgggagatggaccagatagccc

SEQ ID NO: 1330829 - DNA, 22 bp, Artificial Sequence
  chemically synthesized
cttcacttactgggctatctgg

SEQ ID NO: 1330830 - DNA, 22 bp, Artificial Sequence
  chemically synthesized
ttcacttactgggctatctggt

SEQ ID NO: 1330831 - DNA, 22 bp, Artificial Sequence
  chemically synthesized
cacttactgggctatctggtcc

SEQ ID NO: 1330832 - DNA, 22 bp, Artificial Sequence
  chemically synthesized
gttatgggagatggaccagata

SEQ ID NO: 1330833 - DNA, 22 bp, Artificial Sequence
  chemically synthesized
acttactgggctatctggtcca

SEQ ID NO: 1330834 - DNA, 22 bp, Artificial Sequence
  chemically synthesized
actgggctatctggtccatctc

SEQ ID NO: 1330835 - DNA, 22 bp, Artificial Sequence
  chemically synthesized
ctgggctatctggtccatctcc

SEQ ID NO: 1330836 - DNA, 22 bp, Artificial Sequence
  chemically synthesized
gaagactggttatgggagatgg

SEQ ID NO: 1330837 - DNA, 22 bp, Artificial Sequence
  chemically synthesized
ggctatctggtccatctcccat

SEQ ID NO: 1330838 - DNA, 22 bp, Artificial Sequence
  chemically synthesized
tctggtccatctcccataacca

SEQ ID NO: 1330839 - DNA, 22 bp, Artificial Sequence
  chemically synthesized
gtccatctcccataaccagtct

SEQ ID NO: 1330840 - DNA, 22 bp, Artificial Sequence
  chemically synthesized
ccataaccagtcttctaaccct

SEQ ID NO: 1330841 - DNA, 22 bp, Artificial Sequence
  chemically synthesized
caaatcaataggaagggttaga

SEQ ID NO: 1330842 - DNA, 22 bp, Artificial Sequence
  chemically synthesized
gtgaacctgcaaatcaatagga

SEQ ID NO: 1330843 - DNA, 22 bp, Artificial Sequence
  chemically synthesized
ctaacccttcctattgatttgc

SEQ ID NO: 1330844 - DNA, 22 bp, Artificial Sequence
  chemically synthesized
taacccttcctattgatttgca

SEQ ID NO: 1330845 - DNA, 22 bp, Artificial Sequence
  chemically synthesized
acccttcctattgatttgcagg

SEQ ID NO: 1330846 - DNA, 22 bp, Artificial Sequence
  chemically synthesized
cctattgatttgcaggttcact

SEQ ID NO: 1330847 - DNA, 22 bp, Artificial Sequence
  chemically synthesized
ctattgatttgcaggttcacta

SEQ ID NO: 1330848 - DNA, 22 bp, Artificial Sequence
  chemically synthesized
ttgatttgcaggttcactaact

SEQ ID NO: 1330849 - DNA, 22 bp, Artificial Sequence
  chemically synthesized
atttgcaggttcactaactgtt

SEQ ID NO: 1330850 - DNA, 22 bp, Artificial Sequence
  chemically synthesized
gcaggttcactaactgtttcct

SEQ ID NO: 1330851 - DNA, 22 bp, Artificial Sequence
  chemically synthesized
caggttcactaactgtttcctt

SEQ ID NO: 1330852 - DNA, 22 bp, Artificial Sequence
  chemically synthesized
actaactgtttcctttcgatcc

SEQ ID NO: 1330853 - DNA, 22 bp, Artificial Sequence
  chemically synthesized
actgtttcctttcgatccacct

SEQ ID NO: 1330854 - DNA, 22 bp, Artificial Sequence
  chemically synthesized
aaagtgaacaggaggtggatcg

SEQ ID NO: 1330855 - DNA, 22 bp, Artificial Sequence
  chemically synthesized
tttcctttcgatccacctcctg

SEQ ID NO: 1330856 - DNA, 22 bp, Artificial Sequence
  chemically synthesized
cctttcgatccacctcctgttc

SEQ ID NO: 1330857 - DNA, 22 bp, Artificial Sequence
  chemically synthesized
gtacctaaaagtgaacaggagg

SEQ ID NO: 1330858 - DNA, 22 bp, Artificial Sequence
  chemically synthesized
ctttcgatccacctcctgttca

SEQ ID NO: 1330859 - DNA, 22 bp, Artificial Sequence
  chemically synthesized
agtacctaaaagtgaacaggag

SEQ ID NO: 1330860 - DNA, 22 bp, Artificial Sequence
  chemically synthesized
tcgatccacctcctgttcactt

SEQ ID NO: 1330861 - DNA, 22 bp, Artificial Sequence
  chemically synthesized
tttagtacctaaaagtgaacag

SEQ ID NO: 1330862 - DNA, 22 bp, Artificial Sequence
  chemically synthesized
cgatccacctcctgttcacttt

SEQ ID NO: 1330863 - DNA, 22 bp, Artificial Sequence
  chemically synthesized
gatccacctcctgttcactttt

SEQ ID NO: 1330864 - DNA, 22 bp, Artificial Sequence
  chemically synthesized
tgtttagtacctaaaagtgaac

SEQ ID NO: 1330865 - DNA, 22 bp, Artificial Sequence
  chemically synthesized
actctgtttagtacctaaaagt

SEQ ID NO: 1330866 - DNA, 22 bp, Artificial Sequence
  chemically synthesized
cactctgtttagtacctaaaag

SEQ ID NO: 1330867 - DNA, 22 bp, Artificial Sequence
  chemically synthesized
ctgttcacttttaggtactaaa

SEQ ID NO: 1330868 - DNA, 22 bp, Artificial Sequence
  chemically synthesized
ttcacttttaggtactaaacag

SEQ ID NO: 1330869 - DNA, 22 bp, Artificial Sequence
  chemically synthesized
acttttaggtactaaacagagt

SEQ ID NO: 1330870 - DNA, 22 bp, Artificial Sequence
  chemically synthesized
acacgggatgacttcactctgt

SEQ ID NO: 1330871 - DNA, 22 bp, Artificial Sequence
  chemically synthesized
ttaggtactaaacagagtgaag

SEQ ID NO: 1330872 - DNA, 22 bp, Artificial Sequence
  chemically synthesized
taggtactaaacagagtgaagt

SEQ ID NO: 1330873 - DNA, 22 bp, Artificial Sequence
  chemically synthesized
aggtactaaacagagtgaagtc

SEQ ID NO: 1330874 - DNA, 22 bp, Artificial Sequence
  chemically synthesized
ggtactaaacagagtgaagtca

SEQ ID NO: 1330875 - DNA, 22 bp, Artificial Sequence
  chemically synthesized
aacagagtgaagtcatcccgtg

SEQ ID NO: 1330876 - DNA, 22 bp, Artificial Sequence
  chemically synthesized
gagggagggagggtgaggaaac

SEQ ID NO: 1330877 - DNA, 22 bp, Artificial Sequence
  chemically synthesized
agatgttagagggagggagggt

SEQ ID NO: 1330878 - DNA, 22 bp, Artificial Sequence
  chemically synthesized
aagatgttagagggagggaggg

SEQ ID NO: 1330879 - DNA, 22 bp, Artificial Sequence
  chemically synthesized
cctcaccctccctccctctaac

SEQ ID NO: 1330880 - DNA, 22 bp, Artificial Sequence
  chemically synthesized
ctcaccctccctccctctaaca

SEQ ID NO: 1330881 - DNA, 22 bp, Artificial Sequence
  chemically synthesized
accctccctccctctaacatct

SEQ ID NO: 1330882 - DNA, 22 bp, Artificial Sequence
  chemically synthesized
cctccctctaacatcttaagtg

SEQ ID NO: 1330883 - DNA, 22 bp, Artificial Sequence
  chemically synthesized
cctctaacatcttaagtgcctt

SEQ ID NO: 1330884 - DNA, 22 bp, Artificial Sequence
  chemically synthesized
aacaaaacagggcaaaggcact

SEQ ID NO: 1330885 - DNA, 22 bp, Artificial Sequence
  chemically synthesized
aaacaaaacagggcaaaggcac

SEQ ID NO: 1330886 - DNA, 22 bp, Artificial Sequence
  chemically synthesized
taacatcttaagtgcctttgcc

SEQ ID NO: 1330887 - DNA, 22 bp, Artificial Sequence
  chemically synthesized
acatcttaagtgcctttgccct

SEQ ID NO: 1330888 - DNA, 22 bp, Artificial Sequence
  chemically synthesized
acatgcttaaacaaaacagggc

SEQ ID NO: 1330889 - DNA, 22 bp, Artificial Sequence
  chemically synthesized
cacatgcttaaacaaaacaggg

SEQ ID NO: 1330890 - DNA, 22 bp, Artificial Sequence
  chemically synthesized
aagtgcctttgccctgttttgt

SEQ ID NO: 1330891 - DNA, 22 bp, Artificial Sequence
  chemically synthesized
agtgcctttgccctgttttgtt

SEQ ID NO: 1330892 - DNA, 22 bp, Artificial Sequence
  chemically synthesized
tttcacatgcttaaacaaaaca

SEQ ID NO: 1330893 - DNA, 22 bp, Artificial Sequence
  chemically synthesized
tgccctgttttgtttaagcatg

SEQ ID NO: 1330894 - DNA, 22 bp, Artificial Sequence
  chemically synthesized
gccctgttttgtttaagcatgt

SEQ ID NO: 1330895 - DNA, 22 bp, Artificial Sequence
  chemically synthesized
ccctgttttgtttaagcatgtg

SEQ ID NO: 1330896 - DNA, 22 bp, Artificial Sequence
  chemically synthesized
gcgagaaattgtttcacatgct

SEQ ID NO: 1330897 - DNA, 22 bp, Artificial Sequence
  chemically synthesized
ttttgtttaagcatgtgaaaca

SEQ ID NO: 1330898 - DNA, 22 bp, Artificial Sequence
  chemically synthesized
tgtttaagcatgtgaaacaatt

SEQ ID NO: 1330899 - DNA, 22 bp, Artificial Sequence
  chemically synthesized
gtttaagcatgtgaaacaattt

SEQ ID NO: 1330900 - DNA, 22 bp, Artificial Sequence
  chemically synthesized
tttaagcatgtgaaacaatttc

SEQ ID NO: 1330901 - DNA, 22 bp, Artificial Sequence
  chemically synthesized
aagcatgtgaaacaatttctcg

SEQ ID NO: 1330902 - DNA, 22 bp, Artificial Sequence
  chemically synthesized
agcatgtgaaacaatttctcgc

SEQ ID NO: 1330903 - DNA, 22 bp, Artificial Sequence
  chemically synthesized
aagtaacacagaaggttagcga

SEQ ID NO: 1330904 - DNA, 22 bp, Artificial Sequence
  chemically synthesized
ctcgctaaccttctgtgttact

SEQ ID NO: 1330905 - DNA, 22 bp, Artificial Sequence
  chemically synthesized
gggagaatctaaagtaacacag

SEQ ID NO: 1330906 - DNA, 22 bp, Artificial Sequence
  chemically synthesized
tcgctaaccttctgtgttactt

SEQ ID NO: 1330907 - DNA, 22 bp, Artificial Sequence
  chemically synthesized
gctaaccttctgtgttacttta

SEQ ID NO: 1330908 - DNA, 22 bp, Artificial Sequence
  chemically synthesized
tctggggagaatctaaagtaac

SEQ ID NO: 1330909 - DNA, 22 bp, Artificial Sequence
  chemically synthesized
accttctgtgttactttagatt

SEQ ID NO: 1330910 - DNA, 22 bp, Artificial Sequence
  chemically synthesized
ctgtgttactttagattctccc

SEQ ID NO: 1330911 - DNA, 22 bp, Artificial Sequence
  chemically synthesized
agtgtctgtctggggagaatct

SEQ ID NO: 1330912 - DNA, 22 bp, Artificial Sequence
  chemically synthesized
tgtgttactttagattctcccc

SEQ ID NO: 1330913 - DNA, 22 bp, Artificial Sequence
  chemically synthesized
tgttactttagattctccccag

SEQ ID NO: 1330914 - DNA, 22 bp, Artificial Sequence
  chemically synthesized
cctcagtgtctgtctggggaga

SEQ ID NO: 1330915 - DNA, 22 bp, Artificial Sequence
  chemically synthesized
gcctcagtgtctgtctggggag

SEQ ID NO: 1330916 - DNA, 22 bp, Artificial Sequence
  chemically synthesized
ctttagattctccccagacaga

SEQ ID NO: 1330917 - DNA, 22 bp, Artificial Sequence
  chemically synthesized
tagattctccccagacagacac

SEQ ID NO: 1330918 - DNA, 22 bp, Artificial Sequence
  chemically synthesized
agattctccccagacagacact

SEQ ID NO: 1330919 - DNA, 22 bp, Artificial Sequence
  chemically synthesized
gattctccccagacagacactg

SEQ ID NO: 1330920 - DNA, 22 bp, Artificial Sequence
  chemically synthesized
aaatccttgcctcagtgtctgt

SEQ ID NO: 1330921 - DNA, 22 bp, Artificial Sequence
  chemically synthesized
tccccagacagacactgaggca

SEQ ID NO: 1330922 - DNA, 22 bp, Artificial Sequence
  chemically synthesized
cacctcaaatccttgcctcagt

SEQ ID NO: 1330923 - DNA, 22 bp, Artificial Sequence
  chemically synthesized
cccagacagacactgaggcaag

SEQ ID NO: 1330924 - DNA, 22 bp, Artificial Sequence
  chemically synthesized
tgtacctgcacctcaaatcctt

SEQ ID NO: 1330925 - DNA, 22 bp, Artificial Sequence
  chemically synthesized
aggcaaggatttgaggtgcagg

SEQ ID NO: 1330926 - DNA, 22 bp, Artificial Sequence
  chemically synthesized
ccagataaactgtgtacctgca

SEQ ID NO: 1330927 - DNA, 22 bp, Artificial Sequence
  chemically synthesized
gaggtgcaggtacacagtttat

SEQ ID NO: 1330928 - DNA, 22 bp, Artificial Sequence
  chemically synthesized
aggtgcaggtacacagtttatc

SEQ ID NO: 1330929 - DNA, 22 bp, Artificial Sequence
  chemically synthesized
taatcaattgccagataaactg

SEQ ID NO: 1330930 - DNA, 22 bp, Artificial Sequence
  chemically synthesized
gtaatcaattgccagataaact

SEQ ID NO: 1330931 - DNA, 22 bp, Artificial Sequence
  chemically synthesized
tgtaatcaattgccagataaac

SEQ ID NO: 1330932 - DNA, 22 bp, Artificial Sequence
  chemically synthesized
ttgtaatcaattgccagataaa

SEQ ID NO: 1330933 - DNA, 22 bp, Artificial Sequence
  chemically synthesized
tttgtaatcaattgccagataa

SEQ ID NO: 1330934 - DNA, 22 bp, Artificial Sequence
  chemically synthesized
tactttttgtaatcaattgcca

SEQ ID NO: 1330935 - DNA, 22 bp, Artificial Sequence
  chemically synthesized
gtactttttgtaatcaattgcc

SEQ ID NO: 1330936 - DNA, 22 bp, Artificial Sequence
  chemically synthesized
acttgtactttttgtaatcaat

SEQ ID NO: 1330937 - DNA, 22 bp, Artificial Sequence
  chemically synthesized
tcacttgtactttttgtaatca

SEQ ID NO: 1330938 - DNA, 22 bp, Artificial Sequence
  chemically synthesized
atctggcaattgattacaaaaa

SEQ ID NO: 1330939 - DNA, 22 bp, Artificial Sequence
  chemically synthesized
tctggcaattgattacaaaaag

SEQ ID NO: 1330940 - DNA, 22 bp, Artificial Sequence
  chemically synthesized
ctctcacttgtactttttgtaa

SEQ ID NO: 1330941 - DNA, 22 bp, Artificial Sequence
  chemically synthesized
cctctcacttgtactttttgta

SEQ ID NO: 1330942 - DNA, 22 bp, Artificial Sequence
  chemically synthesized
tcctctcacttgtactttttgt

SEQ ID NO: 1330943 - DNA, 22 bp, Artificial Sequence
  chemically synthesized
gcaattgattacaaaaagtaca

SEQ ID NO: 1330944 - DNA, 22 bp, Artificial Sequence
  chemically synthesized
tttcctctcacttgtacttttt

SEQ ID NO: 1330945 - DNA, 22 bp, Artificial Sequence
  chemically synthesized
tctttcctctcacttgtacttt

SEQ ID NO: 1330946 - DNA, 22 bp, Artificial Sequence
  chemically synthesized
ctctttcctctcacttgtactt

SEQ ID NO: 1330947 - DNA, 22 bp, Artificial Sequence
  chemically synthesized
tctctttcctctcacttgtact

SEQ ID NO: 1330948 - DNA, 22 bp, Artificial Sequence
  chemically synthesized
attacaaaaagtacaagtgaga

SEQ ID NO: 1330949 - DNA, 22 bp, Artificial Sequence
  chemically synthesized
actttctctttcctctcacttg

SEQ ID NO: 1330950 - DNA, 22 bp, Artificial Sequence
  chemically synthesized
caaaaagtacaagtgagaggaa

SEQ ID NO: 1330951 - DNA, 22 bp, Artificial Sequence
  chemically synthesized
atctcactttctctttcctctc

SEQ ID NO: 1330952 - DNA, 22 bp, Artificial Sequence
  chemically synthesized
ctaatctcactttctctttcct

SEQ ID NO: 1330953 - DNA, 22 bp, Artificial Sequence
  chemically synthesized
cctaatctcactttctctttcc

SEQ ID NO: 1330954 - DNA, 22 bp, Artificial Sequence
  chemically synthesized
tcctaatctcactttctctttc

SEQ ID NO: 1330955 - DNA, 22 bp, Artificial Sequence
  chemically synthesized
cctttcctaatctcactttctc

SEQ ID NO: 1330956 - DNA, 22 bp, Artificial Sequence
  chemically synthesized
acctttcctaatctcactttct

SEQ ID NO: 1330957 - DNA, 22 bp, Artificial Sequence
  chemically synthesized
cttacctttcctaatctcactt

SEQ ID NO: 1330958 - DNA, 22 bp, Artificial Sequence
  chemically synthesized
cctccttacctttcctaatctc

SEQ ID NO: 1330959 - DNA, 22 bp, Artificial Sequence
  chemically synthesized
attgcctccttacctttcctaa

SEQ ID NO: 1330960 - DNA, 22 bp, Artificial Sequence
  chemically synthesized
gattgcctccttacctttccta

SEQ ID NO: 1330961 - DNA, 22 bp, Artificial Sequence
  chemically synthesized
tgattgcctccttacctttcct

SEQ ID NO: 1330962 - DNA, 22 bp, Artificial Sequence
  chemically synthesized
acacacctttgattgcctcctt

SEQ ID NO: 1330963 - DNA, 22 bp, Artificial Sequence
  chemically synthesized
ggaaaggtaaggaggcaatcaa

SEQ ID NO: 1330964 - DNA, 22 bp, Artificial Sequence
  chemically synthesized
attgacacacctttgattgcct

SEQ ID NO: 1330965 - DNA, 22 bp, Artificial Sequence
  chemically synthesized
agccccagaataatgtgctcat

SEQ ID NO: 1330966 - DNA, 22 bp, Artificial Sequence
  chemically synthesized
accagcaggactgagccccaga

SEQ ID NO: 1330967 - DNA, 22 bp, Artificial Sequence
  chemically synthesized
agagattcaccagcaggactga

SEQ ID NO: 1330968 - DNA, 22 bp, Artificial Sequence
  chemically synthesized
tcagagattcaccagcaggact

SEQ ID NO: 1330969 - DNA, 22 bp, Artificial Sequence
  chemically synthesized
ttctggggctcagtcctgctgg

SEQ ID NO: 1330970 - DNA, 22 bp, Artificial Sequence
  chemically synthesized
ctcagagattcaccagcaggac

SEQ ID NO: 1330971 - DNA, 22 bp, Artificial Sequence
  chemically synthesized
tggggctcagtcctgctggtga

SEQ ID NO: 1330972 - DNA, 22 bp, Artificial Sequence
  chemically synthesized
gggctcagtcctgctggtgaat

SEQ ID NO: 1330973 - DNA, 22 bp, Artificial Sequence
  chemically synthesized
acagcttctcagagattcacca

SEQ ID NO: 1330974 - DNA, 22 bp, Artificial Sequence
  chemically synthesized
ctcacagcttctcagagattca

SEQ ID NO: 1330975 - DNA, 22 bp, Artificial Sequence
  chemically synthesized
agtcctgctggtgaatctctga

SEQ ID NO: 1330976 - DNA, 22 bp, Artificial Sequence
  chemically synthesized
ctggtgaatctctgagaagctg

SEQ ID NO: 1330977 - DNA, 22 bp, Artificial Sequence
  chemically synthesized
aggcatgttcctcacagcttct

SEQ ID NO: 1330978 - DNA, 22 bp, Artificial Sequence
  chemically synthesized
gtgaatctctgagaagctgtga

SEQ ID NO: 1330979 - DNA, 22 bp, Artificial Sequence
  chemically synthesized
tgaggcatgttcctcacagctt

SEQ ID NO: 1330980 - DNA, 22 bp, Artificial Sequence
  chemically synthesized
tgagaagctgtgaggaacatgc

SEQ ID NO: 1330981 - DNA, 22 bp, Artificial Sequence
  chemically synthesized
agaagctgtgaggaacatgcct

SEQ ID NO: 1330982 - DNA, 22 bp, Artificial Sequence
  chemically synthesized
gtgcataattctgaggcatgtt

SEQ ID NO: 1330983 - DNA, 22 bp, Artificial Sequence
  chemically synthesized
tggtgcataattctgaggcatg

SEQ ID NO: 1330984 - DNA, 22 bp, Artificial Sequence
  chemically synthesized
ctggtgcataattctgaggcat

SEQ ID NO: 1330985 - DNA, 22 bp, Artificial Sequence
  chemically synthesized
tgaggaacatgcctcagaatta

SEQ ID NO: 1330986 - DNA, 22 bp, Artificial Sequence
  chemically synthesized
atcttctggtgcataattctga

SEQ ID NO: 1330987 - DNA, 22 bp, Artificial Sequence
  chemically synthesized
agaattatgcaccagaagatga

SEQ ID NO: 1330988 - DNA, 22 bp, Artificial Sequence
  chemically synthesized
tgcaccagaagatgagatggct

SEQ ID NO: 1330989 - DNA, 22 bp, Artificial Sequence
  chemically synthesized
aaaaaagcacgcagccatctca

SEQ ID NO: 1330990 - DNA, 22 bp, Artificial Sequence
  chemically synthesized
gaaaaaagcacgcagccatctc

SEQ ID NO: 1330991 - DNA, 22 bp, Artificial Sequence
  chemically synthesized
cgaggggatggaagtacttgaa

SEQ ID NO: 1330992 - DNA, 22 bp, Artificial Sequence
  chemically synthesized
cgtgcttttttcaagtacttcc

SEQ ID NO: 1330993 - DNA, 22 bp, Artificial Sequence
  chemically synthesized
actacgaggggatggaagtact

SEQ ID NO: 1330994 - DNA, 22 bp, Artificial Sequence
  chemically synthesized
aactacgaggggatggaagtac

SEQ ID NO: 1330995 - DNA, 22 bp, Artificial Sequence
  chemically synthesized
taactacgaggggatggaagta

SEQ ID NO: 1330996 - DNA, 22 bp, Artificial Sequence
  chemically synthesized
ttttcaagtacttccatcccct

SEQ ID NO: 1330997 - DNA, 22 bp, Artificial Sequence
  chemically synthesized
tttcaagtacttccatcccctc

SEQ ID NO: 1330998 - DNA, 22 bp, Artificial Sequence
  chemically synthesized
ttcaagtacttccatcccctcg

SEQ ID NO: 1330999 - DNA, 22 bp, Artificial Sequence
  chemically synthesized
tcaagtacttccatcccctcgt

SEQ ID NO: 1331000 - DNA, 22 bp, Artificial Sequence
  chemically synthesized
caagtacttccatcccctcgta

SEQ ID NO: 1331001 - DNA, 22 bp, Artificial Sequence
  chemically synthesized
aagtacttccatcccctcgtag

SEQ ID NO: 1331002 - DNA, 22 bp, Artificial Sequence
  chemically synthesized
ccatcccctcgtagttaaaggt

SEQ ID NO: 1331003 - DNA, 22 bp, Artificial Sequence
  chemically synthesized
catcccctcgtagttaaaggtc

SEQ ID NO: 1331004 - DNA, 22 bp, Artificial Sequence
  chemically synthesized
atgtcaccagaagcgaccttta

SEQ ID NO: 1331005 - DNA, 22 bp, Artificial Sequence
  chemically synthesized
tgttaatgtcaccagaagcgac

SEQ ID NO: 1331006 - DNA, 22 bp, Artificial Sequence
  chemically synthesized
gtagttaaaggtcgcttctggt

SEQ ID NO: 1331007 - DNA, 22 bp, Artificial Sequence
  chemically synthesized
aaggtcgcttctggtgacatta

SEQ ID NO: 1331008 - DNA, 22 bp, Artificial Sequence
  chemically synthesized
ctggtgacattaacacaacccc

SEQ ID NO: 1331009 - DNA, 22 bp, Artificial Sequence
  chemically synthesized
tggtgacattaacacaacccct

SEQ ID NO: 1331010 - DNA, 22 bp, Artificial Sequence
  chemically synthesized
gtgacattaacacaacccctca

SEQ ID NO: 1331011 - DNA, 22 bp, Artificial Sequence
  chemically synthesized
acacaacccctcatatttctgg

SEQ ID NO: 1331012 - DNA, 22 bp, Artificial Sequence
  chemically synthesized
taaacaggagtaagccagaaat

SEQ ID NO: 1331013 - DNA, 22 bp, Artificial Sequence
  chemically synthesized
ctataaacaggagtaagccaga

SEQ ID NO: 1331014 - DNA, 22 bp, Artificial Sequence
  chemically synthesized
gctataaacaggagtaagccag

SEQ ID NO: 1331015 - DNA, 22 bp, Artificial Sequence
  chemically synthesized
tgctataaacaggagtaagcca

SEQ ID NO: 1331016 - DNA, 22 bp, Artificial Sequence
  chemically synthesized
ctttgctataaacaggagtaag

SEQ ID NO: 1331017 - DNA, 22 bp, Artificial Sequence
  chemically synthesized
gctttgctataaacaggagtaa

SEQ ID NO: 1331018 - DNA, 22 bp, Artificial Sequence
  chemically synthesized
atatttctggcttactcctgtt

SEQ ID NO: 1331019 - DNA, 22 bp, Artificial Sequence
  chemically synthesized
ctggcttactcctgtttatagc

SEQ ID NO: 1331020 - DNA, 22 bp, Artificial Sequence
  chemically synthesized
tggcttactcctgtttatagca

SEQ ID NO: 1331021 - DNA, 22 bp, Artificial Sequence
  chemically synthesized
gcttactcctgtttatagcaaa

SEQ ID NO: 1331022 - DNA, 22 bp, Artificial Sequence
  chemically synthesized
catgcagtatcttgctttgcta

SEQ ID NO: 1331023 - DNA, 22 bp, Artificial Sequence
  chemically synthesized
actcctgtttatagcaaagcaa

SEQ ID NO: 1331024 - DNA, 22 bp, Artificial Sequence
  chemically synthesized
ctcctgtttatagcaaagcaag

SEQ ID NO: 1331025 - DNA, 22 bp, Artificial Sequence
  chemically synthesized
ctgtttatagcaaagcaagata

SEQ ID NO: 1331026 - DNA, 22 bp, Artificial Sequence
  chemically synthesized
tttatagcaaagcaagatactg

SEQ ID NO: 1331027 - DNA, 22 bp, Artificial Sequence
  chemically synthesized
atagcaaagcaagatactgcat

SEQ ID NO: 1331028 - DNA, 22 bp, Artificial Sequence
  chemically synthesized
tagcaaagcaagatactgcatg

SEQ ID NO: 1331029 - DNA, 22 bp, Artificial Sequence
  chemically synthesized
cccacccgagttccatgcagta

SEQ ID NO: 1331030 - DNA, 22 bp, Artificial Sequence
  chemically synthesized
ccccacccgagttccatgcagt

SEQ ID NO: 1331031 - DNA, 22 bp, Artificial Sequence
  chemically synthesized
tccccacccgagttccatgcag

SEQ ID NO: 1331032 - DNA, 22 bp, Artificial Sequence
  chemically synthesized
tttccccacccgagttccatgc

SEQ ID NO: 1331033 - DNA, 22 bp, Artificial Sequence
  chemically synthesized
ctttccccacccgagttccatg

SEQ ID NO: 1331034 - DNA, 22 bp, Artificial Sequence
  chemically synthesized
ccgcatatttctttccccaccc

SEQ ID NO: 1331035 - DNA, 22 bp, Artificial Sequence
  chemically synthesized
catggaactcgggtggggaaag

SEQ ID NO: 1331036 - DNA, 22 bp, Artificial Sequence
  chemically synthesized
tgccgcatatttctttccccac

SEQ ID NO: 1331037 - DNA, 22 bp, Artificial Sequence
  chemically synthesized
atgttctgccgcatatttcttt

SEQ ID NO: 1331038 - DNA, 22 bp, Artificial Sequence
  chemically synthesized
ctgatgttctgccgcatatttc

SEQ ID NO: 1331039 - DNA, 22 bp, Artificial Sequence
  chemically synthesized
gggtggggaaagaaatatgcgg

SEQ ID NO: 1331040 - DNA, 22 bp, Artificial Sequence
  chemically synthesized
ttgctgatgttctgccgcatat

SEQ ID NO: 1331041 - DNA, 22 bp, Artificial Sequence
  chemically synthesized
aagggataagaagatgtaaaag

SEQ ID NO: 1331042 - DNA, 22 bp, Artificial Sequence
  chemically synthesized
ttacatcttcttatcccttcag

SEQ ID NO: 1331043 - DNA, 22 bp, Artificial Sequence
  chemically synthesized
tacatcttcttatcccttcagg

SEQ ID NO: 1331044 - DNA, 22 bp, Artificial Sequence
  chemically synthesized
acatcttcttatcccttcagga

SEQ ID NO: 1331045 - DNA, 22 bp, Artificial Sequence
  chemically synthesized
catcttcttatcccttcaggat

SEQ ID NO: 1331046 - DNA, 22 bp, Artificial Sequence
  chemically synthesized
cttatcccttcaggatcttgtt

SEQ ID NO: 1331047 - DNA, 22 bp, Artificial Sequence
  chemically synthesized
ttatcccttcaggatcttgttt

SEQ ID NO: 1331048 - DNA, 22 bp, Artificial Sequence
  chemically synthesized
atcccttcaggatcttgtttat

SEQ ID NO: 1331049 - DNA, 22 bp, Artificial Sequence
  chemically synthesized
tcccttcaggatcttgtttatt

SEQ ID NO: 1331050 - DNA, 22 bp, Artificial Sequence
  chemically synthesized
aatagaggagagaaataaacaa

SEQ ID NO: 1331051 - DNA, 22 bp, Artificial Sequence
  chemically synthesized
caatagaggagagaaataaaca

SEQ ID NO: 1331052 - DNA, 22 bp, Artificial Sequence
  chemically synthesized
caggatcttgtttatttctctc

SEQ ID NO: 1331053 - DNA, 22 bp, Artificial Sequence
  chemically synthesized
aggatcttgtttatttctctcc

SEQ ID NO: 1331054 - DNA, 22 bp, Artificial Sequence
  chemically synthesized
aaaagtgtttcaatagaggaga

SEQ ID NO: 1331055 - DNA, 22 bp, Artificial Sequence
  chemically synthesized
gtttatttctctcctctattga

SEQ ID NO: 1331056 - DNA, 22 bp, Artificial Sequence
  chemically synthesized
tttatttctctcctctattgaa

SEQ ID NO: 1331057 - DNA, 22 bp, Artificial Sequence
  chemically synthesized
gcctaaaaagtgtttcaataga

SEQ ID NO: 1331058 - DNA, 22 bp, Artificial Sequence
  chemically synthesized
atttctctcctctattgaaaca

SEQ ID NO: 1331059 - DNA, 22 bp, Artificial Sequence
  chemically synthesized
tttctctcctctattgaaacac

SEQ ID NO: 1331060 - DNA, 22 bp, Artificial Sequence
  chemically synthesized
ctctcctctattgaaacacttt

SEQ ID NO: 1331061 - DNA, 22 bp, Artificial Sequence
  chemically synthesized
tgcctggcctaaaaagtgtttc

SEQ ID NO: 1331062 - DNA, 22 bp, Artificial Sequence
  chemically synthesized
tctcctctattgaaacactttt

SEQ ID NO: 1331063 - DNA, 22 bp, Artificial Sequence
  chemically synthesized
tcctctattgaaacacttttta

SEQ ID NO: 1331064 - DNA, 22 bp, Artificial Sequence
  chemically synthesized
ctctattgaaacactttttagg

SEQ ID NO: 1331065 - DNA, 22 bp, Artificial Sequence
  chemically synthesized
tattgaaacactttttaggcca

SEQ ID NO: 1331066 - DNA, 22 bp, Artificial Sequence
  chemically synthesized
ttgaaacactttttaggccagg

SEQ ID NO: 1331067 - DNA, 22 bp, Artificial Sequence
  chemically synthesized
aaacactttttaggccaggcac

SEQ ID NO: 1331068 - DNA, 22 bp, Artificial Sequence
  chemically synthesized
caggcgtgagccactgtgcctg

SEQ ID NO: 1331069 - DNA, 22 bp, Artificial Sequence
  chemically synthesized
tttaggccaggcacagtggctc

SEQ ID NO: 1331070 - DNA, 22 bp, Artificial Sequence
  chemically synthesized
ttaggccaggcacagtggctca

SEQ ID NO: 1331071 - DNA, 22 bp, Artificial Sequence
  chemically synthesized
ggattacaggcgtgagccactg

SEQ ID NO: 1331072 - DNA, 22 bp, Artificial Sequence
  chemically synthesized
taggccaggcacagtggctcac

SEQ ID NO: 1331073 - DNA, 22 bp, Artificial Sequence
  chemically synthesized
aggccaggcacagtggctcacg

SEQ ID NO: 1331074 - DNA, 22 bp, Artificial Sequence
  chemically synthesized
ggccaggcacagtggctcacgc

SEQ ID NO: 1331075 - DNA, 22 bp, Artificial Sequence
  chemically synthesized
ccaaagtgctgggattacaggc

SEQ ID NO: 1331076 - DNA, 22 bp, Artificial Sequence
  chemically synthesized
ggcctcccaaagtgctgggatt

SEQ ID NO: 1331077 - DNA, 22 bp, Artificial Sequence
  chemically synthesized
acgcctgtaatcccagcacttt

SEQ ID NO: 1331078 - DNA, 22 bp, Artificial Sequence
  chemically synthesized
cctcggcctcccaaagtgctgg

SEQ ID NO: 1331079 - DNA, 22 bp, Artificial Sequence
  chemically synthesized
taatcccagcactttgggaggc

SEQ ID NO: 1331080 - DNA, 22 bp, Artificial Sequence
  chemically synthesized
aggtgatccgcctgcctcggcc

SEQ ID NO: 1331081 - DNA, 22 bp, Artificial Sequence
  chemically synthesized
acctcaggtgatccgcctgcct

SEQ ID NO: 1331082 - DNA, 22 bp, Artificial Sequence
  chemically synthesized
tgggaggccgaggcaggcggat

SEQ ID NO: 1331083 - DNA, 22 bp, Artificial Sequence
  chemically synthesized
gggaggccgaggcaggcggatc

SEQ ID NO: 1331084 - DNA, 22 bp, Artificial Sequence
  chemically synthesized
ctgacctcaggtgatccgcctg

SEQ ID NO: 1331085 - DNA, 22 bp, Artificial Sequence
  chemically synthesized
ggaggccgaggcaggcggatca

SEQ ID NO: 1331086 - DNA, 22 bp, Artificial Sequence
  chemically synthesized
aactcctgacctcaggtgatcc

SEQ ID NO: 1331087 - DNA, 22 bp, Artificial Sequence
  chemically synthesized
gaactcctgacctcaggtgatc

SEQ ID NO: 1331088 - DNA, 22 bp, Artificial Sequence
  chemically synthesized
gtcttgaactcctgacctcagg

SEQ ID NO: 1331089 - DNA, 22 bp, Artificial Sequence
  chemically synthesized
gccaggctggtcttgaactcct

SEQ ID NO: 1331090 - DNA, 22 bp, Artificial Sequence
  chemically synthesized
aggtcaggagttcaagaccagc

SEQ ID NO: 1331091 - DNA, 22 bp, Artificial Sequence
  chemically synthesized
gccacgttggccaggctggtct

SEQ ID NO: 1331092 - DNA, 22 bp, Artificial Sequence
  chemically synthesized
cgccacgttggccaggctggtc

SEQ ID NO: 1331093 - DNA, 22 bp, Artificial Sequence
  chemically synthesized
aagaccagcctggccaacgtgg

SEQ ID NO: 1331094 - DNA, 22 bp, Artificial Sequence
  chemically synthesized
gtagagacggggtttcgccacg

SEQ ID NO: 1331095 - DNA, 22 bp, Artificial Sequence
  chemically synthesized
agtagagacggggtttcgccac

SEQ ID NO: 1331096 - DNA, 22 bp, Artificial Sequence
  chemically synthesized
tagtagagacggggtttcgcca

SEQ ID NO: 1331097 - DNA, 22 bp, Artificial Sequence
  chemically synthesized
ttagtagagacggggtttcgcc

SEQ ID NO: 1331098 - DNA, 22 bp, Artificial Sequence
  chemically synthesized
gccaacgtggcgaaaccccgtc

SEQ ID NO: 1331099 - DNA, 22 bp, Artificial Sequence
  chemically synthesized
tatttttagtagagacggggtt

SEQ ID NO: 1331100 - DNA, 22 bp, Artificial Sequence
  chemically synthesized
gtatttttagtagagacggggt

SEQ ID NO: 1331101 - DNA, 22 bp, Artificial Sequence
  chemically synthesized
tgtatttttagtagagacgggg

SEQ ID NO: 1331102 - DNA, 22 bp, Artificial Sequence
  chemically synthesized
ttgtatttttagtagagacggg

SEQ ID NO: 1331103 - DNA, 22 bp, Artificial Sequence
  chemically synthesized
atttttgtatttttagtagaga

SEQ ID NO: 1331104 - DNA, 22 bp, Artificial Sequence
  chemically synthesized
gctaatttttgtatttttagta

SEQ ID NO: 1331105 - DNA, 22 bp, Artificial Sequence
  chemically synthesized
tactaaaaatacaaaaattagc

SEQ ID NO: 1331106 - DNA, 22 bp, Artificial Sequence
  chemically synthesized
ctaaaaatacaaaaattagcca

SEQ ID NO: 1331107 - DNA, 22 bp, Artificial Sequence
  chemically synthesized
aaaatacaaaaattagccaggt

SEQ ID NO: 1331108 - DNA, 22 bp, Artificial Sequence
  chemically synthesized
taggcacacgccaccacacctg

SEQ ID NO: 1331109 - DNA, 22 bp, Artificial Sequence
  chemically synthesized
ggattataggcacacgccacca

SEQ ID NO: 1331110 - DNA, 22 bp, Artificial Sequence
  chemically synthesized
gccaggtgtggtggcgtgtgcc

SEQ ID NO: 1331111 - DNA, 22 bp, Artificial Sequence
  chemically synthesized
ccgagtagctgggattataggc

SEQ ID NO: 1331112 - DNA, 22 bp, Artificial Sequence
  chemically synthesized
agcctcccgagtagctgggatt

SEQ ID NO: 1331113 - DNA, 22 bp, Artificial Sequence
  chemically synthesized
cctcagcctcccgagtagctgg

SEQ ID NO: 1331114 - DNA, 22 bp, Artificial Sequence
  chemically synthesized
ctgcctcagcctcccgagtagc

SEQ ID NO: 1331115 - DNA, 22 bp, Artificial Sequence
  chemically synthesized
tcctgcctcagcctcccgagta

SEQ ID NO: 1331116 - DNA, 22 bp, Artificial Sequence
  chemically synthesized
taatcccagctactcgggaggc

SEQ ID NO: 1331117 - DNA, 22 bp, Artificial Sequence
  chemically synthesized
aagcgattctcctgcctcagcc

SEQ ID NO: 1331118 - DNA, 22 bp, Artificial Sequence
  chemically synthesized
caagcgattctcctgcctcagc

SEQ ID NO: 1331119 - DNA, 22 bp, Artificial Sequence
  chemically synthesized
tttcaagcgattctcctgcctc

SEQ ID NO: 1331120 - DNA, 22 bp, Artificial Sequence
  chemically synthesized
ctcgggaggctgaggcaggaga

SEQ ID NO: 1331121 - DNA, 22 bp, Artificial Sequence
  chemically synthesized
gggaggctgaggcaggagaatc

SEQ ID NO: 1331122 - DNA, 22 bp, Artificial Sequence
  chemically synthesized
cctgtttcaagcgattctcctg

SEQ ID NO: 1331123 - DNA, 22 bp, Artificial Sequence
  chemically synthesized
cgcctccctgtttcaagcgatt

SEQ ID NO: 1331124 - DNA, 22 bp, Artificial Sequence
  chemically synthesized
aggcaggagaatcgcttgaaac

SEQ ID NO: 1331125 - DNA, 22 bp, Artificial Sequence
  chemically synthesized
caacctccgcctccctgtttca

SEQ ID NO: 1331126 - DNA, 22 bp, Artificial Sequence
  chemically synthesized
actgcaacctccgcctccctgt

SEQ ID NO: 1331127 - DNA, 22 bp, Artificial Sequence
  chemically synthesized
agctcactgcaacctccgcctc

SEQ ID NO: 1331128 - DNA, 22 bp, Artificial Sequence
  chemically synthesized
gaaacagggaggcggaggttgc

SEQ ID NO: 1331129 - DNA, 22 bp, Artificial Sequence
  chemically synthesized
aaacagggaggcggaggttgca

SEQ ID NO: 1331130 - DNA, 22 bp, Artificial Sequence
  chemically synthesized
gagtgcagtggcacgatctcag

SEQ ID NO: 1331131 - DNA, 22 bp, Artificial Sequence
  chemically synthesized
cagtgagctgagatcgtgccac

SEQ ID NO: 1331132 - DNA, 22 bp, Artificial Sequence
  chemically synthesized
tcacccaggctggagtgcagtg

SEQ ID NO: 1331133 - DNA, 22 bp, Artificial Sequence
  chemically synthesized
tgtcacccaggctggagtgcag

SEQ ID NO: 1331134 - DNA, 22 bp, Artificial Sequence
  chemically synthesized
agatcgtgccactgcactccag

SEQ ID NO: 1331135 - DNA, 22 bp, Artificial Sequence
  chemically synthesized
agagagtcatgctctgtcaccc

SEQ ID NO: 1331136 - DNA, 22 bp, Artificial Sequence
  chemically synthesized
cactccagcctgggtgacagag

SEQ ID NO: 1331137 - DNA, 22 bp, Artificial Sequence
  chemically synthesized
gagagagtcatgctctgtcacc

SEQ ID NO: 1331138 - DNA, 22 bp, Artificial Sequence
  chemically synthesized
tgagagagtcatgctctgtcac

SEQ ID NO: 1331139 - DNA, 22 bp, Artificial Sequence
  chemically synthesized
ttgagagagtcatgctctgtca

SEQ ID NO: 1331140 - DNA, 22 bp, Artificial Sequence
  chemically synthesized
tttgagagagtcatgctctgtc

SEQ ID NO: 1331141 - DNA, 22 bp, Artificial Sequence
  chemically synthesized
ttttgagagagtcatgctctgt

SEQ ID NO: 1331142 - DNA, 22 bp, Artificial Sequence
  chemically synthesized
cagcctgggtgacagagcatga

SEQ ID NO: 1331143 - DNA, 22 bp, Artificial Sequence
  chemically synthesized
tttttgagagagtcatgctctg

SEQ ID NO: 1331144 - DNA, 22 bp, Artificial Sequence
  chemically synthesized
ttttttgagagagtcatgctct

SEQ ID NO: 1331145 - DNA, 22 bp, Artificial Sequence
  chemically synthesized
tttttttgagagagtcatgctc

SEQ ID NO: 1331146 - DNA, 22 bp, Artificial Sequence
  chemically synthesized
ttttttttgagagagtcatgct

SEQ ID NO: 1331147 - DNA, 22 bp, Artificial Sequence
  chemically synthesized
tttttttttgagagagtcatgc

SEQ ID NO: 1331148 - DNA, 22 bp, Artificial Sequence
  chemically synthesized
ttttttttttgagagagtcatg

SEQ ID NO: 1331149 - DNA, 22 bp, Artificial Sequence
  chemically synthesized
tttttttttttgagagagtcat

SEQ ID NO: 1331150 - DNA, 22 bp, Artificial Sequence
  chemically synthesized
ggtgacagagcatgactctctc

SEQ ID NO: 1331151 - DNA, 22 bp, Artificial Sequence
  chemically synthesized
ttttttttttttgagagagtca

SEQ ID NO: 1331152 - DNA, 22 bp, Artificial Sequence
  chemically synthesized
tttttttttttttgagagagtc

SEQ ID NO: 1331153 - DNA, 22 bp, Artificial Sequence
  chemically synthesized
ttttttttttttttgagagagt

SEQ ID NO: 1331154 - DNA, 22 bp, Artificial Sequence
  chemically synthesized
tttttttttttttttgagagag

SEQ ID NO: 1331155 - DNA, 22 bp, Artificial Sequence
  chemically synthesized
ttttttttttttttttgagaga

SEQ ID NO: 1331156 - DNA, 22 bp, Artificial Sequence
  chemically synthesized
tttttttttttttttttgagag

SEQ ID NO: 1331157 - DNA, 22 bp, Artificial Sequence
  chemically synthesized
ttttttttttttttttttgaga

SEQ ID NO: 1331158 - DNA, 22 bp, Artificial Sequence
  chemically synthesized
tttttttttttttttttttgag

SEQ ID NO: 1331159 - DNA, 22 bp, Artificial Sequence
  chemically synthesized
ttttttttttttttttttttga

SEQ ID NO: 1331160 - DNA, 22 bp, Artificial Sequence
  chemically synthesized
tttttttttttttttttttttg

SEQ ID NO: 1331161 - DNA, 22 bp, Artificial Sequence
  chemically synthesized
tttttttttttttttttttttt

SEQ ID NO: 1331162 - DNA, 22 bp, Artificial Sequence
  chemically synthesized
tttttttttttttttttttttt

SEQ ID NO: 1331163 - DNA, 22 bp, Artificial Sequence
  chemically synthesized
tttttttttttttttttttttt

SEQ ID NO: 1331164 - DNA, 22 bp, Artificial Sequence
  chemically synthesized
tttttttttttttttttttttt

SEQ ID NO: 1331165 - DNA, 22 bp, Artificial Sequence
  chemically synthesized
tctcaaaaaaaaaaaaaaaaaa

SEQ ID NO: 1331166 - DNA, 22 bp, Artificial Sequence
  chemically synthesized
tcaaaaaaaaaaaaaaaaaaaa

SEQ ID NO: 1331167 - DNA, 22 bp, Artificial Sequence
  chemically synthesized
aaaaaaaaaaaaaaaaaaaaaa

SEQ ID NO: 1331168 - DNA, 22 bp, Artificial Sequence
  chemically synthesized
aaaagtcttttttttttttttt

SEQ ID NO: 1331169 - DNA, 22 bp, Artificial Sequence
  chemically synthesized
aaaaagtctttttttttttttt

SEQ ID NO: 1331170 - DNA, 22 bp, Artificial Sequence
  chemically synthesized
taaaaagtcttttttttttttt

SEQ ID NO: 1331171 - DNA, 22 bp, Artificial Sequence
  chemically synthesized
ataataacccctttaaaaagtc

SEQ ID NO: 1331172 - DNA, 22 bp, Artificial Sequence
  chemically synthesized
tttaaaggggttattattaggg

SEQ ID NO: 1331173 - DNA, 22 bp, Artificial Sequence
  chemically synthesized
ttaaaggggttattattagggg

SEQ ID NO: 1331174 - DNA, 22 bp, Artificial Sequence
  chemically synthesized
taaaggggttattattaggggc

SEQ ID NO: 1331175 - DNA, 22 bp, Artificial Sequence
  chemically synthesized
aaaggggttattattaggggct

SEQ ID NO: 1331176 - DNA, 22 bp, Artificial Sequence
  chemically synthesized
aaggggttattattaggggcta

SEQ ID NO: 1331177 - DNA, 22 bp, Artificial Sequence
  chemically synthesized
taagatccagtatatagcccct

SEQ ID NO: 1331178 - DNA, 22 bp, Artificial Sequence
  chemically synthesized
ataagatccagtatatagcccc

SEQ ID NO: 1331179 - DNA, 22 bp, Artificial Sequence
  chemically synthesized
ttattaggggctatatactgga

SEQ ID NO: 1331180 - DNA, 22 bp, Artificial Sequence
  chemically synthesized
gatgatttataagatccagtat

SEQ ID NO: 1331181 - DNA, 22 bp, Artificial Sequence
  chemically synthesized
ttaggggctatatactggatct

SEQ ID NO: 1331182 - DNA, 22 bp, Artificial Sequence
  chemically synthesized
ggggctatatactggatcttat

SEQ ID NO: 1331183 - DNA, 22 bp, Artificial Sequence
  chemically synthesized
gactagatgatttataagatcc

SEQ ID NO: 1331184 - DNA, 22 bp, Artificial Sequence
  chemically synthesized
tatactggatcttataaatcat

SEQ ID NO: 1331185 - DNA, 22 bp, Artificial Sequence
  chemically synthesized
gatcttataaatcatctagtcc

SEQ ID NO: 1331186 - DNA, 22 bp, Artificial Sequence
  chemically synthesized
acataatagggttggactagat

SEQ ID NO: 1331187 - DNA, 22 bp, Artificial Sequence
  chemically synthesized
cacataatagggttggactaga

SEQ ID NO: 1331188 - DNA, 22 bp, Artificial Sequence
  chemically synthesized
ataaatcatctagtccaaccct

SEQ ID NO: 1331189 - DNA, 22 bp, Artificial Sequence
  chemically synthesized
taaatcatctagtccaacccta

SEQ ID NO: 1331190 - DNA, 22 bp, Artificial Sequence
  chemically synthesized
atcttcacataatagggttgga

SEQ ID NO: 1331191 - DNA, 22 bp, Artificial Sequence
  chemically synthesized
taatcttcacataatagggttg

SEQ ID NO: 1331192 - DNA, 22 bp, Artificial Sequence
  chemically synthesized
ctaatcttcacataatagggtt

SEQ ID NO: 1331193 - DNA, 22 bp, Artificial Sequence
  chemically synthesized
tctaatcttcacataatagggt

SEQ ID NO: 1331194 - DNA, 22 bp, Artificial Sequence
  chemically synthesized
ttttctaatcttcacataatag

SEQ ID NO: 1331195 - DNA, 22 bp, Artificial Sequence
  chemically synthesized
gttttctaatcttcacataata

SEQ ID NO: 1331196 - DNA, 22 bp, Artificial Sequence
  chemically synthesized
tgttttctaatcttcacataat

SEQ ID NO: 1331197 - DNA, 22 bp, Artificial Sequence
  chemically synthesized
gtccaaccctattatgtgaaga

SEQ ID NO: 1331198 - DNA, 22 bp, Artificial Sequence
  chemically synthesized
ttatgtgaagattagaaaacaa

SEQ ID NO: 1331199 - DNA, 22 bp, Artificial Sequence
  chemically synthesized
tgtgaagattagaaaacaaagc

SEQ ID NO: 1331200 - DNA, 22 bp, Artificial Sequence
  chemically synthesized
gaaaacaaagcattcacattat

SEQ ID NO: 1331201 - DNA, 22 bp, Artificial Sequence
  chemically synthesized
caaaaatcgatagaataatgtg

SEQ ID NO: 1331202 - DNA, 22 bp, Artificial Sequence
  chemically synthesized
caaatagcattccaaaaatcga

SEQ ID NO: 1331203 - DNA, 22 bp, Artificial Sequence
  chemically synthesized
acattattctatcgatttttgg

SEQ ID NO: 1331204 - DNA, 22 bp, Artificial Sequence
  chemically synthesized
gcaaatagcattccaaaaatcg

SEQ ID NO: 1331205 - DNA, 22 bp, Artificial Sequence
  chemically synthesized
ttctatcgatttttggaatgct

SEQ ID NO: 1331206 - DNA, 22 bp, Artificial Sequence
  chemically synthesized
tatcgatttttggaatgctatt

SEQ ID NO: 1331207 - DNA, 22 bp, Artificial Sequence
  chemically synthesized
tcgatttttggaatgctatttg

SEQ ID NO: 1331208 - DNA, 22 bp, Artificial Sequence
  chemically synthesized
ttggaatgctatttgcaaactt

SEQ ID NO: 1331209 - DNA, 22 bp, Artificial Sequence
  chemically synthesized
tggaatgctatttgcaaacttt

SEQ ID NO: 1331210 - DNA, 22 bp, Artificial Sequence
  chemically synthesized
ggaatgctatttgcaaactttt

SEQ ID NO: 1331211 - DNA, 22 bp, Artificial Sequence
  chemically synthesized
gaatgctatttgcaaacttttt

SEQ ID NO: 1331212 - DNA, 22 bp, Artificial Sequence
  chemically synthesized
agtgggcccagaaaaaagtttg

SEQ ID NO: 1331213 - DNA, 22 bp, Artificial Sequence
  chemically synthesized
aagtgggcccagaaaaaagttt

SEQ ID NO: 1331214 - DNA, 22 bp, Artificial Sequence
  chemically synthesized
tttgcaaacttttttctgggcc

SEQ ID NO: 1331215 - DNA, 22 bp, Artificial Sequence
  chemically synthesized
tacatttaagtgggcccagaaa

SEQ ID NO: 1331216 - DNA, 22 bp, Artificial Sequence
  chemically synthesized
atacatttaagtgggcccagaa

SEQ ID NO: 1331217 - DNA, 22 bp, Artificial Sequence
  chemically synthesized
gcaaacttttttctgggcccac

SEQ ID NO: 1331218 - DNA, 22 bp, Artificial Sequence
  chemically synthesized
caaacttttttctgggcccact

SEQ ID NO: 1331219 - DNA, 22 bp, Artificial Sequence
  chemically synthesized
ttttctgggcccacttaaatgt

SEQ ID NO: 1331220 - DNA, 22 bp, Artificial Sequence
  chemically synthesized
tttctgggcccacttaaatgta

SEQ ID NO: 1331221 - DNA, 22 bp, Artificial Sequence
  chemically synthesized
ttctgggcccacttaaatgtat

SEQ ID NO: 1331222 - DNA, 22 bp, Artificial Sequence
  chemically synthesized
tctgggcccacttaaatgtata

SEQ ID NO: 1331223 - DNA, 22 bp, Artificial Sequence
  chemically synthesized
ctgggcccacttaaatgtataa

SEQ ID NO: 1331224 - DNA, 22 bp, Artificial Sequence
  chemically synthesized
tgggcccacttaaatgtataag

SEQ ID NO: 1331225 - DNA, 22 bp, Artificial Sequence
  chemically synthesized
ggcccacttaaatgtataagtt

SEQ ID NO: 1331226 - DNA, 22 bp, Artificial Sequence
  chemically synthesized
accaacataaaatatggaaaac

SEQ ID NO: 1331227 - DNA, 22 bp, Artificial Sequence
  chemically synthesized
aaatgtataagttttccatatt

SEQ ID NO: 1331228 - DNA, 22 bp, Artificial Sequence
  chemically synthesized
aatgtataagttttccatattt

SEQ ID NO: 1331229 - DNA, 22 bp, Artificial Sequence
  chemically synthesized
ttaaccaacataaaatatggaa

SEQ ID NO: 1331230 - DNA, 22 bp, Artificial Sequence
  chemically synthesized
attaaccaacataaaatatgga

SEQ ID NO: 1331231 - DNA, 22 bp, Artificial Sequence
  chemically synthesized
atcttattaaccaacataaaat

SEQ ID NO: 1331232 - DNA, 22 bp, Artificial Sequence
  chemically synthesized
aatcttattaaccaacataaaa

SEQ ID NO: 1331233 - DNA, 22 bp, Artificial Sequence
  chemically synthesized
taatcttattaaccaacataaa

SEQ ID NO: 1331234 - DNA, 22 bp, Artificial Sequence
  chemically synthesized
gttttaatcttattaaccaaca

SEQ ID NO: 1331235 - DNA, 22 bp, Artificial Sequence
  chemically synthesized
tccatattttatgttggttaat

SEQ ID NO: 1331236 - DNA, 22 bp, Artificial Sequence
  chemically synthesized
ccatattttatgttggttaata

SEQ ID NO: 1331237 - DNA, 22 bp, Artificial Sequence
  chemically synthesized
catattttatgttggttaataa

SEQ ID NO: 1331238 - DNA, 22 bp, Artificial Sequence
  chemically synthesized
aaattggttttaatcttattaa

SEQ ID NO: 1331239 - DNA, 22 bp, Artificial Sequence
  chemically synthesized
tatgttggttaataagattaaa

SEQ ID NO: 1331240 - DNA, 22 bp, Artificial Sequence
  chemically synthesized
atgttggttaataagattaaaa

SEQ ID NO: 1331241 - DNA, 22 bp, Artificial Sequence
  chemically synthesized
tgttggttaataagattaaaac

SEQ ID NO: 1331242 - DNA, 22 bp, Artificial Sequence
  chemically synthesized
gttaataagattaaaaccaatt

SEQ ID NO: 1331243 - DNA, 22 bp, Artificial Sequence
  chemically synthesized
ataagattaaaaccaattttaa

SEQ ID NO: 1331244 - DNA, 22 bp, Artificial Sequence
  chemically synthesized
aaaccaattttaatatcttgac

SEQ ID NO: 1331245 - DNA, 22 bp, Artificial Sequence
  chemically synthesized
ataaatggcaatgtggtgtcaa

SEQ ID NO: 1331246 - DNA, 22 bp, Artificial Sequence
  chemically synthesized
taatatcttgacaccacattgc

SEQ ID NO: 1331247 - DNA, 22 bp, Artificial Sequence
  chemically synthesized
aatatcttgacaccacattgcc

SEQ ID NO: 1331248 - DNA, 22 bp, Artificial Sequence
  chemically synthesized
atatcttgacaccacattgcca

SEQ ID NO: 1331249 - DNA, 22 bp, Artificial Sequence
  chemically synthesized
gacaccacattgccatttatca

SEQ ID NO: 1331250 - DNA, 22 bp, Artificial Sequence
  chemically synthesized
acaccacattgccatttatcaa

SEQ ID NO: 1331251 - DNA, 22 bp, Artificial Sequence
  chemically synthesized
ccatttatcaatatgtactacg

SEQ ID NO: 1331252 - DNA, 22 bp, Artificial Sequence
  chemically synthesized
aggaaccagtaaaaaacgtagt

SEQ ID NO: 1331253 - DNA, 22 bp, Artificial Sequence
  chemically synthesized
gaggaaccagtaaaaaacgtag

SEQ ID NO: 1331254 - DNA, 22 bp, Artificial Sequence
  chemically synthesized
atcaatatgtactacgtttttt

SEQ ID NO: 1331255 - DNA, 22 bp, Artificial Sequence
  chemically synthesized
tcaatatgtactacgtttttta

SEQ ID NO: 1331256 - DNA, 22 bp, Artificial Sequence
  chemically synthesized
agatttgaggaaccagtaaaaa

SEQ ID NO: 1331257 - DNA, 22 bp, Artificial Sequence
  chemically synthesized
gagatttgaggaaccagtaaaa

SEQ ID NO: 1331258 - DNA, 22 bp, Artificial Sequence
  chemically synthesized
cgttttttactggttcctcaaa

SEQ ID NO: 1331259 - DNA, 22 bp, Artificial Sequence
  chemically synthesized
gcacagatttgagatttgagga

SEQ ID NO: 1331260 - DNA, 22 bp, Artificial Sequence
  chemically synthesized
tttactggttcctcaaatctca

SEQ ID NO: 1331261 - DNA, 22 bp, Artificial Sequence
  chemically synthesized
ttactggttcctcaaatctcaa

SEQ ID NO: 1331262 - DNA, 22 bp, Artificial Sequence
  chemically synthesized
tactggttcctcaaatctcaaa

SEQ ID NO: 1331263 - DNA, 22 bp, Artificial Sequence
  chemically synthesized
actggttcctcaaatctcaaat

SEQ ID NO: 1331264 - DNA, 22 bp, Artificial Sequence
  chemically synthesized
ctggttcctcaaatctcaaatc

SEQ ID NO: 1331265 - DNA, 22 bp, Artificial Sequence
  chemically synthesized
gttcctcaaatctcaaatctgt

SEQ ID NO: 1331266 - DNA, 22 bp, Artificial Sequence
  chemically synthesized
aacagacgctggcacagatttg

SEQ ID NO: 1331267 - DNA, 22 bp, Artificial Sequence
  chemically synthesized
ctcaaatctcaaatctgtgcca

SEQ ID NO: 1331268 - DNA, 22 bp, Artificial Sequence
  chemically synthesized
aaatctcaaatctgtgccagcg

SEQ ID NO: 1331269 - DNA, 22 bp, Artificial Sequence
  chemically synthesized
taaaaattcaacagacgctggc

SEQ ID NO: 1331270 - DNA, 22 bp, Artificial Sequence
  chemically synthesized
aaatctgtgccagcgtctgttg

SEQ ID NO: 1331271 - DNA, 22 bp, Artificial Sequence
  chemically synthesized
tgccagcgtctgttgaattttt

SEQ ID NO: 1331272 - DNA, 22 bp, Artificial Sequence
  chemically synthesized
agtcaaaattataaaaattcaa

SEQ ID NO: 1331273 - DNA, 22 bp, Artificial Sequence
  chemically synthesized
ttgaatttttataattttgact

SEQ ID NO: 1331274 - DNA, 22 bp, Artificial Sequence
  chemically synthesized
aatttttataattttgactcaa

SEQ ID NO: 1331275 - DNA, 22 bp, Artificial Sequence
  chemically synthesized
ttataattttgactcaatttat

SEQ ID NO: 1331276 - DNA, 22 bp, Artificial Sequence
  chemically synthesized
tataattttgactcaatttatc

SEQ ID NO: 1331277 - DNA, 22 bp, Artificial Sequence
  chemically synthesized
ataattttgactcaatttatca

SEQ ID NO: 1331278 - DNA, 22 bp, Artificial Sequence
  chemically synthesized
taattttgactcaatttatcat

SEQ ID NO: 1331279 - DNA, 22 bp, Artificial Sequence
  chemically synthesized
tgactcaatttatcattctttt

SEQ ID NO: 1331280 - DNA, 22 bp, Artificial Sequence
  chemically synthesized
gactcaatttatcattcttttt

SEQ ID NO: 1331281 - DNA, 22 bp, Artificial Sequence
  chemically synthesized
aataaaaaaaaaaaaaagaatg

SEQ ID NO: 1331282 - DNA, 22 bp, Artificial Sequence
  chemically synthesized
actcaatttatcattctttttt

SEQ ID NO: 1331283 - DNA, 22 bp, Artificial Sequence
  chemically synthesized
aatttatcattctttttttttt

SEQ ID NO: 1331284 - DNA, 22 bp, Artificial Sequence
  chemically synthesized
cgtctcaataaaaaaaaaaaaa

SEQ ID NO: 1331285 - DNA, 22 bp, Artificial Sequence
  chemically synthesized
atcattctttttttttttttta

SEQ ID NO: 1331286 - DNA, 22 bp, Artificial Sequence
  chemically synthesized
tcattcttttttttttttttat

SEQ ID NO: 1331287 - DNA, 22 bp, Artificial Sequence
  chemically synthesized
ttttttttttttttattgagac

SEQ ID NO: 1331288 - DNA, 22 bp, Artificial Sequence
  chemically synthesized
ttttttttttttattgagacgg

SEQ ID NO: 1331289 - DNA, 22 bp, Artificial Sequence
  chemically synthesized
tttttttttttattgagacgga

SEQ ID NO: 1331290 - DNA, 22 bp, Artificial Sequence
  chemically synthesized
ttttttttttattgagacggag

SEQ ID NO: 1331291 - DNA, 22 bp, Artificial Sequence
  chemically synthesized
tttttttttattgagacggagt

SEQ ID NO: 1331292 - DNA, 22 bp, Artificial Sequence
  chemically synthesized
ttttttttattgagacggagtc

SEQ ID NO: 1331293 - DNA, 22 bp, Artificial Sequence
  chemically synthesized
tttttttattgagacggagtct

SEQ ID NO: 1331294 - DNA, 22 bp, Artificial Sequence
  chemically synthesized
agagacagaggaagactccgtc

SEQ ID NO: 1331295 - DNA, 22 bp, Artificial Sequence
  chemically synthesized
ttttttattgagacggagtctt

SEQ ID NO: 1331296 - DNA, 22 bp, Artificial Sequence
  chemically synthesized
tttttattgagacggagtcttc

SEQ ID NO: 1331297 - DNA, 22 bp, Artificial Sequence
  chemically synthesized
ttttattgagacggagtcttcc

SEQ ID NO: 1331298 - DNA, 22 bp, Artificial Sequence
  chemically synthesized
tttattgagacggagtcttcct

SEQ ID NO: 1331299 - DNA, 22 bp, Artificial Sequence
  chemically synthesized
ttattgagacggagtcttcctc

SEQ ID NO: 1331300 - DNA, 22 bp, Artificial Sequence
  chemically synthesized
tattgagacggagtcttcctct

SEQ ID NO: 1331301 - DNA, 22 bp, Artificial Sequence
  chemically synthesized
attgagacggagtcttcctctg

SEQ ID NO: 1331302 - DNA, 22 bp, Artificial Sequence
  chemically synthesized
cagcctgagagacagaggaaga

SEQ ID NO: 1331303 - DNA, 22 bp, Artificial Sequence
  chemically synthesized
ttgagacggagtcttcctctgt

SEQ ID NO: 1331304 - DNA, 22 bp, Artificial Sequence
  chemically synthesized
agacggagtcttcctctgtctc

SEQ ID NO: 1331305 - DNA, 22 bp, Artificial Sequence
  chemically synthesized
cactccagcctgagagacagag

SEQ ID NO: 1331306 - DNA, 22 bp, Artificial Sequence
  chemically synthesized
cctctgtctctcaggctggagt

SEQ ID NO: 1331307 - DNA, 22 bp, Artificial Sequence
  chemically synthesized
ctctgtctctcaggctggagtg

SEQ ID NO: 1331308 - DNA, 22 bp, Artificial Sequence
  chemically synthesized
tgtctctcaggctggagtgcag

SEQ ID NO: 1331309 - DNA, 22 bp, Artificial Sequence
  chemically synthesized
tctctcaggctggagtgcagtg

SEQ ID NO: 1331310 - DNA, 22 bp, Artificial Sequence
  chemically synthesized
tcaggctggagtgcagtggcac

SEQ ID NO: 1331311 - DNA, 22 bp, Artificial Sequence
  chemically synthesized
aggctggagtgcagtggcacta

SEQ ID NO: 1331312 - DNA, 22 bp, Artificial Sequence
  chemically synthesized
ggtgagccaagatagtgccact

SEQ ID NO: 1331313 - DNA, 22 bp, Artificial Sequence
  chemically synthesized
cggtgagccaagatagtgccac

SEQ ID NO: 1331314 - DNA, 22 bp, Artificial Sequence
  chemically synthesized
gagtgcagtggcactatcttgg

SEQ ID NO: 1331315 - DNA, 22 bp, Artificial Sequence
  chemically synthesized
ggaggcggaggtttcggtgagc

SEQ ID NO: 1331316 - DNA, 22 bp, Artificial Sequence
  chemically synthesized
aacctgggaggcggaggtttcg

SEQ ID NO: 1331317 - DNA, 22 bp, Artificial Sequence
  chemically synthesized
tcttggctcaccgaaacctccg

SEQ ID NO: 1331318 - DNA, 22 bp, Artificial Sequence
  chemically synthesized
gaacctgggaggcggaggtttc

SEQ ID NO: 1331319 - DNA, 22 bp, Artificial Sequence
  chemically synthesized
ggctcaccgaaacctccgcctc

SEQ ID NO: 1331320 - DNA, 22 bp, Artificial Sequence
  chemically synthesized
gctcaccgaaacctccgcctcc

SEQ ID NO: 1331321 - DNA, 22 bp, Artificial Sequence
  chemically synthesized
accgaaacctccgcctcccagg

SEQ ID NO: 1331322 - DNA, 22 bp, Artificial Sequence
  chemically synthesized
aggcaggagaatcacttgaacc

SEQ ID NO: 1331323 - DNA, 22 bp, Artificial Sequence
  chemically synthesized
cgcctcccaggttcaagtgatt

SEQ ID NO: 1331324 - DNA, 22 bp, Artificial Sequence
  chemically synthesized
ccaggttcaagtgattctcctg

SEQ ID NO: 1331325 - DNA, 22 bp, Artificial Sequence
  chemically synthesized
gggaggctgaggcaggagaatc

SEQ ID NO: 1331326 - DNA, 22 bp, Artificial Sequence
  chemically synthesized
ctagggaggctgaggcaggaga

SEQ ID NO: 1331327 - DNA, 22 bp, Artificial Sequence
  chemically synthesized
aagtgattctcctgcctcagcc

SEQ ID NO: 1331328 - DNA, 22 bp, Artificial Sequence
  chemically synthesized
tagtcccagctactagggaggc

SEQ ID NO: 1331329 - DNA, 22 bp, Artificial Sequence
  chemically synthesized
tcctgcctcagcctccctagta

SEQ ID NO: 1331330 - DNA, 22 bp, Artificial Sequence
  chemically synthesized
ctgcctcagcctccctagtagc

SEQ ID NO: 1331331 - DNA, 22 bp, Artificial Sequence
  chemically synthesized
cctcagcctccctagtagctgg

SEQ ID NO: 1331332 - DNA, 22 bp, Artificial Sequence
  chemically synthesized
agcctccctagtagctgggact

SEQ ID NO: 1331333 - DNA, 22 bp, Artificial Sequence
  chemically synthesized
cctagtagctgggactacaggc

SEQ ID NO: 1331334 - DNA, 22 bp, Artificial Sequence
  chemically synthesized
gtagctgggactacaggcgcat

SEQ ID NO: 1331335 - DNA, 22 bp, Artificial Sequence
  chemically synthesized
accagacatggtggcatgcgcc

SEQ ID NO: 1331336 - DNA, 22 bp, Artificial Sequence
  chemically synthesized
ggactacaggcgcatgccacca

SEQ ID NO: 1331337 - DNA, 22 bp, Artificial Sequence
  chemically synthesized
caggcgcatgccaccatgtctg

SEQ ID NO: 1331338 - DNA, 22 bp, Artificial Sequence
  chemically synthesized
ccaaaaatacaaaaaaattaac

SEQ ID NO: 1331339 - DNA, 22 bp, Artificial Sequence
  chemically synthesized
taccaaaaatacaaaaaaatta

SEQ ID NO: 1331340 - DNA, 22 bp, Artificial Sequence
  chemically synthesized
gttaatttttttgtatttttgg

SEQ ID NO: 1331341 - DNA, 22 bp, Artificial Sequence
  chemically synthesized
atttttttgtatttttggtaga

SEQ ID NO: 1331342 - DNA, 22 bp, Artificial Sequence
  chemically synthesized
ttttgtatttttggtagagacg

SEQ ID NO: 1331343 - DNA, 22 bp, Artificial Sequence
  chemically synthesized
tttgtatttttggtagagacgg

SEQ ID NO: 1331344 - DNA, 22 bp, Artificial Sequence
  chemically synthesized
ttgtatttttggtagagacggg

SEQ ID NO: 1331345 - DNA, 22 bp, Artificial Sequence
  chemically synthesized
tgtatttttggtagagacgggg

SEQ ID NO: 1331346 - DNA, 22 bp, Artificial Sequence
  chemically synthesized
gtatttttggtagagacggggt

SEQ ID NO: 1331347 - DNA, 22 bp, Artificial Sequence
  chemically synthesized
tatttttggtagagacggggtt

SEQ ID NO: 1331348 - DNA, 22 bp, Artificial Sequence
  chemically synthesized
gccaacatggtgaaaccccgtc

SEQ ID NO: 1331349 - DNA, 22 bp, Artificial Sequence
  chemically synthesized
ttggtagagacggggtttcacc

SEQ ID NO: 1331350 - DNA, 22 bp, Artificial Sequence
  chemically synthesized
cctggccaacatggtgaaaccc

SEQ ID NO: 1331351 - DNA, 22 bp, Artificial Sequence
  chemically synthesized
tggtagagacggggtttcacca

SEQ ID NO: 1331352 - DNA, 22 bp, Artificial Sequence
  chemically synthesized
ggtagagacggggtttcaccat

SEQ ID NO: 1331353 - DNA, 22 bp, Artificial Sequence
  chemically synthesized
gtagagacggggtttcaccatg

SEQ ID NO: 1331354 - DNA, 22 bp, Artificial Sequence
  chemically synthesized
caccatgttggccaggcaggtc

SEQ ID NO: 1331355 - DNA, 22 bp, Artificial Sequence
  chemically synthesized
accatgttggccaggcaggtct

SEQ ID NO: 1331356 - DNA, 22 bp, Artificial Sequence
  chemically synthesized
aggtcaggatgtcgagacctgc

SEQ ID NO: 1331357 - DNA, 22 bp, Artificial Sequence
  chemically synthesized
gaggtcaggatgtcgagacctg

SEQ ID NO: 1331358 - DNA, 22 bp, Artificial Sequence
  chemically synthesized
cttgaggtcaggatgtcgagac

SEQ ID NO: 1331359 - DNA, 22 bp, Artificial Sequence
  chemically synthesized
gccaggcaggtctcgacatcct

SEQ ID NO: 1331360 - DNA, 22 bp, Artificial Sequence
  chemically synthesized
gacatcctgacctcaagtaatc

SEQ ID NO: 1331361 - DNA, 22 bp, Artificial Sequence
  chemically synthesized
agaggccaaggtgggcggatta

SEQ ID NO: 1331362 - DNA, 22 bp, Artificial Sequence
  chemically synthesized
gagaggccaaggtgggcggatt

SEQ ID NO: 1331363 - DNA, 22 bp, Artificial Sequence
  chemically synthesized
tgagaggccaaggtgggcggat

SEQ ID NO: 1331364 - DNA, 22 bp, Artificial Sequence
  chemically synthesized
acctcaagtaatccgcccacct

SEQ ID NO: 1331365 - DNA, 22 bp, Artificial Sequence
  chemically synthesized
aagtaatccgcccaccttggcc

SEQ ID NO: 1331366 - DNA, 22 bp, Artificial Sequence
  chemically synthesized
taatcccaacattttgagaggc

SEQ ID NO: 1331367 - DNA, 22 bp, Artificial Sequence
  chemically synthesized
acgcctgtaatcccaacatttt

SEQ ID NO: 1331368 - DNA, 22 bp, Artificial Sequence
  chemically synthesized
ggcctctcaaaatgttgggatt

SEQ ID NO: 1331369 - DNA, 22 bp, Artificial Sequence
  chemically synthesized
gcctctcaaaatgttgggatta

SEQ ID NO: 1331370 - DNA, 22 bp, Artificial Sequence
  chemically synthesized
tcaaaatgttgggattacaggc

SEQ ID NO: 1331371 - DNA, 22 bp, Artificial Sequence
  chemically synthesized
aaaatgttgggattacaggcgt

SEQ ID NO: 1331372 - DNA, 22 bp, Artificial Sequence
  chemically synthesized
ggattacaggcgtgagccacca

SEQ ID NO: 1331373 - DNA, 22 bp, Artificial Sequence
  chemically synthesized
caggcgtgagccaccacgcctg

SEQ ID NO: 1331374 - DNA, 22 bp, Artificial Sequence
  chemically synthesized
aaaaagaatgataggccaggcg

SEQ ID NO: 1331375 - DNA, 22 bp, Artificial Sequence
  chemically synthesized
caaattaaaaaagaatgatagg

SEQ ID NO: 1331376 - DNA, 22 bp, Artificial Sequence
  chemically synthesized
aaagtctgcaaattaaaaaaga

SEQ ID NO: 1331377 - DNA, 22 bp, Artificial Sequence
  chemically synthesized
aaaagtctgcaaattaaaaaag

SEQ ID NO: 1331378 - DNA, 22 bp, Artificial Sequence
  chemically synthesized
gcctatcattcttttttaattt

SEQ ID NO: 1331379 - DNA, 22 bp, Artificial Sequence
  chemically synthesized
ttaaaagtctgcaaattaaaaa

SEQ ID NO: 1331380 - DNA, 22 bp, Artificial Sequence
  chemically synthesized
ttcttaaaagtctgcaaattaa

SEQ ID NO: 1331381 - DNA, 22 bp, Artificial Sequence
  chemically synthesized
tcattcttttttaatttgcaga

SEQ ID NO: 1331382 - DNA, 22 bp, Artificial Sequence
  chemically synthesized
gcctgttcttaaaagtctgcaa

SEQ ID NO: 1331383 - DNA, 22 bp, Artificial Sequence
  chemically synthesized
ttttttaatttgcagactttta

SEQ ID NO: 1331384 - DNA, 22 bp, Artificial Sequence
  chemically synthesized
ttttaatttgcagacttttaag

SEQ ID NO: 1331385 - DNA, 22 bp, Artificial Sequence
  chemically synthesized
tttaatttgcagacttttaaga

SEQ ID NO: 1331386 - DNA, 22 bp, Artificial Sequence
  chemically synthesized
aaattagcctgttcttaaaagt

SEQ ID NO: 1331387 - DNA, 22 bp, Artificial Sequence
  chemically synthesized
ttaatttgcagacttttaagaa

SEQ ID NO: 1331388 - DNA, 22 bp, Artificial Sequence
  chemically synthesized
taatttgcagacttttaagaac

SEQ ID NO: 1331389 - DNA, 22 bp, Artificial Sequence
  chemically synthesized
aatttgcagacttttaagaaca

SEQ ID NO: 1331390 - DNA, 22 bp, Artificial Sequence
  chemically synthesized
atttgcagacttttaagaacag

SEQ ID NO: 1331391 - DNA, 22 bp, Artificial Sequence
  chemically synthesized
tgtctcaaattagcctgttctt

SEQ ID NO: 1331392 - DNA, 22 bp, Artificial Sequence
  chemically synthesized
gcagacttttaagaacaggcta

SEQ ID NO: 1331393 - DNA, 22 bp, Artificial Sequence
  chemically synthesized
tgtgtctcaaattagcctgttc

SEQ ID NO: 1331394 - DNA, 22 bp, Artificial Sequence
  chemically synthesized
cagacttttaagaacaggctaa

SEQ ID NO: 1331395 - DNA, 22 bp, Artificial Sequence
  chemically synthesized
tggttctgtgtctcaaattagc

SEQ ID NO: 1331396 - DNA, 22 bp, Artificial Sequence
  chemically synthesized
gtggttctgtgtctcaaattag

SEQ ID NO: 1331397 - DNA, 22 bp, Artificial Sequence
  chemically synthesized
ttaagaacaggctaatttgaga

SEQ ID NO: 1331398 - DNA, 22 bp, Artificial Sequence
  chemically synthesized
tgtggttctgtgtctcaaatta

SEQ ID NO: 1331399 - DNA, 22 bp, Artificial Sequence
  chemically synthesized
taagaacaggctaatttgagac

SEQ ID NO: 1331400 - DNA, 22 bp, Artificial Sequence
  chemically synthesized
ttgtggttctgtgtctcaaatt

SEQ ID NO: 1331401 - DNA, 22 bp, Artificial Sequence
  chemically synthesized
aagaacaggctaatttgagaca

SEQ ID NO: 1331402 - DNA, 22 bp, Artificial Sequence
  chemically synthesized
agaacaggctaatttgagacac

SEQ ID NO: 1331403 - DNA, 22 bp, Artificial Sequence
  chemically synthesized
atttgagacacagaaccacaaa

SEQ ID NO: 1331404 - DNA, 22 bp, Artificial Sequence
  chemically synthesized
gaacgtaagtagcttttgtggt

SEQ ID NO: 1331405 - DNA, 22 bp, Artificial Sequence
  chemically synthesized
ggaacgtaagtagcttttgtgg

SEQ ID NO: 1331406 - DNA, 22 bp, Artificial Sequence
  chemically synthesized
gagacacagaaccacaaaagct

SEQ ID NO: 1331407 - DNA, 22 bp, Artificial Sequence
  chemically synthesized
tggaacgtaagtagcttttgtg

SEQ ID NO: 1331408 - DNA, 22 bp, Artificial Sequence
  chemically synthesized
agacacagaaccacaaaagcta

SEQ ID NO: 1331409 - DNA, 22 bp, Artificial Sequence
  chemically synthesized
cagagcattttggaacgtaagt

SEQ ID NO: 1331410 - DNA, 22 bp, Artificial Sequence
  chemically synthesized
tgcagagcattttggaacgtaa

SEQ ID NO: 1331411 - DNA, 22 bp, Artificial Sequence
  chemically synthesized
cttacgttccaaaatgctctgc

SEQ ID NO: 1331412 - DNA, 22 bp, Artificial Sequence
  chemically synthesized
acgttccaaaatgctctgcaga

SEQ ID NO: 1331413 - DNA, 22 bp, Artificial Sequence
  chemically synthesized
cgttccaaaatgctctgcagaa

SEQ ID NO: 1331414 - DNA, 22 bp, Artificial Sequence
  chemically synthesized
caaaatgctctgcagaatctct

SEQ ID NO: 1331415 - DNA, 22 bp, Artificial Sequence
  chemically synthesized
tgcagaatctctttttgcatgt

SEQ ID NO: 1331416 - DNA, 22 bp, Artificial Sequence
  chemically synthesized
cagaatctctttttgcatgtgc

SEQ ID NO: 1331417 - DNA, 22 bp, Artificial Sequence
  chemically synthesized
ccaaaggccatacgtagcacat

SEQ ID NO: 1331418 - DNA, 22 bp, Artificial Sequence
  chemically synthesized
tcccaaaggccatacgtagcac

SEQ ID NO: 1331419 - DNA, 22 bp, Artificial Sequence
  chemically synthesized
ctcccaaaggccatacgtagca

SEQ ID NO: 1331420 - DNA, 22 bp, Artificial Sequence
  chemically synthesized
tttttgcatgtgctacgtatgg

SEQ ID NO: 1331421 - DNA, 22 bp, Artificial Sequence
  chemically synthesized
tttgcatgtgctacgtatggcc

SEQ ID NO: 1331422 - DNA, 22 bp, Artificial Sequence
  chemically synthesized
ttgcatgtgctacgtatggcct

SEQ ID NO: 1331423 - DNA, 22 bp, Artificial Sequence
  chemically synthesized
tgcatgtgctacgtatggcctt

SEQ ID NO: 1331424 - DNA, 22 bp, Artificial Sequence
  chemically synthesized
gcatgtgctacgtatggccttt

SEQ ID NO: 1331425 - DNA, 22 bp, Artificial Sequence
  chemically synthesized
catgtgctacgtatggcctttg

SEQ ID NO: 1331426 - DNA, 22 bp, Artificial Sequence
  chemically synthesized
caaaaaatgtacttctcccaaa

SEQ ID NO: 1331427 - DNA, 22 bp, Artificial Sequence
  chemically synthesized
cgtatggcctttgggagaagta

SEQ ID NO: 1331428 - DNA, 22 bp, Artificial Sequence
  chemically synthesized
tgggagaagtacattttttgta

SEQ ID NO: 1331429 - DNA, 22 bp, Artificial Sequence
  chemically synthesized
gggagaagtacattttttgtag

SEQ ID NO: 1331430 - DNA, 22 bp, Artificial Sequence
  chemically synthesized
ggagaagtacattttttgtagt

SEQ ID NO: 1331431 - DNA, 22 bp, Artificial Sequence
  chemically synthesized
aaaaaaccacaaaacaactaca

SEQ ID NO: 1331432 - DNA, 22 bp, Artificial Sequence
  chemically synthesized
caaaaaaccacaaaacaactac

SEQ ID NO: 1331433 - DNA, 22 bp, Artificial Sequence
  chemically synthesized
gtcatttcaaaaaaccacaaaa

SEQ ID NO: 1331434 - DNA, 22 bp, Artificial Sequence
  chemically synthesized
tttgtagttgttttgtggtttt

SEQ ID NO: 1331435 - DNA, 22 bp, Artificial Sequence
  chemically synthesized
tagtcatttcaaaaaaccacaa

SEQ ID NO: 1331436 - DNA, 22 bp, Artificial Sequence
  chemically synthesized
ttgtagttgttttgtggttttt

SEQ ID NO: 1331437 - DNA, 22 bp, Artificial Sequence
  chemically synthesized
ctagtcatttcaaaaaaccaca

SEQ ID NO: 1331438 - DNA, 22 bp, Artificial Sequence
  chemically synthesized
tgtagttgttttgtggtttttt

SEQ ID NO: 1331439 - DNA, 22 bp, Artificial Sequence
  chemically synthesized
gtagttgttttgtggttttttg

SEQ ID NO: 1331440 - DNA, 22 bp, Artificial Sequence
  chemically synthesized
tagttgttttgtggttttttga

SEQ ID NO: 1331441 - DNA, 22 bp, Artificial Sequence
  chemically synthesized
ttttgtggttttttgaaatgac

SEQ ID NO: 1331442 - DNA, 22 bp, Artificial Sequence
  chemically synthesized
aaaatatttctagtcatttcaa

SEQ ID NO: 1331443 - DNA, 22 bp, Artificial Sequence
  chemically synthesized
tgtggttttttgaaatgactag

SEQ ID NO: 1331444 - DNA, 22 bp, Artificial Sequence
  chemically synthesized
gtggttttttgaaatgactaga

SEQ ID NO: 1331445 - DNA, 22 bp, Artificial Sequence
  chemically synthesized
tggttttttgaaatgactagaa

SEQ ID NO: 1331446 - DNA, 22 bp, Artificial Sequence
  chemically synthesized
gggccctaaaaatatttctagt

SEQ ID NO: 1331447 - DNA, 22 bp, Artificial Sequence
  chemically synthesized
tagggccctaaaaatatttcta

SEQ ID NO: 1331448 - DNA, 22 bp, Artificial Sequence
  chemically synthesized
tttgaaatgactagaaatattt

SEQ ID NO: 1331449 - DNA, 22 bp, Artificial Sequence
  chemically synthesized
ctagggccctaaaaatatttct

SEQ ID NO: 1331450 - DNA, 22 bp, Artificial Sequence
  chemically synthesized
ttgaaatgactagaaatatttt

SEQ ID NO: 1331451 - DNA, 22 bp, Artificial Sequence
  chemically synthesized
tgaaatgactagaaatattttt

SEQ ID NO: 1331452 - DNA, 22 bp, Artificial Sequence
  chemically synthesized
gaaatgactagaaatattttta

SEQ ID NO: 1331453 - DNA, 22 bp, Artificial Sequence
  chemically synthesized
aaatgactagaaatatttttag

SEQ ID NO: 1331454 - DNA, 22 bp, Artificial Sequence
  chemically synthesized
gaggtttctagggccctaaaaa

SEQ ID NO: 1331455 - DNA, 22 bp, Artificial Sequence
  chemically synthesized
ggaggtttctagggccctaaaa

SEQ ID NO: 1331456 - DNA, 22 bp, Artificial Sequence
  chemically synthesized
ccttggaggtttctagggccct

SEQ ID NO: 1331457 - DNA, 22 bp, Artificial Sequence
  chemically synthesized
gaaatatttttagggccctaga

SEQ ID NO: 1331458 - DNA, 22 bp, Artificial Sequence
  chemically synthesized
accttggaggtttctagggccc

SEQ ID NO: 1331459 - DNA, 22 bp, Artificial Sequence
  chemically synthesized
aacacttaccttggaggtttct

SEQ ID NO: 1331460 - DNA, 22 bp, Artificial Sequence
  chemically synthesized
ttagggccctagaaacctccaa

SEQ ID NO: 1331461 - DNA, 22 bp, Artificial Sequence
  chemically synthesized
taaacacttaccttggaggttt

SEQ ID NO: 1331462 - DNA, 22 bp, Artificial Sequence
  chemically synthesized
tagggccctagaaacctccaag

SEQ ID NO: 1331463 - DNA, 22 bp, Artificial Sequence
  chemically synthesized
ctaaacacttaccttggaggtt

SEQ ID NO: 1331464 - DNA, 22 bp, Artificial Sequence
  chemically synthesized
agggccctagaaacctccaagg

SEQ ID NO: 1331465 - DNA, 22 bp, Artificial Sequence
  chemically synthesized
gggccctagaaacctccaaggt

SEQ ID NO: 1331466 - DNA, 22 bp, Artificial Sequence
  chemically synthesized
gaaacctccaaggtaagtgttt

SEQ ID NO: 1331467 - DNA, 22 bp, Artificial Sequence
  chemically synthesized
gaagcacaatttctaaacactt

SEQ ID NO: 1331468 - DNA, 22 bp, Artificial Sequence
  chemically synthesized
ctagaagcacaatttctaaaca

SEQ ID NO: 1331469 - DNA, 22 bp, Artificial Sequence
  chemically synthesized
caaggtaagtgtttagaaattg

SEQ ID NO: 1331470 - DNA, 22 bp, Artificial Sequence
  chemically synthesized
acagattcctagaagcacaatt

SEQ ID NO: 1331471 - DNA, 22 bp, Artificial Sequence
  chemically synthesized
agaaattgtgcttctaggaatc

SEQ ID NO: 1331472 - DNA, 22 bp, Artificial Sequence
  chemically synthesized
gaaattgtgcttctaggaatct

SEQ ID NO: 1331473 - DNA, 22 bp, Artificial Sequence
  chemically synthesized
caaaagtactgacagattccta

SEQ ID NO: 1331474 - DNA, 22 bp, Artificial Sequence
  chemically synthesized
acaaaagtactgacagattcct

SEQ ID NO: 1331475 - DNA, 22 bp, Artificial Sequence
  chemically synthesized
tgcttctaggaatctgtcagta

SEQ ID NO: 1331476 - DNA, 22 bp, Artificial Sequence
  chemically synthesized
ctaggaatctgtcagtactttt

SEQ ID NO: 1331477 - DNA, 22 bp, Artificial Sequence
  chemically synthesized
taggaatctgtcagtacttttg

SEQ ID NO: 1331478 - DNA, 22 bp, Artificial Sequence
  chemically synthesized
agataatgtttacaaaagtact

SEQ ID NO: 1331479 - DNA, 22 bp, Artificial Sequence
  chemically synthesized
cagataatgtttacaaaagtac

SEQ ID NO: 1331480 - DNA, 22 bp, Artificial Sequence
  chemically synthesized
ggaatctgtcagtacttttgta

SEQ ID NO: 1331481 - DNA, 22 bp, Artificial Sequence
  chemically synthesized
tgcttcagataatgtttacaaa

SEQ ID NO: 1331482 - DNA, 22 bp, Artificial Sequence
  chemically synthesized
atgcttcagataatgtttacaa

SEQ ID NO: 1331483 - DNA, 22 bp, Artificial Sequence
  chemically synthesized
tcagtacttttgtaaacattat

SEQ ID NO: 1331484 - DNA, 22 bp, Artificial Sequence
  chemically synthesized
tgcttatgcttcagataatgtt

SEQ ID NO: 1331485 - DNA, 22 bp, Artificial Sequence
  chemically synthesized
atgcttatgcttcagataatgt

SEQ ID NO: 1331486 - DNA, 22 bp, Artificial Sequence
  chemically synthesized
tttatgcttatgcttcagataa

SEQ ID NO: 1331487 - DNA, 22 bp, Artificial Sequence
  chemically synthesized
gtttatgcttatgcttcagata

SEQ ID NO: 1331488 - DNA, 22 bp, Artificial Sequence
  chemically synthesized
ttgtaaacattatctgaagcat

SEQ ID NO: 1331489 - DNA, 22 bp, Artificial Sequence
  chemically synthesized
tgtaaacattatctgaagcata

SEQ ID NO: 1331490 - DNA, 22 bp, Artificial Sequence
  chemically synthesized
gtaaacattatctgaagcataa

SEQ ID NO: 1331491 - DNA, 22 bp, Artificial Sequence
  chemically synthesized
taaacattatctgaagcataag

SEQ ID NO: 1331492 - DNA, 22 bp, Artificial Sequence
  chemically synthesized
aaatttgtttatgcttatgctt

SEQ ID NO: 1331493 - DNA, 22 bp, Artificial Sequence
  chemically synthesized
ttcaaatttgtttatgcttatg

SEQ ID NO: 1331494 - DNA, 22 bp, Artificial Sequence
  chemically synthesized
ctgttcaaatttgtttatgctt

SEQ ID NO: 1331495 - DNA, 22 bp, Artificial Sequence
  chemically synthesized
tctgaagcataagcataaacaa

SEQ ID NO: 1331496 - DNA, 22 bp, Artificial Sequence
  chemically synthesized
gcctgctgttcaaatttgttta

SEQ ID NO: 1331497 - DNA, 22 bp, Artificial Sequence
  chemically synthesized
aagcataagcataaacaaattt

SEQ ID NO: 1331498 - DNA, 22 bp, Artificial Sequence
  chemically synthesized
tgtgagctagcctgctgttcaa

SEQ ID NO: 1331499 - DNA, 22 bp, Artificial Sequence
  chemically synthesized
tgtgtgagctagcctgctgttc

SEQ ID NO: 1331500 - DNA, 22 bp, Artificial Sequence
  chemically synthesized
ctgtgtgagctagcctgctgtt

SEQ ID NO: 1331501 - DNA, 22 bp, Artificial Sequence
  chemically synthesized
gaacagcaggctagctcacaca

SEQ ID NO: 1331502 - DNA, 22 bp, Artificial Sequence
  chemically synthesized
aacagcaggctagctcacacag

SEQ ID NO: 1331503 - DNA, 22 bp, Artificial Sequence
  chemically synthesized
caatgaataaaatcatttctgt

SEQ ID NO: 1331504 - DNA, 22 bp, Artificial Sequence
  chemically synthesized
gctcacacagaaatgattttat

SEQ ID NO: 1331505 - DNA, 22 bp, Artificial Sequence
  chemically synthesized
acacagaaatgattttattcat

SEQ ID NO: 1331506 - DNA, 22 bp, Artificial Sequence
  chemically synthesized
tattcattggaatgttctcaca

SEQ ID NO: 1331507 - DNA, 22 bp, Artificial Sequence
  chemically synthesized
attcattggaatgttctcacat

SEQ ID NO: 1331508 - DNA, 22 bp, Artificial Sequence
  chemically synthesized
ttcattggaatgttctcacatg

SEQ ID NO: 1331509 - DNA, 22 bp, Artificial Sequence
  chemically synthesized
attggaatgttctcacatgtgg

SEQ ID NO: 1331510 - DNA, 22 bp, Artificial Sequence
  chemically synthesized
aaaataaagtataccacatgtg

SEQ ID NO: 1331511 - DNA, 22 bp, Artificial Sequence
  chemically synthesized
gaatgttctcacatgtggtata

SEQ ID NO: 1331512 - DNA, 22 bp, Artificial Sequence
  chemically synthesized
tcacatgtggtatactttattt

SEQ ID NO: 1331513 - DNA, 22 bp, Artificial Sequence
  chemically synthesized
acatgtggtatactttattttt

SEQ ID NO: 1331514 - DNA, 22 bp, Artificial Sequence
  chemically synthesized
atcataaatgaaaccaaactaa

SEQ ID NO: 1331515 - DNA, 22 bp, Artificial Sequence
  chemically synthesized
ttaatcataaatgaaaccaaac

SEQ ID NO: 1331516 - DNA, 22 bp, Artificial Sequence
  chemically synthesized
tatttttagtttggtttcattt

SEQ ID NO: 1331517 - DNA, 22 bp, Artificial Sequence
  chemically synthesized
atttttagtttggtttcattta

SEQ ID NO: 1331518 - DNA, 22 bp, Artificial Sequence
  chemically synthesized
tttttagtttggtttcatttat

SEQ ID NO: 1331519 - DNA, 22 bp, Artificial Sequence
  chemically synthesized
ttagtttggtttcatttatgat

SEQ ID NO: 1331520 - DNA, 22 bp, Artificial Sequence
  chemically synthesized
tagtttggtttcatttatgatt

SEQ ID NO: 1331521 - DNA, 22 bp, Artificial Sequence
  chemically synthesized
agtttggtttcatttatgatta

SEQ ID NO: 1331522 - DNA, 22 bp, Artificial Sequence
  chemically synthesized
gtttggtttcatttatgattaa

SEQ ID NO: 1331523 - DNA, 22 bp, Artificial Sequence
  chemically synthesized
gaatcataattattaatcataa

SEQ ID NO: 1331524 - DNA, 22 bp, Artificial Sequence
  chemically synthesized
ggaatcataattattaatcata

SEQ ID NO: 1331525 - DNA, 22 bp, Artificial Sequence
  chemically synthesized
tggaatcataattattaatcat

SEQ ID NO: 1331526 - DNA, 22 bp, Artificial Sequence
  chemically synthesized
ggtttcatttatgattaataat

SEQ ID NO: 1331527 - DNA, 22 bp, Artificial Sequence
  chemically synthesized
gtttcatttatgattaataatt

SEQ ID NO: 1331528 - DNA, 22 bp, Artificial Sequence
  chemically synthesized
catttatgattaataattatga

SEQ ID NO: 1331529 - DNA, 22 bp, Artificial Sequence
  chemically synthesized
atttatgattaataattatgat

SEQ ID NO: 1331530 - DNA, 22 bp, Artificial Sequence
  chemically synthesized
agcacctttggaatcataatta

SEQ ID NO: 1331531 - DNA, 22 bp, Artificial Sequence
  chemically synthesized
aagcacctttggaatcataatt

SEQ ID NO: 1331532 - DNA, 22 bp, Artificial Sequence
  chemically synthesized
atgattaataattatgattcca

SEQ ID NO: 1331533 - DNA, 22 bp, Artificial Sequence
  chemically synthesized
tgattaataattatgattccaa

SEQ ID NO: 1331534 - DNA, 22 bp, Artificial Sequence
  chemically synthesized
atttaagcacctttggaatcat

SEQ ID NO: 1331535 - DNA, 22 bp, Artificial Sequence
  chemically synthesized
ataattatgattccaaaggtgc

SEQ ID NO: 1331536 - DNA, 22 bp, Artificial Sequence
  chemically synthesized
tgattccaaaggtgcttaaatc

SEQ ID NO: 1331537 - DNA, 22 bp, Artificial Sequence
  chemically synthesized
caaaggtgcttaaatcagccgg

SEQ ID NO: 1331538 - DNA, 22 bp, Artificial Sequence
  chemically synthesized
caggcatgaaccaccatggccg

SEQ ID NO: 1331539 - DNA, 22 bp, Artificial Sequence
  chemically synthesized
aaatcagccggccatggtggtt

SEQ ID NO: 1331540 - DNA, 22 bp, Artificial Sequence
  chemically synthesized
aatcagccggccatggtggttc

SEQ ID NO: 1331541 - DNA, 22 bp, Artificial Sequence
  chemically synthesized
agattacaggcatgaaccacca

SEQ ID NO: 1331542 - DNA, 22 bp, Artificial Sequence
  chemically synthesized
ccaaagtgttgagattacaggc

SEQ ID NO: 1331543 - DNA, 22 bp, Artificial Sequence
  chemically synthesized
ggcctcccaaagtgttgagatt

SEQ ID NO: 1331544 - DNA, 22 bp, Artificial Sequence
  chemically synthesized
atgcctgtaatctcaacacttt

SEQ ID NO: 1331545 - DNA, 22 bp, Artificial Sequence
  chemically synthesized
cccatctcggcctcccaaagtg

SEQ ID NO: 1331546 - DNA, 22 bp, Artificial Sequence
  chemically synthesized
taatctcaacactttgggaggc

SEQ ID NO: 1331547 - DNA, 22 bp, Artificial Sequence
  chemically synthesized
aacactttgggaggccgagatg

SEQ ID NO: 1331548 - DNA, 22 bp, Artificial Sequence
  chemically synthesized
aagtgatctgcccatctcggcc

SEQ ID NO: 1331549 - DNA, 22 bp, Artificial Sequence
  chemically synthesized
acctcaagtgatctgcccatct

SEQ ID NO: 1331550 - DNA, 22 bp, Artificial Sequence
  chemically synthesized
tgggaggccgagatgggcagat

SEQ ID NO: 1331551 - DNA, 22 bp, Artificial Sequence
  chemically synthesized
gggaggccgagatgggcagatc

SEQ ID NO: 1331552 - DNA, 22 bp, Artificial Sequence
  chemically synthesized
ctgacctcaagtgatctgccca

SEQ ID NO: 1331553 - DNA, 22 bp, Artificial Sequence
  chemically synthesized
ggaggccgagatgggcagatca

SEQ ID NO: 1331554 - DNA, 22 bp, Artificial Sequence
  chemically synthesized
gaactcctgacctcaagtgatc

SEQ ID NO: 1331555 - DNA, 22 bp, Artificial Sequence
  chemically synthesized
gtctcgaactcctgacctcaag

SEQ ID NO: 1331556 - DNA, 22 bp, Artificial Sequence
  chemically synthesized
gccaggctggtctcgaactcct

SEQ ID NO: 1331557 - DNA, 22 bp, Artificial Sequence
  chemically synthesized
ttggccaggctggtctcgaact

SEQ ID NO: 1331558 - DNA, 22 bp, Artificial Sequence
  chemically synthesized
gaggtcaggagttcgagaccag

SEQ ID NO: 1331559 - DNA, 22 bp, Artificial Sequence
  chemically synthesized
aggtcaggagttcgagaccagc

SEQ ID NO: 1331560 - DNA, 22 bp, Artificial Sequence
  chemically synthesized
accctgttggccaggctggtct

SEQ ID NO: 1331561 - DNA, 22 bp, Artificial Sequence
  chemically synthesized
caccctgttggccaggctggtc

SEQ ID NO: 1331562 - DNA, 22 bp, Artificial Sequence
  chemically synthesized
gagaccagcctggccaacaggg

SEQ ID NO: 1331563 - DNA, 22 bp, Artificial Sequence
  chemically synthesized
ggagagacggggtttcaccctg

SEQ ID NO: 1331564 - DNA, 22 bp, Artificial Sequence
  chemically synthesized
aggagagacggggtttcaccct

SEQ ID NO: 1331565 - DNA, 22 bp, Artificial Sequence
  chemically synthesized
taggagagacggggtttcaccc

SEQ ID NO: 1331566 - DNA, 22 bp, Artificial Sequence
  chemically synthesized
ttaggagagacggggtttcacc

SEQ ID NO: 1331567 - DNA, 22 bp, Artificial Sequence
  chemically synthesized
gccaacagggtgaaaccccgtc

SEQ ID NO: 1331568 - DNA, 22 bp, Artificial Sequence
  chemically synthesized
tatttttaggagagacggggtt

SEQ ID NO: 1331569 - DNA, 22 bp, Artificial Sequence
  chemically synthesized
atatttttaggagagacggggt

SEQ ID NO: 1331570 - DNA, 22 bp, Artificial Sequence
  chemically synthesized
tatatttttaggagagacgggg

SEQ ID NO: 1331571 - DNA, 22 bp, Artificial Sequence
  chemically synthesized
ttatatttttaggagagacggg

SEQ ID NO: 1331572 - DNA, 22 bp, Artificial Sequence
  chemically synthesized
atttttatatttttaggagaga

SEQ ID NO: 1331573 - DNA, 22 bp, Artificial Sequence
  chemically synthesized
actaatttttatatttttagga

SEQ ID NO: 1331574 - DNA, 22 bp, Artificial Sequence
  chemically synthesized
tcctaaaaatataaaaattagt

SEQ ID NO: 1331575 - DNA, 22 bp, Artificial Sequence
  chemically synthesized
ctaaaaatataaaaattagtca

SEQ ID NO: 1331576 - DNA, 22 bp, Artificial Sequence
  chemically synthesized
aaaatataaaaattagtcaggc

SEQ ID NO: 1331577 - DNA, 22 bp, Artificial Sequence
  chemically synthesized
caggcatgcaccaccgtgcctg

SEQ ID NO: 1331578 - DNA, 22 bp, Artificial Sequence
  chemically synthesized
ggattacaggcatgcaccaccg

SEQ ID NO: 1331579 - DNA, 22 bp, Artificial Sequence
  chemically synthesized
gtcaggcacggtggtgcatgcc

SEQ ID NO: 1331580 - DNA, 22 bp, Artificial Sequence
  chemically synthesized
agtaactgggattacaggcatg

SEQ ID NO: 1331581 - DNA, 22 bp, Artificial Sequence
  chemically synthesized
ctcagtaactgggattacaggc

SEQ ID NO: 1331582 - DNA, 22 bp, Artificial Sequence
  chemically synthesized
agcctcctcagtaactgggatt

SEQ ID NO: 1331583 - DNA, 22 bp, Artificial Sequence
  chemically synthesized
cctgagcctcctcagtaactgg

SEQ ID NO: 1331584 - DNA, 22 bp, Artificial Sequence
  chemically synthesized
ctgcctgagcctcctcagtaac

SEQ ID NO: 1331585 - DNA, 22 bp, Artificial Sequence
  chemically synthesized
tcctgcctgagcctcctcagta

SEQ ID NO: 1331586 - DNA, 22 bp, Artificial Sequence
  chemically synthesized
taatcccagttactgaggaggc

SEQ ID NO: 1331587 - DNA, 22 bp, Artificial Sequence
  chemically synthesized
aagcaattctcctgcctgagcc

SEQ ID NO: 1331588 - DNA, 22 bp, Artificial Sequence
  chemically synthesized
ctgaggaggctcaggcaggaga

SEQ ID NO: 1331589 - DNA, 22 bp, Artificial Sequence
  chemically synthesized
caggctcaagcaattctcctgc

SEQ ID NO: 1331590 - DNA, 22 bp, Artificial Sequence
  chemically synthesized
aggaggctcaggcaggagaatt

SEQ ID NO: 1331591 - DNA, 22 bp, Artificial Sequence
  chemically synthesized
cacctccaggctcaagcaattc

SEQ ID NO: 1331592 - DNA, 22 bp, Artificial Sequence
  chemically synthesized
aggcaggagaattgcttgagcc

SEQ ID NO: 1331593 - DNA, 22 bp, Artificial Sequence
  chemically synthesized
caacctccacctccaggctcaa

SEQ ID NO: 1331594 - DNA, 22 bp, Artificial Sequence
  chemically synthesized
cctgcaacctccacctccaggc

SEQ ID NO: 1331595 - DNA, 22 bp, Artificial Sequence
  chemically synthesized
ggctccctgcaacctccacctc

SEQ ID NO: 1331596 - DNA, 22 bp, Artificial Sequence
  chemically synthesized
cttgagcctggaggtggaggtt

SEQ ID NO: 1331597 - DNA, 22 bp, Artificial Sequence
  chemically synthesized
gagcctggaggtggaggttgca

SEQ ID NO: 1331598 - DNA, 22 bp, Artificial Sequence
  chemically synthesized
agcctggaggtggaggttgcag

SEQ ID NO: 1331599 - DNA, 22 bp, Artificial Sequence
  chemically synthesized
gtgcaatctcggctccctgcaa

SEQ ID NO: 1331600 - DNA, 22 bp, Artificial Sequence
  chemically synthesized
gaggtggaggttgcagggagcc

SEQ ID NO: 1331601 - DNA, 22 bp, Artificial Sequence
  chemically synthesized
actggtgcaatctcggctccct

SEQ ID NO: 1331602 - DNA, 22 bp, Artificial Sequence
  chemically synthesized
gagctcactggtgcaatctcgg

SEQ ID NO: 1331603 - DNA, 22 bp, Artificial Sequence
  chemically synthesized
cagggagccgagattgcaccag

SEQ ID NO: 1331604 - DNA, 22 bp, Artificial Sequence
  chemically synthesized
tcacccaggctggagctcactg

SEQ ID NO: 1331605 - DNA, 22 bp, Artificial Sequence
  chemically synthesized
tgtcacccaggctggagctcac

SEQ ID NO: 1331606 - DNA, 22 bp, Artificial Sequence
  chemically synthesized
actctgtcacccaggctggagc

SEQ ID NO: 1331607 - DNA, 22 bp, Artificial Sequence
  chemically synthesized
caccagtgagctccagcctggg

SEQ ID NO: 1331608 - DNA, 22 bp, Artificial Sequence
  chemically synthesized
agacggagtctcactctgtcac

SEQ ID NO: 1331609 - DNA, 22 bp, Artificial Sequence
  chemically synthesized
gagacggagtctcactctgtca

SEQ ID NO: 1331610 - DNA, 22 bp, Artificial Sequence
  chemically synthesized
tgagacggagtctcactctgtc

SEQ ID NO: 1331611 - DNA, 22 bp, Artificial Sequence
  chemically synthesized
ttgagacggagtctcactctgt

SEQ ID NO: 1331612 - DNA, 22 bp, Artificial Sequence
  chemically synthesized
cagcctgggtgacagagtgaga

SEQ ID NO: 1331613 - DNA, 22 bp, Artificial Sequence
  chemically synthesized
tttttgagacggagtctcactc

SEQ ID NO: 1331614 - DNA, 22 bp, Artificial Sequence
  chemically synthesized
gtttttgagacggagtctcact

SEQ ID NO: 1331615 - DNA, 22 bp, Artificial Sequence
  chemically synthesized
tttgtttttgagacggagtctc

SEQ ID NO: 1331616 - DNA, 22 bp, Artificial Sequence
  chemically synthesized
ggtgacagagtgagactccgtc

SEQ ID NO: 1331617 - DNA, 22 bp, Artificial Sequence
  chemically synthesized
gtttgtttttgagacggagtct

SEQ ID NO: 1331618 - DNA, 22 bp, Artificial Sequence
  chemically synthesized
tttgtttgtttttgagacggag

SEQ ID NO: 1331619 - DNA, 22 bp, Artificial Sequence
  chemically synthesized
gtttgtttgtttttgagacgga

SEQ ID NO: 1331620 - DNA, 22 bp, Artificial Sequence
  chemically synthesized
tttgtttgtttgtttttgagac

SEQ ID NO: 1331621 - DNA, 22 bp, Artificial Sequence
  chemically synthesized
gtttgtttgtttgtttttgaga

SEQ ID NO: 1331622 - DNA, 22 bp, Artificial Sequence
  chemically synthesized
tttgtttgtttgtttgtttttg

SEQ ID NO: 1331623 - DNA, 22 bp, Artificial Sequence
  chemically synthesized
gtttgtttgtttgtttgttttt

SEQ ID NO: 1331624 - DNA, 22 bp, Artificial Sequence
  chemically synthesized
tgtttgtttgtttgtttgtttt

SEQ ID NO: 1331625 - DNA, 22 bp, Artificial Sequence
  chemically synthesized
ttgtttgtttgtttgtttgttt

SEQ ID NO: 1331626 - DNA, 22 bp, Artificial Sequence
  chemically synthesized
tttgtttgtttgtttgtttgtt

SEQ ID NO: 1331627 - DNA, 22 bp, Artificial Sequence
  chemically synthesized
cgtctcaaaaacaaacaaacaa

SEQ ID NO: 1331628 - DNA, 22 bp, Artificial Sequence
  chemically synthesized
ttttttgtttgtttgtttgttt

SEQ ID NO: 1331629 - DNA, 22 bp, Artificial Sequence
  chemically synthesized
gttttttgtttgtttgtttgtt

SEQ ID NO: 1331630 - DNA, 22 bp, Artificial Sequence
  chemically synthesized
tgttttttgtttgtttgtttgt

SEQ ID NO: 1331631 - DNA, 22 bp, Artificial Sequence
  chemically synthesized
ttgttttttgtttgtttgtttg

SEQ ID NO: 1331632 - DNA, 22 bp, Artificial Sequence
  chemically synthesized
tttgttttttgtttgtttgttt

SEQ ID NO: 1331633 - DNA, 22 bp, Artificial Sequence
  chemically synthesized
aaaaacaaacaaacaaacaaac

SEQ ID NO: 1331634 - DNA, 22 bp, Artificial Sequence
  chemically synthesized
ttttttgttttttgtttgtttg

SEQ ID NO: 1331635 - DNA, 22 bp, Artificial Sequence
  chemically synthesized
gttttttgttttttgtttgttt

SEQ ID NO: 1331636 - DNA, 22 bp, Artificial Sequence
  chemically synthesized
tgttttttgttttttgtttgtt

SEQ ID NO: 1331637 - DNA, 22 bp, Artificial Sequence
  chemically synthesized
ttgttttttgttttttgtttgt

SEQ ID NO: 1331638 - DNA, 22 bp, Artificial Sequence
  chemically synthesized
atttttgttttttgttttttgt

SEQ ID NO: 1331639 - DNA, 22 bp, Artificial Sequence
  chemically synthesized
gatttttgttttttgttttttg

SEQ ID NO: 1331640 - DNA, 22 bp, Artificial Sequence
  chemically synthesized
tgatttttgttttttgtttttt

SEQ ID NO: 1331641 - DNA, 22 bp, Artificial Sequence
  chemically synthesized
accacctttgatttttgttttt

SEQ ID NO: 1331642 - DNA, 22 bp, Artificial Sequence
  chemically synthesized
caccacctttgatttttgtttt

SEQ ID NO: 1331643 - DNA, 22 bp, Artificial Sequence
  chemically synthesized
tttcaccacctttgatttttgt

SEQ ID NO: 1331644 - DNA, 22 bp, Artificial Sequence
  chemically synthesized
aacaaaattatttcaccacctt

SEQ ID NO: 1331645 - DNA, 22 bp, Artificial Sequence
  chemically synthesized
atgtagacagtgccaaatattc

SEQ ID NO: 1331646 - DNA, 22 bp, Artificial Sequence
  chemically synthesized
tgttgaatatttggcactgtct

SEQ ID NO: 1331647 - DNA, 22 bp, Artificial Sequence
  chemically synthesized
gttgaatatttggcactgtcta

SEQ ID NO: 1331648 - DNA, 22 bp, Artificial Sequence
  chemically synthesized
ttgaatatttggcactgtctac

SEQ ID NO: 1331649 - DNA, 22 bp, Artificial Sequence
  chemically synthesized
aatatttggcactgtctacatt

SEQ ID NO: 1331650 - DNA, 22 bp, Artificial Sequence
  chemically synthesized
agtgtgtgcattaatgtagaca

SEQ ID NO: 1331651 - DNA, 22 bp, Artificial Sequence
  chemically synthesized
ggcactgtctacattaatgcac

SEQ ID NO: 1331652 - DNA, 22 bp, Artificial Sequence
  chemically synthesized
gcactgtctacattaatgcaca

SEQ ID NO: 1331653 - DNA, 22 bp, Artificial Sequence
  chemically synthesized
tctacattaatgcacacactca

SEQ ID NO: 1331654 - DNA, 22 bp, Artificial Sequence
  chemically synthesized
aaatatatacattgagtgtgtg

SEQ ID NO: 1331655 - DNA, 22 bp, Artificial Sequence
  chemically synthesized
cattaatgcacacactcaatgt

SEQ ID NO: 1331656 - DNA, 22 bp, Artificial Sequence
  chemically synthesized
agttaaaatatatacattgagt

SEQ ID NO: 1331657 - DNA, 22 bp, Artificial Sequence
  chemically synthesized
atgcacacactcaatgtatata

SEQ ID NO: 1331658 - DNA, 22 bp, Artificial Sequence
  chemically synthesized
agtataaattaagttaaaatat

SEQ ID NO: 1331659 - DNA, 22 bp, Artificial Sequence
  chemically synthesized
aagtataaattaagttaaaata

SEQ ID NO: 1331660 - DNA, 22 bp, Artificial Sequence
  chemically synthesized
taagtataaattaagttaaaat

SEQ ID NO: 1331661 - DNA, 22 bp, Artificial Sequence
  chemically synthesized
aatgtatatattttaacttaat

SEQ ID NO: 1331662 - DNA, 22 bp, Artificial Sequence
  chemically synthesized
tacaattttaagtataaattaa

SEQ ID NO: 1331663 - DNA, 22 bp, Artificial Sequence
  chemically synthesized
atacaattttaagtataaatta

SEQ ID NO: 1331664 - DNA, 22 bp, Artificial Sequence
  chemically synthesized
tatacaattttaagtataaatt

SEQ ID NO: 1331665 - DNA, 22 bp, Artificial Sequence
  chemically synthesized
taacttaatttatacttaaaat

SEQ ID NO: 1331666 - DNA, 22 bp, Artificial Sequence
  chemically synthesized
aacttaatttatacttaaaatt

SEQ ID NO: 1331667 - DNA, 22 bp, Artificial Sequence
  chemically synthesized
acttaatttatacttaaaattg

SEQ ID NO: 1331668 - DNA, 22 bp, Artificial Sequence
  chemically synthesized
aaataattttatacaattttaa

SEQ ID NO: 1331669 - DNA, 22 bp, Artificial Sequence
  chemically synthesized
aatttatacttaaaattgtata

SEQ ID NO: 1331670 - DNA, 22 bp, Artificial Sequence
  chemically synthesized
atttatacttaaaattgtataa

SEQ ID NO: 1331671 - DNA, 22 bp, Artificial Sequence
  chemically synthesized
actaaaataattttatacaatt

SEQ ID NO: 1331672 - DNA, 22 bp, Artificial Sequence
  chemically synthesized
gactaaaataattttatacaat

SEQ ID NO: 1331673 - DNA, 22 bp, Artificial Sequence
  chemically synthesized
tgactaaaataattttatacaa

SEQ ID NO: 1331674 - DNA, 22 bp, Artificial Sequence
  chemically synthesized
atacttaaaattgtataaaatt

SEQ ID NO: 1331675 - DNA, 22 bp, Artificial Sequence
  chemically synthesized
tttgactaaaataattttatac

SEQ ID NO: 1331676 - DNA, 22 bp, Artificial Sequence
  chemically synthesized
tacttaaaattgtataaaatta

SEQ ID NO: 1331677 - DNA, 22 bp, Artificial Sequence
  chemically synthesized
ggttctttgactaaaataattt

SEQ ID NO: 1331678 - DNA, 22 bp, Artificial Sequence
  chemically synthesized
aaaattgtataaaattatttta

SEQ ID NO: 1331679 - DNA, 22 bp, Artificial Sequence
  chemically synthesized
aaattgtataaaattattttag

SEQ ID NO: 1331680 - DNA, 22 bp, Artificial Sequence
  chemically synthesized
cattaggttctttgactaaaat

SEQ ID NO: 1331681 - DNA, 22 bp, Artificial Sequence
  chemically synthesized
tataaaattattttagtcaaag

SEQ ID NO: 1331682 - DNA, 22 bp, Artificial Sequence
  chemically synthesized
agctgcattaggttctttgact

SEQ ID NO: 1331683 - DNA, 22 bp, Artificial Sequence
  chemically synthesized
ttttagtcaaagaacctaatgc

SEQ ID NO: 1331684 - DNA, 22 bp, Artificial Sequence
  chemically synthesized
tagtcaaagaacctaatgcagc

SEQ ID NO: 1331685 - DNA, 22 bp, Artificial Sequence
  chemically synthesized
agtcaaagaacctaatgcagct

SEQ ID NO: 1331686 - DNA, 22 bp, Artificial Sequence
  chemically synthesized
gtcaaagaacctaatgcagctt

SEQ ID NO: 1331687 - DNA, 22 bp, Artificial Sequence
  chemically synthesized
tcaatcaaggctaagctgcatt

SEQ ID NO: 1331688 - DNA, 22 bp, Artificial Sequence
  chemically synthesized
atgcagcttagccttgattgat

SEQ ID NO: 1331689 - DNA, 22 bp, Artificial Sequence
  chemically synthesized
aagataatgaaattatcaatca

SEQ ID NO: 1331690 - DNA, 22 bp, Artificial Sequence
  chemically synthesized
agccttgattgataatttcatt

SEQ ID NO: 1331691 - DNA, 22 bp, Artificial Sequence
  chemically synthesized
gccttgattgataatttcatta

SEQ ID NO: 1331692 - DNA, 22 bp, Artificial Sequence
  chemically synthesized
ccatgtaattaaagataatgaa

SEQ ID NO: 1331693 - DNA, 22 bp, Artificial Sequence
  chemically synthesized
gattgataatttcattatcttt

SEQ ID NO: 1331694 - DNA, 22 bp, Artificial Sequence
  chemically synthesized
tgccatgtaattaaagataatg

SEQ ID NO: 1331695 - DNA, 22 bp, Artificial Sequence
  chemically synthesized
attgataatttcattatcttta

SEQ ID NO: 1331696 - DNA, 22 bp, Artificial Sequence
  chemically synthesized
ataatttcattatctttaatta

SEQ ID NO: 1331697 - DNA, 22 bp, Artificial Sequence
  chemically synthesized
cattatctttaattacatggca

SEQ ID NO: 1331698 - DNA, 22 bp, Artificial Sequence
  chemically synthesized
attatctttaattacatggcag

SEQ ID NO: 1331699 - DNA, 22 bp, Artificial Sequence
  chemically synthesized
tctttaattacatggcagaatt

SEQ ID NO: 1331700 - DNA, 22 bp, Artificial Sequence
  chemically synthesized
taattacatggcagaatttctc

SEQ ID NO: 1331701 - DNA, 22 bp, Artificial Sequence
  chemically synthesized
aagagtaatgaggagaaattct

SEQ ID NO: 1331702 - DNA, 22 bp, Artificial Sequence
  chemically synthesized
aattacatggcagaatttctcc

SEQ ID NO: 1331703 - DNA, 22 bp, Artificial Sequence
  chemically synthesized
attacatggcagaatttctcct

SEQ ID NO: 1331704 - DNA, 22 bp, Artificial Sequence
  chemically synthesized
gttaaagagtaatgaggagaaa

SEQ ID NO: 1331705 - DNA, 22 bp, Artificial Sequence
  chemically synthesized
ggttaaagagtaatgaggagaa

SEQ ID NO: 1331706 - DNA, 22 bp, Artificial Sequence
  chemically synthesized
catggcagaatttctcctcatt

SEQ ID NO: 1331707 - DNA, 22 bp, Artificial Sequence
  chemically synthesized
tggttaaagagtaatgaggaga

SEQ ID NO: 1331708 - DNA, 22 bp, Artificial Sequence
  chemically synthesized
ttggttaaagagtaatgaggag

SEQ ID NO: 1331709 - DNA, 22 bp, Artificial Sequence
  chemically synthesized
ccacagccttttggttaaagag

SEQ ID NO: 1331710 - DNA, 22 bp, Artificial Sequence
  chemically synthesized
ctcctcattactctttaaccaa

SEQ ID NO: 1331711 - DNA, 22 bp, Artificial Sequence
  chemically synthesized
taccacagccttttggttaaag

SEQ ID NO: 1331712 - DNA, 22 bp, Artificial Sequence
  chemically synthesized
tcctcattactctttaaccaaa

SEQ ID NO: 1331713 - DNA, 22 bp, Artificial Sequence
  chemically synthesized
ctaccacagccttttggttaaa

SEQ ID NO: 1331714 - DNA, 22 bp, Artificial Sequence
  chemically synthesized
ctcattactctttaaccaaaag

SEQ ID NO: 1331715 - DNA, 22 bp, Artificial Sequence
  chemically synthesized
attactctttaaccaaaaggct

SEQ ID NO: 1331716 - DNA, 22 bp, Artificial Sequence
  chemically synthesized
ctctttaaccaaaaggctgtgg

SEQ ID NO: 1331717 - DNA, 22 bp, Artificial Sequence
  chemically synthesized
tttaaccaaaaggctgtggtag

SEQ ID NO: 1331718 - DNA, 22 bp, Artificial Sequence
  chemically synthesized
taaccaaaaggctgtggtagaa

SEQ ID NO: 1331719 - DNA, 22 bp, Artificial Sequence
  chemically synthesized
aaccaaaaggctgtggtagaaa

SEQ ID NO: 1331720 - DNA, 22 bp, Artificial Sequence
  chemically synthesized
accaaaaggctgtggtagaaat

SEQ ID NO: 1331721 - DNA, 22 bp, Artificial Sequence
  chemically synthesized
caataaaaatgagcatcaatga

SEQ ID NO: 1331722 - DNA, 22 bp, Artificial Sequence
  chemically synthesized
ccaataaaaatgagcatcaatg

SEQ ID NO: 1331723 - DNA, 22 bp, Artificial Sequence
  chemically synthesized
tccaataaaaatgagcatcaat

SEQ ID NO: 1331724 - DNA, 22 bp, Artificial Sequence
  chemically synthesized
tggtagaaatcattgatgctca

SEQ ID NO: 1331725 - DNA, 22 bp, Artificial Sequence
  chemically synthesized
ctttccaataaaaatgagcatc

SEQ ID NO: 1331726 - DNA, 22 bp, Artificial Sequence
  chemically synthesized
gaaaaattactttccaataaaa

SEQ ID NO: 1331727 - DNA, 22 bp, Artificial Sequence
  chemically synthesized
atgctcatttttattggaaagt

SEQ ID NO: 1331728 - DNA, 22 bp, Artificial Sequence
  chemically synthesized
atttttattggaaagtaatttt

SEQ ID NO: 1331729 - DNA, 22 bp, Artificial Sequence
  chemically synthesized
tcaggaaatctagaaaaattac

SEQ ID NO: 1331730 - DNA, 22 bp, Artificial Sequence
  chemically synthesized
ttattggaaagtaatttttcta

SEQ ID NO: 1331731 - DNA, 22 bp, Artificial Sequence
  chemically synthesized
tattggaaagtaatttttctag

SEQ ID NO: 1331732 - DNA, 22 bp, Artificial Sequence
  chemically synthesized
attggaaagtaatttttctaga

SEQ ID NO: 1331733 - DNA, 22 bp, Artificial Sequence
  chemically synthesized
ttggaaagtaatttttctagat

SEQ ID NO: 1331734 - DNA, 22 bp, Artificial Sequence
  chemically synthesized
aattatcaggaaatctagaaaa

SEQ ID NO: 1331735 - DNA, 22 bp, Artificial Sequence
  chemically synthesized
gaaagtaatttttctagatttc

SEQ ID NO: 1331736 - DNA, 22 bp, Artificial Sequence
  chemically synthesized
tcactcaattatcaggaaatct

SEQ ID NO: 1331737 - DNA, 22 bp, Artificial Sequence
  chemically synthesized
aagttatcactcaattatcagg

SEQ ID NO: 1331738 - DNA, 22 bp, Artificial Sequence
  chemically synthesized
ttctagatttcctgataattga

SEQ ID NO: 1331739 - DNA, 22 bp, Artificial Sequence
  chemically synthesized
tctagatttcctgataattgag

SEQ ID NO: 1331740 - DNA, 22 bp, Artificial Sequence
  chemically synthesized
ctagatttcctgataattgagt

SEQ ID NO: 1331741 - DNA, 22 bp, Artificial Sequence
  chemically synthesized
tagatttcctgataattgagtg

SEQ ID NO: 1331742 - DNA, 22 bp, Artificial Sequence
  chemically synthesized
gatttcctgataattgagtgat

SEQ ID NO: 1331743 - DNA, 22 bp, Artificial Sequence
  chemically synthesized
aggagtgctgaagttatcactc

SEQ ID NO: 1331744 - DNA, 22 bp, Artificial Sequence
  chemically synthesized
cctgataattgagtgataactt

SEQ ID NO: 1331745 - DNA, 22 bp, Artificial Sequence
  chemically synthesized
ctgataattgagtgataacttc

SEQ ID NO: 1331746 - DNA, 22 bp, Artificial Sequence
  chemically synthesized
ataattgagtgataacttcagc

SEQ ID NO: 1331747 - DNA, 22 bp, Artificial Sequence
  chemically synthesized
agtgataacttcagcactcctt

SEQ ID NO: 1331748 - DNA, 22 bp, Artificial Sequence
  chemically synthesized
cataatgaaaagtgactaagga

SEQ ID NO: 1331749 - DNA, 22 bp, Artificial Sequence
  chemically synthesized
tctgcataatgaaaagtgacta

SEQ ID NO: 1331750 - DNA, 22 bp, Artificial Sequence
  chemically synthesized
gtctgcataatgaaaagtgact

SEQ ID NO: 1331751 - DNA, 22 bp, Artificial Sequence
  chemically synthesized
cagcactccttagtcacttttc

SEQ ID NO: 1331752 - DNA, 22 bp, Artificial Sequence
  chemically synthesized
tgtctgcataatgaaaagtgac

SEQ ID NO: 1331753 - DNA, 22 bp, Artificial Sequence
  chemically synthesized
agcactccttagtcacttttca

SEQ ID NO: 1331754 - DNA, 22 bp, Artificial Sequence
  chemically synthesized
cttagtcacttttcattatgca

SEQ ID NO: 1331755 - DNA, 22 bp, Artificial Sequence
  chemically synthesized
agtcacttttcattatgcagac

SEQ ID NO: 1331756 - DNA, 22 bp, Artificial Sequence
  chemically synthesized
gtcacttttcattatgcagaca

SEQ ID NO: 1331757 - DNA, 22 bp, Artificial Sequence
  chemically synthesized
agagtcagattttgtctgcata

SEQ ID NO: 1331758 - DNA, 22 bp, Artificial Sequence
  chemically synthesized
ttcattatgcagacaaaatctg

SEQ ID NO: 1331759 - DNA, 22 bp, Artificial Sequence
  chemically synthesized
aaagttaagagtcagattttgt

SEQ ID NO: 1331760 - DNA, 22 bp, Artificial Sequence
  chemically synthesized
tcattatgcagacaaaatctga

SEQ ID NO: 1331761 - DNA, 22 bp, Artificial Sequence
  chemically synthesized
gaaagttaagagtcagattttg

SEQ ID NO: 1331762 - DNA, 22 bp, Artificial Sequence
  chemically synthesized
cattatgcagacaaaatctgac

SEQ ID NO: 1331763 - DNA, 22 bp, Artificial Sequence
  chemically synthesized
tgaaagttaagagtcagatttt

SEQ ID NO: 1331764 - DNA, 22 bp, Artificial Sequence
  chemically synthesized
attatgcagacaaaatctgact

SEQ ID NO: 1331765 - DNA, 22 bp, Artificial Sequence
  chemically synthesized
ttgaaagttaagagtcagattt

SEQ ID NO: 1331766 - DNA, 22 bp, Artificial Sequence
  chemically synthesized
tttgaaagttaagagtcagatt

SEQ ID NO: 1331767 - DNA, 22 bp, Artificial Sequence
  chemically synthesized
ttttgaaagttaagagtcagat

SEQ ID NO: 1331768 - DNA, 22 bp, Artificial Sequence
  chemically synthesized
tgcagacaaaatctgactctta

SEQ ID NO: 1331769 - DNA, 22 bp, Artificial Sequence
  chemically synthesized
tggtaagatatttttttgaaag

SEQ ID NO: 1331770 - DNA, 22 bp, Artificial Sequence
  chemically synthesized
actcttaactttcaaaaaaata

SEQ ID NO: 1331771 - DNA, 22 bp, Artificial Sequence
  chemically synthesized
ttaactttcaaaaaaatatctt

SEQ ID NO: 1331772 - DNA, 22 bp, Artificial Sequence
  chemically synthesized
aactttcaaaaaaatatcttac

SEQ ID NO: 1331773 - DNA, 22 bp, Artificial Sequence
  chemically synthesized
actttcaaaaaaatatcttacc

SEQ ID NO: 1331774 - DNA, 22 bp, Artificial Sequence
  chemically synthesized
aaaatacattatggtaagatat

SEQ ID NO: 1331775 - DNA, 22 bp, Artificial Sequence
  chemically synthesized
gaaaatacattatggtaagata

SEQ ID NO: 1331776 - DNA, 22 bp, Artificial Sequence
  chemically synthesized
tcaaaaaaatatcttaccataa

SEQ ID NO: 1331777 - DNA, 22 bp, Artificial Sequence
  chemically synthesized
tttgaaaatacattatggtaag

SEQ ID NO: 1331778 - DNA, 22 bp, Artificial Sequence
  chemically synthesized
caaaaaaatatcttaccataat

SEQ ID NO: 1331779 - DNA, 22 bp, Artificial Sequence
  chemically synthesized
aaaaaaatatcttaccataatg

SEQ ID NO: 1331780 - DNA, 22 bp, Artificial Sequence
  chemically synthesized
atgttatttgaaaatacattat

SEQ ID NO: 1331781 - DNA, 22 bp, Artificial Sequence
  chemically synthesized
aactcatgttatttgaaaatac

SEQ ID NO: 1331782 - DNA, 22 bp, Artificial Sequence
  chemically synthesized
accataatgtattttcaaataa

SEQ ID NO: 1331783 - DNA, 22 bp, Artificial Sequence
  chemically synthesized
attaaactcatgttatttgaaa

SEQ ID NO: 1331784 - DNA, 22 bp, Artificial Sequence
  chemically synthesized
ccataatgtattttcaaataac

SEQ ID NO: 1331785 - DNA, 22 bp, Artificial Sequence
  chemically synthesized
aattaaactcatgttatttgaa

SEQ ID NO: 1331786 - DNA, 22 bp, Artificial Sequence
  chemically synthesized
taattaaactcatgttatttga

SEQ ID NO: 1331787 - DNA, 22 bp, Artificial Sequence
  chemically synthesized
ttaattaaactcatgttatttg

SEQ ID NO: 1331788 - DNA, 22 bp, Artificial Sequence
  chemically synthesized
tttaattaaactcatgttattt

SEQ ID NO: 1331789 - DNA, 22 bp, Artificial Sequence
  chemically synthesized
tttttaattaaactcatgttat

SEQ ID NO: 1331790 - DNA, 22 bp, Artificial Sequence
  chemically synthesized
tcaaataacatgagtttaatta

SEQ ID NO: 1331791 - DNA, 22 bp, Artificial Sequence
  chemically synthesized
caaataacatgagtttaattaa

SEQ ID NO: 1331792 - DNA, 22 bp, Artificial Sequence
  chemically synthesized
aaataacatgagtttaattaaa

SEQ ID NO: 1331793 - DNA, 22 bp, Artificial Sequence
  chemically synthesized
tgggaaagttctttttaattaa

SEQ ID NO: 1331794 - DNA, 22 bp, Artificial Sequence
  chemically synthesized
aacatgaacctgtgggaaagtt

SEQ ID NO: 1331795 - DNA, 22 bp, Artificial Sequence
  chemically synthesized
aattaaaaagaactttcccaca

SEQ ID NO: 1331796 - DNA, 22 bp, Artificial Sequence
  chemically synthesized
attaaaaagaactttcccacag

SEQ ID NO: 1331797 - DNA, 22 bp, Artificial Sequence
  chemically synthesized
aaaagaactttcccacaggttc

SEQ ID NO: 1331798 - DNA, 22 bp, Artificial Sequence
  chemically synthesized
aaaccaagattaaacatgaacc

SEQ ID NO: 1331799 - DNA, 22 bp, Artificial Sequence
  chemically synthesized
tcccacaggttcatgtttaatc

SEQ ID NO: 1331800 - DNA, 22 bp, Artificial Sequence
  chemically synthesized
cccacaggttcatgtttaatct

SEQ ID NO: 1331801 - DNA, 22 bp, Artificial Sequence
  chemically synthesized
ccacaggttcatgtttaatctt

SEQ ID NO: 1331802 - DNA, 22 bp, Artificial Sequence
  chemically synthesized
aagactcaaaccaagattaaac

SEQ ID NO: 1331803 - DNA, 22 bp, Artificial Sequence
  chemically synthesized
tattcaagactcaaaccaagat

SEQ ID NO: 1331804 - DNA, 22 bp, Artificial Sequence
  chemically synthesized
tatattcaagactcaaaccaag

SEQ ID NO: 1331805 - DNA, 22 bp, Artificial Sequence
  chemically synthesized
atgtttaatcttggtttgagtc

SEQ ID NO: 1331806 - DNA, 22 bp, Artificial Sequence
  chemically synthesized
actctatattcaagactcaaac

SEQ ID NO: 1331807 - DNA, 22 bp, Artificial Sequence
  chemically synthesized
cactctatattcaagactcaaa

SEQ ID NO: 1331808 - DNA, 22 bp, Artificial Sequence
  chemically synthesized
aatcttggtttgagtcttgaat

SEQ ID NO: 1331809 - DNA, 22 bp, Artificial Sequence
  chemically synthesized
gcttcactctatattcaagact

SEQ ID NO: 1331810 - DNA, 22 bp, Artificial Sequence
  chemically synthesized
atcttggtttgagtcttgaata

SEQ ID NO: 1331811 - DNA, 22 bp, Artificial Sequence
  chemically synthesized
cgcttcactctatattcaagac

SEQ ID NO: 1331812 - DNA, 22 bp, Artificial Sequence
  chemically synthesized
ggtttgagtcttgaatatagag

SEQ ID NO: 1331813 - DNA, 22 bp, Artificial Sequence
  chemically synthesized
tacttcgcttcactctatattc

SEQ ID NO: 1331814 - DNA, 22 bp, Artificial Sequence
  chemically synthesized
gtttgagtcttgaatatagagt

SEQ ID NO: 1331815 - DNA, 22 bp, Artificial Sequence
  chemically synthesized
gagtcttgaatatagagtgaag

SEQ ID NO: 1331816 - DNA, 22 bp, Artificial Sequence
  chemically synthesized
agtcttgaatatagagtgaagc

SEQ ID NO: 1331817 - DNA, 22 bp, Artificial Sequence
  chemically synthesized
gaatatagagtgaagcgaagta

SEQ ID NO: 1331818 - DNA, 22 bp, Artificial Sequence
  chemically synthesized
aatatagagtgaagcgaagtac

SEQ ID NO: 1331819 - DNA, 22 bp, Artificial Sequence
  chemically synthesized
tccaaagcagaaaaagttgtac

SEQ ID NO: 1331820 - DNA, 22 bp, Artificial Sequence
  chemically synthesized
gtccaaagcagaaaaagttgta

SEQ ID NO: 1331821 - DNA, 22 bp, Artificial Sequence
  chemically synthesized
aatttgtccaaagcagaaaaag

SEQ ID NO: 1331822 - DNA, 22 bp, Artificial Sequence
  chemically synthesized
taaatttgtccaaagcagaaaa

SEQ ID NO: 1331823 - DNA, 22 bp, Artificial Sequence
  chemically synthesized
aagcagctctaaatttgtccaa

SEQ ID NO: 1331824 - DNA, 22 bp, Artificial Sequence
  chemically synthesized
caagcagctctaaatttgtcca

SEQ ID NO: 1331825 - DNA, 22 bp, Artificial Sequence
  chemically synthesized
ttcaagcagctctaaatttgtc

SEQ ID NO: 1331826 - DNA, 22 bp, Artificial Sequence
  chemically synthesized
tttctgctttggacaaatttag

SEQ ID NO: 1331827 - DNA, 22 bp, Artificial Sequence
  chemically synthesized
ttctgctttggacaaatttaga

SEQ ID NO: 1331828 - DNA, 22 bp, Artificial Sequence
  chemically synthesized
tctgctttggacaaatttagag

SEQ ID NO: 1331829 - DNA, 22 bp, Artificial Sequence
  chemically synthesized
ctgctttggacaaatttagagc

SEQ ID NO: 1331830 - DNA, 22 bp, Artificial Sequence
  chemically synthesized
tctcttcaagcagctctaaatt

SEQ ID NO: 1331831 - DNA, 22 bp, Artificial Sequence
  chemically synthesized
tgctttggacaaatttagagct

SEQ ID NO: 1331832 - DNA, 22 bp, Artificial Sequence
  chemically synthesized
atctcttcaagcagctctaaat

SEQ ID NO: 1331833 - DNA, 22 bp, Artificial Sequence
  chemically synthesized
tatctcttcaagcagctctaaa

SEQ ID NO: 1331834 - DNA, 22 bp, Artificial Sequence
  chemically synthesized
ctttggacaaatttagagctgc

SEQ ID NO: 1331835 - DNA, 22 bp, Artificial Sequence
  chemically synthesized
ttatctcttcaagcagctctaa

SEQ ID NO: 1331836 - DNA, 22 bp, Artificial Sequence
  chemically synthesized
tggacaaatttagagctgcttg

SEQ ID NO: 1331837 - DNA, 22 bp, Artificial Sequence
  chemically synthesized
tttttatctcttcaagcagctc

SEQ ID NO: 1331838 - DNA, 22 bp, Artificial Sequence
  chemically synthesized
ggacaaatttagagctgcttga

SEQ ID NO: 1331839 - DNA, 22 bp, Artificial Sequence
  chemically synthesized
gtttttatctcttcaagcagct

SEQ ID NO: 1331840 - DNA, 22 bp, Artificial Sequence
  chemically synthesized
gacaaatttagagctgcttgaa

SEQ ID NO: 1331841 - DNA, 22 bp, Artificial Sequence
  chemically synthesized
agagctgcttgaagagataaaa

SEQ ID NO: 1331842 - DNA, 22 bp, Artificial Sequence
  chemically synthesized
gagctgcttgaagagataaaaa

SEQ ID NO: 1331843 - DNA, 22 bp, Artificial Sequence
  chemically synthesized
cttgaagagataaaaacaagcg

SEQ ID NO: 1331844 - DNA, 22 bp, Artificial Sequence
  chemically synthesized
gagggaggtccccgcttgtttt

SEQ ID NO: 1331845 - DNA, 22 bp, Artificial Sequence
  chemically synthesized
agagggaggtccccgcttgttt

SEQ ID NO: 1331846 - DNA, 22 bp, Artificial Sequence
  chemically synthesized
gaagagataaaaacaagcgggg

SEQ ID NO: 1331847 - DNA, 22 bp, Artificial Sequence
  chemically synthesized
aagagataaaaacaagcgggga

SEQ ID NO: 1331848 - DNA, 22 bp, Artificial Sequence
  chemically synthesized
cctctaaaccttccacttctct

SEQ ID NO: 1331849 - DNA, 22 bp, Artificial Sequence
  chemically synthesized
agagagggagagaaagagaagt

SEQ ID NO: 1331850 - DNA, 22 bp, Artificial Sequence
  chemically synthesized
taaaccttccacttctctttct

SEQ ID NO: 1331851 - DNA, 22 bp, Artificial Sequence
  chemically synthesized
aaccttccacttctctttctct

SEQ ID NO: 1331852 - DNA, 22 bp, Artificial Sequence
  chemically synthesized
ccacttctctttctctccctct

SEQ ID NO: 1331853 - DNA, 22 bp, Artificial Sequence
  chemically synthesized
cacttctctttctctccctctc

SEQ ID NO: 1331854 - DNA, 22 bp, Artificial Sequence
  chemically synthesized
ggaacacagttgagagagggag

SEQ ID NO: 1331855 - DNA, 22 bp, Artificial Sequence
  chemically synthesized
ctctttctctccctctctcaac

SEQ ID NO: 1331856 - DNA, 22 bp, Artificial Sequence
  chemically synthesized
tctttctctccctctctcaact

SEQ ID NO: 1331857 - DNA, 22 bp, Artificial Sequence
  chemically synthesized
tttctctccctctctcaactgt

SEQ ID NO: 1331858 - DNA, 22 bp, Artificial Sequence
  chemically synthesized
tctctccctctctcaactgtgt

SEQ ID NO: 1331859 - DNA, 22 bp, Artificial Sequence
  chemically synthesized
ctctccctctctcaactgtgtt

SEQ ID NO: 1331860 - DNA, 22 bp, Artificial Sequence
  chemically synthesized
tctccctctctcaactgtgttc

SEQ ID NO: 1331861 - DNA, 22 bp, Artificial Sequence
  chemically synthesized
gagaaagcattcggaacacagt

SEQ ID NO: 1331862 - DNA, 22 bp, Artificial Sequence
  chemically synthesized
tccctctctcaactgtgttccg

SEQ ID NO: 1331863 - DNA, 22 bp, Artificial Sequence
  chemically synthesized
agagaaagcattcggaacacag

SEQ ID NO: 1331864 - DNA, 22 bp, Artificial Sequence
  chemically synthesized
tagagaaagcattcggaacaca

SEQ ID NO: 1331865 - DNA, 22 bp, Artificial Sequence
  chemically synthesized
cctctctcaactgtgttccgaa

SEQ ID NO: 1331866 - DNA, 22 bp, Artificial Sequence
  chemically synthesized
tctcaactgtgttccgaatgct

SEQ ID NO: 1331867 - DNA, 22 bp, Artificial Sequence
  chemically synthesized
tgttttagagaaagcattcgga

SEQ ID NO: 1331868 - DNA, 22 bp, Artificial Sequence
  chemically synthesized
tcaactgtgttccgaatgcttt

SEQ ID NO: 1331869 - DNA, 22 bp, Artificial Sequence
  chemically synthesized
tgtgttttagagaaagcattcg

SEQ ID NO: 1331870 - DNA, 22 bp, Artificial Sequence
  chemically synthesized
aactgtgttccgaatgctttct

SEQ ID NO: 1331871 - DNA, 22 bp, Artificial Sequence
  chemically synthesized
agcctctgtgttttagagaaag

SEQ ID NO: 1331872 - DNA, 22 bp, Artificial Sequence
  chemically synthesized
tgttccgaatgctttctctaaa

SEQ ID NO: 1331873 - DNA, 22 bp, Artificial Sequence
  chemically synthesized
cgaatgctttctctaaaacaca

SEQ ID NO: 1331874 - DNA, 22 bp, Artificial Sequence
  chemically synthesized
tctctaaaacacagaggctgag

SEQ ID NO: 1331875 - DNA, 22 bp, Artificial Sequence
  chemically synthesized
ctctaaaacacagaggctgagt

SEQ ID NO: 1331876 - DNA, 22 bp, Artificial Sequence
  chemically synthesized
cagccagtcaaaactcagcctc

SEQ ID NO: 1331877 - DNA, 22 bp, Artificial Sequence
  chemically synthesized
tctaaaacacagaggctgagtt

SEQ ID NO: 1331878 - DNA, 22 bp, Artificial Sequence
  chemically synthesized
ccagccagtcaaaactcagcct

SEQ ID NO: 1331879 - DNA, 22 bp, Artificial Sequence
  chemically synthesized
tccagccagtcaaaactcagcc

SEQ ID NO: 1331880 - DNA, 22 bp, Artificial Sequence
  chemically synthesized
taaaacacagaggctgagtttt

SEQ ID NO: 1331881 - DNA, 22 bp, Artificial Sequence
  chemically synthesized
ttccagccagtcaaaactcagc

SEQ ID NO: 1331882 - DNA, 22 bp, Artificial Sequence
  chemically synthesized
aaacacagaggctgagttttga

SEQ ID NO: 1331883 - DNA, 22 bp, Artificial Sequence
  chemically synthesized
atgtttttccagccagtcaaaa

SEQ ID NO: 1331884 - DNA, 22 bp, Artificial Sequence
  chemically synthesized
agttttgactggctggaaaaac

SEQ ID NO: 1331885 - DNA, 22 bp, Artificial Sequence
  chemically synthesized
tgactggctggaaaaacatcag

SEQ ID NO: 1331886 - DNA, 22 bp, Artificial Sequence
  chemically synthesized
gactggctggaaaaacatcagt

SEQ ID NO: 1331887 - DNA, 22 bp, Artificial Sequence
  chemically synthesized
actggctggaaaaacatcagtt

SEQ ID NO: 1331888 - DNA, 22 bp, Artificial Sequence
  chemically synthesized
gctggaaaaacatcagtttatt

SEQ ID NO: 1331889 - DNA, 22 bp, Artificial Sequence
  chemically synthesized
gaaaaacatcagtttatttcat

SEQ ID NO: 1331890 - DNA, 22 bp, Artificial Sequence
  chemically synthesized
gagaaaggaagaacatgaaata

SEQ ID NO: 1331891 - DNA, 22 bp, Artificial Sequence
  chemically synthesized
aaatggaagctggagaaaggaa

SEQ ID NO: 1331892 - DNA, 22 bp, Artificial Sequence
  chemically synthesized
atttcatgttcttcctttctcc

SEQ ID NO: 1331893 - DNA, 22 bp, Artificial Sequence
  chemically synthesized
tttcatgttcttcctttctcca

SEQ ID NO: 1331894 - DNA, 22 bp, Artificial Sequence
  chemically synthesized
catgttcttcctttctccagct

SEQ ID NO: 1331895 - DNA, 22 bp, Artificial Sequence
  chemically synthesized
atgttcttcctttctccagctt

SEQ ID NO: 1331896 - DNA, 22 bp, Artificial Sequence
  chemically synthesized
gaattgaaatggaagctggaga

SEQ ID NO: 1331897 - DNA, 22 bp, Artificial Sequence
  chemically synthesized
ggaattgaaatggaagctggag

SEQ ID NO: 1331898 - DNA, 22 bp, Artificial Sequence
  chemically synthesized
ttcctttctccagcttccattt

SEQ ID NO: 1331899 - DNA, 22 bp, Artificial Sequence
  chemically synthesized
cctttctccagcttccatttca

SEQ ID NO: 1331900 - DNA, 22 bp, Artificial Sequence
  chemically synthesized
ctttctccagcttccatttcaa

SEQ ID NO: 1331901 - DNA, 22 bp, Artificial Sequence
  chemically synthesized
ggccacacttggaattgaaatg

SEQ ID NO: 1331902 - DNA, 22 bp, Artificial Sequence
  chemically synthesized
tctccagcttccatttcaattc

SEQ ID NO: 1331903 - DNA, 22 bp, Artificial Sequence
  chemically synthesized
gggccacacttggaattgaaat

SEQ ID NO: 1331904 - DNA, 22 bp, Artificial Sequence
  chemically synthesized
ctccagcttccatttcaattcc

SEQ ID NO: 1331905 - DNA, 22 bp, Artificial Sequence
  chemically synthesized
tgggccacacttggaattgaaa

SEQ ID NO: 1331906 - DNA, 22 bp, Artificial Sequence
  chemically synthesized
tccagcttccatttcaattcca

SEQ ID NO: 1331907 - DNA, 22 bp, Artificial Sequence
  chemically synthesized
ttgggccacacttggaattgaa

SEQ ID NO: 1331908 - DNA, 22 bp, Artificial Sequence
  chemically synthesized
cagcttccatttcaattccaag

SEQ ID NO: 1331909 - DNA, 22 bp, Artificial Sequence
  chemically synthesized
ttttgggccacacttggaattg

SEQ ID NO: 1331910 - DNA, 22 bp, Artificial Sequence
  chemically synthesized
cttttgggccacacttggaatt

SEQ ID NO: 1331911 - DNA, 22 bp, Artificial Sequence
  chemically synthesized
tcttttgggccacacttggaat

SEQ ID NO: 1331912 - DNA, 22 bp, Artificial Sequence
  chemically synthesized
ttcttttgggccacacttggaa

SEQ ID NO: 1331913 - DNA, 22 bp, Artificial Sequence
  chemically synthesized
ccatttcaattccaagtgtggc

SEQ ID NO: 1331914 - DNA, 22 bp, Artificial Sequence
  chemically synthesized
catttcaattccaagtgtggcc

SEQ ID NO: 1331915 - DNA, 22 bp, Artificial Sequence
  chemically synthesized
tcttttcttttgggccacactt

SEQ ID NO: 1331916 - DNA, 22 bp, Artificial Sequence
  chemically synthesized
ctatcttttcttttgggccaca

SEQ ID NO: 1331917 - DNA, 22 bp, Artificial Sequence
  chemically synthesized
caattccaagtgtggcccaaaa

SEQ ID NO: 1331918 - DNA, 22 bp, Artificial Sequence
  chemically synthesized
aattccaagtgtggcccaaaag

SEQ ID NO: 1331919 - DNA, 22 bp, Artificial Sequence
  chemically synthesized
caagtgtggcccaaaagaaaag

SEQ ID NO: 1331920 - DNA, 22 bp, Artificial Sequence
  chemically synthesized
tgcagttcctatcttttctttt

SEQ ID NO: 1331921 - DNA, 22 bp, Artificial Sequence
  chemically synthesized
atgcagttcctatcttttcttt

SEQ ID NO: 1331922 - DNA, 22 bp, Artificial Sequence
  chemically synthesized
aaacatccttatgcagttccta

SEQ ID NO: 1331923 - DNA, 22 bp, Artificial Sequence
  chemically synthesized
actgaaacatccttatgcagtt

SEQ ID NO: 1331924 - DNA, 22 bp, Artificial Sequence
  chemically synthesized
tcattgactgaaacatccttat

SEQ ID NO: 1331925 - DNA, 22 bp, Artificial Sequence
  chemically synthesized
atcattgactgaaacatcctta

SEQ ID NO: 1331926 - DNA, 22 bp, Artificial Sequence
  chemically synthesized
cataaggatgtttcagtcaatg

SEQ ID NO: 1331927 - DNA, 22 bp, Artificial Sequence
  chemically synthesized
cggtatatgcagtttatcattg

SEQ ID NO: 1331928 - DNA, 22 bp, Artificial Sequence
  chemically synthesized
cagtcaatgataaactgcatat

SEQ ID NO: 1331929 - DNA, 22 bp, Artificial Sequence
  chemically synthesized
agtcaatgataaactgcatata

SEQ ID NO: 1331930 - DNA, 22 bp, Artificial Sequence
  chemically synthesized
taatcaaatgggaccactgcgg

SEQ ID NO: 1331931 - DNA, 22 bp, Artificial Sequence
  chemically synthesized
catataccgcagtggtcccatt

SEQ ID NO: 1331932 - DNA, 22 bp, Artificial Sequence
  chemically synthesized
gaaggtacagtaaaaatcccgt

SEQ ID NO: 1331933 - DNA, 22 bp, Artificial Sequence
  chemically synthesized
gattataacacgggatttttac

SEQ ID NO: 1331934 - DNA, 22 bp, Artificial Sequence
  chemically synthesized
attataacacgggatttttact

SEQ ID NO: 1331935 - DNA, 22 bp, Artificial Sequence
  chemically synthesized
accattagaaggtacagtaaaa

SEQ ID NO: 1331936 - DNA, 22 bp, Artificial Sequence
  chemically synthesized
taacacgggatttttactgtac

SEQ ID NO: 1331937 - DNA, 22 bp, Artificial Sequence
  chemically synthesized
aaacatatctaaccattagaag

SEQ ID NO: 1331938 - DNA, 22 bp, Artificial Sequence
  chemically synthesized
ttactgtaccttctaatggtta

SEQ ID NO: 1331939 - DNA, 22 bp, Artificial Sequence
  chemically synthesized
tactgtaccttctaatggttag

SEQ ID NO: 1331940 - DNA, 22 bp, Artificial Sequence
  chemically synthesized
actgtaccttctaatggttaga

SEQ ID NO: 1331941 - DNA, 22 bp, Artificial Sequence
  chemically synthesized
ctgtaccttctaatggttagat

SEQ ID NO: 1331942 - DNA, 22 bp, Artificial Sequence
  chemically synthesized
aatgtctaaaacatatctaacc

SEQ ID NO: 1331943 - DNA, 22 bp, Artificial Sequence
  chemically synthesized
taccttctaatggttagatatg

SEQ ID NO: 1331944 - DNA, 22 bp, Artificial Sequence
  chemically synthesized
caatgtctaaaacatatctaac

SEQ ID NO: 1331945 - DNA, 22 bp, Artificial Sequence
  chemically synthesized
ctaatggttagatatgttttag

SEQ ID NO: 1331946 - DNA, 22 bp, Artificial Sequence
  chemically synthesized
taatggttagatatgttttaga

SEQ ID NO: 1331947 - DNA, 22 bp, Artificial Sequence
  chemically synthesized
atggttagatatgttttagaca

SEQ ID NO: 1331948 - DNA, 22 bp, Artificial Sequence
  chemically synthesized
gatatgttttagacattgaaat

SEQ ID NO: 1331949 - DNA, 22 bp, Artificial Sequence
  chemically synthesized
tagcacaatggtaaatatttca

SEQ ID NO: 1331950 - DNA, 22 bp, Artificial Sequence
  chemically synthesized
tagacattgaaatatttaccat

SEQ ID NO: 1331951 - DNA, 22 bp, Artificial Sequence
  chemically synthesized
agacattgaaatatttaccatt

SEQ ID NO: 1331952 - DNA, 22 bp, Artificial Sequence
  chemically synthesized
gacattgaaatatttaccattg

SEQ ID NO: 1331953 - DNA, 22 bp, Artificial Sequence
  chemically synthesized
taggcaactgtagcacaatggt

SEQ ID NO: 1331954 - DNA, 22 bp, Artificial Sequence
  chemically synthesized
aaatatttaccattgtgctaca

SEQ ID NO: 1331955 - DNA, 22 bp, Artificial Sequence
  chemically synthesized
aatactgtaggcaactgtagca

SEQ ID NO: 1331956 - DNA, 22 bp, Artificial Sequence
  chemically synthesized
accattgtgctacagttgccta

SEQ ID NO: 1331957 - DNA, 22 bp, Artificial Sequence
  chemically synthesized
tactgaatactgtaggcaactg

SEQ ID NO: 1331958 - DNA, 22 bp, Artificial Sequence
  chemically synthesized
ccattgtgctacagttgcctac

SEQ ID NO: 1331959 - DNA, 22 bp, Artificial Sequence
  chemically synthesized
tgctacagttgcctacagtatt

SEQ ID NO: 1331960 - DNA, 22 bp, Artificial Sequence
  chemically synthesized
cagttgcctacagtattcagta

SEQ ID NO: 1331961 - DNA, 22 bp, Artificial Sequence
  chemically synthesized
tacagcatgtgactgtactgaa

SEQ ID NO: 1331962 - DNA, 22 bp, Artificial Sequence
  chemically synthesized
cctacagtattcagtacagtca

SEQ ID NO: 1331963 - DNA, 22 bp, Artificial Sequence
  chemically synthesized
cagtattcagtacagtcacatg

SEQ ID NO: 1331964 - DNA, 22 bp, Artificial Sequence
  chemically synthesized
caaacctgtacagcatgtgact

SEQ ID NO: 1331965 - DNA, 22 bp, Artificial Sequence
  chemically synthesized
gctacaaacctgtacagcatgt

SEQ ID NO: 1331966 - DNA, 22 bp, Artificial Sequence
  chemically synthesized
ggctacaaacctgtacagcatg

SEQ ID NO: 1331967 - DNA, 22 bp, Artificial Sequence
  chemically synthesized
agtacagtcacatgctgtacag

SEQ ID NO: 1331968 - DNA, 22 bp, Artificial Sequence
  chemically synthesized
tttggctacaaacctgtacagc

SEQ ID NO: 1331969 - DNA, 22 bp, Artificial Sequence
  chemically synthesized
tgtttggctacaaacctgtaca

SEQ ID NO: 1331970 - DNA, 22 bp, Artificial Sequence
  chemically synthesized
ctgtttggctacaaacctgtac

SEQ ID NO: 1331971 - DNA, 22 bp, Artificial Sequence
  chemically synthesized
tttctgtttggctacaaacctg

SEQ ID NO: 1331972 - DNA, 22 bp, Artificial Sequence
  chemically synthesized
tacaggtttgtagccaaacaga

SEQ ID NO: 1331973 - DNA, 22 bp, Artificial Sequence
  chemically synthesized
tatggtatatcctatttctgtt

SEQ ID NO: 1331974 - DNA, 22 bp, Artificial Sequence
  chemically synthesized
gtagccaaacagaaataggata

SEQ ID NO: 1331975 - DNA, 22 bp, Artificial Sequence
  chemically synthesized
ggttgtatggtatatcctattt

SEQ ID NO: 1331976 - DNA, 22 bp, Artificial Sequence
  chemically synthesized
tagccaaacagaaataggatat

SEQ ID NO: 1331977 - DNA, 22 bp, Artificial Sequence
  chemically synthesized
cgtggtatagcgtagtgcagac

SEQ ID NO: 1331978 - DNA, 22 bp, Artificial Sequence
  chemically synthesized
acctacgtggtatagcgtagtg

SEQ ID NO: 1331979 - DNA, 22 bp, Artificial Sequence
  chemically synthesized
cactaacctacgtggtatagcg

SEQ ID NO: 1331980 - DNA, 22 bp, Artificial Sequence
  chemically synthesized
ggtctgcactacgctataccac

SEQ ID NO: 1331981 - DNA, 22 bp, Artificial Sequence
  chemically synthesized
acactaacctacgtggtatagc

SEQ ID NO: 1331982 - DNA, 22 bp, Artificial Sequence
  chemically synthesized
cactacgctataccacgtaggt

SEQ ID NO: 1331983 - DNA, 22 bp, Artificial Sequence
  chemically synthesized
cgctataccacgtaggttagtg

SEQ ID NO: 1331984 - DNA, 22 bp, Artificial Sequence
  chemically synthesized
taccacgtaggttagtgtaagt

SEQ ID NO: 1331985 - DNA, 22 bp, Artificial Sequence
  chemically synthesized
tgtgaatgtcacagagtgtact

SEQ ID NO: 1331986 - DNA, 22 bp, Artificial Sequence
  chemically synthesized
gtgtaagtacactctgtgacat

SEQ ID NO: 1331987 - DNA, 22 bp, Artificial Sequence
  chemically synthesized
atcgttgtgtgaatgtcacaga

SEQ ID NO: 1331988 - DNA, 22 bp, Artificial Sequence
  chemically synthesized
catcgttgtgtgaatgtcacag

SEQ ID NO: 1331989 - DNA, 22 bp, Artificial Sequence
  chemically synthesized
aggtaatttcatcgttgtgtga

SEQ ID NO: 1331990 - DNA, 22 bp, Artificial Sequence
  chemically synthesized
tgtgacattcacacaacgatga

SEQ ID NO: 1331991 - DNA, 22 bp, Artificial Sequence
  chemically synthesized
tgacattcacacaacgatgaaa

SEQ ID NO: 1331992 - DNA, 22 bp, Artificial Sequence
  chemically synthesized
acacaacgatgaaattacctta

SEQ ID NO: 1331993 - DNA, 22 bp, Artificial Sequence
  chemically synthesized
atcaatccatactaaggtaatt

SEQ ID NO: 1331994 - DNA, 22 bp, Artificial Sequence
  chemically synthesized
tgatcaatccatactaaggtaa

SEQ ID NO: 1331995 - DNA, 22 bp, Artificial Sequence
  chemically synthesized
ccttagtatggattgatcagaa

SEQ ID NO: 1331996 - DNA, 22 bp, Artificial Sequence
  chemically synthesized
acaccagggatacattctgatc

SEQ ID NO: 1331997 - DNA, 22 bp, Artificial Sequence
  chemically synthesized
agtatggattgatcagaatgta

SEQ ID NO: 1331998 - DNA, 22 bp, Artificial Sequence
  chemically synthesized
gtatggattgatcagaatgtat

SEQ ID NO: 1331999 - DNA, 22 bp, Artificial Sequence
  chemically synthesized
tgtgttaacaccagggatacat

SEQ ID NO: 1332000 - DNA, 22 bp, Artificial Sequence
  chemically synthesized
atcagaatgtatccctggtgtt

SEQ ID NO: 1332001 - DNA, 22 bp, Artificial Sequence
  chemically synthesized
gtgttaacacataactgtatat

SEQ ID NO: 1332002 - DNA, 22 bp, Artificial Sequence
  chemically synthesized
acacataactgtatatatcctg

SEQ ID NO: 1332003 - DNA, 22 bp, Artificial Sequence
  chemically synthesized
agtgacacacaaacacacacag

SEQ ID NO: 1332004 - DNA, 22 bp, Artificial Sequence
  chemically synthesized
cagtgacacacaaacacacaca

SEQ ID NO: 1332005 - DNA, 22 bp, Artificial Sequence
  chemically synthesized
ttcagtgacacacaaacacaca

SEQ ID NO: 1332006 - DNA, 22 bp, Artificial Sequence
  chemically synthesized
tatatatcctgtgtgtgtttgt

SEQ ID NO: 1332007 - DNA, 22 bp, Artificial Sequence
  chemically synthesized
tgtgtgtttgtgtgtcactgaa

SEQ ID NO: 1332008 - DNA, 22 bp, Artificial Sequence
  chemically synthesized
gtgtgtcactgaagagatatga

SEQ ID NO: 1332009 - DNA, 22 bp, Artificial Sequence
  chemically synthesized
atggtgaaggaatcatatctct

SEQ ID NO: 1332010 - DNA, 22 bp, Artificial Sequence
  chemically synthesized
tgtgtcactgaagagatatgat

SEQ ID NO: 1332011 - DNA, 22 bp, Artificial Sequence
  chemically synthesized
ctcatggtgaaggaatcatatc

SEQ ID NO: 1332012 - DNA, 22 bp, Artificial Sequence
  chemically synthesized
attcctcatggtgaaggaatca

SEQ ID NO: 1332013 - DNA, 22 bp, Artificial Sequence
  chemically synthesized
tgattcctcatggtgaaggaat

SEQ ID NO: 1332014 - DNA, 22 bp, Artificial Sequence
  chemically synthesized
ctgattcctcatggtgaaggaa

SEQ ID NO: 1332015 - DNA, 22 bp, Artificial Sequence
  chemically synthesized
aagagatatgattccttcacca

SEQ ID NO: 1332016 - DNA, 22 bp, Artificial Sequence
  chemically synthesized
tctgattcctcatggtgaagga

SEQ ID NO: 1332017 - DNA, 22 bp, Artificial Sequence
  chemically synthesized
agttttctgattcctcatggtg

SEQ ID NO: 1332018 - DNA, 22 bp, Artificial Sequence
  chemically synthesized
cagttttctgattcctcatggt

SEQ ID NO: 1332019 - DNA, 22 bp, Artificial Sequence
  chemically synthesized
tcagttttctgattcctcatgg

SEQ ID NO: 1332020 - DNA, 22 bp, Artificial Sequence
  chemically synthesized
ttcagttttctgattcctcatg

SEQ ID NO: 1332021 - DNA, 22 bp, Artificial Sequence
  chemically synthesized
ccttttcagttttctgattcct

SEQ ID NO: 1332022 - DNA, 22 bp, Artificial Sequence
  chemically synthesized
accttttcagttttctgattcc

SEQ ID NO: 1332023 - DNA, 22 bp, Artificial Sequence
  chemically synthesized
cttcaccatgaggaatcagaaa

SEQ ID NO: 1332024 - DNA, 22 bp, Artificial Sequence
  chemically synthesized
tttaccttttcagttttctgat

SEQ ID NO: 1332025 - DNA, 22 bp, Artificial Sequence
  chemically synthesized
caccatgaggaatcagaaaact

SEQ ID NO: 1332026 - DNA, 22 bp, Artificial Sequence
  chemically synthesized
gtttaccttttcagttttctga

SEQ ID NO: 1332027 - DNA, 22 bp, Artificial Sequence
  chemically synthesized
accatgaggaatcagaaaactg

SEQ ID NO: 1332028 - DNA, 22 bp, Artificial Sequence
  chemically synthesized
aggatacaataatttgtttacc

SEQ ID NO: 1332029 - DNA, 22 bp, Artificial Sequence
  chemically synthesized
caggatacaataatttgtttac

SEQ ID NO: 1332030 - DNA, 22 bp, Artificial Sequence
  chemically synthesized
tcaggatacaataatttgttta

SEQ ID NO: 1332031 - DNA, 22 bp, Artificial Sequence
  chemically synthesized
aaaaggtaaacaaattattgta

SEQ ID NO: 1332032 - DNA, 22 bp, Artificial Sequence
  chemically synthesized
agactttcaggatacaataatt

SEQ ID NO: 1332033 - DNA, 22 bp, Artificial Sequence
  chemically synthesized
gagactttcaggatacaataat

SEQ ID NO: 1332034 - DNA, 22 bp, Artificial Sequence
  chemically synthesized
atttgagactttcaggatacaa

SEQ ID NO: 1332035 - DNA, 22 bp, Artificial Sequence
  chemically synthesized
ttgtatcctgaaagtctcaaat

SEQ ID NO: 1332036 - DNA, 22 bp, Artificial Sequence
  chemically synthesized
tatcctgaaagtctcaaatgag

SEQ ID NO: 1332037 - DNA, 22 bp, Artificial Sequence
  chemically synthesized
aaagtctcaaatgagtttttgt

SEQ ID NO: 1332038 - DNA, 22 bp, Artificial Sequence
  chemically synthesized
aaatgagtttttgttctacttt

SEQ ID NO: 1332039 - DNA, 22 bp, Artificial Sequence
  chemically synthesized
aaaaaaaaacaaaagaaagtag

SEQ ID NO: 1332040 - DNA, 22 bp, Artificial Sequence
  chemically synthesized
tctcaaaaaaaaacaaaagaaa

SEQ ID NO: 1332041 - DNA, 22 bp, Artificial Sequence
  chemically synthesized
tgtctcaaaaaaaaacaaaaga

SEQ ID NO: 1332042 - DNA, 22 bp, Artificial Sequence
  chemically synthesized
ttgttctactttcttttgtttt

SEQ ID NO: 1332043 - DNA, 22 bp, Artificial Sequence
  chemically synthesized
tgttctactttcttttgttttt

SEQ ID NO: 1332044 - DNA, 22 bp, Artificial Sequence
  chemically synthesized
gttctactttcttttgtttttt

SEQ ID NO: 1332045 - DNA, 22 bp, Artificial Sequence
  chemically synthesized
ttctactttcttttgttttttt

SEQ ID NO: 1332046 - DNA, 22 bp, Artificial Sequence
  chemically synthesized
tactttcttttgtttttttttg

SEQ ID NO: 1332047 - DNA, 22 bp, Artificial Sequence
  chemically synthesized
ctttcttttgtttttttttgag

SEQ ID NO: 1332048 - DNA, 22 bp, Artificial Sequence
  chemically synthesized
tcttttgtttttttttgagaca

SEQ ID NO: 1332049 - DNA, 22 bp, Artificial Sequence
  chemically synthesized
cttttgtttttttttgagacag

SEQ ID NO: 1332050 - DNA, 22 bp, Artificial Sequence
  chemically synthesized
ttttgtttttttttgagacaga

SEQ ID NO: 1332051 - DNA, 22 bp, Artificial Sequence
  chemically synthesized
ttgtttttttttgagacagaat

SEQ ID NO: 1332052 - DNA, 22 bp, Artificial Sequence
  chemically synthesized
tgtttttttttgagacagaatc

SEQ ID NO: 1332053 - DNA, 22 bp, Artificial Sequence
  chemically synthesized
gtttttttttgagacagaatct

SEQ ID NO: 1332054 - DNA, 22 bp, Artificial Sequence
  chemically synthesized
ggcgacagaggtagattctgtc

SEQ ID NO: 1332055 - DNA, 22 bp, Artificial Sequence
  chemically synthesized
tttttttttgagacagaatcta

SEQ ID NO: 1332056 - DNA, 22 bp, Artificial Sequence
  chemically synthesized
ttttttgagacagaatctacct

SEQ ID NO: 1332057 - DNA, 22 bp, Artificial Sequence
  chemically synthesized
tttttgagacagaatctacctc

SEQ ID NO: 1332058 - DNA, 22 bp, Artificial Sequence
  chemically synthesized
ttttgagacagaatctacctct

SEQ ID NO: 1332059 - DNA, 22 bp, Artificial Sequence
  chemically synthesized
tttgagacagaatctacctctg

SEQ ID NO: 1332060 - DNA, 22 bp, Artificial Sequence
  chemically synthesized
cagcctgggcgacagaggtaga

SEQ ID NO: 1332061 - DNA, 22 bp, Artificial Sequence
  chemically synthesized
ttgagacagaatctacctctgt

SEQ ID NO: 1332062 - DNA, 22 bp, Artificial Sequence
  chemically synthesized
tgagacagaatctacctctgtc

SEQ ID NO: 1332063 - DNA, 22 bp, Artificial Sequence
  chemically synthesized
gagacagaatctacctctgtcg

SEQ ID NO: 1332064 - DNA, 22 bp, Artificial Sequence
  chemically synthesized
agacagaatctacctctgtcgc

SEQ ID NO: 1332065 - DNA, 22 bp, Artificial Sequence
  chemically synthesized
cactccagcctgggcgacagag

SEQ ID NO: 1332066 - DNA, 22 bp, Artificial Sequence
  chemically synthesized
cctctgtcgcccaggctggagt

SEQ ID NO: 1332067 - DNA, 22 bp, Artificial Sequence
  chemically synthesized
tgtcgcccaggctggagtgcag

SEQ ID NO: 1332068 - DNA, 22 bp, Artificial Sequence
  chemically synthesized
tcgcccaggctggagtgcaggg

SEQ ID NO: 1332069 - DNA, 22 bp, Artificial Sequence
  chemically synthesized
aaccgagatcgcacccctgcac

SEQ ID NO: 1332070 - DNA, 22 bp, Artificial Sequence
  chemically synthesized
cattgaaccgagatcgcacccc

SEQ ID NO: 1332071 - DNA, 22 bp, Artificial Sequence
  chemically synthesized
gagtgcaggggtgcgatctcgg

SEQ ID NO: 1332072 - DNA, 22 bp, Artificial Sequence
  chemically synthesized
aacccgggaggcggaggttgca

SEQ ID NO: 1332073 - DNA, 22 bp, Artificial Sequence
  chemically synthesized
gaacccgggaggcggaggttgc

SEQ ID NO: 1332074 - DNA, 22 bp, Artificial Sequence
  chemically synthesized
cttgaacccgggaggcggaggt

SEQ ID NO: 1332075 - DNA, 22 bp, Artificial Sequence
  chemically synthesized
ggttcaatgcaacctccgcctc

SEQ ID NO: 1332076 - DNA, 22 bp, Artificial Sequence
  chemically synthesized
aatgcaacctccgcctcccggg

SEQ ID NO: 1332077 - DNA, 22 bp, Artificial Sequence
  chemically synthesized
aggcaggagaattgcttgaacc

SEQ ID NO: 1332078 - DNA, 22 bp, Artificial Sequence
  chemically synthesized
cgcctcccgggttcaagcaatt

SEQ ID NO: 1332079 - DNA, 22 bp, Artificial Sequence
  chemically synthesized
ccgggttcaagcaattctcctg

SEQ ID NO: 1332080 - DNA, 22 bp, Artificial Sequence
  chemically synthesized
gggaggctgaggcaggagaatt

SEQ ID NO: 1332081 - DNA, 22 bp, Artificial Sequence
  chemically synthesized
ctcgggaggctgaggcaggaga

SEQ ID NO: 1332082 - DNA, 22 bp, Artificial Sequence
  chemically synthesized
aagcaattctcctgcctcagcc

SEQ ID NO: 1332083 - DNA, 22 bp, Artificial Sequence
  chemically synthesized
aaatcccagctactcgggaggc

SEQ ID NO: 1332084 - DNA, 22 bp, Artificial Sequence
  chemically synthesized
tcctgcctcagcctcccgagta

SEQ ID NO: 1332085 - DNA, 22 bp, Artificial Sequence
  chemically synthesized
ctgaaatcccagctactcggga

SEQ ID NO: 1332086 - DNA, 22 bp, Artificial Sequence
  chemically synthesized
ctgcctcagcctcccgagtagc

SEQ ID NO: 1332087 - DNA, 22 bp, Artificial Sequence
  chemically synthesized
cctcagcctcccgagtagctgg

SEQ ID NO: 1332088 - DNA, 22 bp, Artificial Sequence
  chemically synthesized
agcctcccgagtagctgggatt

SEQ ID NO: 1332089 - DNA, 22 bp, Artificial Sequence
  chemically synthesized
tggtggcaggttcctgaaatcc

SEQ ID NO: 1332090 - DNA, 22 bp, Artificial Sequence
  chemically synthesized
ccgagtagctgggatttcagga

SEQ ID NO: 1332091 - DNA, 22 bp, Artificial Sequence
  chemically synthesized
gccaggttgtggtggcaggttc

SEQ ID NO: 1332092 - DNA, 22 bp, Artificial Sequence
  chemically synthesized
ggatttcaggaacctgccacca

SEQ ID NO: 1332093 - DNA, 22 bp, Artificial Sequence
  chemically synthesized
caggaacctgccaccacaacct

SEQ ID NO: 1332094 - DNA, 22 bp, Artificial Sequence
  chemically synthesized
aggaacctgccaccacaacctg

SEQ ID NO: 1332095 - DNA, 22 bp, Artificial Sequence
  chemically synthesized
aaaatacaaaaattagccaggt

SEQ ID NO: 1332096 - DNA, 22 bp, Artificial Sequence
  chemically synthesized
ctaaaaatacaaaaattagcca

SEQ ID NO: 1332097 - DNA, 22 bp, Artificial Sequence
  chemically synthesized
ccaccacaacctggctaatttt

SEQ ID NO: 1332098 - DNA, 22 bp, Artificial Sequence
  chemically synthesized
tcctaaaaatacaaaaattagc

SEQ ID NO: 1332099 - DNA, 22 bp, Artificial Sequence
  chemically synthesized
tctctcctaaaaatacaaaaat

SEQ ID NO: 1332100 - DNA, 22 bp, Artificial Sequence
  chemically synthesized
gctaatttttgtatttttagga

SEQ ID NO: 1332101 - DNA, 22 bp, Artificial Sequence
  chemically synthesized
atttttgtatttttaggagaga

SEQ ID NO: 1332102 - DNA, 22 bp, Artificial Sequence
  chemically synthesized
ttgtatttttaggagagacagg

SEQ ID NO: 1332103 - DNA, 22 bp, Artificial Sequence
  chemically synthesized
tgtatttttaggagagacaggg

SEQ ID NO: 1332104 - DNA, 22 bp, Artificial Sequence
  chemically synthesized
gtatttttaggagagacagggt

SEQ ID NO: 1332105 - DNA, 22 bp, Artificial Sequence
  chemically synthesized
tatttttaggagagacagggtt

SEQ ID NO: 1332106 - DNA, 22 bp, Artificial Sequence
  chemically synthesized
gccaacatggcgaaaccctgtc

SEQ ID NO: 1332107 - DNA, 22 bp, Artificial Sequence
  chemically synthesized
ttaggagagacagggtttcgcc

SEQ ID NO: 1332108 - DNA, 22 bp, Artificial Sequence
  chemically synthesized
taggagagacagggtttcgcca

SEQ ID NO: 1332109 - DNA, 22 bp, Artificial Sequence
  chemically synthesized
aggagagacagggtttcgccat

SEQ ID NO: 1332110 - DNA, 22 bp, Artificial Sequence
  chemically synthesized
ggagagacagggtttcgccatg

SEQ ID NO: 1332111 - DNA, 22 bp, Artificial Sequence
  chemically synthesized
agaccagcctggccaacatggc

SEQ ID NO: 1332112 - DNA, 22 bp, Artificial Sequence
  chemically synthesized
gagaccagcctggccaacatgg

SEQ ID NO: 1332113 - DNA, 22 bp, Artificial Sequence
  chemically synthesized
cgccatgttggccaggctggtc

SEQ ID NO: 1332114 - DNA, 22 bp, Artificial Sequence
  chemically synthesized
gccatgttggccaggctggtct

SEQ ID NO: 1332115 - DNA, 22 bp, Artificial Sequence
  chemically synthesized
aggtcaggagtttgagaccagc

SEQ ID NO: 1332116 - DNA, 22 bp, Artificial Sequence
  chemically synthesized
gaggtcaggagtttgagaccag

SEQ ID NO: 1332117 - DNA, 22 bp, Artificial Sequence
  chemically synthesized
gccaggctggtctcaaactcct

SEQ ID NO: 1332118 - DNA, 22 bp, Artificial Sequence
  chemically synthesized
gtctcaaactcctgacctcaag

SEQ ID NO: 1332119 - DNA, 22 bp, Artificial Sequence
  chemically synthesized
aggtgtacagatcacttgaggt

SEQ ID NO: 1332120 - DNA, 22 bp, Artificial Sequence
  chemically synthesized
aaactcctgacctcaagtgatc

SEQ ID NO: 1332121 - DNA, 22 bp, Artificial Sequence
  chemically synthesized
ggaggctgaggtgtacagatca

SEQ ID NO: 1332122 - DNA, 22 bp, Artificial Sequence
  chemically synthesized
ctgacctcaagtgatctgtaca

SEQ ID NO: 1332123 - DNA, 22 bp, Artificial Sequence
  chemically synthesized
gggaggctgaggtgtacagatc

SEQ ID NO: 1332124 - DNA, 22 bp, Artificial Sequence
  chemically synthesized
acctcaagtgatctgtacacct

SEQ ID NO: 1332125 - DNA, 22 bp, Artificial Sequence
  chemically synthesized
aagtgatctgtacacctcagcc

SEQ ID NO: 1332126 - DNA, 22 bp, Artificial Sequence
  chemically synthesized
taatcccagcaatttgggaggc

SEQ ID NO: 1332127 - DNA, 22 bp, Artificial Sequence
  chemically synthesized
tacacctcagcctcccaaattg

SEQ ID NO: 1332128 - DNA, 22 bp, Artificial Sequence
  chemically synthesized
atacctgtaatcccagcaattt

SEQ ID NO: 1332129 - DNA, 22 bp, Artificial Sequence
  chemically synthesized
agcctcccaaattgctgggatt

SEQ ID NO: 1332130 - DNA, 22 bp, Artificial Sequence
  chemically synthesized
ccaaattgctgggattacaggt

SEQ ID NO: 1332131 - DNA, 22 bp, Artificial Sequence
  chemically synthesized
ctgggattacaggtatgagcca

SEQ ID NO: 1332132 - DNA, 22 bp, Artificial Sequence
  chemically synthesized
aaccgggcgtggtggctcatac

SEQ ID NO: 1332133 - DNA, 22 bp, Artificial Sequence
  chemically synthesized
gaaccgggcgtggtggctcata

SEQ ID NO: 1332134 - DNA, 22 bp, Artificial Sequence
  chemically synthesized
ggattacaggtatgagccacca

SEQ ID NO: 1332135 - DNA, 22 bp, Artificial Sequence
  chemically synthesized
atttgaaccgggcgtggtggct

SEQ ID NO: 1332136 - DNA, 22 bp, Artificial Sequence
  chemically synthesized
caggtatgagccaccacgcccg

SEQ ID NO: 1332137 - DNA, 22 bp, Artificial Sequence
  chemically synthesized
aaaaaaaaaaaaaaaaactcat

SEQ ID NO: 1332138 - DNA, 22 bp, Artificial Sequence
  chemically synthesized
gactgaaaaaaaaaaaaaaaaa

SEQ ID NO: 1332139 - DNA, 22 bp, Artificial Sequence
  chemically synthesized
aaatgagttttttttttttttt

SEQ ID NO: 1332140 - DNA, 22 bp, Artificial Sequence
  chemically synthesized
atattggactgaaaaaaaaaaa

SEQ ID NO: 1332141 - DNA, 22 bp, Artificial Sequence
  chemically synthesized
aatattggactgaaaaaaaaaa

SEQ ID NO: 1332142 - DNA, 22 bp, Artificial Sequence
  chemically synthesized
taatattggactgaaaaaaaaa

SEQ ID NO: 1332143 - DNA, 22 bp, Artificial Sequence
  chemically synthesized
ttttaatattggactgaaaaaa

SEQ ID NO: 1332144 - DNA, 22 bp, Artificial Sequence
  chemically synthesized
gttttaatattggactgaaaaa

SEQ ID NO: 1332145 - DNA, 22 bp, Artificial Sequence
  chemically synthesized
ttttttttttttttcagtccaa

SEQ ID NO: 1332146 - DNA, 22 bp, Artificial Sequence
  chemically synthesized
tttttttttttttcagtccaat

SEQ ID NO: 1332147 - DNA, 22 bp, Artificial Sequence
  chemically synthesized
gtttgttttaatattggactga

SEQ ID NO: 1332148 - DNA, 22 bp, Artificial Sequence
  chemically synthesized
ttttttttttttcagtccaata

SEQ ID NO: 1332149 - DNA, 22 bp, Artificial Sequence
  chemically synthesized
cgtttgttttaatattggactg

SEQ ID NO: 1332150 - DNA, 22 bp, Artificial Sequence
  chemically synthesized
tttttttttttcagtccaatat

SEQ ID NO: 1332151 - DNA, 22 bp, Artificial Sequence
  chemically synthesized
tcgtttgttttaatattggact

SEQ ID NO: 1332152 - DNA, 22 bp, Artificial Sequence
  chemically synthesized
ttttttttttcagtccaatatt

SEQ ID NO: 1332153 - DNA, 22 bp, Artificial Sequence
  chemically synthesized
tttttttttcagtccaatatta

SEQ ID NO: 1332154 - DNA, 22 bp, Artificial Sequence
  chemically synthesized
ttttttttcagtccaatattaa

SEQ ID NO: 1332155 - DNA, 22 bp, Artificial Sequence
  chemically synthesized
tttttttcagtccaatattaaa

SEQ ID NO: 1332156 - DNA, 22 bp, Artificial Sequence
  chemically synthesized
gttttcgtttgttttaatattg

SEQ ID NO: 1332157 - DNA, 22 bp, Artificial Sequence
  chemically synthesized
ttttttcagtccaatattaaaa

SEQ ID NO: 1332158 - DNA, 22 bp, Artificial Sequence
  chemically synthesized
tttttcagtccaatattaaaac

SEQ ID NO: 1332159 - DNA, 22 bp, Artificial Sequence
  chemically synthesized
tggttttcgtttgttttaatat

SEQ ID NO: 1332160 - DNA, 22 bp, Artificial Sequence
  chemically synthesized
ttttcagtccaatattaaaaca

SEQ ID NO: 1332161 - DNA, 22 bp, Artificial Sequence
  chemically synthesized
tttcagtccaatattaaaacaa

SEQ ID NO: 1332162 - DNA, 22 bp, Artificial Sequence
  chemically synthesized
ttcagtccaatattaaaacaaa

SEQ ID NO: 1332163 - DNA, 22 bp, Artificial Sequence
  chemically synthesized
tcagtccaatattaaaacaaac

SEQ ID NO: 1332164 - DNA, 22 bp, Artificial Sequence
  chemically synthesized
cagtccaatattaaaacaaacg

SEQ ID NO: 1332165 - DNA, 22 bp, Artificial Sequence
  chemically synthesized
agtccaatattaaaacaaacga

SEQ ID NO: 1332166 - DNA, 22 bp, Artificial Sequence
  chemically synthesized
aaacaaacgaaaaccagaatgc

SEQ ID NO: 1332167 - DNA, 22 bp, Artificial Sequence
  chemically synthesized
aatgtgagaacaaaaggcattc

SEQ ID NO: 1332168 - DNA, 22 bp, Artificial Sequence
  chemically synthesized
tgaattgaatgtgagaacaaaa

SEQ ID NO: 1332169 - DNA, 22 bp, Artificial Sequence
  chemically synthesized
gattatgaattgaatgtgagaa

SEQ ID NO: 1332170 - DNA, 22 bp, Artificial Sequence
  chemically synthesized
ttagattatgaattgaatgtga

SEQ ID NO: 1332171 - DNA, 22 bp, Artificial Sequence
  chemically synthesized
ttgttctcacattcaattcata

SEQ ID NO: 1332172 - DNA, 22 bp, Artificial Sequence
  chemically synthesized
tgttctcacattcaattcataa

SEQ ID NO: 1332173 - DNA, 22 bp, Artificial Sequence
  chemically synthesized
atagctattagattatgaattg

SEQ ID NO: 1332174 - DNA, 22 bp, Artificial Sequence
  chemically synthesized
gttctcacattcaattcataat

SEQ ID NO: 1332175 - DNA, 22 bp, Artificial Sequence
  chemically synthesized
ttctcacattcaattcataatc

SEQ ID NO: 1332176 - DNA, 22 bp, Artificial Sequence
  chemically synthesized
tgatagctattagattatgaat

SEQ ID NO: 1332177 - DNA, 22 bp, Artificial Sequence
  chemically synthesized
tcacattcaattcataatctaa

SEQ ID NO: 1332178 - DNA, 22 bp, Artificial Sequence
  chemically synthesized
ttctgatagctattagattatg

SEQ ID NO: 1332179 - DNA, 22 bp, Artificial Sequence
  chemically synthesized
attctgatagctattagattat

SEQ ID NO: 1332180 - DNA, 22 bp, Artificial Sequence
  chemically synthesized
acattcaattcataatctaata

SEQ ID NO: 1332181 - DNA, 22 bp, Artificial Sequence
  chemically synthesized
tattctgatagctattagatta

SEQ ID NO: 1332182 - DNA, 22 bp, Artificial Sequence
  chemically synthesized
aattcataatctaatagctatc

SEQ ID NO: 1332183 - DNA, 22 bp, Artificial Sequence
  chemically synthesized
ataatctaatagctatcagaat

SEQ ID NO: 1332184 - DNA, 22 bp, Artificial Sequence
  chemically synthesized
atagctatcagaataaaatgtc

SEQ ID NO: 1332185 - DNA, 22 bp, Artificial Sequence
  chemically synthesized
caaatgaataataaatatgaca

SEQ ID NO: 1332186 - DNA, 22 bp, Artificial Sequence
  chemically synthesized
tcagaataaaatgtcatattta

SEQ ID NO: 1332187 - DNA, 22 bp, Artificial Sequence
  chemically synthesized
ccaaatgaataataaatatgac

SEQ ID NO: 1332188 - DNA, 22 bp, Artificial Sequence
  chemically synthesized
ttccaaatgaataataaatatg

SEQ ID NO: 1332189 - DNA, 22 bp, Artificial Sequence
  chemically synthesized
cttccaaatgaataataaatat

SEQ ID NO: 1332190 - DNA, 22 bp, Artificial Sequence
  chemically synthesized
tcttccaaatgaataataaata

SEQ ID NO: 1332191 - DNA, 22 bp, Artificial Sequence
  chemically synthesized
ttttcttccaaatgaataataa

SEQ ID NO: 1332192 - DNA, 22 bp, Artificial Sequence
  chemically synthesized
gttttcttccaaatgaataata

SEQ ID NO: 1332193 - DNA, 22 bp, Artificial Sequence
  chemically synthesized
tttgttttcttccaaatgaata

SEQ ID NO: 1332194 - DNA, 22 bp, Artificial Sequence
  chemically synthesized
ctgtttgttttcttccaaatga

SEQ ID NO: 1332195 - DNA, 22 bp, Artificial Sequence
  chemically synthesized
ctgctgtttgttttcttccaaa

SEQ ID NO: 1332196 - DNA, 22 bp, Artificial Sequence
  chemically synthesized
actgctgtttgttttcttccaa

SEQ ID NO: 1332197 - DNA, 22 bp, Artificial Sequence
  chemically synthesized
tactgctgtttgttttcttcca

SEQ ID NO: 1332198 - DNA, 22 bp, Artificial Sequence
  chemically synthesized
ttactgctgtttgttttcttcc

SEQ ID NO: 1332199 - DNA, 22 bp, Artificial Sequence
  chemically synthesized
attattcatttggaagaaaaca

SEQ ID NO: 1332200 - DNA, 22 bp, Artificial Sequence
  chemically synthesized
ttattcatttggaagaaaacaa

SEQ ID NO: 1332201 - DNA, 22 bp, Artificial Sequence
  chemically synthesized
ttcatttggaagaaaacaaaca

SEQ ID NO: 1332202 - DNA, 22 bp, Artificial Sequence
  chemically synthesized
aatttttactgctgtttgtttt

SEQ ID NO: 1332203 - DNA, 22 bp, Artificial Sequence
  chemically synthesized
caatttttactgctgtttgttt

SEQ ID NO: 1332204 - DNA, 22 bp, Artificial Sequence
  chemically synthesized
atttggaagaaaacaaacagca

SEQ ID NO: 1332205 - DNA, 22 bp, Artificial Sequence
  chemically synthesized
tttcaatttttactgctgtttg

SEQ ID NO: 1332206 - DNA, 22 bp, Artificial Sequence
  chemically synthesized
atttcaatttttactgctgttt

SEQ ID NO: 1332207 - DNA, 22 bp, Artificial Sequence
  chemically synthesized
tatttcaatttttactgctgtt

SEQ ID NO: 1332208 - DNA, 22 bp, Artificial Sequence
  chemically synthesized
ggaagaaaacaaacagcagtaa

SEQ ID NO: 1332209 - DNA, 22 bp, Artificial Sequence
  chemically synthesized
ttatttcaatttttactgctgt

SEQ ID NO: 1332210 - DNA, 22 bp, Artificial Sequence
  chemically synthesized
gaagaaaacaaacagcagtaaa

SEQ ID NO: 1332211 - DNA, 22 bp, Artificial Sequence
  chemically synthesized
acaacgcccagccttttatttc

SEQ ID NO: 1332212 - DNA, 22 bp, Artificial Sequence
  chemically synthesized
taggagtgactcacaacgccca

SEQ ID NO: 1332213 - DNA, 22 bp, Artificial Sequence
  chemically synthesized
aaataaaaggctgggcgttgtg

SEQ ID NO: 1332214 - DNA, 22 bp, Artificial Sequence
  chemically synthesized
ggattataggagtgactcacaa

SEQ ID NO: 1332215 - DNA, 22 bp, Artificial Sequence
  chemically synthesized
ggcgttgtgagtcactcctata

SEQ ID NO: 1332216 - DNA, 22 bp, Artificial Sequence
  chemically synthesized
ccaaagtgttgggattatagga

SEQ ID NO: 1332217 - DNA, 22 bp, Artificial Sequence
  chemically synthesized
tgagtcactcctataatcccaa

SEQ ID NO: 1332218 - DNA, 22 bp, Artificial Sequence
  chemically synthesized
ggcctcccaaagtgttgggatt

SEQ ID NO: 1332219 - DNA, 22 bp, Artificial Sequence
  chemically synthesized
ctataatcccaacactttggga

SEQ ID NO: 1332220 - DNA, 22 bp, Artificial Sequence
  chemically synthesized
taatcccaacactttgggaggc

SEQ ID NO: 1332221 - DNA, 22 bp, Artificial Sequence
  chemically synthesized
aagtgatccgcccacctcggcc

SEQ ID NO: 1332222 - DNA, 22 bp, Artificial Sequence
  chemically synthesized
tcctcaagtgatccgcccacct

SEQ ID NO: 1332223 - DNA, 22 bp, Artificial Sequence
  chemically synthesized
tgggaggccgaggtgggcggat

SEQ ID NO: 1332224 - DNA, 22 bp, Artificial Sequence
  chemically synthesized
gggaggccgaggtgggcggatc

SEQ ID NO: 1332225 - DNA, 22 bp, Artificial Sequence
  chemically synthesized
ctgtcctcaagtgatccgccca

SEQ ID NO: 1332226 - DNA, 22 bp, Artificial Sequence
  chemically synthesized
ggaggccgaggtgggcggatca

SEQ ID NO: 1332227 - DNA, 22 bp, Artificial Sequence
  chemically synthesized
actcctgtcctcaagtgatccg

SEQ ID NO: 1332228 - DNA, 22 bp, Artificial Sequence
  chemically synthesized
taactcctgtcctcaagtgatc

SEQ ID NO: 1332229 - DNA, 22 bp, Artificial Sequence
  chemically synthesized
gtctctaactcctgtcctcaag

SEQ ID NO: 1332230 - DNA, 22 bp, Artificial Sequence
  chemically synthesized
gccaagctggtctctaactcct

SEQ ID NO: 1332231 - DNA, 22 bp, Artificial Sequence
  chemically synthesized
gaggacaggagttagagaccag

SEQ ID NO: 1332232 - DNA, 22 bp, Artificial Sequence
  chemically synthesized
aggacaggagttagagaccagc

SEQ ID NO: 1332233 - DNA, 22 bp, Artificial Sequence
  chemically synthesized
accatgttggccaagctggtct

SEQ ID NO: 1332234 - DNA, 22 bp, Artificial Sequence
  chemically synthesized
caccatgttggccaagctggtc

SEQ ID NO: 1332235 - DNA, 22 bp, Artificial Sequence
  chemically synthesized
gagaccagcttggccaacatgg

SEQ ID NO: 1332236 - DNA, 22 bp, Artificial Sequence
  chemically synthesized
gagacagggtttcaccatgttg

SEQ ID NO: 1332237 - DNA, 22 bp, Artificial Sequence
  chemically synthesized
ttagagacagggtttcaccatg

SEQ ID NO: 1332238 - DNA, 22 bp, Artificial Sequence
  chemically synthesized
attagagacagggtttcaccat

SEQ ID NO: 1332239 - DNA, 22 bp, Artificial Sequence
  chemically synthesized
tattagagacagggtttcacca

SEQ ID NO: 1332240 - DNA, 22 bp, Artificial Sequence
  chemically synthesized
ttattagagacagggtttcacc

SEQ ID NO: 1332241 - DNA, 22 bp, Artificial Sequence
  chemically synthesized
ggccaacatggtgaaaccctgt

SEQ ID NO: 1332242 - DNA, 22 bp, Artificial Sequence
  chemically synthesized
gccaacatggtgaaaccctgtc

SEQ ID NO: 1332243 - DNA, 22 bp, Artificial Sequence
  chemically synthesized
tatttttattagagacagggtt

SEQ ID NO: 1332244 - DNA, 22 bp, Artificial Sequence
  chemically synthesized
gtatttttattagagacagggt

SEQ ID NO: 1332245 - DNA, 22 bp, Artificial Sequence
  chemically synthesized
tgtatttttattagagacaggg

SEQ ID NO: 1332246 - DNA, 22 bp, Artificial Sequence
  chemically synthesized
ttgtatttttattagagacagg

SEQ ID NO: 1332247 - DNA, 22 bp, Artificial Sequence
  chemically synthesized
tttgtatttttattagagacag

SEQ ID NO: 1332248 - DNA, 22 bp, Artificial Sequence
  chemically synthesized
ttttgtatttttattagagaca

SEQ ID NO: 1332249 - DNA, 22 bp, Artificial Sequence
  chemically synthesized
atttttttgtatttttattaga

SEQ ID NO: 1332250 - DNA, 22 bp, Artificial Sequence
  chemically synthesized
tctctaataaaaatacaaaaaa

SEQ ID NO: 1332251 - DNA, 22 bp, Artificial Sequence
  chemically synthesized
cgcccagctaatttttttgtat

SEQ ID NO: 1332252 - DNA, 22 bp, Artificial Sequence
  chemically synthesized
taataaaaatacaaaaaaatta

SEQ ID NO: 1332253 - DNA, 22 bp, Artificial Sequence
  chemically synthesized
ataaaaatacaaaaaaattagc

SEQ ID NO: 1332254 - DNA, 22 bp, Artificial Sequence
  chemically synthesized
gccactacgcccagctaatttt

SEQ ID NO: 1332255 - DNA, 22 bp, Artificial Sequence
  chemically synthesized
ggatataagcattcgccactac

SEQ ID NO: 1332256 - DNA, 22 bp, Artificial Sequence
  chemically synthesized
gctgggcgtagtggcgaatgct

SEQ ID NO: 1332257 - DNA, 22 bp, Artificial Sequence
  chemically synthesized
ggcgtagtggcgaatgcttata

SEQ ID NO: 1332258 - DNA, 22 bp, Artificial Sequence
  chemically synthesized
ccaagtaactgggatataagca

SEQ ID NO: 1332259 - DNA, 22 bp, Artificial Sequence
  chemically synthesized
agcctcccaagtaactgggata

SEQ ID NO: 1332260 - DNA, 22 bp, Artificial Sequence
  chemically synthesized
cctcagcctcccaagtaactgg

SEQ ID NO: 1332261 - DNA, 22 bp, Artificial Sequence
  chemically synthesized
tgcctcagcctcccaagtaact

SEQ ID NO: 1332262 - DNA, 22 bp, Artificial Sequence
  chemically synthesized
ctgcctcagcctcccaagtaac

SEQ ID NO: 1332263 - DNA, 22 bp, Artificial Sequence
  chemically synthesized
ttctgcctcagcctcccaagta

SEQ ID NO: 1332264 - DNA, 22 bp, Artificial Sequence
  chemically synthesized
atatcccagttacttgggaggc

SEQ ID NO: 1332265 - DNA, 22 bp, Artificial Sequence
  chemically synthesized
tatcccagttacttgggaggct

SEQ ID NO: 1332266 - DNA, 22 bp, Artificial Sequence
  chemically synthesized
aagcaattcttctgcctcagcc

SEQ ID NO: 1332267 - DNA, 22 bp, Artificial Sequence
  chemically synthesized
cttgggaggctgaggcagaaga

SEQ ID NO: 1332268 - DNA, 22 bp, Artificial Sequence
  chemically synthesized
ggttcaagcaattcttctgcct

SEQ ID NO: 1332269 - DNA, 22 bp, Artificial Sequence
  chemically synthesized
gggaggctgaggcagaagaatt

SEQ ID NO: 1332270 - DNA, 22 bp, Artificial Sequence
  chemically synthesized
ctgggttcaagcaattcttctg

SEQ ID NO: 1332271 - DNA, 22 bp, Artificial Sequence
  chemically synthesized
ggaggctgaggcagaagaattg

SEQ ID NO: 1332272 - DNA, 22 bp, Artificial Sequence
  chemically synthesized
cgcctcctgggttcaagcaatt

SEQ ID NO: 1332273 - DNA, 22 bp, Artificial Sequence
  chemically synthesized
aggcagaagaattgcttgaacc

SEQ ID NO: 1332274 - DNA, 22 bp, Artificial Sequence
  chemically synthesized
caacctccgcctcctgggttca

SEQ ID NO: 1332275 - DNA, 22 bp, Artificial Sequence
  chemically synthesized
actgcaacctccgcctcctggg

SEQ ID NO: 1332276 - DNA, 22 bp, Artificial Sequence
  chemically synthesized
ggctcactgcaacctccgcctc

SEQ ID NO: 1332277 - DNA, 22 bp, Artificial Sequence
  chemically synthesized
cttgaacccaggaggcggaggt

SEQ ID NO: 1332278 - DNA, 22 bp, Artificial Sequence
  chemically synthesized
gaacccaggaggcggaggttgc

SEQ ID NO: 1332279 - DNA, 22 bp, Artificial Sequence
  chemically synthesized
tctgggctcactgcaacctccg

SEQ ID NO: 1332280 - DNA, 22 bp, Artificial Sequence
  chemically synthesized
aacccaggaggcggaggttgca

SEQ ID NO: 1332281 - DNA, 22 bp, Artificial Sequence
  chemically synthesized
aagtgcaatggcactatctggg

SEQ ID NO: 1332282 - DNA, 22 bp, Artificial Sequence
  chemically synthesized
cagtgagcccagatagtgccat

SEQ ID NO: 1332283 - DNA, 22 bp, Artificial Sequence
  chemically synthesized
tcgcccaggctgaagtgcaatg

SEQ ID NO: 1332284 - DNA, 22 bp, Artificial Sequence
  chemically synthesized
tgtcgcccaggctgaagtgcaa

SEQ ID NO: 1332285 - DNA, 22 bp, Artificial Sequence
  chemically synthesized
cctctgtcgcccaggctgaagt

SEQ ID NO: 1332286 - DNA, 22 bp, Artificial Sequence
  chemically synthesized
cacttcagcctgggcgacagag

SEQ ID NO: 1332287 - DNA, 22 bp, Artificial Sequence
  chemically synthesized
agacagcgtctccctctgtcgc

SEQ ID NO: 1332288 - DNA, 22 bp, Artificial Sequence
  chemically synthesized
gagacagcgtctccctctgtcg

SEQ ID NO: 1332289 - DNA, 22 bp, Artificial Sequence
  chemically synthesized
tgagacagcgtctccctctgtc

SEQ ID NO: 1332290 - DNA, 22 bp, Artificial Sequence
  chemically synthesized
ttgagacagcgtctccctctgt

SEQ ID NO: 1332291 - DNA, 22 bp, Artificial Sequence
  chemically synthesized
cagcctgggcgacagagggaga

SEQ ID NO: 1332292 - DNA, 22 bp, Artificial Sequence
  chemically synthesized
tttgagacagcgtctccctctg

SEQ ID NO: 1332293 - DNA, 22 bp, Artificial Sequence
  chemically synthesized
agcctgggcgacagagggagac

SEQ ID NO: 1332294 - DNA, 22 bp, Artificial Sequence
  chemically synthesized
ttttgagacagcgtctccctct

SEQ ID NO: 1332295 - DNA, 22 bp, Artificial Sequence
  chemically synthesized
tttttttgagacagcgtctccc

SEQ ID NO: 1332296 - DNA, 22 bp, Artificial Sequence
  chemically synthesized
atttttttgagacagcgtctcc

SEQ ID NO: 1332297 - DNA, 22 bp, Artificial Sequence
  chemically synthesized
tatttttttgagacagcgtctc

SEQ ID NO: 1332298 - DNA, 22 bp, Artificial Sequence
  chemically synthesized
ggcgacagagggagacgctgtc

SEQ ID NO: 1332299 - DNA, 22 bp, Artificial Sequence
  chemically synthesized
ttttatttttttgagacagcgt

SEQ ID NO: 1332300 - DNA, 22 bp, Artificial Sequence
  chemically synthesized
attttatttttttgagacagcg

SEQ ID NO: 1332301 - DNA, 22 bp, Artificial Sequence
  chemically synthesized
tattttatttttttgagacagc

SEQ ID NO: 1332302 - DNA, 22 bp, Artificial Sequence
  chemically synthesized
ttattttatttttttgagacag

SEQ ID NO: 1332303 - DNA, 22 bp, Artificial Sequence
  chemically synthesized
tttttattttatttttttgaga

SEQ ID NO: 1332304 - DNA, 22 bp, Artificial Sequence
  chemically synthesized
atttttattttatttttttgag

SEQ ID NO: 1332305 - DNA, 22 bp, Artificial Sequence
  chemically synthesized
tatttttattttatttttttga

SEQ ID NO: 1332306 - DNA, 22 bp, Artificial Sequence
  chemically synthesized
ttatttttattttatttttttg

SEQ ID NO: 1332307 - DNA, 22 bp, Artificial Sequence
  chemically synthesized
tctcaaaaaaataaaataaaaa

SEQ ID NO: 1332308 - DNA, 22 bp, Artificial Sequence
  chemically synthesized
gccagggtatttttatttttat

SEQ ID NO: 1332309 - DNA, 22 bp, Artificial Sequence
  chemically synthesized
aaaaaaataaaataaaaataaa

SEQ ID NO: 1332310 - DNA, 22 bp, Artificial Sequence
  chemically synthesized
caggcgtgagccaccgtgcctg

SEQ ID NO: 1332311 - DNA, 22 bp, Artificial Sequence
  chemically synthesized
gggttacaggcgtgagccaccg

SEQ ID NO: 1332312 - DNA, 22 bp, Artificial Sequence
  chemically synthesized
gccaggcacggtggctcacgcc

SEQ ID NO: 1332313 - DNA, 22 bp, Artificial Sequence
  chemically synthesized
ccaaagtgctggggttacaggc

SEQ ID NO: 1332314 - DNA, 22 bp, Artificial Sequence
  chemically synthesized
gcctcccaaagtgctggggtta

SEQ ID NO: 1332315 - DNA, 22 bp, Artificial Sequence
  chemically synthesized
ggcctcccaaagtgctggggtt

SEQ ID NO: 1332316 - DNA, 22 bp, Artificial Sequence
  chemically synthesized
acgcctgtaaccccagcacttt

SEQ ID NO: 1332317 - DNA, 22 bp, Artificial Sequence
  chemically synthesized
gcatgccttggcctcccaaagt

SEQ ID NO: 1332318 - DNA, 22 bp, Artificial Sequence
  chemically synthesized
taaccccagcactttgggaggc

SEQ ID NO: 1332319 - DNA, 22 bp, Artificial Sequence
  chemically synthesized
gtgattcgcatgccttggcctc

SEQ ID NO: 1332320 - DNA, 22 bp, Artificial Sequence
  chemically synthesized
acctcgtgattcgcatgccttg

SEQ ID NO: 1332321 - DNA, 22 bp, Artificial Sequence
  chemically synthesized
ctgacctcgtgattcgcatgcc

SEQ ID NO: 1332322 - DNA, 22 bp, Artificial Sequence
  chemically synthesized
tgggaggccaaggcatgcgaat

SEQ ID NO: 1332323 - DNA, 22 bp, Artificial Sequence
  chemically synthesized
gggaggccaaggcatgcgaatc

SEQ ID NO: 1332324 - DNA, 22 bp, Artificial Sequence
  chemically synthesized
ggaggccaaggcatgcgaatca

SEQ ID NO: 1332325 - DNA, 22 bp, Artificial Sequence
  chemically synthesized
actcctgacctcgtgattcgca

SEQ ID NO: 1332326 - DNA, 22 bp, Artificial Sequence
  chemically synthesized
taactcctgacctcgtgattcg

SEQ ID NO: 1332327 - DNA, 22 bp, Artificial Sequence
  chemically synthesized
ctaactcctgacctcgtgattc

SEQ ID NO: 1332328 - DNA, 22 bp, Artificial Sequence
  chemically synthesized
tttctaactcctgacctcgtga

SEQ ID NO: 1332329 - DNA, 22 bp, Artificial Sequence
  chemically synthesized
gtttctaactcctgacctcgtg

SEQ ID NO: 1332330 - DNA, 22 bp, Artificial Sequence
  chemically synthesized
gccaggcttgtttctaactcct

SEQ ID NO: 1332331 - DNA, 22 bp, Artificial Sequence
  chemically synthesized
accatgttggccaggcttgttt

SEQ ID NO: 1332332 - DNA, 22 bp, Artificial Sequence
  chemically synthesized
caccatgttggccaggcttgtt

SEQ ID NO: 1332333 - DNA, 22 bp, Artificial Sequence
  chemically synthesized
gaaacaagcctggccaacatgg

SEQ ID NO: 1332334 - DNA, 22 bp, Artificial Sequence
  chemically synthesized
gtagagccgaggtttcaccatg

SEQ ID NO: 1332335 - DNA, 22 bp, Artificial Sequence
  chemically synthesized
agtagagccgaggtttcaccat

SEQ ID NO: 1332336 - DNA, 22 bp, Artificial Sequence
  chemically synthesized
tagtagagccgaggtttcacca

SEQ ID NO: 1332337 - DNA, 22 bp, Artificial Sequence
  chemically synthesized
ttagtagagccgaggtttcacc

SEQ ID NO: 1332338 - DNA, 22 bp, Artificial Sequence
  chemically synthesized
gccaacatggtgaaacctcggc

SEQ ID NO: 1332339 - DNA, 22 bp, Artificial Sequence
  chemically synthesized
tatttttagtagagccgaggtt

SEQ ID NO: 1332340 - DNA, 22 bp, Artificial Sequence
  chemically synthesized
gtatttttagtagagccgaggt

SEQ ID NO: 1332341 - DNA, 22 bp, Artificial Sequence
  chemically synthesized
atgtttgtatttttagtagagc

SEQ ID NO: 1332342 - DNA, 22 bp, Artificial Sequence
  chemically synthesized
ggctctactaaaaatacaaaca

SEQ ID NO: 1332343 - DNA, 22 bp, Artificial Sequence
  chemically synthesized
tactaaaaatacaaacattagc

SEQ ID NO: 1332344 - DNA, 22 bp, Artificial Sequence
  chemically synthesized
ccaccacgcccagctaatgttt

SEQ ID NO: 1332345 - DNA, 22 bp, Artificial Sequence
  chemically synthesized
ctaaaaatacaaacattagctg

SEQ ID NO: 1332346 - DNA, 22 bp, Artificial Sequence
  chemically synthesized
aaaatacaaacattagctgggc

SEQ ID NO: 1332347 - DNA, 22 bp, Artificial Sequence
  chemically synthesized
caggcgcctgccaccacgccca

SEQ ID NO: 1332348 - DNA, 22 bp, Artificial Sequence
  chemically synthesized
ggactacaggcgcctgccacca

SEQ ID NO: 1332349 - DNA, 22 bp, Artificial Sequence
  chemically synthesized
gctgggcgtggtggcaggcgcc

SEQ ID NO: 1332350 - DNA, 22 bp, Artificial Sequence
  chemically synthesized
ggcgtggtggcaggcgcctgta

SEQ ID NO: 1332351 - DNA, 22 bp, Artificial Sequence
  chemically synthesized
ccgaatagctgggactacaggc

SEQ ID NO: 1332352 - DNA, 22 bp, Artificial Sequence
  chemically synthesized
cgtcagcctcccgaatagctgg

SEQ ID NO: 1332353 - DNA, 22 bp, Artificial Sequence
  chemically synthesized
ctgcgtcagcctcccgaatagc

SEQ ID NO: 1332354 - DNA, 22 bp, Artificial Sequence
  chemically synthesized
tcctgcgtcagcctcccgaata

SEQ ID NO: 1332355 - DNA, 22 bp, Artificial Sequence
  chemically synthesized
tagtcccagctattcgggaggc

SEQ ID NO: 1332356 - DNA, 22 bp, Artificial Sequence
  chemically synthesized
aagtgattctcctgcgtcagcc

SEQ ID NO: 1332357 - DNA, 22 bp, Artificial Sequence
  chemically synthesized
ttcgggaggctgacgcaggaga

SEQ ID NO: 1332358 - DNA, 22 bp, Artificial Sequence
  chemically synthesized
aggttcaagtgattctcctgcg

SEQ ID NO: 1332359 - DNA, 22 bp, Artificial Sequence
  chemically synthesized
caggttcaagtgattctcctgc

SEQ ID NO: 1332360 - DNA, 22 bp, Artificial Sequence
  chemically synthesized
gggaggctgacgcaggagaatc

SEQ ID NO: 1332361 - DNA, 22 bp, Artificial Sequence
  chemically synthesized
cgcccttcaggttcaagtgatt

SEQ ID NO: 1332362 - DNA, 22 bp, Artificial Sequence
  chemically synthesized
acgcaggagaatcacttgaacc

SEQ ID NO: 1332363 - DNA, 22 bp, Artificial Sequence
  chemically synthesized
caacctccgcccttcaggttca

SEQ ID NO: 1332364 - DNA, 22 bp, Artificial Sequence
  chemically synthesized
actgcaacctccgcccttcagg

SEQ ID NO: 1332365 - DNA, 22 bp, Artificial Sequence
  chemically synthesized
ggctcactgcaacctccgccct

SEQ ID NO: 1332366 - DNA, 22 bp, Artificial Sequence
  chemically synthesized
gaacctgaagggcggaggttgc

SEQ ID NO: 1332367 - DNA, 22 bp, Artificial Sequence
  chemically synthesized
aacctgaagggcggaggttgca

SEQ ID NO: 1332368 - DNA, 22 bp, Artificial Sequence
  chemically synthesized
aagggcggaggttgcagtgagc

SEQ ID NO: 1332369 - DNA, 22 bp, Artificial Sequence
  chemically synthesized
gagtgcagtggcacgatctcgg

SEQ ID NO: 1332370 - DNA, 22 bp, Artificial Sequence
  chemically synthesized
cagtgagccgagatcgtgccac

SEQ ID NO: 1332371 - DNA, 22 bp, Artificial Sequence
  chemically synthesized
gcccaggctggagtgcagtggc

SEQ ID NO: 1332372 - DNA, 22 bp, Artificial Sequence
  chemically synthesized
ttcgcccaggctggagtgcagt

SEQ ID NO: 1332373 - DNA, 22 bp, Artificial Sequence
  chemically synthesized
tattcgcccaggctggagtgca

SEQ ID NO: 1332374 - DNA, 22 bp, Artificial Sequence
  chemically synthesized
cctctattcgcccaggctggag

SEQ ID NO: 1332375 - DNA, 22 bp, Artificial Sequence
  chemically synthesized
cactccagcctgggcgaataga

SEQ ID NO: 1332376 - DNA, 22 bp, Artificial Sequence
  chemically synthesized
agacagagtctccctctattcg

SEQ ID NO: 1332377 - DNA, 22 bp, Artificial Sequence
  chemically synthesized
cagacagagtctccctctattc

SEQ ID NO: 1332378 - DNA, 22 bp, Artificial Sequence
  chemically synthesized
tcagacagagtctccctctatt

SEQ ID NO: 1332379 - DNA, 22 bp, Artificial Sequence
  chemically synthesized
cagcctgggcgaatagagggag

SEQ ID NO: 1332380 - DNA, 22 bp, Artificial Sequence
  chemically synthesized
ttcagacagagtctccctctat

SEQ ID NO: 1332381 - DNA, 22 bp, Artificial Sequence
  chemically synthesized
tttcagacagagtctccctcta

SEQ ID NO: 1332382 - DNA, 22 bp, Artificial Sequence
  chemically synthesized
ttttcagacagagtctccctct

SEQ ID NO: 1332383 - DNA, 22 bp, Artificial Sequence
  chemically synthesized
tttttcagacagagtctccctc

SEQ ID NO: 1332384 - DNA, 22 bp, Artificial Sequence
  chemically synthesized
ttttttcagacagagtctccct

SEQ ID NO: 1332385 - DNA, 22 bp, Artificial Sequence
  chemically synthesized
tttttttcagacagagtctccc

SEQ ID NO: 1332386 - DNA, 22 bp, Artificial Sequence
  chemically synthesized
ttttttttcagacagagtctcc

SEQ ID NO: 1332387 - DNA, 22 bp, Artificial Sequence
  chemically synthesized
ggcgaatagagggagactctgt

SEQ ID NO: 1332388 - DNA, 22 bp, Artificial Sequence
  chemically synthesized
tttttttttcagacagagtctc

SEQ ID NO: 1332389 - DNA, 22 bp, Artificial Sequence
  chemically synthesized
ttttttttttcagacagagtct

SEQ ID NO: 1332390 - DNA, 22 bp, Artificial Sequence
  chemically synthesized
tttttttttttcagacagagtc

SEQ ID NO: 1332391 - DNA, 22 bp, Artificial Sequence
  chemically synthesized
ttttttttttttcagacagagt

SEQ ID NO: 1332392 - DNA, 22 bp, Artificial Sequence
  chemically synthesized
tttttttttttttcagacagag

SEQ ID NO: 1332393 - DNA, 22 bp, Artificial Sequence
  chemically synthesized
ttttttttttttttcagacaga

SEQ ID NO: 1332394 - DNA, 22 bp, Artificial Sequence
  chemically synthesized
tttttttttttttttcagacag

SEQ ID NO: 1332395 - DNA, 22 bp, Artificial Sequence
  chemically synthesized
ttttttttttttttttcagaca

SEQ ID NO: 1332396 - DNA, 22 bp, Artificial Sequence
  chemically synthesized
tttttttttttttttttcagac

SEQ ID NO: 1332397 - DNA, 22 bp, Artificial Sequence
  chemically synthesized
ttttttttttttttttttcaga

SEQ ID NO: 1332398 - DNA, 22 bp, Artificial Sequence
  chemically synthesized
tttttttttttttttttttcag

SEQ ID NO: 1332399 - DNA, 22 bp, Artificial Sequence
  chemically synthesized
ttttttttttttttttttttca

SEQ ID NO: 1332400 - DNA, 22 bp, Artificial Sequence
  chemically synthesized
tttttttttttttttttttttc

SEQ ID NO: 1332401 - DNA, 22 bp, Artificial Sequence
  chemically synthesized
tttttttttttttttttttttt

SEQ ID NO: 1332402 - DNA, 22 bp, Artificial Sequence
  chemically synthesized
tttttttttttttttttttttt

SEQ ID NO: 1332403 - DNA, 22 bp, Artificial Sequence
  chemically synthesized
tttttttttttttttttttttt

SEQ ID NO: 1332404 - DNA, 22 bp, Artificial Sequence
  chemically synthesized
tttttttttttttttttttttt

SEQ ID NO: 1332405 - DNA, 22 bp, Artificial Sequence
  chemically synthesized
tttttttttttttttttttttt

SEQ ID NO: 1332406 - DNA, 22 bp, Artificial Sequence
  chemically synthesized
tttttttttttttttttttttt

SEQ ID NO: 1332407 - DNA, 22 bp, Artificial Sequence
  chemically synthesized
tgtctgaaaaaaaaaaaaaaaa

SEQ ID NO: 1332408 - DNA, 22 bp, Artificial Sequence
  chemically synthesized
tttttttttttttttttttttt

SEQ ID NO: 1332409 - DNA, 22 bp, Artificial Sequence
  chemically synthesized
tttttttttttttttttttttt

SEQ ID NO: 1332410 - DNA, 22 bp, Artificial Sequence
  chemically synthesized
tctgaaaaaaaaaaaaaaaaaa

SEQ ID NO: 1332411 - DNA, 22 bp, Artificial Sequence
  chemically synthesized
tttttttttttttttttttttt

SEQ ID NO: 1332412 - DNA, 22 bp, Artificial Sequence
  chemically synthesized
tttttttttttttttttttttt

SEQ ID NO: 1332413 - DNA, 22 bp, Artificial Sequence
  chemically synthesized
aaaaaaaaaaaaaaaaaaaaaa

SEQ ID NO: 1332414 - DNA, 22 bp, Artificial Sequence
  chemically synthesized
ggtttttttttttttttttttt

SEQ ID NO: 1332415 - DNA, 22 bp, Artificial Sequence
  chemically synthesized
cggttttttttttttttttttt

SEQ ID NO: 1332416 - DNA, 22 bp, Artificial Sequence
  chemically synthesized
tcggtttttttttttttttttt

SEQ ID NO: 1332417 - DNA, 22 bp, Artificial Sequence
  chemically synthesized
tttcggtttttttttttttttt

SEQ ID NO: 1332418 - DNA, 22 bp, Artificial Sequence
  chemically synthesized
ctttcggttttttttttttttt

SEQ ID NO: 1332419 - DNA, 22 bp, Artificial Sequence
  chemically synthesized
tttctttcggtttttttttttt

SEQ ID NO: 1332420 - DNA, 22 bp, Artificial Sequence
  chemically synthesized
atttctttcggttttttttttt

SEQ ID NO: 1332421 - DNA, 22 bp, Artificial Sequence
  chemically synthesized
tatttctttcggtttttttttt

SEQ ID NO: 1332422 - DNA, 22 bp, Artificial Sequence
  chemically synthesized
ttatttctttcggttttttttt

SEQ ID NO: 1332423 - DNA, 22 bp, Artificial Sequence
  chemically synthesized
ccaaggaagaaaataaagacag

SEQ ID NO: 1332424 - DNA, 22 bp, Artificial Sequence
  chemically synthesized
gccaaggaagaaaataaagaca

SEQ ID NO: 1332425 - DNA, 22 bp, Artificial Sequence
  chemically synthesized
tgccaaggaagaaaataaagac

SEQ ID NO: 1332426 - DNA, 22 bp, Artificial Sequence
  chemically synthesized
cagacaattttgccaaggaaga

SEQ ID NO: 1332427 - DNA, 22 bp, Artificial Sequence
  chemically synthesized
tctttattttcttccttggcaa

SEQ ID NO: 1332428 - DNA, 22 bp, Artificial Sequence
  chemically synthesized
tattttcttccttggcaaaatt

SEQ ID NO: 1332429 - DNA, 22 bp, Artificial Sequence
  chemically synthesized
attttcttccttggcaaaattg

SEQ ID NO: 1332430 - DNA, 22 bp, Artificial Sequence
  chemically synthesized
ttttcttccttggcaaaattgt

SEQ ID NO: 1332431 - DNA, 22 bp, Artificial Sequence
  chemically synthesized
tcttccttggcaaaattgtctg

SEQ ID NO: 1332432 - DNA, 22 bp, Artificial Sequence
  chemically synthesized
cttccttggcaaaattgtctgt

SEQ ID NO: 1332433 - DNA, 22 bp, Artificial Sequence
  chemically synthesized
ttccttggcaaaattgtctgta

SEQ ID NO: 1332434 - DNA, 22 bp, Artificial Sequence
  chemically synthesized
ccttggcaaaattgtctgtagg

SEQ ID NO: 1332435 - DNA, 22 bp, Artificial Sequence
  chemically synthesized
cttggcaaaattgtctgtagga

SEQ ID NO: 1332436 - DNA, 22 bp, Artificial Sequence
  chemically synthesized
ggcaaaattgtctgtaggattc

SEQ ID NO: 1332437 - DNA, 22 bp, Artificial Sequence
  chemically synthesized
gcaaaattgtctgtaggattca

SEQ ID NO: 1332438 - DNA, 22 bp, Artificial Sequence
  chemically synthesized
aataaatggatgagtgaatcct

SEQ ID NO: 1332439 - DNA, 22 bp, Artificial Sequence
  chemically synthesized
attaaataaatggatgagtgaa

SEQ ID NO: 1332440 - DNA, 22 bp, Artificial Sequence
  chemically synthesized
tctgtaggattcactcatccat

SEQ ID NO: 1332441 - DNA, 22 bp, Artificial Sequence
  chemically synthesized
taggattcactcatccatttat

SEQ ID NO: 1332442 - DNA, 22 bp, Artificial Sequence
  chemically synthesized
aataaattaattaaataaatgg

SEQ ID NO: 1332443 - DNA, 22 bp, Artificial Sequence
  chemically synthesized
actcatccatttatttaattaa

SEQ ID NO: 1332444 - DNA, 22 bp, Artificial Sequence
  chemically synthesized
atccatttatttaattaattta

SEQ ID NO: 1332445 - DNA, 22 bp, Artificial Sequence
  chemically synthesized
gaatgtaatgggaattcaataa

SEQ ID NO: 1332446 - DNA, 22 bp, Artificial Sequence
  chemically synthesized
atttaattaatttattgaattc

SEQ ID NO: 1332447 - DNA, 22 bp, Artificial Sequence
  chemically synthesized
ggaatgtaatgggaattcaata

SEQ ID NO: 1332448 - DNA, 22 bp, Artificial Sequence
  chemically synthesized
tttaattaatttattgaattcc

SEQ ID NO: 1332449 - DNA, 22 bp, Artificial Sequence
  chemically synthesized
cttggaatgtaatgggaattca

SEQ ID NO: 1332450 - DNA, 22 bp, Artificial Sequence
  chemically synthesized
aattaatttattgaattcccat

SEQ ID NO: 1332451 - DNA, 22 bp, Artificial Sequence
  chemically synthesized
attaatttattgaattcccatt

SEQ ID NO: 1332452 - DNA, 22 bp, Artificial Sequence
  chemically synthesized
atttattgaattcccattacat

SEQ ID NO: 1332453 - DNA, 22 bp, Artificial Sequence
  chemically synthesized
atacctgcttggaatgtaatgg

SEQ ID NO: 1332454 - DNA, 22 bp, Artificial Sequence
  chemically synthesized
attgaattcccattacattcca

SEQ ID NO: 1332455 - DNA, 22 bp, Artificial Sequence
  chemically synthesized
ttgaattcccattacattccaa

SEQ ID NO: 1332456 - DNA, 22 bp, Artificial Sequence
  chemically synthesized
aattcccattacattccaagca

SEQ ID NO: 1332457 - DNA, 22 bp, Artificial Sequence
  chemically synthesized
gtagttaatacctgcttggaat

SEQ ID NO: 1332458 - DNA, 22 bp, Artificial Sequence
  chemically synthesized
agtagttaatacctgcttggaa

SEQ ID NO: 1332459 - DNA, 22 bp, Artificial Sequence
  chemically synthesized
ccattacattccaagcaggtat

SEQ ID NO: 1332460 - DNA, 22 bp, Artificial Sequence
  chemically synthesized
aatccttagtagttaatacctg

SEQ ID NO: 1332461 - DNA, 22 bp, Artificial Sequence
  chemically synthesized
cattccaagcaggtattaacta

SEQ ID NO: 1332462 - DNA, 22 bp, Artificial Sequence
  chemically synthesized
atcattgaatccttagtagtta

SEQ ID NO: 1332463 - DNA, 22 bp, Artificial Sequence
  chemically synthesized
caagcaggtattaactactaag

SEQ ID NO: 1332464 - DNA, 22 bp, Artificial Sequence
  chemically synthesized
catcattgaatccttagtagtt

SEQ ID NO: 1332465 - DNA, 22 bp, Artificial Sequence
  chemically synthesized
tcatcattgaatccttagtagt

SEQ ID NO: 1332466 - DNA, 22 bp, Artificial Sequence
  chemically synthesized
tctttcatcattgaatccttag

SEQ ID NO: 1332467 - DNA, 22 bp, Artificial Sequence
  chemically synthesized
gtctttcatcattgaatcctta

SEQ ID NO: 1332468 - DNA, 22 bp, Artificial Sequence
  chemically synthesized
actactaaggattcaatgatga

SEQ ID NO: 1332469 - DNA, 22 bp, Artificial Sequence
  chemically synthesized
tacaccttgtctttcatcattg

SEQ ID NO: 1332470 - DNA, 22 bp, Artificial Sequence
  chemically synthesized
ctaaggattcaatgatgaaaga

SEQ ID NO: 1332471 - DNA, 22 bp, Artificial Sequence
  chemically synthesized
ctatacaccttgtctttcatca

SEQ ID NO: 1332472 - DNA, 22 bp, Artificial Sequence
  chemically synthesized
aggattcaatgatgaaagacaa

SEQ ID NO: 1332473 - DNA, 22 bp, Artificial Sequence
  chemically synthesized
ggtctcctatacaccttgtctt

SEQ ID NO: 1332474 - DNA, 22 bp, Artificial Sequence
  chemically synthesized
aatgatgaaagacaaggtgtat

SEQ ID NO: 1332475 - DNA, 22 bp, Artificial Sequence
  chemically synthesized
tacgtactaggtctcctataca

SEQ ID NO: 1332476 - DNA, 22 bp, Artificial Sequence
  chemically synthesized
aggctgtacgtactaggtctcc

SEQ ID NO: 1332477 - DNA, 22 bp, Artificial Sequence
  chemically synthesized
agaaaagaaactaaggctgtac

SEQ ID NO: 1332478 - DNA, 22 bp, Artificial Sequence
  chemically synthesized
gtacgtacagccttagtttctt

SEQ ID NO: 1332479 - DNA, 22 bp, Artificial Sequence
  chemically synthesized
gagcataaatctgagaaaagaa

SEQ ID NO: 1332480 - DNA, 22 bp, Artificial Sequence
  chemically synthesized
agagcataaatctgagaaaaga

SEQ ID NO: 1332481 - DNA, 22 bp, Artificial Sequence
  chemically synthesized
tagagcataaatctgagaaaag

SEQ ID NO: 1332482 - DNA, 22 bp, Artificial Sequence
  chemically synthesized
agtttcttttctcagatttatg

SEQ ID NO: 1332483 - DNA, 22 bp, Artificial Sequence
  chemically synthesized
gtttcttttctcagatttatgc

SEQ ID NO: 1332484 - DNA, 22 bp, Artificial Sequence
  chemically synthesized
acggaattttagagcataaatc

SEQ ID NO: 1332485 - DNA, 22 bp, Artificial Sequence
  chemically synthesized
aacggaattttagagcataaat

SEQ ID NO: 1332486 - DNA, 22 bp, Artificial Sequence
  chemically synthesized
cttttctcagatttatgctcta

SEQ ID NO: 1332487 - DNA, 22 bp, Artificial Sequence
  chemically synthesized
ttaacggaattttagagcataa

SEQ ID NO: 1332488 - DNA, 22 bp, Artificial Sequence
  chemically synthesized
ttttctcagatttatgctctaa

SEQ ID NO: 1332489 - DNA, 22 bp, Artificial Sequence
  chemically synthesized
ttctcagatttatgctctaaaa

SEQ ID NO: 1332490 - DNA, 22 bp, Artificial Sequence
  chemically synthesized
tctcagatttatgctctaaaat

SEQ ID NO: 1332491 - DNA, 22 bp, Artificial Sequence
  chemically synthesized
ctcagatttatgctctaaaatt

SEQ ID NO: 1332492 - DNA, 22 bp, Artificial Sequence
  chemically synthesized
tcagatttatgctctaaaattc

SEQ ID NO: 1332493 - DNA, 22 bp, Artificial Sequence
  chemically synthesized
agatttatgctctaaaattccg

SEQ ID NO: 1332494 - DNA, 22 bp, Artificial Sequence
  chemically synthesized
atgctctaaaattccgttaaga

SEQ ID NO: 1332495 - DNA, 22 bp, Artificial Sequence
  chemically synthesized
tgctctaaaattccgttaagaa

SEQ ID NO: 1332496 - DNA, 22 bp, Artificial Sequence
  chemically synthesized
taaaattccgttaagaatggat

SEQ ID NO: 1332497 - DNA, 22 bp, Artificial Sequence
  chemically synthesized
aaattccgttaagaatggattt

SEQ ID NO: 1332498 - DNA, 22 bp, Artificial Sequence
  chemically synthesized
cgttaagaatggatttattggc

SEQ ID NO: 1332499 - DNA, 22 bp, Artificial Sequence
  chemically synthesized
agaatggatttattggctgggt

SEQ ID NO: 1332500 - DNA, 22 bp, Artificial Sequence
  chemically synthesized
caggcgtgagccaccgcaccca

SEQ ID NO: 1332501 - DNA, 22 bp, Artificial Sequence
  chemically synthesized
attggctgggtgcggtggctca

SEQ ID NO: 1332502 - DNA, 22 bp, Artificial Sequence
  chemically synthesized
ggattacaggcgtgagccaccg

SEQ ID NO: 1332503 - DNA, 22 bp, Artificial Sequence
  chemically synthesized
ttggctgggtgcggtggctcac

SEQ ID NO: 1332504 - DNA, 22 bp, Artificial Sequence
  chemically synthesized
gctgggtgcggtggctcacgcc

SEQ ID NO: 1332505 - DNA, 22 bp, Artificial Sequence
  chemically synthesized
ggtgcggtggctcacgcctgta

SEQ ID NO: 1332506 - DNA, 22 bp, Artificial Sequence
  chemically synthesized
ccaaagtgctgggattacaggc

SEQ ID NO: 1332507 - DNA, 22 bp, Artificial Sequence
  chemically synthesized
cctcccaaagtgctgggattac

SEQ ID NO: 1332508 - DNA, 22 bp, Artificial Sequence
  chemically synthesized
tgcctcccaaagtgctgggatt

SEQ ID NO: 1332509 - DNA, 22 bp, Artificial Sequence
  chemically synthesized
acgcctgtaatcccagcacttt

SEQ ID NO: 1332510 - DNA, 22 bp, Artificial Sequence
  chemically synthesized
cctctgcctcccaaagtgctgg

SEQ ID NO: 1332511 - DNA, 22 bp, Artificial Sequence
  chemically synthesized
taatcccagcactttgggaggc

SEQ ID NO: 1332512 - DNA, 22 bp, Artificial Sequence
  chemically synthesized
aggtgagccacctgcctctgcc

SEQ ID NO: 1332513 - DNA, 22 bp, Artificial Sequence
  chemically synthesized
acctcaggtgagccacctgcct

SEQ ID NO: 1332514 - DNA, 22 bp, Artificial Sequence
  chemically synthesized
tgggaggcagaggcaggtggct

SEQ ID NO: 1332515 - DNA, 22 bp, Artificial Sequence
  chemically synthesized
gggaggcagaggcaggtggctc

SEQ ID NO: 1332516 - DNA, 22 bp, Artificial Sequence
  chemically synthesized
ctgacctcaggtgagccacctg

SEQ ID NO: 1332517 - DNA, 22 bp, Artificial Sequence
  chemically synthesized
ggaggcagaggcaggtggctca

SEQ ID NO: 1332518 - DNA, 22 bp, Artificial Sequence
  chemically synthesized
gaactcctgacctcaggtgagc

SEQ ID NO: 1332519 - DNA, 22 bp, Artificial Sequence
  chemically synthesized
gtctcgaactcctgacctcagg

SEQ ID NO: 1332520 - DNA, 22 bp, Artificial Sequence
  chemically synthesized
gtcaggctggtctcgaactcct

SEQ ID NO: 1332521 - DNA, 22 bp, Artificial Sequence
  chemically synthesized
acctgaggtcaggagttcgaga

SEQ ID NO: 1332522 - DNA, 22 bp, Artificial Sequence
  chemically synthesized
aggtcaggagttcgagaccagc

SEQ ID NO: 1332523 - DNA, 22 bp, Artificial Sequence
  chemically synthesized
catgttggtcaggctggtctcg

SEQ ID NO: 1332524 - DNA, 22 bp, Artificial Sequence
  chemically synthesized
tccatgttggtcaggctggtct

SEQ ID NO: 1332525 - DNA, 22 bp, Artificial Sequence
  chemically synthesized
ctccatgttggtcaggctggtc

SEQ ID NO: 1332526 - DNA, 22 bp, Artificial Sequence
  chemically synthesized
gagaccagcctgaccaacatgg

SEQ ID NO: 1332527 - DNA, 22 bp, Artificial Sequence
  chemically synthesized
ggagagacggagtttctccatg

SEQ ID NO: 1332528 - DNA, 22 bp, Artificial Sequence
  chemically synthesized
aggagagacggagtttctccat

SEQ ID NO: 1332529 - DNA, 22 bp, Artificial Sequence
  chemically synthesized
taggagagacggagtttctcca

SEQ ID NO: 1332530 - DNA, 22 bp, Artificial Sequence
  chemically synthesized
ttaggagagacggagtttctcc

SEQ ID NO: 1332531 - DNA, 22 bp, Artificial Sequence
  chemically synthesized
accaacatggagaaactccgtc

SEQ ID NO: 1332532 - DNA, 22 bp, Artificial Sequence
  chemically synthesized
tatttttaggagagacggagtt

SEQ ID NO: 1332533 - DNA, 22 bp, Artificial Sequence
  chemically synthesized
gtatttttaggagagacggagt

SEQ ID NO: 1332534 - DNA, 22 bp, Artificial Sequence
  chemically synthesized
tgtatttttaggagagacggag

SEQ ID NO: 1332535 - DNA, 22 bp, Artificial Sequence
  chemically synthesized
attttgtatttttaggagagac

SEQ ID NO: 1332536 - DNA, 22 bp, Artificial Sequence
  chemically synthesized
cgtctctcctaaaaatacaaaa

SEQ ID NO: 1332537 - DNA, 22 bp, Artificial Sequence
  chemically synthesized
tcctaaaaatacaaaattagct

SEQ ID NO: 1332538 - DNA, 22 bp, Artificial Sequence
  chemically synthesized
ctaaaaatacaaaattagcttg

SEQ ID NO: 1332539 - DNA, 22 bp, Artificial Sequence
  chemically synthesized
aaaatacaaaattagcttggtg

SEQ ID NO: 1332540 - DNA, 22 bp, Artificial Sequence
  chemically synthesized
caggcatgcaccaccacaccaa

SEQ ID NO: 1332541 - DNA, 22 bp, Artificial Sequence
  chemically synthesized
ggattacaggcatgcaccacca

SEQ ID NO: 1332542 - DNA, 22 bp, Artificial Sequence
  chemically synthesized
gcttggtgtggtggtgcatgcc

SEQ ID NO: 1332543 - DNA, 22 bp, Artificial Sequence
  chemically synthesized
ggtgtggtggtgcatgcctgta

SEQ ID NO: 1332544 - DNA, 22 bp, Artificial Sequence
  chemically synthesized
gtgtggtggtgcatgcctgtaa

SEQ ID NO: 1332545 - DNA, 22 bp, Artificial Sequence
  chemically synthesized
ccgagtagctgggattacaggc

SEQ ID NO: 1332546 - DNA, 22 bp, Artificial Sequence
  chemically synthesized
agcctcccgagtagctgggatt

SEQ ID NO: 1332547 - DNA, 22 bp, Artificial Sequence
  chemically synthesized
cctcagcctcccgagtagctgg

SEQ ID NO: 1332548 - DNA, 22 bp, Artificial Sequence
  chemically synthesized
ctgcctcagcctcccgagtagc

SEQ ID NO: 1332549 - DNA, 22 bp, Artificial Sequence
  chemically synthesized
tcctgcctcagcctcccgagta

SEQ ID NO: 1332550 - DNA, 22 bp, Artificial Sequence
  chemically synthesized
taatcccagctactcgggaggc

SEQ ID NO: 1332551 - DNA, 22 bp, Artificial Sequence
  chemically synthesized
aagcaattctcctgcctcagcc

SEQ ID NO: 1332552 - DNA, 22 bp, Artificial Sequence
  chemically synthesized
ctcgggaggctgaggcaggaga

SEQ ID NO: 1332553 - DNA, 22 bp, Artificial Sequence
  chemically synthesized
ggttcaagcaattctcctgcct

SEQ ID NO: 1332554 - DNA, 22 bp, Artificial Sequence
  chemically synthesized
gggttcaagcaattctcctgcc

SEQ ID NO: 1332555 - DNA, 22 bp, Artificial Sequence
  chemically synthesized
gggaggctgaggcaggagaatt

SEQ ID NO: 1332556 - DNA, 22 bp, Artificial Sequence
  chemically synthesized
ttgggttcaagcaattctcctg

SEQ ID NO: 1332557 - DNA, 22 bp, Artificial Sequence
  chemically synthesized
cgcctcttgggttcaagcaatt

SEQ ID NO: 1332558 - DNA, 22 bp, Artificial Sequence
  chemically synthesized
aggcaggagaattgcttgaacc

SEQ ID NO: 1332559 - DNA, 22 bp, Artificial Sequence
  chemically synthesized
accgcaacctccgcctcttggg

SEQ ID NO: 1332560 - DNA, 22 bp, Artificial Sequence
  chemically synthesized
ggctcaccgcaacctccgcctc

SEQ ID NO: 1332561 - DNA, 22 bp, Artificial Sequence
  chemically synthesized
cttgaacccaagaggcggaggt

SEQ ID NO: 1332562 - DNA, 22 bp, Artificial Sequence
  chemically synthesized
aggctcaccgcaacctccgcct

SEQ ID NO: 1332563 - DNA, 22 bp, Artificial Sequence
  chemically synthesized
gaacccaagaggcggaggttgc

SEQ ID NO: 1332564 - DNA, 22 bp, Artificial Sequence
  chemically synthesized
aacccaagaggcggaggttgcg

SEQ ID NO: 1332565 - DNA, 22 bp, Artificial Sequence
  chemically synthesized
gagtgcaatggcgagatttagg

SEQ ID NO: 1332566 - DNA, 22 bp, Artificial Sequence
  chemically synthesized
cggtgagcctaaatctcgccat

SEQ ID NO: 1332567 - DNA, 22 bp, Artificial Sequence
  chemically synthesized
cccaggctggagtgcaatggcg

SEQ ID NO: 1332568 - DNA, 22 bp, Artificial Sequence
  chemically synthesized
ttgcccaggctggagtgcaatg

SEQ ID NO: 1332569 - DNA, 22 bp, Artificial Sequence
  chemically synthesized
gttgcccaggctggagtgcaat

SEQ ID NO: 1332570 - DNA, 22 bp, Artificial Sequence
  chemically synthesized
ttgttgcccaggctggagtgca

SEQ ID NO: 1332571 - DNA, 22 bp, Artificial Sequence
  chemically synthesized
aatctcgccattgcactccagc

SEQ ID NO: 1332572 - DNA, 22 bp, Artificial Sequence
  chemically synthesized
gctcttgttgcccaggctggag

SEQ ID NO: 1332573 - DNA, 22 bp, Artificial Sequence
  chemically synthesized
cgctcttgttgcccaggctgga

SEQ ID NO: 1332574 - DNA, 22 bp, Artificial Sequence
  chemically synthesized
tcgctcttgttgcccaggctgg

SEQ ID NO: 1332575 - DNA, 22 bp, Artificial Sequence
  chemically synthesized
gccattgcactccagcctgggc

SEQ ID NO: 1332576 - DNA, 22 bp, Artificial Sequence
  chemically synthesized
cactccagcctgggcaacaaga

SEQ ID NO: 1332577 - DNA, 22 bp, Artificial Sequence
  chemically synthesized
gatggactttcgctcttgttgc

SEQ ID NO: 1332578 - DNA, 22 bp, Artificial Sequence
  chemically synthesized
agatggactttcgctcttgttg

SEQ ID NO: 1332579 - DNA, 22 bp, Artificial Sequence
  chemically synthesized
tagatggactttcgctcttgtt

SEQ ID NO: 1332580 - DNA, 22 bp, Artificial Sequence
  chemically synthesized
ttagatggactttcgctcttgt

SEQ ID NO: 1332581 - DNA, 22 bp, Artificial Sequence
  chemically synthesized
cagcctgggcaacaagagcgaa

SEQ ID NO: 1332582 - DNA, 22 bp, Artificial Sequence
  chemically synthesized
tttagatggactttcgctcttg

SEQ ID NO: 1332583 - DNA, 22 bp, Artificial Sequence
  chemically synthesized
ttttagatggactttcgctctt

SEQ ID NO: 1332584 - DNA, 22 bp, Artificial Sequence
  chemically synthesized
tttttagatggactttcgctct

SEQ ID NO: 1332585 - DNA, 22 bp, Artificial Sequence
  chemically synthesized
ttttttagatggactttcgctc

SEQ ID NO: 1332586 - DNA, 22 bp, Artificial Sequence
  chemically synthesized
tttttttagatggactttcgct

SEQ ID NO: 1332587 - DNA, 22 bp, Artificial Sequence
  chemically synthesized
ttttttttagatggactttcgc

SEQ ID NO: 1332588 - DNA, 22 bp, Artificial Sequence
  chemically synthesized
tttttttttagatggactttcg

SEQ ID NO: 1332589 - DNA, 22 bp, Artificial Sequence
  chemically synthesized
ggcaacaagagcgaaagtccat

SEQ ID NO: 1332590 - DNA, 22 bp, Artificial Sequence
  chemically synthesized
ttttttttttagatggactttc

SEQ ID NO: 1332591 - DNA, 22 bp, Artificial Sequence
  chemically synthesized
tttttttttttagatggacttt

SEQ ID NO: 1332592 - DNA, 22 bp, Artificial Sequence
  chemically synthesized
ttttttttttttagatggactt

SEQ ID NO: 1332593 - DNA, 22 bp, Artificial Sequence
  chemically synthesized
tttttttttttttagatggact

SEQ ID NO: 1332594 - DNA, 22 bp, Artificial Sequence
  chemically synthesized
ttttttttttttttagatggac

SEQ ID NO: 1332595 - DNA, 22 bp, Artificial Sequence
  chemically synthesized
tttttttttttttttagatgga

SEQ ID NO: 1332596 - DNA, 22 bp, Artificial Sequence
  chemically synthesized
ttttttttttttttttagatgg

SEQ ID NO: 1332597 - DNA, 22 bp, Artificial Sequence
  chemically synthesized
tttttttttttttttttagatg

SEQ ID NO: 1332598 - DNA, 22 bp, Artificial Sequence
  chemically synthesized
ttttttttttttttttttagat

SEQ ID NO: 1332599 - DNA, 22 bp, Artificial Sequence
  chemically synthesized
tttttttttttttttttttaga

SEQ ID NO: 1332600 - DNA, 22 bp, Artificial Sequence
  chemically synthesized
ttttttttttttttttttttag

SEQ ID NO: 1332601 - DNA, 22 bp, Artificial Sequence
  chemically synthesized
ttttttttttttttttttttta

SEQ ID NO: 1332602 - DNA, 22 bp, Artificial Sequence
  chemically synthesized
tttttttttttttttttttttt

SEQ ID NO: 1332603 - DNA, 22 bp, Artificial Sequence
  chemically synthesized
tttttttttttttttttttttt

SEQ ID NO: 1332604 - DNA, 22 bp, Artificial Sequence
  chemically synthesized
tttttttttttttttttttttt

SEQ ID NO: 1332605 - DNA, 22 bp, Artificial Sequence
  chemically synthesized
aaaaaaaaaaaaaaaaaaaaaa

SEQ ID NO: 1332606 - DNA, 22 bp, Artificial Sequence
  chemically synthesized
ataaaaataaagcctttttttt

SEQ ID NO: 1332607 - DNA, 22 bp, Artificial Sequence
  chemically synthesized
cataaaaataaagccttttttt

SEQ ID NO: 1332608 - DNA, 22 bp, Artificial Sequence
  chemically synthesized
ttcataaaaataaagccttttt

SEQ ID NO: 1332609 - DNA, 22 bp, Artificial Sequence
  chemically synthesized
cttcataaaaataaagcctttt

SEQ ID NO: 1332610 - DNA, 22 bp, Artificial Sequence
  chemically synthesized
tcttcataaaaataaagccttt

SEQ ID NO: 1332611 - DNA, 22 bp, Artificial Sequence
  chemically synthesized
tggttttcttcataaaaataaa

SEQ ID NO: 1332612 - DNA, 22 bp, Artificial Sequence
  chemically synthesized
atggttttcttcataaaaataa

SEQ ID NO: 1332613 - DNA, 22 bp, Artificial Sequence
  chemically synthesized
atttatggttttcttcataaaa

SEQ ID NO: 1332614 - DNA, 22 bp, Artificial Sequence
  chemically synthesized
tgacattaatttatggttttct

SEQ ID NO: 1332615 - DNA, 22 bp, Artificial Sequence
  chemically synthesized
tatttttatgaagaaaaccata

SEQ ID NO: 1332616 - DNA, 22 bp, Artificial Sequence
  chemically synthesized
atgacattaatttatggttttc

SEQ ID NO: 1332617 - DNA, 22 bp, Artificial Sequence
  chemically synthesized
atttttatgaagaaaaccataa

SEQ ID NO: 1332618 - DNA, 22 bp, Artificial Sequence
  chemically synthesized
tttttatgaagaaaaccataaa

SEQ ID NO: 1332619 - DNA, 22 bp, Artificial Sequence
  chemically synthesized
ttatgaagaaaaccataaatta

SEQ ID NO: 1332620 - DNA, 22 bp, Artificial Sequence
  chemically synthesized
tatgaagaaaaccataaattaa

SEQ ID NO: 1332621 - DNA, 22 bp, Artificial Sequence
  chemically synthesized
atgaagaaaaccataaattaat

SEQ ID NO: 1332622 - DNA, 22 bp, Artificial Sequence
  chemically synthesized
tgaagaaaaccataaattaatg

SEQ ID NO: 1332623 - DNA, 22 bp, Artificial Sequence
  chemically synthesized
acatagataagatttatgacat

SEQ ID NO: 1332624 - DNA, 22 bp, Artificial Sequence
  chemically synthesized
ttaacatagataagatttatga

SEQ ID NO: 1332625 - DNA, 22 bp, Artificial Sequence
  chemically synthesized
ataattattaacatagataaga

SEQ ID NO: 1332626 - DNA, 22 bp, Artificial Sequence
  chemically synthesized
atgtcataaatcttatctatgt

SEQ ID NO: 1332627 - DNA, 22 bp, Artificial Sequence
  chemically synthesized
aagcaactgataattattaaca

SEQ ID NO: 1332628 - DNA, 22 bp, Artificial Sequence
  chemically synthesized
atctatgttaataattatcagt

SEQ ID NO: 1332629 - DNA, 22 bp, Artificial Sequence
  chemically synthesized
atgattaaagcaactgataatt

SEQ ID NO: 1332630 - DNA, 22 bp, Artificial Sequence
  chemically synthesized
tctatgttaataattatcagtt

SEQ ID NO: 1332631 - DNA, 22 bp, Artificial Sequence
  chemically synthesized
catgattaaagcaactgataat

SEQ ID NO: 1332632 - DNA, 22 bp, Artificial Sequence
  chemically synthesized
tcatgattaaagcaactgataa

SEQ ID NO: 1332633 - DNA, 22 bp, Artificial Sequence
  chemically synthesized
tgttaataattatcagttgctt

SEQ ID NO: 1332634 - DNA, 22 bp, Artificial Sequence
  chemically synthesized
ttttcatgattaaagcaactga

SEQ ID NO: 1332635 - DNA, 22 bp, Artificial Sequence
  chemically synthesized
gttttcatgattaaagcaactg

SEQ ID NO: 1332636 - DNA, 22 bp, Artificial Sequence
  chemically synthesized
tgttttcatgattaaagcaact

SEQ ID NO: 1332637 - DNA, 22 bp, Artificial Sequence
  chemically synthesized
ttgttttcatgattaaagcaac

SEQ ID NO: 1332638 - DNA, 22 bp, Artificial Sequence
  chemically synthesized
ataattatcagttgctttaatc

SEQ ID NO: 1332639 - DNA, 22 bp, Artificial Sequence
  chemically synthesized
ccttttgttttcatgattaaag

SEQ ID NO: 1332640 - DNA, 22 bp, Artificial Sequence
  chemically synthesized
cccttttgttttcatgattaaa

SEQ ID NO: 1332641 - DNA, 22 bp, Artificial Sequence
  chemically synthesized
tcccttttgttttcatgattaa

SEQ ID NO: 1332642 - DNA, 22 bp, Artificial Sequence
  chemically synthesized
ttcccttttgttttcatgatta

SEQ ID NO: 1332643 - DNA, 22 bp, Artificial Sequence
  chemically synthesized
tcagttgctttaatcatgaaaa

SEQ ID NO: 1332644 - DNA, 22 bp, Artificial Sequence
  chemically synthesized
ccagtttttcccttttgttttc

SEQ ID NO: 1332645 - DNA, 22 bp, Artificial Sequence
  chemically synthesized
gccagtttttcccttttgtttt

SEQ ID NO: 1332646 - DNA, 22 bp, Artificial Sequence
  chemically synthesized
ctttaatcatgaaaacaaaagg

SEQ ID NO: 1332647 - DNA, 22 bp, Artificial Sequence
  chemically synthesized
taatcatgaaaacaaaagggaa

SEQ ID NO: 1332648 - DNA, 22 bp, Artificial Sequence
  chemically synthesized
acttgccagtttttcccttttg

SEQ ID NO: 1332649 - DNA, 22 bp, Artificial Sequence
  chemically synthesized
aatcatgaaaacaaaagggaaa

SEQ ID NO: 1332650 - DNA, 22 bp, Artificial Sequence
  chemically synthesized
atcatgaaaacaaaagggaaaa

SEQ ID NO: 1332651 - DNA, 22 bp, Artificial Sequence
  chemically synthesized
gctcacttgccagtttttccct

SEQ ID NO: 1332652 - DNA, 22 bp, Artificial Sequence
  chemically synthesized
agcctggctcacttgccagttt

SEQ ID NO: 1332653 - DNA, 22 bp, Artificial Sequence
  chemically synthesized
cagcctggctcacttgccagtt

SEQ ID NO: 1332654 - DNA, 22 bp, Artificial Sequence
  chemically synthesized
tttcagcctggctcacttgcca

SEQ ID NO: 1332655 - DNA, 22 bp, Artificial Sequence
  chemically synthesized
aattatttcagcctggctcact

SEQ ID NO: 1332656 - DNA, 22 bp, Artificial Sequence
  chemically synthesized
tattgaattatttcagcctggc

SEQ ID NO: 1332657 - DNA, 22 bp, Artificial Sequence
  chemically synthesized
gcaagtgagccaggctgaaata

SEQ ID NO: 1332658 - DNA, 22 bp, Artificial Sequence
  chemically synthesized
aatattatattgaattatttca

SEQ ID NO: 1332659 - DNA, 22 bp, Artificial Sequence
  chemically synthesized
aaatattatattgaattatttc

SEQ ID NO: 1332660 - DNA, 22 bp, Artificial Sequence
  chemically synthesized
taaatattatattgaattattt

SEQ ID NO: 1332661 - DNA, 22 bp, Artificial Sequence
  chemically synthesized
atctttaaatattatattgaat

SEQ ID NO: 1332662 - DNA, 22 bp, Artificial Sequence
  chemically synthesized
taatctttaaatattatattga

SEQ ID NO: 1332663 - DNA, 22 bp, Artificial Sequence
  chemically synthesized
ctaatctttaaatattatattg

SEQ ID NO: 1332664 - DNA, 22 bp, Artificial Sequence
  chemically synthesized
aaataattcaatataatattta

SEQ ID NO: 1332665 - DNA, 22 bp, Artificial Sequence
  chemically synthesized
aatataatatttaaagattaga

SEQ ID NO: 1332666 - DNA, 22 bp, Artificial Sequence
  chemically synthesized
gaaaacaagtgtaccatatttc

SEQ ID NO: 1332667 - DNA, 22 bp, Artificial Sequence
  chemically synthesized
agaaaacaagtgtaccatattt

SEQ ID NO: 1332668 - DNA, 22 bp, Artificial Sequence
  chemically synthesized
tagaaaacaagtgtaccatatt

SEQ ID NO: 1332669 - DNA, 22 bp, Artificial Sequence
  chemically synthesized
aaagattagaaatatggtacac

SEQ ID NO: 1332670 - DNA, 22 bp, Artificial Sequence
  chemically synthesized
aagattagaaatatggtacact

SEQ ID NO: 1332671 - DNA, 22 bp, Artificial Sequence
  chemically synthesized
atctttagaaaacaagtgtacc

SEQ ID NO: 1332672 - DNA, 22 bp, Artificial Sequence
  chemically synthesized
gaaatatggtacacttgttttc

SEQ ID NO: 1332673 - DNA, 22 bp, Artificial Sequence
  chemically synthesized
ataagatggagctgatctttag

SEQ ID NO: 1332674 - DNA, 22 bp, Artificial Sequence
  chemically synthesized
gataagatggagctgatcttta

SEQ ID NO: 1332675 - DNA, 22 bp, Artificial Sequence
  chemically synthesized
gttttctaaagatcagctccat

SEQ ID NO: 1332676 - DNA, 22 bp, Artificial Sequence
  chemically synthesized
cagtttgataagatggagctga

SEQ ID NO: 1332677 - DNA, 22 bp, Artificial Sequence
  chemically synthesized
ttttctaaagatcagctccatc

SEQ ID NO: 1332678 - DNA, 22 bp, Artificial Sequence
  chemically synthesized
ttccagtttgataagatggagc

SEQ ID NO: 1332679 - DNA, 22 bp, Artificial Sequence
  chemically synthesized
tctaaagatcagctccatctta

SEQ ID NO: 1332680 - DNA, 22 bp, Artificial Sequence
  chemically synthesized
ctaaagatcagctccatcttat

SEQ ID NO: 1332681 - DNA, 22 bp, Artificial Sequence
  chemically synthesized
taaagatcagctccatcttatc

SEQ ID NO: 1332682 - DNA, 22 bp, Artificial Sequence
  chemically synthesized
aagatcagctccatcttatcaa

SEQ ID NO: 1332683 - DNA, 22 bp, Artificial Sequence
  chemically synthesized
agatgttattccagtttgataa

SEQ ID NO: 1332684 - DNA, 22 bp, Artificial Sequence
  chemically synthesized
attcagatgttattccagtttg

SEQ ID NO: 1332685 - DNA, 22 bp, Artificial Sequence
  chemically synthesized
aattcagatgttattccagttt

SEQ ID NO: 1332686 - DNA, 22 bp, Artificial Sequence
  chemically synthesized
taattcagatgttattccagtt

SEQ ID NO: 1332687 - DNA, 22 bp, Artificial Sequence
  chemically synthesized
catcttatcaaactggaataac

SEQ ID NO: 1332688 - DNA, 22 bp, Artificial Sequence
  chemically synthesized
ttttaattcagatgttattcca

SEQ ID NO: 1332689 - DNA, 22 bp, Artificial Sequence
  chemically synthesized
atcaaactggaataacatctga

SEQ ID NO: 1332690 - DNA, 22 bp, Artificial Sequence
  chemically synthesized
tcaaactggaataacatctgaa

SEQ ID NO: 1332691 - DNA, 22 bp, Artificial Sequence
  chemically synthesized
gaataacatctgaattaaaata

SEQ ID NO: 1332692 - DNA, 22 bp, Artificial Sequence
  chemically synthesized
atgacaatgtcacattatttta

SEQ ID NO: 1332693 - DNA, 22 bp, Artificial Sequence
  chemically synthesized
gatgacaatgtcacattatttt

SEQ ID NO: 1332694 - DNA, 22 bp, Artificial Sequence
  chemically synthesized
tgatgacaatgtcacattattt

SEQ ID NO: 1332695 - DNA, 22 bp, Artificial Sequence
  chemically synthesized
aattaaaataatgtgacattgt

SEQ ID NO: 1332696 - DNA, 22 bp, Artificial Sequence
  chemically synthesized
aaataatgtgacattgtcatca

SEQ ID NO: 1332697 - DNA, 22 bp, Artificial Sequence
  chemically synthesized
agcaataatcagagctttgatg

SEQ ID NO: 1332698 - DNA, 22 bp, Artificial Sequence
  chemically synthesized
cagcaataatcagagctttgat

SEQ ID NO: 1332699 - DNA, 22 bp, Artificial Sequence
  chemically synthesized
tcatcaaagctctgattattgc

SEQ ID NO: 1332700 - DNA, 22 bp, Artificial Sequence
  chemically synthesized
tcacatgcttcagcaataatca

SEQ ID NO: 1332701 - DNA, 22 bp, Artificial Sequence
  chemically synthesized
cctatcacatgcttcagcaata

SEQ ID NO: 1332702 - DNA, 22 bp, Artificial Sequence
  chemically synthesized
tgattattgctgaagcatgtga

SEQ ID NO: 1332703 - DNA, 22 bp, Artificial Sequence
  chemically synthesized
attattgctgaagcatgtgata

SEQ ID NO: 1332704 - DNA, 22 bp, Artificial Sequence
  chemically synthesized
gccagtcctacctatcacatgc

SEQ ID NO: 1332705 - DNA, 22 bp, Artificial Sequence
  chemically synthesized
ggccagtcctacctatcacatg

SEQ ID NO: 1332706 - DNA, 22 bp, Artificial Sequence
  chemically synthesized
tggccagtcctacctatcacat

SEQ ID NO: 1332707 - DNA, 22 bp, Artificial Sequence
  chemically synthesized
ttggccagtcctacctatcaca

SEQ ID NO: 1332708 - DNA, 22 bp, Artificial Sequence
  chemically synthesized
ttgctgaagcatgtgataggta

SEQ ID NO: 1332709 - DNA, 22 bp, Artificial Sequence
  chemically synthesized
ctgaagcatgtgataggtagga

SEQ ID NO: 1332710 - DNA, 22 bp, Artificial Sequence
  chemically synthesized
atttttggccagtcctacctat

SEQ ID NO: 1332711 - DNA, 22 bp, Artificial Sequence
  chemically synthesized
aagcatgtgataggtaggactg

SEQ ID NO: 1332712 - DNA, 22 bp, Artificial Sequence
  chemically synthesized
atgtattaatttttggccagtc

SEQ ID NO: 1332713 - DNA, 22 bp, Artificial Sequence
  chemically synthesized
taatgtattaatttttggccag

SEQ ID NO: 1332714 - DNA, 22 bp, Artificial Sequence
  chemically synthesized
ctaatgtattaatttttggcca

SEQ ID NO: 1332715 - DNA, 22 bp, Artificial Sequence
  chemically synthesized
tctaatgtattaatttttggcc

SEQ ID NO: 1332716 - DNA, 22 bp, Artificial Sequence
  chemically synthesized
ttctaatgtattaatttttggc

SEQ ID NO: 1332717 - DNA, 22 bp, Artificial Sequence
  chemically synthesized
acttttctaatgtattaatttt

SEQ ID NO: 1332718 - DNA, 22 bp, Artificial Sequence
  chemically synthesized
aacttttctaatgtattaattt

SEQ ID NO: 1332719 - DNA, 22 bp, Artificial Sequence
  chemically synthesized
tttaacttttctaatgtattaa

SEQ ID NO: 1332720 - DNA, 22 bp, Artificial Sequence
  chemically synthesized
atttaacttttctaatgtatta

SEQ ID NO: 1332721 - DNA, 22 bp, Artificial Sequence
  chemically synthesized
tatttaacttttctaatgtatt

SEQ ID NO: 1332722 - DNA, 22 bp, Artificial Sequence
  chemically synthesized
ttatttaacttttctaatgtat

SEQ ID NO: 1332723 - DNA, 22 bp, Artificial Sequence
  chemically synthesized
gccaaaaattaatacattagaa

SEQ ID NO: 1332724 - DNA, 22 bp, Artificial Sequence
  chemically synthesized
tttatttaacttttctaatgta

SEQ ID NO: 1332725 - DNA, 22 bp, Artificial Sequence
  chemically synthesized
ttttttatttaacttttctaat

SEQ ID NO: 1332726 - DNA, 22 bp, Artificial Sequence
  chemically synthesized
atacattagaaaagttaaataa

SEQ ID NO: 1332727 - DNA, 22 bp, Artificial Sequence
  chemically synthesized
gaaaagttaaataaaaaataat

SEQ ID NO: 1332728 - DNA, 22 bp, Artificial Sequence
  chemically synthesized
aacatatcaaggaaatatatat

SEQ ID NO: 1332729 - DNA, 22 bp, Artificial Sequence
  chemically synthesized
aataaaaaataatatatatttc

SEQ ID NO: 1332730 - DNA, 22 bp, Artificial Sequence
  chemically synthesized
attaaacatatcaaggaaatat

SEQ ID NO: 1332731 - DNA, 22 bp, Artificial Sequence
  chemically synthesized
gattaaacatatcaaggaaata

SEQ ID NO: 1332732 - DNA, 22 bp, Artificial Sequence
  chemically synthesized
tgattaaacatatcaaggaaat

SEQ ID NO: 1332733 - DNA, 22 bp, Artificial Sequence
  chemically synthesized
ttgattaaacatatcaaggaaa

SEQ ID NO: 1332734 - DNA, 22 bp, Artificial Sequence
  chemically synthesized
catgtttttgattaaacatatc

SEQ ID NO: 1332735 - DNA, 22 bp, Artificial Sequence
  chemically synthesized
tccatgtttttgattaaacata

SEQ ID NO: 1332736 - DNA, 22 bp, Artificial Sequence
  chemically synthesized
ctccatgtttttgattaaacat

SEQ ID NO: 1332737 - DNA, 22 bp, Artificial Sequence
  chemically synthesized
tctccatgtttttgattaaaca

SEQ ID NO: 1332738 - DNA, 22 bp, Artificial Sequence
  chemically synthesized
ttttctccatgtttttgattaa

SEQ ID NO: 1332739 - DNA, 22 bp, Artificial Sequence
  chemically synthesized
ccttgatatgtttaatcaaaaa

SEQ ID NO: 1332740 - DNA, 22 bp, Artificial Sequence
  chemically synthesized
cttgatatgtttaatcaaaaac

SEQ ID NO: 1332741 - DNA, 22 bp, Artificial Sequence
  chemically synthesized
gatatgtttaatcaaaaacatg

SEQ ID NO: 1332742 - DNA, 22 bp, Artificial Sequence
  chemically synthesized
atatgtttaatcaaaaacatgg

SEQ ID NO: 1332743 - DNA, 22 bp, Artificial Sequence
  chemically synthesized
caattattttctccatgttttt

SEQ ID NO: 1332744 - DNA, 22 bp, Artificial Sequence
  chemically synthesized
ttacaattattttctccatgtt

SEQ ID NO: 1332745 - DNA, 22 bp, Artificial Sequence
  chemically synthesized
attacaattattttctccatgt

SEQ ID NO: 1332746 - DNA, 22 bp, Artificial Sequence
  chemically synthesized
tattacaattattttctccatg

SEQ ID NO: 1332747 - DNA, 22 bp, Artificial Sequence
  chemically synthesized
ttattacaattattttctccat

SEQ ID NO: 1332748 - DNA, 22 bp, Artificial Sequence
  chemically synthesized
aatcaaaaacatggagaaaata

SEQ ID NO: 1332749 - DNA, 22 bp, Artificial Sequence
  chemically synthesized
atcaaaaacatggagaaaataa

SEQ ID NO: 1332750 - DNA, 22 bp, Artificial Sequence
  chemically synthesized
aggatgtagacatttttattac

SEQ ID NO: 1332751 - DNA, 22 bp, Artificial Sequence
  chemically synthesized
aaggatgtagacatttttatta

SEQ ID NO: 1332752 - DNA, 22 bp, Artificial Sequence
  chemically synthesized
taaggatgtagacatttttatt

SEQ ID NO: 1332753 - DNA, 22 bp, Artificial Sequence
  chemically synthesized
taataaaaatgtctacatcctt

SEQ ID NO: 1332754 - DNA, 22 bp, Artificial Sequence
  chemically synthesized
ggggtgaacatgcctttaagga

SEQ ID NO: 1332755 - DNA, 22 bp, Artificial Sequence
  chemically synthesized
agagttaggggtgaacatgcct

SEQ ID NO: 1332756 - DNA, 22 bp, Artificial Sequence
  chemically synthesized
catccttaaaggcatgttcacc

SEQ ID NO: 1332757 - DNA, 22 bp, Artificial Sequence
  chemically synthesized
gtaactgagagttaggggtgaa

SEQ ID NO: 1332758 - DNA, 22 bp, Artificial Sequence
  chemically synthesized
aaaggcatgttcacccctaact

SEQ ID NO: 1332759 - DNA, 22 bp, Artificial Sequence
  chemically synthesized
aaggcatgttcacccctaactc

SEQ ID NO: 1332760 - DNA, 22 bp, Artificial Sequence
  chemically synthesized
gatgttcgtaactgagagttag

SEQ ID NO: 1332761 - DNA, 22 bp, Artificial Sequence
  chemically synthesized
atctagatgttcgtaactgaga

SEQ ID NO: 1332762 - DNA, 22 bp, Artificial Sequence
  chemically synthesized
aatctagatgttcgtaactgag

SEQ ID NO: 1332763 - DNA, 22 bp, Artificial Sequence
  chemically synthesized
acccctaactctcagttacgaa

SEQ ID NO: 1332764 - DNA, 22 bp, Artificial Sequence
  chemically synthesized
actctcagttacgaacatctag

SEQ ID NO: 1332765 - DNA, 22 bp, Artificial Sequence
  chemically synthesized
atgaaatttaatctagatgttc

SEQ ID NO: 1332766 - DNA, 22 bp, Artificial Sequence
  chemically synthesized
aatgaaatttaatctagatgtt

SEQ ID NO: 1332767 - DNA, 22 bp, Artificial Sequence
  chemically synthesized
taatgaaatttaatctagatgt

SEQ ID NO: 1332768 - DNA, 22 bp, Artificial Sequence
  chemically synthesized
ttaatgaaatttaatctagatg

SEQ ID NO: 1332769 - DNA, 22 bp, Artificial Sequence
  chemically synthesized
tcagttacgaacatctagatta

SEQ ID NO: 1332770 - DNA, 22 bp, Artificial Sequence
  chemically synthesized
agttacgaacatctagattaaa

SEQ ID NO: 1332771 - DNA, 22 bp, Artificial Sequence
  chemically synthesized
acttttaatgaaatttaatcta

SEQ ID NO: 1332772 - DNA, 22 bp, Artificial Sequence
  chemically synthesized
cgaacatctagattaaatttca

SEQ ID NO: 1332773 - DNA, 22 bp, Artificial Sequence
  chemically synthesized
atatggataattgacttttaat

SEQ ID NO: 1332774 - DNA, 22 bp, Artificial Sequence
  chemically synthesized
gattaaatttcattaaaagtca

SEQ ID NO: 1332775 - DNA, 22 bp, Artificial Sequence
  chemically synthesized
aatatggataattgacttttaa

SEQ ID NO: 1332776 - DNA, 22 bp, Artificial Sequence
  chemically synthesized
aatttcattaaaagtcaattat

SEQ ID NO: 1332777 - DNA, 22 bp, Artificial Sequence
  chemically synthesized
aatgtttaatatggataattga

SEQ ID NO: 1332778 - DNA, 22 bp, Artificial Sequence
  chemically synthesized
cattaaaagtcaattatccata

SEQ ID NO: 1332779 - DNA, 22 bp, Artificial Sequence
  chemically synthesized
attaaaagtcaattatccatat

SEQ ID NO: 1332780 - DNA, 22 bp, Artificial Sequence
  chemically synthesized
gattaaatgtttaatatggata

SEQ ID NO: 1332781 - DNA, 22 bp, Artificial Sequence
  chemically synthesized
agattaaatgtttaatatggat

SEQ ID NO: 1332782 - DNA, 22 bp, Artificial Sequence
  chemically synthesized
aaagtcaattatccatattaaa

SEQ ID NO: 1332783 - DNA, 22 bp, Artificial Sequence
  chemically synthesized
tccatattaaacatttaatcta

SEQ ID NO: 1332784 - DNA, 22 bp, Artificial Sequence
  chemically synthesized
atggggcgcaacgtttagatta

SEQ ID NO: 1332785 - DNA, 22 bp, Artificial Sequence
  chemically synthesized
taatggggcgcaacgtttagat

SEQ ID NO: 1332786 - DNA, 22 bp, Artificial Sequence
  chemically synthesized
aacatttaatctaaacgttgcg

SEQ ID NO: 1332787 - DNA, 22 bp, Artificial Sequence
  chemically synthesized
atgtattctaatggggcgcaac

SEQ ID NO: 1332788 - DNA, 22 bp, Artificial Sequence
  chemically synthesized
gatgtattctaatggggcgcaa

SEQ ID NO: 1332789 - DNA, 22 bp, Artificial Sequence
  chemically synthesized
tgatgtattctaatggggcgca

SEQ ID NO: 1332790 - DNA, 22 bp, Artificial Sequence
  chemically synthesized
aatctaaacgttgcgccccatt

SEQ ID NO: 1332791 - DNA, 22 bp, Artificial Sequence
  chemically synthesized
ttgatgtattctaatggggcgc

SEQ ID NO: 1332792 - DNA, 22 bp, Artificial Sequence
  chemically synthesized
atctaaacgttgcgccccatta

SEQ ID NO: 1332793 - DNA, 22 bp, Artificial Sequence
  chemically synthesized
aacgttgcgccccattagaata

SEQ ID NO: 1332794 - DNA, 22 bp, Artificial Sequence
  chemically synthesized
cgccccattagaatacatcaaa

SEQ ID NO: 1332795 - DNA, 22 bp, Artificial Sequence
  chemically synthesized
gtaaaatgtaagcttttgatgt

SEQ ID NO: 1332796 - DNA, 22 bp, Artificial Sequence
  chemically synthesized
agtaaaatgtaagcttttgatg

SEQ ID NO: 1332797 - DNA, 22 bp, Artificial Sequence
  chemically synthesized
tagtaaaatgtaagcttttgat

SEQ ID NO: 1332798 - DNA, 22 bp, Artificial Sequence
  chemically synthesized
ttagtaaaatgtaagcttttga

SEQ ID NO: 1332799 - DNA, 22 bp, Artificial Sequence
  chemically synthesized
ttttagtaaaatgtaagctttt

SEQ ID NO: 1332800 - DNA, 22 bp, Artificial Sequence
  chemically synthesized
cttttagtaaaatgtaagcttt

SEQ ID NO: 1332801 - DNA, 22 bp, Artificial Sequence
  chemically synthesized
tcttttagtaaaatgtaagctt

SEQ ID NO: 1332802 - DNA, 22 bp, Artificial Sequence
  chemically synthesized
gaatacatcaaaagcttacatt

SEQ ID NO: 1332803 - DNA, 22 bp, Artificial Sequence
  chemically synthesized
tagtcactttcttttagtaaaa

SEQ ID NO: 1332804 - DNA, 22 bp, Artificial Sequence
  chemically synthesized
attgtagtcactttcttttagt

SEQ ID NO: 1332805 - DNA, 22 bp, Artificial Sequence
  chemically synthesized
attcattgtagtcactttcttt

SEQ ID NO: 1332806 - DNA, 22 bp, Artificial Sequence
  chemically synthesized
acattttactaaaagaaagtga

SEQ ID NO: 1332807 - DNA, 22 bp, Artificial Sequence
  chemically synthesized
cattttactaaaagaaagtgac

SEQ ID NO: 1332808 - DNA, 22 bp, Artificial Sequence
  chemically synthesized
tactaaaagaaagtgactacaa

SEQ ID NO: 1332809 - DNA, 22 bp, Artificial Sequence
  chemically synthesized
tatgttcattcattgtagtcac

SEQ ID NO: 1332810 - DNA, 22 bp, Artificial Sequence
  chemically synthesized
actaaaagaaagtgactacaat

SEQ ID NO: 1332811 - DNA, 22 bp, Artificial Sequence
  chemically synthesized
ctaaaagaaagtgactacaatg

SEQ ID NO: 1332812 - DNA, 22 bp, Artificial Sequence
  chemically synthesized
aaagaaagtgactacaatgaat

SEQ ID NO: 1332813 - DNA, 22 bp, Artificial Sequence
  chemically synthesized
taaagttatatgttcattcatt

SEQ ID NO: 1332814 - DNA, 22 bp, Artificial Sequence
  chemically synthesized
ctataaagttatatgttcattc

SEQ ID NO: 1332815 - DNA, 22 bp, Artificial Sequence
  chemically synthesized
gctataaagttatatgttcatt

SEQ ID NO: 1332816 - DNA, 22 bp, Artificial Sequence
  chemically synthesized
tgctataaagttatatgttcat

SEQ ID NO: 1332817 - DNA, 22 bp, Artificial Sequence
  chemically synthesized
caatgaatgaacatataacttt

SEQ ID NO: 1332818 - DNA, 22 bp, Artificial Sequence
  chemically synthesized
taacctttgctataaagttata

SEQ ID NO: 1332819 - DNA, 22 bp, Artificial Sequence
  chemically synthesized
aaaaattataacctttgctata

SEQ ID NO: 1332820 - DNA, 22 bp, Artificial Sequence
  chemically synthesized
tatagcaaaggttataattttt

SEQ ID NO: 1332821 - DNA, 22 bp, Artificial Sequence
  chemically synthesized
atagcaaaggttataatttttg

SEQ ID NO: 1332822 - DNA, 22 bp, Artificial Sequence
  chemically synthesized
aagtcaaacattcaaaaattat

SEQ ID NO: 1332823 - DNA, 22 bp, Artificial Sequence
  chemically synthesized
tagcaaaggttataatttttga

SEQ ID NO: 1332824 - DNA, 22 bp, Artificial Sequence
  chemically synthesized
acaactaaagtcaaacattcaa

SEQ ID NO: 1332825 - DNA, 22 bp, Artificial Sequence
  chemically synthesized
taatttttgaatgtttgacttt

SEQ ID NO: 1332826 - DNA, 22 bp, Artificial Sequence
  chemically synthesized
aaaatgttaacaactaaagtca

SEQ ID NO: 1332827 - DNA, 22 bp, Artificial Sequence
  chemically synthesized
aaaaatgttaacaactaaagtc

SEQ ID NO: 1332828 - DNA, 22 bp, Artificial Sequence
  chemically synthesized
taaaaatgttaacaactaaagt

SEQ ID NO: 1332829 - DNA, 22 bp, Artificial Sequence
  chemically synthesized
ttgaatgtttgactttagttgt

SEQ ID NO: 1332830 - DNA, 22 bp, Artificial Sequence
  chemically synthesized
tgaatgtttgactttagttgtt

SEQ ID NO: 1332831 - DNA, 22 bp, Artificial Sequence
  chemically synthesized
gaatgtttgactttagttgtta

SEQ ID NO: 1332832 - DNA, 22 bp, Artificial Sequence
  chemically synthesized
aatgtttgactttagttgttaa

SEQ ID NO: 1332833 - DNA, 22 bp, Artificial Sequence
  chemically synthesized
gaacgtctttaaaaatgttaac

SEQ ID NO: 1332834 - DNA, 22 bp, Artificial Sequence
  chemically synthesized
gactttagttgttaacattttt

SEQ ID NO: 1332835 - DNA, 22 bp, Artificial Sequence
  chemically synthesized
actttagttgttaacattttta

SEQ ID NO: 1332836 - DNA, 22 bp, Artificial Sequence
  chemically synthesized
tagttgttaacatttttaaaga

SEQ ID NO: 1332837 - DNA, 22 bp, Artificial Sequence
  chemically synthesized
agttgttaacatttttaaagac

SEQ ID NO: 1332838 - DNA, 22 bp, Artificial Sequence
  chemically synthesized
gttgttaacatttttaaagacg

SEQ ID NO: 1332839 - DNA, 22 bp, Artificial Sequence
  chemically synthesized
gtaaaaaattagaacgtcttta

SEQ ID NO: 1332840 - DNA, 22 bp, Artificial Sequence
  chemically synthesized
cgtaaaaaattagaacgtcttt

SEQ ID NO: 1332841 - DNA, 22 bp, Artificial Sequence
  chemically synthesized
ttaacatttttaaagacgttct

SEQ ID NO: 1332842 - DNA, 22 bp, Artificial Sequence
  chemically synthesized
acatttttaaagacgttctaat

SEQ ID NO: 1332843 - DNA, 22 bp, Artificial Sequence
  chemically synthesized
taatgcttcgtaaaaaattaga

SEQ ID NO: 1332844 - DNA, 22 bp, Artificial Sequence
  chemically synthesized
ttaaagacgttctaatttttta

SEQ ID NO: 1332845 - DNA, 22 bp, Artificial Sequence
  chemically synthesized
taaagacgttctaattttttac

SEQ ID NO: 1332846 - DNA, 22 bp, Artificial Sequence
  chemically synthesized
aaagacgttctaattttttacg

SEQ ID NO: 1332847 - DNA, 22 bp, Artificial Sequence
  chemically synthesized
attataatgcttcgtaaaaaat

SEQ ID NO: 1332848 - DNA, 22 bp, Artificial Sequence
  chemically synthesized
aagacgttctaattttttacga

SEQ ID NO: 1332849 - DNA, 22 bp, Artificial Sequence
  chemically synthesized
aattataatgcttcgtaaaaaa

SEQ ID NO: 1332850 - DNA, 22 bp, Artificial Sequence
  chemically synthesized
cttaattataatgcttcgtaaa

SEQ ID NO: 1332851 - DNA, 22 bp, Artificial Sequence
  chemically synthesized
gcttaattataatgcttcgtaa

SEQ ID NO: 1332852 - DNA, 22 bp, Artificial Sequence
  chemically synthesized
tgcttaattataatgcttcgta

SEQ ID NO: 1332853 - DNA, 22 bp, Artificial Sequence
  chemically synthesized
taattttttacgaagcattata

SEQ ID NO: 1332854 - DNA, 22 bp, Artificial Sequence
  chemically synthesized
attttttacgaagcattataat

SEQ ID NO: 1332855 - DNA, 22 bp, Artificial Sequence
  chemically synthesized
gatattttgcttaattataatg

SEQ ID NO: 1332856 - DNA, 22 bp, Artificial Sequence
  chemically synthesized
tttacgaagcattataattaag

SEQ ID NO: 1332857 - DNA, 22 bp, Artificial Sequence
  chemically synthesized
ttacgaagcattataattaagc

SEQ ID NO: 1332858 - DNA, 22 bp, Artificial Sequence
  chemically synthesized
tacgaagcattataattaagca

SEQ ID NO: 1332859 - DNA, 22 bp, Artificial Sequence
  chemically synthesized
acgaagcattataattaagcaa

SEQ ID NO: 1332860 - DNA, 22 bp, Artificial Sequence
  chemically synthesized
cgaagcattataattaagcaaa

SEQ ID NO: 1332861 - DNA, 22 bp, Artificial Sequence
  chemically synthesized
tgaaaaaactggatattttgct

SEQ ID NO: 1332862 - DNA, 22 bp, Artificial Sequence
  chemically synthesized
taattaagcaaaatatccagtt

SEQ ID NO: 1332863 - DNA, 22 bp, Artificial Sequence
  chemically synthesized
aaactatgaaaaaactggatat

SEQ ID NO: 1332864 - DNA, 22 bp, Artificial Sequence
  chemically synthesized
agcaaaatatccagttttttca

SEQ ID NO: 1332865 - DNA, 22 bp, Artificial Sequence
  chemically synthesized
aaaactgaaactatgaaaaaac

SEQ ID NO: 1332866 - DNA, 22 bp, Artificial Sequence
  chemically synthesized
gaaaactgaaactatgaaaaaa

SEQ ID NO: 1332867 - DNA, 22 bp, Artificial Sequence
  chemically synthesized
tttcatagtttcagttttcaaa

SEQ ID NO: 1332868 - DNA, 22 bp, Artificial Sequence
  chemically synthesized
ccaaagccacagtttgaaaact

SEQ ID NO: 1332869 - DNA, 22 bp, Artificial Sequence
  chemically synthesized
ttcatagtttcagttttcaaac

SEQ ID NO: 1332870 - DNA, 22 bp, Artificial Sequence
  chemically synthesized
accaaagccacagtttgaaaac

SEQ ID NO: 1332871 - DNA, 22 bp, Artificial Sequence
  chemically synthesized
tcatagtttcagttttcaaact

SEQ ID NO: 1332872 - DNA, 22 bp, Artificial Sequence
  chemically synthesized
catagtttcagttttcaaactg

SEQ ID NO: 1332873 - DNA, 22 bp, Artificial Sequence
  chemically synthesized
atagtttcagttttcaaactgt

SEQ ID NO: 1332874 - DNA, 22 bp, Artificial Sequence
  chemically synthesized
ccttaccaaagccacagtttga

SEQ ID NO: 1332875 - DNA, 22 bp, Artificial Sequence
  chemically synthesized
accttaccaaagccacagtttg

SEQ ID NO: 1332876 - DNA, 22 bp, Artificial Sequence
  chemically synthesized
cagttttcaaactgtggctttg

SEQ ID NO: 1332877 - DNA, 22 bp, Artificial Sequence
  chemically synthesized
agttttcaaactgtggctttgg

SEQ ID NO: 1332878 - DNA, 22 bp, Artificial Sequence
  chemically synthesized
caacttaccttaccaaagccac

SEQ ID NO: 1332879 - DNA, 22 bp, Artificial Sequence
  chemically synthesized
ccaacttaccttaccaaagcca

SEQ ID NO: 1332880 - DNA, 22 bp, Artificial Sequence
  chemically synthesized
tccaacttaccttaccaaagcc

SEQ ID NO: 1332881 - DNA, 22 bp, Artificial Sequence
  chemically synthesized
tcaaactgtggctttggtaagg

SEQ ID NO: 1332882 - DNA, 22 bp, Artificial Sequence
  chemically synthesized
caaactgtggctttggtaaggt

SEQ ID NO: 1332883 - DNA, 22 bp, Artificial Sequence
  chemically synthesized
aaactgtggctttggtaaggta

SEQ ID NO: 1332884 - DNA, 22 bp, Artificial Sequence
  chemically synthesized
agatgttttccaacttacctta

SEQ ID NO: 1332885 - DNA, 22 bp, Artificial Sequence
  chemically synthesized
tggctttggtaaggtaagttgg

SEQ ID NO: 1332886 - DNA, 22 bp, Artificial Sequence
  chemically synthesized
aaactaagatgttttccaactt

SEQ ID NO: 1332887 - DNA, 22 bp, Artificial Sequence
  chemically synthesized
tggtaaggtaagttggaaaaca

SEQ ID NO: 1332888 - DNA, 22 bp, Artificial Sequence
  chemically synthesized
ggtaaggtaagttggaaaacat

SEQ ID NO: 1332889 - DNA, 22 bp, Artificial Sequence
  chemically synthesized
gtaaggtaagttggaaaacatc

SEQ ID NO: 1332890 - DNA, 22 bp, Artificial Sequence
  chemically synthesized
ggccattaaaactaagatgttt

SEQ ID NO: 1332891 - DNA, 22 bp, Artificial Sequence
  chemically synthesized
gggccattaaaactaagatgtt

SEQ ID NO: 1332892 - DNA, 22 bp, Artificial Sequence
  chemically synthesized
tgggccattaaaactaagatgt

SEQ ID NO: 1332893 - DNA, 22 bp, Artificial Sequence
  chemically synthesized
ttgggccattaaaactaagatg

SEQ ID NO: 1332894 - DNA, 22 bp, Artificial Sequence
  chemically synthesized
cccttttgggccattaaaacta

SEQ ID NO: 1332895 - DNA, 22 bp, Artificial Sequence
  chemically synthesized
gaaaacatcttagttttaatgg

SEQ ID NO: 1332896 - DNA, 22 bp, Artificial Sequence
  chemically synthesized
agttttaatggcccaaaagggg

SEQ ID NO: 1332897 - DNA, 22 bp, Artificial Sequence
  chemically synthesized
gttttaatggcccaaaagggga

SEQ ID NO: 1332898 - DNA, 22 bp, Artificial Sequence
  chemically synthesized
tacatcaaagtctccccttttg

SEQ ID NO: 1332899 - DNA, 22 bp, Artificial Sequence
  chemically synthesized
taatggcccaaaaggggagact

SEQ ID NO: 1332900 - DNA, 22 bp, Artificial Sequence
  chemically synthesized
aatggcccaaaaggggagactt

SEQ ID NO: 1332901 - DNA, 22 bp, Artificial Sequence
  chemically synthesized
tactatacatcaaagtctcccc

SEQ ID NO: 1332902 - DNA, 22 bp, Artificial Sequence
  chemically synthesized
atggcccaaaaggggagacttt

SEQ ID NO: 1332903 - DNA, 22 bp, Artificial Sequence
  chemically synthesized
aatctatactatacatcaaagt

SEQ ID NO: 1332904 - DNA, 22 bp, Artificial Sequence
  chemically synthesized
gaatctatactatacatcaaag

SEQ ID NO: 1332905 - DNA, 22 bp, Artificial Sequence
  chemically synthesized
tgatgtatagtatagattcaag

SEQ ID NO: 1332906 - DNA, 22 bp, Artificial Sequence
  chemically synthesized
gatgtatagtatagattcaagt

SEQ ID NO: 1332907 - DNA, 22 bp, Artificial Sequence
  chemically synthesized
atgtatagtatagattcaagtg

SEQ ID NO: 1332908 - DNA, 22 bp, Artificial Sequence
  chemically synthesized
aagtgcttatctcatggatcat

SEQ ID NO: 1332909 - DNA, 22 bp, Artificial Sequence
  chemically synthesized
gtaaaatgaaagcatgatccat

SEQ ID NO: 1332910 - DNA, 22 bp, Artificial Sequence
  chemically synthesized
agtaaaatgaaagcatgatcca

SEQ ID NO: 1332911 - DNA, 22 bp, Artificial Sequence
  chemically synthesized
tagtaaaatgaaagcatgatcc

SEQ ID NO: 1332912 - DNA, 22 bp, Artificial Sequence
  chemically synthesized
ttagtaaaatgaaagcatgatc

SEQ ID NO: 1332913 - DNA, 22 bp, Artificial Sequence
  chemically synthesized
atctcatggatcatgctttcat

SEQ ID NO: 1332914 - DNA, 22 bp, Artificial Sequence
  chemically synthesized
tctcatggatcatgctttcatt

SEQ ID NO: 1332915 - DNA, 22 bp, Artificial Sequence
  chemically synthesized
tatttttagtaaaatgaaagca

SEQ ID NO: 1332916 - DNA, 22 bp, Artificial Sequence
  chemically synthesized
ttatatttttagtaaaatgaaa

SEQ ID NO: 1332917 - DNA, 22 bp, Artificial Sequence
  chemically synthesized
atggatcatgctttcattttac

SEQ ID NO: 1332918 - DNA, 22 bp, Artificial Sequence
  chemically synthesized
gtctattatatttttagtaaaa

SEQ ID NO: 1332919 - DNA, 22 bp, Artificial Sequence
  chemically synthesized
agtctattatatttttagtaaa

SEQ ID NO: 1332920 - DNA, 22 bp, Artificial Sequence
  chemically synthesized
tagtctattatatttttagtaa

SEQ ID NO: 1332921 - DNA, 22 bp, Artificial Sequence
  chemically synthesized
tcattttactaaaaatataata

SEQ ID NO: 1332922 - DNA, 22 bp, Artificial Sequence
  chemically synthesized
cattttactaaaaatataatag

SEQ ID NO: 1332923 - DNA, 22 bp, Artificial Sequence
  chemically synthesized
attttactaaaaatataataga

SEQ ID NO: 1332924 - DNA, 22 bp, Artificial Sequence
  chemically synthesized
tgtaaagttttagtctattata

SEQ ID NO: 1332925 - DNA, 22 bp, Artificial Sequence
  chemically synthesized
tactaaaaatataatagactaa

SEQ ID NO: 1332926 - DNA, 22 bp, Artificial Sequence
  chemically synthesized
actaaaaatataatagactaaa

SEQ ID NO: 1332927 - DNA, 22 bp, Artificial Sequence
  chemically synthesized
cctatgtaaagttttagtctat

SEQ ID NO: 1332928 - DNA, 22 bp, Artificial Sequence
  chemically synthesized
ctaaaaatataatagactaaaa

SEQ ID NO: 1332929 - DNA, 22 bp, Artificial Sequence
  chemically synthesized
tccctatgtaaagttttagtct

SEQ ID NO: 1332930 - DNA, 22 bp, Artificial Sequence
  chemically synthesized
ctccctatgtaaagttttagtc

SEQ ID NO: 1332931 - DNA, 22 bp, Artificial Sequence
  chemically synthesized
aaaatataatagactaaaactt

SEQ ID NO: 1332932 - DNA, 22 bp, Artificial Sequence
  chemically synthesized
cgatttctccctatgtaaagtt

SEQ ID NO: 1332933 - DNA, 22 bp, Artificial Sequence
  chemically synthesized
tgcgatttctccctatgtaaag

SEQ ID NO: 1332934 - DNA, 22 bp, Artificial Sequence
  chemically synthesized
tctgcgatttctccctatgtaa

SEQ ID NO: 1332935 - DNA, 22 bp, Artificial Sequence
  chemically synthesized
ttctctgcgatttctccctatg

SEQ ID NO: 1332936 - DNA, 22 bp, Artificial Sequence
  chemically synthesized
attctctgcgatttctccctat

SEQ ID NO: 1332937 - DNA, 22 bp, Artificial Sequence
  chemically synthesized
ttattctctgcgatttctccct

SEQ ID NO: 1332938 - DNA, 22 bp, Artificial Sequence
  chemically synthesized
aaactttacatagggagaaatc

SEQ ID NO: 1332939 - DNA, 22 bp, Artificial Sequence
  chemically synthesized
attcttattctctgcgatttct

SEQ ID NO: 1332940 - DNA, 22 bp, Artificial Sequence
  chemically synthesized
gattcttattctctgcgatttc

SEQ ID NO: 1332941 - DNA, 22 bp, Artificial Sequence
  chemically synthesized
tgattcttattctctgcgattt

SEQ ID NO: 1332942 - DNA, 22 bp, Artificial Sequence
  chemically synthesized
tacatagggagaaatcgcagag

SEQ ID NO: 1332943 - DNA, 22 bp, Artificial Sequence
  chemically synthesized
acatagggagaaatcgcagaga

SEQ ID NO: 1332944 - DNA, 22 bp, Artificial Sequence
  chemically synthesized
catagggagaaatcgcagagaa

SEQ ID NO: 1332945 - DNA, 22 bp, Artificial Sequence
  chemically synthesized
ctttgattcttattctctgcga

SEQ ID NO: 1332946 - DNA, 22 bp, Artificial Sequence
  chemically synthesized
ctcctttgattcttattctctg

SEQ ID NO: 1332947 - DNA, 22 bp, Artificial Sequence
  chemically synthesized
attactcctttgattcttattc

SEQ ID NO: 1332948 - DNA, 22 bp, Artificial Sequence
  chemically synthesized
aattactcctttgattcttatt

SEQ ID NO: 1332949 - DNA, 22 bp, Artificial Sequence
  chemically synthesized
taattactcctttgattcttat

SEQ ID NO: 1332950 - DNA, 22 bp, Artificial Sequence
  chemically synthesized
ttaattactcctttgattctta

SEQ ID NO: 1332951 - DNA, 22 bp, Artificial Sequence
  chemically synthesized
aatttttaattactcctttgat

SEQ ID NO: 1332952 - DNA, 22 bp, Artificial Sequence
  chemically synthesized
ccaaaaccctcaatttttaatt

SEQ ID NO: 1332953 - DNA, 22 bp, Artificial Sequence
  chemically synthesized
agcctcccaaaaccctcaattt

SEQ ID NO: 1332954 - DNA, 22 bp, Artificial Sequence
  chemically synthesized
cctcagcctcccaaaaccctca

SEQ ID NO: 1332955 - DNA, 22 bp, Artificial Sequence
  chemically synthesized
ctgcctcagcctcccaaaaccc

SEQ ID NO: 1332956 - DNA, 22 bp, Artificial Sequence
  chemically synthesized
tcctgcctcagcctcccaaaac

SEQ ID NO: 1332957 - DNA, 22 bp, Artificial Sequence
  chemically synthesized
aaaattgagggttttgggaggc

SEQ ID NO: 1332958 - DNA, 22 bp, Artificial Sequence
  chemically synthesized
agggttttgggaggctgaggca

SEQ ID NO: 1332959 - DNA, 22 bp, Artificial Sequence
  chemically synthesized
aagtgattctcctgcctcagcc

SEQ ID NO: 1332960 - DNA, 22 bp, Artificial Sequence
  chemically synthesized
tgggaggctgaggcaggagaat

SEQ ID NO: 1332961 - DNA, 22 bp, Artificial Sequence
  chemically synthesized
gggaggctgaggcaggagaatc

SEQ ID NO: 1332962 - DNA, 22 bp, Artificial Sequence
  chemically synthesized
ccatgttcaagtgattctcctg

SEQ ID NO: 1332963 - DNA, 22 bp, Artificial Sequence
  chemically synthesized
ggaggctgaggcaggagaatca

SEQ ID NO: 1332964 - DNA, 22 bp, Artificial Sequence
  chemically synthesized
cacctcccatgttcaagtgatt

SEQ ID NO: 1332965 - DNA, 22 bp, Artificial Sequence
  chemically synthesized
aggcaggagaatcacttgaaca

SEQ ID NO: 1332966 - DNA, 22 bp, Artificial Sequence
  chemically synthesized
caacctccacctcccatgttca

SEQ ID NO: 1332967 - DNA, 22 bp, Artificial Sequence
  chemically synthesized
gggtcactgcaacctccacctc

SEQ ID NO: 1332968 - DNA, 22 bp, Artificial Sequence
  chemically synthesized
gaacatgggaggtggaggttgc

SEQ ID NO: 1332969 - DNA, 22 bp, Artificial Sequence
  chemically synthesized
aacatgggaggtggaggttgca

SEQ ID NO: 1332970 - DNA, 22 bp, Artificial Sequence
  chemically synthesized
gagtgcaatggcacgatctcgg

SEQ ID NO: 1332971 - DNA, 22 bp, Artificial Sequence
  chemically synthesized
cagtgacccgagatcgtgccat

SEQ ID NO: 1332972 - DNA, 22 bp, Artificial Sequence
  chemically synthesized
tcacccaggctagagtgcaatg

SEQ ID NO: 1332973 - DNA, 22 bp, Artificial Sequence
  chemically synthesized
tgtcacccaggctagagtgcaa

SEQ ID NO: 1332974 - DNA, 22 bp, Artificial Sequence
  chemically synthesized
gctctgtcacccaggctagagt

SEQ ID NO: 1332975 - DNA, 22 bp, Artificial Sequence
  chemically synthesized
cactctagcctgggtgacagag

SEQ ID NO: 1332976 - DNA, 22 bp, Artificial Sequence
  chemically synthesized
agacggagtctcgctctgtcac

SEQ ID NO: 1332977 - DNA, 22 bp, Artificial Sequence
  chemically synthesized
gagacggagtctcgctctgtca

SEQ ID NO: 1332978 - DNA, 22 bp, Artificial Sequence
  chemically synthesized
ttgagacggagtctcgctctgt

SEQ ID NO: 1332979 - DNA, 22 bp, Artificial Sequence
  chemically synthesized
tagcctgggtgacagagcgaga

SEQ ID NO: 1332980 - DNA, 22 bp, Artificial Sequence
  chemically synthesized
cttgagacggagtctcgctctg

SEQ ID NO: 1332981 - DNA, 22 bp, Artificial Sequence
  chemically synthesized
tcttgagacggagtctcgctct

SEQ ID NO: 1332982 - DNA, 22 bp, Artificial Sequence
  chemically synthesized
gcctgggtgacagagcgagact

SEQ ID NO: 1332983 - DNA, 22 bp, Artificial Sequence
  chemically synthesized
ttcttgagacggagtctcgctc

SEQ ID NO: 1332984 - DNA, 22 bp, Artificial Sequence
  chemically synthesized
tttcttgagacggagtctcgct

SEQ ID NO: 1332985 - DNA, 22 bp, Artificial Sequence
  chemically synthesized
ttttcttgagacggagtctcgc

SEQ ID NO: 1332986 - DNA, 22 bp, Artificial Sequence
  chemically synthesized
tttttcttgagacggagtctcg

SEQ ID NO: 1332987 - DNA, 22 bp, Artificial Sequence
  chemically synthesized
ttttttcttgagacggagtctc

SEQ ID NO: 1332988 - DNA, 22 bp, Artificial Sequence
  chemically synthesized
ggtgacagagcgagactccgtc

SEQ ID NO: 1332989 - DNA, 22 bp, Artificial Sequence
  chemically synthesized
tttttttcttgagacggagtct

SEQ ID NO: 1332990 - DNA, 22 bp, Artificial Sequence
  chemically synthesized
ttttttttcttgagacggagtc

SEQ ID NO: 1332991 - DNA, 22 bp, Artificial Sequence
  chemically synthesized
tttttttttcttgagacggagt

SEQ ID NO: 1332992 - DNA, 22 bp, Artificial Sequence
  chemically synthesized
ttttttttttcttgagacggag

SEQ ID NO: 1332993 - DNA, 22 bp, Artificial Sequence
  chemically synthesized
tttttttttttcttgagacgga

SEQ ID NO: 1332994 - DNA, 22 bp, Artificial Sequence
  chemically synthesized
aattttttttttttttcttgag

SEQ ID NO: 1332995 - DNA, 22 bp, Artificial Sequence
  chemically synthesized
cgtctcaagaaaaaaaaaaaaa

SEQ ID NO: 1332996 - DNA, 22 bp, Artificial Sequence
  chemically synthesized
aagaaaaaaaaaaaaaattgag

SEQ ID NO: 1332997 - DNA, 22 bp, Artificial Sequence
  chemically synthesized
aaatacgtaaaacctcaatttt

SEQ ID NO: 1332998 - DNA, 22 bp, Artificial Sequence
  chemically synthesized
ggtctcaaatacgtaaaacctc

SEQ ID NO: 1332999 - DNA, 22 bp, Artificial Sequence
  chemically synthesized
gtcattaggtctcaaatacgta

SEQ ID NO: 1333000 - DNA, 22 bp, Artificial Sequence
  chemically synthesized
aggttttacgtatttgagacct

SEQ ID NO: 1333001 - DNA, 22 bp, Artificial Sequence
  chemically synthesized
tacgtatttgagacctaatgac

SEQ ID NO: 1333002 - DNA, 22 bp, Artificial Sequence
  chemically synthesized
acgtatttgagacctaatgacc

SEQ ID NO: 1333003 - DNA, 22 bp, Artificial Sequence
  chemically synthesized
cgtatttgagacctaatgacca

SEQ ID NO: 1333004 - DNA, 22 bp, Artificial Sequence
  chemically synthesized
acaaaagtaaacaattggtcat

SEQ ID NO: 1333005 - DNA, 22 bp, Artificial Sequence
  chemically synthesized
ttgacaaaagtaaacaattggt

SEQ ID NO: 1333006 - DNA, 22 bp, Artificial Sequence
  chemically synthesized
gagacctaatgaccaattgttt

SEQ ID NO: 1333007 - DNA, 22 bp, Artificial Sequence
  chemically synthesized
agacctaatgaccaattgttta

SEQ ID NO: 1333008 - DNA, 22 bp, Artificial Sequence
  chemically synthesized
ctgttgacaaaagtaaacaatt

SEQ ID NO: 1333009 - DNA, 22 bp, Artificial Sequence
  chemically synthesized
atgaccaattgtttacttttgt

SEQ ID NO: 1333010 - DNA, 22 bp, Artificial Sequence
  chemically synthesized
gcagtaaaattactgttgacaa

SEQ ID NO: 1333011 - DNA, 22 bp, Artificial Sequence
  chemically synthesized
agcagtaaaattactgttgaca

SEQ ID NO: 1333012 - DNA, 22 bp, Artificial Sequence
  chemically synthesized
cttagcagtaaaattactgttg

SEQ ID NO: 1333013 - DNA, 22 bp, Artificial Sequence
  chemically synthesized
tttacttttgtcaacagtaatt

SEQ ID NO: 1333014 - DNA, 22 bp, Artificial Sequence
  chemically synthesized
acttttgtcaacagtaatttta

SEQ ID NO: 1333015 - DNA, 22 bp, Artificial Sequence
  chemically synthesized
cttttgtcaacagtaattttac

SEQ ID NO: 1333016 - DNA, 22 bp, Artificial Sequence
  chemically synthesized
aattacttagcagtaaaattac

SEQ ID NO: 1333017 - DNA, 22 bp, Artificial Sequence
  chemically synthesized
aaattacttagcagtaaaatta

SEQ ID NO: 1333018 - DNA, 22 bp, Artificial Sequence
  chemically synthesized
ttgtcaacagtaattttactgc

SEQ ID NO: 1333019 - DNA, 22 bp, Artificial Sequence
  chemically synthesized
tgtcaacagtaattttactgct

SEQ ID NO: 1333020 - DNA, 22 bp, Artificial Sequence
  chemically synthesized
cttaaattacttagcagtaaaa

SEQ ID NO: 1333021 - DNA, 22 bp, Artificial Sequence
  chemically synthesized
gtcaacagtaattttactgcta

SEQ ID NO: 1333022 - DNA, 22 bp, Artificial Sequence
  chemically synthesized
tcaacagtaattttactgctaa

SEQ ID NO: 1333023 - DNA, 22 bp, Artificial Sequence
  chemically synthesized
gcagtaaaattacttaaattac

SEQ ID NO: 1333024 - DNA, 22 bp, Artificial Sequence
  chemically synthesized
tactgctaagtaatttaagtaa

SEQ ID NO: 1333025 - DNA, 22 bp, Artificial Sequence
  chemically synthesized
actgctaagtaatttaagtaat

SEQ ID NO: 1333026 - DNA, 22 bp, Artificial Sequence
  chemically synthesized
ctgctaagtaatttaagtaatt

SEQ ID NO: 1333027 - DNA, 22 bp, Artificial Sequence
  chemically synthesized
aaactggcagtaaaattactta

SEQ ID NO: 1333028 - DNA, 22 bp, Artificial Sequence
  chemically synthesized
ctaagtaatttaagtaatttta

SEQ ID NO: 1333029 - DNA, 22 bp, Artificial Sequence
  chemically synthesized
ctgaaactggcagtaaaattac

SEQ ID NO: 1333030 - DNA, 22 bp, Artificial Sequence
  chemically synthesized
agtaatttaagtaattttactg

SEQ ID NO: 1333031 - DNA, 22 bp, Artificial Sequence
  chemically synthesized
ctgctgaaactggcagtaaaat

SEQ ID NO: 1333032 - DNA, 22 bp, Artificial Sequence
  chemically synthesized
tattcctgctgaaactggcagt

SEQ ID NO: 1333033 - DNA, 22 bp, Artificial Sequence
  chemically synthesized
aagtaattttactgccagtttc

SEQ ID NO: 1333034 - DNA, 22 bp, Artificial Sequence
  chemically synthesized
agtaattttactgccagtttca

SEQ ID NO: 1333035 - DNA, 22 bp, Artificial Sequence
  chemically synthesized
ggaaattgtattcctgctgaaa

SEQ ID NO: 1333036 - DNA, 22 bp, Artificial Sequence
  chemically synthesized
tactgccagtttcagcaggaat

SEQ ID NO: 1333037 - DNA, 22 bp, Artificial Sequence
  chemically synthesized
actgccagtttcagcaggaata

SEQ ID NO: 1333038 - DNA, 22 bp, Artificial Sequence
  chemically synthesized
ctgccagtttcagcaggaatac

SEQ ID NO: 1333039 - DNA, 22 bp, Artificial Sequence
  chemically synthesized
tgttaggaaattgtattcctgc

SEQ ID NO: 1333040 - DNA, 22 bp, Artificial Sequence
  chemically synthesized
ccagtttcagcaggaatacaat

SEQ ID NO: 1333041 - DNA, 22 bp, Artificial Sequence
  chemically synthesized
aatatctatgttaggaaattgt

SEQ ID NO: 1333042 - DNA, 22 bp, Artificial Sequence
  chemically synthesized
cagcaggaatacaatttcctaa

SEQ ID NO: 1333043 - DNA, 22 bp, Artificial Sequence
  chemically synthesized
agcaggaatacaatttcctaac

SEQ ID NO: 1333044 - DNA, 22 bp, Artificial Sequence
  chemically synthesized
aataaaatattaaatatctatg

SEQ ID NO: 1333045 - DNA, 22 bp, Artificial Sequence
  chemically synthesized
cctaacatagatatttaatatt

SEQ ID NO: 1333046 - DNA, 22 bp, Artificial Sequence
  chemically synthesized
ctaacatagatatttaatattt

SEQ ID NO: 1333047 - DNA, 22 bp, Artificial Sequence
  chemically synthesized
aaatattgaataaaatattaaa

SEQ ID NO: 1333048 - DNA, 22 bp, Artificial Sequence
  chemically synthesized
acatagatatttaatattttat

SEQ ID NO: 1333049 - DNA, 22 bp, Artificial Sequence
  chemically synthesized
atatattaaaatattgaataaa

SEQ ID NO: 1333050 - DNA, 22 bp, Artificial Sequence
  chemically synthesized
aatattttattcaatattttaa

SEQ ID NO: 1333051 - DNA, 22 bp, Artificial Sequence
  chemically synthesized
aagattaatatattaaaatatt

SEQ ID NO: 1333052 - DNA, 22 bp, Artificial Sequence
  chemically synthesized
atattttattcaatattttaat

SEQ ID NO: 1333053 - DNA, 22 bp, Artificial Sequence
  chemically synthesized
ctaaagattaatatattaaaat

SEQ ID NO: 1333054 - DNA, 22 bp, Artificial Sequence
  chemically synthesized
tactaaagattaatatattaaa

SEQ ID NO: 1333055 - DNA, 22 bp, Artificial Sequence
  chemically synthesized
tattcaatattttaatatatta

SEQ ID NO: 1333056 - DNA, 22 bp, Artificial Sequence
  chemically synthesized
attcaatattttaatatattaa

SEQ ID NO: 1333057 - DNA, 22 bp, Artificial Sequence
  chemically synthesized
ttcaatattttaatatattaat

SEQ ID NO: 1333058 - DNA, 22 bp, Artificial Sequence
  chemically synthesized
aatattttaatatattaatctt

SEQ ID NO: 1333059 - DNA, 22 bp, Artificial Sequence
  chemically synthesized
aagcatatattctactaaagat

SEQ ID NO: 1333060 - DNA, 22 bp, Artificial Sequence
  chemically synthesized
taatatattaatctttagtaga

SEQ ID NO: 1333061 - DNA, 22 bp, Artificial Sequence
  chemically synthesized
aatatattaatctttagtagaa

SEQ ID NO: 1333062 - DNA, 22 bp, Artificial Sequence
  chemically synthesized
atatattaatctttagtagaat

SEQ ID NO: 1333063 - DNA, 22 bp, Artificial Sequence
  chemically synthesized
acaaaattgaagcatatattct

SEQ ID NO: 1333064 - DNA, 22 bp, Artificial Sequence
  chemically synthesized
atctttagtagaatatatgctt

SEQ ID NO: 1333065 - DNA, 22 bp, Artificial Sequence
  chemically synthesized
tagtagaatatatgcttcaatt

SEQ ID NO: 1333066 - DNA, 22 bp, Artificial Sequence
  chemically synthesized
agtagaatatatgcttcaattt

SEQ ID NO: 1333067 - DNA, 22 bp, Artificial Sequence
  chemically synthesized
gtagaatatatgcttcaatttt

SEQ ID NO: 1333068 - DNA, 22 bp, Artificial Sequence
  chemically synthesized
caattttgtgaggatatgtgtt

SEQ ID NO: 1333069 - DNA, 22 bp, Artificial Sequence
  chemically synthesized
tacaagaaaataaacacatatc

SEQ ID NO: 1333070 - DNA, 22 bp, Artificial Sequence
  chemically synthesized
aattttgtgaggatatgtgttt

SEQ ID NO: 1333071 - DNA, 22 bp, Artificial Sequence
  chemically synthesized
cactgtacaagaaaataaacac

SEQ ID NO: 1333072 - DNA, 22 bp, Artificial Sequence
  chemically synthesized
tgtgaggatatgtgtttatttt

SEQ ID NO: 1333073 - DNA, 22 bp, Artificial Sequence
  chemically synthesized
acactgtacaagaaaataaaca

SEQ ID NO: 1333074 - DNA, 22 bp, Artificial Sequence
  chemically synthesized
gtgaggatatgtgtttattttc

SEQ ID NO: 1333075 - DNA, 22 bp, Artificial Sequence
  chemically synthesized
tgaggatatgtgtttattttct

SEQ ID NO: 1333076 - DNA, 22 bp, Artificial Sequence
  chemically synthesized
gtttacactgtacaagaaaata

SEQ ID NO: 1333077 - DNA, 22 bp, Artificial Sequence
  chemically synthesized
agtttacactgtacaagaaaat

SEQ ID NO: 1333078 - DNA, 22 bp, Artificial Sequence
  chemically synthesized
tttagtttacactgtacaagaa

SEQ ID NO: 1333079 - DNA, 22 bp, Artificial Sequence
  chemically synthesized
tgcgttgtttagtttacactgt

SEQ ID NO: 1333080 - DNA, 22 bp, Artificial Sequence
  chemically synthesized
atgcgttgtttagtttacactg

SEQ ID NO: 1333081 - DNA, 22 bp, Artificial Sequence
  chemically synthesized
attttcttgtacagtgtaaact

SEQ ID NO: 1333082 - DNA, 22 bp, Artificial Sequence
  chemically synthesized
tatgcgttgtttagtttacact

SEQ ID NO: 1333083 - DNA, 22 bp, Artificial Sequence
  chemically synthesized
ttttcttgtacagtgtaaacta

SEQ ID NO: 1333084 - DNA, 22 bp, Artificial Sequence
  chemically synthesized
tttatgcgttgtttagtttaca

SEQ ID NO: 1333085 - DNA, 22 bp, Artificial Sequence
  chemically synthesized
tcttgtacagtgtaaactaaac

SEQ ID NO: 1333086 - DNA, 22 bp, Artificial Sequence
  chemically synthesized
tctttatgcgttgtttagttta

SEQ ID NO: 1333087 - DNA, 22 bp, Artificial Sequence
  chemically synthesized
cttgtacagtgtaaactaaaca

SEQ ID NO: 1333088 - DNA, 22 bp, Artificial Sequence
  chemically synthesized
ttgtacagtgtaaactaaacaa

SEQ ID NO: 1333089 - DNA, 22 bp, Artificial Sequence
  chemically synthesized
gtacagtgtaaactaaacaacg

SEQ ID NO: 1333090 - DNA, 22 bp, Artificial Sequence
  chemically synthesized
tacagtgtaaactaaacaacgc

SEQ ID NO: 1333091 - DNA, 22 bp, Artificial Sequence
  chemically synthesized
tgttctctttatgcgttgttta

SEQ ID NO: 1333092 - DNA, 22 bp, Artificial Sequence
  chemically synthesized
cctgtgttctctttatgcgttg

SEQ ID NO: 1333093 - DNA, 22 bp, Artificial Sequence
  chemically synthesized
gttacctgtgttctctttatgc

SEQ ID NO: 1333094 - DNA, 22 bp, Artificial Sequence
  chemically synthesized
atctagttacctgtgttctctt

SEQ ID NO: 1333095 - DNA, 22 bp, Artificial Sequence
  chemically synthesized
aacaacgcataaagagaacaca

SEQ ID NO: 1333096 - DNA, 22 bp, Artificial Sequence
  chemically synthesized
aatctagttacctgtgttctct

SEQ ID NO: 1333097 - DNA, 22 bp, Artificial Sequence
  chemically synthesized
ttaatctagttacctgtgttct

SEQ ID NO: 1333098 - DNA, 22 bp, Artificial Sequence
  chemically synthesized
ttcttaatctagttacctgtgt

SEQ ID NO: 1333099 - DNA, 22 bp, Artificial Sequence
  chemically synthesized
atacaaagagcagaaaataatt

SEQ ID NO: 1333100 - DNA, 22 bp, Artificial Sequence
  chemically synthesized
gattaagaacaattattttctg

SEQ ID NO: 1333101 - DNA, 22 bp, Artificial Sequence
  chemically synthesized
taatacaaagagcagaaaataa

SEQ ID NO: 1333102 - DNA, 22 bp, Artificial Sequence
  chemically synthesized
agaacaattattttctgctctt

SEQ ID NO: 1333103 - DNA, 22 bp, Artificial Sequence
  chemically synthesized
ttttctgctctttgtattagaa

SEQ ID NO: 1333104 - DNA, 22 bp, Artificial Sequence
  chemically synthesized
tctgctctttgtattagaacac

SEQ ID NO: 1333105 - DNA, 22 bp, Artificial Sequence
  chemically synthesized
ctgctctttgtattagaacact

SEQ ID NO: 1333106 - DNA, 22 bp, Artificial Sequence
  chemically synthesized
tgctctttgtattagaacactc

SEQ ID NO: 1333107 - DNA, 22 bp, Artificial Sequence
  chemically synthesized
agaacagaaaatgagtgttcta

SEQ ID NO: 1333108 - DNA, 22 bp, Artificial Sequence
  chemically synthesized
ctctttgtattagaacactcat

SEQ ID NO: 1333109 - DNA, 22 bp, Artificial Sequence
  chemically synthesized
ctaagaacagaaaatgagtgtt

SEQ ID NO: 1333110 - DNA, 22 bp, Artificial Sequence
  chemically synthesized
tttgtattagaacactcatttt

SEQ ID NO: 1333111 - DNA, 22 bp, Artificial Sequence
  chemically synthesized
tgtattagaacactcattttct

SEQ ID NO: 1333112 - DNA, 22 bp, Artificial Sequence
  chemically synthesized
gtattagaacactcattttctg

SEQ ID NO: 1333113 - DNA, 22 bp, Artificial Sequence
  chemically synthesized
gattactaagaacagaaaatga

SEQ ID NO: 1333114 - DNA, 22 bp, Artificial Sequence
  chemically synthesized
tattagaacactcattttctgt

SEQ ID NO: 1333115 - DNA, 22 bp, Artificial Sequence
  chemically synthesized
ctagattactaagaacagaaaa

SEQ ID NO: 1333116 - DNA, 22 bp, Artificial Sequence
  chemically synthesized
gaacactcattttctgttctta

SEQ ID NO: 1333117 - DNA, 22 bp, Artificial Sequence
  chemically synthesized
atgctgctagattactaagaac

SEQ ID NO: 1333118 - DNA, 22 bp, Artificial Sequence
  chemically synthesized
attttctgttcttagtaatcta

SEQ ID NO: 1333119 - DNA, 22 bp, Artificial Sequence
  chemically synthesized
tctgttcttagtaatctagcag

SEQ ID NO: 1333120 - DNA, 22 bp, Artificial Sequence
  chemically synthesized
ctgttcttagtaatctagcagc

SEQ ID NO: 1333121 - DNA, 22 bp, Artificial Sequence
  chemically synthesized
ggagatgctgatgctgctagat

SEQ ID NO: 1333122 - DNA, 22 bp, Artificial Sequence
  chemically synthesized
tgttcttagtaatctagcagca

SEQ ID NO: 1333123 - DNA, 22 bp, Artificial Sequence
  chemically synthesized
aggagatgctgatgctgctaga

SEQ ID NO: 1333124 - DNA, 22 bp, Artificial Sequence
  chemically synthesized
taggagatgctgatgctgctag

SEQ ID NO: 1333125 - DNA, 22 bp, Artificial Sequence
  chemically synthesized
ttcttagtaatctagcagcatc

SEQ ID NO: 1333126 - DNA, 22 bp, Artificial Sequence
  chemically synthesized
ttaggagatgctgatgctgcta

SEQ ID NO: 1333127 - DNA, 22 bp, Artificial Sequence
  chemically synthesized
tttaggagatgctgatgctgct

SEQ ID NO: 1333128 - DNA, 22 bp, Artificial Sequence
  chemically synthesized
ttagtaatctagcagcatcagc

SEQ ID NO: 1333129 - DNA, 22 bp, Artificial Sequence
  chemically synthesized
agtaatctagcagcatcagcat

SEQ ID NO: 1333130 - DNA, 22 bp, Artificial Sequence
  chemically synthesized
gtaatctagcagcatcagcatc

SEQ ID NO: 1333131 - DNA, 22 bp, Artificial Sequence
  chemically synthesized
acagattttttaggagatgctg

SEQ ID NO: 1333132 - DNA, 22 bp, Artificial Sequence
  chemically synthesized
aacagattttttaggagatgct

SEQ ID NO: 1333133 - DNA, 22 bp, Artificial Sequence
  chemically synthesized
taacagattttttaggagatgc

SEQ ID NO: 1333134 - DNA, 22 bp, Artificial Sequence
  chemically synthesized
ttaacagattttttaggagatg

SEQ ID NO: 1333135 - DNA, 22 bp, Artificial Sequence
  chemically synthesized
gcagcatcagcatctcctaaaa

SEQ ID NO: 1333136 - DNA, 22 bp, Artificial Sequence
  chemically synthesized
catttttaacagattttttagg

SEQ ID NO: 1333137 - DNA, 22 bp, Artificial Sequence
  chemically synthesized
tgcatttttaacagatttttta

SEQ ID NO: 1333138 - DNA, 22 bp, Artificial Sequence
  chemically synthesized
ctaaaaaatctgttaaaaatgc

SEQ ID NO: 1333139 - DNA, 22 bp, Artificial Sequence
  chemically synthesized
aaaaatctgttaaaaatgcaga

SEQ ID NO: 1333140 - DNA, 22 bp, Artificial Sequence
  chemically synthesized
aagtggggccccaacctctgca

SEQ ID NO: 1333141 - DNA, 22 bp, Artificial Sequence
  chemically synthesized
tgaagtggggccccaacctctg

SEQ ID NO: 1333142 - DNA, 22 bp, Artificial Sequence
  chemically synthesized
ctgaagtggggccccaacctct

SEQ ID NO: 1333143 - DNA, 22 bp, Artificial Sequence
  chemically synthesized
ttaaaaatgcagaggttggggc

SEQ ID NO: 1333144 - DNA, 22 bp, Artificial Sequence
  chemically synthesized
aaaatgcagaggttggggcccc

SEQ ID NO: 1333145 - DNA, 22 bp, Artificial Sequence
  chemically synthesized
agtccttctgaagtggggcccc

SEQ ID NO: 1333146 - DNA, 22 bp, Artificial Sequence
  chemically synthesized
attcagtccttctgaagtgggg

SEQ ID NO: 1333147 - DNA, 22 bp, Artificial Sequence
  chemically synthesized
tgattcagtccttctgaagtgg

SEQ ID NO: 1333148 - DNA, 22 bp, Artificial Sequence
  chemically synthesized
ctgattcagtccttctgaagtg

SEQ ID NO: 1333149 - DNA, 22 bp, Artificial Sequence
  chemically synthesized
gggccccacttcagaaggactg

SEQ ID NO: 1333150 - DNA, 22 bp, Artificial Sequence
  chemically synthesized
cagaaggactgaatcagaaact

SEQ ID NO: 1333151 - DNA, 22 bp, Artificial Sequence
  chemically synthesized
agaaggactgaatcagaaactc

SEQ ID NO: 1333152 - DNA, 22 bp, Artificial Sequence
  chemically synthesized
gatgccacccccagagtttctg

SEQ ID NO: 1333153 - DNA, 22 bp, Artificial Sequence
  chemically synthesized
ctggatgccacccccagagttt

SEQ ID NO: 1333154 - DNA, 22 bp, Artificial Sequence
  chemically synthesized
gctggatgccacccccagagtt

SEQ ID NO: 1333155 - DNA, 22 bp, Artificial Sequence
  chemically synthesized
aatcagaaactctgggggtggc

SEQ ID NO: 1333156 - DNA, 22 bp, Artificial Sequence
  chemically synthesized
aaccacagcttgctggatgcca

SEQ ID NO: 1333157 - DNA, 22 bp, Artificial Sequence
  chemically synthesized
gttaaaccacagcttgctggat

SEQ ID NO: 1333158 - DNA, 22 bp, Artificial Sequence
  chemically synthesized
tgggggtggcatccagcaagct

SEQ ID NO: 1333159 - DNA, 22 bp, Artificial Sequence
  chemically synthesized
ggggtggcatccagcaagctgt

SEQ ID NO: 1333160 - DNA, 22 bp, Artificial Sequence
  chemically synthesized
gagggctggttaaaccacagct

SEQ ID NO: 1333161 - DNA, 22 bp, Artificial Sequence
  chemically synthesized
acctggagggctggttaaacca

SEQ ID NO: 1333162 - DNA, 22 bp, Artificial Sequence
  chemically synthesized
tggtttaaccagccctccaggt

SEQ ID NO: 1333163 - DNA, 22 bp, Artificial Sequence
  chemically synthesized
agtgggcatcagattcacctgg

SEQ ID NO: 1333164 - DNA, 22 bp, Artificial Sequence
  chemically synthesized
gagtgggcatcagattcacctg

SEQ ID NO: 1333165 - DNA, 22 bp, Artificial Sequence
  chemically synthesized
aaccagccctccaggtgaatct

SEQ ID NO: 1333166 - DNA, 22 bp, Artificial Sequence
  chemically synthesized
accagccctccaggtgaatctg

SEQ ID NO: 1333167 - DNA, 22 bp, Artificial Sequence
  chemically synthesized
cttgagtgggcatcagattcac

SEQ ID NO: 1333168 - DNA, 22 bp, Artificial Sequence
  chemically synthesized
ccttgagtgggcatcagattca

SEQ ID NO: 1333169 - DNA, 22 bp, Artificial Sequence
  chemically synthesized
ttccttgagtgggcatcagatt

SEQ ID NO: 1333170 - DNA, 22 bp, Artificial Sequence
  chemically synthesized
actcttccttgagtgggcatca

SEQ ID NO: 1333171 - DNA, 22 bp, Artificial Sequence
  chemically synthesized
caggtgaatctgatgcccactc

SEQ ID NO: 1333172 - DNA, 22 bp, Artificial Sequence
  chemically synthesized
tcactcttccttgagtgggcat

SEQ ID NO: 1333173 - DNA, 22 bp, Artificial Sequence
  chemically synthesized
atgcccactcaaggaagagtga

SEQ ID NO: 1333174 - DNA, 22 bp, Artificial Sequence
  chemically synthesized
gaacagtggttctcactcttcc

SEQ ID NO: 1333175 - DNA, 22 bp, Artificial Sequence
  chemically synthesized
aaggaagagtgagaaccactgt

SEQ ID NO: 1333176 - DNA, 22 bp, Artificial Sequence
  chemically synthesized
gaagacgatagattagaacagt

SEQ ID NO: 1333177 - DNA, 22 bp, Artificial Sequence
  chemically synthesized
ggaagacgatagattagaacag

SEQ ID NO: 1333178 - DNA, 22 bp, Artificial Sequence
  chemically synthesized
ttggaagacgatagattagaac

SEQ ID NO: 1333179 - DNA, 22 bp, Artificial Sequence
  chemically synthesized
ccacacactcttggaagacgat

SEQ ID NO: 1333180 - DNA, 22 bp, Artificial Sequence
  chemically synthesized
cccacacactcttggaagacga

SEQ ID NO: 1333181 - DNA, 22 bp, Artificial Sequence
  chemically synthesized
ttctaatctatcgtcttccaag

SEQ ID NO: 1333182 - DNA, 22 bp, Artificial Sequence
  chemically synthesized
taatctatcgtcttccaagagt

SEQ ID NO: 1333183 - DNA, 22 bp, Artificial Sequence
  chemically synthesized
atcttcccacacactcttggaa

SEQ ID NO: 1333184 - DNA, 22 bp, Artificial Sequence
  chemically synthesized
gatcttcccacacactcttgga

SEQ ID NO: 1333185 - DNA, 22 bp, Artificial Sequence
  chemically synthesized
atctatcgtcttccaagagtgt

SEQ ID NO: 1333186 - DNA, 22 bp, Artificial Sequence
  chemically synthesized
tgatcttcccacacactcttgg

SEQ ID NO: 1333187 - DNA, 22 bp, Artificial Sequence
  chemically synthesized
tttgatcttcccacacactctt

SEQ ID NO: 1333188 - DNA, 22 bp, Artificial Sequence
  chemically synthesized
ctttgatcttcccacacactct

SEQ ID NO: 1333189 - DNA, 22 bp, Artificial Sequence
  chemically synthesized
tctttgatcttcccacacactc

SEQ ID NO: 1333190 - DNA, 22 bp, Artificial Sequence
  chemically synthesized
tcgtcttccaagagtgtgtggg

SEQ ID NO: 1333191 - DNA, 22 bp, Artificial Sequence
  chemically synthesized
ttctttgatcttcccacacact

SEQ ID NO: 1333192 - DNA, 22 bp, Artificial Sequence
  chemically synthesized
atttttctttgatcttcccaca

SEQ ID NO: 1333193 - DNA, 22 bp, Artificial Sequence
  chemically synthesized
ccaagagtgtgtgggaagatca

SEQ ID NO: 1333194 - DNA, 22 bp, Artificial Sequence
  chemically synthesized
caagagtgtgtgggaagatcaa

SEQ ID NO: 1333195 - DNA, 22 bp, Artificial Sequence
  chemically synthesized
cgcaaagccccatgacctgatt

SEQ ID NO: 1333196 - DNA, 22 bp, Artificial Sequence
  chemically synthesized
tccgcaaagccccatgacctga

SEQ ID NO: 1333197 - DNA, 22 bp, Artificial Sequence
  chemically synthesized
ttctccgcaaagccccatgacc

SEQ ID NO: 1333198 - DNA, 22 bp, Artificial Sequence
  chemically synthesized
attgttctccgcaaagccccat

SEQ ID NO: 1333199 - DNA, 22 bp, Artificial Sequence
  chemically synthesized
gattgttctccgcaaagcccca

SEQ ID NO: 1333200 - DNA, 22 bp, Artificial Sequence
  chemically synthesized
tttgattgttctccgcaaagcc

SEQ ID NO: 1333201 - DNA, 22 bp, Artificial Sequence
  chemically synthesized
gtttgattgttctccgcaaagc

SEQ ID NO: 1333202 - DNA, 22 bp, Artificial Sequence
  chemically synthesized
tgtatttgtttgattgttctcc

SEQ ID NO: 1333203 - DNA, 22 bp, Artificial Sequence
  chemically synthesized
atgtatttgtttgattgttctc

SEQ ID NO: 1333204 - DNA, 22 bp, Artificial Sequence
  chemically synthesized
atttatgtatttgtttgattgt

SEQ ID NO: 1333205 - DNA, 22 bp, Artificial Sequence
  chemically synthesized
gatttatgtatttgtttgattg

SEQ ID NO: 1333206 - DNA, 22 bp, Artificial Sequence
  chemically synthesized
tgcggagaacaatcaaacaaat

SEQ ID NO: 1333207 - DNA, 22 bp, Artificial Sequence
  chemically synthesized
gcggagaacaatcaaacaaata

SEQ ID NO: 1333208 - DNA, 22 bp, Artificial Sequence
  chemically synthesized
cggagaacaatcaaacaaatac

SEQ ID NO: 1333209 - DNA, 22 bp, Artificial Sequence
  chemically synthesized
tagagtccttgatttatgtatt

SEQ ID NO: 1333210 - DNA, 22 bp, Artificial Sequence
  chemically synthesized
atagagtccttgatttatgtat

SEQ ID NO: 1333211 - DNA, 22 bp, Artificial Sequence
  chemically synthesized
tgcttatagagtccttgattta

SEQ ID NO: 1333212 - DNA, 22 bp, Artificial Sequence
  chemically synthesized
aattatgcttatagagtccttg

SEQ ID NO: 1333213 - DNA, 22 bp, Artificial Sequence
  chemically synthesized
ttaaattatgcttatagagtcc

SEQ ID NO: 1333214 - DNA, 22 bp, Artificial Sequence
  chemically synthesized
attaaattatgcttatagagtc

SEQ ID NO: 1333215 - DNA, 22 bp, Artificial Sequence
  chemically synthesized
tttattaaattatgcttataga

SEQ ID NO: 1333216 - DNA, 22 bp, Artificial Sequence
  chemically synthesized
tataagcataatttaataaata

SEQ ID NO: 1333217 - DNA, 22 bp, Artificial Sequence
  chemically synthesized
taagcataatttaataaataga

SEQ ID NO: 1333218 - DNA, 22 bp, Artificial Sequence
  chemically synthesized
aaaacaatcatccgtctattta

SEQ ID NO: 1333219 - DNA, 22 bp, Artificial Sequence
  chemically synthesized
aataaatagacggatgattgtt

SEQ ID NO: 1333220 - DNA, 22 bp, Artificial Sequence
  chemically synthesized
ataaatagacggatgattgttt

SEQ ID NO: 1333221 - DNA, 22 bp, Artificial Sequence
  chemically synthesized
aaaaataagttaaaaacaatca

SEQ ID NO: 1333222 - DNA, 22 bp, Artificial Sequence
  chemically synthesized
aggaggaaattgaaaaataagt

SEQ ID NO: 1333223 - DNA, 22 bp, Artificial Sequence
  chemically synthesized
tttttaacttatttttcaattt

SEQ ID NO: 1333224 - DNA, 22 bp, Artificial Sequence
  chemically synthesized
ttaacttatttttcaatttcct

SEQ ID NO: 1333225 - DNA, 22 bp, Artificial Sequence
  chemically synthesized
taacttatttttcaatttcctc

SEQ ID NO: 1333226 - DNA, 22 bp, Artificial Sequence
  chemically synthesized
aacttatttttcaatttcctcc

SEQ ID NO: 1333227 - DNA, 22 bp, Artificial Sequence
  chemically synthesized
acttatttttcaatttcctcct

SEQ ID NO: 1333228 - DNA, 22 bp, Artificial Sequence
  chemically synthesized
atttttcaatttcctccttagt

SEQ ID NO: 1333229 - DNA, 22 bp, Artificial Sequence
  chemically synthesized
tttttcaatttcctccttagtt

SEQ ID NO: 1333230 - DNA, 22 bp, Artificial Sequence
  chemically synthesized
aatgcatgtacaaactaaggag

SEQ ID NO: 1333231 - DNA, 22 bp, Artificial Sequence
  chemically synthesized
taaatgcatgtacaaactaagg

SEQ ID NO: 1333232 - DNA, 22 bp, Artificial Sequence
  chemically synthesized
ttcaatttcctccttagtttgt

SEQ ID NO: 1333233 - DNA, 22 bp, Artificial Sequence
  chemically synthesized
tcaatttcctccttagtttgta

SEQ ID NO: 1333234 - DNA, 22 bp, Artificial Sequence
  chemically synthesized
caatttcctccttagtttgtac

SEQ ID NO: 1333235 - DNA, 22 bp, Artificial Sequence
  chemically synthesized
aatttcctccttagtttgtaca

SEQ ID NO: 1333236 - DNA, 22 bp, Artificial Sequence
  chemically synthesized
tctctaaatgcatgtacaaact

SEQ ID NO: 1333237 - DNA, 22 bp, Artificial Sequence
  chemically synthesized
cctccttagtttgtacatgcat

SEQ ID NO: 1333238 - DNA, 22 bp, Artificial Sequence
  chemically synthesized
ctccttagtttgtacatgcatt

SEQ ID NO: 1333239 - DNA, 22 bp, Artificial Sequence
  chemically synthesized
agattatctctaaatgcatgta

SEQ ID NO: 1333240 - DNA, 22 bp, Artificial Sequence
  chemically synthesized
cttagtttgtacatgcatttag

SEQ ID NO: 1333241 - DNA, 22 bp, Artificial Sequence
  chemically synthesized
ctgagattatctctaaatgcat

SEQ ID NO: 1333242 - DNA, 22 bp, Artificial Sequence
  chemically synthesized
agtttgtacatgcatttagaga

SEQ ID NO: 1333243 - DNA, 22 bp, Artificial Sequence
  chemically synthesized
gtttgtacatgcatttagagat

SEQ ID NO: 1333244 - DNA, 22 bp, Artificial Sequence
  chemically synthesized
acattgctgagattatctctaa

SEQ ID NO: 1333245 - DNA, 22 bp, Artificial Sequence
  chemically synthesized
gtacatgcatttagagataatc

SEQ ID NO: 1333246 - DNA, 22 bp, Artificial Sequence
  chemically synthesized
tacatgcatttagagataatct

SEQ ID NO: 1333247 - DNA, 22 bp, Artificial Sequence
  chemically synthesized
gctgacattgctgagattatct

SEQ ID NO: 1333248 - DNA, 22 bp, Artificial Sequence
  chemically synthesized
agagataatctcagcaatgtca

SEQ ID NO: 1333249 - DNA, 22 bp, Artificial Sequence
  chemically synthesized
gagataatctcagcaatgtcag

SEQ ID NO: 1333250 - DNA, 22 bp, Artificial Sequence
  chemically synthesized
tgccaccaagctcgctgacatt

SEQ ID NO: 1333251 - DNA, 22 bp, Artificial Sequence
  chemically synthesized
aactatgccaccaagctcgctg

SEQ ID NO: 1333252 - DNA, 22 bp, Artificial Sequence
  chemically synthesized
gaactatgccaccaagctcgct

SEQ ID NO: 1333253 - DNA, 22 bp, Artificial Sequence
  chemically synthesized
agcaatgtcagcgagcttggtg

SEQ ID NO: 1333254 - DNA, 22 bp, Artificial Sequence
  chemically synthesized
acagcttgaactatgccaccaa

SEQ ID NO: 1333255 - DNA, 22 bp, Artificial Sequence
  chemically synthesized
cacagcttgaactatgccacca

SEQ ID NO: 1333256 - DNA, 22 bp, Artificial Sequence
  chemically synthesized
aaccttcacagcttgaactatg

SEQ ID NO: 1333257 - DNA, 22 bp, Artificial Sequence
  chemically synthesized
ttgaaccttcacagcttgaact

SEQ ID NO: 1333258 - DNA, 22 bp, Artificial Sequence
  chemically synthesized
attgaaccttcacagcttgaac

SEQ ID NO: 1333259 - DNA, 22 bp, Artificial Sequence
  chemically synthesized
ggtggcatagttcaagctgtga

SEQ ID NO: 1333260 - DNA, 22 bp, Artificial Sequence
  chemically synthesized
tttattgaaccttcacagcttg

SEQ ID NO: 1333261 - DNA, 22 bp, Artificial Sequence
  chemically synthesized
gtggcatagttcaagctgtgaa

SEQ ID NO: 1333262 - DNA, 22 bp, Artificial Sequence
  chemically synthesized
ccgacctatttattgaaccttc

SEQ ID NO: 1333263 - DNA, 22 bp, Artificial Sequence
  chemically synthesized
accgacctatttattgaacctt

SEQ ID NO: 1333264 - DNA, 22 bp, Artificial Sequence
  chemically synthesized
aagctgtgaaggttcaataaat

SEQ ID NO: 1333265 - DNA, 22 bp, Artificial Sequence
  chemically synthesized
caatgtttaccgacctatttat

SEQ ID NO: 1333266 - DNA, 22 bp, Artificial Sequence
  chemically synthesized
gcaatgtttaccgacctattta

SEQ ID NO: 1333267 - DNA, 22 bp, Artificial Sequence
  chemically synthesized
tgaaggttcaataaataggtcg

SEQ ID NO: 1333268 - DNA, 22 bp, Artificial Sequence
  chemically synthesized
atttgcaatgtttaccgaccta

SEQ ID NO: 1333269 - DNA, 22 bp, Artificial Sequence
  chemically synthesized
tgttgatttgcaatgtttaccg

SEQ ID NO: 1333270 - DNA, 22 bp, Artificial Sequence
  chemically synthesized
aataaataggtcggtaaacatt

SEQ ID NO: 1333271 - DNA, 22 bp, Artificial Sequence
  chemically synthesized
atcaaaagctgtgttgatttgc

SEQ ID NO: 1333272 - DNA, 22 bp, Artificial Sequence
  chemically synthesized
catcaaaagctgtgttgatttg

SEQ ID NO: 1333273 - DNA, 22 bp, Artificial Sequence
  chemically synthesized
acatttcatcaaaagctgtgtt

SEQ ID NO: 1333274 - DNA, 22 bp, Artificial Sequence
  chemically synthesized
cctgacatttcatcaaaagctg

SEQ ID NO: 1333275 - DNA, 22 bp, Artificial Sequence
  chemically synthesized
gcctgacatttcatcaaaagct

SEQ ID NO: 1333276 - DNA, 22 bp, Artificial Sequence
  chemically synthesized
caaatcaacacagcttttgatg

SEQ ID NO: 1333277 - DNA, 22 bp, Artificial Sequence
  chemically synthesized
tcttgcctgacatttcatcaaa

SEQ ID NO: 1333278 - DNA, 22 bp, Artificial Sequence
  chemically synthesized
agccctgtcttgcctgacattt

SEQ ID NO: 1333279 - DNA, 22 bp, Artificial Sequence
  chemically synthesized
ttgatgaaatgtcaggcaagac

SEQ ID NO: 1333280 - DNA, 22 bp, Artificial Sequence
  chemically synthesized
tgatgaaatgtcaggcaagaca

SEQ ID NO: 1333281 - DNA, 22 bp, Artificial Sequence
  chemically synthesized
gatgaaatgtcaggcaagacag

SEQ ID NO: 1333282 - DNA, 22 bp, Artificial Sequence
  chemically synthesized
atgaaatgtcaggcaagacagg

SEQ ID NO: 1333283 - DNA, 22 bp, Artificial Sequence
  chemically synthesized
agccgaatatagctaagccctg

SEQ ID NO: 1333284 - DNA, 22 bp, Artificial Sequence
  chemically synthesized
aagctgagccgaatatagctaa

SEQ ID NO: 1333285 - DNA, 22 bp, Artificial Sequence
  chemically synthesized
tgagttcaagctgagccgaata

SEQ ID NO: 1333286 - DNA, 22 bp, Artificial Sequence
  chemically synthesized
atgagttcaagctgagccgaat

SEQ ID NO: 1333287 - DNA, 22 bp, Artificial Sequence
  chemically synthesized
agctatattcggctcagcttga

SEQ ID NO: 1333288 - DNA, 22 bp, Artificial Sequence
  chemically synthesized
gctatattcggctcagcttgaa

SEQ ID NO: 1333289 - DNA, 22 bp, Artificial Sequence
  chemically synthesized
atggtttatgagttcaagctga

SEQ ID NO: 1333290 - DNA, 22 bp, Artificial Sequence
  chemically synthesized
tattcggctcagcttgaactca

SEQ ID NO: 1333291 - DNA, 22 bp, Artificial Sequence
  chemically synthesized
ggctcagcttgaactcataaac

SEQ ID NO: 1333292 - DNA, 22 bp, Artificial Sequence
  chemically synthesized
agcttgaactcataaaccatca

SEQ ID NO: 1333293 - DNA, 22 bp, Artificial Sequence
  chemically synthesized
gaactcataaaccatcaactgg

SEQ ID NO: 1333294 - DNA, 22 bp, Artificial Sequence
  chemically synthesized
gaagtacagaggccagttgatg

SEQ ID NO: 1333295 - DNA, 22 bp, Artificial Sequence
  chemically synthesized
aactcataaaccatcaactggc

SEQ ID NO: 1333296 - DNA, 22 bp, Artificial Sequence
  chemically synthesized
tcctggaagtacagaggccagt

SEQ ID NO: 1333297 - DNA, 22 bp, Artificial Sequence
  chemically synthesized
ataaaccatcaactggcctctg

SEQ ID NO: 1333298 - DNA, 22 bp, Artificial Sequence
  chemically synthesized
atcagattgtcctggaagtaca

SEQ ID NO: 1333299 - DNA, 22 bp, Artificial Sequence
  chemically synthesized
ttcatcagattgtcctggaagt

SEQ ID NO: 1333300 - DNA, 22 bp, Artificial Sequence
  chemically synthesized
attcatcagattgtcctggaag

SEQ ID NO: 1333301 - DNA, 22 bp, Artificial Sequence
  chemically synthesized
tattcatcagattgtcctggaa

SEQ ID NO: 1333302 - DNA, 22 bp, Artificial Sequence
  chemically synthesized
gcctctgtacttccaggacaat

SEQ ID NO: 1333303 - DNA, 22 bp, Artificial Sequence
  chemically synthesized
tattttattcatcagattgtcc

SEQ ID NO: 1333304 - DNA, 22 bp, Artificial Sequence
  chemically synthesized
tgtacttccaggacaatctgat

SEQ ID NO: 1333305 - DNA, 22 bp, Artificial Sequence
  chemically synthesized
tacttccaggacaatctgatga

SEQ ID NO: 1333306 - DNA, 22 bp, Artificial Sequence
  chemically synthesized
tatctgtattttattcatcaga

SEQ ID NO: 1333307 - DNA, 22 bp, Artificial Sequence
  chemically synthesized
atatctgtattttattcatcag

SEQ ID NO: 1333308 - DNA, 22 bp, Artificial Sequence
  chemically synthesized
tatatctgtattttattcatca

SEQ ID NO: 1333309 - DNA, 22 bp, Artificial Sequence
  chemically synthesized
ccaggacaatctgatgaataaa

SEQ ID NO: 1333310 - DNA, 22 bp, Artificial Sequence
  chemically synthesized
caggacaatctgatgaataaaa

SEQ ID NO: 1333311 - DNA, 22 bp, Artificial Sequence
  chemically synthesized
attttatatctgtattttattc

SEQ ID NO: 1333312 - DNA, 22 bp, Artificial Sequence
  chemically synthesized
aattttatatctgtattttatt

SEQ ID NO: 1333313 - DNA, 22 bp, Artificial Sequence
  chemically synthesized
taattttatatctgtattttat

SEQ ID NO: 1333314 - DNA, 22 bp, Artificial Sequence
  chemically synthesized
ttaattttatatctgtatttta

SEQ ID NO: 1333315 - DNA, 22 bp, Artificial Sequence
  chemically synthesized
tttaattttatatctgtatttt

SEQ ID NO: 1333316 - DNA, 22 bp, Artificial Sequence
  chemically synthesized
atgaataaaatacagatataaa

SEQ ID NO: 1333317 - DNA, 22 bp, Artificial Sequence
  chemically synthesized
taaatatattttttaattttat

SEQ ID NO: 1333318 - DNA, 22 bp, Artificial Sequence
  chemically synthesized
ataaatatattttttaatttta

SEQ ID NO: 1333319 - DNA, 22 bp, Artificial Sequence
  chemically synthesized
tataaatatattttttaatttt

SEQ ID NO: 1333320 - DNA, 22 bp, Artificial Sequence
  chemically synthesized
tttataaatatattttttaatt

SEQ ID NO: 1333321 - DNA, 22 bp, Artificial Sequence
  chemically synthesized
atctctttataaatatattttt

SEQ ID NO: 1333322 - DNA, 22 bp, Artificial Sequence
  chemically synthesized
ctaatctctttataaatatatt

SEQ ID NO: 1333323 - DNA, 22 bp, Artificial Sequence
  chemically synthesized
actaatctctttataaatatat

SEQ ID NO: 1333324 - DNA, 22 bp, Artificial Sequence
  chemically synthesized
tactaatctctttataaatata

SEQ ID NO: 1333325 - DNA, 22 bp, Artificial Sequence
  chemically synthesized
ttttactaatctctttataaat

SEQ ID NO: 1333326 - DNA, 22 bp, Artificial Sequence
  chemically synthesized
ctgttttactaatctctttata

SEQ ID NO: 1333327 - DNA, 22 bp, Artificial Sequence
  chemically synthesized
aaaaatatatttataaagagat

SEQ ID NO: 1333328 - DNA, 22 bp, Artificial Sequence
  chemically synthesized
cagattgctgttttactaatct

SEQ ID NO: 1333329 - DNA, 22 bp, Artificial Sequence
  chemically synthesized
acagattgctgttttactaatc

SEQ ID NO: 1333330 - DNA, 22 bp, Artificial Sequence
  chemically synthesized
acttacagattgctgttttact

SEQ ID NO: 1333331 - DNA, 22 bp, Artificial Sequence
  chemically synthesized
ataaagagattagtaaaacagc

SEQ ID NO: 1333332 - DNA, 22 bp, Artificial Sequence
  chemically synthesized
taaagagattagtaaaacagca

SEQ ID NO: 1333333 - DNA, 22 bp, Artificial Sequence
  chemically synthesized
tcacttacagattgctgtttta

SEQ ID NO: 1333334 - DNA, 22 bp, Artificial Sequence
  chemically synthesized
ctcacttacagattgctgtttt

SEQ ID NO: 1333335 - DNA, 22 bp, Artificial Sequence
  chemically synthesized
tcatttctcacttacagattgc

SEQ ID NO: 1333336 - DNA, 22 bp, Artificial Sequence
  chemically synthesized
gtaaaacagcaatctgtaagtg

SEQ ID NO: 1333337 - DNA, 22 bp, Artificial Sequence
  chemically synthesized
agtggttgtcatttctcactta

SEQ ID NO: 1333338 - DNA, 22 bp, Artificial Sequence
  chemically synthesized
gactaagtggttgtcatttctc

SEQ ID NO: 1333339 - DNA, 22 bp, Artificial Sequence
  chemically synthesized
gtctggactaagtggttgtcat

SEQ ID NO: 1333340 - DNA, 22 bp, Artificial Sequence
  chemically synthesized
ggtctggactaagtggttgtca

SEQ ID NO: 1333341 - DNA, 22 bp, Artificial Sequence
  chemically synthesized
taagtgagaaatgacaaccact

SEQ ID NO: 1333342 - DNA, 22 bp, Artificial Sequence
  chemically synthesized
atttggtctggactaagtggtt

SEQ ID NO: 1333343 - DNA, 22 bp, Artificial Sequence
  chemically synthesized
tcatttggtctggactaagtgg

SEQ ID NO: 1333344 - DNA, 22 bp, Artificial Sequence
  chemically synthesized
tctcatttggtctggactaagt

SEQ ID NO: 1333345 - DNA, 22 bp, Artificial Sequence
  chemically synthesized
tctctcatttggtctggactaa

SEQ ID NO: 1333346 - DNA, 22 bp, Artificial Sequence
  chemically synthesized
ctctctcatttggtctggacta

SEQ ID NO: 1333347 - DNA, 22 bp, Artificial Sequence
  chemically synthesized
caagtcttctctctcatttggt

SEQ ID NO: 1333348 - DNA, 22 bp, Artificial Sequence
  chemically synthesized
gcaagtcttctctctcatttgg

SEQ ID NO: 1333349 - DNA, 22 bp, Artificial Sequence
  chemically synthesized
tgcaagtcttctctctcatttg

SEQ ID NO: 1333350 - DNA, 22 bp, Artificial Sequence
  chemically synthesized
ttgcaagtcttctctctcattt

SEQ ID NO: 1333351 - DNA, 22 bp, Artificial Sequence
  chemically synthesized
agtccagaccaaatgagagaga

SEQ ID NO: 1333352 - DNA, 22 bp, Artificial Sequence
  chemically synthesized
gtccagaccaaatgagagagaa

SEQ ID NO: 1333353 - DNA, 22 bp, Artificial Sequence
  chemically synthesized
cccttttgcaagtcttctctct

SEQ ID NO: 1333354 - DNA, 22 bp, Artificial Sequence
  chemically synthesized
taagaaaagttacccttttgca

SEQ ID NO: 1333355 - DNA, 22 bp, Artificial Sequence
  chemically synthesized
gtaagaaaagttacccttttgc

SEQ ID NO: 1333356 - DNA, 22 bp, Artificial Sequence
  chemically synthesized
atttgtaagaaaagttaccctt

SEQ ID NO: 1333357 - DNA, 22 bp, Artificial Sequence
  chemically synthesized
gatttgtaagaaaagttaccct

SEQ ID NO: 1333358 - DNA, 22 bp, Artificial Sequence
  chemically synthesized
gcaaaagggtaacttttcttac

SEQ ID NO: 1333359 - DNA, 22 bp, Artificial Sequence
  chemically synthesized
caaaagggtaacttttcttaca

SEQ ID NO: 1333360 - DNA, 22 bp, Artificial Sequence
  chemically synthesized
ccataacttgatttgtaagaaa

SEQ ID NO: 1333361 - DNA, 22 bp, Artificial Sequence
  chemically synthesized
cccataacttgatttgtaagaa

SEQ ID NO: 1333362 - DNA, 22 bp, Artificial Sequence
  chemically synthesized
tcccataacttgatttgtaaga

SEQ ID NO: 1333363 - DNA, 22 bp, Artificial Sequence
  chemically synthesized
aaattttcccataacttgattt

SEQ ID NO: 1333364 - DNA, 22 bp, Artificial Sequence
  chemically synthesized
ttcttacaaatcaagttatggg

SEQ ID NO: 1333365 - DNA, 22 bp, Artificial Sequence
  chemically synthesized
tcttacaaatcaagttatggga

SEQ ID NO: 1333366 - DNA, 22 bp, Artificial Sequence
  chemically synthesized
gatctcaaattttcccataact

SEQ ID NO: 1333367 - DNA, 22 bp, Artificial Sequence
  chemically synthesized
cttacaaatcaagttatgggaa

SEQ ID NO: 1333368 - DNA, 22 bp, Artificial Sequence
  chemically synthesized
ggatctcaaattttcccataac

SEQ ID NO: 1333369 - DNA, 22 bp, Artificial Sequence
  chemically synthesized
ttacaaatcaagttatgggaaa

SEQ ID NO: 1333370 - DNA, 22 bp, Artificial Sequence
  chemically synthesized
acaaatcaagttatgggaaaat

SEQ ID NO: 1333371 - DNA, 22 bp, Artificial Sequence
  chemically synthesized
tttggatctcaaattttcccat

SEQ ID NO: 1333372 - DNA, 22 bp, Artificial Sequence
  chemically synthesized
caaatcaagttatgggaaaatt

SEQ ID NO: 1333373 - DNA, 22 bp, Artificial Sequence
  chemically synthesized
aaagtctatttggatctcaaat

SEQ ID NO: 1333374 - DNA, 22 bp, Artificial Sequence
  chemically synthesized
tgggaaaatttgagatccaaat

SEQ ID NO: 1333375 - DNA, 22 bp, Artificial Sequence
  chemically synthesized
gagatccaaatagacttttaac

SEQ ID NO: 1333376 - DNA, 22 bp, Artificial Sequence
  chemically synthesized
agatccaaatagacttttaact

SEQ ID NO: 1333377 - DNA, 22 bp, Artificial Sequence
  chemically synthesized
ggaataaagacaatccaaagtt

SEQ ID NO: 1333378 - DNA, 22 bp, Artificial Sequence
  chemically synthesized
ttaactttggattgtctttatt

SEQ ID NO: 1333379 - DNA, 22 bp, Artificial Sequence
  chemically synthesized
taactttggattgtctttattc

SEQ ID NO: 1333380 - DNA, 22 bp, Artificial Sequence
  chemically synthesized
aactttggattgtctttattcc

SEQ ID NO: 1333381 - DNA, 22 bp, Artificial Sequence
  chemically synthesized
actttggattgtctttattccc

SEQ ID NO: 1333382 - DNA, 22 bp, Artificial Sequence
  chemically synthesized
aaaacgtgtgttgggaataaag

SEQ ID NO: 1333383 - DNA, 22 bp, Artificial Sequence
  chemically synthesized
tggattgtctttattcccaaca

SEQ ID NO: 1333384 - DNA, 22 bp, Artificial Sequence
  chemically synthesized
ggattgtctttattcccaacac

SEQ ID NO: 1333385 - DNA, 22 bp, Artificial Sequence
  chemically synthesized
aattaaaaacgtgtgttgggaa

SEQ ID NO: 1333386 - DNA, 22 bp, Artificial Sequence
  chemically synthesized
gattgtctttattcccaacaca

SEQ ID NO: 1333387 - DNA, 22 bp, Artificial Sequence
  chemically synthesized
tctttattcccaacacacgttt

SEQ ID NO: 1333388 - DNA, 22 bp, Artificial Sequence
  chemically synthesized
tattcccaacacacgtttttaa

SEQ ID NO: 1333389 - DNA, 22 bp, Artificial Sequence
  chemically synthesized
attcccaacacacgtttttaat

SEQ ID NO: 1333390 - DNA, 22 bp, Artificial Sequence
  chemically synthesized
ttcccaacacacgtttttaatt

SEQ ID NO: 1333391 - DNA, 22 bp, Artificial Sequence
  chemically synthesized
ccaacacacgtttttaatttaa

SEQ ID NO: 1333392 - DNA, 22 bp, Artificial Sequence
  chemically synthesized
ggataaagtacaccgcattaaa

SEQ ID NO: 1333393 - DNA, 22 bp, Artificial Sequence
  chemically synthesized
ttaatttaatgcggtgtacttt

SEQ ID NO: 1333394 - DNA, 22 bp, Artificial Sequence
  chemically synthesized
taatttaatgcggtgtacttta

SEQ ID NO: 1333395 - DNA, 22 bp, Artificial Sequence
  chemically synthesized
aaagagttaggataaagtacac

SEQ ID NO: 1333396 - DNA, 22 bp, Artificial Sequence
  chemically synthesized
aatttaatgcggtgtactttat

SEQ ID NO: 1333397 - DNA, 22 bp, Artificial Sequence
  chemically synthesized
atttaatgcggtgtactttatc

SEQ ID NO: 1333398 - DNA, 22 bp, Artificial Sequence
  chemically synthesized
aatgcggtgtactttatcctaa

SEQ ID NO: 1333399 - DNA, 22 bp, Artificial Sequence
  chemically synthesized
atgcggtgtactttatcctaac

SEQ ID NO: 1333400 - DNA, 22 bp, Artificial Sequence
  chemically synthesized
aggggggtgagctaaaagagtt

SEQ ID NO: 1333401 - DNA, 22 bp, Artificial Sequence
  chemically synthesized
caggggggtgagctaaaagagt

SEQ ID NO: 1333402 - DNA, 22 bp, Artificial Sequence
  chemically synthesized
tcaggggggtgagctaaaagag

SEQ ID NO: 1333403 - DNA, 22 bp, Artificial Sequence
  chemically synthesized
ttcaggggggtgagctaaaaga

SEQ ID NO: 1333404 - DNA, 22 bp, Artificial Sequence
  chemically synthesized
tttcaggggggtgagctaaaag

SEQ ID NO: 1333405 - DNA, 22 bp, Artificial Sequence
  chemically synthesized
ttttcaggggggtgagctaaaa

SEQ ID NO: 1333406 - DNA, 22 bp, Artificial Sequence
  chemically synthesized
tatcctaactcttttagctcac

SEQ ID NO: 1333407 - DNA, 22 bp, Artificial Sequence
  chemically synthesized
tttttcaggggggtgagctaaa

SEQ ID NO: 1333408 - DNA, 22 bp, Artificial Sequence
  chemically synthesized
atcctaactcttttagctcacc

SEQ ID NO: 1333409 - DNA, 22 bp, Artificial Sequence
  chemically synthesized
ttttttcaggggggtgagctaa

SEQ ID NO: 1333410 - DNA, 22 bp, Artificial Sequence
  chemically synthesized
tcctaactcttttagctcaccc

SEQ ID NO: 1333411 - DNA, 22 bp, Artificial Sequence
  chemically synthesized
gtttttttttcaggggggtgag

SEQ ID NO: 1333412 - DNA, 22 bp, Artificial Sequence
  chemically synthesized
actcttttagctcacccccctg

SEQ ID NO: 1333413 - DNA, 22 bp, Artificial Sequence
  chemically synthesized
ttttagctcacccccctgaaaa

SEQ ID NO: 1333414 - DNA, 22 bp, Artificial Sequence
  chemically synthesized
ttagctcacccccctgaaaaaa

SEQ ID NO: 1333415 - DNA, 22 bp, Artificial Sequence
  chemically synthesized
tagctcacccccctgaaaaaaa

SEQ ID NO: 1333416 - DNA, 22 bp, Artificial Sequence
  chemically synthesized
agctcacccccctgaaaaaaaa

SEQ ID NO: 1333417 - DNA, 22 bp, Artificial Sequence
  chemically synthesized
gctcacccccctgaaaaaaaaa

SEQ ID NO: 1333418 - DNA, 22 bp, Artificial Sequence
  chemically synthesized
ggaagacagctagttttttttt

SEQ ID NO: 1333419 - DNA, 22 bp, Artificial Sequence
  chemically synthesized
aggaagacagctagtttttttt

SEQ ID NO: 1333420 - DNA, 22 bp, Artificial Sequence
  chemically synthesized
taggaagacagctagttttttt

SEQ ID NO: 1333421 - DNA, 22 bp, Artificial Sequence
  chemically synthesized
acccccctgaaaaaaaaactag

SEQ ID NO: 1333422 - DNA, 22 bp, Artificial Sequence
  chemically synthesized
tctttaggaagacagctagttt

SEQ ID NO: 1333423 - DNA, 22 bp, Artificial Sequence
  chemically synthesized
tatctttaggaagacagctagt

SEQ ID NO: 1333424 - DNA, 22 bp, Artificial Sequence
  chemically synthesized
tctatctttaggaagacagcta

SEQ ID NO: 1333425 - DNA, 22 bp, Artificial Sequence
  chemically synthesized
ctctatctttaggaagacagct

SEQ ID NO: 1333426 - DNA, 22 bp, Artificial Sequence
  chemically synthesized
aaaaaaaaactagctgtcttcc

SEQ ID NO: 1333427 - DNA, 22 bp, Artificial Sequence
  chemically synthesized
tctctatctttaggaagacagc

SEQ ID NO: 1333428 - DNA, 22 bp, Artificial Sequence
  chemically synthesized
gacaagttttctctatctttag

SEQ ID NO: 1333429 - DNA, 22 bp, Artificial Sequence
  chemically synthesized
ggacaagttttctctatcttta

SEQ ID NO: 1333430 - DNA, 22 bp, Artificial Sequence
  chemically synthesized
gctgtcttcctaaagatagaga

SEQ ID NO: 1333431 - DNA, 22 bp, Artificial Sequence
  chemically synthesized
acttggacaagttttctctatc

SEQ ID NO: 1333432 - DNA, 22 bp, Artificial Sequence
  chemically synthesized
tcttcctaaagatagagaaaac

SEQ ID NO: 1333433 - DNA, 22 bp, Artificial Sequence
  chemically synthesized
tgacttggacaagttttctcta

SEQ ID NO: 1333434 - DNA, 22 bp, Artificial Sequence
  chemically synthesized
ctgacttggacaagttttctct

SEQ ID NO: 1333435 - DNA, 22 bp, Artificial Sequence
  chemically synthesized
cctaaagatagagaaaacttgt

SEQ ID NO: 1333436 - DNA, 22 bp, Artificial Sequence
  chemically synthesized
ctaaagatagagaaaacttgtc

SEQ ID NO: 1333437 - DNA, 22 bp, Artificial Sequence
  chemically synthesized
aagatagagaaaacttgtccaa

SEQ ID NO: 1333438 - DNA, 22 bp, Artificial Sequence
  chemically synthesized
caaagagtttctgacttggaca

SEQ ID NO: 1333439 - DNA, 22 bp, Artificial Sequence
  chemically synthesized
aaattccaaagagtttctgact

SEQ ID NO: 1333440 - DNA, 22 bp, Artificial Sequence
  chemically synthesized
ttaaaattccaaagagtttctg

SEQ ID NO: 1333441 - DNA, 22 bp, Artificial Sequence
  chemically synthesized
attaaaattccaaagagtttct

SEQ ID NO: 1333442 - DNA, 22 bp, Artificial Sequence
  chemically synthesized
tattaaaattccaaagagtttc

SEQ ID NO: 1333443 - DNA, 22 bp, Artificial Sequence
  chemically synthesized
ttattaaaattccaaagagttt

SEQ ID NO: 1333444 - DNA, 22 bp, Artificial Sequence
  chemically synthesized
gtccaagtcagaaactctttgg

SEQ ID NO: 1333445 - DNA, 22 bp, Artificial Sequence
  chemically synthesized
tccaagtcagaaactctttgga

SEQ ID NO: 1333446 - DNA, 22 bp, Artificial Sequence
  chemically synthesized
cttttattaaaattccaaagag

SEQ ID NO: 1333447 - DNA, 22 bp, Artificial Sequence
  chemically synthesized
tgttacttttattaaaattcca

SEQ ID NO: 1333448 - DNA, 22 bp, Artificial Sequence
  chemically synthesized
aattatgttacttttattaaaa

SEQ ID NO: 1333449 - DNA, 22 bp, Artificial Sequence
  chemically synthesized
taaattatgttacttttattaa

SEQ ID NO: 1333450 - DNA, 22 bp, Artificial Sequence
  chemically synthesized
ctaaattatgttacttttatta

SEQ ID NO: 1333451 - DNA, 22 bp, Artificial Sequence
  chemically synthesized
tttggaattttaataaaagtaa

SEQ ID NO: 1333452 - DNA, 22 bp, Artificial Sequence
  chemically synthesized
tggaattttaataaaagtaaca

SEQ ID NO: 1333453 - DNA, 22 bp, Artificial Sequence
  chemically synthesized
atttctaaattatgttactttt

SEQ ID NO: 1333454 - DNA, 22 bp, Artificial Sequence
  chemically synthesized
ggaattttaataaaagtaacat

SEQ ID NO: 1333455 - DNA, 22 bp, Artificial Sequence
  chemically synthesized
gaattttaataaaagtaacata

SEQ ID NO: 1333456 - DNA, 22 bp, Artificial Sequence
  chemically synthesized
taataaaagtaacataatttag

SEQ ID NO: 1333457 - DNA, 22 bp, Artificial Sequence
  chemically synthesized
aataaaagtaacataatttaga

SEQ ID NO: 1333458 - DNA, 22 bp, Artificial Sequence
  chemically synthesized
ataaaagtaacataatttagaa

SEQ ID NO: 1333459 - DNA, 22 bp, Artificial Sequence
  chemically synthesized
aagtatattaatttctaaatta

SEQ ID NO: 1333460 - DNA, 22 bp, Artificial Sequence
  chemically synthesized
gaagtatattaatttctaaatt

SEQ ID NO: 1333461 - DNA, 22 bp, Artificial Sequence
  chemically synthesized
tcagtatatttgaagtatatta

SEQ ID NO: 1333462 - DNA, 22 bp, Artificial Sequence
  chemically synthesized
agaaattaatatacttcaaata

SEQ ID NO: 1333463 - DNA, 22 bp, Artificial Sequence
  chemically synthesized
gaaattaatatacttcaaatat

SEQ ID NO: 1333464 - DNA, 22 bp, Artificial Sequence
  chemically synthesized
ccaatatatactgtcagtatat

SEQ ID NO: 1333465 - DNA, 22 bp, Artificial Sequence
  chemically synthesized
atatacttcaaatatactgaca

SEQ ID NO: 1333466 - DNA, 22 bp, Artificial Sequence
  chemically synthesized
ttgccaatatatactgtcagta

SEQ ID NO: 1333467 - DNA, 22 bp, Artificial Sequence
  chemically synthesized
tgttgccaatatatactgtcag

SEQ ID NO: 1333468 - DNA, 22 bp, Artificial Sequence
  chemically synthesized
caaatatactgacagtatatat

SEQ ID NO: 1333469 - DNA, 22 bp, Artificial Sequence
  chemically synthesized
aaatatactgacagtatatatt

SEQ ID NO: 1333470 - DNA, 22 bp, Artificial Sequence
  chemically synthesized
gcatatattctgttgccaatat

SEQ ID NO: 1333471 - DNA, 22 bp, Artificial Sequence
  chemically synthesized
acagtatatattggcaacagaa

SEQ ID NO: 1333472 - DNA, 22 bp, Artificial Sequence
  chemically synthesized
aattagcatatattctgttgcc

SEQ ID NO: 1333473 - DNA, 22 bp, Artificial Sequence
  chemically synthesized
taaattagcatatattctgttg

SEQ ID NO: 1333474 - DNA, 22 bp, Artificial Sequence
  chemically synthesized
aaattctaaattagcatatatt

SEQ ID NO: 1333475 - DNA, 22 bp, Artificial Sequence
  chemically synthesized
gcaacagaatatatgctaattt

SEQ ID NO: 1333476 - DNA, 22 bp, Artificial Sequence
  chemically synthesized
tagaatatcctaaaattctaaa

SEQ ID NO: 1333477 - DNA, 22 bp, Artificial Sequence
  chemically synthesized
attatagaatatcctaaaattc

SEQ ID NO: 1333478 - DNA, 22 bp, Artificial Sequence
  chemically synthesized
aattatagaatatcctaaaatt

SEQ ID NO: 1333479 - DNA, 22 bp, Artificial Sequence
  chemically synthesized
taattatagaatatcctaaaat

SEQ ID NO: 1333480 - DNA, 22 bp, Artificial Sequence
  chemically synthesized
ttaattatagaatatcctaaaa

SEQ ID NO: 1333481 - DNA, 22 bp, Artificial Sequence
  chemically synthesized
tttaattatagaatatcctaaa

SEQ ID NO: 1333482 - DNA, 22 bp, Artificial Sequence
  chemically synthesized
ttttaattatagaatatcctaa

SEQ ID NO: 1333483 - DNA, 22 bp, Artificial Sequence
  chemically synthesized
tttttaattatagaatatccta

SEQ ID NO: 1333484 - DNA, 22 bp, Artificial Sequence
  chemically synthesized
atttagaattttaggatattct

SEQ ID NO: 1333485 - DNA, 22 bp, Artificial Sequence
  chemically synthesized
ttttttaattatagaatatcct

SEQ ID NO: 1333486 - DNA, 22 bp, Artificial Sequence
  chemically synthesized
agaattttaggatattctataa

SEQ ID NO: 1333487 - DNA, 22 bp, Artificial Sequence
  chemically synthesized
gaattttaggatattctataat

SEQ ID NO: 1333488 - DNA, 22 bp, Artificial Sequence
  chemically synthesized
tcaggtttttttttaattatag

SEQ ID NO: 1333489 - DNA, 22 bp, Artificial Sequence
  chemically synthesized
atcaggtttttttttaattata

SEQ ID NO: 1333490 - DNA, 22 bp, Artificial Sequence
  chemically synthesized
taggatattctataattaaaaa

SEQ ID NO: 1333491 - DNA, 22 bp, Artificial Sequence
  chemically synthesized
aggatattctataattaaaaaa

SEQ ID NO: 1333492 - DNA, 22 bp, Artificial Sequence
  chemically synthesized
ggatattctataattaaaaaaa

SEQ ID NO: 1333493 - DNA, 22 bp, Artificial Sequence
  chemically synthesized
tataattaaaaaaaaacctgat

SEQ ID NO: 1333494 - DNA, 22 bp, Artificial Sequence
  chemically synthesized
taattaaaaaaaaacctgataa

SEQ ID NO: 1333495 - DNA, 22 bp, Artificial Sequence
  chemically synthesized
aaaaaaaacctgataaatcact

SEQ ID NO: 1333496 - DNA, 22 bp, Artificial Sequence
  chemically synthesized
aataaagtgaaaaggtgtagtg

SEQ ID NO: 1333497 - DNA, 22 bp, Artificial Sequence
  chemically synthesized
taaataaagtgaaaaggtgtag

SEQ ID NO: 1333498 - DNA, 22 bp, Artificial Sequence
  chemically synthesized
ctaaataaagtgaaaaggtgta

SEQ ID NO: 1333499 - DNA, 22 bp, Artificial Sequence
  chemically synthesized
ataaatcactacaccttttcac

SEQ ID NO: 1333500 - DNA, 22 bp, Artificial Sequence
  chemically synthesized
aatggtagcttctaaataaagt

SEQ ID NO: 1333501 - DNA, 22 bp, Artificial Sequence
  chemically synthesized
caccttttcactttatttagaa

SEQ ID NO: 1333502 - DNA, 22 bp, Artificial Sequence
  chemically synthesized
ttaaatggtagcttctaaataa

SEQ ID NO: 1333503 - DNA, 22 bp, Artificial Sequence
  chemically synthesized
ttattaaatggtagcttctaaa

SEQ ID NO: 1333504 - DNA, 22 bp, Artificial Sequence
  chemically synthesized
attattaaatggtagcttctaa

SEQ ID NO: 1333505 - DNA, 22 bp, Artificial Sequence
  chemically synthesized
ttcactttatttagaagctacc

SEQ ID NO: 1333506 - DNA, 22 bp, Artificial Sequence
  chemically synthesized
tcactttatttagaagctacca

SEQ ID NO: 1333507 - DNA, 22 bp, Artificial Sequence
  chemically synthesized
cactttatttagaagctaccat

SEQ ID NO: 1333508 - DNA, 22 bp, Artificial Sequence
  chemically synthesized
actttatttagaagctaccatt

SEQ ID NO: 1333509 - DNA, 22 bp, Artificial Sequence
  chemically synthesized
aacacttattattaaatggtag

SEQ ID NO: 1333510 - DNA, 22 bp, Artificial Sequence
  chemically synthesized
tatttagaagctaccatttaat

SEQ ID NO: 1333511 - DNA, 22 bp, Artificial Sequence
  chemically synthesized
atttagaagctaccatttaata

SEQ ID NO: 1333512 - DNA, 22 bp, Artificial Sequence
  chemically synthesized
tttagaagctaccatttaataa

SEQ ID NO: 1333513 - DNA, 22 bp, Artificial Sequence
  chemically synthesized
agaagctaccatttaataataa

SEQ ID NO: 1333514 - DNA, 22 bp, Artificial Sequence
  chemically synthesized
gaggttaaacacttattattaa

SEQ ID NO: 1333515 - DNA, 22 bp, Artificial Sequence
  chemically synthesized
gaagctaccatttaataataag

SEQ ID NO: 1333516 - DNA, 22 bp, Artificial Sequence
  chemically synthesized
agaggttaaacacttattatta

SEQ ID NO: 1333517 - DNA, 22 bp, Artificial Sequence
  chemically synthesized
tagaggttaaacacttattatt

SEQ ID NO: 1333518 - DNA, 22 bp, Artificial Sequence
  chemically synthesized
ccatttaataataagtgtttaa

SEQ ID NO: 1333519 - DNA, 22 bp, Artificial Sequence
  chemically synthesized
agaatgattttagaggttaaac

SEQ ID NO: 1333520 - DNA, 22 bp, Artificial Sequence
  chemically synthesized
aataataagtgtttaacctcta

SEQ ID NO: 1333521 - DNA, 22 bp, Artificial Sequence
  chemically synthesized
ataataagtgtttaacctctaa

SEQ ID NO: 1333522 - DNA, 22 bp, Artificial Sequence
  chemically synthesized
aaatatctcagaatgattttag

SEQ ID NO: 1333523 - DNA, 22 bp, Artificial Sequence
  chemically synthesized
tctgaaatatctcagaatgatt

SEQ ID NO: 1333524 - DNA, 22 bp, Artificial Sequence
  chemically synthesized
aacctctaaaatcattctgaga

SEQ ID NO: 1333525 - DNA, 22 bp, Artificial Sequence
  chemically synthesized
acctctaaaatcattctgagat

SEQ ID NO: 1333526 - DNA, 22 bp, Artificial Sequence
  chemically synthesized
attatctgaaatatctcagaat

SEQ ID NO: 1333527 - DNA, 22 bp, Artificial Sequence
  chemically synthesized
cctaattatctgaaatatctca

SEQ ID NO: 1333528 - DNA, 22 bp, Artificial Sequence
  chemically synthesized
taaaatcattctgagatatttc

SEQ ID NO: 1333529 - DNA, 22 bp, Artificial Sequence
  chemically synthesized
aaatcattctgagatatttcag

SEQ ID NO: 1333530 - DNA, 22 bp, Artificial Sequence
  chemically synthesized
caggctgcctaattatctgaaa

SEQ ID NO: 1333531 - DNA, 22 bp, Artificial Sequence
  chemically synthesized
tgagatatttcagataattagg

SEQ ID NO: 1333532 - DNA, 22 bp, Artificial Sequence
  chemically synthesized
agatatttcagataattaggca

SEQ ID NO: 1333533 - DNA, 22 bp, Artificial Sequence
  chemically synthesized
taaacagtaattccaggctgcc

SEQ ID NO: 1333534 - DNA, 22 bp, Artificial Sequence
  chemically synthesized
cagataattaggcagcctggaa

SEQ ID NO: 1333535 - DNA, 22 bp, Artificial Sequence
  chemically synthesized
agataattaggcagcctggaat

SEQ ID NO: 1333536 - DNA, 22 bp, Artificial Sequence
  chemically synthesized
ggacaattgtaaacagtaattc

SEQ ID NO: 1333537 - DNA, 22 bp, Artificial Sequence
  chemically synthesized
ggcagcctggaattactgttta

SEQ ID NO: 1333538 - DNA, 22 bp, Artificial Sequence
  chemically synthesized
gaattactgtttacaattgtcc

SEQ ID NO: 1333539 - DNA, 22 bp, Artificial Sequence
  chemically synthesized
ggaagcaaactgggacaattgt

SEQ ID NO: 1333540 - DNA, 22 bp, Artificial Sequence
  chemically synthesized
ttaggaagcaaactgggacaat

SEQ ID NO: 1333541 - DNA, 22 bp, Artificial Sequence
  chemically synthesized
attaggaagcaaactgggacaa

SEQ ID NO: 1333542 - DNA, 22 bp, Artificial Sequence
  chemically synthesized
ctgtttacaattgtcccagttt

SEQ ID NO: 1333543 - DNA, 22 bp, Artificial Sequence
  chemically synthesized
tttacaattgtcccagtttgct

SEQ ID NO: 1333544 - DNA, 22 bp, Artificial Sequence
  chemically synthesized
acaattgtcccagtttgcttcc

SEQ ID NO: 1333545 - DNA, 22 bp, Artificial Sequence
  chemically synthesized
caattgtcccagtttgcttcct

SEQ ID NO: 1333546 - DNA, 22 bp, Artificial Sequence
  chemically synthesized
gacaagcacaacttattaggaa

SEQ ID NO: 1333547 - DNA, 22 bp, Artificial Sequence
  chemically synthesized
tcccagtttgcttcctaataag

SEQ ID NO: 1333548 - DNA, 22 bp, Artificial Sequence
  chemically synthesized
agacaagcacaacttattagga

SEQ ID NO: 1333549 - DNA, 22 bp, Artificial Sequence
  chemically synthesized
gcttcctaataagttgtgcttg

SEQ ID NO: 1333550 - DNA, 22 bp, Artificial Sequence
  chemically synthesized
gacatgtttagacaagcacaac

SEQ ID NO: 1333551 - DNA, 22 bp, Artificial Sequence
  chemically synthesized
cttcctaataagttgtgcttgt

SEQ ID NO: 1333552 - DNA, 22 bp, Artificial Sequence
  chemically synthesized
agacatgtttagacaagcacaa

SEQ ID NO: 1333553 - DNA, 22 bp, Artificial Sequence
  chemically synthesized
cctaataagttgtgcttgtcta

SEQ ID NO: 1333554 - DNA, 22 bp, Artificial Sequence
  chemically synthesized
ctaataagttgtgcttgtctaa

SEQ ID NO: 1333555 - DNA, 22 bp, Artificial Sequence
  chemically synthesized
ataagttgtgcttgtctaaaca

SEQ ID NO: 1333556 - DNA, 22 bp, Artificial Sequence
  chemically synthesized
tgaatagtaatttagacatgtt

SEQ ID NO: 1333557 - DNA, 22 bp, Artificial Sequence
  chemically synthesized
gtgaatagtaatttagacatgt

SEQ ID NO: 1333558 - DNA, 22 bp, Artificial Sequence
  chemically synthesized
tgcttgtctaaacatgtctaaa

SEQ ID NO: 1333559 - DNA, 22 bp, Artificial Sequence
  chemically synthesized
gtctaaacatgtctaaattact

SEQ ID NO: 1333560 - DNA, 22 bp, Artificial Sequence
  chemically synthesized
tctaaacatgtctaaattacta

SEQ ID NO: 1333561 - DNA, 22 bp, Artificial Sequence
  chemically synthesized
aacatgtctaaattactattca

SEQ ID NO: 1333562 - DNA, 22 bp, Artificial Sequence
  chemically synthesized
aattactattcacaaggatcct

SEQ ID NO: 1333563 - DNA, 22 bp, Artificial Sequence
  chemically synthesized
ctattcacaaggatccttgtta

SEQ ID NO: 1333564 - DNA, 22 bp, Artificial Sequence
  chemically synthesized
ttcacaaggatccttgttattt

SEQ ID NO: 1333565 - DNA, 22 bp, Artificial Sequence
  chemically synthesized
atcaaagaagacggaaataaca

SEQ ID NO: 1333566 - DNA, 22 bp, Artificial Sequence
  chemically synthesized
acaaggatccttgttatttccg

SEQ ID NO: 1333567 - DNA, 22 bp, Artificial Sequence
  chemically synthesized
aatcaaagaagacggaaataac

SEQ ID NO: 1333568 - DNA, 22 bp, Artificial Sequence
  chemically synthesized
taatcaaagaagacggaaataa

SEQ ID NO: 1333569 - DNA, 22 bp, Artificial Sequence
  chemically synthesized
ttaatcaaagaagacggaaata

SEQ ID NO: 1333570 - DNA, 22 bp, Artificial Sequence
  chemically synthesized
agaagtttttaatcaaagaaga

SEQ ID NO: 1333571 - DNA, 22 bp, Artificial Sequence
  chemically synthesized
aagaagtttttaatcaaagaag

SEQ ID NO: 1333572 - DNA, 22 bp, Artificial Sequence
  chemically synthesized
gttatttccgtcttctttgatt

SEQ ID NO: 1333573 - DNA, 22 bp, Artificial Sequence
  chemically synthesized
taagaagtttttaatcaaagaa

SEQ ID NO: 1333574 - DNA, 22 bp, Artificial Sequence
  chemically synthesized
ttatttccgtcttctttgatta

SEQ ID NO: 1333575 - DNA, 22 bp, Artificial Sequence
  chemically synthesized
ttaagaagtttttaatcaaaga

SEQ ID NO: 1333576 - DNA, 22 bp, Artificial Sequence
  chemically synthesized
tttccgtcttctttgattaaaa

SEQ ID NO: 1333577 - DNA, 22 bp, Artificial Sequence
  chemically synthesized
ccgtcttctttgattaaaaact

SEQ ID NO: 1333578 - DNA, 22 bp, Artificial Sequence
  chemically synthesized
acatttttaagaagtttttaat

SEQ ID NO: 1333579 - DNA, 22 bp, Artificial Sequence
  chemically synthesized
cgtcttctttgattaaaaactt

SEQ ID NO: 1333580 - DNA, 22 bp, Artificial Sequence
  chemically synthesized
ctttgattaaaaacttcttaaa

SEQ ID NO: 1333581 - DNA, 22 bp, Artificial Sequence
  chemically synthesized
tttgattaaaaacttcttaaaa

SEQ ID NO: 1333582 - DNA, 22 bp, Artificial Sequence
  chemically synthesized
tgattaaaaacttcttaaaaat

SEQ ID NO: 1333583 - DNA, 22 bp, Artificial Sequence
  chemically synthesized
gattaaaaacttcttaaaaatg

SEQ ID NO: 1333584 - DNA, 22 bp, Artificial Sequence
  chemically synthesized
attaaaaacttcttaaaaatgt

SEQ ID NO: 1333585 - DNA, 22 bp, Artificial Sequence
  chemically synthesized
aaaacttcttaaaaatgtgagt

SEQ ID NO: 1333586 - DNA, 22 bp, Artificial Sequence
  chemically synthesized
cttaaaaatgtgagtgtatatg

SEQ ID NO: 1333587 - DNA, 22 bp, Artificial Sequence
  chemically synthesized
ttaaaaatgtgagtgtatatgt

SEQ ID NO: 1333588 - DNA, 22 bp, Artificial Sequence
  chemically synthesized
aaaaatgtgagtgtatatgtgt

SEQ ID NO: 1333589 - DNA, 22 bp, Artificial Sequence
  chemically synthesized
aaaatgtgagtgtatatgtgta

SEQ ID NO: 1333590 - DNA, 22 bp, Artificial Sequence
  chemically synthesized
tgcatatatgtacatatgaata

SEQ ID NO: 1333591 - DNA, 22 bp, Artificial Sequence
  chemically synthesized
atgcatatatgtacatatgaat

SEQ ID NO: 1333592 - DNA, 22 bp, Artificial Sequence
  chemically synthesized
tttatgcatatatgtacatatg

SEQ ID NO: 1333593 - DNA, 22 bp, Artificial Sequence
  chemically synthesized
atttatgcatatatgtacatat

SEQ ID NO: 1333594 - DNA, 22 bp, Artificial Sequence
  chemically synthesized
atatgtacatatatgcataaat

SEQ ID NO: 1333595 - DNA, 22 bp, Artificial Sequence
  chemically synthesized
acatatatatatgggcttattt

SEQ ID NO: 1333596 - DNA, 22 bp, Artificial Sequence
  chemically synthesized
cacatatatatatgggcttatt

SEQ ID NO: 1333597 - DNA, 22 bp, Artificial Sequence
  chemically synthesized
tgtttcacatatatatatgggc

SEQ ID NO: 1333598 - DNA, 22 bp, Artificial Sequence
  chemically synthesized
acaatagaaaaacctgtgtttc

SEQ ID NO: 1333599 - DNA, 22 bp, Artificial Sequence
  chemically synthesized
tattaacaatagaaaaacctgt

SEQ ID NO: 1333600 - DNA, 22 bp, Artificial Sequence
  chemically synthesized
atattaacaatagaaaaacctg

SEQ ID NO: 1333601 - DNA, 22 bp, Artificial Sequence
  chemically synthesized
tatattaacaatagaaaaacct

SEQ ID NO: 1333602 - DNA, 22 bp, Artificial Sequence
  chemically synthesized
ttatattaacaatagaaaaacc

SEQ ID NO: 1333603 - DNA, 22 bp, Artificial Sequence
  chemically synthesized
atgagggatttttatattaaca

SEQ ID NO: 1333604 - DNA, 22 bp, Artificial Sequence
  chemically synthesized
ttctattgttaatataaaaatc

SEQ ID NO: 1333605 - DNA, 22 bp, Artificial Sequence
  chemically synthesized
tctattgttaatataaaaatcc

SEQ ID NO: 1333606 - DNA, 22 bp, Artificial Sequence
  chemically synthesized
ctattgttaatataaaaatccc

SEQ ID NO: 1333607 - DNA, 22 bp, Artificial Sequence
  chemically synthesized
gaaaactaatgagggattttta

SEQ ID NO: 1333608 - DNA, 22 bp, Artificial Sequence
  chemically synthesized
tattgttaatataaaaatccct

SEQ ID NO: 1333609 - DNA, 22 bp, Artificial Sequence
  chemically synthesized
ttgttaatataaaaatccctca

SEQ ID NO: 1333610 - DNA, 22 bp, Artificial Sequence
  chemically synthesized
attagaaaactaatgagggatt

SEQ ID NO: 1333611 - DNA, 22 bp, Artificial Sequence
  chemically synthesized
ttaatataaaaatccctcatta

SEQ ID NO: 1333612 - DNA, 22 bp, Artificial Sequence
  chemically synthesized
atataaaaatccctcattagtt

SEQ ID NO: 1333613 - DNA, 22 bp, Artificial Sequence
  chemically synthesized
ataaactcattagaaaactaat

SEQ ID NO: 1333614 - DNA, 22 bp, Artificial Sequence
  chemically synthesized
cattcataaactcattagaaaa

SEQ ID NO: 1333615 - DNA, 22 bp, Artificial Sequence
  chemically synthesized
attagttttctaatgagtttat

SEQ ID NO: 1333616 - DNA, 22 bp, Artificial Sequence
  chemically synthesized
gttttctaatgagtttatgaat

SEQ ID NO: 1333617 - DNA, 22 bp, Artificial Sequence
  chemically synthesized
aggacgtagactacattcataa

SEQ ID NO: 1333618 - DNA, 22 bp, Artificial Sequence
  chemically synthesized
tctaatgagtttatgaatgtag

SEQ ID NO: 1333619 - DNA, 22 bp, Artificial Sequence
  chemically synthesized
taaggacgtagactacattcat

SEQ ID NO: 1333620 - DNA, 22 bp, Artificial Sequence
  chemically synthesized
ctaatgagtttatgaatgtagt

SEQ ID NO: 1333621 - DNA, 22 bp, Artificial Sequence
  chemically synthesized
ctaaggacgtagactacattca

SEQ ID NO: 1333622 - DNA, 22 bp, Artificial Sequence
  chemically synthesized
taatgagtttatgaatgtagtc

SEQ ID NO: 1333623 - DNA, 22 bp, Artificial Sequence
  chemically synthesized
atgagtttatgaatgtagtcta

SEQ ID NO: 1333624 - DNA, 22 bp, Artificial Sequence
  chemically synthesized
aatttctaaggacgtagactac

SEQ ID NO: 1333625 - DNA, 22 bp, Artificial Sequence
  chemically synthesized
atgaatgtagtctacgtcctta

SEQ ID NO: 1333626 - DNA, 22 bp, Artificial Sequence
  chemically synthesized
aaattaaatttctaaggacgta

SEQ ID NO: 1333627 - DNA, 22 bp, Artificial Sequence
  chemically synthesized
tgaatgtagtctacgtccttag

SEQ ID NO: 1333628 - DNA, 22 bp, Artificial Sequence
  chemically synthesized
cctcaaattaaatttctaagga

SEQ ID NO: 1333629 - DNA, 22 bp, Artificial Sequence
  chemically synthesized
acctcaaattaaatttctaagg

SEQ ID NO: 1333630 - DNA, 22 bp, Artificial Sequence
  chemically synthesized
tacctcaaattaaatttctaag

SEQ ID NO: 1333631 - DNA, 22 bp, Artificial Sequence
  chemically synthesized
ttacctcaaattaaatttctaa

SEQ ID NO: 1333632 - DNA, 22 bp, Artificial Sequence
  chemically synthesized
cgtccttagaaatttaatttga

SEQ ID NO: 1333633 - DNA, 22 bp, Artificial Sequence
  chemically synthesized
agaaatttaatttgaggtaaaa

SEQ ID NO: 1333634 - DNA, 22 bp, Artificial Sequence
  chemically synthesized
gaaatttaatttgaggtaaaaa

SEQ ID NO: 1333635 - DNA, 22 bp, Artificial Sequence
  chemically synthesized
taaacgataatatttttacctc

SEQ ID NO: 1333636 - DNA, 22 bp, Artificial Sequence
  chemically synthesized
atctataaacgataatattttt

SEQ ID NO: 1333637 - DNA, 22 bp, Artificial Sequence
  chemically synthesized
aatctataaacgataatatttt

SEQ ID NO: 1333638 - DNA, 22 bp, Artificial Sequence
  chemically synthesized
aatttgaggtaaaaatattatc

SEQ ID NO: 1333639 - DNA, 22 bp, Artificial Sequence
  chemically synthesized
atttgaggtaaaaatattatcg

SEQ ID NO: 1333640 - DNA, 22 bp, Artificial Sequence
  chemically synthesized
gaggtaaaaatattatcgttta

SEQ ID NO: 1333641 - DNA, 22 bp, Artificial Sequence
  chemically synthesized
aggtaaaaatattatcgtttat

SEQ ID NO: 1333642 - DNA, 22 bp, Artificial Sequence
  chemically synthesized
tcgtttatagattaaggtctgg

SEQ ID NO: 1333643 - DNA, 22 bp, Artificial Sequence
  chemically synthesized
atagattaaggtctggatattt

SEQ ID NO: 1333644 - DNA, 22 bp, Artificial Sequence
  chemically synthesized
tagattaaggtctggatatttt

SEQ ID NO: 1333645 - DNA, 22 bp, Artificial Sequence
  chemically synthesized
gtatgaagaaaagaaaaaaata

SEQ ID NO: 1333646 - DNA, 22 bp, Artificial Sequence
  chemically synthesized
tagtatgaagaaaagaaaaaaa

SEQ ID NO: 1333647 - DNA, 22 bp, Artificial Sequence
  chemically synthesized
aggtctggatatttttttcttt

SEQ ID NO: 1333648 - DNA, 22 bp, Artificial Sequence
  chemically synthesized
ctagtatgaagaaaagaaaaaa

SEQ ID NO: 1333649 - DNA, 22 bp, Artificial Sequence
  chemically synthesized
tttctagtatgaagaaaagaaa

SEQ ID NO: 1333650 - DNA, 22 bp, Artificial Sequence
  chemically synthesized
gatatttttttcttttcttcat

SEQ ID NO: 1333651 - DNA, 22 bp, Artificial Sequence
  chemically synthesized
aaattatttctagtatgaagaa

SEQ ID NO: 1333652 - DNA, 22 bp, Artificial Sequence
  chemically synthesized
ttttcttttcttcatactagaa

SEQ ID NO: 1333653 - DNA, 22 bp, Artificial Sequence
  chemically synthesized
tttcttttcttcatactagaaa

SEQ ID NO: 1333654 - DNA, 22 bp, Artificial Sequence
  chemically synthesized
ttcttttcttcatactagaaat

SEQ ID NO: 1333655 - DNA, 22 bp, Artificial Sequence
  chemically synthesized
tcttttcttcatactagaaata

SEQ ID NO: 1333656 - DNA, 22 bp, Artificial Sequence
  chemically synthesized
cttttcttcatactagaaataa

SEQ ID NO: 1333657 - DNA, 22 bp, Artificial Sequence
  chemically synthesized
aggtatctaaaattatttctag

SEQ ID NO: 1333658 - DNA, 22 bp, Artificial Sequence
  chemically synthesized
ttttcttcatactagaaataat

SEQ ID NO: 1333659 - DNA, 22 bp, Artificial Sequence
  chemically synthesized
caggtatctaaaattatttcta

SEQ ID NO: 1333660 - DNA, 22 bp, Artificial Sequence
  chemically synthesized
ttcttcatactagaaataattt

SEQ ID NO: 1333661 - DNA, 22 bp, Artificial Sequence
  chemically synthesized
tcttcatactagaaataatttt

SEQ ID NO: 1333662 - DNA, 22 bp, Artificial Sequence
  chemically synthesized
cttcatactagaaataatttta

SEQ ID NO: 1333663 - DNA, 22 bp, Artificial Sequence
  chemically synthesized
tcttcaggtatctaaaattatt

SEQ ID NO: 1333664 - DNA, 22 bp, Artificial Sequence
  chemically synthesized
ttcatactagaaataattttag

SEQ ID NO: 1333665 - DNA, 22 bp, Artificial Sequence
  chemically synthesized
gtcttcaggtatctaaaattat

SEQ ID NO: 1333666 - DNA, 22 bp, Artificial Sequence
  chemically synthesized
tgtcttcaggtatctaaaatta

SEQ ID NO: 1333667 - DNA, 22 bp, Artificial Sequence
  chemically synthesized
catactagaaataattttagat

SEQ ID NO: 1333668 - DNA, 22 bp, Artificial Sequence
  chemically synthesized
atactagaaataattttagata

SEQ ID NO: 1333669 - DNA, 22 bp, Artificial Sequence
  chemically synthesized
gaaataattttagatacctgaa

SEQ ID NO: 1333670 - DNA, 22 bp, Artificial Sequence
  chemically synthesized
atgaactttgtcttcaggtatc

SEQ ID NO: 1333671 - DNA, 22 bp, Artificial Sequence
  chemically synthesized
aatgaactttgtcttcaggtat

SEQ ID NO: 1333672 - DNA, 22 bp, Artificial Sequence
  chemically synthesized
taatgaactttgtcttcaggta

SEQ ID NO: 1333673 - DNA, 22 bp, Artificial Sequence
  chemically synthesized
tggctttaatgaactttgtctt

SEQ ID NO: 1333674 - DNA, 22 bp, Artificial Sequence
  chemically synthesized
tagatacctgaagacaaagttc

SEQ ID NO: 1333675 - DNA, 22 bp, Artificial Sequence
  chemically synthesized
agatacctgaagacaaagttca

SEQ ID NO: 1333676 - DNA, 22 bp, Artificial Sequence
  chemically synthesized
gatacctgaagacaaagttcat

SEQ ID NO: 1333677 - DNA, 22 bp, Artificial Sequence
  chemically synthesized
ggttgtggctttaatgaacttt

SEQ ID NO: 1333678 - DNA, 22 bp, Artificial Sequence
  chemically synthesized
gggttgtggctttaatgaactt

SEQ ID NO: 1333679 - DNA, 22 bp, Artificial Sequence
  chemically synthesized
tgggttgtggctttaatgaact

SEQ ID NO: 1333680 - DNA, 22 bp, Artificial Sequence
  chemically synthesized
ttgggttgtggctttaatgaac

SEQ ID NO: 1333681 - DNA, 22 bp, Artificial Sequence
  chemically synthesized
tttgggttgtggctttaatgaa

SEQ ID NO: 1333682 - DNA, 22 bp, Artificial Sequence
  chemically synthesized
aagacaaagttcattaaagcca

SEQ ID NO: 1333683 - DNA, 22 bp, Artificial Sequence
  chemically synthesized
ctttttgggttgtggctttaat

SEQ ID NO: 1333684 - DNA, 22 bp, Artificial Sequence
  chemically synthesized
tactttttgggttgtggcttta

SEQ ID NO: 1333685 - DNA, 22 bp, Artificial Sequence
  chemically synthesized
attaaagccacaacccaaaaag

SEQ ID NO: 1333686 - DNA, 22 bp, Artificial Sequence
  chemically synthesized
aagccacaacccaaaaagtaga

SEQ ID NO: 1333687 - DNA, 22 bp, Artificial Sequence
  chemically synthesized
aaataagaaggaacccatattc

SEQ ID NO: 1333688 - DNA, 22 bp, Artificial Sequence
  chemically synthesized
taggataatgcaaatcactgaa

SEQ ID NO: 1333689 - DNA, 22 bp, Artificial Sequence
  chemically synthesized
cttcttatttcagtgatttgca

SEQ ID NO: 1333690 - DNA, 22 bp, Artificial Sequence
  chemically synthesized
cttatttcagtgatttgcatta

SEQ ID NO: 1333691 - DNA, 22 bp, Artificial Sequence
  chemically synthesized
ttatttcagtgatttgcattat

SEQ ID NO: 1333692 - DNA, 22 bp, Artificial Sequence
  chemically synthesized
atttcagtgatttgcattatcc

SEQ ID NO: 1333693 - DNA, 22 bp, Artificial Sequence
  chemically synthesized
tttcagtgatttgcattatcct

SEQ ID NO: 1333694 - DNA, 22 bp, Artificial Sequence
  chemically synthesized
cagtgatttgcattatcctata

SEQ ID NO: 1333695 - DNA, 22 bp, Artificial Sequence
  chemically synthesized
acaccaataacctataggataa

SEQ ID NO: 1333696 - DNA, 22 bp, Artificial Sequence
  chemically synthesized
agtgatttgcattatcctatag

SEQ ID NO: 1333697 - DNA, 22 bp, Artificial Sequence
  chemically synthesized
gacaccaataacctataggata

SEQ ID NO: 1333698 - DNA, 22 bp, Artificial Sequence
  chemically synthesized
gcattatcctataggttattgg

SEQ ID NO: 1333699 - DNA, 22 bp, Artificial Sequence
  chemically synthesized
cattatcctataggttattggt

SEQ ID NO: 1333700 - DNA, 22 bp, Artificial Sequence
  chemically synthesized
tcctataggttattggtgtcaa

SEQ ID NO: 1333701 - DNA, 22 bp, Artificial Sequence
  chemically synthesized
taggttattggtgtcaaacccc

SEQ ID NO: 1333702 - DNA, 22 bp, Artificial Sequence
  chemically synthesized
tgaggaagggaagaaaggggtt

SEQ ID NO: 1333703 - DNA, 22 bp, Artificial Sequence
  chemically synthesized
ttggtgtcaaacccctttcttc

SEQ ID NO: 1333704 - DNA, 22 bp, Artificial Sequence
  chemically synthesized
ttgtgaggaagggaagaaaggg

SEQ ID NO: 1333705 - DNA, 22 bp, Artificial Sequence
  chemically synthesized
gttgtgaggaagggaagaaagg

SEQ ID NO: 1333706 - DNA, 22 bp, Artificial Sequence
  chemically synthesized
tgttgtgaggaagggaagaaag

SEQ ID NO: 1333707 - DNA, 22 bp, Artificial Sequence
  chemically synthesized
gtgtcaaacccctttcttccct

SEQ ID NO: 1333708 - DNA, 22 bp, Artificial Sequence
  chemically synthesized
ttgttgtgaggaagggaagaaa

SEQ ID NO: 1333709 - DNA, 22 bp, Artificial Sequence
  chemically synthesized
gggcttttgttgtgaggaaggg

SEQ ID NO: 1333710 - DNA, 22 bp, Artificial Sequence
  chemically synthesized
aattggggcttttgttgtgagg

SEQ ID NO: 1333711 - DNA, 22 bp, Artificial Sequence
  chemically synthesized
tcttcccttcctcacaacaaaa

SEQ ID NO: 1333712 - DNA, 22 bp, Artificial Sequence
  chemically synthesized
cttcccttcctcacaacaaaag

SEQ ID NO: 1333713 - DNA, 22 bp, Artificial Sequence
  chemically synthesized
ttcccttcctcacaacaaaagc

SEQ ID NO: 1333714 - DNA, 22 bp, Artificial Sequence
  chemically synthesized
cccttcctcacaacaaaagccc

SEQ ID NO: 1333715 - DNA, 22 bp, Artificial Sequence
  chemically synthesized
ccttcctcacaacaaaagcccc

SEQ ID NO: 1333716 - DNA, 22 bp, Artificial Sequence
  chemically synthesized
taaaagttaaattggggctttt

SEQ ID NO: 1333717 - DNA, 22 bp, Artificial Sequence
  chemically synthesized
tataaaagttaaattggggctt

SEQ ID NO: 1333718 - DNA, 22 bp, Artificial Sequence
  chemically synthesized
cctcacaacaaaagccccaatt

SEQ ID NO: 1333719 - DNA, 22 bp, Artificial Sequence
  chemically synthesized
ctataaaagttaaattggggct

SEQ ID NO: 1333720 - DNA, 22 bp, Artificial Sequence
  chemically synthesized
ctcacaacaaaagccccaattt

SEQ ID NO: 1333721 - DNA, 22 bp, Artificial Sequence
  chemically synthesized
tctataaaagttaaattggggc

SEQ ID NO: 1333722 - DNA, 22 bp, Artificial Sequence
  chemically synthesized
acaacaaaagccccaatttaac

SEQ ID NO: 1333723 - DNA, 22 bp, Artificial Sequence
  chemically synthesized
catatgcctttctataaaagtt

SEQ ID NO: 1333724 - DNA, 22 bp, Artificial Sequence
  chemically synthesized
ttccatatgcctttctataaaa

SEQ ID NO: 1333725 - DNA, 22 bp, Artificial Sequence
  chemically synthesized
ctgttccatatgcctttctata

SEQ ID NO: 1333726 - DNA, 22 bp, Artificial Sequence
  chemically synthesized
aacttttatagaaaggcatatg

SEQ ID NO: 1333727 - DNA, 22 bp, Artificial Sequence
  chemically synthesized
acttttatagaaaggcatatgg

SEQ ID NO: 1333728 - DNA, 22 bp, Artificial Sequence
  chemically synthesized
gatgactcctgttccatatgcc

SEQ ID NO: 1333729 - DNA, 22 bp, Artificial Sequence
  chemically synthesized
ggatgactcctgttccatatgc

SEQ ID NO: 1333730 - DNA, 22 bp, Artificial Sequence
  chemically synthesized
ttatagaaaggcatatggaaca

SEQ ID NO: 1333731 - DNA, 22 bp, Artificial Sequence
  chemically synthesized
tatagaaaggcatatggaacag

SEQ ID NO: 1333732 - DNA, 22 bp, Artificial Sequence
  chemically synthesized
atagaaaggcatatggaacagg

SEQ ID NO: 1333733 - DNA, 22 bp, Artificial Sequence
  chemically synthesized
tagaaaggcatatggaacagga

SEQ ID NO: 1333734 - DNA, 22 bp, Artificial Sequence
  chemically synthesized
ggatatatttggatgactcctg

SEQ ID NO: 1333735 - DNA, 22 bp, Artificial Sequence
  chemically synthesized
caacccctgggatatatttgga

SEQ ID NO: 1333736 - DNA, 22 bp, Artificial Sequence
  chemically synthesized
gcaacccctgggatatatttgg

SEQ ID NO: 1333737 - DNA, 22 bp, Artificial Sequence
  chemically synthesized
gtcaatttgcaacccctgggat

SEQ ID NO: 1333738 - DNA, 22 bp, Artificial Sequence
  chemically synthesized
ggtcaatttgcaacccctggga

SEQ ID NO: 1333739 - DNA, 22 bp, Artificial Sequence
  chemically synthesized
tggtcaatttgcaacccctggg

SEQ ID NO: 1333740 - DNA, 22 bp, Artificial Sequence
  chemically synthesized
ttggtcaatttgcaacccctgg

SEQ ID NO: 1333741 - DNA, 22 bp, Artificial Sequence
  chemically synthesized
ttttggtcaatttgcaacccct

SEQ ID NO: 1333742 - DNA, 22 bp, Artificial Sequence
  chemically synthesized
aaggtgactcttttggtcaatt

SEQ ID NO: 1333743 - DNA, 22 bp, Artificial Sequence
  chemically synthesized
cctaaaggtgactcttttggtc

SEQ ID NO: 1333744 - DNA, 22 bp, Artificial Sequence
  chemically synthesized
ccctaaaggtgactcttttggt

SEQ ID NO: 1333745 - DNA, 22 bp, Artificial Sequence
  chemically synthesized
caaattgaccaaaagagtcacc

SEQ ID NO: 1333746 - DNA, 22 bp, Artificial Sequence
  chemically synthesized
accaaaagagtcacctttaggg

SEQ ID NO: 1333747 - DNA, 22 bp, Artificial Sequence
  chemically synthesized
agaagcaggcttccctaaaggt

SEQ ID NO: 1333748 - DNA, 22 bp, Artificial Sequence
  chemically synthesized
cacaagcattcagaagcaggct

SEQ ID NO: 1333749 - DNA, 22 bp, Artificial Sequence
  chemically synthesized
tagggaagcctgcttctgaatg

SEQ ID NO: 1333750 - DNA, 22 bp, Artificial Sequence
  chemically synthesized
agggaagcctgcttctgaatgc

SEQ ID NO: 1333751 - DNA, 22 bp, Artificial Sequence
  chemically synthesized
gggaagcctgcttctgaatgct

SEQ ID NO: 1333752 - DNA, 22 bp, Artificial Sequence
  chemically synthesized
agaagaatgataaattccacaa

SEQ ID NO: 1333753 - DNA, 22 bp, Artificial Sequence
  chemically synthesized
cttctgaatgcttgtggaattt

SEQ ID NO: 1333754 - DNA, 22 bp, Artificial Sequence
  chemically synthesized
ctgaatgcttgtggaatttatc

SEQ ID NO: 1333755 - DNA, 22 bp, Artificial Sequence
  chemically synthesized
tgaatgcttgtggaatttatca

SEQ ID NO: 1333756 - DNA, 22 bp, Artificial Sequence
  chemically synthesized
aatgcttgtggaatttatcatt

SEQ ID NO: 1333757 - DNA, 22 bp, Artificial Sequence
  chemically synthesized
gtggaatttatcattcttctga

SEQ ID NO: 1333758 - DNA, 22 bp, Artificial Sequence
  chemically synthesized
tggaatttatcattcttctgaa

SEQ ID NO: 1333759 - DNA, 22 bp, Artificial Sequence
  chemically synthesized
cagataaatgcaacagccattc

SEQ ID NO: 1333760 - DNA, 22 bp, Artificial Sequence
  chemically synthesized
atcattcttctgaatggctgtt

SEQ ID NO: 1333761 - DNA, 22 bp, Artificial Sequence
  chemically synthesized
tcattcttctgaatggctgttg

SEQ ID NO: 1333762 - DNA, 22 bp, Artificial Sequence
  chemically synthesized
ttctgaatggctgttgcattta

SEQ ID NO: 1333763 - DNA, 22 bp, Artificial Sequence
  chemically synthesized
ctgaatggctgttgcatttatc

SEQ ID NO: 1333764 - DNA, 22 bp, Artificial Sequence
  chemically synthesized
tgaatggctgttgcatttatct

SEQ ID NO: 1333765 - DNA, 22 bp, Artificial Sequence
  chemically synthesized
aatggctgttgcatttatctgc

SEQ ID NO: 1333766 - DNA, 22 bp, Artificial Sequence
  chemically synthesized
gtgagtaaaagctgcagataaa

SEQ ID NO: 1333767 - DNA, 22 bp, Artificial Sequence
  chemically synthesized
atctggtgagtaaaagctgcag

SEQ ID NO: 1333768 - DNA, 22 bp, Artificial Sequence
  chemically synthesized
ttgcatttatctgcagctttta

SEQ ID NO: 1333769 - DNA, 22 bp, Artificial Sequence
  chemically synthesized
catttatctgcagcttttactc

SEQ ID NO: 1333770 - DNA, 22 bp, Artificial Sequence
  chemically synthesized
aggtctcatctggtgagtaaaa

SEQ ID NO: 1333771 - DNA, 22 bp, Artificial Sequence
  chemically synthesized
atctgcagcttttactcaccag

SEQ ID NO: 1333772 - DNA, 22 bp, Artificial Sequence
  chemically synthesized
tctgcagcttttactcaccaga

SEQ ID NO: 1333773 - DNA, 22 bp, Artificial Sequence
  chemically synthesized
cagcttttactcaccagatgag

SEQ ID NO: 1333774 - DNA, 22 bp, Artificial Sequence
  chemically synthesized
aaatgtctgaggtctcatctgg

SEQ ID NO: 1333775 - DNA, 22 bp, Artificial Sequence
  chemically synthesized
gaaatgtctgaggtctcatctg

SEQ ID NO: 1333776 - DNA, 22 bp, Artificial Sequence
  chemically synthesized
ttactcaccagatgagacctca

SEQ ID NO: 1333777 - DNA, 22 bp, Artificial Sequence
  chemically synthesized
tactcaccagatgagacctcag

SEQ ID NO: 1333778 - DNA, 22 bp, Artificial Sequence
  chemically synthesized
actcaccagatgagacctcaga

SEQ ID NO: 1333779 - DNA, 22 bp, Artificial Sequence
  chemically synthesized
ctcaccagatgagacctcagac

SEQ ID NO: 1333780 - DNA, 22 bp, Artificial Sequence
  chemically synthesized
accagatgagacctcagacatt

SEQ ID NO: 1333781 - DNA, 22 bp, Artificial Sequence
  chemically synthesized
cgcagaatttgaaatgtctgag

SEQ ID NO: 1333782 - DNA, 22 bp, Artificial Sequence
  chemically synthesized
agacatttcaaattctgcggag

SEQ ID NO: 1333783 - DNA, 22 bp, Artificial Sequence
  chemically synthesized
tgaaggtgtgtagccagcctcc

SEQ ID NO: 1333784 - DNA, 22 bp, Artificial Sequence
  chemically synthesized
caaattctgcggaggctggcta

SEQ ID NO: 1333785 - DNA, 22 bp, Artificial Sequence
  chemically synthesized
aaattctgcggaggctggctac

SEQ ID NO: 1333786 - DNA, 22 bp, Artificial Sequence
  chemically synthesized
ctatgaaggtgtgtagccagcc

SEQ ID NO: 1333787 - DNA, 22 bp, Artificial Sequence
  chemically synthesized
cctatgaaggtgtgtagccagc

SEQ ID NO: 1333788 - DNA, 22 bp, Artificial Sequence
  chemically synthesized
tcctatgaaggtgtgtagccag

SEQ ID NO: 1333789 - DNA, 22 bp, Artificial Sequence
  chemically synthesized
tgcggaggctggctacacacct

SEQ ID NO: 1333790 - DNA, 22 bp, Artificial Sequence
  chemically synthesized
cggaggctggctacacaccttc

SEQ ID NO: 1333791 - DNA, 22 bp, Artificial Sequence
  chemically synthesized
gctacacaccttcataggaaag

SEQ ID NO: 1333792 - DNA, 22 bp, Artificial Sequence
  chemically synthesized
cacaccttcataggaaagcttt

SEQ ID NO: 1333793 - DNA, 22 bp, Artificial Sequence
  chemically synthesized
cataggaaagctttttgctgat

SEQ ID NO: 1333794 - DNA, 22 bp, Artificial Sequence
  chemically synthesized
ataggaaagctttttgctgatt

SEQ ID NO: 1333795 - DNA, 22 bp, Artificial Sequence
  chemically synthesized
tttgctgatttccctgttggta

SEQ ID NO: 1333796 - DNA, 22 bp, Artificial Sequence
  chemically synthesized
ttgctgatttccctgttggtac

SEQ ID NO: 1333797 - DNA, 22 bp, Artificial Sequence
  chemically synthesized
tgctgatttccctgttggtact

SEQ ID NO: 1333798 - DNA, 22 bp, Artificial Sequence
  chemically synthesized
gctgatttccctgttggtactt

SEQ ID NO: 1333799 - DNA, 22 bp, Artificial Sequence
  chemically synthesized
ctgatttccctgttggtacttt

SEQ ID NO: 1333800 - DNA, 22 bp, Artificial Sequence
  chemically synthesized
atttccctgttggtacttttct

SEQ ID NO: 1333801 - DNA, 22 bp, Artificial Sequence
  chemically synthesized
ccctgttggtacttttctctta

SEQ ID NO: 1333802 - DNA, 22 bp, Artificial Sequence
  chemically synthesized
cctgttggtacttttctcttac

SEQ ID NO: 1333803 - DNA, 22 bp, Artificial Sequence
  chemically synthesized
ttggtacttttctcttacacat

SEQ ID NO: 1333804 - DNA, 22 bp, Artificial Sequence
  chemically synthesized
ccataccccatagaatgtgtaa

SEQ ID NO: 1333805 - DNA, 22 bp, Artificial Sequence
  chemically synthesized
gtacttttctcttacacattct

SEQ ID NO: 1333806 - DNA, 22 bp, Artificial Sequence
  chemically synthesized
accataccccatagaatgtgta

SEQ ID NO: 1333807 - DNA, 22 bp, Artificial Sequence
  chemically synthesized
ttctcttacacattctatgggg

SEQ ID NO: 1333808 - DNA, 22 bp, Artificial Sequence
  chemically synthesized
tctcttacacattctatggggt

SEQ ID NO: 1333809 - DNA, 22 bp, Artificial Sequence
  chemically synthesized
caggtttaccataccccataga

SEQ ID NO: 1333810 - DNA, 22 bp, Artificial Sequence
  chemically synthesized
ctcttacacattctatggggta

SEQ ID NO: 1333811 - DNA, 22 bp, Artificial Sequence
  chemically synthesized
tcttacacattctatggggtat

SEQ ID NO: 1333812 - DNA, 22 bp, Artificial Sequence
  chemically synthesized
ttacacattctatggggtatgg

SEQ ID NO: 1333813 - DNA, 22 bp, Artificial Sequence
  chemically synthesized
cctccaggtttaccatacccca

SEQ ID NO: 1333814 - DNA, 22 bp, Artificial Sequence
  chemically synthesized
acacattctatggggtatggta

SEQ ID NO: 1333815 - DNA, 22 bp, Artificial Sequence
  chemically synthesized
tacctccaggtttaccataccc

SEQ ID NO: 1333816 - DNA, 22 bp, Artificial Sequence
  chemically synthesized
cacattctatggggtatggtaa

SEQ ID NO: 1333817 - DNA, 22 bp, Artificial Sequence
  chemically synthesized
tgactctacctccaggtttacc

SEQ ID NO: 1333818 - DNA, 22 bp, Artificial Sequence
  chemically synthesized
tatggggtatggtaaacctgga

SEQ ID NO: 1333819 - DNA, 22 bp, Artificial Sequence
  chemically synthesized
tggggtatggtaaacctggagg

SEQ ID NO: 1333820 - DNA, 22 bp, Artificial Sequence
  chemically synthesized
gctatgactctacctccaggtt

SEQ ID NO: 1333821 - DNA, 22 bp, Artificial Sequence
  chemically synthesized
ggctatgactctacctccaggt

SEQ ID NO: 1333822 - DNA, 22 bp, Artificial Sequence
  chemically synthesized
tgcttggctatgactctacctc

SEQ ID NO: 1333823 - DNA, 22 bp, Artificial Sequence
  chemically synthesized
tctgtgcttggctatgactcta

SEQ ID NO: 1333824 - DNA, 22 bp, Artificial Sequence
  chemically synthesized
atctgtgcttggctatgactct

SEQ ID NO: 1333825 - DNA, 22 bp, Artificial Sequence
  chemically synthesized
tatctgtgcttggctatgactc

SEQ ID NO: 1333826 - DNA, 22 bp, Artificial Sequence
  chemically synthesized
ctttatctgtgcttggctatga

SEQ ID NO: 1333827 - DNA, 22 bp, Artificial Sequence
  chemically synthesized
gaggtagagtcatagccaagca

SEQ ID NO: 1333828 - DNA, 22 bp, Artificial Sequence
  chemically synthesized
tgcctgctttatctgtgcttgg

SEQ ID NO: 1333829 - DNA, 22 bp, Artificial Sequence
  chemically synthesized
tgtgcctgctttatctgtgctt

SEQ ID NO: 1333830 - DNA, 22 bp, Artificial Sequence
  chemically synthesized
gtcagagattctgtgcctgctt

SEQ ID NO: 1333831 - DNA, 22 bp, Artificial Sequence
  chemically synthesized
tgaggctggtcagagattctgt

SEQ ID NO: 1333832 - DNA, 22 bp, Artificial Sequence
  chemically synthesized
gtgaggctggtcagagattctg

SEQ ID NO: 1333833 - DNA, 22 bp, Artificial Sequence
  chemically synthesized
tgtgaggctggtcagagattct

SEQ ID NO: 1333834 - DNA, 22 bp, Artificial Sequence
  chemically synthesized
ttgtgaggctggtcagagattc

SEQ ID NO: 1333835 - DNA, 22 bp, Artificial Sequence
  chemically synthesized
cttttgtgaggctggtcagaga

SEQ ID NO: 1333836 - DNA, 22 bp, Artificial Sequence
  chemically synthesized
tctgcttttgtgaggctggtca

SEQ ID NO: 1333837 - DNA, 22 bp, Artificial Sequence
  chemically synthesized
gtctgcttttgtgaggctggtc

SEQ ID NO: 1333838 - DNA, 22 bp, Artificial Sequence
  chemically synthesized
tgtgtttgtctgcttttgtgag

SEQ ID NO: 1333839 - DNA, 22 bp, Artificial Sequence
  chemically synthesized
tgaccagcctcacaaaagcaga

SEQ ID NO: 1333840 - DNA, 22 bp, Artificial Sequence
  chemically synthesized
accagcctcacaaaagcagaca

SEQ ID NO: 1333841 - DNA, 22 bp, Artificial Sequence
  chemically synthesized
acaaaagcagacaaacacacaa

SEQ ID NO: 1333842 - DNA, 22 bp, Artificial Sequence
  chemically synthesized
acggcaaccggagtggaagaaa

SEQ ID NO: 1333843 - DNA, 22 bp, Artificial Sequence
  chemically synthesized
tttgcacctgtttcttccactc

SEQ ID NO: 1333844 - DNA, 22 bp, Artificial Sequence
  chemically synthesized
ttgcacctgtttcttccactcc

SEQ ID NO: 1333845 - DNA, 22 bp, Artificial Sequence
  chemically synthesized
ttcacggcaaccggagtggaag

SEQ ID NO: 1333846 - DNA, 22 bp, Artificial Sequence
  chemically synthesized
tgcacctgtttcttccactccg

SEQ ID NO: 1333847 - DNA, 22 bp, Artificial Sequence
  chemically synthesized
gcacctgtttcttccactccgg

SEQ ID NO: 1333848 - DNA, 22 bp, Artificial Sequence
  chemically synthesized
cacctgtttcttccactccggt

SEQ ID NO: 1333849 - DNA, 22 bp, Artificial Sequence
  chemically synthesized
actattcacggcaaccggagtg

SEQ ID NO: 1333850 - DNA, 22 bp, Artificial Sequence
  chemically synthesized
tttcttccactccggttgccgt

SEQ ID NO: 1333851 - DNA, 22 bp, Artificial Sequence
  chemically synthesized
cttccactccggttgccgtgaa

SEQ ID NO: 1333852 - DNA, 22 bp, Artificial Sequence
  chemically synthesized
ttccactccggttgccgtgaat

SEQ ID NO: 1333853 - DNA, 22 bp, Artificial Sequence
  chemically synthesized
ccactccggttgccgtgaatag

SEQ ID NO: 1333854 - DNA, 22 bp, Artificial Sequence
  chemically synthesized
cactccggttgccgtgaatagt

SEQ ID NO: 1333855 - DNA, 22 bp, Artificial Sequence
  chemically synthesized
tgagaacacctcactattcacg

SEQ ID NO: 1333856 - DNA, 22 bp, Artificial Sequence
  chemically synthesized
cggttgccgtgaatagtgaggt

SEQ ID NO: 1333857 - DNA, 22 bp, Artificial Sequence
  chemically synthesized
aatctgtgagaacacctcacta

SEQ ID NO: 1333858 - DNA, 22 bp, Artificial Sequence
  chemically synthesized
ccgtgaatagtgaggtgttctc

SEQ ID NO: 1333859 - DNA, 22 bp, Artificial Sequence
  chemically synthesized
tgaagctgaatctgtgagaaca

SEQ ID NO: 1333860 - DNA, 22 bp, Artificial Sequence
  chemically synthesized
tctgtgaagctgaatctgtgag

SEQ ID NO: 1333861 - DNA, 22 bp, Artificial Sequence
  chemically synthesized
caaaatgctgtctgtgaagctg

SEQ ID NO: 1333862 - DNA, 22 bp, Artificial Sequence
  chemically synthesized
gcaaaatgctgtctgtgaagct

SEQ ID NO: 1333863 - DNA, 22 bp, Artificial Sequence
  chemically synthesized
tcacagattcagcttcacagac

SEQ ID NO: 1333864 - DNA, 22 bp, Artificial Sequence
  chemically synthesized
acagattcagcttcacagacag

SEQ ID NO: 1333865 - DNA, 22 bp, Artificial Sequence
  chemically synthesized
agcttcacagacagcattttgc

SEQ ID NO: 1333866 - DNA, 22 bp, Artificial Sequence
  chemically synthesized
tgagaggggagtgtttgcaaaa

SEQ ID NO: 1333867 - DNA, 22 bp, Artificial Sequence
  chemically synthesized
cacagacagcattttgcaaaca

SEQ ID NO: 1333868 - DNA, 22 bp, Artificial Sequence
  chemically synthesized
acagacagcattttgcaaacac

SEQ ID NO: 1333869 - DNA, 22 bp, Artificial Sequence
  chemically synthesized
ctgtgagaggggagtgtttgca

SEQ ID NO: 1333870 - DNA, 22 bp, Artificial Sequence
  chemically synthesized
tgcaaacactcccctctcacag

SEQ ID NO: 1333871 - DNA, 22 bp, Artificial Sequence
  chemically synthesized
gcaaacactcccctctcacagc

SEQ ID NO: 1333872 - DNA, 22 bp, Artificial Sequence
  chemically synthesized
caaacactcccctctcacagca

SEQ ID NO: 1333873 - DNA, 22 bp, Artificial Sequence
  chemically synthesized
ccctctcacagcaatggtttct

SEQ ID NO: 1333874 - DNA, 22 bp, Artificial Sequence
  chemically synthesized
agccggtgagggaagaaaccat

SEQ ID NO: 1333875 - DNA, 22 bp, Artificial Sequence
  chemically synthesized
tcacagcaatggtttcttccct

SEQ ID NO: 1333876 - DNA, 22 bp, Artificial Sequence
  chemically synthesized
acagcaatggtttcttccctca

SEQ ID NO: 1333877 - DNA, 22 bp, Artificial Sequence
  chemically synthesized
cttccctcaccggctcaatcta

SEQ ID NO: 1333878 - DNA, 22 bp, Artificial Sequence
  chemically synthesized
ttccctcaccggctcaatctac

SEQ ID NO: 1333879 - DNA, 22 bp, Artificial Sequence
  chemically synthesized
ccctcaccggctcaatctacct

SEQ ID NO: 1333880 - DNA, 22 bp, Artificial Sequence
  chemically synthesized
cctcaccggctcaatctacctg

SEQ ID NO: 1333881 - DNA, 22 bp, Artificial Sequence
  chemically synthesized
gaagggaacgtaatcaggtaga

SEQ ID NO: 1333882 - DNA, 22 bp, Artificial Sequence
  chemically synthesized
accggctcaatctacctgatta

SEQ ID NO: 1333883 - DNA, 22 bp, Artificial Sequence
  chemically synthesized
attagaagggaacgtaatcagg

SEQ ID NO: 1333884 - DNA, 22 bp, Artificial Sequence
  chemically synthesized
ctgattagaagggaacgtaatc

SEQ ID NO: 1333885 - DNA, 22 bp, Artificial Sequence
  chemically synthesized
aatctacctgattacgttccct

SEQ ID NO: 1333886 - DNA, 22 bp, Artificial Sequence
  chemically synthesized
aggttactgattagaagggaac

SEQ ID NO: 1333887 - DNA, 22 bp, Artificial Sequence
  chemically synthesized
cctgattacgttcccttctaat

SEQ ID NO: 1333888 - DNA, 22 bp, Artificial Sequence
  chemically synthesized
attacgttcccttctaatcagt

SEQ ID NO: 1333889 - DNA, 22 bp, Artificial Sequence
  chemically synthesized
gaggaactgaggttactgatta

SEQ ID NO: 1333890 - DNA, 22 bp, Artificial Sequence
  chemically synthesized
cgttcccttctaatcagtaacc

SEQ ID NO: 1333891 - DNA, 22 bp, Artificial Sequence
  chemically synthesized
tagaggaactgaggttactgat

SEQ ID NO: 1333892 - DNA, 22 bp, Artificial Sequence
  chemically synthesized
ctagaggaactgaggttactga

SEQ ID NO: 1333893 - DNA, 22 bp, Artificial Sequence
  chemically synthesized
tttctagaggaactgaggttac

SEQ ID NO: 1333894 - DNA, 22 bp, Artificial Sequence
  chemically synthesized
ccttctaatcagtaacctcagt

SEQ ID NO: 1333895 - DNA, 22 bp, Artificial Sequence
  chemically synthesized
ctaatcagtaacctcagttcct

SEQ ID NO: 1333896 - DNA, 22 bp, Artificial Sequence
  chemically synthesized
taatcagtaacctcagttcctc

SEQ ID NO: 1333897 - DNA, 22 bp, Artificial Sequence
  chemically synthesized
atcagtaacctcagttcctcta

SEQ ID NO: 1333898 - DNA, 22 bp, Artificial Sequence
  chemically synthesized
agttcctctagaaataactgtg

SEQ ID NO: 1333899 - DNA, 22 bp, Artificial Sequence
  chemically synthesized
tataaagcagacgacacagtta

SEQ ID NO: 1333900 - DNA, 22 bp, Artificial Sequence
  chemically synthesized
ctctagaaataactgtgtcgtc

SEQ ID NO: 1333901 - DNA, 22 bp, Artificial Sequence
  chemically synthesized
tagaaataactgtgtcgtctgc

SEQ ID NO: 1333902 - DNA, 22 bp, Artificial Sequence
  chemically synthesized
gaaataactgtgtcgtctgctt

SEQ ID NO: 1333903 - DNA, 22 bp, Artificial Sequence
  chemically synthesized
agataaatcctatataaagcag

SEQ ID NO: 1333904 - DNA, 22 bp, Artificial Sequence
  chemically synthesized
tgtcgtctgctttatataggat

SEQ ID NO: 1333905 - DNA, 22 bp, Artificial Sequence
  chemically synthesized
agactcagataaatcctatata

SEQ ID NO: 1333906 - DNA, 22 bp, Artificial Sequence
  chemically synthesized
cagactcagataaatcctatat

SEQ ID NO: 1333907 - DNA, 22 bp, Artificial Sequence
  chemically synthesized
cttcagactcagataaatccta

SEQ ID NO: 1333908 - DNA, 22 bp, Artificial Sequence
  chemically synthesized
tgcttcagactcagataaatcc

SEQ ID NO: 1333909 - DNA, 22 bp, Artificial Sequence
  chemically synthesized
ctgcttcagactcagataaatc

SEQ ID NO: 1333910 - DNA, 22 bp, Artificial Sequence
  chemically synthesized
ctttatataggatttatctgag

SEQ ID NO: 1333911 - DNA, 22 bp, Artificial Sequence
  chemically synthesized
tatataggatttatctgagtct

SEQ ID NO: 1333912 - DNA, 22 bp, Artificial Sequence
  chemically synthesized
atataggatttatctgagtctg

SEQ ID NO: 1333913 - DNA, 22 bp, Artificial Sequence
  chemically synthesized
cagtttctgcttcagactcaga

SEQ ID NO: 1333914 - DNA, 22 bp, Artificial Sequence
  chemically synthesized
tataggatttatctgagtctga

SEQ ID NO: 1333915 - DNA, 22 bp, Artificial Sequence
  chemically synthesized
ccagtttctgcttcagactcag

SEQ ID NO: 1333916 - DNA, 22 bp, Artificial Sequence
  chemically synthesized
tccagtttctgcttcagactca

SEQ ID NO: 1333917 - DNA, 22 bp, Artificial Sequence
  chemically synthesized
ctttccagtttctgcttcagac

SEQ ID NO: 1333918 - DNA, 22 bp, Artificial Sequence
  chemically synthesized
atctgagtctgaagcagaaact

SEQ ID NO: 1333919 - DNA, 22 bp, Artificial Sequence
  chemically synthesized
agtctactttccagtttctgct

SEQ ID NO: 1333920 - DNA, 22 bp, Artificial Sequence
  chemically synthesized
tctgagtctgaagcagaaactg

SEQ ID NO: 1333921 - DNA, 22 bp, Artificial Sequence
  chemically synthesized
taagtctactttccagtttctg

SEQ ID NO: 1333922 - DNA, 22 bp, Artificial Sequence
  chemically synthesized
agtctgaagcagaaactggaaa

SEQ ID NO: 1333923 - DNA, 22 bp, Artificial Sequence
  chemically synthesized
ctctaagtctactttccagttt

SEQ ID NO: 1333924 - DNA, 22 bp, Artificial Sequence
  chemically synthesized
aagcagaaactggaaagtagac

SEQ ID NO: 1333925 - DNA, 22 bp, Artificial Sequence
  chemically synthesized
ataataatcagctcctctaagt

SEQ ID NO: 1333926 - DNA, 22 bp, Artificial Sequence
  chemically synthesized
cataataatcagctcctctaag

SEQ ID NO: 1333927 - DNA, 22 bp, Artificial Sequence
  chemically synthesized
gaaagtagacttagaggagctg

SEQ ID NO: 1333928 - DNA, 22 bp, Artificial Sequence
  chemically synthesized
agaggagctgattattatgaag

SEQ ID NO: 1333929 - DNA, 22 bp, Artificial Sequence
  chemically synthesized
gaggagctgattattatgaaga

SEQ ID NO: 1333930 - DNA, 22 bp, Artificial Sequence
  chemically synthesized
attattatgaagacacctgtat

SEQ ID NO: 1333931 - DNA, 22 bp, Artificial Sequence
  chemically synthesized
ttatgaagacacctgtattttt

SEQ ID NO: 1333932 - DNA, 22 bp, Artificial Sequence
  chemically synthesized
tgaagacacctgtatttttgtc

SEQ ID NO: 1333933 - DNA, 22 bp, Artificial Sequence
  chemically synthesized
acgtgaataccagacaaaaata

SEQ ID NO: 1333934 - DNA, 22 bp, Artificial Sequence
  chemically synthesized
tcgagttcacgtgaataccaga

SEQ ID NO: 1333935 - DNA, 22 bp, Artificial Sequence
  chemically synthesized
tatttttgtctggtattcacgt

SEQ ID NO: 1333936 - DNA, 22 bp, Artificial Sequence
  chemically synthesized
ttgtctggtattcacgtgaact

SEQ ID NO: 1333937 - DNA, 22 bp, Artificial Sequence
  chemically synthesized
tgtctggtattcacgtgaactc

SEQ ID NO: 1333938 - DNA, 22 bp, Artificial Sequence
  chemically synthesized
gtctggtattcacgtgaactcg

SEQ ID NO: 1333939 - DNA, 22 bp, Artificial Sequence
  chemically synthesized
tctggtattcacgtgaactcga

SEQ ID NO: 1333940 - DNA, 22 bp, Artificial Sequence
  chemically synthesized
gtattcacgtgaactcgacagt

SEQ ID NO: 1333941 - DNA, 22 bp, Artificial Sequence
  chemically synthesized
cataaatgagtgcactgtcgag

SEQ ID NO: 1333942 - DNA, 22 bp, Artificial Sequence
  chemically synthesized
gcataaatgagtgcactgtcga

SEQ ID NO: 1333943 - DNA, 22 bp, Artificial Sequence
  chemically synthesized
acgtgaactcgacagtgcactc

SEQ ID NO: 1333944 - DNA, 22 bp, Artificial Sequence
  chemically synthesized
acaccagtttgcataaatgagt

SEQ ID NO: 1333945 - DNA, 22 bp, Artificial Sequence
  chemically synthesized
gacagtgcactcatttatgcaa

SEQ ID NO: 1333946 - DNA, 22 bp, Artificial Sequence
  chemically synthesized
actaacaccagtttgcataaat

SEQ ID NO: 1333947 - DNA, 22 bp, Artificial Sequence
  chemically synthesized
cactaacaccagtttgcataaa

SEQ ID NO: 1333948 - DNA, 22 bp, Artificial Sequence
  chemically synthesized
tcactaacaccagtttgcataa

SEQ ID NO: 1333949 - DNA, 22 bp, Artificial Sequence
  chemically synthesized
ttcactaacaccagtttgcata

SEQ ID NO: 1333950 - DNA, 22 bp, Artificial Sequence
  chemically synthesized
tttcactaacaccagtttgcat

SEQ ID NO: 1333951 - DNA, 22 bp, Artificial Sequence
  chemically synthesized
tttttcactaacaccagtttgc

SEQ ID NO: 1333952 - DNA, 22 bp, Artificial Sequence
  chemically synthesized
ctttttcactaacaccagtttg

SEQ ID NO: 1333953 - DNA, 22 bp, Artificial Sequence
  chemically synthesized
tctttttcactaacaccagttt

SEQ ID NO: 1333954 - DNA, 22 bp, Artificial Sequence
  chemically synthesized
ttctttttcactaacaccagtt

SEQ ID NO: 1333955 - DNA, 22 bp, Artificial Sequence
  chemically synthesized
tttctttttcactaacaccagt

SEQ ID NO: 1333956 - DNA, 22 bp, Artificial Sequence
  chemically synthesized
atttatgcaaactggtgttagt

SEQ ID NO: 1333957 - DNA, 22 bp, Artificial Sequence
  chemically synthesized
tttttctttttcactaacacca

SEQ ID NO: 1333958 - DNA, 22 bp, Artificial Sequence
  chemically synthesized
ctttttctttttcactaacacc

SEQ ID NO: 1333959 - DNA, 22 bp, Artificial Sequence
  chemically synthesized
atgcaaactggtgttagtgaaa

SEQ ID NO: 1333960 - DNA, 22 bp, Artificial Sequence
  chemically synthesized
cttctttttctttttcactaac

SEQ ID NO: 1333961 - DNA, 22 bp, Artificial Sequence
  chemically synthesized
tgcaaactggtgttagtgaaaa

SEQ ID NO: 1333962 - DNA, 22 bp, Artificial Sequence
  chemically synthesized
tgcttctttttctttttcacta

SEQ ID NO: 1333963 - DNA, 22 bp, Artificial Sequence
  chemically synthesized
tctgcttctttttctttttcac

SEQ ID NO: 1333964 - DNA, 22 bp, Artificial Sequence
  chemically synthesized
ctctgcttctttttctttttca

SEQ ID NO: 1333965 - DNA, 22 bp, Artificial Sequence
  chemically synthesized
cttctctgcttctttttctttt

SEQ ID NO: 1333966 - DNA, 22 bp, Artificial Sequence
  chemically synthesized
ccttctctgcttctttttcttt

SEQ ID NO: 1333967 - DNA, 22 bp, Artificial Sequence
  chemically synthesized
gtgttagtgaaaaagaaaaaga

SEQ ID NO: 1333968 - DNA, 22 bp, Artificial Sequence
  chemically synthesized
cttccttctctgcttctttttc

SEQ ID NO: 1333969 - DNA, 22 bp, Artificial Sequence
  chemically synthesized
gcttccttctctgcttcttttt

SEQ ID NO: 1333970 - DNA, 22 bp, Artificial Sequence
  chemically synthesized
tgcttccttctctgcttctttt

SEQ ID NO: 1333971 - DNA, 22 bp, Artificial Sequence
  chemically synthesized
ttgcttccttctctgcttcttt

SEQ ID NO: 1333972 - DNA, 22 bp, Artificial Sequence
  chemically synthesized
gtgaaaaagaaaaagaagcaga

SEQ ID NO: 1333973 - DNA, 22 bp, Artificial Sequence
  chemically synthesized
tttgcttccttctctgcttctt

SEQ ID NO: 1333974 - DNA, 22 bp, Artificial Sequence
  chemically synthesized
tttttgcttccttctctgcttc

SEQ ID NO: 1333975 - DNA, 22 bp, Artificial Sequence
  chemically synthesized
ctttttgcttccttctctgctt

SEQ ID NO: 1333976 - DNA, 22 bp, Artificial Sequence
  chemically synthesized
ttctttttgcttccttctctgc

SEQ ID NO: 1333977 - DNA, 22 bp, Artificial Sequence
  chemically synthesized
taggtccagtctcttctttttg

SEQ ID NO: 1333978 - DNA, 22 bp, Artificial Sequence
  chemically synthesized
ataggtccagtctcttcttttt

SEQ ID NO: 1333979 - DNA, 22 bp, Artificial Sequence
  chemically synthesized
tataggtccagtctcttctttt

SEQ ID NO: 1333980 - DNA, 22 bp, Artificial Sequence
  chemically synthesized
gcatcacacaggtgcgcaactt

SEQ ID NO: 1333981 - DNA, 22 bp, Artificial Sequence
  chemically synthesized
ctagcatcacacaggtgcgcaa

SEQ ID NO: 1333982 - DNA, 22 bp, Artificial Sequence
  chemically synthesized
gacctataaagttgcgcacctg

SEQ ID NO: 1333983 - DNA, 22 bp, Artificial Sequence
  chemically synthesized
tcctagcatcacacaggtgcgc

SEQ ID NO: 1333984 - DNA, 22 bp, Artificial Sequence
  chemically synthesized
ctcctagcatcacacaggtgcg

SEQ ID NO: 1333985 - DNA, 22 bp, Artificial Sequence
  chemically synthesized
ttctcctagcatcacacaggtg

SEQ ID NO: 1333986 - DNA, 22 bp, Artificial Sequence
  chemically synthesized
cttctcctagcatcacacaggt

SEQ ID NO: 1333987 - DNA, 22 bp, Artificial Sequence
  chemically synthesized
taaagttgcgcacctgtgtgat

SEQ ID NO: 1333988 - DNA, 22 bp, Artificial Sequence
  chemically synthesized
tcttctcctagcatcacacagg

SEQ ID NO: 1333989 - DNA, 22 bp, Artificial Sequence
  chemically synthesized
ttttcttctcctagcatcacac

SEQ ID NO: 1333990 - DNA, 22 bp, Artificial Sequence
  chemically synthesized
cgcacctgtgtgatgctaggag

SEQ ID NO: 1333991 - DNA, 22 bp, Artificial Sequence
  chemically synthesized
gagttattttcttctcctagca

SEQ ID NO: 1333992 - DNA, 22 bp, Artificial Sequence
  chemically synthesized
agagttattttcttctcctagc

SEQ ID NO: 1333993 - DNA, 22 bp, Artificial Sequence
  chemically synthesized
tagagttattttcttctcctag

SEQ ID NO: 1333994 - DNA, 22 bp, Artificial Sequence
  chemically synthesized
ttagagttattttcttctccta

SEQ ID NO: 1333995 - DNA, 22 bp, Artificial Sequence
  chemically synthesized
tgtgatgctaggagaagaaaat

SEQ ID NO: 1333996 - DNA, 22 bp, Artificial Sequence
  chemically synthesized
gacgtttttagagttattttct

SEQ ID NO: 1333997 - DNA, 22 bp, Artificial Sequence
  chemically synthesized
ggagaagaaaataactctaaaa

SEQ ID NO: 1333998 - DNA, 22 bp, Artificial Sequence
  chemically synthesized
agcagcactggacgtttttaga

SEQ ID NO: 1333999 - DNA, 22 bp, Artificial Sequence
  chemically synthesized
cagcagcactggacgtttttag

SEQ ID NO: 1334000 - DNA, 22 bp, Artificial Sequence
  chemically synthesized
tcagcagcactggacgttttta

SEQ ID NO: 1334001 - DNA, 22 bp, Artificial Sequence
  chemically synthesized
aaatgtgttttcagcagcactg

SEQ ID NO: 1334002 - DNA, 22 bp, Artificial Sequence
  chemically synthesized
taaaaacgtccagtgctgctga

SEQ ID NO: 1334003 - DNA, 22 bp, Artificial Sequence
  chemically synthesized
aaaacgtccagtgctgctgaaa

SEQ ID NO: 1334004 - DNA, 22 bp, Artificial Sequence
  chemically synthesized
ataggaagttcaaatgtgtttt

SEQ ID NO: 1334005 - DNA, 22 bp, Artificial Sequence
  chemically synthesized
cataggaagttcaaatgtgttt

SEQ ID NO: 1334006 - DNA, 22 bp, Artificial Sequence
  chemically synthesized
tcataggaagttcaaatgtgtt

SEQ ID NO: 1334007 - DNA, 22 bp, Artificial Sequence
  chemically synthesized
gttttcataggaagttcaaatg

SEQ ID NO: 1334008 - DNA, 22 bp, Artificial Sequence
  chemically synthesized
ctgaaaacacatttgaacttcc

SEQ ID NO: 1334009 - DNA, 22 bp, Artificial Sequence
  chemically synthesized
ttggttttcataggaagttcaa

SEQ ID NO: 1334010 - DNA, 22 bp, Artificial Sequence
  chemically synthesized
aaaacacatttgaacttcctat

SEQ ID NO: 1334011 - DNA, 22 bp, Artificial Sequence
  chemically synthesized
gaacttcctatgaaaaccaaca

SEQ ID NO: 1334012 - DNA, 22 bp, Artificial Sequence
  chemically synthesized
tatgtcaagcactgttggtttt

SEQ ID NO: 1334013 - DNA, 22 bp, Artificial Sequence
  chemically synthesized
aacttcctatgaaaaccaacag

SEQ ID NO: 1334014 - DNA, 22 bp, Artificial Sequence
  chemically synthesized
gtatgtcaagcactgttggttt

SEQ ID NO: 1334015 - DNA, 22 bp, Artificial Sequence
  chemically synthesized
cctatgaaaaccaacagtgctt

SEQ ID NO: 1334016 - DNA, 22 bp, Artificial Sequence
  chemically synthesized
ctatgaaaaccaacagtgcttg

SEQ ID NO: 1334017 - DNA, 22 bp, Artificial Sequence
  chemically synthesized
tgaaaaccaacagtgcttgaca

SEQ ID NO: 1334018 - DNA, 22 bp, Artificial Sequence
  chemically synthesized
gaggaagatatttgtatgtcaa

SEQ ID NO: 1334019 - DNA, 22 bp, Artificial Sequence
  chemically synthesized
aaggtgtgtctggaggaagata

SEQ ID NO: 1334020 - DNA, 22 bp, Artificial Sequence
  chemically synthesized
aaaggtgtgtctggaggaagat

SEQ ID NO: 1334021 - DNA, 22 bp, Artificial Sequence
  chemically synthesized
gacatacaaatatcttcctcca

SEQ ID NO: 1334022 - DNA, 22 bp, Artificial Sequence
  chemically synthesized
taaaggtgtgtctggaggaaga

SEQ ID NO: 1334023 - DNA, 22 bp, Artificial Sequence
  chemically synthesized
acatacaaatatcttcctccag

SEQ ID NO: 1334024 - DNA, 22 bp, Artificial Sequence
  chemically synthesized
ttaaaggtgtgtctggaggaag

SEQ ID NO: 1334025 - DNA, 22 bp, Artificial Sequence
  chemically synthesized
aaatgtatttttaaaggtgtgt

SEQ ID NO: 1334026 - DNA, 22 bp, Artificial Sequence
  chemically synthesized
aaaatgtatttttaaaggtgtg

SEQ ID NO: 1334027 - DNA, 22 bp, Artificial Sequence
  chemically synthesized
taaaatgtatttttaaaggtgt

SEQ ID NO: 1334028 - DNA, 22 bp, Artificial Sequence
  chemically synthesized
cctccagacacacctttaaaaa

SEQ ID NO: 1334029 - DNA, 22 bp, Artificial Sequence
  chemically synthesized
ctccagacacacctttaaaaat

SEQ ID NO: 1334030 - DNA, 22 bp, Artificial Sequence
  chemically synthesized
agattttaaaatgtatttttaa

SEQ ID NO: 1334031 - DNA, 22 bp, Artificial Sequence
  chemically synthesized
cagacacacctttaaaaataca

SEQ ID NO: 1334032 - DNA, 22 bp, Artificial Sequence
  chemically synthesized
cagattttaaaatgtattttta

SEQ ID NO: 1334033 - DNA, 22 bp, Artificial Sequence
  chemically synthesized
tttcagattttaaaatgtattt

SEQ ID NO: 1334034 - DNA, 22 bp, Artificial Sequence
  chemically synthesized
agattgtttcagattttaaaat

SEQ ID NO: 1334035 - DNA, 22 bp, Artificial Sequence
  chemically synthesized
aagattgtttcagattttaaaa

SEQ ID NO: 1334036 - DNA, 22 bp, Artificial Sequence
  chemically synthesized
taaaaatacattttaaaatctg

SEQ ID NO: 1334037 - DNA, 22 bp, Artificial Sequence
  chemically synthesized
aaaaatacattttaaaatctga

SEQ ID NO: 1334038 - DNA, 22 bp, Artificial Sequence
  chemically synthesized
aaaatacattttaaaatctgaa

SEQ ID NO: 1334039 - DNA, 22 bp, Artificial Sequence
  chemically synthesized
agtttaagattgtttcagattt

SEQ ID NO: 1334040 - DNA, 22 bp, Artificial Sequence
  chemically synthesized
gattgagtttaagattgtttca

SEQ ID NO: 1334041 - DNA, 22 bp, Artificial Sequence
  chemically synthesized
agattgagtttaagattgtttc

SEQ ID NO: 1334042 - DNA, 22 bp, Artificial Sequence
  chemically synthesized
taaaatctgaaacaatcttaaa

SEQ ID NO: 1334043 - DNA, 22 bp, Artificial Sequence
  chemically synthesized
aaaatctgaaacaatcttaaac

SEQ ID NO: 1334044 - DNA, 22 bp, Artificial Sequence
  chemically synthesized
aaatctgaaacaatcttaaact

SEQ ID NO: 1334045 - DNA, 22 bp, Artificial Sequence
  chemically synthesized
tggtttagattgagtttaagat

SEQ ID NO: 1334046 - DNA, 22 bp, Artificial Sequence
  chemically synthesized
cattgtggtttagattgagttt

SEQ ID NO: 1334047 - DNA, 22 bp, Artificial Sequence
  chemically synthesized
aaacaatcttaaactcaatcta

SEQ ID NO: 1334048 - DNA, 22 bp, Artificial Sequence
  chemically synthesized
tgcattgtggtttagattgagt

SEQ ID NO: 1334049 - DNA, 22 bp, Artificial Sequence
  chemically synthesized
ctgcattgtggtttagattgag

SEQ ID NO: 1334050 - DNA, 22 bp, Artificial Sequence
  chemically synthesized
acttctgcattgtggtttagat

SEQ ID NO: 1334051 - DNA, 22 bp, Artificial Sequence
  chemically synthesized
aaactcaatctaaaccacaatg

SEQ ID NO: 1334052 - DNA, 22 bp, Artificial Sequence
  chemically synthesized
aactcaatctaaaccacaatgc

SEQ ID NO: 1334053 - DNA, 22 bp, Artificial Sequence
  chemically synthesized
agaattaacttctgcattgtgg

SEQ ID NO: 1334054 - DNA, 22 bp, Artificial Sequence
  chemically synthesized
aagaattaacttctgcattgtg

SEQ ID NO: 1334055 - DNA, 22 bp, Artificial Sequence
  chemically synthesized
aatctaaaccacaatgcagaag

SEQ ID NO: 1334056 - DNA, 22 bp, Artificial Sequence
  chemically synthesized
ccttaagaattaacttctgcat

SEQ ID NO: 1334057 - DNA, 22 bp, Artificial Sequence
  chemically synthesized
gccttaagaattaacttctgca

SEQ ID NO: 1334058 - DNA, 22 bp, Artificial Sequence
  chemically synthesized
aaccacaatgcagaagttaatt

SEQ ID NO: 1334059 - DNA, 22 bp, Artificial Sequence
  chemically synthesized
catttgccttaagaattaactt

SEQ ID NO: 1334060 - DNA, 22 bp, Artificial Sequence
  chemically synthesized
atctccatttgccttaagaatt

SEQ ID NO: 1334061 - DNA, 22 bp, Artificial Sequence
  chemically synthesized
aatctccatttgccttaagaat

SEQ ID NO: 1334062 - DNA, 22 bp, Artificial Sequence
  chemically synthesized
ttaatctccatttgccttaaga

SEQ ID NO: 1334063 - DNA, 22 bp, Artificial Sequence
  chemically synthesized
gttcttaatctccatttgcctt

SEQ ID NO: 1334064 - DNA, 22 bp, Artificial Sequence
  chemically synthesized
cgttcttaatctccatttgcct

SEQ ID NO: 1334065 - DNA, 22 bp, Artificial Sequence
  chemically synthesized
attcttaaggcaaatggagatt

SEQ ID NO: 1334066 - DNA, 22 bp, Artificial Sequence
  chemically synthesized
ttaaggcaaatggagattaaga

SEQ ID NO: 1334067 - DNA, 22 bp, Artificial Sequence
  chemically synthesized
aaggcaaatggagattaagaac

SEQ ID NO: 1334068 - DNA, 22 bp, Artificial Sequence
  chemically synthesized
aggcaaatggagattaagaacg

SEQ ID NO: 1334069 - DNA, 22 bp, Artificial Sequence
  chemically synthesized
tgtggatgaagtttcgttctta

SEQ ID NO: 1334070 - DNA, 22 bp, Artificial Sequence
  chemically synthesized
atgtggatgaagtttcgttctt

SEQ ID NO: 1334071 - DNA, 22 bp, Artificial Sequence
  chemically synthesized
agaacgaaacttcatccacata

SEQ ID NO: 1334072 - DNA, 22 bp, Artificial Sequence
  chemically synthesized
aaacacagggtttatgtggatg

SEQ ID NO: 1334073 - DNA, 22 bp, Artificial Sequence
  chemically synthesized
aaaacacagggtttatgtggat

SEQ ID NO: 1334074 - DNA, 22 bp, Artificial Sequence
  chemically synthesized
taaaacacagggtttatgtgga

SEQ ID NO: 1334075 - DNA, 22 bp, Artificial Sequence
  chemically synthesized
ttaaaacacagggtttatgtgg

SEQ ID NO: 1334076 - DNA, 22 bp, Artificial Sequence
  chemically synthesized
tttaaaacacagggtttatgtg

SEQ ID NO: 1334077 - DNA, 22 bp, Artificial Sequence
  chemically synthesized
ttttaaaacacagggtttatgt

SEQ ID NO: 1334078 - DNA, 22 bp, Artificial Sequence
  chemically synthesized
tttttaaaacacagggtttatg

SEQ ID NO: 1334079 - DNA, 22 bp, Artificial Sequence
  chemically synthesized
tttttttaaaacacagggttta

SEQ ID NO: 1334080 - DNA, 22 bp, Artificial Sequence
  chemically synthesized
catccacataaaccctgtgttt

SEQ ID NO: 1334081 - DNA, 22 bp, Artificial Sequence
  chemically synthesized
attctttttttaaaacacaggg

SEQ ID NO: 1334082 - DNA, 22 bp, Artificial Sequence
  chemically synthesized
atccacataaaccctgtgtttt

SEQ ID NO: 1334083 - DNA, 22 bp, Artificial Sequence
  chemically synthesized
aattctttttttaaaacacagg

SEQ ID NO: 1334084 - DNA, 22 bp, Artificial Sequence
  chemically synthesized
taattctttttttaaaacacag

SEQ ID NO: 1334085 - DNA, 22 bp, Artificial Sequence
  chemically synthesized
ttaattctttttttaaaacaca

SEQ ID NO: 1334086 - DNA, 22 bp, Artificial Sequence
  chemically synthesized
cttttaattctttttttaaaac

SEQ ID NO: 1334087 - DNA, 22 bp, Artificial Sequence
  chemically synthesized
ttccttttaattctttttttaa

SEQ ID NO: 1334088 - DNA, 22 bp, Artificial Sequence
  chemically synthesized
tgttttaaaaaaagaattaaaa

SEQ ID NO: 1334089 - DNA, 22 bp, Artificial Sequence
  chemically synthesized
tacggattattccttttaattc

SEQ ID NO: 1334090 - DNA, 22 bp, Artificial Sequence
  chemically synthesized
taaaaaaagaattaaaaggaat

SEQ ID NO: 1334091 - DNA, 22 bp, Artificial Sequence
  chemically synthesized
aaaaaaagaattaaaaggaata

SEQ ID NO: 1334092 - DNA, 22 bp, Artificial Sequence
  chemically synthesized
aaaaaagaattaaaaggaataa

SEQ ID NO: 1334093 - DNA, 22 bp, Artificial Sequence
  chemically synthesized
agtaagttatacggattattcc

SEQ ID NO: 1334094 - DNA, 22 bp, Artificial Sequence
  chemically synthesized
gagtaagttatacggattattc

SEQ ID NO: 1334095 - DNA, 22 bp, Artificial Sequence
  chemically synthesized
aaaggaataatccgtataactt

SEQ ID NO: 1334096 - DNA, 22 bp, Artificial Sequence
  chemically synthesized
aaatacaaatttgagtaagtta

SEQ ID NO: 1334097 - DNA, 22 bp, Artificial Sequence
  chemically synthesized
caaatacaaatttgagtaagtt

SEQ ID NO: 1334098 - DNA, 22 bp, Artificial Sequence
  chemically synthesized
acttcaaatacaaatttgagta

SEQ ID NO: 1334099 - DNA, 22 bp, Artificial Sequence
  chemically synthesized
aacttcaaatacaaatttgagt

SEQ ID NO: 1334100 - DNA, 22 bp, Artificial Sequence
  chemically synthesized
aaggtttaacttcaaatacaaa

SEQ ID NO: 1334101 - DNA, 22 bp, Artificial Sequence
  chemically synthesized
actcaaatttgtatttgaagtt

SEQ ID NO: 1334102 - DNA, 22 bp, Artificial Sequence
  chemically synthesized
ctcaaatttgtatttgaagtta

SEQ ID NO: 1334103 - DNA, 22 bp, Artificial Sequence
  chemically synthesized
aaatttgtatttgaagttaaac

SEQ ID NO: 1334104 - DNA, 22 bp, Artificial Sequence
  chemically synthesized
aagaagcaggattcaaggttta

SEQ ID NO: 1334105 - DNA, 22 bp, Artificial Sequence
  chemically synthesized
gtatttgaagttaaaccttgaa

SEQ ID NO: 1334106 - DNA, 22 bp, Artificial Sequence
  chemically synthesized
caagaagcaggattcaaggttt

SEQ ID NO: 1334107 - DNA, 22 bp, Artificial Sequence
  chemically synthesized
tatttgaagttaaaccttgaat

SEQ ID NO: 1334108 - DNA, 22 bp, Artificial Sequence
  chemically synthesized
tcaagaagcaggattcaaggtt

SEQ ID NO: 1334109 - DNA, 22 bp, Artificial Sequence
  chemically synthesized
ttcaagaagcaggattcaaggt

SEQ ID NO: 1334110 - DNA, 22 bp, Artificial Sequence
  chemically synthesized
tttcaagaagcaggattcaagg

SEQ ID NO: 1334111 - DNA, 22 bp, Artificial Sequence
  chemically synthesized
gaagttaaaccttgaatcctgc

SEQ ID NO: 1334112 - DNA, 22 bp, Artificial Sequence
  chemically synthesized
ttttttcaagaagcaggattca

SEQ ID NO: 1334113 - DNA, 22 bp, Artificial Sequence
  chemically synthesized
aagttaaaccttgaatcctgct

SEQ ID NO: 1334114 - DNA, 22 bp, Artificial Sequence
  chemically synthesized
tgttttttcaagaagcaggatt

SEQ ID NO: 1334115 - DNA, 22 bp, Artificial Sequence
  chemically synthesized
aaccttgaatcctgcttcttga

SEQ ID NO: 1334116 - DNA, 22 bp, Artificial Sequence
  chemically synthesized
acacaattctgttttttcaaga

SEQ ID NO: 1334117 - DNA, 22 bp, Artificial Sequence
  chemically synthesized
gaatcctgcttcttgaaaaaac

SEQ ID NO: 1334118 - DNA, 22 bp, Artificial Sequence
  chemically synthesized
aatcctgcttcttgaaaaaaca

SEQ ID NO: 1334119 - DNA, 22 bp, Artificial Sequence
  chemically synthesized
cttcttgaaaaaacagaattgt

SEQ ID NO: 1334120 - DNA, 22 bp, Artificial Sequence
  chemically synthesized
cagaagcctgacacaattctgt

SEQ ID NO: 1334121 - DNA, 22 bp, Artificial Sequence
  chemically synthesized
cttgaaaaaacagaattgtgtc

SEQ ID NO: 1334122 - DNA, 22 bp, Artificial Sequence
  chemically synthesized
ttgaaaaaacagaattgtgtca

SEQ ID NO: 1334123 - DNA, 22 bp, Artificial Sequence
  chemically synthesized
gaaaaaacagaattgtgtcagg

SEQ ID NO: 1334124 - DNA, 22 bp, Artificial Sequence
  chemically synthesized
aaaaaacagaattgtgtcaggc

SEQ ID NO: 1334125 - DNA, 22 bp, Artificial Sequence
  chemically synthesized
ggtaaacagtcattacagaagc

SEQ ID NO: 1334126 - DNA, 22 bp, Artificial Sequence
  chemically synthesized
tgggtaaacagtcattacagaa

SEQ ID NO: 1334127 - DNA, 22 bp, Artificial Sequence
  chemically synthesized
tgtcaggcttctgtaatgactg

SEQ ID NO: 1334128 - DNA, 22 bp, Artificial Sequence
  chemically synthesized
tgctctgggtaaacagtcatta

SEQ ID NO: 1334129 - DNA, 22 bp, Artificial Sequence
  chemically synthesized
atgctctgggtaaacagtcatt

SEQ ID NO: 1334130 - DNA, 22 bp, Artificial Sequence
  chemically synthesized
aatcttatgctctgggtaaaca

SEQ ID NO: 1334131 - DNA, 22 bp, Artificial Sequence
  chemically synthesized
caatcttatgctctgggtaaac

SEQ ID NO: 1334132 - DNA, 22 bp, Artificial Sequence
  chemically synthesized
ctgtaatgactgtttacccaga

SEQ ID NO: 1334133 - DNA, 22 bp, Artificial Sequence
  chemically synthesized
tgtaatgactgtttacccagag

SEQ ID NO: 1334134 - DNA, 22 bp, Artificial Sequence
  chemically synthesized
taatgactgtttacccagagca

SEQ ID NO: 1334135 - DNA, 22 bp, Artificial Sequence
  chemically synthesized
aaaatccacttcaatcttatgc

SEQ ID NO: 1334136 - DNA, 22 bp, Artificial Sequence
  chemically synthesized
tttacccagagcataagattga

SEQ ID NO: 1334137 - DNA, 22 bp, Artificial Sequence
  chemically synthesized
acccagagcataagattgaagt

SEQ ID NO: 1334138 - DNA, 22 bp, Artificial Sequence
  chemically synthesized
atctgaaaatccacttcaatct

SEQ ID NO: 1334139 - DNA, 22 bp, Artificial Sequence
  chemically synthesized
cccagagcataagattgaagtg

SEQ ID NO: 1334140 - DNA, 22 bp, Artificial Sequence
  chemically synthesized
aatctgaaaatccacttcaatc

SEQ ID NO: 1334141 - DNA, 22 bp, Artificial Sequence
  chemically synthesized
taatctgaaaatccacttcaat

SEQ ID NO: 1334142 - DNA, 22 bp, Artificial Sequence
  chemically synthesized
ttaatctgaaaatccacttcaa

SEQ ID NO: 1334143 - DNA, 22 bp, Artificial Sequence
  chemically synthesized
tttttaatctgaaaatccactt

SEQ ID NO: 1334144 - DNA, 22 bp, Artificial Sequence
  chemically synthesized
atttttaatctgaaaatccact

SEQ ID NO: 1334145 - DNA, 22 bp, Artificial Sequence
  chemically synthesized
tatttttaatctgaaaatccac

SEQ ID NO: 1334146 - DNA, 22 bp, Artificial Sequence
  chemically synthesized
agagttttatttttaatctgaa

SEQ ID NO: 1334147 - DNA, 22 bp, Artificial Sequence
  chemically synthesized
aagagttttatttttaatctga

SEQ ID NO: 1334148 - DNA, 22 bp, Artificial Sequence
  chemically synthesized
aagtggattttcagattaaaaa

SEQ ID NO: 1334149 - DNA, 22 bp, Artificial Sequence
  chemically synthesized
acatacttaagagttttatttt

SEQ ID NO: 1334150 - DNA, 22 bp, Artificial Sequence
  chemically synthesized
tcagattaaaaataaaactctt

SEQ ID NO: 1334151 - DNA, 22 bp, Artificial Sequence
  chemically synthesized
cagattaaaaataaaactctta

SEQ ID NO: 1334152 - DNA, 22 bp, Artificial Sequence
  chemically synthesized
agattaaaaataaaactcttaa

SEQ ID NO: 1334153 - DNA, 22 bp, Artificial Sequence
  chemically synthesized
aaaataaaactcttaagtatgt

SEQ ID NO: 1334154 - DNA, 22 bp, Artificial Sequence
  chemically synthesized
atcagatggggattgacatact

SEQ ID NO: 1334155 - DNA, 22 bp, Artificial Sequence
  chemically synthesized
gatcagatggggattgacatac

SEQ ID NO: 1334156 - DNA, 22 bp, Artificial Sequence
  chemically synthesized
tgatcagatggggattgacata

SEQ ID NO: 1334157 - DNA, 22 bp, Artificial Sequence
  chemically synthesized
ttaagtatgtcaatccccatct

SEQ ID NO: 1334158 - DNA, 22 bp, Artificial Sequence
  chemically synthesized
tatgctttgatcagatggggat

SEQ ID NO: 1334159 - DNA, 22 bp, Artificial Sequence
  chemically synthesized
atatgctttgatcagatgggga

SEQ ID NO: 1334160 - DNA, 22 bp, Artificial Sequence
  chemically synthesized
aagtatgtcaatccccatctga

SEQ ID NO: 1334161 - DNA, 22 bp, Artificial Sequence
  chemically synthesized
agtatgtcaatccccatctgat

SEQ ID NO: 1334162 - DNA, 22 bp, Artificial Sequence
  chemically synthesized
gtttatatgctttgatcagatg

SEQ ID NO: 1334163 - DNA, 22 bp, Artificial Sequence
  chemically synthesized
agtttatatgctttgatcagat

SEQ ID NO: 1334164 - DNA, 22 bp, Artificial Sequence
  chemically synthesized
gaaaaatttagtttatatgctt

SEQ ID NO: 1334165 - DNA, 22 bp, Artificial Sequence
  chemically synthesized
ggaaaaatttagtttatatgct

SEQ ID NO: 1334166 - DNA, 22 bp, Artificial Sequence
  chemically synthesized
atcaaagcatataaactaaatt

SEQ ID NO: 1334167 - DNA, 22 bp, Artificial Sequence
  chemically synthesized
atgaagtccttggaaaaattta

SEQ ID NO: 1334168 - DNA, 22 bp, Artificial Sequence
  chemically synthesized
ttaatgaagtccttggaaaaat

SEQ ID NO: 1334169 - DNA, 22 bp, Artificial Sequence
  chemically synthesized
tattgttaatgaagtccttgga

SEQ ID NO: 1334170 - DNA, 22 bp, Artificial Sequence
  chemically synthesized
gttatattgttaatgaagtcct

SEQ ID NO: 1334171 - DNA, 22 bp, Artificial Sequence
  chemically synthesized
ggttatattgttaatgaagtcc

SEQ ID NO: 1334172 - DNA, 22 bp, Artificial Sequence
  chemically synthesized
aatttttccaaggacttcatta

SEQ ID NO: 1334173 - DNA, 22 bp, Artificial Sequence
  chemically synthesized
cttggttatattgttaatgaag

SEQ ID NO: 1334174 - DNA, 22 bp, Artificial Sequence
  chemically synthesized
tacttggttatattgttaatga

SEQ ID NO: 1334175 - DNA, 22 bp, Artificial Sequence
  chemically synthesized
ttccaaggacttcattaacaat

SEQ ID NO: 1334176 - DNA, 22 bp, Artificial Sequence
  chemically synthesized
tccaaggacttcattaacaata

SEQ ID NO: 1334177 - DNA, 22 bp, Artificial Sequence
  chemically synthesized
ccaaggacttcattaacaatat

SEQ ID NO: 1334178 - DNA, 22 bp, Artificial Sequence
  chemically synthesized
caaggacttcattaacaatata

SEQ ID NO: 1334179 - DNA, 22 bp, Artificial Sequence
  chemically synthesized
cagctctacttggttatattgt

SEQ ID NO: 1334180 - DNA, 22 bp, Artificial Sequence
  chemically synthesized
cattaacaatataaccaagtag

SEQ ID NO: 1334181 - DNA, 22 bp, Artificial Sequence
  chemically synthesized
attaacaatataaccaagtaga

SEQ ID NO: 1334182 - DNA, 22 bp, Artificial Sequence
  chemically synthesized
acaatataaccaagtagagctg

SEQ ID NO: 1334183 - DNA, 22 bp, Artificial Sequence
  chemically synthesized
aagaaaaccaagaactgcagct

SEQ ID NO: 1334184 - DNA, 22 bp, Artificial Sequence
  chemically synthesized
taaagaaaaccaagaactgcag

SEQ ID NO: 1334185 - DNA, 22 bp, Artificial Sequence
  chemically synthesized
ctctaaagaaaaccaagaactg

SEQ ID NO: 1334186 - DNA, 22 bp, Artificial Sequence
  chemically synthesized
actctaaagaaaaccaagaact

SEQ ID NO: 1334187 - DNA, 22 bp, Artificial Sequence
  chemically synthesized
acaacttactctaaagaaaacc

SEQ ID NO: 1334188 - DNA, 22 bp, Artificial Sequence
  chemically synthesized
aacaacttactctaaagaaaac

SEQ ID NO: 1334189 - DNA, 22 bp, Artificial Sequence
  chemically synthesized
taacaacttactctaaagaaaa

SEQ ID NO: 1334190 - DNA, 22 bp, Artificial Sequence
  chemically synthesized
cagttcttggttttctttagag

SEQ ID NO: 1334191 - DNA, 22 bp, Artificial Sequence
  chemically synthesized
ttggttttctttagagtaagtt

SEQ ID NO: 1334192 - DNA, 22 bp, Artificial Sequence
  chemically synthesized
aatcattttaacaacttactct

SEQ ID NO: 1334193 - DNA, 22 bp, Artificial Sequence
  chemically synthesized
caatcattttaacaacttactc

SEQ ID NO: 1334194 - DNA, 22 bp, Artificial Sequence
  chemically synthesized
ggttttctttagagtaagttgt

SEQ ID NO: 1334195 - DNA, 22 bp, Artificial Sequence
  chemically synthesized
gttttctttagagtaagttgtt

SEQ ID NO: 1334196 - DNA, 22 bp, Artificial Sequence
  chemically synthesized
tctttagagtaagttgttaaaa

SEQ ID NO: 1334197 - DNA, 22 bp, Artificial Sequence
  chemically synthesized
ctttagagtaagttgttaaaat

SEQ ID NO: 1334198 - DNA, 22 bp, Artificial Sequence
  chemically synthesized
tttagagtaagttgttaaaatg

SEQ ID NO: 1334199 - DNA, 22 bp, Artificial Sequence
  chemically synthesized
catgaacttcaatcattttaac

SEQ ID NO: 1334200 - DNA, 22 bp, Artificial Sequence
  chemically synthesized
tagagtaagttgttaaaatgat

SEQ ID NO: 1334201 - DNA, 22 bp, Artificial Sequence
  chemically synthesized
acatgaacttcaatcattttaa

SEQ ID NO: 1334202 - DNA, 22 bp, Artificial Sequence
  chemically synthesized
agagtaagttgttaaaatgatt

SEQ ID NO: 1334203 - DNA, 22 bp, Artificial Sequence
  chemically synthesized
tacatgaacttcaatcatttta

SEQ ID NO: 1334204 - DNA, 22 bp, Artificial Sequence
  chemically synthesized
gagtaagttgttaaaatgattg

SEQ ID NO: 1334205 - DNA, 22 bp, Artificial Sequence
  chemically synthesized
ttacatgaacttcaatcatttt

SEQ ID NO: 1334206 - DNA, 22 bp, Artificial Sequence
  chemically synthesized
ttttacatgaacttcaatcatt

SEQ ID NO: 1334207 - DNA, 22 bp, Artificial Sequence
  chemically synthesized
cttttacatgaacttcaatcat

SEQ ID NO: 1334208 - DNA, 22 bp, Artificial Sequence
  chemically synthesized
gatttcttttacatgaacttca

SEQ ID NO: 1334209 - DNA, 22 bp, Artificial Sequence
  chemically synthesized
ttaaaatgattgaagttcatgt

SEQ ID NO: 1334210 - DNA, 22 bp, Artificial Sequence
  chemically synthesized
tggatttcttttacatgaactt

SEQ ID NO: 1334211 - DNA, 22 bp, Artificial Sequence
  chemically synthesized
aaatgattgaagttcatgtaaa

SEQ ID NO: 1334212 - DNA, 22 bp, Artificial Sequence
  chemically synthesized
taactctggatttcttttacat

SEQ ID NO: 1334213 - DNA, 22 bp, Artificial Sequence
  chemically synthesized
actgtaactctggatttctttt

SEQ ID NO: 1334214 - DNA, 22 bp, Artificial Sequence
  chemically synthesized
aactgtaactctggatttcttt

SEQ ID NO: 1334215 - DNA, 22 bp, Artificial Sequence
  chemically synthesized
aagttcatgtaaaagaaatcca

SEQ ID NO: 1334216 - DNA, 22 bp, Artificial Sequence
  chemically synthesized
atgtaaaagaaatccagagtta

SEQ ID NO: 1334217 - DNA, 22 bp, Artificial Sequence
  chemically synthesized
cagttaaggtttgctttttttt

SEQ ID NO: 1334218 - DNA, 22 bp, Artificial Sequence
  chemically synthesized
aggtttgctttttttttttttt

SEQ ID NO: 1334219 - DNA, 22 bp, Artificial Sequence
  chemically synthesized
aaaaaaaaaaaaaaaaaaaaaa

SEQ ID NO: 1334220 - DNA, 22 bp, Artificial Sequence
  chemically synthesized
gctttttttttttttttttttt

SEQ ID NO: 1334221 - DNA, 22 bp, Artificial Sequence
  chemically synthesized
cttttttttttttttttttttt

SEQ ID NO: 1334222 - DNA, 22 bp, Artificial Sequence
  chemically synthesized
ctaaaaaaaaaaaaaaaaaaaa

SEQ ID NO: 1334223 - DNA, 22 bp, Artificial Sequence
  chemically synthesized
tttttttttttttttttttttt

SEQ ID NO: 1334224 - DNA, 22 bp, Artificial Sequence
  chemically synthesized
tttttttttttttttttttttt

SEQ ID NO: 1334225 - DNA, 22 bp, Artificial Sequence
  chemically synthesized
tttttttttttttttttttttt

SEQ ID NO: 1334226 - DNA, 22 bp, Artificial Sequence
  chemically synthesized
tttttttttttttttttttttt

SEQ ID NO: 1334227 - DNA, 22 bp, Artificial Sequence
  chemically synthesized
gatctactaaaaaaaaaaaaaa

SEQ ID NO: 1334228 - DNA, 22 bp, Artificial Sequence
  chemically synthesized
tttttttttttttttttttttt

SEQ ID NO: 1334229 - DNA, 22 bp, Artificial Sequence
  chemically synthesized
tttttttttttttttttttttt

SEQ ID NO: 1334230 - DNA, 22 bp, Artificial Sequence
  chemically synthesized
tttttttttttttttttttttt

SEQ ID NO: 1334231 - DNA, 22 bp, Artificial Sequence
  chemically synthesized
tttttttttttttttttttttt

SEQ ID NO: 1334232 - DNA, 22 bp, Artificial Sequence
  chemically synthesized
ttttttttttttttttttttta

SEQ ID NO: 1334233 - DNA, 22 bp, Artificial Sequence
  chemically synthesized
ttttttttttttttttttttag

SEQ ID NO: 1334234 - DNA, 22 bp, Artificial Sequence
  chemically synthesized
tttttttttttttttttttagt

SEQ ID NO: 1334235 - DNA, 22 bp, Artificial Sequence
  chemically synthesized
ttttttttttttttttttagta

SEQ ID NO: 1334236 - DNA, 22 bp, Artificial Sequence
  chemically synthesized
tttttttttttttttttagtag

SEQ ID NO: 1334237 - DNA, 22 bp, Artificial Sequence
  chemically synthesized
ttttttttttttttttagtaga

SEQ ID NO: 1334238 - DNA, 22 bp, Artificial Sequence
  chemically synthesized
ccgggcactggatctactaaaa

SEQ ID NO: 1334239 - DNA, 22 bp, Artificial Sequence
  chemically synthesized
tttttttttttttttagtagat

SEQ ID NO: 1334240 - DNA, 22 bp, Artificial Sequence
  chemically synthesized
gccgggcactggatctactaaa

SEQ ID NO: 1334241 - DNA, 22 bp, Artificial Sequence
  chemically synthesized
ttttttttttttttagtagatc

SEQ ID NO: 1334242 - DNA, 22 bp, Artificial Sequence
  chemically synthesized
tttttttttttttagtagatcc

SEQ ID NO: 1334243 - DNA, 22 bp, Artificial Sequence
  chemically synthesized
ttttttttttttagtagatcca

SEQ ID NO: 1334244 - DNA, 22 bp, Artificial Sequence
  chemically synthesized
tttgccgggcactggatctact

SEQ ID NO: 1334245 - DNA, 22 bp, Artificial Sequence
  chemically synthesized
tttttttttttagtagatccag

SEQ ID NO: 1334246 - DNA, 22 bp, Artificial Sequence
  chemically synthesized
ttttttttttagtagatccagt

SEQ ID NO: 1334247 - DNA, 22 bp, Artificial Sequence
  chemically synthesized
tttttttttagtagatccagtg

SEQ ID NO: 1334248 - DNA, 22 bp, Artificial Sequence
  chemically synthesized
ttttttttagtagatccagtgc

SEQ ID NO: 1334249 - DNA, 22 bp, Artificial Sequence
  chemically synthesized
tttttttagtagatccagtgcc

SEQ ID NO: 1334250 - DNA, 22 bp, Artificial Sequence
  chemically synthesized
ttttttagtagatccagtgccc

SEQ ID NO: 1334251 - DNA, 22 bp, Artificial Sequence
  chemically synthesized
tttttagtagatccagtgcccg

SEQ ID NO: 1334252 - DNA, 22 bp, Artificial Sequence
  chemically synthesized
ttttagtagatccagtgcccgg

SEQ ID NO: 1334253 - DNA, 22 bp, Artificial Sequence
  chemically synthesized
tttagtagatccagtgcccggc

SEQ ID NO: 1334254 - DNA, 22 bp, Artificial Sequence
  chemically synthesized
ttagtagatccagtgcccggca

SEQ ID NO: 1334255 - DNA, 22 bp, Artificial Sequence
  chemically synthesized
tagtagatccagtgcccggcaa

SEQ ID NO: 1334256 - DNA, 22 bp, Artificial Sequence
  chemically synthesized
agcacatactgtttgccgggca

SEQ ID NO: 1334257 - DNA, 22 bp, Artificial Sequence
  chemically synthesized
agtagatccagtgcccggcaaa

SEQ ID NO: 1334258 - DNA, 22 bp, Artificial Sequence
  chemically synthesized
gtagatccagtgcccggcaaac

SEQ ID NO: 1334259 - DNA, 22 bp, Artificial Sequence
  chemically synthesized
aataaacatatgttgagcacat

SEQ ID NO: 1334260 - DNA, 22 bp, Artificial Sequence
  chemically synthesized
gtcgcattaaataaacatatgt

SEQ ID NO: 1334261 - DNA, 22 bp, Artificial Sequence
  chemically synthesized
ggtcgcattaaataaacatatg

SEQ ID NO: 1334262 - DNA, 22 bp, Artificial Sequence
  chemically synthesized
tggtcgcattaaataaacatat

SEQ ID NO: 1334263 - DNA, 22 bp, Artificial Sequence
  chemically synthesized
ttggtcgcattaaataaacata

SEQ ID NO: 1334264 - DNA, 22 bp, Artificial Sequence
  chemically synthesized
tatgcttttggtcgcattaaat

SEQ ID NO: 1334265 - DNA, 22 bp, Artificial Sequence
  chemically synthesized
aacatatgtttatttaatgcga

SEQ ID NO: 1334266 - DNA, 22 bp, Artificial Sequence
  chemically synthesized
tattgtatgcttttggtcgcat

SEQ ID NO: 1334267 - DNA, 22 bp, Artificial Sequence
  chemically synthesized
atattgtatgcttttggtcgca

SEQ ID NO: 1334268 - DNA, 22 bp, Artificial Sequence
  chemically synthesized
tatattgtatgcttttggtcgc

SEQ ID NO: 1334269 - DNA, 22 bp, Artificial Sequence
  chemically synthesized
atttaatgcgaccaaaagcata

SEQ ID NO: 1334270 - DNA, 22 bp, Artificial Sequence
  chemically synthesized
tttaatgcgaccaaaagcatac

SEQ ID NO: 1334271 - DNA, 22 bp, Artificial Sequence
  chemically synthesized
aatgcgaccaaaagcatacaat

SEQ ID NO: 1334272 - DNA, 22 bp, Artificial Sequence
  chemically synthesized
atgcgaccaaaagcatacaata

SEQ ID NO: 1334273 - DNA, 22 bp, Artificial Sequence
  chemically synthesized
aaaatatcagtggcaatgataa

SEQ ID NO: 1334274 - DNA, 22 bp, Artificial Sequence
  chemically synthesized
aaaaatatcagtggcaatgata

SEQ ID NO: 1334275 - DNA, 22 bp, Artificial Sequence
  chemically synthesized
taaaaatatcagtggcaatgat

SEQ ID NO: 1334276 - DNA, 22 bp, Artificial Sequence
  chemically synthesized
ttaaaaatatcagtggcaatga

SEQ ID NO: 1334277 - DNA, 22 bp, Artificial Sequence
  chemically synthesized
tttaaaaatatcagtggcaatg

SEQ ID NO: 1334278 - DNA, 22 bp, Artificial Sequence
  chemically synthesized
tcattgccactgatatttttaa

SEQ ID NO: 1334279 - DNA, 22 bp, Artificial Sequence
  chemically synthesized
ccactgatatttttaaaaagcc

SEQ ID NO: 1334280 - DNA, 22 bp, Artificial Sequence
  chemically synthesized
atatttttaaaaagccatgttc

SEQ ID NO: 1334281 - DNA, 22 bp, Artificial Sequence
  chemically synthesized
ttaaaaagccatgttctatact

SEQ ID NO: 1334282 - DNA, 22 bp, Artificial Sequence
  chemically synthesized
taaaaagccatgttctatactt

SEQ ID NO: 1334283 - DNA, 22 bp, Artificial Sequence
  chemically synthesized
aaaaagccatgttctatactta

SEQ ID NO: 1334284 - DNA, 22 bp, Artificial Sequence
  chemically synthesized
aaaagccatgttctatacttat

SEQ ID NO: 1334285 - DNA, 22 bp, Artificial Sequence
  chemically synthesized
cgtaaaaatgaaataagtatag

SEQ ID NO: 1334286 - DNA, 22 bp, Artificial Sequence
  chemically synthesized
acgtaaaaatgaaataagtata

SEQ ID NO: 1334287 - DNA, 22 bp, Artificial Sequence
  chemically synthesized
tggcttacgtaaaaatgaaata

SEQ ID NO: 1334288 - DNA, 22 bp, Artificial Sequence
  chemically synthesized
tatacttatttcatttttacgt

SEQ ID NO: 1334289 - DNA, 22 bp, Artificial Sequence
  chemically synthesized
tacttatttcatttttacgtaa

SEQ ID NO: 1334290 - DNA, 22 bp, Artificial Sequence
  chemically synthesized
taaaattgtggcttacgtaaaa

SEQ ID NO: 1334291 - DNA, 22 bp, Artificial Sequence
  chemically synthesized
gtaaaattgtggcttacgtaaa

SEQ ID NO: 1334292 - DNA, 22 bp, Artificial Sequence
  chemically synthesized
atttcatttttacgtaagccac

SEQ ID NO: 1334293 - DNA, 22 bp, Artificial Sequence
  chemically synthesized
tttcatttttacgtaagccaca

SEQ ID NO: 1334294 - DNA, 22 bp, Artificial Sequence
  chemically synthesized
aaaccttgtaaaattgtggctt

SEQ ID NO: 1334295 - DNA, 22 bp, Artificial Sequence
  chemically synthesized
catttttacgtaagccacaatt

SEQ ID NO: 1334296 - DNA, 22 bp, Artificial Sequence
  chemically synthesized
gaaaccttgtaaaattgtggct

SEQ ID NO: 1334297 - DNA, 22 bp, Artificial Sequence
  chemically synthesized
atttttacgtaagccacaattt

SEQ ID NO: 1334298 - DNA, 22 bp, Artificial Sequence
  chemically synthesized
tttgaaaccttgtaaaattgtg

SEQ ID NO: 1334299 - DNA, 22 bp, Artificial Sequence
  chemically synthesized
gtttgaaaccttgtaaaattgt

SEQ ID NO: 1334300 - DNA, 22 bp, Artificial Sequence
  chemically synthesized
ttacgtaagccacaattttaca

SEQ ID NO: 1334301 - DNA, 22 bp, Artificial Sequence
  chemically synthesized
tgtttgaaaccttgtaaaattg

SEQ ID NO: 1334302 - DNA, 22 bp, Artificial Sequence
  chemically synthesized
tacgtaagccacaattttacaa

SEQ ID NO: 1334303 - DNA, 22 bp, Artificial Sequence
  chemically synthesized
ttgtttgaaaccttgtaaaatt

SEQ ID NO: 1334304 - DNA, 22 bp, Artificial Sequence
  chemically synthesized
acgtaagccacaattttacaag

SEQ ID NO: 1334305 - DNA, 22 bp, Artificial Sequence
  chemically synthesized
tttgtttgaaaccttgtaaaat

SEQ ID NO: 1334306 - DNA, 22 bp, Artificial Sequence
  chemically synthesized
cgtaagccacaattttacaagg

SEQ ID NO: 1334307 - DNA, 22 bp, Artificial Sequence
  chemically synthesized
ttttgtttgaaaccttgtaaaa

SEQ ID NO: 1334308 - DNA, 22 bp, Artificial Sequence
  chemically synthesized
tttttgtttgaaaccttgtaaa

SEQ ID NO: 1334309 - DNA, 22 bp, Artificial Sequence
  chemically synthesized
ttttttgtttgaaaccttgtaa

SEQ ID NO: 1334310 - DNA, 22 bp, Artificial Sequence
  chemically synthesized
tttttttgtttgaaaccttgta

SEQ ID NO: 1334311 - DNA, 22 bp, Artificial Sequence
  chemically synthesized
ttttttttgtttgaaaccttgt

SEQ ID NO: 1334312 - DNA, 22 bp, Artificial Sequence
  chemically synthesized
tacaaggtttcaaacaaaaaaa

SEQ ID NO: 1334313 - DNA, 22 bp, Artificial Sequence
  chemically synthesized
acaaggtttcaaacaaaaaaaa

SEQ ID NO: 1334314 - DNA, 22 bp, Artificial Sequence
  chemically synthesized
caaggtttcaaacaaaaaaaaa

SEQ ID NO: 1334315 - DNA, 22 bp, Artificial Sequence
  chemically synthesized
caaacaaaaaaaaaaacccaca

SEQ ID NO: 1334316 - DNA, 22 bp, Artificial Sequence
  chemically synthesized
aagaaaacaaggtgtgggtttt

SEQ ID NO: 1334317 - DNA, 22 bp, Artificial Sequence
  chemically synthesized
aaacaaaaaaaaaaacccacac

SEQ ID NO: 1334318 - DNA, 22 bp, Artificial Sequence
  chemically synthesized
tattaaagaaaacaaggtgtgg

SEQ ID NO: 1334319 - DNA, 22 bp, Artificial Sequence
  chemically synthesized
atattaaagaaaacaaggtgtg

SEQ ID NO: 1334320 - DNA, 22 bp, Artificial Sequence
  chemically synthesized
tatattaaagaaaacaaggtgt

SEQ ID NO: 1334321 - DNA, 22 bp, Artificial Sequence
  chemically synthesized
ccaaatattttatattaaagaa

SEQ ID NO: 1334322 - DNA, 22 bp, Artificial Sequence
  chemically synthesized
taattgccaaatattttatatt

SEQ ID NO: 1334323 - DNA, 22 bp, Artificial Sequence
  chemically synthesized
ataattgccaaatattttatat

SEQ ID NO: 1334324 - DNA, 22 bp, Artificial Sequence
  chemically synthesized
gttttctttaatataaaatatt

SEQ ID NO: 1334325 - DNA, 22 bp, Artificial Sequence
  chemically synthesized
ttttctttaatataaaatattt

SEQ ID NO: 1334326 - DNA, 22 bp, Artificial Sequence
  chemically synthesized
tctttaatataaaatatttggc

SEQ ID NO: 1334327 - DNA, 22 bp, Artificial Sequence
  chemically synthesized
ctttaatataaaatatttggca

SEQ ID NO: 1334328 - DNA, 22 bp, Artificial Sequence
  chemically synthesized
tttaatataaaatatttggcaa

SEQ ID NO: 1334329 - DNA, 22 bp, Artificial Sequence
  chemically synthesized
taatataaaatatttggcaatt

SEQ ID NO: 1334330 - DNA, 22 bp, Artificial Sequence
  chemically synthesized
aatataaaatatttggcaatta

SEQ ID NO: 1334331 - DNA, 22 bp, Artificial Sequence
  chemically synthesized
atataaaatatttggcaattat

SEQ ID NO: 1334332 - DNA, 22 bp, Artificial Sequence
  chemically synthesized
ccagcacggtccatgcttataa

SEQ ID NO: 1334333 - DNA, 22 bp, Artificial Sequence
  chemically synthesized
ctgccagcacggtccatgctta

SEQ ID NO: 1334334 - DNA, 22 bp, Artificial Sequence
  chemically synthesized
actgccagcacggtccatgctt

SEQ ID NO: 1334335 - DNA, 22 bp, Artificial Sequence
  chemically synthesized
ggcaattataagcatggaccgt

SEQ ID NO: 1334336 - DNA, 22 bp, Artificial Sequence
  chemically synthesized
gcaattataagcatggaccgtg

SEQ ID NO: 1334337 - DNA, 22 bp, Artificial Sequence
  chemically synthesized
acttactgccagcacggtccat

SEQ ID NO: 1334338 - DNA, 22 bp, Artificial Sequence
  chemically synthesized
aacttactgccagcacggtcca

SEQ ID NO: 1334339 - DNA, 22 bp, Artificial Sequence
  chemically synthesized
taacttactgccagcacggtcc

SEQ ID NO: 1334340 - DNA, 22 bp, Artificial Sequence
  chemically synthesized
taagcatggaccgtgctggcag

SEQ ID NO: 1334341 - DNA, 22 bp, Artificial Sequence
  chemically synthesized
gcagtaagttaaaatgtgactg

SEQ ID NO: 1334342 - DNA, 22 bp, Artificial Sequence
  chemically synthesized
aaatgtgactgatttttttttt

SEQ ID NO: 1334343 - DNA, 22 bp, Artificial Sequence
  chemically synthesized
agagtagggaacggagaaaaaa

SEQ ID NO: 1334344 - DNA, 22 bp, Artificial Sequence
  chemically synthesized
attttttttttctccgttccct

SEQ ID NO: 1334345 - DNA, 22 bp, Artificial Sequence
  chemically synthesized
aaaattgagagtagggaacgga

SEQ ID NO: 1334346 - DNA, 22 bp, Artificial Sequence
  chemically synthesized
tttttttctccgttccctactc

SEQ ID NO: 1334347 - DNA, 22 bp, Artificial Sequence
  chemically synthesized
ttttttctccgttccctactct

SEQ ID NO: 1334348 - DNA, 22 bp, Artificial Sequence
  chemically synthesized
tttttctccgttccctactctc

SEQ ID NO: 1334349 - DNA, 22 bp, Artificial Sequence
  chemically synthesized
ttttctccgttccctactctca

SEQ ID NO: 1334350 - DNA, 22 bp, Artificial Sequence
  chemically synthesized
tttctccgttccctactctcaa

SEQ ID NO: 1334351 - DNA, 22 bp, Artificial Sequence
  chemically synthesized
cgcatctgaaaattgagagtag

SEQ ID NO: 1334352 - DNA, 22 bp, Artificial Sequence
  chemically synthesized
ttctccgttccctactctcaat

SEQ ID NO: 1334353 - DNA, 22 bp, Artificial Sequence
  chemically synthesized
ccgcatctgaaaattgagagta

SEQ ID NO: 1334354 - DNA, 22 bp, Artificial Sequence
  chemically synthesized
tctccgttccctactctcaatt

SEQ ID NO: 1334355 - DNA, 22 bp, Artificial Sequence
  chemically synthesized
ctccgttccctactctcaattt

SEQ ID NO: 1334356 - DNA, 22 bp, Artificial Sequence
  chemically synthesized
tccgttccctactctcaatttt

SEQ ID NO: 1334357 - DNA, 22 bp, Artificial Sequence
  chemically synthesized
cgttccctactctcaattttca

SEQ ID NO: 1334358 - DNA, 22 bp, Artificial Sequence
  chemically synthesized
cctactctcaattttcagatgc

SEQ ID NO: 1334359 - DNA, 22 bp, Artificial Sequence
  chemically synthesized
caaatgaaatttccgcatctga

SEQ ID NO: 1334360 - DNA, 22 bp, Artificial Sequence
  chemically synthesized
ctctcaattttcagatgcggaa

SEQ ID NO: 1334361 - DNA, 22 bp, Artificial Sequence
  chemically synthesized
tccaaatgaaatttccgcatct

SEQ ID NO: 1334362 - DNA, 22 bp, Artificial Sequence
  chemically synthesized
tctccaaatgaaatttccgcat

SEQ ID NO: 1334363 - DNA, 22 bp, Artificial Sequence
  chemically synthesized
tcaattttcagatgcggaaatt

SEQ ID NO: 1334364 - DNA, 22 bp, Artificial Sequence
  chemically synthesized
aattttcagatgcggaaatttc

SEQ ID NO: 1334365 - DNA, 22 bp, Artificial Sequence
  chemically synthesized
ttctctccaaatgaaatttccg

SEQ ID NO: 1334366 - DNA, 22 bp, Artificial Sequence
  chemically synthesized
ctgttctctccaaatgaaattt

SEQ ID NO: 1334367 - DNA, 22 bp, Artificial Sequence
  chemically synthesized
tcagatgcggaaatttcatttg

SEQ ID NO: 1334368 - DNA, 22 bp, Artificial Sequence
  chemically synthesized
cagatgcggaaatttcatttgg

SEQ ID NO: 1334369 - DNA, 22 bp, Artificial Sequence
  chemically synthesized
agatgcggaaatttcatttgga

SEQ ID NO: 1334370 - DNA, 22 bp, Artificial Sequence
  chemically synthesized
ccaccaacacctcctgttctct

SEQ ID NO: 1334371 - DNA, 22 bp, Artificial Sequence
  chemically synthesized
cccaccaacacctcctgttctc

SEQ ID NO: 1334372 - DNA, 22 bp, Artificial Sequence
  chemically synthesized
tcccaccaacacctcctgttct

SEQ ID NO: 1334373 - DNA, 22 bp, Artificial Sequence
  chemically synthesized
ttcccaccaacacctcctgttc

SEQ ID NO: 1334374 - DNA, 22 bp, Artificial Sequence
  chemically synthesized
catttggagagaacaggaggtg

SEQ ID NO: 1334375 - DNA, 22 bp, Artificial Sequence
  chemically synthesized
atttggagagaacaggaggtgt

SEQ ID NO: 1334376 - DNA, 22 bp, Artificial Sequence
  chemically synthesized
ggagagaacaggaggtgttggt

SEQ ID NO: 1334377 - DNA, 22 bp, Artificial Sequence
  chemically synthesized
gagagaacaggaggtgttggtg

SEQ ID NO: 1334378 - DNA, 22 bp, Artificial Sequence
  chemically synthesized
atgagatttttcccaccaacac

SEQ ID NO: 1334379 - DNA, 22 bp, Artificial Sequence
  chemically synthesized
gtgggaaaaatctcattaatcg

SEQ ID NO: 1334380 - DNA, 22 bp, Artificial Sequence
  chemically synthesized
tagacaagggaatacggtacga

SEQ ID NO: 1334381 - DNA, 22 bp, Artificial Sequence
  chemically synthesized
gtagacaagggaatacggtacg

SEQ ID NO: 1334382 - DNA, 22 bp, Artificial Sequence
  chemically synthesized
tgtagacaagggaatacggtac

SEQ ID NO: 1334383 - DNA, 22 bp, Artificial Sequence
  chemically synthesized
tttgtagacaagggaatacggt

SEQ ID NO: 1334384 - DNA, 22 bp, Artificial Sequence
  chemically synthesized
attaatcgtaccgtattccctt

SEQ ID NO: 1334385 - DNA, 22 bp, Artificial Sequence
  chemically synthesized
atcgtaccgtattcccttgtct

SEQ ID NO: 1334386 - DNA, 22 bp, Artificial Sequence
  chemically synthesized
gatgcagtactctttgtagaca

SEQ ID NO: 1334387 - DNA, 22 bp, Artificial Sequence
  chemically synthesized
ggatgcagtactctttgtagac

SEQ ID NO: 1334388 - DNA, 22 bp, Artificial Sequence
  chemically synthesized
taatttggatgcagtactcttt

SEQ ID NO: 1334389 - DNA, 22 bp, Artificial Sequence
  chemically synthesized
ccttgtctacaaagagtactgc

SEQ ID NO: 1334390 - DNA, 22 bp, Artificial Sequence
  chemically synthesized
tgtaatttggatgcagtactct

SEQ ID NO: 1334391 - DNA, 22 bp, Artificial Sequence
  chemically synthesized
ctgtaatttggatgcagtactc

SEQ ID NO: 1334392 - DNA, 22 bp, Artificial Sequence
  chemically synthesized
ttctgtaatttggatgcagtac

SEQ ID NO: 1334393 - DNA, 22 bp, Artificial Sequence
  chemically synthesized
gtctacaaagagtactgcatcc

SEQ ID NO: 1334394 - DNA, 22 bp, Artificial Sequence
  chemically synthesized
tctacaaagagtactgcatcca

SEQ ID NO: 1334395 - DNA, 22 bp, Artificial Sequence
  chemically synthesized
gttcttctgtaatttggatgca

SEQ ID NO: 1334396 - DNA, 22 bp, Artificial Sequence
  chemically synthesized
agttcttctgtaatttggatgc

SEQ ID NO: 1334397 - DNA, 22 bp, Artificial Sequence
  chemically synthesized
caaagagtactgcatccaaatt

SEQ ID NO: 1334398 - DNA, 22 bp, Artificial Sequence
  chemically synthesized
tagttcttctgtaatttggatg

SEQ ID NO: 1334399 - DNA, 22 bp, Artificial Sequence
  chemically synthesized
tttagttcttctgtaatttgga

SEQ ID NO: 1334400 - DNA, 22 bp, Artificial Sequence
  chemically synthesized
ctttagttcttctgtaatttgg

SEQ ID NO: 1334401 - DNA, 22 bp, Artificial Sequence
  chemically synthesized
caaggtttctttagttcttctg

SEQ ID NO: 1334402 - DNA, 22 bp, Artificial Sequence
  chemically synthesized
catccaaattacagaagaacta

SEQ ID NO: 1334403 - DNA, 22 bp, Artificial Sequence
  chemically synthesized
atgctacaaggtttctttagtt

SEQ ID NO: 1334404 - DNA, 22 bp, Artificial Sequence
  chemically synthesized
tactcatgctacaaggtttctt

SEQ ID NO: 1334405 - DNA, 22 bp, Artificial Sequence
  chemically synthesized
cagaagaactaaagaaaccttg

SEQ ID NO: 1334406 - DNA, 22 bp, Artificial Sequence
  chemically synthesized
attatactcatgctacaaggtt

SEQ ID NO: 1334407 - DNA, 22 bp, Artificial Sequence
  chemically synthesized
ctaattatactcatgctacaag

SEQ ID NO: 1334408 - DNA, 22 bp, Artificial Sequence
  chemically synthesized
aagaaaccttgtagcatgagta

SEQ ID NO: 1334409 - DNA, 22 bp, Artificial Sequence
  chemically synthesized
gtagcactgctaattatactca

SEQ ID NO: 1334410 - DNA, 22 bp, Artificial Sequence
  chemically synthesized
agtagcactgctaattatactc

SEQ ID NO: 1334411 - DNA, 22 bp, Artificial Sequence
  chemically synthesized
acttagtagcactgctaattat

SEQ ID NO: 1334412 - DNA, 22 bp, Artificial Sequence
  chemically synthesized
gtagcatgagtataattagcag

SEQ ID NO: 1334413 - DNA, 22 bp, Artificial Sequence
  chemically synthesized
tagcatgagtataattagcagt

SEQ ID NO: 1334414 - DNA, 22 bp, Artificial Sequence
  chemically synthesized
cattcacttagtagcactgcta

SEQ ID NO: 1334415 - DNA, 22 bp, Artificial Sequence
  chemically synthesized
ccattcacttagtagcactgct

SEQ ID NO: 1334416 - DNA, 22 bp, Artificial Sequence
  chemically synthesized
catttccattcacttagtagca

SEQ ID NO: 1334417 - DNA, 22 bp, Artificial Sequence
  chemically synthesized
gcagtgctactaagtgaatgga

SEQ ID NO: 1334418 - DNA, 22 bp, Artificial Sequence
  chemically synthesized
ggcaacctccatttccattcac

SEQ ID NO: 1334419 - DNA, 22 bp, Artificial Sequence
  chemically synthesized
agttaggcaacctccatttcca

SEQ ID NO: 1334420 - DNA, 22 bp, Artificial Sequence
  chemically synthesized
ctaagtgaatggaaatggaggt

SEQ ID NO: 1334421 - DNA, 22 bp, Artificial Sequence
  chemically synthesized
attaagttaggcaacctccatt

SEQ ID NO: 1334422 - DNA, 22 bp, Artificial Sequence
  chemically synthesized
agtgaatggaaatggaggttgc

SEQ ID NO: 1334423 - DNA, 22 bp, Artificial Sequence
  chemically synthesized
cagttaattaagttaggcaacc

SEQ ID NO: 1334424 - DNA, 22 bp, Artificial Sequence
  chemically synthesized
cctaacttaattaactgtaatc

SEQ ID NO: 1334425 - DNA, 22 bp, Artificial Sequence
  chemically synthesized
acttaattaactgtaatcatta

SEQ ID NO: 1334426 - DNA, 22 bp, Artificial Sequence
  chemically synthesized
aattaactgtaatcattactca

SEQ ID NO: 1334427 - DNA, 22 bp, Artificial Sequence
  chemically synthesized
attaactgtaatcattactcat

SEQ ID NO: 1334428 - DNA, 22 bp, Artificial Sequence
  chemically synthesized
agcagtacgacaatgagtaatg

SEQ ID NO: 1334429 - DNA, 22 bp, Artificial Sequence
  chemically synthesized
taagcagtacgacaatgagtaa

SEQ ID NO: 1334430 - DNA, 22 bp, Artificial Sequence
  chemically synthesized
ctaagcagtacgacaatgagta

SEQ ID NO: 1334431 - DNA, 22 bp, Artificial Sequence
  chemically synthesized
actgtaatcattactcattgtc

SEQ ID NO: 1334432 - DNA, 22 bp, Artificial Sequence
  chemically synthesized
tctaagcagtacgacaatgagt

SEQ ID NO: 1334433 - DNA, 22 bp, Artificial Sequence
  chemically synthesized
taatcattactcattgtcgtac

SEQ ID NO: 1334434 - DNA, 22 bp, Artificial Sequence
  chemically synthesized
atctttctaagcagtacgacaa

SEQ ID NO: 1334435 - DNA, 22 bp, Artificial Sequence
  chemically synthesized
aactaatctttctaagcagtac

SEQ ID NO: 1334436 - DNA, 22 bp, Artificial Sequence
  chemically synthesized
ctcattgtcgtactgcttagaa

SEQ ID NO: 1334437 - DNA, 22 bp, Artificial Sequence
  chemically synthesized
attgtcgtactgcttagaaaga

SEQ ID NO: 1334438 - DNA, 22 bp, Artificial Sequence
  chemically synthesized
tcgtactgcttagaaagattag

SEQ ID NO: 1334439 - DNA, 22 bp, Artificial Sequence
  chemically synthesized
cttagaaagattagttgagggt

SEQ ID NO: 1334440 - DNA, 22 bp, Artificial Sequence
  chemically synthesized
agaaagattagttgagggtatt

SEQ ID NO: 1334441 - DNA, 22 bp, Artificial Sequence
  chemically synthesized
gaaagattagttgagggtattt

SEQ ID NO: 1334442 - DNA, 22 bp, Artificial Sequence
  chemically synthesized
aagtaataccacagaagaaata

SEQ ID NO: 1334443 - DNA, 22 bp, Artificial Sequence
  chemically synthesized
gttgagggtatttcttctgtgg

SEQ ID NO: 1334444 - DNA, 22 bp, Artificial Sequence
  chemically synthesized
agggtatttcttctgtggtatt

SEQ ID NO: 1334445 - DNA, 22 bp, Artificial Sequence
  chemically synthesized
cttctgtggtattactttaggc

SEQ ID NO: 1334446 - DNA, 22 bp, Artificial Sequence
  chemically synthesized
ttctgtggtattactttaggcg

SEQ ID NO: 1334447 - DNA, 22 bp, Artificial Sequence
  chemically synthesized
ctgtggtattactttaggcgtt

SEQ ID NO: 1334448 - DNA, 22 bp, Artificial Sequence
  chemically synthesized
tgtggtattactttaggcgttt

SEQ ID NO: 1334449 - DNA, 22 bp, Artificial Sequence
  chemically synthesized
agagggaaggagaaacgcctaa

SEQ ID NO: 1334450 - DNA, 22 bp, Artificial Sequence
  chemically synthesized
aagagggaaggagaaacgccta

SEQ ID NO: 1334451 - DNA, 22 bp, Artificial Sequence
  chemically synthesized
tggtattactttaggcgtttct

SEQ ID NO: 1334452 - DNA, 22 bp, Artificial Sequence
  chemically synthesized
acatttaagagggaaggagaaa

SEQ ID NO: 1334453 - DNA, 22 bp, Artificial Sequence
  chemically synthesized
cacatttaagagggaaggagaa

SEQ ID NO: 1334454 - DNA, 22 bp, Artificial Sequence
  chemically synthesized
ctttaggcgtttctccttccct

SEQ ID NO: 1334455 - DNA, 22 bp, Artificial Sequence
  chemically synthesized
tttcacatttaagagggaagga

SEQ ID NO: 1334456 - DNA, 22 bp, Artificial Sequence
  chemically synthesized
taggcgtttctccttccctctt

SEQ ID NO: 1334457 - DNA, 22 bp, Artificial Sequence
  chemically synthesized
aggcgtttctccttccctctta

SEQ ID NO: 1334458 - DNA, 22 bp, Artificial Sequence
  chemically synthesized
ggcgtttctccttccctcttaa

SEQ ID NO: 1334459 - DNA, 22 bp, Artificial Sequence
  chemically synthesized
ctccttccctcttaaatgtgaa

SEQ ID NO: 1334460 - DNA, 22 bp, Artificial Sequence
  chemically synthesized
tagtgtaattgtttcacattta

SEQ ID NO: 1334461 - DNA, 22 bp, Artificial Sequence
  chemically synthesized
tccttccctcttaaatgtgaaa

SEQ ID NO: 1334462 - DNA, 22 bp, Artificial Sequence
  chemically synthesized
atagtgtaattgtttcacattt

SEQ ID NO: 1334463 - DNA, 22 bp, Artificial Sequence
  chemically synthesized
tatagtgtaattgtttcacatt

SEQ ID NO: 1334464 - DNA, 22 bp, Artificial Sequence
  chemically synthesized
cttccctcttaaatgtgaaaca

SEQ ID NO: 1334465 - DNA, 22 bp, Artificial Sequence
  chemically synthesized
tttatagtgtaattgtttcaca

SEQ ID NO: 1334466 - DNA, 22 bp, Artificial Sequence
  chemically synthesized
ctttatagtgtaattgtttcac

SEQ ID NO: 1334467 - DNA, 22 bp, Artificial Sequence
  chemically synthesized
ccctcttaaatgtgaaacaatt

SEQ ID NO: 1334468 - DNA, 22 bp, Artificial Sequence
  chemically synthesized
tctttatagtgtaattgtttca

SEQ ID NO: 1334469 - DNA, 22 bp, Artificial Sequence
  chemically synthesized
cctcttaaatgtgaaacaatta

SEQ ID NO: 1334470 - DNA, 22 bp, Artificial Sequence
  chemically synthesized
tttctttatagtgtaattgttt

SEQ ID NO: 1334471 - DNA, 22 bp, Artificial Sequence
  chemically synthesized
ttaaatgtgaaacaattacact

SEQ ID NO: 1334472 - DNA, 22 bp, Artificial Sequence
  chemically synthesized
attctttctttatagtgtaatt

SEQ ID NO: 1334473 - DNA, 22 bp, Artificial Sequence
  chemically synthesized
aaatgtgaaacaattacactat

SEQ ID NO: 1334474 - DNA, 22 bp, Artificial Sequence
  chemically synthesized
aatgtgaaacaattacactata

SEQ ID NO: 1334475 - DNA, 22 bp, Artificial Sequence
  chemically synthesized
aaagggcatgctaattctttct

SEQ ID NO: 1334476 - DNA, 22 bp, Artificial Sequence
  chemically synthesized
cactataaagaaagaattagca

SEQ ID NO: 1334477 - DNA, 22 bp, Artificial Sequence
  chemically synthesized
attgaaagggcatgctaattct

SEQ ID NO: 1334478 - DNA, 22 bp, Artificial Sequence
  chemically synthesized
tctgattgaaagggcatgctaa

SEQ ID NO: 1334479 - DNA, 22 bp, Artificial Sequence
  chemically synthesized
taaagaaagaattagcatgccc

SEQ ID NO: 1334480 - DNA, 22 bp, Artificial Sequence
  chemically synthesized
tatctgattgaaagggcatgct

SEQ ID NO: 1334481 - DNA, 22 bp, Artificial Sequence
  chemically synthesized
ctatctgattgaaagggcatgc

SEQ ID NO: 1334482 - DNA, 22 bp, Artificial Sequence
  chemically synthesized
ggaaaagcttctatctgattga

SEQ ID NO: 1334483 - DNA, 22 bp, Artificial Sequence
  chemically synthesized
gcatgccctttcaatcagatag

SEQ ID NO: 1334484 - DNA, 22 bp, Artificial Sequence
  chemically synthesized
ttcggaaaagcttctatctgat

SEQ ID NO: 1334485 - DNA, 22 bp, Artificial Sequence
  chemically synthesized
gttcggaaaagcttctatctga

SEQ ID NO: 1334486 - DNA, 22 bp, Artificial Sequence
  chemically synthesized
cttgttcggaaaagcttctatc

SEQ ID NO: 1334487 - DNA, 22 bp, Artificial Sequence
  chemically synthesized
acttgttcggaaaagcttctat

SEQ ID NO: 1334488 - DNA, 22 bp, Artificial Sequence
  chemically synthesized
tcaatcagatagaagcttttcc

SEQ ID NO: 1334489 - DNA, 22 bp, Artificial Sequence
  chemically synthesized
caatcagatagaagcttttccg

SEQ ID NO: 1334490 - DNA, 22 bp, Artificial Sequence
  chemically synthesized
aatcagatagaagcttttccga

SEQ ID NO: 1334491 - DNA, 22 bp, Artificial Sequence
  chemically synthesized
ggacatggaacttacttgttcg

SEQ ID NO: 1334492 - DNA, 22 bp, Artificial Sequence
  chemically synthesized
gagctaggacatggaacttact

SEQ ID NO: 1334493 - DNA, 22 bp, Artificial Sequence
  chemically synthesized
ttccgaacaagtaagttccatg

SEQ ID NO: 1334494 - DNA, 22 bp, Artificial Sequence
  chemically synthesized
tccgaacaagtaagttccatgt

SEQ ID NO: 1334495 - DNA, 22 bp, Artificial Sequence
  chemically synthesized
ccgaacaagtaagttccatgtc

SEQ ID NO: 1334496 - DNA, 22 bp, Artificial Sequence
  chemically synthesized
cgaacaagtaagttccatgtcc

SEQ ID NO: 1334497 - DNA, 22 bp, Artificial Sequence
  chemically synthesized
ccgccctcgagctaggacatgg

SEQ ID NO: 1334498 - DNA, 22 bp, Artificial Sequence
  chemically synthesized
gccgccctcgagctaggacatg

SEQ ID NO: 1334499 - DNA, 22 bp, Artificial Sequence
  chemically synthesized
tgccgccctcgagctaggacat

SEQ ID NO: 1334500 - DNA, 22 bp, Artificial Sequence
  chemically synthesized
ttttgccgccctcgagctagga

SEQ ID NO: 1334501 - DNA, 22 bp, Artificial Sequence
  chemically synthesized
ctgttttgccgccctcgagcta

SEQ ID NO: 1334502 - DNA, 22 bp, Artificial Sequence
  chemically synthesized
catgtcctagctcgagggcggc

SEQ ID NO: 1334503 - DNA, 22 bp, Artificial Sequence
  chemically synthesized
ccatcattcctgttttgccgcc

SEQ ID NO: 1334504 - DNA, 22 bp, Artificial Sequence
  chemically synthesized
cccatcattcctgttttgccgc

SEQ ID NO: 1334505 - DNA, 22 bp, Artificial Sequence
  chemically synthesized
tcccatcattcctgttttgccg

SEQ ID NO: 1334506 - DNA, 22 bp, Artificial Sequence
  chemically synthesized
gctcgagggcggcaaaacagga

SEQ ID NO: 1334507 - DNA, 22 bp, Artificial Sequence
  chemically synthesized
gagggcggcaaaacaggaatga

SEQ ID NO: 1334508 - DNA, 22 bp, Artificial Sequence
  chemically synthesized
aatattttcccatcattcctgt

SEQ ID NO: 1334509 - DNA, 22 bp, Artificial Sequence
  chemically synthesized
gcccaactaaatattttcccat

SEQ ID NO: 1334510 - DNA, 22 bp, Artificial Sequence
  chemically synthesized
ggcccaactaaatattttccca

SEQ ID NO: 1334511 - DNA, 22 bp, Artificial Sequence
  chemically synthesized
tggcccaactaaatattttccc

SEQ ID NO: 1334512 - DNA, 22 bp, Artificial Sequence
  chemically synthesized
actttggcccaactaaatattt

SEQ ID NO: 1334513 - DNA, 22 bp, Artificial Sequence
  chemically synthesized
taactttggcccaactaaatat

SEQ ID NO: 1334514 - DNA, 22 bp, Artificial Sequence
  chemically synthesized
tctaactttggcccaactaaat

SEQ ID NO: 1334515 - DNA, 22 bp, Artificial Sequence
  chemically synthesized
ctctaactttggcccaactaaa

SEQ ID NO: 1334516 - DNA, 22 bp, Artificial Sequence
  chemically synthesized
atttctctaactttggcccaac

SEQ ID NO: 1334517 - DNA, 22 bp, Artificial Sequence
  chemically synthesized
aatttctctaactttggcccaa

SEQ ID NO: 1334518 - DNA, 22 bp, Artificial Sequence
  chemically synthesized
ttaatttctctaactttggccc

SEQ ID NO: 1334519 - DNA, 22 bp, Artificial Sequence
  chemically synthesized
cttaatttctctaactttggcc

SEQ ID NO: 1334520 - DNA, 22 bp, Artificial Sequence
  chemically synthesized
tcttaatttctctaactttggc

SEQ ID NO: 1334521 - DNA, 22 bp, Artificial Sequence
  chemically synthesized
ttcttaatttctctaactttgg

SEQ ID NO: 1334522 - DNA, 22 bp, Artificial Sequence
  chemically synthesized
tttcttaatttctctaactttg

SEQ ID NO: 1334523 - DNA, 22 bp, Artificial Sequence
  chemically synthesized
ttttcttaatttctctaacttt

SEQ ID NO: 1334524 - DNA, 22 bp, Artificial Sequence
  chemically synthesized
agttgggccaaagttagagaaa

SEQ ID NO: 1334525 - DNA, 22 bp, Artificial Sequence
  chemically synthesized
cttttttcttaatttctctaac

SEQ ID NO: 1334526 - DNA, 22 bp, Artificial Sequence
  chemically synthesized
gttgggccaaagttagagaaat

SEQ ID NO: 1334527 - DNA, 22 bp, Artificial Sequence
  chemically synthesized
actacttttttcttaatttctc

SEQ ID NO: 1334528 - DNA, 22 bp, Artificial Sequence
  chemically synthesized
ggccaaagttagagaaattaag

SEQ ID NO: 1334529 - DNA, 22 bp, Artificial Sequence
  chemically synthesized
caattaactacttttttcttaa

SEQ ID NO: 1334530 - DNA, 22 bp, Artificial Sequence
  chemically synthesized
tgcaattaactacttttttctt

SEQ ID NO: 1334531 - DNA, 22 bp, Artificial Sequence
  chemically synthesized
ctgcaattaactacttttttct

SEQ ID NO: 1334532 - DNA, 22 bp, Artificial Sequence
  chemically synthesized
gagaaattaagaaaaaagtagt

SEQ ID NO: 1334533 - DNA, 22 bp, Artificial Sequence
  chemically synthesized
agaaaaaagtagttaattgcag

SEQ ID NO: 1334534 - DNA, 22 bp, Artificial Sequence
  chemically synthesized
aagtcagtaacttctgcaatta

SEQ ID NO: 1334535 - DNA, 22 bp, Artificial Sequence
  chemically synthesized
ctcaagtcagtaacttctgcaa

SEQ ID NO: 1334536 - DNA, 22 bp, Artificial Sequence
  chemically synthesized
ctcctcaagtcagtaacttctg

SEQ ID NO: 1334537 - DNA, 22 bp, Artificial Sequence
  chemically synthesized
cctcctcaagtcagtaacttct

SEQ ID NO: 1334538 - DNA, 22 bp, Artificial Sequence
  chemically synthesized
tcctcctcaagtcagtaacttc

SEQ ID NO: 1334539 - DNA, 22 bp, Artificial Sequence
  chemically synthesized
ttcctcctcaagtcagtaactt

SEQ ID NO: 1334540 - DNA, 22 bp, Artificial Sequence
  chemically synthesized
tttcctcctcaagtcagtaact

SEQ ID NO: 1334541 - DNA, 22 bp, Artificial Sequence
  chemically synthesized
ttttcctcctcaagtcagtaac

SEQ ID NO: 1334542 - DNA, 22 bp, Artificial Sequence
  chemically synthesized
attgcagaagttactgacttga

SEQ ID NO: 1334543 - DNA, 22 bp, Artificial Sequence
  chemically synthesized
cttttttcctcctcaagtcagt

SEQ ID NO: 1334544 - DNA, 22 bp, Artificial Sequence
  chemically synthesized
cagaagttactgacttgaggag

SEQ ID NO: 1334545 - DNA, 22 bp, Artificial Sequence
  chemically synthesized
ctgacttgaggaggaaaaaagg

SEQ ID NO: 1334546 - DNA, 22 bp, Artificial Sequence
  chemically synthesized
atatatagggttccttttttcc

SEQ ID NO: 1334547 - DNA, 22 bp, Artificial Sequence
  chemically synthesized
acttgaggaggaaaaaaggaac

SEQ ID NO: 1334548 - DNA, 22 bp, Artificial Sequence
  chemically synthesized
gaggaggaaaaaaggaacccta

SEQ ID NO: 1334549 - DNA, 22 bp, Artificial Sequence
  chemically synthesized
aggaggaaaaaaggaaccctat

SEQ ID NO: 1334550 - DNA, 22 bp, Artificial Sequence
  chemically synthesized
cagaaactcatatatagggttc

SEQ ID NO: 1334551 - DNA, 22 bp, Artificial Sequence
  chemically synthesized
acagaaactcatatatagggtt

SEQ ID NO: 1334552 - DNA, 22 bp, Artificial Sequence
  chemically synthesized
tacagaaactcatatatagggt

SEQ ID NO: 1334553 - DNA, 22 bp, Artificial Sequence
  chemically synthesized
tttacagaaactcatatatagg

SEQ ID NO: 1334554 - DNA, 22 bp, Artificial Sequence
  chemically synthesized
ctttacagaaactcatatatag

SEQ ID NO: 1334555 - DNA, 22 bp, Artificial Sequence
  chemically synthesized
atttctttacagaaactcatat

SEQ ID NO: 1334556 - DNA, 22 bp, Artificial Sequence
  chemically synthesized
tatatgagtttctgtaaagaaa

SEQ ID NO: 1334557 - DNA, 22 bp, Artificial Sequence
  chemically synthesized
gccaagagctaatttctttaca

SEQ ID NO: 1334558 - DNA, 22 bp, Artificial Sequence
  chemically synthesized
cctggccaagagctaatttctt

SEQ ID NO: 1334559 - DNA, 22 bp, Artificial Sequence
  chemically synthesized
ccctggccaagagctaatttct

SEQ ID NO: 1334560 - DNA, 22 bp, Artificial Sequence
  chemically synthesized
ttccctggccaagagctaattt

SEQ ID NO: 1334561 - DNA, 22 bp, Artificial Sequence
  chemically synthesized
cttccctggccaagagctaatt

SEQ ID NO: 1334562 - DNA, 22 bp, Artificial Sequence
  chemically synthesized
ctgtaaagaaattagctcttgg

SEQ ID NO: 1334563 - DNA, 22 bp, Artificial Sequence
  chemically synthesized
tttcttccctggccaagagcta

SEQ ID NO: 1334564 - DNA, 22 bp, Artificial Sequence
  chemically synthesized
tgtaaagaaattagctcttggc

SEQ ID NO: 1334565 - DNA, 22 bp, Artificial Sequence
  chemically synthesized
atttcttccctggccaagagct

SEQ ID NO: 1334566 - DNA, 22 bp, Artificial Sequence
  chemically synthesized
taaagaaattagctcttggcca

SEQ ID NO: 1334567 - DNA, 22 bp, Artificial Sequence
  chemically synthesized
tttatttcttccctggccaaga

SEQ ID NO: 1334568 - DNA, 22 bp, Artificial Sequence
  chemically synthesized
ttatttatttcttccctggcca

SEQ ID NO: 1334569 - DNA, 22 bp, Artificial Sequence
  chemically synthesized
gttatttatttcttccctggcc

SEQ ID NO: 1334570 - DNA, 22 bp, Artificial Sequence
  chemically synthesized
atttgttatttatttcttccct

SEQ ID NO: 1334571 - DNA, 22 bp, Artificial Sequence
  chemically synthesized
aatttgttatttatttcttccc

SEQ ID NO: 1334572 - DNA, 22 bp, Artificial Sequence
  chemically synthesized
gctcttggccagggaagaaata

SEQ ID NO: 1334573 - DNA, 22 bp, Artificial Sequence
  chemically synthesized
ttggccagggaagaaataaata

SEQ ID NO: 1334574 - DNA, 22 bp, Artificial Sequence
  chemically synthesized
gatcttaatttgttatttattt

SEQ ID NO: 1334575 - DNA, 22 bp, Artificial Sequence
  chemically synthesized
ggccagggaagaaataaataac

SEQ ID NO: 1334576 - DNA, 22 bp, Artificial Sequence
  chemically synthesized
agatcttaatttgttatttatt

SEQ ID NO: 1334577 - DNA, 22 bp, Artificial Sequence
  chemically synthesized
gccagggaagaaataaataaca

SEQ ID NO: 1334578 - DNA, 22 bp, Artificial Sequence
  chemically synthesized
tagatcttaatttgttatttat

SEQ ID NO: 1334579 - DNA, 22 bp, Artificial Sequence
  chemically synthesized
cctttagatcttaatttgttat

SEQ ID NO: 1334580 - DNA, 22 bp, Artificial Sequence
  chemically synthesized
ccctttagatcttaatttgtta

SEQ ID NO: 1334581 - DNA, 22 bp, Artificial Sequence
  chemically synthesized
tccctttagatcttaatttgtt

SEQ ID NO: 1334582 - DNA, 22 bp, Artificial Sequence
  chemically synthesized
ttccctttagatcttaatttgt

SEQ ID NO: 1334583 - DNA, 22 bp, Artificial Sequence
  chemically synthesized
atttttccctttagatcttaat

SEQ ID NO: 1334584 - DNA, 22 bp, Artificial Sequence
  chemically synthesized
aatttttccctttagatcttaa

SEQ ID NO: 1334585 - DNA, 22 bp, Artificial Sequence
  chemically synthesized
tccttaatttttccctttagat

SEQ ID NO: 1334586 - DNA, 22 bp, Artificial Sequence
  chemically synthesized
tgttatccttaatttttccctt

SEQ ID NO: 1334587 - DNA, 22 bp, Artificial Sequence
  chemically synthesized
agatctaaagggaaaaattaag

SEQ ID NO: 1334588 - DNA, 22 bp, Artificial Sequence
  chemically synthesized
tactgtgttatccttaattttt

SEQ ID NO: 1334589 - DNA, 22 bp, Artificial Sequence
  chemically synthesized
gtactgtgttatccttaatttt

SEQ ID NO: 1334590 - DNA, 22 bp, Artificial Sequence
  chemically synthesized
aagggaaaaattaaggataaca

SEQ ID NO: 1334591 - DNA, 22 bp, Artificial Sequence
  chemically synthesized
cgtatttgtactgtgttatcct

SEQ ID NO: 1334592 - DNA, 22 bp, Artificial Sequence
  chemically synthesized
aggataacacagtacaaatacg

SEQ ID NO: 1334593 - DNA, 22 bp, Artificial Sequence
  chemically synthesized
atcagacagtactgcgtatttg

SEQ ID NO: 1334594 - DNA, 22 bp, Artificial Sequence
  chemically synthesized
catcagacagtactgcgtattt

SEQ ID NO: 1334595 - DNA, 22 bp, Artificial Sequence
  chemically synthesized
tgaacaacttcatcagacagta

SEQ ID NO: 1334596 - DNA, 22 bp, Artificial Sequence
  chemically synthesized
tgcaattgtgaacaacttcatc

SEQ ID NO: 1334597 - DNA, 22 bp, Artificial Sequence
  chemically synthesized
ttgtgcaattgtgaacaacttc

SEQ ID NO: 1334598 - DNA, 22 bp, Artificial Sequence
  chemically synthesized
cactgttgtgcaattgtgaaca

SEQ ID NO: 1334599 - DNA, 22 bp, Artificial Sequence
  chemically synthesized
tctgatgaagttgttcacaatt

SEQ ID NO: 1334600 - DNA, 22 bp, Artificial Sequence
  chemically synthesized
gcactgttgtgcaattgtgaac

SEQ ID NO: 1334601 - DNA, 22 bp, Artificial Sequence
  chemically synthesized
atgaagttgttcacaattgcac

SEQ ID NO: 1334602 - DNA, 22 bp, Artificial Sequence
  chemically synthesized
tggaatcttgcactgttgtgca

SEQ ID NO: 1334603 - DNA, 22 bp, Artificial Sequence
  chemically synthesized
ttcacaattgcacaacagtgca

SEQ ID NO: 1334604 - DNA, 22 bp, Artificial Sequence
  chemically synthesized
acaattgcacaacagtgcaaga

SEQ ID NO: 1334605 - DNA, 22 bp, Artificial Sequence
  chemically synthesized
aaggtgcattgtggaatcttgc

SEQ ID NO: 1334606 - DNA, 22 bp, Artificial Sequence
  chemically synthesized
gaaggtgcattgtggaatcttg

SEQ ID NO: 1334607 - DNA, 22 bp, Artificial Sequence
  chemically synthesized
cacaacagtgcaagattccaca

SEQ ID NO: 1334608 - DNA, 22 bp, Artificial Sequence
  chemically synthesized
cagtgtccttgaaggtgcattg

SEQ ID NO: 1334609 - DNA, 22 bp, Artificial Sequence
  chemically synthesized
gctacagtgtccttgaaggtgc

SEQ ID NO: 1334610 - DNA, 22 bp, Artificial Sequence
  chemically synthesized
agctacagtgtccttgaaggtg

SEQ ID NO: 1334611 - DNA, 22 bp, Artificial Sequence
  chemically synthesized
cacaatgcaccttcaaggacac

SEQ ID NO: 1334612 - DNA, 22 bp, Artificial Sequence
  chemically synthesized
caaggacactgtagctaaggat

SEQ ID NO: 1334613 - DNA, 22 bp, Artificial Sequence
  chemically synthesized
aaggacactgtagctaaggatt

SEQ ID NO: 1334614 - DNA, 22 bp, Artificial Sequence
  chemically synthesized
tagctaaggattgctttctgat

SEQ ID NO: 1334615 - DNA, 22 bp, Artificial Sequence
  chemically synthesized
aaaggataaatgatcagaaagc

SEQ ID NO: 1334616 - DNA, 22 bp, Artificial Sequence
  chemically synthesized
cgctaaaaggataaatgatcag

SEQ ID NO: 1334617 - DNA, 22 bp, Artificial Sequence
  chemically synthesized
aggattgctttctgatcattta

SEQ ID NO: 1334618 - DNA, 22 bp, Artificial Sequence
  chemically synthesized
ccgctaaaaggataaatgatca

SEQ ID NO: 1334619 - DNA, 22 bp, Artificial Sequence
  chemically synthesized
ctttctgatcatttatcctttt

SEQ ID NO: 1334620 - DNA, 22 bp, Artificial Sequence
  chemically synthesized
tctgatcatttatccttttagc

SEQ ID NO: 1334621 - DNA, 22 bp, Artificial Sequence
  chemically synthesized
ctgatcatttatccttttagcg

SEQ ID NO: 1334622 - DNA, 22 bp, Artificial Sequence
  chemically synthesized
tgatcatttatccttttagcgg

SEQ ID NO: 1334623 - DNA, 22 bp, Artificial Sequence
  chemically synthesized
atcatttatccttttagcggaa

SEQ ID NO: 1334624 - DNA, 22 bp, Artificial Sequence
  chemically synthesized
ccagatgccaagtgtcttccgc

SEQ ID NO: 1334625 - DNA, 22 bp, Artificial Sequence
  chemically synthesized
atccttttagcggaagacactt

SEQ ID NO: 1334626 - DNA, 22 bp, Artificial Sequence
  chemically synthesized
tccttttagcggaagacacttg

SEQ ID NO: 1334627 - DNA, 22 bp, Artificial Sequence
  chemically synthesized
ttagcggaagacacttggcatc

SEQ ID NO: 1334628 - DNA, 22 bp, Artificial Sequence
  chemically synthesized
tagcggaagacacttggcatct

SEQ ID NO: 1334629 - DNA, 22 bp, Artificial Sequence
  chemically synthesized
agcggaagacacttggcatctg

SEQ ID NO: 1334630 - DNA, 22 bp, Artificial Sequence
  chemically synthesized
gcggaagacacttggcatctgg

SEQ ID NO: 1334631 - DNA, 22 bp, Artificial Sequence
  chemically synthesized
aaaagaacaaatgttcccagat

SEQ ID NO: 1334632 - DNA, 22 bp, Artificial Sequence
  chemically synthesized
ttcaaaagaacaaatgttccca

SEQ ID NO: 1334633 - DNA, 22 bp, Artificial Sequence
  chemically synthesized
attcaaaagaacaaatgttccc

SEQ ID NO: 1334634 - DNA, 22 bp, Artificial Sequence
  chemically synthesized
tattcaaaagaacaaatgttcc

SEQ ID NO: 1334635 - DNA, 22 bp, Artificial Sequence
  chemically synthesized
ttattcaaaagaacaaatgttc

SEQ ID NO: 1334636 - DNA, 22 bp, Artificial Sequence
  chemically synthesized
ggcatctgggaacatttgttct

SEQ ID NO: 1334637 - DNA, 22 bp, Artificial Sequence
  chemically synthesized
gcatctgggaacatttgttctt

SEQ ID NO: 1334638 - DNA, 22 bp, Artificial Sequence
  chemically synthesized
ggaacatttgttcttttgaata

SEQ ID NO: 1334639 - DNA, 22 bp, Artificial Sequence
  chemically synthesized
ggtatgaggtgatttttattca

SEQ ID NO: 1334640 - DNA, 22 bp, Artificial Sequence
  chemically synthesized
aggtatgaggtgatttttattc

SEQ ID NO: 1334641 - DNA, 22 bp, Artificial Sequence
  chemically synthesized
taggtatgaggtgatttttatt

SEQ ID NO: 1334642 - DNA, 22 bp, Artificial Sequence
  chemically synthesized
ttaggtatgaggtgatttttat

SEQ ID NO: 1334643 - DNA, 22 bp, Artificial Sequence
  chemically synthesized
gttcttttgaataaaaatcacc

SEQ ID NO: 1334644 - DNA, 22 bp, Artificial Sequence
  chemically synthesized
ttcttttgaataaaaatcacct

SEQ ID NO: 1334645 - DNA, 22 bp, Artificial Sequence
  chemically synthesized
cttttaggtatgaggtgatttt

SEQ ID NO: 1334646 - DNA, 22 bp, Artificial Sequence
  chemically synthesized
ttttgaataaaaatcacctcat

SEQ ID NO: 1334647 - DNA, 22 bp, Artificial Sequence
  chemically synthesized
ttgaataaaaatcacctcatac

SEQ ID NO: 1334648 - DNA, 22 bp, Artificial Sequence
  chemically synthesized
tgaataaaaatcacctcatacc

SEQ ID NO: 1334649 - DNA, 22 bp, Artificial Sequence
  chemically synthesized
gaataaaaatcacctcatacct

SEQ ID NO: 1334650 - DNA, 22 bp, Artificial Sequence
  chemically synthesized
aataaaaatcacctcataccta

SEQ ID NO: 1334651 - DNA, 22 bp, Artificial Sequence
  chemically synthesized
taaaggttccttttaggtatga

SEQ ID NO: 1334652 - DNA, 22 bp, Artificial Sequence
  chemically synthesized
ataaaggttccttttaggtatg

SEQ ID NO: 1334653 - DNA, 22 bp, Artificial Sequence
  chemically synthesized
atatttataaaggttcctttta

SEQ ID NO: 1334654 - DNA, 22 bp, Artificial Sequence
  chemically synthesized
tgatatttataaaggttccttt

SEQ ID NO: 1334655 - DNA, 22 bp, Artificial Sequence
  chemically synthesized
ctgatatttataaaggttcctt

SEQ ID NO: 1334656 - DNA, 22 bp, Artificial Sequence
  chemically synthesized
tctgatatttataaaggttcct

SEQ ID NO: 1334657 - DNA, 22 bp, Artificial Sequence
  chemically synthesized
ttctgatatttataaaggttcc

SEQ ID NO: 1334658 - DNA, 22 bp, Artificial Sequence
  chemically synthesized
atacctaaaaggaacctttata

SEQ ID NO: 1334659 - DNA, 22 bp, Artificial Sequence
  chemically synthesized
tttttctgatatttataaaggt

SEQ ID NO: 1334660 - DNA, 22 bp, Artificial Sequence
  chemically synthesized
ctgtttttctgatatttataaa

SEQ ID NO: 1334661 - DNA, 22 bp, Artificial Sequence
  chemically synthesized
aaaggaacctttataaatatca

SEQ ID NO: 1334662 - DNA, 22 bp, Artificial Sequence
  chemically synthesized
tataaatatcagaaaaacagga

SEQ ID NO: 1334663 - DNA, 22 bp, Artificial Sequence
  chemically synthesized
ataaatatcagaaaaacaggaa

SEQ ID NO: 1334664 - DNA, 22 bp, Artificial Sequence
  chemically synthesized
taaatatcagaaaaacaggaat

SEQ ID NO: 1334665 - DNA, 22 bp, Artificial Sequence
  chemically synthesized
atgaggccaagccccaccaatg

SEQ ID NO: 1334666 - DNA, 22 bp, Artificial Sequence
  chemically synthesized
tgacgacgatcattggtggggc

SEQ ID NO: 1334667 - DNA, 22 bp, Artificial Sequence
  chemically synthesized
gtggccccagagctaatgaggc

SEQ ID NO: 1334668 - DNA, 22 bp, Artificial Sequence
  chemically synthesized
gtggggcttggcctcattagct

SEQ ID NO: 1334669 - DNA, 22 bp, Artificial Sequence
  chemically synthesized
cactagtggccccagagctaat

SEQ ID NO: 1334670 - DNA, 22 bp, Artificial Sequence
  chemically synthesized
acactagtggccccagagctaa

SEQ ID NO: 1334671 - DNA, 22 bp, Artificial Sequence
  chemically synthesized
tacactagtggccccagagcta

SEQ ID NO: 1334672 - DNA, 22 bp, Artificial Sequence
  chemically synthesized
ttacactagtggccccagagct

SEQ ID NO: 1334673 - DNA, 22 bp, Artificial Sequence
  chemically synthesized
tttacactagtggccccagagc

SEQ ID NO: 1334674 - DNA, 22 bp, Artificial Sequence
  chemically synthesized
ttttacactagtggccccagag

SEQ ID NO: 1334675 - DNA, 22 bp, Artificial Sequence
  chemically synthesized
ggcctcattagctctggggcca

SEQ ID NO: 1334676 - DNA, 22 bp, Artificial Sequence
  chemically synthesized
tttttacactagtggccccaga

SEQ ID NO: 1334677 - DNA, 22 bp, Artificial Sequence
  chemically synthesized
gcctcattagctctggggccac

SEQ ID NO: 1334678 - DNA, 22 bp, Artificial Sequence
  chemically synthesized
attagctctggggccactagtg

SEQ ID NO: 1334679 - DNA, 22 bp, Artificial Sequence
  chemically synthesized
tgaacctttttttacactagtg

SEQ ID NO: 1334680 - DNA, 22 bp, Artificial Sequence
  chemically synthesized
gctctggggccactagtgtaaa

SEQ ID NO: 1334681 - DNA, 22 bp, Artificial Sequence
  chemically synthesized
tggggccactagtgtaaaaaaa

SEQ ID NO: 1334682 - DNA, 22 bp, Artificial Sequence
  chemically synthesized
gggccactagtgtaaaaaaagg

SEQ ID NO: 1334683 - DNA, 22 bp, Artificial Sequence
  chemically synthesized
gaagagagtccctgtgaacctt

SEQ ID NO: 1334684 - DNA, 22 bp, Artificial Sequence
  chemically synthesized
gtgtaaaaaaaggttcacaggg

SEQ ID NO: 1334685 - DNA, 22 bp, Artificial Sequence
  chemically synthesized
ctagaagagagtccctgtgaac

SEQ ID NO: 1334686 - DNA, 22 bp, Artificial Sequence
  chemically synthesized
acagggactctcttctagtagg

SEQ ID NO: 1334687 - DNA, 22 bp, Artificial Sequence
  chemically synthesized
tatatatatatagtccctacta

SEQ ID NO: 1334688 - DNA, 22 bp, Artificial Sequence
  chemically synthesized
atatatatatatagtccctact

SEQ ID NO: 1334689 - DNA, 22 bp, Artificial Sequence
  chemically synthesized
tcttctagtagggactatatat

SEQ ID NO: 1334690 - DNA, 22 bp, Artificial Sequence
  chemically synthesized
ttctagtagggactatatatat

SEQ ID NO: 1334691 - DNA, 22 bp, Artificial Sequence
  chemically synthesized
ctagtagggactatatatatat

SEQ ID NO: 1334692 - DNA, 22 bp, Artificial Sequence
  chemically synthesized
tagtagggactatatatatata

SEQ ID NO: 1334693 - DNA, 22 bp, Artificial Sequence
  chemically synthesized
gtagggactatatatatatata

SEQ ID NO: 1334694 - DNA, 22 bp, Artificial Sequence
  chemically synthesized
cgtcatatatatatatatttat

SEQ ID NO: 1334695 - DNA, 22 bp, Artificial Sequence
  chemically synthesized
tatatatatataaatatatata

SEQ ID NO: 1334696 - DNA, 22 bp, Artificial Sequence
  chemically synthesized
ggcaacaagagcaaaactccgt

SEQ ID NO: 1334697 - DNA, 22 bp, Artificial Sequence
  chemically synthesized
caacctgggcaacaagagcaaa

SEQ ID NO: 1334698 - DNA, 22 bp, Artificial Sequence
  chemically synthesized
cactccaacctgggcaacaaga

SEQ ID NO: 1334699 - DNA, 22 bp, Artificial Sequence
  chemically synthesized
tgctcttgttgcccaggttgga

SEQ ID NO: 1334700 - DNA, 22 bp, Artificial Sequence
  chemically synthesized
gctcttgttgcccaggttggag

SEQ ID NO: 1334701 - DNA, 22 bp, Artificial Sequence
  chemically synthesized
ctcttgttgcccaggttggagt

SEQ ID NO: 1334702 - DNA, 22 bp, Artificial Sequence
  chemically synthesized
ttgttgcccaggttggagtgca

SEQ ID NO: 1334703 - DNA, 22 bp, Artificial Sequence
  chemically synthesized
gttgcccaggttggagtgcaat

SEQ ID NO: 1334704 - DNA, 22 bp, Artificial Sequence
  chemically synthesized
ttgcccaggttggagtgcaatg

SEQ ID NO: 1334705 - DNA, 22 bp, Artificial Sequence
  chemically synthesized
cccaggttggagtgcaatggcg

SEQ ID NO: 1334706 - DNA, 22 bp, Artificial Sequence
  chemically synthesized
cggtgagccgagatcacgccat

SEQ ID NO: 1334707 - DNA, 22 bp, Artificial Sequence
  chemically synthesized
gagtgcaatggcgtgatctcgg

SEQ ID NO: 1334708 - DNA, 22 bp, Artificial Sequence
  chemically synthesized
aacccgggaggcagaggttgcg

SEQ ID NO: 1334709 - DNA, 22 bp, Artificial Sequence
  chemically synthesized
gaacccgggaggcagaggttgc

SEQ ID NO: 1334710 - DNA, 22 bp, Artificial Sequence
  chemically synthesized
ggctcaccgcaacctctgcctc

SEQ ID NO: 1334711 - DNA, 22 bp, Artificial Sequence
  chemically synthesized
accgcaacctctgcctcccggg

SEQ ID NO: 1334712 - DNA, 22 bp, Artificial Sequence
  chemically synthesized
aggcaggagaatcgcttgaacc

SEQ ID NO: 1334713 - DNA, 22 bp, Artificial Sequence
  chemically synthesized
tgcctcccgggttcaagcgatt

SEQ ID NO: 1334714 - DNA, 22 bp, Artificial Sequence
  chemically synthesized
cctcccgggttcaagcgattct

SEQ ID NO: 1334715 - DNA, 22 bp, Artificial Sequence
  chemically synthesized
ccgggttcaagcgattctcctg

SEQ ID NO: 1334716 - DNA, 22 bp, Artificial Sequence
  chemically synthesized
cggaggctgaggcaggagaatc

SEQ ID NO: 1334717 - DNA, 22 bp, Artificial Sequence
  chemically synthesized
ctccggaggctgaggcaggaga

SEQ ID NO: 1334718 - DNA, 22 bp, Artificial Sequence
  chemically synthesized
aagcgattctcctgcctcagcc

SEQ ID NO: 1334719 - DNA, 22 bp, Artificial Sequence
  chemically synthesized
tcctgcctcagcctccggagca

SEQ ID NO: 1334720 - DNA, 22 bp, Artificial Sequence
  chemically synthesized
ctgcctcagcctccggagcagc

SEQ ID NO: 1334721 - DNA, 22 bp, Artificial Sequence
  chemically synthesized
cctcagcctccggagcagctgg

SEQ ID NO: 1334722 - DNA, 22 bp, Artificial Sequence
  chemically synthesized
agcctccggagcagctgggact

SEQ ID NO: 1334723 - DNA, 22 bp, Artificial Sequence
  chemically synthesized
cggagcagctgggactaccatg

SEQ ID NO: 1334724 - DNA, 22 bp, Artificial Sequence
  chemically synthesized
ggcgtggtggcgcatggtagtc

SEQ ID NO: 1334725 - DNA, 22 bp, Artificial Sequence
  chemically synthesized
gctgggcgtggtggcgcatggt

SEQ ID NO: 1334726 - DNA, 22 bp, Artificial Sequence
  chemically synthesized
ggactaccatgcgccaccacgc

SEQ ID NO: 1334727 - DNA, 22 bp, Artificial Sequence
  chemically synthesized
ccatgcgccaccacgcccagct

SEQ ID NO: 1334728 - DNA, 22 bp, Artificial Sequence
  chemically synthesized
aaaatacaaaattagctgggcg

SEQ ID NO: 1334729 - DNA, 22 bp, Artificial Sequence
  chemically synthesized
ctaaaaatacaaaattagctgg

SEQ ID NO: 1334730 - DNA, 22 bp, Artificial Sequence
  chemically synthesized
tactaaaaatacaaaattagct

SEQ ID NO: 1334731 - DNA, 22 bp, Artificial Sequence
  chemically synthesized
attttgtatttttagtagagac

SEQ ID NO: 1334732 - DNA, 22 bp, Artificial Sequence
  chemically synthesized
tgtatttttagtagagacgggg

SEQ ID NO: 1334733 - DNA, 22 bp, Artificial Sequence
  chemically synthesized
gtatttttagtagagacggggt

SEQ ID NO: 1334734 - DNA, 22 bp, Artificial Sequence
  chemically synthesized
tatttttagtagagacggggtt

SEQ ID NO: 1334735 - DNA, 22 bp, Artificial Sequence
  chemically synthesized
accaacatggagaaaccccgtc

SEQ ID NO: 1334736 - DNA, 22 bp, Artificial Sequence
  chemically synthesized
ttagtagagacggggtttctcc

SEQ ID NO: 1334737 - DNA, 22 bp, Artificial Sequence
  chemically synthesized
tagtagagacggggtttctcca

SEQ ID NO: 1334738 - DNA, 22 bp, Artificial Sequence
  chemically synthesized
agtagagacggggtttctccat

SEQ ID NO: 1334739 - DNA, 22 bp, Artificial Sequence
  chemically synthesized
gtagagacggggtttctccatg

SEQ ID NO: 1334740 - DNA, 22 bp, Artificial Sequence
  chemically synthesized
ctccatgttggtcaggctggtc

SEQ ID NO: 1334741 - DNA, 22 bp, Artificial Sequence
  chemically synthesized
tccatgttggtcaggctggtct

SEQ ID NO: 1334742 - DNA, 22 bp, Artificial Sequence
  chemically synthesized
catgttggtcaggctggtctcg

SEQ ID NO: 1334743 - DNA, 22 bp, Artificial Sequence
  chemically synthesized
aggtcgggagtccgagaccagc

SEQ ID NO: 1334744 - DNA, 22 bp, Artificial Sequence
  chemically synthesized
gtcaggctggtctcggactccc

SEQ ID NO: 1334745 - DNA, 22 bp, Artificial Sequence
  chemically synthesized
gtctcggactcccgacctcagg

SEQ ID NO: 1334746 - DNA, 22 bp, Artificial Sequence
  chemically synthesized
ggactcccgacctcaggtgatc

SEQ ID NO: 1334747 - DNA, 22 bp, Artificial Sequence
  chemically synthesized
ggaggccgaggcaggcggatca

SEQ ID NO: 1334748 - DNA, 22 bp, Artificial Sequence
  chemically synthesized
ccgacctcaggtgatccgcctg

SEQ ID NO: 1334749 - DNA, 22 bp, Artificial Sequence
  chemically synthesized
gggaggccgaggcaggcggatc

SEQ ID NO: 1334750 - DNA, 22 bp, Artificial Sequence
  chemically synthesized
tgggaggccgaggcaggcggat

SEQ ID NO: 1334751 - DNA, 22 bp, Artificial Sequence
  chemically synthesized
aggtgatccgcctgcctcggcc

SEQ ID NO: 1334752 - DNA, 22 bp, Artificial Sequence
  chemically synthesized
taatcccagcactttgggaggc

SEQ ID NO: 1334753 - DNA, 22 bp, Artificial Sequence
  chemically synthesized
cctcggcctcccaaagtgctgg

SEQ ID NO: 1334754 - DNA, 22 bp, Artificial Sequence
  chemically synthesized
acgcctgtaatcccagcacttt

SEQ ID NO: 1334755 - DNA, 22 bp, Artificial Sequence
  chemically synthesized
ggcctcccaaagtgctgggatt

SEQ ID NO: 1334756 - DNA, 22 bp, Artificial Sequence
  chemically synthesized
tggctcacgcctgtaatcccag

SEQ ID NO: 1334757 - DNA, 22 bp, Artificial Sequence
  chemically synthesized
ccaaagtgctgggattacaggc

SEQ ID NO: 1334758 - DNA, 22 bp, Artificial Sequence
  chemically synthesized
ggattacaggcgtgagccacag

SEQ ID NO: 1334759 - DNA, 22 bp, Artificial Sequence
  chemically synthesized
caggcgtgagccacagcgcctg

SEQ ID NO: 1334760 - DNA, 22 bp, Artificial Sequence
  chemically synthesized
aatatgaagtcccggccaggcg

SEQ ID NO: 1334761 - DNA, 22 bp, Artificial Sequence
  chemically synthesized
attaaatatgaagtcccggcca

SEQ ID NO: 1334762 - DNA, 22 bp, Artificial Sequence
  chemically synthesized
gccgggacttcatatttaatga

SEQ ID NO: 1334763 - DNA, 22 bp, Artificial Sequence
  chemically synthesized
gaacagtgaaaagcctcattaa

SEQ ID NO: 1334764 - DNA, 22 bp, Artificial Sequence
  chemically synthesized
ctagaacagtgaaaagcctcat

SEQ ID NO: 1334765 - DNA, 22 bp, Artificial Sequence
  chemically synthesized
catatttaatgaggcttttcac

SEQ ID NO: 1334766 - DNA, 22 bp, Artificial Sequence
  chemically synthesized
attcctagaacagtgaaaagcc

SEQ ID NO: 1334767 - DNA, 22 bp, Artificial Sequence
  chemically synthesized
atatttaatgaggcttttcact

SEQ ID NO: 1334768 - DNA, 22 bp, Artificial Sequence
  chemically synthesized
aattcctagaacagtgaaaagc

SEQ ID NO: 1334769 - DNA, 22 bp, Artificial Sequence
  chemically synthesized
agtttaattcctagaacagtga

SEQ ID NO: 1334770 - DNA, 22 bp, Artificial Sequence
  chemically synthesized
aatgaggcttttcactgttcta

SEQ ID NO: 1334771 - DNA, 22 bp, Artificial Sequence
  chemically synthesized
atgaggcttttcactgttctag

SEQ ID NO: 1334772 - DNA, 22 bp, Artificial Sequence
  chemically synthesized
aaactcagtttaattcctagaa

SEQ ID NO: 1334773 - DNA, 22 bp, Artificial Sequence
  chemically synthesized
ttcactgttctaggaattaaac

SEQ ID NO: 1334774 - DNA, 22 bp, Artificial Sequence
  chemically synthesized
tcactgttctaggaattaaact

SEQ ID NO: 1334775 - DNA, 22 bp, Artificial Sequence
  chemically synthesized
cactgttctaggaattaaactg

SEQ ID NO: 1334776 - DNA, 22 bp, Artificial Sequence
  chemically synthesized
actgttctaggaattaaactga

SEQ ID NO: 1334777 - DNA, 22 bp, Artificial Sequence
  chemically synthesized
ttctaggaattaaactgagttt

SEQ ID NO: 1334778 - DNA, 22 bp, Artificial Sequence
  chemically synthesized
aatgcaatacctgaaactcagt

SEQ ID NO: 1334779 - DNA, 22 bp, Artificial Sequence
  chemically synthesized
gaatgcaatacctgaaactcag

SEQ ID NO: 1334780 - DNA, 22 bp, Artificial Sequence
  chemically synthesized
taggaattaaactgagtttcag

SEQ ID NO: 1334781 - DNA, 22 bp, Artificial Sequence
  chemically synthesized
ttgaatgcaatacctgaaactc

SEQ ID NO: 1334782 - DNA, 22 bp, Artificial Sequence
  chemically synthesized
ggaattaaactgagtttcaggt

SEQ ID NO: 1334783 - DNA, 22 bp, Artificial Sequence
  chemically synthesized
aactgagtttcaggtattgcat

SEQ ID NO: 1334784 - DNA, 22 bp, Artificial Sequence
  chemically synthesized
agaagattcttgaatgcaatac

SEQ ID NO: 1334785 - DNA, 22 bp, Artificial Sequence
  chemically synthesized
ctgagaagattcttgaatgcaa

SEQ ID NO: 1334786 - DNA, 22 bp, Artificial Sequence
  chemically synthesized
agtttcaggtattgcattcaag

SEQ ID NO: 1334787 - DNA, 22 bp, Artificial Sequence
  chemically synthesized
gctgagaagattcttgaatgca

SEQ ID NO: 1334788 - DNA, 22 bp, Artificial Sequence
  chemically synthesized
caggtattgcattcaagaatct

SEQ ID NO: 1334789 - DNA, 22 bp, Artificial Sequence
  chemically synthesized
aggtattgcattcaagaatctt

SEQ ID NO: 1334790 - DNA, 22 bp, Artificial Sequence
  chemically synthesized
caggtttgctgagaagattctt

SEQ ID NO: 1334791 - DNA, 22 bp, Artificial Sequence
  chemically synthesized
cattcaagaatcttctcagcaa

SEQ ID NO: 1334792 - DNA, 22 bp, Artificial Sequence
  chemically synthesized
ccaatattgcaggtttgctgag

SEQ ID NO: 1334793 - DNA, 22 bp, Artificial Sequence
  chemically synthesized
aagaatcttctcagcaaacctg

SEQ ID NO: 1334794 - DNA, 22 bp, Artificial Sequence
  chemically synthesized
ctcagcaaacctgcaatattgg

SEQ ID NO: 1334795 - DNA, 22 bp, Artificial Sequence
  chemically synthesized
tcagcaaacctgcaatattggt

SEQ ID NO: 1334796 - DNA, 22 bp, Artificial Sequence
  chemically synthesized
aggaataacattaccaatattg

SEQ ID NO: 1334797 - DNA, 22 bp, Artificial Sequence
  chemically synthesized
aaggaataacattaccaatatt

SEQ ID NO: 1334798 - DNA, 22 bp, Artificial Sequence
  chemically synthesized
agcaaacctgcaatattggtaa

SEQ ID NO: 1334799 - DNA, 22 bp, Artificial Sequence
  chemically synthesized
caatattggtaatgttattcct

SEQ ID NO: 1334800 - DNA, 22 bp, Artificial Sequence
  chemically synthesized
taaaacgagtttaaggaataac

SEQ ID NO: 1334801 - DNA, 22 bp, Artificial Sequence
  chemically synthesized
acctgtaaaacgagtttaagga

SEQ ID NO: 1334802 - DNA, 22 bp, Artificial Sequence
  chemically synthesized
gtaatgttattccttaaactcg

SEQ ID NO: 1334803 - DNA, 22 bp, Artificial Sequence
  chemically synthesized
ctcacctgtaaaacgagtttaa

SEQ ID NO: 1334804 - DNA, 22 bp, Artificial Sequence
  chemically synthesized
caatctcctcacctgtaaaacg

SEQ ID NO: 1334805 - DNA, 22 bp, Artificial Sequence
  chemically synthesized
ttccttaaactcgttttacagg

SEQ ID NO: 1334806 - DNA, 22 bp, Artificial Sequence
  chemically synthesized
cttaaactcgttttacaggtga

SEQ ID NO: 1334807 - DNA, 22 bp, Artificial Sequence
  chemically synthesized
agctccaatctcctcacctgta

SEQ ID NO: 1334808 - DNA, 22 bp, Artificial Sequence
  chemically synthesized
aaactcgttttacaggtgagga

SEQ ID NO: 1334809 - DNA, 22 bp, Artificial Sequence
  chemically synthesized
tgagctccaatctcctcacctg

SEQ ID NO: 1334810 - DNA, 22 bp, Artificial Sequence
  chemically synthesized
aactcgttttacaggtgaggag

SEQ ID NO: 1334811 - DNA, 22 bp, Artificial Sequence
  chemically synthesized
tctgagctccaatctcctcacc

SEQ ID NO: 1334812 - DNA, 22 bp, Artificial Sequence
  chemically synthesized
gttttacaggtgaggagattgg

SEQ ID NO: 1334813 - DNA, 22 bp, Artificial Sequence
  chemically synthesized
tacaggtgaggagattggagct

SEQ ID NO: 1334814 - DNA, 22 bp, Artificial Sequence
  chemically synthesized
acaggtgaggagattggagctc

SEQ ID NO: 1334815 - DNA, 22 bp, Artificial Sequence
  chemically synthesized
aaaaacctctctgagctccaat

SEQ ID NO: 1334816 - DNA, 22 bp, Artificial Sequence
  chemically synthesized
caggtgaggagattggagctca

SEQ ID NO: 1334817 - DNA, 22 bp, Artificial Sequence
  chemically synthesized
gatgactgaaaaacctctctga

SEQ ID NO: 1334818 - DNA, 22 bp, Artificial Sequence
  chemically synthesized
gttggatgactgaaaaacctct

SEQ ID NO: 1334819 - DNA, 22 bp, Artificial Sequence
  chemically synthesized
gagctcagagaggtttttcagt

SEQ ID NO: 1334820 - DNA, 22 bp, Artificial Sequence
  chemically synthesized
cggttagttggatgactgaaaa

SEQ ID NO: 1334821 - DNA, 22 bp, Artificial Sequence
  chemically synthesized
ccggttagttggatgactgaaa

SEQ ID NO: 1334822 - DNA, 22 bp, Artificial Sequence
  chemically synthesized
agagaggtttttcagtcatcca

SEQ ID NO: 1334823 - DNA, 22 bp, Artificial Sequence
  chemically synthesized
agcacttccggttagttggatg

SEQ ID NO: 1334824 - DNA, 22 bp, Artificial Sequence
  chemically synthesized
aagcacttccggttagttggat

SEQ ID NO: 1334825 - DNA, 22 bp, Artificial Sequence
  chemically synthesized
ttaagcacttccggttagttgg

SEQ ID NO: 1334826 - DNA, 22 bp, Artificial Sequence
  chemically synthesized
ttcagtcatccaactaaccgga

SEQ ID NO: 1334827 - DNA, 22 bp, Artificial Sequence
  chemically synthesized
tcagtcatccaactaaccggaa

SEQ ID NO: 1334828 - DNA, 22 bp, Artificial Sequence
  chemically synthesized
cagtcatccaactaaccggaag

SEQ ID NO: 1334829 - DNA, 22 bp, Artificial Sequence
  chemically synthesized
gattcttaagcacttccggtta

SEQ ID NO: 1334830 - DNA, 22 bp, Artificial Sequence
  chemically synthesized
agtcatccaactaaccggaagt

SEQ ID NO: 1334831 - DNA, 22 bp, Artificial Sequence
  chemically synthesized
accggaagtgcttaagaatcca

SEQ ID NO: 1334832 - DNA, 22 bp, Artificial Sequence
  chemically synthesized
gggagtcaggtagagctggatt

SEQ ID NO: 1334833 - DNA, 22 bp, Artificial Sequence
  chemically synthesized
agggagtcaggtagagctggat

SEQ ID NO: 1334834 - DNA, 22 bp, Artificial Sequence
  chemically synthesized
tttagggagtcaggtagagctg

SEQ ID NO: 1334835 - DNA, 22 bp, Artificial Sequence
  chemically synthesized
gtttagggagtcaggtagagct

SEQ ID NO: 1334836 - DNA, 22 bp, Artificial Sequence
  chemically synthesized
aagaatccagctctacctgact

SEQ ID NO: 1334837 - DNA, 22 bp, Artificial Sequence
  chemically synthesized
agaatccagctctacctgactc

SEQ ID NO: 1334838 - DNA, 22 bp, Artificial Sequence
  chemically synthesized
acacacacttgtttagggagtc

SEQ ID NO: 1334839 - DNA, 22 bp, Artificial Sequence
  chemically synthesized
gacacacacttgtttagggagt

SEQ ID NO: 1334840 - DNA, 22 bp, Artificial Sequence
  chemically synthesized
ttgacacacacttgtttaggga

SEQ ID NO: 1334841 - DNA, 22 bp, Artificial Sequence
  chemically synthesized
tacctgactccctaaacaagtg

SEQ ID NO: 1334842 - DNA, 22 bp, Artificial Sequence
  chemically synthesized
actcttgacacacacttgttta

SEQ ID NO: 1334843 - DNA, 22 bp, Artificial Sequence
  chemically synthesized
cctgactccctaaacaagtgtg

SEQ ID NO: 1334844 - DNA, 22 bp, Artificial Sequence
  chemically synthesized
actccctaaacaagtgtgtgtc

SEQ ID NO: 1334845 - DNA, 22 bp, Artificial Sequence
  chemically synthesized
cctaaacaagtgtgtgtcaaga

SEQ ID NO: 1334846 - DNA, 22 bp, Artificial Sequence
  chemically synthesized
tatgcccattaactcttgacac

SEQ ID NO: 1334847 - DNA, 22 bp, Artificial Sequence
  chemically synthesized
gtatgcccattaactcttgaca

SEQ ID NO: 1334848 - DNA, 22 bp, Artificial Sequence
  chemically synthesized
aacaagtgtgtgtcaagagtta

SEQ ID NO: 1334849 - DNA, 22 bp, Artificial Sequence
  chemically synthesized
ccaagatacccaggtggtttgt

SEQ ID NO: 1334850 - DNA, 22 bp, Artificial Sequence
  chemically synthesized
accaagatacccaggtggtttg

SEQ ID NO: 1334851 - DNA, 22 bp, Artificial Sequence
  chemically synthesized
taccaagatacccaggtggttt

SEQ ID NO: 1334852 - DNA, 22 bp, Artificial Sequence
  chemically synthesized
atgggcatacaaaccacctggg

SEQ ID NO: 1334853 - DNA, 22 bp, Artificial Sequence
  chemically synthesized
ccgaatcagaacccgtatttta

SEQ ID NO: 1334854 - DNA, 22 bp, Artificial Sequence
  chemically synthesized
ggtatcttggtaaaatacgggt

SEQ ID NO: 1334855 - DNA, 22 bp, Artificial Sequence
  chemically synthesized
aaattaccgaatcagaacccgt

SEQ ID NO: 1334856 - DNA, 22 bp, Artificial Sequence
  chemically synthesized
ggtaaaatacgggttctgattc

SEQ ID NO: 1334857 - DNA, 22 bp, Artificial Sequence
  chemically synthesized
gtaaaatacgggttctgattcg

SEQ ID NO: 1334858 - DNA, 22 bp, Artificial Sequence
  chemically synthesized
aggtcccacctaaaattaccga

SEQ ID NO: 1334859 - DNA, 22 bp, Artificial Sequence
  chemically synthesized
tgattcggtaattttaggtggg

SEQ ID NO: 1334860 - DNA, 22 bp, Artificial Sequence
  chemically synthesized
attcggtaattttaggtgggac

SEQ ID NO: 1334861 - DNA, 22 bp, Artificial Sequence
  chemically synthesized
ggtaattttaggtgggacctga

SEQ ID NO: 1334862 - DNA, 22 bp, Artificial Sequence
  chemically synthesized
gaaatgcagaatctcaggtccc

SEQ ID NO: 1334863 - DNA, 22 bp, Artificial Sequence
  chemically synthesized
ttggaaatgcagaatctcaggt

SEQ ID NO: 1334864 - DNA, 22 bp, Artificial Sequence
  chemically synthesized
attggaaatgcagaatctcagg

SEQ ID NO: 1334865 - DNA, 22 bp, Artificial Sequence
  chemically synthesized
taggtgggacctgagattctgc

SEQ ID NO: 1334866 - DNA, 22 bp, Artificial Sequence
  chemically synthesized
aggtgggacctgagattctgca

SEQ ID NO: 1334867 - DNA, 22 bp, Artificial Sequence
  chemically synthesized
ggtgggacctgagattctgcat

SEQ ID NO: 1334868 - DNA, 22 bp, Artificial Sequence
  chemically synthesized
agattctgcatttccaataagt

SEQ ID NO: 1334869 - DNA, 22 bp, Artificial Sequence
  chemically synthesized
tgcatttccaataagttccctg

SEQ ID NO: 1334870 - DNA, 22 bp, Artificial Sequence
  chemically synthesized
catttccaataagttccctggg

SEQ ID NO: 1334871 - DNA, 22 bp, Artificial Sequence
  chemically synthesized
ccaataagttccctggggctgc

SEQ ID NO: 1334872 - DNA, 22 bp, Artificial Sequence
  chemically synthesized
caataagttccctggggctgct

SEQ ID NO: 1334873 - DNA, 22 bp, Artificial Sequence
  chemically synthesized
cctggggctgctgcggctgctg

SEQ ID NO: 1334874 - DNA, 22 bp, Artificial Sequence
  chemically synthesized
gggctgctgcggctgctgctgc

SEQ ID NO: 1334875 - DNA, 22 bp, Artificial Sequence
  chemically synthesized
tccaaagaccaccagcagcagc

SEQ ID NO: 1334876 - DNA, 22 bp, Artificial Sequence
  chemically synthesized
ctgcggctgctgctgctgctgg

SEQ ID NO: 1334877 - DNA, 22 bp, Artificial Sequence
  chemically synthesized
cggctgctgctgctgctggtgg

SEQ ID NO: 1334878 - DNA, 22 bp, Artificial Sequence
  chemically synthesized
ctgctgctgctggtggtctttg

SEQ ID NO: 1334879 - DNA, 22 bp, Artificial Sequence
  chemically synthesized
cccgatgtgttgtccaaagacc

SEQ ID NO: 1334880 - DNA, 22 bp, Artificial Sequence
  chemically synthesized
ctgctgctggtggtctttggac

SEQ ID NO: 1334881 - DNA, 22 bp, Artificial Sequence
  chemically synthesized
ctgctggtggtctttggacaac

SEQ ID NO: 1334882 - DNA, 22 bp, Artificial Sequence
  chemically synthesized
gctacccgatgtgttgtccaaa

SEQ ID NO: 1334883 - DNA, 22 bp, Artificial Sequence
  chemically synthesized
ctggtggtctttggacaacaca

SEQ ID NO: 1334884 - DNA, 22 bp, Artificial Sequence
  chemically synthesized
gtggtctttggacaacacatcg

SEQ ID NO: 1334885 - DNA, 22 bp, Artificial Sequence
  chemically synthesized
ggggcctcgctacccgatgtgt

SEQ ID NO: 1334886 - DNA, 22 bp, Artificial Sequence
  chemically synthesized
tggacaacacatcgggtagcga

SEQ ID NO: 1334887 - DNA, 22 bp, Artificial Sequence
  chemically synthesized
ggacaacacatcgggtagcgag

SEQ ID NO: 1334888 - DNA, 22 bp, Artificial Sequence
  chemically synthesized
gacaacacatcgggtagcgagg

SEQ ID NO: 1334889 - DNA, 22 bp, Artificial Sequence
  chemically synthesized
gagaaccacgggtctaggggcc

SEQ ID NO: 1334890 - DNA, 22 bp, Artificial Sequence
  chemically synthesized
atatcagcaaagttggagaacc

SEQ ID NO: 1334891 - DNA, 22 bp, Artificial Sequence
  chemically synthesized
taatatcagcaaagttggagaa

SEQ ID NO: 1334892 - DNA, 22 bp, Artificial Sequence
  chemically synthesized
gacccgtggttctccaactttg

SEQ ID NO: 1334893 - DNA, 22 bp, Artificial Sequence
  chemically synthesized
aggggattctaatatcagcaaa

SEQ ID NO: 1334894 - DNA, 22 bp, Artificial Sequence
  chemically synthesized
caggggattctaatatcagcaa

SEQ ID NO: 1334895 - DNA, 22 bp, Artificial Sequence
  chemically synthesized
ttcaggggattctaatatcagc

SEQ ID NO: 1334896 - DNA, 22 bp, Artificial Sequence
  chemically synthesized
tccaactttgctgatattagaa

SEQ ID NO: 1334897 - DNA, 22 bp, Artificial Sequence
  chemically synthesized
caactttgctgatattagaatc

SEQ ID NO: 1334898 - DNA, 22 bp, Artificial Sequence
  chemically synthesized
aagaagttcttcaggggattct

SEQ ID NO: 1334899 - DNA, 22 bp, Artificial Sequence
  chemically synthesized
aaagaagttcttcaggggattc

SEQ ID NO: 1334900 - DNA, 22 bp, Artificial Sequence
  chemically synthesized
tgctgatattagaatcccctga

SEQ ID NO: 1334901 - DNA, 22 bp, Artificial Sequence
  chemically synthesized
gctgatattagaatcccctgaa

SEQ ID NO: 1334902 - DNA, 22 bp, Artificial Sequence
  chemically synthesized
ttaaagaagttcttcaggggat

SEQ ID NO: 1334903 - DNA, 22 bp, Artificial Sequence
  chemically synthesized
ctgatattagaatcccctgaag

SEQ ID NO: 1334904 - DNA, 22 bp, Artificial Sequence
  chemically synthesized
cttaaagaagttcttcagggga

SEQ ID NO: 1334905 - DNA, 22 bp, Artificial Sequence
  chemically synthesized
tcttaaagaagttcttcagggg

SEQ ID NO: 1334906 - DNA, 22 bp, Artificial Sequence
  chemically synthesized
ttcttaaagaagttcttcaggg

SEQ ID NO: 1334907 - DNA, 22 bp, Artificial Sequence
  chemically synthesized
atattagaatcccctgaagaac

SEQ ID NO: 1334908 - DNA, 22 bp, Artificial Sequence
  chemically synthesized
tttcttaaagaagttcttcagg

SEQ ID NO: 1334909 - DNA, 22 bp, Artificial Sequence
  chemically synthesized
ttttcttaaagaagttcttcag

SEQ ID NO: 1334910 - DNA, 22 bp, Artificial Sequence
  chemically synthesized
gaatcccctgaagaacttcttt

SEQ ID NO: 1334911 - DNA, 22 bp, Artificial Sequence
  chemically synthesized
ggtttttttcttaaagaagttc

SEQ ID NO: 1334912 - DNA, 22 bp, Artificial Sequence
  chemically synthesized
ggcactgggtttttttcttaaa

SEQ ID NO: 1334913 - DNA, 22 bp, Artificial Sequence
  chemically synthesized
gggcactgggtttttttcttaa

SEQ ID NO: 1334914 - DNA, 22 bp, Artificial Sequence
  chemically synthesized
aagaacttctttaagaaaaaaa

SEQ ID NO: 1334915 - DNA, 22 bp, Artificial Sequence
  chemically synthesized
ctttaagaaaaaaacccagtgc

SEQ ID NO: 1334916 - DNA, 22 bp, Artificial Sequence
  chemically synthesized
tttaagaaaaaaacccagtgcc

SEQ ID NO: 1334917 - DNA, 22 bp, Artificial Sequence
  chemically synthesized
taagaaaaaaacccagtgccca

SEQ ID NO: 1334918 - DNA, 22 bp, Artificial Sequence
  chemically synthesized
aagaaaaaaacccagtgcccaa

SEQ ID NO: 1334919 - DNA, 22 bp, Artificial Sequence
  chemically synthesized
agaaaaaaacccagtgcccaaa

SEQ ID NO: 1334920 - DNA, 22 bp, Artificial Sequence
  chemically synthesized
atatgaagtgcagtttgggcac

SEQ ID NO: 1334921 - DNA, 22 bp, Artificial Sequence
  chemically synthesized
attgatatgaagtgcagtttgg

SEQ ID NO: 1334922 - DNA, 22 bp, Artificial Sequence
  chemically synthesized
cattgatatgaagtgcagtttg

SEQ ID NO: 1334923 - DNA, 22 bp, Artificial Sequence
  chemically synthesized
atttcattgatatgaagtgcag

SEQ ID NO: 1334924 - DNA, 22 bp, Artificial Sequence
  chemically synthesized
tgatttcattgatatgaagtgc

SEQ ID NO: 1334925 - DNA, 22 bp, Artificial Sequence
  chemically synthesized
gagactctgatttcattgatat

SEQ ID NO: 1334926 - DNA, 22 bp, Artificial Sequence
  chemically synthesized
tagagactctgatttcattgat

SEQ ID NO: 1334927 - DNA, 22 bp, Artificial Sequence
  chemically synthesized
ctagagactctgatttcattga

SEQ ID NO: 1334928 - DNA, 22 bp, Artificial Sequence
  chemically synthesized
cacttcatatcaatgaaatcag

SEQ ID NO: 1334929 - DNA, 22 bp, Artificial Sequence
  chemically synthesized
atttctagagactctgatttca

SEQ ID NO: 1334930 - DNA, 22 bp, Artificial Sequence
  chemically synthesized
catatcaatgaaatcagagtct

SEQ ID NO: 1334931 - DNA, 22 bp, Artificial Sequence
  chemically synthesized
atatcaatgaaatcagagtctc

SEQ ID NO: 1334932 - DNA, 22 bp, Artificial Sequence
  chemically synthesized
agtctcatttctagagactctg

SEQ ID NO: 1334933 - DNA, 22 bp, Artificial Sequence
  chemically synthesized
gagtctcatttctagagactct

SEQ ID NO: 1334934 - DNA, 22 bp, Artificial Sequence
  chemically synthesized
cttgagtctcatttctagagac

SEQ ID NO: 1334935 - DNA, 22 bp, Artificial Sequence
  chemically synthesized
gaattgcttgagtctcatttct

SEQ ID NO: 1334936 - DNA, 22 bp, Artificial Sequence
  chemically synthesized
attagaattgcttgagtctcat

SEQ ID NO: 1334937 - DNA, 22 bp, Artificial Sequence
  chemically synthesized
ttcattagaattgcttgagtct

SEQ ID NO: 1334938 - DNA, 22 bp, Artificial Sequence
  chemically synthesized
tagaaatgagactcaagcaatt

SEQ ID NO: 1334939 - DNA, 22 bp, Artificial Sequence
  chemically synthesized
gctgttcattagaattgcttga

SEQ ID NO: 1334940 - DNA, 22 bp, Artificial Sequence
  chemically synthesized
ggctgttcattagaattgcttg

SEQ ID NO: 1334941 - DNA, 22 bp, Artificial Sequence
  chemically synthesized
gaaatgagactcaagcaattct

SEQ ID NO: 1334942 - DNA, 22 bp, Artificial Sequence
  chemically synthesized
aaacttggctgttcattagaat

SEQ ID NO: 1334943 - DNA, 22 bp, Artificial Sequence
  chemically synthesized
tcaaacttggctgttcattaga

SEQ ID NO: 1334944 - DNA, 22 bp, Artificial Sequence
  chemically synthesized
aagcaattctaatgaacagcca

SEQ ID NO: 1334945 - DNA, 22 bp, Artificial Sequence
  chemically synthesized
taatgaacagccaagtttgaga

SEQ ID NO: 1334946 - DNA, 22 bp, Artificial Sequence
  chemically synthesized
atgaacagccaagtttgagaat

SEQ ID NO: 1334947 - DNA, 22 bp, Artificial Sequence
  chemically synthesized
ataacaacatgtcaatgggtac

SEQ ID NO: 1334948 - DNA, 22 bp, Artificial Sequence
  chemically synthesized
gataacaacatgtcaatgggta

SEQ ID NO: 1334949 - DNA, 22 bp, Artificial Sequence
  chemically synthesized
gagaatctgtacccattgacat

SEQ ID NO: 1334950 - DNA, 22 bp, Artificial Sequence
  chemically synthesized
agaatctgtacccattgacatg

SEQ ID NO: 1334951 - DNA, 22 bp, Artificial Sequence
  chemically synthesized
atttgataacaacatgtcaatg

SEQ ID NO: 1334952 - DNA, 22 bp, Artificial Sequence
  chemically synthesized
tacccattgacatgttgttatc

SEQ ID NO: 1334953 - DNA, 22 bp, Artificial Sequence
  chemically synthesized
atgagcacctaatttgataaca

SEQ ID NO: 1334954 - DNA, 22 bp, Artificial Sequence
  chemically synthesized
tgatgagcacctaatttgataa

SEQ ID NO: 1334955 - DNA, 22 bp, Artificial Sequence
  chemically synthesized
acatgttgttatcaaattaggt

SEQ ID NO: 1334956 - DNA, 22 bp, Artificial Sequence
  chemically synthesized
attctgatgagcacctaatttg

SEQ ID NO: 1334957 - DNA, 22 bp, Artificial Sequence
  chemically synthesized
ttatcaaattaggtgctcatca

SEQ ID NO: 1334958 - DNA, 22 bp, Artificial Sequence
  chemically synthesized
gtcagttgattctgatgagcac

SEQ ID NO: 1334959 - DNA, 22 bp, Artificial Sequence
  chemically synthesized
tcaaattaggtgctcatcagaa

SEQ ID NO: 1334960 - DNA, 22 bp, Artificial Sequence
  chemically synthesized
taatgagctcgtcagttgattc

SEQ ID NO: 1334961 - DNA, 22 bp, Artificial Sequence
  chemically synthesized
ggtgctcatcagaatcaactga

SEQ ID NO: 1334962 - DNA, 22 bp, Artificial Sequence
  chemically synthesized
ataatgagctcgtcagttgatt

SEQ ID NO: 1334963 - DNA, 22 bp, Artificial Sequence
  chemically synthesized
ggtttataatgagctcgtcagt

SEQ ID NO: 1334964 - DNA, 22 bp, Artificial Sequence
  chemically synthesized
atcagaatcaactgacgagctc

SEQ ID NO: 1334965 - DNA, 22 bp, Artificial Sequence
  chemically synthesized
tgggtttataatgagctcgtca

SEQ ID NO: 1334966 - DNA, 22 bp, Artificial Sequence
  chemically synthesized
acgagctcattataaacccaga

SEQ ID NO: 1334967 - DNA, 22 bp, Artificial Sequence
  chemically synthesized
atgaatgtaggtctctgggttt

SEQ ID NO: 1334968 - DNA, 22 bp, Artificial Sequence
  chemically synthesized
aatgaatgtaggtctctgggtt

SEQ ID NO: 1334969 - DNA, 22 bp, Artificial Sequence
  chemically synthesized
taatgaatgtaggtctctgggt

SEQ ID NO: 1334970 - DNA, 22 bp, Artificial Sequence
  chemically synthesized
ctttaatgaatgtaggtctctg

SEQ ID NO: 1334971 - DNA, 22 bp, Artificial Sequence
  chemically synthesized
attataaacccagagacctaca

SEQ ID NO: 1334972 - DNA, 22 bp, Artificial Sequence
  chemically synthesized
taaacccagagacctacattca

SEQ ID NO: 1334973 - DNA, 22 bp, Artificial Sequence
  chemically synthesized
tcactgctttaatgaatgtagg

SEQ ID NO: 1334974 - DNA, 22 bp, Artificial Sequence
  chemically synthesized
atcactgctttaatgaatgtag

SEQ ID NO: 1334975 - DNA, 22 bp, Artificial Sequence
  chemically synthesized
agtcttatcactgctttaatga

SEQ ID NO: 1334976 - DNA, 22 bp, Artificial Sequence
  chemically synthesized
cattcattaaagcagtgataag

SEQ ID NO: 1334977 - DNA, 22 bp, Artificial Sequence
  chemically synthesized
attaaagcagtgataagactta

SEQ ID NO: 1334978 - DNA, 22 bp, Artificial Sequence
  chemically synthesized
aatgtgcaaaggcctaagtctt

SEQ ID NO: 1334979 - DNA, 22 bp, Artificial Sequence
  chemically synthesized
aagcagtgataagacttaggcc

SEQ ID NO: 1334980 - DNA, 22 bp, Artificial Sequence
  chemically synthesized
cctaaatgtgcaaaggcctaag

SEQ ID NO: 1334981 - DNA, 22 bp, Artificial Sequence
  chemically synthesized
gggggtctacctaaatgtgcaa

SEQ ID NO: 1334982 - DNA, 22 bp, Artificial Sequence
  chemically synthesized
aggcctttgcacatttaggtag

SEQ ID NO: 1334983 - DNA, 22 bp, Artificial Sequence
  chemically synthesized
ggcctttgcacatttaggtaga

SEQ ID NO: 1334984 - DNA, 22 bp, Artificial Sequence
  chemically synthesized
tgcacatttaggtagacccccc

SEQ ID NO: 1334985 - DNA, 22 bp, Artificial Sequence
  chemically synthesized
gcacatttaggtagacccccca

SEQ ID NO: 1334986 - DNA, 22 bp, Artificial Sequence
  chemically synthesized
cacatttaggtagaccccccag

SEQ ID NO: 1334987 - DNA, 22 bp, Artificial Sequence
  chemically synthesized
gataacagaatcacctgggggg

SEQ ID NO: 1334988 - DNA, 22 bp, Artificial Sequence
  chemically synthesized
ttggataacagaatcacctggg

SEQ ID NO: 1334989 - DNA, 22 bp, Artificial Sequence
  chemically synthesized
aggtagaccccccaggtgattc

SEQ ID NO: 1334990 - DNA, 22 bp, Artificial Sequence
  chemically synthesized
ggtagaccccccaggtgattct

SEQ ID NO: 1334991 - DNA, 22 bp, Artificial Sequence
  chemically synthesized
aaactgttggataacagaatca

SEQ ID NO: 1334992 - DNA, 22 bp, Artificial Sequence
  chemically synthesized
tcaaactgttggataacagaat

SEQ ID NO: 1334993 - DNA, 22 bp, Artificial Sequence
  chemically synthesized
gaaagtggttctcaaactgttg

SEQ ID NO: 1334994 - DNA, 22 bp, Artificial Sequence
  chemically synthesized
tgttatccaacagtttgagaac

SEQ ID NO: 1334995 - DNA, 22 bp, Artificial Sequence
  chemically synthesized
ttatccaacagtttgagaacca

SEQ ID NO: 1334996 - DNA, 22 bp, Artificial Sequence
  chemically synthesized
tccaacagtttgagaaccactt

SEQ ID NO: 1334997 - DNA, 22 bp, Artificial Sequence
  chemically synthesized
aaggagcatggtctagaaagtg

SEQ ID NO: 1334998 - DNA, 22 bp, Artificial Sequence
  chemically synthesized
gaaggagcatggtctagaaagt

SEQ ID NO: 1334999 - DNA, 22 bp, Artificial Sequence
  chemically synthesized
atttgaaggagcatggtctaga

SEQ ID NO: 1335000 - DNA, 22 bp, Artificial Sequence
  chemically synthesized
gagaaccactttctagaccatg

SEQ ID NO: 1335001 - DNA, 22 bp, Artificial Sequence
  chemically synthesized
agaaccactttctagaccatgc

SEQ ID NO: 1335002 - DNA, 22 bp, Artificial Sequence
  chemically synthesized
attgatttgaaggagcatggtc

SEQ ID NO: 1335003 - DNA, 22 bp, Artificial Sequence
  chemically synthesized
gtctgattgatttgaaggagca

SEQ ID NO: 1335004 - DNA, 22 bp, Artificial Sequence
  chemically synthesized
ggtctgattgatttgaaggagc

SEQ ID NO: 1335005 - DNA, 22 bp, Artificial Sequence
  chemically synthesized
tctagaccatgctccttcaaat

SEQ ID NO: 1335006 - DNA, 22 bp, Artificial Sequence
  chemically synthesized
ctagaccatgctccttcaaatc

SEQ ID NO: 1335007 - DNA, 22 bp, Artificial Sequence
  chemically synthesized
tagaccatgctccttcaaatca

SEQ ID NO: 1335008 - DNA, 22 bp, Artificial Sequence
  chemically synthesized
gaccatgctccttcaaatcaat

SEQ ID NO: 1335009 - DNA, 22 bp, Artificial Sequence
  chemically synthesized
cagggcttggtctgattgattt

SEQ ID NO: 1335010 - DNA, 22 bp, Artificial Sequence
  chemically synthesized
tctgcagggcttggtctgattg

SEQ ID NO: 1335011 - DNA, 22 bp, Artificial Sequence
  chemically synthesized
gtctgcagggcttggtctgatt

SEQ ID NO: 1335012 - DNA, 22 bp, Artificial Sequence
  chemically synthesized
cttcaaatcaatcagaccaagc

SEQ ID NO: 1335013 - DNA, 22 bp, Artificial Sequence
  chemically synthesized
caaatcaatcagaccaagccct

SEQ ID NO: 1335014 - DNA, 22 bp, Artificial Sequence
  chemically synthesized
aaatcaatcagaccaagccctg

SEQ ID NO: 1335015 - DNA, 22 bp, Artificial Sequence
  chemically synthesized
aatggtaagtttgtctgcaggg

SEQ ID NO: 1335016 - DNA, 22 bp, Artificial Sequence
  chemically synthesized
cctgaatggtaagtttgtctgc

SEQ ID NO: 1335017 - DNA, 22 bp, Artificial Sequence
  chemically synthesized
gcctgaatggtaagtttgtctg

SEQ ID NO: 1335018 - DNA, 22 bp, Artificial Sequence
  chemically synthesized
tgcctgaatggtaagtttgtct

SEQ ID NO: 1335019 - DNA, 22 bp, Artificial Sequence
  chemically synthesized
ttgcctgaatggtaagtttgtc

SEQ ID NO: 1335020 - DNA, 22 bp, Artificial Sequence
  chemically synthesized
tttgcctgaatggtaagtttgt

SEQ ID NO: 1335021 - DNA, 22 bp, Artificial Sequence
  chemically synthesized
ttttgcctgaatggtaagtttg

SEQ ID NO: 1335022 - DNA, 22 bp, Artificial Sequence
  chemically synthesized
tttttgcctgaatggtaagttt

SEQ ID NO: 1335023 - DNA, 22 bp, Artificial Sequence
  chemically synthesized
cagacaaacttaccattcaggc

SEQ ID NO: 1335024 - DNA, 22 bp, Artificial Sequence
  chemically synthesized
acaactttttttgcctgaatgg

SEQ ID NO: 1335025 - DNA, 22 bp, Artificial Sequence
  chemically synthesized
ctcacaactttttttgcctgaa

SEQ ID NO: 1335026 - DNA, 22 bp, Artificial Sequence
  chemically synthesized
ctactcacaactttttttgcct

SEQ ID NO: 1335027 - DNA, 22 bp, Artificial Sequence
  chemically synthesized
accattcaggcaaaaaaagttg

SEQ ID NO: 1335028 - DNA, 22 bp, Artificial Sequence
  chemically synthesized
ccattcaggcaaaaaaagttgt

SEQ ID NO: 1335029 - DNA, 22 bp, Artificial Sequence
  chemically synthesized
aggcaaaaaaagttgtgagtag

SEQ ID NO: 1335030 - DNA, 22 bp, Artificial Sequence
  chemically synthesized
aggatatgcatgaaaacaagct

SEQ ID NO: 1335031 - DNA, 22 bp, Artificial Sequence
  chemically synthesized
tgagtaggagcttgttttcatg

SEQ ID NO: 1335032 - DNA, 22 bp, Artificial Sequence
  chemically synthesized
gttttcatgcatatcctcaggg

SEQ ID NO: 1335033 - DNA, 22 bp, Artificial Sequence
  chemically synthesized
ttttcatgcatatcctcagggt

SEQ ID NO: 1335034 - DNA, 22 bp, Artificial Sequence
  chemically synthesized
tcgtaccgatgaaccctgagga

SEQ ID NO: 1335035 - DNA, 22 bp, Artificial Sequence
  chemically synthesized
atcgtaccgatgaaccctgagg

SEQ ID NO: 1335036 - DNA, 22 bp, Artificial Sequence
  chemically synthesized
tcatgcatatcctcagggttca

SEQ ID NO: 1335037 - DNA, 22 bp, Artificial Sequence
  chemically synthesized
catgcatatcctcagggttcat

SEQ ID NO: 1335038 - DNA, 22 bp, Artificial Sequence
  chemically synthesized
atgcatatcctcagggttcatc

SEQ ID NO: 1335039 - DNA, 22 bp, Artificial Sequence
  chemically synthesized
gaggatatcttatcgtaccgat

SEQ ID NO: 1335040 - DNA, 22 bp, Artificial Sequence
  chemically synthesized
ggaggatatcttatcgtaccga

SEQ ID NO: 1335041 - DNA, 22 bp, Artificial Sequence
  chemically synthesized
agggttcatcggtacgataaga

SEQ ID NO: 1335042 - DNA, 22 bp, Artificial Sequence
  chemically synthesized
gcttggaggatatcttatcgta

SEQ ID NO: 1335043 - DNA, 22 bp, Artificial Sequence
  chemically synthesized
agcttggaggatatcttatcgt

SEQ ID NO: 1335044 - DNA, 22 bp, Artificial Sequence
  chemically synthesized
tagcttggaggatatcttatcg

SEQ ID NO: 1335045 - DNA, 22 bp, Artificial Sequence
  chemically synthesized
ttagcttggaggatatcttatc

SEQ ID NO: 1335046 - DNA, 22 bp, Artificial Sequence
  chemically synthesized
atcggtacgataagatatcctc

SEQ ID NO: 1335047 - DNA, 22 bp, Artificial Sequence
  chemically synthesized
caagctaaaaattcatggggcc

SEQ ID NO: 1335048 - DNA, 22 bp, Artificial Sequence
  chemically synthesized
gggatgtggtggtgtgagggcc

SEQ ID NO: 1335049 - DNA, 22 bp, Artificial Sequence
  chemically synthesized
aaaattcatggggccctcacac

SEQ ID NO: 1335050 - DNA, 22 bp, Artificial Sequence
  chemically synthesized
taactggggatgtggtggtgtg

SEQ ID NO: 1335051 - DNA, 22 bp, Artificial Sequence
  chemically synthesized
atggggccctcacaccaccaca

SEQ ID NO: 1335052 - DNA, 22 bp, Artificial Sequence
  chemically synthesized
aaaaaatgtctgtaactgggga

SEQ ID NO: 1335053 - DNA, 22 bp, Artificial Sequence
  chemically synthesized
acaccaccacatccccagttac

SEQ ID NO: 1335054 - DNA, 22 bp, Artificial Sequence
  chemically synthesized
aaaaaaatgtctgtaactgggg

SEQ ID NO: 1335055 - DNA, 22 bp, Artificial Sequence
  chemically synthesized
acaaaagaggtttaaaaaaatg

SEQ ID NO: 1335056 - DNA, 22 bp, Artificial Sequence
  chemically synthesized
atactcacaaaagaggtttaaa

SEQ ID NO: 1335057 - DNA, 22 bp, Artificial Sequence
  chemically synthesized
cagacatttttttaaacctctt

SEQ ID NO: 1335058 - DNA, 22 bp, Artificial Sequence
  chemically synthesized
ttttaaacctcttttgtgagta

SEQ ID NO: 1335059 - DNA, 22 bp, Artificial Sequence
  chemically synthesized
tttaaacctcttttgtgagtat

SEQ ID NO: 1335060 - DNA, 22 bp, Artificial Sequence
  chemically synthesized
ttaaacctcttttgtgagtatc

SEQ ID NO: 1335061 - DNA, 22 bp, Artificial Sequence
  chemically synthesized
taaacctcttttgtgagtatca

SEQ ID NO: 1335062 - DNA, 22 bp, Artificial Sequence
  chemically synthesized
aaacctcttttgtgagtatcag

SEQ ID NO: 1335063 - DNA, 22 bp, Artificial Sequence
  chemically synthesized
aacctcttttgtgagtatcagt

SEQ ID NO: 1335064 - DNA, 22 bp, Artificial Sequence
  chemically synthesized
ttttgtgagtatcagtgtactc

SEQ ID NO: 1335065 - DNA, 22 bp, Artificial Sequence
  chemically synthesized
ttgtgagtatcagtgtactcat

SEQ ID NO: 1335066 - DNA, 22 bp, Artificial Sequence
  chemically synthesized
tgtgagtatcagtgtactcatt

SEQ ID NO: 1335067 - DNA, 22 bp, Artificial Sequence
  chemically synthesized
gtgagtatcagtgtactcattg

SEQ ID NO: 1335068 - DNA, 22 bp, Artificial Sequence
  chemically synthesized
tgagtatcagtgtactcattgt

SEQ ID NO: 1335069 - DNA, 22 bp, Artificial Sequence
  chemically synthesized
attgtatgcttacactgtgtgt

SEQ ID NO: 1335070 - DNA, 22 bp, Artificial Sequence
  chemically synthesized
tatgcttacactgtgtgtgggt

SEQ ID NO: 1335071 - DNA, 22 bp, Artificial Sequence
  chemically synthesized
acactgtgtgtgggtttttatg

SEQ ID NO: 1335072 - DNA, 22 bp, Artificial Sequence
  chemically synthesized
cactgtgtgtgggtttttatgc

SEQ ID NO: 1335073 - DNA, 22 bp, Artificial Sequence
  chemically synthesized
atgcgcaaccacaggcataaaa

SEQ ID NO: 1335074 - DNA, 22 bp, Artificial Sequence
  chemically synthesized
aatgcgcaaccacaggcataaa

SEQ ID NO: 1335075 - DNA, 22 bp, Artificial Sequence
  chemically synthesized
tgtgtgggtttttatgcctgtg

SEQ ID NO: 1335076 - DNA, 22 bp, Artificial Sequence
  chemically synthesized
ttatgcctgtggttgcgcatta

SEQ ID NO: 1335077 - DNA, 22 bp, Artificial Sequence
  chemically synthesized
tatgcctgtggttgcgcattaa

SEQ ID NO: 1335078 - DNA, 22 bp, Artificial Sequence
  chemically synthesized
atgcctgtggttgcgcattaaa

SEQ ID NO: 1335079 - DNA, 22 bp, Artificial Sequence
  chemically synthesized
tgcctgtggttgcgcattaaat

SEQ ID NO: 1335080 - DNA, 22 bp, Artificial Sequence
  chemically synthesized
acaaagtaatagatttaatgcg

SEQ ID NO: 1335081 - DNA, 22 bp, Artificial Sequence
  chemically synthesized
tggttgcgcattaaatctatta

SEQ ID NO: 1335082 - DNA, 22 bp, Artificial Sequence
  chemically synthesized
aagtactgacaaagtaatagat

SEQ ID NO: 1335083 - DNA, 22 bp, Artificial Sequence
  chemically synthesized
cgcattaaatctattactttgt

SEQ ID NO: 1335084 - DNA, 22 bp, Artificial Sequence
  chemically synthesized
ccctgaagtactgacaaagtaa

SEQ ID NO: 1335085 - DNA, 22 bp, Artificial Sequence
  chemically synthesized
cccctgaagtactgacaaagta

SEQ ID NO: 1335086 - DNA, 22 bp, Artificial Sequence
  chemically synthesized
tcccctgaagtactgacaaagt

SEQ ID NO: 1335087 - DNA, 22 bp, Artificial Sequence
  chemically synthesized
aatctattactttgtcagtact

SEQ ID NO: 1335088 - DNA, 22 bp, Artificial Sequence
  chemically synthesized
atacgctttcccctgaagtact

SEQ ID NO: 1335089 - DNA, 22 bp, Artificial Sequence
  chemically synthesized
ttactttgtcagtacttcaggg

SEQ ID NO: 1335090 - DNA, 22 bp, Artificial Sequence
  chemically synthesized
ctttgtcagtacttcaggggaa

SEQ ID NO: 1335091 - DNA, 22 bp, Artificial Sequence
  chemically synthesized
tgtcagtacttcaggggaaagc

SEQ ID NO: 1335092 - DNA, 22 bp, Artificial Sequence
  chemically synthesized
caacattgatacgctttcccct

SEQ ID NO: 1335093 - DNA, 22 bp, Artificial Sequence
  chemically synthesized
gtcagtacttcaggggaaagcg

SEQ ID NO: 1335094 - DNA, 22 bp, Artificial Sequence
  chemically synthesized
acaacattgatacgctttcccc

SEQ ID NO: 1335095 - DNA, 22 bp, Artificial Sequence
  chemically synthesized
tcagtacttcaggggaaagcgt

SEQ ID NO: 1335096 - DNA, 22 bp, Artificial Sequence
  chemically synthesized
aatgtcttacaacattgatacg

SEQ ID NO: 1335097 - DNA, 22 bp, Artificial Sequence
  chemically synthesized
caggggaaagcgtatcaatgtt

SEQ ID NO: 1335098 - DNA, 22 bp, Artificial Sequence
  chemically synthesized
aggggaaagcgtatcaatgttg

SEQ ID NO: 1335099 - DNA, 22 bp, Artificial Sequence
  chemically synthesized
ggcatatattaaatgtcttaca

SEQ ID NO: 1335100 - DNA, 22 bp, Artificial Sequence
  chemically synthesized
ccctgggcatatattaaatgtc

SEQ ID NO: 1335101 - DNA, 22 bp, Artificial Sequence
  chemically synthesized
tacagctaccctgggcatatat

SEQ ID NO: 1335102 - DNA, 22 bp, Artificial Sequence
  chemically synthesized
taagacatttaatatatgccca

SEQ ID NO: 1335103 - DNA, 22 bp, Artificial Sequence
  chemically synthesized
attatacagctaccctgggcat

SEQ ID NO: 1335104 - DNA, 22 bp, Artificial Sequence
  chemically synthesized
aattatacagctaccctgggca

SEQ ID NO: 1335105 - DNA, 22 bp, Artificial Sequence
  chemically synthesized
taattatacagctaccctgggc

SEQ ID NO: 1335106 - DNA, 22 bp, Artificial Sequence
  chemically synthesized
ttaattatacagctaccctggg

SEQ ID NO: 1335107 - DNA, 22 bp, Artificial Sequence
  chemically synthesized
cttttaattatacagctaccct

SEQ ID NO: 1335108 - DNA, 22 bp, Artificial Sequence
  chemically synthesized
aatatatgcccagggtagctgt

SEQ ID NO: 1335109 - DNA, 22 bp, Artificial Sequence
  chemically synthesized
atatatgcccagggtagctgta

SEQ ID NO: 1335110 - DNA, 22 bp, Artificial Sequence
  chemically synthesized
aaaatcaattccttttaattat

SEQ ID NO: 1335111 - DNA, 22 bp, Artificial Sequence
  chemically synthesized
caaaatcaattccttttaatta

SEQ ID NO: 1335112 - DNA, 22 bp, Artificial Sequence
  chemically synthesized
tcaaaatcaattccttttaatt

SEQ ID NO: 1335113 - DNA, 22 bp, Artificial Sequence
  chemically synthesized
ttcaaaatcaattccttttaat

SEQ ID NO: 1335114 - DNA, 22 bp, Artificial Sequence
  chemically synthesized
tttcaaaatcaattccttttaa

SEQ ID NO: 1335115 - DNA, 22 bp, Artificial Sequence
  chemically synthesized
tttttcaaaatcaattcctttt

SEQ ID NO: 1335116 - DNA, 22 bp, Artificial Sequence
  chemically synthesized
tataattaaaaggaattgattt

SEQ ID NO: 1335117 - DNA, 22 bp, Artificial Sequence
  chemically synthesized
ggttctttttcaaaatcaattc

SEQ ID NO: 1335118 - DNA, 22 bp, Artificial Sequence
  chemically synthesized
ccattaggttctttttcaaaat

SEQ ID NO: 1335119 - DNA, 22 bp, Artificial Sequence
  chemically synthesized
aaaggaattgattttgaaaaag

SEQ ID NO: 1335120 - DNA, 22 bp, Artificial Sequence
  chemically synthesized
aggttaccattaggttcttttt

SEQ ID NO: 1335121 - DNA, 22 bp, Artificial Sequence
  chemically synthesized
caggttaccattaggttctttt

SEQ ID NO: 1335122 - DNA, 22 bp, Artificial Sequence
  chemically synthesized
atttcaggttaccattaggttc

SEQ ID NO: 1335123 - DNA, 22 bp, Artificial Sequence
  chemically synthesized
attttgaaaaagaacctaatgg

SEQ ID NO: 1335124 - DNA, 22 bp, Artificial Sequence
  chemically synthesized
ttcatttcaggttaccattagg

SEQ ID NO: 1335125 - DNA, 22 bp, Artificial Sequence
  chemically synthesized
tgaaaaagaacctaatggtaac

SEQ ID NO: 1335126 - DNA, 22 bp, Artificial Sequence
  chemically synthesized
gaaaaagaacctaatggtaacc

SEQ ID NO: 1335127 - DNA, 22 bp, Artificial Sequence
  chemically synthesized
aaaaagaacctaatggtaacct

SEQ ID NO: 1335128 - DNA, 22 bp, Artificial Sequence
  chemically synthesized
tctattcatttcaggttaccat

SEQ ID NO: 1335129 - DNA, 22 bp, Artificial Sequence
  chemically synthesized
gtctattcatttcaggttacca

SEQ ID NO: 1335130 - DNA, 22 bp, Artificial Sequence
  chemically synthesized
tgtctattcatttcaggttacc

SEQ ID NO: 1335131 - DNA, 22 bp, Artificial Sequence
  chemically synthesized
atggtaacctgaaatgaataga

SEQ ID NO: 1335132 - DNA, 22 bp, Artificial Sequence
  chemically synthesized
gggatcattttgtctattcatt

SEQ ID NO: 1335133 - DNA, 22 bp, Artificial Sequence
  chemically synthesized
agggatcattttgtctattcat

SEQ ID NO: 1335134 - DNA, 22 bp, Artificial Sequence
  chemically synthesized
agcttagggatcattttgtcta

SEQ ID NO: 1335135 - DNA, 22 bp, Artificial Sequence
  chemically synthesized
ctgagcttagggatcattttgt

SEQ ID NO: 1335136 - DNA, 22 bp, Artificial Sequence
  chemically synthesized
aaatgaatagacaaaatgatcc

SEQ ID NO: 1335137 - DNA, 22 bp, Artificial Sequence
  chemically synthesized
ttactgagcttagggatcattt

SEQ ID NO: 1335138 - DNA, 22 bp, Artificial Sequence
  chemically synthesized
cagttgttactgagcttaggga

SEQ ID NO: 1335139 - DNA, 22 bp, Artificial Sequence
  chemically synthesized
tgctgcagttgttactgagctt

SEQ ID NO: 1335140 - DNA, 22 bp, Artificial Sequence
  chemically synthesized
agctcagtaacaactgcagcac

SEQ ID NO: 1335141 - DNA, 22 bp, Artificial Sequence
  chemically synthesized
aggtgatacattgtgctgcagt

SEQ ID NO: 1335142 - DNA, 22 bp, Artificial Sequence
  chemically synthesized
agtaacaactgcagcacaatgt

SEQ ID NO: 1335143 - DNA, 22 bp, Artificial Sequence
  chemically synthesized
acctaaggtgatacattgtgct

SEQ ID NO: 1335144 - DNA, 22 bp, Artificial Sequence
  chemically synthesized
aacctaaggtgatacattgtgc

SEQ ID NO: 1335145 - DNA, 22 bp, Artificial Sequence
  chemically synthesized
taacctaaggtgatacattgtg

SEQ ID NO: 1335146 - DNA, 22 bp, Artificial Sequence
  chemically synthesized
ggttttaacctaaggtgataca

SEQ ID NO: 1335147 - DNA, 22 bp, Artificial Sequence
  chemically synthesized
cagcacaatgtatcaccttagg

SEQ ID NO: 1335148 - DNA, 22 bp, Artificial Sequence
  chemically synthesized
tgaactaggttttaacctaagg

SEQ ID NO: 1335149 - DNA, 22 bp, Artificial Sequence
  chemically synthesized
atgaactaggttttaacctaag

SEQ ID NO: 1335150 - DNA, 22 bp, Artificial Sequence
  chemically synthesized
tttatgaactaggttttaacct

SEQ ID NO: 1335151 - DNA, 22 bp, Artificial Sequence
  chemically synthesized
aggattatttatgaactaggtt

SEQ ID NO: 1335152 - DNA, 22 bp, Artificial Sequence
  chemically synthesized
aggttaaaacctagttcataaa

SEQ ID NO: 1335153 - DNA, 22 bp, Artificial Sequence
  chemically synthesized
ggttaaaacctagttcataaat

SEQ ID NO: 1335154 - DNA, 22 bp, Artificial Sequence
  chemically synthesized
aaacctagttcataaataatcc

SEQ ID NO: 1335155 - DNA, 22 bp, Artificial Sequence
  chemically synthesized
aagaggagttgaggattattta

SEQ ID NO: 1335156 - DNA, 22 bp, Artificial Sequence
  chemically synthesized
gaagaggagttgaggattattt

SEQ ID NO: 1335157 - DNA, 22 bp, Artificial Sequence
  chemically synthesized
gttcataaataatcctcaactc

SEQ ID NO: 1335158 - DNA, 22 bp, Artificial Sequence
  chemically synthesized
ataaataatcctcaactcctct

SEQ ID NO: 1335159 - DNA, 22 bp, Artificial Sequence
  chemically synthesized
acaagcccttgaagaggagttg

SEQ ID NO: 1335160 - DNA, 22 bp, Artificial Sequence
  chemically synthesized
cacaagcccttgaagaggagtt

SEQ ID NO: 1335161 - DNA, 22 bp, Artificial Sequence
  chemically synthesized
atcttcacaagcccttgaagag

SEQ ID NO: 1335162 - DNA, 22 bp, Artificial Sequence
  chemically synthesized
aactcctcttcaagggcttgtg

SEQ ID NO: 1335163 - DNA, 22 bp, Artificial Sequence
  chemically synthesized
ctcttcaagggcttgtgaagat

SEQ ID NO: 1335164 - DNA, 22 bp, Artificial Sequence
  chemically synthesized
aaaatgaccctcatcttcacaa

SEQ ID NO: 1335165 - DNA, 22 bp, Artificial Sequence
  chemically synthesized
tcaaaatgaccctcatcttcac

SEQ ID NO: 1335166 - DNA, 22 bp, Artificial Sequence
  chemically synthesized
ttcaagggcttgtgaagatgag

SEQ ID NO: 1335167 - DNA, 22 bp, Artificial Sequence
  chemically synthesized
ctcaaaatgaccctcatcttca

SEQ ID NO: 1335168 - DNA, 22 bp, Artificial Sequence
  chemically synthesized
caagggcttgtgaagatgaggg

SEQ ID NO: 1335169 - DNA, 22 bp, Artificial Sequence
  chemically synthesized
aagggcttgtgaagatgagggt

SEQ ID NO: 1335170 - DNA, 22 bp, Artificial Sequence
  chemically synthesized
gtgaagatgagggtcattttga

SEQ ID NO: 1335171 - DNA, 22 bp, Artificial Sequence
  chemically synthesized
tgaagatgagggtcattttgag

SEQ ID NO: 1335172 - DNA, 22 bp, Artificial Sequence
  chemically synthesized
aagccaaaatgtgtcacttctc

SEQ ID NO: 1335173 - DNA, 22 bp, Artificial Sequence
  chemically synthesized
ccctgaagccaaaatgtgtcac

SEQ ID NO: 1335174 - DNA, 22 bp, Artificial Sequence
  chemically synthesized
tgagaagtgacacattttggct

SEQ ID NO: 1335175 - DNA, 22 bp, Artificial Sequence
  chemically synthesized
aaactcccctgaagccaaaatg

SEQ ID NO: 1335176 - DNA, 22 bp, Artificial Sequence
  chemically synthesized
gagaagtgacacattttggctt

SEQ ID NO: 1335177 - DNA, 22 bp, Artificial Sequence
  chemically synthesized
agaagtgacacattttggcttc

SEQ ID NO: 1335178 - DNA, 22 bp, Artificial Sequence
  chemically synthesized
tgctaaaactcccctgaagcca

SEQ ID NO: 1335179 - DNA, 22 bp, Artificial Sequence
  chemically synthesized
acagcagttatgctaaaactcc

SEQ ID NO: 1335180 - DNA, 22 bp, Artificial Sequence
  chemically synthesized
tggcttcaggggagttttagca

SEQ ID NO: 1335181 - DNA, 22 bp, Artificial Sequence
  chemically synthesized
ggcttcaggggagttttagcat

SEQ ID NO: 1335182 - DNA, 22 bp, Artificial Sequence
  chemically synthesized
gcttcaggggagttttagcata

SEQ ID NO: 1335183 - DNA, 22 bp, Artificial Sequence
  chemically synthesized
caggggagttttagcataactg

SEQ ID NO: 1335184 - DNA, 22 bp, Artificial Sequence
  chemically synthesized
aggggagttttagcataactgc

SEQ ID NO: 1335185 - DNA, 22 bp, Artificial Sequence
  chemically synthesized
agaagatataatctgacagcag

SEQ ID NO: 1335186 - DNA, 22 bp, Artificial Sequence
  chemically synthesized
aagaagatataatctgacagca

SEQ ID NO: 1335187 - DNA, 22 bp, Artificial Sequence
  chemically synthesized
tagcataactgctgtcagatta

SEQ ID NO: 1335188 - DNA, 22 bp, Artificial Sequence
  chemically synthesized
agcataactgctgtcagattat

SEQ ID NO: 1335189 - DNA, 22 bp, Artificial Sequence
  chemically synthesized
gcataactgctgtcagattata

SEQ ID NO: 1335190 - DNA, 22 bp, Artificial Sequence
  chemically synthesized
ctgtcagattatatcttcttaa

SEQ ID NO: 1335191 - DNA, 22 bp, Artificial Sequence
  chemically synthesized
ccaacgaaaatgtttaagaaga

SEQ ID NO: 1335192 - DNA, 22 bp, Artificial Sequence
  chemically synthesized
tcagattatatcttcttaaaca

SEQ ID NO: 1335193 - DNA, 22 bp, Artificial Sequence
  chemically synthesized
actgccaacgaaaatgtttaag

SEQ ID NO: 1335194 - DNA, 22 bp, Artificial Sequence
  chemically synthesized
cactgccaacgaaaatgtttaa

SEQ ID NO: 1335195 - DNA, 22 bp, Artificial Sequence
  chemically synthesized
ccttcactgccaacgaaaatgt

SEQ ID NO: 1335196 - DNA, 22 bp, Artificial Sequence
  chemically synthesized
tatcttcttaaacattttcgtt

SEQ ID NO: 1335197 - DNA, 22 bp, Artificial Sequence
  chemically synthesized
cccttcactgccaacgaaaatg

SEQ ID NO: 1335198 - DNA, 22 bp, Artificial Sequence
  chemically synthesized
cttaaacattttcgttggcagt

SEQ ID NO: 1335199 - DNA, 22 bp, Artificial Sequence
  chemically synthesized
ttaaacattttcgttggcagtg

SEQ ID NO: 1335200 - DNA, 22 bp, Artificial Sequence
  chemically synthesized
acatcttcccttcactgccaac

SEQ ID NO: 1335201 - DNA, 22 bp, Artificial Sequence
  chemically synthesized
aaacattttcgttggcagtgaa

SEQ ID NO: 1335202 - DNA, 22 bp, Artificial Sequence
  chemically synthesized
aacattttcgttggcagtgaag

SEQ ID NO: 1335203 - DNA, 22 bp, Artificial Sequence
  chemically synthesized
tcgttggcagtgaagggaagat

SEQ ID NO: 1335204 - DNA, 22 bp, Artificial Sequence
  chemically synthesized
acatgatctaacatcttccctt

SEQ ID NO: 1335205 - DNA, 22 bp, Artificial Sequence
  chemically synthesized
cgttggcagtgaagggaagatg

SEQ ID NO: 1335206 - DNA, 22 bp, Artificial Sequence
  chemically synthesized
gttggcagtgaagggaagatgt

SEQ ID NO: 1335207 - DNA, 22 bp, Artificial Sequence
  chemically synthesized
taacatgatctaacatcttccc

SEQ ID NO: 1335208 - DNA, 22 bp, Artificial Sequence
  chemically synthesized
ctaacatgatctaacatcttcc

SEQ ID NO: 1335209 - DNA, 22 bp, Artificial Sequence
  chemically synthesized
gcagtgaagggaagatgttaga

SEQ ID NO: 1335210 - DNA, 22 bp, Artificial Sequence
  chemically synthesized
catttctaacatgatctaacat

SEQ ID NO: 1335211 - DNA, 22 bp, Artificial Sequence
  chemically synthesized
gttacatttctaacatgatcta

SEQ ID NO: 1335212 - DNA, 22 bp, Artificial Sequence
  chemically synthesized
accccattagttacatttctaa

SEQ ID NO: 1335213 - DNA, 22 bp, Artificial Sequence
  chemically synthesized
gaccccattagttacatttcta

SEQ ID NO: 1335214 - DNA, 22 bp, Artificial Sequence
  chemically synthesized
tgaccccattagttacatttct

SEQ ID NO: 1335215 - DNA, 22 bp, Artificial Sequence
  chemically synthesized
gatcatgttagaaatgtaacta

SEQ ID NO: 1335216 - DNA, 22 bp, Artificial Sequence
  chemically synthesized
gaaatgtaactaatggggtcaa

SEQ ID NO: 1335217 - DNA, 22 bp, Artificial Sequence
  chemically synthesized
taaggaagtaaaattttgaccc

SEQ ID NO: 1335218 - DNA, 22 bp, Artificial Sequence
  chemically synthesized
agagctgtaaggaagtaaaatt

SEQ ID NO: 1335219 - DNA, 22 bp, Artificial Sequence
  chemically synthesized
aagagctgtaaggaagtaaaat

SEQ ID NO: 1335220 - DNA, 22 bp, Artificial Sequence
  chemically synthesized
atggggtcaaaattttacttcc

SEQ ID NO: 1335221 - DNA, 22 bp, Artificial Sequence
  chemically synthesized
ttaagagctgtaaggaagtaaa

SEQ ID NO: 1335222 - DNA, 22 bp, Artificial Sequence
  chemically synthesized
taagtatgtgctcttaagagct

SEQ ID NO: 1335223 - DNA, 22 bp, Artificial Sequence
  chemically synthesized
tacttccttacagctcttaaga

SEQ ID NO: 1335224 - DNA, 22 bp, Artificial Sequence
  chemically synthesized
acttccttacagctcttaagag

SEQ ID NO: 1335225 - DNA, 22 bp, Artificial Sequence
  chemically synthesized
cttccttacagctcttaagagc

SEQ ID NO: 1335226 - DNA, 22 bp, Artificial Sequence
  chemically synthesized
ctataagtatgtgctcttaaga

SEQ ID NO: 1335227 - DNA, 22 bp, Artificial Sequence
  chemically synthesized
cctataagtatgtgctcttaag

SEQ ID NO: 1335228 - DNA, 22 bp, Artificial Sequence
  chemically synthesized
ccttacagctcttaagagcaca

SEQ ID NO: 1335229 - DNA, 22 bp, Artificial Sequence
  chemically synthesized
cttacagctcttaagagcacat

SEQ ID NO: 1335230 - DNA, 22 bp, Artificial Sequence
  chemically synthesized
acagctcttaagagcacatact

SEQ ID NO: 1335231 - DNA, 22 bp, Artificial Sequence
  chemically synthesized
cagctcttaagagcacatactt

SEQ ID NO: 1335232 - DNA, 22 bp, Artificial Sequence
  chemically synthesized
ttaagagcacatacttatagga

SEQ ID NO: 1335233 - DNA, 22 bp, Artificial Sequence
  chemically synthesized
aagagcacatacttataggaaa

SEQ ID NO: 1335234 - DNA, 22 bp, Artificial Sequence
  chemically synthesized
agagcacatacttataggaaac

SEQ ID NO: 1335235 - DNA, 22 bp, Artificial Sequence
  chemically synthesized
agggagatatccaaaagagttt

SEQ ID NO: 1335236 - DNA, 22 bp, Artificial Sequence
  chemically synthesized
ataggaaactcttttggatatc

SEQ ID NO: 1335237 - DNA, 22 bp, Artificial Sequence
  chemically synthesized
taggaaactcttttggatatct

SEQ ID NO: 1335238 - DNA, 22 bp, Artificial Sequence
  chemically synthesized
gataatattaagggagatatcc

SEQ ID NO: 1335239 - DNA, 22 bp, Artificial Sequence
  chemically synthesized
tagataatattaagggagatat

SEQ ID NO: 1335240 - DNA, 22 bp, Artificial Sequence
  chemically synthesized
ttttggatatctcccttaatat

SEQ ID NO: 1335241 - DNA, 22 bp, Artificial Sequence
  chemically synthesized
ttggatatctcccttaatatta

SEQ ID NO: 1335242 - DNA, 22 bp, Artificial Sequence
  chemically synthesized
gacaattctagataatattaag

SEQ ID NO: 1335243 - DNA, 22 bp, Artificial Sequence
  chemically synthesized
tggatatctcccttaatattat

SEQ ID NO: 1335244 - DNA, 22 bp, Artificial Sequence
  chemically synthesized
ggatatctcccttaatattatc

SEQ ID NO: 1335245 - DNA, 22 bp, Artificial Sequence
  chemically synthesized
gatatctcccttaatattatct

SEQ ID NO: 1335246 - DNA, 22 bp, Artificial Sequence
  chemically synthesized
ccttaatattatctagaattgt

SEQ ID NO: 1335247 - DNA, 22 bp, Artificial Sequence
  chemically synthesized
aaggaatagttggacaattcta

SEQ ID NO: 1335248 - DNA, 22 bp, Artificial Sequence
  chemically synthesized
aaaggaatagttggacaattct

SEQ ID NO: 1335249 - DNA, 22 bp, Artificial Sequence
  chemically synthesized
aatattatctagaattgtccaa

SEQ ID NO: 1335250 - DNA, 22 bp, Artificial Sequence
  chemically synthesized
atattatctagaattgtccaac

SEQ ID NO: 1335251 - DNA, 22 bp, Artificial Sequence
  chemically synthesized
atttaaaggaatagttggacaa

SEQ ID NO: 1335252 - DNA, 22 bp, Artificial Sequence
  chemically synthesized
tctagaattgtccaactattcc

SEQ ID NO: 1335253 - DNA, 22 bp, Artificial Sequence
  chemically synthesized
tgctcatttaaaggaatagttg

SEQ ID NO: 1335254 - DNA, 22 bp, Artificial Sequence
  chemically synthesized
gaattgtccaactattccttta

SEQ ID NO: 1335255 - DNA, 22 bp, Artificial Sequence
  chemically synthesized
tccaactattcctttaaatgag

SEQ ID NO: 1335256 - DNA, 22 bp, Artificial Sequence
  chemically synthesized
ttcctttaaatgagcacaactg

SEQ ID NO: 1335257 - DNA, 22 bp, Artificial Sequence
  chemically synthesized
ctttaaatgagcacaactgggg

SEQ ID NO: 1335258 - DNA, 22 bp, Artificial Sequence
  chemically synthesized
taaatgagcacaactggggcca

SEQ ID NO: 1335259 - DNA, 22 bp, Artificial Sequence
  chemically synthesized
aaatgagcacaactggggccac

SEQ ID NO: 1335260 - DNA, 22 bp, Artificial Sequence
  chemically synthesized
aatgagcacaactggggccact

SEQ ID NO: 1335261 - DNA, 22 bp, Artificial Sequence
  chemically synthesized
gggccactccttatggctctgg

SEQ ID NO: 1335262 - DNA, 22 bp, Artificial Sequence
  chemically synthesized
tgcaaggtgcaatgcccagagc

SEQ ID NO: 1335263 - DNA, 22 bp, Artificial Sequence
  chemically synthesized
gtgcaaggtgcaatgcccagag

SEQ ID NO: 1335264 - DNA, 22 bp, Artificial Sequence
  chemically synthesized
tgtgcaaggtgcaatgcccaga

SEQ ID NO: 1335265 - DNA, 22 bp, Artificial Sequence
  chemically synthesized
cttatggctctgggcattgcac

SEQ ID NO: 1335266 - DNA, 22 bp, Artificial Sequence
  chemically synthesized
atggctctgggcattgcacctt

SEQ ID NO: 1335267 - DNA, 22 bp, Artificial Sequence
  chemically synthesized
tggctctgggcattgcaccttg

SEQ ID NO: 1335268 - DNA, 22 bp, Artificial Sequence
  chemically synthesized
aagcacctttgtgcaaggtgca

SEQ ID NO: 1335269 - DNA, 22 bp, Artificial Sequence
  chemically synthesized
tgggcattgcaccttgcacaaa

SEQ ID NO: 1335270 - DNA, 22 bp, Artificial Sequence
  chemically synthesized
ggcattgcaccttgcacaaagg

SEQ ID NO: 1335271 - DNA, 22 bp, Artificial Sequence
  chemically synthesized
caccttgcacaaaggtgcttga

SEQ ID NO: 1335272 - DNA, 22 bp, Artificial Sequence
  chemically synthesized
gcacaaaggtgcttgagtatca

SEQ ID NO: 1335273 - DNA, 22 bp, Artificial Sequence
  chemically synthesized
cacaaaggtgcttgagtatcat

SEQ ID NO: 1335274 - DNA, 22 bp, Artificial Sequence
  chemically synthesized
gggggaatgtgggtatgatact

SEQ ID NO: 1335275 - DNA, 22 bp, Artificial Sequence
  chemically synthesized
gagtatcatacccacattcccc

SEQ ID NO: 1335276 - DNA, 22 bp, Artificial Sequence
  chemically synthesized
agtatcatacccacattccccc

SEQ ID NO: 1335277 - DNA, 22 bp, Artificial Sequence
  chemically synthesized
gaggatcacagggatggctggg

SEQ ID NO: 1335278 - DNA, 22 bp, Artificial Sequence
  chemically synthesized
ttggaggatcacagggatggct

SEQ ID NO: 1335279 - DNA, 22 bp, Artificial Sequence
  chemically synthesized
attggaggatcacagggatggc

SEQ ID NO: 1335280 - DNA, 22 bp, Artificial Sequence
  chemically synthesized
tattggaggatcacagggatgg

SEQ ID NO: 1335281 - DNA, 22 bp, Artificial Sequence
  chemically synthesized
ctttattggaggatcacaggga

SEQ ID NO: 1335282 - DNA, 22 bp, Artificial Sequence
  chemically synthesized
cccccagccatccctgtgatcc

SEQ ID NO: 1335283 - DNA, 22 bp, Artificial Sequence
  chemically synthesized
tgctttattggaggatcacagg

SEQ ID NO: 1335284 - DNA, 22 bp, Artificial Sequence
  chemically synthesized
agtatgactctgctttattgga

SEQ ID NO: 1335285 - DNA, 22 bp, Artificial Sequence
  chemically synthesized
cagtatgactctgctttattgg

SEQ ID NO: 1335286 - DNA, 22 bp, Artificial Sequence
  chemically synthesized
tcagtatgactctgctttattg

SEQ ID NO: 1335287 - DNA, 22 bp, Artificial Sequence
  chemically synthesized
ttcagtatgactctgctttatt

SEQ ID NO: 1335288 - DNA, 22 bp, Artificial Sequence
  chemically synthesized
tttcagtatgactctgctttat

SEQ ID NO: 1335289 - DNA, 22 bp, Artificial Sequence
  chemically synthesized
ttttcagtatgactctgcttta

SEQ ID NO: 1335290 - DNA, 22 bp, Artificial Sequence
  chemically synthesized
tgatcctccaataaagcagagt

SEQ ID NO: 1335291 - DNA, 22 bp, Artificial Sequence
  chemically synthesized
tttttcagtatgactctgcttt

SEQ ID NO: 1335292 - DNA, 22 bp, Artificial Sequence
  chemically synthesized
ttttttcagtatgactctgctt

SEQ ID NO: 1335293 - DNA, 22 bp, Artificial Sequence
  chemically synthesized
caataaagcagagtcatactga

SEQ ID NO: 1335294 - DNA, 22 bp, Artificial Sequence
  chemically synthesized
aaagaaagcacgcttttttttc

SEQ ID NO: 1335295 - DNA, 22 bp, Artificial Sequence
  chemically synthesized
gaaagaaagcacgctttttttt

SEQ ID NO: 1335296 - DNA, 22 bp, Artificial Sequence
  chemically synthesized
tgaaagaaagcacgcttttttt

SEQ ID NO: 1335297 - DNA, 22 bp, Artificial Sequence
  chemically synthesized
aaaaaaaagcgtgctttctttc

SEQ ID NO: 1335298 - DNA, 22 bp, Artificial Sequence
  chemically synthesized
ccaaatccacagaatagccaat

SEQ ID NO: 1335299 - DNA, 22 bp, Artificial Sequence
  chemically synthesized
cccaaatccacagaatagccaa

SEQ ID NO: 1335300 - DNA, 22 bp, Artificial Sequence
  chemically synthesized
tctttcaaaattggctattctg

SEQ ID NO: 1335301 - DNA, 22 bp, Artificial Sequence
  chemically synthesized
ctttcaaaattggctattctgt

SEQ ID NO: 1335302 - DNA, 22 bp, Artificial Sequence
  chemically synthesized
tttcaaaattggctattctgtg

SEQ ID NO: 1335303 - DNA, 22 bp, Artificial Sequence
  chemically synthesized
tcaaaattggctattctgtgga

SEQ ID NO: 1335304 - DNA, 22 bp, Artificial Sequence
  chemically synthesized
caaaattggctattctgtggat

SEQ ID NO: 1335305 - DNA, 22 bp, Artificial Sequence
  chemically synthesized
cccacttcccaaatccacagaa

SEQ ID NO: 1335306 - DNA, 22 bp, Artificial Sequence
  chemically synthesized
aaaattggctattctgtggatt

SEQ ID NO: 1335307 - DNA, 22 bp, Artificial Sequence
  chemically synthesized
gctattctgtggatttgggaag

SEQ ID NO: 1335308 - DNA, 22 bp, Artificial Sequence
  chemically synthesized
ttctgtggatttgggaagtggg

SEQ ID NO: 1335309 - DNA, 22 bp, Artificial Sequence
  chemically synthesized
tgtggatttgggaagtggggag

SEQ ID NO: 1335310 - DNA, 22 bp, Artificial Sequence
  chemically synthesized
tggatttgggaagtggggagga

SEQ ID NO: 1335311 - DNA, 22 bp, Artificial Sequence
  chemically synthesized
aacaaagaggcatcctccccac

SEQ ID NO: 1335312 - DNA, 22 bp, Artificial Sequence
  chemically synthesized
gggaagtggggaggatgcctct

SEQ ID NO: 1335313 - DNA, 22 bp, Artificial Sequence
  chemically synthesized
aaaattaaacaaagaggcatcc

SEQ ID NO: 1335314 - DNA, 22 bp, Artificial Sequence
  chemically synthesized
ggaagtggggaggatgcctctt

SEQ ID NO: 1335315 - DNA, 22 bp, Artificial Sequence
  chemically synthesized
gaaaattaaacaaagaggcatc

SEQ ID NO: 1335316 - DNA, 22 bp, Artificial Sequence
  chemically synthesized
tgaaaattaaacaaagaggcat

SEQ ID NO: 1335317 - DNA, 22 bp, Artificial Sequence
  chemically synthesized
tttgaaaattaaacaaagaggc

SEQ ID NO: 1335318 - DNA, 22 bp, Artificial Sequence
  chemically synthesized
tatggtactctttgaaaattaa

SEQ ID NO: 1335319 - DNA, 22 bp, Artificial Sequence
  chemically synthesized
atatggtactctttgaaaatta

SEQ ID NO: 1335320 - DNA, 22 bp, Artificial Sequence
  chemically synthesized
tttgtttaattttcaaagagta

SEQ ID NO: 1335321 - DNA, 22 bp, Artificial Sequence
  chemically synthesized
cccgcttatatggtactctttg

SEQ ID NO: 1335322 - DNA, 22 bp, Artificial Sequence
  chemically synthesized
tgtttaattttcaaagagtacc

SEQ ID NO: 1335323 - DNA, 22 bp, Artificial Sequence
  chemically synthesized
gtttaattttcaaagagtacca

SEQ ID NO: 1335324 - DNA, 22 bp, Artificial Sequence
  chemically synthesized
tttaattttcaaagagtaccat

SEQ ID NO: 1335325 - DNA, 22 bp, Artificial Sequence
  chemically synthesized
ctacccgcttatatggtactct

SEQ ID NO: 1335326 - DNA, 22 bp, Artificial Sequence
  chemically synthesized
aattttcaaagagtaccatata

SEQ ID NO: 1335327 - DNA, 22 bp, Artificial Sequence
  chemically synthesized
attttcaaagagtaccatataa

SEQ ID NO: 1335328 - DNA, 22 bp, Artificial Sequence
  chemically synthesized
tcaaagagtaccatataagcgg

SEQ ID NO: 1335329 - DNA, 22 bp, Artificial Sequence
  chemically synthesized
caaagagtaccatataagcggg

SEQ ID NO: 1335330 - DNA, 22 bp, Artificial Sequence
  chemically synthesized
aaagagtaccatataagcgggt

SEQ ID NO: 1335331 - DNA, 22 bp, Artificial Sequence
  chemically synthesized
tccgcaggactgctacccgctt

SEQ ID NO: 1335332 - DNA, 22 bp, Artificial Sequence
  chemically synthesized
ttgtccgcaggactgctacccg

SEQ ID NO: 1335333 - DNA, 22 bp, Artificial Sequence
  chemically synthesized
gttgtccgcaggactgctaccc

SEQ ID NO: 1335334 - DNA, 22 bp, Artificial Sequence
  chemically synthesized
tgttgtccgcaggactgctacc

SEQ ID NO: 1335335 - DNA, 22 bp, Artificial Sequence
  chemically synthesized
cactttgttgtccgcaggactg

SEQ ID NO: 1335336 - DNA, 22 bp, Artificial Sequence
  chemically synthesized
ttacactttgttgtccgcagga

SEQ ID NO: 1335337 - DNA, 22 bp, Artificial Sequence
  chemically synthesized
attacactttgttgtccgcagg

SEQ ID NO: 1335338 - DNA, 22 bp, Artificial Sequence
  chemically synthesized
tattacactttgttgtccgcag

SEQ ID NO: 1335339 - DNA, 22 bp, Artificial Sequence
  chemically synthesized
ttattacactttgttgtccgca

SEQ ID NO: 1335340 - DNA, 22 bp, Artificial Sequence
  chemically synthesized
tttattacactttgttgtccgc

SEQ ID NO: 1335341 - DNA, 22 bp, Artificial Sequence
  chemically synthesized
cggacaacaaagtgtaataaaa

SEQ ID NO: 1335342 - DNA, 22 bp, Artificial Sequence
  chemically synthesized
aaatcccaaacattttttatta

SEQ ID NO: 1335343 - DNA, 22 bp, Artificial Sequence
  chemically synthesized
caactgaaatcccaaacatttt

SEQ ID NO: 1335344 - DNA, 22 bp, Artificial Sequence
  chemically synthesized
ccaactgaaatcccaaacattt

SEQ ID NO: 1335345 - DNA, 22 bp, Artificial Sequence
  chemically synthesized
ccaatgccttccaactgaaatc

SEQ ID NO: 1335346 - DNA, 22 bp, Artificial Sequence
  chemically synthesized
gttcccaatgccttccaactga

SEQ ID NO: 1335347 - DNA, 22 bp, Artificial Sequence
  chemically synthesized
gggatttcagttggaaggcatt

SEQ ID NO: 1335348 - DNA, 22 bp, Artificial Sequence
  chemically synthesized
ggatttcagttggaaggcattg

SEQ ID NO: 1335349 - DNA, 22 bp, Artificial Sequence
  chemically synthesized
cagttggaaggcattgggaact

SEQ ID NO: 1335350 - DNA, 22 bp, Artificial Sequence
  chemically synthesized
ggtcataaaattagttcccaat

SEQ ID NO: 1335351 - DNA, 22 bp, Artificial Sequence
  chemically synthesized
agttggaaggcattgggaacta

SEQ ID NO: 1335352 - DNA, 22 bp, Artificial Sequence
  chemically synthesized
ccctaggtcataaaattagttc

SEQ ID NO: 1335353 - DNA, 22 bp, Artificial Sequence
  chemically synthesized
gaaggcattgggaactaatttt

SEQ ID NO: 1335354 - DNA, 22 bp, Artificial Sequence
  chemically synthesized
gccctaggtcataaaattagtt

SEQ ID NO: 1335355 - DNA, 22 bp, Artificial Sequence
  chemically synthesized
aataccttgccctaggtcataa

SEQ ID NO: 1335356 - DNA, 22 bp, Artificial Sequence
  chemically synthesized
aaataccttgccctaggtcata

SEQ ID NO: 1335357 - DNA, 22 bp, Artificial Sequence
  chemically synthesized
ggaactaattttatgacctagg

SEQ ID NO: 1335358 - DNA, 22 bp, Artificial Sequence
  chemically synthesized
aaagtttaaataccttgcccta

SEQ ID NO: 1335359 - DNA, 22 bp, Artificial Sequence
  chemically synthesized
attttatgacctagggcaaggt

SEQ ID NO: 1335360 - DNA, 22 bp, Artificial Sequence
  chemically synthesized
tatgacctagggcaaggtattt

SEQ ID NO: 1335361 - DNA, 22 bp, Artificial Sequence
  chemically synthesized
atgacctagggcaaggtattta

SEQ ID NO: 1335362 - DNA, 22 bp, Artificial Sequence
  chemically synthesized
tgacctagggcaaggtatttaa

SEQ ID NO: 1335363 - DNA, 22 bp, Artificial Sequence
  chemically synthesized
gtgatgctaaaagtttaaatac

SEQ ID NO: 1335364 - DNA, 22 bp, Artificial Sequence
  chemically synthesized
gggcaaggtatttaaactttta

SEQ ID NO: 1335365 - DNA, 22 bp, Artificial Sequence
  chemically synthesized
gaaagcctggtgatgctaaaag

SEQ ID NO: 1335366 - DNA, 22 bp, Artificial Sequence
  chemically synthesized
tagctggaaagcctggtgatgc

SEQ ID NO: 1335367 - DNA, 22 bp, Artificial Sequence
  chemically synthesized
atagctggaaagcctggtgatg

SEQ ID NO: 1335368 - DNA, 22 bp, Artificial Sequence
  chemically synthesized
tatagctggaaagcctggtgat

SEQ ID NO: 1335369 - DNA, 22 bp, Artificial Sequence
  chemically synthesized
aaacttttagcatcaccaggct

SEQ ID NO: 1335370 - DNA, 22 bp, Artificial Sequence
  chemically synthesized
aacttttagcatcaccaggctt

SEQ ID NO: 1335371 - DNA, 22 bp, Artificial Sequence
  chemically synthesized
ttttatagctggaaagcctggt

SEQ ID NO: 1335372 - DNA, 22 bp, Artificial Sequence
  chemically synthesized
ttagcatcaccaggctttccag

SEQ ID NO: 1335373 - DNA, 22 bp, Artificial Sequence
  chemically synthesized
tagcatcaccaggctttccagc

SEQ ID NO: 1335374 - DNA, 22 bp, Artificial Sequence
  chemically synthesized
agcatcaccaggctttccagct

SEQ ID NO: 1335375 - DNA, 22 bp, Artificial Sequence
  chemically synthesized
gcatcaccaggctttccagcta

SEQ ID NO: 1335376 - DNA, 22 bp, Artificial Sequence
  chemically synthesized
ccaagctattttatagctggaa

SEQ ID NO: 1335377 - DNA, 22 bp, Artificial Sequence
  chemically synthesized
tggcatgttgccaagctatttt

SEQ ID NO: 1335378 - DNA, 22 bp, Artificial Sequence
  chemically synthesized
tccagctataaaatagcttggc

SEQ ID NO: 1335379 - DNA, 22 bp, Artificial Sequence
  chemically synthesized
ccagctataaaatagcttggca

SEQ ID NO: 1335380 - DNA, 22 bp, Artificial Sequence
  chemically synthesized
tctatggcatgttgccaagcta

SEQ ID NO: 1335381 - DNA, 22 bp, Artificial Sequence
  chemically synthesized
cagctataaaatagcttggcaa

SEQ ID NO: 1335382 - DNA, 22 bp, Artificial Sequence
  chemically synthesized
attgtctatggcatgttgccaa

SEQ ID NO: 1335383 - DNA, 22 bp, Artificial Sequence
  chemically synthesized
taaaatagcttggcaacatgcc

SEQ ID NO: 1335384 - DNA, 22 bp, Artificial Sequence
  chemically synthesized
agtgttgattgtctatggcatg

SEQ ID NO: 1335385 - DNA, 22 bp, Artificial Sequence
  chemically synthesized
ggcaacatgccatagacaatca

SEQ ID NO: 1335386 - DNA, 22 bp, Artificial Sequence
  chemically synthesized
gcaacatgccatagacaatcaa

SEQ ID NO: 1335387 - DNA, 22 bp, Artificial Sequence
  chemically synthesized
ggagcctgagtgttgattgtct

SEQ ID NO: 1335388 - DNA, 22 bp, Artificial Sequence
  chemically synthesized
cggagcctgagtgttgattgtc

SEQ ID NO: 1335389 - DNA, 22 bp, Artificial Sequence
  chemically synthesized
acttcggagcctgagtgttgat

SEQ ID NO: 1335390 - DNA, 22 bp, Artificial Sequence
  chemically synthesized
gacttcggagcctgagtgttga

SEQ ID NO: 1335391 - DNA, 22 bp, Artificial Sequence
  chemically synthesized
tgacttcggagcctgagtgttg

SEQ ID NO: 1335392 - DNA, 22 bp, Artificial Sequence
  chemically synthesized
ctttgacttcggagcctgagtg

SEQ ID NO: 1335393 - DNA, 22 bp, Artificial Sequence
  chemically synthesized
aattgctttgacttcggagcct

SEQ ID NO: 1335394 - DNA, 22 bp, Artificial Sequence
  chemically synthesized
gttaaattgctttgacttcgga

SEQ ID NO: 1335395 - DNA, 22 bp, Artificial Sequence
  chemically synthesized
aggctccgaagtcaaagcaatt

SEQ ID NO: 1335396 - DNA, 22 bp, Artificial Sequence
  chemically synthesized
aagccctagttaaattgctttg

SEQ ID NO: 1335397 - DNA, 22 bp, Artificial Sequence
  chemically synthesized
cgaagtcaaagcaatttaacta

SEQ ID NO: 1335398 - DNA, 22 bp, Artificial Sequence
  chemically synthesized
gaattcaagccctagttaaatt

SEQ ID NO: 1335399 - DNA, 22 bp, Artificial Sequence
  chemically synthesized
gtacataggagaactggaattc

SEQ ID NO: 1335400 - DNA, 22 bp, Artificial Sequence
  chemically synthesized
aactagggcttgaattccagtt

SEQ ID NO: 1335401 - DNA, 22 bp, Artificial Sequence
  chemically synthesized
actagggcttgaattccagttc

SEQ ID NO: 1335402 - DNA, 22 bp, Artificial Sequence
  chemically synthesized
gggcttgaattccagttctcct

SEQ ID NO: 1335403 - DNA, 22 bp, Artificial Sequence
  chemically synthesized
tgcagctagtacataggagaac

SEQ ID NO: 1335404 - DNA, 22 bp, Artificial Sequence
  chemically synthesized
gaattccagttctcctatgtac

SEQ ID NO: 1335405 - DNA, 22 bp, Artificial Sequence
  chemically synthesized
aattccagttctcctatgtact

SEQ ID NO: 1335406 - DNA, 22 bp, Artificial Sequence
  chemically synthesized
cagttctcctatgtactagctg

SEQ ID NO: 1335407 - DNA, 22 bp, Artificial Sequence
  chemically synthesized
tcctatgtactagctgcataat

SEQ ID NO: 1335408 - DNA, 22 bp, Artificial Sequence
  chemically synthesized
ctatgtactagctgcataatct

SEQ ID NO: 1335409 - DNA, 22 bp, Artificial Sequence
  chemically synthesized
tgtactagctgcataatcttgg

SEQ ID NO: 1335410 - DNA, 22 bp, Artificial Sequence
  chemically synthesized
gctgcataatcttggcacgtta

SEQ ID NO: 1335411 - DNA, 22 bp, Artificial Sequence
  chemically synthesized
cataatcttggcacgttatgtt

SEQ ID NO: 1335412 - DNA, 22 bp, Artificial Sequence
  chemically synthesized
ggcacgttatgttatttatatc

SEQ ID NO: 1335413 - DNA, 22 bp, Artificial Sequence
  chemically synthesized
gcacgttatgttatttatatca

SEQ ID NO: 1335414 - DNA, 22 bp, Artificial Sequence
  chemically synthesized
cagacaacgaaatgtgatataa

SEQ ID NO: 1335415 - DNA, 22 bp, Artificial Sequence
  chemically synthesized
acagacaacgaaatgtgatata

SEQ ID NO: 1335416 - DNA, 22 bp, Artificial Sequence
  chemically synthesized
tacagacaacgaaatgtgatat

SEQ ID NO: 1335417 - DNA, 22 bp, Artificial Sequence
  chemically synthesized
tgttatttatatcacatttcgt

SEQ ID NO: 1335418 - DNA, 22 bp, Artificial Sequence
  chemically synthesized
tttatatcacatttcgttgtct

SEQ ID NO: 1335419 - DNA, 22 bp, Artificial Sequence
  chemically synthesized
tccccattttacagacaacgaa

SEQ ID NO: 1335420 - DNA, 22 bp, Artificial Sequence
  chemically synthesized
atatcacatttcgttgtctgta

SEQ ID NO: 1335421 - DNA, 22 bp, Artificial Sequence
  chemically synthesized
tatcacatttcgttgtctgtaa

SEQ ID NO: 1335422 - DNA, 22 bp, Artificial Sequence
  chemically synthesized
atattatccccattttacagac

SEQ ID NO: 1335423 - DNA, 22 bp, Artificial Sequence
  chemically synthesized
gaattgatattatccccatttt

SEQ ID NO: 1335424 - DNA, 22 bp, Artificial Sequence
  chemically synthesized
cgttgtctgtaaaatggggata

SEQ ID NO: 1335425 - DNA, 22 bp, Artificial Sequence
  chemically synthesized
gttgtctgtaaaatggggataa

SEQ ID NO: 1335426 - DNA, 22 bp, Artificial Sequence
  chemically synthesized
tctgtaaaatggggataatatc

SEQ ID NO: 1335427 - DNA, 22 bp, Artificial Sequence
  chemically synthesized
aggaggctggaattgatattat

SEQ ID NO: 1335428 - DNA, 22 bp, Artificial Sequence
  chemically synthesized
taaaatggggataatatcaatt

SEQ ID NO: 1335429 - DNA, 22 bp, Artificial Sequence
  chemically synthesized
acaatagcctcaggaggctgga

SEQ ID NO: 1335430 - DNA, 22 bp, Artificial Sequence
  chemically synthesized
tagtggaaactaacaatagcct

SEQ ID NO: 1335431 - DNA, 22 bp, Artificial Sequence
  chemically synthesized
gtagtggaaactaacaatagcc

SEQ ID NO: 1335432 - DNA, 22 bp, Artificial Sequence
  chemically synthesized
cagcctcctgaggctattgtta

SEQ ID NO: 1335433 - DNA, 22 bp, Artificial Sequence
  chemically synthesized
ctgaggctattgttagtttcca

SEQ ID NO: 1335434 - DNA, 22 bp, Artificial Sequence
  chemically synthesized
aggctattgttagtttccacta

SEQ ID NO: 1335435 - DNA, 22 bp, Artificial Sequence
  chemically synthesized
tggtaaacaccttgtagtggaa

SEQ ID NO: 1335436 - DNA, 22 bp, Artificial Sequence
  chemically synthesized
ttgttagtttccactacaaggt

SEQ ID NO: 1335437 - DNA, 22 bp, Artificial Sequence
  chemically synthesized
gaactgtggtaaacaccttgta

SEQ ID NO: 1335438 - DNA, 22 bp, Artificial Sequence
  chemically synthesized
ttagtttccactacaaggtgtt

SEQ ID NO: 1335439 - DNA, 22 bp, Artificial Sequence
  chemically synthesized
gtttccactacaaggtgtttac

SEQ ID NO: 1335440 - DNA, 22 bp, Artificial Sequence
  chemically synthesized
tatctggaactgtggtaaacac

SEQ ID NO: 1335441 - DNA, 22 bp, Artificial Sequence
  chemically synthesized
ccactacaaggtgtttaccaca

SEQ ID NO: 1335442 - DNA, 22 bp, Artificial Sequence
  chemically synthesized
tgtatctggaactgtggtaaac

SEQ ID NO: 1335443 - DNA, 22 bp, Artificial Sequence
  chemically synthesized
cactacaaggtgtttaccacag

SEQ ID NO: 1335444 - DNA, 22 bp, Artificial Sequence
  chemically synthesized
actctgtatctggaactgtggt

SEQ ID NO: 1335445 - DNA, 22 bp, Artificial Sequence
  chemically synthesized
caaggtgtttaccacagttcca

SEQ ID NO: 1335446 - DNA, 22 bp, Artificial Sequence
  chemically synthesized
gcactaactctgtatctggaac

SEQ ID NO: 1335447 - DNA, 22 bp, Artificial Sequence
  chemically synthesized
agcactaactctgtatctggaa

SEQ ID NO: 1335448 - DNA, 22 bp, Artificial Sequence
  chemically synthesized
tttagcactaactctgtatctg

SEQ ID NO: 1335449 - DNA, 22 bp, Artificial Sequence
  chemically synthesized
atttagcactaactctgtatct

SEQ ID NO: 1335450 - DNA, 22 bp, Artificial Sequence
  chemically synthesized
accacagttccagatacagagt

SEQ ID NO: 1335451 - DNA, 22 bp, Artificial Sequence
  chemically synthesized
ccacagttccagatacagagtt

SEQ ID NO: 1335452 - DNA, 22 bp, Artificial Sequence
  chemically synthesized
tttatttagcactaactctgta

SEQ ID NO: 1335453 - DNA, 22 bp, Artificial Sequence
  chemically synthesized
ctatttatttagcactaactct

SEQ ID NO: 1335454 - DNA, 22 bp, Artificial Sequence
  chemically synthesized
cagatacagagttagtgctaaa

SEQ ID NO: 1335455 - DNA, 22 bp, Artificial Sequence
  chemically synthesized
ataaatagtagctactatttat

SEQ ID NO: 1335456 - DNA, 22 bp, Artificial Sequence
  chemically synthesized
ttgataaatagtagctactatt

SEQ ID NO: 1335457 - DNA, 22 bp, Artificial Sequence
  chemically synthesized
gtgctaaataaatagtagctac

SEQ ID NO: 1335458 - DNA, 22 bp, Artificial Sequence
  chemically synthesized
ttgttgataaatagtagctact

SEQ ID NO: 1335459 - DNA, 22 bp, Artificial Sequence
  chemically synthesized
ttgttgttgataaatagtagct

SEQ ID NO: 1335460 - DNA, 22 bp, Artificial Sequence
  chemically synthesized
aataaatagtagctactattta

SEQ ID NO: 1335461 - DNA, 22 bp, Artificial Sequence
  chemically synthesized
ttattgttgttgataaatagta

SEQ ID NO: 1335462 - DNA, 22 bp, Artificial Sequence
  chemically synthesized
attattgttgttgataaatagt

SEQ ID NO: 1335463 - DNA, 22 bp, Artificial Sequence
  chemically synthesized
tcatcttattattgttgttgat

SEQ ID NO: 1335464 - DNA, 22 bp, Artificial Sequence
  chemically synthesized
ctatttatcaacaacaataata

SEQ ID NO: 1335465 - DNA, 22 bp, Artificial Sequence
  chemically synthesized
tttatcaacaacaataataaga

SEQ ID NO: 1335466 - DNA, 22 bp, Artificial Sequence
  chemically synthesized
atcaacaacaataataagatga

SEQ ID NO: 1335467 - DNA, 22 bp, Artificial Sequence
  chemically synthesized
tcaacaacaataataagatgat

SEQ ID NO: 1335468 - DNA, 22 bp, Artificial Sequence
  chemically synthesized
ggaaatgtgagtgattatcatc

SEQ ID NO: 1335469 - DNA, 22 bp, Artificial Sequence
  chemically synthesized
gggaaatgtgagtgattatcat

SEQ ID NO: 1335470 - DNA, 22 bp, Artificial Sequence
  chemically synthesized
caaagccttgggaaatgtgagt

SEQ ID NO: 1335471 - DNA, 22 bp, Artificial Sequence
  chemically synthesized
ctccaaagccttgggaaatgtg

SEQ ID NO: 1335472 - DNA, 22 bp, Artificial Sequence
  chemically synthesized
cctccaaagccttgggaaatgt

SEQ ID NO: 1335473 - DNA, 22 bp, Artificial Sequence
  chemically synthesized
atttcctccaaagccttgggaa

SEQ ID NO: 1335474 - DNA, 22 bp, Artificial Sequence
  chemically synthesized
aatttcctccaaagccttggga

SEQ ID NO: 1335475 - DNA, 22 bp, Artificial Sequence
  chemically synthesized
atttaatttcctccaaagcctt

SEQ ID NO: 1335476 - DNA, 22 bp, Artificial Sequence
  chemically synthesized
gatttaatttcctccaaagcct

SEQ ID NO: 1335477 - DNA, 22 bp, Artificial Sequence
  chemically synthesized
acatttcccaaggctttggagg

SEQ ID NO: 1335478 - DNA, 22 bp, Artificial Sequence
  chemically synthesized
cccaaggctttggaggaaatta

SEQ ID NO: 1335479 - DNA, 22 bp, Artificial Sequence
  chemically synthesized
ccaaggctttggaggaaattaa

SEQ ID NO: 1335480 - DNA, 22 bp, Artificial Sequence
  chemically synthesized
tatgcatcatttgatttaattt

SEQ ID NO: 1335481 - DNA, 22 bp, Artificial Sequence
  chemically synthesized
gtatgcatcatttgatttaatt

SEQ ID NO: 1335482 - DNA, 22 bp, Artificial Sequence
  chemically synthesized
tgtatgcatcatttgatttaat

SEQ ID NO: 1335483 - DNA, 22 bp, Artificial Sequence
  chemically synthesized
ttttgtatgcatcatttgattt

SEQ ID NO: 1335484 - DNA, 22 bp, Artificial Sequence
  chemically synthesized
tggaggaaattaaatcaaatga

SEQ ID NO: 1335485 - DNA, 22 bp, Artificial Sequence
  chemically synthesized
attttgtatgcatcatttgatt

SEQ ID NO: 1335486 - DNA, 22 bp, Artificial Sequence
  chemically synthesized
ggaggaaattaaatcaaatgat

SEQ ID NO: 1335487 - DNA, 22 bp, Artificial Sequence
  chemically synthesized
gaggaaattaaatcaaatgatg

SEQ ID NO: 1335488 - DNA, 22 bp, Artificial Sequence
  chemically synthesized
aaaggcttattttgtatgcatc

SEQ ID NO: 1335489 - DNA, 22 bp, Artificial Sequence
  chemically synthesized
caaaggcttattttgtatgcat

SEQ ID NO: 1335490 - DNA, 22 bp, Artificial Sequence
  chemically synthesized
aatcaaatgatgcatacaaaat

SEQ ID NO: 1335491 - DNA, 22 bp, Artificial Sequence
  chemically synthesized
acttcaaaggcttattttgtat

SEQ ID NO: 1335492 - DNA, 22 bp, Artificial Sequence
  chemically synthesized
cacttcaaaggcttattttgta

SEQ ID NO: 1335493 - DNA, 22 bp, Artificial Sequence
  chemically synthesized
tcacttcaaaggcttattttgt

SEQ ID NO: 1335494 - DNA, 22 bp, Artificial Sequence
  chemically synthesized
ttcacttcaaaggcttattttg

SEQ ID NO: 1335495 - DNA, 22 bp, Artificial Sequence
  chemically synthesized
tggtgtttttcacttcaaaggc

SEQ ID NO: 1335496 - DNA, 22 bp, Artificial Sequence
  chemically synthesized
aacaacattatggtgtttttca

SEQ ID NO: 1335497 - DNA, 22 bp, Artificial Sequence
  chemically synthesized
caacaacattatggtgtttttc

SEQ ID NO: 1335498 - DNA, 22 bp, Artificial Sequence
  chemically synthesized
tgaagtgaaaaacaccataatg

SEQ ID NO: 1335499 - DNA, 22 bp, Artificial Sequence
  chemically synthesized
gaagtgaaaaacaccataatgt

SEQ ID NO: 1335500 - DNA, 22 bp, Artificial Sequence
  chemically synthesized
aagtgaaaaacaccataatgtt

SEQ ID NO: 1335501 - DNA, 22 bp, Artificial Sequence
  chemically synthesized
aaaggaagaaaacccatcttca

SEQ ID NO: 1335502 - DNA, 22 bp, Artificial Sequence
  chemically synthesized
ctaaaaggaagaaaacccatct

SEQ ID NO: 1335503 - DNA, 22 bp, Artificial Sequence
  chemically synthesized
ttgaagatgggttttcttcctt

SEQ ID NO: 1335504 - DNA, 22 bp, Artificial Sequence
  chemically synthesized
aagatgggttttcttcctttta

SEQ ID NO: 1335505 - DNA, 22 bp, Artificial Sequence
  chemically synthesized
tcttccttttagtaatatgttt

SEQ ID NO: 1335506 - DNA, 22 bp, Artificial Sequence
  chemically synthesized
cttccttttagtaatatgtttg

SEQ ID NO: 1335507 - DNA, 22 bp, Artificial Sequence
  chemically synthesized
ttccttttagtaatatgtttgc

SEQ ID NO: 1335508 - DNA, 22 bp, Artificial Sequence
  chemically synthesized
ccttttagtaatatgtttgcca

SEQ ID NO: 1335509 - DNA, 22 bp, Artificial Sequence
  chemically synthesized
aaatcaaagatatggcaaacat

SEQ ID NO: 1335510 - DNA, 22 bp, Artificial Sequence
  chemically synthesized
cttttagtaatatgtttgccat

SEQ ID NO: 1335511 - DNA, 22 bp, Artificial Sequence
  chemically synthesized
aaaatcaaagatatggcaaaca

SEQ ID NO: 1335512 - DNA, 22 bp, Artificial Sequence
  chemically synthesized
taaaatcaaagatatggcaaac

SEQ ID NO: 1335513 - DNA, 22 bp, Artificial Sequence
  chemically synthesized
ttagtaatatgtttgccatatc

SEQ ID NO: 1335514 - DNA, 22 bp, Artificial Sequence
  chemically synthesized
tttaaaatcaaagatatggcaa

SEQ ID NO: 1335515 - DNA, 22 bp, Artificial Sequence
  chemically synthesized
tagtaatatgtttgccatatct

SEQ ID NO: 1335516 - DNA, 22 bp, Artificial Sequence
  chemically synthesized
ctttaaaatcaaagatatggca

SEQ ID NO: 1335517 - DNA, 22 bp, Artificial Sequence
  chemically synthesized
agtaatatgtttgccatatctt

SEQ ID NO: 1335518 - DNA, 22 bp, Artificial Sequence
  chemically synthesized
gtaatatgtttgccatatcttt

SEQ ID NO: 1335519 - DNA, 22 bp, Artificial Sequence
  chemically synthesized
tttctttaaaatcaaagatatg

SEQ ID NO: 1335520 - DNA, 22 bp, Artificial Sequence
  chemically synthesized
ctatttctttaaaatcaaagat

SEQ ID NO: 1335521 - DNA, 22 bp, Artificial Sequence
  chemically synthesized
gccatatctttgattttaaaga

SEQ ID NO: 1335522 - DNA, 22 bp, Artificial Sequence
  chemically synthesized
accactactatttctttaaaat

SEQ ID NO: 1335523 - DNA, 22 bp, Artificial Sequence
  chemically synthesized
ccatatctttgattttaaagaa

SEQ ID NO: 1335524 - DNA, 22 bp, Artificial Sequence
  chemically synthesized
aaccactactatttctttaaaa

SEQ ID NO: 1335525 - DNA, 22 bp, Artificial Sequence
  chemically synthesized
taaccactactatttctttaaa

SEQ ID NO: 1335526 - DNA, 22 bp, Artificial Sequence
  chemically synthesized
ttaaccactactatttctttaa

SEQ ID NO: 1335527 - DNA, 22 bp, Artificial Sequence
  chemically synthesized
tttaaccactactatttcttta

SEQ ID NO: 1335528 - DNA, 22 bp, Artificial Sequence
  chemically synthesized
ttttaaccactactatttcttt

SEQ ID NO: 1335529 - DNA, 22 bp, Artificial Sequence
  chemically synthesized
tttttaaccactactatttctt

SEQ ID NO: 1335530 - DNA, 22 bp, Artificial Sequence
  chemically synthesized
ttttttaaccactactatttct

SEQ ID NO: 1335531 - DNA, 22 bp, Artificial Sequence
  chemically synthesized
tttttttaaccactactatttc

SEQ ID NO: 1335532 - DNA, 22 bp, Artificial Sequence
  chemically synthesized
tgattttaaagaaatagtagtg

SEQ ID NO: 1335533 - DNA, 22 bp, Artificial Sequence
  chemically synthesized
gattttaaagaaatagtagtgg

SEQ ID NO: 1335534 - DNA, 22 bp, Artificial Sequence
  chemically synthesized
ctttttttttaaccactactat

SEQ ID NO: 1335535 - DNA, 22 bp, Artificial Sequence
  chemically synthesized
attttaaagaaatagtagtggt

SEQ ID NO: 1335536 - DNA, 22 bp, Artificial Sequence
  chemically synthesized
gctttttttttaaccactacta

SEQ ID NO: 1335537 - DNA, 22 bp, Artificial Sequence
  chemically synthesized
cttgctttttttttaaccacta

SEQ ID NO: 1335538 - DNA, 22 bp, Artificial Sequence
  chemically synthesized
taaagaaatagtagtggttaaa

SEQ ID NO: 1335539 - DNA, 22 bp, Artificial Sequence
  chemically synthesized
aaagaaatagtagtggttaaaa

SEQ ID NO: 1335540 - DNA, 22 bp, Artificial Sequence
  chemically synthesized
aagaaatagtagtggttaaaaa

SEQ ID NO: 1335541 - DNA, 22 bp, Artificial Sequence
  chemically synthesized
ctacttgctttttttttaacca

SEQ ID NO: 1335542 - DNA, 22 bp, Artificial Sequence
  chemically synthesized
gtggccctactacttgcttttt

SEQ ID NO: 1335543 - DNA, 22 bp, Artificial Sequence
  chemically synthesized
ggtggccctactacttgctttt

SEQ ID NO: 1335544 - DNA, 22 bp, Artificial Sequence
  chemically synthesized
tggtggccctactacttgcttt

SEQ ID NO: 1335545 - DNA, 22 bp, Artificial Sequence
  chemically synthesized
aaaaaaaagcaagtagtagggc

SEQ ID NO: 1335546 - DNA, 22 bp, Artificial Sequence
  chemically synthesized
tagccagatctttggtggccct

SEQ ID NO: 1335547 - DNA, 22 bp, Artificial Sequence
  chemically synthesized
ttgtagccagatctttggtggc

SEQ ID NO: 1335548 - DNA, 22 bp, Artificial Sequence
  chemically synthesized
agaacaattattgtagccagat

SEQ ID NO: 1335549 - DNA, 22 bp, Artificial Sequence
  chemically synthesized
tcagaacaattattgtagccag

SEQ ID NO: 1335550 - DNA, 22 bp, Artificial Sequence
  chemically synthesized
acctctcagaacaattattgta

SEQ ID NO: 1335551 - DNA, 22 bp, Artificial Sequence
  chemically synthesized
gctacaataattgttctgagag

SEQ ID NO: 1335552 - DNA, 22 bp, Artificial Sequence
  chemically synthesized
agcaggagcctaacctctcaga

SEQ ID NO: 1335553 - DNA, 22 bp, Artificial Sequence
  chemically synthesized
caataattgttctgagaggtta

SEQ ID NO: 1335554 - DNA, 22 bp, Artificial Sequence
  chemically synthesized
tcagcaggagcctaacctctca

SEQ ID NO: 1335555 - DNA, 22 bp, Artificial Sequence
  chemically synthesized
caactctcagcaggagcctaac

SEQ ID NO: 1335556 - DNA, 22 bp, Artificial Sequence
  chemically synthesized
ttctgagaggttaggctcctgc

SEQ ID NO: 1335557 - DNA, 22 bp, Artificial Sequence
  chemically synthesized
gctccaactctcagcaggagcc

SEQ ID NO: 1335558 - DNA, 22 bp, Artificial Sequence
  chemically synthesized
agctccaactctcagcaggagc

SEQ ID NO: 1335559 - DNA, 22 bp, Artificial Sequence
  chemically synthesized
tgagaggttaggctcctgctga

SEQ ID NO: 1335560 - DNA, 22 bp, Artificial Sequence
  chemically synthesized
agaggttaggctcctgctgaga

SEQ ID NO: 1335561 - DNA, 22 bp, Artificial Sequence
  chemically synthesized
ggtttagctccaactctcagca

SEQ ID NO: 1335562 - DNA, 22 bp, Artificial Sequence
  chemically synthesized
ggctcctgctgagagttggagc

SEQ ID NO: 1335563 - DNA, 22 bp, Artificial Sequence
  chemically synthesized
ctgctgagagttggagctaaac

SEQ ID NO: 1335564 - DNA, 22 bp, Artificial Sequence
  chemically synthesized
catataggtgctaggtttagct

SEQ ID NO: 1335565 - DNA, 22 bp, Artificial Sequence
  chemically synthesized
ctgagagttggagctaaaccta

SEQ ID NO: 1335566 - DNA, 22 bp, Artificial Sequence
  chemically synthesized
ctacatataggtgctaggttta

SEQ ID NO: 1335567 - DNA, 22 bp, Artificial Sequence
  chemically synthesized
agagttggagctaaacctagca

SEQ ID NO: 1335568 - DNA, 22 bp, Artificial Sequence
  chemically synthesized
tactactacatataggtgctag

SEQ ID NO: 1335569 - DNA, 22 bp, Artificial Sequence
  chemically synthesized
gtactactacatataggtgcta

SEQ ID NO: 1335570 - DNA, 22 bp, Artificial Sequence
  chemically synthesized
gagctaaacctagcacctatat

SEQ ID NO: 1335571 - DNA, 22 bp, Artificial Sequence
  chemically synthesized
ggtttgtactactacatatagg

SEQ ID NO: 1335572 - DNA, 22 bp, Artificial Sequence
  chemically synthesized
aggtttgtactactacatatag

SEQ ID NO: 1335573 - DNA, 22 bp, Artificial Sequence
  chemically synthesized
aacctagcacctatatgtagta

SEQ ID NO: 1335574 - DNA, 22 bp, Artificial Sequence
  chemically synthesized
tatatttaggtttgtactacta

SEQ ID NO: 1335575 - DNA, 22 bp, Artificial Sequence
  chemically synthesized
gcacctatatgtagtagtacaa

SEQ ID NO: 1335576 - DNA, 22 bp, Artificial Sequence
  chemically synthesized
tatgtagtagtacaaacctaaa

SEQ ID NO: 1335577 - DNA, 22 bp, Artificial Sequence
  chemically synthesized
atgtactgtatatttaggtttg

SEQ ID NO: 1335578 - DNA, 22 bp, Artificial Sequence
  chemically synthesized
cctgatgtactgtatatttagg

SEQ ID NO: 1335579 - DNA, 22 bp, Artificial Sequence
  chemically synthesized
ttccctgatgtactgtatattt

SEQ ID NO: 1335580 - DNA, 22 bp, Artificial Sequence
  chemically synthesized
cgttgttccctgatgtactgta

SEQ ID NO: 1335581 - DNA, 22 bp, Artificial Sequence
  chemically synthesized
aatatacagtacatcagggaac

SEQ ID NO: 1335582 - DNA, 22 bp, Artificial Sequence
  chemically synthesized
gaagtctacgttgttccctgat

SEQ ID NO: 1335583 - DNA, 22 bp, Artificial Sequence
  chemically synthesized
tacattcgaagtctacgttgtt

SEQ ID NO: 1335584 - DNA, 22 bp, Artificial Sequence
  chemically synthesized
aatctgtacattcgaagtctac

SEQ ID NO: 1335585 - DNA, 22 bp, Artificial Sequence
  chemically synthesized
aaatctgtacattcgaagtcta

SEQ ID NO: 1335586 - DNA, 22 bp, Artificial Sequence
  chemically synthesized
taaatctgtacattcgaagtct

SEQ ID NO: 1335587 - DNA, 22 bp, Artificial Sequence
  chemically synthesized
gttttaaatctgtacattcgaa

SEQ ID NO: 1335588 - DNA, 22 bp, Artificial Sequence
  chemically synthesized
tagttttaaatctgtacattcg

SEQ ID NO: 1335589 - DNA, 22 bp, Artificial Sequence
  chemically synthesized
cagttctagttttaaatctgta

SEQ ID NO: 1335590 - DNA, 22 bp, Artificial Sequence
  chemically synthesized
ttgcagttctagttttaaatct

SEQ ID NO: 1335591 - DNA, 22 bp, Artificial Sequence
  chemically synthesized
cgaatgtacagatttaaaacta

SEQ ID NO: 1335592 - DNA, 22 bp, Artificial Sequence
  chemically synthesized
gaatgtacagatttaaaactag

SEQ ID NO: 1335593 - DNA, 22 bp, Artificial Sequence
  chemically synthesized
agtatgtcaccaggttattgca

SEQ ID NO: 1335594 - DNA, 22 bp, Artificial Sequence
  chemically synthesized
aaaactagaactgcaataacct

SEQ ID NO: 1335595 - DNA, 22 bp, Artificial Sequence
  chemically synthesized
aaactagaactgcaataacctg

SEQ ID NO: 1335596 - DNA, 22 bp, Artificial Sequence
  chemically synthesized
ttcagtatgtcaccaggttatt

SEQ ID NO: 1335597 - DNA, 22 bp, Artificial Sequence
  chemically synthesized
attcagtatgtcaccaggttat

SEQ ID NO: 1335598 - DNA, 22 bp, Artificial Sequence
  chemically synthesized
gaactgcaataacctggtgaca

SEQ ID NO: 1335599 - DNA, 22 bp, Artificial Sequence
  chemically synthesized
caatttattcagtatgtcacca

SEQ ID NO: 1335600 - DNA, 22 bp, Artificial Sequence
  chemically synthesized
ccaatttattcagtatgtcacc

SEQ ID NO: 1335601 - DNA, 22 bp, Artificial Sequence
  chemically synthesized
caataacctggtgacatactga

SEQ ID NO: 1335602 - DNA, 22 bp, Artificial Sequence
  chemically synthesized
cttccaatttattcagtatgtc

SEQ ID NO: 1335603 - DNA, 22 bp, Artificial Sequence
  chemically synthesized
acttccaatttattcagtatgt

SEQ ID NO: 1335604 - DNA, 22 bp, Artificial Sequence
  chemically synthesized
atggacttacttccaatttatt

SEQ ID NO: 1335605 - DNA, 22 bp, Artificial Sequence
  chemically synthesized
gtgacatactgaataaattgga

SEQ ID NO: 1335606 - DNA, 22 bp, Artificial Sequence
  chemically synthesized
aatggacttacttccaatttat

SEQ ID NO: 1335607 - DNA, 22 bp, Artificial Sequence
  chemically synthesized
aataaattggaagtaagtccat

SEQ ID NO: 1335608 - DNA, 22 bp, Artificial Sequence
  chemically synthesized
gagacaagatttaatggactta

SEQ ID NO: 1335609 - DNA, 22 bp, Artificial Sequence
  chemically synthesized
tagagacaagatttaatggact

SEQ ID NO: 1335610 - DNA, 22 bp, Artificial Sequence
  chemically synthesized
gaagtaagtccattaaatcttg

SEQ ID NO: 1335611 - DNA, 22 bp, Artificial Sequence
  chemically synthesized
ggaataataactctagagacaa

SEQ ID NO: 1335612 - DNA, 22 bp, Artificial Sequence
  chemically synthesized
ttgggaataataactctagaga

SEQ ID NO: 1335613 - DNA, 22 bp, Artificial Sequence
  chemically synthesized
aatcttgtctctagagttatta

SEQ ID NO: 1335614 - DNA, 22 bp, Artificial Sequence
  chemically synthesized
tgattattgggaataataactc

SEQ ID NO: 1335615 - DNA, 22 bp, Artificial Sequence
  chemically synthesized
gtctctagagttattattccca

SEQ ID NO: 1335616 - DNA, 22 bp, Artificial Sequence
  chemically synthesized
tctctagagttattattcccaa

SEQ ID NO: 1335617 - DNA, 22 bp, Artificial Sequence
  chemically synthesized
aaaaattgtgattattgggaat

SEQ ID NO: 1335618 - DNA, 22 bp, Artificial Sequence
  chemically synthesized
aaaaaattgtgattattgggaa

SEQ ID NO: 1335619 - DNA, 22 bp, Artificial Sequence
  chemically synthesized
tagagttattattcccaataat

SEQ ID NO: 1335620 - DNA, 22 bp, Artificial Sequence
  chemically synthesized
taaaaaattgtgattattggga

SEQ ID NO: 1335621 - DNA, 22 bp, Artificial Sequence
  chemically synthesized
gagttattattcccaataatca

SEQ ID NO: 1335622 - DNA, 22 bp, Artificial Sequence
  chemically synthesized
ttattcccaataatcacaattt

SEQ ID NO: 1335623 - DNA, 22 bp, Artificial Sequence
  chemically synthesized
ttcccaataatcacaatttttt

SEQ ID NO: 1335624 - DNA, 22 bp, Artificial Sequence
  chemically synthesized
aagatggtcattttaaaaaatt

SEQ ID NO: 1335625 - DNA, 22 bp, Artificial Sequence
  chemically synthesized
ccaataatcacaattttttaaa

SEQ ID NO: 1335626 - DNA, 22 bp, Artificial Sequence
  chemically synthesized
caagatggtcattttaaaaaat

SEQ ID NO: 1335627 - DNA, 22 bp, Artificial Sequence
  chemically synthesized
tcaagatggtcattttaaaaaa

SEQ ID NO: 1335628 - DNA, 22 bp, Artificial Sequence
  chemically synthesized
tttaaaatgaccatcttgaaaa

SEQ ID NO: 1335629 - DNA, 22 bp, Artificial Sequence
  chemically synthesized
caggaaacatgattttcaagat

SEQ ID NO: 1335630 - DNA, 22 bp, Artificial Sequence
  chemically synthesized
ttaaaatgaccatcttgaaaat

SEQ ID NO: 1335631 - DNA, 22 bp, Artificial Sequence
  chemically synthesized
taaaatgaccatcttgaaaatc

SEQ ID NO: 1335632 - DNA, 22 bp, Artificial Sequence
  chemically synthesized
aaaatgaccatcttgaaaatca

SEQ ID NO: 1335633 - DNA, 22 bp, Artificial Sequence
  chemically synthesized
aaatgaccatcttgaaaatcat

SEQ ID NO: 1335634 - DNA, 22 bp, Artificial Sequence
  chemically synthesized
gaggtgactccaggaaacatga

SEQ ID NO: 1335635 - DNA, 22 bp, Artificial Sequence
  chemically synthesized
ggaggtgactccaggaaacatg

SEQ ID NO: 1335636 - DNA, 22 bp, Artificial Sequence
  chemically synthesized
tttggaggtgactccaggaaac

SEQ ID NO: 1335637 - DNA, 22 bp, Artificial Sequence
  chemically synthesized
gaaaatcatgtttcctggagtc

SEQ ID NO: 1335638 - DNA, 22 bp, Artificial Sequence
  chemically synthesized
ctatttggaggtgactccagga

SEQ ID NO: 1335639 - DNA, 22 bp, Artificial Sequence
  chemically synthesized
aaaatcatgtttcctggagtca

SEQ ID NO: 1335640 - DNA, 22 bp, Artificial Sequence
  chemically synthesized
ctgctatttggaggtgactcca

SEQ ID NO: 1335641 - DNA, 22 bp, Artificial Sequence
  chemically synthesized
actgctatttggaggtgactcc

SEQ ID NO: 1335642 - DNA, 22 bp, Artificial Sequence
  chemically synthesized
cctggagtcacctccaaatagc

SEQ ID NO: 1335643 - DNA, 22 bp, Artificial Sequence
  chemically synthesized
ctggagtcacctccaaatagca

SEQ ID NO: 1335644 - DNA, 22 bp, Artificial Sequence
  chemically synthesized
gagtcacctccaaatagcagta

SEQ ID NO: 1335645 - DNA, 22 bp, Artificial Sequence
  chemically synthesized
taataggagatgggtagcttac

SEQ ID NO: 1335646 - DNA, 22 bp, Artificial Sequence
  chemically synthesized
gtaataggagatgggtagctta

SEQ ID NO: 1335647 - DNA, 22 bp, Artificial Sequence
  chemically synthesized
tgtaataggagatgggtagctt

SEQ ID NO: 1335648 - DNA, 22 bp, Artificial Sequence
  chemically synthesized
caaatagcagtaagctacccat

SEQ ID NO: 1335649 - DNA, 22 bp, Artificial Sequence
  chemically synthesized
ttgtaataggagatgggtagct

SEQ ID NO: 1335650 - DNA, 22 bp, Artificial Sequence
  chemically synthesized
tttgtaataggagatgggtagc

SEQ ID NO: 1335651 - DNA, 22 bp, Artificial Sequence
  chemically synthesized
tttttgtaataggagatgggta

SEQ ID NO: 1335652 - DNA, 22 bp, Artificial Sequence
  chemically synthesized
ctttttgtaataggagatgggt

SEQ ID NO: 1335653 - DNA, 22 bp, Artificial Sequence
  chemically synthesized
tctttttgtaataggagatggg

SEQ ID NO: 1335654 - DNA, 22 bp, Artificial Sequence
  chemically synthesized
ttctttttgtaataggagatgg

SEQ ID NO: 1335655 - DNA, 22 bp, Artificial Sequence
  chemically synthesized
atttttctttttgtaataggag

SEQ ID NO: 1335656 - DNA, 22 bp, Artificial Sequence
  chemically synthesized
gtctcatttttctttttgtaat

SEQ ID NO: 1335657 - DNA, 22 bp, Artificial Sequence
  chemically synthesized
cccatctcctattacaaaaaga

SEQ ID NO: 1335658 - DNA, 22 bp, Artificial Sequence
  chemically synthesized
caagctggtctcatttttcttt

SEQ ID NO: 1335659 - DNA, 22 bp, Artificial Sequence
  chemically synthesized
acaagctggtctcatttttctt

SEQ ID NO: 1335660 - DNA, 22 bp, Artificial Sequence
  chemically synthesized
ctattacaaaaagaaaaatgag

SEQ ID NO: 1335661 - DNA, 22 bp, Artificial Sequence
  chemically synthesized
ttacaaaaagaaaaatgagacc

SEQ ID NO: 1335662 - DNA, 22 bp, Artificial Sequence
  chemically synthesized
caaaaagaaaaatgagaccagc

SEQ ID NO: 1335663 - DNA, 22 bp, Artificial Sequence
  chemically synthesized
ggtaatgtgtttacaagctggt

SEQ ID NO: 1335664 - DNA, 22 bp, Artificial Sequence
  chemically synthesized
ttgggtaatgtgtttacaagct

SEQ ID NO: 1335665 - DNA, 22 bp, Artificial Sequence
  chemically synthesized
attgggtaatgtgtttacaagc

SEQ ID NO: 1335666 - DNA, 22 bp, Artificial Sequence
  chemically synthesized
tattgggtaatgtgtttacaag

SEQ ID NO: 1335667 - DNA, 22 bp, Artificial Sequence
  chemically synthesized
taaggtactttattgggtaatg

SEQ ID NO: 1335668 - DNA, 22 bp, Artificial Sequence
  chemically synthesized
gtaaacacattacccaataaag

SEQ ID NO: 1335669 - DNA, 22 bp, Artificial Sequence
  chemically synthesized
cactgtaaggtactttattggg

SEQ ID NO: 1335670 - DNA, 22 bp, Artificial Sequence
  chemically synthesized
taaacacattacccaataaagt

SEQ ID NO: 1335671 - DNA, 22 bp, Artificial Sequence
  chemically synthesized
gcactgtaaggtactttattgg

SEQ ID NO: 1335672 - DNA, 22 bp, Artificial Sequence
  chemically synthesized
cttgcactgtaaggtactttat

SEQ ID NO: 1335673 - DNA, 22 bp, Artificial Sequence
  chemically synthesized
cctgcttgcactgtaaggtact

SEQ ID NO: 1335674 - DNA, 22 bp, Artificial Sequence
  chemically synthesized
cccaataaagtaccttacagtg

SEQ ID NO: 1335675 - DNA, 22 bp, Artificial Sequence
  chemically synthesized
agcaataatgcctccctgcttg

SEQ ID NO: 1335676 - DNA, 22 bp, Artificial Sequence
  chemically synthesized
cattgagcaataatgcctccct

SEQ ID NO: 1335677 - DNA, 22 bp, Artificial Sequence
  chemically synthesized
acagtgcaagcagggaggcatt

SEQ ID NO: 1335678 - DNA, 22 bp, Artificial Sequence
  chemically synthesized
ccattgagcaataatgcctccc

SEQ ID NO: 1335679 - DNA, 22 bp, Artificial Sequence
  chemically synthesized
cagtgcaagcagggaggcatta

SEQ ID NO: 1335680 - DNA, 22 bp, Artificial Sequence
  chemically synthesized
acttccattgagcaataatgcc

SEQ ID NO: 1335681 - DNA, 22 bp, Artificial Sequence
  chemically synthesized
aattgacttccattgagcaata

SEQ ID NO: 1335682 - DNA, 22 bp, Artificial Sequence
  chemically synthesized
aaattgacttccattgagcaat

SEQ ID NO: 1335683 - DNA, 22 bp, Artificial Sequence
  chemically synthesized
taaattgacttccattgagcaa

SEQ ID NO: 1335684 - DNA, 22 bp, Artificial Sequence
  chemically synthesized
ttttaaattgacttccattgag

SEQ ID NO: 1335685 - DNA, 22 bp, Artificial Sequence
  chemically synthesized
attttaaattgacttccattga

SEQ ID NO: 1335686 - DNA, 22 bp, Artificial Sequence
  chemically synthesized
ttattttaaattgacttccatt

SEQ ID NO: 1335687 - DNA, 22 bp, Artificial Sequence
  chemically synthesized
ttgctcaatggaagtcaattta

SEQ ID NO: 1335688 - DNA, 22 bp, Artificial Sequence
  chemically synthesized
ctcaatggaagtcaatttaaaa

SEQ ID NO: 1335689 - DNA, 22 bp, Artificial Sequence
  chemically synthesized
ggtaacctcttattttaaattg

SEQ ID NO: 1335690 - DNA, 22 bp, Artificial Sequence
  chemically synthesized
aatggaagtcaatttaaaataa

SEQ ID NO: 1335691 - DNA, 22 bp, Artificial Sequence
  chemically synthesized
agaaagctcggtaacctcttat

SEQ ID NO: 1335692 - DNA, 22 bp, Artificial Sequence
  chemically synthesized
ttgagaaagctcggtaacctct

SEQ ID NO: 1335693 - DNA, 22 bp, Artificial Sequence
  chemically synthesized
attgagaaagctcggtaacctc

SEQ ID NO: 1335694 - DNA, 22 bp, Artificial Sequence
  chemically synthesized
ttattgagaaagctcggtaacc

SEQ ID NO: 1335695 - DNA, 22 bp, Artificial Sequence
  chemically synthesized
aaaataagaggttaccgagctt

SEQ ID NO: 1335696 - DNA, 22 bp, Artificial Sequence
  chemically synthesized
ctcttattgagaaagctcggta

SEQ ID NO: 1335697 - DNA, 22 bp, Artificial Sequence
  chemically synthesized
aaataagaggttaccgagcttt

SEQ ID NO: 1335698 - DNA, 22 bp, Artificial Sequence
  chemically synthesized
actcttattgagaaagctcggt

SEQ ID NO: 1335699 - DNA, 22 bp, Artificial Sequence
  chemically synthesized
tactcttattgagaaagctcgg

SEQ ID NO: 1335700 - DNA, 22 bp, Artificial Sequence
  chemically synthesized
ccgagctttctcaataagagta

SEQ ID NO: 1335701 - DNA, 22 bp, Artificial Sequence
  chemically synthesized
tggccgggatcctttactctta

SEQ ID NO: 1335702 - DNA, 22 bp, Artificial Sequence
  chemically synthesized
tctcaataagagtaaaggatcc

SEQ ID NO: 1335703 - DNA, 22 bp, Artificial Sequence
  chemically synthesized
ctcaataagagtaaaggatccc

SEQ ID NO: 1335704 - DNA, 22 bp, Artificial Sequence
  chemically synthesized
tcaataagagtaaaggatcccg

SEQ ID NO: 1335705 - DNA, 22 bp, Artificial Sequence
  chemically synthesized
aataagagtaaaggatcccggc

SEQ ID NO: 1335706 - DNA, 22 bp, Artificial Sequence
  chemically synthesized
cagaacaattatggccgggatc

SEQ ID NO: 1335707 - DNA, 22 bp, Artificial Sequence
  chemically synthesized
ctgcagaacaattatggccggg

SEQ ID NO: 1335708 - DNA, 22 bp, Artificial Sequence
  chemically synthesized
caaagttactgcagaacaatta

SEQ ID NO: 1335709 - DNA, 22 bp, Artificial Sequence
  chemically synthesized
ccaaagttactgcagaacaatt

SEQ ID NO: 1335710 - DNA, 22 bp, Artificial Sequence
  chemically synthesized
tccaaagttactgcagaacaat

SEQ ID NO: 1335711 - DNA, 22 bp, Artificial Sequence
  chemically synthesized
ttctgcagtaactttggaaagg

SEQ ID NO: 1335712 - DNA, 22 bp, Artificial Sequence
  chemically synthesized
aataaaagtacacctttccaaa

SEQ ID NO: 1335713 - DNA, 22 bp, Artificial Sequence
  chemically synthesized
gaataaaagtacacctttccaa

SEQ ID NO: 1335714 - DNA, 22 bp, Artificial Sequence
  chemically synthesized
tgcagtaactttggaaaggtgt

SEQ ID NO: 1335715 - DNA, 22 bp, Artificial Sequence
  chemically synthesized
cagtaactttggaaaggtgtac

SEQ ID NO: 1335716 - DNA, 22 bp, Artificial Sequence
  chemically synthesized
tggaaaggtgtacttttattca

SEQ ID NO: 1335717 - DNA, 22 bp, Artificial Sequence
  chemically synthesized
ggaaaggtgtacttttattcaa

SEQ ID NO: 1335718 - DNA, 22 bp, Artificial Sequence
  chemically synthesized
gaaaggtgtacttttattcaaa

SEQ ID NO: 1335719 - DNA, 22 bp, Artificial Sequence
  chemically synthesized
ttattcaaaccgtgctatgatt

SEQ ID NO: 1335720 - DNA, 22 bp, Artificial Sequence
  chemically synthesized
tattcaaaccgtgctatgattt

SEQ ID NO: 1335721 - DNA, 22 bp, Artificial Sequence
  chemically synthesized
ggagagaagccaaaatcatagc

SEQ ID NO: 1335722 - DNA, 22 bp, Artificial Sequence
  chemically synthesized
attcaaaccgtgctatgatttt

SEQ ID NO: 1335723 - DNA, 22 bp, Artificial Sequence
  chemically synthesized
ttcaaaccgtgctatgattttg

SEQ ID NO: 1335724 - DNA, 22 bp, Artificial Sequence
  chemically synthesized
cctaggagagaagccaaaatca

SEQ ID NO: 1335725 - DNA, 22 bp, Artificial Sequence
  chemically synthesized
aaaccgtgctatgattttggct

SEQ ID NO: 1335726 - DNA, 22 bp, Artificial Sequence
  chemically synthesized
ctccctaggagagaagccaaaa

SEQ ID NO: 1335727 - DNA, 22 bp, Artificial Sequence
  chemically synthesized
tgattttggcttctctcctagg

SEQ ID NO: 1335728 - DNA, 22 bp, Artificial Sequence
  chemically synthesized
aaatgaaagttcctccctagga

SEQ ID NO: 1335729 - DNA, 22 bp, Artificial Sequence
  chemically synthesized
tggcttctctcctagggaggaa

SEQ ID NO: 1335730 - DNA, 22 bp, Artificial Sequence
  chemically synthesized
ctgaaatgaaagttcctcccta

SEQ ID NO: 1335731 - DNA, 22 bp, Artificial Sequence
  chemically synthesized
ggcttctctcctagggaggaac

SEQ ID NO: 1335732 - DNA, 22 bp, Artificial Sequence
  chemically synthesized
gcttctctcctagggaggaact

SEQ ID NO: 1335733 - DNA, 22 bp, Artificial Sequence
  chemically synthesized
gttactgaaatgaaagttcctc

SEQ ID NO: 1335734 - DNA, 22 bp, Artificial Sequence
  chemically synthesized
agttactgaaatgaaagttcct

SEQ ID NO: 1335735 - DNA, 22 bp, Artificial Sequence
  chemically synthesized
ctctcctagggaggaactttca

SEQ ID NO: 1335736 - DNA, 22 bp, Artificial Sequence
  chemically synthesized
tctcctagggaggaactttcat

SEQ ID NO: 1335737 - DNA, 22 bp, Artificial Sequence
  chemically synthesized
tcctagggaggaactttcattt

SEQ ID NO: 1335738 - DNA, 22 bp, Artificial Sequence
  chemically synthesized
ctagggaggaactttcatttca

SEQ ID NO: 1335739 - DNA, 22 bp, Artificial Sequence
  chemically synthesized
atgaacttagttactgaaatga

SEQ ID NO: 1335740 - DNA, 22 bp, Artificial Sequence
  chemically synthesized
gggaggaactttcatttcagta

SEQ ID NO: 1335741 - DNA, 22 bp, Artificial Sequence
  chemically synthesized
catgaacttagttactgaaatg

SEQ ID NO: 1335742 - DNA, 22 bp, Artificial Sequence
  chemically synthesized
tcatgaacttagttactgaaat

SEQ ID NO: 1335743 - DNA, 22 bp, Artificial Sequence
  chemically synthesized
ttcatgaacttagttactgaaa

SEQ ID NO: 1335744 - DNA, 22 bp, Artificial Sequence
  chemically synthesized
gcttttcatgaacttagttact

SEQ ID NO: 1335745 - DNA, 22 bp, Artificial Sequence
  chemically synthesized
ggcttttcatgaacttagttac

SEQ ID NO: 1335746 - DNA, 22 bp, Artificial Sequence
  chemically synthesized
tcatttcagtaactaagttcat

SEQ ID NO: 1335747 - DNA, 22 bp, Artificial Sequence
  chemically synthesized
catttcagtaactaagttcatg

SEQ ID NO: 1335748 - DNA, 22 bp, Artificial Sequence
  chemically synthesized
atttcagtaactaagttcatga

SEQ ID NO: 1335749 - DNA, 22 bp, Artificial Sequence
  chemically synthesized
cagtaactaagttcatgaaaag

SEQ ID NO: 1335750 - DNA, 22 bp, Artificial Sequence
  chemically synthesized
caaagagtttggcttttcatga

SEQ ID NO: 1335751 - DNA, 22 bp, Artificial Sequence
  chemically synthesized
agtaactaagttcatgaaaagc

SEQ ID NO: 1335752 - DNA, 22 bp, Artificial Sequence
  chemically synthesized
aagagctgcaaagagtttggct

SEQ ID NO: 1335753 - DNA, 22 bp, Artificial Sequence
  chemically synthesized
agttcatgaaaagccaaactct

SEQ ID NO: 1335754 - DNA, 22 bp, Artificial Sequence
  chemically synthesized
atgaaaagccaaactctttgca

SEQ ID NO: 1335755 - DNA, 22 bp, Artificial Sequence
  chemically synthesized
ccagctgaagagctgcaaagag

SEQ ID NO: 1335756 - DNA, 22 bp, Artificial Sequence
  chemically synthesized
gaaaaaatgctgccagctgaag

SEQ ID NO: 1335757 - DNA, 22 bp, Artificial Sequence
  chemically synthesized
tttgcagctcttcagctggcag

SEQ ID NO: 1335758 - DNA, 22 bp, Artificial Sequence
  chemically synthesized
tgcagctcttcagctggcagca

SEQ ID NO: 1335759 - DNA, 22 bp, Artificial Sequence
  chemically synthesized
gcagctcttcagctggcagcat

SEQ ID NO: 1335760 - DNA, 22 bp, Artificial Sequence
  chemically synthesized
cagctcttcagctggcagcatt

SEQ ID NO: 1335761 - DNA, 22 bp, Artificial Sequence
  chemically synthesized
tagaaactggaaaaaatgctgc

SEQ ID NO: 1335762 - DNA, 22 bp, Artificial Sequence
  chemically synthesized
ttcagctggcagcattttttcc

SEQ ID NO: 1335763 - DNA, 22 bp, Artificial Sequence
  chemically synthesized
cagctggcagcattttttccag

SEQ ID NO: 1335764 - DNA, 22 bp, Artificial Sequence
  chemically synthesized
agctggcagcattttttccagt

SEQ ID NO: 1335765 - DNA, 22 bp, Artificial Sequence
  chemically synthesized
gcagcattttttccagtttcta

SEQ ID NO: 1335766 - DNA, 22 bp, Artificial Sequence
  chemically synthesized
tttccagtttctacaatctcat

SEQ ID NO: 1335767 - DNA, 22 bp, Artificial Sequence
  chemically synthesized
ttccagtttctacaatctcatc

SEQ ID NO: 1335768 - DNA, 22 bp, Artificial Sequence
  chemically synthesized
tccagtttctacaatctcatca

SEQ ID NO: 1335769 - DNA, 22 bp, Artificial Sequence
  chemically synthesized
ccagtttctacaatctcatcac

SEQ ID NO: 1335770 - DNA, 22 bp, Artificial Sequence
  chemically synthesized
cagtttctacaatctcatcact

SEQ ID NO: 1335771 - DNA, 22 bp, Artificial Sequence
  chemically synthesized
ctacaatctcatcactgtggtg

SEQ ID NO: 1335772 - DNA, 22 bp, Artificial Sequence
  chemically synthesized
tacaatctcatcactgtggtgt

SEQ ID NO: 1335773 - DNA, 22 bp, Artificial Sequence
  chemically synthesized
agtaaacagacacacaccacag

SEQ ID NO: 1335774 - DNA, 22 bp, Artificial Sequence
  chemically synthesized
caatctcatcactgtggtgtgt

SEQ ID NO: 1335775 - DNA, 22 bp, Artificial Sequence
  chemically synthesized
atcactgtggtgtgtgtctgtt

SEQ ID NO: 1335776 - DNA, 22 bp, Artificial Sequence
  chemically synthesized
aaatcgttaagtaaacagacac

SEQ ID NO: 1335777 - DNA, 22 bp, Artificial Sequence
  chemically synthesized
aaaatcgttaagtaaacagaca

SEQ ID NO: 1335778 - DNA, 22 bp, Artificial Sequence
  chemically synthesized
tggtgtgtgtctgtttacttaa

SEQ ID NO: 1335779 - DNA, 22 bp, Artificial Sequence
  chemically synthesized
tgcttaaaatcgttaagtaaac

SEQ ID NO: 1335780 - DNA, 22 bp, Artificial Sequence
  chemically synthesized
tttacttaacgattttaagcac

SEQ ID NO: 1335781 - DNA, 22 bp, Artificial Sequence
  chemically synthesized
acttaacgattttaagcacaat

SEQ ID NO: 1335782 - DNA, 22 bp, Artificial Sequence
  chemically synthesized
cttaacgattttaagcacaatt

SEQ ID NO: 1335783 - DNA, 22 bp, Artificial Sequence
  chemically synthesized
aacgattttaagcacaattctt

SEQ ID NO: 1335784 - DNA, 22 bp, Artificial Sequence
  chemically synthesized
acgattttaagcacaattcttc

SEQ ID NO: 1335785 - DNA, 22 bp, Artificial Sequence
  chemically synthesized
taagcacaattcttcatgaccc

SEQ ID NO: 1335786 - DNA, 22 bp, Artificial Sequence
  chemically synthesized
aagcacaattcttcatgaccca

SEQ ID NO: 1335787 - DNA, 22 bp, Artificial Sequence
  chemically synthesized
agcacaattcttcatgacccat

SEQ ID NO: 1335788 - DNA, 22 bp, Artificial Sequence
  chemically synthesized
ttcatgacccatttatttttgg

SEQ ID NO: 1335789 - DNA, 22 bp, Artificial Sequence
  chemically synthesized
catgacccatttatttttggat

SEQ ID NO: 1335790 - DNA, 22 bp, Artificial Sequence
  chemically synthesized
atgacccatttatttttggata

SEQ ID NO: 1335791 - DNA, 22 bp, Artificial Sequence
  chemically synthesized
atttttggatactgttctttta

SEQ ID NO: 1335792 - DNA, 22 bp, Artificial Sequence
  chemically synthesized
tttttggatactgttcttttat

SEQ ID NO: 1335793 - DNA, 22 bp, Artificial Sequence
  chemically synthesized
ttggatactgttcttttatttt

SEQ ID NO: 1335794 - DNA, 22 bp, Artificial Sequence
  chemically synthesized
tggatactgttcttttattttg

SEQ ID NO: 1335795 - DNA, 22 bp, Artificial Sequence
  chemically synthesized
ggatactgttcttttattttga

SEQ ID NO: 1335796 - DNA, 22 bp, Artificial Sequence
  chemically synthesized
gatactgttcttttattttgat

SEQ ID NO: 1335797 - DNA, 22 bp, Artificial Sequence
  chemically synthesized
tgggaaagatatgcaatcaaaa

SEQ ID NO: 1335798 - DNA, 22 bp, Artificial Sequence
  chemically synthesized
ttcttttattttgattgcatat

SEQ ID NO: 1335799 - DNA, 22 bp, Artificial Sequence
  chemically synthesized
ttttattttgattgcatatctt

SEQ ID NO: 1335800 - DNA, 22 bp, Artificial Sequence
  chemically synthesized
taaccctatgggaaagatatgc

SEQ ID NO: 1335801 - DNA, 22 bp, Artificial Sequence
  chemically synthesized
ttattttgattgcatatctttc

SEQ ID NO: 1335802 - DNA, 22 bp, Artificial Sequence
  chemically synthesized
tattttgattgcatatctttcc

SEQ ID NO: 1335803 - DNA, 22 bp, Artificial Sequence
  chemically synthesized
attttgattgcatatctttccc

SEQ ID NO: 1335804 - DNA, 22 bp, Artificial Sequence
  chemically synthesized
ctgtaaccctatgggaaagata

SEQ ID NO: 1335805 - DNA, 22 bp, Artificial Sequence
  chemically synthesized
ttttgattgcatatctttccca

SEQ ID NO: 1335806 - DNA, 22 bp, Artificial Sequence
  chemically synthesized
gctgtaaccctatgggaaagat

SEQ ID NO: 1335807 - DNA, 22 bp, Artificial Sequence
  chemically synthesized
tgattgcatatctttcccatag

SEQ ID NO: 1335808 - DNA, 22 bp, Artificial Sequence
  chemically synthesized
gattgcatatctttcccatagg

SEQ ID NO: 1335809 - DNA, 22 bp, Artificial Sequence
  chemically synthesized
attgcatatctttcccataggg

SEQ ID NO: 1335810 - DNA, 22 bp, Artificial Sequence
  chemically synthesized
aaacttgctgtaaccctatggg

SEQ ID NO: 1335811 - DNA, 22 bp, Artificial Sequence
  chemically synthesized
caaacttgctgtaaccctatgg

SEQ ID NO: 1335812 - DNA, 22 bp, Artificial Sequence
  chemically synthesized
catatctttcccatagggttac

SEQ ID NO: 1335813 - DNA, 22 bp, Artificial Sequence
  chemically synthesized
cttcaaacttgctgtaacccta

SEQ ID NO: 1335814 - DNA, 22 bp, Artificial Sequence
  chemically synthesized
ccttcaaacttgctgtaaccct

SEQ ID NO: 1335815 - DNA, 22 bp, Artificial Sequence
  chemically synthesized
tccttcaaacttgctgtaaccc

SEQ ID NO: 1335816 - DNA, 22 bp, Artificial Sequence
  chemically synthesized
attttccttcaaacttgctgta

SEQ ID NO: 1335817 - DNA, 22 bp, Artificial Sequence
  chemically synthesized
tcccatagggttacagcaagtt

SEQ ID NO: 1335818 - DNA, 22 bp, Artificial Sequence
  chemically synthesized
gattttccttcaaacttgctgt

SEQ ID NO: 1335819 - DNA, 22 bp, Artificial Sequence
  chemically synthesized
cccatagggttacagcaagttt

SEQ ID NO: 1335820 - DNA, 22 bp, Artificial Sequence
  chemically synthesized
ccatagggttacagcaagtttg

SEQ ID NO: 1335821 - DNA, 22 bp, Artificial Sequence
  chemically synthesized
tttgattttccttcaaacttgc

SEQ ID NO: 1335822 - DNA, 22 bp, Artificial Sequence
  chemically synthesized
ttgtttgattttccttcaaact

SEQ ID NO: 1335823 - DNA, 22 bp, Artificial Sequence
  chemically synthesized
attgtttgattttccttcaaac

SEQ ID NO: 1335824 - DNA, 22 bp, Artificial Sequence
  chemically synthesized
tattgtttgattttccttcaaa

SEQ ID NO: 1335825 - DNA, 22 bp, Artificial Sequence
  chemically synthesized
cagcaagtttgaaggaaaatca

SEQ ID NO: 1335826 - DNA, 22 bp, Artificial Sequence
  chemically synthesized
agtgagtgttttattgtttgat

SEQ ID NO: 1335827 - DNA, 22 bp, Artificial Sequence
  chemically synthesized
gaaggaaaatcaaacaataaaa

SEQ ID NO: 1335828 - DNA, 22 bp, Artificial Sequence
  chemically synthesized
aaggaaaatcaaacaataaaac

SEQ ID NO: 1335829 - DNA, 22 bp, Artificial Sequence
  chemically synthesized
tgatattgagtgagtgttttat

SEQ ID NO: 1335830 - DNA, 22 bp, Artificial Sequence
  chemically synthesized
aaagcaaatacccctatgatat

SEQ ID NO: 1335831 - DNA, 22 bp, Artificial Sequence
  chemically synthesized
gaaagcaaatacccctatgata

SEQ ID NO: 1335832 - DNA, 22 bp, Artificial Sequence
  chemically synthesized
tgaaagcaaatacccctatgat

SEQ ID NO: 1335833 - DNA, 22 bp, Artificial Sequence
  chemically synthesized
ttgaaagcaaatacccctatga

SEQ ID NO: 1335834 - DNA, 22 bp, Artificial Sequence
  chemically synthesized
actcaatatcataggggtattt

SEQ ID NO: 1335835 - DNA, 22 bp, Artificial Sequence
  chemically synthesized
acttttgaaagcaaatacccct

SEQ ID NO: 1335836 - DNA, 22 bp, Artificial Sequence
  chemically synthesized
gacttttgaaagcaaatacccc

SEQ ID NO: 1335837 - DNA, 22 bp, Artificial Sequence
  chemically synthesized
aatatcataggggtatttgctt

SEQ ID NO: 1335838 - DNA, 22 bp, Artificial Sequence
  chemically synthesized
tttgacttttgaaagcaaatac

SEQ ID NO: 1335839 - DNA, 22 bp, Artificial Sequence
  chemically synthesized
tgtttgacttttgaaagcaaat

SEQ ID NO: 1335840 - DNA, 22 bp, Artificial Sequence
  chemically synthesized
attctgtttgacttttgaaagc

SEQ ID NO: 1335841 - DNA, 22 bp, Artificial Sequence
  chemically synthesized
cattctgtttgacttttgaaag

SEQ ID NO: 1335842 - DNA, 22 bp, Artificial Sequence
  chemically synthesized
tcattctgtttgacttttgaaa

SEQ ID NO: 1335843 - DNA, 22 bp, Artificial Sequence
  chemically synthesized
gctttcaaaagtcaaacagaat

SEQ ID NO: 1335844 - DNA, 22 bp, Artificial Sequence
  chemically synthesized
ctttcaaaagtcaaacagaatg

SEQ ID NO: 1335845 - DNA, 22 bp, Artificial Sequence
  chemically synthesized
tcaaaagtcaaacagaatgaaa

SEQ ID NO: 1335846 - DNA, 22 bp, Artificial Sequence
  chemically synthesized
caaaagtcaaacagaatgaaaa

SEQ ID NO: 1335847 - DNA, 22 bp, Artificial Sequence
  chemically synthesized
aaaagtcaaacagaatgaaaat

SEQ ID NO: 1335848 - DNA, 22 bp, Artificial Sequence
  chemically synthesized
aaataaccaaccagatagattt

SEQ ID NO: 1335849 - DNA, 22 bp, Artificial Sequence
  chemically synthesized
atcatctaaaataaccaaccag

SEQ ID NO: 1335850 - DNA, 22 bp, Artificial Sequence
  chemically synthesized
acactaatcatctaaaataacc

SEQ ID NO: 1335851 - DNA, 22 bp, Artificial Sequence
  chemically synthesized
tctggttggttattttagatga

SEQ ID NO: 1335852 - DNA, 22 bp, Artificial Sequence
  chemically synthesized
gttggttattttagatgattag

SEQ ID NO: 1335853 - DNA, 22 bp, Artificial Sequence
  chemically synthesized
gttattttagatgattagtgtt

SEQ ID NO: 1335854 - DNA, 22 bp, Artificial Sequence
  chemically synthesized
ttttagatgattagtgttaatt

SEQ ID NO: 1335855 - DNA, 22 bp, Artificial Sequence
  chemically synthesized
tagatgattagtgttaattttt

SEQ ID NO: 1335856 - DNA, 22 bp, Artificial Sequence
  chemically synthesized
gtcatcaggtgcaaaaattaac

SEQ ID NO: 1335857 - DNA, 22 bp, Artificial Sequence
  chemically synthesized
agatgattagtgttaatttttg

SEQ ID NO: 1335858 - DNA, 22 bp, Artificial Sequence
  chemically synthesized
ggtcatcaggtgcaaaaattaa

SEQ ID NO: 1335859 - DNA, 22 bp, Artificial Sequence
  chemically synthesized
gatgattagtgttaatttttgc

SEQ ID NO: 1335860 - DNA, 22 bp, Artificial Sequence
  chemically synthesized
tggtcatcaggtgcaaaaatta

SEQ ID NO: 1335861 - DNA, 22 bp, Artificial Sequence
  chemically synthesized
ttggtcatcaggtgcaaaaatt

SEQ ID NO: 1335862 - DNA, 22 bp, Artificial Sequence
  chemically synthesized
gtgttaatttttgcacctgatg

SEQ ID NO: 1335863 - DNA, 22 bp, Artificial Sequence
  chemically synthesized
aaatgatttttggtcatcaggt

SEQ ID NO: 1335864 - DNA, 22 bp, Artificial Sequence
  chemically synthesized
taaaatgatttttggtcatcag

SEQ ID NO: 1335865 - DNA, 22 bp, Artificial Sequence
  chemically synthesized
atttttgcacctgatgaccaaa

SEQ ID NO: 1335866 - DNA, 22 bp, Artificial Sequence
  chemically synthesized
ttgcacctgatgaccaaaaatc

SEQ ID NO: 1335867 - DNA, 22 bp, Artificial Sequence
  chemically synthesized
tgcacctgatgaccaaaaatca

SEQ ID NO: 1335868 - DNA, 22 bp, Artificial Sequence
  chemically synthesized
gcacctgatgaccaaaaatcat

SEQ ID NO: 1335869 - DNA, 22 bp, Artificial Sequence
  chemically synthesized
cacctgatgaccaaaaatcatt

SEQ ID NO: 1335870 - DNA, 22 bp, Artificial Sequence
  chemically synthesized
tatcaaattctaaaatgatttt

SEQ ID NO: 1335871 - DNA, 22 bp, Artificial Sequence
  chemically synthesized
atatcaaattctaaaatgattt

SEQ ID NO: 1335872 - DNA, 22 bp, Artificial Sequence
  chemically synthesized
cttatatcaaattctaaaatga

SEQ ID NO: 1335873 - DNA, 22 bp, Artificial Sequence
  chemically synthesized
atgaccaaaaatcattttagaa

SEQ ID NO: 1335874 - DNA, 22 bp, Artificial Sequence
  chemically synthesized
tgcaaaagttccttatatcaaa

SEQ ID NO: 1335875 - DNA, 22 bp, Artificial Sequence
  chemically synthesized
tagaatttgatataaggaactt

SEQ ID NO: 1335876 - DNA, 22 bp, Artificial Sequence
  chemically synthesized
agaatttgatataaggaacttt

SEQ ID NO: 1335877 - DNA, 22 bp, Artificial Sequence
  chemically synthesized
gaatttgatataaggaactttt

SEQ ID NO: 1335878 - DNA, 22 bp, Artificial Sequence
  chemically synthesized
taagatgtctgtgcaaaagttc

SEQ ID NO: 1335879 - DNA, 22 bp, Artificial Sequence
  chemically synthesized
gatataaggaacttttgcacag

SEQ ID NO: 1335880 - DNA, 22 bp, Artificial Sequence
  chemically synthesized
atataaggaacttttgcacaga

SEQ ID NO: 1335881 - DNA, 22 bp, Artificial Sequence
  chemically synthesized
catgttgtaagatgtctgtgca

SEQ ID NO: 1335882 - DNA, 22 bp, Artificial Sequence
  chemically synthesized
gagatattccatgttgtaagat

SEQ ID NO: 1335883 - DNA, 22 bp, Artificial Sequence
  chemically synthesized
agagatattccatgttgtaaga

SEQ ID NO: 1335884 - DNA, 22 bp, Artificial Sequence
  chemically synthesized
ttgcacagacatcttacaacat

SEQ ID NO: 1335885 - DNA, 22 bp, Artificial Sequence
  chemically synthesized
tgcacagacatcttacaacatg

SEQ ID NO: 1335886 - DNA, 22 bp, Artificial Sequence
  chemically synthesized
gcacagacatcttacaacatgg

SEQ ID NO: 1335887 - DNA, 22 bp, Artificial Sequence
  chemically synthesized
cacagacatcttacaacatgga

SEQ ID NO: 1335888 - DNA, 22 bp, Artificial Sequence
  chemically synthesized
acacttagagatattccatgtt

SEQ ID NO: 1335889 - DNA, 22 bp, Artificial Sequence
  chemically synthesized
aacacttagagatattccatgt

SEQ ID NO: 1335890 - DNA, 22 bp, Artificial Sequence
  chemically synthesized
acaacatggaatatctctaagt

SEQ ID NO: 1335891 - DNA, 22 bp, Artificial Sequence
  chemically synthesized
caacatggaatatctctaagtg

SEQ ID NO: 1335892 - DNA, 22 bp, Artificial Sequence
  chemically synthesized
tgtaaaacttaacacttagaga

SEQ ID NO: 1335893 - DNA, 22 bp, Artificial Sequence
  chemically synthesized
atgtaaaacttaacacttagag

SEQ ID NO: 1335894 - DNA, 22 bp, Artificial Sequence
  chemically synthesized
atgtttatgtaaaacttaacac

SEQ ID NO: 1335895 - DNA, 22 bp, Artificial Sequence
  chemically synthesized
taagtgttaagttttacataaa

SEQ ID NO: 1335896 - DNA, 22 bp, Artificial Sequence
  chemically synthesized
cagatgttcatgtttatgtaaa

SEQ ID NO: 1335897 - DNA, 22 bp, Artificial Sequence
  chemically synthesized
ccagatgttcatgtttatgtaa

SEQ ID NO: 1335898 - DNA, 22 bp, Artificial Sequence
  chemically synthesized
agtgttaagttttacataaaca

SEQ ID NO: 1335899 - DNA, 22 bp, Artificial Sequence
  chemically synthesized
ttccagatgttcatgtttatgt

SEQ ID NO: 1335900 - DNA, 22 bp, Artificial Sequence
  chemically synthesized
agttttacataaacatgaacat

SEQ ID NO: 1335901 - DNA, 22 bp, Artificial Sequence
  chemically synthesized
aagttcttccagatgttcatgt

SEQ ID NO: 1335902 - DNA, 22 bp, Artificial Sequence
  chemically synthesized
gctcaagttcttccagatgttc

SEQ ID NO: 1335903 - DNA, 22 bp, Artificial Sequence
  chemically synthesized
tacataaacatgaacatctgga

SEQ ID NO: 1335904 - DNA, 22 bp, Artificial Sequence
  chemically synthesized
acataaacatgaacatctggaa

SEQ ID NO: 1335905 - DNA, 22 bp, Artificial Sequence
  chemically synthesized
cataaacatgaacatctggaag

SEQ ID NO: 1335906 - DNA, 22 bp, Artificial Sequence
  chemically synthesized
ccaagttggctcaagttcttcc

SEQ ID NO: 1335907 - DNA, 22 bp, Artificial Sequence
  chemically synthesized
gaagaacttgagccaacttggg

SEQ ID NO: 1335908 - DNA, 22 bp, Artificial Sequence
  chemically synthesized
ggtaaaataatagctcccaagt

SEQ ID NO: 1335909 - DNA, 22 bp, Artificial Sequence
  chemically synthesized
gagccaacttgggagctattat

SEQ ID NO: 1335910 - DNA, 22 bp, Artificial Sequence
  chemically synthesized
agccaacttgggagctattatt

SEQ ID NO: 1335911 - DNA, 22 bp, Artificial Sequence
  chemically synthesized
atgaaggaggctgggtaaaata

SEQ ID NO: 1335912 - DNA, 22 bp, Artificial Sequence
  chemically synthesized
gatgaaggaggctgggtaaaat

SEQ ID NO: 1335913 - DNA, 22 bp, Artificial Sequence
  chemically synthesized
gggagctattattttacccagc

SEQ ID NO: 1335914 - DNA, 22 bp, Artificial Sequence
  chemically synthesized
ggagctattattttacccagcc

SEQ ID NO: 1335915 - DNA, 22 bp, Artificial Sequence
  chemically synthesized
tttgatgaaggaggctgggtaa

SEQ ID NO: 1335916 - DNA, 22 bp, Artificial Sequence
  chemically synthesized
tgtttgatgaaggaggctgggt

SEQ ID NO: 1335917 - DNA, 22 bp, Artificial Sequence
  chemically synthesized
ttattttacccagcctccttca

SEQ ID NO: 1335918 - DNA, 22 bp, Artificial Sequence
  chemically synthesized
agctctgtttgatgaaggaggc

SEQ ID NO: 1335919 - DNA, 22 bp, Artificial Sequence
  chemically synthesized
tgagctctgtttgatgaaggag

SEQ ID NO: 1335920 - DNA, 22 bp, Artificial Sequence
  chemically synthesized
ttttacccagcctccttcatca

SEQ ID NO: 1335921 - DNA, 22 bp, Artificial Sequence
  chemically synthesized
tacccagcctccttcatcaaac

SEQ ID NO: 1335922 - DNA, 22 bp, Artificial Sequence
  chemically synthesized
acccagcctccttcatcaaaca

SEQ ID NO: 1335923 - DNA, 22 bp, Artificial Sequence
  chemically synthesized
cccagcctccttcatcaaacag

SEQ ID NO: 1335924 - DNA, 22 bp, Artificial Sequence
  chemically synthesized
acggaggggagttctgagctct

SEQ ID NO: 1335925 - DNA, 22 bp, Artificial Sequence
  chemically synthesized
cttcatcaaacagagctcagaa

SEQ ID NO: 1335926 - DNA, 22 bp, Artificial Sequence
  chemically synthesized
catcaaacagagctcagaactc

SEQ ID NO: 1335927 - DNA, 22 bp, Artificial Sequence
  chemically synthesized
atcaaacagagctcagaactcc

SEQ ID NO: 1335928 - DNA, 22 bp, Artificial Sequence
  chemically synthesized
aagctaacggaggggagttctg

SEQ ID NO: 1335929 - DNA, 22 bp, Artificial Sequence
  chemically synthesized
aaagctaacggaggggagttct

SEQ ID NO: 1335930 - DNA, 22 bp, Artificial Sequence
  chemically synthesized
agaaaagcttaaagctaacgga

SEQ ID NO: 1335931 - DNA, 22 bp, Artificial Sequence
  chemically synthesized
agaactcccctccgttagcttt

SEQ ID NO: 1335932 - DNA, 22 bp, Artificial Sequence
  chemically synthesized
attgagaaaagcttaaagctaa

SEQ ID NO: 1335933 - DNA, 22 bp, Artificial Sequence
  chemically synthesized
ccctccgttagctttaagcttt

SEQ ID NO: 1335934 - DNA, 22 bp, Artificial Sequence
  chemically synthesized
agttcattgagaaaagcttaaa

SEQ ID NO: 1335935 - DNA, 22 bp, Artificial Sequence
  chemically synthesized
ctcagttcattgagaaaagctt

SEQ ID NO: 1335936 - DNA, 22 bp, Artificial Sequence
  chemically synthesized
cgttagctttaagcttttctca

SEQ ID NO: 1335937 - DNA, 22 bp, Artificial Sequence
  chemically synthesized
cattactcagttcattgagaaa

SEQ ID NO: 1335938 - DNA, 22 bp, Artificial Sequence
  chemically synthesized
gctttaagcttttctcaatgaa

SEQ ID NO: 1335939 - DNA, 22 bp, Artificial Sequence
  chemically synthesized
taagcttttctcaatgaactga

SEQ ID NO: 1335940 - DNA, 22 bp, Artificial Sequence
  chemically synthesized
aagcttttctcaatgaactgag

SEQ ID NO: 1335941 - DNA, 22 bp, Artificial Sequence
  chemically synthesized
aagattccattactcagttcat

SEQ ID NO: 1335942 - DNA, 22 bp, Artificial Sequence
  chemically synthesized
agcttttctcaatgaactgagt

SEQ ID NO: 1335943 - DNA, 22 bp, Artificial Sequence
  chemically synthesized
ttctcaatgaactgagtaatgg

SEQ ID NO: 1335944 - DNA, 22 bp, Artificial Sequence
  chemically synthesized
tctcaatgaactgagtaatgga

SEQ ID NO: 1335945 - DNA, 22 bp, Artificial Sequence
  chemically synthesized
ctcaatgaactgagtaatggaa

SEQ ID NO: 1335946 - DNA, 22 bp, Artificial Sequence
  chemically synthesized
tcaatgaactgagtaatggaat

SEQ ID NO: 1335947 - DNA, 22 bp, Artificial Sequence
  chemically synthesized
aatgaactgagtaatggaatct

SEQ ID NO: 1335948 - DNA, 22 bp, Artificial Sequence
  chemically synthesized
aaggtgtccctcaagattccat

SEQ ID NO: 1335949 - DNA, 22 bp, Artificial Sequence
  chemically synthesized
aaaggtgtccctcaagattcca

SEQ ID NO: 1335950 - DNA, 22 bp, Artificial Sequence
  chemically synthesized
gatttaaaggtgtccctcaaga

SEQ ID NO: 1335951 - DNA, 22 bp, Artificial Sequence
  chemically synthesized
agtaatggaatcttgagggaca

SEQ ID NO: 1335952 - DNA, 22 bp, Artificial Sequence
  chemically synthesized
ctggatttaaaggtgtccctca

SEQ ID NO: 1335953 - DNA, 22 bp, Artificial Sequence
  chemically synthesized
ctgctggatttaaaggtgtccc

SEQ ID NO: 1335954 - DNA, 22 bp, Artificial Sequence
  chemically synthesized
tactgctggatttaaaggtgtc

SEQ ID NO: 1335955 - DNA, 22 bp, Artificial Sequence
  chemically synthesized
ctactgctggatttaaaggtgt

SEQ ID NO: 1335956 - DNA, 22 bp, Artificial Sequence
  chemically synthesized
cttctactgctggatttaaagg

SEQ ID NO: 1335957 - DNA, 22 bp, Artificial Sequence
  chemically synthesized
gcttctactgctggatttaaag

SEQ ID NO: 1335958 - DNA, 22 bp, Artificial Sequence
  chemically synthesized
tgcttctactgctggatttaaa

SEQ ID NO: 1335959 - DNA, 22 bp, Artificial Sequence
  chemically synthesized
ttgcttctactgctggatttaa

SEQ ID NO: 1335960 - DNA, 22 bp, Artificial Sequence
  chemically synthesized
gagggacacctttaaatccagc

SEQ ID NO: 1335961 - DNA, 22 bp, Artificial Sequence
  chemically synthesized
agggacacctttaaatccagca

SEQ ID NO: 1335962 - DNA, 22 bp, Artificial Sequence
  chemically synthesized
taaatccagcagtagaagcaaa

SEQ ID NO: 1335963 - DNA, 22 bp, Artificial Sequence
  chemically synthesized
aaatccagcagtagaagcaaaa

SEQ ID NO: 1335964 - DNA, 22 bp, Artificial Sequence
  chemically synthesized
aatccagcagtagaagcaaaaa

SEQ ID NO: 1335965 - DNA, 22 bp, Artificial Sequence
  chemically synthesized
tcagtggggaaggtttttgctt

SEQ ID NO: 1335966 - DNA, 22 bp, Artificial Sequence
  chemically synthesized
atcagtggggaaggtttttgct

SEQ ID NO: 1335967 - DNA, 22 bp, Artificial Sequence
  chemically synthesized
cttatcagtggggaaggttttt

SEQ ID NO: 1335968 - DNA, 22 bp, Artificial Sequence
  chemically synthesized
gcttatcagtggggaaggtttt

SEQ ID NO: 1335969 - DNA, 22 bp, Artificial Sequence
  chemically synthesized
tgcttatcagtggggaaggttt

SEQ ID NO: 1335970 - DNA, 22 bp, Artificial Sequence
  chemically synthesized
ttgcttatcagtggggaaggtt

SEQ ID NO: 1335971 - DNA, 22 bp, Artificial Sequence
  chemically synthesized
ttttgcttatcagtggggaagg

SEQ ID NO: 1335972 - DNA, 22 bp, Artificial Sequence
  chemically synthesized
ccagaaatattcttttgcttat

SEQ ID NO: 1335973 - DNA, 22 bp, Artificial Sequence
  chemically synthesized
ttgccagaaatattcttttgct

SEQ ID NO: 1335974 - DNA, 22 bp, Artificial Sequence
  chemically synthesized
ccccactgataagcaaaagaat

SEQ ID NO: 1335975 - DNA, 22 bp, Artificial Sequence
  chemically synthesized
gttgccagaaatattcttttgc

SEQ ID NO: 1335976 - DNA, 22 bp, Artificial Sequence
  chemically synthesized
cccactgataagcaaaagaata

SEQ ID NO: 1335977 - DNA, 22 bp, Artificial Sequence
  chemically synthesized
tgttgccagaaatattcttttg

SEQ ID NO: 1335978 - DNA, 22 bp, Artificial Sequence
  chemically synthesized
ataagcaaaagaatatttctgg

SEQ ID NO: 1335979 - DNA, 22 bp, Artificial Sequence
  chemically synthesized
atgggttttgttgccagaaata

SEQ ID NO: 1335980 - DNA, 22 bp, Artificial Sequence
  chemically synthesized
tagttgatgggttttgttgcca

SEQ ID NO: 1335981 - DNA, 22 bp, Artificial Sequence
  chemically synthesized
ctggcaacaaaacccatcaact

SEQ ID NO: 1335982 - DNA, 22 bp, Artificial Sequence
  chemically synthesized
tggcaacaaaacccatcaacta

SEQ ID NO: 1335983 - DNA, 22 bp, Artificial Sequence
  chemically synthesized
gcaacaaaacccatcaactata

SEQ ID NO: 1335984 - DNA, 22 bp, Artificial Sequence
  chemically synthesized
gatatataccgcctatagttga

SEQ ID NO: 1335985 - DNA, 22 bp, Artificial Sequence
  chemically synthesized
agttagatatataccgcctata

SEQ ID NO: 1335986 - DNA, 22 bp, Artificial Sequence
  chemically synthesized
actgagttagatatataccgcc

SEQ ID NO: 1335987 - DNA, 22 bp, Artificial Sequence
  chemically synthesized
aaggctgactgagttagatata

SEQ ID NO: 1335988 - DNA, 22 bp, Artificial Sequence
  chemically synthesized
taggcggtatatatctaactca

SEQ ID NO: 1335989 - DNA, 22 bp, Artificial Sequence
  chemically synthesized
actcaaggctgactgagttaga

SEQ ID NO: 1335990 - DNA, 22 bp, Artificial Sequence
  chemically synthesized
aactcaaggctgactgagttag

SEQ ID NO: 1335991 - DNA, 22 bp, Artificial Sequence
  chemically synthesized
acgtttaactcaaggctgactg

SEQ ID NO: 1335992 - DNA, 22 bp, Artificial Sequence
  chemically synthesized
actcacgtttaactcaaggctg

SEQ ID NO: 1335993 - DNA, 22 bp, Artificial Sequence
  chemically synthesized
ctgactcacgtttaactcaagg

SEQ ID NO: 1335994 - DNA, 22 bp, Artificial Sequence
  chemically synthesized
actcagtcagccttgagttaaa

SEQ ID NO: 1335995 - DNA, 22 bp, Artificial Sequence
  chemically synthesized
agtcagccttgagttaaacgtg

SEQ ID NO: 1335996 - DNA, 22 bp, Artificial Sequence
  chemically synthesized
aggggttactgactcacgttta

SEQ ID NO: 1335997 - DNA, 22 bp, Artificial Sequence
  chemically synthesized
caggggttactgactcacgttt

SEQ ID NO: 1335998 - DNA, 22 bp, Artificial Sequence
  chemically synthesized
ccttcaggggttactgactcac

SEQ ID NO: 1335999 - DNA, 22 bp, Artificial Sequence
  chemically synthesized
gagttaaacgtgagtcagtaac

SEQ ID NO: 1336000 - DNA, 22 bp, Artificial Sequence
  chemically synthesized
ttgccttcaggggttactgact

SEQ ID NO: 1336001 - DNA, 22 bp, Artificial Sequence
  chemically synthesized
agttaaacgtgagtcagtaacc

SEQ ID NO: 1336002 - DNA, 22 bp, Artificial Sequence
  chemically synthesized
ttgttgccttcaggggttactg

SEQ ID NO: 1336003 - DNA, 22 bp, Artificial Sequence
  chemically synthesized
gttgttgccttcaggggttact

SEQ ID NO: 1336004 - DNA, 22 bp, Artificial Sequence
  chemically synthesized
tgttgttgccttcaggggttac

SEQ ID NO: 1336005 - DNA, 22 bp, Artificial Sequence
  chemically synthesized
aacgtgagtcagtaacccctga

SEQ ID NO: 1336006 - DNA, 22 bp, Artificial Sequence
  chemically synthesized
agcctttgttgttgccttcagg

SEQ ID NO: 1336007 - DNA, 22 bp, Artificial Sequence
  chemically synthesized
taagcctttgttgttgccttca

SEQ ID NO: 1336008 - DNA, 22 bp, Artificial Sequence
  chemically synthesized
actctaagcctttgttgttgcc

SEQ ID NO: 1336009 - DNA, 22 bp, Artificial Sequence
  chemically synthesized
cactctaagcctttgttgttgc

SEQ ID NO: 1336010 - DNA, 22 bp, Artificial Sequence
  chemically synthesized
tttcactctaagcctttgttgt

SEQ ID NO: 1336011 - DNA, 22 bp, Artificial Sequence
  chemically synthesized
atttcactctaagcctttgttg

SEQ ID NO: 1336012 - DNA, 22 bp, Artificial Sequence
  chemically synthesized
tatttcactctaagcctttgtt

SEQ ID NO: 1336013 - DNA, 22 bp, Artificial Sequence
  chemically synthesized
ttatttcactctaagcctttgt

SEQ ID NO: 1336014 - DNA, 22 bp, Artificial Sequence
  chemically synthesized
tttatttcactctaagcctttg

SEQ ID NO: 1336015 - DNA, 22 bp, Artificial Sequence
  chemically synthesized
ttttatttcactctaagccttt

SEQ ID NO: 1336016 - DNA, 22 bp, Artificial Sequence
  chemically synthesized
aaggcaacaacaaaggcttaga

SEQ ID NO: 1336017 - DNA, 22 bp, Artificial Sequence
  chemically synthesized
cgaacttttttatttcactcta

SEQ ID NO: 1336018 - DNA, 22 bp, Artificial Sequence
  chemically synthesized
cagtatgtctgcgaactttttt

SEQ ID NO: 1336019 - DNA, 22 bp, Artificial Sequence
  chemically synthesized
agagtgaaataaaaaagttcgc

SEQ ID NO: 1336020 - DNA, 22 bp, Artificial Sequence
  chemically synthesized
tgcagtatgtctgcgaactttt

SEQ ID NO: 1336021 - DNA, 22 bp, Artificial Sequence
  chemically synthesized
gagtgaaataaaaaagttcgca

SEQ ID NO: 1336022 - DNA, 22 bp, Artificial Sequence
  chemically synthesized
ctgcagtatgtctgcgaacttt

SEQ ID NO: 1336023 - DNA, 22 bp, Artificial Sequence
  chemically synthesized
gatcttctgcagtatgtctgcg

SEQ ID NO: 1336024 - DNA, 22 bp, Artificial Sequence
  chemically synthesized
agactggatcttctgcagtatg

SEQ ID NO: 1336025 - DNA, 22 bp, Artificial Sequence
  chemically synthesized
tgagactggatcttctgcagta

SEQ ID NO: 1336026 - DNA, 22 bp, Artificial Sequence
  chemically synthesized
tctgagactggatcttctgcag

SEQ ID NO: 1336027 - DNA, 22 bp, Artificial Sequence
  chemically synthesized
gcagacatactgcagaagatcc

SEQ ID NO: 1336028 - DNA, 22 bp, Artificial Sequence
  chemically synthesized
agcagatcattctctgagactg

SEQ ID NO: 1336029 - DNA, 22 bp, Artificial Sequence
  chemically synthesized
cagaagatccagtctcagagaa

SEQ ID NO: 1336030 - DNA, 22 bp, Artificial Sequence
  chemically synthesized
agggccaagtgttaagcagatc

SEQ ID NO: 1336031 - DNA, 22 bp, Artificial Sequence
  chemically synthesized
agagaatgatctgcttaacact

SEQ ID NO: 1336032 - DNA, 22 bp, Artificial Sequence
  chemically synthesized
agataatctcagggccaagtgt

SEQ ID NO: 1336033 - DNA, 22 bp, Artificial Sequence
  chemically synthesized
tcagataatctcagggccaagt

SEQ ID NO: 1336034 - DNA, 22 bp, Artificial Sequence
  chemically synthesized
cttaacacttggccctgagatt

SEQ ID NO: 1336035 - DNA, 22 bp, Artificial Sequence
  chemically synthesized
ggaaattctcagataatctcag

SEQ ID NO: 1336036 - DNA, 22 bp, Artificial Sequence
  chemically synthesized
aacacttggccctgagattatc

SEQ ID NO: 1336037 - DNA, 22 bp, Artificial Sequence
  chemically synthesized
aggaaattctcagataatctca

SEQ ID NO: 1336038 - DNA, 22 bp, Artificial Sequence
  chemically synthesized
acacttggccctgagattatct

SEQ ID NO: 1336039 - DNA, 22 bp, Artificial Sequence
  chemically synthesized
taggaaattctcagataatctc

SEQ ID NO: 1336040 - DNA, 22 bp, Artificial Sequence
  chemically synthesized
ggccctgagattatctgagaat

SEQ ID NO: 1336041 - DNA, 22 bp, Artificial Sequence
  chemically synthesized
gccctgagattatctgagaatt

SEQ ID NO: 1336042 - DNA, 22 bp, Artificial Sequence
  chemically synthesized
aatgttttaggaaattctcaga

SEQ ID NO: 1336043 - DNA, 22 bp, Artificial Sequence
  chemically synthesized
agattatctgagaatttcctaa

SEQ ID NO: 1336044 - DNA, 22 bp, Artificial Sequence
  chemically synthesized
tgaggtgttgaatgttttagga

SEQ ID NO: 1336045 - DNA, 22 bp, Artificial Sequence
  chemically synthesized
tctgagaatttcctaaaacatt

SEQ ID NO: 1336046 - DNA, 22 bp, Artificial Sequence
  chemically synthesized
agaatttcctaaaacattcaac

SEQ ID NO: 1336047 - DNA, 22 bp, Artificial Sequence
  chemically synthesized
tggtcactgtgaggtgttgaat

SEQ ID NO: 1336048 - DNA, 22 bp, Artificial Sequence
  chemically synthesized
cctaaaacattcaacacctcac

SEQ ID NO: 1336049 - DNA, 22 bp, Artificial Sequence
  chemically synthesized
actgtggtcactgtgaggtgtt

SEQ ID NO: 1336050 - DNA, 22 bp, Artificial Sequence
  chemically synthesized
ctaaaacattcaacacctcaca

SEQ ID NO: 1336051 - DNA, 22 bp, Artificial Sequence
  chemically synthesized
aactgtggtcactgtgaggtgt

SEQ ID NO: 1336052 - DNA, 22 bp, Artificial Sequence
  chemically synthesized
taactgtggtcactgtgaggtg

SEQ ID NO: 1336053 - DNA, 22 bp, Artificial Sequence
  chemically synthesized
ttaactgtggtcactgtgaggt

SEQ ID NO: 1336054 - DNA, 22 bp, Artificial Sequence
  chemically synthesized
aaacattcaacacctcacagtg

SEQ ID NO: 1336055 - DNA, 22 bp, Artificial Sequence
  chemically synthesized
tttttaactgtggtcactgtga

SEQ ID NO: 1336056 - DNA, 22 bp, Artificial Sequence
  chemically synthesized
aacacctcacagtgaccacagt

SEQ ID NO: 1336057 - DNA, 22 bp, Artificial Sequence
  chemically synthesized
taatacattatttttaactgtg

SEQ ID NO: 1336058 - DNA, 22 bp, Artificial Sequence
  chemically synthesized
acagtgaccacagttaaaaata

SEQ ID NO: 1336059 - DNA, 22 bp, Artificial Sequence
  chemically synthesized
aaacctataatacattattttt

SEQ ID NO: 1336060 - DNA, 22 bp, Artificial Sequence
  chemically synthesized
gaaacctataatacattatttt

SEQ ID NO: 1336061 - DNA, 22 bp, Artificial Sequence
  chemically synthesized
tgaaacctataatacattattt

SEQ ID NO: 1336062 - DNA, 22 bp, Artificial Sequence
  chemically synthesized
gcaattttgaaacctataatac

SEQ ID NO: 1336063 - DNA, 22 bp, Artificial Sequence
  chemically synthesized
agcaattttgaaacctataata

SEQ ID NO: 1336064 - DNA, 22 bp, Artificial Sequence
  chemically synthesized
tagcaattttgaaacctataat

SEQ ID NO: 1336065 - DNA, 22 bp, Artificial Sequence
  chemically synthesized
ttagcaattttgaaacctataa

SEQ ID NO: 1336066 - DNA, 22 bp, Artificial Sequence
  chemically synthesized
aaaataatgtattataggtttc

SEQ ID NO: 1336067 - DNA, 22 bp, Artificial Sequence
  chemically synthesized
ttttagcaattttgaaacctat

SEQ ID NO: 1336068 - DNA, 22 bp, Artificial Sequence
  chemically synthesized
ttcttttagcaattttgaaacc

SEQ ID NO: 1336069 - DNA, 22 bp, Artificial Sequence
  chemically synthesized
aaaaatctattcttttagcaat

SEQ ID NO: 1336070 - DNA, 22 bp, Artificial Sequence
  chemically synthesized
taggtttcaaaattgctaaaag

SEQ ID NO: 1336071 - DNA, 22 bp, Artificial Sequence
  chemically synthesized
caaaattgctaaaagaatagat

SEQ ID NO: 1336072 - DNA, 22 bp, Artificial Sequence
  chemically synthesized
aaaattgctaaaagaatagatt

SEQ ID NO: 1336073 - DNA, 22 bp, Artificial Sequence
  chemically synthesized
tagcgagaacattaaaaaatct

SEQ ID NO: 1336074 - DNA, 22 bp, Artificial Sequence
  chemically synthesized
gtagcgagaacattaaaaaatc

SEQ ID NO: 1336075 - DNA, 22 bp, Artificial Sequence
  chemically synthesized
ctaaaagaatagattttttaat

SEQ ID NO: 1336076 - DNA, 22 bp, Artificial Sequence
  chemically synthesized
tgtagcgagaacattaaaaaat

SEQ ID NO: 1336077 - DNA, 22 bp, Artificial Sequence
  chemically synthesized
ttgtagcgagaacattaaaaaa

SEQ ID NO: 1336078 - DNA, 22 bp, Artificial Sequence
  chemically synthesized
tttgtagcgagaacattaaaaa

SEQ ID NO: 1336079 - DNA, 22 bp, Artificial Sequence
  chemically synthesized
aaagaatagattttttaatgtt

SEQ ID NO: 1336080 - DNA, 22 bp, Artificial Sequence
  chemically synthesized
tcattttttgtagcgagaacat

SEQ ID NO: 1336081 - DNA, 22 bp, Artificial Sequence
  chemically synthesized
atcattttttgtagcgagaaca

SEQ ID NO: 1336082 - DNA, 22 bp, Artificial Sequence
  chemically synthesized
tttaatgttctcgctacaaaaa

SEQ ID NO: 1336083 - DNA, 22 bp, Artificial Sequence
  chemically synthesized
ttaatgttctcgctacaaaaaa

SEQ ID NO: 1336084 - DNA, 22 bp, Artificial Sequence
  chemically synthesized
accaacttatcattttttgtag

SEQ ID NO: 1336085 - DNA, 22 bp, Artificial Sequence
  chemically synthesized
taatgttctcgctacaaaaaat

SEQ ID NO: 1336086 - DNA, 22 bp, Artificial Sequence
  chemically synthesized
aatgttctcgctacaaaaaatg

SEQ ID NO: 1336087 - DNA, 22 bp, Artificial Sequence
  chemically synthesized
atgttctcgctacaaaaaatga

SEQ ID NO: 1336088 - DNA, 22 bp, Artificial Sequence
  chemically synthesized
tcacctcaccaacttatcattt

SEQ ID NO: 1336089 - DNA, 22 bp, Artificial Sequence
  chemically synthesized
tcgctacaaaaaatgataagtt

SEQ ID NO: 1336090 - DNA, 22 bp, Artificial Sequence
  chemically synthesized
gctacaaaaaatgataagttgg

SEQ ID NO: 1336091 - DNA, 22 bp, Artificial Sequence
  chemically synthesized
caaaaaatgataagttggtgag

SEQ ID NO: 1336092 - DNA, 22 bp, Artificial Sequence
  chemically synthesized
acatatctatcacctcaccaac

SEQ ID NO: 1336093 - DNA, 22 bp, Artificial Sequence
  chemically synthesized
actaacatatctatcacctcac

SEQ ID NO: 1336094 - DNA, 22 bp, Artificial Sequence
  chemically synthesized
gtgaggtgatagatatgttagt

SEQ ID NO: 1336095 - DNA, 22 bp, Artificial Sequence
  chemically synthesized
tagaaagagtcagtcgagctga

SEQ ID NO: 1336096 - DNA, 22 bp, Artificial Sequence
  chemically synthesized
gtcagctcgactgactctttct

SEQ ID NO: 1336097 - DNA, 22 bp, Artificial Sequence
  chemically synthesized
tgtgtatgttgtagaaagagtc

SEQ ID NO: 1336098 - DNA, 22 bp, Artificial Sequence
  chemically synthesized
atctatgtgtatgttgtagaaa

SEQ ID NO: 1336099 - DNA, 22 bp, Artificial Sequence
  chemically synthesized
gatctatgtgtatgttgtagaa

SEQ ID NO: 1336100 - DNA, 22 bp, Artificial Sequence
  chemically synthesized
tgatctatgtgtatgttgtaga

SEQ ID NO: 1336101 - DNA, 22 bp, Artificial Sequence
  chemically synthesized
gactgactctttctacaacata

SEQ ID NO: 1336102 - DNA, 22 bp, Artificial Sequence
  chemically synthesized
ttgatctatgtgtatgttgtag

SEQ ID NO: 1336103 - DNA, 22 bp, Artificial Sequence
  chemically synthesized
actctttctacaacatacacat

SEQ ID NO: 1336104 - DNA, 22 bp, Artificial Sequence
  chemically synthesized
tttctacaacatacacatagat

SEQ ID NO: 1336105 - DNA, 22 bp, Artificial Sequence
  chemically synthesized
tctacaacatacacatagatca

SEQ ID NO: 1336106 - DNA, 22 bp, Artificial Sequence
  chemically synthesized
ctacaacatacacatagatcaa

SEQ ID NO: 1336107 - DNA, 22 bp, Artificial Sequence
  chemically synthesized
tacaacatacacatagatcaaa

SEQ ID NO: 1336108 - DNA, 22 bp, Artificial Sequence
  chemically synthesized
caacatacacatagatcaaaaa

SEQ ID NO: 1336109 - DNA, 22 bp, Artificial Sequence
  chemically synthesized
ccgagtacaacgtgatgttttt

SEQ ID NO: 1336110 - DNA, 22 bp, Artificial Sequence
  chemically synthesized
accgagtacaacgtgatgtttt

SEQ ID NO: 1336111 - DNA, 22 bp, Artificial Sequence
  chemically synthesized
tacatatttaccgagtacaacg

SEQ ID NO: 1336112 - DNA, 22 bp, Artificial Sequence
  chemically synthesized
acaaataatagttgtacatatt

SEQ ID NO: 1336113 - DNA, 22 bp, Artificial Sequence
  chemically synthesized
tactcggtaaatatgtacaact

SEQ ID NO: 1336114 - DNA, 22 bp, Artificial Sequence
  chemically synthesized
actgacaaataatagttgtaca

SEQ ID NO: 1336115 - DNA, 22 bp, Artificial Sequence
  chemically synthesized
aactgacaaataatagttgtac

SEQ ID NO: 1336116 - DNA, 22 bp, Artificial Sequence
  chemically synthesized
taactgacaaataatagttgta

SEQ ID NO: 1336117 - DNA, 22 bp, Artificial Sequence
  chemically synthesized
ttaactgacaaataatagttgt

SEQ ID NO: 1336118 - DNA, 22 bp, Artificial Sequence
  chemically synthesized
ggtaaatatgtacaactattat

SEQ ID NO: 1336119 - DNA, 22 bp, Artificial Sequence
  chemically synthesized
tttttaactgacaaataatagt

SEQ ID NO: 1336120 - DNA, 22 bp, Artificial Sequence
  chemically synthesized
atttttaactgacaaataatag

SEQ ID NO: 1336121 - DNA, 22 bp, Artificial Sequence
  chemically synthesized
atttatttttaactgacaaata

SEQ ID NO: 1336122 - DNA, 22 bp, Artificial Sequence
  chemically synthesized
attaatttatttttaactgaca

SEQ ID NO: 1336123 - DNA, 22 bp, Artificial Sequence
  chemically synthesized
ttatttgtcagttaaaaataaa

SEQ ID NO: 1336124 - DNA, 22 bp, Artificial Sequence
  chemically synthesized
aaaattaattaatttattttta

SEQ ID NO: 1336125 - DNA, 22 bp, Artificial Sequence
  chemically synthesized
aaaaattaattaatttattttt

SEQ ID NO: 1336126 - DNA, 22 bp, Artificial Sequence
  chemically synthesized
taaaaattaattaatttatttt

SEQ ID NO: 1336127 - DNA, 22 bp, Artificial Sequence
  chemically synthesized
tttgtcagttaaaaataaatta

SEQ ID NO: 1336128 - DNA, 22 bp, Artificial Sequence
  chemically synthesized
ttaaaaattaattaatttattt

SEQ ID NO: 1336129 - DNA, 22 bp, Artificial Sequence
  chemically synthesized
tttaaaaattaattaatttatt

SEQ ID NO: 1336130 - DNA, 22 bp, Artificial Sequence
  chemically synthesized
gtcagttaaaaataaattaatt

SEQ ID NO: 1336131 - DNA, 22 bp, Artificial Sequence
  chemically synthesized
tcagttaaaaataaattaatta

SEQ ID NO: 1336132 - DNA, 22 bp, Artificial Sequence
  chemically synthesized
aagttttttaaaaattaattaa

SEQ ID NO: 1336133 - DNA, 22 bp, Artificial Sequence
  chemically synthesized
aaaataaattaattaattttta

SEQ ID NO: 1336134 - DNA, 22 bp, Artificial Sequence
  chemically synthesized
gaagtattgaagttttttaaaa

SEQ ID NO: 1336135 - DNA, 22 bp, Artificial Sequence
  chemically synthesized
ggaagtattgaagttttttaaa

SEQ ID NO: 1336136 - DNA, 22 bp, Artificial Sequence
  chemically synthesized
attaatttttaaaaaacttcaa

SEQ ID NO: 1336137 - DNA, 22 bp, Artificial Sequence
  chemically synthesized
atttttaaaaaacttcaatact

SEQ ID NO: 1336138 - DNA, 22 bp, Artificial Sequence
  chemically synthesized
ccagatcttggaagtattgaag

SEQ ID NO: 1336139 - DNA, 22 bp, Artificial Sequence
  chemically synthesized
ttcccagatcttggaagtattg

SEQ ID NO: 1336140 - DNA, 22 bp, Artificial Sequence
  chemically synthesized
ttaaaaaacttcaatacttcca

SEQ ID NO: 1336141 - DNA, 22 bp, Artificial Sequence
  chemically synthesized
taaaaaacttcaatacttccaa

SEQ ID NO: 1336142 - DNA, 22 bp, Artificial Sequence
  chemically synthesized
aaaaaacttcaatacttccaag

SEQ ID NO: 1336143 - DNA, 22 bp, Artificial Sequence
  chemically synthesized
aaaaacttcaatacttccaaga

SEQ ID NO: 1336144 - DNA, 22 bp, Artificial Sequence
  chemically synthesized
ccacgtagttgttcccagatct

SEQ ID NO: 1336145 - DNA, 22 bp, Artificial Sequence
  chemically synthesized
caatacttccaagatctgggaa

SEQ ID NO: 1336146 - DNA, 22 bp, Artificial Sequence
  chemically synthesized
accacgtagttgttcccagatc

SEQ ID NO: 1336147 - DNA, 22 bp, Artificial Sequence
  chemically synthesized
aatacttccaagatctgggaac

SEQ ID NO: 1336148 - DNA, 22 bp, Artificial Sequence
  chemically synthesized
ccaagatctgggaacaactacg

SEQ ID NO: 1336149 - DNA, 22 bp, Artificial Sequence
  chemically synthesized
atgggcttaccacgtagttgtt

SEQ ID NO: 1336150 - DNA, 22 bp, Artificial Sequence
  chemically synthesized
caagatctgggaacaactacgt

SEQ ID NO: 1336151 - DNA, 22 bp, Artificial Sequence
  chemically synthesized
taaattaatgggcttaccacgt

SEQ ID NO: 1336152 - DNA, 22 bp, Artificial Sequence
  chemically synthesized
ggaacaactacgtggtaagccc

SEQ ID NO: 1336153 - DNA, 22 bp, Artificial Sequence
  chemically synthesized
cagtcccagttataaattaatg

SEQ ID NO: 1336154 - DNA, 22 bp, Artificial Sequence
  chemically synthesized
cgtggtaagcccattaatttat

SEQ ID NO: 1336155 - DNA, 22 bp, Artificial Sequence
  chemically synthesized
acagtcccagttataaattaat

SEQ ID NO: 1336156 - DNA, 22 bp, Artificial Sequence
  chemically synthesized
gtttacagtcccagttataaat

SEQ ID NO: 1336157 - DNA, 22 bp, Artificial Sequence
  chemically synthesized
ttggtttacagtcccagttata

SEQ ID NO: 1336158 - DNA, 22 bp, Artificial Sequence
  chemically synthesized
tgttggtttacagtcccagtta

SEQ ID NO: 1336159 - DNA, 22 bp, Artificial Sequence
  chemically synthesized
gttctgttggtttacagtccca

SEQ ID NO: 1336160 - DNA, 22 bp, Artificial Sequence
  chemically synthesized
atttataactgggactgtaaac

SEQ ID NO: 1336161 - DNA, 22 bp, Artificial Sequence
  chemically synthesized
ataactgggactgtaaaccaac

SEQ ID NO: 1336162 - DNA, 22 bp, Artificial Sequence
  chemically synthesized
taactgggactgtaaaccaaca

SEQ ID NO: 1336163 - DNA, 22 bp, Artificial Sequence
  chemically synthesized
agtggaagaattcgttctgttg

SEQ ID NO: 1336164 - DNA, 22 bp, Artificial Sequence
  chemically synthesized
ggactgtaaaccaacagaacga

SEQ ID NO: 1336165 - DNA, 22 bp, Artificial Sequence
  chemically synthesized
aagtggaagaattcgttctgtt

SEQ ID NO: 1336166 - DNA, 22 bp, Artificial Sequence
  chemically synthesized
taagtggaagaattcgttctgt

SEQ ID NO: 1336167 - DNA, 22 bp, Artificial Sequence
  chemically synthesized
attttaagtggaagaattcgtt

SEQ ID NO: 1336168 - DNA, 22 bp, Artificial Sequence
  chemically synthesized
taaaccaacagaacgaattctt

SEQ ID NO: 1336169 - DNA, 22 bp, Artificial Sequence
  chemically synthesized
atcaaaggctgattttaagtgg

SEQ ID NO: 1336170 - DNA, 22 bp, Artificial Sequence
  chemically synthesized
ttccacttaaaatcagcctttg

SEQ ID NO: 1336171 - DNA, 22 bp, Artificial Sequence
  chemically synthesized
ccacttaaaatcagcctttgat

SEQ ID NO: 1336172 - DNA, 22 bp, Artificial Sequence
  chemically synthesized
cacttaaaatcagcctttgatt

SEQ ID NO: 1336173 - DNA, 22 bp, Artificial Sequence
  chemically synthesized
aaaatcagcctttgattaatgg

SEQ ID NO: 1336174 - DNA, 22 bp, Artificial Sequence
  chemically synthesized
aaatcagcctttgattaatggc

SEQ ID NO: 1336175 - DNA, 22 bp, Artificial Sequence
  chemically synthesized
tgattaatggcatacccatata

SEQ ID NO: 1336176 - DNA, 22 bp, Artificial Sequence
  chemically synthesized
gattaatggcatacccatatat

SEQ ID NO: 1336177 - DNA, 22 bp, Artificial Sequence
  chemically synthesized
attaatggcatacccatatatt

SEQ ID NO: 1336178 - DNA, 22 bp, Artificial Sequence
  chemically synthesized
atataggagacgtaatatatgg

SEQ ID NO: 1336179 - DNA, 22 bp, Artificial Sequence
  chemically synthesized
tcatataggagacgtaatatat

SEQ ID NO: 1336180 - DNA, 22 bp, Artificial Sequence
  chemically synthesized
atggcatacccatatattacgt

SEQ ID NO: 1336181 - DNA, 22 bp, Artificial Sequence
  chemically synthesized
ttctcatataggagacgtaata

SEQ ID NO: 1336182 - DNA, 22 bp, Artificial Sequence
  chemically synthesized
tatgttgttctcatataggaga

SEQ ID NO: 1336183 - DNA, 22 bp, Artificial Sequence
  chemically synthesized
cgtctcctatatgagaacaaca

SEQ ID NO: 1336184 - DNA, 22 bp, Artificial Sequence
  chemically synthesized
ctatatgagaacaacatataat

SEQ ID NO: 1336185 - DNA, 22 bp, Artificial Sequence
  chemically synthesized
tatgagaacaacatataatgta

SEQ ID NO: 1336186 - DNA, 22 bp, Artificial Sequence
  chemically synthesized
tgataataaataccatacatta

SEQ ID NO: 1336187 - DNA, 22 bp, Artificial Sequence
  chemically synthesized
gtgataataaataccatacatt

SEQ ID NO: 1336188 - DNA, 22 bp, Artificial Sequence
  chemically synthesized
tgtgataataaataccatacat

SEQ ID NO: 1336189 - DNA, 22 bp, Artificial Sequence
  chemically synthesized
gaaattttgtgataataaatac

SEQ ID NO: 1336190 - DNA, 22 bp, Artificial Sequence
  chemically synthesized
tagaaattttgtgataataaat

SEQ ID NO: 1336191 - DNA, 22 bp, Artificial Sequence
  chemically synthesized
ctagaaattttgtgataataaa

SEQ ID NO: 1336192 - DNA, 22 bp, Artificial Sequence
  chemically synthesized
tttctagaaattttgtgataat

SEQ ID NO: 1336193 - DNA, 22 bp, Artificial Sequence
  chemically synthesized
atttctagaaattttgtgataa

SEQ ID NO: 1336194 - DNA, 22 bp, Artificial Sequence
  chemically synthesized
tatttctagaaattttgtgata

SEQ ID NO: 1336195 - DNA, 22 bp, Artificial Sequence
  chemically synthesized
ttttatttctagaaattttgtg

SEQ ID NO: 1336196 - DNA, 22 bp, Artificial Sequence
  chemically synthesized
attttatttctagaaattttgt

SEQ ID NO: 1336197 - DNA, 22 bp, Artificial Sequence
  chemically synthesized
gacttattttatttctagaaat

SEQ ID NO: 1336198 - DNA, 22 bp, Artificial Sequence
  chemically synthesized
attatcacaaaatttctagaaa

SEQ ID NO: 1336199 - DNA, 22 bp, Artificial Sequence
  chemically synthesized
ttatcacaaaatttctagaaat

SEQ ID NO: 1336200 - DNA, 22 bp, Artificial Sequence
  chemically synthesized
tcacaaaatttctagaaataaa

SEQ ID NO: 1336201 - DNA, 22 bp, Artificial Sequence
  chemically synthesized
aactggacttattttatttcta

SEQ ID NO: 1336202 - DNA, 22 bp, Artificial Sequence
  chemically synthesized
ctgaactggacttattttattt

SEQ ID NO: 1336203 - DNA, 22 bp, Artificial Sequence
  chemically synthesized
tacctactgaactggacttatt

SEQ ID NO: 1336204 - DNA, 22 bp, Artificial Sequence
  chemically synthesized
ctagaaataaaataagtccagt

SEQ ID NO: 1336205 - DNA, 22 bp, Artificial Sequence
  chemically synthesized
tagaaataaaataagtccagtt

SEQ ID NO: 1336206 - DNA, 22 bp, Artificial Sequence
  chemically synthesized
gaaataaaataagtccagttca

SEQ ID NO: 1336207 - DNA, 22 bp, Artificial Sequence
  chemically synthesized
gaacaggattatacctactgaa

SEQ ID NO: 1336208 - DNA, 22 bp, Artificial Sequence
  chemically synthesized
agaacaggattatacctactga

SEQ ID NO: 1336209 - DNA, 22 bp, Artificial Sequence
  chemically synthesized
agtaggtataatcctgttctaa

SEQ ID NO: 1336210 - DNA, 22 bp, Artificial Sequence
  chemically synthesized
tagacatatggggatttagaac

SEQ ID NO: 1336211 - DNA, 22 bp, Artificial Sequence
  chemically synthesized
ttctaaatccccatatgtctat

SEQ ID NO: 1336212 - DNA, 22 bp, Artificial Sequence
  chemically synthesized
taaatccccatatgtctataat

SEQ ID NO: 1336213 - DNA, 22 bp, Artificial Sequence
  chemically synthesized
aatccccatatgtctataatgc

SEQ ID NO: 1336214 - DNA, 22 bp, Artificial Sequence
  chemically synthesized
agaagatatatgtggcagcatt

SEQ ID NO: 1336215 - DNA, 22 bp, Artificial Sequence
  chemically synthesized
aagaagatatatgtggcagcat

SEQ ID NO: 1336216 - DNA, 22 bp, Artificial Sequence
  chemically synthesized
taagaagatatatgtggcagca

SEQ ID NO: 1336217 - DNA, 22 bp, Artificial Sequence
  chemically synthesized
gtgttttaagaagatatatgtg

SEQ ID NO: 1336218 - DNA, 22 bp, Artificial Sequence
  chemically synthesized
taatgctgccacatatatcttc

SEQ ID NO: 1336219 - DNA, 22 bp, Artificial Sequence
  chemically synthesized
ccacatatatcttcttaaaaca

SEQ ID NO: 1336220 - DNA, 22 bp, Artificial Sequence
  chemically synthesized
cttaaaacactagtttcttcat

SEQ ID NO: 1336221 - DNA, 22 bp, Artificial Sequence
  chemically synthesized
ttaaaacactagtttcttcata

SEQ ID NO: 1336222 - DNA, 22 bp, Artificial Sequence
  chemically synthesized
aaaacactagtttcttcatatc

SEQ ID NO: 1336223 - DNA, 22 bp, Artificial Sequence
  chemically synthesized
aaacactagtttcttcatatca

SEQ ID NO: 1336224 - DNA, 22 bp, Artificial Sequence
  chemically synthesized
taagaatgacagtaggtgatat

SEQ ID NO: 1336225 - DNA, 22 bp, Artificial Sequence
  chemically synthesized
gtttcttcatatcacctactgt

SEQ ID NO: 1336226 - DNA, 22 bp, Artificial Sequence
  chemically synthesized
gggttataagaatgacagtagg

SEQ ID NO: 1336227 - DNA, 22 bp, Artificial Sequence
  chemically synthesized
cttcatatcacctactgtcatt

SEQ ID NO: 1336228 - DNA, 22 bp, Artificial Sequence
  chemically synthesized
ttcatatcacctactgtcattc

SEQ ID NO: 1336229 - DNA, 22 bp, Artificial Sequence
  chemically synthesized
catatcacctactgtcattctt

SEQ ID NO: 1336230 - DNA, 22 bp, Artificial Sequence
  chemically synthesized
atatcacctactgtcattctta

SEQ ID NO: 1336231 - DNA, 22 bp, Artificial Sequence
  chemically synthesized
tcaagagttggggttataagaa

SEQ ID NO: 1336232 - DNA, 22 bp, Artificial Sequence
  chemically synthesized
atcaagagttggggttataaga

SEQ ID NO: 1336233 - DNA, 22 bp, Artificial Sequence
  chemically synthesized
tcttatcaagagttggggttat

SEQ ID NO: 1336234 - DNA, 22 bp, Artificial Sequence
  chemically synthesized
ctgtcattcttataaccccaac

SEQ ID NO: 1336235 - DNA, 22 bp, Artificial Sequence
  chemically synthesized
tcattcttataaccccaactct

SEQ ID NO: 1336236 - DNA, 22 bp, Artificial Sequence
  chemically synthesized
ttataaccccaactcttgataa

SEQ ID NO: 1336237 - DNA, 22 bp, Artificial Sequence
  chemically synthesized
ataaccccaactcttgataaga

SEQ ID NO: 1336238 - DNA, 22 bp, Artificial Sequence
  chemically synthesized
taaccccaactcttgataagat

SEQ ID NO: 1336239 - DNA, 22 bp, Artificial Sequence
  chemically synthesized
gacaatggatggaaactatctt

SEQ ID NO: 1336240 - DNA, 22 bp, Artificial Sequence
  chemically synthesized
ggacaatggatggaaactatct

SEQ ID NO: 1336241 - DNA, 22 bp, Artificial Sequence
  chemically synthesized
ttgataagatagtttccatcca

SEQ ID NO: 1336242 - DNA, 22 bp, Artificial Sequence
  chemically synthesized
gataagatagtttccatccatt

SEQ ID NO: 1336243 - DNA, 22 bp, Artificial Sequence
  chemically synthesized
ataagatagtttccatccattg

SEQ ID NO: 1336244 - DNA, 22 bp, Artificial Sequence
  chemically synthesized
ccatccattgtccaaacttcat

SEQ ID NO: 1336245 - DNA, 22 bp, Artificial Sequence
  chemically synthesized
catccattgtccaaacttcatc

SEQ ID NO: 1336246 - DNA, 22 bp, Artificial Sequence
  chemically synthesized
agaaatgaaaggcagatgatga

SEQ ID NO: 1336247 - DNA, 22 bp, Artificial Sequence
  chemically synthesized
tccaaacttcatcatctgcctt

SEQ ID NO: 1336248 - DNA, 22 bp, Artificial Sequence
  chemically synthesized
gtgtactgagaaatgaaaggca

SEQ ID NO: 1336249 - DNA, 22 bp, Artificial Sequence
  chemically synthesized
agtgtactgagaaatgaaaggc

SEQ ID NO: 1336250 - DNA, 22 bp, Artificial Sequence
  chemically synthesized
catcatctgcctttcatttctc

SEQ ID NO: 1336251 - DNA, 22 bp, Artificial Sequence
  chemically synthesized
atcatctgcctttcatttctca

SEQ ID NO: 1336252 - DNA, 22 bp, Artificial Sequence
  chemically synthesized
cctttcatttctcagtacacta

SEQ ID NO: 1336253 - DNA, 22 bp, Artificial Sequence
  chemically synthesized
agtagaagcaagcttagtgtac

SEQ ID NO: 1336254 - DNA, 22 bp, Artificial Sequence
  chemically synthesized
cagtagaagcaagcttagtgta

SEQ ID NO: 1336255 - DNA, 22 bp, Artificial Sequence
  chemically synthesized
tcatttctcagtacactaagct

SEQ ID NO: 1336256 - DNA, 22 bp, Artificial Sequence
  chemically synthesized
catttctcagtacactaagctt

SEQ ID NO: 1336257 - DNA, 22 bp, Artificial Sequence
  chemically synthesized
atttctcagtacactaagcttg

SEQ ID NO: 1336258 - DNA, 22 bp, Artificial Sequence
  chemically synthesized
ctcagtacactaagcttgcttc

SEQ ID NO: 1336259 - DNA, 22 bp, Artificial Sequence
  chemically synthesized
tcagtacactaagcttgcttct

SEQ ID NO: 1336260 - DNA, 22 bp, Artificial Sequence
  chemically synthesized
agtacactaagcttgcttctac

SEQ ID NO: 1336261 - DNA, 22 bp, Artificial Sequence
  chemically synthesized
tagaatagtgcgtttcagtaga

SEQ ID NO: 1336262 - DNA, 22 bp, Artificial Sequence
  chemically synthesized
agcttgcttctactgaaacgca

SEQ ID NO: 1336263 - DNA, 22 bp, Artificial Sequence
  chemically synthesized
gcttctactgaaacgcactatt

SEQ ID NO: 1336264 - DNA, 22 bp, Artificial Sequence
  chemically synthesized
cttctactgaaacgcactattc

SEQ ID NO: 1336265 - DNA, 22 bp, Artificial Sequence
  chemically synthesized
ctactgaaacgcactattctac

SEQ ID NO: 1336266 - DNA, 22 bp, Artificial Sequence
  chemically synthesized
tactgaaacgcactattctaca

SEQ ID NO: 1336267 - DNA, 22 bp, Artificial Sequence
  chemically synthesized
ctgaaacgcactattctacagg

SEQ ID NO: 1336268 - DNA, 22 bp, Artificial Sequence
  chemically synthesized
atggagagagaaacctgtagaa

SEQ ID NO: 1336269 - DNA, 22 bp, Artificial Sequence
  chemically synthesized
aaacgcactattctacaggttt

SEQ ID NO: 1336270 - DNA, 22 bp, Artificial Sequence
  chemically synthesized
taatctaatggagagagaaacc

SEQ ID NO: 1336271 - DNA, 22 bp, Artificial Sequence
  chemically synthesized
ataatctaatggagagagaaac

SEQ ID NO: 1336272 - DNA, 22 bp, Artificial Sequence
  chemically synthesized
ttctacaggtttctctctccat

SEQ ID NO: 1336273 - DNA, 22 bp, Artificial Sequence
  chemically synthesized
tacaggtttctctctccattag

SEQ ID NO: 1336274 - DNA, 22 bp, Artificial Sequence
  chemically synthesized
aatatcttataatctaatggag

SEQ ID NO: 1336275 - DNA, 22 bp, Artificial Sequence
  chemically synthesized
caggtttctctctccattagat

SEQ ID NO: 1336276 - DNA, 22 bp, Artificial Sequence
  chemically synthesized
aaatatcttataatctaatgga

SEQ ID NO: 1336277 - DNA, 22 bp, Artificial Sequence
  chemically synthesized
ttaaatatcttataatctaatg

SEQ ID NO: 1336278 - DNA, 22 bp, Artificial Sequence
  chemically synthesized
ttcttaaatatcttataatcta

SEQ ID NO: 1336279 - DNA, 22 bp, Artificial Sequence
  chemically synthesized
ctctctccattagattataaga

SEQ ID NO: 1336280 - DNA, 22 bp, Artificial Sequence
  chemically synthesized
tgttcttaaatatcttataatc

SEQ ID NO: 1336281 - DNA, 22 bp, Artificial Sequence
  chemically synthesized
tctctccattagattataagat

SEQ ID NO: 1336282 - DNA, 22 bp, Artificial Sequence
  chemically synthesized
ctgttcttaaatatcttataat

SEQ ID NO: 1336283 - DNA, 22 bp, Artificial Sequence
  chemically synthesized
tctgttcttaaatatcttataa

SEQ ID NO: 1336284 - DNA, 22 bp, Artificial Sequence
  chemically synthesized
tctccattagattataagatat

SEQ ID NO: 1336285 - DNA, 22 bp, Artificial Sequence
  chemically synthesized
tccattagattataagatattt

SEQ ID NO: 1336286 - DNA, 22 bp, Artificial Sequence
  chemically synthesized
cattagattataagatatttaa

SEQ ID NO: 1336287 - DNA, 22 bp, Artificial Sequence
  chemically synthesized
gattataagatatttaagaaca

SEQ ID NO: 1336288 - DNA, 22 bp, Artificial Sequence
  chemically synthesized
taagatatttaagaacagaaag

SEQ ID NO: 1336289 - DNA, 22 bp, Artificial Sequence
  chemically synthesized
taaaaaagccagtctttctgtt

SEQ ID NO: 1336290 - DNA, 22 bp, Artificial Sequence
  chemically synthesized
gaaagctgtaaaaaagccagtc

SEQ ID NO: 1336291 - DNA, 22 bp, Artificial Sequence
  chemically synthesized
aagaacagaaagactggctttt

SEQ ID NO: 1336292 - DNA, 22 bp, Artificial Sequence
  chemically synthesized
agaacagaaagactggcttttt

SEQ ID NO: 1336293 - DNA, 22 bp, Artificial Sequence
  chemically synthesized
gggactggaaagctgtaaaaaa

SEQ ID NO: 1336294 - DNA, 22 bp, Artificial Sequence
  chemically synthesized
gcttttttacagctttccagtc

SEQ ID NO: 1336295 - DNA, 22 bp, Artificial Sequence
  chemically synthesized
ggaagcactagggactggaaag

SEQ ID NO: 1336296 - DNA, 22 bp, Artificial Sequence
  chemically synthesized
ttttacagctttccagtcccta

SEQ ID NO: 1336297 - DNA, 22 bp, Artificial Sequence
  chemically synthesized
tttacagctttccagtccctag

SEQ ID NO: 1336298 - DNA, 22 bp, Artificial Sequence
  chemically synthesized
ttacagctttccagtccctagt

SEQ ID NO: 1336299 - DNA, 22 bp, Artificial Sequence
  chemically synthesized
tacagctttccagtccctagtg

SEQ ID NO: 1336300 - DNA, 22 bp, Artificial Sequence
  chemically synthesized
acagctttccagtccctagtgc

SEQ ID NO: 1336301 - DNA, 22 bp, Artificial Sequence
  chemically synthesized
cagctttccagtccctagtgct

SEQ ID NO: 1336302 - DNA, 22 bp, Artificial Sequence
  chemically synthesized
caggaacagtgctaggaagcac

SEQ ID NO: 1336303 - DNA, 22 bp, Artificial Sequence
  chemically synthesized
tccagtccctagtgcttcctag

SEQ ID NO: 1336304 - DNA, 22 bp, Artificial Sequence
  chemically synthesized
ccagtccctagtgcttcctagc

SEQ ID NO: 1336305 - DNA, 22 bp, Artificial Sequence
  chemically synthesized
cagtccctagtgcttcctagca

SEQ ID NO: 1336306 - DNA, 22 bp, Artificial Sequence
  chemically synthesized
tgttccaggaacagtgctagga

SEQ ID NO: 1336307 - DNA, 22 bp, Artificial Sequence
  chemically synthesized
gtgcttcctagcactgttcctg

SEQ ID NO: 1336308 - DNA, 22 bp, Artificial Sequence
  chemically synthesized
tggtaactatgttccaggaaca

SEQ ID NO: 1336309 - DNA, 22 bp, Artificial Sequence
  chemically synthesized
gtggtaactatgttccaggaac

SEQ ID NO: 1336310 - DNA, 22 bp, Artificial Sequence
  chemically synthesized
tgtggtaactatgttccaggaa

SEQ ID NO: 1336311 - DNA, 22 bp, Artificial Sequence
  chemically synthesized
cctagcactgttcctggaacat

SEQ ID NO: 1336312 - DNA, 22 bp, Artificial Sequence
  chemically synthesized
ctagcactgttcctggaacata

SEQ ID NO: 1336313 - DNA, 22 bp, Artificial Sequence
  chemically synthesized
ctttgtggtaactatgttccag

SEQ ID NO: 1336314 - DNA, 22 bp, Artificial Sequence
  chemically synthesized
gctttgtggtaactatgttcca

SEQ ID NO: 1336315 - DNA, 22 bp, Artificial Sequence
  chemically synthesized
gcactgttcctggaacatagtt

SEQ ID NO: 1336316 - DNA, 22 bp, Artificial Sequence
  chemically synthesized
ttcctggaacatagttaccaca

SEQ ID NO: 1336317 - DNA, 22 bp, Artificial Sequence
  chemically synthesized
ctggaacatagttaccacaaag

SEQ ID NO: 1336318 - DNA, 22 bp, Artificial Sequence
  chemically synthesized
gaacatagttaccacaaagcaa

SEQ ID NO: 1336319 - DNA, 22 bp, Artificial Sequence
  chemically synthesized
ccacaaagcaaacatctacttc

SEQ ID NO: 1336320 - DNA, 22 bp, Artificial Sequence
  chemically synthesized
gtggggtatatatcaatgtgaa

SEQ ID NO: 1336321 - DNA, 22 bp, Artificial Sequence
  chemically synthesized
cttcatgtttcacattgatata

SEQ ID NO: 1336322 - DNA, 22 bp, Artificial Sequence
  chemically synthesized
catgtttcacattgatatatac

SEQ ID NO: 1336323 - DNA, 22 bp, Artificial Sequence
  chemically synthesized
gacgttagtggggtatatatca

SEQ ID NO: 1336324 - DNA, 22 bp, Artificial Sequence
  chemically synthesized
atgtttcacattgatatatacc

SEQ ID NO: 1336325 - DNA, 22 bp, Artificial Sequence
  chemically synthesized
cacattgatatataccccacta

SEQ ID NO: 1336326 - DNA, 22 bp, Artificial Sequence
  chemically synthesized
acattgatatataccccactaa

SEQ ID NO: 1336327 - DNA, 22 bp, Artificial Sequence
  chemically synthesized
atatataccccactaacgtcca

SEQ ID NO: 1336328 - DNA, 22 bp, Artificial Sequence
  chemically synthesized
aataacacgtgttggacgttag

SEQ ID NO: 1336329 - DNA, 22 bp, Artificial Sequence
  chemically synthesized
aaataacacgtgttggacgtta

SEQ ID NO: 1336330 - DNA, 22 bp, Artificial Sequence
  chemically synthesized
tttaaataacacgtgttggacg

SEQ ID NO: 1336331 - DNA, 22 bp, Artificial Sequence
  chemically synthesized
gtttaaataacacgtgttggac

SEQ ID NO: 1336332 - DNA, 22 bp, Artificial Sequence
  chemically synthesized
gtatttgtttaaataacacgtg

SEQ ID NO: 1336333 - DNA, 22 bp, Artificial Sequence
  chemically synthesized
acgtccaacacgtgttatttaa

SEQ ID NO: 1336334 - DNA, 22 bp, Artificial Sequence
  chemically synthesized
gagactagtatttgtttaaata

SEQ ID NO: 1336335 - DNA, 22 bp, Artificial Sequence
  chemically synthesized
agagactagtatttgtttaaat

SEQ ID NO: 1336336 - DNA, 22 bp, Artificial Sequence
  chemically synthesized
tttaaacaaatactagtctcta

SEQ ID NO: 1336337 - DNA, 22 bp, Artificial Sequence
  chemically synthesized
aaacaaatactagtctctaaat

SEQ ID NO: 1336338 - DNA, 22 bp, Artificial Sequence
  chemically synthesized
aacaaatactagtctctaaata

SEQ ID NO: 1336339 - DNA, 22 bp, Artificial Sequence
  chemically synthesized
agcagatgtacaagtatttaga

SEQ ID NO: 1336340 - DNA, 22 bp, Artificial Sequence
  chemically synthesized
gagcagatgtacaagtatttag

SEQ ID NO: 1336341 - DNA, 22 bp, Artificial Sequence
  chemically synthesized
tgagcagatgtacaagtattta

SEQ ID NO: 1336342 - DNA, 22 bp, Artificial Sequence
  chemically synthesized
ttgagcagatgtacaagtattt

SEQ ID NO: 1336343 - DNA, 22 bp, Artificial Sequence
  chemically synthesized
gtctctaaatacttgtacatct

SEQ ID NO: 1336344 - DNA, 22 bp, Artificial Sequence
  chemically synthesized
taaaatttttgagcagatgtac

SEQ ID NO: 1336345 - DNA, 22 bp, Artificial Sequence
  chemically synthesized
ataaaatttttgagcagatgta

SEQ ID NO: 1336346 - DNA, 22 bp, Artificial Sequence
  chemically synthesized
tataaaatttttgagcagatgt

SEQ ID NO: 1336347 - DNA, 22 bp, Artificial Sequence
  chemically synthesized
taaatacttgtacatctgctca

SEQ ID NO: 1336348 - DNA, 22 bp, Artificial Sequence
  chemically synthesized
aatacttgtacatctgctcaaa

SEQ ID NO: 1336349 - DNA, 22 bp, Artificial Sequence
  chemically synthesized
gcatattttataaaatttttga

SEQ ID NO: 1336350 - DNA, 22 bp, Artificial Sequence
  chemically synthesized
gtacatctgctcaaaaatttta

SEQ ID NO: 1336351 - DNA, 22 bp, Artificial Sequence
  chemically synthesized
tacatctgctcaaaaattttat

SEQ ID NO: 1336352 - DNA, 22 bp, Artificial Sequence
  chemically synthesized
ctcaaaaattttataaaatatg

SEQ ID NO: 1336353 - DNA, 22 bp, Artificial Sequence
  chemically synthesized
aaaaattttataaaatatgcta

SEQ ID NO: 1336354 - DNA, 22 bp, Artificial Sequence
  chemically synthesized
acaatagaaatgatctagcata

SEQ ID NO: 1336355 - DNA, 22 bp, Artificial Sequence
  chemically synthesized
cacaatagaaatgatctagcat

SEQ ID NO: 1336356 - DNA, 22 bp, Artificial Sequence
  chemically synthesized
tcacaatagaaatgatctagca

SEQ ID NO: 1336357 - DNA, 22 bp, Artificial Sequence
  chemically synthesized
ttcacaatagaaatgatctagc

SEQ ID NO: 1336358 - DNA, 22 bp, Artificial Sequence
  chemically synthesized
tataaaatatgctagatcattt

SEQ ID NO: 1336359 - DNA, 22 bp, Artificial Sequence
  chemically synthesized
ataaaatatgctagatcatttc

SEQ ID NO: 1336360 - DNA, 22 bp, Artificial Sequence
  chemically synthesized
taaaatatgctagatcatttct

SEQ ID NO: 1336361 - DNA, 22 bp, Artificial Sequence
  chemically synthesized
atttttcacaatagaaatgatc

SEQ ID NO: 1336362 - DNA, 22 bp, Artificial Sequence
  chemically synthesized
taatttttcacaatagaaatga

SEQ ID NO: 1336363 - DNA, 22 bp, Artificial Sequence
  chemically synthesized
ctaatttttcacaatagaaatg

SEQ ID NO: 1336364 - DNA, 22 bp, Artificial Sequence
  chemically synthesized
cttctaatttttcacaatagaa

SEQ ID NO: 1336365 - DNA, 22 bp, Artificial Sequence
  chemically synthesized
gcttctaatttttcacaataga

SEQ ID NO: 1336366 - DNA, 22 bp, Artificial Sequence
  chemically synthesized
gtttgcttctaatttttcacaa

SEQ ID NO: 1336367 - DNA, 22 bp, Artificial Sequence
  chemically synthesized
gatcatttctattgtgaaaaat

SEQ ID NO: 1336368 - DNA, 22 bp, Artificial Sequence
  chemically synthesized
agtttgcttctaatttttcaca

SEQ ID NO: 1336369 - DNA, 22 bp, Artificial Sequence
  chemically synthesized
ctattgtgaaaaattagaagca

SEQ ID NO: 1336370 - DNA, 22 bp, Artificial Sequence
  chemically synthesized
tattgtgaaaaattagaagcaa

SEQ ID NO: 1336371 - DNA, 22 bp, Artificial Sequence
  chemically synthesized
atgaatatttagtttgcttcta

SEQ ID NO: 1336372 - DNA, 22 bp, Artificial Sequence
  chemically synthesized
ttgtgaaaaattagaagcaaac

SEQ ID NO: 1336373 - DNA, 22 bp, Artificial Sequence
  chemically synthesized
catgaatatttagtttgcttct

SEQ ID NO: 1336374 - DNA, 22 bp, Artificial Sequence
  chemically synthesized
tgaaaaattagaagcaaactaa

SEQ ID NO: 1336375 - DNA, 22 bp, Artificial Sequence
  chemically synthesized
tttcatgaatatttagtttgct

SEQ ID NO: 1336376 - DNA, 22 bp, Artificial Sequence
  chemically synthesized
tatttcatgaatatttagtttg

SEQ ID NO: 1336377 - DNA, 22 bp, Artificial Sequence
  chemically synthesized
ctatttcatgaatatttagttt

SEQ ID NO: 1336378 - DNA, 22 bp, Artificial Sequence
  chemically synthesized
atttctatttcatgaatattta

SEQ ID NO: 1336379 - DNA, 22 bp, Artificial Sequence
  chemically synthesized
catttctatttcatgaatattt

SEQ ID NO: 1336380 - DNA, 22 bp, Artificial Sequence
  chemically synthesized
tcatttctatttcatgaatatt

SEQ ID NO: 1336381 - DNA, 22 bp, Artificial Sequence
  chemically synthesized
gaagcaaactaaatattcatga

SEQ ID NO: 1336382 - DNA, 22 bp, Artificial Sequence
  chemically synthesized
ttttcatttctatttcatgaat

SEQ ID NO: 1336383 - DNA, 22 bp, Artificial Sequence
  chemically synthesized
aatattcatgaaatagaaatga

SEQ ID NO: 1336384 - DNA, 22 bp, Artificial Sequence
  chemically synthesized
atgaaatagaaatgaaaacaat

SEQ ID NO: 1336385 - DNA, 22 bp, Artificial Sequence
  chemically synthesized
ataggatgtaccagaattgttt

SEQ ID NO: 1336386 - DNA, 22 bp, Artificial Sequence
  chemically synthesized
catataaatatattaataggat

SEQ ID NO: 1336387 - DNA, 22 bp, Artificial Sequence
  chemically synthesized
tggtacatcctattaatatatt

SEQ ID NO: 1336388 - DNA, 22 bp, Artificial Sequence
  chemically synthesized
tgtctgcatataaatatattaa

SEQ ID NO: 1336389 - DNA, 22 bp, Artificial Sequence
  chemically synthesized
atgtctgcatataaatatatta

SEQ ID NO: 1336390 - DNA, 22 bp, Artificial Sequence
  chemically synthesized
gtacatcctattaatatattta

SEQ ID NO: 1336391 - DNA, 22 bp, Artificial Sequence
  chemically synthesized
tatgtctgcatataaatatatt

SEQ ID NO: 1336392 - DNA, 22 bp, Artificial Sequence
  chemically synthesized
ttatgtctgcatataaatatat

SEQ ID NO: 1336393 - DNA, 22 bp, Artificial Sequence
  chemically synthesized
tttatgtctgcatataaatata

SEQ ID NO: 1336394 - DNA, 22 bp, Artificial Sequence
  chemically synthesized
ttttatgtctgcatataaatat

SEQ ID NO: 1336395 - DNA, 22 bp, Artificial Sequence
  chemically synthesized
ttaatatatttatatgcagaca

SEQ ID NO: 1336396 - DNA, 22 bp, Artificial Sequence
  chemically synthesized
atatatttatatgcagacataa

SEQ ID NO: 1336397 - DNA, 22 bp, Artificial Sequence
  chemically synthesized
cataagaatgtgatttttttat

SEQ ID NO: 1336398 - DNA, 22 bp, Artificial Sequence
  chemically synthesized
atatgcagacataaaaaaatca

SEQ ID NO: 1336399 - DNA, 22 bp, Artificial Sequence
  chemically synthesized
tatgcagacataaaaaaatcac

SEQ ID NO: 1336400 - DNA, 22 bp, Artificial Sequence
  chemically synthesized
aatattccataagaatgtgatt

SEQ ID NO: 1336401 - DNA, 22 bp, Artificial Sequence
  chemically synthesized
caacgtagttaaatattccata

SEQ ID NO: 1336402 - DNA, 22 bp, Artificial Sequence
  chemically synthesized
ccaacgtagttaaatattccat

SEQ ID NO: 1336403 - DNA, 22 bp, Artificial Sequence
  chemically synthesized
tccaacgtagttaaatattcca

SEQ ID NO: 1336404 - DNA, 22 bp, Artificial Sequence
  chemically synthesized
ttatggaatatttaactacgtt

SEQ ID NO: 1336405 - DNA, 22 bp, Artificial Sequence
  chemically synthesized
atggaatatttaactacgttgg

SEQ ID NO: 1336406 - DNA, 22 bp, Artificial Sequence
  chemically synthesized
tggaatatttaactacgttgga

SEQ ID NO: 1336407 - DNA, 22 bp, Artificial Sequence
  chemically synthesized
atatatcatatggttttccaac

SEQ ID NO: 1336408 - DNA, 22 bp, Artificial Sequence
  chemically synthesized
aatatatcatatggttttccaa

SEQ ID NO: 1336409 - DNA, 22 bp, Artificial Sequence
  chemically synthesized
acttaatatatcatatggtttt

SEQ ID NO: 1336410 - DNA, 22 bp, Artificial Sequence
  chemically synthesized
aactacgttggaaaaccatatg

SEQ ID NO: 1336411 - DNA, 22 bp, Artificial Sequence
  chemically synthesized
actacgttggaaaaccatatga

SEQ ID NO: 1336412 - DNA, 22 bp, Artificial Sequence
  chemically synthesized
attcacttaatatatcatatgg

SEQ ID NO: 1336413 - DNA, 22 bp, Artificial Sequence
  chemically synthesized
aattcacttaatatatcatatg

SEQ ID NO: 1336414 - DNA, 22 bp, Artificial Sequence
  chemically synthesized
cgttggaaaaccatatgatata

SEQ ID NO: 1336415 - DNA, 22 bp, Artificial Sequence
  chemically synthesized
cttaattcacttaatatatcat

SEQ ID NO: 1336416 - DNA, 22 bp, Artificial Sequence
  chemically synthesized
gaaaaccatatgatatattaag

SEQ ID NO: 1336417 - DNA, 22 bp, Artificial Sequence
  chemically synthesized
gaagctgcttaattcacttaat

SEQ ID NO: 1336418 - DNA, 22 bp, Artificial Sequence
  chemically synthesized
ggaagctgcttaattcacttaa

SEQ ID NO: 1336419 - DNA, 22 bp, Artificial Sequence
  chemically synthesized
tggaagctgcttaattcactta

SEQ ID NO: 1336420 - DNA, 22 bp, Artificial Sequence
  chemically synthesized
agtgaattaagcagcttccaaa

SEQ ID NO: 1336421 - DNA, 22 bp, Artificial Sequence
  chemically synthesized
gcatacacatagttttggaagc

SEQ ID NO: 1336422 - DNA, 22 bp, Artificial Sequence
  chemically synthesized
agcatacacatagttttggaag

SEQ ID NO: 1336423 - DNA, 22 bp, Artificial Sequence
  chemically synthesized
tagcatacacatagttttggaa

SEQ ID NO: 1336424 - DNA, 22 bp, Artificial Sequence
  chemically synthesized
agcagcttccaaaactatgtgt

SEQ ID NO: 1336425 - DNA, 22 bp, Artificial Sequence
  chemically synthesized
gtattttagcatacacatagtt

SEQ ID NO: 1336426 - DNA, 22 bp, Artificial Sequence
  chemically synthesized
agtattttagcatacacatagt

SEQ ID NO: 1336427 - DNA, 22 bp, Artificial Sequence
  chemically synthesized
tagtattttagcatacacatag

SEQ ID NO: 1336428 - DNA, 22 bp, Artificial Sequence
  chemically synthesized
ccaaaactatgtgtatgctaaa

SEQ ID NO: 1336429 - DNA, 22 bp, Artificial Sequence
  chemically synthesized
caaaactatgtgtatgctaaaa

SEQ ID NO: 1336430 - DNA, 22 bp, Artificial Sequence
  chemically synthesized
agaataatacattttagtattt

SEQ ID NO: 1336431 - DNA, 22 bp, Artificial Sequence
  chemically synthesized
tgtgtatgctaaaatactaaaa

SEQ ID NO: 1336432 - DNA, 22 bp, Artificial Sequence
  chemically synthesized
accactaagaataatacatttt

SEQ ID NO: 1336433 - DNA, 22 bp, Artificial Sequence
  chemically synthesized
aaccactaagaataatacattt

SEQ ID NO: 1336434 - DNA, 22 bp, Artificial Sequence
  chemically synthesized
taaccactaagaataatacatt

SEQ ID NO: 1336435 - DNA, 22 bp, Artificial Sequence
  chemically synthesized
ttaaccactaagaataatacat

SEQ ID NO: 1336436 - DNA, 22 bp, Artificial Sequence
  chemically synthesized
aaatactaaaatgtattattct

SEQ ID NO: 1336437 - DNA, 22 bp, Artificial Sequence
  chemically synthesized
ggtttttaaccactaagaataa

SEQ ID NO: 1336438 - DNA, 22 bp, Artificial Sequence
  chemically synthesized
aaatgtattattcttagtggtt

SEQ ID NO: 1336439 - DNA, 22 bp, Artificial Sequence
  chemically synthesized
cagagcctaggtttttaaccac

SEQ ID NO: 1336440 - DNA, 22 bp, Artificial Sequence
  chemically synthesized
ttcttagtggttaaaaacctag

SEQ ID NO: 1336441 - DNA, 22 bp, Artificial Sequence
  chemically synthesized
aggctccagagcctaggttttt

SEQ ID NO: 1336442 - DNA, 22 bp, Artificial Sequence
  chemically synthesized
ttagtggttaaaaacctaggct

SEQ ID NO: 1336443 - DNA, 22 bp, Artificial Sequence
  chemically synthesized
agtggttaaaaacctaggctct

SEQ ID NO: 1336444 - DNA, 22 bp, Artificial Sequence
  chemically synthesized
gtggttaaaaacctaggctctg

SEQ ID NO: 1336445 - DNA, 22 bp, Artificial Sequence
  chemically synthesized
aaccaggcattcaggctccaga

SEQ ID NO: 1336446 - DNA, 22 bp, Artificial Sequence
  chemically synthesized
aaaacctaggctctggagcctg

SEQ ID NO: 1336447 - DNA, 22 bp, Artificial Sequence
  chemically synthesized
taaaccaggcattcaggctcca

SEQ ID NO: 1336448 - DNA, 22 bp, Artificial Sequence
  chemically synthesized
ggctctggagcctgaatgcctg

SEQ ID NO: 1336449 - DNA, 22 bp, Artificial Sequence
  chemically synthesized
tggagcctgaatgcctggttta

SEQ ID NO: 1336450 - DNA, 22 bp, Artificial Sequence
  chemically synthesized
gagcctgaatgcctggtttaga

SEQ ID NO: 1336451 - DNA, 22 bp, Artificial Sequence
  chemically synthesized
taaaatggagccggaattctaa

SEQ ID NO: 1336452 - DNA, 22 bp, Artificial Sequence
  chemically synthesized
aatgcctggtttagaattccgg

SEQ ID NO: 1336453 - DNA, 22 bp, Artificial Sequence
  chemically synthesized
gtttagaattccggctccattt

SEQ ID NO: 1336454 - DNA, 22 bp, Artificial Sequence
  chemically synthesized
agaattccggctccattttata

SEQ ID NO: 1336455 - DNA, 22 bp, Artificial Sequence
  chemically synthesized
gaattccggctccattttataa

SEQ ID NO: 1336456 - DNA, 22 bp, Artificial Sequence
  chemically synthesized
agggtcacaatgccattataaa

SEQ ID NO: 1336457 - DNA, 22 bp, Artificial Sequence
  chemically synthesized
cggctccattttataatggcat

SEQ ID NO: 1336458 - DNA, 22 bp, Artificial Sequence
  chemically synthesized
ttcagggtcacaatgccattat

SEQ ID NO: 1336459 - DNA, 22 bp, Artificial Sequence
  chemically synthesized
gttcagggtcacaatgccatta

SEQ ID NO: 1336460 - DNA, 22 bp, Artificial Sequence
  chemically synthesized
acttgttcagggtcacaatgcc

SEQ ID NO: 1336461 - DNA, 22 bp, Artificial Sequence
  chemically synthesized
cattttataatggcattgtgac

SEQ ID NO: 1336462 - DNA, 22 bp, Artificial Sequence
  chemically synthesized
tataatggcattgtgaccctga

SEQ ID NO: 1336463 - DNA, 22 bp, Artificial Sequence
  chemically synthesized
ataatggcattgtgaccctgaa

SEQ ID NO: 1336464 - DNA, 22 bp, Artificial Sequence
  chemically synthesized
taatggcattgtgaccctgaac

SEQ ID NO: 1336465 - DNA, 22 bp, Artificial Sequence
  chemically synthesized
tgaccctgaacaagttaatgca

SEQ ID NO: 1336466 - DNA, 22 bp, Artificial Sequence
  chemically synthesized
gtgcaataacaagatgcattaa

SEQ ID NO: 1336467 - DNA, 22 bp, Artificial Sequence
  chemically synthesized
aacaagttaatgcatcttgtta

SEQ ID NO: 1336468 - DNA, 22 bp, Artificial Sequence
  chemically synthesized
atgcatcttgttattgcaccaa

SEQ ID NO: 1336469 - DNA, 22 bp, Artificial Sequence
  chemically synthesized
aaaatgtgaaaattggtgcaat

SEQ ID NO: 1336470 - DNA, 22 bp, Artificial Sequence
  chemically synthesized
aaaaatgtgaaaattggtgcaa

SEQ ID NO: 1336471 - DNA, 22 bp, Artificial Sequence
  chemically synthesized
taaaaatgtgaaaattggtgca

SEQ ID NO: 1336472 - DNA, 22 bp, Artificial Sequence
  chemically synthesized
gttattgcaccaattttcacat

SEQ ID NO: 1336473 - DNA, 22 bp, Artificial Sequence
  chemically synthesized
ttattgcaccaattttcacatt

SEQ ID NO: 1336474 - DNA, 22 bp, Artificial Sequence
  chemically synthesized
gaccattttaaaaatgtgaaaa

SEQ ID NO: 1336475 - DNA, 22 bp, Artificial Sequence
  chemically synthesized
ttgcaccaattttcacattttt

SEQ ID NO: 1336476 - DNA, 22 bp, Artificial Sequence
  chemically synthesized
ttagaccattttaaaaatgtga

SEQ ID NO: 1336477 - DNA, 22 bp, Artificial Sequence
  chemically synthesized
caccaattttcacatttttaaa

SEQ ID NO: 1336478 - DNA, 22 bp, Artificial Sequence
  chemically synthesized
ttattagaccattttaaaaatg

SEQ ID NO: 1336479 - DNA, 22 bp, Artificial Sequence
  chemically synthesized
tcacatttttaaaatggtctaa

SEQ ID NO: 1336480 - DNA, 22 bp, Artificial Sequence
  chemically synthesized
cacatttttaaaatggtctaat

SEQ ID NO: 1336481 - DNA, 22 bp, Artificial Sequence
  chemically synthesized
acatttttaaaatggtctaata

SEQ ID NO: 1336482 - DNA, 22 bp, Artificial Sequence
  chemically synthesized
taatataagtactgttattaga

SEQ ID NO: 1336483 - DNA, 22 bp, Artificial Sequence
  chemically synthesized
ataatataagtactgttattag

SEQ ID NO: 1336484 - DNA, 22 bp, Artificial Sequence
  chemically synthesized
tataatataagtactgttatta

SEQ ID NO: 1336485 - DNA, 22 bp, Artificial Sequence
  chemically synthesized
ttaaaatggtctaataacagta

SEQ ID NO: 1336486 - DNA, 22 bp, Artificial Sequence
  chemically synthesized
taaaatggtctaataacagtac

SEQ ID NO: 1336487 - DNA, 22 bp, Artificial Sequence
  chemically synthesized
aaaatggtctaataacagtact

SEQ ID NO: 1336488 - DNA, 22 bp, Artificial Sequence
  chemically synthesized
aaatggtctaataacagtactt

SEQ ID NO: 1336489 - DNA, 22 bp, Artificial Sequence
  chemically synthesized
aaaataattttataatataagt

SEQ ID NO: 1336490 - DNA, 22 bp, Artificial Sequence
  chemically synthesized
ataacagtacttatattataaa

SEQ ID NO: 1336491 - DNA, 22 bp, Artificial Sequence
  chemically synthesized
tgcctgaaaataattttataat

SEQ ID NO: 1336492 - DNA, 22 bp, Artificial Sequence
  chemically synthesized
atgcctgaaaataattttataa

SEQ ID NO: 1336493 - DNA, 22 bp, Artificial Sequence
  chemically synthesized
tccatttatgcctgaaaataat

SEQ ID NO: 1336494 - DNA, 22 bp, Artificial Sequence
  chemically synthesized
atattataaaattattttcagg

SEQ ID NO: 1336495 - DNA, 22 bp, Artificial Sequence
  chemically synthesized
tattataaaattattttcaggc

SEQ ID NO: 1336496 - DNA, 22 bp, Artificial Sequence
  chemically synthesized
aatattatccatttatgcctga

SEQ ID NO: 1336497 - DNA, 22 bp, Artificial Sequence
  chemically synthesized
taaaattattttcaggcataaa

SEQ ID NO: 1336498 - DNA, 22 bp, Artificial Sequence
  chemically synthesized
tatgttaaatattatccattta

SEQ ID NO: 1336499 - DNA, 22 bp, Artificial Sequence
  chemically synthesized
atatgttaaatattatccattt

SEQ ID NO: 1336500 - DNA, 22 bp, Artificial Sequence
  chemically synthesized
ttttcaggcataaatggataat

SEQ ID NO: 1336501 - DNA, 22 bp, Artificial Sequence
  chemically synthesized
tcaggcataaatggataatatt

SEQ ID NO: 1336502 - DNA, 22 bp, Artificial Sequence
  chemically synthesized
ccttatatgttaaatattatcc

SEQ ID NO: 1336503 - DNA, 22 bp, Artificial Sequence
  chemically synthesized
caggcataaatggataatattt

SEQ ID NO: 1336504 - DNA, 22 bp, Artificial Sequence
  chemically synthesized
aggcataaatggataatattta

SEQ ID NO: 1336505 - DNA, 22 bp, Artificial Sequence
  chemically synthesized
aattaccttatatgttaaatat

SEQ ID NO: 1336506 - DNA, 22 bp, Artificial Sequence
  chemically synthesized
caattaccttatatgttaaata

SEQ ID NO: 1336507 - DNA, 22 bp, Artificial Sequence
  chemically synthesized
gtacatacccatgtttcaatta

SEQ ID NO: 1336508 - DNA, 22 bp, Artificial Sequence
  chemically synthesized
aacatataaggtaattgaaaca

SEQ ID NO: 1336509 - DNA, 22 bp, Artificial Sequence
  chemically synthesized
ggtacatacccatgtttcaatt

SEQ ID NO: 1336510 - DNA, 22 bp, Artificial Sequence
  chemically synthesized
acatataaggtaattgaaacat

SEQ ID NO: 1336511 - DNA, 22 bp, Artificial Sequence
  chemically synthesized
gcacttggtacatacccatgtt

SEQ ID NO: 1336512 - DNA, 22 bp, Artificial Sequence
  chemically synthesized
ctagcacttggtacatacccat

SEQ ID NO: 1336513 - DNA, 22 bp, Artificial Sequence
  chemically synthesized
actagcacttggtacataccca

SEQ ID NO: 1336514 - DNA, 22 bp, Artificial Sequence
  chemically synthesized
atatttactagcacttggtaca

SEQ ID NO: 1336515 - DNA, 22 bp, Artificial Sequence
  chemically synthesized
aaacatgggtatgtaccaagtg

SEQ ID NO: 1336516 - DNA, 22 bp, Artificial Sequence
  chemically synthesized
tataatgatagctaatatttac

SEQ ID NO: 1336517 - DNA, 22 bp, Artificial Sequence
  chemically synthesized
agaactatataatgatagctaa

SEQ ID NO: 1336518 - DNA, 22 bp, Artificial Sequence
  chemically synthesized
ttgagaactatataatgatagc

SEQ ID NO: 1336519 - DNA, 22 bp, Artificial Sequence
  chemically synthesized
gtaaatattagctatcattata

SEQ ID NO: 1336520 - DNA, 22 bp, Artificial Sequence
  chemically synthesized
ctattgagaactatataatgat

SEQ ID NO: 1336521 - DNA, 22 bp, Artificial Sequence
  chemically synthesized
gctatcattatatagttctcaa

SEQ ID NO: 1336522 - DNA, 22 bp, Artificial Sequence
  chemically synthesized
gcacagacattcctattgagaa

SEQ ID NO: 1336523 - DNA, 22 bp, Artificial Sequence
  chemically synthesized
tcattatatagttctcaatagg

SEQ ID NO: 1336524 - DNA, 22 bp, Artificial Sequence
  chemically synthesized
ggcacagacattcctattgaga

SEQ ID NO: 1336525 - DNA, 22 bp, Artificial Sequence
  chemically synthesized
tttggcacagacattcctattg

SEQ ID NO: 1336526 - DNA, 22 bp, Artificial Sequence
  chemically synthesized
tatagttctcaataggaatgtc

SEQ ID NO: 1336527 - DNA, 22 bp, Artificial Sequence
  chemically synthesized
cctgtttggcacagacattcct

SEQ ID NO: 1336528 - DNA, 22 bp, Artificial Sequence
  chemically synthesized
tcaataggaatgtctgtgccaa

SEQ ID NO: 1336529 - DNA, 22 bp, Artificial Sequence
  chemically synthesized
aataggaatgtctgtgccaaac

SEQ ID NO: 1336530 - DNA, 22 bp, Artificial Sequence
  chemically synthesized
aggaataaccagtgttacctgt

SEQ ID NO: 1336531 - DNA, 22 bp, Artificial Sequence
  chemically synthesized
ttcaggaataaccagtgttacc

SEQ ID NO: 1336532 - DNA, 22 bp, Artificial Sequence
  chemically synthesized
tgccaaacaggtaacactggtt

SEQ ID NO: 1336533 - DNA, 22 bp, Artificial Sequence
  chemically synthesized
ctattcaggaataaccagtgtt

SEQ ID NO: 1336534 - DNA, 22 bp, Artificial Sequence
  chemically synthesized
gctattcaggaataaccagtgt

SEQ ID NO: 1336535 - DNA, 22 bp, Artificial Sequence
  chemically synthesized
tgctattcaggaataaccagtg

SEQ ID NO: 1336536 - DNA, 22 bp, Artificial Sequence
  chemically synthesized
taattttgctattcaggaataa

SEQ ID NO: 1336537 - DNA, 22 bp, Artificial Sequence
  chemically synthesized
cctataattttgctattcagga

SEQ ID NO: 1336538 - DNA, 22 bp, Artificial Sequence
  chemically synthesized
gttattcctgaatagcaaaatt

SEQ ID NO: 1336539 - DNA, 22 bp, Artificial Sequence
  chemically synthesized
ttcctgaatagcaaaattatag

SEQ ID NO: 1336540 - DNA, 22 bp, Artificial Sequence
  chemically synthesized
ctgaatagcaaaattataggca

SEQ ID NO: 1336541 - DNA, 22 bp, Artificial Sequence
  chemically synthesized
aatagcaaaattataggcaact

SEQ ID NO: 1336542 - DNA, 22 bp, Artificial Sequence
  chemically synthesized
taggcaactattacctttattg

SEQ ID NO: 1336543 - DNA, 22 bp, Artificial Sequence
  chemically synthesized
ttacctttattgtgtttttctg

SEQ ID NO: 1336544 - DNA, 22 bp, Artificial Sequence
  chemically synthesized
ccaaaagtagaatacagaaaaa

SEQ ID NO: 1336545 - DNA, 22 bp, Artificial Sequence
  chemically synthesized
cctttattgtgtttttctgtat

SEQ ID NO: 1336546 - DNA, 22 bp, Artificial Sequence
  chemically synthesized
actgccaaaagtagaatacaga

SEQ ID NO: 1336547 - DNA, 22 bp, Artificial Sequence
  chemically synthesized
tattgtgtttttctgtattcta

SEQ ID NO: 1336548 - DNA, 22 bp, Artificial Sequence
  chemically synthesized
attgtgtttttctgtattctac

SEQ ID NO: 1336549 - DNA, 22 bp, Artificial Sequence
  chemically synthesized
ttgtgtttttctgtattctact

SEQ ID NO: 1336550 - DNA, 22 bp, Artificial Sequence
  chemically synthesized
tgtttttctgtattctactttt

SEQ ID NO: 1336551 - DNA, 22 bp, Artificial Sequence
  chemically synthesized
ttctgtattctacttttggcag

SEQ ID NO: 1336552 - DNA, 22 bp, Artificial Sequence
  chemically synthesized
tctgtattctacttttggcagt

SEQ ID NO: 1336553 - DNA, 22 bp, Artificial Sequence
  chemically synthesized
ctgtattctacttttggcagtg

SEQ ID NO: 1336554 - DNA, 22 bp, Artificial Sequence
  chemically synthesized
tgtattctacttttggcagtga

SEQ ID NO: 1336555 - DNA, 22 bp, Artificial Sequence
  chemically synthesized
tattctacttttggcagtgagt

SEQ ID NO: 1336556 - DNA, 22 bp, Artificial Sequence
  chemically synthesized
tacttttggcagtgagtgtata

SEQ ID NO: 1336557 - DNA, 22 bp, Artificial Sequence
  chemically synthesized
taatacaaaataatatacactc

SEQ ID NO: 1336558 - DNA, 22 bp, Artificial Sequence
  chemically synthesized
cttttggcagtgagtgtatatt

SEQ ID NO: 1336559 - DNA, 22 bp, Artificial Sequence
  chemically synthesized
ataatacaaaataatatacact

SEQ ID NO: 1336560 - DNA, 22 bp, Artificial Sequence
  chemically synthesized
tataatacaaaataatatacac

SEQ ID NO: 1336561 - DNA, 22 bp, Artificial Sequence
  chemically synthesized
ttataatacaaaataatataca

SEQ ID NO: 1336562 - DNA, 22 bp, Artificial Sequence
  chemically synthesized
ttggcagtgagtgtatattatt

SEQ ID NO: 1336563 - DNA, 22 bp, Artificial Sequence
  chemically synthesized
tttataatacaaaataatatac

SEQ ID NO: 1336564 - DNA, 22 bp, Artificial Sequence
  chemically synthesized
tggcagtgagtgtatattattt

SEQ ID NO: 1336565 - DNA, 22 bp, Artificial Sequence
  chemically synthesized
ggcagtgagtgtatattatttt

SEQ ID NO: 1336566 - DNA, 22 bp, Artificial Sequence
  chemically synthesized
gcagtgagtgtatattattttg

SEQ ID NO: 1336567 - DNA, 22 bp, Artificial Sequence
  chemically synthesized
attttttataatacaaaataat

SEQ ID NO: 1336568 - DNA, 22 bp, Artificial Sequence
  chemically synthesized
ttttgtattataaaaaatcagg

SEQ ID NO: 1336569 - DNA, 22 bp, Artificial Sequence
  chemically synthesized
tgtattataaaaaatcaggctg

SEQ ID NO: 1336570 - DNA, 22 bp, Artificial Sequence
  chemically synthesized
gtattataaaaaatcaggctgg

SEQ ID NO: 1336571 - DNA, 22 bp, Artificial Sequence
  chemically synthesized
tattataaaaaatcaggctggg

SEQ ID NO: 1336572 - DNA, 22 bp, Artificial Sequence
  chemically synthesized
taaaaaatcaggctgggtttgg

SEQ ID NO: 1336573 - DNA, 22 bp, Artificial Sequence
  chemically synthesized
caggcatgagccaccaaaccca

SEQ ID NO: 1336574 - DNA, 22 bp, Artificial Sequence
  chemically synthesized
ggattacaggcatgagccacca

SEQ ID NO: 1336575 - DNA, 22 bp, Artificial Sequence
  chemically synthesized
ggtttggtggctcatgcctgta

SEQ ID NO: 1336576 - DNA, 22 bp, Artificial Sequence
  chemically synthesized
caaagtgctgggattacaggca

SEQ ID NO: 1336577 - DNA, 22 bp, Artificial Sequence
  chemically synthesized
ccaaagtgctgggattacaggc

SEQ ID NO: 1336578 - DNA, 22 bp, Artificial Sequence
  chemically synthesized
ggtggctcatgcctgtaatccc

SEQ ID NO: 1336579 - DNA, 22 bp, Artificial Sequence
  chemically synthesized
gtggctcatgcctgtaatccca

SEQ ID NO: 1336580 - DNA, 22 bp, Artificial Sequence
  chemically synthesized
gccttccaaagtgctgggatta

SEQ ID NO: 1336581 - DNA, 22 bp, Artificial Sequence
  chemically synthesized
ggccttccaaagtgctgggatt

SEQ ID NO: 1336582 - DNA, 22 bp, Artificial Sequence
  chemically synthesized
atgcctgtaatcccagcacttt

SEQ ID NO: 1336583 - DNA, 22 bp, Artificial Sequence
  chemically synthesized
gccttggccttccaaagtgctg

SEQ ID NO: 1336584 - DNA, 22 bp, Artificial Sequence
  chemically synthesized
tggccttggccttccaaagtgc

SEQ ID NO: 1336585 - DNA, 22 bp, Artificial Sequence
  chemically synthesized
taatcccagcactttggaaggc

SEQ ID NO: 1336586 - DNA, 22 bp, Artificial Sequence
  chemically synthesized
aaccacccctctggccttggcc

SEQ ID NO: 1336587 - DNA, 22 bp, Artificial Sequence
  chemically synthesized
ggctcaaccacccctctggcct

SEQ ID NO: 1336588 - DNA, 22 bp, Artificial Sequence
  chemically synthesized
tggaaggccaaggccagagggg

SEQ ID NO: 1336589 - DNA, 22 bp, Artificial Sequence
  chemically synthesized
tgggctcaaccacccctctggc

SEQ ID NO: 1336590 - DNA, 22 bp, Artificial Sequence
  chemically synthesized
ggaaggccaaggccagaggggt

SEQ ID NO: 1336591 - DNA, 22 bp, Artificial Sequence
  chemically synthesized
ctgggctcaaccacccctctgg

SEQ ID NO: 1336592 - DNA, 22 bp, Artificial Sequence
  chemically synthesized
gaaggccaaggccagaggggtg

SEQ ID NO: 1336593 - DNA, 22 bp, Artificial Sequence
  chemically synthesized
aacttctgggctcaaccacccc

SEQ ID NO: 1336594 - DNA, 22 bp, Artificial Sequence
  chemically synthesized
gaacttctgggctcaaccaccc

SEQ ID NO: 1336595 - DNA, 22 bp, Artificial Sequence
  chemically synthesized
gtcttgaacttctgggctcaac

SEQ ID NO: 1336596 - DNA, 22 bp, Artificial Sequence
  chemically synthesized
aggctggtcttgaacttctggg

SEQ ID NO: 1336597 - DNA, 22 bp, Artificial Sequence
  chemically synthesized
ctcaggctggtcttgaacttct

SEQ ID NO: 1336598 - DNA, 22 bp, Artificial Sequence
  chemically synthesized
cgttgctcaggctggtcttgaa

SEQ ID NO: 1336599 - DNA, 22 bp, Artificial Sequence
  chemically synthesized
agcccagaagttcaagaccagc

SEQ ID NO: 1336600 - DNA, 22 bp, Artificial Sequence
  chemically synthesized
actacgttgctcaggctggtct

SEQ ID NO: 1336601 - DNA, 22 bp, Artificial Sequence
  chemically synthesized
aagaccagcctgagcaacgtag

SEQ ID NO: 1336602 - DNA, 22 bp, Artificial Sequence
  chemically synthesized
tagagacaaggtctcactacgt

SEQ ID NO: 1336603 - DNA, 22 bp, Artificial Sequence
  chemically synthesized
gtagagacaaggtctcactacg

SEQ ID NO: 1336604 - DNA, 22 bp, Artificial Sequence
  chemically synthesized
tttgtagagacaaggtctcact

SEQ ID NO: 1336605 - DNA, 22 bp, Artificial Sequence
  chemically synthesized
agcaacgtagtgagaccttgtc

SEQ ID NO: 1336606 - DNA, 22 bp, Artificial Sequence
  chemically synthesized
aaaaagaaattatttgtagaga

SEQ ID NO: 1336607 - DNA, 22 bp, Artificial Sequence
  chemically synthesized
aaaaaagaaattatttgtagag

SEQ ID NO: 1336608 - DNA, 22 bp, Artificial Sequence
  chemically synthesized
atttaaaaaagaaattatttgt

SEQ ID NO: 1336609 - DNA, 22 bp, Artificial Sequence
  chemically synthesized
gctgatttaaaaaagaaattat

SEQ ID NO: 1336610 - DNA, 22 bp, Artificial Sequence
  chemically synthesized
gtctctacaaataatttctttt

SEQ ID NO: 1336611 - DNA, 22 bp, Artificial Sequence
  chemically synthesized
tctctacaaataatttcttttt

SEQ ID NO: 1336612 - DNA, 22 bp, Artificial Sequence
  chemically synthesized
tacaaataatttcttttttaaa

SEQ ID NO: 1336613 - DNA, 22 bp, Artificial Sequence
  chemically synthesized
caaataatttcttttttaaatc

SEQ ID NO: 1336614 - DNA, 22 bp, Artificial Sequence
  chemically synthesized
cttttttaaatcagccaggcgt

SEQ ID NO: 1336615 - DNA, 22 bp, Artificial Sequence
  chemically synthesized
ttttttaaatcagccaggcgtg

SEQ ID NO: 1336616 - DNA, 22 bp, Artificial Sequence
  chemically synthesized
ttttaaatcagccaggcgtggt

SEQ ID NO: 1336617 - DNA, 22 bp, Artificial Sequence
  chemically synthesized
tttaaatcagccaggcgtggtg

SEQ ID NO: 1336618 - DNA, 22 bp, Artificial Sequence
  chemically synthesized
ttaaatcagccaggcgtggtgg

SEQ ID NO: 1336619 - DNA, 22 bp, Artificial Sequence
  chemically synthesized
taaatcagccaggcgtggtggc

SEQ ID NO: 1336620 - DNA, 22 bp, Artificial Sequence
  chemically synthesized
aaatcagccaggcgtggtggca

SEQ ID NO: 1336621 - DNA, 22 bp, Artificial Sequence
  chemically synthesized
aatcagccaggcgtggtggcac

SEQ ID NO: 1336622 - DNA, 22 bp, Artificial Sequence
  chemically synthesized
ccagaccacaggtgcgtgccac

SEQ ID NO: 1336623 - DNA, 22 bp, Artificial Sequence
  chemically synthesized
ccctcccagaccacaggtgcgt

SEQ ID NO: 1336624 - DNA, 22 bp, Artificial Sequence
  chemically synthesized
gccctcccagaccacaggtgcg

SEQ ID NO: 1336625 - DNA, 22 bp, Artificial Sequence
  chemically synthesized
cagccttgccctcccagaccac

SEQ ID NO: 1336626 - DNA, 22 bp, Artificial Sequence
  chemically synthesized
actgcagccttgccctcccaga

SEQ ID NO: 1336627 - DNA, 22 bp, Artificial Sequence
  chemically synthesized
tggtctgggagggcaaggctgc

SEQ ID NO: 1336628 - DNA, 22 bp, Artificial Sequence
  chemically synthesized
atcacagctcactgcagccttg

SEQ ID NO: 1336629 - DNA, 22 bp, Artificial Sequence
  chemically synthesized
aatcacagctcactgcagcctt

SEQ ID NO: 1336630 - DNA, 22 bp, Artificial Sequence
  chemically synthesized
gcttaatcacagctcactgcag

SEQ ID NO: 1336631 - DNA, 22 bp, Artificial Sequence
  chemically synthesized
ggagggcaaggctgcagtgagc

SEQ ID NO: 1336632 - DNA, 22 bp, Artificial Sequence
  chemically synthesized
aagtgcattggcttaatcacag

SEQ ID NO: 1336633 - DNA, 22 bp, Artificial Sequence
  chemically synthesized
cagtgagctgtgattaagccaa

SEQ ID NO: 1336634 - DNA, 22 bp, Artificial Sequence
  chemically synthesized
ccacccaggctgaagtgcattg

SEQ ID NO: 1336635 - DNA, 22 bp, Artificial Sequence
  chemically synthesized
tgccacccaggctgaagtgcat

SEQ ID NO: 1336636 - DNA, 22 bp, Artificial Sequence
  chemically synthesized
tgattaagccaatgcacttcag

SEQ ID NO: 1336637 - DNA, 22 bp, Artificial Sequence
  chemically synthesized
actctgccacccaggctgaagt

SEQ ID NO: 1336638 - DNA, 22 bp, Artificial Sequence
  chemically synthesized
agccaatgcacttcagcctggg

SEQ ID NO: 1336639 - DNA, 22 bp, Artificial Sequence
  chemically synthesized
agacggggtctcactctgccac

SEQ ID NO: 1336640 - DNA, 22 bp, Artificial Sequence
  chemically synthesized
gagacggggtctcactctgcca

SEQ ID NO: 1336641 - DNA, 22 bp, Artificial Sequence
  chemically synthesized
tgagacggggtctcactctgcc

SEQ ID NO: 1336642 - DNA, 22 bp, Artificial Sequence
  chemically synthesized
ttgagacggggtctcactctgc

SEQ ID NO: 1336643 - DNA, 22 bp, Artificial Sequence
  chemically synthesized
cagcctgggtggcagagtgaga

SEQ ID NO: 1336644 - DNA, 22 bp, Artificial Sequence
  chemically synthesized
tttgagacggggtctcactctg

SEQ ID NO: 1336645 - DNA, 22 bp, Artificial Sequence
  chemically synthesized
agcctgggtggcagagtgagac

SEQ ID NO: 1336646 - DNA, 22 bp, Artificial Sequence
  chemically synthesized
ttttgagacggggtctcactct

SEQ ID NO: 1336647 - DNA, 22 bp, Artificial Sequence
  chemically synthesized
tttttgagacggggtctcactc

SEQ ID NO: 1336648 - DNA, 22 bp, Artificial Sequence
  chemically synthesized
ttttttgagacggggtctcact

SEQ ID NO: 1336649 - DNA, 22 bp, Artificial Sequence
  chemically synthesized
tttttttgagacggggtctcac

SEQ ID NO: 1336650 - DNA, 22 bp, Artificial Sequence
  chemically synthesized
ttttttttgagacggggtctca

SEQ ID NO: 1336651 - DNA, 22 bp, Artificial Sequence
  chemically synthesized
tttttttttgagacggggtctc

SEQ ID NO: 1336652 - DNA, 22 bp, Artificial Sequence
  chemically synthesized
ggtggcagagtgagaccccgtc

SEQ ID NO: 1336653 - DNA, 22 bp, Artificial Sequence
  chemically synthesized
ttttttttttgagacggggtct

SEQ ID NO: 1336654 - DNA, 22 bp, Artificial Sequence
  chemically synthesized
tttttttttttgagacggggtc

SEQ ID NO: 1336655 - DNA, 22 bp, Artificial Sequence
  chemically synthesized
ttttttttttttgagacggggt

SEQ ID NO: 1336656 - DNA, 22 bp, Artificial Sequence
  chemically synthesized
tttttttttttttgagacgggg

SEQ ID NO: 1336657 - DNA, 22 bp, Artificial Sequence
  chemically synthesized
ttttttttttttttgagacggg

SEQ ID NO: 1336658 - DNA, 22 bp, Artificial Sequence
  chemically synthesized
tttttttttttttttgagacgg

SEQ ID NO: 1336659 - DNA, 22 bp, Artificial Sequence
  chemically synthesized
ttttttttttttttttgagacg

SEQ ID NO: 1336660 - DNA, 22 bp, Artificial Sequence
  chemically synthesized
tttttttttttttttttgagac

SEQ ID NO: 1336661 - DNA, 22 bp, Artificial Sequence
  chemically synthesized
ttttttttttttttttttgaga

SEQ ID NO: 1336662 - DNA, 22 bp, Artificial Sequence
  chemically synthesized
tttttttttttttttttttgag

SEQ ID NO: 1336663 - DNA, 22 bp, Artificial Sequence
  chemically synthesized
ttttttttttttttttttttga

SEQ ID NO: 1336664 - DNA, 22 bp, Artificial Sequence
  chemically synthesized
tttttttttttttttttttttg

SEQ ID NO: 1336665 - DNA, 22 bp, Artificial Sequence
  chemically synthesized
tttttttttttttttttttttt

SEQ ID NO: 1336666 - DNA, 22 bp, Artificial Sequence
  chemically synthesized
tttttttttttttttttttttt

SEQ ID NO: 1336667 - DNA, 22 bp, Artificial Sequence
  chemically synthesized
tttttttttttttttttttttt

SEQ ID NO: 1336668 - DNA, 22 bp, Artificial Sequence
  chemically synthesized
tttttttttttttttttttttt

SEQ ID NO: 1336669 - DNA, 22 bp, Artificial Sequence
  chemically synthesized
tggttttttttttttttttttt

SEQ ID NO: 1336670 - DNA, 22 bp, Artificial Sequence
  chemically synthesized
aaaaaaaaaaaaaaaaaaaaaa

SEQ ID NO: 1336671 - DNA, 22 bp, Artificial Sequence
  chemically synthesized
ttgtggtttttttttttttttt

SEQ ID NO: 1336672 - DNA, 22 bp, Artificial Sequence
  chemically synthesized
agaggaatctgttgtggttttt

SEQ ID NO: 1336673 - DNA, 22 bp, Artificial Sequence
  chemically synthesized
aagaggaatctgttgtggtttt

SEQ ID NO: 1336674 - DNA, 22 bp, Artificial Sequence
  chemically synthesized
taagaggaatctgttgtggttt

SEQ ID NO: 1336675 - DNA, 22 bp, Artificial Sequence
  chemically synthesized
catattttaagaggaatctgtt

SEQ ID NO: 1336676 - DNA, 22 bp, Artificial Sequence
  chemically synthesized
gcatattttaagaggaatctgt

SEQ ID NO: 1336677 - DNA, 22 bp, Artificial Sequence
  chemically synthesized
tgcatattttaagaggaatctg

SEQ ID NO: 1336678 - DNA, 22 bp, Artificial Sequence
  chemically synthesized
agtaaatattttgcatatttta

SEQ ID NO: 1336679 - DNA, 22 bp, Artificial Sequence
  chemically synthesized
ctcttaaaatatgcaaaatatt

SEQ ID NO: 1336680 - DNA, 22 bp, Artificial Sequence
  chemically synthesized
ttaaaatatgcaaaatatttac

SEQ ID NO: 1336681 - DNA, 22 bp, Artificial Sequence
  chemically synthesized
aaaatatgcaaaatatttactg

SEQ ID NO: 1336682 - DNA, 22 bp, Artificial Sequence
  chemically synthesized
aaatatgcaaaatatttactga

SEQ ID NO: 1336683 - DNA, 22 bp, Artificial Sequence
  chemically synthesized
ccaatgtaatgttcagtaaata

SEQ ID NO: 1336684 - DNA, 22 bp, Artificial Sequence
  chemically synthesized
accaatgtaatgttcagtaaat

SEQ ID NO: 1336685 - DNA, 22 bp, Artificial Sequence
  chemically synthesized
actgaacattacattggtaaga

SEQ ID NO: 1336686 - DNA, 22 bp, Artificial Sequence
  chemically synthesized
acaatgtatgcatcttaccaat

SEQ ID NO: 1336687 - DNA, 22 bp, Artificial Sequence
  chemically synthesized
ctgaacattacattggtaagat

SEQ ID NO: 1336688 - DNA, 22 bp, Artificial Sequence
  chemically synthesized
aacattacattggtaagatgca

SEQ ID NO: 1336689 - DNA, 22 bp, Artificial Sequence
  chemically synthesized
cattaacaatgtatgcatctta

SEQ ID NO: 1336690 - DNA, 22 bp, Artificial Sequence
  chemically synthesized
ttccattaacaatgtatgcatc

SEQ ID NO: 1336691 - DNA, 22 bp, Artificial Sequence
  chemically synthesized
cattggtaagatgcatacattg

SEQ ID NO: 1336692 - DNA, 22 bp, Artificial Sequence
  chemically synthesized
gtaagatgcatacattgttaat

SEQ ID NO: 1336693 - DNA, 22 bp, Artificial Sequence
  chemically synthesized
gtatcccagcattgttccatta

SEQ ID NO: 1336694 - DNA, 22 bp, Artificial Sequence
  chemically synthesized
gatctagtatcccagcattgtt

SEQ ID NO: 1336695 - DNA, 22 bp, Artificial Sequence
  chemically synthesized
cgatctagtatcccagcattgt

SEQ ID NO: 1336696 - DNA, 22 bp, Artificial Sequence
  chemically synthesized
ttcgatctagtatcccagcatt

SEQ ID NO: 1336697 - DNA, 22 bp, Artificial Sequence
  chemically synthesized
cttcgatctagtatcccagcat

SEQ ID NO: 1336698 - DNA, 22 bp, Artificial Sequence
  chemically synthesized
ttaatggaacaatgctgggata

SEQ ID NO: 1336699 - DNA, 22 bp, Artificial Sequence
  chemically synthesized
atggaacaatgctgggatacta

SEQ ID NO: 1336700 - DNA, 22 bp, Artificial Sequence
  chemically synthesized
gtgatgacaatacttcttcgat

SEQ ID NO: 1336701 - DNA, 22 bp, Artificial Sequence
  chemically synthesized
ggatactagatcgaagaagtat

SEQ ID NO: 1336702 - DNA, 22 bp, Artificial Sequence
  chemically synthesized
ctcgtgatgacaatacttcttc

SEQ ID NO: 1336703 - DNA, 22 bp, Artificial Sequence
  chemically synthesized
ctactcgtgatgacaatacttc

SEQ ID NO: 1336704 - DNA, 22 bp, Artificial Sequence
  chemically synthesized
gctactcgtgatgacaatactt

SEQ ID NO: 1336705 - DNA, 22 bp, Artificial Sequence
  chemically synthesized
gatcgaagaagtattgtcatca

SEQ ID NO: 1336706 - DNA, 22 bp, Artificial Sequence
  chemically synthesized
caggcagcttgctactcgtgat

SEQ ID NO: 1336707 - DNA, 22 bp, Artificial Sequence
  chemically synthesized
acaggcagcttgctactcgtga

SEQ ID NO: 1336708 - DNA, 22 bp, Artificial Sequence
  chemically synthesized
tacaggcagcttgctactcgtg

SEQ ID NO: 1336709 - DNA, 22 bp, Artificial Sequence
  chemically synthesized
ttttacaggcagcttgctactc

SEQ ID NO: 1336710 - DNA, 22 bp, Artificial Sequence
  chemically synthesized
ctattttacaggcagcttgcta

SEQ ID NO: 1336711 - DNA, 22 bp, Artificial Sequence
  chemically synthesized
tcatcacgagtagcaagctgcc

SEQ ID NO: 1336712 - DNA, 22 bp, Artificial Sequence
  chemically synthesized
gagagcaatgtctactatttta

SEQ ID NO: 1336713 - DNA, 22 bp, Artificial Sequence
  chemically synthesized
agagagcaatgtctactatttt

SEQ ID NO: 1336714 - DNA, 22 bp, Artificial Sequence
  chemically synthesized
tagagagcaatgtctactattt

SEQ ID NO: 1336715 - DNA, 22 bp, Artificial Sequence
  chemically synthesized
ttagagagcaatgtctactatt

SEQ ID NO: 1336716 - DNA, 22 bp, Artificial Sequence
  chemically synthesized
cctgtaaaatagtagacattgc

SEQ ID NO: 1336717 - DNA, 22 bp, Artificial Sequence
  chemically synthesized
taaaatagtagacattgctctc

SEQ ID NO: 1336718 - DNA, 22 bp, Artificial Sequence
  chemically synthesized
atgaaatacagcatttttagag

SEQ ID NO: 1336719 - DNA, 22 bp, Artificial Sequence
  chemically synthesized
ctctctaaaaatgctgtatttc

SEQ ID NO: 1336720 - DNA, 22 bp, Artificial Sequence
  chemically synthesized
tctaaaaatgctgtatttcatt

SEQ ID NO: 1336721 - DNA, 22 bp, Artificial Sequence
  chemically synthesized
aacccatagcactaatgaaata

SEQ ID NO: 1336722 - DNA, 22 bp, Artificial Sequence
  chemically synthesized
taaaaatgctgtatttcattag

SEQ ID NO: 1336723 - DNA, 22 bp, Artificial Sequence
  chemically synthesized
aaaatgctgtatttcattagtg

SEQ ID NO: 1336724 - DNA, 22 bp, Artificial Sequence
  chemically synthesized
tatttcattagtgctatgggtt

SEQ ID NO: 1336725 - DNA, 22 bp, Artificial Sequence
  chemically synthesized
cattagtgctatgggttgaata

SEQ ID NO: 1336726 - DNA, 22 bp, Artificial Sequence
  chemically synthesized
gagggacacaaatattcaaccc

SEQ ID NO: 1336727 - DNA, 22 bp, Artificial Sequence
  chemically synthesized
attagtgctatgggttgaatat

SEQ ID NO: 1336728 - DNA, 22 bp, Artificial Sequence
  chemically synthesized
ggagggacacaaatattcaacc

SEQ ID NO: 1336729 - DNA, 22 bp, Artificial Sequence
  chemically synthesized
tggagggacacaaatattcaac

SEQ ID NO: 1336730 - DNA, 22 bp, Artificial Sequence
  chemically synthesized
gtgctatgggttgaatatttgt

SEQ ID NO: 1336731 - DNA, 22 bp, Artificial Sequence
  chemically synthesized
tgggttgaatatttgtgtccct

SEQ ID NO: 1336732 - DNA, 22 bp, Artificial Sequence
  chemically synthesized
catatgaattttggagggacac

SEQ ID NO: 1336733 - DNA, 22 bp, Artificial Sequence
  chemically synthesized
tacatatgaattttggagggac

SEQ ID NO: 1336734 - DNA, 22 bp, Artificial Sequence
  chemically synthesized
ctacatatgaattttggaggga

SEQ ID NO: 1336735 - DNA, 22 bp, Artificial Sequence
  chemically synthesized
aatatttgtgtccctccaaaat

SEQ ID NO: 1336736 - DNA, 22 bp, Artificial Sequence
  chemically synthesized
tgtttctacatatgaattttgg

SEQ ID NO: 1336737 - DNA, 22 bp, Artificial Sequence
  chemically synthesized
gtgtccctccaaaattcatatg

SEQ ID NO: 1336738 - DNA, 22 bp, Artificial Sequence
  chemically synthesized
tgtccctccaaaattcatatgt

SEQ ID NO: 1336739 - DNA, 22 bp, Artificial Sequence
  chemically synthesized
gggattatgtttctacatatga

SEQ ID NO: 1336740 - DNA, 22 bp, Artificial Sequence
  chemically synthesized
caaaattcatatgtagaaacat

SEQ ID NO: 1336741 - DNA, 22 bp, Artificial Sequence
  chemically synthesized
tggcattggggattatgtttct

SEQ ID NO: 1336742 - DNA, 22 bp, Artificial Sequence
  chemically synthesized
atatgtagaaacataatcccca

SEQ ID NO: 1336743 - DNA, 22 bp, Artificial Sequence
  chemically synthesized
atactgtggcattggggattat

SEQ ID NO: 1336744 - DNA, 22 bp, Artificial Sequence
  chemically synthesized
aatactgtggcattggggatta

SEQ ID NO: 1336745 - DNA, 22 bp, Artificial Sequence
  chemically synthesized
ttaatactgtggcattggggat

SEQ ID NO: 1336746 - DNA, 22 bp, Artificial Sequence
  chemically synthesized
cctcttaatactgtggcattgg

SEQ ID NO: 1336747 - DNA, 22 bp, Artificial Sequence
  chemically synthesized
aaaccctacctcttaatactgt

SEQ ID NO: 1336748 - DNA, 22 bp, Artificial Sequence
  chemically synthesized
aaaaccctacctcttaatactg

SEQ ID NO: 1336749 - DNA, 22 bp, Artificial Sequence
  chemically synthesized
ttaaaaccctacctcttaatac

SEQ ID NO: 1336750 - DNA, 22 bp, Artificial Sequence
  chemically synthesized
cttaaaaccctacctcttaata

SEQ ID NO: 1336751 - DNA, 22 bp, Artificial Sequence
  chemically synthesized
atcaccttcttaaaaccctacc

SEQ ID NO: 1336752 - DNA, 22 bp, Artificial Sequence
  chemically synthesized
agaggtagggttttaagaaggt

SEQ ID NO: 1336753 - DNA, 22 bp, Artificial Sequence
  chemically synthesized
tatgacctaatcaccttcttaa

SEQ ID NO: 1336754 - DNA, 22 bp, Artificial Sequence
  chemically synthesized
atatgacctaatcaccttctta

SEQ ID NO: 1336755 - DNA, 22 bp, Artificial Sequence
  chemically synthesized
cgcttatatgacctaatcacct

SEQ ID NO: 1336756 - DNA, 22 bp, Artificial Sequence
  chemically synthesized
taagaaggtgattaggtcatat

SEQ ID NO: 1336757 - DNA, 22 bp, Artificial Sequence
  chemically synthesized
aagaaggtgattaggtcatata

SEQ ID NO: 1336758 - DNA, 22 bp, Artificial Sequence
  chemically synthesized
agaaggtgattaggtcatataa

SEQ ID NO: 1336759 - DNA, 22 bp, Artificial Sequence
  chemically synthesized
atgagggctccgcttatatgac

SEQ ID NO: 1336760 - DNA, 22 bp, Artificial Sequence
  chemically synthesized
atcccattcatgagggctccgc

SEQ ID NO: 1336761 - DNA, 22 bp, Artificial Sequence
  chemically synthesized
ggtcatataagcggagccctca

SEQ ID NO: 1336762 - DNA, 22 bp, Artificial Sequence
  chemically synthesized
taagggcactaatcccattcat

SEQ ID NO: 1336763 - DNA, 22 bp, Artificial Sequence
  chemically synthesized
ataagggcactaatcccattca

SEQ ID NO: 1336764 - DNA, 22 bp, Artificial Sequence
  chemically synthesized
tataagggcactaatcccattc

SEQ ID NO: 1336765 - DNA, 22 bp, Artificial Sequence
  chemically synthesized
ttataagggcactaatcccatt

SEQ ID NO: 1336766 - DNA, 22 bp, Artificial Sequence
  chemically synthesized
ttttataagggcactaatccca

SEQ ID NO: 1336767 - DNA, 22 bp, Artificial Sequence
  chemically synthesized
gcctcttttataagggcactaa

SEQ ID NO: 1336768 - DNA, 22 bp, Artificial Sequence
  chemically synthesized
ggcctcttttataagggcacta

SEQ ID NO: 1336769 - DNA, 22 bp, Artificial Sequence
  chemically synthesized
atgaatgggattagtgccctta

SEQ ID NO: 1336770 - DNA, 22 bp, Artificial Sequence
  chemically synthesized
ccttggcctcttttataagggc

SEQ ID NO: 1336771 - DNA, 22 bp, Artificial Sequence
  chemically synthesized
gtgcccttataaaagaggccaa

SEQ ID NO: 1336772 - DNA, 22 bp, Artificial Sequence
  chemically synthesized
gaagggcaaacaagttcccttg

SEQ ID NO: 1336773 - DNA, 22 bp, Artificial Sequence
  chemically synthesized
ataaaagaggccaagggaactt

SEQ ID NO: 1336774 - DNA, 22 bp, Artificial Sequence
  chemically synthesized
taaaagaggccaagggaacttg

SEQ ID NO: 1336775 - DNA, 22 bp, Artificial Sequence
  chemically synthesized
acatactggaagggcaaacaag

SEQ ID NO: 1336776 - DNA, 22 bp, Artificial Sequence
  chemically synthesized
ccctcacatactggaagggcaa

SEQ ID NO: 1336777 - DNA, 22 bp, Artificial Sequence
  chemically synthesized
accctcacatactggaagggca

SEQ ID NO: 1336778 - DNA, 22 bp, Artificial Sequence
  chemically synthesized
taccctcacatactggaagggc

SEQ ID NO: 1336779 - DNA, 22 bp, Artificial Sequence
  chemically synthesized
ctttaccctcacatactggaag

SEQ ID NO: 1336780 - DNA, 22 bp, Artificial Sequence
  chemically synthesized
cctttaccctcacatactggaa

SEQ ID NO: 1336781 - DNA, 22 bp, Artificial Sequence
  chemically synthesized
ttcctttaccctcacatactgg

SEQ ID NO: 1336782 - DNA, 22 bp, Artificial Sequence
  chemically synthesized
cttcctttaccctcacatactg

SEQ ID NO: 1336783 - DNA, 22 bp, Artificial Sequence
  chemically synthesized
gtttgcccttccagtatgtgag

SEQ ID NO: 1336784 - DNA, 22 bp, Artificial Sequence
  chemically synthesized
tttgcccttccagtatgtgagg

SEQ ID NO: 1336785 - DNA, 22 bp, Artificial Sequence
  chemically synthesized
gcccttccagtatgtgagggta

SEQ ID NO: 1336786 - DNA, 22 bp, Artificial Sequence
  chemically synthesized
cccttccagtatgtgagggtaa

SEQ ID NO: 1336787 - DNA, 22 bp, Artificial Sequence
  chemically synthesized
ccagtatgtgagggtaaaggaa

SEQ ID NO: 1336788 - DNA, 22 bp, Artificial Sequence
  chemically synthesized
cagtatgtgagggtaaaggaag

SEQ ID NO: 1336789 - DNA, 22 bp, Artificial Sequence
  chemically synthesized
acagatggtgccttcttccttt

SEQ ID NO: 1336790 - DNA, 22 bp, Artificial Sequence
  chemically synthesized
cacagatggtgccttcttcctt

SEQ ID NO: 1336791 - DNA, 22 bp, Artificial Sequence
  chemically synthesized
cttcacagatggtgccttcttc

SEQ ID NO: 1336792 - DNA, 22 bp, Artificial Sequence
  chemically synthesized
tctgcttcacagatggtgcctt

SEQ ID NO: 1336793 - DNA, 22 bp, Artificial Sequence
  chemically synthesized
tgtctgcttcacagatggtgcc

SEQ ID NO: 1336794 - DNA, 22 bp, Artificial Sequence
  chemically synthesized
gtgagggttctgtctgcttcac

SEQ ID NO: 1336795 - DNA, 22 bp, Artificial Sequence
  chemically synthesized
gtgtctggtgagggttctgtct

SEQ ID NO: 1336796 - DNA, 22 bp, Artificial Sequence
  chemically synthesized
ggtgtctggtgagggttctgtc

SEQ ID NO: 1336797 - DNA, 22 bp, Artificial Sequence
  chemically synthesized
tgaagcagacagaaccctcacc

SEQ ID NO: 1336798 - DNA, 22 bp, Artificial Sequence
  chemically synthesized
gcagatttggtgtctggtgagg

SEQ ID NO: 1336799 - DNA, 22 bp, Artificial Sequence
  chemically synthesized
accagacaccaaatctgccaac

SEQ ID NO: 1336800 - DNA, 22 bp, Artificial Sequence
  chemically synthesized
cagcccaggaaatccaagatca

SEQ ID NO: 1336801 - DNA, 22 bp, Artificial Sequence
  chemically synthesized
tgcagcccaggaaatccaagat

SEQ ID NO: 1336802 - DNA, 22 bp, Artificial Sequence
  chemically synthesized
ccaacattttgatcttggattt

SEQ ID NO: 1336803 - DNA, 22 bp, Artificial Sequence
  chemically synthesized
ctgcagcccaggaaatccaaga

SEQ ID NO: 1336804 - DNA, 22 bp, Artificial Sequence
  chemically synthesized
tttctgcagcccaggaaatcca

SEQ ID NO: 1336805 - DNA, 22 bp, Artificial Sequence
  chemically synthesized
tgatcttggatttcctgggctg

SEQ ID NO: 1336806 - DNA, 22 bp, Artificial Sequence
  chemically synthesized
gatcttggatttcctgggctgc

SEQ ID NO: 1336807 - DNA, 22 bp, Artificial Sequence
  chemically synthesized
atcttggatttcctgggctgca

SEQ ID NO: 1336808 - DNA, 22 bp, Artificial Sequence
  chemically synthesized
cagaactgtttctgcagcccag

SEQ ID NO: 1336809 - DNA, 22 bp, Artificial Sequence
  chemically synthesized
ctgcagaactgtttctgcagcc

SEQ ID NO: 1336810 - DNA, 22 bp, Artificial Sequence
  chemically synthesized
ggatttcctgggctgcagaaac

SEQ ID NO: 1336811 - DNA, 22 bp, Artificial Sequence
  chemically synthesized
gatttcctgggctgcagaaaca

SEQ ID NO: 1336812 - DNA, 22 bp, Artificial Sequence
  chemically synthesized
ttgctgcagaactgtttctgca

SEQ ID NO: 1336813 - DNA, 22 bp, Artificial Sequence
  chemically synthesized
attgctgcagaactgtttctgc

SEQ ID NO: 1336814 - DNA, 22 bp, Artificial Sequence
  chemically synthesized
cctgggctgcagaaacagttct

SEQ ID NO: 1336815 - DNA, 22 bp, Artificial Sequence
  chemically synthesized
ctgggctgcagaaacagttctg

SEQ ID NO: 1336816 - DNA, 22 bp, Artificial Sequence
  chemically synthesized
ggctgcagaaacagttctgcag

SEQ ID NO: 1336817 - DNA, 22 bp, Artificial Sequence
  chemically synthesized
cagaaacagttctgcagcaata

SEQ ID NO: 1336818 - DNA, 22 bp, Artificial Sequence
  chemically synthesized
taaacaacgaagatttattgct

SEQ ID NO: 1336819 - DNA, 22 bp, Artificial Sequence
  chemically synthesized
ataaacaacgaagatttattgc

SEQ ID NO: 1336820 - DNA, 22 bp, Artificial Sequence
  chemically synthesized
tgcagcaataaatcttcgttgt

SEQ ID NO: 1336821 - DNA, 22 bp, Artificial Sequence
  chemically synthesized
tgtaatttataaacaacgaaga

SEQ ID NO: 1336822 - DNA, 22 bp, Artificial Sequence
  chemically synthesized
cagcaataaatcttcgttgttt

SEQ ID NO: 1336823 - DNA, 22 bp, Artificial Sequence
  chemically synthesized
cgttgtttataaattacacagt

SEQ ID NO: 1336824 - DNA, 22 bp, Artificial Sequence
  chemically synthesized
gttgtttataaattacacagtc

SEQ ID NO: 1336825 - DNA, 22 bp, Artificial Sequence
  chemically synthesized
tttataaattacacagtctatg

SEQ ID NO: 1336826 - DNA, 22 bp, Artificial Sequence
  chemically synthesized
taataaaaatatcatagactgt

SEQ ID NO: 1336827 - DNA, 22 bp, Artificial Sequence
  chemically synthesized
ataaattacacagtctatgata

SEQ ID NO: 1336828 - DNA, 22 bp, Artificial Sequence
  chemically synthesized
ctataataaaaatatcatagac

SEQ ID NO: 1336829 - DNA, 22 bp, Artificial Sequence
  chemically synthesized
taaattacacagtctatgatat

SEQ ID NO: 1336830 - DNA, 22 bp, Artificial Sequence
  chemically synthesized
ggctgctataataaaaatatca

SEQ ID NO: 1336831 - DNA, 22 bp, Artificial Sequence
  chemically synthesized
cacagtctatgatatttttatt

SEQ ID NO: 1336832 - DNA, 22 bp, Artificial Sequence
  chemically synthesized
aattgggctgctataataaaaa

SEQ ID NO: 1336833 - DNA, 22 bp, Artificial Sequence
  chemically synthesized
gttcaattgggctgctataata

SEQ ID NO: 1336834 - DNA, 22 bp, Artificial Sequence
  chemically synthesized
agttcaattgggctgctataat

SEQ ID NO: 1336835 - DNA, 22 bp, Artificial Sequence
  chemically synthesized
tgatatttttattatagcagcc

SEQ ID NO: 1336836 - DNA, 22 bp, Artificial Sequence
  chemically synthesized
tcttagttcaattgggctgcta

SEQ ID NO: 1336837 - DNA, 22 bp, Artificial Sequence
  chemically synthesized
attgtcttagttcaattgggct

SEQ ID NO: 1336838 - DNA, 22 bp, Artificial Sequence
  chemically synthesized
ttattatagcagcccaattgaa

SEQ ID NO: 1336839 - DNA, 22 bp, Artificial Sequence
  chemically synthesized
tattatagcagcccaattgaac

SEQ ID NO: 1336840 - DNA, 22 bp, Artificial Sequence
  chemically synthesized
ctaattgtcttagttcaattgg

SEQ ID NO: 1336841 - DNA, 22 bp, Artificial Sequence
  chemically synthesized
attatagcagcccaattgaact

SEQ ID NO: 1336842 - DNA, 22 bp, Artificial Sequence
  chemically synthesized
ttatagcagcccaattgaacta

SEQ ID NO: 1336843 - DNA, 22 bp, Artificial Sequence
  chemically synthesized
ctcctaattgtcttagttcaat

SEQ ID NO: 1336844 - DNA, 22 bp, Artificial Sequence
  chemically synthesized
actcctaattgtcttagttcaa

SEQ ID NO: 1336845 - DNA, 22 bp, Artificial Sequence
  chemically synthesized
tagcagcccaattgaactaaga

SEQ ID NO: 1336846 - DNA, 22 bp, Artificial Sequence
  chemically synthesized
ttactcctaattgtcttagttc

SEQ ID NO: 1336847 - DNA, 22 bp, Artificial Sequence
  chemically synthesized
cttactcctaattgtcttagtt

SEQ ID NO: 1336848 - DNA, 22 bp, Artificial Sequence
  chemically synthesized
gtacttcttactcctaattgtc

SEQ ID NO: 1336849 - DNA, 22 bp, Artificial Sequence
  chemically synthesized
cgtacttcttactcctaattgt

SEQ ID NO: 1336850 - DNA, 22 bp, Artificial Sequence
  chemically synthesized
ttcgtacttcttactcctaatt

SEQ ID NO: 1336851 - DNA, 22 bp, Artificial Sequence
  chemically synthesized
aactaagacaattaggagtaag

SEQ ID NO: 1336852 - DNA, 22 bp, Artificial Sequence
  chemically synthesized
agacaattaggagtaagaagta

SEQ ID NO: 1336853 - DNA, 22 bp, Artificial Sequence
  chemically synthesized
ggagtaagaagtacgaagaatt

SEQ ID NO: 1336854 - DNA, 22 bp, Artificial Sequence
  chemically synthesized
atcatatataatgatggtaatt

SEQ ID NO: 1336855 - DNA, 22 bp, Artificial Sequence
  chemically synthesized
acctcatcatatataatgatgg

SEQ ID NO: 1336856 - DNA, 22 bp, Artificial Sequence
  chemically synthesized
aacctcatcatatataatgatg

SEQ ID NO: 1336857 - DNA, 22 bp, Artificial Sequence
  chemically synthesized
taacctcatcatatataatgat

SEQ ID NO: 1336858 - DNA, 22 bp, Artificial Sequence
  chemically synthesized
ttaacctcatcatatataatga

SEQ ID NO: 1336859 - DNA, 22 bp, Artificial Sequence
  chemically synthesized
taatttttaacctcatcatata

SEQ ID NO: 1336860 - DNA, 22 bp, Artificial Sequence
  chemically synthesized
tataatttttaacctcatcata

SEQ ID NO: 1336861 - DNA, 22 bp, Artificial Sequence
  chemically synthesized
ccatcattatatatgatgaggt

SEQ ID NO: 1336862 - DNA, 22 bp, Artificial Sequence
  chemically synthesized
ctataatttttaacctcatcat

SEQ ID NO: 1336863 - DNA, 22 bp, Artificial Sequence
  chemically synthesized
tctataatttttaacctcatca

SEQ ID NO: 1336864 - DNA, 22 bp, Artificial Sequence
  chemically synthesized
ttctataatttttaacctcatc

SEQ ID NO: 1336865 - DNA, 22 bp, Artificial Sequence
  chemically synthesized
tatatgatgaggttaaaaatta

SEQ ID NO: 1336866 - DNA, 22 bp, Artificial Sequence
  chemically synthesized
tagaaatatcttttctataatt

SEQ ID NO: 1336867 - DNA, 22 bp, Artificial Sequence
  chemically synthesized
tgtagaaatatcttttctataa

SEQ ID NO: 1336868 - DNA, 22 bp, Artificial Sequence
  chemically synthesized
ctgtagaaatatcttttctata

SEQ ID NO: 1336869 - DNA, 22 bp, Artificial Sequence
  chemically synthesized
ttctgtagaaatatcttttcta

SEQ ID NO: 1336870 - DNA, 22 bp, Artificial Sequence
  chemically synthesized
aaaattatagaaaagatatttc

SEQ ID NO: 1336871 - DNA, 22 bp, Artificial Sequence
  chemically synthesized
aaaattcttctgtagaaatatc

SEQ ID NO: 1336872 - DNA, 22 bp, Artificial Sequence
  chemically synthesized
aaaaattcttctgtagaaatat

SEQ ID NO: 1336873 - DNA, 22 bp, Artificial Sequence
  chemically synthesized
tagaaaagatatttctacagaa

SEQ ID NO: 1336874 - DNA, 22 bp, Artificial Sequence
  chemically synthesized
taccacttaaaaattcttctgt

SEQ ID NO: 1336875 - DNA, 22 bp, Artificial Sequence
  chemically synthesized
gtaccacttaaaaattcttctg

SEQ ID NO: 1336876 - DNA, 22 bp, Artificial Sequence
  chemically synthesized
aacttgtaccacttaaaaattc

SEQ ID NO: 1336877 - DNA, 22 bp, Artificial Sequence
  chemically synthesized
ctacagaagaatttttaagtgg

SEQ ID NO: 1336878 - DNA, 22 bp, Artificial Sequence
  chemically synthesized
tacagaagaatttttaagtggt

SEQ ID NO: 1336879 - DNA, 22 bp, Artificial Sequence
  chemically synthesized
cagaagaatttttaagtggtac

SEQ ID NO: 1336880 - DNA, 22 bp, Artificial Sequence
  chemically synthesized
tatatgtattaaacttgtacca

SEQ ID NO: 1336881 - DNA, 22 bp, Artificial Sequence
  chemically synthesized
atatatgtattaaacttgtacc

SEQ ID NO: 1336882 - DNA, 22 bp, Artificial Sequence
  chemically synthesized
ttaagtggtacaagtttaatac

SEQ ID NO: 1336883 - DNA, 22 bp, Artificial Sequence
  chemically synthesized
taagtggtacaagtttaataca

SEQ ID NO: 1336884 - DNA, 22 bp, Artificial Sequence
  chemically synthesized
tatatttatatatgtattaaac

SEQ ID NO: 1336885 - DNA, 22 bp, Artificial Sequence
  chemically synthesized
aagtggtacaagtttaatacat

SEQ ID NO: 1336886 - DNA, 22 bp, Artificial Sequence
  chemically synthesized
gtatatttatatatgtattaaa

SEQ ID NO: 1336887 - DNA, 22 bp, Artificial Sequence
  chemically synthesized
agtggtacaagtttaatacata

SEQ ID NO: 1336888 - DNA, 22 bp, Artificial Sequence
  chemically synthesized
aacttgtatatttatatatgta

SEQ ID NO: 1336889 - DNA, 22 bp, Artificial Sequence
  chemically synthesized
aatacatatataaatatacaag

SEQ ID NO: 1336890 - DNA, 22 bp, Artificial Sequence
  chemically synthesized
atacatatataaatatacaagt

SEQ ID NO: 1336891 - DNA, 22 bp, Artificial Sequence
  chemically synthesized
aatatataaaatatatactaaa

SEQ ID NO: 1336892 - DNA, 22 bp, Artificial Sequence
  chemically synthesized
gaatatataaaatatatactaa

SEQ ID NO: 1336893 - DNA, 22 bp, Artificial Sequence
  chemically synthesized
aacttgaatatataaaatatat

SEQ ID NO: 1336894 - DNA, 22 bp, Artificial Sequence
  chemically synthesized
aaacttgaatatataaaatata

SEQ ID NO: 1336895 - DNA, 22 bp, Artificial Sequence
  chemically synthesized
taaacttgaatatataaaatat

SEQ ID NO: 1336896 - DNA, 22 bp, Artificial Sequence
  chemically synthesized
ttaaacttgaatatataaaata

SEQ ID NO: 1336897 - DNA, 22 bp, Artificial Sequence
  chemically synthesized
agtatatattttatatattcaa

SEQ ID NO: 1336898 - DNA, 22 bp, Artificial Sequence
  chemically synthesized
gtatatattttatatattcaag

SEQ ID NO: 1336899 - DNA, 22 bp, Artificial Sequence
  chemically synthesized
tatatattcaagtttaaaaact

SEQ ID NO: 1336900 - DNA, 22 bp, Artificial Sequence
  chemically synthesized
atatattcaagtttaaaaacta

SEQ ID NO: 1336901 - DNA, 22 bp, Artificial Sequence
  chemically synthesized
tatattcaagtttaaaaactat

SEQ ID NO: 1336902 - DNA, 22 bp, Artificial Sequence
  chemically synthesized
atatatatgtatatagttttta

SEQ ID NO: 1336903 - DNA, 22 bp, Artificial Sequence
  chemically synthesized
aatatatatgtatatagttttt

SEQ ID NO: 1336904 - DNA, 22 bp, Artificial Sequence
  chemically synthesized
taatatatatgtatatagtttt

SEQ ID NO: 1336905 - DNA, 22 bp, Artificial Sequence
  chemically synthesized
aagtttaaaaactatatacata

SEQ ID NO: 1336906 - DNA, 22 bp, Artificial Sequence
  chemically synthesized
aaaaactatatacatatatatt

SEQ ID NO: 1336907 - DNA, 22 bp, Artificial Sequence
  chemically synthesized
aaaactatatacatatatatta

SEQ ID NO: 1336908 - DNA, 22 bp, Artificial Sequence
  chemically synthesized
tgtgataaattttaatatatat

SEQ ID NO: 1336909 - DNA, 22 bp, Artificial Sequence
  chemically synthesized
atgtgataaattttaatatata

SEQ ID NO: 1336910 - DNA, 22 bp, Artificial Sequence
  chemically synthesized
tatgtgataaattttaatatat

SEQ ID NO: 1336911 - DNA, 22 bp, Artificial Sequence
  chemically synthesized
ttatgtgataaattttaatata

SEQ ID NO: 1336912 - DNA, 22 bp, Artificial Sequence
  chemically synthesized
tatacatatatattaaaattta

SEQ ID NO: 1336913 - DNA, 22 bp, Artificial Sequence
  chemically synthesized
gagaggtatttttatgtgataa

SEQ ID NO: 1336914 - DNA, 22 bp, Artificial Sequence
  chemically synthesized
tagagaggtatttttatgtgat

SEQ ID NO: 1336915 - DNA, 22 bp, Artificial Sequence
  chemically synthesized
ctagagaggtatttttatgtga

SEQ ID NO: 1336916 - DNA, 22 bp, Artificial Sequence
  chemically synthesized
aaatttatcacataaaaatacc

SEQ ID NO: 1336917 - DNA, 22 bp, Artificial Sequence
  chemically synthesized
atcacataaaaatacctctcta

SEQ ID NO: 1336918 - DNA, 22 bp, Artificial Sequence
  chemically synthesized
tcacataaaaatacctctctag

SEQ ID NO: 1336919 - DNA, 22 bp, Artificial Sequence
  chemically synthesized
tagaaaggatatttctagagag

SEQ ID NO: 1336920 - DNA, 22 bp, Artificial Sequence
  chemically synthesized
aaaattatagaaaggatatttc

SEQ ID NO: 1336921 - DNA, 22 bp, Artificial Sequence
  chemically synthesized
tctagaaatatcctttctataa

SEQ ID NO: 1336922 - DNA, 22 bp, Artificial Sequence
  chemically synthesized
tagaaatatcctttctataatt

SEQ ID NO: 1336923 - DNA, 22 bp, Artificial Sequence
  chemically synthesized
gaaatatcctttctataatttt

SEQ ID NO: 1336924 - DNA, 22 bp, Artificial Sequence
  chemically synthesized
caataaatgatgaggttaaaaa

SEQ ID NO: 1336925 - DNA, 22 bp, Artificial Sequence
  chemically synthesized
tctataatttttaacctcatca

SEQ ID NO: 1336926 - DNA, 22 bp, Artificial Sequence
  chemically synthesized
ctataatttttaacctcatcat

SEQ ID NO: 1336927 - DNA, 22 bp, Artificial Sequence
  chemically synthesized
tataatttttaacctcatcatt

SEQ ID NO: 1336928 - DNA, 22 bp, Artificial Sequence
  chemically synthesized
taatttttaacctcatcattta

SEQ ID NO: 1336929 - DNA, 22 bp, Artificial Sequence
  chemically synthesized
cataacaaattccaataaatga

SEQ ID NO: 1336930 - DNA, 22 bp, Artificial Sequence
  chemically synthesized
ttaacctcatcatttattggaa

SEQ ID NO: 1336931 - DNA, 22 bp, Artificial Sequence
  chemically synthesized
taacctcatcatttattggaat

SEQ ID NO: 1336932 - DNA, 22 bp, Artificial Sequence
  chemically synthesized
cctccataacaaattccaataa

SEQ ID NO: 1336933 - DNA, 22 bp, Artificial Sequence
  chemically synthesized
aacctcatcatttattggaatt

SEQ ID NO: 1336934 - DNA, 22 bp, Artificial Sequence
  chemically synthesized
acctcatcatttattggaattt

SEQ ID NO: 1336935 - DNA, 22 bp, Artificial Sequence
  chemically synthesized
atcatttattggaatttgttat

SEQ ID NO: 1336936 - DNA, 22 bp, Artificial Sequence
  chemically synthesized
attggaatttgttatggaggga

SEQ ID NO: 1336937 - DNA, 22 bp, Artificial Sequence
  chemically synthesized
ttggaatttgttatggagggag

SEQ ID NO: 1336938 - DNA, 22 bp, Artificial Sequence
  chemically synthesized
gaatttgttatggagggagatc

SEQ ID NO: 1336939 - DNA, 22 bp, Artificial Sequence
  chemically synthesized
agggagcaggggacgatctccc

SEQ ID NO: 1336940 - DNA, 22 bp, Artificial Sequence
  chemically synthesized
aagggagcaggggacgatctcc

SEQ ID NO: 1336941 - DNA, 22 bp, Artificial Sequence
  chemically synthesized
taagggagcaggggacgatctc

SEQ ID NO: 1336942 - DNA, 22 bp, Artificial Sequence
  chemically synthesized
gttatggagggagatcgtcccc

SEQ ID NO: 1336943 - DNA, 22 bp, Artificial Sequence
  chemically synthesized
ttatggagggagatcgtcccct

SEQ ID NO: 1336944 - DNA, 22 bp, Artificial Sequence
  chemically synthesized
tggagggagatcgtcccctgct

SEQ ID NO: 1336945 - DNA, 22 bp, Artificial Sequence
  chemically synthesized
taaactttaagggagcagggga

SEQ ID NO: 1336946 - DNA, 22 bp, Artificial Sequence
  chemically synthesized
tataaactttaagggagcaggg

SEQ ID NO: 1336947 - DNA, 22 bp, Artificial Sequence
  chemically synthesized
ctataaactttaagggagcagg

SEQ ID NO: 1336948 - DNA, 22 bp, Artificial Sequence
  chemically synthesized
tttctataaactttaagggagc

SEQ ID NO: 1336949 - DNA, 22 bp, Artificial Sequence
  chemically synthesized
acctatttctataaactttaag

SEQ ID NO: 1336950 - DNA, 22 bp, Artificial Sequence
  chemically synthesized
ctcccttaaagtttatagaaat

SEQ ID NO: 1336951 - DNA, 22 bp, Artificial Sequence
  chemically synthesized
ccttaaagtttatagaaatagg

SEQ ID NO: 1336952 - DNA, 22 bp, Artificial Sequence
  chemically synthesized
aaagtttatagaaataggtcaa

SEQ ID NO: 1336953 - DNA, 22 bp, Artificial Sequence
  chemically synthesized
aagtttatagaaataggtcaat

SEQ ID NO: 1336954 - DNA, 22 bp, Artificial Sequence
  chemically synthesized
atagaaataggtcaatgccatc

SEQ ID NO: 1336955 - DNA, 22 bp, Artificial Sequence
  chemically synthesized
tagaaataggtcaatgccatct

SEQ ID NO: 1336956 - DNA, 22 bp, Artificial Sequence
  chemically synthesized
ggagagccccgaaagatggcat

SEQ ID NO: 1336957 - DNA, 22 bp, Artificial Sequence
  chemically synthesized
gggagagccccgaaagatggca

SEQ ID NO: 1336958 - DNA, 22 bp, Artificial Sequence
  chemically synthesized
taatagtcttgggagagccccg

SEQ ID NO: 1336959 - DNA, 22 bp, Artificial Sequence
  chemically synthesized
ttgtaatagtcttgggagagcc

SEQ ID NO: 1336960 - DNA, 22 bp, Artificial Sequence
  chemically synthesized
attgtaatagtcttgggagagc

SEQ ID NO: 1336961 - DNA, 22 bp, Artificial Sequence
  chemically synthesized
tattgtaatagtcttgggagag

SEQ ID NO: 1336962 - DNA, 22 bp, Artificial Sequence
  chemically synthesized
tcggggctctcccaagactatt

SEQ ID NO: 1336963 - DNA, 22 bp, Artificial Sequence
  chemically synthesized
cggggctctcccaagactatta

SEQ ID NO: 1336964 - DNA, 22 bp, Artificial Sequence
  chemically synthesized
ggggctctcccaagactattac

SEQ ID NO: 1336965 - DNA, 22 bp, Artificial Sequence
  chemically synthesized
caccccgttttattgtaatagt

SEQ ID NO: 1336966 - DNA, 22 bp, Artificial Sequence
  chemically synthesized
ctacaccccgttttattgtaat

SEQ ID NO: 1336967 - DNA, 22 bp, Artificial Sequence
  chemically synthesized
gctacaccccgttttattgtaa

SEQ ID NO: 1336968 - DNA, 22 bp, Artificial Sequence
  chemically synthesized
tcccaagactattacaataaaa

SEQ ID NO: 1336969 - DNA, 22 bp, Artificial Sequence
  chemically synthesized
ccaagactattacaataaaacg

SEQ ID NO: 1336970 - DNA, 22 bp, Artificial Sequence
  chemically synthesized
tcttgctacaccccgttttatt

SEQ ID NO: 1336971 - DNA, 22 bp, Artificial Sequence
  chemically synthesized
atcttgctacaccccgttttat

SEQ ID NO: 1336972 - DNA, 22 bp, Artificial Sequence
  chemically synthesized
tttatcttgctacaccccgttt

SEQ ID NO: 1336973 - DNA, 22 bp, Artificial Sequence
  chemically synthesized
atttatcttgctacaccccgtt

SEQ ID NO: 1336974 - DNA, 22 bp, Artificial Sequence
  chemically synthesized
tatttatcttgctacaccccgt

SEQ ID NO: 1336975 - DNA, 22 bp, Artificial Sequence
  chemically synthesized
ttacaataaaacggggtgtagc

SEQ ID NO: 1336976 - DNA, 22 bp, Artificial Sequence
  chemically synthesized
caataaaacggggtgtagcaag

SEQ ID NO: 1336977 - DNA, 22 bp, Artificial Sequence
  chemically synthesized
agtgtgttttatttatcttgct

SEQ ID NO: 1336978 - DNA, 22 bp, Artificial Sequence
  chemically synthesized
cctaagtgtgttttatttatct

SEQ ID NO: 1336979 - DNA, 22 bp, Artificial Sequence
  chemically synthesized
gcctaagtgtgttttatttatc

SEQ ID NO: 1336980 - DNA, 22 bp, Artificial Sequence
  chemically synthesized
gcacaccttgcctaagtgtgtt

SEQ ID NO: 1336981 - DNA, 22 bp, Artificial Sequence
  chemically synthesized
gaaatcctagcacaccttgcct

SEQ ID NO: 1336982 - DNA, 22 bp, Artificial Sequence
  chemically synthesized
aagtggttggaaatcctagcac

SEQ ID NO: 1336983 - DNA, 22 bp, Artificial Sequence
  chemically synthesized
aggcaaggtgtgctaggatttc

SEQ ID NO: 1336984 - DNA, 22 bp, Artificial Sequence
  chemically synthesized
ggcaaggtgtgctaggatttcc

SEQ ID NO: 1336985 - DNA, 22 bp, Artificial Sequence
  chemically synthesized
atgccaagttaaagtggttgga

SEQ ID NO: 1336986 - DNA, 22 bp, Artificial Sequence
  chemically synthesized
ggatttccaaccactttaactt

SEQ ID NO: 1336987 - DNA, 22 bp, Artificial Sequence
  chemically synthesized
atagtcctcatgccaagttaaa

SEQ ID NO: 1336988 - DNA, 22 bp, Artificial Sequence
  chemically synthesized
ccaaccactttaacttggcatg

SEQ ID NO: 1336989 - DNA, 22 bp, Artificial Sequence
  chemically synthesized
caaccactttaacttggcatga

SEQ ID NO: 1336990 - DNA, 22 bp, Artificial Sequence
  chemically synthesized
gactaatagtcctcatgccaag

SEQ ID NO: 1336991 - DNA, 22 bp, Artificial Sequence
  chemically synthesized
ttagactaatagtcctcatgcc

SEQ ID NO: 1336992 - DNA, 22 bp, Artificial Sequence
  chemically synthesized
tgttagactaatagtcctcatg

SEQ ID NO: 1336993 - DNA, 22 bp, Artificial Sequence
  chemically synthesized
taacttggcatgaggactatta

SEQ ID NO: 1336994 - DNA, 22 bp, Artificial Sequence
  chemically synthesized
attctgttagactaatagtcct

SEQ ID NO: 1336995 - DNA, 22 bp, Artificial Sequence
  chemically synthesized
aacttggcatgaggactattag

SEQ ID NO: 1336996 - DNA, 22 bp, Artificial Sequence
  chemically synthesized
acttggcatgaggactattagt

SEQ ID NO: 1336997 - DNA, 22 bp, Artificial Sequence
  chemically synthesized
ggcatgaggactattagtctaa

SEQ ID NO: 1336998 - DNA, 22 bp, Artificial Sequence
  chemically synthesized
gcatgaggactattagtctaac

SEQ ID NO: 1336999 - DNA, 22 bp, Artificial Sequence
  chemically synthesized
agtatctcattctgttagacta

SEQ ID NO: 1337000 - DNA, 22 bp, Artificial Sequence
  chemically synthesized
tcagtatctcattctgttagac

SEQ ID NO: 1337001 - DNA, 22 bp, Artificial Sequence
  chemically synthesized
ttagtctaacagaatgagatac

SEQ ID NO: 1337002 - DNA, 22 bp, Artificial Sequence
  chemically synthesized
atgatgtgttctcagtatctca

SEQ ID NO: 1337003 - DNA, 22 bp, Artificial Sequence
  chemically synthesized
gtctaacagaatgagatactga

SEQ ID NO: 1337004 - DNA, 22 bp, Artificial Sequence
  chemically synthesized
tgatgatgtgttctcagtatct

SEQ ID NO: 1337005 - DNA, 22 bp, Artificial Sequence
  chemically synthesized
ctgatgatgtgttctcagtatc

SEQ ID NO: 1337006 - DNA, 22 bp, Artificial Sequence
  chemically synthesized
acagaatgagatactgagaaca

SEQ ID NO: 1337007 - DNA, 22 bp, Artificial Sequence
  chemically synthesized
agtgcttctgatgatgtgttct

SEQ ID NO: 1337008 - DNA, 22 bp, Artificial Sequence
  chemically synthesized
aagtgcttctgatgatgtgttc

SEQ ID NO: 1337009 - DNA, 22 bp, Artificial Sequence
  chemically synthesized
tgcttaagtgcttctgatgatg

SEQ ID NO: 1337010 - DNA, 22 bp, Artificial Sequence
  chemically synthesized
atgcttaagtgcttctgatgat

SEQ ID NO: 1337011 - DNA, 22 bp, Artificial Sequence
  chemically synthesized
agaacacatcatcagaagcact

SEQ ID NO: 1337012 - DNA, 22 bp, Artificial Sequence
  chemically synthesized
taaaaagagaacatttatgctt

SEQ ID NO: 1337013 - DNA, 22 bp, Artificial Sequence
  chemically synthesized
aagcataaatgttctcttttta

SEQ ID NO: 1337014 - DNA, 22 bp, Artificial Sequence
  chemically synthesized
cccccaccactataaaaagaga

SEQ ID NO: 1337015 - DNA, 22 bp, Artificial Sequence
  chemically synthesized
agcataaatgttctctttttat

SEQ ID NO: 1337016 - DNA, 22 bp, Artificial Sequence
  chemically synthesized
tcctccccccaccactataaaa

SEQ ID NO: 1337017 - DNA, 22 bp, Artificial Sequence
  chemically synthesized
ccgttatcctccccccaccact

SEQ ID NO: 1337018 - DNA, 22 bp, Artificial Sequence
  chemically synthesized
tcccgttatcctccccccacca

SEQ ID NO: 1337019 - DNA, 22 bp, Artificial Sequence
  chemically synthesized
tctttttatagtggtgggggga

SEQ ID NO: 1337020 - DNA, 22 bp, Artificial Sequence
  chemically synthesized
ctcccgttatcctccccccacc

SEQ ID NO: 1337021 - DNA, 22 bp, Artificial Sequence
  chemically synthesized
tttttatagtggtggggggagg

SEQ ID NO: 1337022 - DNA, 22 bp, Artificial Sequence
  chemically synthesized
tttatagtggtggggggaggat

SEQ ID NO: 1337023 - DNA, 22 bp, Artificial Sequence
  chemically synthesized
atttctcccgttatcctccccc

SEQ ID NO: 1337024 - DNA, 22 bp, Artificial Sequence
  chemically synthesized
ttatagtggtggggggaggata

SEQ ID NO: 1337025 - DNA, 22 bp, Artificial Sequence
  chemically synthesized
tatagtggtggggggaggataa

SEQ ID NO: 1337026 - DNA, 22 bp, Artificial Sequence
  chemically synthesized
atagtggtggggggaggataac

SEQ ID NO: 1337027 - DNA, 22 bp, Artificial Sequence
  chemically synthesized
ctcatttctcccgttatcctcc

SEQ ID NO: 1337028 - DNA, 22 bp, Artificial Sequence
  chemically synthesized
tagtggtggggggaggataacg

SEQ ID NO: 1337029 - DNA, 22 bp, Artificial Sequence
  chemically synthesized
actcatttctcccgttatcctc

SEQ ID NO: 1337030 - DNA, 22 bp, Artificial Sequence
  chemically synthesized
tactcatttctcccgttatcct

SEQ ID NO: 1337031 - DNA, 22 bp, Artificial Sequence
  chemically synthesized
ttactcatttctcccgttatcc

SEQ ID NO: 1337032 - DNA, 22 bp, Artificial Sequence
  chemically synthesized
aaaccacatttttactcatttc

SEQ ID NO: 1337033 - DNA, 22 bp, Artificial Sequence
  chemically synthesized
gaagctgaaaccacatttttac

SEQ ID NO: 1337034 - DNA, 22 bp, Artificial Sequence
  chemically synthesized
gtgaaactagaagctgaaacca

SEQ ID NO: 1337035 - DNA, 22 bp, Artificial Sequence
  chemically synthesized
ctagtgaaactagaagctgaaa

SEQ ID NO: 1337036 - DNA, 22 bp, Artificial Sequence
  chemically synthesized
tccgttcctagtgaaactagaa

SEQ ID NO: 1337037 - DNA, 22 bp, Artificial Sequence
  chemically synthesized
gtccgttcctagtgaaactaga

SEQ ID NO: 1337038 - DNA, 22 bp, Artificial Sequence
  chemically synthesized
atttgtccgttcctagtgaaac

SEQ ID NO: 1337039 - DNA, 22 bp, Artificial Sequence
  chemically synthesized
taatttgtccgttcctagtgaa

SEQ ID NO: 1337040 - DNA, 22 bp, Artificial Sequence
  chemically synthesized
cagcttctagtttcactaggaa

SEQ ID NO: 1337041 - DNA, 22 bp, Artificial Sequence
  chemically synthesized
ctaatttgtccgttcctagtga

SEQ ID NO: 1337042 - DNA, 22 bp, Artificial Sequence
  chemically synthesized
agcttctagtttcactaggaac

SEQ ID NO: 1337043 - DNA, 22 bp, Artificial Sequence
  chemically synthesized
tctaatttgtccgttcctagtg

SEQ ID NO: 1337044 - DNA, 22 bp, Artificial Sequence
  chemically synthesized
actttctaatttgtccgttcct

SEQ ID NO: 1337045 - DNA, 22 bp, Artificial Sequence
  chemically synthesized
ctagtttcactaggaacggaca

SEQ ID NO: 1337046 - DNA, 22 bp, Artificial Sequence
  chemically synthesized
cactttctaatttgtccgttcc

SEQ ID NO: 1337047 - DNA, 22 bp, Artificial Sequence
  chemically synthesized
tagtttcactaggaacggacaa

SEQ ID NO: 1337048 - DNA, 22 bp, Artificial Sequence
  chemically synthesized
gtttcactaggaacggacaaat

SEQ ID NO: 1337049 - DNA, 22 bp, Artificial Sequence
  chemically synthesized
acatttcactttctaatttgtc

SEQ ID NO: 1337050 - DNA, 22 bp, Artificial Sequence
  chemically synthesized
cactaggaacggacaaattaga

SEQ ID NO: 1337051 - DNA, 22 bp, Artificial Sequence
  chemically synthesized
actaggaacggacaaattagaa

SEQ ID NO: 1337052 - DNA, 22 bp, Artificial Sequence
  chemically synthesized
tctcacatttcactttctaatt

SEQ ID NO: 1337053 - DNA, 22 bp, Artificial Sequence
  chemically synthesized
ggaacggacaaattagaaagtg

SEQ ID NO: 1337054 - DNA, 22 bp, Artificial Sequence
  chemically synthesized
ttgtctcacatttcactttcta

SEQ ID NO: 1337055 - DNA, 22 bp, Artificial Sequence
  chemically synthesized
tattgtctcacatttcactttc

SEQ ID NO: 1337056 - DNA, 22 bp, Artificial Sequence
  chemically synthesized
ctattgtctcacatttcacttt

SEQ ID NO: 1337057 - DNA, 22 bp, Artificial Sequence
  chemically synthesized
tctattgtctcacatttcactt

SEQ ID NO: 1337058 - DNA, 22 bp, Artificial Sequence
  chemically synthesized
gaaagtgaaatgtgagacaata

SEQ ID NO: 1337059 - DNA, 22 bp, Artificial Sequence
  chemically synthesized
catcaaactttctattgtctca

SEQ ID NO: 1337060 - DNA, 22 bp, Artificial Sequence
  chemically synthesized
aattacatcaaactttctattg

SEQ ID NO: 1337061 - DNA, 22 bp, Artificial Sequence
  chemically synthesized
ctgaattacatcaaactttcta

SEQ ID NO: 1337062 - DNA, 22 bp, Artificial Sequence
  chemically synthesized
cagtgctgctgaattacatcaa

SEQ ID NO: 1337063 - DNA, 22 bp, Artificial Sequence
  chemically synthesized
atggttgcagtgctgctgaatt

SEQ ID NO: 1337064 - DNA, 22 bp, Artificial Sequence
  chemically synthesized
gatgtaattcagcagcactgca

SEQ ID NO: 1337065 - DNA, 22 bp, Artificial Sequence
  chemically synthesized
atgtaattcagcagcactgcaa

SEQ ID NO: 1337066 - DNA, 22 bp, Artificial Sequence
  chemically synthesized
aaataataattgatggttgcag

SEQ ID NO: 1337067 - DNA, 22 bp, Artificial Sequence
  chemically synthesized
agcagcactgcaaccatcaatt

SEQ ID NO: 1337068 - DNA, 22 bp, Artificial Sequence
  chemically synthesized
ccaaaaatgttaaaataataat

SEQ ID NO: 1337069 - DNA, 22 bp, Artificial Sequence
  chemically synthesized
accaaaaatgttaaaataataa

SEQ ID NO: 1337070 - DNA, 22 bp, Artificial Sequence
  chemically synthesized
taccaaaaatgttaaaataata

SEQ ID NO: 1337071 - DNA, 22 bp, Artificial Sequence
  chemically synthesized
caaccatcaattattattttaa

SEQ ID NO: 1337072 - DNA, 22 bp, Artificial Sequence
  chemically synthesized
ttattttaacatttttggtaaa

SEQ ID NO: 1337073 - DNA, 22 bp, Artificial Sequence
  chemically synthesized
ttttaacatttttggtaaagct

SEQ ID NO: 1337074 - DNA, 22 bp, Artificial Sequence
  chemically synthesized
gatgtaaaaggaagctttacca

SEQ ID NO: 1337075 - DNA, 22 bp, Artificial Sequence
  chemically synthesized
ggatgtaaaaggaagctttacc

SEQ ID NO: 1337076 - DNA, 22 bp, Artificial Sequence
  chemically synthesized
taacatttttggtaaagcttcc

SEQ ID NO: 1337077 - DNA, 22 bp, Artificial Sequence
  chemically synthesized
ttggatgtaaaaggaagcttta

SEQ ID NO: 1337078 - DNA, 22 bp, Artificial Sequence
  chemically synthesized
aacatttttggtaaagcttcct

SEQ ID NO: 1337079 - DNA, 22 bp, Artificial Sequence
  chemically synthesized
acatttttggtaaagcttcctt

SEQ ID NO: 1337080 - DNA, 22 bp, Artificial Sequence
  chemically synthesized
gtcctcttggatgtaaaaggaa

SEQ ID NO: 1337081 - DNA, 22 bp, Artificial Sequence
  chemically synthesized
ggtcctcttggatgtaaaagga

SEQ ID NO: 1337082 - DNA, 22 bp, Artificial Sequence
  chemically synthesized
ttggtaaagcttccttttacat

SEQ ID NO: 1337083 - DNA, 22 bp, Artificial Sequence
  chemically synthesized
tggtaaagcttccttttacatc

SEQ ID NO: 1337084 - DNA, 22 bp, Artificial Sequence
  chemically synthesized
ggtaaagcttccttttacatcc

SEQ ID NO: 1337085 - DNA, 22 bp, Artificial Sequence
  chemically synthesized
gtaaagcttccttttacatcca

SEQ ID NO: 1337086 - DNA, 22 bp, Artificial Sequence
  chemically synthesized
acttggtcctcttggatgtaaa

SEQ ID NO: 1337087 - DNA, 22 bp, Artificial Sequence
  chemically synthesized
cacttggtcctcttggatgtaa

SEQ ID NO: 1337088 - DNA, 22 bp, Artificial Sequence
  chemically synthesized
ccttttacatccaagaggacca

SEQ ID NO: 1337089 - DNA, 22 bp, Artificial Sequence
  chemically synthesized
cttttacatccaagaggaccaa

SEQ ID NO: 1337090 - DNA, 22 bp, Artificial Sequence
  chemically synthesized
ttacatccaagaggaccaagtg

SEQ ID NO: 1337091 - DNA, 22 bp, Artificial Sequence
  chemically synthesized
tacatccaagaggaccaagtga

SEQ ID NO: 1337092 - DNA, 22 bp, Artificial Sequence
  chemically synthesized
acatccaagaggaccaagtgaa

SEQ ID NO: 1337093 - DNA, 22 bp, Artificial Sequence
  chemically synthesized
catccaagaggaccaagtgaaa

SEQ ID NO: 1337094 - DNA, 22 bp, Artificial Sequence
  chemically synthesized
tgggtaaatataagaacatggt

SEQ ID NO: 1337095 - DNA, 22 bp, Artificial Sequence
  chemically synthesized
ttatatttacccatagcatttc

SEQ ID NO: 1337096 - DNA, 22 bp, Artificial Sequence
  chemically synthesized
atatttacccatagcatttctt

SEQ ID NO: 1337097 - DNA, 22 bp, Artificial Sequence
  chemically synthesized
ataaaaataaaaaagaaatgct

SEQ ID NO: 1337098 - DNA, 22 bp, Artificial Sequence
  chemically synthesized
tatttacccatagcatttcttt

SEQ ID NO: 1337099 - DNA, 22 bp, Artificial Sequence
  chemically synthesized
acccatagcatttcttttttat

SEQ ID NO: 1337100 - DNA, 22 bp, Artificial Sequence
  chemically synthesized
cccatagcatttcttttttatt

SEQ ID NO: 1337101 - DNA, 22 bp, Artificial Sequence
  chemically synthesized
agcaaaagaaggagctcataaa

SEQ ID NO: 1337102 - DNA, 22 bp, Artificial Sequence
  chemically synthesized
cttttttatttttatgagctcc

SEQ ID NO: 1337103 - DNA, 22 bp, Artificial Sequence
  chemically synthesized
ttttttatttttatgagctcct

SEQ ID NO: 1337104 - DNA, 22 bp, Artificial Sequence
  chemically synthesized
attcagcaaaagaaggagctca

SEQ ID NO: 1337105 - DNA, 22 bp, Artificial Sequence
  chemically synthesized
ttttatttttatgagctccttc

SEQ ID NO: 1337106 - DNA, 22 bp, Artificial Sequence
  chemically synthesized
tttatttttatgagctccttct

SEQ ID NO: 1337107 - DNA, 22 bp, Artificial Sequence
  chemically synthesized
ttatttttatgagctccttctt

SEQ ID NO: 1337108 - DNA, 22 bp, Artificial Sequence
  chemically synthesized
ttcattcagcaaaagaaggagc

SEQ ID NO: 1337109 - DNA, 22 bp, Artificial Sequence
  chemically synthesized
tatttttatgagctccttcttt

SEQ ID NO: 1337110 - DNA, 22 bp, Artificial Sequence
  chemically synthesized
atttttatgagctccttctttt

SEQ ID NO: 1337111 - DNA, 22 bp, Artificial Sequence
  chemically synthesized
tttttatgagctccttcttttg

SEQ ID NO: 1337112 - DNA, 22 bp, Artificial Sequence
  chemically synthesized
ttatgagctccttcttttgctg

SEQ ID NO: 1337113 - DNA, 22 bp, Artificial Sequence
  chemically synthesized
tatgagctccttcttttgctga

SEQ ID NO: 1337114 - DNA, 22 bp, Artificial Sequence
  chemically synthesized
atgagctccttcttttgctgaa

SEQ ID NO: 1337115 - DNA, 22 bp, Artificial Sequence
  chemically synthesized
tgagctccttcttttgctgaat

SEQ ID NO: 1337116 - DNA, 22 bp, Artificial Sequence
  chemically synthesized
aaatagttattcattcagcaaa

SEQ ID NO: 1337117 - DNA, 22 bp, Artificial Sequence
  chemically synthesized
cttcttttgctgaatgaataac

SEQ ID NO: 1337118 - DNA, 22 bp, Artificial Sequence
  chemically synthesized
gtgtgctgaaatagttattcat

SEQ ID NO: 1337119 - DNA, 22 bp, Artificial Sequence
  chemically synthesized
agtgtgctgaaatagttattca

SEQ ID NO: 1337120 - DNA, 22 bp, Artificial Sequence
  chemically synthesized
cttttgctgaatgaataactat

SEQ ID NO: 1337121 - DNA, 22 bp, Artificial Sequence
  chemically synthesized
tagtgtgctgaaatagttattc

SEQ ID NO: 1337122 - DNA, 22 bp, Artificial Sequence
  chemically synthesized
ttttgctgaatgaataactatt

SEQ ID NO: 1337123 - DNA, 22 bp, Artificial Sequence
  chemically synthesized
ttagtgtgctgaaatagttatt

SEQ ID NO: 1337124 - DNA, 22 bp, Artificial Sequence
  chemically synthesized
tttagtgtgctgaaatagttat

SEQ ID NO: 1337125 - DNA, 22 bp, Artificial Sequence
  chemically synthesized
ttgctgaatgaataactatttc

SEQ ID NO: 1337126 - DNA, 22 bp, Artificial Sequence
  chemically synthesized
tgctgaatgaataactatttca

SEQ ID NO: 1337127 - DNA, 22 bp, Artificial Sequence
  chemically synthesized
gctgaatgaataactatttcag

SEQ ID NO: 1337128 - DNA, 22 bp, Artificial Sequence
  chemically synthesized
ctgaatgaataactatttcagc

SEQ ID NO: 1337129 - DNA, 22 bp, Artificial Sequence
  chemically synthesized
aatgaataactatttcagcaca

SEQ ID NO: 1337130 - DNA, 22 bp, Artificial Sequence
  chemically synthesized
aggcacaattttttagtgtgct

SEQ ID NO: 1337131 - DNA, 22 bp, Artificial Sequence
  chemically synthesized
tttcagcacactaaaaaattgt

SEQ ID NO: 1337132 - DNA, 22 bp, Artificial Sequence
  chemically synthesized
cagcacactaaaaaattgtgcc

SEQ ID NO: 1337133 - DNA, 22 bp, Artificial Sequence
  chemically synthesized
agcacactaaaaaattgtgcct

SEQ ID NO: 1337134 - DNA, 22 bp, Artificial Sequence
  chemically synthesized
gaaagacatctaaggcacaatt

SEQ ID NO: 1337135 - DNA, 22 bp, Artificial Sequence
  chemically synthesized
ttagaaagacatctaaggcaca

SEQ ID NO: 1337136 - DNA, 22 bp, Artificial Sequence
  chemically synthesized
aaaaattgtgccttagatgtct

SEQ ID NO: 1337137 - DNA, 22 bp, Artificial Sequence
  chemically synthesized
tgccttagatgtctttctaaca

SEQ ID NO: 1337138 - DNA, 22 bp, Artificial Sequence
  chemically synthesized
ccatatacaggcactgttagaa

SEQ ID NO: 1337139 - DNA, 22 bp, Artificial Sequence
  chemically synthesized
accatatacaggcactgttaga

SEQ ID NO: 1337140 - DNA, 22 bp, Artificial Sequence
  chemically synthesized
agatgtctttctaacagtgcct

SEQ ID NO: 1337141 - DNA, 22 bp, Artificial Sequence
  chemically synthesized
gatgtctttctaacagtgcctg

SEQ ID NO: 1337142 - DNA, 22 bp, Artificial Sequence
  chemically synthesized
agcacttaccatatacaggcac

SEQ ID NO: 1337143 - DNA, 22 bp, Artificial Sequence
  chemically synthesized
ttgagcacttaccatatacagg

SEQ ID NO: 1337144 - DNA, 22 bp, Artificial Sequence
  chemically synthesized
tctaacagtgcctgtatatggt

SEQ ID NO: 1337145 - DNA, 22 bp, Artificial Sequence
  chemically synthesized
ctaacagtgcctgtatatggta

SEQ ID NO: 1337146 - DNA, 22 bp, Artificial Sequence
  chemically synthesized
taacagtgcctgtatatggtaa

SEQ ID NO: 1337147 - DNA, 22 bp, Artificial Sequence
  chemically synthesized
acagtgcctgtatatggtaagt

SEQ ID NO: 1337148 - DNA, 22 bp, Artificial Sequence
  chemically synthesized
tcaagcaattattgagcactta

SEQ ID NO: 1337149 - DNA, 22 bp, Artificial Sequence
  chemically synthesized
atcaagcaattattgagcactt

SEQ ID NO: 1337150 - DNA, 22 bp, Artificial Sequence
  chemically synthesized
tttatcaagcaattattgagca

SEQ ID NO: 1337151 - DNA, 22 bp, Artificial Sequence
  chemically synthesized
tatatggtaagtgctcaataat

SEQ ID NO: 1337152 - DNA, 22 bp, Artificial Sequence
  chemically synthesized
cagaatgcatattatttatcaa

SEQ ID NO: 1337153 - DNA, 22 bp, Artificial Sequence
  chemically synthesized
aataattgcttgataaataata

SEQ ID NO: 1337154 - DNA, 22 bp, Artificial Sequence
  chemically synthesized
aactgcagaatgcatattattt

SEQ ID NO: 1337155 - DNA, 22 bp, Artificial Sequence
  chemically synthesized
cctcaactgcagaatgcatatt

SEQ ID NO: 1337156 - DNA, 22 bp, Artificial Sequence
  chemically synthesized
gcctcaactgcagaatgcatat

SEQ ID NO: 1337157 - DNA, 22 bp, Artificial Sequence
  chemically synthesized
cttgataaataatatgcattct

SEQ ID NO: 1337158 - DNA, 22 bp, Artificial Sequence
  chemically synthesized
tgcctcaactgcagaatgcata

SEQ ID NO: 1337159 - DNA, 22 bp, Artificial Sequence
  chemically synthesized
ttgcctcaactgcagaatgcat

SEQ ID NO: 1337160 - DNA, 22 bp, Artificial Sequence
  chemically synthesized
tttgcctcaactgcagaatgca

SEQ ID NO: 1337161 - DNA, 22 bp, Artificial Sequence
  chemically synthesized
gataaataatatgcattctgca

SEQ ID NO: 1337162 - DNA, 22 bp, Artificial Sequence
  chemically synthesized
ttttgcctcaactgcagaatgc

SEQ ID NO: 1337163 - DNA, 22 bp, Artificial Sequence
  chemically synthesized
ataaataatatgcattctgcag

SEQ ID NO: 1337164 - DNA, 22 bp, Artificial Sequence
  chemically synthesized
ttttttgcctcaactgcagaat

SEQ ID NO: 1337165 - DNA, 22 bp, Artificial Sequence
  chemically synthesized
cttttttgcctcaactgcagaa

SEQ ID NO: 1337166 - DNA, 22 bp, Artificial Sequence
  chemically synthesized
tgcagttgaggcaaaaaagaaa

SEQ ID NO: 1337167 - DNA, 22 bp, Artificial Sequence
  chemically synthesized
caaaaaagggtcatttcttttt

SEQ ID NO: 1337168 - DNA, 22 bp, Artificial Sequence
  chemically synthesized
cagttgaggcaaaaaagaaatg

SEQ ID NO: 1337169 - DNA, 22 bp, Artificial Sequence
  chemically synthesized
attccaaaaaagggtcatttct

SEQ ID NO: 1337170 - DNA, 22 bp, Artificial Sequence
  chemically synthesized
aggcaaaaaagaaatgaccctt

SEQ ID NO: 1337171 - DNA, 22 bp, Artificial Sequence
  chemically synthesized
gttcattccaaaaaagggtcat

SEQ ID NO: 1337172 - DNA, 22 bp, Artificial Sequence
  chemically synthesized
ggttcattccaaaaaagggtca

SEQ ID NO: 1337173 - DNA, 22 bp, Artificial Sequence
  chemically synthesized
ttggttcattccaaaaaagggt

SEQ ID NO: 1337174 - DNA, 22 bp, Artificial Sequence
  chemically synthesized
tcttggttcattccaaaaaagg

SEQ ID NO: 1337175 - DNA, 22 bp, Artificial Sequence
  chemically synthesized
tctctcttggttcattccaaaa

SEQ ID NO: 1337176 - DNA, 22 bp, Artificial Sequence
  chemically synthesized
tgtctctcttggttcattccaa

SEQ ID NO: 1337177 - DNA, 22 bp, Artificial Sequence
  chemically synthesized
agttctgtctctcttggttcat

SEQ ID NO: 1337178 - DNA, 22 bp, Artificial Sequence
  chemically synthesized
cagttctgtctctcttggttca

SEQ ID NO: 1337179 - DNA, 22 bp, Artificial Sequence
  chemically synthesized
tcagttctgtctctcttggttc

SEQ ID NO: 1337180 - DNA, 22 bp, Artificial Sequence
  chemically synthesized
ttcagttctgtctctcttggtt

SEQ ID NO: 1337181 - DNA, 22 bp, Artificial Sequence
  chemically synthesized
tttcagttctgtctctcttggt

SEQ ID NO: 1337182 - DNA, 22 bp, Artificial Sequence
  chemically synthesized
ttttggaatgaaccaagagaga

SEQ ID NO: 1337183 - DNA, 22 bp, Artificial Sequence
  chemically synthesized
tttggaatgaaccaagagagac

SEQ ID NO: 1337184 - DNA, 22 bp, Artificial Sequence
  chemically synthesized
ttggaatgaaccaagagagaca

SEQ ID NO: 1337185 - DNA, 22 bp, Artificial Sequence
  chemically synthesized
tggaatgaaccaagagagacag

SEQ ID NO: 1337186 - DNA, 22 bp, Artificial Sequence
  chemically synthesized
actttttcagttctgtctctct

SEQ ID NO: 1337187 - DNA, 22 bp, Artificial Sequence
  chemically synthesized
ggaatgaaccaagagagacaga

SEQ ID NO: 1337188 - DNA, 22 bp, Artificial Sequence
  chemically synthesized
gaatgaaccaagagagacagaa

SEQ ID NO: 1337189 - DNA, 22 bp, Artificial Sequence
  chemically synthesized
ctcactttttcagttctgtctc

SEQ ID NO: 1337190 - DNA, 22 bp, Artificial Sequence
  chemically synthesized
cctcactttttcagttctgtct

SEQ ID NO: 1337191 - DNA, 22 bp, Artificial Sequence
  chemically synthesized
ttcctcactttttcagttctgt

SEQ ID NO: 1337192 - DNA, 22 bp, Artificial Sequence
  chemically synthesized
cttcctcactttttcagttctg

SEQ ID NO: 1337193 - DNA, 22 bp, Artificial Sequence
  chemically synthesized
ccttcttcctcactttttcagt

SEQ ID NO: 1337194 - DNA, 22 bp, Artificial Sequence
  chemically synthesized
cccttcttcctcactttttcag

SEQ ID NO: 1337195 - DNA, 22 bp, Artificial Sequence
  chemically synthesized
tcccttcttcctcactttttca

SEQ ID NO: 1337196 - DNA, 22 bp, Artificial Sequence
  chemically synthesized
ttcccttcttcctcactttttc

SEQ ID NO: 1337197 - DNA, 22 bp, Artificial Sequence
  chemically synthesized
tttttcccttcttcctcacttt

SEQ ID NO: 1337198 - DNA, 22 bp, Artificial Sequence
  chemically synthesized
attatttttcccttcttcctca

SEQ ID NO: 1337199 - DNA, 22 bp, Artificial Sequence
  chemically synthesized
cattatttttcccttcttcctc

SEQ ID NO: 1337200 - DNA, 22 bp, Artificial Sequence
  chemically synthesized
cttcattatttttcccttcttc

SEQ ID NO: 1337201 - DNA, 22 bp, Artificial Sequence
  chemically synthesized
aaaaagtgaggaagaagggaaa

SEQ ID NO: 1337202 - DNA, 22 bp, Artificial Sequence
  chemically synthesized
ttccttcattatttttcccttc

SEQ ID NO: 1337203 - DNA, 22 bp, Artificial Sequence
  chemically synthesized
tgttccttcattatttttccct

SEQ ID NO: 1337204 - DNA, 22 bp, Artificial Sequence
  chemically synthesized
ctgttccttcattatttttccc

SEQ ID NO: 1337205 - DNA, 22 bp, Artificial Sequence
  chemically synthesized
acatcatcttctgttccttcat

SEQ ID NO: 1337206 - DNA, 22 bp, Artificial Sequence
  chemically synthesized
tctgacatcatcttctgttcct

SEQ ID NO: 1337207 - DNA, 22 bp, Artificial Sequence
  chemically synthesized
ataaaagtcctatctgacatca

SEQ ID NO: 1337208 - DNA, 22 bp, Artificial Sequence
  chemically synthesized
cattgataaaagtcctatctga

SEQ ID NO: 1337209 - DNA, 22 bp, Artificial Sequence
  chemically synthesized
acattgataaaagtcctatctg

SEQ ID NO: 1337210 - DNA, 22 bp, Artificial Sequence
  chemically synthesized
cttacattgataaaagtcctat

SEQ ID NO: 1337211 - DNA, 22 bp, Artificial Sequence
  chemically synthesized
acttacattgataaaagtccta

SEQ ID NO: 1337212 - DNA, 22 bp, Artificial Sequence
  chemically synthesized
tatttacttacattgataaaag

SEQ ID NO: 1337213 - DNA, 22 bp, Artificial Sequence
  chemically synthesized
atatataggaattatatttact

SEQ ID NO: 1337214 - DNA, 22 bp, Artificial Sequence
  chemically synthesized
ttatcaatgtaagtaaatataa

SEQ ID NO: 1337215 - DNA, 22 bp, Artificial Sequence
  chemically synthesized
tatcaatgtaagtaaatataat

SEQ ID NO: 1337216 - DNA, 22 bp, Artificial Sequence
  chemically synthesized
atcaatgtaagtaaatataatt

SEQ ID NO: 1337217 - DNA, 22 bp, Artificial Sequence
  chemically synthesized
tcaatgtaagtaaatataattc

SEQ ID NO: 1337218 - DNA, 22 bp, Artificial Sequence
  chemically synthesized
attaatatataggaattatatt

SEQ ID NO: 1337219 - DNA, 22 bp, Artificial Sequence
  chemically synthesized
ctatatattaatgaatgtgata

SEQ ID NO: 1337220 - DNA, 22 bp, Artificial Sequence
  chemically synthesized
atatgaatgtaacatatcacat

SEQ ID NO: 1337221 - DNA, 22 bp, Artificial Sequence
  chemically synthesized
tatattaatgaatgtgatatgt

SEQ ID NO: 1337222 - DNA, 22 bp, Artificial Sequence
  chemically synthesized
aatatgaatgtaacatatcaca

SEQ ID NO: 1337223 - DNA, 22 bp, Artificial Sequence
  chemically synthesized
taatatgaatgtaacatatcac

SEQ ID NO: 1337224 - DNA, 22 bp, Artificial Sequence
  chemically synthesized
ttaatatgaatgtaacatatca

SEQ ID NO: 1337225 - DNA, 22 bp, Artificial Sequence
  chemically synthesized
atgaatgtgatatgttacattc

SEQ ID NO: 1337226 - DNA, 22 bp, Artificial Sequence
  chemically synthesized
ataaacttttaatatgaatgta

SEQ ID NO: 1337227 - DNA, 22 bp, Artificial Sequence
  chemically synthesized
ttaataaacttttaatatgaat

SEQ ID NO: 1337228 - DNA, 22 bp, Artificial Sequence
  chemically synthesized
gttaataaacttttaatatgaa

SEQ ID NO: 1337229 - DNA, 22 bp, Artificial Sequence
  chemically synthesized
tgttaataaacttttaatatga

SEQ ID NO: 1337230 - DNA, 22 bp, Artificial Sequence
  chemically synthesized
cattcatattaaaagtttatta

SEQ ID NO: 1337231 - DNA, 22 bp, Artificial Sequence
  chemically synthesized
tggtgatgttttgttaataaac

SEQ ID NO: 1337232 - DNA, 22 bp, Artificial Sequence
  chemically synthesized
atattaaaagtttattaacaaa

SEQ ID NO: 1337233 - DNA, 22 bp, Artificial Sequence
  chemically synthesized
attgtggtgatgttttgttaat

SEQ ID NO: 1337234 - DNA, 22 bp, Artificial Sequence
  chemically synthesized
aaagtttattaacaaaacatca

SEQ ID NO: 1337235 - DNA, 22 bp, Artificial Sequence
  chemically synthesized
tattcattgtggtgatgttttg

SEQ ID NO: 1337236 - DNA, 22 bp, Artificial Sequence
  chemically synthesized
aactatattcattgtggtgatg

SEQ ID NO: 1337237 - DNA, 22 bp, Artificial Sequence
  chemically synthesized
attaacaaaacatcaccacaat

SEQ ID NO: 1337238 - DNA, 22 bp, Artificial Sequence
  chemically synthesized
ttaacaaaacatcaccacaatg

SEQ ID NO: 1337239 - DNA, 22 bp, Artificial Sequence
  chemically synthesized
acaaaacatcaccacaatgaat

SEQ ID NO: 1337240 - DNA, 22 bp, Artificial Sequence
  chemically synthesized
tcacatagcaaggaaaatctca

SEQ ID NO: 1337241 - DNA, 22 bp, Artificial Sequence
  chemically synthesized
gaccagtacctatcacatagca

SEQ ID NO: 1337242 - DNA, 22 bp, Artificial Sequence
  chemically synthesized
agaccagtacctatcacatagc

SEQ ID NO: 1337243 - DNA, 22 bp, Artificial Sequence
  chemically synthesized
agattttccttgctatgtgata

SEQ ID NO: 1337244 - DNA, 22 bp, Artificial Sequence
  chemically synthesized
tccttgctatgtgataggtact

SEQ ID NO: 1337245 - DNA, 22 bp, Artificial Sequence
  chemically synthesized
ccttgctatgtgataggtactg

SEQ ID NO: 1337246 - DNA, 22 bp, Artificial Sequence
  chemically synthesized
cttgctatgtgataggtactgg

SEQ ID NO: 1337247 - DNA, 22 bp, Artificial Sequence
  chemically synthesized
gctatgtgataggtactggtct

SEQ ID NO: 1337248 - DNA, 22 bp, Artificial Sequence
  chemically synthesized
ctatgtgataggtactggtcta

SEQ ID NO: 1337249 - DNA, 22 bp, Artificial Sequence
  chemically synthesized
tgtgataggtactggtctaagt

SEQ ID NO: 1337250 - DNA, 22 bp, Artificial Sequence
  chemically synthesized
acaaataaaaatcacttagacc

SEQ ID NO: 1337251 - DNA, 22 bp, Artificial Sequence
  chemically synthesized
gtctaagtgatttttatttgtt

SEQ ID NO: 1337252 - DNA, 22 bp, Artificial Sequence
  chemically synthesized
agatgagaaaattaacaaataa

SEQ ID NO: 1337253 - DNA, 22 bp, Artificial Sequence
  chemically synthesized
ctgagatgagaaaattaacaaa

SEQ ID NO: 1337254 - DNA, 22 bp, Artificial Sequence
  chemically synthesized
agtgatttttatttgttaattt

SEQ ID NO: 1337255 - DNA, 22 bp, Artificial Sequence
  chemically synthesized
ttatttgttaattttctcatct

SEQ ID NO: 1337256 - DNA, 22 bp, Artificial Sequence
  chemically synthesized
ataggattgctgagatgagaaa

SEQ ID NO: 1337257 - DNA, 22 bp, Artificial Sequence
  chemically synthesized
tatttgttaattttctcatctc

SEQ ID NO: 1337258 - DNA, 22 bp, Artificial Sequence
  chemically synthesized
atttgttaattttctcatctca

SEQ ID NO: 1337259 - DNA, 22 bp, Artificial Sequence
  chemically synthesized
tttgttaattttctcatctcag

SEQ ID NO: 1337260 - DNA, 22 bp, Artificial Sequence
  chemically synthesized
cctcataggattgctgagatga

SEQ ID NO: 1337261 - DNA, 22 bp, Artificial Sequence
  chemically synthesized
gttaattttctcatctcagcaa

SEQ ID NO: 1337262 - DNA, 22 bp, Artificial Sequence
  chemically synthesized
ttaattttctcatctcagcaat

SEQ ID NO: 1337263 - DNA, 22 bp, Artificial Sequence
  chemically synthesized
attttctcatctcagcaatcct

SEQ ID NO: 1337264 - DNA, 22 bp, Artificial Sequence
  chemically synthesized
tctcatctcagcaatcctatga

SEQ ID NO: 1337265 - DNA, 22 bp, Artificial Sequence
  chemically synthesized
ctcatctcagcaatcctatgag

SEQ ID NO: 1337266 - DNA, 22 bp, Artificial Sequence
  chemically synthesized
tcatctcagcaatcctatgagg

SEQ ID NO: 1337267 - DNA, 22 bp, Artificial Sequence
  chemically synthesized
ataatagcacctacctcatagg

SEQ ID NO: 1337268 - DNA, 22 bp, Artificial Sequence
  chemically synthesized
atctcagcaatcctatgaggta

SEQ ID NO: 1337269 - DNA, 22 bp, Artificial Sequence
  chemically synthesized
agcaatcctatgaggtaggtgc

SEQ ID NO: 1337270 - DNA, 22 bp, Artificial Sequence
  chemically synthesized
aaaaatagagttaataatagca

SEQ ID NO: 1337271 - DNA, 22 bp, Artificial Sequence
  chemically synthesized
tgaggtaggtgctattattaac

SEQ ID NO: 1337272 - DNA, 22 bp, Artificial Sequence
  chemically synthesized
atctgaaaaatagagttaataa

SEQ ID NO: 1337273 - DNA, 22 bp, Artificial Sequence
  chemically synthesized
catctgaaaaatagagttaata

SEQ ID NO: 1337274 - DNA, 22 bp, Artificial Sequence
  chemically synthesized
ttcatctgaaaaatagagttaa

SEQ ID NO: 1337275 - DNA, 22 bp, Artificial Sequence
  chemically synthesized
cttcatctgaaaaatagagtta

SEQ ID NO: 1337276 - DNA, 22 bp, Artificial Sequence
  chemically synthesized
gtttcttcatctgaaaaataga

SEQ ID NO: 1337277 - DNA, 22 bp, Artificial Sequence
  chemically synthesized
agtttcttcatctgaaaaatag

SEQ ID NO: 1337278 - DNA, 22 bp, Artificial Sequence
  chemically synthesized
ttattaactctatttttcagat

SEQ ID NO: 1337279 - DNA, 22 bp, Artificial Sequence
  chemically synthesized
cttagtttcttcatctgaaaaa

SEQ ID NO: 1337280 - DNA, 22 bp, Artificial Sequence
  chemically synthesized
ccttagtttcttcatctgaaaa

SEQ ID NO: 1337281 - DNA, 22 bp, Artificial Sequence
  chemically synthesized
tccttagtttcttcatctgaaa

SEQ ID NO: 1337282 - DNA, 22 bp, Artificial Sequence
  chemically synthesized
ttaactctatttttcagatgaa

SEQ ID NO: 1337283 - DNA, 22 bp, Artificial Sequence
  chemically synthesized
ttccttagtttcttcatctgaa

SEQ ID NO: 1337284 - DNA, 22 bp, Artificial Sequence
  chemically synthesized
tttccttagtttcttcatctga

SEQ ID NO: 1337285 - DNA, 22 bp, Artificial Sequence
  chemically synthesized
ttttccttagtttcttcatctg

SEQ ID NO: 1337286 - DNA, 22 bp, Artificial Sequence
  chemically synthesized
actctatttttcagatgaagaa

SEQ ID NO: 1337287 - DNA, 22 bp, Artificial Sequence
  chemically synthesized
ttttttccttagtttcttcatc

SEQ ID NO: 1337288 - DNA, 22 bp, Artificial Sequence
  chemically synthesized
tcttttttccttagtttcttca

SEQ ID NO: 1337289 - DNA, 22 bp, Artificial Sequence
  chemically synthesized
tatttttcagatgaagaaacta

SEQ ID NO: 1337290 - DNA, 22 bp, Artificial Sequence
  chemically synthesized
tttttcagatgaagaaactaag

SEQ ID NO: 1337291 - DNA, 22 bp, Artificial Sequence
  chemically synthesized
actctcttttttccttagtttc

SEQ ID NO: 1337292 - DNA, 22 bp, Artificial Sequence
  chemically synthesized
ttcagatgaagaaactaaggaa

SEQ ID NO: 1337293 - DNA, 22 bp, Artificial Sequence
  chemically synthesized
tcagatgaagaaactaaggaaa

SEQ ID NO: 1337294 - DNA, 22 bp, Artificial Sequence
  chemically synthesized
cagatgaagaaactaaggaaaa

SEQ ID NO: 1337295 - DNA, 22 bp, Artificial Sequence
  chemically synthesized
agatgaagaaactaaggaaaaa

SEQ ID NO: 1337296 - DNA, 22 bp, Artificial Sequence
  chemically synthesized
tacactgactctcttttttcct

SEQ ID NO: 1337297 - DNA, 22 bp, Artificial Sequence
  chemically synthesized
atacactgactctcttttttcc

SEQ ID NO: 1337298 - DNA, 22 bp, Artificial Sequence
  chemically synthesized
tatacactgactctcttttttc

SEQ ID NO: 1337299 - DNA, 22 bp, Artificial Sequence
  chemically synthesized
ttatacactgactctctttttt

SEQ ID NO: 1337300 - DNA, 22 bp, Artificial Sequence
  chemically synthesized
tttatacactgactctcttttt

SEQ ID NO: 1337301 - DNA, 22 bp, Artificial Sequence
  chemically synthesized
ttttatacactgactctctttt

SEQ ID NO: 1337302 - DNA, 22 bp, Artificial Sequence
  chemically synthesized
tcttttttatacactgactctc

SEQ ID NO: 1337303 - DNA, 22 bp, Artificial Sequence
  chemically synthesized
aggaaaaaagagagtcagtgta

SEQ ID NO: 1337304 - DNA, 22 bp, Artificial Sequence
  chemically synthesized
tactgtcttttttatacactga

SEQ ID NO: 1337305 - DNA, 22 bp, Artificial Sequence
  chemically synthesized
gtactgtcttttttatacactg

SEQ ID NO: 1337306 - DNA, 22 bp, Artificial Sequence
  chemically synthesized
tgtactgtcttttttatacact

SEQ ID NO: 1337307 - DNA, 22 bp, Artificial Sequence
  chemically synthesized
ttgtactgtcttttttatacac

SEQ ID NO: 1337308 - DNA, 22 bp, Artificial Sequence
  chemically synthesized
tttgtactgtcttttttataca

SEQ ID NO: 1337309 - DNA, 22 bp, Artificial Sequence
  chemically synthesized
ttttgtactgtcttttttatac

SEQ ID NO: 1337310 - DNA, 22 bp, Artificial Sequence
  chemically synthesized
tttttgtactgtcttttttata

SEQ ID NO: 1337311 - DNA, 22 bp, Artificial Sequence
  chemically synthesized
tacactttttttgtactgtctt

SEQ ID NO: 1337312 - DNA, 22 bp, Artificial Sequence
  chemically synthesized
atacactttttttgtactgtct

SEQ ID NO: 1337313 - DNA, 22 bp, Artificial Sequence
  chemically synthesized
tatacactttttttgtactgtc

SEQ ID NO: 1337314 - DNA, 22 bp, Artificial Sequence
  chemically synthesized
ttatacactttttttgtactgt

SEQ ID NO: 1337315 - DNA, 22 bp, Artificial Sequence
  chemically synthesized
tttatacactttttttgtactg

SEQ ID NO: 1337316 - DNA, 22 bp, Artificial Sequence
  chemically synthesized
tttttatacactttttttgtac

SEQ ID NO: 1337317 - DNA, 22 bp, Artificial Sequence
  chemically synthesized
tctttttatacactttttttgt

SEQ ID NO: 1337318 - DNA, 22 bp, Artificial Sequence
  chemically synthesized
taggactctctttttatacact

SEQ ID NO: 1337319 - DNA, 22 bp, Artificial Sequence
  chemically synthesized
tactgtaggactctctttttat

SEQ ID NO: 1337320 - DNA, 22 bp, Artificial Sequence
  chemically synthesized
agtactgtactgtaggactctc

SEQ ID NO: 1337321 - DNA, 22 bp, Artificial Sequence
  chemically synthesized
tcagtactgtactgtaggactc

SEQ ID NO: 1337322 - DNA, 22 bp, Artificial Sequence
  chemically synthesized
tctcagtactgtactgtaggac

SEQ ID NO: 1337323 - DNA, 22 bp, Artificial Sequence
  chemically synthesized
ctctcagtactgtactgtagga

SEQ ID NO: 1337324 - DNA, 22 bp, Artificial Sequence
  chemically synthesized
tctctcagtactgtactgtagg

SEQ ID NO: 1337325 - DNA, 22 bp, Artificial Sequence
  chemically synthesized
attttctctcagtactgtactg

SEQ ID NO: 1337326 - DNA, 22 bp, Artificial Sequence
  chemically synthesized
cattttctctcagtactgtact

SEQ ID NO: 1337327 - DNA, 22 bp, Artificial Sequence
  chemically synthesized
tcattttctctcagtactgtac

SEQ ID NO: 1337328 - DNA, 22 bp, Artificial Sequence
  chemically synthesized
tttcattttctctcagtactgt

SEQ ID NO: 1337329 - DNA, 22 bp, Artificial Sequence
  chemically synthesized
cagtacagtactgagagaaaat

SEQ ID NO: 1337330 - DNA, 22 bp, Artificial Sequence
  chemically synthesized
gaaatccaactctttcattttc

SEQ ID NO: 1337331 - DNA, 22 bp, Artificial Sequence
  chemically synthesized
ggttggaaatccaactctttca

SEQ ID NO: 1337332 - DNA, 22 bp, Artificial Sequence
  chemically synthesized
tgggttggaaatccaactcttt

SEQ ID NO: 1337333 - DNA, 22 bp, Artificial Sequence
  chemically synthesized
ctgggttggaaatccaactctt

SEQ ID NO: 1337334 - DNA, 22 bp, Artificial Sequence
  chemically synthesized
agagaaaatgaaagagttggat

SEQ ID NO: 1337335 - DNA, 22 bp, Artificial Sequence
  chemically synthesized
tctgggttggaaatccaactct

SEQ ID NO: 1337336 - DNA, 22 bp, Artificial Sequence
  chemically synthesized
aaagccaaactttctgggttgg

SEQ ID NO: 1337337 - DNA, 22 bp, Artificial Sequence
  chemically synthesized
gatttccaacccagaaagtttg

SEQ ID NO: 1337338 - DNA, 22 bp, Artificial Sequence
  chemically synthesized
ccaacccagaaagtttggcttt

SEQ ID NO: 1337339 - DNA, 22 bp, Artificial Sequence
  chemically synthesized
caacccagaaagtttggctttg

SEQ ID NO: 1337340 - DNA, 22 bp, Artificial Sequence
  chemically synthesized
aaaggacagactcaaagccaaa

SEQ ID NO: 1337341 - DNA, 22 bp, Artificial Sequence
  chemically synthesized
gttaaaaggacagactcaaagc

SEQ ID NO: 1337342 - DNA, 22 bp, Artificial Sequence
  chemically synthesized
ggttaaaaggacagactcaaag

SEQ ID NO: 1337343 - DNA, 22 bp, Artificial Sequence
  chemically synthesized
tggttaaaaggacagactcaaa

SEQ ID NO: 1337344 - DNA, 22 bp, Artificial Sequence
  chemically synthesized
ggctttgagtctgtccttttaa

SEQ ID NO: 1337345 - DNA, 22 bp, Artificial Sequence
  chemically synthesized
agaatattttggttaaaaggac

SEQ ID NO: 1337346 - DNA, 22 bp, Artificial Sequence
  chemically synthesized
gctttgagtctgtccttttaac

SEQ ID NO: 1337347 - DNA, 22 bp, Artificial Sequence
  chemically synthesized
aagaatattttggttaaaagga

SEQ ID NO: 1337348 - DNA, 22 bp, Artificial Sequence
  chemically synthesized
tgagtctgtccttttaaccaaa

SEQ ID NO: 1337349 - DNA, 22 bp, Artificial Sequence
  chemically synthesized
gagtctgtccttttaaccaaaa

SEQ ID NO: 1337350 - DNA, 22 bp, Artificial Sequence
  chemically synthesized
agtctgtccttttaaccaaaat

SEQ ID NO: 1337351 - DNA, 22 bp, Artificial Sequence
  chemically synthesized
tccttttaaccaaaatattctt

SEQ ID NO: 1337352 - DNA, 22 bp, Artificial Sequence
  chemically synthesized
ttaaccaaaatattcttaaaca

SEQ ID NO: 1337353 - DNA, 22 bp, Artificial Sequence
  chemically synthesized
taaccaaaatattcttaaacat

SEQ ID NO: 1337354 - DNA, 22 bp, Artificial Sequence
  chemically synthesized
aaccaaaatattcttaaacatc

SEQ ID NO: 1337355 - DNA, 22 bp, Artificial Sequence
  chemically synthesized
accaaaatattcttaaacatct

SEQ ID NO: 1337356 - DNA, 22 bp, Artificial Sequence
  chemically synthesized
ttaaacatctgtctatattgtc

SEQ ID NO: 1337357 - DNA, 22 bp, Artificial Sequence
  chemically synthesized
aaacatctgtctatattgtctc

SEQ ID NO: 1337358 - DNA, 22 bp, Artificial Sequence
  chemically synthesized
aacatctgtctatattgtctcc

SEQ ID NO: 1337359 - DNA, 22 bp, Artificial Sequence
  chemically synthesized
atgtatatataaatggagacaa

SEQ ID NO: 1337360 - DNA, 22 bp, Artificial Sequence
  chemically synthesized
agttaatgtatatataaatgga

SEQ ID NO: 1337361 - DNA, 22 bp, Artificial Sequence
  chemically synthesized
tctatattgtctccatttatat

SEQ ID NO: 1337362 - DNA, 22 bp, Artificial Sequence
  chemically synthesized
tattgtctccatttatatatac

SEQ ID NO: 1337363 - DNA, 22 bp, Artificial Sequence
  chemically synthesized
tctccatttatatatacattaa

SEQ ID NO: 1337364 - DNA, 22 bp, Artificial Sequence
  chemically synthesized
aaaaaatattcagttaatgtat

SEQ ID NO: 1337365 - DNA, 22 bp, Artificial Sequence
  chemically synthesized
catttatatatacattaactga

SEQ ID NO: 1337366 - DNA, 22 bp, Artificial Sequence
  chemically synthesized
atatatacattaactgaatatt

SEQ ID NO: 1337367 - DNA, 22 bp, Artificial Sequence
  chemically synthesized
tatatacattaactgaatattt

SEQ ID NO: 1337368 - DNA, 22 bp, Artificial Sequence
  chemically synthesized
aagggacattaaaaaaatattc

SEQ ID NO: 1337369 - DNA, 22 bp, Artificial Sequence
  chemically synthesized
actcaagggacattaaaaaaat

SEQ ID NO: 1337370 - DNA, 22 bp, Artificial Sequence
  chemically synthesized
taactcaagggacattaaaaaa

SEQ ID NO: 1337371 - DNA, 22 bp, Artificial Sequence
  chemically synthesized
tctaactcaagggacattaaaa

SEQ ID NO: 1337372 - DNA, 22 bp, Artificial Sequence
  chemically synthesized
actgaatatttttttaatgtcc

SEQ ID NO: 1337373 - DNA, 22 bp, Artificial Sequence
  chemically synthesized
ctctaactcaagggacattaaa

SEQ ID NO: 1337374 - DNA, 22 bp, Artificial Sequence
  chemically synthesized
tttctctaactcaagggacatt

SEQ ID NO: 1337375 - DNA, 22 bp, Artificial Sequence
  chemically synthesized
aatatttttttaatgtcccttg

SEQ ID NO: 1337376 - DNA, 22 bp, Artificial Sequence
  chemically synthesized
ttttaatgtcccttgagttaga

SEQ ID NO: 1337377 - DNA, 22 bp, Artificial Sequence
  chemically synthesized
tttaatgtcccttgagttagag

SEQ ID NO: 1337378 - DNA, 22 bp, Artificial Sequence
  chemically synthesized
ttaatgtcccttgagttagaga

SEQ ID NO: 1337379 - DNA, 22 bp, Artificial Sequence
  chemically synthesized
taatgtcccttgagttagagaa

SEQ ID NO: 1337380 - DNA, 22 bp, Artificial Sequence
  chemically synthesized
aatgtcccttgagttagagaaa

SEQ ID NO: 1337381 - DNA, 22 bp, Artificial Sequence
  chemically synthesized
atgtcccttgagttagagaaat

SEQ ID NO: 1337382 - DNA, 22 bp, Artificial Sequence
  chemically synthesized
tcgaataggtaatagtattatt

SEQ ID NO: 1337383 - DNA, 22 bp, Artificial Sequence
  chemically synthesized
gagttagagaaataatactatt

SEQ ID NO: 1337384 - DNA, 22 bp, Artificial Sequence
  chemically synthesized
agttagagaaataatactatta

SEQ ID NO: 1337385 - DNA, 22 bp, Artificial Sequence
  chemically synthesized
ctgtcgaataggtaatagtatt

SEQ ID NO: 1337386 - DNA, 22 bp, Artificial Sequence
  chemically synthesized
cctgtcgaataggtaatagtat

SEQ ID NO: 1337387 - DNA, 22 bp, Artificial Sequence
  chemically synthesized
ttcctgtcgaataggtaatagt

SEQ ID NO: 1337388 - DNA, 22 bp, Artificial Sequence
  chemically synthesized
cttcctgtcgaataggtaatag

SEQ ID NO: 1337389 - DNA, 22 bp, Artificial Sequence
  chemically synthesized
gagaaataatactattacctat

SEQ ID NO: 1337390 - DNA, 22 bp, Artificial Sequence
  chemically synthesized
atgtttcttcctgtcgaatagg

SEQ ID NO: 1337391 - DNA, 22 bp, Artificial Sequence
  chemically synthesized
tctgatgtttcttcctgtcgaa

SEQ ID NO: 1337392 - DNA, 22 bp, Artificial Sequence
  chemically synthesized
tgtctgatgtttcttcctgtcg

SEQ ID NO: 1337393 - DNA, 22 bp, Artificial Sequence
  chemically synthesized
ctgtctgatgtttcttcctgtc

SEQ ID NO: 1337394 - DNA, 22 bp, Artificial Sequence
  chemically synthesized
ttacctattcgacaggaagaaa

SEQ ID NO: 1337395 - DNA, 22 bp, Artificial Sequence
  chemically synthesized
cctattcgacaggaagaaacat

SEQ ID NO: 1337396 - DNA, 22 bp, Artificial Sequence
  chemically synthesized
ttcgacaggaagaaacatcaga

SEQ ID NO: 1337397 - DNA, 22 bp, Artificial Sequence
  chemically synthesized
gacaggaagaaacatcagacag

SEQ ID NO: 1337398 - DNA, 22 bp, Artificial Sequence
  chemically synthesized
agtgatcaggccacgtcatttc

SEQ ID NO: 1337399 - DNA, 22 bp, Artificial Sequence
  chemically synthesized
ccaatataatagctgagtgatc

SEQ ID NO: 1337400 - DNA, 22 bp, Artificial Sequence
  chemically synthesized
ctgccaatataatagctgagtg

SEQ ID NO: 1337401 - DNA, 22 bp, Artificial Sequence
  chemically synthesized
gctgccaatataatagctgagt

SEQ ID NO: 1337402 - DNA, 22 bp, Artificial Sequence
  chemically synthesized
tgctgccaatataatagctgag

SEQ ID NO: 1337403 - DNA, 22 bp, Artificial Sequence
  chemically synthesized
atcactcagctattatattggc

SEQ ID NO: 1337404 - DNA, 22 bp, Artificial Sequence
  chemically synthesized
agctattatattggcagcaaag

SEQ ID NO: 1337405 - DNA, 22 bp, Artificial Sequence
  chemically synthesized
ttatattggcagcaaagccttt

SEQ ID NO: 1337406 - DNA, 22 bp, Artificial Sequence
  chemically synthesized
agtaatgccagagaaaggcttt

SEQ ID NO: 1337407 - DNA, 22 bp, Artificial Sequence
  chemically synthesized
tattggcagcaaagcctttctc

SEQ ID NO: 1337408 - DNA, 22 bp, Artificial Sequence
  chemically synthesized
gcagcaaagcctttctctggca

SEQ ID NO: 1337409 - DNA, 22 bp, Artificial Sequence
  chemically synthesized
tgagaatacgaattaagtaatg

SEQ ID NO: 1337410 - DNA, 22 bp, Artificial Sequence
  chemically synthesized
ctgtgagaatacgaattaagta

SEQ ID NO: 1337411 - DNA, 22 bp, Artificial Sequence
  chemically synthesized
tctctggcattacttaattcgt

SEQ ID NO: 1337412 - DNA, 22 bp, Artificial Sequence
  chemically synthesized
ctctggcattacttaattcgta

SEQ ID NO: 1337413 - DNA, 22 bp, Artificial Sequence
  chemically synthesized
ttactgtgagaatacgaattaa

SEQ ID NO: 1337414 - DNA, 22 bp, Artificial Sequence
  chemically synthesized
tctggcattacttaattcgtat

SEQ ID NO: 1337415 - DNA, 22 bp, Artificial Sequence
  chemically synthesized
tggcattacttaattcgtattc

SEQ ID NO: 1337416 - DNA, 22 bp, Artificial Sequence
  chemically synthesized
gcattacttaattcgtattctc

SEQ ID NO: 1337417 - DNA, 22 bp, Artificial Sequence
  chemically synthesized
cttaattcgtattctcacagta

SEQ ID NO: 1337418 - DNA, 22 bp, Artificial Sequence
  chemically synthesized
aattcgtattctcacagtaaca

SEQ ID NO: 1337419 - DNA, 22 bp, Artificial Sequence
  chemically synthesized
attcgtattctcacagtaacag

SEQ ID NO: 1337420 - DNA, 22 bp, Artificial Sequence
  chemically synthesized
gggataggagaatgctgttact

SEQ ID NO: 1337421 - DNA, 22 bp, Artificial Sequence
  chemically synthesized
gtattctcacagtaacagcatt

SEQ ID NO: 1337422 - DNA, 22 bp, Artificial Sequence
  chemically synthesized
agaattagggataggagaatgc

SEQ ID NO: 1337423 - DNA, 22 bp, Artificial Sequence
  chemically synthesized
tcacagtaacagcattctccta

SEQ ID NO: 1337424 - DNA, 22 bp, Artificial Sequence
  chemically synthesized
acagtaacagcattctcctatc

SEQ ID NO: 1337425 - DNA, 22 bp, Artificial Sequence
  chemically synthesized
aagcactgagaattagggatag

SEQ ID NO: 1337426 - DNA, 22 bp, Artificial Sequence
  chemically synthesized
tcctatccctaattctcagtgc

SEQ ID NO: 1337427 - DNA, 22 bp, Artificial Sequence
  chemically synthesized
ctatccctaattctcagtgctt

SEQ ID NO: 1337428 - DNA, 22 bp, Artificial Sequence
  chemically synthesized
ggaaatagcctaaagcactgag

SEQ ID NO: 1337429 - DNA, 22 bp, Artificial Sequence
  chemically synthesized
tccctaattctcagtgctttag

SEQ ID NO: 1337430 - DNA, 22 bp, Artificial Sequence
  chemically synthesized
ctgggaaatagcctaaagcact

SEQ ID NO: 1337431 - DNA, 22 bp, Artificial Sequence
  chemically synthesized
attctcagtgctttaggctatt

SEQ ID NO: 1337432 - DNA, 22 bp, Artificial Sequence
  chemically synthesized
tcagtgctttaggctatttccc

SEQ ID NO: 1337433 - DNA, 22 bp, Artificial Sequence
  chemically synthesized
agtgctttaggctatttcccag

SEQ ID NO: 1337434 - DNA, 22 bp, Artificial Sequence
  chemically synthesized
tatagcatgttcctgggaaata

SEQ ID NO: 1337435 - DNA, 22 bp, Artificial Sequence
  chemically synthesized
cagctatatagcatgttcctgg

SEQ ID NO: 1337436 - DNA, 22 bp, Artificial Sequence
  chemically synthesized
taggctatttcccaggaacatg

SEQ ID NO: 1337437 - DNA, 22 bp, Artificial Sequence
  chemically synthesized
ccagctatatagcatgttcctg

SEQ ID NO: 1337438 - DNA, 22 bp, Artificial Sequence
  chemically synthesized
aggctatttcccaggaacatgc

SEQ ID NO: 1337439 - DNA, 22 bp, Artificial Sequence
  chemically synthesized
tccagctatatagcatgttcct

SEQ ID NO: 1337440 - DNA, 22 bp, Artificial Sequence
  chemically synthesized
ggctatttcccaggaacatgct

SEQ ID NO: 1337441 - DNA, 22 bp, Artificial Sequence
  chemically synthesized
tttccagctatatagcatgttc

SEQ ID NO: 1337442 - DNA, 22 bp, Artificial Sequence
  chemically synthesized
tttcccaggaacatgctatata

SEQ ID NO: 1337443 - DNA, 22 bp, Artificial Sequence
  chemically synthesized
tatctctttccagctatatagc

SEQ ID NO: 1337444 - DNA, 22 bp, Artificial Sequence
  chemically synthesized
cccaggaacatgctatatagct

SEQ ID NO: 1337445 - DNA, 22 bp, Artificial Sequence
  chemically synthesized
atatctctttccagctatatag

SEQ ID NO: 1337446 - DNA, 22 bp, Artificial Sequence
  chemically synthesized
ccaggaacatgctatatagctg

SEQ ID NO: 1337447 - DNA, 22 bp, Artificial Sequence
  chemically synthesized
tacttatatctctttccagcta

SEQ ID NO: 1337448 - DNA, 22 bp, Artificial Sequence
  chemically synthesized
gcaaattgtacttatatctctt

SEQ ID NO: 1337449 - DNA, 22 bp, Artificial Sequence
  chemically synthesized
tatagctggaaagagatataag

SEQ ID NO: 1337450 - DNA, 22 bp, Artificial Sequence
  chemically synthesized
atgctggcaaattgtacttata

SEQ ID NO: 1337451 - DNA, 22 bp, Artificial Sequence
  chemically synthesized
ttaatgctggcaaattgtactt

SEQ ID NO: 1337452 - DNA, 22 bp, Artificial Sequence
  chemically synthesized
gaaagagatataagtacaattt

SEQ ID NO: 1337453 - DNA, 22 bp, Artificial Sequence
  chemically synthesized
ttattaatgctggcaaattgta

SEQ ID NO: 1337454 - DNA, 22 bp, Artificial Sequence
  chemically synthesized
gccagcattaataatagggata

SEQ ID NO: 1337455 - DNA, 22 bp, Artificial Sequence
  chemically synthesized
ccagcattaataatagggatat

SEQ ID NO: 1337456 - DNA, 22 bp, Artificial Sequence
  chemically synthesized
ataatagggatattgctccttg

SEQ ID NO: 1337457 - DNA, 22 bp, Artificial Sequence
  chemically synthesized
ctccttgcatttgctacttctt

SEQ ID NO: 1337458 - DNA, 22 bp, Artificial Sequence
  chemically synthesized
cttgcatttgctacttctttct

SEQ ID NO: 1337459 - DNA, 22 bp, Artificial Sequence
  chemically synthesized
gcatttgctacttctttctgta

SEQ ID NO: 1337460 - DNA, 22 bp, Artificial Sequence
  chemically synthesized
catttgctacttctttctgtat

SEQ ID NO: 1337461 - DNA, 22 bp, Artificial Sequence
  chemically synthesized
gctacttctttctgtatctgtc

SEQ ID NO: 1337462 - DNA, 22 bp, Artificial Sequence
  chemically synthesized
ctacttctttctgtatctgtct

SEQ ID NO: 1337463 - DNA, 22 bp, Artificial Sequence
  chemically synthesized
cttctttctgtatctgtctact

SEQ ID NO: 1337464 - DNA, 22 bp, Artificial Sequence
  chemically synthesized
ctttctgtatctgtctactttt

SEQ ID NO: 1337465 - DNA, 22 bp, Artificial Sequence
  chemically synthesized
tttctgtatctgtctactttta

SEQ ID NO: 1337466 - DNA, 22 bp, Artificial Sequence
  chemically synthesized
tctgtatctgtctacttttatt

SEQ ID NO: 1337467 - DNA, 22 bp, Artificial Sequence
  chemically synthesized
ctgtatctgtctacttttattt

SEQ ID NO: 1337468 - DNA, 22 bp, Artificial Sequence
  chemically synthesized
tgtatctgtctacttttatttt

SEQ ID NO: 1337469 - DNA, 22 bp, Artificial Sequence
  chemically synthesized
gggaataagaaaaaaaataaaa

SEQ ID NO: 1337470 - DNA, 22 bp, Artificial Sequence
  chemically synthesized
tatctgtctacttttatttttt

SEQ ID NO: 1337471 - DNA, 22 bp, Artificial Sequence
  chemically synthesized
agggaataagaaaaaaaataaa

SEQ ID NO: 1337472 - DNA, 22 bp, Artificial Sequence
  chemically synthesized
tctacttttattttttttctta

SEQ ID NO: 1337473 - DNA, 22 bp, Artificial Sequence
  chemically synthesized
cttttattttttttcttattcc

SEQ ID NO: 1337474 - DNA, 22 bp, Artificial Sequence
  chemically synthesized
ttattttttttcttattcccta

SEQ ID NO: 1337475 - DNA, 22 bp, Artificial Sequence
  chemically synthesized
tattttttttcttattccctaa

SEQ ID NO: 1337476 - DNA, 22 bp, Artificial Sequence
  chemically synthesized
attttttttcttattccctaaa

SEQ ID NO: 1337477 - DNA, 22 bp, Artificial Sequence
  chemically synthesized
ttttttttcttattccctaaac

SEQ ID NO: 1337478 - DNA, 22 bp, Artificial Sequence
  chemically synthesized
tttttcttattccctaaacact

SEQ ID NO: 1337479 - DNA, 22 bp, Artificial Sequence
  chemically synthesized
ttttcttattccctaaacactc

SEQ ID NO: 1337480 - DNA, 22 bp, Artificial Sequence
  chemically synthesized
tttcttattccctaaacactct

SEQ ID NO: 1337481 - DNA, 22 bp, Artificial Sequence
  chemically synthesized
ttcttattccctaaacactcta

SEQ ID NO: 1337482 - DNA, 22 bp, Artificial Sequence
  chemically synthesized
tcttattccctaaacactctat

SEQ ID NO: 1337483 - DNA, 22 bp, Artificial Sequence
  chemically synthesized
cttattccctaaacactctatc

SEQ ID NO: 1337484 - DNA, 22 bp, Artificial Sequence
  chemically synthesized
ttattccctaaacactctatct

SEQ ID NO: 1337485 - DNA, 22 bp, Artificial Sequence
  chemically synthesized
attccctaaacactctatctcc

SEQ ID NO: 1337486 - DNA, 22 bp, Artificial Sequence
  chemically synthesized
ttccctaaacactctatctcca

SEQ ID NO: 1337487 - DNA, 22 bp, Artificial Sequence
  chemically synthesized
cctaaacactctatctccattg

SEQ ID NO: 1337488 - DNA, 22 bp, Artificial Sequence
  chemically synthesized
aaaaaatcagcacaatggagat

SEQ ID NO: 1337489 - DNA, 22 bp, Artificial Sequence
  chemically synthesized
caaaaaatcagcacaatggaga

SEQ ID NO: 1337490 - DNA, 22 bp, Artificial Sequence
  chemically synthesized
aacactctatctccattgtgct

SEQ ID NO: 1337491 - DNA, 22 bp, Artificial Sequence
  chemically synthesized
tatctccattgtgctgattttt

SEQ ID NO: 1337492 - DNA, 22 bp, Artificial Sequence
  chemically synthesized
tctccattgtgctgattttttg

SEQ ID NO: 1337493 - DNA, 22 bp, Artificial Sequence
  chemically synthesized
cattgtgctgattttttgaaga

SEQ ID NO: 1337494 - DNA, 22 bp, Artificial Sequence
  chemically synthesized
tgctgattttttgaagatattc

SEQ ID NO: 1337495 - DNA, 22 bp, Artificial Sequence
  chemically synthesized
attttttgaagatattcatcta

SEQ ID NO: 1337496 - DNA, 22 bp, Artificial Sequence
  chemically synthesized
tttgaagatattcatctatctt

SEQ ID NO: 1337497 - DNA, 22 bp, Artificial Sequence
  chemically synthesized
ttgaagatattcatctatcttg

SEQ ID NO: 1337498 - DNA, 22 bp, Artificial Sequence
  chemically synthesized
tgaagatattcatctatcttga

SEQ ID NO: 1337499 - DNA, 22 bp, Artificial Sequence
  chemically synthesized
gaagatattcatctatcttgat

SEQ ID NO: 1337500 - DNA, 22 bp, Artificial Sequence
  chemically synthesized
aagatattcatctatcttgatt

SEQ ID NO: 1337501 - DNA, 22 bp, Artificial Sequence
  chemically synthesized
atctatcttgattttccttact

SEQ ID NO: 1337502 - DNA, 22 bp, Artificial Sequence
  chemically synthesized
tcttgattttccttacttttta

SEQ ID NO: 1337503 - DNA, 22 bp, Artificial Sequence
  chemically synthesized
gattttccttactttttatttt

SEQ ID NO: 1337504 - DNA, 22 bp, Artificial Sequence
  chemically synthesized
caaggcaaaaagaaaataaaaa

SEQ ID NO: 1337505 - DNA, 22 bp, Artificial Sequence
  chemically synthesized
attttccttactttttattttc

SEQ ID NO: 1337506 - DNA, 22 bp, Artificial Sequence
  chemically synthesized
ctccaaggcaaaaagaaaataa

SEQ ID NO: 1337507 - DNA, 22 bp, Artificial Sequence
  chemically synthesized
tccttactttttattttctttt

SEQ ID NO: 1337508 - DNA, 22 bp, Artificial Sequence
  chemically synthesized
ccttactttttattttcttttt

SEQ ID NO: 1337509 - DNA, 22 bp, Artificial Sequence
  chemically synthesized
cttactttttattttctttttg

SEQ ID NO: 1337510 - DNA, 22 bp, Artificial Sequence
  chemically synthesized
actttttattttctttttgcct

SEQ ID NO: 1337511 - DNA, 22 bp, Artificial Sequence
  chemically synthesized
ctttttattttctttttgcctt

SEQ ID NO: 1337512 - DNA, 22 bp, Artificial Sequence
  chemically synthesized
tttattttctttttgccttgga

SEQ ID NO: 1337513 - DNA, 22 bp, Artificial Sequence
  chemically synthesized
ttattttctttttgccttggag

SEQ ID NO: 1337514 - DNA, 22 bp, Artificial Sequence
  chemically synthesized
tattttctttttgccttggagt

SEQ ID NO: 1337515 - DNA, 22 bp, Artificial Sequence
  chemically synthesized
attttctttttgccttggagta

SEQ ID NO: 1337516 - DNA, 22 bp, Artificial Sequence
  chemically synthesized
ttttctttttgccttggagtag

SEQ ID NO: 1337517 - DNA, 22 bp, Artificial Sequence
  chemically synthesized
tctttttgccttggagtagtgt

SEQ ID NO: 1337518 - DNA, 22 bp, Artificial Sequence
  chemically synthesized
ctttttgccttggagtagtgtt

SEQ ID NO: 1337519 - DNA, 22 bp, Artificial Sequence
  chemically synthesized
tttttgccttggagtagtgttt

SEQ ID NO: 1337520 - DNA, 22 bp, Artificial Sequence
  chemically synthesized
tttgccttggagtagtgtttcc

SEQ ID NO: 1337521 - DNA, 22 bp, Artificial Sequence
  chemically synthesized
ttgccttggagtagtgtttcct

SEQ ID NO: 1337522 - DNA, 22 bp, Artificial Sequence
  chemically synthesized
tgccttggagtagtgtttcctt

SEQ ID NO: 1337523 - DNA, 22 bp, Artificial Sequence
  chemically synthesized
gccttggagtagtgtttccttt

SEQ ID NO: 1337524 - DNA, 22 bp, Artificial Sequence
  chemically synthesized
ccttggagtagtgtttcctttt

SEQ ID NO: 1337525 - DNA, 22 bp, Artificial Sequence
  chemically synthesized
caggatgaaaagaaaaggaaac

SEQ ID NO: 1337526 - DNA, 22 bp, Artificial Sequence
  chemically synthesized
ttccaggatgaaaagaaaagga

SEQ ID NO: 1337527 - DNA, 22 bp, Artificial Sequence
  chemically synthesized
ggagtagtgtttccttttcttt

SEQ ID NO: 1337528 - DNA, 22 bp, Artificial Sequence
  chemically synthesized
gagtagtgtttccttttctttt

SEQ ID NO: 1337529 - DNA, 22 bp, Artificial Sequence
  chemically synthesized
ccttttcttttcatcctggaat

SEQ ID NO: 1337530 - DNA, 22 bp, Artificial Sequence
  chemically synthesized
cttttcttttcatcctggaata

SEQ ID NO: 1337531 - DNA, 22 bp, Artificial Sequence
  chemically synthesized
aaatgacaataatctattccag

SEQ ID NO: 1337532 - DNA, 22 bp, Artificial Sequence
  chemically synthesized
ttcttttcatcctggaatagat

SEQ ID NO: 1337533 - DNA, 22 bp, Artificial Sequence
  chemically synthesized
gaaatgacaataatctattcca

SEQ ID NO: 1337534 - DNA, 22 bp, Artificial Sequence
  chemically synthesized
tcttttcatcctggaatagatt

SEQ ID NO: 1337535 - DNA, 22 bp, Artificial Sequence
  chemically synthesized
cttttcatcctggaatagatta

SEQ ID NO: 1337536 - DNA, 22 bp, Artificial Sequence
  chemically synthesized
ttttcatcctggaatagattat

SEQ ID NO: 1337537 - DNA, 22 bp, Artificial Sequence
  chemically synthesized
ttcatcctggaatagattattg

SEQ ID NO: 1337538 - DNA, 22 bp, Artificial Sequence
  chemically synthesized
tcatcctggaatagattattgt

SEQ ID NO: 1337539 - DNA, 22 bp, Artificial Sequence
  chemically synthesized
catcctggaatagattattgtc

SEQ ID NO: 1337540 - DNA, 22 bp, Artificial Sequence
  chemically synthesized
atcctggaatagattattgtca

SEQ ID NO: 1337541 - DNA, 22 bp, Artificial Sequence
  chemically synthesized
gaatagattattgtcatttcaa

SEQ ID NO: 1337542 - DNA, 22 bp, Artificial Sequence
  chemically synthesized
acaagggaggccttgaaatgac

SEQ ID NO: 1337543 - DNA, 22 bp, Artificial Sequence
  chemically synthesized
ttgtcatttcaaggcctccctt

SEQ ID NO: 1337544 - DNA, 22 bp, Artificial Sequence
  chemically synthesized
tcatttcaaggcctcccttgtg

SEQ ID NO: 1337545 - DNA, 22 bp, Artificial Sequence
  chemically synthesized
caaggcctcccttgtgagtact

SEQ ID NO: 1337546 - DNA, 22 bp, Artificial Sequence
  chemically synthesized
aaggcctcccttgtgagtactt

SEQ ID NO: 1337547 - DNA, 22 bp, Artificial Sequence
  chemically synthesized
ccttgtgagtacttttttctcc

SEQ ID NO: 1337548 - DNA, 22 bp, Artificial Sequence
  chemically synthesized
gtgagtacttttttctcctttt

SEQ ID NO: 1337549 - DNA, 22 bp, Artificial Sequence
  chemically synthesized
tgagtacttttttctccttttt

SEQ ID NO: 1337550 - DNA, 22 bp, Artificial Sequence
  chemically synthesized
aagaatggcaataaaaaggaga

SEQ ID NO: 1337551 - DNA, 22 bp, Artificial Sequence
  chemically synthesized
ttttctcctttttattgccatt

SEQ ID NO: 1337552 - DNA, 22 bp, Artificial Sequence
  chemically synthesized
tttctcctttttattgccattc

SEQ ID NO: 1337553 - DNA, 22 bp, Artificial Sequence
  chemically synthesized
ttctcctttttattgccattct

SEQ ID NO: 1337554 - DNA, 22 bp, Artificial Sequence
  chemically synthesized
tctcctttttattgccattctt

SEQ ID NO: 1337555 - DNA, 22 bp, Artificial Sequence
  chemically synthesized
ctcctttttattgccattcttc

SEQ ID NO: 1337556 - DNA, 22 bp, Artificial Sequence
  chemically synthesized
tcctttttattgccattcttca

SEQ ID NO: 1337557 - DNA, 22 bp, Artificial Sequence
  chemically synthesized
ctttttattgccattcttcagc

SEQ ID NO: 1337558 - DNA, 22 bp, Artificial Sequence
  chemically synthesized
tttattgccattcttcagcatt

SEQ ID NO: 1337559 - DNA, 22 bp, Artificial Sequence
  chemically synthesized
ttattgccattcttcagcattt

SEQ ID NO: 1337560 - DNA, 22 bp, Artificial Sequence
  chemically synthesized
tattgccattcttcagcatttt

SEQ ID NO: 1337561 - DNA, 22 bp, Artificial Sequence
  chemically synthesized
taagtaccagtaaaaatgctga

SEQ ID NO: 1337562 - DNA, 22 bp, Artificial Sequence
  chemically synthesized
attgccattcttcagcattttt

SEQ ID NO: 1337563 - DNA, 22 bp, Artificial Sequence
  chemically synthesized
ttgccattcttcagcattttta

SEQ ID NO: 1337564 - DNA, 22 bp, Artificial Sequence
  chemically synthesized
ttataagtaccagtaaaaatgc

SEQ ID NO: 1337565 - DNA, 22 bp, Artificial Sequence
  chemically synthesized
ccattcttcagcatttttactg

SEQ ID NO: 1337566 - DNA, 22 bp, Artificial Sequence
  chemically synthesized
ttcagcatttttactggtactt

SEQ ID NO: 1337567 - DNA, 22 bp, Artificial Sequence
  chemically synthesized
cagcatttttactggtacttat

SEQ ID NO: 1337568 - DNA, 22 bp, Artificial Sequence
  chemically synthesized
agcatttttactggtacttata

SEQ ID NO: 1337569 - DNA, 22 bp, Artificial Sequence
  chemically synthesized
ttactggtacttataacagttc

SEQ ID NO: 1337570 - DNA, 22 bp, Artificial Sequence
  chemically synthesized
tactggtacttataacagttct

SEQ ID NO: 1337571 - DNA, 22 bp, Artificial Sequence
  chemically synthesized
actggtacttataacagttctc

SEQ ID NO: 1337572 - DNA, 22 bp, Artificial Sequence
  chemically synthesized
ctggtacttataacagttctcc

SEQ ID NO: 1337573 - DNA, 22 bp, Artificial Sequence
  chemically synthesized
gtacttataacagttctccttt

SEQ ID NO: 1337574 - DNA, 22 bp, Artificial Sequence
  chemically synthesized
ataacagttctccttttcttgc

SEQ ID NO: 1337575 - DNA, 22 bp, Artificial Sequence
  chemically synthesized
taacagttctccttttcttgct

SEQ ID NO: 1337576 - DNA, 22 bp, Artificial Sequence
  chemically synthesized
tccttttcttgctggcttctgg

SEQ ID NO: 1337577 - DNA, 22 bp, Artificial Sequence
  chemically synthesized
cttttcttgctggcttctggcg

SEQ ID NO: 1337578 - DNA, 22 bp, Artificial Sequence
  chemically synthesized
ttcttgctggcttctggcgtgg

SEQ ID NO: 1337579 - DNA, 22 bp, Artificial Sequence
  chemically synthesized
tcttgctggcttctggcgtggg

SEQ ID NO: 1337580 - DNA, 22 bp, Artificial Sequence
  chemically synthesized
cttgctggcttctggcgtgggt

SEQ ID NO: 1337581 - DNA, 22 bp, Artificial Sequence
  chemically synthesized
ttgctggcttctggcgtgggtt

SEQ ID NO: 1337582 - DNA, 22 bp, Artificial Sequence
  chemically synthesized
gctggcttctggcgtgggtttg

SEQ ID NO: 1337583 - DNA, 22 bp, Artificial Sequence
  chemically synthesized
ctggcttctggcgtgggtttgt

SEQ ID NO: 1337584 - DNA, 22 bp, Artificial Sequence
  chemically synthesized
gcttctggcgtgggtttgttgc

SEQ ID NO: 1337585 - DNA, 22 bp, Artificial Sequence
  chemically synthesized
ctggcgtgggtttgttgctatt

SEQ ID NO: 1337586 - DNA, 22 bp, Artificial Sequence
  chemically synthesized
tggcgtgggtttgttgctattt

SEQ ID NO: 1337587 - DNA, 22 bp, Artificial Sequence
  chemically synthesized
gcgtgggtttgttgctatttct

SEQ ID NO: 1337588 - DNA, 22 bp, Artificial Sequence
  chemically synthesized
gttgctatttcttgttctttga

SEQ ID NO: 1337589 - DNA, 22 bp, Artificial Sequence
  chemically synthesized
ttgctatttcttgttctttgat

SEQ ID NO: 1337590 - DNA, 22 bp, Artificial Sequence
  chemically synthesized
ctatttcttgttctttgatgtt

SEQ ID NO: 1337591 - DNA, 22 bp, Artificial Sequence
  chemically synthesized
tttcttgttctttgatgtttcg

SEQ ID NO: 1337592 - DNA, 22 bp, Artificial Sequence
  chemically synthesized
cttgttctttgatgtttcgcat

SEQ ID NO: 1337593 - DNA, 22 bp, Artificial Sequence
  chemically synthesized
ttgttctttgatgtttcgcata

SEQ ID NO: 1337594 - DNA, 22 bp, Artificial Sequence
  chemically synthesized
gttctttgatgtttcgcatatc

SEQ ID NO: 1337595 - DNA, 22 bp, Artificial Sequence
  chemically synthesized
ttctttgatgtttcgcatatct

SEQ ID NO: 1337596 - DNA, 22 bp, Artificial Sequence
  chemically synthesized
tttgatgtttcgcatatctgat

SEQ ID NO: 1337597 - DNA, 22 bp, Artificial Sequence
  chemically synthesized
tgatgtttcgcatatctgattg

SEQ ID NO: 1337598 - DNA, 22 bp, Artificial Sequence
  chemically synthesized
gatgtttcgcatatctgattgt

SEQ ID NO: 1337599 - DNA, 22 bp, Artificial Sequence
  chemically synthesized
atgtttcgcatatctgattgtt

SEQ ID NO: 1337600 - DNA, 22 bp, Artificial Sequence
  chemically synthesized
cgcatatctgattgttcccttt

SEQ ID NO: 1337601 - DNA, 22 bp, Artificial Sequence
  chemically synthesized
gcatatctgattgttccctttc

SEQ ID NO: 1337602 - DNA, 22 bp, Artificial Sequence
  chemically synthesized
attgttccctttctcacccctg

SEQ ID NO: 1337603 - DNA, 22 bp, Artificial Sequence
  chemically synthesized
ttccctttctcacccctgcttt

SEQ ID NO: 1337604 - DNA, 22 bp, Artificial Sequence
  chemically synthesized
cctttctcacccctgctttctg

SEQ ID NO: 1337605 - DNA, 22 bp, Artificial Sequence
  chemically synthesized
tctcacccctgctttctgccac

SEQ ID NO: 1337606 - DNA, 22 bp, Artificial Sequence
  chemically synthesized
ctcacccctgctttctgccacg

SEQ ID NO: 1337607 - DNA, 22 bp, Artificial Sequence
  chemically synthesized
tcacccctgctttctgccacgt

SEQ ID NO: 1337608 - DNA, 22 bp, Artificial Sequence
  chemically synthesized
acccctgctttctgccacgttt

SEQ ID NO: 1337609 - DNA, 22 bp, Artificial Sequence
  chemically synthesized
ctttctgccacgtttacctctt

SEQ ID NO: 1337610 - DNA, 22 bp, Artificial Sequence
  chemically synthesized
tctgccacgtttacctctttgc

SEQ ID NO: 1337611 - DNA, 22 bp, Artificial Sequence
  chemically synthesized
ctgccacgtttacctctttgct

SEQ ID NO: 1337612 - DNA, 22 bp, Artificial Sequence
  chemically synthesized
tgccacgtttacctctttgcta

SEQ ID NO: 1337613 - DNA, 22 bp, Artificial Sequence
  chemically synthesized
ccacgtttacctctttgctatt

SEQ ID NO: 1337614 - DNA, 22 bp, Artificial Sequence
  chemically synthesized
aaaataggaaacaaataatagc

SEQ ID NO: 1337615 - DNA, 22 bp, Artificial Sequence
  chemically synthesized
caaaataggaaacaaataatag

SEQ ID NO: 1337616 - DNA, 22 bp, Artificial Sequence
  chemically synthesized
acctctttgctattatttgttt

SEQ ID NO: 1337617 - DNA, 22 bp, Artificial Sequence
  chemically synthesized
cctctttgctattatttgtttc

SEQ ID NO: 1337618 - DNA, 22 bp, Artificial Sequence
  chemically synthesized
tttgctattatttgtttcctat

SEQ ID NO: 1337619 - DNA, 22 bp, Artificial Sequence
  chemically synthesized
tcaaccttcaaaataggaaaca

SEQ ID NO: 1337620 - DNA, 22 bp, Artificial Sequence
  chemically synthesized
tgctattatttgtttcctattt

SEQ ID NO: 1337621 - DNA, 22 bp, Artificial Sequence
  chemically synthesized
gctattatttgtttcctatttt

SEQ ID NO: 1337622 - DNA, 22 bp, Artificial Sequence
  chemically synthesized
ctattatttgtttcctattttg

SEQ ID NO: 1337623 - DNA, 22 bp, Artificial Sequence
  chemically synthesized
gttgtcaaccttcaaaatagga

SEQ ID NO: 1337624 - DNA, 22 bp, Artificial Sequence
  chemically synthesized
agttgtcaaccttcaaaatagg

SEQ ID NO: 1337625 - DNA, 22 bp, Artificial Sequence
  chemically synthesized
ttatttgtttcctattttgaag

SEQ ID NO: 1337626 - DNA, 22 bp, Artificial Sequence
  chemically synthesized
tttgtttcctattttgaaggtt

SEQ ID NO: 1337627 - DNA, 22 bp, Artificial Sequence
  chemically synthesized
tccccttagttgtcaaccttca

SEQ ID NO: 1337628 - DNA, 22 bp, Artificial Sequence
  chemically synthesized
gtttcctattttgaaggttgac

SEQ ID NO: 1337629 - DNA, 22 bp, Artificial Sequence
  chemically synthesized
tttcctattttgaaggttgaca

SEQ ID NO: 1337630 - DNA, 22 bp, Artificial Sequence
  chemically synthesized
cctattttgaaggttgacaact

SEQ ID NO: 1337631 - DNA, 22 bp, Artificial Sequence
  chemically synthesized
ctattttgaaggttgacaacta

SEQ ID NO: 1337632 - DNA, 22 bp, Artificial Sequence
  chemically synthesized
ttttgaaggttgacaactaagg

SEQ ID NO: 1337633 - DNA, 22 bp, Artificial Sequence
  chemically synthesized
tgaaggttgacaactaagggga

SEQ ID NO: 1337634 - DNA, 22 bp, Artificial Sequence
  chemically synthesized
gaaggttgacaactaaggggac

SEQ ID NO: 1337635 - DNA, 22 bp, Artificial Sequence
  chemically synthesized
aggaatgatactgtccccttag

SEQ ID NO: 1337636 - DNA, 22 bp, Artificial Sequence
  chemically synthesized
aaggttgacaactaaggggaca

SEQ ID NO: 1337637 - DNA, 22 bp, Artificial Sequence
  chemically synthesized
acaactaaggggacagtatcat

SEQ ID NO: 1337638 - DNA, 22 bp, Artificial Sequence
  chemically synthesized
gagaaacacattaaggaatgat

SEQ ID NO: 1337639 - DNA, 22 bp, Artificial Sequence
  chemically synthesized
aggggacagtatcattccttaa

SEQ ID NO: 1337640 - DNA, 22 bp, Artificial Sequence
  chemically synthesized
atgagtaagctggagaaacaca

SEQ ID NO: 1337641 - DNA, 22 bp, Artificial Sequence
  chemically synthesized
catgagtaagctggagaaacac

SEQ ID NO: 1337642 - DNA, 22 bp, Artificial Sequence
  chemically synthesized
atttcatgagtaagctggagaa

SEQ ID NO: 1337643 - DNA, 22 bp, Artificial Sequence
  chemically synthesized
cttaatgtgtttctccagctta

SEQ ID NO: 1337644 - DNA, 22 bp, Artificial Sequence
  chemically synthesized
ctgatttcatgagtaagctgga

SEQ ID NO: 1337645 - DNA, 22 bp, Artificial Sequence
  chemically synthesized
aatgtgtttctccagcttactc

SEQ ID NO: 1337646 - DNA, 22 bp, Artificial Sequence
  chemically synthesized
atgtgtttctccagcttactca

SEQ ID NO: 1337647 - DNA, 22 bp, Artificial Sequence
  chemically synthesized
ctgctgatttcatgagtaagct

SEQ ID NO: 1337648 - DNA, 22 bp, Artificial Sequence
  chemically synthesized
ctccagcttactcatgaaatca

SEQ ID NO: 1337649 - DNA, 22 bp, Artificial Sequence
  chemically synthesized
tccagcttactcatgaaatcag

SEQ ID NO: 1337650 - DNA, 22 bp, Artificial Sequence
  chemically synthesized
cagcttactcatgaaatcagca

SEQ ID NO: 1337651 - DNA, 22 bp, Artificial Sequence
  chemically synthesized
tgtgtgaaggaggctgctgctg

SEQ ID NO: 1337652 - DNA, 22 bp, Artificial Sequence
  chemically synthesized
actcatgaaatcagcagcagcc

SEQ ID NO: 1337653 - DNA, 22 bp, Artificial Sequence
  chemically synthesized
atgtgtgaaggaggctgctgct

SEQ ID NO: 1337654 - DNA, 22 bp, Artificial Sequence
  chemically synthesized
ctcatgaaatcagcagcagcct

SEQ ID NO: 1337655 - DNA, 22 bp, Artificial Sequence
  chemically synthesized
tatgtgtgaaggaggctgctgc

SEQ ID NO: 1337656 - DNA, 22 bp, Artificial Sequence
  chemically synthesized
atgaaatcagcagcagcctcct

SEQ ID NO: 1337657 - DNA, 22 bp, Artificial Sequence
  chemically synthesized
gttttatgtgtgaaggaggctg

SEQ ID NO: 1337658 - DNA, 22 bp, Artificial Sequence
  chemically synthesized
ccggactggttttatgtgtgaa

SEQ ID NO: 1337659 - DNA, 22 bp, Artificial Sequence
  chemically synthesized
ccctcccggactggttttatgt

SEQ ID NO: 1337660 - DNA, 22 bp, Artificial Sequence
  chemically synthesized
gccctcccggactggttttatg

SEQ ID NO: 1337661 - DNA, 22 bp, Artificial Sequence
  chemically synthesized
tgccctcccggactggttttat

SEQ ID NO: 1337662 - DNA, 22 bp, Artificial Sequence
  chemically synthesized
cttcacacataaaaccagtccg

SEQ ID NO: 1337663 - DNA, 22 bp, Artificial Sequence
  chemically synthesized
cacacataaaaccagtccggga

SEQ ID NO: 1337664 - DNA, 22 bp, Artificial Sequence
  chemically synthesized
acacataaaaccagtccgggag

SEQ ID NO: 1337665 - DNA, 22 bp, Artificial Sequence
  chemically synthesized
cagacgtgagtcactttgccct

SEQ ID NO: 1337666 - DNA, 22 bp, Artificial Sequence
  chemically synthesized
ggattacagacgtgagtcactt

SEQ ID NO: 1337667 - DNA, 22 bp, Artificial Sequence
  chemically synthesized
ggagtgctgggattacagacgt

SEQ ID NO: 1337668 - DNA, 22 bp, Artificial Sequence
  chemically synthesized
tcggagtgctgggattacagac

SEQ ID NO: 1337669 - DNA, 22 bp, Artificial Sequence
  chemically synthesized
ggcctctcggagtgctgggatt

SEQ ID NO: 1337670 - DNA, 22 bp, Artificial Sequence
  chemically synthesized
acgtctgtaatcccagcactcc

SEQ ID NO: 1337671 - DNA, 22 bp, Artificial Sequence
  chemically synthesized
taatcccagcactccgagaggc

SEQ ID NO: 1337672 - DNA, 22 bp, Artificial Sequence
  chemically synthesized
agtgatccgcccatctcggcct

SEQ ID NO: 1337673 - DNA, 22 bp, Artificial Sequence
  chemically synthesized
aagtgatccgcccatctcggcc

SEQ ID NO: 1337674 - DNA, 22 bp, Artificial Sequence
  chemically synthesized
gccttaagtgatccgcccatct

SEQ ID NO: 1337675 - DNA, 22 bp, Artificial Sequence
  chemically synthesized
cgagaggccgagatgggcggat

SEQ ID NO: 1337676 - DNA, 22 bp, Artificial Sequence
  chemically synthesized
ctggccttaagtgatccgccca

SEQ ID NO: 1337677 - DNA, 22 bp, Artificial Sequence
  chemically synthesized
aaactcctggccttaagtgatc

SEQ ID NO: 1337678 - DNA, 22 bp, Artificial Sequence
  chemically synthesized
gtctcaaactcctggccttaag

SEQ ID NO: 1337679 - DNA, 22 bp, Artificial Sequence
  chemically synthesized
ggtctcaaactcctggccttaa

SEQ ID NO: 1337680 - DNA, 22 bp, Artificial Sequence
  chemically synthesized
tggtctcaaactcctggcctta

SEQ ID NO: 1337681 - DNA, 22 bp, Artificial Sequence
  chemically synthesized
ctttggtctcaaactcctggcc

SEQ ID NO: 1337682 - DNA, 22 bp, Artificial Sequence
  chemically synthesized
cctgctttggtctcaaactcct

SEQ ID NO: 1337683 - DNA, 22 bp, Artificial Sequence
  chemically synthesized
tgttgcctgctttggtctcaaa

SEQ ID NO: 1337684 - DNA, 22 bp, Artificial Sequence
  chemically synthesized
aaggccaggagtttgagaccaa

SEQ ID NO: 1337685 - DNA, 22 bp, Artificial Sequence
  chemically synthesized
atgttgcctgctttggtctcaa

SEQ ID NO: 1337686 - DNA, 22 bp, Artificial Sequence
  chemically synthesized
aggccaggagtttgagaccaaa

SEQ ID NO: 1337687 - DNA, 22 bp, Artificial Sequence
  chemically synthesized
cttatgttgcctgctttggtct

SEQ ID NO: 1337688 - DNA, 22 bp, Artificial Sequence
  chemically synthesized
gagaccaaagcaggcaacataa

SEQ ID NO: 1337689 - DNA, 22 bp, Artificial Sequence
  chemically synthesized
agaccaaagcaggcaacataag

SEQ ID NO: 1337690 - DNA, 22 bp, Artificial Sequence
  chemically synthesized
tagaaatggggtctccttatgt

SEQ ID NO: 1337691 - DNA, 22 bp, Artificial Sequence
  chemically synthesized
gtagaaatggggtctccttatg

SEQ ID NO: 1337692 - DNA, 22 bp, Artificial Sequence
  chemically synthesized
tgtagaaatggggtctccttat

SEQ ID NO: 1337693 - DNA, 22 bp, Artificial Sequence
  chemically synthesized
ttgtagaaatggggtctcctta

SEQ ID NO: 1337694 - DNA, 22 bp, Artificial Sequence
  chemically synthesized
atttttgtagaaatggggtctc

SEQ ID NO: 1337695 - DNA, 22 bp, Artificial Sequence
  chemically synthesized
gctcatttttgtagaaatgggg

SEQ ID NO: 1337696 - DNA, 22 bp, Artificial Sequence
  chemically synthesized
cgccaccacatctggctcattt

SEQ ID NO: 1337697 - DNA, 22 bp, Artificial Sequence
  chemically synthesized
ctacaaaaatgagccagatgtg

SEQ ID NO: 1337698 - DNA, 22 bp, Artificial Sequence
  chemically synthesized
cagttgcgccaccacatctggc

SEQ ID NO: 1337699 - DNA, 22 bp, Artificial Sequence
  chemically synthesized
tacaaaaatgagccagatgtgg

SEQ ID NO: 1337700 - DNA, 22 bp, Artificial Sequence
  chemically synthesized
caaaaatgagccagatgtggtg

SEQ ID NO: 1337701 - DNA, 22 bp, Artificial Sequence
  chemically synthesized
ggactacagttgcgccaccaca

SEQ ID NO: 1337702 - DNA, 22 bp, Artificial Sequence
  chemically synthesized
cccagtagctaggactacagtt

SEQ ID NO: 1337703 - DNA, 22 bp, Artificial Sequence
  chemically synthesized
ccccagtagctaggactacagt

SEQ ID NO: 1337704 - DNA, 22 bp, Artificial Sequence
  chemically synthesized
agcttccccagtagctaggact

SEQ ID NO: 1337705 - DNA, 22 bp, Artificial Sequence
  chemically synthesized
ccacctcagcttccccagtagc

SEQ ID NO: 1337706 - DNA, 22 bp, Artificial Sequence
  chemically synthesized
tagtcctagctactggggaagc

SEQ ID NO: 1337707 - DNA, 22 bp, Artificial Sequence
  chemically synthesized
cggcgatcctcccacctcagct

SEQ ID NO: 1337708 - DNA, 22 bp, Artificial Sequence
  chemically synthesized
gctactggggaagctgaggtgg

SEQ ID NO: 1337709 - DNA, 22 bp, Artificial Sequence
  chemically synthesized
ctggggaagctgaggtgggagg

SEQ ID NO: 1337710 - DNA, 22 bp, Artificial Sequence
  chemically synthesized
tattccggcgatcctcccacct

SEQ ID NO: 1337711 - DNA, 22 bp, Artificial Sequence
  chemically synthesized
gggaagctgaggtgggaggatc

SEQ ID NO: 1337712 - DNA, 22 bp, Artificial Sequence
  chemically synthesized
ctgtattccggcgatcctccca

SEQ ID NO: 1337713 - DNA, 22 bp, Artificial Sequence
  chemically synthesized
gaactcctgtattccggcgatc

SEQ ID NO: 1337714 - DNA, 22 bp, Artificial Sequence
  chemically synthesized
aggtgggaggatcgccggaata

SEQ ID NO: 1337715 - DNA, 22 bp, Artificial Sequence
  chemically synthesized
cagcctggaactcctgtattcc

SEQ ID NO: 1337716 - DNA, 22 bp, Artificial Sequence
  chemically synthesized
actgcagcctggaactcctgta

SEQ ID NO: 1337717 - DNA, 22 bp, Artificial Sequence
  chemically synthesized
agtggcaccatcgtaactcact

SEQ ID NO: 1337718 - DNA, 22 bp, Artificial Sequence
  chemically synthesized
cagtggcaccatcgtaactcac

SEQ ID NO: 1337719 - DNA, 22 bp, Artificial Sequence
  chemically synthesized
caggctgcagtgagttacgatg

SEQ ID NO: 1337720 - DNA, 22 bp, Artificial Sequence
  chemically synthesized
ccaggcttcagtggcaccatcg

SEQ ID NO: 1337721 - DNA, 22 bp, Artificial Sequence
  chemically synthesized
cagtgagttacgatggtgccac

SEQ ID NO: 1337722 - DNA, 22 bp, Artificial Sequence
  chemically synthesized
tctcccaggcttcagtggcacc

SEQ ID NO: 1337723 - DNA, 22 bp, Artificial Sequence
  chemically synthesized
tgtctcccaggcttcagtggca

SEQ ID NO: 1337724 - DNA, 22 bp, Artificial Sequence
  chemically synthesized
gctctgtctcccaggcttcagt

SEQ ID NO: 1337725 - DNA, 22 bp, Artificial Sequence
  chemically synthesized
cgatggtgccactgaagcctgg

SEQ ID NO: 1337726 - DNA, 22 bp, Artificial Sequence
  chemically synthesized
tatcaggggtctcgctctgtct

SEQ ID NO: 1337727 - DNA, 22 bp, Artificial Sequence
  chemically synthesized
aagcctgggagacagagcgaga

SEQ ID NO: 1337728 - DNA, 22 bp, Artificial Sequence
  chemically synthesized
aaactatatcaggggtctcgct

SEQ ID NO: 1337729 - DNA, 22 bp, Artificial Sequence
  chemically synthesized
ggagacagagcgagacccctga

SEQ ID NO: 1337730 - DNA, 22 bp, Artificial Sequence
  chemically synthesized
tggcagggacaaatattcaaac

SEQ ID NO: 1337731 - DNA, 22 bp, Artificial Sequence
  chemically synthesized
atatagtttgaatatttgtccc

SEQ ID NO: 1337732 - DNA, 22 bp, Artificial Sequence
  chemically synthesized
aatatgagattatggcagggac

SEQ ID NO: 1337733 - DNA, 22 bp, Artificial Sequence
  chemically synthesized
caatatgagattatggcaggga

SEQ ID NO: 1337734 - DNA, 22 bp, Artificial Sequence
  chemically synthesized
gaatatttgtccctgccataat

SEQ ID NO: 1337735 - DNA, 22 bp, Artificial Sequence
  chemically synthesized
aatatttgtccctgccataatc

SEQ ID NO: 1337736 - DNA, 22 bp, Artificial Sequence
  chemically synthesized
catttcaatatgagattatggc

SEQ ID NO: 1337737 - DNA, 22 bp, Artificial Sequence
  chemically synthesized
gtccctgccataatctcatatt

SEQ ID NO: 1337738 - DNA, 22 bp, Artificial Sequence
  chemically synthesized
tccctgccataatctcatattg

SEQ ID NO: 1337739 - DNA, 22 bp, Artificial Sequence
  chemically synthesized
gggattacatttcaatatgaga

SEQ ID NO: 1337740 - DNA, 22 bp, Artificial Sequence
  chemically synthesized
ccataatctcatattgaaatgt

SEQ ID NO: 1337741 - DNA, 22 bp, Artificial Sequence
  chemically synthesized
atattgaaatgtaatccccaat

SEQ ID NO: 1337742 - DNA, 22 bp, Artificial Sequence
  chemically synthesized
aaatgtaatccccaatgtttgt

SEQ ID NO: 1337743 - DNA, 22 bp, Artificial Sequence
  chemically synthesized
aaaaacaaacaaacaaacattg

SEQ ID NO: 1337744 - DNA, 22 bp, Artificial Sequence
  chemically synthesized
cgtctcaaaaacaaacaaacaa

SEQ ID NO: 1337745 - DNA, 22 bp, Artificial Sequence
  chemically synthesized
gtttgtttgtttttgagacgga

SEQ ID NO: 1337746 - DNA, 22 bp, Artificial Sequence
  chemically synthesized
tttgtttgtttttgagacggaa

SEQ ID NO: 1337747 - DNA, 22 bp, Artificial Sequence
  chemically synthesized
gtttgtttttgagacggaattt

SEQ ID NO: 1337748 - DNA, 22 bp, Artificial Sequence
  chemically synthesized
tttgtttttgagacggaatttc

SEQ ID NO: 1337749 - DNA, 22 bp, Artificial Sequence
  chemically synthesized
ggtgacaagagtgaaattccgt

SEQ ID NO: 1337750 - DNA, 22 bp, Artificial Sequence
  chemically synthesized
gtttttgagacggaatttcact

SEQ ID NO: 1337751 - DNA, 22 bp, Artificial Sequence
  chemically synthesized
tttttgagacggaatttcactc

SEQ ID NO: 1337752 - DNA, 22 bp, Artificial Sequence
  chemically synthesized
ttgagacggaatttcactcttg

SEQ ID NO: 1337753 - DNA, 22 bp, Artificial Sequence
  chemically synthesized
cagcctgggtgacaagagtgaa

SEQ ID NO: 1337754 - DNA, 22 bp, Artificial Sequence
  chemically synthesized
tgagacggaatttcactcttgt

SEQ ID NO: 1337755 - DNA, 22 bp, Artificial Sequence
  chemically synthesized
gagacggaatttcactcttgtc

SEQ ID NO: 1337756 - DNA, 22 bp, Artificial Sequence
  chemically synthesized
agacggaatttcactcttgtca

SEQ ID NO: 1337757 - DNA, 22 bp, Artificial Sequence
  chemically synthesized
cactccagcctgggtgacaaga

SEQ ID NO: 1337758 - DNA, 22 bp, Artificial Sequence
  chemically synthesized
cactgcactccagcctgggtga

SEQ ID NO: 1337759 - DNA, 22 bp, Artificial Sequence
  chemically synthesized
cactcttgtcacccaggctgga

SEQ ID NO: 1337760 - DNA, 22 bp, Artificial Sequence
  chemically synthesized
actcttgtcacccaggctggag

SEQ ID NO: 1337761 - DNA, 22 bp, Artificial Sequence
  chemically synthesized
ttgtcacccaggctggagtgca

SEQ ID NO: 1337762 - DNA, 22 bp, Artificial Sequence
  chemically synthesized
agatcgttccactgcactccag

SEQ ID NO: 1337763 - DNA, 22 bp, Artificial Sequence
  chemically synthesized
gtcacccaggctggagtgcagt

SEQ ID NO: 1337764 - DNA, 22 bp, Artificial Sequence
  chemically synthesized
tcacccaggctggagtgcagtg

SEQ ID NO: 1337765 - DNA, 22 bp, Artificial Sequence
  chemically synthesized
cagtgagctgagatcgttccac

SEQ ID NO: 1337766 - DNA, 22 bp, Artificial Sequence
  chemically synthesized
gagtgcagtggaacgatctcag

SEQ ID NO: 1337767 - DNA, 22 bp, Artificial Sequence
  chemically synthesized
ggagacagacgttgcagtgagc

SEQ ID NO: 1337768 - DNA, 22 bp, Artificial Sequence
  chemically synthesized
gggagacagacgttgcagtgag

SEQ ID NO: 1337769 - DNA, 22 bp, Artificial Sequence
  chemically synthesized
cttgggagacagacgttgcagt

SEQ ID NO: 1337770 - DNA, 22 bp, Artificial Sequence
  chemically synthesized
agctacttgggagacagacgtt

SEQ ID NO: 1337771 - DNA, 22 bp, Artificial Sequence
  chemically synthesized
agctcactgcaacgtctgtctc

SEQ ID NO: 1337772 - DNA, 22 bp, Artificial Sequence
  chemically synthesized
actgcaacgtctgtctcccaag

SEQ ID NO: 1337773 - DNA, 22 bp, Artificial Sequence
  chemically synthesized
taatctcagctacttgggagac

SEQ ID NO: 1337774 - DNA, 22 bp, Artificial Sequence
  chemically synthesized
caacgtctgtctcccaagtagc

SEQ ID NO: 1337775 - DNA, 22 bp, Artificial Sequence
  chemically synthesized
tctcccaagtagctgagattac

SEQ ID NO: 1337776 - DNA, 22 bp, Artificial Sequence
  chemically synthesized
ccaagtagctgagattacaggc

SEQ ID NO: 1337777 - DNA, 22 bp, Artificial Sequence
  chemically synthesized
accgggcgtgatggcaggtgcc

SEQ ID NO: 1337778 - DNA, 22 bp, Artificial Sequence
  chemically synthesized
aaccgggcgtgatggcaggtgc

SEQ ID NO: 1337779 - DNA, 22 bp, Artificial Sequence
  chemically synthesized
agattacaggcacctgccatca

SEQ ID NO: 1337780 - DNA, 22 bp, Artificial Sequence
  chemically synthesized
caggcacctgccatcacgcccg

SEQ ID NO: 1337781 - DNA, 22 bp, Artificial Sequence
  chemically synthesized
ggaataacttaaccgggcgtga

SEQ ID NO: 1337782 - DNA, 22 bp, Artificial Sequence
  chemically synthesized
aacactgggaataacttaaccg

SEQ ID NO: 1337783 - DNA, 22 bp, Artificial Sequence
  chemically synthesized
caacactgggaataacttaacc

SEQ ID NO: 1337784 - DNA, 22 bp, Artificial Sequence
  chemically synthesized
ccatcacgcccggttaagttat

SEQ ID NO: 1337785 - DNA, 22 bp, Artificial Sequence
  chemically synthesized
agttattcccagtgttgaaggt

SEQ ID NO: 1337786 - DNA, 22 bp, Artificial Sequence
  chemically synthesized
ccaccaggccccaccttcaaca

SEQ ID NO: 1337787 - DNA, 22 bp, Artificial Sequence
  chemically synthesized
ttcccagtgttgaaggtggggc

SEQ ID NO: 1337788 - DNA, 22 bp, Artificial Sequence
  chemically synthesized
ccagtgttgaaggtggggcctg

SEQ ID NO: 1337789 - DNA, 22 bp, Artificial Sequence
  chemically synthesized
cgatcacctcccaccaggcccc

SEQ ID NO: 1337790 - DNA, 22 bp, Artificial Sequence
  chemically synthesized
aaggtggggcctggtgggaggt

SEQ ID NO: 1337791 - DNA, 22 bp, Artificial Sequence
  chemically synthesized
gtgggaggtgatcggagcatgc

SEQ ID NO: 1337792 - DNA, 22 bp, Artificial Sequence
  chemically synthesized
gtgagaaatccacccgcatgct

SEQ ID NO: 1337793 - DNA, 22 bp, Artificial Sequence
  chemically synthesized
ctcacgagtggtttatcatcat

SEQ ID NO: 1337794 - DNA, 22 bp, Artificial Sequence
  chemically synthesized
tcacgagtggtttatcatcatc

SEQ ID NO: 1337795 - DNA, 22 bp, Artificial Sequence
  chemically synthesized
acgagtggtttatcatcatccc

SEQ ID NO: 1337796 - DNA, 22 bp, Artificial Sequence
  chemically synthesized
aagacagcaccaatgggatgat

SEQ ID NO: 1337797 - DNA, 22 bp, Artificial Sequence
  chemically synthesized
accatctgaagacagcaccaat

SEQ ID NO: 1337798 - DNA, 22 bp, Artificial Sequence
  chemically synthesized
atcatcatcccattggtgctgt

SEQ ID NO: 1337799 - DNA, 22 bp, Artificial Sequence
  chemically synthesized
tcatcatcccattggtgctgtc

SEQ ID NO: 1337800 - DNA, 22 bp, Artificial Sequence
  chemically synthesized
atgagaatacactcaccatctg

SEQ ID NO: 1337801 - DNA, 22 bp, Artificial Sequence
  chemically synthesized
gtgctgtcttcagatggtgagt

SEQ ID NO: 1337802 - DNA, 22 bp, Artificial Sequence
  chemically synthesized
tcttcagatggtgagtgtattc

SEQ ID NO: 1337803 - DNA, 22 bp, Artificial Sequence
  chemically synthesized
cagatggtgagtgtattctcat

SEQ ID NO: 1337804 - DNA, 22 bp, Artificial Sequence
  chemically synthesized
agatggtgagtgtattctcatg

SEQ ID NO: 1337805 - DNA, 22 bp, Artificial Sequence
  chemically synthesized
agcaaccgtatctcatgagaat

SEQ ID NO: 1337806 - DNA, 22 bp, Artificial Sequence
  chemically synthesized
aagcaaccgtatctcatgagaa

SEQ ID NO: 1337807 - DNA, 22 bp, Artificial Sequence
  chemically synthesized
taagcaaccgtatctcatgaga

SEQ ID NO: 1337808 - DNA, 22 bp, Artificial Sequence
  chemically synthesized
ttaagcaaccgtatctcatgag

SEQ ID NO: 1337809 - DNA, 22 bp, Artificial Sequence
  chemically synthesized
tcatgagatacggttgcttaaa

SEQ ID NO: 1337810 - DNA, 22 bp, Artificial Sequence
  chemically synthesized
atgagatacggttgcttaaaag

SEQ ID NO: 1337811 - DNA, 22 bp, Artificial Sequence
  chemically synthesized
cttaaaagtgtttgacacctcc

SEQ ID NO: 1337812 - DNA, 22 bp, Artificial Sequence
  chemically synthesized
aaaagtgtttgacacctcccac

SEQ ID NO: 1337813 - DNA, 22 bp, Artificial Sequence
  chemically synthesized
aaagtgtttgacacctcccact

SEQ ID NO: 1337814 - DNA, 22 bp, Artificial Sequence
  chemically synthesized
gacacctcccactctctctctc

SEQ ID NO: 1337815 - DNA, 22 bp, Artificial Sequence
  chemically synthesized
acacctcccactctctctctca

SEQ ID NO: 1337816 - DNA, 22 bp, Artificial Sequence
  chemically synthesized
ccactctctctctcatgttcct

SEQ ID NO: 1337817 - DNA, 22 bp, Artificial Sequence
  chemically synthesized
tctctctcatgttcctgccctg

SEQ ID NO: 1337818 - DNA, 22 bp, Artificial Sequence
  chemically synthesized
tctctcatgttcctgccctggc

SEQ ID NO: 1337819 - DNA, 22 bp, Artificial Sequence
  chemically synthesized
tctcatgttcctgccctggcca

SEQ ID NO: 1337820 - DNA, 22 bp, Artificial Sequence
  chemically synthesized
tcatgttcctgccctggccaca

SEQ ID NO: 1337821 - DNA, 22 bp, Artificial Sequence
  chemically synthesized
atgttcctgccctggccacatg

SEQ ID NO: 1337822 - DNA, 22 bp, Artificial Sequence
  chemically synthesized
ctgccctggccacatgacatgc

SEQ ID NO: 1337823 - DNA, 22 bp, Artificial Sequence
  chemically synthesized
ccctggccacatgacatgcttg

SEQ ID NO: 1337824 - DNA, 22 bp, Artificial Sequence
  chemically synthesized
gccacatgacatgcttgctccc

SEQ ID NO: 1337825 - DNA, 22 bp, Artificial Sequence
  chemically synthesized
aaaatcatggtggaaatgaagg

SEQ ID NO: 1337826 - DNA, 22 bp, Artificial Sequence
  chemically synthesized
gctcccccttcatttccaccat

SEQ ID NO: 1337827 - DNA, 22 bp, Artificial Sequence
  chemically synthesized
ctcccccttcatttccaccatg

SEQ ID NO: 1337828 - DNA, 22 bp, Artificial Sequence
  chemically synthesized
aggaagctcaaaatcatggtgg

SEQ ID NO: 1337829 - DNA, 22 bp, Artificial Sequence
  chemically synthesized
ccccttcatttccaccatgatt

SEQ ID NO: 1337830 - DNA, 22 bp, Artificial Sequence
  chemically synthesized
catttccaccatgattttgagc

SEQ ID NO: 1337831 - DNA, 22 bp, Artificial Sequence
  chemically synthesized
atttccaccatgattttgagct

SEQ ID NO: 1337832 - DNA, 22 bp, Artificial Sequence
  chemically synthesized
ggaaagcctcaggaagctcaaa

SEQ ID NO: 1337833 - DNA, 22 bp, Artificial Sequence
  chemically synthesized
ccaccatgattttgagcttcct

SEQ ID NO: 1337834 - DNA, 22 bp, Artificial Sequence
  chemically synthesized
tgggaaagcctcaggaagctca

SEQ ID NO: 1337835 - DNA, 22 bp, Artificial Sequence
  chemically synthesized
caccatgattttgagcttcctg

SEQ ID NO: 1337836 - DNA, 22 bp, Artificial Sequence
  chemically synthesized
ctgggaaagcctcaggaagctc

SEQ ID NO: 1337837 - DNA, 22 bp, Artificial Sequence
  chemically synthesized
ggcttctgggaaagcctcagga

SEQ ID NO: 1337838 - DNA, 22 bp, Artificial Sequence
  chemically synthesized
tcggcttctgggaaagcctcag

SEQ ID NO: 1337839 - DNA, 22 bp, Artificial Sequence
  chemically synthesized
ctcggcttctgggaaagcctca

SEQ ID NO: 1337840 - DNA, 22 bp, Artificial Sequence
  chemically synthesized
tgagcttcctgaggctttccca

SEQ ID NO: 1337841 - DNA, 22 bp, Artificial Sequence
  chemically synthesized
gagcttcctgaggctttcccag

SEQ ID NO: 1337842 - DNA, 22 bp, Artificial Sequence
  chemically synthesized
agcttcctgaggctttcccaga

SEQ ID NO: 1337843 - DNA, 22 bp, Artificial Sequence
  chemically synthesized
gcatcttctcggcttctgggaa

SEQ ID NO: 1337844 - DNA, 22 bp, Artificial Sequence
  chemically synthesized
cctgaggctttcccagaagccg

SEQ ID NO: 1337845 - DNA, 22 bp, Artificial Sequence
  chemically synthesized
ctgaggctttcccagaagccga

SEQ ID NO: 1337846 - DNA, 22 bp, Artificial Sequence
  chemically synthesized
aggctttcccagaagccgagaa

SEQ ID NO: 1337847 - DNA, 22 bp, Artificial Sequence
  chemically synthesized
tcccagaagccgagaagatgcc

SEQ ID NO: 1337848 - DNA, 22 bp, Artificial Sequence
  chemically synthesized
cccagaagccgagaagatgcca

SEQ ID NO: 1337849 - DNA, 22 bp, Artificial Sequence
  chemically synthesized
ccagaagccgagaagatgccag

SEQ ID NO: 1337850 - DNA, 22 bp, Artificial Sequence
  chemically synthesized
tacaggaagcataatgctggca

SEQ ID NO: 1337851 - DNA, 22 bp, Artificial Sequence
  chemically synthesized
cataggctgtacaggaagcata

SEQ ID NO: 1337852 - DNA, 22 bp, Artificial Sequence
  chemically synthesized
aaagttccataggctgtacagg

SEQ ID NO: 1337853 - DNA, 22 bp, Artificial Sequence
  chemically synthesized
gctcaaagttccataggctgta

SEQ ID NO: 1337854 - DNA, 22 bp, Artificial Sequence
  chemically synthesized
tgcttcctgtacagcctatgga

SEQ ID NO: 1337855 - DNA, 22 bp, Artificial Sequence
  chemically synthesized
cctgtacagcctatggaacttt

SEQ ID NO: 1337856 - DNA, 22 bp, Artificial Sequence
  chemically synthesized
ctgtacagcctatggaactttg

SEQ ID NO: 1337857 - DNA, 22 bp, Artificial Sequence
  chemically synthesized
tacagcctatggaactttgagc

SEQ ID NO: 1337858 - DNA, 22 bp, Artificial Sequence
  chemically synthesized
aagaaaagagtaattggctcaa

SEQ ID NO: 1337859 - DNA, 22 bp, Artificial Sequence
  chemically synthesized
aaagaaaagagtaattggctca

SEQ ID NO: 1337860 - DNA, 22 bp, Artificial Sequence
  chemically synthesized
taaagaaaagagtaattggctc

SEQ ID NO: 1337861 - DNA, 22 bp, Artificial Sequence
  chemically synthesized
ttaaagaaaagagtaattggct

SEQ ID NO: 1337862 - DNA, 22 bp, Artificial Sequence
  chemically synthesized
tggaactttgagccaattactc

SEQ ID NO: 1337863 - DNA, 22 bp, Artificial Sequence
  chemically synthesized
tgagccaattactcttttcttt

SEQ ID NO: 1337864 - DNA, 22 bp, Artificial Sequence
  chemically synthesized
gagccaattactcttttcttta

SEQ ID NO: 1337865 - DNA, 22 bp, Artificial Sequence
  chemically synthesized
agccaattactcttttctttaa

SEQ ID NO: 1337866 - DNA, 22 bp, Artificial Sequence
  chemically synthesized
ctcttttctttaaaaattacct

SEQ ID NO: 1337867 - DNA, 22 bp, Artificial Sequence
  chemically synthesized
ttttctttaaaaattacctcat

SEQ ID NO: 1337868 - DNA, 22 bp, Artificial Sequence
  chemically synthesized
ttctttaaaaattacctcatct

SEQ ID NO: 1337869 - DNA, 22 bp, Artificial Sequence
  chemically synthesized
tctttaaaaattacctcatctt

SEQ ID NO: 1337870 - DNA, 22 bp, Artificial Sequence
  chemically synthesized
ctttaaaaattacctcatcttg

SEQ ID NO: 1337871 - DNA, 22 bp, Artificial Sequence
  chemically synthesized
tttaaaaattacctcatcttgc

SEQ ID NO: 1337872 - DNA, 22 bp, Artificial Sequence
  chemically synthesized
taaaaattacctcatcttgcgt

SEQ ID NO: 1337873 - DNA, 22 bp, Artificial Sequence
  chemically synthesized
ccataaagaaatacgcaagatg

SEQ ID NO: 1337874 - DNA, 22 bp, Artificial Sequence
  chemically synthesized
aaaaattacctcatcttgcgta

SEQ ID NO: 1337875 - DNA, 22 bp, Artificial Sequence
  chemically synthesized
aaaattacctcatcttgcgtat

SEQ ID NO: 1337876 - DNA, 22 bp, Artificial Sequence
  chemically synthesized
acactgccataaagaaatacgc

SEQ ID NO: 1337877 - DNA, 22 bp, Artificial Sequence
  chemically synthesized
tcacactgccataaagaaatac

SEQ ID NO: 1337878 - DNA, 22 bp, Artificial Sequence
  chemically synthesized
cctcatcttgcgtatttcttta

SEQ ID NO: 1337879 - DNA, 22 bp, Artificial Sequence
  chemically synthesized
atcttgcgtatttctttatggc

SEQ ID NO: 1337880 - DNA, 22 bp, Artificial Sequence
  chemically synthesized
gtcaattctcacactgccataa

SEQ ID NO: 1337881 - DNA, 22 bp, Artificial Sequence
  chemically synthesized
gcgtatttctttatggcagtgt

SEQ ID NO: 1337882 - DNA, 22 bp, Artificial Sequence
  chemically synthesized
cgtatttctttatggcagtgtg

SEQ ID NO: 1337883 - DNA, 22 bp, Artificial Sequence
  chemically synthesized
tattagtcaattctcacactgc

SEQ ID NO: 1337884 - DNA, 22 bp, Artificial Sequence
  chemically synthesized
ctttatggcagtgtgagaattg

SEQ ID NO: 1337885 - DNA, 22 bp, Artificial Sequence
  chemically synthesized
tttatggcagtgtgagaattga

SEQ ID NO: 1337886 - DNA, 22 bp, Artificial Sequence
  chemically synthesized
tatggcagtgtgagaattgact

SEQ ID NO: 1337887 - DNA, 22 bp, Artificial Sequence
  chemically synthesized
atggcagtgtgagaattgacta

SEQ ID NO: 1337888 - DNA, 22 bp, Artificial Sequence
  chemically synthesized
tggcagtgtgagaattgactaa

SEQ ID NO: 1337889 - DNA, 22 bp, Artificial Sequence
  chemically synthesized
gcgatggggctgtattagtcaa

SEQ ID NO: 1337890 - DNA, 22 bp, Artificial Sequence
  chemically synthesized
agcgatggggctgtattagtca

SEQ ID NO: 1337891 - DNA, 22 bp, Artificial Sequence
  chemically synthesized
tagcgatggggctgtattagtc

SEQ ID NO: 1337892 - DNA, 22 bp, Artificial Sequence
  chemically synthesized
ttagcgatggggctgtattagt

SEQ ID NO: 1337893 - DNA, 22 bp, Artificial Sequence
  chemically synthesized
tttagcgatggggctgtattag

SEQ ID NO: 1337894 - DNA, 22 bp, Artificial Sequence
  chemically synthesized
ttttagcgatggggctgtatta

SEQ ID NO: 1337895 - DNA, 22 bp, Artificial Sequence
  chemically synthesized
tttttagcgatggggctgtatt

SEQ ID NO: 1337896 - DNA, 22 bp, Artificial Sequence
  chemically synthesized
ttttttagcgatggggctgtat

SEQ ID NO: 1337897 - DNA, 22 bp, Artificial Sequence
  chemically synthesized
tttttttagcgatggggctgta

SEQ ID NO: 1337898 - DNA, 22 bp, Artificial Sequence
  chemically synthesized
ttttttttagcgatggggctgt

SEQ ID NO: 1337899 - DNA, 22 bp, Artificial Sequence
  chemically synthesized
tttttttttagcgatggggctg

SEQ ID NO: 1337900 - DNA, 22 bp, Artificial Sequence
  chemically synthesized
ttttttttttagcgatggggct

SEQ ID NO: 1337901 - DNA, 22 bp, Artificial Sequence
  chemically synthesized
tttttttttttagcgatggggc

SEQ ID NO: 1337902 - DNA, 22 bp, Artificial Sequence
  chemically synthesized
ttttttttttttagcgatgggg

SEQ ID NO: 1337903 - DNA, 22 bp, Artificial Sequence
  chemically synthesized
tttttttttttttagcgatggg

SEQ ID NO: 1337904 - DNA, 22 bp, Artificial Sequence
  chemically synthesized
actaatacagccccatcgctaa

SEQ ID NO: 1337905 - DNA, 22 bp, Artificial Sequence
  chemically synthesized
ttttttttttttttagcgatgg

SEQ ID NO: 1337906 - DNA, 22 bp, Artificial Sequence
  chemically synthesized
tttttttttttttttagcgatg

SEQ ID NO: 1337907 - DNA, 22 bp, Artificial Sequence
  chemically synthesized
ttttttttttttttttagcgat

SEQ ID NO: 1337908 - DNA, 22 bp, Artificial Sequence
  chemically synthesized
tttttttttttttttttagcga

SEQ ID NO: 1337909 - DNA, 22 bp, Artificial Sequence
  chemically synthesized
atacagccccatcgctaaaaaa

SEQ ID NO: 1337910 - DNA, 22 bp, Artificial Sequence
  chemically synthesized
ttttttttttttttttttagcg

SEQ ID NO: 1337911 - DNA, 22 bp, Artificial Sequence
  chemically synthesized
tttttttttttttttttttagc

SEQ ID NO: 1337912 - DNA, 22 bp, Artificial Sequence
  chemically synthesized
ttttttttttttttttttttag

SEQ ID NO: 1337913 - DNA, 22 bp, Artificial Sequence
  chemically synthesized
ttttttttttttttttttttta

SEQ ID NO: 1337914 - DNA, 22 bp, Artificial Sequence
  chemically synthesized
tttttttttttttttttttttt

SEQ ID NO: 1337915 - DNA, 22 bp, Artificial Sequence
  chemically synthesized
tttttttttttttttttttttt

SEQ ID NO: 1337916 - DNA, 22 bp, Artificial Sequence
  chemically synthesized
tttttttttttttttttttttt

SEQ ID NO: 1337917 - DNA, 22 bp, Artificial Sequence
  chemically synthesized
tttttttttttttttttttttt

SEQ ID NO: 1337918 - DNA, 22 bp, Artificial Sequence
  chemically synthesized
gacatttttttttttttttttt

SEQ ID NO: 1337919 - DNA, 22 bp, Artificial Sequence
  chemically synthesized
aaaaaaaaaaaaaaaaaaaaaa

SEQ ID NO: 1337920 - DNA, 22 bp, Artificial Sequence
  chemically synthesized
attagacatttttttttttttt

SEQ ID NO: 1337921 - DNA, 22 bp, Artificial Sequence
  chemically synthesized
gattagacattttttttttttt

SEQ ID NO: 1337922 - DNA, 22 bp, Artificial Sequence
  chemically synthesized
tgattagacatttttttttttt

SEQ ID NO: 1337923 - DNA, 22 bp, Artificial Sequence
  chemically synthesized
caactttgattagacatttttt

SEQ ID NO: 1337924 - DNA, 22 bp, Artificial Sequence
  chemically synthesized
ccaactttgattagacattttt

SEQ ID NO: 1337925 - DNA, 22 bp, Artificial Sequence
  chemically synthesized
tccaactttgattagacatttt

SEQ ID NO: 1337926 - DNA, 22 bp, Artificial Sequence
  chemically synthesized
actttccaactttgattagaca

SEQ ID NO: 1337927 - DNA, 22 bp, Artificial Sequence
  chemically synthesized
atgttcactttccaactttgat

SEQ ID NO: 1337928 - DNA, 22 bp, Artificial Sequence
  chemically synthesized
cctaatgttcactttccaactt

SEQ ID NO: 1337929 - DNA, 22 bp, Artificial Sequence
  chemically synthesized
ccctaatgttcactttccaact

SEQ ID NO: 1337930 - DNA, 22 bp, Artificial Sequence
  chemically synthesized
atcaaagttggaaagtgaacat

SEQ ID NO: 1337931 - DNA, 22 bp, Artificial Sequence
  chemically synthesized
tacaaaatatgtatttccctaa

SEQ ID NO: 1337932 - DNA, 22 bp, Artificial Sequence
  chemically synthesized
gaaagtgaacattagggaaata

SEQ ID NO: 1337933 - DNA, 22 bp, Artificial Sequence
  chemically synthesized
atacaaaatatgtatttcccta

SEQ ID NO: 1337934 - DNA, 22 bp, Artificial Sequence
  chemically synthesized
tttatacaaaatatgtatttcc

SEQ ID NO: 1337935 - DNA, 22 bp, Artificial Sequence
  chemically synthesized
atttatacaaaatatgtatttc

SEQ ID NO: 1337936 - DNA, 22 bp, Artificial Sequence
  chemically synthesized
gggaaatacatattttgtataa

SEQ ID NO: 1337937 - DNA, 22 bp, Artificial Sequence
  chemically synthesized
ggagtccaaaggatttatttat

SEQ ID NO: 1337938 - DNA, 22 bp, Artificial Sequence
  chemically synthesized
tgtataaataaatcctttggac

SEQ ID NO: 1337939 - DNA, 22 bp, Artificial Sequence
  chemically synthesized
gtataaataaatcctttggact

SEQ ID NO: 1337940 - DNA, 22 bp, Artificial Sequence
  chemically synthesized
tataaataaatcctttggactc

SEQ ID NO: 1337941 - DNA, 22 bp, Artificial Sequence
  chemically synthesized
atcggcaaaggaagaagctggg

SEQ ID NO: 1337942 - DNA, 22 bp, Artificial Sequence
  chemically synthesized
tggactcccagcttcttccttt

SEQ ID NO: 1337943 - DNA, 22 bp, Artificial Sequence
  chemically synthesized
aagctgatcggcaaaggaagaa

SEQ ID NO: 1337944 - DNA, 22 bp, Artificial Sequence
  chemically synthesized
ggactcccagcttcttcctttg

SEQ ID NO: 1337945 - DNA, 22 bp, Artificial Sequence
  chemically synthesized
aaagctgatcggcaaaggaaga

SEQ ID NO: 1337946 - DNA, 22 bp, Artificial Sequence
  chemically synthesized
gactcccagcttcttcctttgc

SEQ ID NO: 1337947 - DNA, 22 bp, Artificial Sequence
  chemically synthesized
ccagcttcttcctttgccgatc

SEQ ID NO: 1337948 - DNA, 22 bp, Artificial Sequence
  chemically synthesized
tcccttaaagctgatcggcaaa

SEQ ID NO: 1337949 - DNA, 22 bp, Artificial Sequence
  chemically synthesized
cttcctttgccgatcagcttta

SEQ ID NO: 1337950 - DNA, 22 bp, Artificial Sequence
  chemically synthesized
ttcctttgccgatcagctttaa

SEQ ID NO: 1337951 - DNA, 22 bp, Artificial Sequence
  chemically synthesized
cctttgccgatcagctttaagg

SEQ ID NO: 1337952 - DNA, 22 bp, Artificial Sequence
  chemically synthesized
ctttgccgatcagctttaaggg

SEQ ID NO: 1337953 - DNA, 22 bp, Artificial Sequence
  chemically synthesized
tgccgatcagctttaagggaca

SEQ ID NO: 1337954 - DNA, 22 bp, Artificial Sequence
  chemically synthesized
gccgatcagctttaagggacag

SEQ ID NO: 1337955 - DNA, 22 bp, Artificial Sequence
  chemically synthesized
ccgatcagctttaagggacagt

SEQ ID NO: 1337956 - DNA, 22 bp, Artificial Sequence
  chemically synthesized
aaaagtcaaacagaaccactgt

SEQ ID NO: 1337957 - DNA, 22 bp, Artificial Sequence
  chemically synthesized
caaaagtcaaacagaaccactg

SEQ ID NO: 1337958 - DNA, 22 bp, Artificial Sequence
  chemically synthesized
tcaaaagtcaaacagaaccact

SEQ ID NO: 1337959 - DNA, 22 bp, Artificial Sequence
  chemically synthesized
taagggacagtggttctgtttg

SEQ ID NO: 1337960 - DNA, 22 bp, Artificial Sequence
  chemically synthesized
aagggacagtggttctgtttga

SEQ ID NO: 1337961 - DNA, 22 bp, Artificial Sequence
  chemically synthesized
tcctttcaaaagtcaaacagaa

SEQ ID NO: 1337962 - DNA, 22 bp, Artificial Sequence
  chemically synthesized
agggacagtggttctgtttgac

SEQ ID NO: 1337963 - DNA, 22 bp, Artificial Sequence
  chemically synthesized
tgtcctttcaaaagtcaaacag

SEQ ID NO: 1337964 - DNA, 22 bp, Artificial Sequence
  chemically synthesized
ttctgtcctttcaaaagtcaaa

SEQ ID NO: 1337965 - DNA, 22 bp, Artificial Sequence
  chemically synthesized
gttctgtcctttcaaaagtcaa

SEQ ID NO: 1337966 - DNA, 22 bp, Artificial Sequence
  chemically synthesized
tgtttgacttttgaaaggacag

SEQ ID NO: 1337967 - DNA, 22 bp, Artificial Sequence
  chemically synthesized
tttgacttttgaaaggacagaa

SEQ ID NO: 1337968 - DNA, 22 bp, Artificial Sequence
  chemically synthesized
gacttttgaaaggacagaacaa

SEQ ID NO: 1337969 - DNA, 22 bp, Artificial Sequence
  chemically synthesized
acttttgaaaggacagaacaag

SEQ ID NO: 1337970 - DNA, 22 bp, Artificial Sequence
  chemically synthesized
ttgaaaggacagaacaagatcc

SEQ ID NO: 1337971 - DNA, 22 bp, Artificial Sequence
  chemically synthesized
tgaaaggacagaacaagatcct

SEQ ID NO: 1337972 - DNA, 22 bp, Artificial Sequence
  chemically synthesized
gaaaggacagaacaagatcctt

SEQ ID NO: 1337973 - DNA, 22 bp, Artificial Sequence
  chemically synthesized
aaaggacagaacaagatcctta

SEQ ID NO: 1337974 - DNA, 22 bp, Artificial Sequence
  chemically synthesized
atagcagaaatgtgatatataa

SEQ ID NO: 1337975 - DNA, 22 bp, Artificial Sequence
  chemically synthesized
ttgatagcagaaatgtgatata

SEQ ID NO: 1337976 - DNA, 22 bp, Artificial Sequence
  chemically synthesized
actattgatagcagaaatgtga

SEQ ID NO: 1337977 - DNA, 22 bp, Artificial Sequence
  chemically synthesized
aactattgatagcagaaatgtg

SEQ ID NO: 1337978 - DNA, 22 bp, Artificial Sequence
  chemically synthesized
ttaactattgatagcagaaatg

SEQ ID NO: 1337979 - DNA, 22 bp, Artificial Sequence
  chemically synthesized
atatatcacatttctgctatca

SEQ ID NO: 1337980 - DNA, 22 bp, Artificial Sequence
  chemically synthesized
tatatcacatttctgctatcaa

SEQ ID NO: 1337981 - DNA, 22 bp, Artificial Sequence
  chemically synthesized
tagcaaaaactcttaactattg

SEQ ID NO: 1337982 - DNA, 22 bp, Artificial Sequence
  chemically synthesized
atagcaaaaactcttaactatt

SEQ ID NO: 1337983 - DNA, 22 bp, Artificial Sequence
  chemically synthesized
ctgctatcaatagttaagagtt

SEQ ID NO: 1337984 - DNA, 22 bp, Artificial Sequence
  chemically synthesized
tgctatcaatagttaagagttt

SEQ ID NO: 1337985 - DNA, 22 bp, Artificial Sequence
  chemically synthesized
aatttatagcaaaaactcttaa

SEQ ID NO: 1337986 - DNA, 22 bp, Artificial Sequence
  chemically synthesized
caatttatagcaaaaactctta

SEQ ID NO: 1337987 - DNA, 22 bp, Artificial Sequence
  chemically synthesized
ctatcaatagttaagagttttt

SEQ ID NO: 1337988 - DNA, 22 bp, Artificial Sequence
  chemically synthesized
tcaatttatagcaaaaactctt

SEQ ID NO: 1337989 - DNA, 22 bp, Artificial Sequence
  chemically synthesized
tcaatagttaagagtttttgct

SEQ ID NO: 1337990 - DNA, 22 bp, Artificial Sequence
  chemically synthesized
agagtttttgctataaattgaa

SEQ ID NO: 1337991 - DNA, 22 bp, Artificial Sequence
  chemically synthesized
ttgctataaattgaaagtatca

SEQ ID NO: 1337992 - DNA, 22 bp, Artificial Sequence
  chemically synthesized
tgctataaattgaaagtatcat

SEQ ID NO: 1337993 - DNA, 22 bp, Artificial Sequence
  chemically synthesized
aagaatgtgtccatgatacttt

SEQ ID NO: 1337994 - DNA, 22 bp, Artificial Sequence
  chemically synthesized
gctataaattgaaagtatcatg

SEQ ID NO: 1337995 - DNA, 22 bp, Artificial Sequence
  chemically synthesized
ctataaattgaaagtatcatgg

SEQ ID NO: 1337996 - DNA, 22 bp, Artificial Sequence
  chemically synthesized
actaaagaatgtgtccatgata

SEQ ID NO: 1337997 - DNA, 22 bp, Artificial Sequence
  chemically synthesized
taaattgaaagtatcatggaca

SEQ ID NO: 1337998 - DNA, 22 bp, Artificial Sequence
  chemically synthesized
ctgactaaagaatgtgtccatg

SEQ ID NO: 1337999 - DNA, 22 bp, Artificial Sequence
  chemically synthesized
aaagtatcatggacacattctt

SEQ ID NO: 1338000 - DNA, 22 bp, Artificial Sequence
  chemically synthesized
atgacagggagtgactgctgac

SEQ ID NO: 1338001 - DNA, 22 bp, Artificial Sequence
  chemically synthesized
attaatgacagggagtgactgc

SEQ ID NO: 1338002 - DNA, 22 bp, Artificial Sequence
  chemically synthesized
tttagtcagcagtcactccctg

SEQ ID NO: 1338003 - DNA, 22 bp, Artificial Sequence
  chemically synthesized
tagtcagcagtcactccctgtc

SEQ ID NO: 1338004 - DNA, 22 bp, Artificial Sequence
  chemically synthesized
agtcagcagtcactccctgtca

SEQ ID NO: 1338005 - DNA, 22 bp, Artificial Sequence
  chemically synthesized
gtcagcagtcactccctgtcat

SEQ ID NO: 1338006 - DNA, 22 bp, Artificial Sequence
  chemically synthesized
caacacctaattaatgacaggg

SEQ ID NO: 1338007 - DNA, 22 bp, Artificial Sequence
  chemically synthesized
agaacatcattccaacacctaa

SEQ ID NO: 1338008 - DNA, 22 bp, Artificial Sequence
  chemically synthesized
cctgtcattaattaggtgttgg

SEQ ID NO: 1338009 - DNA, 22 bp, Artificial Sequence
  chemically synthesized
cagaacatcattccaacaccta

SEQ ID NO: 1338010 - DNA, 22 bp, Artificial Sequence
  chemically synthesized
tcattaattaggtgttggaatg

SEQ ID NO: 1338011 - DNA, 22 bp, Artificial Sequence
  chemically synthesized
attaggtgttggaatgatgttc

SEQ ID NO: 1338012 - DNA, 22 bp, Artificial Sequence
  chemically synthesized
aacagcatttcagaacatcatt

SEQ ID NO: 1338013 - DNA, 22 bp, Artificial Sequence
  chemically synthesized
ggtgttggaatgatgttctgaa

SEQ ID NO: 1338014 - DNA, 22 bp, Artificial Sequence
  chemically synthesized
atagaaattaaacagcatttca

SEQ ID NO: 1338015 - DNA, 22 bp, Artificial Sequence
  chemically synthesized
gaatgatgttctgaaatgctgt

SEQ ID NO: 1338016 - DNA, 22 bp, Artificial Sequence
  chemically synthesized
aaattcatagaaattaaacagc

SEQ ID NO: 1338017 - DNA, 22 bp, Artificial Sequence
  chemically synthesized
gaaattcatagaaattaaacag

SEQ ID NO: 1338018 - DNA, 22 bp, Artificial Sequence
  chemically synthesized
tgaaatgctgtttaatttctat

SEQ ID NO: 1338019 - DNA, 22 bp, Artificial Sequence
  chemically synthesized
aaatgctgtttaatttctatga

SEQ ID NO: 1338020 - DNA, 22 bp, Artificial Sequence
  chemically synthesized
ggcaatcccacttgaaattcat

SEQ ID NO: 1338021 - DNA, 22 bp, Artificial Sequence
  chemically synthesized
tttaatttctatgaatttcaag

SEQ ID NO: 1338022 - DNA, 22 bp, Artificial Sequence
  chemically synthesized
ctgggcaatcccacttgaaatt

SEQ ID NO: 1338023 - DNA, 22 bp, Artificial Sequence
  chemically synthesized
gctgggcaatcccacttgaaat

SEQ ID NO: 1338024 - DNA, 22 bp, Artificial Sequence
  chemically synthesized
aatttctatgaatttcaagtgg

SEQ ID NO: 1338025 - DNA, 22 bp, Artificial Sequence
  chemically synthesized
atttctatgaatttcaagtggg

SEQ ID NO: 1338026 - DNA, 22 bp, Artificial Sequence
  chemically synthesized
ctatgaatttcaagtgggattg

SEQ ID NO: 1338027 - DNA, 22 bp, Artificial Sequence
  chemically synthesized
tatgaatttcaagtgggattgc

SEQ ID NO: 1338028 - DNA, 22 bp, Artificial Sequence
  chemically synthesized
tgaatttcaagtgggattgccc

SEQ ID NO: 1338029 - DNA, 22 bp, Artificial Sequence
  chemically synthesized
gcaatgtacttgctgggcaatc

SEQ ID NO: 1338030 - DNA, 22 bp, Artificial Sequence
  chemically synthesized
caagtgggattgcccagcaagt

SEQ ID NO: 1338031 - DNA, 22 bp, Artificial Sequence
  chemically synthesized
aagtgggattgcccagcaagta

SEQ ID NO: 1338032 - DNA, 22 bp, Artificial Sequence
  chemically synthesized
catatgctggcaatgtacttgc

SEQ ID NO: 1338033 - DNA, 22 bp, Artificial Sequence
  chemically synthesized
ctacatatgctggcaatgtact

SEQ ID NO: 1338034 - DNA, 22 bp, Artificial Sequence
  chemically synthesized
actacatatgctggcaatgtac

SEQ ID NO: 1338035 - DNA, 22 bp, Artificial Sequence
  chemically synthesized
cttactacatatgctggcaatg

SEQ ID NO: 1338036 - DNA, 22 bp, Artificial Sequence
  chemically synthesized
cccagcaagtacattgccagca

SEQ ID NO: 1338037 - DNA, 22 bp, Artificial Sequence
  chemically synthesized
cctacttactacatatgctggc

SEQ ID NO: 1338038 - DNA, 22 bp, Artificial Sequence
  chemically synthesized
aaagaaaattacctacttacta

SEQ ID NO: 1338039 - DNA, 22 bp, Artificial Sequence
  chemically synthesized
aaaagaaaattacctacttact

SEQ ID NO: 1338040 - DNA, 22 bp, Artificial Sequence
  chemically synthesized
ccagcatatgtagtaagtaggt

SEQ ID NO: 1338041 - DNA, 22 bp, Artificial Sequence
  chemically synthesized
ataatcttaaaagaaaattacc

SEQ ID NO: 1338042 - DNA, 22 bp, Artificial Sequence
  chemically synthesized
agaataacattcataatcttaa

SEQ ID NO: 1338043 - DNA, 22 bp, Artificial Sequence
  chemically synthesized
gagaataacattcataatctta

SEQ ID NO: 1338044 - DNA, 22 bp, Artificial Sequence
  chemically synthesized
tgagaataacattcataatctt

SEQ ID NO: 1338045 - DNA, 22 bp, Artificial Sequence
  chemically synthesized
tcttttaagattatgaatgtta

SEQ ID NO: 1338046 - DNA, 22 bp, Artificial Sequence
  chemically synthesized
aaattttgagaataacattcat

SEQ ID NO: 1338047 - DNA, 22 bp, Artificial Sequence
  chemically synthesized
cttttaagattatgaatgttat

SEQ ID NO: 1338048 - DNA, 22 bp, Artificial Sequence
  chemically synthesized
ttttaagattatgaatgttatt

SEQ ID NO: 1338049 - DNA, 22 bp, Artificial Sequence
  chemically synthesized
ttaagattatgaatgttattct

SEQ ID NO: 1338050 - DNA, 22 bp, Artificial Sequence
  chemically synthesized
taagattatgaatgttattctc

SEQ ID NO: 1338051 - DNA, 22 bp, Artificial Sequence
  chemically synthesized
aagattatgaatgttattctca

SEQ ID NO: 1338052 - DNA, 22 bp, Artificial Sequence
  chemically synthesized
agattatgaatgttattctcaa

SEQ ID NO: 1338053 - DNA, 22 bp, Artificial Sequence
  chemically synthesized
tgaatgttattctcaaaatttt

SEQ ID NO: 1338054 - DNA, 22 bp, Artificial Sequence
  chemically synthesized
taaaaacaacctaaaattttga

SEQ ID NO: 1338055 - DNA, 22 bp, Artificial Sequence
  chemically synthesized
ataaaaacaacctaaaattttg

SEQ ID NO: 1338056 - DNA, 22 bp, Artificial Sequence
  chemically synthesized
tcccttataaaaacaacctaaa

SEQ ID NO: 1338057 - DNA, 22 bp, Artificial Sequence
  chemically synthesized
ttctcaaaattttaggttgttt

SEQ ID NO: 1338058 - DNA, 22 bp, Artificial Sequence
  chemically synthesized
tcaaaattttaggttgttttta

SEQ ID NO: 1338059 - DNA, 22 bp, Artificial Sequence
  chemically synthesized
aaaattttaggttgtttttata

SEQ ID NO: 1338060 - DNA, 22 bp, Artificial Sequence
  chemically synthesized
tacactgtcccttataaaaaca

SEQ ID NO: 1338061 - DNA, 22 bp, Artificial Sequence
  chemically synthesized
taggttgtttttataagggaca

SEQ ID NO: 1338062 - DNA, 22 bp, Artificial Sequence
  chemically synthesized
aggttgtttttataagggacag

SEQ ID NO: 1338063 - DNA, 22 bp, Artificial Sequence
  chemically synthesized
ggttgtttttataagggacagt

SEQ ID NO: 1338064 - DNA, 22 bp, Artificial Sequence
  chemically synthesized
tttttataagggacagtgtaca

SEQ ID NO: 1338065 - DNA, 22 bp, Artificial Sequence
  chemically synthesized
ttataagggacagtgtacagtt

SEQ ID NO: 1338066 - DNA, 22 bp, Artificial Sequence
  chemically synthesized
tataagggacagtgtacagttt

SEQ ID NO: 1338067 - DNA, 22 bp, Artificial Sequence
  chemically synthesized
acacaaaagcccaaactgtaca

SEQ ID NO: 1338068 - DNA, 22 bp, Artificial Sequence
  chemically synthesized
ataagggacagtgtacagtttg

SEQ ID NO: 1338069 - DNA, 22 bp, Artificial Sequence
  chemically synthesized
taagggacagtgtacagtttgg

SEQ ID NO: 1338070 - DNA, 22 bp, Artificial Sequence
  chemically synthesized
caattaacacaaaagcccaaac

SEQ ID NO: 1338071 - DNA, 22 bp, Artificial Sequence
  chemically synthesized
tcaacctccaattaacacaaaa

SEQ ID NO: 1338072 - DNA, 22 bp, Artificial Sequence
  chemically synthesized
gtcaacctccaattaacacaaa

SEQ ID NO: 1338073 - DNA, 22 bp, Artificial Sequence
  chemically synthesized
ccttgtcaacctccaattaaca

SEQ ID NO: 1338074 - DNA, 22 bp, Artificial Sequence
  chemically synthesized
cccttgtcaacctccaattaac

SEQ ID NO: 1338075 - DNA, 22 bp, Artificial Sequence
  chemically synthesized
tcccttgtcaacctccaattaa

SEQ ID NO: 1338076 - DNA, 22 bp, Artificial Sequence
  chemically synthesized
gggcttttgtgttaattggagg

SEQ ID NO: 1338077 - DNA, 22 bp, Artificial Sequence
  chemically synthesized
ttcccttgtcaacctccaatta

SEQ ID NO: 1338078 - DNA, 22 bp, Artificial Sequence
  chemically synthesized
ggcttttgtgttaattggaggt

SEQ ID NO: 1338079 - DNA, 22 bp, Artificial Sequence
  chemically synthesized
tttcccttgtcaacctccaatt

SEQ ID NO: 1338080 - DNA, 22 bp, Artificial Sequence
  chemically synthesized
ttgtgttaattggaggttgaca

SEQ ID NO: 1338081 - DNA, 22 bp, Artificial Sequence
  chemically synthesized
tgtgttaattggaggttgacaa

SEQ ID NO: 1338082 - DNA, 22 bp, Artificial Sequence
  chemically synthesized
tccctttttcccttgtcaacct

SEQ ID NO: 1338083 - DNA, 22 bp, Artificial Sequence
  chemically synthesized
gtgttaattggaggttgacaag

SEQ ID NO: 1338084 - DNA, 22 bp, Artificial Sequence
  chemically synthesized
tgttaattggaggttgacaagg

SEQ ID NO: 1338085 - DNA, 22 bp, Artificial Sequence
  chemically synthesized
attggaggttgacaagggaaaa

SEQ ID NO: 1338086 - DNA, 22 bp, Artificial Sequence
  chemically synthesized
gaaaactatccctttttccctt

SEQ ID NO: 1338087 - DNA, 22 bp, Artificial Sequence
  chemically synthesized
gaggttgacaagggaaaaaggg

SEQ ID NO: 1338088 - DNA, 22 bp, Artificial Sequence
  chemically synthesized
acaagggaaaaagggatagttt

SEQ ID NO: 1338089 - DNA, 22 bp, Artificial Sequence
  chemically synthesized
gaaagcatgctggaaaactatc

SEQ ID NO: 1338090 - DNA, 22 bp, Artificial Sequence
  chemically synthesized
gaaaaacctagaaagcatgctg

SEQ ID NO: 1338091 - DNA, 22 bp, Artificial Sequence
  chemically synthesized
agaaaaacctagaaagcatgct

SEQ ID NO: 1338092 - DNA, 22 bp, Artificial Sequence
  chemically synthesized
tttagaaaaacctagaaagcat

SEQ ID NO: 1338093 - DNA, 22 bp, Artificial Sequence
  chemically synthesized
tactatttagaaaaacctagaa

SEQ ID NO: 1338094 - DNA, 22 bp, Artificial Sequence
  chemically synthesized
tccagcatgctttctaggtttt

SEQ ID NO: 1338095 - DNA, 22 bp, Artificial Sequence
  chemically synthesized
gtactatttagaaaaacctaga

SEQ ID NO: 1338096 - DNA, 22 bp, Artificial Sequence
  chemically synthesized
ccagcatgctttctaggttttt

SEQ ID NO: 1338097 - DNA, 22 bp, Artificial Sequence
  chemically synthesized
tgtactatttagaaaaacctag

SEQ ID NO: 1338098 - DNA, 22 bp, Artificial Sequence
  chemically synthesized
cagcatgctttctaggtttttc

SEQ ID NO: 1338099 - DNA, 22 bp, Artificial Sequence
  chemically synthesized
aacatctttgtactatttagaa

SEQ ID NO: 1338100 - DNA, 22 bp, Artificial Sequence
  chemically synthesized
tctaggtttttctaaatagtac

SEQ ID NO: 1338101 - DNA, 22 bp, Artificial Sequence
  chemically synthesized
ctgaacatctttgtactattta

SEQ ID NO: 1338102 - DNA, 22 bp, Artificial Sequence
  chemically synthesized
ctaggtttttctaaatagtaca

SEQ ID NO: 1338103 - DNA, 22 bp, Artificial Sequence
  chemically synthesized
taggtttttctaaatagtacaa

SEQ ID NO: 1338104 - DNA, 22 bp, Artificial Sequence
  chemically synthesized
ctcctgaacatctttgtactat

SEQ ID NO: 1338105 - DNA, 22 bp, Artificial Sequence
  chemically synthesized
ggtttttctaaatagtacaaag

SEQ ID NO: 1338106 - DNA, 22 bp, Artificial Sequence
  chemically synthesized
cctcctgaacatctttgtacta

SEQ ID NO: 1338107 - DNA, 22 bp, Artificial Sequence
  chemically synthesized
ttcctcctgaacatctttgtac

SEQ ID NO: 1338108 - DNA, 22 bp, Artificial Sequence
  chemically synthesized
cttcctcctgaacatctttgta

SEQ ID NO: 1338109 - DNA, 22 bp, Artificial Sequence
  chemically synthesized
tcttcctcctgaacatctttgt

SEQ ID NO: 1338110 - DNA, 22 bp, Artificial Sequence
  chemically synthesized
ttctaaatagtacaaagatgtt

SEQ ID NO: 1338111 - DNA, 22 bp, Artificial Sequence
  chemically synthesized
tctaaatagtacaaagatgttc

SEQ ID NO: 1338112 - DNA, 22 bp, Artificial Sequence
  chemically synthesized
ctaaatagtacaaagatgttca

SEQ ID NO: 1338113 - DNA, 22 bp, Artificial Sequence
  chemically synthesized
taaatagtacaaagatgttcag

SEQ ID NO: 1338114 - DNA, 22 bp, Artificial Sequence
  chemically synthesized
aatagtacaaagatgttcagga

SEQ ID NO: 1338115 - DNA, 22 bp, Artificial Sequence
  chemically synthesized
aaatagcaatattttcttcctc

SEQ ID NO: 1338116 - DNA, 22 bp, Artificial Sequence
  chemically synthesized
aaaatagcaatattttcttcct

SEQ ID NO: 1338117 - DNA, 22 bp, Artificial Sequence
  chemically synthesized
catttaaaatagcaatattttc

SEQ ID NO: 1338118 - DNA, 22 bp, Artificial Sequence
  chemically synthesized
aggaggaagaaaatattgctat

SEQ ID NO: 1338119 - DNA, 22 bp, Artificial Sequence
  chemically synthesized
aaaatattccatttaaaatagc

SEQ ID NO: 1338120 - DNA, 22 bp, Artificial Sequence
  chemically synthesized
gcgttgaaaatattccatttaa

SEQ ID NO: 1338121 - DNA, 22 bp, Artificial Sequence
  chemically synthesized
agttagcgttgaaaatattcca

SEQ ID NO: 1338122 - DNA, 22 bp, Artificial Sequence
  chemically synthesized
aagttagcgttgaaaatattcc

SEQ ID NO: 1338123 - DNA, 22 bp, Artificial Sequence
  chemically synthesized
ctattttaaatggaatattttc

SEQ ID NO: 1338124 - DNA, 22 bp, Artificial Sequence
  chemically synthesized
ttttaaatggaatattttcaac

SEQ ID NO: 1338125 - DNA, 22 bp, Artificial Sequence
  chemically synthesized
taaatggaatattttcaacgct

SEQ ID NO: 1338126 - DNA, 22 bp, Artificial Sequence
  chemically synthesized
aaatggaatattttcaacgcta

SEQ ID NO: 1338127 - DNA, 22 bp, Artificial Sequence
  chemically synthesized
aatggaatattttcaacgctaa

SEQ ID NO: 1338128 - DNA, 22 bp, Artificial Sequence
  chemically synthesized
agatatgcttaagttagcgttg

SEQ ID NO: 1338129 - DNA, 22 bp, Artificial Sequence
  chemically synthesized
aatactgagatatgcttaagtt

SEQ ID NO: 1338130 - DNA, 22 bp, Artificial Sequence
  chemically synthesized
aaatactgagatatgcttaagt

SEQ ID NO: 1338131 - DNA, 22 bp, Artificial Sequence
  chemically synthesized
tcaacgctaacttaagcatatc

SEQ ID NO: 1338132 - DNA, 22 bp, Artificial Sequence
  chemically synthesized
cttaaatactgagatatgctta

SEQ ID NO: 1338133 - DNA, 22 bp, Artificial Sequence
  chemically synthesized
caacgctaacttaagcatatct

SEQ ID NO: 1338134 - DNA, 22 bp, Artificial Sequence
  chemically synthesized
aacgctaacttaagcatatctc

SEQ ID NO: 1338135 - DNA, 22 bp, Artificial Sequence
  chemically synthesized
acttaagcatatctcagtattt

SEQ ID NO: 1338136 - DNA, 22 bp, Artificial Sequence
  chemically synthesized
aagcatatctcagtatttaagc

SEQ ID NO: 1338137 - DNA, 22 bp, Artificial Sequence
  chemically synthesized
agcatatctcagtatttaagca

SEQ ID NO: 1338138 - DNA, 22 bp, Artificial Sequence
  chemically synthesized
agtatttaagcagacatttgga

SEQ ID NO: 1338139 - DNA, 22 bp, Artificial Sequence
  chemically synthesized
agatgaggaaaatatccaaatg

SEQ ID NO: 1338140 - DNA, 22 bp, Artificial Sequence
  chemically synthesized
tctgagatgaggaaaatatcca

SEQ ID NO: 1338141 - DNA, 22 bp, Artificial Sequence
  chemically synthesized
aagcagacatttggatattttc

SEQ ID NO: 1338142 - DNA, 22 bp, Artificial Sequence
  chemically synthesized
agcagacatttggatattttcc

SEQ ID NO: 1338143 - DNA, 22 bp, Artificial Sequence
  chemically synthesized
ttgtctgagatgaggaaaatat

SEQ ID NO: 1338144 - DNA, 22 bp, Artificial Sequence
  chemically synthesized
ggatattttcctcatctcagac

SEQ ID NO: 1338145 - DNA, 22 bp, Artificial Sequence
  chemically synthesized
gatattttcctcatctcagaca

SEQ ID NO: 1338146 - DNA, 22 bp, Artificial Sequence
  chemically synthesized
aaggtcatagtagttattgtct

SEQ ID NO: 1338147 - DNA, 22 bp, Artificial Sequence
  chemically synthesized
tcctcatctcagacaataacta

SEQ ID NO: 1338148 - DNA, 22 bp, Artificial Sequence
  chemically synthesized
cctcatctcagacaataactac

SEQ ID NO: 1338149 - DNA, 22 bp, Artificial Sequence
  chemically synthesized
ttcaaggtcatagtagttattg

SEQ ID NO: 1338150 - DNA, 22 bp, Artificial Sequence
  chemically synthesized
ctcatctcagacaataactact

SEQ ID NO: 1338151 - DNA, 22 bp, Artificial Sequence
  chemically synthesized
gttcaaggtcatagtagttatt

SEQ ID NO: 1338152 - DNA, 22 bp, Artificial Sequence
  chemically synthesized
atctcagacaataactactatg

SEQ ID NO: 1338153 - DNA, 22 bp, Artificial Sequence
  chemically synthesized
agacaataactactatgacctt

SEQ ID NO: 1338154 - DNA, 22 bp, Artificial Sequence
  chemically synthesized
ctatgaccttgaacaaatccct

SEQ ID NO: 1338155 - DNA, 22 bp, Artificial Sequence
  chemically synthesized
tgaccttgaacaaatccctcca

SEQ ID NO: 1338156 - DNA, 22 bp, Artificial Sequence
  chemically synthesized
agaatcagaaaatggagggatt

SEQ ID NO: 1338157 - DNA, 22 bp, Artificial Sequence
  chemically synthesized
gaacaaatccctccattttctg

SEQ ID NO: 1338158 - DNA, 22 bp, Artificial Sequence
  chemically synthesized
aacaaatccctccattttctga

SEQ ID NO: 1338159 - DNA, 22 bp, Artificial Sequence
  chemically synthesized
tagatgagaaaactgagaatca

SEQ ID NO: 1338160 - DNA, 22 bp, Artificial Sequence
  chemically synthesized
atagatgagaaaactgagaatc

SEQ ID NO: 1338161 - DNA, 22 bp, Artificial Sequence
  chemically synthesized
tatagatgagaaaactgagaat

SEQ ID NO: 1338162 - DNA, 22 bp, Artificial Sequence
  chemically synthesized
cattttctgattctcagttttc

SEQ ID NO: 1338163 - DNA, 22 bp, Artificial Sequence
  chemically synthesized
tctgattctcagttttctcatc

SEQ ID NO: 1338164 - DNA, 22 bp, Artificial Sequence
  chemically synthesized
ccatattttatagatgagaaaa

SEQ ID NO: 1338165 - DNA, 22 bp, Artificial Sequence
  chemically synthesized
ctgattctcagttttctcatct

SEQ ID NO: 1338166 - DNA, 22 bp, Artificial Sequence
  chemically synthesized
tgattctcagttttctcatcta

SEQ ID NO: 1338167 - DNA, 22 bp, Artificial Sequence
  chemically synthesized
attctcagttttctcatctata

SEQ ID NO: 1338168 - DNA, 22 bp, Artificial Sequence
  chemically synthesized
tcagttttctcatctataaaat

SEQ ID NO: 1338169 - DNA, 22 bp, Artificial Sequence
  chemically synthesized
gtccaattcccatattttatag

SEQ ID NO: 1338170 - DNA, 22 bp, Artificial Sequence
  chemically synthesized
agttttctcatctataaaatat

SEQ ID NO: 1338171 - DNA, 22 bp, Artificial Sequence
  chemically synthesized
agtccaattcccatattttata

SEQ ID NO: 1338172 - DNA, 22 bp, Artificial Sequence
  chemically synthesized
tttagtccaattcccatatttt

SEQ ID NO: 1338173 - DNA, 22 bp, Artificial Sequence
  chemically synthesized
tctcatctataaaatatgggaa

SEQ ID NO: 1338174 - DNA, 22 bp, Artificial Sequence
  chemically synthesized
ctcatctataaaatatgggaat

SEQ ID NO: 1338175 - DNA, 22 bp, Artificial Sequence
  chemically synthesized
tcatctataaaatatgggaatt

SEQ ID NO: 1338176 - DNA, 22 bp, Artificial Sequence
  chemically synthesized
atctataaaatatgggaattgg

SEQ ID NO: 1338177 - DNA, 22 bp, Artificial Sequence
  chemically synthesized
taaaatatgggaattggactaa

SEQ ID NO: 1338178 - DNA, 22 bp, Artificial Sequence
  chemically synthesized
aatggaaacaaagttatttagt

SEQ ID NO: 1338179 - DNA, 22 bp, Artificial Sequence
  chemically synthesized
aagctaaatggaaacaaagtta

SEQ ID NO: 1338180 - DNA, 22 bp, Artificial Sequence
  chemically synthesized
gactaaataactttgtttccat

SEQ ID NO: 1338181 - DNA, 22 bp, Artificial Sequence
  chemically synthesized
aataactttgtttccatttagc

SEQ ID NO: 1338182 - DNA, 22 bp, Artificial Sequence
  chemically synthesized
tgtttccatttagctttagcac

SEQ ID NO: 1338183 - DNA, 22 bp, Artificial Sequence
  chemically synthesized
gtttccatttagctttagcact

SEQ ID NO: 1338184 - DNA, 22 bp, Artificial Sequence
  chemically synthesized
tttccatttagctttagcactc

SEQ ID NO: 1338185 - DNA, 22 bp, Artificial Sequence
  chemically synthesized
ccatttagctttagcactctat

SEQ ID NO: 1338186 - DNA, 22 bp, Artificial Sequence
  chemically synthesized
catttagctttagcactctatg

SEQ ID NO: 1338187 - DNA, 22 bp, Artificial Sequence
  chemically synthesized
agctttagcactctatgacttt

SEQ ID NO: 1338188 - DNA, 22 bp, Artificial Sequence
  chemically synthesized
gctttagcactctatgactttt

SEQ ID NO: 1338189 - DNA, 22 bp, Artificial Sequence
  chemically synthesized
tgtaagtaaatggataaaagtc

SEQ ID NO: 1338190 - DNA, 22 bp, Artificial Sequence
  chemically synthesized
tagcactctatgacttttatcc

SEQ ID NO: 1338191 - DNA, 22 bp, Artificial Sequence
  chemically synthesized
agcactctatgacttttatcca

SEQ ID NO: 1338192 - DNA, 22 bp, Artificial Sequence
  chemically synthesized
gcactctatgacttttatccat

SEQ ID NO: 1338193 - DNA, 22 bp, Artificial Sequence
  chemically synthesized
tatgacttttatccatttactt

SEQ ID NO: 1338194 - DNA, 22 bp, Artificial Sequence
  chemically synthesized
tgacttttatccatttacttac

SEQ ID NO: 1338195 - DNA, 22 bp, Artificial Sequence
  chemically synthesized
aggagtagtgttgtgtaagtaa

SEQ ID NO: 1338196 - DNA, 22 bp, Artificial Sequence
  chemically synthesized
tcaggagtagtgttgtgtaagt

SEQ ID NO: 1338197 - DNA, 22 bp, Artificial Sequence
  chemically synthesized
ctcaggagtagtgttgtgtaag

SEQ ID NO: 1338198 - DNA, 22 bp, Artificial Sequence
  chemically synthesized
ttatccatttacttacacaaca

SEQ ID NO: 1338199 - DNA, 22 bp, Artificial Sequence
  chemically synthesized
tatccatttacttacacaacac

SEQ ID NO: 1338200 - DNA, 22 bp, Artificial Sequence
  chemically synthesized
atccatttacttacacaacact

SEQ ID NO: 1338201 - DNA, 22 bp, Artificial Sequence
  chemically synthesized
tccatttacttacacaacacta

SEQ ID NO: 1338202 - DNA, 22 bp, Artificial Sequence
  chemically synthesized
acttacacaacactactcctga

SEQ ID NO: 1338203 - DNA, 22 bp, Artificial Sequence
  chemically synthesized
cttacacaacactactcctgag

SEQ ID NO: 1338204 - DNA, 22 bp, Artificial Sequence
  chemically synthesized
acacaacactactcctgagaaa

SEQ ID NO: 1338205 - DNA, 22 bp, Artificial Sequence
  chemically synthesized
cataaatgtatgtttctcagga

SEQ ID NO: 1338206 - DNA, 22 bp, Artificial Sequence
  chemically synthesized
cacaacactactcctgagaaac

SEQ ID NO: 1338207 - DNA, 22 bp, Artificial Sequence
  chemically synthesized
taattgcataaatgtatgtttc

SEQ ID NO: 1338208 - DNA, 22 bp, Artificial Sequence
  chemically synthesized
ctcctgagaaacatacatttat

SEQ ID NO: 1338209 - DNA, 22 bp, Artificial Sequence
  chemically synthesized
tccctataattgcataaatgta

SEQ ID NO: 1338210 - DNA, 22 bp, Artificial Sequence
  chemically synthesized
atccctataattgcataaatgt

SEQ ID NO: 1338211 - DNA, 22 bp, Artificial Sequence
  chemically synthesized
ctgagaaacatacatttatgca

SEQ ID NO: 1338212 - DNA, 22 bp, Artificial Sequence
  chemically synthesized
agaaacatacatttatgcaatt

SEQ ID NO: 1338213 - DNA, 22 bp, Artificial Sequence
  chemically synthesized
ggtgtttatccctataattgca

SEQ ID NO: 1338214 - DNA, 22 bp, Artificial Sequence
  chemically synthesized
atgcaattatagggataaacac

SEQ ID NO: 1338215 - DNA, 22 bp, Artificial Sequence
  chemically synthesized
tgcaattatagggataaacacc

SEQ ID NO: 1338216 - DNA, 22 bp, Artificial Sequence
  chemically synthesized
aatgaagtcctgggtgtttatc

SEQ ID NO: 1338217 - DNA, 22 bp, Artificial Sequence
  chemically synthesized
ttaaatgaagtcctgggtgttt

SEQ ID NO: 1338218 - DNA, 22 bp, Artificial Sequence
  chemically synthesized
tagggataaacacccaggactt

SEQ ID NO: 1338219 - DNA, 22 bp, Artificial Sequence
  chemically synthesized
catttaatagattttccttata

SEQ ID NO: 1338220 - DNA, 22 bp, Artificial Sequence
  chemically synthesized
atttaatagattttccttatac

SEQ ID NO: 1338221 - DNA, 22 bp, Artificial Sequence
  chemically synthesized
aatagattttccttataccacc

SEQ ID NO: 1338222 - DNA, 22 bp, Artificial Sequence
  chemically synthesized
atagattttccttataccacca

SEQ ID NO: 1338223 - DNA, 22 bp, Artificial Sequence
  chemically synthesized
ccagtacagtacagtggtggta

SEQ ID NO: 1338224 - DNA, 22 bp, Artificial Sequence
  chemically synthesized
ttaccagtacagtacagtggtg

SEQ ID NO: 1338225 - DNA, 22 bp, Artificial Sequence
  chemically synthesized
tccttataccaccactgtactg

SEQ ID NO: 1338226 - DNA, 22 bp, Artificial Sequence
  chemically synthesized
ccttataccaccactgtactgt

SEQ ID NO: 1338227 - DNA, 22 bp, Artificial Sequence
  chemically synthesized
cttataccaccactgtactgta

SEQ ID NO: 1338228 - DNA, 22 bp, Artificial Sequence
  chemically synthesized
ataccaccactgtactgtactg

SEQ ID NO: 1338229 - DNA, 22 bp, Artificial Sequence
  chemically synthesized
taccaccactgtactgtactgg

SEQ ID NO: 1338230 - DNA, 22 bp, Artificial Sequence
  chemically synthesized
tacaggggaaagtgtctgttac

SEQ ID NO: 1338231 - DNA, 22 bp, Artificial Sequence
  chemically synthesized
atacaggggaaagtgtctgtta

SEQ ID NO: 1338232 - DNA, 22 bp, Artificial Sequence
  chemically synthesized
tactgtactggtaacagacact

SEQ ID NO: 1338233 - DNA, 22 bp, Artificial Sequence
  chemically synthesized
cttatacaggggaaagtgtctg

SEQ ID NO: 1338234 - DNA, 22 bp, Artificial Sequence
  chemically synthesized
acttatacaggggaaagtgtct

SEQ ID NO: 1338235 - DNA, 22 bp, Artificial Sequence
  chemically synthesized
tactggtaacagacactttccc

SEQ ID NO: 1338236 - DNA, 22 bp, Artificial Sequence
  chemically synthesized
gtaacagacactttcccctgta

SEQ ID NO: 1338237 - DNA, 22 bp, Artificial Sequence
  chemically synthesized
caggatagcttacttatacagg

SEQ ID NO: 1338238 - DNA, 22 bp, Artificial Sequence
  chemically synthesized
gcatctgcaggatagcttactt

SEQ ID NO: 1338239 - DNA, 22 bp, Artificial Sequence
  chemically synthesized
tcccctgtataagtaagctatc

SEQ ID NO: 1338240 - DNA, 22 bp, Artificial Sequence
  chemically synthesized
cccctgtataagtaagctatcc

SEQ ID NO: 1338241 - DNA, 22 bp, Artificial Sequence
  chemically synthesized
ccctgtataagtaagctatcct

SEQ ID NO: 1338242 - DNA, 22 bp, Artificial Sequence
  chemically synthesized
tataagtaagctatcctgcaga

SEQ ID NO: 1338243 - DNA, 22 bp, Artificial Sequence
  chemically synthesized
gggtcaccccattagcatctgc

SEQ ID NO: 1338244 - DNA, 22 bp, Artificial Sequence
  chemically synthesized
ggggtcaccccattagcatctg

SEQ ID NO: 1338245 - DNA, 22 bp, Artificial Sequence
  chemically synthesized
tggggtcaccccattagcatct

SEQ ID NO: 1338246 - DNA, 22 bp, Artificial Sequence
  chemically synthesized
ttggggtcaccccattagcatc

SEQ ID NO: 1338247 - DNA, 22 bp, Artificial Sequence
  chemically synthesized
tcctgcagatgctaatggggtg

SEQ ID NO: 1338248 - DNA, 22 bp, Artificial Sequence
  chemically synthesized
gccttttggggtcaccccatta

SEQ ID NO: 1338249 - DNA, 22 bp, Artificial Sequence
  chemically synthesized
ttggccttttggggtcacccca

SEQ ID NO: 1338250 - DNA, 22 bp, Artificial Sequence
  chemically synthesized
cagatgctaatggggtgacccc

SEQ ID NO: 1338251 - DNA, 22 bp, Artificial Sequence
  chemically synthesized
tgttggccttttggggtcaccc

SEQ ID NO: 1338252 - DNA, 22 bp, Artificial Sequence
  chemically synthesized
ctgttggccttttggggtcacc

SEQ ID NO: 1338253 - DNA, 22 bp, Artificial Sequence
  chemically synthesized
atttctgttggccttttggggt

SEQ ID NO: 1338254 - DNA, 22 bp, Artificial Sequence
  chemically synthesized
aatttctgttggccttttgggg

SEQ ID NO: 1338255 - DNA, 22 bp, Artificial Sequence
  chemically synthesized
taatttctgttggccttttggg

SEQ ID NO: 1338256 - DNA, 22 bp, Artificial Sequence
  chemically synthesized
atggggtgaccccaaaaggcca

SEQ ID NO: 1338257 - DNA, 22 bp, Artificial Sequence
  chemically synthesized
tttaatttctgttggccttttg

SEQ ID NO: 1338258 - DNA, 22 bp, Artificial Sequence
  chemically synthesized
ctttaatttctgttggcctttt

SEQ ID NO: 1338259 - DNA, 22 bp, Artificial Sequence
  chemically synthesized
ccaagtttctttaatttctgtt

SEQ ID NO: 1338260 - DNA, 22 bp, Artificial Sequence
  chemically synthesized
gccaagtttctttaatttctgt

SEQ ID NO: 1338261 - DNA, 22 bp, Artificial Sequence
  chemically synthesized
tgccaagtttctttaatttctg

SEQ ID NO: 1338262 - DNA, 22 bp, Artificial Sequence
  chemically synthesized
ttgccaagtttctttaatttct

SEQ ID NO: 1338263 - DNA, 22 bp, Artificial Sequence
  chemically synthesized
tttttgccaagtttctttaatt

SEQ ID NO: 1338264 - DNA, 22 bp, Artificial Sequence
  chemically synthesized
atttttgccaagtttctttaat

SEQ ID NO: 1338265 - DNA, 22 bp, Artificial Sequence
  chemically synthesized
tttatttttgccaagtttcttt

SEQ ID NO: 1338266 - DNA, 22 bp, Artificial Sequence
  chemically synthesized
gtttatttttgccaagtttctt

SEQ ID NO: 1338267 - DNA, 22 bp, Artificial Sequence
  chemically synthesized
tttgtttatttttgccaagttt

SEQ ID NO: 1338268 - DNA, 22 bp, Artificial Sequence
  chemically synthesized
gtttgtttatttttgccaagtt

SEQ ID NO: 1338269 - DNA, 22 bp, Artificial Sequence
  chemically synthesized
tgtttgtttatttttgccaagt

SEQ ID NO: 1338270 - DNA, 22 bp, Artificial Sequence
  chemically synthesized
ttgtttgtttatttttgccaag

SEQ ID NO: 1338271 - DNA, 22 bp, Artificial Sequence
  chemically synthesized
tttgtttgtttatttttgccaa

SEQ ID NO: 1338272 - DNA, 22 bp, Artificial Sequence
  chemically synthesized
gttttttgtttgtttatttttg

SEQ ID NO: 1338273 - DNA, 22 bp, Artificial Sequence
  chemically synthesized
aagaaacttggcaaaaataaac

SEQ ID NO: 1338274 - DNA, 22 bp, Artificial Sequence
  chemically synthesized
ggcaaaaataaacaaacaaaaa

SEQ ID NO: 1338275 - DNA, 22 bp, Artificial Sequence
  chemically synthesized
gcaaaaataaacaaacaaaaaa

SEQ ID NO: 1338276 - DNA, 22 bp, Artificial Sequence
  chemically synthesized
tatgccacggctagttttttgt

SEQ ID NO: 1338277 - DNA, 22 bp, Artificial Sequence
  chemically synthesized
atctgtatgccacggctagttt

SEQ ID NO: 1338278 - DNA, 22 bp, Artificial Sequence
  chemically synthesized
aatctgtatgccacggctagtt

SEQ ID NO: 1338279 - DNA, 22 bp, Artificial Sequence
  chemically synthesized
gtgtaaatatacttaatctgta

SEQ ID NO: 1338280 - DNA, 22 bp, Artificial Sequence
  chemically synthesized
ggtgtaaatatacttaatctgt

SEQ ID NO: 1338281 - DNA, 22 bp, Artificial Sequence
  chemically synthesized
gccgtggcatacagattaagta

SEQ ID NO: 1338282 - DNA, 22 bp, Artificial Sequence
  chemically synthesized
aaaaaatcataacttggtgtaa

SEQ ID NO: 1338283 - DNA, 22 bp, Artificial Sequence
  chemically synthesized
agtatatttacaccaagttatg

SEQ ID NO: 1338284 - DNA, 22 bp, Artificial Sequence
  chemically synthesized
acaccaagttatgattttttta

SEQ ID NO: 1338285 - DNA, 22 bp, Artificial Sequence
  chemically synthesized
caccaagttatgatttttttag

SEQ ID NO: 1338286 - DNA, 22 bp, Artificial Sequence
  chemically synthesized
aatggggaagtcactaaaaaaa

SEQ ID NO: 1338287 - DNA, 22 bp, Artificial Sequence
  chemically synthesized
aaatggggaagtcactaaaaaa

SEQ ID NO: 1338288 - DNA, 22 bp, Artificial Sequence
  chemically synthesized
taaatggggaagtcactaaaaa

SEQ ID NO: 1338289 - DNA, 22 bp, Artificial Sequence
  chemically synthesized
tgatttttttagtgacttcccc

SEQ ID NO: 1338290 - DNA, 22 bp, Artificial Sequence
  chemically synthesized
ttttagtgacttccccatttaa

SEQ ID NO: 1338291 - DNA, 22 bp, Artificial Sequence
  chemically synthesized
tttagtgacttccccatttaaa

SEQ ID NO: 1338292 - DNA, 22 bp, Artificial Sequence
  chemically synthesized
ttagtgacttccccatttaaag

SEQ ID NO: 1338293 - DNA, 22 bp, Artificial Sequence
  chemically synthesized
tagtgacttccccatttaaagt

SEQ ID NO: 1338294 - DNA, 22 bp, Artificial Sequence
  chemically synthesized
agtgacttccccatttaaagtt

SEQ ID NO: 1338295 - DNA, 22 bp, Artificial Sequence
  chemically synthesized
gtgacttccccatttaaagtta

SEQ ID NO: 1338296 - DNA, 22 bp, Artificial Sequence
  chemically synthesized
ccccatttaaagttactgatat

SEQ ID NO: 1338297 - DNA, 22 bp, Artificial Sequence
  chemically synthesized
cccatttaaagttactgatata

SEQ ID NO: 1338298 - DNA, 22 bp, Artificial Sequence
  chemically synthesized
aaagttactgatatatacgtgt

SEQ ID NO: 1338299 - DNA, 22 bp, Artificial Sequence
  chemically synthesized
aagttactgatatatacgtgtg

SEQ ID NO: 1338300 - DNA, 22 bp, Artificial Sequence
  chemically synthesized
tatatatatacacacacgtata

SEQ ID NO: 1338301 - DNA, 22 bp, Artificial Sequence
  chemically synthesized
ctgatatatacgtgtgtgtata

SEQ ID NO: 1338302 - DNA, 22 bp, Artificial Sequence
  chemically synthesized
tatattgtatatatatacacac

SEQ ID NO: 1338303 - DNA, 22 bp, Artificial Sequence
  chemically synthesized
gtatattgtatatatatacaca

SEQ ID NO: 1338304 - DNA, 22 bp, Artificial Sequence
  chemically synthesized
atatatacgtgtgtgtatatat

SEQ ID NO: 1338305 - DNA, 22 bp, Artificial Sequence
  chemically synthesized
tgtatattgtatatatatacac

SEQ ID NO: 1338306 - DNA, 22 bp, Artificial Sequence
  chemically synthesized
atgattttgtatattgtatata

SEQ ID NO: 1338307 - DNA, 22 bp, Artificial Sequence
  chemically synthesized
ggggaaaatatactgatgattt

SEQ ID NO: 1338308 - DNA, 22 bp, Artificial Sequence
  chemically synthesized
tctaggggaaaatatactgatg

SEQ ID NO: 1338309 - DNA, 22 bp, Artificial Sequence
  chemically synthesized
ttatctaggggaaaatatactg

SEQ ID NO: 1338310 - DNA, 22 bp, Artificial Sequence
  chemically synthesized
acaattattatctaggggaaaa

SEQ ID NO: 1338311 - DNA, 22 bp, Artificial Sequence
  chemically synthesized
aacaattattatctaggggaaa

SEQ ID NO: 1338312 - DNA, 22 bp, Artificial Sequence
  chemically synthesized
tacttaacaattattatctagg

SEQ ID NO: 1338313 - DNA, 22 bp, Artificial Sequence
  chemically synthesized
aattatacttaacaattattat

SEQ ID NO: 1338314 - DNA, 22 bp, Artificial Sequence
  chemically synthesized
ttgaattatacttaacaattat

SEQ ID NO: 1338315 - DNA, 22 bp, Artificial Sequence
  chemically synthesized
tcccctagataataattgttaa

SEQ ID NO: 1338316 - DNA, 22 bp, Artificial Sequence
  chemically synthesized
cccctagataataattgttaag

SEQ ID NO: 1338317 - DNA, 22 bp, Artificial Sequence
  chemically synthesized
ccctagataataattgttaagt

SEQ ID NO: 1338318 - DNA, 22 bp, Artificial Sequence
  chemically synthesized
gataataattgttaagtataat

SEQ ID NO: 1338319 - DNA, 22 bp, Artificial Sequence
  chemically synthesized
ttaagtataattcaataattgt

SEQ ID NO: 1338320 - DNA, 22 bp, Artificial Sequence
  chemically synthesized
agtataattcaataattgttac

SEQ ID NO: 1338321 - DNA, 22 bp, Artificial Sequence
  chemically synthesized
aaatgtatacagcatgtaacaa

SEQ ID NO: 1338322 - DNA, 22 bp, Artificial Sequence
  chemically synthesized
aaaatgtatacagcatgtaaca

SEQ ID NO: 1338323 - DNA, 22 bp, Artificial Sequence
  chemically synthesized
aataattgttacatgctgtata

SEQ ID NO: 1338324 - DNA, 22 bp, Artificial Sequence
  chemically synthesized
tatcacttaaaatgtatacagc

SEQ ID NO: 1338325 - DNA, 22 bp, Artificial Sequence
  chemically synthesized
atatcacttaaaatgtatacag

SEQ ID NO: 1338326 - DNA, 22 bp, Artificial Sequence
  chemically synthesized
ttacatgctgtatacattttaa

SEQ ID NO: 1338327 - DNA, 22 bp, Artificial Sequence
  chemically synthesized
catgctgtatacattttaagtg

SEQ ID NO: 1338328 - DNA, 22 bp, Artificial Sequence
  chemically synthesized
gaaagatttatatcacttaaaa

SEQ ID NO: 1338329 - DNA, 22 bp, Artificial Sequence
  chemically synthesized
ttggaaagatttatatcactta

SEQ ID NO: 1338330 - DNA, 22 bp, Artificial Sequence
  chemically synthesized
gttggaaagatttatatcactt

SEQ ID NO: 1338331 - DNA, 22 bp, Artificial Sequence
  chemically synthesized
tatacattttaagtgatataaa

SEQ ID NO: 1338332 - DNA, 22 bp, Artificial Sequence
  chemically synthesized
ggtttgttggaaagatttatat

SEQ ID NO: 1338333 - DNA, 22 bp, Artificial Sequence
  chemically synthesized
aggtttgttggaaagatttata

SEQ ID NO: 1338334 - DNA, 22 bp, Artificial Sequence
  chemically synthesized
taggtttgttggaaagatttat

SEQ ID NO: 1338335 - DNA, 22 bp, Artificial Sequence
  chemically synthesized
taagtgatataaatctttccaa

SEQ ID NO: 1338336 - DNA, 22 bp, Artificial Sequence
  chemically synthesized
aagtgatataaatctttccaac

SEQ ID NO: 1338337 - DNA, 22 bp, Artificial Sequence
  chemically synthesized
cattttaggtttgttggaaaga

SEQ ID NO: 1338338 - DNA, 22 bp, Artificial Sequence
  chemically synthesized
agtgatataaatctttccaaca

SEQ ID NO: 1338339 - DNA, 22 bp, Artificial Sequence
  chemically synthesized
acattttaggtttgttggaaag

SEQ ID NO: 1338340 - DNA, 22 bp, Artificial Sequence
  chemically synthesized
cttacattttaggtttgttgga

SEQ ID NO: 1338341 - DNA, 22 bp, Artificial Sequence
  chemically synthesized
tccaacaaacctaaaatgtaag

SEQ ID NO: 1338342 - DNA, 22 bp, Artificial Sequence
  chemically synthesized
ggaaaagaactacttacatttt

SEQ ID NO: 1338343 - DNA, 22 bp, Artificial Sequence
  chemically synthesized
ccaacaaacctaaaatgtaagt

SEQ ID NO: 1338344 - DNA, 22 bp, Artificial Sequence
  chemically synthesized
caacaaacctaaaatgtaagta

SEQ ID NO: 1338345 - DNA, 22 bp, Artificial Sequence
  chemically synthesized
gaaattaggaaaagaactactt

SEQ ID NO: 1338346 - DNA, 22 bp, Artificial Sequence
  chemically synthesized
ggaaattaggaaaagaactact

SEQ ID NO: 1338347 - DNA, 22 bp, Artificial Sequence
  chemically synthesized
tggaaattaggaaaagaactac

SEQ ID NO: 1338348 - DNA, 22 bp, Artificial Sequence
  chemically synthesized
aaatgtaagtagttcttttcct

SEQ ID NO: 1338349 - DNA, 22 bp, Artificial Sequence
  chemically synthesized
attttggaaattaggaaaagaa

SEQ ID NO: 1338350 - DNA, 22 bp, Artificial Sequence
  chemically synthesized
aattttggaaattaggaaaaga

SEQ ID NO: 1338351 - DNA, 22 bp, Artificial Sequence
  chemically synthesized
ttaattttggaaattaggaaaa

SEQ ID NO: 1338352 - DNA, 22 bp, Artificial Sequence
  chemically synthesized
tcttaattttggaaattaggaa

SEQ ID NO: 1338353 - DNA, 22 bp, Artificial Sequence
  chemically synthesized
cctctcttaattttggaaatta

SEQ ID NO: 1338354 - DNA, 22 bp, Artificial Sequence
  chemically synthesized
tgcctctcttaattttggaaat

SEQ ID NO: 1338355 - DNA, 22 bp, Artificial Sequence
  chemically synthesized
ttttcctaatttccaaaattaa

SEQ ID NO: 1338356 - DNA, 22 bp, Artificial Sequence
  chemically synthesized
actctgcctctcttaattttgg

SEQ ID NO: 1338357 - DNA, 22 bp, Artificial Sequence
  chemically synthesized
aactctgcctctcttaattttg

SEQ ID NO: 1338358 - DNA, 22 bp, Artificial Sequence
  chemically synthesized
ttcctaatttccaaaattaaga

SEQ ID NO: 1338359 - DNA, 22 bp, Artificial Sequence
  chemically synthesized
tcctaatttccaaaattaagag

SEQ ID NO: 1338360 - DNA, 22 bp, Artificial Sequence
  chemically synthesized
cctaatttccaaaattaagaga

SEQ ID NO: 1338361 - DNA, 22 bp, Artificial Sequence
  chemically synthesized
cttaactctgcctctcttaatt

SEQ ID NO: 1338362 - DNA, 22 bp, Artificial Sequence
  chemically synthesized
ctaatttccaaaattaagagag

SEQ ID NO: 1338363 - DNA, 22 bp, Artificial Sequence
  chemically synthesized
atttccaaaattaagagaggca

SEQ ID NO: 1338364 - DNA, 22 bp, Artificial Sequence
  chemically synthesized
ccaaaattaagagaggcagagt

SEQ ID NO: 1338365 - DNA, 22 bp, Artificial Sequence
  chemically synthesized
caaaattaagagaggcagagtt

SEQ ID NO: 1338366 - DNA, 22 bp, Artificial Sequence
  chemically synthesized
ggcaagttgcttaactctgcct

SEQ ID NO: 1338367 - DNA, 22 bp, Artificial Sequence
  chemically synthesized
aggcaagttgcttaactctgcc

SEQ ID NO: 1338368 - DNA, 22 bp, Artificial Sequence
  chemically synthesized
agagaggcagagttaagcaact

SEQ ID NO: 1338369 - DNA, 22 bp, Artificial Sequence
  chemically synthesized
tgaccttaggcaagttgcttaa

SEQ ID NO: 1338370 - DNA, 22 bp, Artificial Sequence
  chemically synthesized
atgactgtgaccttaggcaagt

SEQ ID NO: 1338371 - DNA, 22 bp, Artificial Sequence
  chemically synthesized
aatgactgtgaccttaggcaag

SEQ ID NO: 1338372 - DNA, 22 bp, Artificial Sequence
  chemically synthesized
tttaatgactgtgaccttaggc

SEQ ID NO: 1338373 - DNA, 22 bp, Artificial Sequence
  chemically synthesized
ctatttaatgactgtgacctta

SEQ ID NO: 1338374 - DNA, 22 bp, Artificial Sequence
  chemically synthesized
agcaacttgcctaaggtcacag

SEQ ID NO: 1338375 - DNA, 22 bp, Artificial Sequence
  chemically synthesized
agtgctgctatttaatgactgt

SEQ ID NO: 1338376 - DNA, 22 bp, Artificial Sequence
  chemically synthesized
gcctaaggtcacagtcattaaa

SEQ ID NO: 1338377 - DNA, 22 bp, Artificial Sequence
  chemically synthesized
cctaaggtcacagtcattaaat

SEQ ID NO: 1338378 - DNA, 22 bp, Artificial Sequence
  chemically synthesized
aggtcacagtcattaaatagca

SEQ ID NO: 1338379 - DNA, 22 bp, Artificial Sequence
  chemically synthesized
gaatctcagtgctgctatttaa

SEQ ID NO: 1338380 - DNA, 22 bp, Artificial Sequence
  chemically synthesized
agttcgaatctcagtgctgcta

SEQ ID NO: 1338381 - DNA, 22 bp, Artificial Sequence
  chemically synthesized
ctgagttcgaatctcagtgctg

SEQ ID NO: 1338382 - DNA, 22 bp, Artificial Sequence
  chemically synthesized
gctgagttcgaatctcagtgct

SEQ ID NO: 1338383 - DNA, 22 bp, Artificial Sequence
  chemically synthesized
tttgctgagttcgaatctcagt

SEQ ID NO: 1338384 - DNA, 22 bp, Artificial Sequence
  chemically synthesized
aatagcagcactgagattcgaa

SEQ ID NO: 1338385 - DNA, 22 bp, Artificial Sequence
  chemically synthesized
gagccaggctgtttgctgagtt

SEQ ID NO: 1338386 - DNA, 22 bp, Artificial Sequence
  chemically synthesized
tggagccaggctgtttgctgag

SEQ ID NO: 1338387 - DNA, 22 bp, Artificial Sequence
  chemically synthesized
agattcgaactcagcaaacagc

SEQ ID NO: 1338388 - DNA, 22 bp, Artificial Sequence
  chemically synthesized
gaactcagcaaacagcctggct

SEQ ID NO: 1338389 - DNA, 22 bp, Artificial Sequence
  chemically synthesized
agcaaacagcctggctccagaa

SEQ ID NO: 1338390 - DNA, 22 bp, Artificial Sequence
  chemically synthesized
tcagacgcatgggttctggagc

SEQ ID NO: 1338391 - DNA, 22 bp, Artificial Sequence
  chemically synthesized
gctccagaacccatgcgtctga

SEQ ID NO: 1338392 - DNA, 22 bp, Artificial Sequence
  chemically synthesized
taagaagcagttatcagacgca

SEQ ID NO: 1338393 - DNA, 22 bp, Artificial Sequence
  chemically synthesized
cagaacccatgcgtctgataac

SEQ ID NO: 1338394 - DNA, 22 bp, Artificial Sequence
  chemically synthesized
ataactgcttcttataatatgg

SEQ ID NO: 1338395 - DNA, 22 bp, Artificial Sequence
  chemically synthesized
cttcttataatatggttgtgtt

SEQ ID NO: 1338396 - DNA, 22 bp, Artificial Sequence
  chemically synthesized
cttataatatggttgtgttcat

SEQ ID NO: 1338397 - DNA, 22 bp, Artificial Sequence
  chemically synthesized
ttataatatggttgtgttcatc

SEQ ID NO: 1338398 - DNA, 22 bp, Artificial Sequence
  chemically synthesized
ataatatggttgtgttcatcca

SEQ ID NO: 1338399 - DNA, 22 bp, Artificial Sequence
  chemically synthesized
taatatggttgtgttcatccat

SEQ ID NO: 1338400 - DNA, 22 bp, Artificial Sequence
  chemically synthesized
acaatagatgaacaagaaaatg

SEQ ID NO: 1338401 - DNA, 22 bp, Artificial Sequence
  chemically synthesized
tgttcatccattttcttgttca

SEQ ID NO: 1338402 - DNA, 22 bp, Artificial Sequence
  chemically synthesized
gcaacctcacaatagatgaaca

SEQ ID NO: 1338403 - DNA, 22 bp, Artificial Sequence
  chemically synthesized
atccattttcttgttcatctat

SEQ ID NO: 1338404 - DNA, 22 bp, Artificial Sequence
  chemically synthesized
tcttgttcatctattgtgaggt

SEQ ID NO: 1338405 - DNA, 22 bp, Artificial Sequence
  chemically synthesized
cttgttcatctattgtgaggtt

SEQ ID NO: 1338406 - DNA, 22 bp, Artificial Sequence
  chemically synthesized
ttgttcatctattgtgaggttg

SEQ ID NO: 1338407 - DNA, 22 bp, Artificial Sequence
  chemically synthesized
gttcatctattgtgaggttgcc

SEQ ID NO: 1338408 - DNA, 22 bp, Artificial Sequence
  chemically synthesized
ttcatctattgtgaggttgcca

SEQ ID NO: 1338409 - DNA, 22 bp, Artificial Sequence
  chemically synthesized
aagaaatcacgctggcaacctc

SEQ ID NO: 1338410 - DNA, 22 bp, Artificial Sequence
  chemically synthesized
gaagaaatcacgctggcaacct

SEQ ID NO: 1338411 - DNA, 22 bp, Artificial Sequence
  chemically synthesized
tgaagaaatcacgctggcaacc

SEQ ID NO: 1338412 - DNA, 22 bp, Artificial Sequence
  chemically synthesized
atctattgtgaggttgccagcg

SEQ ID NO: 1338413 - DNA, 22 bp, Artificial Sequence
  chemically synthesized
ttgtgaggttgccagcgtgatt

SEQ ID NO: 1338414 - DNA, 22 bp, Artificial Sequence
  chemically synthesized
tgaggttgccagcgtgatttct

SEQ ID NO: 1338415 - DNA, 22 bp, Artificial Sequence
  chemically synthesized
cagcaggcctttgaagaaatca

SEQ ID NO: 1338416 - DNA, 22 bp, Artificial Sequence
  chemically synthesized
actccagcaggcctttgaagaa

SEQ ID NO: 1338417 - DNA, 22 bp, Artificial Sequence
  chemically synthesized
ccagcgtgatttcttcaaaggc

SEQ ID NO: 1338418 - DNA, 22 bp, Artificial Sequence
  chemically synthesized
ctgactccagcaggcctttgaa

SEQ ID NO: 1338419 - DNA, 22 bp, Artificial Sequence
  chemically synthesized
cttcaaaggcctgctggagtca

SEQ ID NO: 1338420 - DNA, 22 bp, Artificial Sequence
  chemically synthesized
gggacatattcctgactccagc

SEQ ID NO: 1338421 - DNA, 22 bp, Artificial Sequence
  chemically synthesized
ttcaaaggcctgctggagtcag

SEQ ID NO: 1338422 - DNA, 22 bp, Artificial Sequence
  chemically synthesized
caaaggcctgctggagtcagga

SEQ ID NO: 1338423 - DNA, 22 bp, Artificial Sequence
  chemically synthesized
aaaggcctgctggagtcaggaa

SEQ ID NO: 1338424 - DNA, 22 bp, Artificial Sequence
  chemically synthesized
tgacctagggacatattcctga

SEQ ID NO: 1338425 - DNA, 22 bp, Artificial Sequence
  chemically synthesized
tgtgacctagggacatattcct

SEQ ID NO: 1338426 - DNA, 22 bp, Artificial Sequence
  chemically synthesized
ctggagtcaggaatatgtccct

SEQ ID NO: 1338427 - DNA, 22 bp, Artificial Sequence
  chemically synthesized
agctctgtgacctagggacata

SEQ ID NO: 1338428 - DNA, 22 bp, Artificial Sequence
  chemically synthesized
gagtcaggaatatgtccctagg

SEQ ID NO: 1338429 - DNA, 22 bp, Artificial Sequence
  chemically synthesized
ctgagctctgtgacctagggac

SEQ ID NO: 1338430 - DNA, 22 bp, Artificial Sequence
  chemically synthesized
gctgagctctgtgacctaggga

SEQ ID NO: 1338431 - DNA, 22 bp, Artificial Sequence
  chemically synthesized
aaatttgctgagctctgtgacc

SEQ ID NO: 1338432 - DNA, 22 bp, Artificial Sequence
  chemically synthesized
ctaaaatttgctgagctctgtg

SEQ ID NO: 1338433 - DNA, 22 bp, Artificial Sequence
  chemically synthesized
ggctactaaaatttgctgagct

SEQ ID NO: 1338434 - DNA, 22 bp, Artificial Sequence
  chemically synthesized
aggctactaaaatttgctgagc

SEQ ID NO: 1338435 - DNA, 22 bp, Artificial Sequence
  chemically synthesized
taggctactaaaatttgctgag

SEQ ID NO: 1338436 - DNA, 22 bp, Artificial Sequence
  chemically synthesized
ggtcacagagctcagcaaattt

SEQ ID NO: 1338437 - DNA, 22 bp, Artificial Sequence
  chemically synthesized
agtcaagttttaggctactaaa

SEQ ID NO: 1338438 - DNA, 22 bp, Artificial Sequence
  chemically synthesized
agcaaattttagtagcctaaaa

SEQ ID NO: 1338439 - DNA, 22 bp, Artificial Sequence
  chemically synthesized
aggagaattgagtcaagtttta

SEQ ID NO: 1338440 - DNA, 22 bp, Artificial Sequence
  chemically synthesized
tagtagcctaaaacttgactca

SEQ ID NO: 1338441 - DNA, 22 bp, Artificial Sequence
  chemically synthesized
agtagcctaaaacttgactcaa

SEQ ID NO: 1338442 - DNA, 22 bp, Artificial Sequence
  chemically synthesized
gtagcctaaaacttgactcaat

SEQ ID NO: 1338443 - DNA, 22 bp, Artificial Sequence
  chemically synthesized
agagtaccgctcaggagaattg

SEQ ID NO: 1338444 - DNA, 22 bp, Artificial Sequence
  chemically synthesized
aaacttgactcaattctcctga

SEQ ID NO: 1338445 - DNA, 22 bp, Artificial Sequence
  chemically synthesized
gactcaattctcctgagcggta

SEQ ID NO: 1338446 - DNA, 22 bp, Artificial Sequence
  chemically synthesized
actcaattctcctgagcggtac

SEQ ID NO: 1338447 - DNA, 22 bp, Artificial Sequence
  chemically synthesized
aattctcctgagcggtactctc

SEQ ID NO: 1338448 - DNA, 22 bp, Artificial Sequence
  chemically synthesized
tcctgagcggtactctcagtgt

SEQ ID NO: 1338449 - DNA, 22 bp, Artificial Sequence
  chemically synthesized
ctgagcggtactctcagtgtga

SEQ ID NO: 1338450 - DNA, 22 bp, Artificial Sequence
  chemically synthesized
accagtagcgaggtcacactga

SEQ ID NO: 1338451 - DNA, 22 bp, Artificial Sequence
  chemically synthesized
gaccagtagcgaggtcacactg

SEQ ID NO: 1338452 - DNA, 22 bp, Artificial Sequence
  chemically synthesized
agcggtactctcagtgtgacct

SEQ ID NO: 1338453 - DNA, 22 bp, Artificial Sequence
  chemically synthesized
tgaccagtagcgaggtcacact

SEQ ID NO: 1338454 - DNA, 22 bp, Artificial Sequence
  chemically synthesized
ttgaccagtagcgaggtcacac

SEQ ID NO: 1338455 - DNA, 22 bp, Artificial Sequence
  chemically synthesized
caacttttgaccagtagcgagg

SEQ ID NO: 1338456 - DNA, 22 bp, Artificial Sequence
  chemically synthesized
acaacttttgaccagtagcgag

SEQ ID NO: 1338457 - DNA, 22 bp, Artificial Sequence
  chemically synthesized
tcagtgtgacctcgctactggt

SEQ ID NO: 1338458 - DNA, 22 bp, Artificial Sequence
  chemically synthesized
agtgtgacctcgctactggtca

SEQ ID NO: 1338459 - DNA, 22 bp, Artificial Sequence
  chemically synthesized
gtttacaacttttgaccagtag

SEQ ID NO: 1338460 - DNA, 22 bp, Artificial Sequence
  chemically synthesized
ctcgtttacaacttttgaccag

SEQ ID NO: 1338461 - DNA, 22 bp, Artificial Sequence
  chemically synthesized
gctactggtcaaaagttgtaaa

SEQ ID NO: 1338462 - DNA, 22 bp, Artificial Sequence
  chemically synthesized
ctggtcaaaagttgtaaacgag

SEQ ID NO: 1338463 - DNA, 22 bp, Artificial Sequence
  chemically synthesized
gtcaaaagttgtaaacgagcag

SEQ ID NO: 1338464 - DNA, 22 bp, Artificial Sequence
  chemically synthesized
taaacgagcagttacatatttt

SEQ ID NO: 1338465 - DNA, 22 bp, Artificial Sequence
  chemically synthesized
gtgagagcagcaaaaaatatgt

SEQ ID NO: 1338466 - DNA, 22 bp, Artificial Sequence
  chemically synthesized
catattttttgctgctctcacc

SEQ ID NO: 1338467 - DNA, 22 bp, Artificial Sequence
  chemically synthesized
tttgctgctctcaccaatacat

SEQ ID NO: 1338468 - DNA, 22 bp, Artificial Sequence
  chemically synthesized
ttgctgctctcaccaatacatg

SEQ ID NO: 1338469 - DNA, 22 bp, Artificial Sequence
  chemically synthesized
tgctgctctcaccaatacatgt

SEQ ID NO: 1338470 - DNA, 22 bp, Artificial Sequence
  chemically synthesized
gctgctctcaccaatacatgtc

SEQ ID NO: 1338471 - DNA, 22 bp, Artificial Sequence
  chemically synthesized
ctgctctcaccaatacatgtct

SEQ ID NO: 1338472 - DNA, 22 bp, Artificial Sequence
  chemically synthesized
gccatacatagcaagacatgta

SEQ ID NO: 1338473 - DNA, 22 bp, Artificial Sequence
  chemically synthesized
ggccatacatagcaagacatgt

SEQ ID NO: 1338474 - DNA, 22 bp, Artificial Sequence
  chemically synthesized
ctctcaccaatacatgtcttgc

SEQ ID NO: 1338475 - DNA, 22 bp, Artificial Sequence
  chemically synthesized
tcaccaatacatgtcttgctat

SEQ ID NO: 1338476 - DNA, 22 bp, Artificial Sequence
  chemically synthesized
accaatacatgtcttgctatgt

SEQ ID NO: 1338477 - DNA, 22 bp, Artificial Sequence
  chemically synthesized
gctatgtatggccaaacgggtt

SEQ ID NO: 1338478 - DNA, 22 bp, Artificial Sequence
  chemically synthesized
agtgcacaagtcaacccgtttg

SEQ ID NO: 1338479 - DNA, 22 bp, Artificial Sequence
  chemically synthesized
ctatgtatggccaaacgggttg

SEQ ID NO: 1338480 - DNA, 22 bp, Artificial Sequence
  chemically synthesized
gagtgcacaagtcaacccgttt

SEQ ID NO: 1338481 - DNA, 22 bp, Artificial Sequence
  chemically synthesized
tgagtgcacaagtcaacccgtt

SEQ ID NO: 1338482 - DNA, 22 bp, Artificial Sequence
  chemically synthesized
tgtatggccaaacgggttgact

SEQ ID NO: 1338483 - DNA, 22 bp, Artificial Sequence
  chemically synthesized
cattttgagtgcacaagtcaac

SEQ ID NO: 1338484 - DNA, 22 bp, Artificial Sequence
  chemically synthesized
gcattttgagtgcacaagtcaa

SEQ ID NO: 1338485 - DNA, 22 bp, Artificial Sequence
  chemically synthesized
tgcattttgagtgcacaagtca

SEQ ID NO: 1338486 - DNA, 22 bp, Artificial Sequence
  chemically synthesized
ttgcattttgagtgcacaagtc

SEQ ID NO: 1338487 - DNA, 22 bp, Artificial Sequence
  chemically synthesized
tttgcattttgagtgcacaagt

SEQ ID NO: 1338488 - DNA, 22 bp, Artificial Sequence
  chemically synthesized
ttttgcattttgagtgcacaag

SEQ ID NO: 1338489 - DNA, 22 bp, Artificial Sequence
  chemically synthesized
tagtacttttttgcattttgag

SEQ ID NO: 1338490 - DNA, 22 bp, Artificial Sequence
  chemically synthesized
atagtacttttttgcattttga

SEQ ID NO: 1338491 - DNA, 22 bp, Artificial Sequence
  chemically synthesized
acttgtgcactcaaaatgcaaa

SEQ ID NO: 1338492 - DNA, 22 bp, Artificial Sequence
  chemically synthesized
tatttatagtacttttttgcat

SEQ ID NO: 1338493 - DNA, 22 bp, Artificial Sequence
  chemically synthesized
gtgcactcaaaatgcaaaaaag

SEQ ID NO: 1338494 - DNA, 22 bp, Artificial Sequence
  chemically synthesized
tgcactcaaaatgcaaaaaagt

SEQ ID NO: 1338495 - DNA, 22 bp, Artificial Sequence
  chemically synthesized
tatatttatagtacttttttgc

SEQ ID NO: 1338496 - DNA, 22 bp, Artificial Sequence
  chemically synthesized
ctctatatttatagtacttttt

SEQ ID NO: 1338497 - DNA, 22 bp, Artificial Sequence
  chemically synthesized
tactctatatttatagtacttt

SEQ ID NO: 1338498 - DNA, 22 bp, Artificial Sequence
  chemically synthesized
ctactctatatttatagtactt

SEQ ID NO: 1338499 - DNA, 22 bp, Artificial Sequence
  chemically synthesized
aaaatgcaaaaaagtactataa

SEQ ID NO: 1338500 - DNA, 22 bp, Artificial Sequence
  chemically synthesized
catttctactctatatttatag

SEQ ID NO: 1338501 - DNA, 22 bp, Artificial Sequence
  chemically synthesized
ccatttctactctatatttata

SEQ ID NO: 1338502 - DNA, 22 bp, Artificial Sequence
  chemically synthesized
tgtcgccaatttccatttctac

SEQ ID NO: 1338503 - DNA, 22 bp, Artificial Sequence
  chemically synthesized
taaatatagagtagaaatggaa

SEQ ID NO: 1338504 - DNA, 22 bp, Artificial Sequence
  chemically synthesized
tcatattatgtcgccaatttcc

SEQ ID NO: 1338505 - DNA, 22 bp, Artificial Sequence
  chemically synthesized
aattgtcatattatgtcgccaa

SEQ ID NO: 1338506 - DNA, 22 bp, Artificial Sequence
  chemically synthesized
aaattgtcatattatgtcgcca

SEQ ID NO: 1338507 - DNA, 22 bp, Artificial Sequence
  chemically synthesized
taaattgtcatattatgtcgcc

SEQ ID NO: 1338508 - DNA, 22 bp, Artificial Sequence
  chemically synthesized
ttaaattgtcatattatgtcgc

SEQ ID NO: 1338509 - DNA, 22 bp, Artificial Sequence
  chemically synthesized
aatttttaaattgtcatattat

SEQ ID NO: 1338510 - DNA, 22 bp, Artificial Sequence
  chemically synthesized
aaatttttaaattgtcatatta

SEQ ID NO: 1338511 - DNA, 22 bp, Artificial Sequence
  chemically synthesized
taaatttttaaattgtcatatt

SEQ ID NO: 1338512 - DNA, 22 bp, Artificial Sequence
  chemically synthesized
gcgacataatatgacaatttaa

SEQ ID NO: 1338513 - DNA, 22 bp, Artificial Sequence
  chemically synthesized
tgaaaatcagatattttaaatt

SEQ ID NO: 1338514 - DNA, 22 bp, Artificial Sequence
  chemically synthesized
gtgaaaatcagatattttaaat

SEQ ID NO: 1338515 - DNA, 22 bp, Artificial Sequence
  chemically synthesized
agacttgtgaaaatcagatatt

SEQ ID NO: 1338516 - DNA, 22 bp, Artificial Sequence
  chemically synthesized
aagacttgtgaaaatcagatat

SEQ ID NO: 1338517 - DNA, 22 bp, Artificial Sequence
  chemically synthesized
aaaaatttaaaatatctgattt

SEQ ID NO: 1338518 - DNA, 22 bp, Artificial Sequence
  chemically synthesized
aaaatttaaaatatctgatttt

SEQ ID NO: 1338519 - DNA, 22 bp, Artificial Sequence
  chemically synthesized
ttaagacttgtgaaaatcagat

SEQ ID NO: 1338520 - DNA, 22 bp, Artificial Sequence
  chemically synthesized
aggctcttaagacttgtgaaaa

SEQ ID NO: 1338521 - DNA, 22 bp, Artificial Sequence
  chemically synthesized
aaaatatctgattttcacaagt

SEQ ID NO: 1338522 - DNA, 22 bp, Artificial Sequence
  chemically synthesized
aaatatctgattttcacaagtc

SEQ ID NO: 1338523 - DNA, 22 bp, Artificial Sequence
  chemically synthesized
aatatcactgaggctcttaaga

SEQ ID NO: 1338524 - DNA, 22 bp, Artificial Sequence
  chemically synthesized
attttcacaagtcttaagagcc

SEQ ID NO: 1338525 - DNA, 22 bp, Artificial Sequence
  chemically synthesized
tcacaagtcttaagagcctcag

SEQ ID NO: 1338526 - DNA, 22 bp, Artificial Sequence
  chemically synthesized
cacaagtcttaagagcctcagt

SEQ ID NO: 1338527 - DNA, 22 bp, Artificial Sequence
  chemically synthesized
acaagtcttaagagcctcagtg

SEQ ID NO: 1338528 - DNA, 22 bp, Artificial Sequence
  chemically synthesized
caatcatactgaatatcactga

SEQ ID NO: 1338529 - DNA, 22 bp, Artificial Sequence
  chemically synthesized
tccaatcatactgaatatcact

SEQ ID NO: 1338530 - DNA, 22 bp, Artificial Sequence
  chemically synthesized
aagagcctcagtgatattcagt

SEQ ID NO: 1338531 - DNA, 22 bp, Artificial Sequence
  chemically synthesized
agagcctcagtgatattcagta

SEQ ID NO: 1338532 - DNA, 22 bp, Artificial Sequence
  chemically synthesized
aaactctccaatcatactgaat

SEQ ID NO: 1338533 - DNA, 22 bp, Artificial Sequence
  chemically synthesized
agtgatattcagtatgattgga

SEQ ID NO: 1338534 - DNA, 22 bp, Artificial Sequence
  chemically synthesized
cacaattcaaactctccaatca

SEQ ID NO: 1338535 - DNA, 22 bp, Artificial Sequence
  chemically synthesized
acacaattcaaactctccaatc

SEQ ID NO: 1338536 - DNA, 22 bp, Artificial Sequence
  chemically synthesized
agtatgattggagagtttgaat

SEQ ID NO: 1338537 - DNA, 22 bp, Artificial Sequence
  chemically synthesized
ataaagtttacacaattcaaac

SEQ ID NO: 1338538 - DNA, 22 bp, Artificial Sequence
  chemically synthesized
aataaagtttacacaattcaaa

SEQ ID NO: 1338539 - DNA, 22 bp, Artificial Sequence
  chemically synthesized
ttaataaagtttacacaattca

SEQ ID NO: 1338540 - DNA, 22 bp, Artificial Sequence
  chemically synthesized
gagagtttgaattgtgtaaact

SEQ ID NO: 1338541 - DNA, 22 bp, Artificial Sequence
  chemically synthesized
gtctcttaataaagtttacaca

SEQ ID NO: 1338542 - DNA, 22 bp, Artificial Sequence
  chemically synthesized
gctagtctcttaataaagttta

SEQ ID NO: 1338543 - DNA, 22 bp, Artificial Sequence
  chemically synthesized
tagctagtctcttaataaagtt

SEQ ID NO: 1338544 - DNA, 22 bp, Artificial Sequence
  chemically synthesized
ctagctagtctcttaataaagt

SEQ ID NO: 1338545 - DNA, 22 bp, Artificial Sequence
  chemically synthesized
gaattgtgtaaactttattaag

SEQ ID NO: 1338546 - DNA, 22 bp, Artificial Sequence
  chemically synthesized
aattgtgtaaactttattaaga

SEQ ID NO: 1338547 - DNA, 22 bp, Artificial Sequence
  chemically synthesized
agtttctagctagtctcttaat

SEQ ID NO: 1338548 - DNA, 22 bp, Artificial Sequence
  chemically synthesized
tgtaaactttattaagagacta

SEQ ID NO: 1338549 - DNA, 22 bp, Artificial Sequence
  chemically synthesized
ctgagtttctagctagtctctt

SEQ ID NO: 1338550 - DNA, 22 bp, Artificial Sequence
  chemically synthesized
tgctgagtttctagctagtctc

SEQ ID NO: 1338551 - DNA, 22 bp, Artificial Sequence
  chemically synthesized
tattaagagactagctagaaac

SEQ ID NO: 1338552 - DNA, 22 bp, Artificial Sequence
  chemically synthesized
attaagagactagctagaaact

SEQ ID NO: 1338553 - DNA, 22 bp, Artificial Sequence
  chemically synthesized
ttaagagactagctagaaactc

SEQ ID NO: 1338554 - DNA, 22 bp, Artificial Sequence
  chemically synthesized
agagactagctagaaactcagc

SEQ ID NO: 1338555 - DNA, 22 bp, Artificial Sequence
  chemically synthesized
gctagaaactcagcagagtttt

SEQ ID NO: 1338556 - DNA, 22 bp, Artificial Sequence
  chemically synthesized
gaaactcagcagagttttcatg

SEQ ID NO: 1338557 - DNA, 22 bp, Artificial Sequence
  chemically synthesized
agcagagttttcatggattgca

SEQ ID NO: 1338558 - DNA, 22 bp, Artificial Sequence
  chemically synthesized
tcatggattgcatgacactact

SEQ ID NO: 1338559 - DNA, 22 bp, Artificial Sequence
  chemically synthesized
catggattgcatgacactactt

SEQ ID NO: 1338560 - DNA, 22 bp, Artificial Sequence
  chemically synthesized
caaagaaaatgaaagtagtgtc

SEQ ID NO: 1338561 - DNA, 22 bp, Artificial Sequence
  chemically synthesized
atggattgcatgacactacttt

SEQ ID NO: 1338562 - DNA, 22 bp, Artificial Sequence
  chemically synthesized
catgacactactttcattttct

SEQ ID NO: 1338563 - DNA, 22 bp, Artificial Sequence
  chemically synthesized
tgtgatgactgcaaagaaaatg

SEQ ID NO: 1338564 - DNA, 22 bp, Artificial Sequence
  chemically synthesized
gtgtgatgactgcaaagaaaat

SEQ ID NO: 1338565 - DNA, 22 bp, Artificial Sequence
  chemically synthesized
cttgtgtgatgactgcaaagaa

SEQ ID NO: 1338566 - DNA, 22 bp, Artificial Sequence
  chemically synthesized
acttgtgtgatgactgcaaaga

SEQ ID NO: 1338567 - DNA, 22 bp, Artificial Sequence
  chemically synthesized
tacttgtgtgatgactgcaaag

SEQ ID NO: 1338568 - DNA, 22 bp, Artificial Sequence
  chemically synthesized
ctttcattttctttgcagtcat

SEQ ID NO: 1338569 - DNA, 22 bp, Artificial Sequence
  chemically synthesized
tcattttctttgcagtcatcac

SEQ ID NO: 1338570 - DNA, 22 bp, Artificial Sequence
  chemically synthesized
cattttctttgcagtcatcaca

SEQ ID NO: 1338571 - DNA, 22 bp, Artificial Sequence
  chemically synthesized
attttctttgcagtcatcacac

SEQ ID NO: 1338572 - DNA, 22 bp, Artificial Sequence
  chemically synthesized
taaaattttacttgtgtgatga

SEQ ID NO: 1338573 - DNA, 22 bp, Artificial Sequence
  chemically synthesized
tctttgcagtcatcacacaagt

SEQ ID NO: 1338574 - DNA, 22 bp, Artificial Sequence
  chemically synthesized
ctttgcagtcatcacacaagta

SEQ ID NO: 1338575 - DNA, 22 bp, Artificial Sequence
  chemically synthesized
tttgcagtcatcacacaagtaa

SEQ ID NO: 1338576 - DNA, 22 bp, Artificial Sequence
  chemically synthesized
aacctataaaattttacttgtg

SEQ ID NO: 1338577 - DNA, 22 bp, Artificial Sequence
  chemically synthesized
tgcagtcatcacacaagtaaaa

SEQ ID NO: 1338578 - DNA, 22 bp, Artificial Sequence
  chemically synthesized
gcagtcatcacacaagtaaaat

SEQ ID NO: 1338579 - DNA, 22 bp, Artificial Sequence
  chemically synthesized
cagtcatcacacaagtaaaatt

SEQ ID NO: 1338580 - DNA, 22 bp, Artificial Sequence
  chemically synthesized
ggtgtatgtggagtgtgttgaa

SEQ ID NO: 1338581 - DNA, 22 bp, Artificial Sequence
  chemically synthesized
tataggttcaacacactccaca

SEQ ID NO: 1338582 - DNA, 22 bp, Artificial Sequence
  chemically synthesized
ataggttcaacacactccacat

SEQ ID NO: 1338583 - DNA, 22 bp, Artificial Sequence
  chemically synthesized
taggttcaacacactccacata

SEQ ID NO: 1338584 - DNA, 22 bp, Artificial Sequence
  chemically synthesized
gagagcaattaggtgtatgtgg

SEQ ID NO: 1338585 - DNA, 22 bp, Artificial Sequence
  chemically synthesized
aacacactccacatacacctaa

SEQ ID NO: 1338586 - DNA, 22 bp, Artificial Sequence
  chemically synthesized
ccctagagagcaattaggtgta

SEQ ID NO: 1338587 - DNA, 22 bp, Artificial Sequence
  chemically synthesized
ctaccctagagagcaattaggt

SEQ ID NO: 1338588 - DNA, 22 bp, Artificial Sequence
  chemically synthesized
actaccctagagagcaattagg

SEQ ID NO: 1338589 - DNA, 22 bp, Artificial Sequence
  chemically synthesized
tactaccctagagagcaattag

SEQ ID NO: 1338590 - DNA, 22 bp, Artificial Sequence
  chemically synthesized
cacatacacctaattgctctct

SEQ ID NO: 1338591 - DNA, 22 bp, Artificial Sequence
  chemically synthesized
ttttactaccctagagagcaat

SEQ ID NO: 1338592 - DNA, 22 bp, Artificial Sequence
  chemically synthesized
gttgttttactaccctagagag

SEQ ID NO: 1338593 - DNA, 22 bp, Artificial Sequence
  chemically synthesized
ggttgttttactaccctagaga

SEQ ID NO: 1338594 - DNA, 22 bp, Artificial Sequence
  chemically synthesized
cttggttgttttactaccctag

SEQ ID NO: 1338595 - DNA, 22 bp, Artificial Sequence
  chemically synthesized
attgctctctagggtagtaaaa

SEQ ID NO: 1338596 - DNA, 22 bp, Artificial Sequence
  chemically synthesized
actgcttggttgttttactacc

SEQ ID NO: 1338597 - DNA, 22 bp, Artificial Sequence
  chemically synthesized
ctctctagggtagtaaaacaac

SEQ ID NO: 1338598 - DNA, 22 bp, Artificial Sequence
  chemically synthesized
tctagggtagtaaaacaaccaa

SEQ ID NO: 1338599 - DNA, 22 bp, Artificial Sequence
  chemically synthesized
tggattcactgcttggttgttt

SEQ ID NO: 1338600 - DNA, 22 bp, Artificial Sequence
  chemically synthesized
gtggattcactgcttggttgtt

SEQ ID NO: 1338601 - DNA, 22 bp, Artificial Sequence
  chemically synthesized
tagggtagtaaaacaaccaagc

SEQ ID NO: 1338602 - DNA, 22 bp, Artificial Sequence
  chemically synthesized
tgtggattcactgcttggttgt

SEQ ID NO: 1338603 - DNA, 22 bp, Artificial Sequence
  chemically synthesized
ttgtggattcactgcttggttg

SEQ ID NO: 1338604 - DNA, 22 bp, Artificial Sequence
  chemically synthesized
gggtagtaaaacaaccaagcag

SEQ ID NO: 1338605 - DNA, 22 bp, Artificial Sequence
  chemically synthesized
tttttgtggattcactgcttgg

SEQ ID NO: 1338606 - DNA, 22 bp, Artificial Sequence
  chemically synthesized
aactgtttttgtggattcactg

SEQ ID NO: 1338607 - DNA, 22 bp, Artificial Sequence
  chemically synthesized
actgaactgtttttgtggattc

SEQ ID NO: 1338608 - DNA, 22 bp, Artificial Sequence
  chemically synthesized
aatgaaactcactgaactgttt

SEQ ID NO: 1338609 - DNA, 22 bp, Artificial Sequence
  chemically synthesized
aaatgaaactcactgaactgtt

SEQ ID NO: 1338610 - DNA, 22 bp, Artificial Sequence
  chemically synthesized
gtagtgtatgcatggtttaaat

SEQ ID NO: 1338611 - DNA, 22 bp, Artificial Sequence
  chemically synthesized
ggtagtgtatgcatggtttaaa

SEQ ID NO: 1338612 - DNA, 22 bp, Artificial Sequence
  chemically synthesized
agtgagtttcatttaaaccatg

SEQ ID NO: 1338613 - DNA, 22 bp, Artificial Sequence
  chemically synthesized
tggtagtgtatgcatggtttaa

SEQ ID NO: 1338614 - DNA, 22 bp, Artificial Sequence
  chemically synthesized
ttggtagtgtatgcatggttta

SEQ ID NO: 1338615 - DNA, 22 bp, Artificial Sequence
  chemically synthesized
tttggtagtgtatgcatggttt

SEQ ID NO: 1338616 - DNA, 22 bp, Artificial Sequence
  chemically synthesized
catttaaaccatgcatacacta

SEQ ID NO: 1338617 - DNA, 22 bp, Artificial Sequence
  chemically synthesized
atttaaaccatgcatacactac

SEQ ID NO: 1338618 - DNA, 22 bp, Artificial Sequence
  chemically synthesized
tgagtcactttttggtagtgta

SEQ ID NO: 1338619 - DNA, 22 bp, Artificial Sequence
  chemically synthesized
aaaccatgcatacactaccaaa

SEQ ID NO: 1338620 - DNA, 22 bp, Artificial Sequence
  chemically synthesized
aaccatgcatacactaccaaaa

SEQ ID NO: 1338621 - DNA, 22 bp, Artificial Sequence
  chemically synthesized
ctgtgagtcactttttggtagt

SEQ ID NO: 1338622 - DNA, 22 bp, Artificial Sequence
  chemically synthesized
tgctgtgagtcactttttggta

SEQ ID NO: 1338623 - DNA, 22 bp, Artificial Sequence
  chemically synthesized
ctctgctgtgagtcactttttg

SEQ ID NO: 1338624 - DNA, 22 bp, Artificial Sequence
  chemically synthesized
cctctgctgtgagtcacttttt

SEQ ID NO: 1338625 - DNA, 22 bp, Artificial Sequence
  chemically synthesized
atttcctctgctgtgagtcact

SEQ ID NO: 1338626 - DNA, 22 bp, Artificial Sequence
  chemically synthesized
ccaaaaagtgactcacagcaga

SEQ ID NO: 1338627 - DNA, 22 bp, Artificial Sequence
  chemically synthesized
atggcgagtaaattaatttcct

SEQ ID NO: 1338628 - DNA, 22 bp, Artificial Sequence
  chemically synthesized
catggcgagtaaattaatttcc

SEQ ID NO: 1338629 - DNA, 22 bp, Artificial Sequence
  chemically synthesized
tcatggcgagtaaattaatttc

SEQ ID NO: 1338630 - DNA, 22 bp, Artificial Sequence
  chemically synthesized
acagcagaggaaattaatttac

SEQ ID NO: 1338631 - DNA, 22 bp, Artificial Sequence
  chemically synthesized
tgttttcatggcgagtaaatta

SEQ ID NO: 1338632 - DNA, 22 bp, Artificial Sequence
  chemically synthesized
agaattgtgttttcatggcgag

SEQ ID NO: 1338633 - DNA, 22 bp, Artificial Sequence
  chemically synthesized
atttactcgccatgaaaacaca

SEQ ID NO: 1338634 - DNA, 22 bp, Artificial Sequence
  chemically synthesized
ggatcattaagaattgtgtttt

SEQ ID NO: 1338635 - DNA, 22 bp, Artificial Sequence
  chemically synthesized
actcgccatgaaaacacaattc

SEQ ID NO: 1338636 - DNA, 22 bp, Artificial Sequence
  chemically synthesized
ctcgccatgaaaacacaattct

SEQ ID NO: 1338637 - DNA, 22 bp, Artificial Sequence
  chemically synthesized
gccatgaaaacacaattcttaa

SEQ ID NO: 1338638 - DNA, 22 bp, Artificial Sequence
  chemically synthesized
tcatagtgttgggatcattaag

SEQ ID NO: 1338639 - DNA, 22 bp, Artificial Sequence
  chemically synthesized
ggtactgtcatagtgttgggat

SEQ ID NO: 1338640 - DNA, 22 bp, Artificial Sequence
  chemically synthesized
aggtactgtcatagtgttggga

SEQ ID NO: 1338641 - DNA, 22 bp, Artificial Sequence
  chemically synthesized
taggtactgtcatagtgttggg

SEQ ID NO: 1338642 - DNA, 22 bp, Artificial Sequence
  chemically synthesized
ttaatgatcccaacactatgac

SEQ ID NO: 1338643 - DNA, 22 bp, Artificial Sequence
  chemically synthesized
aatgatcccaacactatgacag

SEQ ID NO: 1338644 - DNA, 22 bp, Artificial Sequence
  chemically synthesized
atgatcccaacactatgacagt

SEQ ID NO: 1338645 - DNA, 22 bp, Artificial Sequence
  chemically synthesized
tgacagtacctaaaatttcttg

SEQ ID NO: 1338646 - DNA, 22 bp, Artificial Sequence
  chemically synthesized
aaatttcttgtgtgtatatatt

SEQ ID NO: 1338647 - DNA, 22 bp, Artificial Sequence
  chemically synthesized
cttgtgtgtatatatttggaca

SEQ ID NO: 1338648 - DNA, 22 bp, Artificial Sequence
  chemically synthesized
ttgtgtgtatatatttggacac

SEQ ID NO: 1338649 - DNA, 22 bp, Artificial Sequence
  chemically synthesized
gtgtgtatatatttggacacac

SEQ ID NO: 1338650 - DNA, 22 bp, Artificial Sequence
  chemically synthesized
tgtgtatatatttggacacaca

SEQ ID NO: 1338651 - DNA, 22 bp, Artificial Sequence
  chemically synthesized
taaaatgtgtggacatgtgtgt

SEQ ID NO: 1338652 - DNA, 22 bp, Artificial Sequence
  chemically synthesized
ctataaaatgtgtggacatgtg

SEQ ID NO: 1338653 - DNA, 22 bp, Artificial Sequence
  chemically synthesized
gctataaaatgtgtggacatgt

SEQ ID NO: 1338654 - DNA, 22 bp, Artificial Sequence
  chemically synthesized
ttgctataaaatgtgtggacat

SEQ ID NO: 1338655 - DNA, 22 bp, Artificial Sequence
  chemically synthesized
ggacacacatgtccacacattt

SEQ ID NO: 1338656 - DNA, 22 bp, Artificial Sequence
  chemically synthesized
gacacacatgtccacacatttt

SEQ ID NO: 1338657 - DNA, 22 bp, Artificial Sequence
  chemically synthesized
tgttcttgctataaaatgtgtg

SEQ ID NO: 1338658 - DNA, 22 bp, Artificial Sequence
  chemically synthesized
atgttcttgctataaaatgtgt

SEQ ID NO: 1338659 - DNA, 22 bp, Artificial Sequence
  chemically synthesized
aaatgtttatgttcttgctata

SEQ ID NO: 1338660 - DNA, 22 bp, Artificial Sequence
  chemically synthesized
gaaatgtttatgttcttgctat

SEQ ID NO: 1338661 - DNA, 22 bp, Artificial Sequence
  chemically synthesized
agtttgaaatgtttatgttctt

SEQ ID NO: 1338662 - DNA, 22 bp, Artificial Sequence
  chemically synthesized
cagtttgaaatgtttatgttct

SEQ ID NO: 1338663 - DNA, 22 bp, Artificial Sequence
  chemically synthesized
tatagcaagaacataaacattt

SEQ ID NO: 1338664 - DNA, 22 bp, Artificial Sequence
  chemically synthesized
atagcaagaacataaacatttc

SEQ ID NO: 1338665 - DNA, 22 bp, Artificial Sequence
  chemically synthesized
tagcaagaacataaacatttca

SEQ ID NO: 1338666 - DNA, 22 bp, Artificial Sequence
  chemically synthesized
ggcatttcagtttgaaatgttt

SEQ ID NO: 1338667 - DNA, 22 bp, Artificial Sequence
  chemically synthesized
aggcatttcagtttgaaatgtt

SEQ ID NO: 1338668 - DNA, 22 bp, Artificial Sequence
  chemically synthesized
cttaggcatttcagtttgaaat

SEQ ID NO: 1338669 - DNA, 22 bp, Artificial Sequence
  chemically synthesized
agggttgcttaggcatttcagt

SEQ ID NO: 1338670 - DNA, 22 bp, Artificial Sequence
  chemically synthesized
aagggttgcttaggcatttcag

SEQ ID NO: 1338671 - DNA, 22 bp, Artificial Sequence
  chemically synthesized
taagggttgcttaggcatttca

SEQ ID NO: 1338672 - DNA, 22 bp, Artificial Sequence
  chemically synthesized
tctttaagggttgcttaggcat

SEQ ID NO: 1338673 - DNA, 22 bp, Artificial Sequence
  chemically synthesized
caaactgaaatgcctaagcaac

SEQ ID NO: 1338674 - DNA, 22 bp, Artificial Sequence
  chemically synthesized
aaactgaaatgcctaagcaacc

SEQ ID NO: 1338675 - DNA, 22 bp, Artificial Sequence
  chemically synthesized
aaatgcctaagcaacccttaaa

SEQ ID NO: 1338676 - DNA, 22 bp, Artificial Sequence
  chemically synthesized
acaaaagctatctttaagggtt

SEQ ID NO: 1338677 - DNA, 22 bp, Artificial Sequence
  chemically synthesized
gacaaaagctatctttaagggt

SEQ ID NO: 1338678 - DNA, 22 bp, Artificial Sequence
  chemically synthesized
gcttgacaaaagctatctttaa

SEQ ID NO: 1338679 - DNA, 22 bp, Artificial Sequence
  chemically synthesized
agcttgacaaaagctatcttta

SEQ ID NO: 1338680 - DNA, 22 bp, Artificial Sequence
  chemically synthesized
tagcttgacaaaagctatcttt

SEQ ID NO: 1338681 - DNA, 22 bp, Artificial Sequence
  chemically synthesized
agcaacccttaaagatagcttt

SEQ ID NO: 1338682 - DNA, 22 bp, Artificial Sequence
  chemically synthesized
accagattttagcttgacaaaa

SEQ ID NO: 1338683 - DNA, 22 bp, Artificial Sequence
  chemically synthesized
tcaccagattttagcttgacaa

SEQ ID NO: 1338684 - DNA, 22 bp, Artificial Sequence
  chemically synthesized
aaagatagcttttgtcaagcta

SEQ ID NO: 1338685 - DNA, 22 bp, Artificial Sequence
  chemically synthesized
ctcaccagattttagcttgaca

SEQ ID NO: 1338686 - DNA, 22 bp, Artificial Sequence
  chemically synthesized
aagatagcttttgtcaagctaa

SEQ ID NO: 1338687 - DNA, 22 bp, Artificial Sequence
  chemically synthesized
tctcaccagattttagcttgac

SEQ ID NO: 1338688 - DNA, 22 bp, Artificial Sequence
  chemically synthesized
attttctcaccagattttagct

SEQ ID NO: 1338689 - DNA, 22 bp, Artificial Sequence
  chemically synthesized
cattttctcaccagattttagc

SEQ ID NO: 1338690 - DNA, 22 bp, Artificial Sequence
  chemically synthesized
tcattttctcaccagattttag

SEQ ID NO: 1338691 - DNA, 22 bp, Artificial Sequence
  chemically synthesized
ttgtcaagctaaaatctggtga

SEQ ID NO: 1338692 - DNA, 22 bp, Artificial Sequence
  chemically synthesized
actttcattttctcaccagatt

SEQ ID NO: 1338693 - DNA, 22 bp, Artificial Sequence
  chemically synthesized
tgtcaagctaaaatctggtgag

SEQ ID NO: 1338694 - DNA, 22 bp, Artificial Sequence
  chemically synthesized
aactttcattttctcaccagat

SEQ ID NO: 1338695 - DNA, 22 bp, Artificial Sequence
  chemically synthesized
gtcaagctaaaatctggtgaga

SEQ ID NO: 1338696 - DNA, 22 bp, Artificial Sequence
  chemically synthesized
tcaagctaaaatctggtgagaa

SEQ ID NO: 1338697 - DNA, 22 bp, Artificial Sequence
  chemically synthesized
aaatctggtgagaaaatgaaag

SEQ ID NO: 1338698 - DNA, 22 bp, Artificial Sequence
  chemically synthesized
gtgagaaaatgaaagttaaggc

SEQ ID NO: 1338699 - DNA, 22 bp, Artificial Sequence
  chemically synthesized
aaaaaataaaataaaataaaag

SEQ ID NO: 1338700 - DNA, 22 bp, Artificial Sequence
  chemically synthesized
catctcaaaaaataaaataaaa

SEQ ID NO: 1338701 - DNA, 22 bp, Artificial Sequence
  chemically synthesized
aggcttttattttattttattt

SEQ ID NO: 1338702 - DNA, 22 bp, Artificial Sequence
  chemically synthesized
ttattttattttattttttgag

SEQ ID NO: 1338703 - DNA, 22 bp, Artificial Sequence
  chemically synthesized
tattttattttattttttgaga

SEQ ID NO: 1338704 - DNA, 22 bp, Artificial Sequence
  chemically synthesized
attttattttattttttgagat

SEQ ID NO: 1338705 - DNA, 22 bp, Artificial Sequence
  chemically synthesized
ttttattttattttttgagatg

SEQ ID NO: 1338706 - DNA, 22 bp, Artificial Sequence
  chemically synthesized
tattttattttttgagatggag

SEQ ID NO: 1338707 - DNA, 22 bp, Artificial Sequence
  chemically synthesized
attttattttttgagatggagt

SEQ ID NO: 1338708 - DNA, 22 bp, Artificial Sequence
  chemically synthesized
ttttattttttgagatggagtt

SEQ ID NO: 1338709 - DNA, 22 bp, Artificial Sequence
  chemically synthesized
ggcaacaagagtgaaactccat

SEQ ID NO: 1338710 - DNA, 22 bp, Artificial Sequence
  chemically synthesized
tattttttgagatggagtttca

SEQ ID NO: 1338711 - DNA, 22 bp, Artificial Sequence
  chemically synthesized
attttttgagatggagtttcac

SEQ ID NO: 1338712 - DNA, 22 bp, Artificial Sequence
  chemically synthesized
ttttttgagatggagtttcact

SEQ ID NO: 1338713 - DNA, 22 bp, Artificial Sequence
  chemically synthesized
tttgagatggagtttcactctt

SEQ ID NO: 1338714 - DNA, 22 bp, Artificial Sequence
  chemically synthesized
ttgagatggagtttcactcttg

SEQ ID NO: 1338715 - DNA, 22 bp, Artificial Sequence
  chemically synthesized
cagcctgggcaacaagagtgaa

SEQ ID NO: 1338716 - DNA, 22 bp, Artificial Sequence
  chemically synthesized
tgagatggagtttcactcttgt

SEQ ID NO: 1338717 - DNA, 22 bp, Artificial Sequence
  chemically synthesized
gagatggagtttcactcttgtt

SEQ ID NO: 1338718 - DNA, 22 bp, Artificial Sequence
  chemically synthesized
agatggagtttcactcttgttg

SEQ ID NO: 1338719 - DNA, 22 bp, Artificial Sequence
  chemically synthesized
cactccagcctgggcaacaaga

SEQ ID NO: 1338720 - DNA, 22 bp, Artificial Sequence
  chemically synthesized
tgccattgcactccagcctggg

SEQ ID NO: 1338721 - DNA, 22 bp, Artificial Sequence
  chemically synthesized
cactcttgttgcccaggctgga

SEQ ID NO: 1338722 - DNA, 22 bp, Artificial Sequence
  chemically synthesized
actcttgttgcccaggctggag

SEQ ID NO: 1338723 - DNA, 22 bp, Artificial Sequence
  chemically synthesized
ttgttgcccaggctggagtgca

SEQ ID NO: 1338724 - DNA, 22 bp, Artificial Sequence
  chemically synthesized
gttgcccaggctggagtgcaat

SEQ ID NO: 1338725 - DNA, 22 bp, Artificial Sequence
  chemically synthesized
ttgcccaggctggagtgcaatg

SEQ ID NO: 1338726 - DNA, 22 bp, Artificial Sequence
  chemically synthesized
cccaggctggagtgcaatggca

SEQ ID NO: 1338727 - DNA, 22 bp, Artificial Sequence
  chemically synthesized
cagtgagcggagattgtgccat

SEQ ID NO: 1338728 - DNA, 22 bp, Artificial Sequence
  chemically synthesized
gagtgcaatggcacaatctccg

SEQ ID NO: 1338729 - DNA, 22 bp, Artificial Sequence
  chemically synthesized
ggaggcggaggttgcagtgagc

SEQ ID NO: 1338730 - DNA, 22 bp, Artificial Sequence
  chemically synthesized
aagctgggaggcggaggttgca

SEQ ID NO: 1338731 - DNA, 22 bp, Artificial Sequence
  chemically synthesized
gaagctgggaggcggaggttgc

SEQ ID NO: 1338732 - DNA, 22 bp, Artificial Sequence
  chemically synthesized
cttgaagctgggaggcggaggt

SEQ ID NO: 1338733 - DNA, 22 bp, Artificial Sequence
  chemically synthesized
cgctcactgcaacctccgcctc

SEQ ID NO: 1338734 - DNA, 22 bp, Artificial Sequence
  chemically synthesized
actgcaacctccgcctcccagc

SEQ ID NO: 1338735 - DNA, 22 bp, Artificial Sequence
  chemically synthesized
caacctccgcctcccagcttca

SEQ ID NO: 1338736 - DNA, 22 bp, Artificial Sequence
  chemically synthesized
agacaggagaactgcttgaagc

SEQ ID NO: 1338737 - DNA, 22 bp, Artificial Sequence
  chemically synthesized
cgcctcccagcttcaagcagtt

SEQ ID NO: 1338738 - DNA, 22 bp, Artificial Sequence
  chemically synthesized
ggaggctgagacaggagaactg

SEQ ID NO: 1338739 - DNA, 22 bp, Artificial Sequence
  chemically synthesized
ccagcttcaagcagttctcctg

SEQ ID NO: 1338740 - DNA, 22 bp, Artificial Sequence
  chemically synthesized
gggaggctgagacaggagaact

SEQ ID NO: 1338741 - DNA, 22 bp, Artificial Sequence
  chemically synthesized
cttgggaggctgagacaggaga

SEQ ID NO: 1338742 - DNA, 22 bp, Artificial Sequence
  chemically synthesized
caagcagttctcctgtctcagc

SEQ ID NO: 1338743 - DNA, 22 bp, Artificial Sequence
  chemically synthesized
aagcagttctcctgtctcagcc

SEQ ID NO: 1338744 - DNA, 22 bp, Artificial Sequence
  chemically synthesized
taatcccagctacttgggaggc

SEQ ID NO: 1338745 - DNA, 22 bp, Artificial Sequence
  chemically synthesized
tcctgtctcagcctcccaagta

SEQ ID NO: 1338746 - DNA, 22 bp, Artificial Sequence
  chemically synthesized
ctgtctcagcctcccaagtagc

SEQ ID NO: 1338747 - DNA, 22 bp, Artificial Sequence
  chemically synthesized
tctcagcctcccaagtagctgg

SEQ ID NO: 1338748 - DNA, 22 bp, Artificial Sequence
  chemically synthesized
agcctcccaagtagctgggatt

SEQ ID NO: 1338749 - DNA, 22 bp, Artificial Sequence
  chemically synthesized
ccaagtagctgggattacaggc

SEQ ID NO: 1338750 - DNA, 22 bp, Artificial Sequence
  chemically synthesized
gccgagcatggtggcacatgcc

SEQ ID NO: 1338751 - DNA, 22 bp, Artificial Sequence
  chemically synthesized
ggattacaggcatgtgccacca

SEQ ID NO: 1338752 - DNA, 22 bp, Artificial Sequence
  chemically synthesized
caggcatgtgccaccatgctcg

SEQ ID NO: 1338753 - DNA, 22 bp, Artificial Sequence
  chemically synthesized
aaaacgcaaaattagccgagca

SEQ ID NO: 1338754 - DNA, 22 bp, Artificial Sequence
  chemically synthesized
ctaaaaacgcaaaattagccga

SEQ ID NO: 1338755 - DNA, 22 bp, Artificial Sequence
  chemically synthesized
tactaaaaacgcaaaattagcc

SEQ ID NO: 1338756 - DNA, 22 bp, Artificial Sequence
  chemically synthesized
tctactaaaaacgcaaaattag

SEQ ID NO: 1338757 - DNA, 22 bp, Artificial Sequence
  chemically synthesized
ctctactaaaaacgcaaaatta

SEQ ID NO: 1338758 - DNA, 22 bp, Artificial Sequence
  chemically synthesized
tctctactaaaaacgcaaaatt

SEQ ID NO: 1338759 - DNA, 22 bp, Artificial Sequence
  chemically synthesized
ggctaattttgcgtttttagta

SEQ ID NO: 1338760 - DNA, 22 bp, Artificial Sequence
  chemically synthesized
attttgcgtttttagtagagaa

SEQ ID NO: 1338761 - DNA, 22 bp, Artificial Sequence
  chemically synthesized
tgcgtttttagtagagaaaggg

SEQ ID NO: 1338762 - DNA, 22 bp, Artificial Sequence
  chemically synthesized
gcgtttttagtagagaaagggt

SEQ ID NO: 1338763 - DNA, 22 bp, Artificial Sequence
  chemically synthesized
cgtttttagtagagaaagggtt

SEQ ID NO: 1338764 - DNA, 22 bp, Artificial Sequence
  chemically synthesized
atcaacatggtgaaaccctttc

SEQ ID NO: 1338765 - DNA, 22 bp, Artificial Sequence
  chemically synthesized
ttagtagagaaagggtttcacc

SEQ ID NO: 1338766 - DNA, 22 bp, Artificial Sequence
  chemically synthesized
tagtagagaaagggtttcacca

SEQ ID NO: 1338767 - DNA, 22 bp, Artificial Sequence
  chemically synthesized
agtagagaaagggtttcaccat

SEQ ID NO: 1338768 - DNA, 22 bp, Artificial Sequence
  chemically synthesized
gtagagaaagggtttcaccatg

SEQ ID NO: 1338769 - DNA, 22 bp, Artificial Sequence
  chemically synthesized
cagaccagcctgatcaacatgg

SEQ ID NO: 1338770 - DNA, 22 bp, Artificial Sequence
  chemically synthesized
caccatgttgatcaggctggtc

SEQ ID NO: 1338771 - DNA, 22 bp, Artificial Sequence
  chemically synthesized
accatgttgatcaggctggtct

SEQ ID NO: 1338772 - DNA, 22 bp, Artificial Sequence
  chemically synthesized
aggtcaggagttccagaccagc

SEQ ID NO: 1338773 - DNA, 22 bp, Artificial Sequence
  chemically synthesized
atcaggctggtctggaactcct

SEQ ID NO: 1338774 - DNA, 22 bp, Artificial Sequence
  chemically synthesized
gtctggaactcctgacctcagg

SEQ ID NO: 1338775 - DNA, 22 bp, Artificial Sequence
  chemically synthesized
gaactcctgacctcaggtgatc

SEQ ID NO: 1338776 - DNA, 22 bp, Artificial Sequence
  chemically synthesized
ggaggccaaggcgggtggatca

SEQ ID NO: 1338777 - DNA, 22 bp, Artificial Sequence
  chemically synthesized
ctgacctcaggtgatccacccg

SEQ ID NO: 1338778 - DNA, 22 bp, Artificial Sequence
  chemically synthesized
gggaggccaaggcgggtggatc

SEQ ID NO: 1338779 - DNA, 22 bp, Artificial Sequence
  chemically synthesized
tgggaggccaaggcgggtggat

SEQ ID NO: 1338780 - DNA, 22 bp, Artificial Sequence
  chemically synthesized
acctcaggtgatccacccgcct

SEQ ID NO: 1338781 - DNA, 22 bp, Artificial Sequence
  chemically synthesized
aggtgatccacccgccttggcc

SEQ ID NO: 1338782 - DNA, 22 bp, Artificial Sequence
  chemically synthesized
taatcccagtactttgggaggc

SEQ ID NO: 1338783 - DNA, 22 bp, Artificial Sequence
  chemically synthesized
acgcctgtaatcccagtacttt

SEQ ID NO: 1338784 - DNA, 22 bp, Artificial Sequence
  chemically synthesized
ggcctcccaaagtactgggatt

SEQ ID NO: 1338785 - DNA, 22 bp, Artificial Sequence
  chemically synthesized
gcctcccaaagtactgggatta

SEQ ID NO: 1338786 - DNA, 22 bp, Artificial Sequence
  chemically synthesized
ccaaagtactgggattacaggc

SEQ ID NO: 1338787 - DNA, 22 bp, Artificial Sequence
  chemically synthesized
gccgggcacagcggctcacgcc

SEQ ID NO: 1338788 - DNA, 22 bp, Artificial Sequence
  chemically synthesized
ggattacaggcgtgagccgctg

SEQ ID NO: 1338789 - DNA, 22 bp, Artificial Sequence
  chemically synthesized
aaagcctcgccgggcacagcgg

SEQ ID NO: 1338790 - DNA, 22 bp, Artificial Sequence
  chemically synthesized
aaaagcctcgccgggcacagcg

SEQ ID NO: 1338791 - DNA, 22 bp, Artificial Sequence
  chemically synthesized
caggcgtgagccgctgtgcccg

SEQ ID NO: 1338792 - DNA, 22 bp, Artificial Sequence
  chemically synthesized
accaatttaaaagcctcgccgg

SEQ ID NO: 1338793 - DNA, 22 bp, Artificial Sequence
  chemically synthesized
caccaatttaaaagcctcgccg

SEQ ID NO: 1338794 - DNA, 22 bp, Artificial Sequence
  chemically synthesized
tcaccaatttaaaagcctcgcc

SEQ ID NO: 1338795 - DNA, 22 bp, Artificial Sequence
  chemically synthesized
gcattttcaccaatttaaaagc

SEQ ID NO: 1338796 - DNA, 22 bp, Artificial Sequence
  chemically synthesized
tgcccggcgaggcttttaaatt

SEQ ID NO: 1338797 - DNA, 22 bp, Artificial Sequence
  chemically synthesized
aatggttggcattttcaccaat

SEQ ID NO: 1338798 - DNA, 22 bp, Artificial Sequence
  chemically synthesized
ttaaattggtgaaaatgccaac

SEQ ID NO: 1338799 - DNA, 22 bp, Artificial Sequence
  chemically synthesized
taaattggtgaaaatgccaacc

SEQ ID NO: 1338800 - DNA, 22 bp, Artificial Sequence
  chemically synthesized
aaattggtgaaaatgccaacca

SEQ ID NO: 1338801 - DNA, 22 bp, Artificial Sequence
  chemically synthesized
aattggtgaaaatgccaaccat

SEQ ID NO: 1338802 - DNA, 22 bp, Artificial Sequence
  chemically synthesized
aaagtaaaaattgaatggttgg

SEQ ID NO: 1338803 - DNA, 22 bp, Artificial Sequence
  chemically synthesized
gtgaaaatgccaaccattcaat

SEQ ID NO: 1338804 - DNA, 22 bp, Artificial Sequence
  chemically synthesized
ttcaaagtaaaaattgaatggt

SEQ ID NO: 1338805 - DNA, 22 bp, Artificial Sequence
  chemically synthesized
attattcaaagtaaaaattgaa

SEQ ID NO: 1338806 - DNA, 22 bp, Artificial Sequence
  chemically synthesized
gattattcaaagtaaaaattga

SEQ ID NO: 1338807 - DNA, 22 bp, Artificial Sequence
  chemically synthesized
tgattattcaaagtaaaaattg

SEQ ID NO: 1338808 - DNA, 22 bp, Artificial Sequence
  chemically synthesized
agttttgattattcaaagtaaa

SEQ ID NO: 1338809 - DNA, 22 bp, Artificial Sequence
  chemically synthesized
cagttttgattattcaaagtaa

SEQ ID NO: 1338810 - DNA, 22 bp, Artificial Sequence
  chemically synthesized
aatttttactttgaataatcaa

SEQ ID NO: 1338811 - DNA, 22 bp, Artificial Sequence
  chemically synthesized
aatcacttcagttttgattatt

SEQ ID NO: 1338812 - DNA, 22 bp, Artificial Sequence
  chemically synthesized
gaatcacttcagttttgattat

SEQ ID NO: 1338813 - DNA, 22 bp, Artificial Sequence
  chemically synthesized
ttactttgaataatcaaaactg

SEQ ID NO: 1338814 - DNA, 22 bp, Artificial Sequence
  chemically synthesized
cttgaatcacttcagttttgat

SEQ ID NO: 1338815 - DNA, 22 bp, Artificial Sequence
  chemically synthesized
tactttgaataatcaaaactga

SEQ ID NO: 1338816 - DNA, 22 bp, Artificial Sequence
  chemically synthesized
actttgaataatcaaaactgaa

SEQ ID NO: 1338817 - DNA, 22 bp, Artificial Sequence
  chemically synthesized
ctttgaataatcaaaactgaag

SEQ ID NO: 1338818 - DNA, 22 bp, Artificial Sequence
  chemically synthesized
tgaataatcaaaactgaagtga

SEQ ID NO: 1338819 - DNA, 22 bp, Artificial Sequence
  chemically synthesized
gaataatcaaaactgaagtgat

SEQ ID NO: 1338820 - DNA, 22 bp, Artificial Sequence
  chemically synthesized
aataatcaaaactgaagtgatt

SEQ ID NO: 1338821 - DNA, 22 bp, Artificial Sequence
  chemically synthesized
gatgatgaatcactacttgaat

SEQ ID NO: 1338822 - DNA, 22 bp, Artificial Sequence
  chemically synthesized
cactggatgatgaatcactact

SEQ ID NO: 1338823 - DNA, 22 bp, Artificial Sequence
  chemically synthesized
aagtgattcaagtagtgattca

SEQ ID NO: 1338824 - DNA, 22 bp, Artificial Sequence
  chemically synthesized
gattacactggatgatgaatca

SEQ ID NO: 1338825 - DNA, 22 bp, Artificial Sequence
  chemically synthesized
tgctagattacactggatgatg

SEQ ID NO: 1338826 - DNA, 22 bp, Artificial Sequence
  chemically synthesized
aagtagtgattcatcatccagt

SEQ ID NO: 1338827 - DNA, 22 bp, Artificial Sequence
  chemically synthesized
ctgtgctagattacactggatg

SEQ ID NO: 1338828 - DNA, 22 bp, Artificial Sequence
  chemically synthesized
cattgctgtgctagattacact

SEQ ID NO: 1338829 - DNA, 22 bp, Artificial Sequence
  chemically synthesized
atcatccagtgtaatctagcac

SEQ ID NO: 1338830 - DNA, 22 bp, Artificial Sequence
  chemically synthesized
acacaaaatctccattgctgtg

SEQ ID NO: 1338831 - DNA, 22 bp, Artificial Sequence
  chemically synthesized
cacacaaaatctccattgctgt

SEQ ID NO: 1338832 - DNA, 22 bp, Artificial Sequence
  chemically synthesized
gtatgtttcacacaaaatctcc

SEQ ID NO: 1338833 - DNA, 22 bp, Artificial Sequence
  chemically synthesized
ggtatgtttcacacaaaatctc

SEQ ID NO: 1338834 - DNA, 22 bp, Artificial Sequence
  chemically synthesized
gcacagcaatggagattttgtg

SEQ ID NO: 1338835 - DNA, 22 bp, Artificial Sequence
  chemically synthesized
tggtatgtttcacacaaaatct

SEQ ID NO: 1338836 - DNA, 22 bp, Artificial Sequence
  chemically synthesized
ctttggtatgtttcacacaaaa

SEQ ID NO: 1338837 - DNA, 22 bp, Artificial Sequence
  chemically synthesized
cctttggtatgtttcacacaaa

SEQ ID NO: 1338838 - DNA, 22 bp, Artificial Sequence
  chemically synthesized
tcctttggtatgtttcacacaa

SEQ ID NO: 1338839 - DNA, 22 bp, Artificial Sequence
  chemically synthesized
tgtgtgaaacataccaaaggaa

SEQ ID NO: 1338840 - DNA, 22 bp, Artificial Sequence
  chemically synthesized
gtgtgaaacataccaaaggaaa

SEQ ID NO: 1338841 - DNA, 22 bp, Artificial Sequence
  chemically synthesized
tgtgaaacataccaaaggaaag

SEQ ID NO: 1338842 - DNA, 22 bp, Artificial Sequence
  chemically synthesized
aaaaccccaaacctttcctttg

SEQ ID NO: 1338843 - DNA, 22 bp, Artificial Sequence
  chemically synthesized
cgcaattaaaaaccccaaacct

SEQ ID NO: 1338844 - DNA, 22 bp, Artificial Sequence
  chemically synthesized
gtcaattacgcaattaaaaacc

SEQ ID NO: 1338845 - DNA, 22 bp, Artificial Sequence
  chemically synthesized
ggggtttttaattgcgtaattg

SEQ ID NO: 1338846 - DNA, 22 bp, Artificial Sequence
  chemically synthesized
gggtttttaattgcgtaattga

SEQ ID NO: 1338847 - DNA, 22 bp, Artificial Sequence
  chemically synthesized
ttaattgcgtaattgactaatt

SEQ ID NO: 1338848 - DNA, 22 bp, Artificial Sequence
  chemically synthesized
taattgcgtaattgactaattc

SEQ ID NO: 1338849 - DNA, 22 bp, Artificial Sequence
  chemically synthesized
aattgcgtaattgactaattct

SEQ ID NO: 1338850 - DNA, 22 bp, Artificial Sequence
  chemically synthesized
attgcgtaattgactaattctt

SEQ ID NO: 1338851 - DNA, 22 bp, Artificial Sequence
  chemically synthesized
cgtaattgactaattcttgggc

SEQ ID NO: 1338852 - DNA, 22 bp, Artificial Sequence
  chemically synthesized
agggaaggaggtgcccaagaat

SEQ ID NO: 1338853 - DNA, 22 bp, Artificial Sequence
  chemically synthesized
attgagggaaggaggtgcccaa

SEQ ID NO: 1338854 - DNA, 22 bp, Artificial Sequence
  chemically synthesized
gattgagggaaggaggtgccca

SEQ ID NO: 1338855 - DNA, 22 bp, Artificial Sequence
  chemically synthesized
tgattgagggaaggaggtgccc

SEQ ID NO: 1338856 - DNA, 22 bp, Artificial Sequence
  chemically synthesized
actaattcttgggcacctcctt

SEQ ID NO: 1338857 - DNA, 22 bp, Artificial Sequence
  chemically synthesized
attcttgggcacctccttccct

SEQ ID NO: 1338858 - DNA, 22 bp, Artificial Sequence
  chemically synthesized
ttgggcacctccttccctcaat

SEQ ID NO: 1338859 - DNA, 22 bp, Artificial Sequence
  chemically synthesized
gggcacctccttccctcaatca

SEQ ID NO: 1338860 - DNA, 22 bp, Artificial Sequence
  chemically synthesized
ggcacctccttccctcaatcaa

SEQ ID NO: 1338861 - DNA, 22 bp, Artificial Sequence
  chemically synthesized
agatgatgtatctttgattgag

SEQ ID NO: 1338862 - DNA, 22 bp, Artificial Sequence
  chemically synthesized
ttcagatgatgtatctttgatt

SEQ ID NO: 1338863 - DNA, 22 bp, Artificial Sequence
  chemically synthesized
cttccctcaatcaaagatacat

SEQ ID NO: 1338864 - DNA, 22 bp, Artificial Sequence
  chemically synthesized
ccctcaatcaaagatacatcat

SEQ ID NO: 1338865 - DNA, 22 bp, Artificial Sequence
  chemically synthesized
tgaactattcagatgatgtatc

SEQ ID NO: 1338866 - DNA, 22 bp, Artificial Sequence
  chemically synthesized
cctcaatcaaagatacatcatc

SEQ ID NO: 1338867 - DNA, 22 bp, Artificial Sequence
  chemically synthesized
aatcaaagatacatcatctgaa

SEQ ID NO: 1338868 - DNA, 22 bp, Artificial Sequence
  chemically synthesized
gggggaggctgtgaactattca

SEQ ID NO: 1338869 - DNA, 22 bp, Artificial Sequence
  chemically synthesized
ttcgggggaggctgtgaactat

SEQ ID NO: 1338870 - DNA, 22 bp, Artificial Sequence
  chemically synthesized
attcgggggaggctgtgaacta

SEQ ID NO: 1338871 - DNA, 22 bp, Artificial Sequence
  chemically synthesized
atttattcgggggaggctgtga

SEQ ID NO: 1338872 - DNA, 22 bp, Artificial Sequence
  chemically synthesized
catttattcgggggaggctgtg

SEQ ID NO: 1338873 - DNA, 22 bp, Artificial Sequence
  chemically synthesized
tcatttattcgggggaggctgt

SEQ ID NO: 1338874 - DNA, 22 bp, Artificial Sequence
  chemically synthesized
aatagttcacagcctcccccga

SEQ ID NO: 1338875 - DNA, 22 bp, Artificial Sequence
  chemically synthesized
tcactttcatttattcggggga

SEQ ID NO: 1338876 - DNA, 22 bp, Artificial Sequence
  chemically synthesized
acagcctcccccgaataaatga

SEQ ID NO: 1338877 - DNA, 22 bp, Artificial Sequence
  chemically synthesized
ccccgaataaatgaaagtgaca

SEQ ID NO: 1338878 - DNA, 22 bp, Artificial Sequence
  chemically synthesized
agaaatacagagcctgtcactt

SEQ ID NO: 1338879 - DNA, 22 bp, Artificial Sequence
  chemically synthesized
aaaggcgtcaaattaagaaata

SEQ ID NO: 1338880 - DNA, 22 bp, Artificial Sequence
  chemically synthesized
gaaaggcgtcaaattaagaaat

SEQ ID NO: 1338881 - DNA, 22 bp, Artificial Sequence
  chemically synthesized
tgaaaggcgtcaaattaagaaa

SEQ ID NO: 1338882 - DNA, 22 bp, Artificial Sequence
  chemically synthesized
tctttgaaaggcgtcaaattaa

SEQ ID NO: 1338883 - DNA, 22 bp, Artificial Sequence
  chemically synthesized
atctttgaaaggcgtcaaatta

SEQ ID NO: 1338884 - DNA, 22 bp, Artificial Sequence
  chemically synthesized
tgtatttcttaatttgacgcct

SEQ ID NO: 1338885 - DNA, 22 bp, Artificial Sequence
  chemically synthesized
tatttcttaatttgacgccttt

SEQ ID NO: 1338886 - DNA, 22 bp, Artificial Sequence
  chemically synthesized
accttatctttgaaaggcgtca

SEQ ID NO: 1338887 - DNA, 22 bp, Artificial Sequence
  chemically synthesized
cttaatttgacgcctttcaaag

SEQ ID NO: 1338888 - DNA, 22 bp, Artificial Sequence
  chemically synthesized
cattaaccttatctttgaaagg

SEQ ID NO: 1338889 - DNA, 22 bp, Artificial Sequence
  chemically synthesized
ttaatttgacgcctttcaaaga

SEQ ID NO: 1338890 - DNA, 22 bp, Artificial Sequence
  chemically synthesized
aatttgacgcctttcaaagata

SEQ ID NO: 1338891 - DNA, 22 bp, Artificial Sequence
  chemically synthesized
atttgacgcctttcaaagataa

SEQ ID NO: 1338892 - DNA, 22 bp, Artificial Sequence
  chemically synthesized
attccattaaccttatctttga

SEQ ID NO: 1338893 - DNA, 22 bp, Artificial Sequence
  chemically synthesized
aattccattaaccttatctttg

SEQ ID NO: 1338894 - DNA, 22 bp, Artificial Sequence
  chemically synthesized
gacgcctttcaaagataaggtt

SEQ ID NO: 1338895 - DNA, 22 bp, Artificial Sequence
  chemically synthesized
cttaattccattaaccttatct

SEQ ID NO: 1338896 - DNA, 22 bp, Artificial Sequence
  chemically synthesized
acgcctttcaaagataaggtta

SEQ ID NO: 1338897 - DNA, 22 bp, Artificial Sequence
  chemically synthesized
tggttacttaattccattaacc

SEQ ID NO: 1338898 - DNA, 22 bp, Artificial Sequence
  chemically synthesized
atggttacttaattccattaac

SEQ ID NO: 1338899 - DNA, 22 bp, Artificial Sequence
  chemically synthesized
tcaaagataaggttaatggaat

SEQ ID NO: 1338900 - DNA, 22 bp, Artificial Sequence
  chemically synthesized
tatggttacttaattccattaa

SEQ ID NO: 1338901 - DNA, 22 bp, Artificial Sequence
  chemically synthesized
caaagataaggttaatggaatt

SEQ ID NO: 1338902 - DNA, 22 bp, Artificial Sequence
  chemically synthesized
aaagataaggttaatggaatta

SEQ ID NO: 1338903 - DNA, 22 bp, Artificial Sequence
  chemically synthesized
caataatctttatggttactta

SEQ ID NO: 1338904 - DNA, 22 bp, Artificial Sequence
  chemically synthesized
acaataatctttatggttactt

SEQ ID NO: 1338905 - DNA, 22 bp, Artificial Sequence
  chemically synthesized
atggaattaagtaaccataaag

SEQ ID NO: 1338906 - DNA, 22 bp, Artificial Sequence
  chemically synthesized
atttacaataatctttatggtt

SEQ ID NO: 1338907 - DNA, 22 bp, Artificial Sequence
  chemically synthesized
aatttacaataatctttatggt

SEQ ID NO: 1338908 - DNA, 22 bp, Artificial Sequence
  chemically synthesized
agtaaccataaagattattgta

SEQ ID NO: 1338909 - DNA, 22 bp, Artificial Sequence
  chemically synthesized
aggatataacatttaatttaca

SEQ ID NO: 1338910 - DNA, 22 bp, Artificial Sequence
  chemically synthesized
agacatctaaggatataacatt

SEQ ID NO: 1338911 - DNA, 22 bp, Artificial Sequence
  chemically synthesized
ttgtaaattaaatgttatatcc

SEQ ID NO: 1338912 - DNA, 22 bp, Artificial Sequence
  chemically synthesized
actcagacatctaaggatataa

SEQ ID NO: 1338913 - DNA, 22 bp, Artificial Sequence
  chemically synthesized
taaattaaatgttatatcctta

SEQ ID NO: 1338914 - DNA, 22 bp, Artificial Sequence
  chemically synthesized
aattaactcagacatctaagga

SEQ ID NO: 1338915 - DNA, 22 bp, Artificial Sequence
  chemically synthesized
aatgttatatccttagatgtct

SEQ ID NO: 1338916 - DNA, 22 bp, Artificial Sequence
  chemically synthesized
tatccttagatgtctgagttaa

SEQ ID NO: 1338917 - DNA, 22 bp, Artificial Sequence
  chemically synthesized
aaatgcattaaattaactcaga

SEQ ID NO: 1338918 - DNA, 22 bp, Artificial Sequence
  chemically synthesized
ttgaaatgcattaaattaactc

SEQ ID NO: 1338919 - DNA, 22 bp, Artificial Sequence
  chemically synthesized
attgaaatgcattaaattaact

SEQ ID NO: 1338920 - DNA, 22 bp, Artificial Sequence
  chemically synthesized
agatgtctgagttaatttaatg

SEQ ID NO: 1338921 - DNA, 22 bp, Artificial Sequence
  chemically synthesized
gatgtctgagttaatttaatgc

SEQ ID NO: 1338922 - DNA, 22 bp, Artificial Sequence
  chemically synthesized
atatttattgaaatgcattaaa

SEQ ID NO: 1338923 - DNA, 22 bp, Artificial Sequence
  chemically synthesized
acctcatatttattgaaatgca

SEQ ID NO: 1338924 - DNA, 22 bp, Artificial Sequence
  chemically synthesized
agttaatttaatgcatttcaat

SEQ ID NO: 1338925 - DNA, 22 bp, Artificial Sequence
  chemically synthesized
ctaacctcatatttattgaaat

SEQ ID NO: 1338926 - DNA, 22 bp, Artificial Sequence
  chemically synthesized
cctaacctcatatttattgaaa

SEQ ID NO: 1338927 - DNA, 22 bp, Artificial Sequence
  chemically synthesized
atttaatgcatttcaataaata

SEQ ID NO: 1338928 - DNA, 22 bp, Artificial Sequence
  chemically synthesized
tgtttcctaacctcatatttat

SEQ ID NO: 1338929 - DNA, 22 bp, Artificial Sequence
  chemically synthesized
aatgcatttcaataaatatgag

SEQ ID NO: 1338930 - DNA, 22 bp, Artificial Sequence
  chemically synthesized
atgtttcctaacctcatattta

SEQ ID NO: 1338931 - DNA, 22 bp, Artificial Sequence
  chemically synthesized
atgcatttcaataaatatgagg

SEQ ID NO: 1338932 - DNA, 22 bp, Artificial Sequence
  chemically synthesized
tatgtttcctaacctcatattt

SEQ ID NO: 1338933 - DNA, 22 bp, Artificial Sequence
  chemically synthesized
ttatgtttcctaacctcatatt

SEQ ID NO: 1338934 - DNA, 22 bp, Artificial Sequence
  chemically synthesized
tttatgtttcctaacctcatat

SEQ ID NO: 1338935 - DNA, 22 bp, Artificial Sequence
  chemically synthesized
ctttttatgtttcctaacctca

SEQ ID NO: 1338936 - DNA, 22 bp, Artificial Sequence
  chemically synthesized
cctttttatgtttcctaacctc

SEQ ID NO: 1338937 - DNA, 22 bp, Artificial Sequence
  chemically synthesized
tcctttttatgtttcctaacct

SEQ ID NO: 1338938 - DNA, 22 bp, Artificial Sequence
  chemically synthesized
caataaatatgaggttaggaaa

SEQ ID NO: 1338939 - DNA, 22 bp, Artificial Sequence
  chemically synthesized
aataaatatgaggttaggaaac

SEQ ID NO: 1338940 - DNA, 22 bp, Artificial Sequence
  chemically synthesized
gtaccataaattttccttttta

SEQ ID NO: 1338941 - DNA, 22 bp, Artificial Sequence
  chemically synthesized
ggaaacataaaaaggaaaattt

SEQ ID NO: 1338942 - DNA, 22 bp, Artificial Sequence
  chemically synthesized
aattagtaccataaattttcct

SEQ ID NO: 1338943 - DNA, 22 bp, Artificial Sequence
  chemically synthesized
aaattagtaccataaattttcc

SEQ ID NO: 1338944 - DNA, 22 bp, Artificial Sequence
  chemically synthesized
atggtactaatttaaatggtac

SEQ ID NO: 1338945 - DNA, 22 bp, Artificial Sequence
  chemically synthesized
tggtactaatttaaatggtacc

SEQ ID NO: 1338946 - DNA, 22 bp, Artificial Sequence
  chemically synthesized
atttaaatggtacctttccaca

SEQ ID NO: 1338947 - DNA, 22 bp, Artificial Sequence
  chemically synthesized
gcacgcacaagagatgtggaaa

SEQ ID NO: 1338948 - DNA, 22 bp, Artificial Sequence
  chemically synthesized
agcacgcacaagagatgtggaa

SEQ ID NO: 1338949 - DNA, 22 bp, Artificial Sequence
  chemically synthesized
aaatggtacctttccacatctc

SEQ ID NO: 1338950 - DNA, 22 bp, Artificial Sequence
  chemically synthesized
tagcacgcacaagagatgtgga

SEQ ID NO: 1338951 - DNA, 22 bp, Artificial Sequence
  chemically synthesized
aatggtacctttccacatctct

SEQ ID NO: 1338952 - DNA, 22 bp, Artificial Sequence
  chemically synthesized
tgctttagcacgcacaagagat

SEQ ID NO: 1338953 - DNA, 22 bp, Artificial Sequence
  chemically synthesized
tccacatctcttgtgcgtgcta

SEQ ID NO: 1338954 - DNA, 22 bp, Artificial Sequence
  chemically synthesized
ccacatctcttgtgcgtgctaa

SEQ ID NO: 1338955 - DNA, 22 bp, Artificial Sequence
  chemically synthesized
cacatctcttgtgcgtgctaaa

SEQ ID NO: 1338956 - DNA, 22 bp, Artificial Sequence
  chemically synthesized
ttgtgcgtgctaaagcataggc

SEQ ID NO: 1338957 - DNA, 22 bp, Artificial Sequence
  chemically synthesized
acaaacataaaagcctatgctt

SEQ ID NO: 1338958 - DNA, 22 bp, Artificial Sequence
  chemically synthesized
gtgcgtgctaaagcataggctt

SEQ ID NO: 1338959 - DNA, 22 bp, Artificial Sequence
  chemically synthesized
tgcgtgctaaagcataggcttt

SEQ ID NO: 1338960 - DNA, 22 bp, Artificial Sequence
  chemically synthesized
tgagttgacaaacataaaagcc

SEQ ID NO: 1338961 - DNA, 22 bp, Artificial Sequence
  chemically synthesized
gtgagttgacaaacataaaagc

SEQ ID NO: 1338962 - DNA, 22 bp, Artificial Sequence
  chemically synthesized
aagcataggcttttatgtttgt

SEQ ID NO: 1338963 - DNA, 22 bp, Artificial Sequence
  chemically synthesized
caacaatatttgtgagttgaca

SEQ ID NO: 1338964 - DNA, 22 bp, Artificial Sequence
  chemically synthesized
cctgcaacaatatttgtgagtt

SEQ ID NO: 1338965 - DNA, 22 bp, Artificial Sequence
  chemically synthesized
ttatgtttgtcaactcacaaat

SEQ ID NO: 1338966 - DNA, 22 bp, Artificial Sequence
  chemically synthesized
ccctgcaacaatatttgtgagt

SEQ ID NO: 1338967 - DNA, 22 bp, Artificial Sequence
  chemically synthesized
tatgtttgtcaactcacaaata

SEQ ID NO: 1338968 - DNA, 22 bp, Artificial Sequence
  chemically synthesized
atgtttgtcaactcacaaatat

SEQ ID NO: 1338969 - DNA, 22 bp, Artificial Sequence
  chemically synthesized
ttccctgcaacaatatttgtga

SEQ ID NO: 1338970 - DNA, 22 bp, Artificial Sequence
  chemically synthesized
tgtttgtcaactcacaaatatt

SEQ ID NO: 1338971 - DNA, 22 bp, Artificial Sequence
  chemically synthesized
tctcttccctgcaacaatattt

SEQ ID NO: 1338972 - DNA, 22 bp, Artificial Sequence
  chemically synthesized
gtcaactcacaaatattgttgc

SEQ ID NO: 1338973 - DNA, 22 bp, Artificial Sequence
  chemically synthesized
tatctcttccctgcaacaatat

SEQ ID NO: 1338974 - DNA, 22 bp, Artificial Sequence
  chemically synthesized
tcaactcacaaatattgttgca

SEQ ID NO: 1338975 - DNA, 22 bp, Artificial Sequence
  chemically synthesized
ggacctctatctcttccctgca

SEQ ID NO: 1338976 - DNA, 22 bp, Artificial Sequence
  chemically synthesized
acaaatattgttgcagggaaga

SEQ ID NO: 1338977 - DNA, 22 bp, Artificial Sequence
  chemically synthesized
gggacctctatctcttccctgc

SEQ ID NO: 1338978 - DNA, 22 bp, Artificial Sequence
  chemically synthesized
agacaacttgggacctctatct

SEQ ID NO: 1338979 - DNA, 22 bp, Artificial Sequence
  chemically synthesized
ttgcagggaagagatagaggtc

SEQ ID NO: 1338980 - DNA, 22 bp, Artificial Sequence
  chemically synthesized
aagacaacttgggacctctatc

SEQ ID NO: 1338981 - DNA, 22 bp, Artificial Sequence
  chemically synthesized
ttaagacaacttgggacctcta

SEQ ID NO: 1338982 - DNA, 22 bp, Artificial Sequence
  chemically synthesized
cagggaagagatagaggtccca

SEQ ID NO: 1338983 - DNA, 22 bp, Artificial Sequence
  chemically synthesized
catattcttaagacaacttggg

SEQ ID NO: 1338984 - DNA, 22 bp, Artificial Sequence
  chemically synthesized
actccatattcttaagacaact

SEQ ID NO: 1338985 - DNA, 22 bp, Artificial Sequence
  chemically synthesized
aacatctgactccatattctta

SEQ ID NO: 1338986 - DNA, 22 bp, Artificial Sequence
  chemically synthesized
tcttaagaatatggagtcagat

SEQ ID NO: 1338987 - DNA, 22 bp, Artificial Sequence
  chemically synthesized
aaatcatactgaacatctgact

SEQ ID NO: 1338988 - DNA, 22 bp, Artificial Sequence
  chemically synthesized
aagaatatggagtcagatgttc

SEQ ID NO: 1338989 - DNA, 22 bp, Artificial Sequence
  chemically synthesized
agaatatggagtcagatgttca

SEQ ID NO: 1338990 - DNA, 22 bp, Artificial Sequence
  chemically synthesized
ctaaaatcatactgaacatctg

SEQ ID NO: 1338991 - DNA, 22 bp, Artificial Sequence
  chemically synthesized
ttcctaaaatcatactgaacat

SEQ ID NO: 1338992 - DNA, 22 bp, Artificial Sequence
  chemically synthesized
atatggctgttcctaaaatcat

SEQ ID NO: 1338993 - DNA, 22 bp, Artificial Sequence
  chemically synthesized
catatggctgttcctaaaatca

SEQ ID NO: 1338994 - DNA, 22 bp, Artificial Sequence
  chemically synthesized
atttcatatggctgttcctaaa

SEQ ID NO: 1338995 - DNA, 22 bp, Artificial Sequence
  chemically synthesized
catttcatatggctgttcctaa

SEQ ID NO: 1338996 - DNA, 22 bp, Artificial Sequence
  chemically synthesized
agtatgattttaggaacagcca

SEQ ID NO: 1338997 - DNA, 22 bp, Artificial Sequence
  chemically synthesized
tttcatttcatatggctgttcc

SEQ ID NO: 1338998 - DNA, 22 bp, Artificial Sequence
  chemically synthesized
tgactatttcatttcatatggc

SEQ ID NO: 1338999 - DNA, 22 bp, Artificial Sequence
  chemically synthesized
taggaacagccatatgaaatga

SEQ ID NO: 1339000 - DNA, 22 bp, Artificial Sequence
  chemically synthesized
aggaacagccatatgaaatgaa

SEQ ID NO: 1339001 - DNA, 22 bp, Artificial Sequence
  chemically synthesized
ggaacagccatatgaaatgaaa

SEQ ID NO: 1339002 - DNA, 22 bp, Artificial Sequence
  chemically synthesized
atagctatgactatttcatttc

SEQ ID NO: 1339003 - DNA, 22 bp, Artificial Sequence
  chemically synthesized
acaatagttcatagctatgact

SEQ ID NO: 1339004 - DNA, 22 bp, Artificial Sequence
  chemically synthesized
aacaatagttcatagctatgac

SEQ ID NO: 1339005 - DNA, 22 bp, Artificial Sequence
  chemically synthesized
atgtttaacaatagttcatagc

SEQ ID NO: 1339006 - DNA, 22 bp, Artificial Sequence
  chemically synthesized
ttgatgtttaacaatagttcat

SEQ ID NO: 1339007 - DNA, 22 bp, Artificial Sequence
  chemically synthesized
tattgatgtttaacaatagttc

SEQ ID NO: 1339008 - DNA, 22 bp, Artificial Sequence
  chemically synthesized
cctctattgatgtttaacaata

SEQ ID NO: 1339009 - DNA, 22 bp, Artificial Sequence
  chemically synthesized
tgaactattgttaaacatcaat

SEQ ID NO: 1339010 - DNA, 22 bp, Artificial Sequence
  chemically synthesized
tgtaccctccctctattgatgt

SEQ ID NO: 1339011 - DNA, 22 bp, Artificial Sequence
  chemically synthesized
atgtaccctccctctattgatg

SEQ ID NO: 1339012 - DNA, 22 bp, Artificial Sequence
  chemically synthesized
tttatgtaccctccctctattg

SEQ ID NO: 1339013 - DNA, 22 bp, Artificial Sequence
  chemically synthesized
ttgttaaacatcaatagaggga

SEQ ID NO: 1339014 - DNA, 22 bp, Artificial Sequence
  chemically synthesized
tatttatgtaccctccctctat

SEQ ID NO: 1339015 - DNA, 22 bp, Artificial Sequence
  chemically synthesized
ctatttatgtaccctccctcta

SEQ ID NO: 1339016 - DNA, 22 bp, Artificial Sequence
  chemically synthesized
ttaaacatcaatagagggaggg

SEQ ID NO: 1339017 - DNA, 22 bp, Artificial Sequence
  chemically synthesized
aacatcaatagagggagggtac

SEQ ID NO: 1339018 - DNA, 22 bp, Artificial Sequence
  chemically synthesized
acttctatttatgtaccctccc

SEQ ID NO: 1339019 - DNA, 22 bp, Artificial Sequence
  chemically synthesized
tgattaacttctatttatgtac

SEQ ID NO: 1339020 - DNA, 22 bp, Artificial Sequence
  chemically synthesized
gtgattaacttctatttatgta

SEQ ID NO: 1339021 - DNA, 22 bp, Artificial Sequence
  chemically synthesized
cttgtgattaacttctatttat

SEQ ID NO: 1339022 - DNA, 22 bp, Artificial Sequence
  chemically synthesized
acttgtgattaacttctattta

SEQ ID NO: 1339023 - DNA, 22 bp, Artificial Sequence
  chemically synthesized
tacttgtgattaacttctattt

SEQ ID NO: 1339024 - DNA, 22 bp, Artificial Sequence
  chemically synthesized
ttttacttgtgattaacttcta

SEQ ID NO: 1339025 - DNA, 22 bp, Artificial Sequence
  chemically synthesized
ggttattttacttgtgattaac

SEQ ID NO: 1339026 - DNA, 22 bp, Artificial Sequence
  chemically synthesized
ttaggttattttacttgtgatt

SEQ ID NO: 1339027 - DNA, 22 bp, Artificial Sequence
  chemically synthesized
atcacaagtaaaataacctaac

SEQ ID NO: 1339028 - DNA, 22 bp, Artificial Sequence
  chemically synthesized
tgataataaaaataatcactgt

SEQ ID NO: 1339029 - DNA, 22 bp, Artificial Sequence
  chemically synthesized
atgattatgataataaaaataa

SEQ ID NO: 1339030 - DNA, 22 bp, Artificial Sequence
  chemically synthesized
gatgattatgataataaaaata

SEQ ID NO: 1339031 - DNA, 22 bp, Artificial Sequence
  chemically synthesized
acagtgattatttttattatca

SEQ ID NO: 1339032 - DNA, 22 bp, Artificial Sequence
  chemically synthesized
accttgatgattatgataataa

SEQ ID NO: 1339033 - DNA, 22 bp, Artificial Sequence
  chemically synthesized
taaatctaaccttgatgattat

SEQ ID NO: 1339034 - DNA, 22 bp, Artificial Sequence
  chemically synthesized
tttttattatcataatcatcaa

SEQ ID NO: 1339035 - DNA, 22 bp, Artificial Sequence
  chemically synthesized
tgtaaatctaaccttgatgatt

SEQ ID NO: 1339036 - DNA, 22 bp, Artificial Sequence
  chemically synthesized
ttattatcataatcatcaaggt

SEQ ID NO: 1339037 - DNA, 22 bp, Artificial Sequence
  chemically synthesized
tattatcataatcatcaaggtt

SEQ ID NO: 1339038 - DNA, 22 bp, Artificial Sequence
  chemically synthesized
ctctgtaaatctaaccttgatg

SEQ ID NO: 1339039 - DNA, 22 bp, Artificial Sequence
  chemically synthesized
attatcataatcatcaaggtta

SEQ ID NO: 1339040 - DNA, 22 bp, Artificial Sequence
  chemically synthesized
gctctgtaaatctaaccttgat

SEQ ID NO: 1339041 - DNA, 22 bp, Artificial Sequence
  chemically synthesized
ttatcataatcatcaaggttag

SEQ ID NO: 1339042 - DNA, 22 bp, Artificial Sequence
  chemically synthesized
tgctctgtaaatctaaccttga

SEQ ID NO: 1339043 - DNA, 22 bp, Artificial Sequence
  chemically synthesized
tcataatcatcaaggttagatt

SEQ ID NO: 1339044 - DNA, 22 bp, Artificial Sequence
  chemically synthesized
ttttgctctgtaaatctaacct

SEQ ID NO: 1339045 - DNA, 22 bp, Artificial Sequence
  chemically synthesized
gttttgctctgtaaatctaacc

SEQ ID NO: 1339046 - DNA, 22 bp, Artificial Sequence
  chemically synthesized
gatttacagagcaaaacaaatg

SEQ ID NO: 1339047 - DNA, 22 bp, Artificial Sequence
  chemically synthesized
aaccaacatagaaaagcatttg

SEQ ID NO: 1339048 - DNA, 22 bp, Artificial Sequence
  chemically synthesized
acagagcaaaacaaatgctttt

SEQ ID NO: 1339049 - DNA, 22 bp, Artificial Sequence
  chemically synthesized
cagagcaaaacaaatgcttttc

SEQ ID NO: 1339050 - DNA, 22 bp, Artificial Sequence
  chemically synthesized
actaaaccaacatagaaaagca

SEQ ID NO: 1339051 - DNA, 22 bp, Artificial Sequence
  chemically synthesized
tgaaaatactcactaaaccaac

SEQ ID NO: 1339052 - DNA, 22 bp, Artificial Sequence
  chemically synthesized
ttctatgttggtttagtgagta

SEQ ID NO: 1339053 - DNA, 22 bp, Artificial Sequence
  chemically synthesized
tctatgttggtttagtgagtat

SEQ ID NO: 1339054 - DNA, 22 bp, Artificial Sequence
  chemically synthesized
ctatgttggtttagtgagtatt

SEQ ID NO: 1339055 - DNA, 22 bp, Artificial Sequence
  chemically synthesized
tatgttggtttagtgagtattt

SEQ ID NO: 1339056 - DNA, 22 bp, Artificial Sequence
  chemically synthesized
tgttggtttagtgagtattttc

SEQ ID NO: 1339057 - DNA, 22 bp, Artificial Sequence
  chemically synthesized
aaatacatatagctgtgaaaat

SEQ ID NO: 1339058 - DNA, 22 bp, Artificial Sequence
  chemically synthesized
gtttagtgagtattttcacagc

SEQ ID NO: 1339059 - DNA, 22 bp, Artificial Sequence
  chemically synthesized
agtgagtattttcacagctata

SEQ ID NO: 1339060 - DNA, 22 bp, Artificial Sequence
  chemically synthesized
gtgagtattttcacagctatat

SEQ ID NO: 1339061 - DNA, 22 bp, Artificial Sequence
  chemically synthesized
aagaaaaactaaaatacatata

SEQ ID NO: 1339062 - DNA, 22 bp, Artificial Sequence
  chemically synthesized
aaagaaaaactaaaatacatat

SEQ ID NO: 1339063 - DNA, 22 bp, Artificial Sequence
  chemically synthesized
tcacagctatatgtattttagt

SEQ ID NO: 1339064 - DNA, 22 bp, Artificial Sequence
  chemically synthesized
cacagctatatgtattttagtt

SEQ ID NO: 1339065 - DNA, 22 bp, Artificial Sequence
  chemically synthesized
acagctatatgtattttagttt

SEQ ID NO: 1339066 - DNA, 22 bp, Artificial Sequence
  chemically synthesized
tatgtattttagtttttcttta

SEQ ID NO: 1339067 - DNA, 22 bp, Artificial Sequence
  chemically synthesized
atatatataaaaatttaaagaa

SEQ ID NO: 1339068 - DNA, 22 bp, Artificial Sequence
  chemically synthesized
gttaatatatataaaaatttaa

SEQ ID NO: 1339069 - DNA, 22 bp, Artificial Sequence
  chemically synthesized
tagtttttctttaaatttttat

SEQ ID NO: 1339070 - DNA, 22 bp, Artificial Sequence
  chemically synthesized
tagttaatatatataaaaattt

SEQ ID NO: 1339071 - DNA, 22 bp, Artificial Sequence
  chemically synthesized
agtttttctttaaatttttata

SEQ ID NO: 1339072 - DNA, 22 bp, Artificial Sequence
  chemically synthesized
gtttttctttaaatttttatat

SEQ ID NO: 1339073 - DNA, 22 bp, Artificial Sequence
  chemically synthesized
tgttctagttaatatatataaa

SEQ ID NO: 1339074 - DNA, 22 bp, Artificial Sequence
  chemically synthesized
ttctttaaatttttatatatat

SEQ ID NO: 1339075 - DNA, 22 bp, Artificial Sequence
  chemically synthesized
tctttaaatttttatatatatt

SEQ ID NO: 1339076 - DNA, 22 bp, Artificial Sequence
  chemically synthesized
ctttaaatttttatatatatta

SEQ ID NO: 1339077 - DNA, 22 bp, Artificial Sequence
  chemically synthesized
tttaaatttttatatatattaa

SEQ ID NO: 1339078 - DNA, 22 bp, Artificial Sequence
  chemically synthesized
tattatgttctagttaatatat

SEQ ID NO: 1339079 - DNA, 22 bp, Artificial Sequence
  chemically synthesized
taaatttttatatatattaact

SEQ ID NO: 1339080 - DNA, 22 bp, Artificial Sequence
  chemically synthesized
gtattatgttctagttaatata

SEQ ID NO: 1339081 - DNA, 22 bp, Artificial Sequence
  chemically synthesized
aaatttttatatatattaacta

SEQ ID NO: 1339082 - DNA, 22 bp, Artificial Sequence
  chemically synthesized
aatttttatatatattaactag

SEQ ID NO: 1339083 - DNA, 22 bp, Artificial Sequence
  chemically synthesized
ttatatatattaactagaacat

SEQ ID NO: 1339084 - DNA, 22 bp, Artificial Sequence
  chemically synthesized
tatatatattaactagaacata

SEQ ID NO: 1339085 - DNA, 22 bp, Artificial Sequence
  chemically synthesized
atatatattaactagaacataa

SEQ ID NO: 1339086 - DNA, 22 bp, Artificial Sequence
  chemically synthesized
tatatattaactagaacataat

SEQ ID NO: 1339087 - DNA, 22 bp, Artificial Sequence
  chemically synthesized
gtaccaaagtgaagtttgtatt

SEQ ID NO: 1339088 - DNA, 22 bp, Artificial Sequence
  chemically synthesized
actagaacataatacaaacttc

SEQ ID NO: 1339089 - DNA, 22 bp, Artificial Sequence
  chemically synthesized
tagtaccaaagtgaagtttgta

SEQ ID NO: 1339090 - DNA, 22 bp, Artificial Sequence
  chemically synthesized
gaacataatacaaacttcactt

SEQ ID NO: 1339091 - DNA, 22 bp, Artificial Sequence
  chemically synthesized
aaaatgtaattctagtaccaaa

SEQ ID NO: 1339092 - DNA, 22 bp, Artificial Sequence
  chemically synthesized
aaaaatgtaattctagtaccaa

SEQ ID NO: 1339093 - DNA, 22 bp, Artificial Sequence
  chemically synthesized
taaaaatgtaattctagtacca

SEQ ID NO: 1339094 - DNA, 22 bp, Artificial Sequence
  chemically synthesized
cactttggtactagaattacat

SEQ ID NO: 1339095 - DNA, 22 bp, Artificial Sequence
  chemically synthesized
atggttttaaaaatgtaattct

SEQ ID NO: 1339096 - DNA, 22 bp, Artificial Sequence
  chemically synthesized
actttggtactagaattacatt

SEQ ID NO: 1339097 - DNA, 22 bp, Artificial Sequence
  chemically synthesized
tggtactagaattacattttta

SEQ ID NO: 1339098 - DNA, 22 bp, Artificial Sequence
  chemically synthesized
ggtactagaattacatttttaa

SEQ ID NO: 1339099 - DNA, 22 bp, Artificial Sequence
  chemically synthesized
gtactagaattacatttttaaa

SEQ ID NO: 1339100 - DNA, 22 bp, Artificial Sequence
  chemically synthesized
taacgttaatggttttaaaaat

SEQ ID NO: 1339101 - DNA, 22 bp, Artificial Sequence
  chemically synthesized
gaattacatttttaaaaccatt

SEQ ID NO: 1339102 - DNA, 22 bp, Artificial Sequence
  chemically synthesized
taaaaattataacgttaatggt

SEQ ID NO: 1339103 - DNA, 22 bp, Artificial Sequence
  chemically synthesized
gtaaaaattataacgttaatgg

SEQ ID NO: 1339104 - DNA, 22 bp, Artificial Sequence
  chemically synthesized
catttttaaaaccattaacgtt

SEQ ID NO: 1339105 - DNA, 22 bp, Artificial Sequence
  chemically synthesized
cttgtaaaaattataacgttaa

SEQ ID NO: 1339106 - DNA, 22 bp, Artificial Sequence
  chemically synthesized
tccttgtaaaaattataacgtt

SEQ ID NO: 1339107 - DNA, 22 bp, Artificial Sequence
  chemically synthesized
ttaaaaccattaacgttataat

SEQ ID NO: 1339108 - DNA, 22 bp, Artificial Sequence
  chemically synthesized
ctccttgtaaaaattataacgt

SEQ ID NO: 1339109 - DNA, 22 bp, Artificial Sequence
  chemically synthesized
taaaaccattaacgttataatt

SEQ ID NO: 1339110 - DNA, 22 bp, Artificial Sequence
  chemically synthesized
tctccttgtaaaaattataacg

SEQ ID NO: 1339111 - DNA, 22 bp, Artificial Sequence
  chemically synthesized
aaaaccattaacgttataattt

SEQ ID NO: 1339112 - DNA, 22 bp, Artificial Sequence
  chemically synthesized
aaaccattaacgttataatttt

SEQ ID NO: 1339113 - DNA, 22 bp, Artificial Sequence
  chemically synthesized
cctttctccttgtaaaaattat

SEQ ID NO: 1339114 - DNA, 22 bp, Artificial Sequence
  chemically synthesized
acgttataatttttacaaggag

SEQ ID NO: 1339115 - DNA, 22 bp, Artificial Sequence
  chemically synthesized
taatttttacaaggagaaaggt

SEQ ID NO: 1339116 - DNA, 22 bp, Artificial Sequence
  chemically synthesized
ttacaaggagaaaggtaatgtt

SEQ ID NO: 1339117 - DNA, 22 bp, Artificial Sequence
  chemically synthesized
tacaaggagaaaggtaatgttt

SEQ ID NO: 1339118 - DNA, 22 bp, Artificial Sequence
  chemically synthesized
acaaggagaaaggtaatgtttt

SEQ ID NO: 1339119 - DNA, 22 bp, Artificial Sequence
  chemically synthesized
caaggagaaaggtaatgttttg

SEQ ID NO: 1339120 - DNA, 22 bp, Artificial Sequence
  chemically synthesized
ataataatataataatcatcac

SEQ ID NO: 1339121 - DNA, 22 bp, Artificial Sequence
  chemically synthesized
tgtgatgattattatattatta

SEQ ID NO: 1339122 - DNA, 22 bp, Artificial Sequence
  chemically synthesized
gtgatgattattatattattat

SEQ ID NO: 1339123 - DNA, 22 bp, Artificial Sequence
  chemically synthesized
tgatgattattatattattatc

SEQ ID NO: 1339124 - DNA, 22 bp, Artificial Sequence
  chemically synthesized
agataaccaatattgataataa

SEQ ID NO: 1339125 - DNA, 22 bp, Artificial Sequence
  chemically synthesized
tgagataaccaatattgataat

SEQ ID NO: 1339126 - DNA, 22 bp, Artificial Sequence
  chemically synthesized
ctgagataaccaatattgataa

SEQ ID NO: 1339127 - DNA, 22 bp, Artificial Sequence
  chemically synthesized
ttatattattatcaatattggt

SEQ ID NO: 1339128 - DNA, 22 bp, Artificial Sequence
  chemically synthesized
tattattatcaatattggttat

SEQ ID NO: 1339129 - DNA, 22 bp, Artificial Sequence
  chemically synthesized
agcacagtttctgagataacca

SEQ ID NO: 1339130 - DNA, 22 bp, Artificial Sequence
  chemically synthesized
ttatcaatattggttatctcag

SEQ ID NO: 1339131 - DNA, 22 bp, Artificial Sequence
  chemically synthesized
tcaatattggttatctcagaaa

SEQ ID NO: 1339132 - DNA, 22 bp, Artificial Sequence
  chemically synthesized
gttatctcagaaactgtgctta

SEQ ID NO: 1339133 - DNA, 22 bp, Artificial Sequence
  chemically synthesized
ccatgagaaaagtattaagcac

SEQ ID NO: 1339134 - DNA, 22 bp, Artificial Sequence
  chemically synthesized
tctcagaaactgtgcttaatac

SEQ ID NO: 1339135 - DNA, 22 bp, Artificial Sequence
  chemically synthesized
agaaactgtgcttaatactttt

SEQ ID NO: 1339136 - DNA, 22 bp, Artificial Sequence
  chemically synthesized
ataagttgccatgagaaaagta

SEQ ID NO: 1339137 - DNA, 22 bp, Artificial Sequence
  chemically synthesized
cataagttgccatgagaaaagt

SEQ ID NO: 1339138 - DNA, 22 bp, Artificial Sequence
  chemically synthesized
tgcttaatacttttctcatggc

SEQ ID NO: 1339139 - DNA, 22 bp, Artificial Sequence
  chemically synthesized
aatacttttctcatggcaactt

SEQ ID NO: 1339140 - DNA, 22 bp, Artificial Sequence
  chemically synthesized
atacttttctcatggcaactta

SEQ ID NO: 1339141 - DNA, 22 bp, Artificial Sequence
  chemically synthesized
taataaagacttcataagttgc

SEQ ID NO: 1339142 - DNA, 22 bp, Artificial Sequence
  chemically synthesized
ttctcatggcaacttatgaagt

SEQ ID NO: 1339143 - DNA, 22 bp, Artificial Sequence
  chemically synthesized
tctcatggcaacttatgaagtc

SEQ ID NO: 1339144 - DNA, 22 bp, Artificial Sequence
  chemically synthesized
ctcatggcaacttatgaagtct

SEQ ID NO: 1339145 - DNA, 22 bp, Artificial Sequence
  chemically synthesized
tcatggcaacttatgaagtctt

SEQ ID NO: 1339146 - DNA, 22 bp, Artificial Sequence
  chemically synthesized
atggcaacttatgaagtcttta

SEQ ID NO: 1339147 - DNA, 22 bp, Artificial Sequence
  chemically synthesized
taaataaaatgattataataaa

SEQ ID NO: 1339148 - DNA, 22 bp, Artificial Sequence
  chemically synthesized
ataaataaaatgattataataa

SEQ ID NO: 1339149 - DNA, 22 bp, Artificial Sequence
  chemically synthesized
atgaagtctttattataatcat

SEQ ID NO: 1339150 - DNA, 22 bp, Artificial Sequence
  chemically synthesized
tgaagtctttattataatcatt

SEQ ID NO: 1339151 - DNA, 22 bp, Artificial Sequence
  chemically synthesized
ccttataaataaaatgattata

SEQ ID NO: 1339152 - DNA, 22 bp, Artificial Sequence
  chemically synthesized
aattgccttataaataaaatga

SEQ ID NO: 1339153 - DNA, 22 bp, Artificial Sequence
  chemically synthesized
tattataatcattttatttata

SEQ ID NO: 1339154 - DNA, 22 bp, Artificial Sequence
  chemically synthesized
attataatcattttatttataa

SEQ ID NO: 1339155 - DNA, 22 bp, Artificial Sequence
  chemically synthesized
ttataatcattttatttataag

SEQ ID NO: 1339156 - DNA, 22 bp, Artificial Sequence
  chemically synthesized
agactcaattgccttataaata

SEQ ID NO: 1339157 - DNA, 22 bp, Artificial Sequence
  chemically synthesized
taagactcaattgccttataaa

SEQ ID NO: 1339158 - DNA, 22 bp, Artificial Sequence
  chemically synthesized
taatcattttatttataaggca

SEQ ID NO: 1339159 - DNA, 22 bp, Artificial Sequence
  chemically synthesized
ctaagactcaattgccttataa

SEQ ID NO: 1339160 - DNA, 22 bp, Artificial Sequence
  chemically synthesized
tctaagactcaattgccttata

SEQ ID NO: 1339161 - DNA, 22 bp, Artificial Sequence
  chemically synthesized
acctttctaagactcaattgcc

SEQ ID NO: 1339162 - DNA, 22 bp, Artificial Sequence
  chemically synthesized
aacctttctaagactcaattgc

SEQ ID NO: 1339163 - DNA, 22 bp, Artificial Sequence
  chemically synthesized
tatttataaggcaattgagtct

SEQ ID NO: 1339164 - DNA, 22 bp, Artificial Sequence
  chemically synthesized
atttataaggcaattgagtctt

SEQ ID NO: 1339165 - DNA, 22 bp, Artificial Sequence
  chemically synthesized
tttaacctttctaagactcaat

SEQ ID NO: 1339166 - DNA, 22 bp, Artificial Sequence
  chemically synthesized
tttataaggcaattgagtctta

SEQ ID NO: 1339167 - DNA, 22 bp, Artificial Sequence
  chemically synthesized
ataaggcaattgagtcttagaa

SEQ ID NO: 1339168 - DNA, 22 bp, Artificial Sequence
  chemically synthesized
tctatttaacctttctaagact

SEQ ID NO: 1339169 - DNA, 22 bp, Artificial Sequence
  chemically synthesized
taaggcaattgagtcttagaaa

SEQ ID NO: 1339170 - DNA, 22 bp, Artificial Sequence
  chemically synthesized
tactatctatttaacctttcta

SEQ ID NO: 1339171 - DNA, 22 bp, Artificial Sequence
  chemically synthesized
atactatctatttaacctttct

SEQ ID NO: 1339172 - DNA, 22 bp, Artificial Sequence
  chemically synthesized
agtcttagaaaggttaaataga

SEQ ID NO: 1339173 - DNA, 22 bp, Artificial Sequence
  chemically synthesized
agaaaggttaaatagatagtat

SEQ ID NO: 1339174 - DNA, 22 bp, Artificial Sequence
  chemically synthesized
gaaaggttaaatagatagtata

SEQ ID NO: 1339175 - DNA, 22 bp, Artificial Sequence
  chemically synthesized
gaaggatgaccttatactatct

SEQ ID NO: 1339176 - DNA, 22 bp, Artificial Sequence
  chemically synthesized
tagaaggatgaccttatactat

SEQ ID NO: 1339177 - DNA, 22 bp, Artificial Sequence
  chemically synthesized
ctagaaggatgaccttatacta

SEQ ID NO: 1339178 - DNA, 22 bp, Artificial Sequence
  chemically synthesized
tctagaaggatgaccttatact

SEQ ID NO: 1339179 - DNA, 22 bp, Artificial Sequence
  chemically synthesized
attttctagaaggatgacctta

SEQ ID NO: 1339180 - DNA, 22 bp, Artificial Sequence
  chemically synthesized
aatagatagtataaggtcatcc

SEQ ID NO: 1339181 - DNA, 22 bp, Artificial Sequence
  chemically synthesized
tcactcattttctagaaggatg

SEQ ID NO: 1339182 - DNA, 22 bp, Artificial Sequence
  chemically synthesized
gtcactcattttctagaaggat

SEQ ID NO: 1339183 - DNA, 22 bp, Artificial Sequence
  chemically synthesized
aatttgtcactcattttctaga

SEQ ID NO: 1339184 - DNA, 22 bp, Artificial Sequence
  chemically synthesized
aaatttgtcactcattttctag

SEQ ID NO: 1339185 - DNA, 22 bp, Artificial Sequence
  chemically synthesized
agtttaaatttgtcactcattt

SEQ ID NO: 1339186 - DNA, 22 bp, Artificial Sequence
  chemically synthesized
ctagaaaatgagtgacaaattt

SEQ ID NO: 1339187 - DNA, 22 bp, Artificial Sequence
  chemically synthesized
tagaaaatgagtgacaaattta

SEQ ID NO: 1339188 - DNA, 22 bp, Artificial Sequence
  chemically synthesized
gaaaatgagtgacaaatttaaa

SEQ ID NO: 1339189 - DNA, 22 bp, Artificial Sequence
  chemically synthesized
gaaatcatctaagtttaaattt

SEQ ID NO: 1339190 - DNA, 22 bp, Artificial Sequence
  chemically synthesized
agaaatcatctaagtttaaatt

SEQ ID NO: 1339191 - DNA, 22 bp, Artificial Sequence
  chemically synthesized
aaacttagatgatttctaagct

SEQ ID NO: 1339192 - DNA, 22 bp, Artificial Sequence
  chemically synthesized
aacttagatgatttctaagctt

SEQ ID NO: 1339193 - DNA, 22 bp, Artificial Sequence
  chemically synthesized
cagtcaaaagaataagcttaga

SEQ ID NO: 1339194 - DNA, 22 bp, Artificial Sequence
  chemically synthesized
agatgatttctaagcttattct

SEQ ID NO: 1339195 - DNA, 22 bp, Artificial Sequence
  chemically synthesized
gatgatttctaagcttattctt

SEQ ID NO: 1339196 - DNA, 22 bp, Artificial Sequence
  chemically synthesized
ctaagcttattcttttgactgt

SEQ ID NO: 1339197 - DNA, 22 bp, Artificial Sequence
  chemically synthesized
taagcttattcttttgactgta

SEQ ID NO: 1339198 - DNA, 22 bp, Artificial Sequence
  chemically synthesized
agcttattcttttgactgtagc

SEQ ID NO: 1339199 - DNA, 22 bp, Artificial Sequence
  chemically synthesized
attcttttgactgtagcattat

SEQ ID NO: 1339200 - DNA, 22 bp, Artificial Sequence
  chemically synthesized
caggaacataatataatgctac

SEQ ID NO: 1339201 - DNA, 22 bp, Artificial Sequence
  chemically synthesized
ttcttttgactgtagcattata

SEQ ID NO: 1339202 - DNA, 22 bp, Artificial Sequence
  chemically synthesized
ttttgactgtagcattatatta

SEQ ID NO: 1339203 - DNA, 22 bp, Artificial Sequence
  chemically synthesized
ttgactgtagcattatattatg

SEQ ID NO: 1339204 - DNA, 22 bp, Artificial Sequence
  chemically synthesized
taactacaggaacataatataa

SEQ ID NO: 1339205 - DNA, 22 bp, Artificial Sequence
  chemically synthesized
tgactgtagcattatattatgt

SEQ ID NO: 1339206 - DNA, 22 bp, Artificial Sequence
  chemically synthesized
gactgtagcattatattatgtt

SEQ ID NO: 1339207 - DNA, 22 bp, Artificial Sequence
  chemically synthesized
tgtaactacaggaacataatat

SEQ ID NO: 1339208 - DNA, 22 bp, Artificial Sequence
  chemically synthesized
actgtagcattatattatgttc

SEQ ID NO: 1339209 - DNA, 22 bp, Artificial Sequence
  chemically synthesized
ttctgtaactacaggaacataa

SEQ ID NO: 1339210 - DNA, 22 bp, Artificial Sequence
  chemically synthesized
tagcattatattatgttcctgt

SEQ ID NO: 1339211 - DNA, 22 bp, Artificial Sequence
  chemically synthesized
tattattctgtaactacaggaa

SEQ ID NO: 1339212 - DNA, 22 bp, Artificial Sequence
  chemically synthesized
tattatgttcctgtagttacag

SEQ ID NO: 1339213 - DNA, 22 bp, Artificial Sequence
  chemically synthesized
tgttatattattctgtaactac

SEQ ID NO: 1339214 - DNA, 22 bp, Artificial Sequence
  chemically synthesized
tgttcctgtagttacagaataa

SEQ ID NO: 1339215 - DNA, 22 bp, Artificial Sequence
  chemically synthesized
gacactgtgttatattattctg

SEQ ID NO: 1339216 - DNA, 22 bp, Artificial Sequence
  chemically synthesized
ggacactgtgttatattattct

SEQ ID NO: 1339217 - DNA, 22 bp, Artificial Sequence
  chemically synthesized
tggacactgtgttatattattc

SEQ ID NO: 1339218 - DNA, 22 bp, Artificial Sequence
  chemically synthesized
ctgtagttacagaataatataa

SEQ ID NO: 1339219 - DNA, 22 bp, Artificial Sequence
  chemically synthesized
ttggacactgtgttatattatt

SEQ ID NO: 1339220 - DNA, 22 bp, Artificial Sequence
  chemically synthesized
tagttacagaataatataacac

SEQ ID NO: 1339221 - DNA, 22 bp, Artificial Sequence
  chemically synthesized
gtttttggacactgtgttatat

SEQ ID NO: 1339222 - DNA, 22 bp, Artificial Sequence
  chemically synthesized
tagtttttggacactgtgttat

SEQ ID NO: 1339223 - DNA, 22 bp, Artificial Sequence
  chemically synthesized
ctagtttttggacactgtgtta

SEQ ID NO: 1339224 - DNA, 22 bp, Artificial Sequence
  chemically synthesized
cagaataatataacacagtgtc

SEQ ID NO: 1339225 - DNA, 22 bp, Artificial Sequence
  chemically synthesized
aataagggaataaaatgatttc

SEQ ID NO: 1339226 - DNA, 22 bp, Artificial Sequence
  chemically synthesized
ccctaaataagggaataaaatg

SEQ ID NO: 1339227 - DNA, 22 bp, Artificial Sequence
  chemically synthesized
taccctaaataagggaataaaa

SEQ ID NO: 1339228 - DNA, 22 bp, Artificial Sequence
  chemically synthesized
gaaatcattttattcccttatt

SEQ ID NO: 1339229 - DNA, 22 bp, Artificial Sequence
  chemically synthesized
tcagccctctaccctaaataag

SEQ ID NO: 1339230 - DNA, 22 bp, Artificial Sequence
  chemically synthesized
ttatcagccctctaccctaaat

SEQ ID NO: 1339231 - DNA, 22 bp, Artificial Sequence
  chemically synthesized
tattcccttatttagggtagag

SEQ ID NO: 1339232 - DNA, 22 bp, Artificial Sequence
  chemically synthesized
attcccttatttagggtagagg

SEQ ID NO: 1339233 - DNA, 22 bp, Artificial Sequence
  chemically synthesized
ttcccttatttagggtagaggg

SEQ ID NO: 1339234 - DNA, 22 bp, Artificial Sequence
  chemically synthesized
ccttatttagggtagagggctg

SEQ ID NO: 1339235 - DNA, 22 bp, Artificial Sequence
  chemically synthesized
ccaaggttattatcagccctct

SEQ ID NO: 1339236 - DNA, 22 bp, Artificial Sequence
  chemically synthesized
atttagggtagagggctgataa

SEQ ID NO: 1339237 - DNA, 22 bp, Artificial Sequence
  chemically synthesized
ttgccaaggttattatcagccc

SEQ ID NO: 1339238 - DNA, 22 bp, Artificial Sequence
  chemically synthesized
tttagggtagagggctgataat

SEQ ID NO: 1339239 - DNA, 22 bp, Artificial Sequence
  chemically synthesized
attgccaaggttattatcagcc

SEQ ID NO: 1339240 - DNA, 22 bp, Artificial Sequence
  chemically synthesized
tattgccaaggttattatcagc

SEQ ID NO: 1339241 - DNA, 22 bp, Artificial Sequence
  chemically synthesized
ttattgccaaggttattatcag

SEQ ID NO: 1339242 - DNA, 22 bp, Artificial Sequence
  chemically synthesized
agggtagagggctgataataac

SEQ ID NO: 1339243 - DNA, 22 bp, Artificial Sequence
  chemically synthesized
tttattgccaaggttattatca

SEQ ID NO: 1339244 - DNA, 22 bp, Artificial Sequence
  chemically synthesized
gggtagagggctgataataacc

SEQ ID NO: 1339245 - DNA, 22 bp, Artificial Sequence
  chemically synthesized
ttttattgccaaggttattatc

SEQ ID NO: 1339246 - DNA, 22 bp, Artificial Sequence
  chemically synthesized
ggtttttttattgccaaggtta

SEQ ID NO: 1339247 - DNA, 22 bp, Artificial Sequence
  chemically synthesized
gggtttttttattgccaaggtt

SEQ ID NO: 1339248 - DNA, 22 bp, Artificial Sequence
  chemically synthesized
tgggtttttttattgccaaggt

SEQ ID NO: 1339249 - DNA, 22 bp, Artificial Sequence
  chemically synthesized
ataataaccttggcaataaaaa

SEQ ID NO: 1339250 - DNA, 22 bp, Artificial Sequence
  chemically synthesized
tgacagtaggttttgggttttt

SEQ ID NO: 1339251 - DNA, 22 bp, Artificial Sequence
  chemically synthesized
ggcaataaaaaaacccaaaacc

SEQ ID NO: 1339252 - DNA, 22 bp, Artificial Sequence
  chemically synthesized
gcaataaaaaaacccaaaacct

SEQ ID NO: 1339253 - DNA, 22 bp, Artificial Sequence
  chemically synthesized
aaaccatcaacagtaagaactg

SEQ ID NO: 1339254 - DNA, 22 bp, Artificial Sequence
  chemically synthesized
ttaaaaccatcaacagtaagaa

SEQ ID NO: 1339255 - DNA, 22 bp, Artificial Sequence
  chemically synthesized
attaaaaccatcaacagtaaga

SEQ ID NO: 1339256 - DNA, 22 bp, Artificial Sequence
  chemically synthesized
tattaaaaccatcaacagtaag

SEQ ID NO: 1339257 - DNA, 22 bp, Artificial Sequence
  chemically synthesized
ctgtcacagttcttactgttga

SEQ ID NO: 1339258 - DNA, 22 bp, Artificial Sequence
  chemically synthesized
ttattaaaaccatcaacagtaa

SEQ ID NO: 1339259 - DNA, 22 bp, Artificial Sequence
  chemically synthesized
ttttattaaaaccatcaacagt

SEQ ID NO: 1339260 - DNA, 22 bp, Artificial Sequence
  chemically synthesized
tcacagttcttactgttgatgg

SEQ ID NO: 1339261 - DNA, 22 bp, Artificial Sequence
  chemically synthesized
cttttattaaaaccatcaacag

SEQ ID NO: 1339262 - DNA, 22 bp, Artificial Sequence
  chemically synthesized
tcttttattaaaaccatcaaca

SEQ ID NO: 1339263 - DNA, 22 bp, Artificial Sequence
  chemically synthesized
ttcttttattaaaaccatcaac

SEQ ID NO: 1339264 - DNA, 22 bp, Artificial Sequence
  chemically synthesized
tttcttttattaaaaccatcaa

SEQ ID NO: 1339265 - DNA, 22 bp, Artificial Sequence
  chemically synthesized
ttactgttgatggttttaataa

SEQ ID NO: 1339266 - DNA, 22 bp, Artificial Sequence
  chemically synthesized
actgttgatggttttaataaaa

SEQ ID NO: 1339267 - DNA, 22 bp, Artificial Sequence
  chemically synthesized
ctgttgatggttttaataaaag

SEQ ID NO: 1339268 - DNA, 22 bp, Artificial Sequence
  chemically synthesized
aaagacattttttcttttatta

SEQ ID NO: 1339269 - DNA, 22 bp, Artificial Sequence
  chemically synthesized
ttgatggttttaataaaagaaa

SEQ ID NO: 1339270 - DNA, 22 bp, Artificial Sequence
  chemically synthesized
atggttttaataaaagaaaaaa

SEQ ID NO: 1339271 - DNA, 22 bp, Artificial Sequence
  chemically synthesized
taataaaagaaaaaatgtcttt

SEQ ID NO: 1339272 - DNA, 22 bp, Artificial Sequence
  chemically synthesized
aataaaagaaaaaatgtctttg

SEQ ID NO: 1339273 - DNA, 22 bp, Artificial Sequence
  chemically synthesized
ataaaagaaaaaatgtctttga

SEQ ID NO: 1339274 - DNA, 22 bp, Artificial Sequence
  chemically synthesized
tgaggttttccttttatgtggc

SEQ ID NO: 1339275 - DNA, 22 bp, Artificial Sequence
  chemically synthesized
gaggttttccttttatgtggca

SEQ ID NO: 1339276 - DNA, 22 bp, Artificial Sequence
  chemically synthesized
aggttttccttttatgtggcat

SEQ ID NO: 1339277 - DNA, 22 bp, Artificial Sequence
  chemically synthesized
tccttttatgtggcatctggta

SEQ ID NO: 1339278 - DNA, 22 bp, Artificial Sequence
  chemically synthesized
ccttttatgtggcatctggtat

SEQ ID NO: 1339279 - DNA, 22 bp, Artificial Sequence
  chemically synthesized
cttttatgtggcatctggtatt

SEQ ID NO: 1339280 - DNA, 22 bp, Artificial Sequence
  chemically synthesized
ttatgtggcatctggtatttgc

SEQ ID NO: 1339281 - DNA, 22 bp, Artificial Sequence
  chemically synthesized
tatgtggcatctggtatttgcc

SEQ ID NO: 1339282 - DNA, 22 bp, Artificial Sequence
  chemically synthesized
atgtggcatctggtatttgcct

SEQ ID NO: 1339283 - DNA, 22 bp, Artificial Sequence
  chemically synthesized
tgtggcatctggtatttgccta

SEQ ID NO: 1339284 - DNA, 22 bp, Artificial Sequence
  chemically synthesized
taaatagatcatggatataggc

SEQ ID NO: 1339285 - DNA, 22 bp, Artificial Sequence
  chemically synthesized
gtatttgcctatatccatgatc

SEQ ID NO: 1339286 - DNA, 22 bp, Artificial Sequence
  chemically synthesized
aaagaggctgtaaatagatcat

SEQ ID NO: 1339287 - DNA, 22 bp, Artificial Sequence
  chemically synthesized
caaagaggctgtaaatagatca

SEQ ID NO: 1339288 - DNA, 22 bp, Artificial Sequence
  chemically synthesized
gcctatatccatgatctattta

SEQ ID NO: 1339289 - DNA, 22 bp, Artificial Sequence
  chemically synthesized
tcaaagaggctgtaaatagatc

SEQ ID NO: 1339290 - DNA, 22 bp, Artificial Sequence
  chemically synthesized
cctatatccatgatctatttac

SEQ ID NO: 1339291 - DNA, 22 bp, Artificial Sequence
  chemically synthesized
attttcaaagaggctgtaaata

SEQ ID NO: 1339292 - DNA, 22 bp, Artificial Sequence
  chemically synthesized
tatccatgatctatttacagcc

SEQ ID NO: 1339293 - DNA, 22 bp, Artificial Sequence
  chemically synthesized
ggttaattttcaaagaggctgt

SEQ ID NO: 1339294 - DNA, 22 bp, Artificial Sequence
  chemically synthesized
tttacagcctctttgaaaatta

SEQ ID NO: 1339295 - DNA, 22 bp, Artificial Sequence
  chemically synthesized
atatcattcggttaattttcaa

SEQ ID NO: 1339296 - DNA, 22 bp, Artificial Sequence
  chemically synthesized
acagcctctttgaaaattaacc

SEQ ID NO: 1339297 - DNA, 22 bp, Artificial Sequence
  chemically synthesized
ttaatatcattcggttaatttt

SEQ ID NO: 1339298 - DNA, 22 bp, Artificial Sequence
  chemically synthesized
cagcctctttgaaaattaaccg

SEQ ID NO: 1339299 - DNA, 22 bp, Artificial Sequence
  chemically synthesized
tctattaatatcattcggttaa

SEQ ID NO: 1339300 - DNA, 22 bp, Artificial Sequence
  chemically synthesized
tttgaaaattaaccgaatgata

SEQ ID NO: 1339301 - DNA, 22 bp, Artificial Sequence
  chemically synthesized
tgaaaattaaccgaatgatatt

SEQ ID NO: 1339302 - DNA, 22 bp, Artificial Sequence
  chemically synthesized
gaaaattaaccgaatgatatta

SEQ ID NO: 1339303 - DNA, 22 bp, Artificial Sequence
  chemically synthesized
aaaattaaccgaatgatattaa

SEQ ID NO: 1339304 - DNA, 22 bp, Artificial Sequence
  chemically synthesized
tataaaataaactatctattaa

SEQ ID NO: 1339305 - DNA, 22 bp, Artificial Sequence
  chemically synthesized
accgaatgatattaatagatag

SEQ ID NO: 1339306 - DNA, 22 bp, Artificial Sequence
  chemically synthesized
acgctatataaaataaactatc

SEQ ID NO: 1339307 - DNA, 22 bp, Artificial Sequence
  chemically synthesized
atagatagtttattttatatag

SEQ ID NO: 1339308 - DNA, 22 bp, Artificial Sequence
  chemically synthesized
ggaggagttaacgctatataaa

SEQ ID NO: 1339309 - DNA, 22 bp, Artificial Sequence
  chemically synthesized
attttatatagcgttaactcct

SEQ ID NO: 1339310 - DNA, 22 bp, Artificial Sequence
  chemically synthesized
ttttatatagcgttaactcctc

SEQ ID NO: 1339311 - DNA, 22 bp, Artificial Sequence
  chemically synthesized
tatatagcgttaactcctccta

SEQ ID NO: 1339312 - DNA, 22 bp, Artificial Sequence
  chemically synthesized
atatagcgttaactcctcctaa

SEQ ID NO: 1339313 - DNA, 22 bp, Artificial Sequence
  chemically synthesized
tatagcgttaactcctcctaac

SEQ ID NO: 1339314 - DNA, 22 bp, Artificial Sequence
  chemically synthesized
tgcagagaaatgtgtacaaagt

SEQ ID NO: 1339315 - DNA, 22 bp, Artificial Sequence
  chemically synthesized
actcctcctaactttgtacaca

SEQ ID NO: 1339316 - DNA, 22 bp, Artificial Sequence
  chemically synthesized
ctcctaactttgtacacatttc

SEQ ID NO: 1339317 - DNA, 22 bp, Artificial Sequence
  chemically synthesized
aaattatgcagagaaatgtgta

SEQ ID NO: 1339318 - DNA, 22 bp, Artificial Sequence
  chemically synthesized
caaattatgcagagaaatgtgt

SEQ ID NO: 1339319 - DNA, 22 bp, Artificial Sequence
  chemically synthesized
ctaactttgtacacatttctct

SEQ ID NO: 1339320 - DNA, 22 bp, Artificial Sequence
  chemically synthesized
ttcaaattatgcagagaaatgt

SEQ ID NO: 1339321 - DNA, 22 bp, Artificial Sequence
  chemically synthesized
actttgtacacatttctctgca

SEQ ID NO: 1339322 - DNA, 22 bp, Artificial Sequence
  chemically synthesized
ttcttcaaattatgcagagaaa

SEQ ID NO: 1339323 - DNA, 22 bp, Artificial Sequence
  chemically synthesized
attcttcaaattatgcagagaa

SEQ ID NO: 1339324 - DNA, 22 bp, Artificial Sequence
  chemically synthesized
ttattcttcaaattatgcagag

SEQ ID NO: 1339325 - DNA, 22 bp, Artificial Sequence
  chemically synthesized
tgtacacatttctctgcataat

SEQ ID NO: 1339326 - DNA, 22 bp, Artificial Sequence
  chemically synthesized
gtacacatttctctgcataatt

SEQ ID NO: 1339327 - DNA, 22 bp, Artificial Sequence
  chemically synthesized
tacacatttctctgcataattt

SEQ ID NO: 1339328 - DNA, 22 bp, Artificial Sequence
  chemically synthesized
ttcttattcttcaaattatgca

SEQ ID NO: 1339329 - DNA, 22 bp, Artificial Sequence
  chemically synthesized
tgttcttattcttcaaattatg

SEQ ID NO: 1339330 - DNA, 22 bp, Artificial Sequence
  chemically synthesized
ctctgttcttattcttcaaatt

SEQ ID NO: 1339331 - DNA, 22 bp, Artificial Sequence
  chemically synthesized
cctctgttcttattcttcaaat

SEQ ID NO: 1339332 - DNA, 22 bp, Artificial Sequence
  chemically synthesized
ctctgcataatttgaagaataa

SEQ ID NO: 1339333 - DNA, 22 bp, Artificial Sequence
  chemically synthesized
tctgcataatttgaagaataag

SEQ ID NO: 1339334 - DNA, 22 bp, Artificial Sequence
  chemically synthesized
atttcctctgttcttattcttc

SEQ ID NO: 1339335 - DNA, 22 bp, Artificial Sequence
  chemically synthesized
tgcataatttgaagaataagaa

SEQ ID NO: 1339336 - DNA, 22 bp, Artificial Sequence
  chemically synthesized
cataatttgaagaataagaaca

SEQ ID NO: 1339337 - DNA, 22 bp, Artificial Sequence
  chemically synthesized
tcggtgttgatttcctctgttc

SEQ ID NO: 1339338 - DNA, 22 bp, Artificial Sequence
  chemically synthesized
gaagaataagaacagaggaaat

SEQ ID NO: 1339339 - DNA, 22 bp, Artificial Sequence
  chemically synthesized
aagaataagaacagaggaaatc

SEQ ID NO: 1339340 - DNA, 22 bp, Artificial Sequence
  chemically synthesized
tattatcggtgttgatttcctc

SEQ ID NO: 1339341 - DNA, 22 bp, Artificial Sequence
  chemically synthesized
cctgtattatcggtgttgattt

SEQ ID NO: 1339342 - DNA, 22 bp, Artificial Sequence
  chemically synthesized
ccctgtattatcggtgttgatt

SEQ ID NO: 1339343 - DNA, 22 bp, Artificial Sequence
  chemically synthesized
tccctgtattatcggtgttgat

SEQ ID NO: 1339344 - DNA, 22 bp, Artificial Sequence
  chemically synthesized
ttccctgtattatcggtgttga

SEQ ID NO: 1339345 - DNA, 22 bp, Artificial Sequence
  chemically synthesized
tttccctgtattatcggtgttg

SEQ ID NO: 1339346 - DNA, 22 bp, Artificial Sequence
  chemically synthesized
ttttccctgtattatcggtgtt

SEQ ID NO: 1339347 - DNA, 22 bp, Artificial Sequence
  chemically synthesized
tatttttttccctgtattatcg

SEQ ID NO: 1339348 - DNA, 22 bp, Artificial Sequence
  chemically synthesized
aaaaaaactgtatttttttccc

SEQ ID NO: 1339349 - DNA, 22 bp, Artificial Sequence
  chemically synthesized
aaaaaaaactgtatttttttcc

SEQ ID NO: 1339350 - DNA, 22 bp, Artificial Sequence
  chemically synthesized
gtttaaaaaaaactgtattttt

SEQ ID NO: 1339351 - DNA, 22 bp, Artificial Sequence
  chemically synthesized
ggtttaaaaaaaactgtatttt

SEQ ID NO: 1339352 - DNA, 22 bp, Artificial Sequence
  chemically synthesized
cttggtttaaaaaaaactgtat

SEQ ID NO: 1339353 - DNA, 22 bp, Artificial Sequence
  chemically synthesized
gcttggtttaaaaaaaactgta

SEQ ID NO: 1339354 - DNA, 22 bp, Artificial Sequence
  chemically synthesized
ttgcttggtttaaaaaaaactg

SEQ ID NO: 1339355 - DNA, 22 bp, Artificial Sequence
  chemically synthesized
cttgcttggtttaaaaaaaact

SEQ ID NO: 1339356 - DNA, 22 bp, Artificial Sequence
  chemically synthesized
tcttgcttggtttaaaaaaaac

SEQ ID NO: 1339357 - DNA, 22 bp, Artificial Sequence
  chemically synthesized
cattttcttgcttggtttaaaa

SEQ ID NO: 1339358 - DNA, 22 bp, Artificial Sequence
  chemically synthesized
tttttaaaccaagcaagaaaat

SEQ ID NO: 1339359 - DNA, 22 bp, Artificial Sequence
  chemically synthesized
gcatcagattgcattttcttgc

SEQ ID NO: 1339360 - DNA, 22 bp, Artificial Sequence
  chemically synthesized
ttttaaaccaagcaagaaaatg

SEQ ID NO: 1339361 - DNA, 22 bp, Artificial Sequence
  chemically synthesized
ggcatcagattgcattttcttg

SEQ ID NO: 1339362 - DNA, 22 bp, Artificial Sequence
  chemically synthesized
tttaaaccaagcaagaaaatgc

SEQ ID NO: 1339363 - DNA, 22 bp, Artificial Sequence
  chemically synthesized
tggcatcagattgcattttctt

SEQ ID NO: 1339364 - DNA, 22 bp, Artificial Sequence
  chemically synthesized
ttaaaccaagcaagaaaatgca

SEQ ID NO: 1339365 - DNA, 22 bp, Artificial Sequence
  chemically synthesized
taaaccaagcaagaaaatgcaa

SEQ ID NO: 1339366 - DNA, 22 bp, Artificial Sequence
  chemically synthesized
aaaccaagcaagaaaatgcaat

SEQ ID NO: 1339367 - DNA, 22 bp, Artificial Sequence
  chemically synthesized
ttttggcatcagattgcatttt

SEQ ID NO: 1339368 - DNA, 22 bp, Artificial Sequence
  chemically synthesized
aaccaagcaagaaaatgcaatc

SEQ ID NO: 1339369 - DNA, 22 bp, Artificial Sequence
  chemically synthesized
gttttggcatcagattgcattt

SEQ ID NO: 1339370 - DNA, 22 bp, Artificial Sequence
  chemically synthesized
tttgttttggcatcagattgca

SEQ ID NO: 1339371 - DNA, 22 bp, Artificial Sequence
  chemically synthesized
atttgttttggcatcagattgc

SEQ ID NO: 1339372 - DNA, 22 bp, Artificial Sequence
  chemically synthesized
atatttatttgttttggcatca

SEQ ID NO: 1339373 - DNA, 22 bp, Artificial Sequence
  chemically synthesized
catatttatttgttttggcatc

SEQ ID NO: 1339374 - DNA, 22 bp, Artificial Sequence
  chemically synthesized
gtcttcatatttatttgttttg

SEQ ID NO: 1339375 - DNA, 22 bp, Artificial Sequence
  chemically synthesized
tggtcttcatatttatttgttt

SEQ ID NO: 1339376 - DNA, 22 bp, Artificial Sequence
  chemically synthesized
tctggtcttcatatttatttgt

SEQ ID NO: 1339377 - DNA, 22 bp, Artificial Sequence
  chemically synthesized
ctctggtcttcatatttatttg

SEQ ID NO: 1339378 - DNA, 22 bp, Artificial Sequence
  chemically synthesized
tctctggtcttcatatttattt

SEQ ID NO: 1339379 - DNA, 22 bp, Artificial Sequence
  chemically synthesized
ttctctggtcttcatatttatt

SEQ ID NO: 1339380 - DNA, 22 bp, Artificial Sequence
  chemically synthesized
atgccaaaacaaataaatatga

SEQ ID NO: 1339381 - DNA, 22 bp, Artificial Sequence
  chemically synthesized
gatatcagatttttctctggtc

SEQ ID NO: 1339382 - DNA, 22 bp, Artificial Sequence
  chemically synthesized
ggatatcagatttttctctggt

SEQ ID NO: 1339383 - DNA, 22 bp, Artificial Sequence
  chemically synthesized
tggatatcagatttttctctgg

SEQ ID NO: 1339384 - DNA, 22 bp, Artificial Sequence
  chemically synthesized
cagtctttggatatcagatttt

SEQ ID NO: 1339385 - DNA, 22 bp, Artificial Sequence
  chemically synthesized
gattccagtctttggatatcag

SEQ ID NO: 1339386 - DNA, 22 bp, Artificial Sequence
  chemically synthesized
agattccagtctttggatatca

SEQ ID NO: 1339387 - DNA, 22 bp, Artificial Sequence
  chemically synthesized
tagattccagtctttggatatc

SEQ ID NO: 1339388 - DNA, 22 bp, Artificial Sequence
  chemically synthesized
ctttagattccagtctttggat

SEQ ID NO: 1339389 - DNA, 22 bp, Artificial Sequence
  chemically synthesized
actttagattccagtctttgga

SEQ ID NO: 1339390 - DNA, 22 bp, Artificial Sequence
  chemically synthesized
atcatttactttagattccagt

SEQ ID NO: 1339391 - DNA, 22 bp, Artificial Sequence
  chemically synthesized
catcatttactttagattccag

SEQ ID NO: 1339392 - DNA, 22 bp, Artificial Sequence
  chemically synthesized
atatccaaagactggaatctaa

SEQ ID NO: 1339393 - DNA, 22 bp, Artificial Sequence
  chemically synthesized
atatcttcatcatttactttag

SEQ ID NO: 1339394 - DNA, 22 bp, Artificial Sequence
  chemically synthesized
ctaatatcttcatcatttactt

SEQ ID NO: 1339395 - DNA, 22 bp, Artificial Sequence
  chemically synthesized
gaatctaaagtaaatgatgaag

SEQ ID NO: 1339396 - DNA, 22 bp, Artificial Sequence
  chemically synthesized
aagtaaatgatgaagatattag

SEQ ID NO: 1339397 - DNA, 22 bp, Artificial Sequence
  chemically synthesized
acagaaaacagattgctaatat

SEQ ID NO: 1339398 - DNA, 22 bp, Artificial Sequence
  chemically synthesized
aacagaaaacagattgctaata

SEQ ID NO: 1339399 - DNA, 22 bp, Artificial Sequence
  chemically synthesized
gcaatctgttttctgttaaatg

SEQ ID NO: 1339400 - DNA, 22 bp, Artificial Sequence
  chemically synthesized
ttttctgttaaatggattcctc

SEQ ID NO: 1339401 - DNA, 22 bp, Artificial Sequence
  chemically synthesized
tctgttaaatggattcctcttt

SEQ ID NO: 1339402 - DNA, 22 bp, Artificial Sequence
  chemically synthesized
ctgttaaatggattcctctttg

SEQ ID NO: 1339403 - DNA, 22 bp, Artificial Sequence
  chemically synthesized
tgttaaatggattcctctttgt

SEQ ID NO: 1339404 - DNA, 22 bp, Artificial Sequence
  chemically synthesized
tgtgcaaaggtaacaaagagga

SEQ ID NO: 1339405 - DNA, 22 bp, Artificial Sequence
  chemically synthesized
ttaaatggattcctctttgtta

SEQ ID NO: 1339406 - DNA, 22 bp, Artificial Sequence
  chemically synthesized
aatggattcctctttgttacct

SEQ ID NO: 1339407 - DNA, 22 bp, Artificial Sequence
  chemically synthesized
aatgtatgctgtgtgcaaaggt

SEQ ID NO: 1339408 - DNA, 22 bp, Artificial Sequence
  chemically synthesized
gaatgtatgctgtgtgcaaagg

SEQ ID NO: 1339409 - DNA, 22 bp, Artificial Sequence
  chemically synthesized
tgaatgtatgctgtgtgcaaag

SEQ ID NO: 1339410 - DNA, 22 bp, Artificial Sequence
  chemically synthesized
ctctttgttacctttgcacaca

SEQ ID NO: 1339411 - DNA, 22 bp, Artificial Sequence
  chemically synthesized
tttgttacctttgcacacagca

SEQ ID NO: 1339412 - DNA, 22 bp, Artificial Sequence
  chemically synthesized
tgttacctttgcacacagcata

SEQ ID NO: 1339413 - DNA, 22 bp, Artificial Sequence
  chemically synthesized
atattttgaatgtatgctgtgt

SEQ ID NO: 1339414 - DNA, 22 bp, Artificial Sequence
  chemically synthesized
gttacctttgcacacagcatac

SEQ ID NO: 1339415 - DNA, 22 bp, Artificial Sequence
  chemically synthesized
ttacctttgcacacagcataca

SEQ ID NO: 1339416 - DNA, 22 bp, Artificial Sequence
  chemically synthesized
taatattttgaatgtatgctgt

SEQ ID NO: 1339417 - DNA, 22 bp, Artificial Sequence
  chemically synthesized
ctaatattttgaatgtatgctg

SEQ ID NO: 1339418 - DNA, 22 bp, Artificial Sequence
  chemically synthesized
tctaatattttgaatgtatgct

SEQ ID NO: 1339419 - DNA, 22 bp, Artificial Sequence
  chemically synthesized
cctttgcacacagcatacattc

SEQ ID NO: 1339420 - DNA, 22 bp, Artificial Sequence
  chemically synthesized
ttctaatattttgaatgtatgc

SEQ ID NO: 1339421 - DNA, 22 bp, Artificial Sequence
  chemically synthesized
tttctaatattttgaatgtatg

SEQ ID NO: 1339422 - DNA, 22 bp, Artificial Sequence
  chemically synthesized
ttttctaatattttgaatgtat

SEQ ID NO: 1339423 - DNA, 22 bp, Artificial Sequence
  chemically synthesized
tgcacacagcatacattcaaaa

SEQ ID NO: 1339424 - DNA, 22 bp, Artificial Sequence
  chemically synthesized
gcacacagcatacattcaaaat

SEQ ID NO: 1339425 - DNA, 22 bp, Artificial Sequence
  chemically synthesized
cacacagcatacattcaaaata

SEQ ID NO: 1339426 - DNA, 22 bp, Artificial Sequence
  chemically synthesized
atttttttctaatattttgaat

SEQ ID NO: 1339427 - DNA, 22 bp, Artificial Sequence
  chemically synthesized
gatttttttctaatattttgaa

SEQ ID NO: 1339428 - DNA, 22 bp, Artificial Sequence
  chemically synthesized
aaacttgatttttttctaatat

SEQ ID NO: 1339429 - DNA, 22 bp, Artificial Sequence
  chemically synthesized
aaaatattagaaaaaaatcaag

SEQ ID NO: 1339430 - DNA, 22 bp, Artificial Sequence
  chemically synthesized
gaaaaaaatcaagtttcaactg

SEQ ID NO: 1339431 - DNA, 22 bp, Artificial Sequence
  chemically synthesized
ccaataaagcaaaccacagttg

SEQ ID NO: 1339432 - DNA, 22 bp, Artificial Sequence
  chemically synthesized
ctgccaataaagcaaaccacag

SEQ ID NO: 1339433 - DNA, 22 bp, Artificial Sequence
  chemically synthesized
acattactgccaataaagcaaa

SEQ ID NO: 1339434 - DNA, 22 bp, Artificial Sequence
  chemically synthesized
cacattactgccaataaagcaa

SEQ ID NO: 1339435 - DNA, 22 bp, Artificial Sequence
  chemically synthesized
caactgtggtttgctttattgg

SEQ ID NO: 1339436 - DNA, 22 bp, Artificial Sequence
  chemically synthesized
aactgtggtttgctttattggc

SEQ ID NO: 1339437 - DNA, 22 bp, Artificial Sequence
  chemically synthesized
atccttcacattactgccaata

SEQ ID NO: 1339438 - DNA, 22 bp, Artificial Sequence
  chemically synthesized
gatccttcacattactgccaat

SEQ ID NO: 1339439 - DNA, 22 bp, Artificial Sequence
  chemically synthesized
tggtttgctttattggcagtaa

SEQ ID NO: 1339440 - DNA, 22 bp, Artificial Sequence
  chemically synthesized
gctttattggcagtaatgtgaa

SEQ ID NO: 1339441 - DNA, 22 bp, Artificial Sequence
  chemically synthesized
agtacttgatccttcacattac

SEQ ID NO: 1339442 - DNA, 22 bp, Artificial Sequence
  chemically synthesized
ctttattggcagtaatgtgaag

SEQ ID NO: 1339443 - DNA, 22 bp, Artificial Sequence
  chemically synthesized
gagtacttgatccttcacatta

SEQ ID NO: 1339444 - DNA, 22 bp, Artificial Sequence
  chemically synthesized
tattggcagtaatgtgaaggat

SEQ ID NO: 1339445 - DNA, 22 bp, Artificial Sequence
  chemically synthesized
tttgagtacttgatccttcaca

SEQ ID NO: 1339446 - DNA, 22 bp, Artificial Sequence
  chemically synthesized
attggcagtaatgtgaaggatc

SEQ ID NO: 1339447 - DNA, 22 bp, Artificial Sequence
  chemically synthesized
ttggcagtaatgtgaaggatca

SEQ ID NO: 1339448 - DNA, 22 bp, Artificial Sequence
  chemically synthesized
gcagtaatgtgaaggatcaagt

SEQ ID NO: 1339449 - DNA, 22 bp, Artificial Sequence
  chemically synthesized
aattatttgagtacttgatcct

SEQ ID NO: 1339450 - DNA, 22 bp, Artificial Sequence
  chemically synthesized
aaattatttgagtacttgatcc

SEQ ID NO: 1339451 - DNA, 22 bp, Artificial Sequence
  chemically synthesized
cttaaattatttgagtacttga

SEQ ID NO: 1339452 - DNA, 22 bp, Artificial Sequence
  chemically synthesized
gcttaaattatttgagtacttg

SEQ ID NO: 1339453 - DNA, 22 bp, Artificial Sequence
  chemically synthesized
aaatttgcttaaattatttgag

SEQ ID NO: 1339454 - DNA, 22 bp, Artificial Sequence
  chemically synthesized
taaaatttgcttaaattatttg

SEQ ID NO: 1339455 - DNA, 22 bp, Artificial Sequence
  chemically synthesized
ctaaaatttgcttaaattattt

SEQ ID NO: 1339456 - DNA, 22 bp, Artificial Sequence
  chemically synthesized
tttctaaaatttgcttaaatta

SEQ ID NO: 1339457 - DNA, 22 bp, Artificial Sequence
  chemically synthesized
atttctaaaatttgcttaaatt

SEQ ID NO: 1339458 - DNA, 22 bp, Artificial Sequence
  chemically synthesized
ttatttctaaaatttgcttaaa

SEQ ID NO: 1339459 - DNA, 22 bp, Artificial Sequence
  chemically synthesized
aaataatttaagcaaattttag

SEQ ID NO: 1339460 - DNA, 22 bp, Artificial Sequence
  chemically synthesized
gacaacctcttatttctaaaat

SEQ ID NO: 1339461 - DNA, 22 bp, Artificial Sequence
  chemically synthesized
attagacaacctcttatttcta

SEQ ID NO: 1339462 - DNA, 22 bp, Artificial Sequence
  chemically synthesized
gattagacaacctcttatttct

SEQ ID NO: 1339463 - DNA, 22 bp, Artificial Sequence
  chemically synthesized
aagcaaattttagaaataagag

SEQ ID NO: 1339464 - DNA, 22 bp, Artificial Sequence
  chemically synthesized
tgattagacaacctcttatttc

SEQ ID NO: 1339465 - DNA, 22 bp, Artificial Sequence
  chemically synthesized
agcaaattttagaaataagagg

SEQ ID NO: 1339466 - DNA, 22 bp, Artificial Sequence
  chemically synthesized
tgttttgattagacaacctctt

SEQ ID NO: 1339467 - DNA, 22 bp, Artificial Sequence
  chemically synthesized
tagaaataagaggttgtctaat

SEQ ID NO: 1339468 - DNA, 22 bp, Artificial Sequence
  chemically synthesized
ggttgtgttttgattagacaac

SEQ ID NO: 1339469 - DNA, 22 bp, Artificial Sequence
  chemically synthesized
agaaataagaggttgtctaatc

SEQ ID NO: 1339470 - DNA, 22 bp, Artificial Sequence
  chemically synthesized
gaaataagaggttgtctaatca

SEQ ID NO: 1339471 - DNA, 22 bp, Artificial Sequence
  chemically synthesized
taggttgtgttttgattagaca

SEQ ID NO: 1339472 - DNA, 22 bp, Artificial Sequence
  chemically synthesized
ctaggttgtgttttgattagac

SEQ ID NO: 1339473 - DNA, 22 bp, Artificial Sequence
  chemically synthesized
tctaggttgtgttttgattaga

SEQ ID NO: 1339474 - DNA, 22 bp, Artificial Sequence
  chemically synthesized
tctttctaggttgtgttttgat

SEQ ID NO: 1339475 - DNA, 22 bp, Artificial Sequence
  chemically synthesized
gtctttctaggttgtgttttga

SEQ ID NO: 1339476 - DNA, 22 bp, Artificial Sequence
  chemically synthesized
tctaatcaaaacacaacctaga

SEQ ID NO: 1339477 - DNA, 22 bp, Artificial Sequence
  chemically synthesized
atcaaaacacaacctagaaaga

SEQ ID NO: 1339478 - DNA, 22 bp, Artificial Sequence
  chemically synthesized
gaaagacaaatattgcatgttc

SEQ ID NO: 1339479 - DNA, 22 bp, Artificial Sequence
  chemically synthesized
ccacatacgcgtgagaacatgc

SEQ ID NO: 1339480 - DNA, 22 bp, Artificial Sequence
  chemically synthesized
gctcccacatacgcgtgagaac

SEQ ID NO: 1339481 - DNA, 22 bp, Artificial Sequence
  chemically synthesized
agctcccacatacgcgtgagaa

SEQ ID NO: 1339482 - DNA, 22 bp, Artificial Sequence
  chemically synthesized
tagctcccacatacgcgtgaga

SEQ ID NO: 1339483 - DNA, 22 bp, Artificial Sequence
  chemically synthesized
ttagctcccacatacgcgtgag

SEQ ID NO: 1339484 - DNA, 22 bp, Artificial Sequence
  chemically synthesized
tttagctcccacatacgcgtga

SEQ ID NO: 1339485 - DNA, 22 bp, Artificial Sequence
  chemically synthesized
catgttctcacgcgtatgtggg

SEQ ID NO: 1339486 - DNA, 22 bp, Artificial Sequence
  chemically synthesized
tcacgcgtatgtgggagctaaa

SEQ ID NO: 1339487 - DNA, 22 bp, Artificial Sequence
  chemically synthesized
acgcgtatgtgggagctaaaaa

SEQ ID NO: 1339488 - DNA, 22 bp, Artificial Sequence
  chemically synthesized
catgagatcaattttttagctc

SEQ ID NO: 1339489 - DNA, 22 bp, Artificial Sequence
  chemically synthesized
cctccatgagatcaatttttta

SEQ ID NO: 1339490 - DNA, 22 bp, Artificial Sequence
  chemically synthesized
tacctccatgagatcaattttt

SEQ ID NO: 1339491 - DNA, 22 bp, Artificial Sequence
  chemically synthesized
ctacctccatgagatcaatttt

SEQ ID NO: 1339492 - DNA, 22 bp, Artificial Sequence
  chemically synthesized
tctacctccatgagatcaattt

SEQ ID NO: 1339493 - DNA, 22 bp, Artificial Sequence
  chemically synthesized
cactttctacctccatgagatc

SEQ ID NO: 1339494 - DNA, 22 bp, Artificial Sequence
  chemically synthesized
aaaaattgatctcatggaggta

SEQ ID NO: 1339495 - DNA, 22 bp, Artificial Sequence
  chemically synthesized
atctcatggaggtagaaagtgg

SEQ ID NO: 1339496 - DNA, 22 bp, Artificial Sequence
  chemically synthesized
gtaacaatcattccactttcta

SEQ ID NO: 1339497 - DNA, 22 bp, Artificial Sequence
  chemically synthesized
tggtaacaatcattccactttc

SEQ ID NO: 1339498 - DNA, 22 bp, Artificial Sequence
  chemically synthesized
atggaggtagaaagtggaatga

SEQ ID NO: 1339499 - DNA, 22 bp, Artificial Sequence
  chemically synthesized
ccagcctctggtaacaatcatt

SEQ ID NO: 1339500 - DNA, 22 bp, Artificial Sequence
  chemically synthesized
cccagcctctggtaacaatcat

SEQ ID NO: 1339501 - DNA, 22 bp, Artificial Sequence
  chemically synthesized
cccttcccagcctctggtaaca

SEQ ID NO: 1339502 - DNA, 22 bp, Artificial Sequence
  chemically synthesized
cccactacccttcccagcctct

SEQ ID NO: 1339503 - DNA, 22 bp, Artificial Sequence
  chemically synthesized
ttaccagaggctgggaagggta

SEQ ID NO: 1339504 - DNA, 22 bp, Artificial Sequence
  chemically synthesized
ccagaggctgggaagggtagtg

SEQ ID NO: 1339505 - DNA, 22 bp, Artificial Sequence
  chemically synthesized
atcaccccctccccactaccct

SEQ ID NO: 1339506 - DNA, 22 bp, Artificial Sequence
  chemically synthesized
catcaccccctccccactaccc

SEQ ID NO: 1339507 - DNA, 22 bp, Artificial Sequence
  chemically synthesized
ttcatcaccccctccccactac

SEQ ID NO: 1339508 - DNA, 22 bp, Artificial Sequence
  chemically synthesized
ggaagggtagtggggagggggt

SEQ ID NO: 1339509 - DNA, 22 bp, Artificial Sequence
  chemically synthesized
aacaagcccctcttcatcaccc

SEQ ID NO: 1339510 - DNA, 22 bp, Artificial Sequence
  chemically synthesized
attaaacaagcccctcttcatc

SEQ ID NO: 1339511 - DNA, 22 bp, Artificial Sequence
  chemically synthesized
tactcattaaacaagcccctct

SEQ ID NO: 1339512 - DNA, 22 bp, Artificial Sequence
  chemically synthesized
atactcattaaacaagcccctc

SEQ ID NO: 1339513 - DNA, 22 bp, Artificial Sequence
  chemically synthesized
tatactcattaaacaagcccct

SEQ ID NO: 1339514 - DNA, 22 bp, Artificial Sequence
  chemically synthesized
ttatactcattaaacaagcccc

SEQ ID NO: 1339515 - DNA, 22 bp, Artificial Sequence
  chemically synthesized
tatttttatactcattaaacaa

SEQ ID NO: 1339516 - DNA, 22 bp, Artificial Sequence
  chemically synthesized
actgtatttttatactcattaa

SEQ ID NO: 1339517 - DNA, 22 bp, Artificial Sequence
  chemically synthesized
gctaactgtatttttatactca

SEQ ID NO: 1339518 - DNA, 22 bp, Artificial Sequence
  chemically synthesized
ctagctaactgtatttttatac

SEQ ID NO: 1339519 - DNA, 22 bp, Artificial Sequence
  chemically synthesized
gtttaatgagtataaaaataca

SEQ ID NO: 1339520 - DNA, 22 bp, Artificial Sequence
  chemically synthesized
ctactagctaactgtattttta

SEQ ID NO: 1339521 - DNA, 22 bp, Artificial Sequence
  chemically synthesized
tttaatgagtataaaaatacag

SEQ ID NO: 1339522 - DNA, 22 bp, Artificial Sequence
  chemically synthesized
ttcctactagctaactgtattt

SEQ ID NO: 1339523 - DNA, 22 bp, Artificial Sequence
  chemically synthesized
aatgagtataaaaatacagtta

SEQ ID NO: 1339524 - DNA, 22 bp, Artificial Sequence
  chemically synthesized
attcctactagctaactgtatt

SEQ ID NO: 1339525 - DNA, 22 bp, Artificial Sequence
  chemically synthesized
atgagtataaaaatacagttag

SEQ ID NO: 1339526 - DNA, 22 bp, Artificial Sequence
  chemically synthesized
tattcctactagctaactgtat

SEQ ID NO: 1339527 - DNA, 22 bp, Artificial Sequence
  chemically synthesized
gattttattcctactagctaac

SEQ ID NO: 1339528 - DNA, 22 bp, Artificial Sequence
  chemically synthesized
tggtacagaacactagatttta

SEQ ID NO: 1339529 - DNA, 22 bp, Artificial Sequence
  chemically synthesized
gctagtaggaataaaatctagt

SEQ ID NO: 1339530 - DNA, 22 bp, Artificial Sequence
  chemically synthesized
ttgtggtacagaacactagatt

SEQ ID NO: 1339531 - DNA, 22 bp, Artificial Sequence
  chemically synthesized
gtaggaataaaatctagtgttc

SEQ ID NO: 1339532 - DNA, 22 bp, Artificial Sequence
  chemically synthesized
taatcaccctattgtggtacag

SEQ ID NO: 1339533 - DNA, 22 bp, Artificial Sequence
  chemically synthesized
actataatcaccctattgtggt

SEQ ID NO: 1339534 - DNA, 22 bp, Artificial Sequence
  chemically synthesized
gtgttctgtaccacaatagggt

SEQ ID NO: 1339535 - DNA, 22 bp, Artificial Sequence
  chemically synthesized
ttaactataatcaccctattgt

SEQ ID NO: 1339536 - DNA, 22 bp, Artificial Sequence
  chemically synthesized
ttgttaactataatcaccctat

SEQ ID NO: 1339537 - DNA, 22 bp, Artificial Sequence
  chemically synthesized
tgtaccacaatagggtgattat

SEQ ID NO: 1339538 - DNA, 22 bp, Artificial Sequence
  chemically synthesized
attattgttaactataatcacc

SEQ ID NO: 1339539 - DNA, 22 bp, Artificial Sequence
  chemically synthesized
taccacaatagggtgattatag

SEQ ID NO: 1339540 - DNA, 22 bp, Artificial Sequence
  chemically synthesized
aaataaacaattaattattgtt

SEQ ID NO: 1339541 - DNA, 22 bp, Artificial Sequence
  chemically synthesized
gaaataaacaattaattattgt

SEQ ID NO: 1339542 - DNA, 22 bp, Artificial Sequence
  chemically synthesized
atttgaaataaacaattaatta

SEQ ID NO: 1339543 - DNA, 22 bp, Artificial Sequence
  chemically synthesized
tagttaacaataattaattgtt

SEQ ID NO: 1339544 - DNA, 22 bp, Artificial Sequence
  chemically synthesized
cagttaatttgaaataaacaat

SEQ ID NO: 1339545 - DNA, 22 bp, Artificial Sequence
  chemically synthesized
acaataattaattgtttatttc

SEQ ID NO: 1339546 - DNA, 22 bp, Artificial Sequence
  chemically synthesized
ctccagttaatttgaaataaac

SEQ ID NO: 1339547 - DNA, 22 bp, Artificial Sequence
  chemically synthesized
ctcctccagttaatttgaaata

SEQ ID NO: 1339548 - DNA, 22 bp, Artificial Sequence
  chemically synthesized
attgtttatttcaaattaactg

SEQ ID NO: 1339549 - DNA, 22 bp, Artificial Sequence
  chemically synthesized
caagtctactcctccagttaat

SEQ ID NO: 1339550 - DNA, 22 bp, Artificial Sequence
  chemically synthesized
tttatttcaaattaactggagg

SEQ ID NO: 1339551 - DNA, 22 bp, Artificial Sequence
  chemically synthesized
atttcaaattaactggaggagt

SEQ ID NO: 1339552 - DNA, 22 bp, Artificial Sequence
  chemically synthesized
tttcaaattaactggaggagta

SEQ ID NO: 1339553 - DNA, 22 bp, Artificial Sequence
  chemically synthesized
caaattaactggaggagtagac

SEQ ID NO: 1339554 - DNA, 22 bp, Artificial Sequence
  chemically synthesized
ggaacattccaagtctactcct

SEQ ID NO: 1339555 - DNA, 22 bp, Artificial Sequence
  chemically synthesized
aaattaactggaggagtagact

SEQ ID NO: 1339556 - DNA, 22 bp, Artificial Sequence
  chemically synthesized
tgttgggaacattccaagtcta

SEQ ID NO: 1339557 - DNA, 22 bp, Artificial Sequence
  chemically synthesized
gtgttgggaacattccaagtct

SEQ ID NO: 1339558 - DNA, 22 bp, Artificial Sequence
  chemically synthesized
actggaggagtagacttggaat

SEQ ID NO: 1339559 - DNA, 22 bp, Artificial Sequence
  chemically synthesized
tttgtgttgggaacattccaag

SEQ ID NO: 1339560 - DNA, 22 bp, Artificial Sequence
  chemically synthesized
atttgtgttgggaacattccaa

SEQ ID NO: 1339561 - DNA, 22 bp, Artificial Sequence
  chemically synthesized
gaggagtagacttggaatgttc

SEQ ID NO: 1339562 - DNA, 22 bp, Artificial Sequence
  chemically synthesized
tcatttatttgtgttgggaaca

SEQ ID NO: 1339563 - DNA, 22 bp, Artificial Sequence
  chemically synthesized
atcatttatttgtgttgggaac

SEQ ID NO: 1339564 - DNA, 22 bp, Artificial Sequence
  chemically synthesized
ggaatgttcccaacacaaataa

SEQ ID NO: 1339565 - DNA, 22 bp, Artificial Sequence
  chemically synthesized
gaatgttcccaacacaaataaa

SEQ ID NO: 1339566 - DNA, 22 bp, Artificial Sequence
  chemically synthesized
aaacatttatcatttatttgtg

SEQ ID NO: 1339567 - DNA, 22 bp, Artificial Sequence
  chemically synthesized
cctcaaacatttatcatttatt

SEQ ID NO: 1339568 - DNA, 22 bp, Artificial Sequence
  chemically synthesized
ccaacacaaataaatgataaat

SEQ ID NO: 1339569 - DNA, 22 bp, Artificial Sequence
  chemically synthesized
attacctcaaacatttatcatt

SEQ ID NO: 1339570 - DNA, 22 bp, Artificial Sequence
  chemically synthesized
gaatattcattacctcaaacat

SEQ ID NO: 1339571 - DNA, 22 bp, Artificial Sequence
  chemically synthesized
gaggtaatgaatattccaatta

SEQ ID NO: 1339572 - DNA, 22 bp, Artificial Sequence
  chemically synthesized
aggtaatgaatattccaattat

SEQ ID NO: 1339573 - DNA, 22 bp, Artificial Sequence
  chemically synthesized
taataatcaaatcaggataatt

SEQ ID NO: 1339574 - DNA, 22 bp, Artificial Sequence
  chemically synthesized
caattatcctgatttgattatt

SEQ ID NO: 1339575 - DNA, 22 bp, Artificial Sequence
  chemically synthesized
tcctgatttgattattacagat

SEQ ID NO: 1339576 - DNA, 22 bp, Artificial Sequence
  chemically synthesized
atacaggcatacaatctgtaat

SEQ ID NO: 1339577 - DNA, 22 bp, Artificial Sequence
  chemically synthesized
gatacaggcatacaatctgtaa

SEQ ID NO: 1339578 - DNA, 22 bp, Artificial Sequence
  chemically synthesized
tgatacaggcatacaatctgta

SEQ ID NO: 1339579 - DNA, 22 bp, Artificial Sequence
  chemically synthesized
atttgattattacagattgtat

SEQ ID NO: 1339580 - DNA, 22 bp, Artificial Sequence
  chemically synthesized
gattattacagattgtatgcct

SEQ ID NO: 1339581 - DNA, 22 bp, Artificial Sequence
  chemically synthesized
attattacagattgtatgcctg

SEQ ID NO: 1339582 - DNA, 22 bp, Artificial Sequence
  chemically synthesized
ttacagattgtatgcctgtatc

SEQ ID NO: 1339583 - DNA, 22 bp, Artificial Sequence
  chemically synthesized
cagattgtatgcctgtatcaaa

SEQ ID NO: 1339584 - DNA, 22 bp, Artificial Sequence
  chemically synthesized
tgaaatacatgtgatattttga

SEQ ID NO: 1339585 - DNA, 22 bp, Artificial Sequence
  chemically synthesized
atgaaatacatgtgatattttg

SEQ ID NO: 1339586 - DNA, 22 bp, Artificial Sequence
  chemically synthesized
tatgcctgtatcaaaatatcac

SEQ ID NO: 1339587 - DNA, 22 bp, Artificial Sequence
  chemically synthesized
tatcaaaatatcacatgtattt

SEQ ID NO: 1339588 - DNA, 22 bp, Artificial Sequence
  chemically synthesized
tacatatttatgaaatacatgt

SEQ ID NO: 1339589 - DNA, 22 bp, Artificial Sequence
  chemically synthesized
tgggtacgtaagagttgtacat

SEQ ID NO: 1339590 - DNA, 22 bp, Artificial Sequence
  chemically synthesized
ttgtgggtacgtaagagttgta

SEQ ID NO: 1339591 - DNA, 22 bp, Artificial Sequence
  chemically synthesized
cataaatatgtacaactcttac

SEQ ID NO: 1339592 - DNA, 22 bp, Artificial Sequence
  chemically synthesized
ataaatatgtacaactcttacg

SEQ ID NO: 1339593 - DNA, 22 bp, Artificial Sequence
  chemically synthesized
attattgtgggtacgtaagagt

SEQ ID NO: 1339594 - DNA, 22 bp, Artificial Sequence
  chemically synthesized
aattattgtgggtacgtaagag

SEQ ID NO: 1339595 - DNA, 22 bp, Artificial Sequence
  chemically synthesized
taattattgtgggtacgtaaga

SEQ ID NO: 1339596 - DNA, 22 bp, Artificial Sequence
  chemically synthesized
ttaattattgtgggtacgtaag

SEQ ID NO: 1339597 - DNA, 22 bp, Artificial Sequence
  chemically synthesized
tttaattattgtgggtacgtaa

SEQ ID NO: 1339598 - DNA, 22 bp, Artificial Sequence
  chemically synthesized
tttttaattattgtgggtacgt

SEQ ID NO: 1339599 - DNA, 22 bp, Artificial Sequence
  chemically synthesized
ctttttaattattgtgggtacg

SEQ ID NO: 1339600 - DNA, 22 bp, Artificial Sequence
  chemically synthesized
ttctttttaattattgtgggta

SEQ ID NO: 1339601 - DNA, 22 bp, Artificial Sequence
  chemically synthesized
cttctttttaattattgtgggt

SEQ ID NO: 1339602 - DNA, 22 bp, Artificial Sequence
  chemically synthesized
tcttctttttaattattgtggg

SEQ ID NO: 1339603 - DNA, 22 bp, Artificial Sequence
  chemically synthesized
tttcttctttttaattattgtg

SEQ ID NO: 1339604 - DNA, 22 bp, Artificial Sequence
  chemically synthesized
ctttcttctttttaattattgt

SEQ ID NO: 1339605 - DNA, 22 bp, Artificial Sequence
  chemically synthesized
tctttcttctttttaattattg

SEQ ID NO: 1339606 - DNA, 22 bp, Artificial Sequence
  chemically synthesized
ttacgtacccacaataattaaa

SEQ ID NO: 1339607 - DNA, 22 bp, Artificial Sequence
  chemically synthesized
ttctttcttctttttaattatt

SEQ ID NO: 1339608 - DNA, 22 bp, Artificial Sequence
  chemically synthesized
acgtacccacaataattaaaaa

SEQ ID NO: 1339609 - DNA, 22 bp, Artificial Sequence
  chemically synthesized
cgtacccacaataattaaaaag

SEQ ID NO: 1339610 - DNA, 22 bp, Artificial Sequence
  chemically synthesized
tttttctttcttctttttaatt

SEQ ID NO: 1339611 - DNA, 22 bp, Artificial Sequence
  chemically synthesized
gtttttctttcttctttttaat

SEQ ID NO: 1339612 - DNA, 22 bp, Artificial Sequence
  chemically synthesized
tgtttttctttcttctttttaa

SEQ ID NO: 1339613 - DNA, 22 bp, Artificial Sequence
  chemically synthesized
tgatatgttttgtttttctttc

SEQ ID NO: 1339614 - DNA, 22 bp, Artificial Sequence
  chemically synthesized
gtgatatgttttgtttttcttt

SEQ ID NO: 1339615 - DNA, 22 bp, Artificial Sequence
  chemically synthesized
tgtgatatgttttgtttttctt

SEQ ID NO: 1339616 - DNA, 22 bp, Artificial Sequence
  chemically synthesized
aaaagaagaaagaaaaacaaaa

SEQ ID NO: 1339617 - DNA, 22 bp, Artificial Sequence
  chemically synthesized
cgtcatcctttgtgatatgttt

SEQ ID NO: 1339618 - DNA, 22 bp, Artificial Sequence
  chemically synthesized
atcaatcaagctacgtcatcct

SEQ ID NO: 1339619 - DNA, 22 bp, Artificial Sequence
  chemically synthesized
attcatcaatcaagctacgtca

SEQ ID NO: 1339620 - DNA, 22 bp, Artificial Sequence
  chemically synthesized
ttaattcatcaatcaagctacg

SEQ ID NO: 1339621 - DNA, 22 bp, Artificial Sequence
  chemically synthesized
catacactattaattcatcaat

SEQ ID NO: 1339622 - DNA, 22 bp, Artificial Sequence
  chemically synthesized
gttgcatacactattaattcat

SEQ ID NO: 1339623 - DNA, 22 bp, Artificial Sequence
  chemically synthesized
agttgcatacactattaattca

SEQ ID NO: 1339624 - DNA, 22 bp, Artificial Sequence
  chemically synthesized
gattgatgaattaatagtgtat

SEQ ID NO: 1339625 - DNA, 22 bp, Artificial Sequence
  chemically synthesized
attgatgaattaatagtgtatg

SEQ ID NO: 1339626 - DNA, 22 bp, Artificial Sequence
  chemically synthesized
caatcatcttagttgcatacac

SEQ ID NO: 1339627 - DNA, 22 bp, Artificial Sequence
  chemically synthesized
atgaattaatagtgtatgcaac

SEQ ID NO: 1339628 - DNA, 22 bp, Artificial Sequence
  chemically synthesized
tccaatcatcttagttgcatac

SEQ ID NO: 1339629 - DNA, 22 bp, Artificial Sequence
  chemically synthesized
cactctccaatcatcttagttg

SEQ ID NO: 1339630 - DNA, 22 bp, Artificial Sequence
  chemically synthesized
atagtgtatgcaactaagatga

SEQ ID NO: 1339631 - DNA, 22 bp, Artificial Sequence
  chemically synthesized
aggtctacactctccaatcatc

SEQ ID NO: 1339632 - DNA, 22 bp, Artificial Sequence
  chemically synthesized
atggactaaggtctacactctc

SEQ ID NO: 1339633 - DNA, 22 bp, Artificial Sequence
  chemically synthesized
catggactaaggtctacactct

SEQ ID NO: 1339634 - DNA, 22 bp, Artificial Sequence
  chemically synthesized
tcatggactaaggtctacactc

SEQ ID NO: 1339635 - DNA, 22 bp, Artificial Sequence
  chemically synthesized
agatgattggagagtgtagacc

SEQ ID NO: 1339636 - DNA, 22 bp, Artificial Sequence
  chemically synthesized
ctttcatggactaaggtctaca

SEQ ID NO: 1339637 - DNA, 22 bp, Artificial Sequence
  chemically synthesized
cctttcatggactaaggtctac

SEQ ID NO: 1339638 - DNA, 22 bp, Artificial Sequence
  chemically synthesized
tcctttcatggactaaggtcta

SEQ ID NO: 1339639 - DNA, 22 bp, Artificial Sequence
  chemically synthesized
attttcctttcatggactaagg

SEQ ID NO: 1339640 - DNA, 22 bp, Artificial Sequence
  chemically synthesized
gagagtgtagaccttagtccat

SEQ ID NO: 1339641 - DNA, 22 bp, Artificial Sequence
  chemically synthesized
tgattttcctttcatggactaa

SEQ ID NO: 1339642 - DNA, 22 bp, Artificial Sequence
  chemically synthesized
tgaaaactctgattttcctttc

SEQ ID NO: 1339643 - DNA, 22 bp, Artificial Sequence
  chemically synthesized
tgtgaaaactctgattttcctt

SEQ ID NO: 1339644 - DNA, 22 bp, Artificial Sequence
  chemically synthesized
tctgtgaaaactctgattttcc

SEQ ID NO: 1339645 - DNA, 22 bp, Artificial Sequence
  chemically synthesized
agtccatgaaaggaaaatcaga

SEQ ID NO: 1339646 - DNA, 22 bp, Artificial Sequence
  chemically synthesized
gtccatgaaaggaaaatcagag

SEQ ID NO: 1339647 - DNA, 22 bp, Artificial Sequence
  chemically synthesized
ctctctgtgaaaactctgattt

SEQ ID NO: 1339648 - DNA, 22 bp, Artificial Sequence
  chemically synthesized
gctctctgtgaaaactctgatt

SEQ ID NO: 1339649 - DNA, 22 bp, Artificial Sequence
  chemically synthesized
tgctctctgtgaaaactctgat

SEQ ID NO: 1339650 - DNA, 22 bp, Artificial Sequence
  chemically synthesized
ttgctctctgtgaaaactctga

SEQ ID NO: 1339651 - DNA, 22 bp, Artificial Sequence
  chemically synthesized
tcacagagagcaaaagggtgat

SEQ ID NO: 1339652 - DNA, 22 bp, Artificial Sequence
  chemically synthesized
cacagagagcaaaagggtgatt

SEQ ID NO: 1339653 - DNA, 22 bp, Artificial Sequence
  chemically synthesized
acagagagcaaaagggtgattc

SEQ ID NO: 1339654 - DNA, 22 bp, Artificial Sequence
  chemically synthesized
gagagaaatccaaagacaagat

SEQ ID NO: 1339655 - DNA, 22 bp, Artificial Sequence
  chemically synthesized
tggctggagagaaatccaaaga

SEQ ID NO: 1339656 - DNA, 22 bp, Artificial Sequence
  chemically synthesized
tatcttgtctttggatttctct

SEQ ID NO: 1339657 - DNA, 22 bp, Artificial Sequence
  chemically synthesized
tcttgtctttggatttctctcc

SEQ ID NO: 1339658 - DNA, 22 bp, Artificial Sequence
  chemically synthesized
gtctttggatttctctccagcc

SEQ ID NO: 1339659 - DNA, 22 bp, Artificial Sequence
  chemically synthesized
tctttggatttctctccagcca

SEQ ID NO: 1339660 - DNA, 22 bp, Artificial Sequence
  chemically synthesized
tggatttctctccagccataga

SEQ ID NO: 1339661 - DNA, 22 bp, Artificial Sequence
  chemically synthesized
ggatttctctccagccatagat

SEQ ID NO: 1339662 - DNA, 22 bp, Artificial Sequence
  chemically synthesized
gatttctctccagccatagatg

SEQ ID NO: 1339663 - DNA, 22 bp, Artificial Sequence
  chemically synthesized
ctctccagccatagatgcacac

SEQ ID NO: 1339664 - DNA, 22 bp, Artificial Sequence
  chemically synthesized
tctccagccatagatgcacacg

SEQ ID NO: 1339665 - DNA, 22 bp, Artificial Sequence
  chemically synthesized
tccagccatagatgcacacgct

SEQ ID NO: 1339666 - DNA, 22 bp, Artificial Sequence
  chemically synthesized
cagccatagatgcacacgctcg

SEQ ID NO: 1339667 - DNA, 22 bp, Artificial Sequence
  chemically synthesized
gatggtggagtaaggtatgcaa

SEQ ID NO: 1339668 - DNA, 22 bp, Artificial Sequence
  chemically synthesized
agatggtggagtaaggtatgca

SEQ ID NO: 1339669 - DNA, 22 bp, Artificial Sequence
  chemically synthesized
tagatggtggagtaaggtatgc

SEQ ID NO: 1339670 - DNA, 22 bp, Artificial Sequence
  chemically synthesized
ttagatggtggagtaaggtatg

SEQ ID NO: 1339671 - DNA, 22 bp, Artificial Sequence
  chemically synthesized
tttagatggtggagtaaggtat

SEQ ID NO: 1339672 - DNA, 22 bp, Artificial Sequence
  chemically synthesized
gctacctttgcataccttactc

SEQ ID NO: 1339673 - DNA, 22 bp, Artificial Sequence
  chemically synthesized
cctttgcataccttactccacc

SEQ ID NO: 1339674 - DNA, 22 bp, Artificial Sequence
  chemically synthesized
tgcataccttactccaccatct

SEQ ID NO: 1339675 - DNA, 22 bp, Artificial Sequence
  chemically synthesized
gcataccttactccaccatcta

SEQ ID NO: 1339676 - DNA, 22 bp, Artificial Sequence
  chemically synthesized
cataccttactccaccatctaa

SEQ ID NO: 1339677 - DNA, 22 bp, Artificial Sequence
  chemically synthesized
aaataaaaggaaactttttaga

SEQ ID NO: 1339678 - DNA, 22 bp, Artificial Sequence
  chemically synthesized
actccaccatctaaaaagtttc

SEQ ID NO: 1339679 - DNA, 22 bp, Artificial Sequence
  chemically synthesized
ctccaccatctaaaaagtttcc

SEQ ID NO: 1339680 - DNA, 22 bp, Artificial Sequence
  chemically synthesized
caccatctaaaaagtttccttt

SEQ ID NO: 1339681 - DNA, 22 bp, Artificial Sequence
  chemically synthesized
cagtggtattgaaataaaagga

SEQ ID NO: 1339682 - DNA, 22 bp, Artificial Sequence
  chemically synthesized
ccagtggtattgaaataaaagg

SEQ ID NO: 1339683 - DNA, 22 bp, Artificial Sequence
  chemically synthesized
tccagtggtattgaaataaaag

SEQ ID NO: 1339684 - DNA, 22 bp, Artificial Sequence
  chemically synthesized
aaaagtttccttttatttcaat

SEQ ID NO: 1339685 - DNA, 22 bp, Artificial Sequence
  chemically synthesized
ccttttatttcaataccactgg

SEQ ID NO: 1339686 - DNA, 22 bp, Artificial Sequence
  chemically synthesized
cttttatttcaataccactgga

SEQ ID NO: 1339687 - DNA, 22 bp, Artificial Sequence
  chemically synthesized
ttatttcaataccactggaaaa

SEQ ID NO: 1339688 - DNA, 22 bp, Artificial Sequence
  chemically synthesized
tatttcaataccactggaaaac

SEQ ID NO: 1339689 - DNA, 22 bp, Artificial Sequence
  chemically synthesized
atttcaataccactggaaaacc

SEQ ID NO: 1339690 - DNA, 22 bp, Artificial Sequence
  chemically synthesized
tttcaataccactggaaaaccc

SEQ ID NO: 1339691 - DNA, 22 bp, Artificial Sequence
  chemically synthesized
caataccactggaaaacccacc

SEQ ID NO: 1339692 - DNA, 22 bp, Artificial Sequence
  chemically synthesized
aataccactggaaaacccacca

SEQ ID NO: 1339693 - DNA, 22 bp, Artificial Sequence
  chemically synthesized
tgatgaaggaaatggtgggttt

SEQ ID NO: 1339694 - DNA, 22 bp, Artificial Sequence
  chemically synthesized
atctatgatgaaggaaatggtg

SEQ ID NO: 1339695 - DNA, 22 bp, Artificial Sequence
  chemically synthesized
aatctatgatgaaggaaatggt

SEQ ID NO: 1339696 - DNA, 22 bp, Artificial Sequence
  chemically synthesized
ttaatctatgatgaaggaaatg

SEQ ID NO: 1339697 - DNA, 22 bp, Artificial Sequence
  chemically synthesized
cttaatctatgatgaaggaaat

SEQ ID NO: 1339698 - DNA, 22 bp, Artificial Sequence
  chemically synthesized
gaaaacccaccatttccttcat

SEQ ID NO: 1339699 - DNA, 22 bp, Artificial Sequence
  chemically synthesized
tcttaatctatgatgaaggaaa

SEQ ID NO: 1339700 - DNA, 22 bp, Artificial Sequence
  chemically synthesized
tttcttaatctatgatgaagga

SEQ ID NO: 1339701 - DNA, 22 bp, Artificial Sequence
  chemically synthesized
ccttcatcatagattaagaaag

SEQ ID NO: 1339702 - DNA, 22 bp, Artificial Sequence
  chemically synthesized
cttcatcatagattaagaaaga

SEQ ID NO: 1339703 - DNA, 22 bp, Artificial Sequence
  chemically synthesized
agaaaaacccactctttcttaa

SEQ ID NO: 1339704 - DNA, 22 bp, Artificial Sequence
  chemically synthesized
cagaaaaacccactctttctta

SEQ ID NO: 1339705 - DNA, 22 bp, Artificial Sequence
  chemically synthesized
catcatagattaagaaagagtg

SEQ ID NO: 1339706 - DNA, 22 bp, Artificial Sequence
  chemically synthesized
atcatagattaagaaagagtgg

SEQ ID NO: 1339707 - DNA, 22 bp, Artificial Sequence
  chemically synthesized
gaacttcagaaaaacccactct

SEQ ID NO: 1339708 - DNA, 22 bp, Artificial Sequence
  chemically synthesized
agaaagagtgggtttttctgaa

SEQ ID NO: 1339709 - DNA, 22 bp, Artificial Sequence
  chemically synthesized
acaatggtagttggaacttcag

SEQ ID NO: 1339710 - DNA, 22 bp, Artificial Sequence
  chemically synthesized
aaagcattaacaatggtagttg

SEQ ID NO: 1339711 - DNA, 22 bp, Artificial Sequence
  chemically synthesized
ttctgaagttccaactaccatt

SEQ ID NO: 1339712 - DNA, 22 bp, Artificial Sequence
  chemically synthesized
tctgaagttccaactaccattg

SEQ ID NO: 1339713 - DNA, 22 bp, Artificial Sequence
  chemically synthesized
ctgaagttccaactaccattgt

SEQ ID NO: 1339714 - DNA, 22 bp, Artificial Sequence
  chemically synthesized
tgaagttccaactaccattgtt

SEQ ID NO: 1339715 - DNA, 22 bp, Artificial Sequence
  chemically synthesized
aagttccaactaccattgttaa

SEQ ID NO: 1339716 - DNA, 22 bp, Artificial Sequence
  chemically synthesized
caactaccattgttaatgcttt

SEQ ID NO: 1339717 - DNA, 22 bp, Artificial Sequence
  chemically synthesized
ccattgttaatgctttcaatct

SEQ ID NO: 1339718 - DNA, 22 bp, Artificial Sequence
  chemically synthesized
ttaatgctttcaatctattgtc

SEQ ID NO: 1339719 - DNA, 22 bp, Artificial Sequence
  chemically synthesized
atgctttcaatctattgtctat

SEQ ID NO: 1339720 - DNA, 22 bp, Artificial Sequence
  chemically synthesized
tcaatctattgtctattttcca

SEQ ID NO: 1339721 - DNA, 22 bp, Artificial Sequence
  chemically synthesized
caatctattgtctattttccat

SEQ ID NO: 1339722 - DNA, 22 bp, Artificial Sequence
  chemically synthesized
aatctattgtctattttccatg

SEQ ID NO: 1339723 - DNA, 22 bp, Artificial Sequence
  chemically synthesized
acacaatcataagcatggaaaa

SEQ ID NO: 1339724 - DNA, 22 bp, Artificial Sequence
  chemically synthesized
ttgtctattttccatgcttatg

SEQ ID NO: 1339725 - DNA, 22 bp, Artificial Sequence
  chemically synthesized
tctattttccatgcttatgatt

SEQ ID NO: 1339726 - DNA, 22 bp, Artificial Sequence
  chemically synthesized
cacatgggctgacacaatcata

SEQ ID NO: 1339727 - DNA, 22 bp, Artificial Sequence
  chemically synthesized
ttttccatgcttatgattgtgt

SEQ ID NO: 1339728 - DNA, 22 bp, Artificial Sequence
  chemically synthesized
tccatgcttatgattgtgtcag

SEQ ID NO: 1339729 - DNA, 22 bp, Artificial Sequence
  chemically synthesized
gttacacatgggctgacacaat

SEQ ID NO: 1339730 - DNA, 22 bp, Artificial Sequence
  chemically synthesized
ccatgcttatgattgtgtcagc

SEQ ID NO: 1339731 - DNA, 22 bp, Artificial Sequence
  chemically synthesized
catgcttatgattgtgtcagcc

SEQ ID NO: 1339732 - DNA, 22 bp, Artificial Sequence
  chemically synthesized
atgattgtgtcagcccatgtgt

SEQ ID NO: 1339733 - DNA, 22 bp, Artificial Sequence
  chemically synthesized
tgattgtgtcagcccatgtgta

SEQ ID NO: 1339734 - DNA, 22 bp, Artificial Sequence
  chemically synthesized
gtaagagttagttacacatggg

SEQ ID NO: 1339735 - DNA, 22 bp, Artificial Sequence
  chemically synthesized
ggtaagagttagttacacatgg

SEQ ID NO: 1339736 - DNA, 22 bp, Artificial Sequence
  chemically synthesized
tgtcagcccatgtgtaactaac

SEQ ID NO: 1339737 - DNA, 22 bp, Artificial Sequence
  chemically synthesized
aacttggtaagagttagttaca

SEQ ID NO: 1339738 - DNA, 22 bp, Artificial Sequence
  chemically synthesized
caacttggtaagagttagttac

SEQ ID NO: 1339739 - DNA, 22 bp, Artificial Sequence
  chemically synthesized
gtgaacgtatttcaacttggta

SEQ ID NO: 1339740 - DNA, 22 bp, Artificial Sequence
  chemically synthesized
agtgaacgtatttcaacttggt

SEQ ID NO: 1339741 - DNA, 22 bp, Artificial Sequence
  chemically synthesized
actcttaccaagttgaaatacg

SEQ ID NO: 1339742 - DNA, 22 bp, Artificial Sequence
  chemically synthesized
ttaccaagttgaaatacgttca

SEQ ID NO: 1339743 - DNA, 22 bp, Artificial Sequence
  chemically synthesized
accaagttgaaatacgttcact

SEQ ID NO: 1339744 - DNA, 22 bp, Artificial Sequence
  chemically synthesized
ccaagttgaaatacgttcacta

SEQ ID NO: 1339745 - DNA, 22 bp, Artificial Sequence
  chemically synthesized
tgcaaaaaagaaccttagtgaa

SEQ ID NO: 1339746 - DNA, 22 bp, Artificial Sequence
  chemically synthesized
atgcaaaaaagaaccttagtga

SEQ ID NO: 1339747 - DNA, 22 bp, Artificial Sequence
  chemically synthesized
aaatacgttcactaaggttctt

SEQ ID NO: 1339748 - DNA, 22 bp, Artificial Sequence
  chemically synthesized
tacaggtcttatgcaaaaaaga

SEQ ID NO: 1339749 - DNA, 22 bp, Artificial Sequence
  chemically synthesized
tatacaggtcttatgcaaaaaa

SEQ ID NO: 1339750 - DNA, 22 bp, Artificial Sequence
  chemically synthesized
actaaggttcttttttgcataa

SEQ ID NO: 1339751 - DNA, 22 bp, Artificial Sequence
  chemically synthesized
ttctatacaggtcttatgcaaa

SEQ ID NO: 1339752 - DNA, 22 bp, Artificial Sequence
  chemically synthesized
aggttcttttttgcataagacc

SEQ ID NO: 1339753 - DNA, 22 bp, Artificial Sequence
  chemically synthesized
ttttttgcataagacctgtata

SEQ ID NO: 1339754 - DNA, 22 bp, Artificial Sequence
  chemically synthesized
ttttgcataagacctgtataga

SEQ ID NO: 1339755 - DNA, 22 bp, Artificial Sequence
  chemically synthesized
tttgcataagacctgtatagaa

SEQ ID NO: 1339756 - DNA, 22 bp, Artificial Sequence
  chemically synthesized
aatatatagctattctatacag

SEQ ID NO: 1339757 - DNA, 22 bp, Artificial Sequence
  chemically synthesized
ttgcataagacctgtatagaat

SEQ ID NO: 1339758 - DNA, 22 bp, Artificial Sequence
  chemically synthesized
tgcataagacctgtatagaata

SEQ ID NO: 1339759 - DNA, 22 bp, Artificial Sequence
  chemically synthesized
gcataagacctgtatagaatag

SEQ ID NO: 1339760 - DNA, 22 bp, Artificial Sequence
  chemically synthesized
ctcaatatatagctattctata

SEQ ID NO: 1339761 - DNA, 22 bp, Artificial Sequence
  chemically synthesized
cataagacctgtatagaatagc

SEQ ID NO: 1339762 - DNA, 22 bp, Artificial Sequence
  chemically synthesized
attcctcaatatatagctattc

SEQ ID NO: 1339763 - DNA, 22 bp, Artificial Sequence
  chemically synthesized
ttaattcctcaatatatagcta

SEQ ID NO: 1339764 - DNA, 22 bp, Artificial Sequence
  chemically synthesized
tattaattcctcaatatatagc

SEQ ID NO: 1339765 - DNA, 22 bp, Artificial Sequence
  chemically synthesized
tatagaatagctatatattgag

SEQ ID NO: 1339766 - DNA, 22 bp, Artificial Sequence
  chemically synthesized
ttctattaattcctcaatatat

SEQ ID NO: 1339767 - DNA, 22 bp, Artificial Sequence
  chemically synthesized
ctgttctattaattcctcaata

SEQ ID NO: 1339768 - DNA, 22 bp, Artificial Sequence
  chemically synthesized
tatattgaggaattaatagaac

SEQ ID NO: 1339769 - DNA, 22 bp, Artificial Sequence
  chemically synthesized
aggaattaatagaacagcaata

SEQ ID NO: 1339770 - DNA, 22 bp, Artificial Sequence
  chemically synthesized
gtatataaaaaatattgctgtt

SEQ ID NO: 1339771 - DNA, 22 bp, Artificial Sequence
  chemically synthesized
gtggttggtatataaaaaatat

SEQ ID NO: 1339772 - DNA, 22 bp, Artificial Sequence
  chemically synthesized
atagaacagcaatattttttat

SEQ ID NO: 1339773 - DNA, 22 bp, Artificial Sequence
  chemically synthesized
actcgtggttggtatataaaaa

SEQ ID NO: 1339774 - DNA, 22 bp, Artificial Sequence
  chemically synthesized
gtatagtatctcactcgtggtt

SEQ ID NO: 1339775 - DNA, 22 bp, Artificial Sequence
  chemically synthesized
tttatataccaaccacgagtga

SEQ ID NO: 1339776 - DNA, 22 bp, Artificial Sequence
  chemically synthesized
ttatataccaaccacgagtgag

SEQ ID NO: 1339777 - DNA, 22 bp, Artificial Sequence
  chemically synthesized
tatataccaaccacgagtgaga

SEQ ID NO: 1339778 - DNA, 22 bp, Artificial Sequence
  chemically synthesized
atataccaaccacgagtgagat

SEQ ID NO: 1339779 - DNA, 22 bp, Artificial Sequence
  chemically synthesized
tataccaaccacgagtgagata

SEQ ID NO: 1339780 - DNA, 22 bp, Artificial Sequence
  chemically synthesized
caaaaatacatgaataacacct

SEQ ID NO: 1339781 - DNA, 22 bp, Artificial Sequence
  chemically synthesized
tactaggtgttattcatgtatt

SEQ ID NO: 1339782 - DNA, 22 bp, Artificial Sequence
  chemically synthesized
tgaagttacaaaaatacatgaa

SEQ ID NO: 1339783 - DNA, 22 bp, Artificial Sequence
  chemically synthesized
ttgtgaagttacaaaaatacat

SEQ ID NO: 1339784 - DNA, 22 bp, Artificial Sequence
  chemically synthesized
ggtgttattcatgtatttttgt

SEQ ID NO: 1339785 - DNA, 22 bp, Artificial Sequence
  chemically synthesized
ttcatgtatttttgtaacttca

SEQ ID NO: 1339786 - DNA, 22 bp, Artificial Sequence
  chemically synthesized
atgtatttttgtaacttcacaa

SEQ ID NO: 1339787 - DNA, 22 bp, Artificial Sequence
  chemically synthesized
acatggaggattattgtgaagt

SEQ ID NO: 1339788 - DNA, 22 bp, Artificial Sequence
  chemically synthesized
ttgtaacttcacaataatcctc

SEQ ID NO: 1339789 - DNA, 22 bp, Artificial Sequence
  chemically synthesized
tgtaacttcacaataatcctcc

SEQ ID NO: 1339790 - DNA, 22 bp, Artificial Sequence
  chemically synthesized
gtaacttcacaataatcctcca

SEQ ID NO: 1339791 - DNA, 22 bp, Artificial Sequence
  chemically synthesized
taacttcacaataatcctccat

SEQ ID NO: 1339792 - DNA, 22 bp, Artificial Sequence
  chemically synthesized
cacaataatcctccatgttagt

SEQ ID NO: 1339793 - DNA, 22 bp, Artificial Sequence
  chemically synthesized
atatatgaaataactaacatgg

SEQ ID NO: 1339794 - DNA, 22 bp, Artificial Sequence
  chemically synthesized
acaataatcctccatgttagtt

SEQ ID NO: 1339795 - DNA, 22 bp, Artificial Sequence
  chemically synthesized
tcatatatgaaataactaacat

SEQ ID NO: 1339796 - DNA, 22 bp, Artificial Sequence
  chemically synthesized
ctcatatatgaaataactaaca

SEQ ID NO: 1339797 - DNA, 22 bp, Artificial Sequence
  chemically synthesized
tctcatatatgaaataactaac

SEQ ID NO: 1339798 - DNA, 22 bp, Artificial Sequence
  chemically synthesized
ccatgttttctcatatatgaaa

SEQ ID NO: 1339799 - DNA, 22 bp, Artificial Sequence
  chemically synthesized
catgttagttatttcatatatg

SEQ ID NO: 1339800 - DNA, 22 bp, Artificial Sequence
  chemically synthesized
cccatgttttctcatatatgaa

SEQ ID NO: 1339801 - DNA, 22 bp, Artificial Sequence
  chemically synthesized
gttatttcatatatgagaaaac

SEQ ID NO: 1339802 - DNA, 22 bp, Artificial Sequence
  chemically synthesized
tttcatatatgagaaaacatgg

SEQ ID NO: 1339803 - DNA, 22 bp, Artificial Sequence
  chemically synthesized
gaaggagccttcccatgttttc

SEQ ID NO: 1339804 - DNA, 22 bp, Artificial Sequence
  chemically synthesized
catatatgagaaaacatgggaa

SEQ ID NO: 1339805 - DNA, 22 bp, Artificial Sequence
  chemically synthesized
atatatgagaaaacatgggaag

SEQ ID NO: 1339806 - DNA, 22 bp, Artificial Sequence
  chemically synthesized
gcaagatagcctggaaggagcc

SEQ ID NO: 1339807 - DNA, 22 bp, Artificial Sequence
  chemically synthesized
tagttagcaagatagcctggaa

SEQ ID NO: 1339808 - DNA, 22 bp, Artificial Sequence
  chemically synthesized
gggttatagttagcaagatagc

SEQ ID NO: 1339809 - DNA, 22 bp, Artificial Sequence
  chemically synthesized
cttccaggctatcttgctaact

SEQ ID NO: 1339810 - DNA, 22 bp, Artificial Sequence
  chemically synthesized
ccaggctatcttgctaactata

SEQ ID NO: 1339811 - DNA, 22 bp, Artificial Sequence
  chemically synthesized
caggctatcttgctaactataa

SEQ ID NO: 1339812 - DNA, 22 bp, Artificial Sequence
  chemically synthesized
gaaatgctagggttatagttag

SEQ ID NO: 1339813 - DNA, 22 bp, Artificial Sequence
  chemically synthesized
agaaatgctagggttatagtta

SEQ ID NO: 1339814 - DNA, 22 bp, Artificial Sequence
  chemically synthesized
tgtttagaaatgctagggttat

SEQ ID NO: 1339815 - DNA, 22 bp, Artificial Sequence
  chemically synthesized
tcttgctaactataaccctagc

SEQ ID NO: 1339816 - DNA, 22 bp, Artificial Sequence
  chemically synthesized
gtgtttagaaatgctagggtta

SEQ ID NO: 1339817 - DNA, 22 bp, Artificial Sequence
  chemically synthesized
tgtgtttagaaatgctagggtt

SEQ ID NO: 1339818 - DNA, 22 bp, Artificial Sequence
  chemically synthesized
gctaactataaccctagcattt

SEQ ID NO: 1339819 - DNA, 22 bp, Artificial Sequence
  chemically synthesized
ctaactataaccctagcatttc

SEQ ID NO: 1339820 - DNA, 22 bp, Artificial Sequence
  chemically synthesized
tattttgtgtttagaaatgcta

SEQ ID NO: 1339821 - DNA, 22 bp, Artificial Sequence
  chemically synthesized
atattttgtgtttagaaatgct

SEQ ID NO: 1339822 - DNA, 22 bp, Artificial Sequence
  chemically synthesized
actataaccctagcatttctaa

SEQ ID NO: 1339823 - DNA, 22 bp, Artificial Sequence
  chemically synthesized
ttatattttgtgtttagaaatg

SEQ ID NO: 1339824 - DNA, 22 bp, Artificial Sequence
  chemically synthesized
cttatattttgtgtttagaaat

SEQ ID NO: 1339825 - DNA, 22 bp, Artificial Sequence
  chemically synthesized
taaccctagcatttctaaacac

SEQ ID NO: 1339826 - DNA, 22 bp, Artificial Sequence
  chemically synthesized
aatttcttatattttgtgttta

SEQ ID NO: 1339827 - DNA, 22 bp, Artificial Sequence
  chemically synthesized
gcatttctaaacacaaaatata

SEQ ID NO: 1339828 - DNA, 22 bp, Artificial Sequence
  chemically synthesized
agacactgaatttcttatattt

SEQ ID NO: 1339829 - DNA, 22 bp, Artificial Sequence
  chemically synthesized
ctaaacacaaaatataagaaat

SEQ ID NO: 1339830 - DNA, 22 bp, Artificial Sequence
  chemically synthesized
taaacacaaaatataagaaatt

SEQ ID NO: 1339831 - DNA, 22 bp, Artificial Sequence
  chemically synthesized
aacacaaaatataagaaattca

SEQ ID NO: 1339832 - DNA, 22 bp, Artificial Sequence
  chemically synthesized
cagaaggaaagaatagccagtg

SEQ ID NO: 1339833 - DNA, 22 bp, Artificial Sequence
  chemically synthesized
ccagaaggaaagaatagccagt

SEQ ID NO: 1339834 - DNA, 22 bp, Artificial Sequence
  chemically synthesized
agtgtcttagcactggctattc

SEQ ID NO: 1339835 - DNA, 22 bp, Artificial Sequence
  chemically synthesized
agcactggctattctttccttc

SEQ ID NO: 1339836 - DNA, 22 bp, Artificial Sequence
  chemically synthesized
gcactggctattctttccttct

SEQ ID NO: 1339837 - DNA, 22 bp, Artificial Sequence
  chemically synthesized
aggaagaaccttccagaaggaa

SEQ ID NO: 1339838 - DNA, 22 bp, Artificial Sequence
  chemically synthesized
gctattctttccttctggaagg

SEQ ID NO: 1339839 - DNA, 22 bp, Artificial Sequence
  chemically synthesized
ttctttccttctggaaggttct

SEQ ID NO: 1339840 - DNA, 22 bp, Artificial Sequence
  chemically synthesized
tttccttctggaaggttcttcc

SEQ ID NO: 1339841 - DNA, 22 bp, Artificial Sequence
  chemically synthesized
tccttctggaaggttcttcctc

SEQ ID NO: 1339842 - DNA, 22 bp, Artificial Sequence
  chemically synthesized
ccttctggaaggttcttcctca

SEQ ID NO: 1339843 - DNA, 22 bp, Artificial Sequence
  chemically synthesized
cttctggaaggttcttcctcag

SEQ ID NO: 1339844 - DNA, 22 bp, Artificial Sequence
  chemically synthesized
ctggaaggttcttcctcagttt

SEQ ID NO: 1339845 - DNA, 22 bp, Artificial Sequence
  chemically synthesized
tggaaggttcttcctcagtttt

SEQ ID NO: 1339846 - DNA, 22 bp, Artificial Sequence
  chemically synthesized
gaaggttcttcctcagttttta

SEQ ID NO: 1339847 - DNA, 22 bp, Artificial Sequence
  chemically synthesized
gaggaaccagtcatgtaaaaac

SEQ ID NO: 1339848 - DNA, 22 bp, Artificial Sequence
  chemically synthesized
tctagaggaaccagtcatgtaa

SEQ ID NO: 1339849 - DNA, 22 bp, Artificial Sequence
  chemically synthesized
ttcctcagtttttacatgactg

SEQ ID NO: 1339850 - DNA, 22 bp, Artificial Sequence
  chemically synthesized
cctcagtttttacatgactggt

SEQ ID NO: 1339851 - DNA, 22 bp, Artificial Sequence
  chemically synthesized
ctcagtttttacatgactggtt

SEQ ID NO: 1339852 - DNA, 22 bp, Artificial Sequence
  chemically synthesized
agtttttacatgactggttcct

SEQ ID NO: 1339853 - DNA, 22 bp, Artificial Sequence
  chemically synthesized
agatatgactgtctagaggaac

SEQ ID NO: 1339854 - DNA, 22 bp, Artificial Sequence
  chemically synthesized
ttacatgactggttcctctaga

SEQ ID NO: 1339855 - DNA, 22 bp, Artificial Sequence
  chemically synthesized
tacatgactggttcctctagac

SEQ ID NO: 1339856 - DNA, 22 bp, Artificial Sequence
  chemically synthesized
acatgactggttcctctagaca

SEQ ID NO: 1339857 - DNA, 22 bp, Artificial Sequence
  chemically synthesized
catgactggttcctctagacag

SEQ ID NO: 1339858 - DNA, 22 bp, Artificial Sequence
  chemically synthesized
gttcctctagacagtcatatct

SEQ ID NO: 1339859 - DNA, 22 bp, Artificial Sequence
  chemically synthesized
ctctagacagtcatatctcagc

SEQ ID NO: 1339860 - DNA, 22 bp, Artificial Sequence
  chemically synthesized
aagaggcatgtcagctgagata

SEQ ID NO: 1339861 - DNA, 22 bp, Artificial Sequence
  chemically synthesized
tagacagtcatatctcagctga

SEQ ID NO: 1339862 - DNA, 22 bp, Artificial Sequence
  chemically synthesized
ctgaagaggcatgtcagctgag

SEQ ID NO: 1339863 - DNA, 22 bp, Artificial Sequence
  chemically synthesized
gacagtcatatctcagctgaca

SEQ ID NO: 1339864 - DNA, 22 bp, Artificial Sequence
  chemically synthesized
gctgaagaggcatgtcagctga

SEQ ID NO: 1339865 - DNA, 22 bp, Artificial Sequence
  chemically synthesized
tgctgaagaggcatgtcagctg

SEQ ID NO: 1339866 - DNA, 22 bp, Artificial Sequence
  chemically synthesized
agctgacatgcctcttcagcaa

SEQ ID NO: 1339867 - DNA, 22 bp, Artificial Sequence
  chemically synthesized
acatgcctcttcagcaaagatt

SEQ ID NO: 1339868 - DNA, 22 bp, Artificial Sequence
  chemically synthesized
agtagtaaagagaatctttgct

SEQ ID NO: 1339869 - DNA, 22 bp, Artificial Sequence
  chemically synthesized
cagtagtaaagagaatctttgc

SEQ ID NO: 1339870 - DNA, 22 bp, Artificial Sequence
  chemically synthesized
cagcttcagtagtaaagagaat

SEQ ID NO: 1339871 - DNA, 22 bp, Artificial Sequence
  chemically synthesized
ttcagcaaagattctctttact

SEQ ID NO: 1339872 - DNA, 22 bp, Artificial Sequence
  chemically synthesized
ttccagcttcagtagtaaagag

SEQ ID NO: 1339873 - DNA, 22 bp, Artificial Sequence
  chemically synthesized
cagcaaagattctctttactac

SEQ ID NO: 1339874 - DNA, 22 bp, Artificial Sequence
  chemically synthesized
agcaaagattctctttactact

SEQ ID NO: 1339875 - DNA, 22 bp, Artificial Sequence
  chemically synthesized
ggtagttattccagcttcagta

SEQ ID NO: 1339876 - DNA, 22 bp, Artificial Sequence
  chemically synthesized
tctttactactgaagctggaat

SEQ ID NO: 1339877 - DNA, 22 bp, Artificial Sequence
  chemically synthesized
tttactactgaagctggaataa

SEQ ID NO: 1339878 - DNA, 22 bp, Artificial Sequence
  chemically synthesized
tactactgaagctggaataact

SEQ ID NO: 1339879 - DNA, 22 bp, Artificial Sequence
  chemically synthesized
actactgaagctggaataacta

SEQ ID NO: 1339880 - DNA, 22 bp, Artificial Sequence
  chemically synthesized
ctactgaagctggaataactac

SEQ ID NO: 1339881 - DNA, 22 bp, Artificial Sequence
  chemically synthesized
ctgaagctggaataactaccca

SEQ ID NO: 1339882 - DNA, 22 bp, Artificial Sequence
  chemically synthesized
agatagtgagtgattgggtagt

SEQ ID NO: 1339883 - DNA, 22 bp, Artificial Sequence
  chemically synthesized
aagctggaataactacccaatc

SEQ ID NO: 1339884 - DNA, 22 bp, Artificial Sequence
  chemically synthesized
agttgagatagtgagtgattgg

SEQ ID NO: 1339885 - DNA, 22 bp, Artificial Sequence
  chemically synthesized
gaataactacccaatcactcac

SEQ ID NO: 1339886 - DNA, 22 bp, Artificial Sequence
  chemically synthesized
cccaatcactcactatctcaac

SEQ ID NO: 1339887 - DNA, 22 bp, Artificial Sequence
  chemically synthesized
agaacaaactgagttgagatag

SEQ ID NO: 1339888 - DNA, 22 bp, Artificial Sequence
  chemically synthesized
cattgagaacaaactgagttga

SEQ ID NO: 1339889 - DNA, 22 bp, Artificial Sequence
  chemically synthesized
actatctcaactcagtttgttc

SEQ ID NO: 1339890 - DNA, 22 bp, Artificial Sequence
  chemically synthesized
tctcaactcagtttgttctcaa

SEQ ID NO: 1339891 - DNA, 22 bp, Artificial Sequence
  chemically synthesized
aactcagtttgttctcaatgca

SEQ ID NO: 1339892 - DNA, 22 bp, Artificial Sequence
  chemically synthesized
agtttgttctcaatgcaacact

SEQ ID NO: 1339893 - DNA, 22 bp, Artificial Sequence
  chemically synthesized
gttctcaatgcaacacttttat

SEQ ID NO: 1339894 - DNA, 22 bp, Artificial Sequence
  chemically synthesized
ttctcaatgcaacacttttatc

SEQ ID NO: 1339895 - DNA, 22 bp, Artificial Sequence
  chemically synthesized
tcaatgcaacacttttatctga

SEQ ID NO: 1339896 - DNA, 22 bp, Artificial Sequence
  chemically synthesized
aatgcaacacttttatctgata

SEQ ID NO: 1339897 - DNA, 22 bp, Artificial Sequence
  chemically synthesized
tgataaataaacaagaaacata

SEQ ID NO: 1339898 - DNA, 22 bp, Artificial Sequence
  chemically synthesized
gtgataaataaacaagaaacat

SEQ ID NO: 1339899 - DNA, 22 bp, Artificial Sequence
  chemically synthesized
ttgtgataaataaacaagaaac

SEQ ID NO: 1339900 - DNA, 22 bp, Artificial Sequence
  chemically synthesized
ttatctgatatgtttcttgttt

SEQ ID NO: 1339901 - DNA, 22 bp, Artificial Sequence
  chemically synthesized
tatctgatatgtttcttgttta

SEQ ID NO: 1339902 - DNA, 22 bp, Artificial Sequence
  chemically synthesized
atctgatatgtttcttgtttat

SEQ ID NO: 1339903 - DNA, 22 bp, Artificial Sequence
  chemically synthesized
tctgatatgtttcttgtttatt

SEQ ID NO: 1339904 - DNA, 22 bp, Artificial Sequence
  chemically synthesized
tgtctcttgtgataaataaaca

SEQ ID NO: 1339905 - DNA, 22 bp, Artificial Sequence
  chemically synthesized
atatgtttcttgtttatttatc

SEQ ID NO: 1339906 - DNA, 22 bp, Artificial Sequence
  chemically synthesized
cttgtttatttatcacaagaga

SEQ ID NO: 1339907 - DNA, 22 bp, Artificial Sequence
  chemically synthesized
ttgtttatttatcacaagagac

SEQ ID NO: 1339908 - DNA, 22 bp, Artificial Sequence
  chemically synthesized
aaaaagaaattatgtctcttgt

SEQ ID NO: 1339909 - DNA, 22 bp, Artificial Sequence
  chemically synthesized
gtttatttatcacaagagacat

SEQ ID NO: 1339910 - DNA, 22 bp, Artificial Sequence
  chemically synthesized
tttatttatcacaagagacata

SEQ ID NO: 1339911 - DNA, 22 bp, Artificial Sequence
  chemically synthesized
tgaaaaagaaattatgtctctt

SEQ ID NO: 1339912 - DNA, 22 bp, Artificial Sequence
  chemically synthesized
ctgaaaaagaaattatgtctct

SEQ ID NO: 1339913 - DNA, 22 bp, Artificial Sequence
  chemically synthesized
atttatcacaagagacataatt

SEQ ID NO: 1339914 - DNA, 22 bp, Artificial Sequence
  chemically synthesized
tttatcacaagagacataattt

SEQ ID NO: 1339915 - DNA, 22 bp, Artificial Sequence
  chemically synthesized
catttctgaaaaagaaattatg

SEQ ID NO: 1339916 - DNA, 22 bp, Artificial Sequence
  chemically synthesized
atcacaagagacataatttctt

SEQ ID NO: 1339917 - DNA, 22 bp, Artificial Sequence
  chemically synthesized
tcacaagagacataatttcttt

SEQ ID NO: 1339918 - DNA, 22 bp, Artificial Sequence
  chemically synthesized
ccacagagcctacatttctgaa

SEQ ID NO: 1339919 - DNA, 22 bp, Artificial Sequence
  chemically synthesized
ctcccacagagcctacatttct

SEQ ID NO: 1339920 - DNA, 22 bp, Artificial Sequence
  chemically synthesized
cctgctcccacagagcctacat

SEQ ID NO: 1339921 - DNA, 22 bp, Artificial Sequence
  chemically synthesized
ctttttcagaaatgtaggctct

SEQ ID NO: 1339922 - DNA, 22 bp, Artificial Sequence
  chemically synthesized
ccctgctcccacagagcctaca

SEQ ID NO: 1339923 - DNA, 22 bp, Artificial Sequence
  chemically synthesized
tttttcagaaatgtaggctctg

SEQ ID NO: 1339924 - DNA, 22 bp, Artificial Sequence
  chemically synthesized
tttcagaaatgtaggctctgtg

SEQ ID NO: 1339925 - DNA, 22 bp, Artificial Sequence
  chemically synthesized
ttcagaaatgtaggctctgtgg

SEQ ID NO: 1339926 - DNA, 22 bp, Artificial Sequence
  chemically synthesized
tcagaaatgtaggctctgtggg

SEQ ID NO: 1339927 - DNA, 22 bp, Artificial Sequence
  chemically synthesized
cagaaatgtaggctctgtggga

SEQ ID NO: 1339928 - DNA, 22 bp, Artificial Sequence
  chemically synthesized
agaaatgtaggctctgtgggag

SEQ ID NO: 1339929 - DNA, 22 bp, Artificial Sequence
  chemically synthesized
tatatatttccctgctcccaca

SEQ ID NO: 1339930 - DNA, 22 bp, Artificial Sequence
  chemically synthesized
atatatatttccctgctcccac

SEQ ID NO: 1339931 - DNA, 22 bp, Artificial Sequence
  chemically synthesized
gatcttatatatatttccctgc

SEQ ID NO: 1339932 - DNA, 22 bp, Artificial Sequence
  chemically synthesized
tgtgggagcagggaaatatata

SEQ ID NO: 1339933 - DNA, 22 bp, Artificial Sequence
  chemically synthesized
taattggatcttatatatattt

SEQ ID NO: 1339934 - DNA, 22 bp, Artificial Sequence
  chemically synthesized
tgggagcagggaaatatatata

SEQ ID NO: 1339935 - DNA, 22 bp, Artificial Sequence
  chemically synthesized
agttgtaattggatcttatata

SEQ ID NO: 1339936 - DNA, 22 bp, Artificial Sequence
  chemically synthesized
ttgagttgtaattggatcttat

SEQ ID NO: 1339937 - DNA, 22 bp, Artificial Sequence
  chemically synthesized
ttgttgagttgtaattggatct

SEQ ID NO: 1339938 - DNA, 22 bp, Artificial Sequence
  chemically synthesized
tctattgttgagttgtaattgg

SEQ ID NO: 1339939 - DNA, 22 bp, Artificial Sequence
  chemically synthesized
atctattgttgagttgtaattg

SEQ ID NO: 1339940 - DNA, 22 bp, Artificial Sequence
  chemically synthesized
aatgatggaagtgacttatcta

SEQ ID NO: 1339941 - DNA, 22 bp, Artificial Sequence
  chemically synthesized
caactcaacaatagataagtca

SEQ ID NO: 1339942 - DNA, 22 bp, Artificial Sequence
  chemically synthesized
caatgatggaagtgacttatct

SEQ ID NO: 1339943 - DNA, 22 bp, Artificial Sequence
  chemically synthesized
aacaatagataagtcacttcca

SEQ ID NO: 1339944 - DNA, 22 bp, Artificial Sequence
  chemically synthesized
agatcttcaatgatggaagtga

SEQ ID NO: 1339945 - DNA, 22 bp, Artificial Sequence
  chemically synthesized
tagatgatgaaactcagatctt

SEQ ID NO: 1339946 - DNA, 22 bp, Artificial Sequence
  chemically synthesized
atagatgatgaaactcagatct

SEQ ID NO: 1339947 - DNA, 22 bp, Artificial Sequence
  chemically synthesized
tatagatgatgaaactcagatc

SEQ ID NO: 1339948 - DNA, 22 bp, Artificial Sequence
  chemically synthesized
ccatcattgaagatctgagttt

SEQ ID NO: 1339949 - DNA, 22 bp, Artificial Sequence
  chemically synthesized
catcattgaagatctgagtttc

SEQ ID NO: 1339950 - DNA, 22 bp, Artificial Sequence
  chemically synthesized
ctttatagatgatgaaactcag

SEQ ID NO: 1339951 - DNA, 22 bp, Artificial Sequence
  chemically synthesized
actttatagatgatgaaactca

SEQ ID NO: 1339952 - DNA, 22 bp, Artificial Sequence
  chemically synthesized
tcttactttatagatgatgaaa

SEQ ID NO: 1339953 - DNA, 22 bp, Artificial Sequence
  chemically synthesized
aagatctgagtttcatcatcta

SEQ ID NO: 1339954 - DNA, 22 bp, Artificial Sequence
  chemically synthesized
agtttcatcatctataaagtaa

SEQ ID NO: 1339955 - DNA, 22 bp, Artificial Sequence
  chemically synthesized
ataaatattatcttactttata

SEQ ID NO: 1339956 - DNA, 22 bp, Artificial Sequence
  chemically synthesized
catcatctataaagtaagataa

SEQ ID NO: 1339957 - DNA, 22 bp, Artificial Sequence
  chemically synthesized
atcatctataaagtaagataat

SEQ ID NO: 1339958 - DNA, 22 bp, Artificial Sequence
  chemically synthesized
taaagtaagataatatttatca

SEQ ID NO: 1339959 - DNA, 22 bp, Artificial Sequence
  chemically synthesized
tatgataaccatatctgataaa

SEQ ID NO: 1339960 - DNA, 22 bp, Artificial Sequence
  chemically synthesized
tataaatacattatatgataac

SEQ ID NO: 1339961 - DNA, 22 bp, Artificial Sequence
  chemically synthesized
atcagatatggttatcatataa

SEQ ID NO: 1339962 - DNA, 22 bp, Artificial Sequence
  chemically synthesized
tcagatatggttatcatataat

SEQ ID NO: 1339963 - DNA, 22 bp, Artificial Sequence
  chemically synthesized
gtattatataaatacattatat

SEQ ID NO: 1339964 - DNA, 22 bp, Artificial Sequence
  chemically synthesized
agtattatataaatacattata

SEQ ID NO: 1339965 - DNA, 22 bp, Artificial Sequence
  chemically synthesized
tcatataatgtatttatataat

SEQ ID NO: 1339966 - DNA, 22 bp, Artificial Sequence
  chemically synthesized
tatatatatatatatttagtat

SEQ ID NO: 1339967 - DNA, 22 bp, Artificial Sequence
  chemically synthesized
ctgtatatatatatatatttag

SEQ ID NO: 1339968 - DNA, 22 bp, Artificial Sequence
  chemically synthesized
atataatactaaatatatatat

SEQ ID NO: 1339969 - DNA, 22 bp, Artificial Sequence
  chemically synthesized
tataatactaaatatatatata

SEQ ID NO: 1339970 - DNA, 22 bp, Artificial Sequence
  chemically synthesized
gacattactgtatatatatata

SEQ ID NO: 1339971 - DNA, 22 bp, Artificial Sequence
  chemically synthesized
ctggacattactgtatatatat

SEQ ID NO: 1339972 - DNA, 22 bp, Artificial Sequence
  chemically synthesized
tactggacattactgtatatat

SEQ ID NO: 1339973 - DNA, 22 bp, Artificial Sequence
  chemically synthesized
ctactggacattactgtatata

SEQ ID NO: 1339974 - DNA, 22 bp, Artificial Sequence
  chemically synthesized
tctactggacattactgtatat

SEQ ID NO: 1339975 - DNA, 22 bp, Artificial Sequence
  chemically synthesized
aatatatatatatatacagtaa

SEQ ID NO: 1339976 - DNA, 22 bp, Artificial Sequence
  chemically synthesized
agcatactttctactggacatt

SEQ ID NO: 1339977 - DNA, 22 bp, Artificial Sequence
  chemically synthesized
ttcagcatactttctactggac

SEQ ID NO: 1339978 - DNA, 22 bp, Artificial Sequence
  chemically synthesized
attgttcagcatactttctact

SEQ ID NO: 1339979 - DNA, 22 bp, Artificial Sequence
  chemically synthesized
cagaacactaattgttcagcat

SEQ ID NO: 1339980 - DNA, 22 bp, Artificial Sequence
  chemically synthesized
acagaacactaattgttcagca

SEQ ID NO: 1339981 - DNA, 22 bp, Artificial Sequence
  chemically synthesized
tttacagaacactaattgttca

SEQ ID NO: 1339982 - DNA, 22 bp, Artificial Sequence
  chemically synthesized
gtttacagaacactaattgttc

SEQ ID NO: 1339983 - DNA, 22 bp, Artificial Sequence
  chemically synthesized
aaaaatttgtttacagaacact

SEQ ID NO: 1339984 - DNA, 22 bp, Artificial Sequence
  chemically synthesized
aaaaaatttgtttacagaacac

SEQ ID NO: 1339985 - DNA, 22 bp, Artificial Sequence
  chemically synthesized
aacaattagtgttctgtaaaca

SEQ ID NO: 1339986 - DNA, 22 bp, Artificial Sequence
  chemically synthesized
gtgttctgtaaacaaatttttt

SEQ ID NO: 1339987 - DNA, 22 bp, Artificial Sequence
  chemically synthesized
agaatagtgcacttaaaaaatt

SEQ ID NO: 1339988 - DNA, 22 bp, Artificial Sequence
  chemically synthesized
cagaatagtgcacttaaaaaat

SEQ ID NO: 1339989 - DNA, 22 bp, Artificial Sequence
  chemically synthesized
tgtaaacaaattttttaagtgc

SEQ ID NO: 1339990 - DNA, 22 bp, Artificial Sequence
  chemically synthesized
taaacaaattttttaagtgcac

SEQ ID NO: 1339991 - DNA, 22 bp, Artificial Sequence
  chemically synthesized
tttaagtgcactattctgaaat

SEQ ID NO: 1339992 - DNA, 22 bp, Artificial Sequence
  chemically synthesized
ttaagtgcactattctgaaata

SEQ ID NO: 1339993 - DNA, 22 bp, Artificial Sequence
  chemically synthesized
taagtgcactattctgaaatat

SEQ ID NO: 1339994 - DNA, 22 bp, Artificial Sequence
  chemically synthesized
aagtgcactattctgaaatata

SEQ ID NO: 1339995 - DNA, 22 bp, Artificial Sequence
  chemically synthesized
agtgcactattctgaaatatac

SEQ ID NO: 1339996 - DNA, 22 bp, Artificial Sequence
  chemically synthesized
ttctgaaatataccggtctctc

SEQ ID NO: 1339997 - DNA, 22 bp, Artificial Sequence
  chemically synthesized
tgaaatataccggtctctcatc

SEQ ID NO: 1339998 - DNA, 22 bp, Artificial Sequence
  chemically synthesized
aaatataccggtctctcatcct

SEQ ID NO: 1339999 - DNA, 22 bp, Artificial Sequence
  chemically synthesized
aaaaataaaatgagaaggatga

SEQ ID NO: 1340000 - DNA, 22 bp, Artificial Sequence
  chemically synthesized
aaaaaataaaatgagaaggatg

SEQ ID NO: 1340001 - DNA, 22 bp, Artificial Sequence
  chemically synthesized
taaaaaataaaatgagaaggat

SEQ ID NO: 1340002 - DNA, 22 bp, Artificial Sequence
  chemically synthesized
tcatccttctcattttattttt

SEQ ID NO: 1340003 - DNA, 22 bp, Artificial Sequence
  chemically synthesized
atccttctcattttatttttta

SEQ ID NO: 1340004 - DNA, 22 bp, Artificial Sequence
  chemically synthesized
aataaaatgattttaaaaaata

SEQ ID NO: 1340005 - DNA, 22 bp, Artificial Sequence
  chemically synthesized
ctcattttattttttaaaatca

SEQ ID NO: 1340006 - DNA, 22 bp, Artificial Sequence
  chemically synthesized
tcattttattttttaaaatcat

SEQ ID NO: 1340007 - DNA, 22 bp, Artificial Sequence
  chemically synthesized
tagctcaataaaatgattttaa

SEQ ID NO: 1340008 - DNA, 22 bp, Artificial Sequence
  chemically synthesized
attttattttttaaaatcattt

SEQ ID NO: 1340009 - DNA, 22 bp, Artificial Sequence
  chemically synthesized
tattttttaaaatcattttatt

SEQ ID NO: 1340010 - DNA, 22 bp, Artificial Sequence
  chemically synthesized
attttttaaaatcattttattg

SEQ ID NO: 1340011 - DNA, 22 bp, Artificial Sequence
  chemically synthesized
ttttttaaaatcattttattga

SEQ ID NO: 1340012 - DNA, 22 bp, Artificial Sequence
  chemically synthesized
tttaaaatcattttattgagct

SEQ ID NO: 1340013 - DNA, 22 bp, Artificial Sequence
  chemically synthesized
ttaaaatcattttattgagcta

SEQ ID NO: 1340014 - DNA, 22 bp, Artificial Sequence
  chemically synthesized
taaaatcattttattgagctat

SEQ ID NO: 1340015 - DNA, 22 bp, Artificial Sequence
  chemically synthesized
aaaatcattttattgagctata

SEQ ID NO: 1340016 - DNA, 22 bp, Artificial Sequence
  chemically synthesized
tggtgtgtgagttatagctcaa

SEQ ID NO: 1340017 - DNA, 22 bp, Artificial Sequence
  chemically synthesized
aaatcattttattgagctataa

SEQ ID NO: 1340018 - DNA, 22 bp, Artificial Sequence
  chemically synthesized
gtggtgtgtgagttatagctca

SEQ ID NO: 1340019 - DNA, 22 bp, Artificial Sequence
  chemically synthesized
tgtggtgtgtgagttatagctc

SEQ ID NO: 1340020 - DNA, 22 bp, Artificial Sequence
  chemically synthesized
tattgagctataactcacacac

SEQ ID NO: 1340021 - DNA, 22 bp, Artificial Sequence
  chemically synthesized
attgagctataactcacacacc

SEQ ID NO: 1340022 - DNA, 22 bp, Artificial Sequence
  chemically synthesized
ttgagctataactcacacacca

SEQ ID NO: 1340023 - DNA, 22 bp, Artificial Sequence
  chemically synthesized
agctataactcacacaccacaa

SEQ ID NO: 1340024 - DNA, 22 bp, Artificial Sequence
  chemically synthesized
aaagagtgaattttgtggtgtg

SEQ ID NO: 1340025 - DNA, 22 bp, Artificial Sequence
  chemically synthesized
aaaagagtgaattttgtggtgt

SEQ ID NO: 1340026 - DNA, 22 bp, Artificial Sequence
  chemically synthesized
taaaagagtgaattttgtggtg

SEQ ID NO: 1340027 - DNA, 22 bp, Artificial Sequence
  chemically synthesized
taactcacacaccacaaaattc

SEQ ID NO: 1340028 - DNA, 22 bp, Artificial Sequence
  chemically synthesized
tgcactttaaaagagtgaattt

SEQ ID NO: 1340029 - DNA, 22 bp, Artificial Sequence
  chemically synthesized
acacaccacaaaattcactctt

SEQ ID NO: 1340030 - DNA, 22 bp, Artificial Sequence
  chemically synthesized
aattgtgcactttaaaagagtg

SEQ ID NO: 1340031 - DNA, 22 bp, Artificial Sequence
  chemically synthesized
tatatcactgaattgtgcactt

SEQ ID NO: 1340032 - DNA, 22 bp, Artificial Sequence
  chemically synthesized
actcttttaaagtgcacaattc

SEQ ID NO: 1340033 - DNA, 22 bp, Artificial Sequence
  chemically synthesized
ttttaaagtgcacaattcagtg

SEQ ID NO: 1340034 - DNA, 22 bp, Artificial Sequence
  chemically synthesized
ttaaagtgcacaattcagtgat

SEQ ID NO: 1340035 - DNA, 22 bp, Artificial Sequence
  chemically synthesized
taaagtgcacaattcagtgata

SEQ ID NO: 1340036 - DNA, 22 bp, Artificial Sequence
  chemically synthesized
aaagtgcacaattcagtgatat

SEQ ID NO: 1340037 - DNA, 22 bp, Artificial Sequence
  chemically synthesized
aagtgcacaattcagtgatata

SEQ ID NO: 1340038 - DNA, 22 bp, Artificial Sequence
  chemically synthesized
tgtgaatatactatatatcact

SEQ ID NO: 1340039 - DNA, 22 bp, Artificial Sequence
  chemically synthesized
cataactatgtgaatatactat

SEQ ID NO: 1340040 - DNA, 22 bp, Artificial Sequence
  chemically synthesized
agtgatatatagtatattcaca

SEQ ID NO: 1340041 - DNA, 22 bp, Artificial Sequence
  chemically synthesized
acatagttatgcaactgtcacc

SEQ ID NO: 1340042 - DNA, 22 bp, Artificial Sequence
  chemically synthesized
tgcaactgtcaccactttcttt

SEQ ID NO: 1340043 - DNA, 22 bp, Artificial Sequence
  chemically synthesized
tcaccactttcttttttccttt

SEQ ID NO: 1340044 - DNA, 22 bp, Artificial Sequence
  chemically synthesized
aaaaaaataaataaataaagga

SEQ ID NO: 1340045 - DNA, 22 bp, Artificial Sequence
  chemically synthesized
tctcaaaaaaataaataaataa

SEQ ID NO: 1340046 - DNA, 22 bp, Artificial Sequence
  chemically synthesized
tcttttttcctttatttattta

SEQ ID NO: 1340047 - DNA, 22 bp, Artificial Sequence
  chemically synthesized
cttttttcctttatttatttat

SEQ ID NO: 1340048 - DNA, 22 bp, Artificial Sequence
  chemically synthesized
tgtctcaaaaaaataaataaat

SEQ ID NO: 1340049 - DNA, 22 bp, Artificial Sequence
  chemically synthesized
ttttttcctttatttatttatt

SEQ ID NO: 1340050 - DNA, 22 bp, Artificial Sequence
  chemically synthesized
ttttcctttatttatttatttt

SEQ ID NO: 1340051 - DNA, 22 bp, Artificial Sequence
  chemically synthesized
tttcctttatttatttattttt

SEQ ID NO: 1340052 - DNA, 22 bp, Artificial Sequence
  chemically synthesized
ttcctttatttatttatttttt

SEQ ID NO: 1340053 - DNA, 22 bp, Artificial Sequence
  chemically synthesized
tcctttatttatttattttttt

SEQ ID NO: 1340054 - DNA, 22 bp, Artificial Sequence
  chemically synthesized
cctttatttatttatttttttg

SEQ ID NO: 1340055 - DNA, 22 bp, Artificial Sequence
  chemically synthesized
ctttatttatttatttttttga

SEQ ID NO: 1340056 - DNA, 22 bp, Artificial Sequence
  chemically synthesized
tatttatttatttttttgagac

SEQ ID NO: 1340057 - DNA, 22 bp, Artificial Sequence
  chemically synthesized
atttatttatttttttgagaca

SEQ ID NO: 1340058 - DNA, 22 bp, Artificial Sequence
  chemically synthesized
tttatttatttttttgagacag

SEQ ID NO: 1340059 - DNA, 22 bp, Artificial Sequence
  chemically synthesized
atttatttttttgagacagagt

SEQ ID NO: 1340060 - DNA, 22 bp, Artificial Sequence
  chemically synthesized
tttatttttttgagacagagtc

SEQ ID NO: 1340061 - DNA, 22 bp, Artificial Sequence
  chemically synthesized
gcgacagagcgagactctgtct

SEQ ID NO: 1340062 - DNA, 22 bp, Artificial Sequence
  chemically synthesized
atttttttgagacagagtctcg

SEQ ID NO: 1340063 - DNA, 22 bp, Artificial Sequence
  chemically synthesized
tttttttgagacagagtctcgc

SEQ ID NO: 1340064 - DNA, 22 bp, Artificial Sequence
  chemically synthesized
ttttgagacagagtctcgctct

SEQ ID NO: 1340065 - DNA, 22 bp, Artificial Sequence
  chemically synthesized
cagcctggcgacagagcgagac

SEQ ID NO: 1340066 - DNA, 22 bp, Artificial Sequence
  chemically synthesized
tttgagacagagtctcgctctg

SEQ ID NO: 1340067 - DNA, 22 bp, Artificial Sequence
  chemically synthesized
ttgagacagagtctcgctctgt

SEQ ID NO: 1340068 - DNA, 22 bp, Artificial Sequence
  chemically synthesized
tgagacagagtctcgctctgtc

SEQ ID NO: 1340069 - DNA, 22 bp, Artificial Sequence
  chemically synthesized
gagacagagtctcgctctgtcg

SEQ ID NO: 1340070 - DNA, 22 bp, Artificial Sequence
  chemically synthesized
agacagagtctcgctctgtcgc

SEQ ID NO: 1340071 - DNA, 22 bp, Artificial Sequence
  chemically synthesized
cactccagcctggcgacagagc

SEQ ID NO: 1340072 - DNA, 22 bp, Artificial Sequence
  chemically synthesized
gctctgtcgccaggctggagtg

SEQ ID NO: 1340073 - DNA, 22 bp, Artificial Sequence
  chemically synthesized
tgtcgccaggctggagtgcagc

SEQ ID NO: 1340074 - DNA, 22 bp, Artificial Sequence
  chemically synthesized
tcgccaggctggagtgcagcgg

SEQ ID NO: 1340075 - DNA, 22 bp, Artificial Sequence
  chemically synthesized
cagtgagccaagatcgcgccgc

SEQ ID NO: 1340076 - DNA, 22 bp, Artificial Sequence
  chemically synthesized
gagtgcagcggcgcgatcttgg

SEQ ID NO: 1340077 - DNA, 22 bp, Artificial Sequence
  chemically synthesized
aacccaggaggtggaggttgca

SEQ ID NO: 1340078 - DNA, 22 bp, Artificial Sequence
  chemically synthesized
gaacccaggaggtggaggttgc

SEQ ID NO: 1340079 - DNA, 22 bp, Artificial Sequence
  chemically synthesized
cttgaacccaggaggtggaggt

SEQ ID NO: 1340080 - DNA, 22 bp, Artificial Sequence
  chemically synthesized
ggctcactgcaacctccacctc

SEQ ID NO: 1340081 - DNA, 22 bp, Artificial Sequence
  chemically synthesized
gctcactgcaacctccacctcc

SEQ ID NO: 1340082 - DNA, 22 bp, Artificial Sequence
  chemically synthesized
actgcaacctccacctcctggg

SEQ ID NO: 1340083 - DNA, 22 bp, Artificial Sequence
  chemically synthesized
caacctccacctcctgggttca

SEQ ID NO: 1340084 - DNA, 22 bp, Artificial Sequence
  chemically synthesized
aggcaggagaattgcttgaacc

SEQ ID NO: 1340085 - DNA, 22 bp, Artificial Sequence
  chemically synthesized
cacctcctgggttcaagcaatt

SEQ ID NO: 1340086 - DNA, 22 bp, Artificial Sequence
  chemically synthesized
ctgggttcaagcaattctcctg

SEQ ID NO: 1340087 - DNA, 22 bp, Artificial Sequence
  chemically synthesized
gggagactgaggcaggagaatt

SEQ ID NO: 1340088 - DNA, 22 bp, Artificial Sequence
  chemically synthesized
ggttcaagcaattctcctgcct

SEQ ID NO: 1340089 - DNA, 22 bp, Artificial Sequence
  chemically synthesized
ctcgggagactgaggcaggaga

SEQ ID NO: 1340090 - DNA, 22 bp, Artificial Sequence
  chemically synthesized
gctgctcgggagactgaggcag

SEQ ID NO: 1340091 - DNA, 22 bp, Artificial Sequence
  chemically synthesized
aagcaattctcctgcctcagtc

SEQ ID NO: 1340092 - DNA, 22 bp, Artificial Sequence
  chemically synthesized
tagtcctagctgctcgggagac

SEQ ID NO: 1340093 - DNA, 22 bp, Artificial Sequence
  chemically synthesized
tcctgcctcagtctcccgagca

SEQ ID NO: 1340094 - DNA, 22 bp, Artificial Sequence
  chemically synthesized
ctgcctcagtctcccgagcagc

SEQ ID NO: 1340095 - DNA, 22 bp, Artificial Sequence
  chemically synthesized
cctcagtctcccgagcagctag

SEQ ID NO: 1340096 - DNA, 22 bp, Artificial Sequence
  chemically synthesized
agtctcccgagcagctaggact

SEQ ID NO: 1340097 - DNA, 22 bp, Artificial Sequence
  chemically synthesized
ccgagcagctaggactacaggt

SEQ ID NO: 1340098 - DNA, 22 bp, Artificial Sequence
  chemically synthesized
ggtgtggtagtgcgcacctgta

SEQ ID NO: 1340099 - DNA, 22 bp, Artificial Sequence
  chemically synthesized
ggactacaggtgcgcactacca

SEQ ID NO: 1340100 - DNA, 22 bp, Artificial Sequence
  chemically synthesized
caggtgcgcactaccacaccca

SEQ ID NO: 1340101 - DNA, 22 bp, Artificial Sequence
  chemically synthesized
aaaaaaatgagctgggtgtggt

SEQ ID NO: 1340102 - DNA, 22 bp, Artificial Sequence
  chemically synthesized
aaaaaaaatgagctgggtgtgg

SEQ ID NO: 1340103 - DNA, 22 bp, Artificial Sequence
  chemically synthesized
ccacacccagctcatttttttt

SEQ ID NO: 1340104 - DNA, 22 bp, Artificial Sequence
  chemically synthesized
aaaatatatatttaaaaaaaat

SEQ ID NO: 1340105 - DNA, 22 bp, Artificial Sequence
  chemically synthesized
ctgaaaatatatatttaaaaaa

SEQ ID NO: 1340106 - DNA, 22 bp, Artificial Sequence
  chemically synthesized
tactgaaaatatatatttaaaa

SEQ ID NO: 1340107 - DNA, 22 bp, Artificial Sequence
  chemically synthesized
attttttttaaatatatatttt

SEQ ID NO: 1340108 - DNA, 22 bp, Artificial Sequence
  chemically synthesized
tttttaaatatatattttcagt

SEQ ID NO: 1340109 - DNA, 22 bp, Artificial Sequence
  chemically synthesized
ttttaaatatatattttcagta

SEQ ID NO: 1340110 - DNA, 22 bp, Artificial Sequence
  chemically synthesized
tttaaatatatattttcagtag

SEQ ID NO: 1340111 - DNA, 22 bp, Artificial Sequence
  chemically synthesized
ttaaatatatattttcagtaga

SEQ ID NO: 1340112 - DNA, 22 bp, Artificial Sequence
  chemically synthesized
taaatatatattttcagtagag

SEQ ID NO: 1340113 - DNA, 22 bp, Artificial Sequence
  chemically synthesized
aaatatatattttcagtagaga

SEQ ID NO: 1340114 - DNA, 22 bp, Artificial Sequence
  chemically synthesized
aatatatattttcagtagagac

SEQ ID NO: 1340115 - DNA, 22 bp, Artificial Sequence
  chemically synthesized
gccaatatggtgaaatcccgtc

SEQ ID NO: 1340116 - DNA, 22 bp, Artificial Sequence
  chemically synthesized
tcagtagagacgggatttcacc

SEQ ID NO: 1340117 - DNA, 22 bp, Artificial Sequence
  chemically synthesized
cagtagagacgggatttcacca

SEQ ID NO: 1340118 - DNA, 22 bp, Artificial Sequence
  chemically synthesized
agtagagacgggatttcaccat

SEQ ID NO: 1340119 - DNA, 22 bp, Artificial Sequence
  chemically synthesized
ggagatcaagaccatcctggcc

SEQ ID NO: 1340120 - DNA, 22 bp, Artificial Sequence
  chemically synthesized
caccatattggccaggatggtc

SEQ ID NO: 1340121 - DNA, 22 bp, Artificial Sequence
  chemically synthesized
accatattggccaggatggtct

SEQ ID NO: 1340122 - DNA, 22 bp, Artificial Sequence
  chemically synthesized
gccaggatggtcttgatctcct

SEQ ID NO: 1340123 - DNA, 22 bp, Artificial Sequence
  chemically synthesized
gatctcctaacctcgtgatcca

SEQ ID NO: 1340124 - DNA, 22 bp, Artificial Sequence
  chemically synthesized
atctcctaacctcgtgatccac

SEQ ID NO: 1340125 - DNA, 22 bp, Artificial Sequence
  chemically synthesized
ggaggccaaggcaggtggatca

SEQ ID NO: 1340126 - DNA, 22 bp, Artificial Sequence
  chemically synthesized
gggaggccaaggcaggtggatc

SEQ ID NO: 1340127 - DNA, 22 bp, Artificial Sequence
  chemically synthesized
tgggaggccaaggcaggtggat

SEQ ID NO: 1340128 - DNA, 22 bp, Artificial Sequence
  chemically synthesized
ctaacctcgtgatccacctgcc

SEQ ID NO: 1340129 - DNA, 22 bp, Artificial Sequence
  chemically synthesized
acctcgtgatccacctgccttg

SEQ ID NO: 1340130 - DNA, 22 bp, Artificial Sequence
  chemically synthesized
gtgatccacctgccttggcctc

SEQ ID NO: 1340131 - DNA, 22 bp, Artificial Sequence
  chemically synthesized
taatcccagcactttgggaggc

SEQ ID NO: 1340132 - DNA, 22 bp, Artificial Sequence
  chemically synthesized
ccttggcctcccaaagtgctgg

SEQ ID NO: 1340133 - DNA, 22 bp, Artificial Sequence
  chemically synthesized
acacctgtaatcccagcacttt

SEQ ID NO: 1340134 - DNA, 22 bp, Artificial Sequence
  chemically synthesized
ggcctcccaaagtgctgggatt

SEQ ID NO: 1340135 - DNA, 22 bp, Artificial Sequence
  chemically synthesized
gcctcccaaagtgctgggatta

SEQ ID NO: 1340136 - DNA, 22 bp, Artificial Sequence
  chemically synthesized
ccaaagtgctgggattacaggt

SEQ ID NO: 1340137 - DNA, 22 bp, Artificial Sequence
  chemically synthesized
gccaggcgcagtggctcacacc

SEQ ID NO: 1340138 - DNA, 22 bp, Artificial Sequence
  chemically synthesized
ggattacaggtgtgagccactg

SEQ ID NO: 1340139 - DNA, 22 bp, Artificial Sequence
  chemically synthesized
caggtgtgagccactgcgcctg

SEQ ID NO: 1340140 - DNA, 22 bp, Artificial Sequence
  chemically synthesized
gaaagtggtaacagttggccag

SEQ ID NO: 1340141 - DNA, 22 bp, Artificial Sequence
  chemically synthesized
tattagaaagtggtaacagttg

SEQ ID NO: 1340142 - DNA, 22 bp, Artificial Sequence
  chemically synthesized
atattagaaagtggtaacagtt

SEQ ID NO: 1340143 - DNA, 22 bp, Artificial Sequence
  chemically synthesized
tatattagaaagtggtaacagt

SEQ ID NO: 1340144 - DNA, 22 bp, Artificial Sequence
  chemically synthesized
cgcctggccaactgttaccact

SEQ ID NO: 1340145 - DNA, 22 bp, Artificial Sequence
  chemically synthesized
gccaactgttaccactttctaa

SEQ ID NO: 1340146 - DNA, 22 bp, Artificial Sequence
  chemically synthesized
acgaaaatgttttatattagaa

SEQ ID NO: 1340147 - DNA, 22 bp, Artificial Sequence
  chemically synthesized
ttaccactttctaatataaaac

SEQ ID NO: 1340148 - DNA, 22 bp, Artificial Sequence
  chemically synthesized
ggctgacgaaaatgttttatat

SEQ ID NO: 1340149 - DNA, 22 bp, Artificial Sequence
  chemically synthesized
gggctgacgaaaatgttttata

SEQ ID NO: 1340150 - DNA, 22 bp, Artificial Sequence
  chemically synthesized
ccactttctaatataaaacatt

SEQ ID NO: 1340151 - DNA, 22 bp, Artificial Sequence
  chemically synthesized
tgggctgacgaaaatgttttat

SEQ ID NO: 1340152 - DNA, 22 bp, Artificial Sequence
  chemically synthesized
ttgggctgacgaaaatgtttta

SEQ ID NO: 1340153 - DNA, 22 bp, Artificial Sequence
  chemically synthesized
tttgggctgacgaaaatgtttt

SEQ ID NO: 1340154 - DNA, 22 bp, Artificial Sequence
  chemically synthesized
ttttgggctgacgaaaatgttt

SEQ ID NO: 1340155 - DNA, 22 bp, Artificial Sequence
  chemically synthesized
ttttttgggctgacgaaaatgt

SEQ ID NO: 1340156 - DNA, 22 bp, Artificial Sequence
  chemically synthesized
tctaatataaaacattttcgtc

SEQ ID NO: 1340157 - DNA, 22 bp, Artificial Sequence
  chemically synthesized
cttttttgggctgacgaaaatg

SEQ ID NO: 1340158 - DNA, 22 bp, Artificial Sequence
  chemically synthesized
ctaatataaaacattttcgtca

SEQ ID NO: 1340159 - DNA, 22 bp, Artificial Sequence
  chemically synthesized
taatataaaacattttcgtcag

SEQ ID NO: 1340160 - DNA, 22 bp, Artificial Sequence
  chemically synthesized
atataaaacattttcgtcagcc

SEQ ID NO: 1340161 - DNA, 22 bp, Artificial Sequence
  chemically synthesized
atgagtatggggtttctttttt

SEQ ID NO: 1340162 - DNA, 22 bp, Artificial Sequence
  chemically synthesized
tcgtcagcccaaaaaagaaacc

SEQ ID NO: 1340163 - DNA, 22 bp, Artificial Sequence
  chemically synthesized
cgtcagcccaaaaaagaaaccc

SEQ ID NO: 1340164 - DNA, 22 bp, Artificial Sequence
  chemically synthesized
ctaatgagtatggggtttcttt

SEQ ID NO: 1340165 - DNA, 22 bp, Artificial Sequence
  chemically synthesized
gtcagcccaaaaaagaaacccc

SEQ ID NO: 1340166 - DNA, 22 bp, Artificial Sequence
  chemically synthesized
gggacgtggagaaaggagagtg

SEQ ID NO: 1340167 - DNA, 22 bp, Artificial Sequence
  chemically synthesized
attaggaatcactctcctttct

SEQ ID NO: 1340168 - DNA, 22 bp, Artificial Sequence
  chemically synthesized
ggaatcactctcctttctccac

SEQ ID NO: 1340169 - DNA, 22 bp, Artificial Sequence
  chemically synthesized
gtagggcctggggacgtggaga

SEQ ID NO: 1340170 - DNA, 22 bp, Artificial Sequence
  chemically synthesized
tcctttctccacgtccccaggc

SEQ ID NO: 1340171 - DNA, 22 bp, Artificial Sequence
  chemically synthesized
ctttctccacgtccccaggccc

SEQ ID NO: 1340172 - DNA, 22 bp, Artificial Sequence
  chemically synthesized
tctccacgtccccaggccctac

SEQ ID NO: 1340173 - DNA, 22 bp, Artificial Sequence
  chemically synthesized
ctccacgtccccaggccctact

SEQ ID NO: 1340174 - DNA, 22 bp, Artificial Sequence
  chemically synthesized
tccacgtccccaggccctacta

SEQ ID NO: 1340175 - DNA, 22 bp, Artificial Sequence
  chemically synthesized
cacgtccccaggccctactaat

SEQ ID NO: 1340176 - DNA, 22 bp, Artificial Sequence
  chemically synthesized
atcaatacagacagaaagtaga

SEQ ID NO: 1340177 - DNA, 22 bp, Artificial Sequence
  chemically synthesized
ctaatctactttctgtctgtat

SEQ ID NO: 1340178 - DNA, 22 bp, Artificial Sequence
  chemically synthesized
atctactttctgtctgtattga

SEQ ID NO: 1340179 - DNA, 22 bp, Artificial Sequence
  chemically synthesized
agaatagtctaatcaatacaga

SEQ ID NO: 1340180 - DNA, 22 bp, Artificial Sequence
  chemically synthesized
cagaatagtctaatcaatacag

SEQ ID NO: 1340181 - DNA, 22 bp, Artificial Sequence
  chemically synthesized
tcagaatagtctaatcaataca

SEQ ID NO: 1340182 - DNA, 22 bp, Artificial Sequence
  chemically synthesized
ctttctgtctgtattgattaga

SEQ ID NO: 1340183 - DNA, 22 bp, Artificial Sequence
  chemically synthesized
tctgtctgtattgattagacta

SEQ ID NO: 1340184 - DNA, 22 bp, Artificial Sequence
  chemically synthesized
ctgtctgtattgattagactat

SEQ ID NO: 1340185 - DNA, 22 bp, Artificial Sequence
  chemically synthesized
tgtctgtattgattagactatt

SEQ ID NO: 1340186 - DNA, 22 bp, Artificial Sequence
  chemically synthesized
tctgtattgattagactattct

SEQ ID NO: 1340187 - DNA, 22 bp, Artificial Sequence
  chemically synthesized
cataaagttttcagaatagtct

SEQ ID NO: 1340188 - DNA, 22 bp, Artificial Sequence
  chemically synthesized
acataaagttttcagaatagtc

SEQ ID NO: 1340189 - DNA, 22 bp, Artificial Sequence
  chemically synthesized
tattgattagactattctgaaa

SEQ ID NO: 1340190 - DNA, 22 bp, Artificial Sequence
  chemically synthesized
attagactattctgaaaacttt

SEQ ID NO: 1340191 - DNA, 22 bp, Artificial Sequence
  chemically synthesized
tgagatttacataaagttttca

SEQ ID NO: 1340192 - DNA, 22 bp, Artificial Sequence
  chemically synthesized
gactattctgaaaactttatgt

SEQ ID NO: 1340193 - DNA, 22 bp, Artificial Sequence
  chemically synthesized
aattatgagatttacataaagt

SEQ ID NO: 1340194 - DNA, 22 bp, Artificial Sequence
  chemically synthesized
aaattatgagatttacataaag

SEQ ID NO: 1340195 - DNA, 22 bp, Artificial Sequence
  chemically synthesized
taaattatgagatttacataaa

SEQ ID NO: 1340196 - DNA, 22 bp, Artificial Sequence
  chemically synthesized
ttaaattatgagatttacataa

SEQ ID NO: 1340197 - DNA, 22 bp, Artificial Sequence
  chemically synthesized
ttctgaaaactttatgtaaatc

SEQ ID NO: 1340198 - DNA, 22 bp, Artificial Sequence
  chemically synthesized
tttaaattatgagatttacata

SEQ ID NO: 1340199 - DNA, 22 bp, Artificial Sequence
  chemically synthesized
tgaaaactttatgtaaatctca

SEQ ID NO: 1340200 - DNA, 22 bp, Artificial Sequence
  chemically synthesized
aaaactttatgtaaatctcata

SEQ ID NO: 1340201 - DNA, 22 bp, Artificial Sequence
  chemically synthesized
tgaaattttttaaattatgaga

SEQ ID NO: 1340202 - DNA, 22 bp, Artificial Sequence
  chemically synthesized
tatgtaaatctcataatttaaa

SEQ ID NO: 1340203 - DNA, 22 bp, Artificial Sequence
  chemically synthesized
atgtaaatctcataatttaaaa

SEQ ID NO: 1340204 - DNA, 22 bp, Artificial Sequence
  chemically synthesized
tgtaaatctcataatttaaaaa

SEQ ID NO: 1340205 - DNA, 22 bp, Artificial Sequence
  chemically synthesized
aaaattatgaaattttttaaat

SEQ ID NO: 1340206 - DNA, 22 bp, Artificial Sequence
  chemically synthesized
aaaaattatgaaattttttaaa

SEQ ID NO: 1340207 - DNA, 22 bp, Artificial Sequence
  chemically synthesized
ataatttaaaaaatttcataat

SEQ ID NO: 1340208 - DNA, 22 bp, Artificial Sequence
  chemically synthesized
taaaaatttaaaaattatgaaa

SEQ ID NO: 1340209 - DNA, 22 bp, Artificial Sequence
  chemically synthesized
ataaaaatttaaaaattatgaa

SEQ ID NO: 1340210 - DNA, 22 bp, Artificial Sequence
  chemically synthesized
aaaaaatttcataatttttaaa

SEQ ID NO: 1340211 - DNA, 22 bp, Artificial Sequence
  chemically synthesized
aacttataaaaatttaaaaatt

SEQ ID NO: 1340212 - DNA, 22 bp, Artificial Sequence
  chemically synthesized
aaaaatttcataatttttaaat

SEQ ID NO: 1340213 - DNA, 22 bp, Artificial Sequence
  chemically synthesized
caacttataaaaatttaaaaat

SEQ ID NO: 1340214 - DNA, 22 bp, Artificial Sequence
  chemically synthesized
ataccttcaacttataaaaatt

SEQ ID NO: 1340215 - DNA, 22 bp, Artificial Sequence
  chemically synthesized
cataatttttaaatttttataa

SEQ ID NO: 1340216 - DNA, 22 bp, Artificial Sequence
  chemically synthesized
ataatttttaaatttttataag

SEQ ID NO: 1340217 - DNA, 22 bp, Artificial Sequence
  chemically synthesized
ttaataccttcaacttataaaa

SEQ ID NO: 1340218 - DNA, 22 bp, Artificial Sequence
  chemically synthesized
gttaataccttcaacttataaa

SEQ ID NO: 1340219 - DNA, 22 bp, Artificial Sequence
  chemically synthesized
acttgttaataccttcaactta

SEQ ID NO: 1340220 - DNA, 22 bp, Artificial Sequence
  chemically synthesized
ttaaatttttataagttgaagg

SEQ ID NO: 1340221 - DNA, 22 bp, Artificial Sequence
  chemically synthesized
taaatttttataagttgaaggt

SEQ ID NO: 1340222 - DNA, 22 bp, Artificial Sequence
  chemically synthesized
aaatttttataagttgaaggta

SEQ ID NO: 1340223 - DNA, 22 bp, Artificial Sequence
  chemically synthesized
ttaacttgttaataccttcaac

SEQ ID NO: 1340224 - DNA, 22 bp, Artificial Sequence
  chemically synthesized
aatttttataagttgaaggtat

SEQ ID NO: 1340225 - DNA, 22 bp, Artificial Sequence
  chemically synthesized
ttattaacttgttaataccttc

SEQ ID NO: 1340226 - DNA, 22 bp, Artificial Sequence
  chemically synthesized
attattaacttgttaatacctt

SEQ ID NO: 1340227 - DNA, 22 bp, Artificial Sequence
  chemically synthesized
tattattaacttgttaatacct

SEQ ID NO: 1340228 - DNA, 22 bp, Artificial Sequence
  chemically synthesized
ttataagttgaaggtattaaca

SEQ ID NO: 1340229 - DNA, 22 bp, Artificial Sequence
  chemically synthesized
tataagttgaaggtattaacaa

SEQ ID NO: 1340230 - DNA, 22 bp, Artificial Sequence
  chemically synthesized
ataagttgaaggtattaacaag

SEQ ID NO: 1340231 - DNA, 22 bp, Artificial Sequence
  chemically synthesized
taagttgaaggtattaacaagt

SEQ ID NO: 1340232 - DNA, 22 bp, Artificial Sequence
  chemically synthesized
aaggtattaacaagttaataat

SEQ ID NO: 1340233 - DNA, 22 bp, Artificial Sequence
  chemically synthesized
aagaagtattttattattaact

SEQ ID NO: 1340234 - DNA, 22 bp, Artificial Sequence
  chemically synthesized
tcaagaagtattttattattaa

SEQ ID NO: 1340235 - DNA, 22 bp, Artificial Sequence
  chemically synthesized
gctctcaagaagtattttatta

SEQ ID NO: 1340236 - DNA, 22 bp, Artificial Sequence
  chemically synthesized
acaagttaataataaaatactt

SEQ ID NO: 1340237 - DNA, 22 bp, Artificial Sequence
  chemically synthesized
agttagctctcaagaagtattt

SEQ ID NO: 1340238 - DNA, 22 bp, Artificial Sequence
  chemically synthesized
ataataaaatacttcttgagag

SEQ ID NO: 1340239 - DNA, 22 bp, Artificial Sequence
  chemically synthesized
accctgagttagctctcaagaa

SEQ ID NO: 1340240 - DNA, 22 bp, Artificial Sequence
  chemically synthesized
cttgagagctaactcagggtta

SEQ ID NO: 1340241 - DNA, 22 bp, Artificial Sequence
  chemically synthesized
ttgagagctaactcagggttag

SEQ ID NO: 1340242 - DNA, 22 bp, Artificial Sequence
  chemically synthesized
gagagctaactcagggttagct

SEQ ID NO: 1340243 - DNA, 22 bp, Artificial Sequence
  chemically synthesized
agagctaactcagggttagctg

SEQ ID NO: 1340244 - DNA, 22 bp, Artificial Sequence
  chemically synthesized
actcagggttagctgctttata

SEQ ID NO: 1340245 - DNA, 22 bp, Artificial Sequence
  chemically synthesized
aagcatgaagaaatataaagca

SEQ ID NO: 1340246 - DNA, 22 bp, Artificial Sequence
  chemically synthesized
agggttagctgctttatatttc

SEQ ID NO: 1340247 - DNA, 22 bp, Artificial Sequence
  chemically synthesized
tatgagctaaagcatgaagaaa

SEQ ID NO: 1340248 - DNA, 22 bp, Artificial Sequence
  chemically synthesized
gctgctttatatttcttcatgc

SEQ ID NO: 1340249 - DNA, 22 bp, Artificial Sequence
  chemically synthesized
ctttatatttcttcatgcttta

SEQ ID NO: 1340250 - DNA, 22 bp, Artificial Sequence
  chemically synthesized
tatatttcttcatgctttagct

SEQ ID NO: 1340251 - DNA, 22 bp, Artificial Sequence
  chemically synthesized
atatttcttcatgctttagctc

SEQ ID NO: 1340252 - DNA, 22 bp, Artificial Sequence
  chemically synthesized
taatgattatatgagctaaagc

SEQ ID NO: 1340253 - DNA, 22 bp, Artificial Sequence
  chemically synthesized
tatttcttcatgctttagctca

SEQ ID NO: 1340254 - DNA, 22 bp, Artificial Sequence
  chemically synthesized
ttataatgattatatgagctaa

SEQ ID NO: 1340255 - DNA, 22 bp, Artificial Sequence
  chemically synthesized
tgttataatgattatatgagct

SEQ ID NO: 1340256 - DNA, 22 bp, Artificial Sequence
  chemically synthesized
cttcatgctttagctcatataa

SEQ ID NO: 1340257 - DNA, 22 bp, Artificial Sequence
  chemically synthesized
ttcatgctttagctcatataat

SEQ ID NO: 1340258 - DNA, 22 bp, Artificial Sequence
  chemically synthesized
tctgttataatgattatatgag

SEQ ID NO: 1340259 - DNA, 22 bp, Artificial Sequence
  chemically synthesized
ctctgttataatgattatatga

SEQ ID NO: 1340260 - DNA, 22 bp, Artificial Sequence
  chemically synthesized
catgctttagctcatataatca

SEQ ID NO: 1340261 - DNA, 22 bp, Artificial Sequence
  chemically synthesized
atgctttagctcatataatcat

SEQ ID NO: 1340262 - DNA, 22 bp, Artificial Sequence
  chemically synthesized
ccttctctgttataatgattat

SEQ ID NO: 1340263 - DNA, 22 bp, Artificial Sequence
  chemically synthesized
tagctcatataatcattataac

SEQ ID NO: 1340264 - DNA, 22 bp, Artificial Sequence
  chemically synthesized
agctcatataatcattataaca

SEQ ID NO: 1340265 - DNA, 22 bp, Artificial Sequence
  chemically synthesized
gctcatataatcattataacag

SEQ ID NO: 1340266 - DNA, 22 bp, Artificial Sequence
  chemically synthesized
atataatcattataacagagaa

SEQ ID NO: 1340267 - DNA, 22 bp, Artificial Sequence
  chemically synthesized
taatagaaactaccttctctgt

SEQ ID NO: 1340268 - DNA, 22 bp, Artificial Sequence
  chemically synthesized
taacagagaaggtagtttctat

SEQ ID NO: 1340269 - DNA, 22 bp, Artificial Sequence
  chemically synthesized
tagaaagattgtaatagaaact

SEQ ID NO: 1340270 - DNA, 22 bp, Artificial Sequence
  chemically synthesized
catctgtagaaagattgtaata

SEQ ID NO: 1340271 - DNA, 22 bp, Artificial Sequence
  chemically synthesized
gcatctgtagaaagattgtaat

SEQ ID NO: 1340272 - DNA, 22 bp, Artificial Sequence
  chemically synthesized
catttgcatctgtagaaagatt

SEQ ID NO: 1340273 - DNA, 22 bp, Artificial Sequence
  chemically synthesized
ccatttgcatctgtagaaagat

SEQ ID NO: 1340274 - DNA, 22 bp, Artificial Sequence
  chemically synthesized
tccatttgcatctgtagaaaga

SEQ ID NO: 1340275 - DNA, 22 bp, Artificial Sequence
  chemically synthesized
ttccatttgcatctgtagaaag

SEQ ID NO: 1340276 - DNA, 22 bp, Artificial Sequence
  chemically synthesized
ctattacaatctttctacagat

SEQ ID NO: 1340277 - DNA, 22 bp, Artificial Sequence
  chemically synthesized
tattacaatctttctacagatg

SEQ ID NO: 1340278 - DNA, 22 bp, Artificial Sequence
  chemically synthesized
ttacaatctttctacagatgca

SEQ ID NO: 1340279 - DNA, 22 bp, Artificial Sequence
  chemically synthesized
agtttttccatttgcatctgta

SEQ ID NO: 1340280 - DNA, 22 bp, Artificial Sequence
  chemically synthesized
caatctttctacagatgcaaat

SEQ ID NO: 1340281 - DNA, 22 bp, Artificial Sequence
  chemically synthesized
gtgtgcctcagtttttccattt

SEQ ID NO: 1340282 - DNA, 22 bp, Artificial Sequence
  chemically synthesized
tctacagatgcaaatggaaaaa

SEQ ID NO: 1340283 - DNA, 22 bp, Artificial Sequence
  chemically synthesized
ctacagatgcaaatggaaaaac

SEQ ID NO: 1340284 - DNA, 22 bp, Artificial Sequence
  chemically synthesized
tacagatgcaaatggaaaaact

SEQ ID NO: 1340285 - DNA, 22 bp, Artificial Sequence
  chemically synthesized
cagatgcaaatggaaaaactga

SEQ ID NO: 1340286 - DNA, 22 bp, Artificial Sequence
  chemically synthesized
aactcgtgtgcctcagtttttc

SEQ ID NO: 1340287 - DNA, 22 bp, Artificial Sequence
  chemically synthesized
aaactcgtgtgcctcagttttt

SEQ ID NO: 1340288 - DNA, 22 bp, Artificial Sequence
  chemically synthesized
ttaaactcgtgtgcctcagttt

SEQ ID NO: 1340289 - DNA, 22 bp, Artificial Sequence
  chemically synthesized
cttaaactcgtgtgcctcagtt

SEQ ID NO: 1340290 - DNA, 22 bp, Artificial Sequence
  chemically synthesized
ggagtttcttaaactcgtgtgc

SEQ ID NO: 1340291 - DNA, 22 bp, Artificial Sequence
  chemically synthesized
tgggagtttcttaaactcgtgt

SEQ ID NO: 1340292 - DNA, 22 bp, Artificial Sequence
  chemically synthesized
aggcacacgagtttaagaaact

SEQ ID NO: 1340293 - DNA, 22 bp, Artificial Sequence
  chemically synthesized
tgtagttctgggagtttcttaa

SEQ ID NO: 1340294 - DNA, 22 bp, Artificial Sequence
  chemically synthesized
actgtgtagttctgggagtttc

SEQ ID NO: 1340295 - DNA, 22 bp, Artificial Sequence
  chemically synthesized
aactgtgtagttctgggagttt

SEQ ID NO: 1340296 - DNA, 22 bp, Artificial Sequence
  chemically synthesized
taactgtgtagttctgggagtt

SEQ ID NO: 1340297 - DNA, 22 bp, Artificial Sequence
  chemically synthesized
ttaactgtgtagttctgggagt

SEQ ID NO: 1340298 - DNA, 22 bp, Artificial Sequence
  chemically synthesized
tttaactgtgtagttctgggag

SEQ ID NO: 1340299 - DNA, 22 bp, Artificial Sequence
  chemically synthesized
cattttttaactgtgtagttct

SEQ ID NO: 1340300 - DNA, 22 bp, Artificial Sequence
  chemically synthesized
aagaaactcccagaactacaca

SEQ ID NO: 1340301 - DNA, 22 bp, Artificial Sequence
  chemically synthesized
agaaactcccagaactacacag

SEQ ID NO: 1340302 - DNA, 22 bp, Artificial Sequence
  chemically synthesized
tacattttttaactgtgtagtt

SEQ ID NO: 1340303 - DNA, 22 bp, Artificial Sequence
  chemically synthesized
ctacattttttaactgtgtagt

SEQ ID NO: 1340304 - DNA, 22 bp, Artificial Sequence
  chemically synthesized
acttctacattttttaactgtg

SEQ ID NO: 1340305 - DNA, 22 bp, Artificial Sequence
  chemically synthesized
ccagaactacacagttaaaaaa

SEQ ID NO: 1340306 - DNA, 22 bp, Artificial Sequence
  chemically synthesized
gaatcctgacttctacattttt

SEQ ID NO: 1340307 - DNA, 22 bp, Artificial Sequence
  chemically synthesized
ggaatcctgacttctacatttt

SEQ ID NO: 1340308 - DNA, 22 bp, Artificial Sequence
  chemically synthesized
cacagttaaaaaatgtagaagt

SEQ ID NO: 1340309 - DNA, 22 bp, Artificial Sequence
  chemically synthesized
aaaaatgtagaagtcaggattc

SEQ ID NO: 1340310 - DNA, 22 bp, Artificial Sequence
  chemically synthesized
aaaagcccgacttggaatcctg

SEQ ID NO: 1340311 - DNA, 22 bp, Artificial Sequence
  chemically synthesized
gcaaacacaggaagactgaaaa

SEQ ID NO: 1340312 - DNA, 22 bp, Artificial Sequence
  chemically synthesized
caagtcgggcttttcagtcttc

SEQ ID NO: 1340313 - DNA, 22 bp, Artificial Sequence
  chemically synthesized
aggtgagagctggcaaacacag

SEQ ID NO: 1340314 - DNA, 22 bp, Artificial Sequence
  chemically synthesized
ttcagtcttcctgtgtttgcca

SEQ ID NO: 1340315 - DNA, 22 bp, Artificial Sequence
  chemically synthesized
tcagtcttcctgtgtttgccag

SEQ ID NO: 1340316 - DNA, 22 bp, Artificial Sequence
  chemically synthesized
cagtcttcctgtgtttgccagc

SEQ ID NO: 1340317 - DNA, 22 bp, Artificial Sequence
  chemically synthesized
agtcttcctgtgtttgccagct

SEQ ID NO: 1340318 - DNA, 22 bp, Artificial Sequence
  chemically synthesized
cctgtgtttgccagctctcacc

SEQ ID NO: 1340319 - DNA, 22 bp, Artificial Sequence
  chemically synthesized
ctgtgtttgccagctctcacct

SEQ ID NO: 1340320 - DNA, 22 bp, Artificial Sequence
  chemically synthesized
gtaacacaatactcaggtgaga

SEQ ID NO: 1340321 - DNA, 22 bp, Artificial Sequence
  chemically synthesized
tgtttgccagctctcacctgag

SEQ ID NO: 1340322 - DNA, 22 bp, Artificial Sequence
  chemically synthesized
ctagtaacacaatactcaggtg

SEQ ID NO: 1340323 - DNA, 22 bp, Artificial Sequence
  chemically synthesized
tactagtaacacaatactcagg

SEQ ID NO: 1340324 - DNA, 22 bp, Artificial Sequence
  chemically synthesized
gccagctctcacctgagtattg

SEQ ID NO: 1340325 - DNA, 22 bp, Artificial Sequence
  chemically synthesized
ccagctctcacctgagtattgt

SEQ ID NO: 1340326 - DNA, 22 bp, Artificial Sequence
  chemically synthesized
tcacctgagtattgtgttacta

SEQ ID NO: 1340327 - DNA, 22 bp, Artificial Sequence
  chemically synthesized
acctgagtattgtgttactagt

SEQ ID NO: 1340328 - DNA, 22 bp, Artificial Sequence
  chemically synthesized
tgagcacgtccctctactagta

SEQ ID NO: 1340329 - DNA, 22 bp, Artificial Sequence
  chemically synthesized
agtattgtgttactagtagagg

SEQ ID NO: 1340330 - DNA, 22 bp, Artificial Sequence
  chemically synthesized
tgttactagtagagggacgtgc

SEQ ID NO: 1340331 - DNA, 22 bp, Artificial Sequence
  chemically synthesized
ataggggcgactgtgagcacgt

SEQ ID NO: 1340332 - DNA, 22 bp, Artificial Sequence
  chemically synthesized
ctagtagagggacgtgctcaca

SEQ ID NO: 1340333 - DNA, 22 bp, Artificial Sequence
  chemically synthesized
gtagagggacgtgctcacagtc

SEQ ID NO: 1340334 - DNA, 22 bp, Artificial Sequence
  chemically synthesized
catccaaatacccctcataggg

SEQ ID NO: 1340335 - DNA, 22 bp, Artificial Sequence
  chemically synthesized
acagtcgcccctatgaggggta

SEQ ID NO: 1340336 - DNA, 22 bp, Artificial Sequence
  chemically synthesized
tctgcatccaaatacccctcat

SEQ ID NO: 1340337 - DNA, 22 bp, Artificial Sequence
  chemically synthesized
attatctgcatccaaatacccc

SEQ ID NO: 1340338 - DNA, 22 bp, Artificial Sequence
  chemically synthesized
tgaggggtatttggatgcagat

SEQ ID NO: 1340339 - DNA, 22 bp, Artificial Sequence
  chemically synthesized
aaatgatgttaattatctgcat

SEQ ID NO: 1340340 - DNA, 22 bp, Artificial Sequence
  chemically synthesized
tggattgaaatgatgttaatta

SEQ ID NO: 1340341 - DNA, 22 bp, Artificial Sequence
  chemically synthesized
gtggattgaaatgatgttaatt

SEQ ID NO: 1340342 - DNA, 22 bp, Artificial Sequence
  chemically synthesized
tgtggattgaaatgatgttaat

SEQ ID NO: 1340343 - DNA, 22 bp, Artificial Sequence
  chemically synthesized
ggatgcagataattaacatcat

SEQ ID NO: 1340344 - DNA, 22 bp, Artificial Sequence
  chemically synthesized
ttgtggattgaaatgatgttaa

SEQ ID NO: 1340345 - DNA, 22 bp, Artificial Sequence
  chemically synthesized
gatgcagataattaacatcatt

SEQ ID NO: 1340346 - DNA, 22 bp, Artificial Sequence
  chemically synthesized
tttttgtggattgaaatgatgt

SEQ ID NO: 1340347 - DNA, 22 bp, Artificial Sequence
  chemically synthesized
agcctatttttgtggattgaaa

SEQ ID NO: 1340348 - DNA, 22 bp, Artificial Sequence
  chemically synthesized
acatcatttcaatccacaaaaa

SEQ ID NO: 1340349 - DNA, 22 bp, Artificial Sequence
  chemically synthesized
aggactaagcctatttttgtgg

SEQ ID NO: 1340350 - DNA, 22 bp, Artificial Sequence
  chemically synthesized
ttgaggactaagcctatttttg

SEQ ID NO: 1340351 - DNA, 22 bp, Artificial Sequence
  chemically synthesized
attgaggactaagcctattttt

SEQ ID NO: 1340352 - DNA, 22 bp, Artificial Sequence
  chemically synthesized
cttattgaggactaagcctatt

SEQ ID NO: 1340353 - DNA, 22 bp, Artificial Sequence
  chemically synthesized
caatccacaaaaataggcttag

SEQ ID NO: 1340354 - DNA, 22 bp, Artificial Sequence
  chemically synthesized
acttattgaggactaagcctat

SEQ ID NO: 1340355 - DNA, 22 bp, Artificial Sequence
  chemically synthesized
aatccacaaaaataggcttagt

SEQ ID NO: 1340356 - DNA, 22 bp, Artificial Sequence
  chemically synthesized
cttacttattgaggactaagcc

SEQ ID NO: 1340357 - DNA, 22 bp, Artificial Sequence
  chemically synthesized
attccttacttattgaggacta

SEQ ID NO: 1340358 - DNA, 22 bp, Artificial Sequence
  chemically synthesized
gattccttacttattgaggact

SEQ ID NO: 1340359 - DNA, 22 bp, Artificial Sequence
  chemically synthesized
accttgattccttacttattga

SEQ ID NO: 1340360 - DNA, 22 bp, Artificial Sequence
  chemically synthesized
agtcctcaataagtaaggaatc

SEQ ID NO: 1340361 - DNA, 22 bp, Artificial Sequence
  chemically synthesized
gtcctcaataagtaaggaatca

SEQ ID NO: 1340362 - DNA, 22 bp, Artificial Sequence
  chemically synthesized
cagtgccctcaccttgattcct

SEQ ID NO: 1340363 - DNA, 22 bp, Artificial Sequence
  chemically synthesized
tgcagtgccctcaccttgattc

SEQ ID NO: 1340364 - DNA, 22 bp, Artificial Sequence
  chemically synthesized
aataagtaaggaatcaaggtga

SEQ ID NO: 1340365 - DNA, 22 bp, Artificial Sequence
  chemically synthesized
actctgcagtgccctcaccttg

SEQ ID NO: 1340366 - DNA, 22 bp, Artificial Sequence
  chemically synthesized
aacaaaatactaactctgcagt

SEQ ID NO: 1340367 - DNA, 22 bp, Artificial Sequence
  chemically synthesized
caacaaaatactaactctgcag

SEQ ID NO: 1340368 - DNA, 22 bp, Artificial Sequence
  chemically synthesized
tcttcaacaaaatactaactct

SEQ ID NO: 1340369 - DNA, 22 bp, Artificial Sequence
  chemically synthesized
gtcttcaacaaaatactaactc

SEQ ID NO: 1340370 - DNA, 22 bp, Artificial Sequence
  chemically synthesized
atttgtcttcaacaaaatacta

SEQ ID NO: 1340371 - DNA, 22 bp, Artificial Sequence
  chemically synthesized
ttaatttgtcttcaacaaaata

SEQ ID NO: 1340372 - DNA, 22 bp, Artificial Sequence
  chemically synthesized
attaatttgtcttcaacaaaat

SEQ ID NO: 1340373 - DNA, 22 bp, Artificial Sequence
  chemically synthesized
cagagttagtattttgttgaag

SEQ ID NO: 1340374 - DNA, 22 bp, Artificial Sequence
  chemically synthesized
gtattttgttgaagacaaatta

SEQ ID NO: 1340375 - DNA, 22 bp, Artificial Sequence
  chemically synthesized
tgttgaagacaaattaataaat

SEQ ID NO: 1340376 - DNA, 22 bp, Artificial Sequence
  chemically synthesized
gttgaagacaaattaataaatc

SEQ ID NO: 1340377 - DNA, 22 bp, Artificial Sequence
  chemically synthesized
ttgaagacaaattaataaatct

SEQ ID NO: 1340378 - DNA, 22 bp, Artificial Sequence
  chemically synthesized
aagacaaattaataaatctttt

SEQ ID NO: 1340379 - DNA, 22 bp, Artificial Sequence
  chemically synthesized
aaaaagaaaaaaaaaagattta

SEQ ID NO: 1340380 - DNA, 22 bp, Artificial Sequence
  chemically synthesized
gtctcaaaaagaaaaaaaaaag

SEQ ID NO: 1340381 - DNA, 22 bp, Artificial Sequence
  chemically synthesized
ataaatcttttttttttctttt

SEQ ID NO: 1340382 - DNA, 22 bp, Artificial Sequence
  chemically synthesized
ttttttttctttttgagacgag

SEQ ID NO: 1340383 - DNA, 22 bp, Artificial Sequence
  chemically synthesized
tttttttctttttgagacgagt

SEQ ID NO: 1340384 - DNA, 22 bp, Artificial Sequence
  chemically synthesized
ttttttctttttgagacgagtc

SEQ ID NO: 1340385 - DNA, 22 bp, Artificial Sequence
  chemically synthesized
tttttctttttgagacgagtct

SEQ ID NO: 1340386 - DNA, 22 bp, Artificial Sequence
  chemically synthesized
ggtgacagagcaagactcgtct

SEQ ID NO: 1340387 - DNA, 22 bp, Artificial Sequence
  chemically synthesized
ttttctttttgagacgagtctt

SEQ ID NO: 1340388 - DNA, 22 bp, Artificial Sequence
  chemically synthesized
tttctttttgagacgagtcttg

SEQ ID NO: 1340389 - DNA, 22 bp, Artificial Sequence
  chemically synthesized
ttctttttgagacgagtcttgc

SEQ ID NO: 1340390 - DNA, 22 bp, Artificial Sequence
  chemically synthesized
tctttttgagacgagtcttgct

SEQ ID NO: 1340391 - DNA, 22 bp, Artificial Sequence
  chemically synthesized
ctttttgagacgagtcttgctc

SEQ ID NO: 1340392 - DNA, 22 bp, Artificial Sequence
  chemically synthesized
tttttgagacgagtcttgctct

SEQ ID NO: 1340393 - DNA, 22 bp, Artificial Sequence
  chemically synthesized
cagcctgggtgacagagcaaga

SEQ ID NO: 1340394 - DNA, 22 bp, Artificial Sequence
  chemically synthesized
tttgagacgagtcttgctctgt

SEQ ID NO: 1340395 - DNA, 22 bp, Artificial Sequence
  chemically synthesized
ttgagacgagtcttgctctgtc

SEQ ID NO: 1340396 - DNA, 22 bp, Artificial Sequence
  chemically synthesized
tgagacgagtcttgctctgtca

SEQ ID NO: 1340397 - DNA, 22 bp, Artificial Sequence
  chemically synthesized
gagacgagtcttgctctgtcac

SEQ ID NO: 1340398 - DNA, 22 bp, Artificial Sequence
  chemically synthesized
agacgagtcttgctctgtcacc

SEQ ID NO: 1340399 - DNA, 22 bp, Artificial Sequence
  chemically synthesized
cactgcagcctgggtgacagag

SEQ ID NO: 1340400 - DNA, 22 bp, Artificial Sequence
  chemically synthesized
agccactgcactgcagcctggg

SEQ ID NO: 1340401 - DNA, 22 bp, Artificial Sequence
  chemically synthesized
gctctgtcacccaggctgcagt

SEQ ID NO: 1340402 - DNA, 22 bp, Artificial Sequence
  chemically synthesized
ctctgtcacccaggctgcagtg

SEQ ID NO: 1340403 - DNA, 22 bp, Artificial Sequence
  chemically synthesized
tgtcacccaggctgcagtgcag

SEQ ID NO: 1340404 - DNA, 22 bp, Artificial Sequence
  chemically synthesized
tcacccaggctgcagtgcagtg

SEQ ID NO: 1340405 - DNA, 22 bp, Artificial Sequence
  chemically synthesized
cagtgagcagagattgagccac

SEQ ID NO: 1340406 - DNA, 22 bp, Artificial Sequence
  chemically synthesized
cagtgcagtggctcaatctctg

SEQ ID NO: 1340407 - DNA, 22 bp, Artificial Sequence
  chemically synthesized
ggaggcggaggttgcagtgagc

SEQ ID NO: 1340408 - DNA, 22 bp, Artificial Sequence
  chemically synthesized
aatctctgctcactgcaacctc

SEQ ID NO: 1340409 - DNA, 22 bp, Artificial Sequence
  chemically synthesized
aacctgggaggcggaggttgca

SEQ ID NO: 1340410 - DNA, 22 bp, Artificial Sequence
  chemically synthesized
gaacctgggaggcggaggttgc

SEQ ID NO: 1340411 - DNA, 22 bp, Artificial Sequence
  chemically synthesized
tgctcactgcaacctccgcctc

SEQ ID NO: 1340412 - DNA, 22 bp, Artificial Sequence
  chemically synthesized
ctcactgcaacctccgcctccc

SEQ ID NO: 1340413 - DNA, 22 bp, Artificial Sequence
  chemically synthesized
actgcaacctccgcctcccagg

SEQ ID NO: 1340414 - DNA, 22 bp, Artificial Sequence
  chemically synthesized
caacctccgcctcccaggttca

SEQ ID NO: 1340415 - DNA, 22 bp, Artificial Sequence
  chemically synthesized
aggcaggagaatcgcttgaacc

SEQ ID NO: 1340416 - DNA, 22 bp, Artificial Sequence
  chemically synthesized
cgcctcccaggttcaagcgatt

SEQ ID NO: 1340417 - DNA, 22 bp, Artificial Sequence
  chemically synthesized
ccaggttcaagcgattctcctg

SEQ ID NO: 1340418 - DNA, 22 bp, Artificial Sequence
  chemically synthesized
gggaggctgaggcaggagaatc

SEQ ID NO: 1340419 - DNA, 22 bp, Artificial Sequence
  chemically synthesized
ctcgggaggctgaggcaggaga

SEQ ID NO: 1340420 - DNA, 22 bp, Artificial Sequence
  chemically synthesized
aagcgattctcctgcctcagcc

SEQ ID NO: 1340421 - DNA, 22 bp, Artificial Sequence
  chemically synthesized
tagtcccagctactcgggaggc

SEQ ID NO: 1340422 - DNA, 22 bp, Artificial Sequence
  chemically synthesized
tcctgcctcagcctcccgagta

SEQ ID NO: 1340423 - DNA, 22 bp, Artificial Sequence
  chemically synthesized
ctgcctcagcctcccgagtagc

SEQ ID NO: 1340424 - DNA, 22 bp, Artificial Sequence
  chemically synthesized
cctcagcctcccgagtagctgg

SEQ ID NO: 1340425 - DNA, 22 bp, Artificial Sequence
  chemically synthesized
agcctcccgagtagctgggact

SEQ ID NO: 1340426 - DNA, 22 bp, Artificial Sequence
  chemically synthesized
ccgagtagctgggactacaggt

SEQ ID NO: 1340427 - DNA, 22 bp, Artificial Sequence
  chemically synthesized
gccaggtgtagtagcacacacc

SEQ ID NO: 1340428 - DNA, 22 bp, Artificial Sequence
  chemically synthesized
ggactacaggtgtgtgctacta

SEQ ID NO: 1340429 - DNA, 22 bp, Artificial Sequence
  chemically synthesized
caggtgtgtgctactacacctg

SEQ ID NO: 1340430 - DNA, 22 bp, Artificial Sequence
  chemically synthesized
aaaaataaaaaaattagccagg

SEQ ID NO: 1340431 - DNA, 22 bp, Artificial Sequence
  chemically synthesized
ctaaaaaataaaaaaattagcc

SEQ ID NO: 1340432 - DNA, 22 bp, Artificial Sequence
  chemically synthesized
tactaaaaaataaaaaaattag

SEQ ID NO: 1340433 - DNA, 22 bp, Artificial Sequence
  chemically synthesized
ctacacctggctaattttttta

SEQ ID NO: 1340434 - DNA, 22 bp, Artificial Sequence
  chemically synthesized
cacctggctaatttttttattt

SEQ ID NO: 1340435 - DNA, 22 bp, Artificial Sequence
  chemically synthesized
gctaatttttttattttttagt

SEQ ID NO: 1340436 - DNA, 22 bp, Artificial Sequence
  chemically synthesized
atttttttattttttagtagag

SEQ ID NO: 1340437 - DNA, 22 bp, Artificial Sequence
  chemically synthesized
ttttattttttagtagagacgg

SEQ ID NO: 1340438 - DNA, 22 bp, Artificial Sequence
  chemically synthesized
tttattttttagtagagacggg

SEQ ID NO: 1340439 - DNA, 22 bp, Artificial Sequence
  chemically synthesized
acacggtgaaaccccgtctcta

SEQ ID NO: 1340440 - DNA, 22 bp, Artificial Sequence
  chemically synthesized
ttattttttagtagagacgggg

SEQ ID NO: 1340441 - DNA, 22 bp, Artificial Sequence
  chemically synthesized
tattttttagtagagacggggt

SEQ ID NO: 1340442 - DNA, 22 bp, Artificial Sequence
  chemically synthesized
attttttagtagagacggggtt

SEQ ID NO: 1340443 - DNA, 22 bp, Artificial Sequence
  chemically synthesized
ttttttagtagagacggggttt

SEQ ID NO: 1340444 - DNA, 22 bp, Artificial Sequence
  chemically synthesized
gctgacacggtgaaaccccgtc

SEQ ID NO: 1340445 - DNA, 22 bp, Artificial Sequence
  chemically synthesized
tttagtagagacggggtttcac

SEQ ID NO: 1340446 - DNA, 22 bp, Artificial Sequence
  chemically synthesized
ttagtagagacggggtttcacc

SEQ ID NO: 1340447 - DNA, 22 bp, Artificial Sequence
  chemically synthesized
tagtagagacggggtttcaccg

SEQ ID NO: 1340448 - DNA, 22 bp, Artificial Sequence
  chemically synthesized
agtagagacggggtttcaccgt

SEQ ID NO: 1340449 - DNA, 22 bp, Artificial Sequence
  chemically synthesized
gtagagacggggtttcaccgtg

SEQ ID NO: 1340450 - DNA, 22 bp, Artificial Sequence
  chemically synthesized
caccgtgtcagccaggatggtc

SEQ ID NO: 1340451 - DNA, 22 bp, Artificial Sequence
  chemically synthesized
accgtgtcagccaggatggtct

SEQ ID NO: 1340452 - DNA, 22 bp, Artificial Sequence
  chemically synthesized
aggcgggtggatcacaaggtca

SEQ ID NO: 1340453 - DNA, 22 bp, Artificial Sequence
  chemically synthesized
gacatcctgaccttgtgatcca

SEQ ID NO: 1340454 - DNA, 22 bp, Artificial Sequence
  chemically synthesized
ggaggctgaggcgggtggatca

SEQ ID NO: 1340455 - DNA, 22 bp, Artificial Sequence
  chemically synthesized
gggaggctgaggcgggtggatc

SEQ ID NO: 1340456 - DNA, 22 bp, Artificial Sequence
  chemically synthesized
tgggaggctgaggcgggtggat

SEQ ID NO: 1340457 - DNA, 22 bp, Artificial Sequence
  chemically synthesized
accttgtgatccacccgcctca

SEQ ID NO: 1340458 - DNA, 22 bp, Artificial Sequence
  chemically synthesized
gtgatccacccgcctcagcctc

SEQ ID NO: 1340459 - DNA, 22 bp, Artificial Sequence
  chemically synthesized
tgatccacccgcctcagcctcc

SEQ ID NO: 1340460 - DNA, 22 bp, Artificial Sequence
  chemically synthesized
taatcccagcactttgggaggc

SEQ ID NO: 1340461 - DNA, 22 bp, Artificial Sequence
  chemically synthesized
acgcctgtaatcccagcacttt

SEQ ID NO: 1340462 - DNA, 22 bp, Artificial Sequence
  chemically synthesized
agcctcccaaagtgctgggatt

SEQ ID NO: 1340463 - DNA, 22 bp, Artificial Sequence
  chemically synthesized
ccaaagtgctgggattacaggc

SEQ ID NO: 1340464 - DNA, 22 bp, Artificial Sequence
  chemically synthesized
gccagcggcggtggttcacgcc

SEQ ID NO: 1340465 - DNA, 22 bp, Artificial Sequence
  chemically synthesized
ttggccagcggcggtggttcac

SEQ ID NO: 1340466 - DNA, 22 bp, Artificial Sequence
  chemically synthesized
ggattacaggcgtgaaccaccg

SEQ ID NO: 1340467 - DNA, 22 bp, Artificial Sequence
  chemically synthesized
attggccagcggcggtggttca

SEQ ID NO: 1340468 - DNA, 22 bp, Artificial Sequence
  chemically synthesized
caggcgtgaaccaccgccgctg

SEQ ID NO: 1340469 - DNA, 22 bp, Artificial Sequence
  chemically synthesized
agatttattggccagcggcggt

SEQ ID NO: 1340470 - DNA, 22 bp, Artificial Sequence
  chemically synthesized
aagatttattggccagcggcgg

SEQ ID NO: 1340471 - DNA, 22 bp, Artificial Sequence
  chemically synthesized
taagatttattggccagcggcg

SEQ ID NO: 1340472 - DNA, 22 bp, Artificial Sequence
  chemically synthesized
gccaataaatcttaaaatattc

SEQ ID NO: 1340473 - DNA, 22 bp, Artificial Sequence
  chemically synthesized
aaaatattcttcctgctctcct

SEQ ID NO: 1340474 - DNA, 22 bp, Artificial Sequence
  chemically synthesized
aaatattcttcctgctctcctt

SEQ ID NO: 1340475 - DNA, 22 bp, Artificial Sequence
  chemically synthesized
ttcctgctctcctttcttttgt

SEQ ID NO: 1340476 - DNA, 22 bp, Artificial Sequence
  chemically synthesized
cctgctctcctttcttttgtct

SEQ ID NO: 1340477 - DNA, 22 bp, Artificial Sequence
  chemically synthesized
ctgctctcctttcttttgtctg

SEQ ID NO: 1340478 - DNA, 22 bp, Artificial Sequence
  chemically synthesized
ctctcctttcttttgtctgtta

SEQ ID NO: 1340479 - DNA, 22 bp, Artificial Sequence
  chemically synthesized
tcctttcttttgtctgttattt

SEQ ID NO: 1340480 - DNA, 22 bp, Artificial Sequence
  chemically synthesized
ctttcttttgtctgttatttcc

SEQ ID NO: 1340481 - DNA, 22 bp, Artificial Sequence
  chemically synthesized
tcttttgtctgttatttccctg

SEQ ID NO: 1340482 - DNA, 22 bp, Artificial Sequence
  chemically synthesized
acagtagatatccagggaaata

SEQ ID NO: 1340483 - DNA, 22 bp, Artificial Sequence
  chemically synthesized
cttttgtctgttatttccctgg

SEQ ID NO: 1340484 - DNA, 22 bp, Artificial Sequence
  chemically synthesized
cacagtagatatccagggaaat

SEQ ID NO: 1340485 - DNA, 22 bp, Artificial Sequence
  chemically synthesized
ttttgtctgttatttccctgga

SEQ ID NO: 1340486 - DNA, 22 bp, Artificial Sequence
  chemically synthesized
ttgtctgttatttccctggata

SEQ ID NO: 1340487 - DNA, 22 bp, Artificial Sequence
  chemically synthesized
tgtctgttatttccctggatat

SEQ ID NO: 1340488 - DNA, 22 bp, Artificial Sequence
  chemically synthesized
gtctgttatttccctggatatc

SEQ ID NO: 1340489 - DNA, 22 bp, Artificial Sequence
  chemically synthesized
tctgttatttccctggatatct

SEQ ID NO: 1340490 - DNA, 22 bp, Artificial Sequence
  chemically synthesized
ttatttccctggatatctactg

SEQ ID NO: 1340491 - DNA, 22 bp, Artificial Sequence
  chemically synthesized
tttccctggatatctactgtga

SEQ ID NO: 1340492 - DNA, 22 bp, Artificial Sequence
  chemically synthesized
ccctggatatctactgtgaaat

SEQ ID NO: 1340493 - DNA, 22 bp, Artificial Sequence
  chemically synthesized
cctggatatctactgtgaaata

SEQ ID NO: 1340494 - DNA, 22 bp, Artificial Sequence
  chemically synthesized
tatgtgagaccacagtatttca

SEQ ID NO: 1340495 - DNA, 22 bp, Artificial Sequence
  chemically synthesized
gatatctactgtgaaatactgt

SEQ ID NO: 1340496 - DNA, 22 bp, Artificial Sequence
  chemically synthesized
gtatgtgagaccacagtatttc

SEQ ID NO: 1340497 - DNA, 22 bp, Artificial Sequence
  chemically synthesized
gtttgtatgtgagaccacagta

SEQ ID NO: 1340498 - DNA, 22 bp, Artificial Sequence
  chemically synthesized
ctggtttgtatgtgagaccaca

SEQ ID NO: 1340499 - DNA, 22 bp, Artificial Sequence
  chemically synthesized
ctgtgaaatactgtggtctcac

SEQ ID NO: 1340500 - DNA, 22 bp, Artificial Sequence
  chemically synthesized
cctggtttgtatgtgagaccac

SEQ ID NO: 1340501 - DNA, 22 bp, Artificial Sequence
  chemically synthesized
tcctggtttgtatgtgagacca

SEQ ID NO: 1340502 - DNA, 22 bp, Artificial Sequence
  chemically synthesized
ttcctggtttgtatgtgagacc

SEQ ID NO: 1340503 - DNA, 22 bp, Artificial Sequence
  chemically synthesized
tgaaatactgtggtctcacata

SEQ ID NO: 1340504 - DNA, 22 bp, Artificial Sequence
  chemically synthesized
atttttcctggtttgtatgtga

SEQ ID NO: 1340505 - DNA, 22 bp, Artificial Sequence
  chemically synthesized
tcatttttcctggtttgtatgt

SEQ ID NO: 1340506 - DNA, 22 bp, Artificial Sequence
  chemically synthesized
cctctcatttttcctggtttgt

SEQ ID NO: 1340507 - DNA, 22 bp, Artificial Sequence
  chemically synthesized
tggtctcacatacaaaccagga

SEQ ID NO: 1340508 - DNA, 22 bp, Artificial Sequence
  chemically synthesized
acatacaaaccaggaaaaatga

SEQ ID NO: 1340509 - DNA, 22 bp, Artificial Sequence
  chemically synthesized
agataaaatgcacctccctctc

SEQ ID NO: 1340510 - DNA, 22 bp, Artificial Sequence
  chemically synthesized
gagataaaatgcacctccctct

SEQ ID NO: 1340511 - DNA, 22 bp, Artificial Sequence
  chemically synthesized
tatttgagataaaatgcacctc

SEQ ID NO: 1340512 - DNA, 22 bp, Artificial Sequence
  chemically synthesized
tgtatttgagataaaatgcacc

SEQ ID NO: 1340513 - DNA, 22 bp, Artificial Sequence
  chemically synthesized
gaagttctgtatttgagataaa

SEQ ID NO: 1340514 - DNA, 22 bp, Artificial Sequence
  chemically synthesized
ttagaagttctgtatttgagat

SEQ ID NO: 1340515 - DNA, 22 bp, Artificial Sequence
  chemically synthesized
attagaagttctgtatttgaga

SEQ ID NO: 1340516 - DNA, 22 bp, Artificial Sequence
  chemically synthesized
tattagaagttctgtatttgag

SEQ ID NO: 1340517 - DNA, 22 bp, Artificial Sequence
  chemically synthesized
ttttattagaagttctgtattt

SEQ ID NO: 1340518 - DNA, 22 bp, Artificial Sequence
  chemically synthesized
tgttttattagaagttctgtat

SEQ ID NO: 1340519 - DNA, 22 bp, Artificial Sequence
  chemically synthesized
tatctcaaatacagaacttcta

SEQ ID NO: 1340520 - DNA, 22 bp, Artificial Sequence
  chemically synthesized
atctcaaatacagaacttctaa

SEQ ID NO: 1340521 - DNA, 22 bp, Artificial Sequence
  chemically synthesized
tctcaaatacagaacttctaat

SEQ ID NO: 1340522 - DNA, 22 bp, Artificial Sequence
  chemically synthesized
aaataactctgttttattagaa

SEQ ID NO: 1340523 - DNA, 22 bp, Artificial Sequence
  chemically synthesized
aaatacagaacttctaataaaa

SEQ ID NO: 1340524 - DNA, 22 bp, Artificial Sequence
  chemically synthesized
aaaataactctgttttattaga

SEQ ID NO: 1340525 - DNA, 22 bp, Artificial Sequence
  chemically synthesized
tacatttaaaataactctgttt

SEQ ID NO: 1340526 - DNA, 22 bp, Artificial Sequence
  chemically synthesized
ctaataaaacagagttatttta

SEQ ID NO: 1340527 - DNA, 22 bp, Artificial Sequence
  chemically synthesized
taataaaacagagttattttaa

SEQ ID NO: 1340528 - DNA, 22 bp, Artificial Sequence
  chemically synthesized
ataaaacagagttattttaaat

SEQ ID NO: 1340529 - DNA, 22 bp, Artificial Sequence
  chemically synthesized
atccccctatacatttaaaata

SEQ ID NO: 1340530 - DNA, 22 bp, Artificial Sequence
  chemically synthesized
gatccccctatacatttaaaat

SEQ ID NO: 1340531 - DNA, 22 bp, Artificial Sequence
  chemically synthesized
tgatccccctatacatttaaaa

SEQ ID NO: 1340532 - DNA, 22 bp, Artificial Sequence
  chemically synthesized
tgtattttgatccccctataca

SEQ ID NO: 1340533 - DNA, 22 bp, Artificial Sequence
  chemically synthesized
atgtattttgatccccctatac

SEQ ID NO: 1340534 - DNA, 22 bp, Artificial Sequence
  chemically synthesized
ttttaaatgtatagggggatca

SEQ ID NO: 1340535 - DNA, 22 bp, Artificial Sequence
  chemically synthesized
tgtttatgtattttgatccccc

SEQ ID NO: 1340536 - DNA, 22 bp, Artificial Sequence
  chemically synthesized
atgtttatgtattttgatcccc

SEQ ID NO: 1340537 - DNA, 22 bp, Artificial Sequence
  chemically synthesized
taaatgtatagggggatcaaaa

SEQ ID NO: 1340538 - DNA, 22 bp, Artificial Sequence
  chemically synthesized
aaatgtatagggggatcaaaat

SEQ ID NO: 1340539 - DNA, 22 bp, Artificial Sequence
  chemically synthesized
aatgtatagggggatcaaaata

SEQ ID NO: 1340540 - DNA, 22 bp, Artificial Sequence
  chemically synthesized
aatcaaataatcaagtgtttat

SEQ ID NO: 1340541 - DNA, 22 bp, Artificial Sequence
  chemically synthesized
gattatttgatttagcattaca

SEQ ID NO: 1340542 - DNA, 22 bp, Artificial Sequence
  chemically synthesized
attatttgatttagcattacat

SEQ ID NO: 1340543 - DNA, 22 bp, Artificial Sequence
  chemically synthesized
tttgatttagcattacattcat

SEQ ID NO: 1340544 - DNA, 22 bp, Artificial Sequence
  chemically synthesized
gatttagcattacattcattgt

SEQ ID NO: 1340545 - DNA, 22 bp, Artificial Sequence
  chemically synthesized
atttagcattacattcattgta

SEQ ID NO: 1340546 - DNA, 22 bp, Artificial Sequence
  chemically synthesized
agcattacattcattgtattca

SEQ ID NO: 1340547 - DNA, 22 bp, Artificial Sequence
  chemically synthesized
gcattacattcattgtattcat

SEQ ID NO: 1340548 - DNA, 22 bp, Artificial Sequence
  chemically synthesized
cattcattgtattcattgcatg

SEQ ID NO: 1340549 - DNA, 22 bp, Artificial Sequence
  chemically synthesized
ccagcagaataaaatgcatgca

SEQ ID NO: 1340550 - DNA, 22 bp, Artificial Sequence
  chemically synthesized
attgtattcattgcatgcattt

SEQ ID NO: 1340551 - DNA, 22 bp, Artificial Sequence
  chemically synthesized
attgccagcagaataaaatgca

SEQ ID NO: 1340552 - DNA, 22 bp, Artificial Sequence
  chemically synthesized
tattcattgcatgcattttatt

SEQ ID NO: 1340553 - DNA, 22 bp, Artificial Sequence
  chemically synthesized
gattgccagcagaataaaatgc

SEQ ID NO: 1340554 - DNA, 22 bp, Artificial Sequence
  chemically synthesized
tgattgccagcagaataaaatg

SEQ ID NO: 1340555 - DNA, 22 bp, Artificial Sequence
  chemically synthesized
attgcatgcattttattctgct

SEQ ID NO: 1340556 - DNA, 22 bp, Artificial Sequence
  chemically synthesized
attttgattgccagcagaataa

SEQ ID NO: 1340557 - DNA, 22 bp, Artificial Sequence
  chemically synthesized
catgcattttattctgctggca

SEQ ID NO: 1340558 - DNA, 22 bp, Artificial Sequence
  chemically synthesized
gaactaattttgattgccagca

SEQ ID NO: 1340559 - DNA, 22 bp, Artificial Sequence
  chemically synthesized
tggaactaattttgattgccag

SEQ ID NO: 1340560 - DNA, 22 bp, Artificial Sequence
  chemically synthesized
ctggaactaattttgattgcca

SEQ ID NO: 1340561 - DNA, 22 bp, Artificial Sequence
  chemically synthesized
ttctggaactaattttgattgc

SEQ ID NO: 1340562 - DNA, 22 bp, Artificial Sequence
  chemically synthesized
cttctggaactaattttgattg

SEQ ID NO: 1340563 - DNA, 22 bp, Artificial Sequence
  chemically synthesized
tattctgctggcaatcaaaatt

SEQ ID NO: 1340564 - DNA, 22 bp, Artificial Sequence
  chemically synthesized
attctgctggcaatcaaaatta

SEQ ID NO: 1340565 - DNA, 22 bp, Artificial Sequence
  chemically synthesized
ttctgctggcaatcaaaattag

SEQ ID NO: 1340566 - DNA, 22 bp, Artificial Sequence
  chemically synthesized
tgctggcaatcaaaattagttc

SEQ ID NO: 1340567 - DNA, 22 bp, Artificial Sequence
  chemically synthesized
ctggcaatcaaaattagttcca

SEQ ID NO: 1340568 - DNA, 22 bp, Artificial Sequence
  chemically synthesized
cggaccttcttctggaactaat

SEQ ID NO: 1340569 - DNA, 22 bp, Artificial Sequence
  chemically synthesized
gcaatcaaaattagttccagaa

SEQ ID NO: 1340570 - DNA, 22 bp, Artificial Sequence
  chemically synthesized
ccattccggaccttcttctgga

SEQ ID NO: 1340571 - DNA, 22 bp, Artificial Sequence
  chemically synthesized
gttccagaagaaggtccggaat

SEQ ID NO: 1340572 - DNA, 22 bp, Artificial Sequence
  chemically synthesized
cagaagaaggtccggaatggca

SEQ ID NO: 1340573 - DNA, 22 bp, Artificial Sequence
  chemically synthesized
agcaggggaatgtgtcaactgc

SEQ ID NO: 1340574 - DNA, 22 bp, Artificial Sequence
  chemically synthesized
ttgagcaggggaatgtgtcaac

SEQ ID NO: 1340575 - DNA, 22 bp, Artificial Sequence
  chemically synthesized
taaatatcagggctattgagca

SEQ ID NO: 1340576 - DNA, 22 bp, Artificial Sequence
  chemically synthesized
acacattcccctgctcaatagc

SEQ ID NO: 1340577 - DNA, 22 bp, Artificial Sequence
  chemically synthesized
ccctgctcaatagccctgatat

SEQ ID NO: 1340578 - DNA, 22 bp, Artificial Sequence
  chemically synthesized
aaatcataattataaatatcag

SEQ ID NO: 1340579 - DNA, 22 bp, Artificial Sequence
  chemically synthesized
ctcaatagccctgatatttata

SEQ ID NO: 1340580 - DNA, 22 bp, Artificial Sequence
  chemically synthesized
aatagccctgatatttataatt

SEQ ID NO: 1340581 - DNA, 22 bp, Artificial Sequence
  chemically synthesized
atatttataattatgatttgaa

SEQ ID NO: 1340582 - DNA, 22 bp, Artificial Sequence
  chemically synthesized
gcccagtaaaatgtattcaaat

SEQ ID NO: 1340583 - DNA, 22 bp, Artificial Sequence
  chemically synthesized
ataattatgatttgaatacatt

SEQ ID NO: 1340584 - DNA, 22 bp, Artificial Sequence
  chemically synthesized
ctagcccagtaaaatgtattca

SEQ ID NO: 1340585 - DNA, 22 bp, Artificial Sequence
  chemically synthesized
taattatgatttgaatacattt

SEQ ID NO: 1340586 - DNA, 22 bp, Artificial Sequence
  chemically synthesized
actagcccagtaaaatgtattc

SEQ ID NO: 1340587 - DNA, 22 bp, Artificial Sequence
  chemically synthesized
tgatttgaatacattttactgg

SEQ ID NO: 1340588 - DNA, 22 bp, Artificial Sequence
  chemically synthesized
atatttactagcccagtaaaat

SEQ ID NO: 1340589 - DNA, 22 bp, Artificial Sequence
  chemically synthesized
aatatttactagcccagtaaaa

SEQ ID NO: 1340590 - DNA, 22 bp, Artificial Sequence
  chemically synthesized
taatatttactagcccagtaaa

SEQ ID NO: 1340591 - DNA, 22 bp, Artificial Sequence
  chemically synthesized
ctttaatatttactagcccagt

SEQ ID NO: 1340592 - DNA, 22 bp, Artificial Sequence
  chemically synthesized
gaatacattttactgggctagt

SEQ ID NO: 1340593 - DNA, 22 bp, Artificial Sequence
  chemically synthesized
gctttaatatttactagcccag

SEQ ID NO: 1340594 - DNA, 22 bp, Artificial Sequence
  chemically synthesized
aatacattttactgggctagta

SEQ ID NO: 1340595 - DNA, 22 bp, Artificial Sequence
  chemically synthesized
aaaatttgctttaatatttact

SEQ ID NO: 1340596 - DNA, 22 bp, Artificial Sequence
  chemically synthesized
taaaaatttgctttaatattta

SEQ ID NO: 1340597 - DNA, 22 bp, Artificial Sequence
  chemically synthesized
tactgggctagtaaatattaaa

SEQ ID NO: 1340598 - DNA, 22 bp, Artificial Sequence
  chemically synthesized
ctaaaaatttgctttaatattt

SEQ ID NO: 1340599 - DNA, 22 bp, Artificial Sequence
  chemically synthesized
actgggctagtaaatattaaag

SEQ ID NO: 1340600 - DNA, 22 bp, Artificial Sequence
  chemically synthesized
ctgggctagtaaatattaaagc

SEQ ID NO: 1340601 - DNA, 22 bp, Artificial Sequence
  chemically synthesized
ggctagtaaatattaaagcaaa

SEQ ID NO: 1340602 - DNA, 22 bp, Artificial Sequence
  chemically synthesized
atcatttctaaaaatttgcttt

SEQ ID NO: 1340603 - DNA, 22 bp, Artificial Sequence
  chemically synthesized
catcatttctaaaaatttgctt

SEQ ID NO: 1340604 - DNA, 22 bp, Artificial Sequence
  chemically synthesized
tcatcatttctaaaaatttgct

SEQ ID NO: 1340605 - DNA, 22 bp, Artificial Sequence
  chemically synthesized
gtaaatattaaagcaaattttt

SEQ ID NO: 1340606 - DNA, 22 bp, Artificial Sequence
  chemically synthesized
ttcatcatttctaaaaatttgc

SEQ ID NO: 1340607 - DNA, 22 bp, Artificial Sequence
  chemically synthesized
tttcatcatttctaaaaatttg

SEQ ID NO: 1340608 - DNA, 22 bp, Artificial Sequence
  chemically synthesized
attttttcatcatttctaaaaa

SEQ ID NO: 1340609 - DNA, 22 bp, Artificial Sequence
  chemically synthesized
aagcaaatttttagaaatgatg

SEQ ID NO: 1340610 - DNA, 22 bp, Artificial Sequence
  chemically synthesized
aattaattttttcatcatttct

SEQ ID NO: 1340611 - DNA, 22 bp, Artificial Sequence
  chemically synthesized
aaattaattttttcatcatttc

SEQ ID NO: 1340612 - DNA, 22 bp, Artificial Sequence
  chemically synthesized
ttagaaatgatgaaaaaattaa

SEQ ID NO: 1340613 - DNA, 22 bp, Artificial Sequence
  chemically synthesized
tagaaatgatgaaaaaattaat

SEQ ID NO: 1340614 - DNA, 22 bp, Artificial Sequence
  chemically synthesized
agaaatgatgaaaaaattaatt

SEQ ID NO: 1340615 - DNA, 22 bp, Artificial Sequence
  chemically synthesized
gaaatgatgaaaaaattaattt

SEQ ID NO: 1340616 - DNA, 22 bp, Artificial Sequence
  chemically synthesized
gagacaaaaaatgcttaaatta

SEQ ID NO: 1340617 - DNA, 22 bp, Artificial Sequence
  chemically synthesized
agagacaaaaaatgcttaaatt

SEQ ID NO: 1340618 - DNA, 22 bp, Artificial Sequence
  chemically synthesized
taaatttagagacaaaaaatgc

SEQ ID NO: 1340619 - DNA, 22 bp, Artificial Sequence
  chemically synthesized
gtaaatttagagacaaaaaatg

SEQ ID NO: 1340620 - DNA, 22 bp, Artificial Sequence
  chemically synthesized
tttgtaaatttagagacaaaaa

SEQ ID NO: 1340621 - DNA, 22 bp, Artificial Sequence
  chemically synthesized
atttaagcattttttgtctcta

SEQ ID NO: 1340622 - DNA, 22 bp, Artificial Sequence
  chemically synthesized
ttgtttgtaaatttagagacaa

SEQ ID NO: 1340623 - DNA, 22 bp, Artificial Sequence
  chemically synthesized
gttgtttgtaaatttagagaca

SEQ ID NO: 1340624 - DNA, 22 bp, Artificial Sequence
  chemically synthesized
aagcattttttgtctctaaatt

SEQ ID NO: 1340625 - DNA, 22 bp, Artificial Sequence
  chemically synthesized
agcattttttgtctctaaattt

SEQ ID NO: 1340626 - DNA, 22 bp, Artificial Sequence
  chemically synthesized
catgtttgttgtttgtaaattt

SEQ ID NO: 1340627 - DNA, 22 bp, Artificial Sequence
  chemically synthesized
tttgtctctaaatttacaaaca

SEQ ID NO: 1340628 - DNA, 22 bp, Artificial Sequence
  chemically synthesized
ttgtctctaaatttacaaacaa

SEQ ID NO: 1340629 - DNA, 22 bp, Artificial Sequence
  chemically synthesized
tgtctctaaatttacaaacaac

SEQ ID NO: 1340630 - DNA, 22 bp, Artificial Sequence
  chemically synthesized
gtctctaaatttacaaacaaca

SEQ ID NO: 1340631 - DNA, 22 bp, Artificial Sequence
  chemically synthesized
tctctaaatttacaaacaacaa

SEQ ID NO: 1340632 - DNA, 22 bp, Artificial Sequence
  chemically synthesized
gaaaattgcatgtttgttgttt

SEQ ID NO: 1340633 - DNA, 22 bp, Artificial Sequence
  chemically synthesized
agaaaattgcatgtttgttgtt

SEQ ID NO: 1340634 - DNA, 22 bp, Artificial Sequence
  chemically synthesized
taaatttacaaacaacaaacat

SEQ ID NO: 1340635 - DNA, 22 bp, Artificial Sequence
  chemically synthesized
cttagaaaattgcatgtttgtt

SEQ ID NO: 1340636 - DNA, 22 bp, Artificial Sequence
  chemically synthesized
aatttacaaacaacaaacatgc

SEQ ID NO: 1340637 - DNA, 22 bp, Artificial Sequence
  chemically synthesized
tacttagaaaattgcatgtttg

SEQ ID NO: 1340638 - DNA, 22 bp, Artificial Sequence
  chemically synthesized
ttctacttagaaaattgcatgt

SEQ ID NO: 1340639 - DNA, 22 bp, Artificial Sequence
  chemically synthesized
acaaacaacaaacatgcaattt

SEQ ID NO: 1340640 - DNA, 22 bp, Artificial Sequence
  chemically synthesized
caaacaacaaacatgcaatttt

SEQ ID NO: 1340641 - DNA, 22 bp, Artificial Sequence
  chemically synthesized
gtgtgtgttattctacttagaa

SEQ ID NO: 1340642 - DNA, 22 bp, Artificial Sequence
  chemically synthesized
cctggtgtgtgttattctactt

SEQ ID NO: 1340643 - DNA, 22 bp, Artificial Sequence
  chemically synthesized
ctccctggtgtgtgttattcta

SEQ ID NO: 1340644 - DNA, 22 bp, Artificial Sequence
  chemically synthesized
tctaagtagaataacacacacc

SEQ ID NO: 1340645 - DNA, 22 bp, Artificial Sequence
  chemically synthesized
ctaagtagaataacacacacca

SEQ ID NO: 1340646 - DNA, 22 bp, Artificial Sequence
  chemically synthesized
taagtagaataacacacaccag

SEQ ID NO: 1340647 - DNA, 22 bp, Artificial Sequence
  chemically synthesized
agtagaataacacacaccaggg

SEQ ID NO: 1340648 - DNA, 22 bp, Artificial Sequence
  chemically synthesized
aaatatcattactccctggtgt

SEQ ID NO: 1340649 - DNA, 22 bp, Artificial Sequence
  chemically synthesized
caaatatcattactccctggtg

SEQ ID NO: 1340650 - DNA, 22 bp, Artificial Sequence
  chemically synthesized
acagtcatttcaaatatcatta

SEQ ID NO: 1340651 - DNA, 22 bp, Artificial Sequence
  chemically synthesized
gaaatgactgtgaattttggtc

SEQ ID NO: 1340652 - DNA, 22 bp, Artificial Sequence
  chemically synthesized
aaatgactgtgaattttggtct

SEQ ID NO: 1340653 - DNA, 22 bp, Artificial Sequence
  chemically synthesized
tgaattttggtctctggatgtt

SEQ ID NO: 1340654 - DNA, 22 bp, Artificial Sequence
  chemically synthesized
tggtctctggatgttcttggct

SEQ ID NO: 1340655 - DNA, 22 bp, Artificial Sequence
  chemically synthesized
ggtctctggatgttcttggctt

SEQ ID NO: 1340656 - DNA, 22 bp, Artificial Sequence
  chemically synthesized
gtctctggatgttcttggcttt

SEQ ID NO: 1340657 - DNA, 22 bp, Artificial Sequence
  chemically synthesized
tggatgttcttggcttttggtc

SEQ ID NO: 1340658 - DNA, 22 bp, Artificial Sequence
  chemically synthesized
gatgttcttggcttttggtcat

SEQ ID NO: 1340659 - DNA, 22 bp, Artificial Sequence
  chemically synthesized
gaaggtgtagtgaatcatatga

SEQ ID NO: 1340660 - DNA, 22 bp, Artificial Sequence
  chemically synthesized
ttggcttttggtcatatgattc

SEQ ID NO: 1340661 - DNA, 22 bp, Artificial Sequence
  chemically synthesized
ggcttttggtcatatgattcac

SEQ ID NO: 1340662 - DNA, 22 bp, Artificial Sequence
  chemically synthesized
gcttttggtcatatgattcact

SEQ ID NO: 1340663 - DNA, 22 bp, Artificial Sequence
  chemically synthesized
ttggtcatatgattcactacac

SEQ ID NO: 1340664 - DNA, 22 bp, Artificial Sequence
  chemically synthesized
catgcctagaaggtgtagtgaa

SEQ ID NO: 1340665 - DNA, 22 bp, Artificial Sequence
  chemically synthesized
tggtcatatgattcactacacc

SEQ ID NO: 1340666 - DNA, 22 bp, Artificial Sequence
  chemically synthesized
ggtcatatgattcactacacct

SEQ ID NO: 1340667 - DNA, 22 bp, Artificial Sequence
  chemically synthesized
gtcatatgattcactacacctt

SEQ ID NO: 1340668 - DNA, 22 bp, Artificial Sequence
  chemically synthesized
agagataattacatgcctagaa

SEQ ID NO: 1340669 - DNA, 22 bp, Artificial Sequence
  chemically synthesized
actacaccttctaggcatgtaa

SEQ ID NO: 1340670 - DNA, 22 bp, Artificial Sequence
  chemically synthesized
caccttctaggcatgtaattat

SEQ ID NO: 1340671 - DNA, 22 bp, Artificial Sequence
  chemically synthesized
ctaggcatgtaattatctctta

SEQ ID NO: 1340672 - DNA, 22 bp, Artificial Sequence
  chemically synthesized
taggcatgtaattatctcttaa

SEQ ID NO: 1340673 - DNA, 22 bp, Artificial Sequence
  chemically synthesized
ggcatgtaattatctcttaaca

SEQ ID NO: 1340674 - DNA, 22 bp, Artificial Sequence
  chemically synthesized
tatgacaggatgtgaggtgtta

SEQ ID NO: 1340675 - DNA, 22 bp, Artificial Sequence
  chemically synthesized
tctcttaacacctcacatcctg

SEQ ID NO: 1340676 - DNA, 22 bp, Artificial Sequence
  chemically synthesized
ttaacacctcacatcctgtcat

SEQ ID NO: 1340677 - DNA, 22 bp, Artificial Sequence
  chemically synthesized
aacacctcacatcctgtcatac

SEQ ID NO: 1340678 - DNA, 22 bp, Artificial Sequence
  chemically synthesized
acacctcacatcctgtcataca

SEQ ID NO: 1340679 - DNA, 22 bp, Artificial Sequence
  chemically synthesized
aggaatggcatactgtatgaca

SEQ ID NO: 1340680 - DNA, 22 bp, Artificial Sequence
  chemically synthesized
aaggaatggcatactgtatgac

SEQ ID NO: 1340681 - DNA, 22 bp, Artificial Sequence
  chemically synthesized
atttaaggaatggcatactgta

SEQ ID NO: 1340682 - DNA, 22 bp, Artificial Sequence
  chemically synthesized
acatcctgtcatacagtatgcc

SEQ ID NO: 1340683 - DNA, 22 bp, Artificial Sequence
  chemically synthesized
tcatttaaggaatggcatactg

SEQ ID NO: 1340684 - DNA, 22 bp, Artificial Sequence
  chemically synthesized
tcatacagtatgccattcctta

SEQ ID NO: 1340685 - DNA, 22 bp, Artificial Sequence
  chemically synthesized
gagaccaattctcatttaagga

SEQ ID NO: 1340686 - DNA, 22 bp, Artificial Sequence
  chemically synthesized
cttaaatgagaattggtctcga

SEQ ID NO: 1340687 - DNA, 22 bp, Artificial Sequence
  chemically synthesized
aaatgagaattggtctcgagta

SEQ ID NO: 1340688 - DNA, 22 bp, Artificial Sequence
  chemically synthesized
aatatacaatgatactcgagac

SEQ ID NO: 1340689 - DNA, 22 bp, Artificial Sequence
  chemically synthesized
aatgagaattggtctcgagtat

SEQ ID NO: 1340690 - DNA, 22 bp, Artificial Sequence
  chemically synthesized
agatctaaatatacaatgatac

SEQ ID NO: 1340691 - DNA, 22 bp, Artificial Sequence
  chemically synthesized
ttaagatctaaatatacaatga

SEQ ID NO: 1340692 - DNA, 22 bp, Artificial Sequence
  chemically synthesized
gtctcgagtatcattgtatatt

SEQ ID NO: 1340693 - DNA, 22 bp, Artificial Sequence
  chemically synthesized
aaattattaagatctaaatata

SEQ ID NO: 1340694 - DNA, 22 bp, Artificial Sequence
  chemically synthesized
gagtatcattgtatatttagat

SEQ ID NO: 1340695 - DNA, 22 bp, Artificial Sequence
  chemically synthesized
ttaaaattattaagatctaaat

SEQ ID NO: 1340696 - DNA, 22 bp, Artificial Sequence
  chemically synthesized
tattaaaattattaagatctaa

SEQ ID NO: 1340697 - DNA, 22 bp, Artificial Sequence
  chemically synthesized
ctattaaaattattaagatcta

SEQ ID NO: 1340698 - DNA, 22 bp, Artificial Sequence
  chemically synthesized
tatatttagatcttaataattt

SEQ ID NO: 1340699 - DNA, 22 bp, Artificial Sequence
  chemically synthesized
atgtttctattaaaattattaa

SEQ ID NO: 1340700 - DNA, 22 bp, Artificial Sequence
  chemically synthesized
gttgatgtttctattaaaatta

SEQ ID NO: 1340701 - DNA, 22 bp, Artificial Sequence
  chemically synthesized
agatcttaataattttaataga

SEQ ID NO: 1340702 - DNA, 22 bp, Artificial Sequence
  chemically synthesized
ctggttgatgtttctattaaaa

SEQ ID NO: 1340703 - DNA, 22 bp, Artificial Sequence
  chemically synthesized
gatcttaataattttaatagaa

SEQ ID NO: 1340704 - DNA, 22 bp, Artificial Sequence
  chemically synthesized
aataattttaatagaaacatca

SEQ ID NO: 1340705 - DNA, 22 bp, Artificial Sequence
  chemically synthesized
ataattttaatagaaacatcaa

SEQ ID NO: 1340706 - DNA, 22 bp, Artificial Sequence
  chemically synthesized
agaaattactggttgatgtttc

SEQ ID NO: 1340707 - DNA, 22 bp, Artificial Sequence
  chemically synthesized
cagaaattactggttgatgttt

SEQ ID NO: 1340708 - DNA, 22 bp, Artificial Sequence
  chemically synthesized
cccttcagaaattactggttga

SEQ ID NO: 1340709 - DNA, 22 bp, Artificial Sequence
  chemically synthesized
taatagaaacatcaaccagtaa

SEQ ID NO: 1340710 - DNA, 22 bp, Artificial Sequence
  chemically synthesized
gcccttcagaaattactggttg

SEQ ID NO: 1340711 - DNA, 22 bp, Artificial Sequence
  chemically synthesized
aatagaaacatcaaccagtaat

SEQ ID NO: 1340712 - DNA, 22 bp, Artificial Sequence
  chemically synthesized
tgcccttcagaaattactggtt

SEQ ID NO: 1340713 - DNA, 22 bp, Artificial Sequence
  chemically synthesized
atagaaacatcaaccagtaatt

SEQ ID NO: 1340714 - DNA, 22 bp, Artificial Sequence
  chemically synthesized
tatattttgcccttcagaaatt

SEQ ID NO: 1340715 - DNA, 22 bp, Artificial Sequence
  chemically synthesized
atatattttgcccttcagaaat

SEQ ID NO: 1340716 - DNA, 22 bp, Artificial Sequence
  chemically synthesized
agtgataaaatttatatatttt

SEQ ID NO: 1340717 - DNA, 22 bp, Artificial Sequence
  chemically synthesized
aagtgataaaatttatatattt

SEQ ID NO: 1340718 - DNA, 22 bp, Artificial Sequence
  chemically synthesized
taagtgataaaatttatatatt

SEQ ID NO: 1340719 - DNA, 22 bp, Artificial Sequence
  chemically synthesized
ctgaagggcaaaatatataaat

SEQ ID NO: 1340720 - DNA, 22 bp, Artificial Sequence
  chemically synthesized
tgaagggcaaaatatataaatt

SEQ ID NO: 1340721 - DNA, 22 bp, Artificial Sequence
  chemically synthesized
aagggcaaaatatataaatttt

SEQ ID NO: 1340722 - DNA, 22 bp, Artificial Sequence
  chemically synthesized
aagaaaagatatattttaagtg

SEQ ID NO: 1340723 - DNA, 22 bp, Artificial Sequence
  chemically synthesized
ttaaagaaaagatatattttaa

SEQ ID NO: 1340724 - DNA, 22 bp, Artificial Sequence
  chemically synthesized
attaaagaaaagatatatttta

SEQ ID NO: 1340725 - DNA, 22 bp, Artificial Sequence
  chemically synthesized
tattaaagaaaagatatatttt

SEQ ID NO: 1340726 - DNA, 22 bp, Artificial Sequence
  chemically synthesized
tatcacttaaaatatatctttt

SEQ ID NO: 1340727 - DNA, 22 bp, Artificial Sequence
  chemically synthesized
atcacttaaaatatatcttttc

SEQ ID NO: 1340728 - DNA, 22 bp, Artificial Sequence
  chemically synthesized
gattttattaaagaaaagatat

SEQ ID NO: 1340729 - DNA, 22 bp, Artificial Sequence
  chemically synthesized
tcacttaaaatatatcttttct

SEQ ID NO: 1340730 - DNA, 22 bp, Artificial Sequence
  chemically synthesized
aaaatatatcttttctttaata

SEQ ID NO: 1340731 - DNA, 22 bp, Artificial Sequence
  chemically synthesized
agagctagattttattaaagaa

SEQ ID NO: 1340732 - DNA, 22 bp, Artificial Sequence
  chemically synthesized
aaatatatcttttctttaataa

SEQ ID NO: 1340733 - DNA, 22 bp, Artificial Sequence
  chemically synthesized
aagagctagattttattaaaga

SEQ ID NO: 1340734 - DNA, 22 bp, Artificial Sequence
  chemically synthesized
taagagctagattttattaaag

SEQ ID NO: 1340735 - DNA, 22 bp, Artificial Sequence
  chemically synthesized
ttctttaataaaatctagctct

SEQ ID NO: 1340736 - DNA, 22 bp, Artificial Sequence
  chemically synthesized
aatagaattttaagagctagat

SEQ ID NO: 1340737 - DNA, 22 bp, Artificial Sequence
  chemically synthesized
tctttaataaaatctagctctt

SEQ ID NO: 1340738 - DNA, 22 bp, Artificial Sequence
  chemically synthesized
ctttaataaaatctagctctta

SEQ ID NO: 1340739 - DNA, 22 bp, Artificial Sequence
  chemically synthesized
tttaataaaatctagctcttaa

SEQ ID NO: 1340740 - DNA, 22 bp, Artificial Sequence
  chemically synthesized
taataaaatctagctcttaaaa

SEQ ID NO: 1340741 - DNA, 22 bp, Artificial Sequence
  chemically synthesized
aataaaatctagctcttaaaat

SEQ ID NO: 1340742 - DNA, 22 bp, Artificial Sequence
  chemically synthesized
ggtctgaatagaattttaagag

SEQ ID NO: 1340743 - DNA, 22 bp, Artificial Sequence
  chemically synthesized
ataaaatctagctcttaaaatt

SEQ ID NO: 1340744 - DNA, 22 bp, Artificial Sequence
  chemically synthesized
taggtctgaatagaattttaag

SEQ ID NO: 1340745 - DNA, 22 bp, Artificial Sequence
  chemically synthesized
gctcttaaaattctattcagac

SEQ ID NO: 1340746 - DNA, 22 bp, Artificial Sequence
  chemically synthesized
aaggatcattctaggtctgaat

SEQ ID NO: 1340747 - DNA, 22 bp, Artificial Sequence
  chemically synthesized
aaaggatcattctaggtctgaa

SEQ ID NO: 1340748 - DNA, 22 bp, Artificial Sequence
  chemically synthesized
ttaaaattctattcagacctag

SEQ ID NO: 1340749 - DNA, 22 bp, Artificial Sequence
  chemically synthesized
aaaattctattcagacctagaa

SEQ ID NO: 1340750 - DNA, 22 bp, Artificial Sequence
  chemically synthesized
aaattctattcagacctagaat

SEQ ID NO: 1340751 - DNA, 22 bp, Artificial Sequence
  chemically synthesized
aatgatcttaaaggatcattct

SEQ ID NO: 1340752 - DNA, 22 bp, Artificial Sequence
  chemically synthesized
tattcagacctagaatgatcct

SEQ ID NO: 1340753 - DNA, 22 bp, Artificial Sequence
  chemically synthesized
ttcagacctagaatgatccttt

SEQ ID NO: 1340754 - DNA, 22 bp, Artificial Sequence
  chemically synthesized
agacctagaatgatcctttaag

SEQ ID NO: 1340755 - DNA, 22 bp, Artificial Sequence
  chemically synthesized
taggagttaaatgatcttaaag

SEQ ID NO: 1340756 - DNA, 22 bp, Artificial Sequence
  chemically synthesized
gaatgatcctttaagatcattt

SEQ ID NO: 1340757 - DNA, 22 bp, Artificial Sequence
  chemically synthesized
attataggagttaaatgatctt

SEQ ID NO: 1340758 - DNA, 22 bp, Artificial Sequence
  chemically synthesized
aattataggagttaaatgatct

SEQ ID NO: 1340759 - DNA, 22 bp, Artificial Sequence
  chemically synthesized
caatttaattataggagttaaa

SEQ ID NO: 1340760 - DNA, 22 bp, Artificial Sequence
  chemically synthesized
gcaatttaattataggagttaa

SEQ ID NO: 1340761 - DNA, 22 bp, Artificial Sequence
  chemically synthesized
tgcaatttaattataggagtta

SEQ ID NO: 1340762 - DNA, 22 bp, Artificial Sequence
  chemically synthesized
taagatcatttaactcctataa

SEQ ID NO: 1340763 - DNA, 22 bp, Artificial Sequence
  chemically synthesized
aagatcatttaactcctataat

SEQ ID NO: 1340764 - DNA, 22 bp, Artificial Sequence
  chemically synthesized
agatcatttaactcctataatt

SEQ ID NO: 1340765 - DNA, 22 bp, Artificial Sequence
  chemically synthesized
aaattttgcaatttaattatag

SEQ ID NO: 1340766 - DNA, 22 bp, Artificial Sequence
  chemically synthesized
caaattttgcaatttaattata

SEQ ID NO: 1340767 - DNA, 22 bp, Artificial Sequence
  chemically synthesized
aactcctataattaaattgcaa

SEQ ID NO: 1340768 - DNA, 22 bp, Artificial Sequence
  chemically synthesized
actcctataattaaattgcaaa

SEQ ID NO: 1340769 - DNA, 22 bp, Artificial Sequence
  chemically synthesized
aacatatttcaaattttgcaat

SEQ ID NO: 1340770 - DNA, 22 bp, Artificial Sequence
  chemically synthesized
ctataattaaattgcaaaattt

SEQ ID NO: 1340771 - DNA, 22 bp, Artificial Sequence
  chemically synthesized
taattaaattgcaaaatttgaa

SEQ ID NO: 1340772 - DNA, 22 bp, Artificial Sequence
  chemically synthesized
agttgaacatatttcaaatttt

SEQ ID NO: 1340773 - DNA, 22 bp, Artificial Sequence
  chemically synthesized
aagttgaacatatttcaaattt

SEQ ID NO: 1340774 - DNA, 22 bp, Artificial Sequence
  chemically synthesized
taagttgaacatatttcaaatt

SEQ ID NO: 1340775 - DNA, 22 bp, Artificial Sequence
  chemically synthesized
aattgcaaaatttgaaatatgt

SEQ ID NO: 1340776 - DNA, 22 bp, Artificial Sequence
  chemically synthesized
aattttaagttgaacatatttc

SEQ ID NO: 1340777 - DNA, 22 bp, Artificial Sequence
  chemically synthesized
caaaatttgaaatatgttcaac

SEQ ID NO: 1340778 - DNA, 22 bp, Artificial Sequence
  chemically synthesized
ggttgaattttaagttgaacat

SEQ ID NO: 1340779 - DNA, 22 bp, Artificial Sequence
  chemically synthesized
aggttgaattttaagttgaaca

SEQ ID NO: 1340780 - DNA, 22 bp, Artificial Sequence
  chemically synthesized
taggttgaattttaagttgaac

SEQ ID NO: 1340781 - DNA, 22 bp, Artificial Sequence
  chemically synthesized
gaaatatgttcaacttaaaatt

SEQ ID NO: 1340782 - DNA, 22 bp, Artificial Sequence
  chemically synthesized
agttttaggttgaattttaagt

SEQ ID NO: 1340783 - DNA, 22 bp, Artificial Sequence
  chemically synthesized
aaatatgttcaacttaaaattc

SEQ ID NO: 1340784 - DNA, 22 bp, Artificial Sequence
  chemically synthesized
gagttttaggttgaattttaag

SEQ ID NO: 1340785 - DNA, 22 bp, Artificial Sequence
  chemically synthesized
tgagttttaggttgaattttaa

SEQ ID NO: 1340786 - DNA, 22 bp, Artificial Sequence
  chemically synthesized
aacttaaaattcaacctaaaac

SEQ ID NO: 1340787 - DNA, 22 bp, Artificial Sequence
  chemically synthesized
aaatacagctttgagttttagg

SEQ ID NO: 1340788 - DNA, 22 bp, Artificial Sequence
  chemically synthesized
aaaatacagctttgagttttag

SEQ ID NO: 1340789 - DNA, 22 bp, Artificial Sequence
  chemically synthesized
taaaatacagctttgagtttta

SEQ ID NO: 1340790 - DNA, 22 bp, Artificial Sequence
  chemically synthesized
aaaattcaacctaaaactcaaa

SEQ ID NO: 1340791 - DNA, 22 bp, Artificial Sequence
  chemically synthesized
aaattcaacctaaaactcaaag

SEQ ID NO: 1340792 - DNA, 22 bp, Artificial Sequence
  chemically synthesized
aacctaaaactcaaagctgtat

SEQ ID NO: 1340793 - DNA, 22 bp, Artificial Sequence
  chemically synthesized
aaactcaaagctgtattttaaa

SEQ ID NO: 1340794 - DNA, 22 bp, Artificial Sequence
  chemically synthesized
aaagctgtattttaaagttcat

SEQ ID NO: 1340795 - DNA, 22 bp, Artificial Sequence
  chemically synthesized
tattttaaagttcatgttgcac

SEQ ID NO: 1340796 - DNA, 22 bp, Artificial Sequence
  chemically synthesized
taaagttcatgttgcacttgtt

SEQ ID NO: 1340797 - DNA, 22 bp, Artificial Sequence
  chemically synthesized
aaagttcatgttgcacttgttt

SEQ ID NO: 1340798 - DNA, 22 bp, Artificial Sequence
  chemically synthesized
gcagatgcagtaaaacaagtgc

SEQ ID NO: 1340799 - DNA, 22 bp, Artificial Sequence
  chemically synthesized
aagttcatgttgcacttgtttt

SEQ ID NO: 1340800 - DNA, 22 bp, Artificial Sequence
  chemically synthesized
tggcagatgcagtaaaacaagt

SEQ ID NO: 1340801 - DNA, 22 bp, Artificial Sequence
  chemically synthesized
tctggcagatgcagtaaaacaa

SEQ ID NO: 1340802 - DNA, 22 bp, Artificial Sequence
  chemically synthesized
atgttgcacttgttttactgca

SEQ ID NO: 1340803 - DNA, 22 bp, Artificial Sequence
  chemically synthesized
cacttgttttactgcatctgcc

SEQ ID NO: 1340804 - DNA, 22 bp, Artificial Sequence
  chemically synthesized
tggtgcattctctggcagatgc

SEQ ID NO: 1340805 - DNA, 22 bp, Artificial Sequence
  chemically synthesized
gtggtgcattctctggcagatg

SEQ ID NO: 1340806 - DNA, 22 bp, Artificial Sequence
  chemically synthesized
tgtggtgcattctctggcagat

SEQ ID NO: 1340807 - DNA, 22 bp, Artificial Sequence
  chemically synthesized
gttttactgcatctgccagaga

SEQ ID NO: 1340808 - DNA, 22 bp, Artificial Sequence
  chemically synthesized
ttttactgcatctgccagagaa

SEQ ID NO: 1340809 - DNA, 22 bp, Artificial Sequence
  chemically synthesized
tactgcatctgccagagaatgc

SEQ ID NO: 1340810 - DNA, 22 bp, Artificial Sequence
  chemically synthesized
actgcatctgccagagaatgca

SEQ ID NO: 1340811 - DNA, 22 bp, Artificial Sequence
  chemically synthesized
ctgcatctgccagagaatgcac

SEQ ID NO: 1340812 - DNA, 22 bp, Artificial Sequence
  chemically synthesized
taaaggattttgtggtgcattc

SEQ ID NO: 1340813 - DNA, 22 bp, Artificial Sequence
  chemically synthesized
catctgccagagaatgcaccac

SEQ ID NO: 1340814 - DNA, 22 bp, Artificial Sequence
  chemically synthesized
ccagagaatgcaccacaaaatc

SEQ ID NO: 1340815 - DNA, 22 bp, Artificial Sequence
  chemically synthesized
aatatctataaaggattttgtg

SEQ ID NO: 1340816 - DNA, 22 bp, Artificial Sequence
  chemically synthesized
atctgaatatctataaaggatt

SEQ ID NO: 1340817 - DNA, 22 bp, Artificial Sequence
  chemically synthesized
gtagagagattcatctgaatat

SEQ ID NO: 1340818 - DNA, 22 bp, Artificial Sequence
  chemically synthesized
tggtagagagattcatctgaat

SEQ ID NO: 1340819 - DNA, 22 bp, Artificial Sequence
  chemically synthesized
ctggtagagagattcatctgaa

SEQ ID NO: 1340820 - DNA, 22 bp, Artificial Sequence
  chemically synthesized
tatagatattcagatgaatctc

SEQ ID NO: 1340821 - DNA, 22 bp, Artificial Sequence
  chemically synthesized
atttctggtagagagattcatc

SEQ ID NO: 1340822 - DNA, 22 bp, Artificial Sequence
  chemically synthesized
atagatattcagatgaatctct

SEQ ID NO: 1340823 - DNA, 22 bp, Artificial Sequence
  chemically synthesized
catttctggtagagagattcat

SEQ ID NO: 1340824 - DNA, 22 bp, Artificial Sequence
  chemically synthesized
tagatattcagatgaatctctc

SEQ ID NO: 1340825 - DNA, 22 bp, Artificial Sequence
  chemically synthesized
ttcatttctggtagagagattc

SEQ ID NO: 1340826 - DNA, 22 bp, Artificial Sequence
  chemically synthesized
cttcatttctggtagagagatt

SEQ ID NO: 1340827 - DNA, 22 bp, Artificial Sequence
  chemically synthesized
cttcttcatttctggtagagag

SEQ ID NO: 1340828 - DNA, 22 bp, Artificial Sequence
  chemically synthesized
agatgaatctctctaccagaaa

SEQ ID NO: 1340829 - DNA, 22 bp, Artificial Sequence
  chemically synthesized
gcagcgttccttcttcatttct

SEQ ID NO: 1340830 - DNA, 22 bp, Artificial Sequence
  chemically synthesized
tctaccagaaatgaagaaggaa

SEQ ID NO: 1340831 - DNA, 22 bp, Artificial Sequence
  chemically synthesized
taccagaaatgaagaaggaacg

SEQ ID NO: 1340832 - DNA, 22 bp, Artificial Sequence
  chemically synthesized
ccagaaatgaagaaggaacgct

SEQ ID NO: 1340833 - DNA, 22 bp, Artificial Sequence
  chemically synthesized
ctaatcttgggctttcattggt

SEQ ID NO: 1340834 - DNA, 22 bp, Artificial Sequence
  chemically synthesized
aaatggtaatcaaaccaatgaa

SEQ ID NO: 1340835 - DNA, 22 bp, Artificial Sequence
  chemically synthesized
atcttgggctttcattggtttg

SEQ ID NO: 1340836 - DNA, 22 bp, Artificial Sequence
  chemically synthesized
gagttgaaatggtaatcaaacc

SEQ ID NO: 1340837 - DNA, 22 bp, Artificial Sequence
  chemically synthesized
gggctttcattggtttgattac

SEQ ID NO: 1340838 - DNA, 22 bp, Artificial Sequence
  chemically synthesized
agagttgaaatggtaatcaaac

SEQ ID NO: 1340839 - DNA, 22 bp, Artificial Sequence
  chemically synthesized
ggctttcattggtttgattacc

SEQ ID NO: 1340840 - DNA, 22 bp, Artificial Sequence
  chemically synthesized
tcattggtttgattaccatttc

SEQ ID NO: 1340841 - DNA, 22 bp, Artificial Sequence
  chemically synthesized
cattggtttgattaccatttca

SEQ ID NO: 1340842 - DNA, 22 bp, Artificial Sequence
  chemically synthesized
attggtttgattaccatttcaa

SEQ ID NO: 1340843 - DNA, 22 bp, Artificial Sequence
  chemically synthesized
gtttgattaccatttcaactct

SEQ ID NO: 1340844 - DNA, 22 bp, Artificial Sequence
  chemically synthesized
tcatgcagccatttagagttga

SEQ ID NO: 1340845 - DNA, 22 bp, Artificial Sequence
  chemically synthesized
gattaccatttcaactctaaat

SEQ ID NO: 1340846 - DNA, 22 bp, Artificial Sequence
  chemically synthesized
attaccatttcaactctaaatg

SEQ ID NO: 1340847 - DNA, 22 bp, Artificial Sequence
  chemically synthesized
attatcatgcagccatttagag

SEQ ID NO: 1340848 - DNA, 22 bp, Artificial Sequence
  chemically synthesized
ccatttcaactctaaatggctg

SEQ ID NO: 1340849 - DNA, 22 bp, Artificial Sequence
  chemically synthesized
caactctaaatggctgcatgat

SEQ ID NO: 1340850 - DNA, 22 bp, Artificial Sequence
  chemically synthesized
aactctaaatggctgcatgata

SEQ ID NO: 1340851 - DNA, 22 bp, Artificial Sequence
  chemically synthesized
cacacccactaattatcatgca

SEQ ID NO: 1340852 - DNA, 22 bp, Artificial Sequence
  chemically synthesized
ttccacacccactaattatcat

SEQ ID NO: 1340853 - DNA, 22 bp, Artificial Sequence
  chemically synthesized
taaatggctgcatgataattag

SEQ ID NO: 1340854 - DNA, 22 bp, Artificial Sequence
  chemically synthesized
aatggctgcatgataattagtg

SEQ ID NO: 1340855 - DNA, 22 bp, Artificial Sequence
  chemically synthesized
gttattccacacccactaatta

SEQ ID NO: 1340856 - DNA, 22 bp, Artificial Sequence
  chemically synthesized
catgataattagtgggtgtgga

SEQ ID NO: 1340857 - DNA, 22 bp, Artificial Sequence
  chemically synthesized
agcagtactggttattccacac

SEQ ID NO: 1340858 - DNA, 22 bp, Artificial Sequence
  chemically synthesized
gagcagtactggttattccaca

SEQ ID NO: 1340859 - DNA, 22 bp, Artificial Sequence
  chemically synthesized
ttgagcagtactggttattcca

SEQ ID NO: 1340860 - DNA, 22 bp, Artificial Sequence
  chemically synthesized
cttgagcagtactggttattcc

SEQ ID NO: 1340861 - DNA, 22 bp, Artificial Sequence
  chemically synthesized
cttcttgagcagtactggttat

SEQ ID NO: 1340862 - DNA, 22 bp, Artificial Sequence
  chemically synthesized
gtgggtgtggaataaccagtac

SEQ ID NO: 1340863 - DNA, 22 bp, Artificial Sequence
  chemically synthesized
agtaaaggcaattgcttcttga

SEQ ID NO: 1340864 - DNA, 22 bp, Artificial Sequence
  chemically synthesized
cagtaaaggcaattgcttcttg

SEQ ID NO: 1340865 - DNA, 22 bp, Artificial Sequence
  chemically synthesized
tcagtaaaggcaattgcttctt

SEQ ID NO: 1340866 - DNA, 22 bp, Artificial Sequence
  chemically synthesized
ttcagtaaaggcaattgcttct

SEQ ID NO: 1340867 - DNA, 22 bp, Artificial Sequence
  chemically synthesized
tttttcagtaaaggcaattgct

SEQ ID NO: 1340868 - DNA, 22 bp, Artificial Sequence
  chemically synthesized
gtttttcagtaaaggcaattgc

SEQ ID NO: 1340869 - DNA, 22 bp, Artificial Sequence
  chemically synthesized
tgtttttcagtaaaggcaattg

SEQ ID NO: 1340870 - DNA, 22 bp, Artificial Sequence
  chemically synthesized
ctcaagaagcaattgcctttac

SEQ ID NO: 1340871 - DNA, 22 bp, Artificial Sequence
  chemically synthesized
aagaagcaattgcctttactga

SEQ ID NO: 1340872 - DNA, 22 bp, Artificial Sequence
  chemically synthesized
gaaactttgtttttcagtaaag

SEQ ID NO: 1340873 - DNA, 22 bp, Artificial Sequence
  chemically synthesized
cgaaactttgtttttcagtaaa

SEQ ID NO: 1340874 - DNA, 22 bp, Artificial Sequence
  chemically synthesized
tcgaaactttgtttttcagtaa

SEQ ID NO: 1340875 - DNA, 22 bp, Artificial Sequence
  chemically synthesized
tttcgaaactttgtttttcagt

SEQ ID NO: 1340876 - DNA, 22 bp, Artificial Sequence
  chemically synthesized
ctttcgaaactttgtttttcag

SEQ ID NO: 1340877 - DNA, 22 bp, Artificial Sequence
  chemically synthesized
tgcttctttcgaaactttgttt

SEQ ID NO: 1340878 - DNA, 22 bp, Artificial Sequence
  chemically synthesized
cctttactgaaaaacaaagttt

SEQ ID NO: 1340879 - DNA, 22 bp, Artificial Sequence
  chemically synthesized
ctgtgcttctttcgaaactttg

SEQ ID NO: 1340880 - DNA, 22 bp, Artificial Sequence
  chemically synthesized
actgtgcttctttcgaaacttt

SEQ ID NO: 1340881 - DNA, 22 bp, Artificial Sequence
  chemically synthesized
tactgaaaaacaaagtttcgaa

SEQ ID NO: 1340882 - DNA, 22 bp, Artificial Sequence
  chemically synthesized
actgaaaaacaaagtttcgaaa

SEQ ID NO: 1340883 - DNA, 22 bp, Artificial Sequence
  chemically synthesized
ctgaaaaacaaagtttcgaaag

SEQ ID NO: 1340884 - DNA, 22 bp, Artificial Sequence
  chemically synthesized
aaaaacaaagtttcgaaagaag

SEQ ID NO: 1340885 - DNA, 22 bp, Artificial Sequence
  chemically synthesized
gagtttactgtgcttctttcga

SEQ ID NO: 1340886 - DNA, 22 bp, Artificial Sequence
  chemically synthesized
ggagtttactgtgcttctttcg

SEQ ID NO: 1340887 - DNA, 22 bp, Artificial Sequence
  chemically synthesized
ttggagtttactgtgcttcttt

SEQ ID NO: 1340888 - DNA, 22 bp, Artificial Sequence
  chemically synthesized
tctcttggagtttactgtgctt

SEQ ID NO: 1340889 - DNA, 22 bp, Artificial Sequence
  chemically synthesized
attgtctcttggagtttactgt

SEQ ID NO: 1340890 - DNA, 22 bp, Artificial Sequence
  chemically synthesized
cgaaagaagcacagtaaactcc

SEQ ID NO: 1340891 - DNA, 22 bp, Artificial Sequence
  chemically synthesized
gaaagaagcacagtaaactcca

SEQ ID NO: 1340892 - DNA, 22 bp, Artificial Sequence
  chemically synthesized
aattgattgtctcttggagttt

SEQ ID NO: 1340893 - DNA, 22 bp, Artificial Sequence
  chemically synthesized
caagagacaatcaattcaatct

SEQ ID NO: 1340894 - DNA, 22 bp, Artificial Sequence
  chemically synthesized
tggcagggaggtgtgtaagatt

SEQ ID NO: 1340895 - DNA, 22 bp, Artificial Sequence
  chemically synthesized
aaactatggcagggaggtgtgt

SEQ ID NO: 1340896 - DNA, 22 bp, Artificial Sequence
  chemically synthesized
aaaactatggcagggaggtgtg

SEQ ID NO: 1340897 - DNA, 22 bp, Artificial Sequence
  chemically synthesized
aatcttacacacctccctgcca

SEQ ID NO: 1340898 - DNA, 22 bp, Artificial Sequence
  chemically synthesized
catttaaaactatggcagggag

SEQ ID NO: 1340899 - DNA, 22 bp, Artificial Sequence
  chemically synthesized
ctccatttaaaactatggcagg

SEQ ID NO: 1340900 - DNA, 22 bp, Artificial Sequence
  chemically synthesized
acacacctccctgccatagttt

SEQ ID NO: 1340901 - DNA, 22 bp, Artificial Sequence
  chemically synthesized
cacacctccctgccatagtttt

SEQ ID NO: 1340902 - DNA, 22 bp, Artificial Sequence
  chemically synthesized
gcacatctgctccatttaaaac

SEQ ID NO: 1340903 - DNA, 22 bp, Artificial Sequence
  chemically synthesized
agcacatctgctccatttaaaa

SEQ ID NO: 1340904 - DNA, 22 bp, Artificial Sequence
  chemically synthesized
tagcacatctgctccatttaaa

SEQ ID NO: 1340905 - DNA, 22 bp, Artificial Sequence
  chemically synthesized
cctgccatagttttaaatggag

SEQ ID NO: 1340906 - DNA, 22 bp, Artificial Sequence
  chemically synthesized
ttagcacatctgctccatttaa

SEQ ID NO: 1340907 - DNA, 22 bp, Artificial Sequence
  chemically synthesized
ccatagttttaaatggagcaga

SEQ ID NO: 1340908 - DNA, 22 bp, Artificial Sequence
  chemically synthesized
gcttttagcacatctgctccat

SEQ ID NO: 1340909 - DNA, 22 bp, Artificial Sequence
  chemically synthesized
actggcttttagcacatctgct

SEQ ID NO: 1340910 - DNA, 22 bp, Artificial Sequence
  chemically synthesized
tcactggcttttagcacatctg

SEQ ID NO: 1340911 - DNA, 22 bp, Artificial Sequence
  chemically synthesized
ctcactggcttttagcacatct

SEQ ID NO: 1340912 - DNA, 22 bp, Artificial Sequence
  chemically synthesized
taaatggagcagatgtgctaaa

SEQ ID NO: 1340913 - DNA, 22 bp, Artificial Sequence
  chemically synthesized
aaatggagcagatgtgctaaaa

SEQ ID NO: 1340914 - DNA, 22 bp, Artificial Sequence
  chemically synthesized
aatggagcagatgtgctaaaag

SEQ ID NO: 1340915 - DNA, 22 bp, Artificial Sequence
  chemically synthesized
agaaatatcaaccgtcttctca

SEQ ID NO: 1340916 - DNA, 22 bp, Artificial Sequence
  chemically synthesized
aaagccagtgagaagacggttg

SEQ ID NO: 1340917 - DNA, 22 bp, Artificial Sequence
  chemically synthesized
aaccctaagaaatatcaaccgt

SEQ ID NO: 1340918 - DNA, 22 bp, Artificial Sequence
  chemically synthesized
gaaccctaagaaatatcaaccg

SEQ ID NO: 1340919 - DNA, 22 bp, Artificial Sequence
  chemically synthesized
tttgaaccctaagaaatatcaa

SEQ ID NO: 1340920 - DNA, 22 bp, Artificial Sequence
  chemically synthesized
tgtttgaaccctaagaaatatc

SEQ ID NO: 1340921 - DNA, 22 bp, Artificial Sequence
  chemically synthesized
ctgtttgaaccctaagaaatat

SEQ ID NO: 1340922 - DNA, 22 bp, Artificial Sequence
  chemically synthesized
tttctgtttgaaccctaagaaa

SEQ ID NO: 1340923 - DNA, 22 bp, Artificial Sequence
  chemically synthesized
tatttctgtttgaaccctaaga

SEQ ID NO: 1340924 - DNA, 22 bp, Artificial Sequence
  chemically synthesized
atatttcttagggttcaaacag

SEQ ID NO: 1340925 - DNA, 22 bp, Artificial Sequence
  chemically synthesized
gatattctatttctgtttgaac

SEQ ID NO: 1340926 - DNA, 22 bp, Artificial Sequence
  chemically synthesized
cttagggttcaaacagaaatag

SEQ ID NO: 1340927 - DNA, 22 bp, Artificial Sequence
  chemically synthesized
ttagggttcaaacagaaataga

SEQ ID NO: 1340928 - DNA, 22 bp, Artificial Sequence
  chemically synthesized
agggttcaaacagaaatagaat

SEQ ID NO: 1340929 - DNA, 22 bp, Artificial Sequence
  chemically synthesized
gggttcaaacagaaatagaata

SEQ ID NO: 1340930 - DNA, 22 bp, Artificial Sequence
  chemically synthesized
aaacagaaatagaatatccagc

SEQ ID NO: 1340931 - DNA, 22 bp, Artificial Sequence
  chemically synthesized
tgaaaaatatgggcagtcaagt

SEQ ID NO: 1340932 - DNA, 22 bp, Artificial Sequence
  chemically synthesized
caataaatcattgtgaaaaata

SEQ ID NO: 1340933 - DNA, 22 bp, Artificial Sequence
  chemically synthesized
gactgcccatatttttcacaat

SEQ ID NO: 1340934 - DNA, 22 bp, Artificial Sequence
  chemically synthesized
ctgcaataaatcattgtgaaaa

SEQ ID NO: 1340935 - DNA, 22 bp, Artificial Sequence
  chemically synthesized
actgcccatatttttcacaatg

SEQ ID NO: 1340936 - DNA, 22 bp, Artificial Sequence
  chemically synthesized
actgcaataaatcattgtgaaa

SEQ ID NO: 1340937 - DNA, 22 bp, Artificial Sequence
  chemically synthesized
tttactgcaataaatcattgtg

SEQ ID NO: 1340938 - DNA, 22 bp, Artificial Sequence
  chemically synthesized
cccatatttttcacaatgattt

SEQ ID NO: 1340939 - DNA, 22 bp, Artificial Sequence
  chemically synthesized
ttcacaatgatttattgcagta

SEQ ID NO: 1340940 - DNA, 22 bp, Artificial Sequence
  chemically synthesized
gtgtagactatttactgcaata

SEQ ID NO: 1340941 - DNA, 22 bp, Artificial Sequence
  chemically synthesized
tcacaatgatttattgcagtaa

SEQ ID NO: 1340942 - DNA, 22 bp, Artificial Sequence
  chemically synthesized
cacaatgatttattgcagtaaa

SEQ ID NO: 1340943 - DNA, 22 bp, Artificial Sequence
  chemically synthesized
acaatgatttattgcagtaaat

SEQ ID NO: 1340944 - DNA, 22 bp, Artificial Sequence
  chemically synthesized
ggacgctcgtgtagactattta

SEQ ID NO: 1340945 - DNA, 22 bp, Artificial Sequence
  chemically synthesized
attgcagtaaatagtctacacg

SEQ ID NO: 1340946 - DNA, 22 bp, Artificial Sequence
  chemically synthesized
ttgcagtaaatagtctacacga

SEQ ID NO: 1340947 - DNA, 22 bp, Artificial Sequence
  chemically synthesized
cagtaaatagtctacacgagcg

SEQ ID NO: 1340948 - DNA, 22 bp, Artificial Sequence
  chemically synthesized
atagggaaaaagtccaaaactg

SEQ ID NO: 1340949 - DNA, 22 bp, Artificial Sequence
  chemically synthesized
cacgagcgtcccagttttggac

SEQ ID NO: 1340950 - DNA, 22 bp, Artificial Sequence
  chemically synthesized
actgatagggaaaaagtccaaa

SEQ ID NO: 1340951 - DNA, 22 bp, Artificial Sequence
  chemically synthesized
aaaacctgactgatagggaaaa

SEQ ID NO: 1340952 - DNA, 22 bp, Artificial Sequence
  chemically synthesized
aaaaacctgactgatagggaaa

SEQ ID NO: 1340953 - DNA, 22 bp, Artificial Sequence
  chemically synthesized
taaaaacctgactgatagggaa

SEQ ID NO: 1340954 - DNA, 22 bp, Artificial Sequence
  chemically synthesized
tggactttttccctatcagtca

SEQ ID NO: 1340955 - DNA, 22 bp, Artificial Sequence
  chemically synthesized
ggactttttccctatcagtcag

SEQ ID NO: 1340956 - DNA, 22 bp, Artificial Sequence
  chemically synthesized
gactttttccctatcagtcagg

SEQ ID NO: 1340957 - DNA, 22 bp, Artificial Sequence
  chemically synthesized
aggctttaaaaacctgactgat

SEQ ID NO: 1340958 - DNA, 22 bp, Artificial Sequence
  chemically synthesized
aaggctttaaaaacctgactga

SEQ ID NO: 1340959 - DNA, 22 bp, Artificial Sequence
  chemically synthesized
taaggctttaaaaacctgactg

SEQ ID NO: 1340960 - DNA, 22 bp, Artificial Sequence
  chemically synthesized
tttccctatcagtcaggttttt

SEQ ID NO: 1340961 - DNA, 22 bp, Artificial Sequence
  chemically synthesized
ctttaaggctttaaaaacctga

SEQ ID NO: 1340962 - DNA, 22 bp, Artificial Sequence
  chemically synthesized
ttccctatcagtcaggttttta

SEQ ID NO: 1340963 - DNA, 22 bp, Artificial Sequence
  chemically synthesized
tccctatcagtcaggtttttaa

SEQ ID NO: 1340964 - DNA, 22 bp, Artificial Sequence
  chemically synthesized
tactttaaggctttaaaaacct

SEQ ID NO: 1340965 - DNA, 22 bp, Artificial Sequence
  chemically synthesized
ccctatcagtcaggtttttaaa

SEQ ID NO: 1340966 - DNA, 22 bp, Artificial Sequence
  chemically synthesized
cctatcagtcaggtttttaaag

SEQ ID NO: 1340967 - DNA, 22 bp, Artificial Sequence
  chemically synthesized
actctactttaaggctttaaaa

SEQ ID NO: 1340968 - DNA, 22 bp, Artificial Sequence
  chemically synthesized
aactctactttaaggctttaaa

SEQ ID NO: 1340969 - DNA, 22 bp, Artificial Sequence
  chemically synthesized
tcagtcaggtttttaaagcctt

SEQ ID NO: 1340970 - DNA, 22 bp, Artificial Sequence
  chemically synthesized
atttaactctactttaaggctt

SEQ ID NO: 1340971 - DNA, 22 bp, Artificial Sequence
  chemically synthesized
aatttaactctactttaaggct

SEQ ID NO: 1340972 - DNA, 22 bp, Artificial Sequence
  chemically synthesized
tttaatttaactctactttaag

SEQ ID NO: 1340973 - DNA, 22 bp, Artificial Sequence
  chemically synthesized
atttaatttaactctactttaa

SEQ ID NO: 1340974 - DNA, 22 bp, Artificial Sequence
  chemically synthesized
tatttaatttaactctacttta

SEQ ID NO: 1340975 - DNA, 22 bp, Artificial Sequence
  chemically synthesized
ttatttaatttaactctacttt

SEQ ID NO: 1340976 - DNA, 22 bp, Artificial Sequence
  chemically synthesized
ttaaagccttaaagtagagtta

SEQ ID NO: 1340977 - DNA, 22 bp, Artificial Sequence
  chemically synthesized
ttttatttaatttaactctact

SEQ ID NO: 1340978 - DNA, 22 bp, Artificial Sequence
  chemically synthesized
taaagccttaaagtagagttaa

SEQ ID NO: 1340979 - DNA, 22 bp, Artificial Sequence
  chemically synthesized
cttttatttaatttaactctac

SEQ ID NO: 1340980 - DNA, 22 bp, Artificial Sequence
  chemically synthesized
aaagccttaaagtagagttaaa

SEQ ID NO: 1340981 - DNA, 22 bp, Artificial Sequence
  chemically synthesized
aagccttaaagtagagttaaat

SEQ ID NO: 1340982 - DNA, 22 bp, Artificial Sequence
  chemically synthesized
aaagtagagttaaattaaataa

SEQ ID NO: 1340983 - DNA, 22 bp, Artificial Sequence
  chemically synthesized
aagtagagttaaattaaataaa

SEQ ID NO: 1340984 - DNA, 22 bp, Artificial Sequence
  chemically synthesized
gataaaagccatcccttctttt

SEQ ID NO: 1340985 - DNA, 22 bp, Artificial Sequence
  chemically synthesized
agataaaagccatcccttcttt

SEQ ID NO: 1340986 - DNA, 22 bp, Artificial Sequence
  chemically synthesized
tagataaaagccatcccttctt

SEQ ID NO: 1340987 - DNA, 22 bp, Artificial Sequence
  chemically synthesized
ttagataaaagccatcccttct

SEQ ID NO: 1340988 - DNA, 22 bp, Artificial Sequence
  chemically synthesized
aattaaataaaagaagggatgg

SEQ ID NO: 1340989 - DNA, 22 bp, Artificial Sequence
  chemically synthesized
acttttagataaaagccatccc

SEQ ID NO: 1340990 - DNA, 22 bp, Artificial Sequence
  chemically synthesized
aataaaagaagggatggctttt

SEQ ID NO: 1340991 - DNA, 22 bp, Artificial Sequence
  chemically synthesized
taacttttagataaaagccatc

SEQ ID NO: 1340992 - DNA, 22 bp, Artificial Sequence
  chemically synthesized
tctaacttttagataaaagcca

SEQ ID NO: 1340993 - DNA, 22 bp, Artificial Sequence
  chemically synthesized
gttctctaacttttagataaaa

SEQ ID NO: 1340994 - DNA, 22 bp, Artificial Sequence
  chemically synthesized
ttcgttctctaacttttagata

SEQ ID NO: 1340995 - DNA, 22 bp, Artificial Sequence
  chemically synthesized
gttcgttctctaacttttagat

SEQ ID NO: 1340996 - DNA, 22 bp, Artificial Sequence
  chemically synthesized
ttgttcgttctctaacttttag

SEQ ID NO: 1340997 - DNA, 22 bp, Artificial Sequence
  chemically synthesized
ttatctaaaagttagagaacga

SEQ ID NO: 1340998 - DNA, 22 bp, Artificial Sequence
  chemically synthesized
tatctaaaagttagagaacgaa

SEQ ID NO: 1340999 - DNA, 22 bp, Artificial Sequence
  chemically synthesized
atctaaaagttagagaacgaac

SEQ ID NO: 1341000 - DNA, 22 bp, Artificial Sequence
  chemically synthesized
gaaaacattcttgttcgttctc

SEQ ID NO: 1341001 - DNA, 22 bp, Artificial Sequence
  chemically synthesized
tctaaaagttagagaacgaaca

SEQ ID NO: 1341002 - DNA, 22 bp, Artificial Sequence
  chemically synthesized
aaagttagagaacgaacaagaa

SEQ ID NO: 1341003 - DNA, 22 bp, Artificial Sequence
  chemically synthesized
atatctagaaaacattcttgtt

SEQ ID NO: 1341004 - DNA, 22 bp, Artificial Sequence
  chemically synthesized
aatatctagaaaacattcttgt

SEQ ID NO: 1341005 - DNA, 22 bp, Artificial Sequence
  chemically synthesized
taatatctagaaaacattcttg

SEQ ID NO: 1341006 - DNA, 22 bp, Artificial Sequence
  chemically synthesized
gagaacgaacaagaatgttttc

SEQ ID NO: 1341007 - DNA, 22 bp, Artificial Sequence
  chemically synthesized
ctttaatatctagaaaacattc

SEQ ID NO: 1341008 - DNA, 22 bp, Artificial Sequence
  chemically synthesized
actttaatatctagaaaacatt

SEQ ID NO: 1341009 - DNA, 22 bp, Artificial Sequence
  chemically synthesized
taaatgaatttactttaatatc

SEQ ID NO: 1341010 - DNA, 22 bp, Artificial Sequence
  chemically synthesized
tctagatattaaagtaaattca

SEQ ID NO: 1341011 - DNA, 22 bp, Artificial Sequence
  chemically synthesized
ctagatattaaagtaaattcat

SEQ ID NO: 1341012 - DNA, 22 bp, Artificial Sequence
  chemically synthesized
tagatattaaagtaaattcatt

SEQ ID NO: 1341013 - DNA, 22 bp, Artificial Sequence
  chemically synthesized
gatattaaagtaaattcattta

SEQ ID NO: 1341014 - DNA, 22 bp, Artificial Sequence
  chemically synthesized
aatatggcataattataaatga

SEQ ID NO: 1341015 - DNA, 22 bp, Artificial Sequence
  chemically synthesized
aagtaaattcatttataattat

SEQ ID NO: 1341016 - DNA, 22 bp, Artificial Sequence
  chemically synthesized
atttataattatgccatattca

SEQ ID NO: 1341017 - DNA, 22 bp, Artificial Sequence
  chemically synthesized
ataattatgccatattcagatg

SEQ ID NO: 1341018 - DNA, 22 bp, Artificial Sequence
  chemically synthesized
taattatgccatattcagatgg

SEQ ID NO: 1341019 - DNA, 22 bp, Artificial Sequence
  chemically synthesized
atatataggaatggcatccatc

SEQ ID NO: 1341020 - DNA, 22 bp, Artificial Sequence
  chemically synthesized
tgccatattcagatggatgcca

SEQ ID NO: 1341021 - DNA, 22 bp, Artificial Sequence
  chemically synthesized
aatatataggaatggcatccat

SEQ ID NO: 1341022 - DNA, 22 bp, Artificial Sequence
  chemically synthesized
agatggatgccattcctatata

SEQ ID NO: 1341023 - DNA, 22 bp, Artificial Sequence
  chemically synthesized
aaatcatgaacatttaatatat

SEQ ID NO: 1341024 - DNA, 22 bp, Artificial Sequence
  chemically synthesized
aaaatcatgaacatttaatata

SEQ ID NO: 1341025 - DNA, 22 bp, Artificial Sequence
  chemically synthesized
taaaatcatgaacatttaatat

SEQ ID NO: 1341026 - DNA, 22 bp, Artificial Sequence
  chemically synthesized
ctatatattaaatgttcatgat

SEQ ID NO: 1341027 - DNA, 22 bp, Artificial Sequence
  chemically synthesized
tatattaaatgttcatgatttt

SEQ ID NO: 1341028 - DNA, 22 bp, Artificial Sequence
  chemically synthesized
tccaatgacctttaaaatcatg

SEQ ID NO: 1341029 - DNA, 22 bp, Artificial Sequence
  chemically synthesized
gtccaatgacctttaaaatcat

SEQ ID NO: 1341030 - DNA, 22 bp, Artificial Sequence
  chemically synthesized
tgtccaatgacctttaaaatca

SEQ ID NO: 1341031 - DNA, 22 bp, Artificial Sequence
  chemically synthesized
ttgtccaatgacctttaaaatc

SEQ ID NO: 1341032 - DNA, 22 bp, Artificial Sequence
  chemically synthesized
aatgttcatgattttaaaggtc

SEQ ID NO: 1341033 - DNA, 22 bp, Artificial Sequence
  chemically synthesized
atagtgtttttgtccaatgacc

SEQ ID NO: 1341034 - DNA, 22 bp, Artificial Sequence
  chemically synthesized
atgattttaaaggtcattggac

SEQ ID NO: 1341035 - DNA, 22 bp, Artificial Sequence
  chemically synthesized
ttcatagtgtttttgtccaatg

SEQ ID NO: 1341036 - DNA, 22 bp, Artificial Sequence
  chemically synthesized
ttattcatagtgtttttgtcca

SEQ ID NO: 1341037 - DNA, 22 bp, Artificial Sequence
  chemically synthesized
attattcatagtgtttttgtcc

SEQ ID NO: 1341038 - DNA, 22 bp, Artificial Sequence
  chemically synthesized
taaaggtcattggacaaaaaca

SEQ ID NO: 1341039 - DNA, 22 bp, Artificial Sequence
  chemically synthesized
tattattcatagtgtttttgtc

SEQ ID NO: 1341040 - DNA, 22 bp, Artificial Sequence
  chemically synthesized
aaaggtcattggacaaaaacac

SEQ ID NO: 1341041 - DNA, 22 bp, Artificial Sequence
  chemically synthesized
ttattattcatagtgtttttgt

SEQ ID NO: 1341042 - DNA, 22 bp, Artificial Sequence
  chemically synthesized
aaggtcattggacaaaaacact

SEQ ID NO: 1341043 - DNA, 22 bp, Artificial Sequence
  chemically synthesized
tttattattcatagtgtttttg

SEQ ID NO: 1341044 - DNA, 22 bp, Artificial Sequence
  chemically synthesized
attttttattattcatagtgtt

SEQ ID NO: 1341045 - DNA, 22 bp, Artificial Sequence
  chemically synthesized
taattttttattattcatagtg

SEQ ID NO: 1341046 - DNA, 22 bp, Artificial Sequence
  chemically synthesized
ctaattttttattattcatagt

SEQ ID NO: 1341047 - DNA, 22 bp, Artificial Sequence
  chemically synthesized
tctaattttttattattcatag

SEQ ID NO: 1341048 - DNA, 22 bp, Artificial Sequence
  chemically synthesized
ttctaattttttattattcata

SEQ ID NO: 1341049 - DNA, 22 bp, Artificial Sequence
  chemically synthesized
gacaaaaacactatgaataata

SEQ ID NO: 1341050 - DNA, 22 bp, Artificial Sequence
  chemically synthesized
tttctaattttttattattcat

SEQ ID NO: 1341051 - DNA, 22 bp, Artificial Sequence
  chemically synthesized
acattttttctaattttttatt

SEQ ID NO: 1341052 - DNA, 22 bp, Artificial Sequence
  chemically synthesized
cacattttttctaattttttat

SEQ ID NO: 1341053 - DNA, 22 bp, Artificial Sequence
  chemically synthesized
tcacattttttctaatttttta

SEQ ID NO: 1341054 - DNA, 22 bp, Artificial Sequence
  chemically synthesized
ttcacattttttctaatttttt

SEQ ID NO: 1341055 - DNA, 22 bp, Artificial Sequence
  chemically synthesized
tttttcacattttttctaattt

SEQ ID NO: 1341056 - DNA, 22 bp, Artificial Sequence
  chemically synthesized
tgaataataaaaaattagaaaa

SEQ ID NO: 1341057 - DNA, 22 bp, Artificial Sequence
  chemically synthesized
attatttttcacattttttcta

SEQ ID NO: 1341058 - DNA, 22 bp, Artificial Sequence
  chemically synthesized
cattcattatttttcacatttt

SEQ ID NO: 1341059 - DNA, 22 bp, Artificial Sequence
  chemically synthesized
taattccattcattatttttca

SEQ ID NO: 1341060 - DNA, 22 bp, Artificial Sequence
  chemically synthesized
gaaaaaatgtgaaaaataatga

SEQ ID NO: 1341061 - DNA, 22 bp, Artificial Sequence
  chemically synthesized
ctataattccattcattatttt

SEQ ID NO: 1341062 - DNA, 22 bp, Artificial Sequence
  chemically synthesized
tactataattccattcattatt

SEQ ID NO: 1341063 - DNA, 22 bp, Artificial Sequence
  chemically synthesized
aaatagattctactataattcc

SEQ ID NO: 1341064 - DNA, 22 bp, Artificial Sequence
  chemically synthesized
aatggagatccattaaaataga

SEQ ID NO: 1341065 - DNA, 22 bp, Artificial Sequence
  chemically synthesized
tagtagaatctattttaatgga

SEQ ID NO: 1341066 - DNA, 22 bp, Artificial Sequence
  chemically synthesized
agttaaatggagatccattaaa

SEQ ID NO: 1341067 - DNA, 22 bp, Artificial Sequence
  chemically synthesized
atgattcagttaaatggagatc

SEQ ID NO: 1341068 - DNA, 22 bp, Artificial Sequence
  chemically synthesized
ttttaatggatctccatttaac

SEQ ID NO: 1341069 - DNA, 22 bp, Artificial Sequence
  chemically synthesized
atctaatgattcagttaaatgg

SEQ ID NO: 1341070 - DNA, 22 bp, Artificial Sequence
  chemically synthesized
taatggatctccatttaactga

SEQ ID NO: 1341071 - DNA, 22 bp, Artificial Sequence
  chemically synthesized
aatggatctccatttaactgaa

SEQ ID NO: 1341072 - DNA, 22 bp, Artificial Sequence
  chemically synthesized
atggatctccatttaactgaat

SEQ ID NO: 1341073 - DNA, 22 bp, Artificial Sequence
  chemically synthesized
gttaatctaatgattcagttaa

SEQ ID NO: 1341074 - DNA, 22 bp, Artificial Sequence
  chemically synthesized
ggttaatctaatgattcagtta

SEQ ID NO: 1341075 - DNA, 22 bp, Artificial Sequence
  chemically synthesized
tggttaatctaatgattcagtt

SEQ ID NO: 1341076 - DNA, 22 bp, Artificial Sequence
  chemically synthesized
catttaactgaatcattagatt

SEQ ID NO: 1341077 - DNA, 22 bp, Artificial Sequence
  chemically synthesized
aactgaatcattagattaacca

SEQ ID NO: 1341078 - DNA, 22 bp, Artificial Sequence
  chemically synthesized
actgaatcattagattaaccaa

SEQ ID NO: 1341079 - DNA, 22 bp, Artificial Sequence
  chemically synthesized
aatcattagattaaccaaagct

SEQ ID NO: 1341080 - DNA, 22 bp, Artificial Sequence
  chemically synthesized
acaaagggaatggagagctttg

SEQ ID NO: 1341081 - DNA, 22 bp, Artificial Sequence
  chemically synthesized
gattaaccaaagctctccattc

SEQ ID NO: 1341082 - DNA, 22 bp, Artificial Sequence
  chemically synthesized
accaaagctctccattcccttt

SEQ ID NO: 1341083 - DNA, 22 bp, Artificial Sequence
  chemically synthesized
atccatagtaaatctaacaaag

SEQ ID NO: 1341084 - DNA, 22 bp, Artificial Sequence
  chemically synthesized
gatccatagtaaatctaacaaa

SEQ ID NO: 1341085 - DNA, 22 bp, Artificial Sequence
  chemically synthesized
tccattccctttgttagattta

SEQ ID NO: 1341086 - DNA, 22 bp, Artificial Sequence
  chemically synthesized
cattccctttgttagatttact

SEQ ID NO: 1341087 - DNA, 22 bp, Artificial Sequence
  chemically synthesized
cctttgttagatttactatgga

SEQ ID NO: 1341088 - DNA, 22 bp, Artificial Sequence
  chemically synthesized
agcaggtcatcttgatccatag

SEQ ID NO: 1341089 - DNA, 22 bp, Artificial Sequence
  chemically synthesized
tgttagatttactatggatcaa

SEQ ID NO: 1341090 - DNA, 22 bp, Artificial Sequence
  chemically synthesized
cagcaggtcatcttgatccata

SEQ ID NO: 1341091 - DNA, 22 bp, Artificial Sequence
  chemically synthesized
gttagatttactatggatcaag

SEQ ID NO: 1341092 - DNA, 22 bp, Artificial Sequence
  chemically synthesized
tcagcaggtcatcttgatccat

SEQ ID NO: 1341093 - DNA, 22 bp, Artificial Sequence
  chemically synthesized
ttagatttactatggatcaaga

SEQ ID NO: 1341094 - DNA, 22 bp, Artificial Sequence
  chemically synthesized
ttcagcaggtcatcttgatcca

SEQ ID NO: 1341095 - DNA, 22 bp, Artificial Sequence
  chemically synthesized
gatttactatggatcaagatga

SEQ ID NO: 1341096 - DNA, 22 bp, Artificial Sequence
  chemically synthesized
aggtttttcagcaggtcatctt

SEQ ID NO: 1341097 - DNA, 22 bp, Artificial Sequence
  chemically synthesized
actatggatcaagatgacctgc

SEQ ID NO: 1341098 - DNA, 22 bp, Artificial Sequence
  chemically synthesized
ctatggatcaagatgacctgct

SEQ ID NO: 1341099 - DNA, 22 bp, Artificial Sequence
  chemically synthesized
gttaaggtttttcagcaggtca

SEQ ID NO: 1341100 - DNA, 22 bp, Artificial Sequence
  chemically synthesized
tggatcaagatgacctgctgaa

SEQ ID NO: 1341101 - DNA, 22 bp, Artificial Sequence
  chemically synthesized
tagttaaggtttttcagcaggt

SEQ ID NO: 1341102 - DNA, 22 bp, Artificial Sequence
  chemically synthesized
ctagttaaggtttttcagcagg

SEQ ID NO: 1341103 - DNA, 22 bp, Artificial Sequence
  chemically synthesized
atagagagatttctagttaagg

SEQ ID NO: 1341104 - DNA, 22 bp, Artificial Sequence
  chemically synthesized
tcatagagagatttctagttaa

SEQ ID NO: 1341105 - DNA, 22 bp, Artificial Sequence
  chemically synthesized
ctgaaaaaccttaactagaaat

SEQ ID NO: 1341106 - DNA, 22 bp, Artificial Sequence
  chemically synthesized
tctctcatagagagatttctag

SEQ ID NO: 1341107 - DNA, 22 bp, Artificial Sequence
  chemically synthesized
aaaaaccttaactagaaatctc

SEQ ID NO: 1341108 - DNA, 22 bp, Artificial Sequence
  chemically synthesized
atctctcatagagagatttcta

SEQ ID NO: 1341109 - DNA, 22 bp, Artificial Sequence
  chemically synthesized
aactagaaatctctctatgaga

SEQ ID NO: 1341110 - DNA, 22 bp, Artificial Sequence
  chemically synthesized
actagaaatctctctatgagag

SEQ ID NO: 1341111 - DNA, 22 bp, Artificial Sequence
  chemically synthesized
gaaatctctctatgagagataa

SEQ ID NO: 1341112 - DNA, 22 bp, Artificial Sequence
  chemically synthesized
atccgccaaagcatacgattta

SEQ ID NO: 1341113 - DNA, 22 bp, Artificial Sequence
  chemically synthesized
tctatgagagataaatcgtatg

SEQ ID NO: 1341114 - DNA, 22 bp, Artificial Sequence
  chemically synthesized
aatccgccaaagcatacgattt

SEQ ID NO: 1341115 - DNA, 22 bp, Artificial Sequence
  chemically synthesized
taatccgccaaagcatacgatt

SEQ ID NO: 1341116 - DNA, 22 bp, Artificial Sequence
  chemically synthesized
tatgagagataaatcgtatgct

SEQ ID NO: 1341117 - DNA, 22 bp, Artificial Sequence
  chemically synthesized
tgagagataaatcgtatgcttt

SEQ ID NO: 1341118 - DNA, 22 bp, Artificial Sequence
  chemically synthesized
tctttaatccgccaaagcatac

SEQ ID NO: 1341119 - DNA, 22 bp, Artificial Sequence
  chemically synthesized
gcagctatctttaatccgccaa

SEQ ID NO: 1341120 - DNA, 22 bp, Artificial Sequence
  chemically synthesized
tggcggattaaagatagctgcg

SEQ ID NO: 1341121 - DNA, 22 bp, Artificial Sequence
  chemically synthesized
ggcggattaaagatagctgcga

SEQ ID NO: 1341122 - DNA, 22 bp, Artificial Sequence
  chemically synthesized
gcggattaaagatagctgcgaa

SEQ ID NO: 1341123 - DNA, 22 bp, Artificial Sequence
  chemically synthesized
aagatagctgcgaatttttttg

SEQ ID NO: 1341124 - DNA, 22 bp, Artificial Sequence
  chemically synthesized
cccagtgaagaaatgtcaaaaa

SEQ ID NO: 1341125 - DNA, 22 bp, Artificial Sequence
  chemically synthesized
cctccccagtgaagaaatgtca

SEQ ID NO: 1341126 - DNA, 22 bp, Artificial Sequence
  chemically synthesized
acctccccagtgaagaaatgtc

SEQ ID NO: 1341127 - DNA, 22 bp, Artificial Sequence
  chemically synthesized
cgaatttttttgacatttcttc

SEQ ID NO: 1341128 - DNA, 22 bp, Artificial Sequence
  chemically synthesized
tacctccccagtgaagaaatgt

SEQ ID NO: 1341129 - DNA, 22 bp, Artificial Sequence
  chemically synthesized
ttttgacatttcttcactgggg

SEQ ID NO: 1341130 - DNA, 22 bp, Artificial Sequence
  chemically synthesized
tttgacatttcttcactgggga

SEQ ID NO: 1341131 - DNA, 22 bp, Artificial Sequence
  chemically synthesized
ttgacatttcttcactggggag

SEQ ID NO: 1341132 - DNA, 22 bp, Artificial Sequence
  chemically synthesized
tgacatttcttcactggggagg

SEQ ID NO: 1341133 - DNA, 22 bp, Artificial Sequence
  chemically synthesized
gacatttcttcactggggaggt

SEQ ID NO: 1341134 - DNA, 22 bp, Artificial Sequence
  chemically synthesized
acatttcttcactggggaggta

SEQ ID NO: 1341135 - DNA, 22 bp, Artificial Sequence
  chemically synthesized
cttcactggggaggtaaagtct

SEQ ID NO: 1341136 - DNA, 22 bp, Artificial Sequence
  chemically synthesized
ttcactggggaggtaaagtctt

SEQ ID NO: 1341137 - DNA, 22 bp, Artificial Sequence
  chemically synthesized
aagggaggaaacaaagacttta

SEQ ID NO: 1341138 - DNA, 22 bp, Artificial Sequence
  chemically synthesized
cactggggaggtaaagtctttg

SEQ ID NO: 1341139 - DNA, 22 bp, Artificial Sequence
  chemically synthesized
actggggaggtaaagtctttgt

SEQ ID NO: 1341140 - DNA, 22 bp, Artificial Sequence
  chemically synthesized
gggaggtaaagtctttgtttcc

SEQ ID NO: 1341141 - DNA, 22 bp, Artificial Sequence
  chemically synthesized
tgtttcctcccttgaatttggg

SEQ ID NO: 1341142 - DNA, 22 bp, Artificial Sequence
  chemically synthesized
gtttcctcccttgaatttgggt

SEQ ID NO: 1341143 - DNA, 22 bp, Artificial Sequence
  chemically synthesized
tttcctcccttgaatttgggtg

SEQ ID NO: 1341144 - DNA, 22 bp, Artificial Sequence
  chemically synthesized
cctcccttgaatttgggtgggt

SEQ ID NO: 1341145 - DNA, 22 bp, Artificial Sequence
  chemically synthesized
ctcccttgaatttgggtgggtt

SEQ ID NO: 1341146 - DNA, 22 bp, Artificial Sequence
  chemically synthesized
gagcagccacagaacccaccca

SEQ ID NO: 1341147 - DNA, 22 bp, Artificial Sequence
  chemically synthesized
ccttgaatttgggtgggttctg

SEQ ID NO: 1341148 - DNA, 22 bp, Artificial Sequence
  chemically synthesized
ttagagcagccacagaacccac

SEQ ID NO: 1341149 - DNA, 22 bp, Artificial Sequence
  chemically synthesized
tattagagcagccacagaaccc

SEQ ID NO: 1341150 - DNA, 22 bp, Artificial Sequence
  chemically synthesized
gaatttgggtgggttctgtggc

SEQ ID NO: 1341151 - DNA, 22 bp, Artificial Sequence
  chemically synthesized
aatttgggtgggttctgtggct

SEQ ID NO: 1341152 - DNA, 22 bp, Artificial Sequence
  chemically synthesized
cattctattagagcagccacag

SEQ ID NO: 1341153 - DNA, 22 bp, Artificial Sequence
  chemically synthesized
gggtgggttctgtggctgctct

SEQ ID NO: 1341154 - DNA, 22 bp, Artificial Sequence
  chemically synthesized
ctgcattctattagagcagcca

SEQ ID NO: 1341155 - DNA, 22 bp, Artificial Sequence
  chemically synthesized
ggtgggttctgtggctgctcta

SEQ ID NO: 1341156 - DNA, 22 bp, Artificial Sequence
  chemically synthesized
tactgcattctattagagcagc

SEQ ID NO: 1341157 - DNA, 22 bp, Artificial Sequence
  chemically synthesized
ttctactgcattctattagagc

SEQ ID NO: 1341158 - DNA, 22 bp, Artificial Sequence
  chemically synthesized
tgtggctgctctaatagaatgc

SEQ ID NO: 1341159 - DNA, 22 bp, Artificial Sequence
  chemically synthesized
tggctgctctaatagaatgcag

SEQ ID NO: 1341160 - DNA, 22 bp, Artificial Sequence
  chemically synthesized
gggaccactattctactgcatt

SEQ ID NO: 1341161 - DNA, 22 bp, Artificial Sequence
  chemically synthesized
ctctaatagaatgcagtagaat

SEQ ID NO: 1341162 - DNA, 22 bp, Artificial Sequence
  chemically synthesized
taatagaatgcagtagaatagt

SEQ ID NO: 1341163 - DNA, 22 bp, Artificial Sequence
  chemically synthesized
atagaatgcagtagaatagtgg

SEQ ID NO: 1341164 - DNA, 22 bp, Artificial Sequence
  chemically synthesized
gtgccaaaaaggctggggacca

SEQ ID NO: 1341165 - DNA, 22 bp, Artificial Sequence
  chemically synthesized
tggtgccaaaaaggctggggac

SEQ ID NO: 1341166 - DNA, 22 bp, Artificial Sequence
  chemically synthesized
tcatccatcaaaccccagtctc

SEQ ID NO: 1341167 - DNA, 22 bp, Artificial Sequence
  chemically synthesized
tttggcaccagagactggggtt

SEQ ID NO: 1341168 - DNA, 22 bp, Artificial Sequence
  chemically synthesized
ttggcaccagagactggggttt

SEQ ID NO: 1341169 - DNA, 22 bp, Artificial Sequence
  chemically synthesized
tggcaccagagactggggtttg

SEQ ID NO: 1341170 - DNA, 22 bp, Artificial Sequence
  chemically synthesized
ggcaccagagactggggtttga

SEQ ID NO: 1341171 - DNA, 22 bp, Artificial Sequence
  chemically synthesized
gcaccagagactggggtttgat

SEQ ID NO: 1341172 - DNA, 22 bp, Artificial Sequence
  chemically synthesized
tgggaaaattgtcatccatcaa

SEQ ID NO: 1341173 - DNA, 22 bp, Artificial Sequence
  chemically synthesized
gggtttgatggatgacaatttt

SEQ ID NO: 1341174 - DNA, 22 bp, Artificial Sequence
  chemically synthesized
accccagtctgtgggaaaattg

SEQ ID NO: 1341175 - DNA, 22 bp, Artificial Sequence
  chemically synthesized
gatggatgacaattttcccaca

SEQ ID NO: 1341176 - DNA, 22 bp, Artificial Sequence
  chemically synthesized
atggatgacaattttcccacag

SEQ ID NO: 1341177 - DNA, 22 bp, Artificial Sequence
  chemically synthesized
ccccccactaaccccagtctgt

SEQ ID NO: 1341178 - DNA, 22 bp, Artificial Sequence
  chemically synthesized
acctcccccccactaaccccag

SEQ ID NO: 1341179 - DNA, 22 bp, Artificial Sequence
  chemically synthesized
tcccacagactggggttagtgg

SEQ ID NO: 1341180 - DNA, 22 bp, Artificial Sequence
  chemically synthesized
cccacagactggggttagtggg

SEQ ID NO: 1341181 - DNA, 22 bp, Artificial Sequence
  chemically synthesized
ccacagactggggttagtgggg

SEQ ID NO: 1341182 - DNA, 22 bp, Artificial Sequence
  chemically synthesized
tccctcacctcccccccactaa

SEQ ID NO: 1341183 - DNA, 22 bp, Artificial Sequence
  chemically synthesized
acactatccctcacctcccccc

SEQ ID NO: 1341184 - DNA, 22 bp, Artificial Sequence
  chemically synthesized
aacactatccctcacctccccc

SEQ ID NO: 1341185 - DNA, 22 bp, Artificial Sequence
  chemically synthesized
gggttagtgggggggaggtgag

SEQ ID NO: 1341186 - DNA, 22 bp, Artificial Sequence
  chemically synthesized
tcttaacactatccctcacctc

SEQ ID NO: 1341187 - DNA, 22 bp, Artificial Sequence
  chemically synthesized
gtgggggggaggtgagggatag

SEQ ID NO: 1341188 - DNA, 22 bp, Artificial Sequence
  chemically synthesized
caattatcttaacactatccct

SEQ ID NO: 1341189 - DNA, 22 bp, Artificial Sequence
  chemically synthesized
agataattggagactatttcat

SEQ ID NO: 1341190 - DNA, 22 bp, Artificial Sequence
  chemically synthesized
gagactatttcatttatcatgc

SEQ ID NO: 1341191 - DNA, 22 bp, Artificial Sequence
  chemically synthesized
tttcatttatcatgcactttat

SEQ ID NO: 1341192 - DNA, 22 bp, Artificial Sequence
  chemically synthesized
catttatcatgcactttatttc

SEQ ID NO: 1341193 - DNA, 22 bp, Artificial Sequence
  chemically synthesized
atttatcatgcactttatttct

SEQ ID NO: 1341194 - DNA, 22 bp, Artificial Sequence
  chemically synthesized
atcatgcactttatttctatta

SEQ ID NO: 1341195 - DNA, 22 bp, Artificial Sequence
  chemically synthesized
tcatgcactttatttctattat

SEQ ID NO: 1341196 - DNA, 22 bp, Artificial Sequence
  chemically synthesized
tataatacaatgtaataataat

SEQ ID NO: 1341197 - DNA, 22 bp, Artificial Sequence
  chemically synthesized
tatttctattattattattaca

SEQ ID NO: 1341198 - DNA, 22 bp, Artificial Sequence
  chemically synthesized
atttctattattattattacat

SEQ ID NO: 1341199 - DNA, 22 bp, Artificial Sequence
  chemically synthesized
ttatataatacaatgtaataat

SEQ ID NO: 1341200 - DNA, 22 bp, Artificial Sequence
  chemically synthesized
tttctattattattattacatt

SEQ ID NO: 1341201 - DNA, 22 bp, Artificial Sequence
  chemically synthesized
attatataatacaatgtaataa

SEQ ID NO: 1341202 - DNA, 22 bp, Artificial Sequence
  chemically synthesized
tattatataatacaatgtaata

SEQ ID NO: 1341203 - DNA, 22 bp, Artificial Sequence
  chemically synthesized
ctattattattattacattgta

SEQ ID NO: 1341204 - DNA, 22 bp, Artificial Sequence
  chemically synthesized
tattattattattacattgtat

SEQ ID NO: 1341205 - DNA, 22 bp, Artificial Sequence
  chemically synthesized
ttttattatataatacaatgta

SEQ ID NO: 1341206 - DNA, 22 bp, Artificial Sequence
  chemically synthesized
ttattattattacattgtatta

SEQ ID NO: 1341207 - DNA, 22 bp, Artificial Sequence
  chemically synthesized
ttattattacattgtattatat

SEQ ID NO: 1341208 - DNA, 22 bp, Artificial Sequence
  chemically synthesized
ttattacattgtattatataat

SEQ ID NO: 1341209 - DNA, 22 bp, Artificial Sequence
  chemically synthesized
cataattattttattatataat

SEQ ID NO: 1341210 - DNA, 22 bp, Artificial Sequence
  chemically synthesized
ttacattgtattatataataaa

SEQ ID NO: 1341211 - DNA, 22 bp, Artificial Sequence
  chemically synthesized
cattgtattatataataaaata

SEQ ID NO: 1341212 - DNA, 22 bp, Artificial Sequence
  chemically synthesized
tattatataataaaataattat

SEQ ID NO: 1341213 - DNA, 22 bp, Artificial Sequence
  chemically synthesized
tgatatggtgagttacataatt

SEQ ID NO: 1341214 - DNA, 22 bp, Artificial Sequence
  chemically synthesized
tataataaaataattatgtaac

SEQ ID NO: 1341215 - DNA, 22 bp, Artificial Sequence
  chemically synthesized
tatgatatggtgagttacataa

SEQ ID NO: 1341216 - DNA, 22 bp, Artificial Sequence
  chemically synthesized
attctatgatatggtgagttac

SEQ ID NO: 1341217 - DNA, 22 bp, Artificial Sequence
  chemically synthesized
ccactgattctatgatatggtg

SEQ ID NO: 1341218 - DNA, 22 bp, Artificial Sequence
  chemically synthesized
tgtaactcaccatatcatagaa

SEQ ID NO: 1341219 - DNA, 22 bp, Artificial Sequence
  chemically synthesized
agggctcccactgattctatga

SEQ ID NO: 1341220 - DNA, 22 bp, Artificial Sequence
  chemically synthesized
accatatcatagaatcagtggg

SEQ ID NO: 1341221 - DNA, 22 bp, Artificial Sequence
  chemically synthesized
caggaaagaaagctcagggctc

SEQ ID NO: 1341222 - DNA, 22 bp, Artificial Sequence
  chemically synthesized
gttgcaggaaagaaagctcagg

SEQ ID NO: 1341223 - DNA, 22 bp, Artificial Sequence
  chemically synthesized
agctttctttcctgcaactaga

SEQ ID NO: 1341224 - DNA, 22 bp, Artificial Sequence
  chemically synthesized
tctttcctgcaactagacggtc

SEQ ID NO: 1341225 - DNA, 22 bp, Artificial Sequence
  chemically synthesized
ctttcctgcaactagacggtcc

SEQ ID NO: 1341226 - DNA, 22 bp, Artificial Sequence
  chemically synthesized
tttcctgcaactagacggtccc

SEQ ID NO: 1341227 - DNA, 22 bp, Artificial Sequence
  chemically synthesized
tcctgcaactagacggtcccat

SEQ ID NO: 1341228 - DNA, 22 bp, Artificial Sequence
  chemically synthesized
cctgcaactagacggtcccatc

SEQ ID NO: 1341229 - DNA, 22 bp, Artificial Sequence
  chemically synthesized
ccgtcatgcccagatgggaccg

SEQ ID NO: 1341230 - DNA, 22 bp, Artificial Sequence
  chemically synthesized
ctgcaactagacggtcccatct

SEQ ID NO: 1341231 - DNA, 22 bp, Artificial Sequence
  chemically synthesized
caactagacggtcccatctggg

SEQ ID NO: 1341232 - DNA, 22 bp, Artificial Sequence
  chemically synthesized
tctcccgtcatgcccagatggg

SEQ ID NO: 1341233 - DNA, 22 bp, Artificial Sequence
  chemically synthesized
gacggtcccatctgggcatgac

SEQ ID NO: 1341234 - DNA, 22 bp, Artificial Sequence
  chemically synthesized
atgatgtgtcactgtctcccgt

SEQ ID NO: 1341235 - DNA, 22 bp, Artificial Sequence
  chemically synthesized
ggcatgacgggagacagtgaca

SEQ ID NO: 1341236 - DNA, 22 bp, Artificial Sequence
  chemically synthesized
gtgactgatgatgtgtcactgt

SEQ ID NO: 1341237 - DNA, 22 bp, Artificial Sequence
  chemically synthesized
tgaggagtatcaggcaatctag

SEQ ID NO: 1341238 - DNA, 22 bp, Artificial Sequence
  chemically synthesized
atgaggagtatcaggcaatcta

SEQ ID NO: 1341239 - DNA, 22 bp, Artificial Sequence
  chemically synthesized
tatgaggagtatcaggcaatct

SEQ ID NO: 1341240 - DNA, 22 bp, Artificial Sequence
  chemically synthesized
tttatgaggagtatcaggcaat

SEQ ID NO: 1341241 - DNA, 22 bp, Artificial Sequence
  chemically synthesized
gattgcctgatactcctcataa

SEQ ID NO: 1341242 - DNA, 22 bp, Artificial Sequence
  chemically synthesized
ggtcgcatactctttatgagga

SEQ ID NO: 1341243 - DNA, 22 bp, Artificial Sequence
  chemically synthesized
cctgatactcctcataaagagt

SEQ ID NO: 1341244 - DNA, 22 bp, Artificial Sequence
  chemically synthesized
atactcctcataaagagtatgc

SEQ ID NO: 1341245 - DNA, 22 bp, Artificial Sequence
  chemically synthesized
ctcataaagagtatgcgaccta

SEQ ID NO: 1341246 - DNA, 22 bp, Artificial Sequence
  chemically synthesized
ataaagagtatgcgacctagat

SEQ ID NO: 1341247 - DNA, 22 bp, Artificial Sequence
  chemically synthesized
cacatgtgagagatctaggtcg

SEQ ID NO: 1341248 - DNA, 22 bp, Artificial Sequence
  chemically synthesized
tgaactgcacatgtgagagatc

SEQ ID NO: 1341249 - DNA, 22 bp, Artificial Sequence
  chemically synthesized
ttgtgaactgcacatgtgagag

SEQ ID NO: 1341250 - DNA, 22 bp, Artificial Sequence
  chemically synthesized
gatctctcacatgtgcagttca

SEQ ID NO: 1341251 - DNA, 22 bp, Artificial Sequence
  chemically synthesized
tcacatgtgcagttcacaatag

SEQ ID NO: 1341252 - DNA, 22 bp, Artificial Sequence
  chemically synthesized
aggagcacaaccctattgtgaa

SEQ ID NO: 1341253 - DNA, 22 bp, Artificial Sequence
  chemically synthesized
acatgtgcagttcacaataggg

SEQ ID NO: 1341254 - DNA, 22 bp, Artificial Sequence
  chemically synthesized
gagtctcaggagcacaacccta

SEQ ID NO: 1341255 - DNA, 22 bp, Artificial Sequence
  chemically synthesized
agagtctcaggagcacaaccct

SEQ ID NO: 1341256 - DNA, 22 bp, Artificial Sequence
  chemically synthesized
tagagtctcaggagcacaaccc

SEQ ID NO: 1341257 - DNA, 22 bp, Artificial Sequence
  chemically synthesized
acaatagggttgtgctcctgag

SEQ ID NO: 1341258 - DNA, 22 bp, Artificial Sequence
  chemically synthesized
tgctcctgagactctaaagcca

SEQ ID NO: 1341259 - DNA, 22 bp, Artificial Sequence
  chemically synthesized
tcagatcagcaatggctttaga

SEQ ID NO: 1341260 - DNA, 22 bp, Artificial Sequence
  chemically synthesized
ctgtcagatcagcaatggcttt

SEQ ID NO: 1341261 - DNA, 22 bp, Artificial Sequence
  chemically synthesized
ctgagactctaaagccattgct

SEQ ID NO: 1341262 - DNA, 22 bp, Artificial Sequence
  chemically synthesized
cctcctgtcagatcagcaatgg

SEQ ID NO: 1341263 - DNA, 22 bp, Artificial Sequence
  chemically synthesized
agactctaaagccattgctgat

SEQ ID NO: 1341264 - DNA, 22 bp, Artificial Sequence
  chemically synthesized
taaagccattgctgatctgaca

SEQ ID NO: 1341265 - DNA, 22 bp, Artificial Sequence
  chemically synthesized
aaccctgcctcctgtcagatca

SEQ ID NO: 1341266 - DNA, 22 bp, Artificial Sequence
  chemically synthesized
aagccattgctgatctgacagg

SEQ ID NO: 1341267 - DNA, 22 bp, Artificial Sequence
  chemically synthesized
cctgaaccctgcctcctgtcag

SEQ ID NO: 1341268 - DNA, 22 bp, Artificial Sequence
  chemically synthesized
ctgcctgaaccctgcctcctgt

SEQ ID NO: 1341269 - DNA, 22 bp, Artificial Sequence
  chemically synthesized
ctgatctgacaggaggcagggt

SEQ ID NO: 1341270 - DNA, 22 bp, Artificial Sequence
  chemically synthesized
gcattactgcctgaaccctgcc

SEQ ID NO: 1341271 - DNA, 22 bp, Artificial Sequence
  chemically synthesized
atctgacaggaggcagggttca

SEQ ID NO: 1341272 - DNA, 22 bp, Artificial Sequence
  chemically synthesized
ctggcattactgcctgaaccct

SEQ ID NO: 1341273 - DNA, 22 bp, Artificial Sequence
  chemically synthesized
acaggaggcagggttcaggcag

SEQ ID NO: 1341274 - DNA, 22 bp, Artificial Sequence
  chemically synthesized
ccattgctggcattactgcctg

SEQ ID NO: 1341275 - DNA, 22 bp, Artificial Sequence
  chemically synthesized
cccattgctggcattactgcct

SEQ ID NO: 1341276 - DNA, 22 bp, Artificial Sequence
  chemically synthesized
cagccacttcccattgctggca

SEQ ID NO: 1341277 - DNA, 22 bp, Artificial Sequence
  chemically synthesized
acagccacttcccattgctggc

SEQ ID NO: 1341278 - DNA, 22 bp, Artificial Sequence
  chemically synthesized
aggcagtaatgccagcaatggg

SEQ ID NO: 1341279 - DNA, 22 bp, Artificial Sequence
  chemically synthesized
tatttacagccacttcccattg

SEQ ID NO: 1341280 - DNA, 22 bp, Artificial Sequence
  chemically synthesized
atctgtatttacagccacttcc

SEQ ID NO: 1341281 - DNA, 22 bp, Artificial Sequence
  chemically synthesized
catctgtatttacagccacttc

SEQ ID NO: 1341282 - DNA, 22 bp, Artificial Sequence
  chemically synthesized
taaatacagatgaagcttcact

SEQ ID NO: 1341283 - DNA, 22 bp, Artificial Sequence
  chemically synthesized
cacagcaggaggcgagcggtga

SEQ ID NO: 1341284 - DNA, 22 bp, Artificial Sequence
  chemically synthesized
cactggctcaccgctcgcctcc

SEQ ID NO: 1341285 - DNA, 22 bp, Artificial Sequence
  chemically synthesized
actggctcaccgctcgcctcct

SEQ ID NO: 1341286 - DNA, 22 bp, Artificial Sequence
  chemically synthesized
gctcaccgctcgcctcctgctg

SEQ ID NO: 1341287 - DNA, 22 bp, Artificial Sequence
  chemically synthesized
accgctcgcctcctgctgtgca

SEQ ID NO: 1341288 - DNA, 22 bp, Artificial Sequence
  chemically synthesized
tgaggaacccagctgcacagca

SEQ ID NO: 1341289 - DNA, 22 bp, Artificial Sequence
  chemically synthesized
gcctcctgctgtgcagctgggt

SEQ ID NO: 1341290 - DNA, 22 bp, Artificial Sequence
  chemically synthesized
tggcctgtgaggaacccagctg

SEQ ID NO: 1341291 - DNA, 22 bp, Artificial Sequence
  chemically synthesized
ctgctgtgcagctgggttcctc

SEQ ID NO: 1341292 - DNA, 22 bp, Artificial Sequence
  chemically synthesized
ctgtgcagctgggttcctcaca

SEQ ID NO: 1341293 - DNA, 22 bp, Artificial Sequence
  chemically synthesized
tgcagctgggttcctcacaggc

SEQ ID NO: 1341294 - DNA, 22 bp, Artificial Sequence
  chemically synthesized
ggttcctcacaggccacagatg

SEQ ID NO: 1341295 - DNA, 22 bp, Artificial Sequence
  chemically synthesized
ctcacaggccacagatgggtac

SEQ ID NO: 1341296 - DNA, 22 bp, Artificial Sequence
  chemically synthesized
ggccacacaccggtacccatct

SEQ ID NO: 1341297 - DNA, 22 bp, Artificial Sequence
  chemically synthesized
acaggccacagatgggtaccgg

SEQ ID NO: 1341298 - DNA, 22 bp, Artificial Sequence
  chemically synthesized
caggggtccccaacccctgggc

SEQ ID NO: 1341299 - DNA, 22 bp, Artificial Sequence
  chemically synthesized
actgcaggggtccccaacccct

SEQ ID NO: 1341300 - DNA, 22 bp, Artificial Sequence
  chemically synthesized
cactgcaggggtccccaacccc

SEQ ID NO: 1341301 - DNA, 22 bp, Artificial Sequence
  chemically synthesized
tcactgcaggggtccccaaccc

SEQ ID NO: 1341302 - DNA, 22 bp, Artificial Sequence
  chemically synthesized
tttcactgcaggggtccccaac

SEQ ID NO: 1341303 - DNA, 22 bp, Artificial Sequence
  chemically synthesized
gaacagcagctctttcactgca

SEQ ID NO: 1341304 - DNA, 22 bp, Artificial Sequence
  chemically synthesized
gggacccctgcagtgaaagagc

SEQ ID NO: 1341305 - DNA, 22 bp, Artificial Sequence
  chemically synthesized
gaaactagaacagcagctcttt

SEQ ID NO: 1341306 - DNA, 22 bp, Artificial Sequence
  chemically synthesized
accctggaaactagaacagcag

SEQ ID NO: 1341307 - DNA, 22 bp, Artificial Sequence
  chemically synthesized
cagtgaaagagctgctgttcta

SEQ ID NO: 1341308 - DNA, 22 bp, Artificial Sequence
  chemically synthesized
aggcctaaccctggaaactaga

SEQ ID NO: 1341309 - DNA, 22 bp, Artificial Sequence
  chemically synthesized
caggcctaaccctggaaactag

SEQ ID NO: 1341310 - DNA, 22 bp, Artificial Sequence
  chemically synthesized
ctgttctagtttccagggttag

SEQ ID NO: 1341311 - DNA, 22 bp, Artificial Sequence
  chemically synthesized
gtatcttcaggcctaaccctgg

SEQ ID NO: 1341312 - DNA, 22 bp, Artificial Sequence
  chemically synthesized
tggtatcttcaggcctaaccct

SEQ ID NO: 1341313 - DNA, 22 bp, Artificial Sequence
  chemically synthesized
ttctagtttccagggttaggcc

SEQ ID NO: 1341314 - DNA, 22 bp, Artificial Sequence
  chemically synthesized
ctggtatcttcaggcctaaccc

SEQ ID NO: 1341315 - DNA, 22 bp, Artificial Sequence
  chemically synthesized
tagtttccagggttaggcctga

SEQ ID NO: 1341316 - DNA, 22 bp, Artificial Sequence
  chemically synthesized
gtttccagggttaggcctgaag

SEQ ID NO: 1341317 - DNA, 22 bp, Artificial Sequence
  chemically synthesized
ccagggttaggcctgaagatac

SEQ ID NO: 1341318 - DNA, 22 bp, Artificial Sequence
  chemically synthesized
cagggttaggcctgaagatacc

SEQ ID NO: 1341319 - DNA, 22 bp, Artificial Sequence
  chemically synthesized
ggcctgaagataccagaaactt

SEQ ID NO: 1341320 - DNA, 22 bp, Artificial Sequence
  chemically synthesized
aagataccagaaacttatattt

SEQ ID NO: 1341321 - DNA, 22 bp, Artificial Sequence
  chemically synthesized
gagtgaatgatacaaaagacgg

SEQ ID NO: 1341322 - DNA, 22 bp, Artificial Sequence
  chemically synthesized
tagagtgaatgatacaaaagac

SEQ ID NO: 1341323 - DNA, 22 bp, Artificial Sequence
  chemically synthesized
atattttccgtcttttgtatca

SEQ ID NO: 1341324 - DNA, 22 bp, Artificial Sequence
  chemically synthesized
tattttccgtcttttgtatcat

SEQ ID NO: 1341325 - DNA, 22 bp, Artificial Sequence
  chemically synthesized
agggttctagagtgaatgatac

SEQ ID NO: 1341326 - DNA, 22 bp, Artificial Sequence
  chemically synthesized
tccgtcttttgtatcattcact

SEQ ID NO: 1341327 - DNA, 22 bp, Artificial Sequence
  chemically synthesized
ccgtcttttgtatcattcactc

SEQ ID NO: 1341328 - DNA, 22 bp, Artificial Sequence
  chemically synthesized
cgtcttttgtatcattcactct

SEQ ID NO: 1341329 - DNA, 22 bp, Artificial Sequence
  chemically synthesized
ttgtatcattcactctagaacc

SEQ ID NO: 1341330 - DNA, 22 bp, Artificial Sequence
  chemically synthesized
tgtatcattcactctagaaccc

SEQ ID NO: 1341331 - DNA, 22 bp, Artificial Sequence
  chemically synthesized
gtatcattcactctagaaccct

SEQ ID NO: 1341332 - DNA, 22 bp, Artificial Sequence
  chemically synthesized
tatcattcactctagaaccctg

SEQ ID NO: 1341333 - DNA, 22 bp, Artificial Sequence
  chemically synthesized
tcacatgggagctcagggttct

SEQ ID NO: 1341334 - DNA, 22 bp, Artificial Sequence
  chemically synthesized
atcacatgggagctcagggttc

SEQ ID NO: 1341335 - DNA, 22 bp, Artificial Sequence
  chemically synthesized
aacttatcacatgggagctcag

SEQ ID NO: 1341336 - DNA, 22 bp, Artificial Sequence
  chemically synthesized
actctagaaccctgagctccca

SEQ ID NO: 1341337 - DNA, 22 bp, Artificial Sequence
  chemically synthesized
ttgaacttatcacatgggagct

SEQ ID NO: 1341338 - DNA, 22 bp, Artificial Sequence
  chemically synthesized
tagaaccctgagctcccatgtg

SEQ ID NO: 1341339 - DNA, 22 bp, Artificial Sequence
  chemically synthesized
gaaccctgagctcccatgtgat

SEQ ID NO: 1341340 - DNA, 22 bp, Artificial Sequence
  chemically synthesized
agctcccatgtgataagttcaa

SEQ ID NO: 1341341 - DNA, 22 bp, Artificial Sequence
  chemically synthesized
ccatgtgataagttcaacaatc

SEQ ID NO: 1341342 - DNA, 22 bp, Artificial Sequence
  chemically synthesized
agcatggtagacccaggattgt

SEQ ID NO: 1341343 - DNA, 22 bp, Artificial Sequence
  chemically synthesized
cagcatggtagacccaggattg

SEQ ID NO: 1341344 - DNA, 22 bp, Artificial Sequence
  chemically synthesized
ttcagcatggtagacccaggat

SEQ ID NO: 1341345 - DNA, 22 bp, Artificial Sequence
  chemically synthesized
aacaatcctgggtctaccatgc

SEQ ID NO: 1341346 - DNA, 22 bp, Artificial Sequence
  chemically synthesized
catgtggcctcttcagcatggt

SEQ ID NO: 1341347 - DNA, 22 bp, Artificial Sequence
  chemically synthesized
ggtctaccatgctgaagaggcc

SEQ ID NO: 1341348 - DNA, 22 bp, Artificial Sequence
  chemically synthesized
gtacctacatgtggcctcttca

SEQ ID NO: 1341349 - DNA, 22 bp, Artificial Sequence
  chemically synthesized
tagtacctacatgtggcctctt

SEQ ID NO: 1341350 - DNA, 22 bp, Artificial Sequence
  chemically synthesized
ccatgctgaagaggccacatgt

SEQ ID NO: 1341351 - DNA, 22 bp, Artificial Sequence
  chemically synthesized
actctagtacctacatgtggcc

SEQ ID NO: 1341352 - DNA, 22 bp, Artificial Sequence
  chemically synthesized
ttgactctagtacctacatgtg

SEQ ID NO: 1341353 - DNA, 22 bp, Artificial Sequence
  chemically synthesized
aagaggccacatgtaggtacta

SEQ ID NO: 1341354 - DNA, 22 bp, Artificial Sequence
  chemically synthesized
gatctattgactctagtaccta

SEQ ID NO: 1341355 - DNA, 22 bp, Artificial Sequence
  chemically synthesized
ggtcaactagatctattgactc

SEQ ID NO: 1341356 - DNA, 22 bp, Artificial Sequence
  chemically synthesized
gggtcaactagatctattgact

SEQ ID NO: 1341357 - DNA, 22 bp, Artificial Sequence
  chemically synthesized
gagtcaatagatctagttgacc

SEQ ID NO: 1341358 - DNA, 22 bp, Artificial Sequence
  chemically synthesized
gtggagacgacagggagacttg

SEQ ID NO: 1341359 - DNA, 22 bp, Artificial Sequence
  chemically synthesized
ggtggagacgacagggagactt

SEQ ID NO: 1341360 - DNA, 22 bp, Artificial Sequence
  chemically synthesized
tggtggagacgacagggagact

SEQ ID NO: 1341361 - DNA, 22 bp, Artificial Sequence
  chemically synthesized
gttgacccaagtctccctgtcg

SEQ ID NO: 1341362 - DNA, 22 bp, Artificial Sequence
  chemically synthesized
ctttggtggagacgacagggag

SEQ ID NO: 1341363 - DNA, 22 bp, Artificial Sequence
  chemically synthesized
acccaagtctccctgtcgtctc

SEQ ID NO: 1341364 - DNA, 22 bp, Artificial Sequence
  chemically synthesized
atatgtatgttgctttggtgga

SEQ ID NO: 1341365 - DNA, 22 bp, Artificial Sequence
  chemically synthesized
cctgtcgtctccaccaaagcaa

SEQ ID NO: 1341366 - DNA, 22 bp, Artificial Sequence
  chemically synthesized
tactcatatgtatgttgctttg

SEQ ID NO: 1341367 - DNA, 22 bp, Artificial Sequence
  chemically synthesized
tcgtctccaccaaagcaacata

SEQ ID NO: 1341368 - DNA, 22 bp, Artificial Sequence
  chemically synthesized
caccaaagcaacatacatatga

SEQ ID NO: 1341369 - DNA, 22 bp, Artificial Sequence
  chemically synthesized
gtcagcagaatccaagacagct

SEQ ID NO: 1341370 - DNA, 22 bp, Artificial Sequence
  chemically synthesized
gcagatgagctggtcagcagaa

SEQ ID NO: 1341371 - DNA, 22 bp, Artificial Sequence
  chemically synthesized
tcttggattctgctgaccagct

SEQ ID NO: 1341372 - DNA, 22 bp, Artificial Sequence
  chemically synthesized
agctggcagatgagctggtcag

SEQ ID NO: 1341373 - DNA, 22 bp, Artificial Sequence
  chemically synthesized
ggattctgctgaccagctcatc

SEQ ID NO: 1341374 - DNA, 22 bp, Artificial Sequence
  chemically synthesized
gattctgctgaccagctcatct

SEQ ID NO: 1341375 - DNA, 22 bp, Artificial Sequence
  chemically synthesized
tgctgaccagctcatctgccag

SEQ ID NO: 1341376 - DNA, 22 bp, Artificial Sequence
  chemically synthesized
aatgatactcagctggcagatg

SEQ ID NO: 1341377 - DNA, 22 bp, Artificial Sequence
  chemically synthesized
ctgaccagctcatctgccagct

SEQ ID NO: 1341378 - DNA, 22 bp, Artificial Sequence
  chemically synthesized
accagctcatctgccagctgag

SEQ ID NO: 1341379 - DNA, 22 bp, Artificial Sequence
  chemically synthesized
atccctaaatgatactcagctg

SEQ ID NO: 1341380 - DNA, 22 bp, Artificial Sequence
  chemically synthesized
gatccctaaatgatactcagct

SEQ ID NO: 1341381 - DNA, 22 bp, Artificial Sequence
  chemically synthesized
atctgccagctgagtatcattt

SEQ ID NO: 1341382 - DNA, 22 bp, Artificial Sequence
  chemically synthesized
ccagctgagtatcatttaggga

SEQ ID NO: 1341383 - DNA, 22 bp, Artificial Sequence
  chemically synthesized
tgtggtatcaacttgatcccta

SEQ ID NO: 1341384 - DNA, 22 bp, Artificial Sequence
  chemically synthesized
tatgtggtatcaacttgatccc

SEQ ID NO: 1341385 - DNA, 22 bp, Artificial Sequence
  chemically synthesized
agtatcatttagggatcaagtt

SEQ ID NO: 1341386 - DNA, 22 bp, Artificial Sequence
  chemically synthesized
cactctatgtggtatcaacttg

SEQ ID NO: 1341387 - DNA, 22 bp, Artificial Sequence
  chemically synthesized
ccactctatgtggtatcaactt

SEQ ID NO: 1341388 - DNA, 22 bp, Artificial Sequence
  chemically synthesized
tccactctatgtggtatcaact

SEQ ID NO: 1341389 - DNA, 22 bp, Artificial Sequence
  chemically synthesized
agggatcaagttgataccacat

SEQ ID NO: 1341390 - DNA, 22 bp, Artificial Sequence
  chemically synthesized
gggatcaagttgataccacata

SEQ ID NO: 1341391 - DNA, 22 bp, Artificial Sequence
  chemically synthesized
ggtgattttccactctatgtgg

SEQ ID NO: 1341392 - DNA, 22 bp, Artificial Sequence
  chemically synthesized
ataccacatagagtggaaaatc

SEQ ID NO: 1341393 - DNA, 22 bp, Artificial Sequence
  chemically synthesized
agcgtgggtcaactgggtgatt

SEQ ID NO: 1341394 - DNA, 22 bp, Artificial Sequence
  chemically synthesized
gagcgtgggtcaactgggtgat

SEQ ID NO: 1341395 - DNA, 22 bp, Artificial Sequence
  chemically synthesized
tgggtcataaatttgagcgtgg

SEQ ID NO: 1341396 - DNA, 22 bp, Artificial Sequence
  chemically synthesized
gtgggtcataaatttgagcgtg

SEQ ID NO: 1341397 - DNA, 22 bp, Artificial Sequence
  chemically synthesized
tgtgggtcataaatttgagcgt

SEQ ID NO: 1341398 - DNA, 22 bp, Artificial Sequence
  chemically synthesized
atgattttgtgggtcataaatt

SEQ ID NO: 1341399 - DNA, 22 bp, Artificial Sequence
  chemically synthesized
acccacgctcaaatttatgacc

SEQ ID NO: 1341400 - DNA, 22 bp, Artificial Sequence
  chemically synthesized
tagctcatgattttgtgggtca

SEQ ID NO: 1341401 - DNA, 22 bp, Artificial Sequence
  chemically synthesized
atagctcatgattttgtgggtc

SEQ ID NO: 1341402 - DNA, 22 bp, Artificial Sequence
  chemically synthesized
tatagctcatgattttgtgggt

SEQ ID NO: 1341403 - DNA, 22 bp, Artificial Sequence
  chemically synthesized
ttatagctcatgattttgtggg

SEQ ID NO: 1341404 - DNA, 22 bp, Artificial Sequence
  chemically synthesized
tttatagctcatgattttgtgg

SEQ ID NO: 1341405 - DNA, 22 bp, Artificial Sequence
  chemically synthesized
aaatttatgacccacaaaatca

SEQ ID NO: 1341406 - DNA, 22 bp, Artificial Sequence
  chemically synthesized
atgacccacaaaatcatgagct

SEQ ID NO: 1341407 - DNA, 22 bp, Artificial Sequence
  chemically synthesized
tgacccacaaaatcatgagcta

SEQ ID NO: 1341408 - DNA, 22 bp, Artificial Sequence
  chemically synthesized
aaacaccagtcactttttatag

SEQ ID NO: 1341409 - DNA, 22 bp, Artificial Sequence
  chemically synthesized
aaaacaccagtcactttttata

SEQ ID NO: 1341410 - DNA, 22 bp, Artificial Sequence
  chemically synthesized
atagcttaaaacaccagtcact

SEQ ID NO: 1341411 - DNA, 22 bp, Artificial Sequence
  chemically synthesized
aatagcttaaaacaccagtcac

SEQ ID NO: 1341412 - DNA, 22 bp, Artificial Sequence
  chemically synthesized
taaaaagtgactggtgttttaa

SEQ ID NO: 1341413 - DNA, 22 bp, Artificial Sequence
  chemically synthesized
taaaacttaatagcttaaaaca

SEQ ID NO: 1341414 - DNA, 22 bp, Artificial Sequence
  chemically synthesized
ttataaaacttaatagcttaaa

SEQ ID NO: 1341415 - DNA, 22 bp, Artificial Sequence
  chemically synthesized
attataaaacttaatagcttaa

SEQ ID NO: 1341416 - DNA, 22 bp, Artificial Sequence
  chemically synthesized
gtgttttaagctattaagtttt

SEQ ID NO: 1341417 - DNA, 22 bp, Artificial Sequence
  chemically synthesized
agtaacaatttattataaaact

SEQ ID NO: 1341418 - DNA, 22 bp, Artificial Sequence
  chemically synthesized
taagctattaagttttataata

SEQ ID NO: 1341419 - DNA, 22 bp, Artificial Sequence
  chemically synthesized
aagctattaagttttataataa

SEQ ID NO: 1341420 - DNA, 22 bp, Artificial Sequence
  chemically synthesized
ctgagtaacaatttattataaa

SEQ ID NO: 1341421 - DNA, 22 bp, Artificial Sequence
  chemically synthesized
agctattaagttttataataaa

SEQ ID NO: 1341422 - DNA, 22 bp, Artificial Sequence
  chemically synthesized
ttgctgagtaacaatttattat

SEQ ID NO: 1341423 - DNA, 22 bp, Artificial Sequence
  chemically synthesized
ttaagttttataataaattgtt

SEQ ID NO: 1341424 - DNA, 22 bp, Artificial Sequence
  chemically synthesized
tctattgctgagtaacaattta

SEQ ID NO: 1341425 - DNA, 22 bp, Artificial Sequence
  chemically synthesized
agttttataataaattgttact

SEQ ID NO: 1341426 - DNA, 22 bp, Artificial Sequence
  chemically synthesized
cggttatctattgctgagtaac

SEQ ID NO: 1341427 - DNA, 22 bp, Artificial Sequence
  chemically synthesized
tataataaattgttactcagca

SEQ ID NO: 1341428 - DNA, 22 bp, Artificial Sequence
  chemically synthesized
ataataaattgttactcagcaa

SEQ ID NO: 1341429 - DNA, 22 bp, Artificial Sequence
  chemically synthesized
taataaattgttactcagcaat

SEQ ID NO: 1341430 - DNA, 22 bp, Artificial Sequence
  chemically synthesized
tgttccggttatctattgctga

SEQ ID NO: 1341431 - DNA, 22 bp, Artificial Sequence
  chemically synthesized
ctatgttccggttatctattgc

SEQ ID NO: 1341432 - DNA, 22 bp, Artificial Sequence
  chemically synthesized
gctatgttccggttatctattg

SEQ ID NO: 1341433 - DNA, 22 bp, Artificial Sequence
  chemically synthesized
ttgctatgttccggttatctat

SEQ ID NO: 1341434 - DNA, 22 bp, Artificial Sequence
  chemically synthesized
ttactcagcaatagataaccgg

SEQ ID NO: 1341435 - DNA, 22 bp, Artificial Sequence
  chemically synthesized
attcttgctatgttccggttat

SEQ ID NO: 1341436 - DNA, 22 bp, Artificial Sequence
  chemically synthesized
ctcagcaatagataaccggaac

SEQ ID NO: 1341437 - DNA, 22 bp, Artificial Sequence
  chemically synthesized
agcaatagataaccggaacata

SEQ ID NO: 1341438 - DNA, 22 bp, Artificial Sequence
  chemically synthesized
catgagcaggaatgggaacaat

SEQ ID NO: 1341439 - DNA, 22 bp, Artificial Sequence
  chemically synthesized
gatcattacatgagcaggaatg

SEQ ID NO: 1341440 - DNA, 22 bp, Artificial Sequence
  chemically synthesized
tgattgttcccattcctgctca

SEQ ID NO: 1341441 - DNA, 22 bp, Artificial Sequence
  chemically synthesized
tattagatcattacatgagcag

SEQ ID NO: 1341442 - DNA, 22 bp, Artificial Sequence
  chemically synthesized
ttcccattcctgctcatgtaat

SEQ ID NO: 1341443 - DNA, 22 bp, Artificial Sequence
  chemically synthesized
ccattcctgctcatgtaatgat

SEQ ID NO: 1341444 - DNA, 22 bp, Artificial Sequence
  chemically synthesized
ctgctcatgtaatgatctaata

SEQ ID NO: 1341445 - DNA, 22 bp, Artificial Sequence
  chemically synthesized
ctcatgtaatgatctaatataa

SEQ ID NO: 1341446 - DNA, 22 bp, Artificial Sequence
  chemically synthesized
tgtagtatataattatattaga

SEQ ID NO: 1341447 - DNA, 22 bp, Artificial Sequence
  chemically synthesized
atgtaatgatctaatataatta

SEQ ID NO: 1341448 - DNA, 22 bp, Artificial Sequence
  chemically synthesized
atataattatatactacataat

SEQ ID NO: 1341449 - DNA, 22 bp, Artificial Sequence
  chemically synthesized
tagtcatgtatcatcaaattat

SEQ ID NO: 1341450 - DNA, 22 bp, Artificial Sequence
  chemically synthesized
atagtcatgtatcatcaaatta

SEQ ID NO: 1341451 - DNA, 22 bp, Artificial Sequence
  chemically synthesized
tatagtcatgtatcatcaaatt

SEQ ID NO: 1341452 - DNA, 22 bp, Artificial Sequence
  chemically synthesized
tatactacataatttgatgata

SEQ ID NO: 1341453 - DNA, 22 bp, Artificial Sequence
  chemically synthesized
ttttatagtcatgtatcatcaa

SEQ ID NO: 1341454 - DNA, 22 bp, Artificial Sequence
  chemically synthesized
attttatagtcatgtatcatca

SEQ ID NO: 1341455 - DNA, 22 bp, Artificial Sequence
  chemically synthesized
tattttatagtcatgtatcatc

SEQ ID NO: 1341456 - DNA, 22 bp, Artificial Sequence
  chemically synthesized
tttattttatagtcatgtatca

SEQ ID NO: 1341457 - DNA, 22 bp, Artificial Sequence
  chemically synthesized
cataatttgatgatacatgact

SEQ ID NO: 1341458 - DNA, 22 bp, Artificial Sequence
  chemically synthesized
gatgatacatgactataaaata

SEQ ID NO: 1341459 - DNA, 22 bp, Artificial Sequence
  chemically synthesized
atgatacatgactataaaataa

SEQ ID NO: 1341460 - DNA, 22 bp, Artificial Sequence
  chemically synthesized
gaaagaacgcatctctttattt

SEQ ID NO: 1341461 - DNA, 22 bp, Artificial Sequence
  chemically synthesized
agaaagaacgcatctctttatt

SEQ ID NO: 1341462 - DNA, 22 bp, Artificial Sequence
  chemically synthesized
tagaaagaacgcatctctttat

SEQ ID NO: 1341463 - DNA, 22 bp, Artificial Sequence
  chemically synthesized
ttagaaagaacgcatctcttta

SEQ ID NO: 1341464 - DNA, 22 bp, Artificial Sequence
  chemically synthesized
tttagaaagaacgcatctcttt

SEQ ID NO: 1341465 - DNA, 22 bp, Artificial Sequence
  chemically synthesized
tattttttagaaagaacgcatc

SEQ ID NO: 1341466 - DNA, 22 bp, Artificial Sequence
  chemically synthesized
taaaataaagagatgcgttctt

SEQ ID NO: 1341467 - DNA, 22 bp, Artificial Sequence
  chemically synthesized
gtattttttagaaagaacgcat

SEQ ID NO: 1341468 - DNA, 22 bp, Artificial Sequence
  chemically synthesized
ataatttgtattttttagaaag

SEQ ID NO: 1341469 - DNA, 22 bp, Artificial Sequence
  chemically synthesized
ctgataatttgtattttttaga

SEQ ID NO: 1341470 - DNA, 22 bp, Artificial Sequence
  chemically synthesized
actgataatttgtattttttag

SEQ ID NO: 1341471 - DNA, 22 bp, Artificial Sequence
  chemically synthesized
tactgataatttgtatttttta

SEQ ID NO: 1341472 - DNA, 22 bp, Artificial Sequence
  chemically synthesized
ttactgataatttgtatttttt

SEQ ID NO: 1341473 - DNA, 22 bp, Artificial Sequence
  chemically synthesized
atttttactgataatttgtatt

SEQ ID NO: 1341474 - DNA, 22 bp, Artificial Sequence
  chemically synthesized
tttctaaaaaatacaaattatc

SEQ ID NO: 1341475 - DNA, 22 bp, Artificial Sequence
  chemically synthesized
tctaaaaaatacaaattatcag

SEQ ID NO: 1341476 - DNA, 22 bp, Artificial Sequence
  chemically synthesized
agctaatttttactgataattt

SEQ ID NO: 1341477 - DNA, 22 bp, Artificial Sequence
  chemically synthesized
ctaaaaaatacaaattatcagt

SEQ ID NO: 1341478 - DNA, 22 bp, Artificial Sequence
  chemically synthesized
cagctaatttttactgataatt

SEQ ID NO: 1341479 - DNA, 22 bp, Artificial Sequence
  chemically synthesized
taaaaaatacaaattatcagta

SEQ ID NO: 1341480 - DNA, 22 bp, Artificial Sequence
  chemically synthesized
ttcagctaatttttactgataa

SEQ ID NO: 1341481 - DNA, 22 bp, Artificial Sequence
  chemically synthesized
aaaaatacaaattatcagtaaa

SEQ ID NO: 1341482 - DNA, 22 bp, Artificial Sequence
  chemically synthesized
ttcttcagctaatttttactga

SEQ ID NO: 1341483 - DNA, 22 bp, Artificial Sequence
  chemically synthesized
attcttcagctaatttttactg

SEQ ID NO: 1341484 - DNA, 22 bp, Artificial Sequence
  chemically synthesized
tttattcttcagctaattttta

SEQ ID NO: 1341485 - DNA, 22 bp, Artificial Sequence
  chemically synthesized
tcagtaaaaattagctgaagaa

SEQ ID NO: 1341486 - DNA, 22 bp, Artificial Sequence
  chemically synthesized
ccaaaggcctgtttattcttca

SEQ ID NO: 1341487 - DNA, 22 bp, Artificial Sequence
  chemically synthesized
tcccaaaggcctgtttattctt

SEQ ID NO: 1341488 - DNA, 22 bp, Artificial Sequence
  chemically synthesized
gctgaagaataaacaggccttt

SEQ ID NO: 1341489 - DNA, 22 bp, Artificial Sequence
  chemically synthesized
atatccctctcccaaaggcctg

SEQ ID NO: 1341490 - DNA, 22 bp, Artificial Sequence
  chemically synthesized
taatatccctctcccaaaggcc

SEQ ID NO: 1341491 - DNA, 22 bp, Artificial Sequence
  chemically synthesized
aagaataaacaggcctttggga

SEQ ID NO: 1341492 - DNA, 22 bp, Artificial Sequence
  chemically synthesized
ctaatatccctctcccaaaggc

SEQ ID NO: 1341493 - DNA, 22 bp, Artificial Sequence
  chemically synthesized
tctaatatccctctcccaaagg

SEQ ID NO: 1341494 - DNA, 22 bp, Artificial Sequence
  chemically synthesized
ttctaatatccctctcccaaag

SEQ ID NO: 1341495 - DNA, 22 bp, Artificial Sequence
  chemically synthesized
aatacttttctaatatccctct

SEQ ID NO: 1341496 - DNA, 22 bp, Artificial Sequence
  chemically synthesized
caatacttttctaatatccctc

SEQ ID NO: 1341497 - DNA, 22 bp, Artificial Sequence
  chemically synthesized
cttcaatacttttctaatatcc

SEQ ID NO: 1341498 - DNA, 22 bp, Artificial Sequence
  chemically synthesized
tgggagagggatattagaaaag

SEQ ID NO: 1341499 - DNA, 22 bp, Artificial Sequence
  chemically synthesized
gggagagggatattagaaaagt

SEQ ID NO: 1341500 - DNA, 22 bp, Artificial Sequence
  chemically synthesized
ggagagggatattagaaaagta

SEQ ID NO: 1341501 - DNA, 22 bp, Artificial Sequence
  chemically synthesized
agaggggattccttcaatactt

SEQ ID NO: 1341502 - DNA, 22 bp, Artificial Sequence
  chemically synthesized
aagaggggattccttcaatact

SEQ ID NO: 1341503 - DNA, 22 bp, Artificial Sequence
  chemically synthesized
gaaaagtattgaaggaatcccc

SEQ ID NO: 1341504 - DNA, 22 bp, Artificial Sequence
  chemically synthesized
caaaacaatttaagaggggatt

SEQ ID NO: 1341505 - DNA, 22 bp, Artificial Sequence
  chemically synthesized
gcaaaacaatttaagaggggat

SEQ ID NO: 1341506 - DNA, 22 bp, Artificial Sequence
  chemically synthesized
aaggaatcccctcttaaattgt

SEQ ID NO: 1341507 - DNA, 22 bp, Artificial Sequence
  chemically synthesized
ttaaattgttttgcaaatgtct

SEQ ID NO: 1341508 - DNA, 22 bp, Artificial Sequence
  chemically synthesized
aaattgttttgcaaatgtctct

SEQ ID NO: 1341509 - DNA, 22 bp, Artificial Sequence
  chemically synthesized
aattgttttgcaaatgtctctg

SEQ ID NO: 1341510 - DNA, 22 bp, Artificial Sequence
  chemically synthesized
ttttgcaaatgtctctgtgttc

SEQ ID NO: 1341511 - DNA, 22 bp, Artificial Sequence
  chemically synthesized
tgcagtagagaaagaacacaga

SEQ ID NO: 1341512 - DNA, 22 bp, Artificial Sequence
  chemically synthesized
tgcaaatgtctctgtgttcttt

SEQ ID NO: 1341513 - DNA, 22 bp, Artificial Sequence
  chemically synthesized
tgtgcagtagagaaagaacaca

SEQ ID NO: 1341514 - DNA, 22 bp, Artificial Sequence
  chemically synthesized
gcaaatgtctctgtgttctttc

SEQ ID NO: 1341515 - DNA, 22 bp, Artificial Sequence
  chemically synthesized
ctgtgcagtagagaaagaacac

SEQ ID NO: 1341516 - DNA, 22 bp, Artificial Sequence
  chemically synthesized
caaatgtctctgtgttctttct

SEQ ID NO: 1341517 - DNA, 22 bp, Artificial Sequence
  chemically synthesized
gtttctgtgcagtagagaaaga

SEQ ID NO: 1341518 - DNA, 22 bp, Artificial Sequence
  chemically synthesized
cgtttctgtgcagtagagaaag

SEQ ID NO: 1341519 - DNA, 22 bp, Artificial Sequence
  chemically synthesized
tcgtttctgtgcagtagagaaa

SEQ ID NO: 1341520 - DNA, 22 bp, Artificial Sequence
  chemically synthesized
tgtgttctttctctactgcaca

SEQ ID NO: 1341521 - DNA, 22 bp, Artificial Sequence
  chemically synthesized
tgttctttctctactgcacaga

SEQ ID NO: 1341522 - DNA, 22 bp, Artificial Sequence
  chemically synthesized
tacgttttcgtttctgtgcagt

SEQ ID NO: 1341523 - DNA, 22 bp, Artificial Sequence
  chemically synthesized
gtacgttttcgtttctgtgcag

SEQ ID NO: 1341524 - DNA, 22 bp, Artificial Sequence
  chemically synthesized
tttctctactgcacagaaacga

SEQ ID NO: 1341525 - DNA, 22 bp, Artificial Sequence
  chemically synthesized
tctctactgcacagaaacgaaa

SEQ ID NO: 1341526 - DNA, 22 bp, Artificial Sequence
  chemically synthesized
ctctactgcacagaaacgaaaa

SEQ ID NO: 1341527 - DNA, 22 bp, Artificial Sequence
  chemically synthesized
gagacttgtacgttttcgtttc

SEQ ID NO: 1341528 - DNA, 22 bp, Artificial Sequence
  chemically synthesized
tctactgcacagaaacgaaaac

SEQ ID NO: 1341529 - DNA, 22 bp, Artificial Sequence
  chemically synthesized
tactgcacagaaacgaaaacgt

SEQ ID NO: 1341530 - DNA, 22 bp, Artificial Sequence
  chemically synthesized
ctgcacagaaacgaaaacgtac

SEQ ID NO: 1341531 - DNA, 22 bp, Artificial Sequence
  chemically synthesized
cacagaaacgaaaacgtacaag

SEQ ID NO: 1341532 - DNA, 22 bp, Artificial Sequence
  chemically synthesized
gtggtacagattagagacttgt

SEQ ID NO: 1341533 - DNA, 22 bp, Artificial Sequence
  chemically synthesized
ggtggtacagattagagacttg

SEQ ID NO: 1341534 - DNA, 22 bp, Artificial Sequence
  chemically synthesized
taatctgtaccaccaaatcctc

SEQ ID NO: 1341535 - DNA, 22 bp, Artificial Sequence
  chemically synthesized
atctgtaccaccaaatcctctt

SEQ ID NO: 1341536 - DNA, 22 bp, Artificial Sequence
  chemically synthesized
taccaccaaatcctcttgattt

SEQ ID NO: 1341537 - DNA, 22 bp, Artificial Sequence
  chemically synthesized
ttgattttatgatctcttacta

SEQ ID NO: 1341538 - DNA, 22 bp, Artificial Sequence
  chemically synthesized
taaggaagaaagtagtaagaga

SEQ ID NO: 1341539 - DNA, 22 bp, Artificial Sequence
  chemically synthesized
ataaggaagaaagtagtaagag

SEQ ID NO: 1341540 - DNA, 22 bp, Artificial Sequence
  chemically synthesized
gattttatgatctcttactact

SEQ ID NO: 1341541 - DNA, 22 bp, Artificial Sequence
  chemically synthesized
tataaggaagaaagtagtaaga

SEQ ID NO: 1341542 - DNA, 22 bp, Artificial Sequence
  chemically synthesized
attttatgatctcttactactt

SEQ ID NO: 1341543 - DNA, 22 bp, Artificial Sequence
  chemically synthesized
ttataaggaagaaagtagtaag

SEQ ID NO: 1341544 - DNA, 22 bp, Artificial Sequence
  chemically synthesized
tatgatctcttactactttctt

SEQ ID NO: 1341545 - DNA, 22 bp, Artificial Sequence
  chemically synthesized
acttttataaggaagaaagtag

SEQ ID NO: 1341546 - DNA, 22 bp, Artificial Sequence
  chemically synthesized
atgatctcttactactttcttc

SEQ ID NO: 1341547 - DNA, 22 bp, Artificial Sequence
  chemically synthesized
tgatctcttactactttcttcc

SEQ ID NO: 1341548 - DNA, 22 bp, Artificial Sequence
  chemically synthesized
ttactactttcttccttataaa

SEQ ID NO: 1341549 - DNA, 22 bp, Artificial Sequence
  chemically synthesized
actactttcttccttataaaag

SEQ ID NO: 1341550 - DNA, 22 bp, Artificial Sequence
  chemically synthesized
ctactttcttccttataaaagt

SEQ ID NO: 1341551 - DNA, 22 bp, Artificial Sequence
  chemically synthesized
ctttcttccttataaaagtcag

SEQ ID NO: 1341552 - DNA, 22 bp, Artificial Sequence
  chemically synthesized
tcttccttataaaagtcagtct

SEQ ID NO: 1341553 - DNA, 22 bp, Artificial Sequence
  chemically synthesized
cttccttataaaagtcagtctt

SEQ ID NO: 1341554 - DNA, 22 bp, Artificial Sequence
  chemically synthesized
ttccttataaaagtcagtcttt

SEQ ID NO: 1341555 - DNA, 22 bp, Artificial Sequence
  chemically synthesized
ccttataaaagtcagtcttttt

SEQ ID NO: 1341556 - DNA, 22 bp, Artificial Sequence
  chemically synthesized
cttataaaagtcagtctttttt

SEQ ID NO: 1341557 - DNA, 22 bp, Artificial Sequence
  chemically synthesized
aaaaaaaaaaaaaaaaaaaaga

SEQ ID NO: 1341558 - DNA, 22 bp, Artificial Sequence
  chemically synthesized
ataaaagtcagtcttttttttt

SEQ ID NO: 1341559 - DNA, 22 bp, Artificial Sequence
  chemically synthesized
taaaagtcagtctttttttttt

SEQ ID NO: 1341560 - DNA, 22 bp, Artificial Sequence
  chemically synthesized
tcaaaaaaaaaaaaaaaaaaaa

SEQ ID NO: 1341561 - DNA, 22 bp, Artificial Sequence
  chemically synthesized
cctctcaaaaaaaaaaaaaaaa

SEQ ID NO: 1341562 - DNA, 22 bp, Artificial Sequence
  chemically synthesized
ttttttttttttttttttgaga

SEQ ID NO: 1341563 - DNA, 22 bp, Artificial Sequence
  chemically synthesized
tttttttttttttttttgagag

SEQ ID NO: 1341564 - DNA, 22 bp, Artificial Sequence
  chemically synthesized
ttttttttttttttttgagagg

SEQ ID NO: 1341565 - DNA, 22 bp, Artificial Sequence
  chemically synthesized
tttttttttttttttgagaggg

SEQ ID NO: 1341566 - DNA, 22 bp, Artificial Sequence
  chemically synthesized
ttttttttttttttgagaggga

SEQ ID NO: 1341567 - DNA, 22 bp, Artificial Sequence
  chemically synthesized
tttttttttttttgagagggag

SEQ ID NO: 1341568 - DNA, 22 bp, Artificial Sequence
  chemically synthesized
ttttttttttttgagagggagt

SEQ ID NO: 1341569 - DNA, 22 bp, Artificial Sequence
  chemically synthesized
tttttttttttgagagggagtc

SEQ ID NO: 1341570 - DNA, 22 bp, Artificial Sequence
  chemically synthesized
ttttttttttgagagggagtct

SEQ ID NO: 1341571 - DNA, 22 bp, Artificial Sequence
  chemically synthesized
ggcaacagagtgagactccctc

SEQ ID NO: 1341572 - DNA, 22 bp, Artificial Sequence
  chemically synthesized
tttttttttgagagggagtctc

SEQ ID NO: 1341573 - DNA, 22 bp, Artificial Sequence
  chemically synthesized
ttttttttgagagggagtctca

SEQ ID NO: 1341574 - DNA, 22 bp, Artificial Sequence
  chemically synthesized
tttttttgagagggagtctcac

SEQ ID NO: 1341575 - DNA, 22 bp, Artificial Sequence
  chemically synthesized
ttttttgagagggagtctcact

SEQ ID NO: 1341576 - DNA, 22 bp, Artificial Sequence
  chemically synthesized
tttttgagagggagtctcactc

SEQ ID NO: 1341577 - DNA, 22 bp, Artificial Sequence
  chemically synthesized
ttttgagagggagtctcactct

SEQ ID NO: 1341578 - DNA, 22 bp, Artificial Sequence
  chemically synthesized
tttgagagggagtctcactctg

SEQ ID NO: 1341579 - DNA, 22 bp, Artificial Sequence
  chemically synthesized
cagcctgggcaacagagtgaga

SEQ ID NO: 1341580 - DNA, 22 bp, Artificial Sequence
  chemically synthesized
ttgagagggagtctcactctgt

SEQ ID NO: 1341581 - DNA, 22 bp, Artificial Sequence
  chemically synthesized
tgagagggagtctcactctgtt

SEQ ID NO: 1341582 - DNA, 22 bp, Artificial Sequence
  chemically synthesized
gagagggagtctcactctgttg

SEQ ID NO: 1341583 - DNA, 22 bp, Artificial Sequence
  chemically synthesized
agagggagtctcactctgttgc

SEQ ID NO: 1341584 - DNA, 22 bp, Artificial Sequence
  chemically synthesized
cactccagcctgggcaacagag

SEQ ID NO: 1341585 - DNA, 22 bp, Artificial Sequence
  chemically synthesized
actctgttgcccaggctggagt

SEQ ID NO: 1341586 - DNA, 22 bp, Artificial Sequence
  chemically synthesized
tgttgcccaggctggagtgcag

SEQ ID NO: 1341587 - DNA, 22 bp, Artificial Sequence
  chemically synthesized
ttgcccaggctggagtgcagtg

SEQ ID NO: 1341588 - DNA, 22 bp, Artificial Sequence
  chemically synthesized
cccaggctggagtgcagtggcg

SEQ ID NO: 1341589 - DNA, 22 bp, Artificial Sequence
  chemically synthesized
cagtgagccgagatcacgccac

SEQ ID NO: 1341590 - DNA, 22 bp, Artificial Sequence
  chemically synthesized
gagtgcagtggcgtgatctcgg

SEQ ID NO: 1341591 - DNA, 22 bp, Artificial Sequence
  chemically synthesized
aaggcagaggttgcagtgagcc

SEQ ID NO: 1341592 - DNA, 22 bp, Artificial Sequence
  chemically synthesized
aaactgaaggcagaggttgcag

SEQ ID NO: 1341593 - DNA, 22 bp, Artificial Sequence
  chemically synthesized
gaaactgaaggcagaggttgca

SEQ ID NO: 1341594 - DNA, 22 bp, Artificial Sequence
  chemically synthesized
ggctcactgcaacctctgcctt

SEQ ID NO: 1341595 - DNA, 22 bp, Artificial Sequence
  chemically synthesized
actgcaacctctgccttcagtt

SEQ ID NO: 1341596 - DNA, 22 bp, Artificial Sequence
  chemically synthesized
caacctctgccttcagtttcaa

SEQ ID NO: 1341597 - DNA, 22 bp, Artificial Sequence
  chemically synthesized
aggcaggagaatcccttgaaac

SEQ ID NO: 1341598 - DNA, 22 bp, Artificial Sequence
  chemically synthesized
tgccttcagtttcaagggattc

SEQ ID NO: 1341599 - DNA, 22 bp, Artificial Sequence
  chemically synthesized
ccttcagtttcaagggattctc

SEQ ID NO: 1341600 - DNA, 22 bp, Artificial Sequence
  chemically synthesized
aggaggctgaggcaggagaatc

SEQ ID NO: 1341601 - DNA, 22 bp, Artificial Sequence
  chemically synthesized
cagtttcaagggattctcctgc

SEQ ID NO: 1341602 - DNA, 22 bp, Artificial Sequence
  chemically synthesized
agtttcaagggattctcctgcc

SEQ ID NO: 1341603 - DNA, 22 bp, Artificial Sequence
  chemically synthesized
ctcaggaggctgaggcaggaga

SEQ ID NO: 1341604 - DNA, 22 bp, Artificial Sequence
  chemically synthesized
caagggattctcctgcctcagc

SEQ ID NO: 1341605 - DNA, 22 bp, Artificial Sequence
  chemically synthesized
aagggattctcctgcctcagcc

SEQ ID NO: 1341606 - DNA, 22 bp, Artificial Sequence
  chemically synthesized
taatcccagctactcaggaggc

SEQ ID NO: 1341607 - DNA, 22 bp, Artificial Sequence
  chemically synthesized
tcctgcctcagcctcctgagta

SEQ ID NO: 1341608 - DNA, 22 bp, Artificial Sequence
  chemically synthesized
ctgcctcagcctcctgagtagc

SEQ ID NO: 1341609 - DNA, 22 bp, Artificial Sequence
  chemically synthesized
cctcagcctcctgagtagctgg

SEQ ID NO: 1341610 - DNA, 22 bp, Artificial Sequence
  chemically synthesized
agcctcctgagtagctgggatt

SEQ ID NO: 1341611 - DNA, 22 bp, Artificial Sequence
  chemically synthesized
ctgagtagctgggattacagat

SEQ ID NO: 1341612 - DNA, 22 bp, Artificial Sequence
  chemically synthesized
agtagctgggattacagatgtg

SEQ ID NO: 1341613 - DNA, 22 bp, Artificial Sequence
  chemically synthesized
gccgggcgtggtggtgcacatc

SEQ ID NO: 1341614 - DNA, 22 bp, Artificial Sequence
  chemically synthesized
ggattacagatgtgcaccacca

SEQ ID NO: 1341615 - DNA, 22 bp, Artificial Sequence
  chemically synthesized
cagatgtgcaccaccacgcccg

SEQ ID NO: 1341616 - DNA, 22 bp, Artificial Sequence
  chemically synthesized
aacatacaaagattagccgggc

SEQ ID NO: 1341617 - DNA, 22 bp, Artificial Sequence
  chemically synthesized
ctaaacatacaaagattagccg

SEQ ID NO: 1341618 - DNA, 22 bp, Artificial Sequence
  chemically synthesized
tactaaacatacaaagattagc

SEQ ID NO: 1341619 - DNA, 22 bp, Artificial Sequence
  chemically synthesized
atctttgtatgtttagtagagt

SEQ ID NO: 1341620 - DNA, 22 bp, Artificial Sequence
  chemically synthesized
tgtatgtttagtagagttgggg

SEQ ID NO: 1341621 - DNA, 22 bp, Artificial Sequence
  chemically synthesized
gtatgtttagtagagttggggt

SEQ ID NO: 1341622 - DNA, 22 bp, Artificial Sequence
  chemically synthesized
tatgtttagtagagttggggtt

SEQ ID NO: 1341623 - DNA, 22 bp, Artificial Sequence
  chemically synthesized
gccagtatggcgaaaccccaac

SEQ ID NO: 1341624 - DNA, 22 bp, Artificial Sequence
  chemically synthesized
agtagagttggggtttcgccat

SEQ ID NO: 1341625 - DNA, 22 bp, Artificial Sequence
  chemically synthesized
gtagagttggggtttcgccata

SEQ ID NO: 1341626 - DNA, 22 bp, Artificial Sequence
  chemically synthesized
gagaccaacctggccagtatgg

SEQ ID NO: 1341627 - DNA, 22 bp, Artificial Sequence
  chemically synthesized
gggtttcgccatactggccagg

SEQ ID NO: 1341628 - DNA, 22 bp, Artificial Sequence
  chemically synthesized
cgccatactggccaggttggtc

SEQ ID NO: 1341629 - DNA, 22 bp, Artificial Sequence
  chemically synthesized
gccatactggccaggttggtct

SEQ ID NO: 1341630 - DNA, 22 bp, Artificial Sequence
  chemically synthesized
aggtcaggagttcgagaccaac

SEQ ID NO: 1341631 - DNA, 22 bp, Artificial Sequence
  chemically synthesized
gaggtcaggagttcgagaccaa

SEQ ID NO: 1341632 - DNA, 22 bp, Artificial Sequence
  chemically synthesized
gccaggttggtctcgaactcct

SEQ ID NO: 1341633 - DNA, 22 bp, Artificial Sequence
  chemically synthesized
gtctcgaactcctgacctcaag

SEQ ID NO: 1341634 - DNA, 22 bp, Artificial Sequence
  chemically synthesized
gaactcctgacctcaagtgatc

SEQ ID NO: 1341635 - DNA, 22 bp, Artificial Sequence
  chemically synthesized
ggaggccgaggcgggcggatca

SEQ ID NO: 1341636 - DNA, 22 bp, Artificial Sequence
  chemically synthesized
ctgacctcaagtgatccgcccg

SEQ ID NO: 1341637 - DNA, 22 bp, Artificial Sequence
  chemically synthesized
gggaggccgaggcgggcggatc

SEQ ID NO: 1341638 - DNA, 22 bp, Artificial Sequence
  chemically synthesized
tgggaggccgaggcgggcggat

SEQ ID NO: 1341639 - DNA, 22 bp, Artificial Sequence
  chemically synthesized
ttgggaggccgaggcgggcgga

SEQ ID NO: 1341640 - DNA, 22 bp, Artificial Sequence
  chemically synthesized
acctcaagtgatccgcccgcct

SEQ ID NO: 1341641 - DNA, 22 bp, Artificial Sequence
  chemically synthesized
aagtgatccgcccgcctcggcc

SEQ ID NO: 1341642 - DNA, 22 bp, Artificial Sequence
  chemically synthesized
taatcccagcatttttgggagg

SEQ ID NO: 1341643 - DNA, 22 bp, Artificial Sequence
  chemically synthesized
ccacctgtaatcccagcatttt

SEQ ID NO: 1341644 - DNA, 22 bp, Artificial Sequence
  chemically synthesized
ggcctcccaaaaatgctgggat

SEQ ID NO: 1341645 - DNA, 22 bp, Artificial Sequence
  chemically synthesized
ccaaaaatgctgggattacagg

SEQ ID NO: 1341646 - DNA, 22 bp, Artificial Sequence
  chemically synthesized
gccaggcgcagtggctcccacc

SEQ ID NO: 1341647 - DNA, 22 bp, Artificial Sequence
  chemically synthesized
ctggccaggcgcagtggctccc

SEQ ID NO: 1341648 - DNA, 22 bp, Artificial Sequence
  chemically synthesized
ggattacaggtgggagccactg

SEQ ID NO: 1341649 - DNA, 22 bp, Artificial Sequence
  chemically synthesized
tgactactggccaggcgcagtg

SEQ ID NO: 1341650 - DNA, 22 bp, Artificial Sequence
  chemically synthesized
caggtgggagccactgcgcctg

SEQ ID NO: 1341651 - DNA, 22 bp, Artificial Sequence
  chemically synthesized
agactgtgactactggccaggc

SEQ ID NO: 1341652 - DNA, 22 bp, Artificial Sequence
  chemically synthesized
cgcctggccagtagtcacagtc

SEQ ID NO: 1341653 - DNA, 22 bp, Artificial Sequence
  chemically synthesized
aaggaatagcaattaagactgt

SEQ ID NO: 1341654 - DNA, 22 bp, Artificial Sequence
  chemically synthesized
gccagtagtcacagtcttaatt

SEQ ID NO: 1341655 - DNA, 22 bp, Artificial Sequence
  chemically synthesized
aggtgagagtgtgttcaaggaa

SEQ ID NO: 1341656 - DNA, 22 bp, Artificial Sequence
  chemically synthesized
tcaggtgagagtgtgttcaagg

SEQ ID NO: 1341657 - DNA, 22 bp, Artificial Sequence
  chemically synthesized
aattgctattccttgaacacac

SEQ ID NO: 1341658 - DNA, 22 bp, Artificial Sequence
  chemically synthesized
attgctattccttgaacacact

SEQ ID NO: 1341659 - DNA, 22 bp, Artificial Sequence
  chemically synthesized
ctattccttgaacacactctca

SEQ ID NO: 1341660 - DNA, 22 bp, Artificial Sequence
  chemically synthesized
ttccttgaacacactctcacct

SEQ ID NO: 1341661 - DNA, 22 bp, Artificial Sequence
  chemically synthesized
cttgaacacactctcacctgag

SEQ ID NO: 1341662 - DNA, 22 bp, Artificial Sequence
  chemically synthesized
gaacacactctcacctgagagc

SEQ ID NO: 1341663 - DNA, 22 bp, Artificial Sequence
  chemically synthesized
aacacactctcacctgagagcc

SEQ ID NO: 1341664 - DNA, 22 bp, Artificial Sequence
  chemically synthesized
agggaatgagtggaaaaaaggc

SEQ ID NO: 1341665 - DNA, 22 bp, Artificial Sequence
  chemically synthesized
tcacctgagagccttttttcca

SEQ ID NO: 1341666 - DNA, 22 bp, Artificial Sequence
  chemically synthesized
acctgagagccttttttccact

SEQ ID NO: 1341667 - DNA, 22 bp, Artificial Sequence
  chemically synthesized
caggttaagggaatgagtggaa

SEQ ID NO: 1341668 - DNA, 22 bp, Artificial Sequence
  chemically synthesized
agagccttttttccactcattc

SEQ ID NO: 1341669 - DNA, 22 bp, Artificial Sequence
  chemically synthesized
ttccaggttaagggaatgagtg

SEQ ID NO: 1341670 - DNA, 22 bp, Artificial Sequence
  chemically synthesized
ttttccactcattcccttaacc

SEQ ID NO: 1341671 - DNA, 22 bp, Artificial Sequence
  chemically synthesized
tttccactcattcccttaacct

SEQ ID NO: 1341672 - DNA, 22 bp, Artificial Sequence
  chemically synthesized
ttccactcattcccttaacctg

SEQ ID NO: 1341673 - DNA, 22 bp, Artificial Sequence
  chemically synthesized
tccactcattcccttaacctgg

SEQ ID NO: 1341674 - DNA, 22 bp, Artificial Sequence
  chemically synthesized
ccactcattcccttaacctgga

SEQ ID NO: 1341675 - DNA, 22 bp, Artificial Sequence
  chemically synthesized
cactcattcccttaacctggaa

SEQ ID NO: 1341676 - DNA, 22 bp, Artificial Sequence
  chemically synthesized
gatagagaagattgttccaggt

SEQ ID NO: 1341677 - DNA, 22 bp, Artificial Sequence
  chemically synthesized
attcccttaacctggaacaatc

SEQ ID NO: 1341678 - DNA, 22 bp, Artificial Sequence
  chemically synthesized
ccttaacctggaacaatcttct

SEQ ID NO: 1341679 - DNA, 22 bp, Artificial Sequence
  chemically synthesized
aacctggaacaatcttctctat

SEQ ID NO: 1341680 - DNA, 22 bp, Artificial Sequence
  chemically synthesized
acctggaacaatcttctctatc

SEQ ID NO: 1341681 - DNA, 22 bp, Artificial Sequence
  chemically synthesized
gaacaatcttctctatctagtt

SEQ ID NO: 1341682 - DNA, 22 bp, Artificial Sequence
  chemically synthesized
ctctatctagttggcttcttgt

SEQ ID NO: 1341683 - DNA, 22 bp, Artificial Sequence
  chemically synthesized
aatcagaacgagacaagaagcc

SEQ ID NO: 1341684 - DNA, 22 bp, Artificial Sequence
  chemically synthesized
tctatctagttggcttcttgtc

SEQ ID NO: 1341685 - DNA, 22 bp, Artificial Sequence
  chemically synthesized
tatctagttggcttcttgtctc

SEQ ID NO: 1341686 - DNA, 22 bp, Artificial Sequence
  chemically synthesized
tctagttggcttcttgtctcgt

SEQ ID NO: 1341687 - DNA, 22 bp, Artificial Sequence
  chemically synthesized
gttggcttcttgtctcgttctg

SEQ ID NO: 1341688 - DNA, 22 bp, Artificial Sequence
  chemically synthesized
agcaggttaaatcagaacgaga

SEQ ID NO: 1341689 - DNA, 22 bp, Artificial Sequence
  chemically synthesized
gcttcttgtctcgttctgattt

SEQ ID NO: 1341690 - DNA, 22 bp, Artificial Sequence
  chemically synthesized
cactgagcaggttaaatcagaa

SEQ ID NO: 1341691 - DNA, 22 bp, Artificial Sequence
  chemically synthesized
cttgtctcgttctgatttaacc

SEQ ID NO: 1341692 - DNA, 22 bp, Artificial Sequence
  chemically synthesized
ttgtctcgttctgatttaacct

SEQ ID NO: 1341693 - DNA, 22 bp, Artificial Sequence
  chemically synthesized
gtctcgttctgatttaacctgc

SEQ ID NO: 1341694 - DNA, 22 bp, Artificial Sequence
  chemically synthesized
tctcgttctgatttaacctgct

SEQ ID NO: 1341695 - DNA, 22 bp, Artificial Sequence
  chemically synthesized
tgatgagttgcactgagcaggt

SEQ ID NO: 1341696 - DNA, 22 bp, Artificial Sequence
  chemically synthesized
gttctgatttaacctgctcagt

SEQ ID NO: 1341697 - DNA, 22 bp, Artificial Sequence
  chemically synthesized
tgatttaacctgctcagtgcaa

SEQ ID NO: 1341698 - DNA, 22 bp, Artificial Sequence
  chemically synthesized
atttaacctgctcagtgcaact

SEQ ID NO: 1341699 - DNA, 22 bp, Artificial Sequence
  chemically synthesized
aacctgctcagtgcaactcatc

SEQ ID NO: 1341700 - DNA, 22 bp, Artificial Sequence
  chemically synthesized
acctgctcagtgcaactcatca

SEQ ID NO: 1341701 - DNA, 22 bp, Artificial Sequence
  chemically synthesized
ctcagtgcaactcatcataaca

SEQ ID NO: 1341702 - DNA, 22 bp, Artificial Sequence
  chemically synthesized
agtgcaactcatcataacacat

SEQ ID NO: 1341703 - DNA, 22 bp, Artificial Sequence
  chemically synthesized
gaaaagagcatgaaataatgtg

SEQ ID NO: 1341704 - DNA, 22 bp, Artificial Sequence
  chemically synthesized
atcataacacattatttcatgc

SEQ ID NO: 1341705 - DNA, 22 bp, Artificial Sequence
  chemically synthesized
gggcctggaaaagagcatgaaa

SEQ ID NO: 1341706 - DNA, 22 bp, Artificial Sequence
  chemically synthesized
tttcatgctcttttccaggccc

SEQ ID NO: 1341707 - DNA, 22 bp, Artificial Sequence
  chemically synthesized
catgctcttttccaggccctag

SEQ ID NO: 1341708 - DNA, 22 bp, Artificial Sequence
  chemically synthesized
atgctcttttccaggccctagt

SEQ ID NO: 1341709 - DNA, 22 bp, Artificial Sequence
  chemically synthesized
ttttccaggccctagtattcct

SEQ ID NO: 1341710 - DNA, 22 bp, Artificial Sequence
  chemically synthesized
ttccaggccctagtattcctga

SEQ ID NO: 1341711 - DNA, 22 bp, Artificial Sequence
  chemically synthesized
tccaggccctagtattcctgat

SEQ ID NO: 1341712 - DNA, 22 bp, Artificial Sequence
  chemically synthesized
ccaggccctagtattcctgatt

SEQ ID NO: 1341713 - DNA, 22 bp, Artificial Sequence
  chemically synthesized
caggccctagtattcctgattt

SEQ ID NO: 1341714 - DNA, 22 bp, Artificial Sequence
  chemically synthesized
gtattcctgatttcccttgccc

SEQ ID NO: 1341715 - DNA, 22 bp, Artificial Sequence
  chemically synthesized
ctgatttcccttgccctactac

SEQ ID NO: 1341716 - DNA, 22 bp, Artificial Sequence
  chemically synthesized
aggaaaataaaagtagtagggc

SEQ ID NO: 1341717 - DNA, 22 bp, Artificial Sequence
  chemically synthesized
atttcccttgccctactacttt

SEQ ID NO: 1341718 - DNA, 22 bp, Artificial Sequence
  chemically synthesized
cccttgccctactacttttatt

SEQ ID NO: 1341719 - DNA, 22 bp, Artificial Sequence
  chemically synthesized
ccttgccctactacttttattt

SEQ ID NO: 1341720 - DNA, 22 bp, Artificial Sequence
  chemically synthesized
gccctactacttttattttcct

SEQ ID NO: 1341721 - DNA, 22 bp, Artificial Sequence
  chemically synthesized
ccctactacttttattttcctt

SEQ ID NO: 1341722 - DNA, 22 bp, Artificial Sequence
  chemically synthesized
gtgaaatataagtgctaaggaa

SEQ ID NO: 1341723 - DNA, 22 bp, Artificial Sequence
  chemically synthesized
ctacttttattttccttagcac

SEQ ID NO: 1341724 - DNA, 22 bp, Artificial Sequence
  chemically synthesized
cttttattttccttagcactta

SEQ ID NO: 1341725 - DNA, 22 bp, Artificial Sequence
  chemically synthesized
ttattttccttagcacttatat

SEQ ID NO: 1341726 - DNA, 22 bp, Artificial Sequence
  chemically synthesized
tgtgttagtgaaatataagtgc

SEQ ID NO: 1341727 - DNA, 22 bp, Artificial Sequence
  chemically synthesized
tattttccttagcacttatatt

SEQ ID NO: 1341728 - DNA, 22 bp, Artificial Sequence
  chemically synthesized
attttccttagcacttatattt

SEQ ID NO: 1341729 - DNA, 22 bp, Artificial Sequence
  chemically synthesized
ttttccttagcacttatatttc

SEQ ID NO: 1341730 - DNA, 22 bp, Artificial Sequence
  chemically synthesized
tgttgtgtgttagtgaaatata

SEQ ID NO: 1341731 - DNA, 22 bp, Artificial Sequence
  chemically synthesized
tccttagcacttatatttcact

SEQ ID NO: 1341732 - DNA, 22 bp, Artificial Sequence
  chemically synthesized
ccttagcacttatatttcacta

SEQ ID NO: 1341733 - DNA, 22 bp, Artificial Sequence
  chemically synthesized
cttagcacttatatttcactaa

SEQ ID NO: 1341734 - DNA, 22 bp, Artificial Sequence
  chemically synthesized
agcacttatatttcactaacac

SEQ ID NO: 1341735 - DNA, 22 bp, Artificial Sequence
  chemically synthesized
gcacttatatttcactaacaca

SEQ ID NO: 1341736 - DNA, 22 bp, Artificial Sequence
  chemically synthesized
ataagttatgttgtgtgttagt

SEQ ID NO: 1341737 - DNA, 22 bp, Artificial Sequence
  chemically synthesized
atatttcactaacacacaacat

SEQ ID NO: 1341738 - DNA, 22 bp, Artificial Sequence
  chemically synthesized
tatttcactaacacacaacata

SEQ ID NO: 1341739 - DNA, 22 bp, Artificial Sequence
  chemically synthesized
gtaggttaataagttatgttgt

SEQ ID NO: 1341740 - DNA, 22 bp, Artificial Sequence
  chemically synthesized
ggtaggttaataagttatgttg

SEQ ID NO: 1341741 - DNA, 22 bp, Artificial Sequence
  chemically synthesized
cactaacacacaacataactta

SEQ ID NO: 1341742 - DNA, 22 bp, Artificial Sequence
  chemically synthesized
actaacacacaacataacttat

SEQ ID NO: 1341743 - DNA, 22 bp, Artificial Sequence
  chemically synthesized
acacacaacataacttattaac

SEQ ID NO: 1341744 - DNA, 22 bp, Artificial Sequence
  chemically synthesized
ccacaatcaggacagtaatttg

SEQ ID NO: 1341745 - DNA, 22 bp, Artificial Sequence
  chemically synthesized
cccacaatcaggacagtaattt

SEQ ID NO: 1341746 - DNA, 22 bp, Artificial Sequence
  chemically synthesized
attaacctaccaaattactgtc

SEQ ID NO: 1341747 - DNA, 22 bp, Artificial Sequence
  chemically synthesized
ttaacctaccaaattactgtcc

SEQ ID NO: 1341748 - DNA, 22 bp, Artificial Sequence
  chemically synthesized
atttcccacaatcaggacagta

SEQ ID NO: 1341749 - DNA, 22 bp, Artificial Sequence
  chemically synthesized
acctaccaaattactgtcctga

SEQ ID NO: 1341750 - DNA, 22 bp, Artificial Sequence
  chemically synthesized
tgatttcccacaatcaggacag

SEQ ID NO: 1341751 - DNA, 22 bp, Artificial Sequence
  chemically synthesized
ccaaattactgtcctgattgtg

SEQ ID NO: 1341752 - DNA, 22 bp, Artificial Sequence
  chemically synthesized
ctgtcctgattgtgggaaatca

SEQ ID NO: 1341753 - DNA, 22 bp, Artificial Sequence
  chemically synthesized
tcctgattgtgggaaatcagag

SEQ ID NO: 1341754 - DNA, 22 bp, Artificial Sequence
  chemically synthesized
agggtaaaagccctctgatttc

SEQ ID NO: 1341755 - DNA, 22 bp, Artificial Sequence
  chemically synthesized
cagggtaaaagccctctgattt

SEQ ID NO: 1341756 - DNA, 22 bp, Artificial Sequence
  chemically synthesized
cttcagggtaaaagccctctga

SEQ ID NO: 1341757 - DNA, 22 bp, Artificial Sequence
  chemically synthesized
attgtgggaaatcagagggctt

SEQ ID NO: 1341758 - DNA, 22 bp, Artificial Sequence
  chemically synthesized
gcttcagggtaaaagccctctg

SEQ ID NO: 1341759 - DNA, 22 bp, Artificial Sequence
  chemically synthesized
tgggaaatcagagggcttttac

SEQ ID NO: 1341760 - DNA, 22 bp, Artificial Sequence
  chemically synthesized
tggtttgcttcagggtaaaagc

SEQ ID NO: 1341761 - DNA, 22 bp, Artificial Sequence
  chemically synthesized
ttgtggtttgcttcagggtaaa

SEQ ID NO: 1341762 - DNA, 22 bp, Artificial Sequence
  chemically synthesized
tgttgtggtttgcttcagggta

SEQ ID NO: 1341763 - DNA, 22 bp, Artificial Sequence
  chemically synthesized
tctgttgtggtttgcttcaggg

SEQ ID NO: 1341764 - DNA, 22 bp, Artificial Sequence
  chemically synthesized
ctctgttgtggtttgcttcagg

SEQ ID NO: 1341765 - DNA, 22 bp, Artificial Sequence
  chemically synthesized
tttctctgttgtggtttgcttc

SEQ ID NO: 1341766 - DNA, 22 bp, Artificial Sequence
  chemically synthesized
ttaccctgaagcaaaccacaac

SEQ ID NO: 1341767 - DNA, 22 bp, Artificial Sequence
  chemically synthesized
taccctgaagcaaaccacaaca

SEQ ID NO: 1341768 - DNA, 22 bp, Artificial Sequence
  chemically synthesized
accctgaagcaaaccacaacag

SEQ ID NO: 1341769 - DNA, 22 bp, Artificial Sequence
  chemically synthesized
ccctgaagcaaaccacaacaga

SEQ ID NO: 1341770 - DNA, 22 bp, Artificial Sequence
  chemically synthesized
aaaatagtctatttctctgttg

SEQ ID NO: 1341771 - DNA, 22 bp, Artificial Sequence
  chemically synthesized
caaaatagtctatttctctgtt

SEQ ID NO: 1341772 - DNA, 22 bp, Artificial Sequence
  chemically synthesized
aagcaaaccacaacagagaaat

SEQ ID NO: 1341773 - DNA, 22 bp, Artificial Sequence
  chemically synthesized
cttcaaaatagtctatttctct

SEQ ID NO: 1341774 - DNA, 22 bp, Artificial Sequence
  chemically synthesized
gcttcaaaatagtctatttctc

SEQ ID NO: 1341775 - DNA, 22 bp, Artificial Sequence
  chemically synthesized
tgcttcaaaatagtctatttct

SEQ ID NO: 1341776 - DNA, 22 bp, Artificial Sequence
  chemically synthesized
aacctttgcttcaaaatagtct

SEQ ID NO: 1341777 - DNA, 22 bp, Artificial Sequence
  chemically synthesized
ctaaacctttgcttcaaaatag

SEQ ID NO: 1341778 - DNA, 22 bp, Artificial Sequence
  chemically synthesized
tatgtgatctcctaaacctttg

SEQ ID NO: 1341779 - DNA, 22 bp, Artificial Sequence
  chemically synthesized
ttttgaagcaaaggtttaggag

SEQ ID NO: 1341780 - DNA, 22 bp, Artificial Sequence
  chemically synthesized
tgaagcaaaggtttaggagatc

SEQ ID NO: 1341781 - DNA, 22 bp, Artificial Sequence
  chemically synthesized
acagctatatgtgatctcctaa

SEQ ID NO: 1341782 - DNA, 22 bp, Artificial Sequence
  chemically synthesized
gaagcaaaggtttaggagatca

SEQ ID NO: 1341783 - DNA, 22 bp, Artificial Sequence
  chemically synthesized
aagcaaaggtttaggagatcac

SEQ ID NO: 1341784 - DNA, 22 bp, Artificial Sequence
  chemically synthesized
ttcacagctatatgtgatctcc

SEQ ID NO: 1341785 - DNA, 22 bp, Artificial Sequence
  chemically synthesized
gttcacagctatatgtgatctc

SEQ ID NO: 1341786 - DNA, 22 bp, Artificial Sequence
  chemically synthesized
tgttcacagctatatgtgatct

SEQ ID NO: 1341787 - DNA, 22 bp, Artificial Sequence
  chemically synthesized
atattttgttcacagctatatg

SEQ ID NO: 1341788 - DNA, 22 bp, Artificial Sequence
  chemically synthesized
aggagatcacatatagctgtga

SEQ ID NO: 1341789 - DNA, 22 bp, Artificial Sequence
  chemically synthesized
ggagatcacatatagctgtgaa

SEQ ID NO: 1341790 - DNA, 22 bp, Artificial Sequence
  chemically synthesized
aaatgttgatattttgttcaca

SEQ ID NO: 1341791 - DNA, 22 bp, Artificial Sequence
  chemically synthesized
aaaatgttgatattttgttcac

SEQ ID NO: 1341792 - DNA, 22 bp, Artificial Sequence
  chemically synthesized
taaaatgttgatattttgttca

SEQ ID NO: 1341793 - DNA, 22 bp, Artificial Sequence
  chemically synthesized
gtatatagttttaaaatgttga

SEQ ID NO: 1341794 - DNA, 22 bp, Artificial Sequence
  chemically synthesized
tgaacaaaatatcaacatttta

SEQ ID NO: 1341795 - DNA, 22 bp, Artificial Sequence
  chemically synthesized
atagtctggtatatagttttaa

SEQ ID NO: 1341796 - DNA, 22 bp, Artificial Sequence
  chemically synthesized
aatagtctggtatatagtttta

SEQ ID NO: 1341797 - DNA, 22 bp, Artificial Sequence
  chemically synthesized
ttaatagtctggtatatagttt

SEQ ID NO: 1341798 - DNA, 22 bp, Artificial Sequence
  chemically synthesized
cttaatagtctggtatatagtt

SEQ ID NO: 1341799 - DNA, 22 bp, Artificial Sequence
  chemically synthesized
ttcttaatagtctggtatatag

SEQ ID NO: 1341800 - DNA, 22 bp, Artificial Sequence
  chemically synthesized
agttcttcttaatagtctggta

SEQ ID NO: 1341801 - DNA, 22 bp, Artificial Sequence
  chemically synthesized
gagttcttcttaatagtctggt

SEQ ID NO: 1341802 - DNA, 22 bp, Artificial Sequence
  chemically synthesized
taaaactatataccagactatt

SEQ ID NO: 1341803 - DNA, 22 bp, Artificial Sequence
  chemically synthesized
aaaactatataccagactatta

SEQ ID NO: 1341804 - DNA, 22 bp, Artificial Sequence
  chemically synthesized
aaactatataccagactattaa

SEQ ID NO: 1341805 - DNA, 22 bp, Artificial Sequence
  chemically synthesized
aaaaccttgagttcttcttaat

SEQ ID NO: 1341806 - DNA, 22 bp, Artificial Sequence
  chemically synthesized
tataccagactattaagaagaa

SEQ ID NO: 1341807 - DNA, 22 bp, Artificial Sequence
  chemically synthesized
ttgaaaaccttgagttcttctt

SEQ ID NO: 1341808 - DNA, 22 bp, Artificial Sequence
  chemically synthesized
gttgaaaaccttgagttcttct

SEQ ID NO: 1341809 - DNA, 22 bp, Artificial Sequence
  chemically synthesized
cccttgttgaaaaccttgagtt

SEQ ID NO: 1341810 - DNA, 22 bp, Artificial Sequence
  chemically synthesized
ttaagaagaactcaaggttttc

SEQ ID NO: 1341811 - DNA, 22 bp, Artificial Sequence
  chemically synthesized
tcactgcccttgttgaaaacct

SEQ ID NO: 1341812 - DNA, 22 bp, Artificial Sequence
  chemically synthesized
agaagaactcaaggttttcaac

SEQ ID NO: 1341813 - DNA, 22 bp, Artificial Sequence
  chemically synthesized
atcactgcccttgttgaaaacc

SEQ ID NO: 1341814 - DNA, 22 bp, Artificial Sequence
  chemically synthesized
cttatcactgcccttgttgaaa

SEQ ID NO: 1341815 - DNA, 22 bp, Artificial Sequence
  chemically synthesized
tccttatcactgcccttgttga

SEQ ID NO: 1341816 - DNA, 22 bp, Artificial Sequence
  chemically synthesized
aaggttttcaacaagggcagtg

SEQ ID NO: 1341817 - DNA, 22 bp, Artificial Sequence
  chemically synthesized
acctctccttatcactgccctt

SEQ ID NO: 1341818 - DNA, 22 bp, Artificial Sequence
  chemically synthesized
tcaacaagggcagtgataagga

SEQ ID NO: 1341819 - DNA, 22 bp, Artificial Sequence
  chemically synthesized
caacaagggcagtgataaggag

SEQ ID NO: 1341820 - DNA, 22 bp, Artificial Sequence
  chemically synthesized
aacaagggcagtgataaggaga

SEQ ID NO: 1341821 - DNA, 22 bp, Artificial Sequence
  chemically synthesized
catgccagagggcagcataaca

SEQ ID NO: 1341822 - DNA, 22 bp, Artificial Sequence
  chemically synthesized
aactccatgccagagggcagca

SEQ ID NO: 1341823 - DNA, 22 bp, Artificial Sequence
  chemically synthesized
gaactccatgccagagggcagc

SEQ ID NO: 1341824 - DNA, 22 bp, Artificial Sequence
  chemically synthesized
tgctatgttatgctgccctctg

SEQ ID NO: 1341825 - DNA, 22 bp, Artificial Sequence
  chemically synthesized
gctatgttatgctgccctctgg

SEQ ID NO: 1341826 - DNA, 22 bp, Artificial Sequence
  chemically synthesized
ctatgttatgctgccctctggc

SEQ ID NO: 1341827 - DNA, 22 bp, Artificial Sequence
  chemically synthesized
tttgaactccatgccagagggc

SEQ ID NO: 1341828 - DNA, 22 bp, Artificial Sequence
  chemically synthesized
tgttatgctgccctctggcatg

SEQ ID NO: 1341829 - DNA, 22 bp, Artificial Sequence
  chemically synthesized
gcctatttgaactccatgccag

SEQ ID NO: 1341830 - DNA, 22 bp, Artificial Sequence
  chemically synthesized
ggcctatttgaactccatgcca

SEQ ID NO: 1341831 - DNA, 22 bp, Artificial Sequence
  chemically synthesized
tgctgccctctggcatggagtt

SEQ ID NO: 1341832 - DNA, 22 bp, Artificial Sequence
  chemically synthesized
tcttggcctatttgaactccat

SEQ ID NO: 1341833 - DNA, 22 bp, Artificial Sequence
  chemically synthesized
atcttggcctatttgaactcca

SEQ ID NO: 1341834 - DNA, 22 bp, Artificial Sequence
  chemically synthesized
tatcttggcctatttgaactcc

SEQ ID NO: 1341835 - DNA, 22 bp, Artificial Sequence
  chemically synthesized
ccctctggcatggagttcaaat

SEQ ID NO: 1341836 - DNA, 22 bp, Artificial Sequence
  chemically synthesized
tggcatggagttcaaataggcc

SEQ ID NO: 1341837 - DNA, 22 bp, Artificial Sequence
  chemically synthesized
gcatggagttcaaataggccaa

SEQ ID NO: 1341838 - DNA, 22 bp, Artificial Sequence
  chemically synthesized
aaataggccaagataaagccct

SEQ ID NO: 1341839 - DNA, 22 bp, Artificial Sequence
  chemically synthesized
aaaaatacatgaacagggcttt

SEQ ID NO: 1341840 - DNA, 22 bp, Artificial Sequence
  chemically synthesized
tccattcaaaaatacatgaaca

SEQ ID NO: 1341841 - DNA, 22 bp, Artificial Sequence
  chemically synthesized
atccattcaaaaatacatgaac

SEQ ID NO: 1341842 - DNA, 22 bp, Artificial Sequence
  chemically synthesized
tttatccattcaaaaatacatg

SEQ ID NO: 1341843 - DNA, 22 bp, Artificial Sequence
  chemically synthesized
gtttatccattcaaaaatacat

SEQ ID NO: 1341844 - DNA, 22 bp, Artificial Sequence
  chemically synthesized
tgtttatccattcaaaaataca

SEQ ID NO: 1341845 - DNA, 22 bp, Artificial Sequence
  chemically synthesized
ttcatgtatttttgaatggata

SEQ ID NO: 1341846 - DNA, 22 bp, Artificial Sequence
  chemically synthesized
gagggactttgtttatccattc

SEQ ID NO: 1341847 - DNA, 22 bp, Artificial Sequence
  chemically synthesized
atgtatttttgaatggataaac

SEQ ID NO: 1341848 - DNA, 22 bp, Artificial Sequence
  chemically synthesized
atctagagggactttgtttatc

SEQ ID NO: 1341849 - DNA, 22 bp, Artificial Sequence
  chemically synthesized
ttgaatggataaacaaagtccc

SEQ ID NO: 1341850 - DNA, 22 bp, Artificial Sequence
  chemically synthesized
tactcatctagagggactttgt

SEQ ID NO: 1341851 - DNA, 22 bp, Artificial Sequence
  chemically synthesized
tgaatggataaacaaagtccct

SEQ ID NO: 1341852 - DNA, 22 bp, Artificial Sequence
  chemically synthesized
gaatggataaacaaagtccctc

SEQ ID NO: 1341853 - DNA, 22 bp, Artificial Sequence
  chemically synthesized
aatggataaacaaagtccctct

SEQ ID NO: 1341854 - DNA, 22 bp, Artificial Sequence
  chemically synthesized
aaaatcaaacgctgtactcatc

SEQ ID NO: 1341855 - DNA, 22 bp, Artificial Sequence
  chemically synthesized
tagatgagtacagcgtttgatt

SEQ ID NO: 1341856 - DNA, 22 bp, Artificial Sequence
  chemically synthesized
gatgagtacagcgtttgatttt

SEQ ID NO: 1341857 - DNA, 22 bp, Artificial Sequence
  chemically synthesized
aaatagtgtagttaaaaatcaa

SEQ ID NO: 1341858 - DNA, 22 bp, Artificial Sequence
  chemically synthesized
cctgaaatagtgtagttaaaaa

SEQ ID NO: 1341859 - DNA, 22 bp, Artificial Sequence
  chemically synthesized
ggttacctgaaatagtgtagtt

SEQ ID NO: 1341860 - DNA, 22 bp, Artificial Sequence
  chemically synthesized
gggttacctgaaatagtgtagt

SEQ ID NO: 1341861 - DNA, 22 bp, Artificial Sequence
  chemically synthesized
tgggttacctgaaatagtgtag

SEQ ID NO: 1341862 - DNA, 22 bp, Artificial Sequence
  chemically synthesized
gatttttaactacactatttca

SEQ ID NO: 1341863 - DNA, 22 bp, Artificial Sequence
  chemically synthesized
atttttaactacactatttcag

SEQ ID NO: 1341864 - DNA, 22 bp, Artificial Sequence
  chemically synthesized
ttaactacactatttcaggtaa

SEQ ID NO: 1341865 - DNA, 22 bp, Artificial Sequence
  chemically synthesized
taactacactatttcaggtaac

SEQ ID NO: 1341866 - DNA, 22 bp, Artificial Sequence
  chemically synthesized
aactacactatttcaggtaacc

SEQ ID NO: 1341867 - DNA, 22 bp, Artificial Sequence
  chemically synthesized
actacactatttcaggtaaccc

SEQ ID NO: 1341868 - DNA, 22 bp, Artificial Sequence
  chemically synthesized
cactatttcaggtaacccaaag

SEQ ID NO: 1341869 - DNA, 22 bp, Artificial Sequence
  chemically synthesized
agacaagaaaagctttgggtta

SEQ ID NO: 1341870 - DNA, 22 bp, Artificial Sequence
  chemically synthesized
cagacaagaaaagctttgggtt

SEQ ID NO: 1341871 - DNA, 22 bp, Artificial Sequence
  chemically synthesized
tttcaggtaacccaaagctttt

SEQ ID NO: 1341872 - DNA, 22 bp, Artificial Sequence
  chemically synthesized
caggtaacccaaagcttttctt

SEQ ID NO: 1341873 - DNA, 22 bp, Artificial Sequence
  chemically synthesized
tatgtttcagacaagaaaagct

SEQ ID NO: 1341874 - DNA, 22 bp, Artificial Sequence
  chemically synthesized
aggtaacccaaagcttttcttg

SEQ ID NO: 1341875 - DNA, 22 bp, Artificial Sequence
  chemically synthesized
atatgtttcagacaagaaaagc

SEQ ID NO: 1341876 - DNA, 22 bp, Artificial Sequence
  chemically synthesized
tcataacttatatgtttcagac

SEQ ID NO: 1341877 - DNA, 22 bp, Artificial Sequence
  chemically synthesized
ttcttgtctgaaacatataagt

SEQ ID NO: 1341878 - DNA, 22 bp, Artificial Sequence
  chemically synthesized
tcttgtctgaaacatataagtt

SEQ ID NO: 1341879 - DNA, 22 bp, Artificial Sequence
  chemically synthesized
cttgtctgaaacatataagtta

SEQ ID NO: 1341880 - DNA, 22 bp, Artificial Sequence
  chemically synthesized
ttgtctgaaacatataagttat

SEQ ID NO: 1341881 - DNA, 22 bp, Artificial Sequence
  chemically synthesized
cagagacctgtcataacttata

SEQ ID NO: 1341882 - DNA, 22 bp, Artificial Sequence
  chemically synthesized
gtctgaaacatataagttatga

SEQ ID NO: 1341883 - DNA, 22 bp, Artificial Sequence
  chemically synthesized
tctgaaacatataagttatgac

SEQ ID NO: 1341884 - DNA, 22 bp, Artificial Sequence
  chemically synthesized
ttccagagacctgtcataactt

SEQ ID NO: 1341885 - DNA, 22 bp, Artificial Sequence
  chemically synthesized
gttccagagacctgtcataact

SEQ ID NO: 1341886 - DNA, 22 bp, Artificial Sequence
  chemically synthesized
aaacatataagttatgacaggt

SEQ ID NO: 1341887 - DNA, 22 bp, Artificial Sequence
  chemically synthesized
gatataacttgttccagagacc

SEQ ID NO: 1341888 - DNA, 22 bp, Artificial Sequence
  chemically synthesized
agatataacttgttccagagac

SEQ ID NO: 1341889 - DNA, 22 bp, Artificial Sequence
  chemically synthesized
tgacaggtctctggaacaagtt

SEQ ID NO: 1341890 - DNA, 22 bp, Artificial Sequence
  chemically synthesized
gcatttagatataacttgttcc

SEQ ID NO: 1341891 - DNA, 22 bp, Artificial Sequence
  chemically synthesized
tggcatttagatataacttgtt

SEQ ID NO: 1341892 - DNA, 22 bp, Artificial Sequence
  chemically synthesized
actctggcatttagatataact

SEQ ID NO: 1341893 - DNA, 22 bp, Artificial Sequence
  chemically synthesized
cctgactctggcatttagatat

SEQ ID NO: 1341894 - DNA, 22 bp, Artificial Sequence
  chemically synthesized
tggaacaagttatatctaaatg

SEQ ID NO: 1341895 - DNA, 22 bp, Artificial Sequence
  chemically synthesized
gaacaagttatatctaaatgcc

SEQ ID NO: 1341896 - DNA, 22 bp, Artificial Sequence
  chemically synthesized
tactacctgactctggcattta

SEQ ID NO: 1341897 - DNA, 22 bp, Artificial Sequence
  chemically synthesized
atactacctgactctggcattt

SEQ ID NO: 1341898 - DNA, 22 bp, Artificial Sequence
  chemically synthesized
ccttatactacctgactctggc

SEQ ID NO: 1341899 - DNA, 22 bp, Artificial Sequence
  chemically synthesized
gccttatactacctgactctgg

SEQ ID NO: 1341900 - DNA, 22 bp, Artificial Sequence
  chemically synthesized
tgccttatactacctgactctg

SEQ ID NO: 1341901 - DNA, 22 bp, Artificial Sequence
  chemically synthesized
tatctaaatgccagagtcaggt

SEQ ID NO: 1341902 - DNA, 22 bp, Artificial Sequence
  chemically synthesized
ttgccttatactacctgactct

SEQ ID NO: 1341903 - DNA, 22 bp, Artificial Sequence
  chemically synthesized
tttgccttatactacctgactc

SEQ ID NO: 1341904 - DNA, 22 bp, Artificial Sequence
  chemically synthesized
aatgccagagtcaggtagtata

SEQ ID NO: 1341905 - DNA, 22 bp, Artificial Sequence
  chemically synthesized
tatactttttgccttatactac

SEQ ID NO: 1341906 - DNA, 22 bp, Artificial Sequence
  chemically synthesized
gtgacacaagtaaaaatggatt

SEQ ID NO: 1341907 - DNA, 22 bp, Artificial Sequence
  chemically synthesized
ggtgacacaagtaaaaatggat

SEQ ID NO: 1341908 - DNA, 22 bp, Artificial Sequence
  chemically synthesized
aaatgtaagagatgtttggtga

SEQ ID NO: 1341909 - DNA, 22 bp, Artificial Sequence
  chemically synthesized
ttacttgtgtcaccaaacatct

SEQ ID NO: 1341910 - DNA, 22 bp, Artificial Sequence
  chemically synthesized
tacttgtgtcaccaaacatctc

SEQ ID NO: 1341911 - DNA, 22 bp, Artificial Sequence
  chemically synthesized
acttgtgtcaccaaacatctct

SEQ ID NO: 1341912 - DNA, 22 bp, Artificial Sequence
  chemically synthesized
cttgtgtcaccaaacatctctt

SEQ ID NO: 1341913 - DNA, 22 bp, Artificial Sequence
  chemically synthesized
gtgtcaccaaacatctcttaca

SEQ ID NO: 1341914 - DNA, 22 bp, Artificial Sequence
  chemically synthesized
tgtcaccaaacatctcttacat

SEQ ID NO: 1341915 - DNA, 22 bp, Artificial Sequence
  chemically synthesized
gtgaaaagtcagcagctaaaat

SEQ ID NO: 1341916 - DNA, 22 bp, Artificial Sequence
  chemically synthesized
ttacattttagctgctgacttt

SEQ ID NO: 1341917 - DNA, 22 bp, Artificial Sequence
  chemically synthesized
atacattagtgaaaagtcagca

SEQ ID NO: 1341918 - DNA, 22 bp, Artificial Sequence
  chemically synthesized
acattttagctgctgacttttc

SEQ ID NO: 1341919 - DNA, 22 bp, Artificial Sequence
  chemically synthesized
cattttagctgctgacttttca

SEQ ID NO: 1341920 - DNA, 22 bp, Artificial Sequence
  chemically synthesized
tattaatacattagtgaaaagt

SEQ ID NO: 1341921 - DNA, 22 bp, Artificial Sequence
  chemically synthesized
tgtattaatacattagtgaaaa

SEQ ID NO: 1341922 - DNA, 22 bp, Artificial Sequence
  chemically synthesized
tagctgctgacttttcactaat

SEQ ID NO: 1341923 - DNA, 22 bp, Artificial Sequence
  chemically synthesized
agctgctgacttttcactaatg

SEQ ID NO: 1341924 - DNA, 22 bp, Artificial Sequence
  chemically synthesized
gctgctgacttttcactaatgt

SEQ ID NO: 1341925 - DNA, 22 bp, Artificial Sequence
  chemically synthesized
ctgacttttcactaatgtatta

SEQ ID NO: 1341926 - DNA, 22 bp, Artificial Sequence
  chemically synthesized
acttttcactaatgtattaata

SEQ ID NO: 1341927 - DNA, 22 bp, Artificial Sequence
  chemically synthesized
ttcactaatgtattaatacaga

SEQ ID NO: 1341928 - DNA, 22 bp, Artificial Sequence
  chemically synthesized
tcactaatgtattaatacagaa

SEQ ID NO: 1341929 - DNA, 22 bp, Artificial Sequence
  chemically synthesized
cactaatgtattaatacagaat

SEQ ID NO: 1341930 - DNA, 22 bp, Artificial Sequence
  chemically synthesized
actaatgtattaatacagaata

SEQ ID NO: 1341931 - DNA, 22 bp, Artificial Sequence
  chemically synthesized
atgtattaatacagaatattat

SEQ ID NO: 1341932 - DNA, 22 bp, Artificial Sequence
  chemically synthesized
aagaaaagcagaaataatattc

SEQ ID NO: 1341933 - DNA, 22 bp, Artificial Sequence
  chemically synthesized
aattgaagaaaagcagaaataa

SEQ ID NO: 1341934 - DNA, 22 bp, Artificial Sequence
  chemically synthesized
atacagaatattatttctgctt

SEQ ID NO: 1341935 - DNA, 22 bp, Artificial Sequence
  chemically synthesized
gttaaattgaagaaaagcagaa

SEQ ID NO: 1341936 - DNA, 22 bp, Artificial Sequence
  chemically synthesized
agttaaattgaagaaaagcaga

SEQ ID NO: 1341937 - DNA, 22 bp, Artificial Sequence
  chemically synthesized
tagttaaattgaagaaaagcag

SEQ ID NO: 1341938 - DNA, 22 bp, Artificial Sequence
  chemically synthesized
tttagttaaattgaagaaaagc

SEQ ID NO: 1341939 - DNA, 22 bp, Artificial Sequence
  chemically synthesized
agttctttagttaaattgaaga

SEQ ID NO: 1341940 - DNA, 22 bp, Artificial Sequence
  chemically synthesized
tttctgcttttcttcaatttaa

SEQ ID NO: 1341941 - DNA, 22 bp, Artificial Sequence
  chemically synthesized
ctgcttttcttcaatttaacta

SEQ ID NO: 1341942 - DNA, 22 bp, Artificial Sequence
  chemically synthesized
tgcttttcttcaatttaactaa

SEQ ID NO: 1341943 - DNA, 22 bp, Artificial Sequence
  chemically synthesized
cttttcttcaatttaactaaag

SEQ ID NO: 1341944 - DNA, 22 bp, Artificial Sequence
  chemically synthesized
ttcttcaatttaactaaagaac

SEQ ID NO: 1341945 - DNA, 22 bp, Artificial Sequence
  chemically synthesized
tcttcaatttaactaaagaact

SEQ ID NO: 1341946 - DNA, 22 bp, Artificial Sequence
  chemically synthesized
cttcaatttaactaaagaactg

SEQ ID NO: 1341947 - DNA, 22 bp, Artificial Sequence
  chemically synthesized
aatgtaagtattcagttcttta

SEQ ID NO: 1341948 - DNA, 22 bp, Artificial Sequence
  chemically synthesized
ttcaatttaactaaagaactga

SEQ ID NO: 1341949 - DNA, 22 bp, Artificial Sequence
  chemically synthesized
caatttaactaaagaactgaat

SEQ ID NO: 1341950 - DNA, 22 bp, Artificial Sequence
  chemically synthesized
aatttaactaaagaactgaata

SEQ ID NO: 1341951 - DNA, 22 bp, Artificial Sequence
  chemically synthesized
atactaaatgtaagtattcagt

SEQ ID NO: 1341952 - DNA, 22 bp, Artificial Sequence
  chemically synthesized
gatactaaatgtaagtattcag

SEQ ID NO: 1341953 - DNA, 22 bp, Artificial Sequence
  chemically synthesized
aactaaagaactgaatacttac

SEQ ID NO: 1341954 - DNA, 22 bp, Artificial Sequence
  chemically synthesized
actaaagaactgaatacttaca

SEQ ID NO: 1341955 - DNA, 22 bp, Artificial Sequence
  chemically synthesized
aagaactgaatacttacattta

SEQ ID NO: 1341956 - DNA, 22 bp, Artificial Sequence
  chemically synthesized
tagaaatttgatactaaatgta

SEQ ID NO: 1341957 - DNA, 22 bp, Artificial Sequence
  chemically synthesized
aatacttacatttagtatcaaa

SEQ ID NO: 1341958 - DNA, 22 bp, Artificial Sequence
  chemically synthesized
acatttagtatcaaatttctat

SEQ ID NO: 1341959 - DNA, 22 bp, Artificial Sequence
  chemically synthesized
catttagtatcaaatttctata

SEQ ID NO: 1341960 - DNA, 22 bp, Artificial Sequence
  chemically synthesized
aaagaagacacattatagaaat

SEQ ID NO: 1341961 - DNA, 22 bp, Artificial Sequence
  chemically synthesized
aaaagaagacacattatagaaa

SEQ ID NO: 1341962 - DNA, 22 bp, Artificial Sequence
  chemically synthesized
taaaagaagacacattatagaa

SEQ ID NO: 1341963 - DNA, 22 bp, Artificial Sequence
  chemically synthesized
ttaaaagaagacacattataga

SEQ ID NO: 1341964 - DNA, 22 bp, Artificial Sequence
  chemically synthesized
agtatcaaatttctataatgtg

SEQ ID NO: 1341965 - DNA, 22 bp, Artificial Sequence
  chemically synthesized
gtatcaaatttctataatgtgt

SEQ ID NO: 1341966 - DNA, 22 bp, Artificial Sequence
  chemically synthesized
tatttttaaaagaagacacatt

SEQ ID NO: 1341967 - DNA, 22 bp, Artificial Sequence
  chemically synthesized
gtatttttaaaagaagacacat

SEQ ID NO: 1341968 - DNA, 22 bp, Artificial Sequence
  chemically synthesized
tgtatttttaaaagaagacaca

SEQ ID NO: 1341969 - DNA, 22 bp, Artificial Sequence
  chemically synthesized
cctttgtatttttaaaagaaga

SEQ ID NO: 1341970 - DNA, 22 bp, Artificial Sequence
  chemically synthesized
ctataatgtgtcttcttttaaa

SEQ ID NO: 1341971 - DNA, 22 bp, Artificial Sequence
  chemically synthesized
tataatgtgtcttcttttaaaa

SEQ ID NO: 1341972 - DNA, 22 bp, Artificial Sequence
  chemically synthesized
taatgtgtcttcttttaaaaat

SEQ ID NO: 1341973 - DNA, 22 bp, Artificial Sequence
  chemically synthesized
aattacctttgtatttttaaaa

SEQ ID NO: 1341974 - DNA, 22 bp, Artificial Sequence
  chemically synthesized
caattacctttgtatttttaaa

SEQ ID NO: 1341975 - DNA, 22 bp, Artificial Sequence
  chemically synthesized
tcaattacctttgtatttttaa

SEQ ID NO: 1341976 - DNA, 22 bp, Artificial Sequence
  chemically synthesized
atattttcaattacctttgtat

SEQ ID NO: 1341977 - DNA, 22 bp, Artificial Sequence
  chemically synthesized
cttttaaaaatacaaaggtaat

SEQ ID NO: 1341978 - DNA, 22 bp, Artificial Sequence
  chemically synthesized
ttttaaaaatacaaaggtaatt

SEQ ID NO: 1341979 - DNA, 22 bp, Artificial Sequence
  chemically synthesized
attgatattttcaattaccttt

SEQ ID NO: 1341980 - DNA, 22 bp, Artificial Sequence
  chemically synthesized
aattgatattttcaattacctt

SEQ ID NO: 1341981 - DNA, 22 bp, Artificial Sequence
  chemically synthesized
ttaaaaatacaaaggtaattga

SEQ ID NO: 1341982 - DNA, 22 bp, Artificial Sequence
  chemically synthesized
taaaaatacaaaggtaattgaa

SEQ ID NO: 1341983 - DNA, 22 bp, Artificial Sequence
  chemically synthesized
aaaaatacaaaggtaattgaaa

SEQ ID NO: 1341984 - DNA, 22 bp, Artificial Sequence
  chemically synthesized
aaaatacaaaggtaattgaaaa

SEQ ID NO: 1341985 - DNA, 22 bp, Artificial Sequence
  chemically synthesized
agatttaattgatattttcaat

SEQ ID NO: 1341986 - DNA, 22 bp, Artificial Sequence
  chemically synthesized
ttcagatttaattgatattttc

SEQ ID NO: 1341987 - DNA, 22 bp, Artificial Sequence
  chemically synthesized
gtcactattcagatttaattga

SEQ ID NO: 1341988 - DNA, 22 bp, Artificial Sequence
  chemically synthesized
aaaatatcaattaaatctgaat

SEQ ID NO: 1341989 - DNA, 22 bp, Artificial Sequence
  chemically synthesized
aataaaatctagtcactattca

SEQ ID NO: 1341990 - DNA, 22 bp, Artificial Sequence
  chemically synthesized
atatctaaataaaatctagtca

SEQ ID NO: 1341991 - DNA, 22 bp, Artificial Sequence
  chemically synthesized
aatctgaatagtgactagattt

SEQ ID NO: 1341992 - DNA, 22 bp, Artificial Sequence
  chemically synthesized
tcatatctaaataaaatctagt

SEQ ID NO: 1341993 - DNA, 22 bp, Artificial Sequence
  chemically synthesized
aatagtgactagattttattta

SEQ ID NO: 1341994 - DNA, 22 bp, Artificial Sequence
  chemically synthesized
tgtatctctcatatctaaataa

SEQ ID NO: 1341995 - DNA, 22 bp, Artificial Sequence
  chemically synthesized
atgtatctctcatatctaaata

SEQ ID NO: 1341996 - DNA, 22 bp, Artificial Sequence
  chemically synthesized
gattttatttagatatgagaga

SEQ ID NO: 1341997 - DNA, 22 bp, Artificial Sequence
  chemically synthesized
tatttagatatgagagatacat

SEQ ID NO: 1341998 - DNA, 22 bp, Artificial Sequence
  chemically synthesized
atttagatatgagagatacata

SEQ ID NO: 1341999 - DNA, 22 bp, Artificial Sequence
  chemically synthesized
tttagatatgagagatacataa

SEQ ID NO: 1342000 - DNA, 22 bp, Artificial Sequence
  chemically synthesized
tatccatagtatttatgtatct

SEQ ID NO: 1342001 - DNA, 22 bp, Artificial Sequence
  chemically synthesized
gtatccatagtatttatgtatc

SEQ ID NO: 1342002 - DNA, 22 bp, Artificial Sequence
  chemically synthesized
agatatgagagatacataaata

SEQ ID NO: 1342003 - DNA, 22 bp, Artificial Sequence
  chemically synthesized
gatatgagagatacataaatac

SEQ ID NO: 1342004 - DNA, 22 bp, Artificial Sequence
  chemically synthesized
aaggcagagaccatgatttgta

SEQ ID NO: 1342005 - DNA, 22 bp, Artificial Sequence
  chemically synthesized
cctgaaggcagagaccatgatt

SEQ ID NO: 1342006 - DNA, 22 bp, Artificial Sequence
  chemically synthesized
tggatacaaatcatggtctctg

SEQ ID NO: 1342007 - DNA, 22 bp, Artificial Sequence
  chemically synthesized
acagggccatcagctgcctgaa

SEQ ID NO: 1342008 - DNA, 22 bp, Artificial Sequence
  chemically synthesized
tgccttcaggcagctgatggcc

SEQ ID NO: 1342009 - DNA, 22 bp, Artificial Sequence
  chemically synthesized
ccttcaggcagctgatggccct

SEQ ID NO: 1342010 - DNA, 22 bp, Artificial Sequence
  chemically synthesized
acatacaagttcacagggccat

SEQ ID NO: 1342011 - DNA, 22 bp, Artificial Sequence
  chemically synthesized
cacatacaagttcacagggcca

SEQ ID NO: 1342012 - DNA, 22 bp, Artificial Sequence
  chemically synthesized
caggcagctgatggccctgtga

SEQ ID NO: 1342013 - DNA, 22 bp, Artificial Sequence
  chemically synthesized
aggcagctgatggccctgtgaa

SEQ ID NO: 1342014 - DNA, 22 bp, Artificial Sequence
  chemically synthesized
atggccctgtgaacttgtatgt

SEQ ID NO: 1342015 - DNA, 22 bp, Artificial Sequence
  chemically synthesized
accccagacaggcttcacatac

SEQ ID NO: 1342016 - DNA, 22 bp, Artificial Sequence
  chemically synthesized
gaccccagacaggcttcacata

SEQ ID NO: 1342017 - DNA, 22 bp, Artificial Sequence
  chemically synthesized
tgaacttgtatgtgaagcctgt

SEQ ID NO: 1342018 - DNA, 22 bp, Artificial Sequence
  chemically synthesized
gaatttgaccccagacaggctt

SEQ ID NO: 1342019 - DNA, 22 bp, Artificial Sequence
  chemically synthesized
gtatgtgaagcctgtctggggt

SEQ ID NO: 1342020 - DNA, 22 bp, Artificial Sequence
  chemically synthesized
tatgtgaagcctgtctggggtc

SEQ ID NO: 1342021 - DNA, 22 bp, Artificial Sequence
  chemically synthesized
tctggggtcaaattctagctct

SEQ ID NO: 1342022 - DNA, 22 bp, Artificial Sequence
  chemically synthesized
caagtaagtggcagagctagaa

SEQ ID NO: 1342023 - DNA, 22 bp, Artificial Sequence
  chemically synthesized
gggtcaaattctagctctgcca

SEQ ID NO: 1342024 - DNA, 22 bp, Artificial Sequence
  chemically synthesized
agactacaagtaagtggcagag

SEQ ID NO: 1342025 - DNA, 22 bp, Artificial Sequence
  chemically synthesized
cctaagactacaagtaagtggc

SEQ ID NO: 1342026 - DNA, 22 bp, Artificial Sequence
  chemically synthesized
acctaagactacaagtaagtgg

SEQ ID NO: 1342027 - DNA, 22 bp, Artificial Sequence
  chemically synthesized
tagctctgccacttacttgtag

SEQ ID NO: 1342028 - DNA, 22 bp, Artificial Sequence
  chemically synthesized
gctctgccacttacttgtagtc

SEQ ID NO: 1342029 - DNA, 22 bp, Artificial Sequence
  chemically synthesized
agtaacttacctaagactacaa

SEQ ID NO: 1342030 - DNA, 22 bp, Artificial Sequence
  chemically synthesized
tgccacttacttgtagtcttag

SEQ ID NO: 1342031 - DNA, 22 bp, Artificial Sequence
  chemically synthesized
ccacttacttgtagtcttaggt

SEQ ID NO: 1342032 - DNA, 22 bp, Artificial Sequence
  chemically synthesized
acttgtagtcttaggtaagtta

SEQ ID NO: 1342033 - DNA, 22 bp, Artificial Sequence
  chemically synthesized
cttgtagtcttaggtaagttac

SEQ ID NO: 1342034 - DNA, 22 bp, Artificial Sequence
  chemically synthesized
gtagtcttaggtaagttactca

SEQ ID NO: 1342035 - DNA, 22 bp, Artificial Sequence
  chemically synthesized
tagtcttaggtaagttactcaa

SEQ ID NO: 1342036 - DNA, 22 bp, Artificial Sequence
  chemically synthesized
gagatcagaaaaaattgagtaa

SEQ ID NO: 1342037 - DNA, 22 bp, Artificial Sequence
  chemically synthesized
aggtaagttactcaattttttc

SEQ ID NO: 1342038 - DNA, 22 bp, Artificial Sequence
  chemically synthesized
ggtaagttactcaattttttct

SEQ ID NO: 1342039 - DNA, 22 bp, Artificial Sequence
  chemically synthesized
ctcaattttttctgatctccaa

SEQ ID NO: 1342040 - DNA, 22 bp, Artificial Sequence
  chemically synthesized
taggcaatgaaattggagatca

SEQ ID NO: 1342041 - DNA, 22 bp, Artificial Sequence
  chemically synthesized
ataggcaatgaaattggagatc

SEQ ID NO: 1342042 - DNA, 22 bp, Artificial Sequence
  chemically synthesized
tataggcaatgaaattggagat

SEQ ID NO: 1342043 - DNA, 22 bp, Artificial Sequence
  chemically synthesized
aattttttctgatctccaattt

SEQ ID NO: 1342044 - DNA, 22 bp, Artificial Sequence
  chemically synthesized
ttataggcaatgaaattggaga

SEQ ID NO: 1342045 - DNA, 22 bp, Artificial Sequence
  chemically synthesized
ttttataggcaatgaaattgga

SEQ ID NO: 1342046 - DNA, 22 bp, Artificial Sequence
  chemically synthesized
tcttttataggcaatgaaattg

SEQ ID NO: 1342047 - DNA, 22 bp, Artificial Sequence
  chemically synthesized
tttctgatctccaatttcattg

SEQ ID NO: 1342048 - DNA, 22 bp, Artificial Sequence
  chemically synthesized
ttctgatctccaatttcattgc

SEQ ID NO: 1342049 - DNA, 22 bp, Artificial Sequence
  chemically synthesized
tctgatctccaatttcattgcc

SEQ ID NO: 1342050 - DNA, 22 bp, Artificial Sequence
  chemically synthesized
ctgatctccaatttcattgcct

SEQ ID NO: 1342051 - DNA, 22 bp, Artificial Sequence
  chemically synthesized
tgatctccaatttcattgccta

SEQ ID NO: 1342052 - DNA, 22 bp, Artificial Sequence
  chemically synthesized
atctccaatttcattgcctata

SEQ ID NO: 1342053 - DNA, 22 bp, Artificial Sequence
  chemically synthesized
caatttcattgcctataaaaga

SEQ ID NO: 1342054 - DNA, 22 bp, Artificial Sequence
  chemically synthesized
gcatatacaccaattctctttt

SEQ ID NO: 1342055 - DNA, 22 bp, Artificial Sequence
  chemically synthesized
cattgcctataaaagagaattg

SEQ ID NO: 1342056 - DNA, 22 bp, Artificial Sequence
  chemically synthesized
attgcctataaaagagaattgg

SEQ ID NO: 1342057 - DNA, 22 bp, Artificial Sequence
  chemically synthesized
cctataaaagagaattggtgta

SEQ ID NO: 1342058 - DNA, 22 bp, Artificial Sequence
  chemically synthesized
taaaagagaattggtgtatatg

SEQ ID NO: 1342059 - DNA, 22 bp, Artificial Sequence
  chemically synthesized
aggtatgattggcatatacacc

SEQ ID NO: 1342060 - DNA, 22 bp, Artificial Sequence
  chemically synthesized
ttgaggtatgattggcatatac

SEQ ID NO: 1342061 - DNA, 22 bp, Artificial Sequence
  chemically synthesized
attgaggtatgattggcatata

SEQ ID NO: 1342062 - DNA, 22 bp, Artificial Sequence
  chemically synthesized
tattgaggtatgattggcatat

SEQ ID NO: 1342063 - DNA, 22 bp, Artificial Sequence
  chemically synthesized
ctttattgaggtatgattggca

SEQ ID NO: 1342064 - DNA, 22 bp, Artificial Sequence
  chemically synthesized
gtgtatatgccaatcatacctc

SEQ ID NO: 1342065 - DNA, 22 bp, Artificial Sequence
  chemically synthesized
aactgctttattgaggtatgat

SEQ ID NO: 1342066 - DNA, 22 bp, Artificial Sequence
  chemically synthesized
aaactgctttattgaggtatga

SEQ ID NO: 1342067 - DNA, 22 bp, Artificial Sequence
  chemically synthesized
taaactgctttattgaggtatg

SEQ ID NO: 1342068 - DNA, 22 bp, Artificial Sequence
  chemically synthesized
ttaaactgctttattgaggtat

SEQ ID NO: 1342069 - DNA, 22 bp, Artificial Sequence
  chemically synthesized
tttaaactgctttattgaggta

SEQ ID NO: 1342070 - DNA, 22 bp, Artificial Sequence
  chemically synthesized
agttttttaaactgctttattg

SEQ ID NO: 1342071 - DNA, 22 bp, Artificial Sequence
  chemically synthesized
cagttttttaaactgctttatt

SEQ ID NO: 1342072 - DNA, 22 bp, Artificial Sequence
  chemically synthesized
ttcagttttttaaactgcttta

SEQ ID NO: 1342073 - DNA, 22 bp, Artificial Sequence
  chemically synthesized
attcttcagttttttaaactgc

SEQ ID NO: 1342074 - DNA, 22 bp, Artificial Sequence
  chemically synthesized
aataaagcagtttaaaaaactg

SEQ ID NO: 1342075 - DNA, 22 bp, Artificial Sequence
  chemically synthesized
agaaataattgattcttcagtt

SEQ ID NO: 1342076 - DNA, 22 bp, Artificial Sequence
  chemically synthesized
cagaaataattgattcttcagt

SEQ ID NO: 1342077 - DNA, 22 bp, Artificial Sequence
  chemically synthesized
ttcagaaataattgattcttca

SEQ ID NO: 1342078 - DNA, 22 bp, Artificial Sequence
  chemically synthesized
cttcagaaataattgattcttc

SEQ ID NO: 1342079 - DNA, 22 bp, Artificial Sequence
  chemically synthesized
tcttcagaaataattgattctt

SEQ ID NO: 1342080 - DNA, 22 bp, Artificial Sequence
  chemically synthesized
ttcttcagaaataattgattct

SEQ ID NO: 1342081 - DNA, 22 bp, Artificial Sequence
  chemically synthesized
tttcttcagaaataattgattc

SEQ ID NO: 1342082 - DNA, 22 bp, Artificial Sequence
  chemically synthesized
aaaaaactgaagaatcaattat

SEQ ID NO: 1342083 - DNA, 22 bp, Artificial Sequence
  chemically synthesized
ttttcttcagaaataattgatt

SEQ ID NO: 1342084 - DNA, 22 bp, Artificial Sequence
  chemically synthesized
aaaaactgaagaatcaattatt

SEQ ID NO: 1342085 - DNA, 22 bp, Artificial Sequence
  chemically synthesized
tttttcttcagaaataattgat

SEQ ID NO: 1342086 - DNA, 22 bp, Artificial Sequence
  chemically synthesized
ttttttcttcagaaataattga

SEQ ID NO: 1342087 - DNA, 22 bp, Artificial Sequence
  chemically synthesized
ttttttttcttcagaaataatt

SEQ ID NO: 1342088 - DNA, 22 bp, Artificial Sequence
  chemically synthesized
aagaatcaattatttctgaaga

SEQ ID NO: 1342089 - DNA, 22 bp, Artificial Sequence
  chemically synthesized
ccaattcttttttttcttcaga

SEQ ID NO: 1342090 - DNA, 22 bp, Artificial Sequence
  chemically synthesized
accaattcttttttttcttcag

SEQ ID NO: 1342091 - DNA, 22 bp, Artificial Sequence
  chemically synthesized
ttaccaattcttttttttcttc

SEQ ID NO: 1342092 - DNA, 22 bp, Artificial Sequence
  chemically synthesized
tttctgaagaaaaaaaagaatt

SEQ ID NO: 1342093 - DNA, 22 bp, Artificial Sequence
  chemically synthesized
ctgaagaaaaaaaagaattggt

SEQ ID NO: 1342094 - DNA, 22 bp, Artificial Sequence
  chemically synthesized
tgaagaaaaaaaagaattggta

SEQ ID NO: 1342095 - DNA, 22 bp, Artificial Sequence
  chemically synthesized
taaaggagttcttaccaattct

SEQ ID NO: 1342096 - DNA, 22 bp, Artificial Sequence
  chemically synthesized
aagaaaaaaaagaattggtaag

SEQ ID NO: 1342097 - DNA, 22 bp, Artificial Sequence
  chemically synthesized
tcacacactataaaggagttct

SEQ ID NO: 1342098 - DNA, 22 bp, Artificial Sequence
  chemically synthesized
attatcacacactataaaggag

SEQ ID NO: 1342099 - DNA, 22 bp, Artificial Sequence
  chemically synthesized
aattatcacacactataaagga

SEQ ID NO: 1342100 - DNA, 22 bp, Artificial Sequence
  chemically synthesized
tttaattatcacacactataaa

SEQ ID NO: 1342101 - DNA, 22 bp, Artificial Sequence
  chemically synthesized
gtaagaactcctttatagtgtg

SEQ ID NO: 1342102 - DNA, 22 bp, Artificial Sequence
  chemically synthesized
ttatttaattatcacacactat

SEQ ID NO: 1342103 - DNA, 22 bp, Artificial Sequence
  chemically synthesized
gttatttaattatcacacacta

SEQ ID NO: 1342104 - DNA, 22 bp, Artificial Sequence
  chemically synthesized
tgttatttaattatcacacact

SEQ ID NO: 1342105 - DNA, 22 bp, Artificial Sequence
  chemically synthesized
ttgttatttaattatcacacac

SEQ ID NO: 1342106 - DNA, 22 bp, Artificial Sequence
  chemically synthesized
gtttttgttatttaattatcac

SEQ ID NO: 1342107 - DNA, 22 bp, Artificial Sequence
  chemically synthesized
ctttatagtgtgtgataattaa

SEQ ID NO: 1342108 - DNA, 22 bp, Artificial Sequence
  chemically synthesized
tagtttttgttatttaattatc

SEQ ID NO: 1342109 - DNA, 22 bp, Artificial Sequence
  chemically synthesized
tatagtgtgtgataattaaata

SEQ ID NO: 1342110 - DNA, 22 bp, Artificial Sequence
  chemically synthesized
atagtgtgtgataattaaataa

SEQ ID NO: 1342111 - DNA, 22 bp, Artificial Sequence
  chemically synthesized
ttctagtttttgttatttaatt

SEQ ID NO: 1342112 - DNA, 22 bp, Artificial Sequence
  chemically synthesized
tagtgtgtgataattaaataac

SEQ ID NO: 1342113 - DNA, 22 bp, Artificial Sequence
  chemically synthesized
gttctagtttttgttatttaat

SEQ ID NO: 1342114 - DNA, 22 bp, Artificial Sequence
  chemically synthesized
tgttctagtttttgttatttaa

SEQ ID NO: 1342115 - DNA, 22 bp, Artificial Sequence
  chemically synthesized
ccactttgttctagtttttgtt

SEQ ID NO: 1342116 - DNA, 22 bp, Artificial Sequence
  chemically synthesized
aataacaaaaactagaacaaag

SEQ ID NO: 1342117 - DNA, 22 bp, Artificial Sequence
  chemically synthesized
gaacaaagtggcaggcatggga

SEQ ID NO: 1342118 - DNA, 22 bp, Artificial Sequence
  chemically synthesized
aatatggaccatgtcccatgcc

SEQ ID NO: 1342119 - DNA, 22 bp, Artificial Sequence
  chemically synthesized
tgaatatggaccatgtcccatg

SEQ ID NO: 1342120 - DNA, 22 bp, Artificial Sequence
  chemically synthesized
gctctgaatatggaccatgtcc

SEQ ID NO: 1342121 - DNA, 22 bp, Artificial Sequence
  chemically synthesized
agctctgaatatggaccatgtc

SEQ ID NO: 1342122 - DNA, 22 bp, Artificial Sequence
  chemically synthesized
tagctctgaatatggaccatgt

SEQ ID NO: 1342123 - DNA, 22 bp, Artificial Sequence
  chemically synthesized
ttagctctgaatatggaccatg

SEQ ID NO: 1342124 - DNA, 22 bp, Artificial Sequence
  chemically synthesized
agagctaaaagttttctctcac

SEQ ID NO: 1342125 - DNA, 22 bp, Artificial Sequence
  chemically synthesized
ggaaaataaaaatagtgagaga

SEQ ID NO: 1342126 - DNA, 22 bp, Artificial Sequence
  chemically synthesized
aggaaaataaaaatagtgagag

SEQ ID NO: 1342127 - DNA, 22 bp, Artificial Sequence
  chemically synthesized
taggaaaataaaaatagtgaga

SEQ ID NO: 1342128 - DNA, 22 bp, Artificial Sequence
  chemically synthesized
aaagttttctctcactattttt

SEQ ID NO: 1342129 - DNA, 22 bp, Artificial Sequence
  chemically synthesized
attttaggaaaataaaaatagt

SEQ ID NO: 1342130 - DNA, 22 bp, Artificial Sequence
  chemically synthesized
gttcattttaggaaaataaaaa

SEQ ID NO: 1342131 - DNA, 22 bp, Artificial Sequence
  chemically synthesized
tctctcactatttttattttcc

SEQ ID NO: 1342132 - DNA, 22 bp, Artificial Sequence
  chemically synthesized
ctctcactatttttattttcct

SEQ ID NO: 1342133 - DNA, 22 bp, Artificial Sequence
  chemically synthesized
tctcactatttttattttccta

SEQ ID NO: 1342134 - DNA, 22 bp, Artificial Sequence
  chemically synthesized
tcactatttttattttcctaaa

SEQ ID NO: 1342135 - DNA, 22 bp, Artificial Sequence
  chemically synthesized
actatttttattttcctaaaat

SEQ ID NO: 1342136 - DNA, 22 bp, Artificial Sequence
  chemically synthesized
gaaatactagttcattttagga

SEQ ID NO: 1342137 - DNA, 22 bp, Artificial Sequence
  chemically synthesized
tagaaatactagttcattttag

SEQ ID NO: 1342138 - DNA, 22 bp, Artificial Sequence
  chemically synthesized
tttttattttcctaaaatgaac

SEQ ID NO: 1342139 - DNA, 22 bp, Artificial Sequence
  chemically synthesized
ctagaaatactagttcatttta

SEQ ID NO: 1342140 - DNA, 22 bp, Artificial Sequence
  chemically synthesized
ttattttcctaaaatgaactag

SEQ ID NO: 1342141 - DNA, 22 bp, Artificial Sequence
  chemically synthesized
tattttcctaaaatgaactagt

SEQ ID NO: 1342142 - DNA, 22 bp, Artificial Sequence
  chemically synthesized
attttcctaaaatgaactagta

SEQ ID NO: 1342143 - DNA, 22 bp, Artificial Sequence
  chemically synthesized
ttttcctaaaatgaactagtat

SEQ ID NO: 1342144 - DNA, 22 bp, Artificial Sequence
  chemically synthesized
tatcttctagaaatactagttc

SEQ ID NO: 1342145 - DNA, 22 bp, Artificial Sequence
  chemically synthesized
tcctaaaatgaactagtatttc

SEQ ID NO: 1342146 - DNA, 22 bp, Artificial Sequence
  chemically synthesized
cctaaaatgaactagtatttct

SEQ ID NO: 1342147 - DNA, 22 bp, Artificial Sequence
  chemically synthesized
attgtatcttctagaaatacta

SEQ ID NO: 1342148 - DNA, 22 bp, Artificial Sequence
  chemically synthesized
ctaaaatgaactagtatttcta

SEQ ID NO: 1342149 - DNA, 22 bp, Artificial Sequence
  chemically synthesized
tcattgtatcttctagaaatac

SEQ ID NO: 1342150 - DNA, 22 bp, Artificial Sequence
  chemically synthesized
aaatgaactagtatttctagaa

SEQ ID NO: 1342151 - DNA, 22 bp, Artificial Sequence
  chemically synthesized
ttctcattgtatcttctagaaa

SEQ ID NO: 1342152 - DNA, 22 bp, Artificial Sequence
  chemically synthesized
attctcattgtatcttctagaa

SEQ ID NO: 1342153 - DNA, 22 bp, Artificial Sequence
  chemically synthesized
tattctcattgtatcttctaga

SEQ ID NO: 1342154 - DNA, 22 bp, Artificial Sequence
  chemically synthesized
gttttattctcattgtatcttc

SEQ ID NO: 1342155 - DNA, 22 bp, Artificial Sequence
  chemically synthesized
gtatttctagaagatacaatga

SEQ ID NO: 1342156 - DNA, 22 bp, Artificial Sequence
  chemically synthesized
aattggttttattctcattgta

SEQ ID NO: 1342157 - DNA, 22 bp, Artificial Sequence
  chemically synthesized
caattggttttattctcattgt

SEQ ID NO: 1342158 - DNA, 22 bp, Artificial Sequence
  chemically synthesized
tcaattggttttattctcattg

SEQ ID NO: 1342159 - DNA, 22 bp, Artificial Sequence
  chemically synthesized
ctagaagatacaatgagaataa

SEQ ID NO: 1342160 - DNA, 22 bp, Artificial Sequence
  chemically synthesized
tagaagatacaatgagaataaa

SEQ ID NO: 1342161 - DNA, 22 bp, Artificial Sequence
  chemically synthesized
gaagatacaatgagaataaaac

SEQ ID NO: 1342162 - DNA, 22 bp, Artificial Sequence
  chemically synthesized
aaagaaaatattttcaattggt

SEQ ID NO: 1342163 - DNA, 22 bp, Artificial Sequence
  chemically synthesized
ttaaaagaaaatattttcaatt

SEQ ID NO: 1342164 - DNA, 22 bp, Artificial Sequence
  chemically synthesized
ttattaaaagaaaatattttca

SEQ ID NO: 1342165 - DNA, 22 bp, Artificial Sequence
  chemically synthesized
aagcactgttattaaaagaaaa

SEQ ID NO: 1342166 - DNA, 22 bp, Artificial Sequence
  chemically synthesized
aaagcactgttattaaaagaaa

SEQ ID NO: 1342167 - DNA, 22 bp, Artificial Sequence
  chemically synthesized
taaagcactgttattaaaagaa

SEQ ID NO: 1342168 - DNA, 22 bp, Artificial Sequence
  chemically synthesized
aaaatattttcttttaataaca

SEQ ID NO: 1342169 - DNA, 22 bp, Artificial Sequence
  chemically synthesized
attttaaagcactgttattaaa

SEQ ID NO: 1342170 - DNA, 22 bp, Artificial Sequence
  chemically synthesized
ctaattttaaagcactgttatt

SEQ ID NO: 1342171 - DNA, 22 bp, Artificial Sequence
  chemically synthesized
gctaattttaaagcactgttat

SEQ ID NO: 1342172 - DNA, 22 bp, Artificial Sequence
  chemically synthesized
tgctaattttaaagcactgtta

SEQ ID NO: 1342173 - DNA, 22 bp, Artificial Sequence
  chemically synthesized
ttgctaattttaaagcactgtt

SEQ ID NO: 1342174 - DNA, 22 bp, Artificial Sequence
  chemically synthesized
tttgctaattttaaagcactgt

SEQ ID NO: 1342175 - DNA, 22 bp, Artificial Sequence
  chemically synthesized
ttttgctaattttaaagcactg

SEQ ID NO: 1342176 - DNA, 22 bp, Artificial Sequence
  chemically synthesized
tcttttaataacagtgctttaa

SEQ ID NO: 1342177 - DNA, 22 bp, Artificial Sequence
  chemically synthesized
cttttaataacagtgctttaaa

SEQ ID NO: 1342178 - DNA, 22 bp, Artificial Sequence
  chemically synthesized
ttttaataacagtgctttaaaa

SEQ ID NO: 1342179 - DNA, 22 bp, Artificial Sequence
  chemically synthesized
atttttttgctaattttaaagc

SEQ ID NO: 1342180 - DNA, 22 bp, Artificial Sequence
  chemically synthesized
ttaataacagtgctttaaaatt

SEQ ID NO: 1342181 - DNA, 22 bp, Artificial Sequence
  chemically synthesized
aatttttttgctaattttaaag

SEQ ID NO: 1342182 - DNA, 22 bp, Artificial Sequence
  chemically synthesized
taataacagtgctttaaaatta

SEQ ID NO: 1342183 - DNA, 22 bp, Artificial Sequence
  chemically synthesized
taatttttttgctaattttaaa

SEQ ID NO: 1342184 - DNA, 22 bp, Artificial Sequence
  chemically synthesized
aataacagtgctttaaaattag

SEQ ID NO: 1342185 - DNA, 22 bp, Artificial Sequence
  chemically synthesized
ataacagtgctttaaaattagc

SEQ ID NO: 1342186 - DNA, 22 bp, Artificial Sequence
  chemically synthesized
ttttaatttttttgctaatttt

SEQ ID NO: 1342187 - DNA, 22 bp, Artificial Sequence
  chemically synthesized
tattttaatttttttgctaatt

SEQ ID NO: 1342188 - DNA, 22 bp, Artificial Sequence
  chemically synthesized
aaaattctattttaattttttt

SEQ ID NO: 1342189 - DNA, 22 bp, Artificial Sequence
  chemically synthesized
caaaattctattttaatttttt

SEQ ID NO: 1342190 - DNA, 22 bp, Artificial Sequence
  chemically synthesized
taaaattagcaaaaaaattaaa

SEQ ID NO: 1342191 - DNA, 22 bp, Artificial Sequence
  chemically synthesized
tcaaaattctattttaattttt

SEQ ID NO: 1342192 - DNA, 22 bp, Artificial Sequence
  chemically synthesized
aaaattagcaaaaaaattaaaa

SEQ ID NO: 1342193 - DNA, 22 bp, Artificial Sequence
  chemically synthesized
ttcaaaattctattttaatttt

SEQ ID NO: 1342194 - DNA, 22 bp, Artificial Sequence
  chemically synthesized
aaattagcaaaaaaattaaaat

SEQ ID NO: 1342195 - DNA, 22 bp, Artificial Sequence
  chemically synthesized
tttcaaaattctattttaattt

SEQ ID NO: 1342196 - DNA, 22 bp, Artificial Sequence
  chemically synthesized
ttttcaaaattctattttaatt

SEQ ID NO: 1342197 - DNA, 22 bp, Artificial Sequence
  chemically synthesized
cttttttcaaaattctatttta

SEQ ID NO: 1342198 - DNA, 22 bp, Artificial Sequence
  chemically synthesized
gcaaaaaaattaaaatagaatt

SEQ ID NO: 1342199 - DNA, 22 bp, Artificial Sequence
  chemically synthesized
attacttttttcaaaattctat

SEQ ID NO: 1342200 - DNA, 22 bp, Artificial Sequence
  chemically synthesized
gattacttttttcaaaattcta

SEQ ID NO: 1342201 - DNA, 22 bp, Artificial Sequence
  chemically synthesized
tttgattacttttttcaaaatt

SEQ ID NO: 1342202 - DNA, 22 bp, Artificial Sequence
  chemically synthesized
aaatagaattttgaaaaaagta

SEQ ID NO: 1342203 - DNA, 22 bp, Artificial Sequence
  chemically synthesized
tgaaaaaagtaatcaaatagat

SEQ ID NO: 1342204 - DNA, 22 bp, Artificial Sequence
  chemically synthesized
gaaaaaagtaatcaaatagatt

SEQ ID NO: 1342205 - DNA, 22 bp, Artificial Sequence
  chemically synthesized
aaaaaagtaatcaaatagattt

SEQ ID NO: 1342206 - DNA, 22 bp, Artificial Sequence
  chemically synthesized
gctgtactactgactgtatgtt

SEQ ID NO: 1342207 - DNA, 22 bp, Artificial Sequence
  chemically synthesized
ctgtactactgactgtatgttc

SEQ ID NO: 1342208 - DNA, 22 bp, Artificial Sequence
  chemically synthesized
tactactgactgtatgttcttt

SEQ ID NO: 1342209 - DNA, 22 bp, Artificial Sequence
  chemically synthesized
ctgactgtatgttctttacatt

SEQ ID NO: 1342210 - DNA, 22 bp, Artificial Sequence
  chemically synthesized
actgtatgttctttacatttgt

SEQ ID NO: 1342211 - DNA, 22 bp, Artificial Sequence
  chemically synthesized
tatgttctttacatttgtatgt

SEQ ID NO: 1342212 - DNA, 22 bp, Artificial Sequence
  chemically synthesized
tttacatttgtatgttttgttt

SEQ ID NO: 1342213 - DNA, 22 bp, Artificial Sequence
  chemically synthesized
tacatttgtatgttttgttttt

SEQ ID NO: 1342214 - DNA, 22 bp, Artificial Sequence
  chemically synthesized
acatttgtatgttttgttttta

SEQ ID NO: 1342215 - DNA, 22 bp, Artificial Sequence
  chemically synthesized
catttgtatgttttgtttttat

SEQ ID NO: 1342216 - DNA, 22 bp, Artificial Sequence
  chemically synthesized
aaaataccaaaatataaaaaca

SEQ ID NO: 1342217 - DNA, 22 bp, Artificial Sequence
  chemically synthesized
aaaaataccaaaatataaaaac

SEQ ID NO: 1342218 - DNA, 22 bp, Artificial Sequence
  chemically synthesized
gtatgttttgtttttatatttt

SEQ ID NO: 1342219 - DNA, 22 bp, Artificial Sequence
  chemically synthesized
tatgttttgtttttatattttg

SEQ ID NO: 1342220 - DNA, 22 bp, Artificial Sequence
  chemically synthesized
ataatacttaaaaataccaaaa

SEQ ID NO: 1342221 - DNA, 22 bp, Artificial Sequence
  chemically synthesized
tgtttttatattttggtatttt

SEQ ID NO: 1342222 - DNA, 22 bp, Artificial Sequence
  chemically synthesized
gtttttatattttggtattttt

SEQ ID NO: 1342223 - DNA, 22 bp, Artificial Sequence
  chemically synthesized
ctaataatacttaaaaatacca

SEQ ID NO: 1342224 - DNA, 22 bp, Artificial Sequence
  chemically synthesized
tttttatattttggtattttta

SEQ ID NO: 1342225 - DNA, 22 bp, Artificial Sequence
  chemically synthesized
ttatattttggtatttttaagt

SEQ ID NO: 1342226 - DNA, 22 bp, Artificial Sequence
  chemically synthesized
tatattttggtatttttaagta

SEQ ID NO: 1342227 - DNA, 22 bp, Artificial Sequence
  chemically synthesized
atattttggtatttttaagtat

SEQ ID NO: 1342228 - DNA, 22 bp, Artificial Sequence
  chemically synthesized
tattttggtatttttaagtatt

SEQ ID NO: 1342229 - DNA, 22 bp, Artificial Sequence
  chemically synthesized
agaacacctactaataatactt

SEQ ID NO: 1342230 - DNA, 22 bp, Artificial Sequence
  chemically synthesized
aagaacacctactaataatact

SEQ ID NO: 1342231 - DNA, 22 bp, Artificial Sequence
  chemically synthesized
tggtatttttaagtattattag

SEQ ID NO: 1342232 - DNA, 22 bp, Artificial Sequence
  chemically synthesized
ggtatttttaagtattattagt

SEQ ID NO: 1342233 - DNA, 22 bp, Artificial Sequence
  chemically synthesized
gtatttttaagtattattagta

SEQ ID NO: 1342234 - DNA, 22 bp, Artificial Sequence
  chemically synthesized
aatgtttaagaacacctactaa

SEQ ID NO: 1342235 - DNA, 22 bp, Artificial Sequence
  chemically synthesized
ttaagtattattagtaggtgtt

SEQ ID NO: 1342236 - DNA, 22 bp, Artificial Sequence
  chemically synthesized
taagtattattagtaggtgttc

SEQ ID NO: 1342237 - DNA, 22 bp, Artificial Sequence
  chemically synthesized
aagtattattagtaggtgttct

SEQ ID NO: 1342238 - DNA, 22 bp, Artificial Sequence
  chemically synthesized
cctaaatgtttaagaacaccta

SEQ ID NO: 1342239 - DNA, 22 bp, Artificial Sequence
  chemically synthesized
agtattattagtaggtgttctt

SEQ ID NO: 1342240 - DNA, 22 bp, Artificial Sequence
  chemically synthesized
acctaaatgtttaagaacacct

SEQ ID NO: 1342241 - DNA, 22 bp, Artificial Sequence
  chemically synthesized
ttagtaggtgttcttaaacatt

SEQ ID NO: 1342242 - DNA, 22 bp, Artificial Sequence
  chemically synthesized
gtaggtgttcttaaacatttag

SEQ ID NO: 1342243 - DNA, 22 bp, Artificial Sequence
  chemically synthesized
tacaatatcttacctaaatgtt

SEQ ID NO: 1342244 - DNA, 22 bp, Artificial Sequence
  chemically synthesized
ataactatacaatatcttacct

SEQ ID NO: 1342245 - DNA, 22 bp, Artificial Sequence
  chemically synthesized
ttaaacatttaggtaagatatt

SEQ ID NO: 1342246 - DNA, 22 bp, Artificial Sequence
  chemically synthesized
aaacatttaggtaagatattgt

SEQ ID NO: 1342247 - DNA, 22 bp, Artificial Sequence
  chemically synthesized
aacatttaggtaagatattgta

SEQ ID NO: 1342248 - DNA, 22 bp, Artificial Sequence
  chemically synthesized
aggtaagatattgtatagttat

SEQ ID NO: 1342249 - DNA, 22 bp, Artificial Sequence
  chemically synthesized
ggtaagatattgtatagttatt

SEQ ID NO: 1342250 - DNA, 22 bp, Artificial Sequence
  chemically synthesized
tatagttattagctttactatt

SEQ ID NO: 1342251 - DNA, 22 bp, Artificial Sequence
  chemically synthesized
ttagctttactattattattat

SEQ ID NO: 1342252 - DNA, 22 bp, Artificial Sequence
  chemically synthesized
gctttactattattattattat

SEQ ID NO: 1342253 - DNA, 22 bp, Artificial Sequence
  chemically synthesized
ataataataataataataataa

SEQ ID NO: 1342254 - DNA, 22 bp, Artificial Sequence
  chemically synthesized
tactattattattattattatt

SEQ ID NO: 1342255 - DNA, 22 bp, Artificial Sequence
  chemically synthesized
tctaataataataataataata

SEQ ID NO: 1342256 - DNA, 22 bp, Artificial Sequence
  chemically synthesized
actattattattattattatta

SEQ ID NO: 1342257 - DNA, 22 bp, Artificial Sequence
  chemically synthesized
ctattattattattattattat

SEQ ID NO: 1342258 - DNA, 22 bp, Artificial Sequence
  chemically synthesized
tatctaataataataataataa

SEQ ID NO: 1342259 - DNA, 22 bp, Artificial Sequence
  chemically synthesized
ttattattattattattattat

SEQ ID NO: 1342260 - DNA, 22 bp, Artificial Sequence
  chemically synthesized
ttattattattattattattat

SEQ ID NO: 1342261 - DNA, 22 bp, Artificial Sequence
  chemically synthesized
ttattattattattattattag

SEQ ID NO: 1342262 - DNA, 22 bp, Artificial Sequence
  chemically synthesized
ttattattattattattagata

SEQ ID NO: 1342263 - DNA, 22 bp, Artificial Sequence
  chemically synthesized
ttattattattattagatagag

SEQ ID NO: 1342264 - DNA, 22 bp, Artificial Sequence
  chemically synthesized
ttattattattagatagagtct

SEQ ID NO: 1342265 - DNA, 22 bp, Artificial Sequence
  chemically synthesized
ggcgacagagggagactctatc

SEQ ID NO: 1342266 - DNA, 22 bp, Artificial Sequence
  chemically synthesized
ttattattagatagagtctccc

SEQ ID NO: 1342267 - DNA, 22 bp, Artificial Sequence
  chemically synthesized
ttattagatagagtctccctct

SEQ ID NO: 1342268 - DNA, 22 bp, Artificial Sequence
  chemically synthesized
catcctgggcgacagagggaga

SEQ ID NO: 1342269 - DNA, 22 bp, Artificial Sequence
  chemically synthesized
ttagatagagtctccctctgtc

SEQ ID NO: 1342270 - DNA, 22 bp, Artificial Sequence
  chemically synthesized
gatagagtctccctctgtcgcc

SEQ ID NO: 1342271 - DNA, 22 bp, Artificial Sequence
  chemically synthesized
cactccatcctgggcgacagag

SEQ ID NO: 1342272 - DNA, 22 bp, Artificial Sequence
  chemically synthesized
ggccactgcactccatcctggg

SEQ ID NO: 1342273 - DNA, 22 bp, Artificial Sequence
  chemically synthesized
cctctgtcgcccaggatggagt

SEQ ID NO: 1342274 - DNA, 22 bp, Artificial Sequence
  chemically synthesized
tgtcgcccaggatggagtgcag

SEQ ID NO: 1342275 - DNA, 22 bp, Artificial Sequence
  chemically synthesized
tcgcccaggatggagtgcagtg

SEQ ID NO: 1342276 - DNA, 22 bp, Artificial Sequence
  chemically synthesized
cagtgagccaagattgggccac

SEQ ID NO: 1342277 - DNA, 22 bp, Artificial Sequence
  chemically synthesized
ggaggcagaggttgcagtgagc

SEQ ID NO: 1342278 - DNA, 22 bp, Artificial Sequence
  chemically synthesized
aacctgggaggcagaggttgca

SEQ ID NO: 1342279 - DNA, 22 bp, Artificial Sequence
  chemically synthesized
gaacctgggaggcagaggttgc

SEQ ID NO: 1342280 - DNA, 22 bp, Artificial Sequence
  chemically synthesized
ggctcactgcaacctctgcctc

SEQ ID NO: 1342281 - DNA, 22 bp, Artificial Sequence
  chemically synthesized
gctcactgcaacctctgcctcc

SEQ ID NO: 1342282 - DNA, 22 bp, Artificial Sequence
  chemically synthesized
actgcaacctctgcctcccagg

SEQ ID NO: 1342283 - DNA, 22 bp, Artificial Sequence
  chemically synthesized
caacctctgcctcccaggttca

SEQ ID NO: 1342284 - DNA, 22 bp, Artificial Sequence
  chemically synthesized
aggcaggagaatcacttgaacc

SEQ ID NO: 1342285 - DNA, 22 bp, Artificial Sequence
  chemically synthesized
tgcctcccaggttcaagtgatt

SEQ ID NO: 1342286 - DNA, 22 bp, Artificial Sequence
  chemically synthesized
cctcccaggttcaagtgattct

SEQ ID NO: 1342287 - DNA, 22 bp, Artificial Sequence
  chemically synthesized
ggaggctgaggcaggagaatca

SEQ ID NO: 1342288 - DNA, 22 bp, Artificial Sequence
  chemically synthesized
ccaggttcaagtgattctcctg

SEQ ID NO: 1342289 - DNA, 22 bp, Artificial Sequence
  chemically synthesized
cctgggaggctgaggcaggaga

SEQ ID NO: 1342290 - DNA, 22 bp, Artificial Sequence
  chemically synthesized
aagtgattctcctgcctcagcc

SEQ ID NO: 1342291 - DNA, 22 bp, Artificial Sequence
  chemically synthesized
taatcccagctacctgggaggc

SEQ ID NO: 1342292 - DNA, 22 bp, Artificial Sequence
  chemically synthesized
tcctgcctcagcctcccaggta

SEQ ID NO: 1342293 - DNA, 22 bp, Artificial Sequence
  chemically synthesized
ctgcctcagcctcccaggtagc

SEQ ID NO: 1342294 - DNA, 22 bp, Artificial Sequence
  chemically synthesized
cctcagcctcccaggtagctgg

SEQ ID NO: 1342295 - DNA, 22 bp, Artificial Sequence
  chemically synthesized
agcctcccaggtagctgggatt

SEQ ID NO: 1342296 - DNA, 22 bp, Artificial Sequence
  chemically synthesized
gtggtgggtccctgtaatccca

SEQ ID NO: 1342297 - DNA, 22 bp, Artificial Sequence
  chemically synthesized
ggtggtgggtccctgtaatccc

SEQ ID NO: 1342298 - DNA, 22 bp, Artificial Sequence
  chemically synthesized
ccaggtagctgggattacaggg

SEQ ID NO: 1342299 - DNA, 22 bp, Artificial Sequence
  chemically synthesized
gccagtcttggtggtgggtccc

SEQ ID NO: 1342300 - DNA, 22 bp, Artificial Sequence
  chemically synthesized
ggattacagggacccaccacca

SEQ ID NO: 1342301 - DNA, 22 bp, Artificial Sequence
  chemically synthesized
cagggacccaccaccaagactg

SEQ ID NO: 1342302 - DNA, 22 bp, Artificial Sequence
  chemically synthesized
aaaatacaaaaaaaaattagcc

SEQ ID NO: 1342303 - DNA, 22 bp, Artificial Sequence
  chemically synthesized
ctaaaaatacaaaaaaaaatta

SEQ ID NO: 1342304 - DNA, 22 bp, Artificial Sequence
  chemically synthesized
tactaaaaatacaaaaaaaaat

SEQ ID NO: 1342305 - DNA, 22 bp, Artificial Sequence
  chemically synthesized
tctactaaaaatacaaaaaaaa

SEQ ID NO: 1342306 - DNA, 22 bp, Artificial Sequence
  chemically synthesized
ctctactaaaaatacaaaaaaa

SEQ ID NO: 1342307 - DNA, 22 bp, Artificial Sequence
  chemically synthesized
gctaatttttttttgtattttt

SEQ ID NO: 1342308 - DNA, 22 bp, Artificial Sequence
  chemically synthesized
atttttttttgtatttttagta

SEQ ID NO: 1342309 - DNA, 22 bp, Artificial Sequence
  chemically synthesized
ttttttgtatttttagtagaga

SEQ ID NO: 1342310 - DNA, 22 bp, Artificial Sequence
  chemically synthesized
tttttgtatttttagtagagaa

SEQ ID NO: 1342311 - DNA, 22 bp, Artificial Sequence
  chemically synthesized
ttttgtatttttagtagagaag

SEQ ID NO: 1342312 - DNA, 22 bp, Artificial Sequence
  chemically synthesized
tttgtatttttagtagagaagg

SEQ ID NO: 1342313 - DNA, 22 bp, Artificial Sequence
  chemically synthesized
ttgtatttttagtagagaaggg

SEQ ID NO: 1342314 - DNA, 22 bp, Artificial Sequence
  chemically synthesized
tgtatttttagtagagaagggg

SEQ ID NO: 1342315 - DNA, 22 bp, Artificial Sequence
  chemically synthesized
gtatttttagtagagaaggggt

SEQ ID NO: 1342316 - DNA, 22 bp, Artificial Sequence
  chemically synthesized
tatttttagtagagaaggggtt

SEQ ID NO: 1342317 - DNA, 22 bp, Artificial Sequence
  chemically synthesized
gccaacaaggtgaaaccccttc

SEQ ID NO: 1342318 - DNA, 22 bp, Artificial Sequence
  chemically synthesized
ttagtagagaaggggtttcacc

SEQ ID NO: 1342319 - DNA, 22 bp, Artificial Sequence
  chemically synthesized
tagtagagaaggggtttcacct

SEQ ID NO: 1342320 - DNA, 22 bp, Artificial Sequence
  chemically synthesized
agtagagaaggggtttcacctt

SEQ ID NO: 1342321 - DNA, 22 bp, Artificial Sequence
  chemically synthesized
gtagagaaggggtttcaccttg

SEQ ID NO: 1342322 - DNA, 22 bp, Artificial Sequence
  chemically synthesized
aagaccagcctggccaacaagg

SEQ ID NO: 1342323 - DNA, 22 bp, Artificial Sequence
  chemically synthesized
caccttgttggccaggctggtc

SEQ ID NO: 1342324 - DNA, 22 bp, Artificial Sequence
  chemically synthesized
accttgttggccaggctggtct

SEQ ID NO: 1342325 - DNA, 22 bp, Artificial Sequence
  chemically synthesized
aggtgaagggttcaagaccagc

SEQ ID NO: 1342326 - DNA, 22 bp, Artificial Sequence
  chemically synthesized
gttggccaggctggtcttgaac

SEQ ID NO: 1342327 - DNA, 22 bp, Artificial Sequence
  chemically synthesized
ttggccaggctggtcttgaacc

SEQ ID NO: 1342328 - DNA, 22 bp, Artificial Sequence
  chemically synthesized
cctcaggtgaagggttcaagac

SEQ ID NO: 1342329 - DNA, 22 bp, Artificial Sequence
  chemically synthesized
gccaggctggtcttgaaccctt

SEQ ID NO: 1342330 - DNA, 22 bp, Artificial Sequence
  chemically synthesized
gtcttgaacccttcacctgagg

SEQ ID NO: 1342331 - DNA, 22 bp, Artificial Sequence
  chemically synthesized
gaacccttcacctgaggtaatc

SEQ ID NO: 1342332 - DNA, 22 bp, Artificial Sequence
  chemically synthesized
aacccttcacctgaggtaatct

SEQ ID NO: 1342333 - DNA, 22 bp, Artificial Sequence
  chemically synthesized
ggaggccaaggcaggcagatta

SEQ ID NO: 1342334 - DNA, 22 bp, Artificial Sequence
  chemically synthesized
gggaggccaaggcaggcagatt

SEQ ID NO: 1342335 - DNA, 22 bp, Artificial Sequence
  chemically synthesized
tgggaggccaaggcaggcagat

SEQ ID NO: 1342336 - DNA, 22 bp, Artificial Sequence
  chemically synthesized
cacctgaggtaatctgcctgcc

SEQ ID NO: 1342337 - DNA, 22 bp, Artificial Sequence
  chemically synthesized
acctgaggtaatctgcctgcct

SEQ ID NO: 1342338 - DNA, 22 bp, Artificial Sequence
  chemically synthesized
aggtaatctgcctgccttggcc

SEQ ID NO: 1342339 - DNA, 22 bp, Artificial Sequence
  chemically synthesized
taatcccagcattttgggaggc

SEQ ID NO: 1342340 - DNA, 22 bp, Artificial Sequence
  chemically synthesized
gtaatcccagcattttgggagg

SEQ ID NO: 1342341 - DNA, 22 bp, Artificial Sequence
  chemically synthesized
cctgccttggcctcccaaaatg

SEQ ID NO: 1342342 - DNA, 22 bp, Artificial Sequence
  chemically synthesized
ccttggcctcccaaaatgctgg

SEQ ID NO: 1342343 - DNA, 22 bp, Artificial Sequence
  chemically synthesized
acacttgtaatcccagcatttt

SEQ ID NO: 1342344 - DNA, 22 bp, Artificial Sequence
  chemically synthesized
ggcctcccaaaatgctgggatt

SEQ ID NO: 1342345 - DNA, 22 bp, Artificial Sequence
  chemically synthesized
gcctcccaaaatgctgggatta

SEQ ID NO: 1342346 - DNA, 22 bp, Artificial Sequence
  chemically synthesized
ccaaaatgctgggattacaagt

SEQ ID NO: 1342347 - DNA, 22 bp, Artificial Sequence
  chemically synthesized
gccaggtacagtggctcacact

SEQ ID NO: 1342348 - DNA, 22 bp, Artificial Sequence
  chemically synthesized
ggattacaagtgtgagccactg

SEQ ID NO: 1342349 - DNA, 22 bp, Artificial Sequence
  chemically synthesized
caagtgtgagccactgtacctg

SEQ ID NO: 1342350 - DNA, 22 bp, Artificial Sequence
  chemically synthesized
gaaaaataggaaagctggccag

SEQ ID NO: 1342351 - DNA, 22 bp, Artificial Sequence
  chemically synthesized
attagaaaaataggaaagctgg

SEQ ID NO: 1342352 - DNA, 22 bp, Artificial Sequence
  chemically synthesized
tcattagaaaaataggaaagct

SEQ ID NO: 1342353 - DNA, 22 bp, Artificial Sequence
  chemically synthesized
ctcattagaaaaataggaaagc

SEQ ID NO: 1342354 - DNA, 22 bp, Artificial Sequence
  chemically synthesized
tctcattagaaaaataggaaag

SEQ ID NO: 1342355 - DNA, 22 bp, Artificial Sequence
  chemically synthesized
tacctggccagctttcctattt

SEQ ID NO: 1342356 - DNA, 22 bp, Artificial Sequence
  chemically synthesized
ttttctcattagaaaaatagga

SEQ ID NO: 1342357 - DNA, 22 bp, Artificial Sequence
  chemically synthesized
ctattttctcattagaaaaata

SEQ ID NO: 1342358 - DNA, 22 bp, Artificial Sequence
  chemically synthesized
gccagctttcctatttttctaa

SEQ ID NO: 1342359 - DNA, 22 bp, Artificial Sequence
  chemically synthesized
tcctatttttctaatgagaaaa

SEQ ID NO: 1342360 - DNA, 22 bp, Artificial Sequence
  chemically synthesized
aacaagctactattttctcatt

SEQ ID NO: 1342361 - DNA, 22 bp, Artificial Sequence
  chemically synthesized
cctatttttctaatgagaaaat

SEQ ID NO: 1342362 - DNA, 22 bp, Artificial Sequence
  chemically synthesized
ctatttttctaatgagaaaata

SEQ ID NO: 1342363 - DNA, 22 bp, Artificial Sequence
  chemically synthesized
tcaacaagctactattttctca

SEQ ID NO: 1342364 - DNA, 22 bp, Artificial Sequence
  chemically synthesized
tttttctaatgagaaaatagta

SEQ ID NO: 1342365 - DNA, 22 bp, Artificial Sequence
  chemically synthesized
ttctaatgagaaaatagtagct

SEQ ID NO: 1342366 - DNA, 22 bp, Artificial Sequence
  chemically synthesized
tctaatgagaaaatagtagctt

SEQ ID NO: 1342367 - DNA, 22 bp, Artificial Sequence
  chemically synthesized
ctaatgagaaaatagtagcttg

SEQ ID NO: 1342368 - DNA, 22 bp, Artificial Sequence
  chemically synthesized
taatgagaaaatagtagcttgt

SEQ ID NO: 1342369 - DNA, 22 bp, Artificial Sequence
  chemically synthesized
atgagaaaatagtagcttgttg

SEQ ID NO: 1342370 - DNA, 22 bp, Artificial Sequence
  chemically synthesized
cgtgtgtggctctcaacaagct

SEQ ID NO: 1342371 - DNA, 22 bp, Artificial Sequence
  chemically synthesized
gttgagagccacacacggagtt

SEQ ID NO: 1342372 - DNA, 22 bp, Artificial Sequence
  chemically synthesized
ttgagagccacacacggagttt

SEQ ID NO: 1342373 - DNA, 22 bp, Artificial Sequence
  chemically synthesized
agagccacacacggagtttgtg

SEQ ID NO: 1342374 - DNA, 22 bp, Artificial Sequence
  chemically synthesized
aagaaaaaaaaaaatcacaaac

SEQ ID NO: 1342375 - DNA, 22 bp, Artificial Sequence
  chemically synthesized
gtgatttttttttttcttcagg

SEQ ID NO: 1342376 - DNA, 22 bp, Artificial Sequence
  chemically synthesized
tgatttttttttttcttcagga

SEQ ID NO: 1342377 - DNA, 22 bp, Artificial Sequence
  chemically synthesized
ttttttttcttcaggatacgtt

SEQ ID NO: 1342378 - DNA, 22 bp, Artificial Sequence
  chemically synthesized
tttttttcttcaggatacgttg

SEQ ID NO: 1342379 - DNA, 22 bp, Artificial Sequence
  chemically synthesized
ttttttcttcaggatacgttgc

SEQ ID NO: 1342380 - DNA, 22 bp, Artificial Sequence
  chemically synthesized
tttttcttcaggatacgttgca

SEQ ID NO: 1342381 - DNA, 22 bp, Artificial Sequence
  chemically synthesized
ttttcttcaggatacgttgcat

SEQ ID NO: 1342382 - DNA, 22 bp, Artificial Sequence
  chemically synthesized
tttcttcaggatacgttgcatt

SEQ ID NO: 1342383 - DNA, 22 bp, Artificial Sequence
  chemically synthesized
atatacaatataaatgcaacgt

SEQ ID NO: 1342384 - DNA, 22 bp, Artificial Sequence
  chemically synthesized
ttcttcaggatacgttgcattt

SEQ ID NO: 1342385 - DNA, 22 bp, Artificial Sequence
  chemically synthesized
tcttcaggatacgttgcattta

SEQ ID NO: 1342386 - DNA, 22 bp, Artificial Sequence
  chemically synthesized
cttcaggatacgttgcatttat

SEQ ID NO: 1342387 - DNA, 22 bp, Artificial Sequence
  chemically synthesized
ttcaggatacgttgcatttata

SEQ ID NO: 1342388 - DNA, 22 bp, Artificial Sequence
  chemically synthesized
caggatacgttgcatttatatt

SEQ ID NO: 1342389 - DNA, 22 bp, Artificial Sequence
  chemically synthesized
aggatacgttgcatttatattg

SEQ ID NO: 1342390 - DNA, 22 bp, Artificial Sequence
  chemically synthesized
atacacgctgatatacaatata

SEQ ID NO: 1342391 - DNA, 22 bp, Artificial Sequence
  chemically synthesized
aatacacgctgatatacaatat

SEQ ID NO: 1342392 - DNA, 22 bp, Artificial Sequence
  chemically synthesized
taatacacgctgatatacaata

SEQ ID NO: 1342393 - DNA, 22 bp, Artificial Sequence
  chemically synthesized
catttatattgtatatcagcgt

SEQ ID NO: 1342394 - DNA, 22 bp, Artificial Sequence
  chemically synthesized
cacacactttaatacacgctga

SEQ ID NO: 1342395 - DNA, 22 bp, Artificial Sequence
  chemically synthesized
ccacacactttaatacacgctg

SEQ ID NO: 1342396 - DNA, 22 bp, Artificial Sequence
  chemically synthesized
atattgtatatcagcgtgtatt

SEQ ID NO: 1342397 - DNA, 22 bp, Artificial Sequence
  chemically synthesized
tattgtatatcagcgtgtatta

SEQ ID NO: 1342398 - DNA, 22 bp, Artificial Sequence
  chemically synthesized
tatatcagcgtgtattaaagtg

SEQ ID NO: 1342399 - DNA, 22 bp, Artificial Sequence
  chemically synthesized
cagagggcttccacacacttta

SEQ ID NO: 1342400 - DNA, 22 bp, Artificial Sequence
  chemically synthesized
aagtgtgtggaagccctctgga

SEQ ID NO: 1342401 - DNA, 22 bp, Artificial Sequence
  chemically synthesized
cacatgtaaaaatctccagagg

SEQ ID NO: 1342402 - DNA, 22 bp, Artificial Sequence
  chemically synthesized
gtatattccacatgtaaaaatc

SEQ ID NO: 1342403 - DNA, 22 bp, Artificial Sequence
  chemically synthesized
tggagatttttacatgtggaat

SEQ ID NO: 1342404 - DNA, 22 bp, Artificial Sequence
  chemically synthesized
agtaactagtatattccacatg

SEQ ID NO: 1342405 - DNA, 22 bp, Artificial Sequence
  chemically synthesized
gagatttttacatgtggaatat

SEQ ID NO: 1342406 - DNA, 22 bp, Artificial Sequence
  chemically synthesized
ctaagtaactagtatattccac

SEQ ID NO: 1342407 - DNA, 22 bp, Artificial Sequence
  chemically synthesized
ttacatgtggaatatactagtt

SEQ ID NO: 1342408 - DNA, 22 bp, Artificial Sequence
  chemically synthesized
tacatgtggaatatactagtta

SEQ ID NO: 1342409 - DNA, 22 bp, Artificial Sequence
  chemically synthesized
acatgtggaatatactagttac

SEQ ID NO: 1342410 - DNA, 22 bp, Artificial Sequence
  chemically synthesized
catgtggaatatactagttact

SEQ ID NO: 1342411 - DNA, 22 bp, Artificial Sequence
  chemically synthesized
cagagaattactaagtaactag

SEQ ID NO: 1342412 - DNA, 22 bp, Artificial Sequence
  chemically synthesized
cctacagagaattactaagtaa

SEQ ID NO: 1342413 - DNA, 22 bp, Artificial Sequence
  chemically synthesized
gcctacagagaattactaagta

SEQ ID NO: 1342414 - DNA, 22 bp, Artificial Sequence
  chemically synthesized
gccgcttgcctacagagaatta

SEQ ID NO: 1342415 - DNA, 22 bp, Artificial Sequence
  chemically synthesized
agccgcttgcctacagagaatt

SEQ ID NO: 1342416 - DNA, 22 bp, Artificial Sequence
  chemically synthesized
gttacttagtaattctctgtag

SEQ ID NO: 1342417 - DNA, 22 bp, Artificial Sequence
  chemically synthesized
cttagtaattctctgtaggcaa

SEQ ID NO: 1342418 - DNA, 22 bp, Artificial Sequence
  chemically synthesized
agtaattctctgtaggcaagcg

SEQ ID NO: 1342419 - DNA, 22 bp, Artificial Sequence
  chemically synthesized
gtaattctctgtaggcaagcgg

SEQ ID NO: 1342420 - DNA, 22 bp, Artificial Sequence
  chemically synthesized
catacgtgaacttagccgcttg

SEQ ID NO: 1342421 - DNA, 22 bp, Artificial Sequence
  chemically synthesized
ccatacgtgaacttagccgctt

SEQ ID NO: 1342422 - DNA, 22 bp, Artificial Sequence
  chemically synthesized
tccatacgtgaacttagccgct

SEQ ID NO: 1342423 - DNA, 22 bp, Artificial Sequence
  chemically synthesized
tctgtaggcaagcggctaagtt

SEQ ID NO: 1342424 - DNA, 22 bp, Artificial Sequence
  chemically synthesized
tgtaggcaagcggctaagttca

SEQ ID NO: 1342425 - DNA, 22 bp, Artificial Sequence
  chemically synthesized
taggcaagcggctaagttcacg

SEQ ID NO: 1342426 - DNA, 22 bp, Artificial Sequence
  chemically synthesized
atggttttccatacgtgaactt

SEQ ID NO: 1342427 - DNA, 22 bp, Artificial Sequence
  chemically synthesized
aatggttttccatacgtgaact

SEQ ID NO: 1342428 - DNA, 22 bp, Artificial Sequence
  chemically synthesized
agttcacgtatggaaaaccatt

SEQ ID NO: 1342429 - DNA, 22 bp, Artificial Sequence
  chemically synthesized
cagcaatgggtcttaatggttt

SEQ ID NO: 1342430 - DNA, 22 bp, Artificial Sequence
  chemically synthesized
acgtatggaaaaccattaagac

SEQ ID NO: 1342431 - DNA, 22 bp, Artificial Sequence
  chemically synthesized
tgttacagcaatgggtcttaat

SEQ ID NO: 1342432 - DNA, 22 bp, Artificial Sequence
  chemically synthesized
tctgtgttacagcaatgggtct

SEQ ID NO: 1342433 - DNA, 22 bp, Artificial Sequence
  chemically synthesized
gtctgtgttacagcaatgggtc

SEQ ID NO: 1342434 - DNA, 22 bp, Artificial Sequence
  chemically synthesized
agacccattgctgtaacacaga

SEQ ID NO: 1342435 - DNA, 22 bp, Artificial Sequence
  chemically synthesized
acagtaatacccttgtctgtgt

SEQ ID NO: 1342436 - DNA, 22 bp, Artificial Sequence
  chemically synthesized
aacagtaatacccttgtctgtg

SEQ ID NO: 1342437 - DNA, 22 bp, Artificial Sequence
  chemically synthesized
ctgtaacacagacaagggtatt

SEQ ID NO: 1342438 - DNA, 22 bp, Artificial Sequence
  chemically synthesized
taacacagacaagggtattact

SEQ ID NO: 1342439 - DNA, 22 bp, Artificial Sequence
  chemically synthesized
gaatgaccataaaatggcaata

SEQ ID NO: 1342440 - DNA, 22 bp, Artificial Sequence
  chemically synthesized
ggaatgaccataaaatggcaat

SEQ ID NO: 1342441 - DNA, 22 bp, Artificial Sequence
  chemically synthesized
ctgttaagtgtattgccatttt

SEQ ID NO: 1342442 - DNA, 22 bp, Artificial Sequence
  chemically synthesized
ttaagtgtattgccattttatg

SEQ ID NO: 1342443 - DNA, 22 bp, Artificial Sequence
  chemically synthesized
gtttggaatgaccataaaatgg

SEQ ID NO: 1342444 - DNA, 22 bp, Artificial Sequence
  chemically synthesized
tcgtttggaatgaccataaaat

SEQ ID NO: 1342445 - DNA, 22 bp, Artificial Sequence
  chemically synthesized
agtgtattgccattttatggtc

SEQ ID NO: 1342446 - DNA, 22 bp, Artificial Sequence
  chemically synthesized
ctcgtttggaatgaccataaaa

SEQ ID NO: 1342447 - DNA, 22 bp, Artificial Sequence
  chemically synthesized
tctcgtttggaatgaccataaa

SEQ ID NO: 1342448 - DNA, 22 bp, Artificial Sequence
  chemically synthesized
ttctcgtttggaatgaccataa

SEQ ID NO: 1342449 - DNA, 22 bp, Artificial Sequence
  chemically synthesized
ccattttatggtcattccaaac

SEQ ID NO: 1342450 - DNA, 22 bp, Artificial Sequence
  chemically synthesized
tatggtcattccaaacgagaaa

SEQ ID NO: 1342451 - DNA, 22 bp, Artificial Sequence
  chemically synthesized
atggtcattccaaacgagaaaa

SEQ ID NO: 1342452 - DNA, 22 bp, Artificial Sequence
  chemically synthesized
gaatgaagcagcttttctcgtt

SEQ ID NO: 1342453 - DNA, 22 bp, Artificial Sequence
  chemically synthesized
tggtcattccaaacgagaaaag

SEQ ID NO: 1342454 - DNA, 22 bp, Artificial Sequence
  chemically synthesized
ctggaatgaagcagcttttctc

SEQ ID NO: 1342455 - DNA, 22 bp, Artificial Sequence
  chemically synthesized
caaacgagaaaagctgcttcat

SEQ ID NO: 1342456 - DNA, 22 bp, Artificial Sequence
  chemically synthesized
taatagcaatatgattcctgga

SEQ ID NO: 1342457 - DNA, 22 bp, Artificial Sequence
  chemically synthesized
cttcattccaggaatcatattg

SEQ ID NO: 1342458 - DNA, 22 bp, Artificial Sequence
  chemically synthesized
gtgaattataatagcaatatga

SEQ ID NO: 1342459 - DNA, 22 bp, Artificial Sequence
  chemically synthesized
cattccaggaatcatattgcta

SEQ ID NO: 1342460 - DNA, 22 bp, Artificial Sequence
  chemically synthesized
attccaggaatcatattgctat

SEQ ID NO: 1342461 - DNA, 22 bp, Artificial Sequence
  chemically synthesized
tggtgaattataatagcaatat

SEQ ID NO: 1342462 - DNA, 22 bp, Artificial Sequence
  chemically synthesized
ctggtgaattataatagcaata

SEQ ID NO: 1342463 - DNA, 22 bp, Artificial Sequence
  chemically synthesized
tctggtgaattataatagcaat

SEQ ID NO: 1342464 - DNA, 22 bp, Artificial Sequence
  chemically synthesized
caggaatcatattgctattata

SEQ ID NO: 1342465 - DNA, 22 bp, Artificial Sequence
  chemically synthesized
ctattataattcaccagaaaac

SEQ ID NO: 1342466 - DNA, 22 bp, Artificial Sequence
  chemically synthesized
ttataattcaccagaaaaccta

SEQ ID NO: 1342467 - DNA, 22 bp, Artificial Sequence
  chemically synthesized
taattcaccagaaaacctacac

SEQ ID NO: 1342468 - DNA, 22 bp, Artificial Sequence
  chemically synthesized
gaggaaaagaaagtgtaggttt

SEQ ID NO: 1342469 - DNA, 22 bp, Artificial Sequence
  chemically synthesized
ttggaggaaaagaaagtgtagg

SEQ ID NO: 1342470 - DNA, 22 bp, Artificial Sequence
  chemically synthesized
accagaaaacctacactttctt

SEQ ID NO: 1342471 - DNA, 22 bp, Artificial Sequence
  chemically synthesized
tctattggaggaaaagaaagtg

SEQ ID NO: 1342472 - DNA, 22 bp, Artificial Sequence
  chemically synthesized
agtgactgtctattggaggaaa

SEQ ID NO: 1342473 - DNA, 22 bp, Artificial Sequence
  chemically synthesized
aagtgactgtctattggaggaa

SEQ ID NO: 1342474 - DNA, 22 bp, Artificial Sequence
  chemically synthesized
taagtgactgtctattggagga

SEQ ID NO: 1342475 - DNA, 22 bp, Artificial Sequence
  chemically synthesized
cactttcttttcctccaataga

SEQ ID NO: 1342476 - DNA, 22 bp, Artificial Sequence
  chemically synthesized
ctttaagtgactgtctattgga

SEQ ID NO: 1342477 - DNA, 22 bp, Artificial Sequence
  chemically synthesized
gctttaagtgactgtctattgg

SEQ ID NO: 1342478 - DNA, 22 bp, Artificial Sequence
  chemically synthesized
tcttttcctccaatagacagtc

SEQ ID NO: 1342479 - DNA, 22 bp, Artificial Sequence
  chemically synthesized
cttttcctccaatagacagtca

SEQ ID NO: 1342480 - DNA, 22 bp, Artificial Sequence
  chemically synthesized
ttttcctccaatagacagtcac

SEQ ID NO: 1342481 - DNA, 22 bp, Artificial Sequence
  chemically synthesized
ttcctccaatagacagtcactt

SEQ ID NO: 1342482 - DNA, 22 bp, Artificial Sequence
  chemically synthesized
tacatttgctttaagtgactgt

SEQ ID NO: 1342483 - DNA, 22 bp, Artificial Sequence
  chemically synthesized
tcctccaatagacagtcactta

SEQ ID NO: 1342484 - DNA, 22 bp, Artificial Sequence
  chemically synthesized
gtacatttgctttaagtgactg

SEQ ID NO: 1342485 - DNA, 22 bp, Artificial Sequence
  chemically synthesized
cctccaatagacagtcacttaa

SEQ ID NO: 1342486 - DNA, 22 bp, Artificial Sequence
  chemically synthesized
tgtacatttgctttaagtgact

SEQ ID NO: 1342487 - DNA, 22 bp, Artificial Sequence
  chemically synthesized
ctccaatagacagtcacttaaa

SEQ ID NO: 1342488 - DNA, 22 bp, Artificial Sequence
  chemically synthesized
ttgtacatttgctttaagtgac

SEQ ID NO: 1342489 - DNA, 22 bp, Artificial Sequence
  chemically synthesized
tttgtacatttgctttaagtga

SEQ ID NO: 1342490 - DNA, 22 bp, Artificial Sequence
  chemically synthesized
ttttgtacatttgctttaagtg

SEQ ID NO: 1342491 - DNA, 22 bp, Artificial Sequence
  chemically synthesized
caatagacagtcacttaaagca

SEQ ID NO: 1342492 - DNA, 22 bp, Artificial Sequence
  chemically synthesized
tttttgtacatttgctttaagt

SEQ ID NO: 1342493 - DNA, 22 bp, Artificial Sequence
  chemically synthesized
tattttttttgtacatttgctt

SEQ ID NO: 1342494 - DNA, 22 bp, Artificial Sequence
  chemically synthesized
cattgtattttttttgtacatt

SEQ ID NO: 1342495 - DNA, 22 bp, Artificial Sequence
  chemically synthesized
aaagcaaatgtacaaaaaaaat

SEQ ID NO: 1342496 - DNA, 22 bp, Artificial Sequence
  chemically synthesized
aagcaaatgtacaaaaaaaata

SEQ ID NO: 1342497 - DNA, 22 bp, Artificial Sequence
  chemically synthesized
aaccatattccattgtattttt

SEQ ID NO: 1342498 - DNA, 22 bp, Artificial Sequence
  chemically synthesized
ctaaaccatattccattgtatt

SEQ ID NO: 1342499 - DNA, 22 bp, Artificial Sequence
  chemically synthesized
attcctaaaccatattccattg

SEQ ID NO: 1342500 - DNA, 22 bp, Artificial Sequence
  chemically synthesized
attaattcctaaaccatattcc

SEQ ID NO: 1342501 - DNA, 22 bp, Artificial Sequence
  chemically synthesized
cattaattcctaaaccatattc

SEQ ID NO: 1342502 - DNA, 22 bp, Artificial Sequence
  chemically synthesized
tcattaattcctaaaccatatt

SEQ ID NO: 1342503 - DNA, 22 bp, Artificial Sequence
  chemically synthesized
aattttcattaattcctaaacc

SEQ ID NO: 1342504 - DNA, 22 bp, Artificial Sequence
  chemically synthesized
aaattttcattaattcctaaac

SEQ ID NO: 1342505 - DNA, 22 bp, Artificial Sequence
  chemically synthesized
taaattttcattaattcctaaa

SEQ ID NO: 1342506 - DNA, 22 bp, Artificial Sequence
  chemically synthesized
ttaaattttcattaattcctaa

SEQ ID NO: 1342507 - DNA, 22 bp, Artificial Sequence
  chemically synthesized
tttaaattttcattaattccta

SEQ ID NO: 1342508 - DNA, 22 bp, Artificial Sequence
  chemically synthesized
ctttttaaattttcattaattc

SEQ ID NO: 1342509 - DNA, 22 bp, Artificial Sequence
  chemically synthesized
ctgctttttaaattttcattaa

SEQ ID NO: 1342510 - DNA, 22 bp, Artificial Sequence
  chemically synthesized
aggaattaatgaaaatttaaaa

SEQ ID NO: 1342511 - DNA, 22 bp, Artificial Sequence
  chemically synthesized
ggaattaatgaaaatttaaaaa

SEQ ID NO: 1342512 - DNA, 22 bp, Artificial Sequence
  chemically synthesized
aatgggattgctgctttttaaa

SEQ ID NO: 1342513 - DNA, 22 bp, Artificial Sequence
  chemically synthesized
tcaatgggattgctgcttttta

SEQ ID NO: 1342514 - DNA, 22 bp, Artificial Sequence
  chemically synthesized
ctcaatgggattgctgcttttt

SEQ ID NO: 1342515 - DNA, 22 bp, Artificial Sequence
  chemically synthesized
atgaaaatttaaaaagcagcaa

SEQ ID NO: 1342516 - DNA, 22 bp, Artificial Sequence
  chemically synthesized
tcttctcaatgggattgctgct

SEQ ID NO: 1342517 - DNA, 22 bp, Artificial Sequence
  chemically synthesized
tgtcttctcaatgggattgctg

SEQ ID NO: 1342518 - DNA, 22 bp, Artificial Sequence
  chemically synthesized
ctgtcttctcaatgggattgct

SEQ ID NO: 1342519 - DNA, 22 bp, Artificial Sequence
  chemically synthesized
ccttctgtcttctcaatgggat

SEQ ID NO: 1342520 - DNA, 22 bp, Artificial Sequence
  chemically synthesized
aaaaagcagcaatcccattgag

SEQ ID NO: 1342521 - DNA, 22 bp, Artificial Sequence
  chemically synthesized
aaaagcagcaatcccattgaga

SEQ ID NO: 1342522 - DNA, 22 bp, Artificial Sequence
  chemically synthesized
aaatgtattgccttctgtcttc

SEQ ID NO: 1342523 - DNA, 22 bp, Artificial Sequence
  chemically synthesized
aaaatgtattgccttctgtctt

SEQ ID NO: 1342524 - DNA, 22 bp, Artificial Sequence
  chemically synthesized
taaaatgtattgccttctgtct

SEQ ID NO: 1342525 - DNA, 22 bp, Artificial Sequence
  chemically synthesized
ttaaaatgtattgccttctgtc

SEQ ID NO: 1342526 - DNA, 22 bp, Artificial Sequence
  chemically synthesized
agtttttaaaatgtattgcctt

SEQ ID NO: 1342527 - DNA, 22 bp, Artificial Sequence
  chemically synthesized
agaagacagaaggcaatacatt

SEQ ID NO: 1342528 - DNA, 22 bp, Artificial Sequence
  chemically synthesized
cataatgctcagtttttaaaat

SEQ ID NO: 1342529 - DNA, 22 bp, Artificial Sequence
  chemically synthesized
gcataatgctcagtttttaaaa

SEQ ID NO: 1342530 - DNA, 22 bp, Artificial Sequence
  chemically synthesized
ccttgcataatgctcagttttt

SEQ ID NO: 1342531 - DNA, 22 bp, Artificial Sequence
  chemically synthesized
cccttgcataatgctcagtttt

SEQ ID NO: 1342532 - DNA, 22 bp, Artificial Sequence
  chemically synthesized
tcccttgcataatgctcagttt

SEQ ID NO: 1342533 - DNA, 22 bp, Artificial Sequence
  chemically synthesized
aaattttcccttgcataatgct

SEQ ID NO: 1342534 - DNA, 22 bp, Artificial Sequence
  chemically synthesized
taaaaactgagcattatgcaag

SEQ ID NO: 1342535 - DNA, 22 bp, Artificial Sequence
  chemically synthesized
ctcaaattttcccttgcataat

SEQ ID NO: 1342536 - DNA, 22 bp, Artificial Sequence
  chemically synthesized
aaaaactgagcattatgcaagg

SEQ ID NO: 1342537 - DNA, 22 bp, Artificial Sequence
  chemically synthesized
aaaactgagcattatgcaaggg

SEQ ID NO: 1342538 - DNA, 22 bp, Artificial Sequence
  chemically synthesized
aaaactgctcaaattttccctt

SEQ ID NO: 1342539 - DNA, 22 bp, Artificial Sequence
  chemically synthesized
gaaaactgctcaaattttccct

SEQ ID NO: 1342540 - DNA, 22 bp, Artificial Sequence
  chemically synthesized
agcattatgcaagggaaaattt

SEQ ID NO: 1342541 - DNA, 22 bp, Artificial Sequence
  chemically synthesized
acttgaaaactgctcaaatttt

SEQ ID NO: 1342542 - DNA, 22 bp, Artificial Sequence
  chemically synthesized
tgcaagggaaaatttgagcagt

SEQ ID NO: 1342543 - DNA, 22 bp, Artificial Sequence
  chemically synthesized
gagcagttttcaagttagttct

SEQ ID NO: 1342544 - DNA, 22 bp, Artificial Sequence
  chemically synthesized
agcagttttcaagttagttctg

SEQ ID NO: 1342545 - DNA, 22 bp, Artificial Sequence
  chemically synthesized
atgagaacaatacagaactaac

SEQ ID NO: 1342546 - DNA, 22 bp, Artificial Sequence
  chemically synthesized
ttaatgagaacaatacagaact

SEQ ID NO: 1342547 - DNA, 22 bp, Artificial Sequence
  chemically synthesized
gttaatgagaacaatacagaac

SEQ ID NO: 1342548 - DNA, 22 bp, Artificial Sequence
  chemically synthesized
tcaagttagttctgtattgttc

SEQ ID NO: 1342549 - DNA, 22 bp, Artificial Sequence
  chemically synthesized
caagttagttctgtattgttct

SEQ ID NO: 1342550 - DNA, 22 bp, Artificial Sequence
  chemically synthesized
catttgttaatgagaacaatac

SEQ ID NO: 1342551 - DNA, 22 bp, Artificial Sequence
  chemically synthesized
aagttagttctgtattgttctc

SEQ ID NO: 1342552 - DNA, 22 bp, Artificial Sequence
  chemically synthesized
gttctgtattgttctcattaac

SEQ ID NO: 1342553 - DNA, 22 bp, Artificial Sequence
  chemically synthesized
caccatctacatttgttaatga

SEQ ID NO: 1342554 - DNA, 22 bp, Artificial Sequence
  chemically synthesized
tgtattgttctcattaacaaat

SEQ ID NO: 1342555 - DNA, 22 bp, Artificial Sequence
  chemically synthesized
tattgttctcattaacaaatgt

SEQ ID NO: 1342556 - DNA, 22 bp, Artificial Sequence
  chemically synthesized
ttctcattaacaaatgtagatg

SEQ ID NO: 1342557 - DNA, 22 bp, Artificial Sequence
  chemically synthesized
tcattaacaaatgtagatggtg

SEQ ID NO: 1342558 - DNA, 22 bp, Artificial Sequence
  chemically synthesized
tagtaaatgctgcaccatctac

SEQ ID NO: 1342559 - DNA, 22 bp, Artificial Sequence
  chemically synthesized
attaacaaatgtagatggtgca

SEQ ID NO: 1342560 - DNA, 22 bp, Artificial Sequence
  chemically synthesized
tctgtagtaaatgctgcaccat

SEQ ID NO: 1342561 - DNA, 22 bp, Artificial Sequence
  chemically synthesized
acaaatgtagatggtgcagcat

SEQ ID NO: 1342562 - DNA, 22 bp, Artificial Sequence
  chemically synthesized
aatcaattgtctgtagtaaatg

SEQ ID NO: 1342563 - DNA, 22 bp, Artificial Sequence
  chemically synthesized
agtctgaatcaattgtctgtag

SEQ ID NO: 1342564 - DNA, 22 bp, Artificial Sequence
  chemically synthesized
aagtctgaatcaattgtctgta

SEQ ID NO: 1342565 - DNA, 22 bp, Artificial Sequence
  chemically synthesized
actacagacaattgattcagac

SEQ ID NO: 1342566 - DNA, 22 bp, Artificial Sequence
  chemically synthesized
ctacagacaattgattcagact

SEQ ID NO: 1342567 - DNA, 22 bp, Artificial Sequence
  chemically synthesized
cagacaattgattcagacttaa

SEQ ID NO: 1342568 - DNA, 22 bp, Artificial Sequence
  chemically synthesized
tagcccaaaagtttaagtctga

SEQ ID NO: 1342569 - DNA, 22 bp, Artificial Sequence
  chemically synthesized
gtagcccaaaagtttaagtctg

SEQ ID NO: 1342570 - DNA, 22 bp, Artificial Sequence
  chemically synthesized
attcagacttaaacttttgggc

SEQ ID NO: 1342571 - DNA, 22 bp, Artificial Sequence
  chemically synthesized
agacttaaacttttgggctaca

SEQ ID NO: 1342572 - DNA, 22 bp, Artificial Sequence
  chemically synthesized
aaatataaatgatttgtagccc

SEQ ID NO: 1342573 - DNA, 22 bp, Artificial Sequence
  chemically synthesized
tgaaatataaatgatttgtagc

SEQ ID NO: 1342574 - DNA, 22 bp, Artificial Sequence
  chemically synthesized
aaacttttgggctacaaatcat

SEQ ID NO: 1342575 - DNA, 22 bp, Artificial Sequence
  chemically synthesized
tctgaaatataaatgatttgta

SEQ ID NO: 1342576 - DNA, 22 bp, Artificial Sequence
  chemically synthesized
aacttttgggctacaaatcatt

SEQ ID NO: 1342577 - DNA, 22 bp, Artificial Sequence
  chemically synthesized
ctctgaaatataaatgatttgt

SEQ ID NO: 1342578 - DNA, 22 bp, Artificial Sequence
  chemically synthesized
tctctgaaatataaatgatttg

SEQ ID NO: 1342579 - DNA, 22 bp, Artificial Sequence
  chemically synthesized
ttctctgaaatataaatgattt

SEQ ID NO: 1342580 - DNA, 22 bp, Artificial Sequence
  chemically synthesized
tttctctgaaatataaatgatt

SEQ ID NO: 1342581 - DNA, 22 bp, Artificial Sequence
  chemically synthesized
ttgggctacaaatcatttatat

SEQ ID NO: 1342582 - DNA, 22 bp, Artificial Sequence
  chemically synthesized
tgggctacaaatcatttatatt

SEQ ID NO: 1342583 - DNA, 22 bp, Artificial Sequence
  chemically synthesized
gggctacaaatcatttatattt

SEQ ID NO: 1342584 - DNA, 22 bp, Artificial Sequence
  chemically synthesized
ggctacaaatcatttatatttc

SEQ ID NO: 1342585 - DNA, 22 bp, Artificial Sequence
  chemically synthesized
caaatcatttatatttcagaga

SEQ ID NO: 1342586 - DNA, 22 bp, Artificial Sequence
  chemically synthesized
accacatattttttctctgaaa

SEQ ID NO: 1342587 - DNA, 22 bp, Artificial Sequence
  chemically synthesized
gaccacatattttttctctgaa

SEQ ID NO: 1342588 - DNA, 22 bp, Artificial Sequence
  chemically synthesized
tgaccacatattttttctctga

SEQ ID NO: 1342589 - DNA, 22 bp, Artificial Sequence
  chemically synthesized
ttgaccacatattttttctctg

SEQ ID NO: 1342590 - DNA, 22 bp, Artificial Sequence
  chemically synthesized
tttttgaccacatattttttct

SEQ ID NO: 1342591 - DNA, 22 bp, Artificial Sequence
  chemically synthesized
atatttcagagaaaaaatatgt

SEQ ID NO: 1342592 - DNA, 22 bp, Artificial Sequence
  chemically synthesized
tatttcagagaaaaaatatgtg

SEQ ID NO: 1342593 - DNA, 22 bp, Artificial Sequence
  chemically synthesized
gttgtttttgaccacatatttt

SEQ ID NO: 1342594 - DNA, 22 bp, Artificial Sequence
  chemically synthesized
cctagttgtttttgaccacata

SEQ ID NO: 1342595 - DNA, 22 bp, Artificial Sequence
  chemically synthesized
cagagaaaaaatatgtggtcaa

SEQ ID NO: 1342596 - DNA, 22 bp, Artificial Sequence
  chemically synthesized
agagaaaaaatatgtggtcaaa

SEQ ID NO: 1342597 - DNA, 22 bp, Artificial Sequence
  chemically synthesized
caggcgtgagccaacgccccct

SEQ ID NO: 1342598 - DNA, 22 bp, Artificial Sequence
  chemically synthesized
ggattacaggcgtgagccaacg

SEQ ID NO: 1342599 - DNA, 22 bp, Artificial Sequence
  chemically synthesized
tgggattacaggcgtgagccaa

SEQ ID NO: 1342600 - DNA, 22 bp, Artificial Sequence
  chemically synthesized
ggcagggggcgttggctcacgc

SEQ ID NO: 1342601 - DNA, 22 bp, Artificial Sequence
  chemically synthesized
ccaaagttctgggattacaggc

SEQ ID NO: 1342602 - DNA, 22 bp, Artificial Sequence
  chemically synthesized
gctcacgcctgtaatcccagaa

SEQ ID NO: 1342603 - DNA, 22 bp, Artificial Sequence
  chemically synthesized
ggcctcccaaagttctgggatt

SEQ ID NO: 1342604 - DNA, 22 bp, Artificial Sequence
  chemically synthesized
acgcctgtaatcccagaacttt

SEQ ID NO: 1342605 - DNA, 22 bp, Artificial Sequence
  chemically synthesized
cctcggcctcccaaagttctgg

SEQ ID NO: 1342606 - DNA, 22 bp, Artificial Sequence
  chemically synthesized
taatcccagaactttgggaggc

SEQ ID NO: 1342607 - DNA, 22 bp, Artificial Sequence
  chemically synthesized
ggtgatccgcctgcctcggcct

SEQ ID NO: 1342608 - DNA, 22 bp, Artificial Sequence
  chemically synthesized
aggtgatccgcctgcctcggcc

SEQ ID NO: 1342609 - DNA, 22 bp, Artificial Sequence
  chemically synthesized
tgggaggccgaggcaggcggat

SEQ ID NO: 1342610 - DNA, 22 bp, Artificial Sequence
  chemically synthesized
gggaggccgaggcaggcggatc

SEQ ID NO: 1342611 - DNA, 22 bp, Artificial Sequence
  chemically synthesized
ccaaccttaggtgatccgcctg

SEQ ID NO: 1342612 - DNA, 22 bp, Artificial Sequence
  chemically synthesized
ggaggccgaggcaggcggatca

SEQ ID NO: 1342613 - DNA, 22 bp, Artificial Sequence
  chemically synthesized
aactcccaaccttaggtgatcc

SEQ ID NO: 1342614 - DNA, 22 bp, Artificial Sequence
  chemically synthesized
aaactcccaaccttaggtgatc

SEQ ID NO: 1342615 - DNA, 22 bp, Artificial Sequence
  chemically synthesized
gtcttaaactcccaaccttagg

SEQ ID NO: 1342616 - DNA, 22 bp, Artificial Sequence
  chemically synthesized
gtcaggctggtcttaaactccc

SEQ ID NO: 1342617 - DNA, 22 bp, Artificial Sequence
  chemically synthesized
aggttgggagtttaagaccagc

SEQ ID NO: 1342618 - DNA, 22 bp, Artificial Sequence
  chemically synthesized
catgttggtcaggctggtctta

SEQ ID NO: 1342619 - DNA, 22 bp, Artificial Sequence
  chemically synthesized
tccatgttggtcaggctggtct

SEQ ID NO: 1342620 - DNA, 22 bp, Artificial Sequence
  chemically synthesized
ctccatgttggtcaggctggtc

SEQ ID NO: 1342621 - DNA, 22 bp, Artificial Sequence
  chemically synthesized
ggagtttaagaccagcctgacc

SEQ ID NO: 1342622 - DNA, 22 bp, Artificial Sequence
  chemically synthesized
aagaccagcctgaccaacatgg

SEQ ID NO: 1342623 - DNA, 22 bp, Artificial Sequence
  chemically synthesized
agaccagcctgaccaacatgga

SEQ ID NO: 1342624 - DNA, 22 bp, Artificial Sequence
  chemically synthesized
atagaaacggggtttctccatg

SEQ ID NO: 1342625 - DNA, 22 bp, Artificial Sequence
  chemically synthesized
aatagaaacggggtttctccat

SEQ ID NO: 1342626 - DNA, 22 bp, Artificial Sequence
  chemically synthesized
taatagaaacggggtttctcca

SEQ ID NO: 1342627 - DNA, 22 bp, Artificial Sequence
  chemically synthesized
ttaatagaaacggggtttctcc

SEQ ID NO: 1342628 - DNA, 22 bp, Artificial Sequence
  chemically synthesized
accaacatggagaaaccccgtt

SEQ ID NO: 1342629 - DNA, 22 bp, Artificial Sequence
  chemically synthesized
tatttttaatagaaacggggtt

SEQ ID NO: 1342630 - DNA, 22 bp, Artificial Sequence
  chemically synthesized
gtatttttaatagaaacggggt

SEQ ID NO: 1342631 - DNA, 22 bp, Artificial Sequence
  chemically synthesized
tgtatttttaatagaaacgggg

SEQ ID NO: 1342632 - DNA, 22 bp, Artificial Sequence
  chemically synthesized
actttgtatttttaatagaaac

SEQ ID NO: 1342633 - DNA, 22 bp, Artificial Sequence
  chemically synthesized
ccatgcccggctaactttgtat

SEQ ID NO: 1342634 - DNA, 22 bp, Artificial Sequence
  chemically synthesized
ctattaaaaatacaaagttagc

SEQ ID NO: 1342635 - DNA, 22 bp, Artificial Sequence
  chemically synthesized
tattaaaaatacaaagttagcc

SEQ ID NO: 1342636 - DNA, 22 bp, Artificial Sequence
  chemically synthesized
ttaaaaatacaaagttagccgg

SEQ ID NO: 1342637 - DNA, 22 bp, Artificial Sequence
  chemically synthesized
aaaatacaaagttagccgggca

SEQ ID NO: 1342638 - DNA, 22 bp, Artificial Sequence
  chemically synthesized
taggcaatgcactaccatgccc

SEQ ID NO: 1342639 - DNA, 22 bp, Artificial Sequence
  chemically synthesized
ggattataggcaatgcactacc

SEQ ID NO: 1342640 - DNA, 22 bp, Artificial Sequence
  chemically synthesized
gccgggcatggtagtgcattgc

SEQ ID NO: 1342641 - DNA, 22 bp, Artificial Sequence
  chemically synthesized
ccaagtagctgggattataggc

SEQ ID NO: 1342642 - DNA, 22 bp, Artificial Sequence
  chemically synthesized
agcctcccaagtagctgggatt

SEQ ID NO: 1342643 - DNA, 22 bp, Artificial Sequence
  chemically synthesized
cctcagcctcccaagtagctgg

SEQ ID NO: 1342644 - DNA, 22 bp, Artificial Sequence
  chemically synthesized
cctataatcccagctacttggg

SEQ ID NO: 1342645 - DNA, 22 bp, Artificial Sequence
  chemically synthesized
ctgcctcagcctcccaagtagc

SEQ ID NO: 1342646 - DNA, 22 bp, Artificial Sequence
  chemically synthesized
tcctgcctcagcctcccaagta

SEQ ID NO: 1342647 - DNA, 22 bp, Artificial Sequence
  chemically synthesized
taatcccagctacttgggaggc

SEQ ID NO: 1342648 - DNA, 22 bp, Artificial Sequence
  chemically synthesized
aagtgattctcctgcctcagcc

SEQ ID NO: 1342649 - DNA, 22 bp, Artificial Sequence
  chemically synthesized
cttgggaggctgaggcaggaga

SEQ ID NO: 1342650 - DNA, 22 bp, Artificial Sequence
  chemically synthesized
ggttcaagtgattctcctgcct

SEQ ID NO: 1342651 - DNA, 22 bp, Artificial Sequence
  chemically synthesized
gggaggctgaggcaggagaatc

SEQ ID NO: 1342652 - DNA, 22 bp, Artificial Sequence
  chemically synthesized
ctgggttcaagtgattctcctg

SEQ ID NO: 1342653 - DNA, 22 bp, Artificial Sequence
  chemically synthesized
ggaggctgaggcaggagaatca

SEQ ID NO: 1342654 - DNA, 22 bp, Artificial Sequence
  chemically synthesized
cacctcctgggttcaagtgatt

SEQ ID NO: 1342655 - DNA, 22 bp, Artificial Sequence
  chemically synthesized
aggcaggagaatcacttgaacc

SEQ ID NO: 1342656 - DNA, 22 bp, Artificial Sequence
  chemically synthesized
cgcaacctccacctcctgggtt

SEQ ID NO: 1342657 - DNA, 22 bp, Artificial Sequence
  chemically synthesized
tccgcaacctccacctcctggg

SEQ ID NO: 1342658 - DNA, 22 bp, Artificial Sequence
  chemically synthesized
ggctctccgcaacctccacctc

SEQ ID NO: 1342659 - DNA, 22 bp, Artificial Sequence
  chemically synthesized
gaacccaggaggtggaggttgc

SEQ ID NO: 1342660 - DNA, 22 bp, Artificial Sequence
  chemically synthesized
aacccaggaggtggaggttgcg

SEQ ID NO: 1342661 - DNA, 22 bp, Artificial Sequence
  chemically synthesized
gagtgcaatggcacgatctcgg

SEQ ID NO: 1342662 - DNA, 22 bp, Artificial Sequence
  chemically synthesized
cggagagccgagatcgtgccat

SEQ ID NO: 1342663 - DNA, 22 bp, Artificial Sequence
  chemically synthesized
cccaggctggagtgcaatggca

SEQ ID NO: 1342664 - DNA, 22 bp, Artificial Sequence
  chemically synthesized
ttgcccaggctggagtgcaatg

SEQ ID NO: 1342665 - DNA, 22 bp, Artificial Sequence
  chemically synthesized
gttgcccaggctggagtgcaat

SEQ ID NO: 1342666 - DNA, 22 bp, Artificial Sequence
  chemically synthesized
ttgttgcccaggctggagtgca

SEQ ID NO: 1342667 - DNA, 22 bp, Artificial Sequence
  chemically synthesized
actcttgttgcccaggctggag

SEQ ID NO: 1342668 - DNA, 22 bp, Artificial Sequence
  chemically synthesized
cactcttgttgcccaggctgga

SEQ ID NO: 1342669 - DNA, 22 bp, Artificial Sequence
  chemically synthesized
cactccagcctgggcaacaaga

SEQ ID NO: 1342670 - DNA, 22 bp, Artificial Sequence
  chemically synthesized
agaccgagtttcactcttgttg

SEQ ID NO: 1342671 - DNA, 22 bp, Artificial Sequence
  chemically synthesized
gagaccgagtttcactcttgtt

SEQ ID NO: 1342672 - DNA, 22 bp, Artificial Sequence
  chemically synthesized
tgagaccgagtttcactcttgt

SEQ ID NO: 1342673 - DNA, 22 bp, Artificial Sequence
  chemically synthesized
cagcctgggcaacaagagtgaa

SEQ ID NO: 1342674 - DNA, 22 bp, Artificial Sequence
  chemically synthesized
ttttgagaccgagtttcactct

SEQ ID NO: 1342675 - DNA, 22 bp, Artificial Sequence
  chemically synthesized
gttttgagaccgagtttcactc

SEQ ID NO: 1342676 - DNA, 22 bp, Artificial Sequence
  chemically synthesized
tttgttttgagaccgagtttca

SEQ ID NO: 1342677 - DNA, 22 bp, Artificial Sequence
  chemically synthesized
ggcaacaagagtgaaactcggt

SEQ ID NO: 1342678 - DNA, 22 bp, Artificial Sequence
  chemically synthesized
gtttgttttgagaccgagtttc

SEQ ID NO: 1342679 - DNA, 22 bp, Artificial Sequence
  chemically synthesized
tttgtttgttttgagaccgagt

SEQ ID NO: 1342680 - DNA, 22 bp, Artificial Sequence
  chemically synthesized
gtttgtttgttttgagaccgag

SEQ ID NO: 1342681 - DNA, 22 bp, Artificial Sequence
  chemically synthesized
tttgtttgtttgttttgagacc

SEQ ID NO: 1342682 - DNA, 22 bp, Artificial Sequence
  chemically synthesized
gtttgtttgtttgttttgagac

SEQ ID NO: 1342683 - DNA, 22 bp, Artificial Sequence
  chemically synthesized
tgtttgtttgtttgttttgaga

SEQ ID NO: 1342684 - DNA, 22 bp, Artificial Sequence
  chemically synthesized
ttttgtttgtttgtttgttttg

SEQ ID NO: 1342685 - DNA, 22 bp, Artificial Sequence
  chemically synthesized
gttttgtttgtttgtttgtttt

SEQ ID NO: 1342686 - DNA, 22 bp, Artificial Sequence
  chemically synthesized
tgttttgtttgtttgtttgttt

SEQ ID NO: 1342687 - DNA, 22 bp, Artificial Sequence
  chemically synthesized
ttttgttttgtttgtttgtttg

SEQ ID NO: 1342688 - DNA, 22 bp, Artificial Sequence
  chemically synthesized
gttttgttttgtttgtttgttt

SEQ ID NO: 1342689 - DNA, 22 bp, Artificial Sequence
  chemically synthesized
ggtctcaaaacaaacaaacaaa

SEQ ID NO: 1342690 - DNA, 22 bp, Artificial Sequence
  chemically synthesized
tgttttgttttgtttgtttgtt

SEQ ID NO: 1342691 - DNA, 22 bp, Artificial Sequence
  chemically synthesized
aaaacaaacaaacaaacaaaac

SEQ ID NO: 1342692 - DNA, 22 bp, Artificial Sequence
  chemically synthesized
tgggaaatacagttttgttttg

SEQ ID NO: 1342693 - DNA, 22 bp, Artificial Sequence
  chemically synthesized
gtgggaaatacagttttgtttt

SEQ ID NO: 1342694 - DNA, 22 bp, Artificial Sequence
  chemically synthesized
ttgtgggaaatacagttttgtt

SEQ ID NO: 1342695 - DNA, 22 bp, Artificial Sequence
  chemically synthesized
atgtctcttgtgggaaatacag

SEQ ID NO: 1342696 - DNA, 22 bp, Artificial Sequence
  chemically synthesized
aatgtctcttgtgggaaataca

SEQ ID NO: 1342697 - DNA, 22 bp, Artificial Sequence
  chemically synthesized
tatttcccacaagagacattaa

SEQ ID NO: 1342698 - DNA, 22 bp, Artificial Sequence
  chemically synthesized
cccacaagagacattaaactat

SEQ ID NO: 1342699 - DNA, 22 bp, Artificial Sequence
  chemically synthesized
ccacaagagacattaaactatt

SEQ ID NO: 1342700 - DNA, 22 bp, Artificial Sequence
  chemically synthesized
aggtagtaaataaaaacaaaaa

SEQ ID NO: 1342701 - DNA, 22 bp, Artificial Sequence
  chemically synthesized
aactatttttgtttttatttac

SEQ ID NO: 1342702 - DNA, 22 bp, Artificial Sequence
  chemically synthesized
cgtaacattaaggtagtaaata

SEQ ID NO: 1342703 - DNA, 22 bp, Artificial Sequence
  chemically synthesized
tttttgtttttatttactacct

SEQ ID NO: 1342704 - DNA, 22 bp, Artificial Sequence
  chemically synthesized
ttgtttttatttactaccttaa

SEQ ID NO: 1342705 - DNA, 22 bp, Artificial Sequence
  chemically synthesized
tgtttttatttactaccttaat

SEQ ID NO: 1342706 - DNA, 22 bp, Artificial Sequence
  chemically synthesized
gtttttatttactaccttaatg

SEQ ID NO: 1342707 - DNA, 22 bp, Artificial Sequence
  chemically synthesized
tttttatttactaccttaatgt

SEQ ID NO: 1342708 - DNA, 22 bp, Artificial Sequence
  chemically synthesized
aaaaattgcgtaacattaaggt

SEQ ID NO: 1342709 - DNA, 22 bp, Artificial Sequence
  chemically synthesized
gaaaaattgcgtaacattaagg

SEQ ID NO: 1342710 - DNA, 22 bp, Artificial Sequence
  chemically synthesized
tgaaaaattgcgtaacattaag

SEQ ID NO: 1342711 - DNA, 22 bp, Artificial Sequence
  chemically synthesized
ttatttactaccttaatgttac

SEQ ID NO: 1342712 - DNA, 22 bp, Artificial Sequence
  chemically synthesized
ttgaaaaattgcgtaacattaa

SEQ ID NO: 1342713 - DNA, 22 bp, Artificial Sequence
  chemically synthesized
tatttactaccttaatgttacg

SEQ ID NO: 1342714 - DNA, 22 bp, Artificial Sequence
  chemically synthesized
atttactaccttaatgttacgc

SEQ ID NO: 1342715 - DNA, 22 bp, Artificial Sequence
  chemically synthesized
ttttgaaaaattgcgtaacatt

SEQ ID NO: 1342716 - DNA, 22 bp, Artificial Sequence
  chemically synthesized
tttactaccttaatgttacgca

SEQ ID NO: 1342717 - DNA, 22 bp, Artificial Sequence
  chemically synthesized
cttttgaaaaattgcgtaacat

SEQ ID NO: 1342718 - DNA, 22 bp, Artificial Sequence
  chemically synthesized
tcttttgaaaaattgcgtaaca

SEQ ID NO: 1342719 - DNA, 22 bp, Artificial Sequence
  chemically synthesized
actaccttaatgttacgcaatt

SEQ ID NO: 1342720 - DNA, 22 bp, Artificial Sequence
  chemically synthesized
ctaccttaatgttacgcaattt

SEQ ID NO: 1342721 - DNA, 22 bp, Artificial Sequence
  chemically synthesized
tattttcttttgaaaaattgcg

SEQ ID NO: 1342722 - DNA, 22 bp, Artificial Sequence
  chemically synthesized
ccttaatgttacgcaatttttc

SEQ ID NO: 1342723 - DNA, 22 bp, Artificial Sequence
  chemically synthesized
aatgttacgcaatttttcaaaa

SEQ ID NO: 1342724 - DNA, 22 bp, Artificial Sequence
  chemically synthesized
atgttacgcaatttttcaaaag

SEQ ID NO: 1342725 - DNA, 22 bp, Artificial Sequence
  chemically synthesized
cagtattatattttcttttgaa

SEQ ID NO: 1342726 - DNA, 22 bp, Artificial Sequence
  chemically synthesized
cgcaatttttcaaaagaaaata

SEQ ID NO: 1342727 - DNA, 22 bp, Artificial Sequence
  chemically synthesized
cgtctacagtattatattttct

SEQ ID NO: 1342728 - DNA, 22 bp, Artificial Sequence
  chemically synthesized
acgtctacagtattatattttc

SEQ ID NO: 1342729 - DNA, 22 bp, Artificial Sequence
  chemically synthesized
tacgtctacagtattatatttt

SEQ ID NO: 1342730 - DNA, 22 bp, Artificial Sequence
  chemically synthesized
ttacgtctacagtattatattt

SEQ ID NO: 1342731 - DNA, 22 bp, Artificial Sequence
  chemically synthesized
tttacgtctacagtattatatt

SEQ ID NO: 1342732 - DNA, 22 bp, Artificial Sequence
  chemically synthesized
ttcaaaagaaaatataatactg

SEQ ID NO: 1342733 - DNA, 22 bp, Artificial Sequence
  chemically synthesized
tcaaaagaaaatataatactgt

SEQ ID NO: 1342734 - DNA, 22 bp, Artificial Sequence
  chemically synthesized
caaaagaaaatataatactgta

SEQ ID NO: 1342735 - DNA, 22 bp, Artificial Sequence
  chemically synthesized
aaaagaaaatataatactgtag

SEQ ID NO: 1342736 - DNA, 22 bp, Artificial Sequence
  chemically synthesized
aattttttacgtctacagtatt

SEQ ID NO: 1342737 - DNA, 22 bp, Artificial Sequence
  chemically synthesized
aaattttttacgtctacagtat

SEQ ID NO: 1342738 - DNA, 22 bp, Artificial Sequence
  chemically synthesized
taaattttttacgtctacagta

SEQ ID NO: 1342739 - DNA, 22 bp, Artificial Sequence
  chemically synthesized
atacgttttaaattttttacgt

SEQ ID NO: 1342740 - DNA, 22 bp, Artificial Sequence
  chemically synthesized
catacgttttaaattttttacg

SEQ ID NO: 1342741 - DNA, 22 bp, Artificial Sequence
  chemically synthesized
tcatacgttttaaattttttac

SEQ ID NO: 1342742 - DNA, 22 bp, Artificial Sequence
  chemically synthesized
tagacgtaaaaaatttaaaacg

SEQ ID NO: 1342743 - DNA, 22 bp, Artificial Sequence
  chemically synthesized
atatatcccagttttcatacgt

SEQ ID NO: 1342744 - DNA, 22 bp, Artificial Sequence
  chemically synthesized
aaaacgtatgaaaactgggata

SEQ ID NO: 1342745 - DNA, 22 bp, Artificial Sequence
  chemically synthesized
agataattgatatatcccagtt

SEQ ID NO: 1342746 - DNA, 22 bp, Artificial Sequence
  chemically synthesized
aaacgtatgaaaactgggatat

SEQ ID NO: 1342747 - DNA, 22 bp, Artificial Sequence
  chemically synthesized
aagataattgatatatcccagt

SEQ ID NO: 1342748 - DNA, 22 bp, Artificial Sequence
  chemically synthesized
taagataattgatatatcccag

SEQ ID NO: 1342749 - DNA, 22 bp, Artificial Sequence
  chemically synthesized
tttaagataattgatatatccc

SEQ ID NO: 1342750 - DNA, 22 bp, Artificial Sequence
  chemically synthesized
ctttaagataattgatatatcc

SEQ ID NO: 1342751 - DNA, 22 bp, Artificial Sequence
  chemically synthesized
aggaatatcttctttaagataa

SEQ ID NO: 1342752 - DNA, 22 bp, Artificial Sequence
  chemically synthesized
ggatatatcaattatcttaaag

SEQ ID NO: 1342753 - DNA, 22 bp, Artificial Sequence
  chemically synthesized
caggaatatcttctttaagata

SEQ ID NO: 1342754 - DNA, 22 bp, Artificial Sequence
  chemically synthesized
agtatgtttcaggaatatcttc

SEQ ID NO: 1342755 - DNA, 22 bp, Artificial Sequence
  chemically synthesized
aagtatgtttcaggaatatctt

SEQ ID NO: 1342756 - DNA, 22 bp, Artificial Sequence
  chemically synthesized
tcttaaagaagatattcctgaa

SEQ ID NO: 1342757 - DNA, 22 bp, Artificial Sequence
  chemically synthesized
aatcttaagtatgtttcaggaa

SEQ ID NO: 1342758 - DNA, 22 bp, Artificial Sequence
  chemically synthesized
aaagaagatattcctgaaacat

SEQ ID NO: 1342759 - DNA, 22 bp, Artificial Sequence
  chemically synthesized
aagaagatattcctgaaacata

SEQ ID NO: 1342760 - DNA, 22 bp, Artificial Sequence
  chemically synthesized
aatattaaatcttaagtatgtt

SEQ ID NO: 1342761 - DNA, 22 bp, Artificial Sequence
  chemically synthesized
caatattaaatcttaagtatgt

SEQ ID NO: 1342762 - DNA, 22 bp, Artificial Sequence
  chemically synthesized
ctgaaacatacttaagatttaa

SEQ ID NO: 1342763 - DNA, 22 bp, Artificial Sequence
  chemically synthesized
tatatttcaatattaaatctta

SEQ ID NO: 1342764 - DNA, 22 bp, Artificial Sequence
  chemically synthesized
aaacatacttaagatttaatat

SEQ ID NO: 1342765 - DNA, 22 bp, Artificial Sequence
  chemically synthesized
aacaattatatatttcaatatt

SEQ ID NO: 1342766 - DNA, 22 bp, Artificial Sequence
  chemically synthesized
aaacaattatatatttcaatat

SEQ ID NO: 1342767 - DNA, 22 bp, Artificial Sequence
  chemically synthesized
taaacaattatatatttcaata

SEQ ID NO: 1342768 - DNA, 22 bp, Artificial Sequence
  chemically synthesized
ttaaacaattatatatttcaat

SEQ ID NO: 1342769 - DNA, 22 bp, Artificial Sequence
  chemically synthesized
aagatttaatattgaaatatat

SEQ ID NO: 1342770 - DNA, 22 bp, Artificial Sequence
  chemically synthesized
agatttaatattgaaatatata

SEQ ID NO: 1342771 - DNA, 22 bp, Artificial Sequence
  chemically synthesized
atgtatttttaaacaattatat

SEQ ID NO: 1342772 - DNA, 22 bp, Artificial Sequence
  chemically synthesized
aatattgaaatatataattgtt

SEQ ID NO: 1342773 - DNA, 22 bp, Artificial Sequence
  chemically synthesized
aatgtatttttaaacaattata

SEQ ID NO: 1342774 - DNA, 22 bp, Artificial Sequence
  chemically synthesized
atattgaaatatataattgttt

SEQ ID NO: 1342775 - DNA, 22 bp, Artificial Sequence
  chemically synthesized
aaatatataattgtttaaaaat

SEQ ID NO: 1342776 - DNA, 22 bp, Artificial Sequence
  chemically synthesized
aacaatatttaatgtattttta

SEQ ID NO: 1342777 - DNA, 22 bp, Artificial Sequence
  chemically synthesized
aaacaatatttaatgtattttt

SEQ ID NO: 1342778 - DNA, 22 bp, Artificial Sequence
  chemically synthesized
taaacaatatttaatgtatttt

SEQ ID NO: 1342779 - DNA, 22 bp, Artificial Sequence
  chemically synthesized
tttaaacaatatttaatgtatt

SEQ ID NO: 1342780 - DNA, 22 bp, Artificial Sequence
  chemically synthesized
ctttaaacaatatttaatgtat

SEQ ID NO: 1342781 - DNA, 22 bp, Artificial Sequence
  chemically synthesized
tttaaaaatacattaaatattg

SEQ ID NO: 1342782 - DNA, 22 bp, Artificial Sequence
  chemically synthesized
aaaaatacattaaatattgttt

SEQ ID NO: 1342783 - DNA, 22 bp, Artificial Sequence
  chemically synthesized
aaaatacattaaatattgttta

SEQ ID NO: 1342784 - DNA, 22 bp, Artificial Sequence
  chemically synthesized
acagaatttctttaaacaatat

SEQ ID NO: 1342785 - DNA, 22 bp, Artificial Sequence
  chemically synthesized
aacagaatttctttaaacaata

SEQ ID NO: 1342786 - DNA, 22 bp, Artificial Sequence
  chemically synthesized
taacagaatttctttaaacaat

SEQ ID NO: 1342787 - DNA, 22 bp, Artificial Sequence
  chemically synthesized
ttaacagaatttctttaaacaa

SEQ ID NO: 1342788 - DNA, 22 bp, Artificial Sequence
  chemically synthesized
aatattgtttaaagaaattctg

SEQ ID NO: 1342789 - DNA, 22 bp, Artificial Sequence
  chemically synthesized
tttaaagaaattctgttaaaag

SEQ ID NO: 1342790 - DNA, 22 bp, Artificial Sequence
  chemically synthesized
aaagaaattctgttaaaagctg

SEQ ID NO: 1342791 - DNA, 22 bp, Artificial Sequence
  chemically synthesized
aagaaattctgttaaaagctgt

SEQ ID NO: 1342792 - DNA, 22 bp, Artificial Sequence
  chemically synthesized
ataatgtgccccacagctttta

SEQ ID NO: 1342793 - DNA, 22 bp, Artificial Sequence
  chemically synthesized
cataatgtgccccacagctttt

SEQ ID NO: 1342794 - DNA, 22 bp, Artificial Sequence
  chemically synthesized
ccttcataatgtgccccacagc

SEQ ID NO: 1342795 - DNA, 22 bp, Artificial Sequence
  chemically synthesized
tgttaaaagctgtggggcacat

SEQ ID NO: 1342796 - DNA, 22 bp, Artificial Sequence
  chemically synthesized
ttaaaagctgtggggcacatta

SEQ ID NO: 1342797 - DNA, 22 bp, Artificial Sequence
  chemically synthesized
aaagctgtggggcacattatga

SEQ ID NO: 1342798 - DNA, 22 bp, Artificial Sequence
  chemically synthesized
tggggcacattatgaaggcaat

SEQ ID NO: 1342799 - DNA, 22 bp, Artificial Sequence
  chemically synthesized
taacaaaggtaaagaagtgagt

SEQ ID NO: 1342800 - DNA, 22 bp, Artificial Sequence
  chemically synthesized
ataacaaaggtaaagaagtgag

SEQ ID NO: 1342801 - DNA, 22 bp, Artificial Sequence
  chemically synthesized
tgaaggcaatactcacttcttt

SEQ ID NO: 1342802 - DNA, 22 bp, Artificial Sequence
  chemically synthesized
tataacaaaggtaaagaagtga

SEQ ID NO: 1342803 - DNA, 22 bp, Artificial Sequence
  chemically synthesized
attttataacaaaggtaaagaa

SEQ ID NO: 1342804 - DNA, 22 bp, Artificial Sequence
  chemically synthesized
acttctttacctttgttataaa

SEQ ID NO: 1342805 - DNA, 22 bp, Artificial Sequence
  chemically synthesized
atggacaaaattaattttataa

SEQ ID NO: 1342806 - DNA, 22 bp, Artificial Sequence
  chemically synthesized
ctttacctttgttataaaatta

SEQ ID NO: 1342807 - DNA, 22 bp, Artificial Sequence
  chemically synthesized
tttacctttgttataaaattaa

SEQ ID NO: 1342808 - DNA, 22 bp, Artificial Sequence
  chemically synthesized
tacctttgttataaaattaatt

SEQ ID NO: 1342809 - DNA, 22 bp, Artificial Sequence
  chemically synthesized
acctttgttataaaattaattt

SEQ ID NO: 1342810 - DNA, 22 bp, Artificial Sequence
  chemically synthesized
cctttgttataaaattaatttt

SEQ ID NO: 1342811 - DNA, 22 bp, Artificial Sequence
  chemically synthesized
tgttataaaattaattttgtcc

SEQ ID NO: 1342812 - DNA, 22 bp, Artificial Sequence
  chemically synthesized
gttataaaattaattttgtcca

SEQ ID NO: 1342813 - DNA, 22 bp, Artificial Sequence
  chemically synthesized
atgaaaaattgatggacaaaat

SEQ ID NO: 1342814 - DNA, 22 bp, Artificial Sequence
  chemically synthesized
ttataaaattaattttgtccat

SEQ ID NO: 1342815 - DNA, 22 bp, Artificial Sequence
  chemically synthesized
taaaattaattttgtccatcaa

SEQ ID NO: 1342816 - DNA, 22 bp, Artificial Sequence
  chemically synthesized
attgatgaaaaattgatggaca

SEQ ID NO: 1342817 - DNA, 22 bp, Artificial Sequence
  chemically synthesized
gattgatgaaaaattgatggac

SEQ ID NO: 1342818 - DNA, 22 bp, Artificial Sequence
  chemically synthesized
attttgtccatcaatttttcat

SEQ ID NO: 1342819 - DNA, 22 bp, Artificial Sequence
  chemically synthesized
tgtccatcaatttttcatcaat

SEQ ID NO: 1342820 - DNA, 22 bp, Artificial Sequence
  chemically synthesized
gtccatcaatttttcatcaatc

SEQ ID NO: 1342821 - DNA, 22 bp, Artificial Sequence
  chemically synthesized
tccatcaatttttcatcaatca

SEQ ID NO: 1342822 - DNA, 22 bp, Artificial Sequence
  chemically synthesized
aagtgtatagataaaccttgat

SEQ ID NO: 1342823 - DNA, 22 bp, Artificial Sequence
  chemically synthesized
caagtgtatagataaaccttga

SEQ ID NO: 1342824 - DNA, 22 bp, Artificial Sequence
  chemically synthesized
tcaagtgtatagataaaccttg

SEQ ID NO: 1342825 - DNA, 22 bp, Artificial Sequence
  chemically synthesized
ttcatcaatcaaggtttatcta

SEQ ID NO: 1342826 - DNA, 22 bp, Artificial Sequence
  chemically synthesized
tcatcaatcaaggtttatctat

SEQ ID NO: 1342827 - DNA, 22 bp, Artificial Sequence
  chemically synthesized
catcaatcaaggtttatctata

SEQ ID NO: 1342828 - DNA, 22 bp, Artificial Sequence
  chemically synthesized
aattttcaagtgtatagataaa

SEQ ID NO: 1342829 - DNA, 22 bp, Artificial Sequence
  chemically synthesized
atcaatcaaggtttatctatac

SEQ ID NO: 1342830 - DNA, 22 bp, Artificial Sequence
  chemically synthesized
gaattttcaagtgtatagataa

SEQ ID NO: 1342831 - DNA, 22 bp, Artificial Sequence
  chemically synthesized
tggatttgaattttcaagtgta

SEQ ID NO: 1342832 - DNA, 22 bp, Artificial Sequence
  chemically synthesized
atctatacacttgaaaattcaa

SEQ ID NO: 1342833 - DNA, 22 bp, Artificial Sequence
  chemically synthesized
tctatacacttgaaaattcaaa

SEQ ID NO: 1342834 - DNA, 22 bp, Artificial Sequence
  chemically synthesized
aagatccctgtggatttgaatt

SEQ ID NO: 1342835 - DNA, 22 bp, Artificial Sequence
  chemically synthesized
caagatccctgtggatttgaat

SEQ ID NO: 1342836 - DNA, 22 bp, Artificial Sequence
  chemically synthesized
tacacttgaaaattcaaatcca

SEQ ID NO: 1342837 - DNA, 22 bp, Artificial Sequence
  chemically synthesized
tcaagatccctgtggatttgaa

SEQ ID NO: 1342838 - DNA, 22 bp, Artificial Sequence
  chemically synthesized
ttcaagatccctgtggatttga

SEQ ID NO: 1342839 - DNA, 22 bp, Artificial Sequence
  chemically synthesized
tcttttcaagatccctgtggat

SEQ ID NO: 1342840 - DNA, 22 bp, Artificial Sequence
  chemically synthesized
gaaaattcaaatccacagggat

SEQ ID NO: 1342841 - DNA, 22 bp, Artificial Sequence
  chemically synthesized
aaaattcaaatccacagggatc

SEQ ID NO: 1342842 - DNA, 22 bp, Artificial Sequence
  chemically synthesized
tgctatcttttcaagatccctg

SEQ ID NO: 1342843 - DNA, 22 bp, Artificial Sequence
  chemically synthesized
tctatgctatcttttcaagatc

SEQ ID NO: 1342844 - DNA, 22 bp, Artificial Sequence
  chemically synthesized
aaatccacagggatcttgaaaa

SEQ ID NO: 1342845 - DNA, 22 bp, Artificial Sequence
  chemically synthesized
aaagagaaagatactatctatg

SEQ ID NO: 1342846 - DNA, 22 bp, Artificial Sequence
  chemically synthesized
gaaaagatagcatagatagtat

SEQ ID NO: 1342847 - DNA, 22 bp, Artificial Sequence
  chemically synthesized
aaaagatagcatagatagtatc

SEQ ID NO: 1342848 - DNA, 22 bp, Artificial Sequence
  chemically synthesized
ttaaaagagaaagatactatct

SEQ ID NO: 1342849 - DNA, 22 bp, Artificial Sequence
  chemically synthesized
atctattaaaagagaaagatac

SEQ ID NO: 1342850 - DNA, 22 bp, Artificial Sequence
  chemically synthesized
catctattaaaagagaaagata

SEQ ID NO: 1342851 - DNA, 22 bp, Artificial Sequence
  chemically synthesized
tcatctattaaaagagaaagat

SEQ ID NO: 1342852 - DNA, 22 bp, Artificial Sequence
  chemically synthesized
ttcatctattaaaagagaaaga

SEQ ID NO: 1342853 - DNA, 22 bp, Artificial Sequence
  chemically synthesized
tttttcatctattaaaagagaa

SEQ ID NO: 1342854 - DNA, 22 bp, Artificial Sequence
  chemically synthesized
cagttgtttttcatctattaaa

SEQ ID NO: 1342855 - DNA, 22 bp, Artificial Sequence
  chemically synthesized
tgcagttgtttttcatctatta

SEQ ID NO: 1342856 - DNA, 22 bp, Artificial Sequence
  chemically synthesized
ctgcagttgtttttcatctatt

SEQ ID NO: 1342857 - DNA, 22 bp, Artificial Sequence
  chemically synthesized
tctgcagttgtttttcatctat

SEQ ID NO: 1342858 - DNA, 22 bp, Artificial Sequence
  chemically synthesized
tctcttttaatagatgaaaaac

SEQ ID NO: 1342859 - DNA, 22 bp, Artificial Sequence
  chemically synthesized
ctcttttaatagatgaaaaaca

SEQ ID NO: 1342860 - DNA, 22 bp, Artificial Sequence
  chemically synthesized
tcttttaatagatgaaaaacaa

SEQ ID NO: 1342861 - DNA, 22 bp, Artificial Sequence
  chemically synthesized
tgcctttctgcagttgtttttc

SEQ ID NO: 1342862 - DNA, 22 bp, Artificial Sequence
  chemically synthesized
ttttaatagatgaaaaacaact

SEQ ID NO: 1342863 - DNA, 22 bp, Artificial Sequence
  chemically synthesized
ttaatagatgaaaaacaactgc

SEQ ID NO: 1342864 - DNA, 22 bp, Artificial Sequence
  chemically synthesized
taatagatgaaaaacaactgca

SEQ ID NO: 1342865 - DNA, 22 bp, Artificial Sequence
  chemically synthesized
aatagatgaaaaacaactgcag

SEQ ID NO: 1342866 - DNA, 22 bp, Artificial Sequence
  chemically synthesized
atagatgaaaaacaactgcaga

SEQ ID NO: 1342867 - DNA, 22 bp, Artificial Sequence
  chemically synthesized
aagatgtctgtgcctttctgca

SEQ ID NO: 1342868 - DNA, 22 bp, Artificial Sequence
  chemically synthesized
gtactgaagatgtctgtgcctt

SEQ ID NO: 1342869 - DNA, 22 bp, Artificial Sequence
  chemically synthesized
agtactgaagatgtctgtgcct

SEQ ID NO: 1342870 - DNA, 22 bp, Artificial Sequence
  chemically synthesized
tttagtactgaagatgtctgtg

SEQ ID NO: 1342871 - DNA, 22 bp, Artificial Sequence
  chemically synthesized
atttagtactgaagatgtctgt

SEQ ID NO: 1342872 - DNA, 22 bp, Artificial Sequence
  chemically synthesized
cagaaaggcacagacatcttca

SEQ ID NO: 1342873 - DNA, 22 bp, Artificial Sequence
  chemically synthesized
tatcgtatgacttatttagtac

SEQ ID NO: 1342874 - DNA, 22 bp, Artificial Sequence
  chemically synthesized
gacatattgtatcgtatgactt

SEQ ID NO: 1342875 - DNA, 22 bp, Artificial Sequence
  chemically synthesized
cagtactaaataagtcatacga

SEQ ID NO: 1342876 - DNA, 22 bp, Artificial Sequence
  chemically synthesized
agtactaaataagtcatacgat

SEQ ID NO: 1342877 - DNA, 22 bp, Artificial Sequence
  chemically synthesized
aataagtcatacgatacaatat

SEQ ID NO: 1342878 - DNA, 22 bp, Artificial Sequence
  chemically synthesized
tatcaattagacatattgtatc

SEQ ID NO: 1342879 - DNA, 22 bp, Artificial Sequence
  chemically synthesized
atatcaattagacatattgtat

SEQ ID NO: 1342880 - DNA, 22 bp, Artificial Sequence
  chemically synthesized
tatatcaattagacatattgta

SEQ ID NO: 1342881 - DNA, 22 bp, Artificial Sequence
  chemically synthesized
tttatatcaattagacatattg

SEQ ID NO: 1342882 - DNA, 22 bp, Artificial Sequence
  chemically synthesized
ctttatatcaattagacatatt

SEQ ID NO: 1342883 - DNA, 22 bp, Artificial Sequence
  chemically synthesized
tctttatatcaattagacatat

SEQ ID NO: 1342884 - DNA, 22 bp, Artificial Sequence
  chemically synthesized
ttctttatatcaattagacata

SEQ ID NO: 1342885 - DNA, 22 bp, Artificial Sequence
  chemically synthesized
ccttttctttatatcaattaga

SEQ ID NO: 1342886 - DNA, 22 bp, Artificial Sequence
  chemically synthesized
attgatataaagaaaaggtaat

SEQ ID NO: 1342887 - DNA, 22 bp, Artificial Sequence
  chemically synthesized
atataaagaaaaggtaatcttg

SEQ ID NO: 1342888 - DNA, 22 bp, Artificial Sequence
  chemically synthesized
gccagaaggagcagtatggcaa

SEQ ID NO: 1342889 - DNA, 22 bp, Artificial Sequence
  chemically synthesized
gaaataaactagccagaaggag

SEQ ID NO: 1342890 - DNA, 22 bp, Artificial Sequence
  chemically synthesized
agaaataaactagccagaagga

SEQ ID NO: 1342891 - DNA, 22 bp, Artificial Sequence
  chemically synthesized
tagaaataaactagccagaagg

SEQ ID NO: 1342892 - DNA, 22 bp, Artificial Sequence
  chemically synthesized
gccatactgctccttctggcta

SEQ ID NO: 1342893 - DNA, 22 bp, Artificial Sequence
  chemically synthesized
ccatactgctccttctggctag

SEQ ID NO: 1342894 - DNA, 22 bp, Artificial Sequence
  chemically synthesized
ctccttctggctagtttatttc

SEQ ID NO: 1342895 - DNA, 22 bp, Artificial Sequence
  chemically synthesized
gatatagctttagaaataaact

SEQ ID NO: 1342896 - DNA, 22 bp, Artificial Sequence
  chemically synthesized
ggatatagctttagaaataaac

SEQ ID NO: 1342897 - DNA, 22 bp, Artificial Sequence
  chemically synthesized
cttctggctagtttatttctaa

SEQ ID NO: 1342898 - DNA, 22 bp, Artificial Sequence
  chemically synthesized
ttggatatagctttagaaataa

SEQ ID NO: 1342899 - DNA, 22 bp, Artificial Sequence
  chemically synthesized
ctggctagtttatttctaaagc

SEQ ID NO: 1342900 - DNA, 22 bp, Artificial Sequence
  chemically synthesized
tggctagtttatttctaaagct

SEQ ID NO: 1342901 - DNA, 22 bp, Artificial Sequence
  chemically synthesized
gctagtttatttctaaagctat

SEQ ID NO: 1342902 - DNA, 22 bp, Artificial Sequence
  chemically synthesized
gcaagattcttggatatagctt

SEQ ID NO: 1342903 - DNA, 22 bp, Artificial Sequence
  chemically synthesized
gtttatttctaaagctatatcc

SEQ ID NO: 1342904 - DNA, 22 bp, Artificial Sequence
  chemically synthesized
agcaagattcttggatatagct

SEQ ID NO: 1342905 - DNA, 22 bp, Artificial Sequence
  chemically synthesized
tagcaagattcttggatatagc

SEQ ID NO: 1342906 - DNA, 22 bp, Artificial Sequence
  chemically synthesized
ttagcaagattcttggatatag

SEQ ID NO: 1342907 - DNA, 22 bp, Artificial Sequence
  chemically synthesized
atttctaaagctatatccaaga

SEQ ID NO: 1342908 - DNA, 22 bp, Artificial Sequence
  chemically synthesized
tttctaaagctatatccaagaa

SEQ ID NO: 1342909 - DNA, 22 bp, Artificial Sequence
  chemically synthesized
ctaaagctatatccaagaatct

SEQ ID NO: 1342910 - DNA, 22 bp, Artificial Sequence
  chemically synthesized
atatttttagcaagattcttgg

SEQ ID NO: 1342911 - DNA, 22 bp, Artificial Sequence
  chemically synthesized
taaagctatatccaagaatctt

SEQ ID NO: 1342912 - DNA, 22 bp, Artificial Sequence
  chemically synthesized
aagctatatccaagaatcttgc

SEQ ID NO: 1342913 - DNA, 22 bp, Artificial Sequence
  chemically synthesized
tatccaagaatcttgctaaaaa

SEQ ID NO: 1342914 - DNA, 22 bp, Artificial Sequence
  chemically synthesized
aatgaaaataacacagctgata

SEQ ID NO: 1342915 - DNA, 22 bp, Artificial Sequence
  chemically synthesized
gctaaaaatatcagctgtgtta

SEQ ID NO: 1342916 - DNA, 22 bp, Artificial Sequence
  chemically synthesized
ctaaaaatatcagctgtgttat

SEQ ID NO: 1342917 - DNA, 22 bp, Artificial Sequence
  chemically synthesized
aaaatatcagctgtgttatttt

SEQ ID NO: 1342918 - DNA, 22 bp, Artificial Sequence
  chemically synthesized
aaagaaatagattgaatgaaaa

SEQ ID NO: 1342919 - DNA, 22 bp, Artificial Sequence
  chemically synthesized
gaaagaaatagattgaatgaaa

SEQ ID NO: 1342920 - DNA, 22 bp, Artificial Sequence
  chemically synthesized
tgttattttcattcaatctatt

SEQ ID NO: 1342921 - DNA, 22 bp, Artificial Sequence
  chemically synthesized
ttttcattcaatctatttcttt

SEQ ID NO: 1342922 - DNA, 22 bp, Artificial Sequence
  chemically synthesized
tcattcaatctatttctttcaa

SEQ ID NO: 1342923 - DNA, 22 bp, Artificial Sequence
  chemically synthesized
cattcaatctatttctttcaaa

SEQ ID NO: 1342924 - DNA, 22 bp, Artificial Sequence
  chemically synthesized
aaaaatagaatgtttgaaagaa

SEQ ID NO: 1342925 - DNA, 22 bp, Artificial Sequence
  chemically synthesized
attcaatctatttctttcaaac

SEQ ID NO: 1342926 - DNA, 22 bp, Artificial Sequence
  chemically synthesized
gaaaaatagaatgtttgaaaga

SEQ ID NO: 1342927 - DNA, 22 bp, Artificial Sequence
  chemically synthesized
tgaaaaatagaatgtttgaaag

SEQ ID NO: 1342928 - DNA, 22 bp, Artificial Sequence
  chemically synthesized
aatctatttctttcaaacattc

SEQ ID NO: 1342929 - DNA, 22 bp, Artificial Sequence
  chemically synthesized
attttgaaaaatagaatgtttg

SEQ ID NO: 1342930 - DNA, 22 bp, Artificial Sequence
  chemically synthesized
tttctttcaaacattctatttt

SEQ ID NO: 1342931 - DNA, 22 bp, Artificial Sequence
  chemically synthesized
ctttcaaacattctatttttca

SEQ ID NO: 1342932 - DNA, 22 bp, Artificial Sequence
  chemically synthesized
tttcaaacattctatttttcaa

SEQ ID NO: 1342933 - DNA, 22 bp, Artificial Sequence
  chemically synthesized
tcaaacattctatttttcaaaa

SEQ ID NO: 1342934 - DNA, 22 bp, Artificial Sequence
  chemically synthesized
caaacattctatttttcaaaat

SEQ ID NO: 1342935 - DNA, 22 bp, Artificial Sequence
  chemically synthesized
aaatgaaacctaattttgaaaa

SEQ ID NO: 1342936 - DNA, 22 bp, Artificial Sequence
  chemically synthesized
aaacattctatttttcaaaatt

SEQ ID NO: 1342937 - DNA, 22 bp, Artificial Sequence
  chemically synthesized
atgctcaaatgaaacctaattt

SEQ ID NO: 1342938 - DNA, 22 bp, Artificial Sequence
  chemically synthesized
tatttttcaaaattaggtttca

SEQ ID NO: 1342939 - DNA, 22 bp, Artificial Sequence
  chemically synthesized
ctgatgctcaaatgaaacctaa

SEQ ID NO: 1342940 - DNA, 22 bp, Artificial Sequence
  chemically synthesized
tttttcaaaattaggtttcatt

SEQ ID NO: 1342941 - DNA, 22 bp, Artificial Sequence
  chemically synthesized
ttcaaaattaggtttcatttga

SEQ ID NO: 1342942 - DNA, 22 bp, Artificial Sequence
  chemically synthesized
tcaaaattaggtttcatttgag

SEQ ID NO: 1342943 - DNA, 22 bp, Artificial Sequence
  chemically synthesized
aagttactgatgctcaaatgaa

SEQ ID NO: 1342944 - DNA, 22 bp, Artificial Sequence
  chemically synthesized
caaaattaggtttcatttgagc

SEQ ID NO: 1342945 - DNA, 22 bp, Artificial Sequence
  chemically synthesized
aaaattaggtttcatttgagca

SEQ ID NO: 1342946 - DNA, 22 bp, Artificial Sequence
  chemically synthesized
taaagttactgatgctcaaatg

SEQ ID NO: 1342947 - DNA, 22 bp, Artificial Sequence
  chemically synthesized
ctaaagttactgatgctcaaat

SEQ ID NO: 1342948 - DNA, 22 bp, Artificial Sequence
  chemically synthesized
ttctaaagttactgatgctcaa

SEQ ID NO: 1342949 - DNA, 22 bp, Artificial Sequence
  chemically synthesized
cttctaaagttactgatgctca

SEQ ID NO: 1342950 - DNA, 22 bp, Artificial Sequence
  chemically synthesized
tcttctaaagttactgatgctc

SEQ ID NO: 1342951 - DNA, 22 bp, Artificial Sequence
  chemically synthesized
ttcttctaaagttactgatgct

SEQ ID NO: 1342952 - DNA, 22 bp, Artificial Sequence
  chemically synthesized
ggtttcatttgagcatcagtaa

SEQ ID NO: 1342953 - DNA, 22 bp, Artificial Sequence
  chemically synthesized
tttcttctaaagttactgatgc

SEQ ID NO: 1342954 - DNA, 22 bp, Artificial Sequence
  chemically synthesized
ttttttcttctaaagttactga

SEQ ID NO: 1342955 - DNA, 22 bp, Artificial Sequence
  chemically synthesized
catttgagcatcagtaacttta

SEQ ID NO: 1342956 - DNA, 22 bp, Artificial Sequence
  chemically synthesized
atttgagcatcagtaactttag

SEQ ID NO: 1342957 - DNA, 22 bp, Artificial Sequence
  chemically synthesized
gagcatcagtaactttagaaga

SEQ ID NO: 1342958 - DNA, 22 bp, Artificial Sequence
  chemically synthesized
agtattattttttcttctaaag

SEQ ID NO: 1342959 - DNA, 22 bp, Artificial Sequence
  chemically synthesized
agcatcagtaactttagaagaa

SEQ ID NO: 1342960 - DNA, 22 bp, Artificial Sequence
  chemically synthesized
aagtattattttttcttctaaa

SEQ ID NO: 1342961 - DNA, 22 bp, Artificial Sequence
  chemically synthesized
taagtattattttttcttctaa

SEQ ID NO: 1342962 - DNA, 22 bp, Artificial Sequence
  chemically synthesized
ttaagtattattttttcttcta

SEQ ID NO: 1342963 - DNA, 22 bp, Artificial Sequence
  chemically synthesized
tttaagtattattttttcttct

SEQ ID NO: 1342964 - DNA, 22 bp, Artificial Sequence
  chemically synthesized
tagaagaaaaaataatacttaa

SEQ ID NO: 1342965 - DNA, 22 bp, Artificial Sequence
  chemically synthesized
gccagggcctttttaagtatta

SEQ ID NO: 1342966 - DNA, 22 bp, Artificial Sequence
  chemically synthesized
agaagaaaaaataatacttaaa

SEQ ID NO: 1342967 - DNA, 22 bp, Artificial Sequence
  chemically synthesized
gaagaaaaaataatacttaaaa

SEQ ID NO: 1342968 - DNA, 22 bp, Artificial Sequence
  chemically synthesized
aaaaaggccctggccaggcacg

SEQ ID NO: 1342969 - DNA, 22 bp, Artificial Sequence
  chemically synthesized
aaaaggccctggccaggcacgg

SEQ ID NO: 1342970 - DNA, 22 bp, Artificial Sequence
  chemically synthesized
caggcatgagccaccgtgcctg

SEQ ID NO: 1342971 - DNA, 22 bp, Artificial Sequence
  chemically synthesized
ggattacaggcatgagccaccg

SEQ ID NO: 1342972 - DNA, 22 bp, Artificial Sequence
  chemically synthesized
gccaggcacggtggctcatgcc

SEQ ID NO: 1342973 - DNA, 22 bp, Artificial Sequence
  chemically synthesized
ccaaagtgctgggattacaggc

SEQ ID NO: 1342974 - DNA, 22 bp, Artificial Sequence
  chemically synthesized
ggcctcccaaagtgctgggatt

SEQ ID NO: 1342975 - DNA, 22 bp, Artificial Sequence
  chemically synthesized
atgcctgtaatcccagcacttt

SEQ ID NO: 1342976 - DNA, 22 bp, Artificial Sequence
  chemically synthesized
cctcggcctcccaaagtgctgg

SEQ ID NO: 1342977 - DNA, 22 bp, Artificial Sequence
  chemically synthesized
cctgcctcggcctcccaaagtg

SEQ ID NO: 1342978 - DNA, 22 bp, Artificial Sequence
  chemically synthesized
taatcccagcactttgggaggc

SEQ ID NO: 1342979 - DNA, 22 bp, Artificial Sequence
  chemically synthesized
aaatgatctgcctgcctcggcc

SEQ ID NO: 1342980 - DNA, 22 bp, Artificial Sequence
  chemically synthesized
acctcaaatgatctgcctgcct

SEQ ID NO: 1342981 - DNA, 22 bp, Artificial Sequence
  chemically synthesized
tgggaggccgaggcaggcagat

SEQ ID NO: 1342982 - DNA, 22 bp, Artificial Sequence
  chemically synthesized
gggaggccgaggcaggcagatc

SEQ ID NO: 1342983 - DNA, 22 bp, Artificial Sequence
  chemically synthesized
ctgacctcaaatgatctgcctg

SEQ ID NO: 1342984 - DNA, 22 bp, Artificial Sequence
  chemically synthesized
ggaggccgaggcaggcagatca

SEQ ID NO: 1342985 - DNA, 22 bp, Artificial Sequence
  chemically synthesized
catctcctgacctcaaatgatc

SEQ ID NO: 1342986 - DNA, 22 bp, Artificial Sequence
  chemically synthesized
gtctccatctcctgacctcaaa

SEQ ID NO: 1342987 - DNA, 22 bp, Artificial Sequence
  chemically synthesized
atcaggctggtctccatctcct

SEQ ID NO: 1342988 - DNA, 22 bp, Artificial Sequence
  chemically synthesized
tgttgatcaggctggtctccat

SEQ ID NO: 1342989 - DNA, 22 bp, Artificial Sequence
  chemically synthesized
gaggtcaggagatggagaccag

SEQ ID NO: 1342990 - DNA, 22 bp, Artificial Sequence
  chemically synthesized
aggtcaggagatggagaccagc

SEQ ID NO: 1342991 - DNA, 22 bp, Artificial Sequence
  chemically synthesized
actgtgttgatcaggctggtct

SEQ ID NO: 1342992 - DNA, 22 bp, Artificial Sequence
  chemically synthesized
cactgtgttgatcaggctggtc

SEQ ID NO: 1342993 - DNA, 22 bp, Artificial Sequence
  chemically synthesized
gtagagacagggtttcactgtg

SEQ ID NO: 1342994 - DNA, 22 bp, Artificial Sequence
  chemically synthesized
agtagagacagggtttcactgt

SEQ ID NO: 1342995 - DNA, 22 bp, Artificial Sequence
  chemically synthesized
tagtagagacagggtttcactg

SEQ ID NO: 1342996 - DNA, 22 bp, Artificial Sequence
  chemically synthesized
ttagtagagacagggtttcact

SEQ ID NO: 1342997 - DNA, 22 bp, Artificial Sequence
  chemically synthesized
atcaacacagtgaaaccctgtc

SEQ ID NO: 1342998 - DNA, 22 bp, Artificial Sequence
  chemically synthesized
tatttttagtagagacagggtt

SEQ ID NO: 1342999 - DNA, 22 bp, Artificial Sequence
  chemically synthesized
gtatttttagtagagacagggt

SEQ ID NO: 1343000 - DNA, 22 bp, Artificial Sequence
  chemically synthesized
tgtatttttagtagagacaggg

SEQ ID NO: 1343001 - DNA, 22 bp, Artificial Sequence
  chemically synthesized
ttgtatttttagtagagacagg

SEQ ID NO: 1343002 - DNA, 22 bp, Artificial Sequence
  chemically synthesized
atttttgtatttttagtagaga

SEQ ID NO: 1343003 - DNA, 22 bp, Artificial Sequence
  chemically synthesized
gctaatttttgtatttttagta

SEQ ID NO: 1343004 - DNA, 22 bp, Artificial Sequence
  chemically synthesized
tctctactaaaaatacaaaaat

SEQ ID NO: 1343005 - DNA, 22 bp, Artificial Sequence
  chemically synthesized
tactaaaaatacaaaaattagc

SEQ ID NO: 1343006 - DNA, 22 bp, Artificial Sequence
  chemically synthesized
ctaaaaatacaaaaattagcca

SEQ ID NO: 1343007 - DNA, 22 bp, Artificial Sequence
  chemically synthesized
aaaatacaaaaattagccaggc

SEQ ID NO: 1343008 - DNA, 22 bp, Artificial Sequence
  chemically synthesized
caggcgcccaccaccacgcctg

SEQ ID NO: 1343009 - DNA, 22 bp, Artificial Sequence
  chemically synthesized
ggattacaggcgcccaccacca

SEQ ID NO: 1343010 - DNA, 22 bp, Artificial Sequence
  chemically synthesized
gccaggcgtggtggtgggcgcc

SEQ ID NO: 1343011 - DNA, 22 bp, Artificial Sequence
  chemically synthesized
agtagctgggattacaggcgcc

SEQ ID NO: 1343012 - DNA, 22 bp, Artificial Sequence
  chemically synthesized
ctaagtagctgggattacaggc

SEQ ID NO: 1343013 - DNA, 22 bp, Artificial Sequence
  chemically synthesized
agcctcctaagtagctgggatt

SEQ ID NO: 1343014 - DNA, 22 bp, Artificial Sequence
  chemically synthesized
cctcagcctcctaagtagctgg

SEQ ID NO: 1343015 - DNA, 22 bp, Artificial Sequence
  chemically synthesized
ctgcctcagcctcctaagtagc

SEQ ID NO: 1343016 - DNA, 22 bp, Artificial Sequence
  chemically synthesized
tcctgcctcagcctcctaagta

SEQ ID NO: 1343017 - DNA, 22 bp, Artificial Sequence
  chemically synthesized
taatcccagctacttaggaggc

SEQ ID NO: 1343018 - DNA, 22 bp, Artificial Sequence
  chemically synthesized
aagcaattctcctgcctcagcc

SEQ ID NO: 1343019 - DNA, 22 bp, Artificial Sequence
  chemically synthesized
cttaggaggctgaggcaggaga

SEQ ID NO: 1343020 - DNA, 22 bp, Artificial Sequence
  chemically synthesized
ggctcaagcaattctcctgcct

SEQ ID NO: 1343021 - DNA, 22 bp, Artificial Sequence
  chemically synthesized
aggaggctgaggcaggagaatt

SEQ ID NO: 1343022 - DNA, 22 bp, Artificial Sequence
  chemically synthesized
ctgggctcaagcaattctcctg

SEQ ID NO: 1343023 - DNA, 22 bp, Artificial Sequence
  chemically synthesized
ggaggctgaggcaggagaattg

SEQ ID NO: 1343024 - DNA, 22 bp, Artificial Sequence
  chemically synthesized
cgcctcctgggctcaagcaatt

SEQ ID NO: 1343025 - DNA, 22 bp, Artificial Sequence
  chemically synthesized
ccgcctcctgggctcaagcaat

SEQ ID NO: 1343026 - DNA, 22 bp, Artificial Sequence
  chemically synthesized
aggcaggagaattgcttgagcc

SEQ ID NO: 1343027 - DNA, 22 bp, Artificial Sequence
  chemically synthesized
caacttccgcctcctgggctca

SEQ ID NO: 1343028 - DNA, 22 bp, Artificial Sequence
  chemically synthesized
actgcaacttccgcctcctggg

SEQ ID NO: 1343029 - DNA, 22 bp, Artificial Sequence
  chemically synthesized
ctcactgcaacttccgcctcct

SEQ ID NO: 1343030 - DNA, 22 bp, Artificial Sequence
  chemically synthesized
tgctcactgcaacttccgcctc

SEQ ID NO: 1343031 - DNA, 22 bp, Artificial Sequence
  chemically synthesized
cttgagcccaggaggcggaagt

SEQ ID NO: 1343032 - DNA, 22 bp, Artificial Sequence
  chemically synthesized
gagcccaggaggcggaagttgc

SEQ ID NO: 1343033 - DNA, 22 bp, Artificial Sequence
  chemically synthesized
agcccaggaggcggaagttgca

SEQ ID NO: 1343034 - DNA, 22 bp, Artificial Sequence
  chemically synthesized
gagtgcaatggtgcagtctctg

SEQ ID NO: 1343035 - DNA, 22 bp, Artificial Sequence
  chemically synthesized
cagtgagcagagactgcaccat

SEQ ID NO: 1343036 - DNA, 22 bp, Artificial Sequence
  chemically synthesized
cccaggctggagtgcaatggtg

SEQ ID NO: 1343037 - DNA, 22 bp, Artificial Sequence
  chemically synthesized
ctgcccaggctggagtgcaatg

SEQ ID NO: 1343038 - DNA, 22 bp, Artificial Sequence
  chemically synthesized
gctgcccaggctggagtgcaat

SEQ ID NO: 1343039 - DNA, 22 bp, Artificial Sequence
  chemically synthesized
tgctgcccaggctggagtgcaa

SEQ ID NO: 1343040 - DNA, 22 bp, Artificial Sequence
  chemically synthesized
gttttgctgcccaggctggagt

SEQ ID NO: 1343041 - DNA, 22 bp, Artificial Sequence
  chemically synthesized
caccattgcactccagcctggg

SEQ ID NO: 1343042 - DNA, 22 bp, Artificial Sequence
  chemically synthesized
gtgctcgttttgctgcccaggc

SEQ ID NO: 1343043 - DNA, 22 bp, Artificial Sequence
  chemically synthesized
agtgctcgttttgctgcccagg

SEQ ID NO: 1343044 - DNA, 22 bp, Artificial Sequence
  chemically synthesized
ttagtgctcgttttgctgccca

SEQ ID NO: 1343045 - DNA, 22 bp, Artificial Sequence
  chemically synthesized
cttagtgctcgttttgctgccc

SEQ ID NO: 1343046 - DNA, 22 bp, Artificial Sequence
  chemically synthesized
cactccagcctgggcagcaaaa

SEQ ID NO: 1343047 - DNA, 22 bp, Artificial Sequence
  chemically synthesized
tcttagtgctcgttttgctgcc

SEQ ID NO: 1343048 - DNA, 22 bp, Artificial Sequence
  chemically synthesized
ttcttagtgctcgttttgctgc

SEQ ID NO: 1343049 - DNA, 22 bp, Artificial Sequence
  chemically synthesized
tttcttagtgctcgttttgctg

SEQ ID NO: 1343050 - DNA, 22 bp, Artificial Sequence
  chemically synthesized
ttttcttagtgctcgttttgct

SEQ ID NO: 1343051 - DNA, 22 bp, Artificial Sequence
  chemically synthesized
cagcctgggcagcaaaacgagc

SEQ ID NO: 1343052 - DNA, 22 bp, Artificial Sequence
  chemically synthesized
atttttttcttagtgctcgttt

SEQ ID NO: 1343053 - DNA, 22 bp, Artificial Sequence
  chemically synthesized
ctaatttttttcttagtgctcg

SEQ ID NO: 1343054 - DNA, 22 bp, Artificial Sequence
  chemically synthesized
ggcagcaaaacgagcactaaga

SEQ ID NO: 1343055 - DNA, 22 bp, Artificial Sequence
  chemically synthesized
ctactaatttttttcttagtgc

SEQ ID NO: 1343056 - DNA, 22 bp, Artificial Sequence
  chemically synthesized
catattactactaatttttttc

SEQ ID NO: 1343057 - DNA, 22 bp, Artificial Sequence
  chemically synthesized
gcatattactactaattttttt

SEQ ID NO: 1343058 - DNA, 22 bp, Artificial Sequence
  chemically synthesized
tgcatattactactaatttttt

SEQ ID NO: 1343059 - DNA, 22 bp, Artificial Sequence
  chemically synthesized
actttgcatattactactaatt

SEQ ID NO: 1343060 - DNA, 22 bp, Artificial Sequence
  chemically synthesized
agaaaaaaattagtagtaatat

SEQ ID NO: 1343061 - DNA, 22 bp, Artificial Sequence
  chemically synthesized
agacctgactttgcatattact

SEQ ID NO: 1343062 - DNA, 22 bp, Artificial Sequence
  chemically synthesized
tgagacctgactttgcatatta

SEQ ID NO: 1343063 - DNA, 22 bp, Artificial Sequence
  chemically synthesized
gtagtaatatgcaaagtcaggt

SEQ ID NO: 1343064 - DNA, 22 bp, Artificial Sequence
  chemically synthesized
gaagaaacaggagctctgagac

SEQ ID NO: 1343065 - DNA, 22 bp, Artificial Sequence
  chemically synthesized
agaagaaacaggagctctgaga

SEQ ID NO: 1343066 - DNA, 22 bp, Artificial Sequence
  chemically synthesized
atttagaagaaacaggagctct

SEQ ID NO: 1343067 - DNA, 22 bp, Artificial Sequence
  chemically synthesized
agagctcctgtttcttctaaat

SEQ ID NO: 1343068 - DNA, 22 bp, Artificial Sequence
  chemically synthesized
aggagatacacctaatttagaa

SEQ ID NO: 1343069 - DNA, 22 bp, Artificial Sequence
  chemically synthesized
ctgtttcttctaaattaggtgt

SEQ ID NO: 1343070 - DNA, 22 bp, Artificial Sequence
  chemically synthesized
tttcttctaaattaggtgtatc

SEQ ID NO: 1343071 - DNA, 22 bp, Artificial Sequence
  chemically synthesized
aaagactgaggagatacaccta

SEQ ID NO: 1343072 - DNA, 22 bp, Artificial Sequence
  chemically synthesized
cttctaaattaggtgtatctcc

SEQ ID NO: 1343073 - DNA, 22 bp, Artificial Sequence
  chemically synthesized
ttctaaattaggtgtatctcct

SEQ ID NO: 1343074 - DNA, 22 bp, Artificial Sequence
  chemically synthesized
aattcaaagactgaggagatac

SEQ ID NO: 1343075 - DNA, 22 bp, Artificial Sequence
  chemically synthesized
ctaaattaggtgtatctcctca

SEQ ID NO: 1343076 - DNA, 22 bp, Artificial Sequence
  chemically synthesized
taaattaggtgtatctcctcag

SEQ ID NO: 1343077 - DNA, 22 bp, Artificial Sequence
  chemically synthesized
aattaggtgtatctcctcagtc

SEQ ID NO: 1343078 - DNA, 22 bp, Artificial Sequence
  chemically synthesized
gactaaattcaaagactgagga

SEQ ID NO: 1343079 - DNA, 22 bp, Artificial Sequence
  chemically synthesized
agactaaattcaaagactgagg

SEQ ID NO: 1343080 - DNA, 22 bp, Artificial Sequence
  chemically synthesized
ggtgtatctcctcagtctttga

SEQ ID NO: 1343081 - DNA, 22 bp, Artificial Sequence
  chemically synthesized
taaaccaatttagactaaattc

SEQ ID NO: 1343082 - DNA, 22 bp, Artificial Sequence
  chemically synthesized
ataaaccaatttagactaaatt

SEQ ID NO: 1343083 - DNA, 22 bp, Artificial Sequence
  chemically synthesized
ctcagtctttgaatttagtcta

SEQ ID NO: 1343084 - DNA, 22 bp, Artificial Sequence
  chemically synthesized
tttataaaccaatttagactaa

SEQ ID NO: 1343085 - DNA, 22 bp, Artificial Sequence
  chemically synthesized
agtctttgaatttagtctaaat

SEQ ID NO: 1343086 - DNA, 22 bp, Artificial Sequence
  chemically synthesized
ttatttataaaccaatttagac

SEQ ID NO: 1343087 - DNA, 22 bp, Artificial Sequence
  chemically synthesized
tgaatttagtctaaattggttt

SEQ ID NO: 1343088 - DNA, 22 bp, Artificial Sequence
  chemically synthesized
gaatttagtctaaattggttta

SEQ ID NO: 1343089 - DNA, 22 bp, Artificial Sequence
  chemically synthesized
aatttagtctaaattggtttat

SEQ ID NO: 1343090 - DNA, 22 bp, Artificial Sequence
  chemically synthesized
aggattattatttataaaccaa

SEQ ID NO: 1343091 - DNA, 22 bp, Artificial Sequence
  chemically synthesized
agtctaaattggtttataaata

SEQ ID NO: 1343092 - DNA, 22 bp, Artificial Sequence
  chemically synthesized
gtctaaattggtttataaataa

SEQ ID NO: 1343093 - DNA, 22 bp, Artificial Sequence
  chemically synthesized
gaaagattcaggattattattt

SEQ ID NO: 1343094 - DNA, 22 bp, Artificial Sequence
  chemically synthesized
aattggtttataaataataatc

SEQ ID NO: 1343095 - DNA, 22 bp, Artificial Sequence
  chemically synthesized
gtttataaataataatcctgaa

SEQ ID NO: 1343096 - DNA, 22 bp, Artificial Sequence
  chemically synthesized
ataaataataatcctgaatctt

SEQ ID NO: 1343097 - DNA, 22 bp, Artificial Sequence
  chemically synthesized
taaataataatcctgaatcttt

SEQ ID NO: 1343098 - DNA, 22 bp, Artificial Sequence
  chemically synthesized
tggcagggagctagaaagattc

SEQ ID NO: 1343099 - DNA, 22 bp, Artificial Sequence
  chemically synthesized
gtggcagggagctagaaagatt

SEQ ID NO: 1343100 - DNA, 22 bp, Artificial Sequence
  chemically synthesized
tgtggcagggagctagaaagat

SEQ ID NO: 1343101 - DNA, 22 bp, Artificial Sequence
  chemically synthesized
aatctttctagctccctgccac

SEQ ID NO: 1343102 - DNA, 22 bp, Artificial Sequence
  chemically synthesized
aatatccatctttgtggcaggg

SEQ ID NO: 1343103 - DNA, 22 bp, Artificial Sequence
  chemically synthesized
tctagctccctgccacaaagat

SEQ ID NO: 1343104 - DNA, 22 bp, Artificial Sequence
  chemically synthesized
ctagctccctgccacaaagatg

SEQ ID NO: 1343105 - DNA, 22 bp, Artificial Sequence
  chemically synthesized
tagctccctgccacaaagatgg

SEQ ID NO: 1343106 - DNA, 22 bp, Artificial Sequence
  chemically synthesized
gctccctgccacaaagatggat

SEQ ID NO: 1343107 - DNA, 22 bp, Artificial Sequence
  chemically synthesized
cctgccacaaagatggatattt

SEQ ID NO: 1343108 - DNA, 22 bp, Artificial Sequence
  chemically synthesized
catagtatatctaaatatccat

SEQ ID NO: 1343109 - DNA, 22 bp, Artificial Sequence
  chemically synthesized
ccacaaagatggatatttagat

SEQ ID NO: 1343110 - DNA, 22 bp, Artificial Sequence
  chemically synthesized
agatatactatggaatatttca

SEQ ID NO: 1343111 - DNA, 22 bp, Artificial Sequence
  chemically synthesized
gatatactatggaatatttcac

SEQ ID NO: 1343112 - DNA, 22 bp, Artificial Sequence
  chemically synthesized
gaaataaaacaggaatagtgaa

SEQ ID NO: 1343113 - DNA, 22 bp, Artificial Sequence
  chemically synthesized
tggaatatttcactattcctgt

SEQ ID NO: 1343114 - DNA, 22 bp, Artificial Sequence
  chemically synthesized
atctagaaataaaacaggaata

SEQ ID NO: 1343115 - DNA, 22 bp, Artificial Sequence
  chemically synthesized
aatctagaaataaaacaggaat

SEQ ID NO: 1343116 - DNA, 22 bp, Artificial Sequence
  chemically synthesized
taatctagaaataaaacaggaa

SEQ ID NO: 1343117 - DNA, 22 bp, Artificial Sequence
  chemically synthesized
ttaatctagaaataaaacagga

SEQ ID NO: 1343118 - DNA, 22 bp, Artificial Sequence
  chemically synthesized
cactattcctgttttatttcta

SEQ ID NO: 1343119 - DNA, 22 bp, Artificial Sequence
  chemically synthesized
actattcctgttttatttctag

SEQ ID NO: 1343120 - DNA, 22 bp, Artificial Sequence
  chemically synthesized
gtgatttttaatctagaaataa

SEQ ID NO: 1343121 - DNA, 22 bp, Artificial Sequence
  chemically synthesized
ggtgatttttaatctagaaata

SEQ ID NO: 1343122 - DNA, 22 bp, Artificial Sequence
  chemically synthesized
tggtgatttttaatctagaaat

SEQ ID NO: 1343123 - DNA, 22 bp, Artificial Sequence
  chemically synthesized
ttcctgttttatttctagatta

SEQ ID NO: 1343124 - DNA, 22 bp, Artificial Sequence
  chemically synthesized
ttttggtgatttttaatctaga

SEQ ID NO: 1343125 - DNA, 22 bp, Artificial Sequence
  chemically synthesized
gttttggtgatttttaatctag

SEQ ID NO: 1343126 - DNA, 22 bp, Artificial Sequence
  chemically synthesized
ctgttttatttctagattaaaa

SEQ ID NO: 1343127 - DNA, 22 bp, Artificial Sequence
  chemically synthesized
cttgttttggtgatttttaatc

SEQ ID NO: 1343128 - DNA, 22 bp, Artificial Sequence
  chemically synthesized
ttttatttctagattaaaaatc

SEQ ID NO: 1343129 - DNA, 22 bp, Artificial Sequence
  chemically synthesized
tatttctagattaaaaatcacc

SEQ ID NO: 1343130 - DNA, 22 bp, Artificial Sequence
  chemically synthesized
tctccttgttttggtgattttt

SEQ ID NO: 1343131 - DNA, 22 bp, Artificial Sequence
  chemically synthesized
atttctagattaaaaatcacca

SEQ ID NO: 1343132 - DNA, 22 bp, Artificial Sequence
  chemically synthesized
tttctagattaaaaatcaccaa

SEQ ID NO: 1343133 - DNA, 22 bp, Artificial Sequence
  chemically synthesized
tgtctccttgttttggtgattt

SEQ ID NO: 1343134 - DNA, 22 bp, Artificial Sequence
  chemically synthesized
ctgtctccttgttttggtgatt

SEQ ID NO: 1343135 - DNA, 22 bp, Artificial Sequence
  chemically synthesized
ctagattaaaaatcaccaaaac

SEQ ID NO: 1343136 - DNA, 22 bp, Artificial Sequence
  chemically synthesized
tagattaaaaatcaccaaaaca

SEQ ID NO: 1343137 - DNA, 22 bp, Artificial Sequence
  chemically synthesized
gattaaaaatcaccaaaacaag

SEQ ID NO: 1343138 - DNA, 22 bp, Artificial Sequence
  chemically synthesized
aaaatcaccaaaacaaggagac

SEQ ID NO: 1343139 - DNA, 22 bp, Artificial Sequence
  chemically synthesized
gggtcagggaagatataaaatt

SEQ ID NO: 1343140 - DNA, 22 bp, Artificial Sequence
  chemically synthesized
aaggggaaaaattagggtcagg

SEQ ID NO: 1343141 - DNA, 22 bp, Artificial Sequence
  chemically synthesized
caaggggaaaaattagggtcag

SEQ ID NO: 1343142 - DNA, 22 bp, Artificial Sequence
  chemically synthesized
tatatcttccctgaccctaatt

SEQ ID NO: 1343143 - DNA, 22 bp, Artificial Sequence
  chemically synthesized
atatcttccctgaccctaattt

SEQ ID NO: 1343144 - DNA, 22 bp, Artificial Sequence
  chemically synthesized
tatcttccctgaccctaatttt

SEQ ID NO: 1343145 - DNA, 22 bp, Artificial Sequence
  chemically synthesized
ccctgaccctaatttttcccct

SEQ ID NO: 1343146 - DNA, 22 bp, Artificial Sequence
  chemically synthesized
cctgaccctaatttttcccctt

SEQ ID NO: 1343147 - DNA, 22 bp, Artificial Sequence
  chemically synthesized
atagcaagatttcaaggggaaa

SEQ ID NO: 1343148 - DNA, 22 bp, Artificial Sequence
  chemically synthesized
accctaatttttccccttgaaa

SEQ ID NO: 1343149 - DNA, 22 bp, Artificial Sequence
  chemically synthesized
atttttccccttgaaatcttgc

SEQ ID NO: 1343150 - DNA, 22 bp, Artificial Sequence
  chemically synthesized
ttccccttgaaatcttgctatc

SEQ ID NO: 1343151 - DNA, 22 bp, Artificial Sequence
  chemically synthesized
tccccttgaaatcttgctatca

SEQ ID NO: 1343152 - DNA, 22 bp, Artificial Sequence
  chemically synthesized
ccccttgaaatcttgctatcaa

SEQ ID NO: 1343153 - DNA, 22 bp, Artificial Sequence
  chemically synthesized
cccttgaaatcttgctatcaat

SEQ ID NO: 1343154 - DNA, 22 bp, Artificial Sequence
  chemically synthesized
gaaatcttgctatcaattatac

SEQ ID NO: 1343155 - DNA, 22 bp, Artificial Sequence
  chemically synthesized
aaatcttgctatcaattatact

SEQ ID NO: 1343156 - DNA, 22 bp, Artificial Sequence
  chemically synthesized
caaccaaaggtcagtataattg

SEQ ID NO: 1343157 - DNA, 22 bp, Artificial Sequence
  chemically synthesized
gctatcaattatactgaccttt

SEQ ID NO: 1343158 - DNA, 22 bp, Artificial Sequence
  chemically synthesized
ctatcaattatactgacctttg

SEQ ID NO: 1343159 - DNA, 22 bp, Artificial Sequence
  chemically synthesized
tcaattatactgacctttggtt

SEQ ID NO: 1343160 - DNA, 22 bp, Artificial Sequence
  chemically synthesized
tactgacctttggttgtaggca

SEQ ID NO: 1343161 - DNA, 22 bp, Artificial Sequence
  chemically synthesized
acctttggttgtaggcatttct

SEQ ID NO: 1343162 - DNA, 22 bp, Artificial Sequence
  chemically synthesized
tggttgtaggcatttctttata

SEQ ID NO: 1343163 - DNA, 22 bp, Artificial Sequence
  chemically synthesized
ggttgtaggcatttctttatat

SEQ ID NO: 1343164 - DNA, 22 bp, Artificial Sequence
  chemically synthesized
gttgtaggcatttctttatatt

SEQ ID NO: 1343165 - DNA, 22 bp, Artificial Sequence
  chemically synthesized
taggcatttctttatatttgtg

SEQ ID NO: 1343166 - DNA, 22 bp, Artificial Sequence
  chemically synthesized
tgtagaaagcaacaaaaaaaca

SEQ ID NO: 1343167 - DNA, 22 bp, Artificial Sequence
  chemically synthesized
ctttatatttgtgtttttttgt

SEQ ID NO: 1343168 - DNA, 22 bp, Artificial Sequence
  chemically synthesized
atgtagaaagcaacaaaaaaac

SEQ ID NO: 1343169 - DNA, 22 bp, Artificial Sequence
  chemically synthesized
tttatatttgtgtttttttgtt

SEQ ID NO: 1343170 - DNA, 22 bp, Artificial Sequence
  chemically synthesized
tatatttgtgtttttttgttgc

SEQ ID NO: 1343171 - DNA, 22 bp, Artificial Sequence
  chemically synthesized
atatttgtgtttttttgttgct

SEQ ID NO: 1343172 - DNA, 22 bp, Artificial Sequence
  chemically synthesized
tatttgtgtttttttgttgctt

SEQ ID NO: 1343173 - DNA, 22 bp, Artificial Sequence
  chemically synthesized
gtgtttttttgttgctttctac

SEQ ID NO: 1343174 - DNA, 22 bp, Artificial Sequence
  chemically synthesized
tgtttttttgttgctttctaca

SEQ ID NO: 1343175 - DNA, 22 bp, Artificial Sequence
  chemically synthesized
ttttgttgctttctacataaac

SEQ ID NO: 1343176 - DNA, 22 bp, Artificial Sequence
  chemically synthesized
tttgttgctttctacataaact

SEQ ID NO: 1343177 - DNA, 22 bp, Artificial Sequence
  chemically synthesized
ttgttgctttctacataaactc

SEQ ID NO: 1343178 - DNA, 22 bp, Artificial Sequence
  chemically synthesized
tgttgctttctacataaactct

SEQ ID NO: 1343179 - DNA, 22 bp, Artificial Sequence
  chemically synthesized
gttgctttctacataaactcta

SEQ ID NO: 1343180 - DNA, 22 bp, Artificial Sequence
  chemically synthesized
ttgctttctacataaactctat

SEQ ID NO: 1343181 - DNA, 22 bp, Artificial Sequence
  chemically synthesized
ctttctacataaactctattca

SEQ ID NO: 1343182 - DNA, 22 bp, Artificial Sequence
  chemically synthesized
gcaaaagaccccatgaatagag

SEQ ID NO: 1343183 - DNA, 22 bp, Artificial Sequence
  chemically synthesized
tctacataaactctattcatgg

SEQ ID NO: 1343184 - DNA, 22 bp, Artificial Sequence
  chemically synthesized
ctacataaactctattcatggg

SEQ ID NO: 1343185 - DNA, 22 bp, Artificial Sequence
  chemically synthesized
tacataaactctattcatgggg

SEQ ID NO: 1343186 - DNA, 22 bp, Artificial Sequence
  chemically synthesized
cataaactctattcatggggtc

SEQ ID NO: 1343187 - DNA, 22 bp, Artificial Sequence
  chemically synthesized
tattcatggggtcttttgccaa

SEQ ID NO: 1343188 - DNA, 22 bp, Artificial Sequence
  chemically synthesized
ttcatggggtcttttgccaact

SEQ ID NO: 1343189 - DNA, 22 bp, Artificial Sequence
  chemically synthesized
atggggtcttttgccaactcat

SEQ ID NO: 1343190 - DNA, 22 bp, Artificial Sequence
  chemically synthesized
aaaggataatataatgagttgg

SEQ ID NO: 1343191 - DNA, 22 bp, Artificial Sequence
  chemically synthesized
tgaaaggataatataatgagtt

SEQ ID NO: 1343192 - DNA, 22 bp, Artificial Sequence
  chemically synthesized
ttgccaactcattatattatcc

SEQ ID NO: 1343193 - DNA, 22 bp, Artificial Sequence
  chemically synthesized
tgccaactcattatattatcct

SEQ ID NO: 1343194 - DNA, 22 bp, Artificial Sequence
  chemically synthesized
gccaactcattatattatcctt

SEQ ID NO: 1343195 - DNA, 22 bp, Artificial Sequence
  chemically synthesized
accatattctgaaaggataata

SEQ ID NO: 1343196 - DNA, 22 bp, Artificial Sequence
  chemically synthesized
ccaactcattatattatccttt

SEQ ID NO: 1343197 - DNA, 22 bp, Artificial Sequence
  chemically synthesized
gaccatattctgaaaggataat

SEQ ID NO: 1343198 - DNA, 22 bp, Artificial Sequence
  chemically synthesized
tgaccatattctgaaaggataa

SEQ ID NO: 1343199 - DNA, 22 bp, Artificial Sequence
  chemically synthesized
cctttgaccatattctgaaagg

SEQ ID NO: 1343200 - DNA, 22 bp, Artificial Sequence
  chemically synthesized
gcctttgaccatattctgaaag

SEQ ID NO: 1343201 - DNA, 22 bp, Artificial Sequence
  chemically synthesized
attatattatcctttcagaata

SEQ ID NO: 1343202 - DNA, 22 bp, Artificial Sequence
  chemically synthesized
tattatcctttcagaatatggt

SEQ ID NO: 1343203 - DNA, 22 bp, Artificial Sequence
  chemically synthesized
tcctttcagaatatggtcaaag

SEQ ID NO: 1343204 - DNA, 22 bp, Artificial Sequence
  chemically synthesized
taaaatgggcttgcctttgacc

SEQ ID NO: 1343205 - DNA, 22 bp, Artificial Sequence
  chemically synthesized
tcagaatatggtcaaaggcaag

SEQ ID NO: 1343206 - DNA, 22 bp, Artificial Sequence
  chemically synthesized
cagaatatggtcaaaggcaagc

SEQ ID NO: 1343207 - DNA, 22 bp, Artificial Sequence
  chemically synthesized
agaatatggtcaaaggcaagcc

SEQ ID NO: 1343208 - DNA, 22 bp, Artificial Sequence
  chemically synthesized
gattgtaaaatgggcttgcctt

SEQ ID NO: 1343209 - DNA, 22 bp, Artificial Sequence
  chemically synthesized
gaaatgacaattggattgtaaa

SEQ ID NO: 1343210 - DNA, 22 bp, Artificial Sequence
  chemically synthesized
agaaatgacaattggattgtaa

SEQ ID NO: 1343211 - DNA, 22 bp, Artificial Sequence
  chemically synthesized
ttagaaatgacaattggattgt

SEQ ID NO: 1343212 - DNA, 22 bp, Artificial Sequence
  chemically synthesized
caatatcctcttagaaatgaca

SEQ ID NO: 1343213 - DNA, 22 bp, Artificial Sequence
  chemically synthesized
tacaatccaattgtcatttcta

SEQ ID NO: 1343214 - DNA, 22 bp, Artificial Sequence
  chemically synthesized
acaatccaattgtcatttctaa

SEQ ID NO: 1343215 - DNA, 22 bp, Artificial Sequence
  chemically synthesized
caatccaattgtcatttctaag

SEQ ID NO: 1343216 - DNA, 22 bp, Artificial Sequence
  chemically synthesized
tcatttctaagaggatattgga

SEQ ID NO: 1343217 - DNA, 22 bp, Artificial Sequence
  chemically synthesized
tacatgagtaattccaatatcc

SEQ ID NO: 1343218 - DNA, 22 bp, Artificial Sequence
  chemically synthesized
tgtacatgagtaattccaatat

SEQ ID NO: 1343219 - DNA, 22 bp, Artificial Sequence
  chemically synthesized
ctctgtacatgagtaattccaa

SEQ ID NO: 1343220 - DNA, 22 bp, Artificial Sequence
  chemically synthesized
ctaagaggatattggaattact

SEQ ID NO: 1343221 - DNA, 22 bp, Artificial Sequence
  chemically synthesized
actctgtacatgagtaattcca

SEQ ID NO: 1343222 - DNA, 22 bp, Artificial Sequence
  chemically synthesized
taagaggatattggaattactc

SEQ ID NO: 1343223 - DNA, 22 bp, Artificial Sequence
  chemically synthesized
tactctgtacatgagtaattcc

SEQ ID NO: 1343224 - DNA, 22 bp, Artificial Sequence
  chemically synthesized
ttactctgtacatgagtaattc

SEQ ID NO: 1343225 - DNA, 22 bp, Artificial Sequence
  chemically synthesized
agaggatattggaattactcat

SEQ ID NO: 1343226 - DNA, 22 bp, Artificial Sequence
  chemically synthesized
gaattactcatgtacagagtaa

SEQ ID NO: 1343227 - DNA, 22 bp, Artificial Sequence
  chemically synthesized
ctcatgtacagagtaaaaggtt

SEQ ID NO: 1343228 - DNA, 22 bp, Artificial Sequence
  chemically synthesized
atgtacagagtaaaaggttatt

SEQ ID NO: 1343229 - DNA, 22 bp, Artificial Sequence
  chemically synthesized
agtaggaggtgaggaaaataac

SEQ ID NO: 1343230 - DNA, 22 bp, Artificial Sequence
  chemically synthesized
ctaagtaggaggtgaggaaaat

SEQ ID NO: 1343231 - DNA, 22 bp, Artificial Sequence
  chemically synthesized
gctaagtaggaggtgaggaaaa

SEQ ID NO: 1343232 - DNA, 22 bp, Artificial Sequence
  chemically synthesized
tgctaagtaggaggtgaggaaa

SEQ ID NO: 1343233 - DNA, 22 bp, Artificial Sequence
  chemically synthesized
ttgctaagtaggaggtgaggaa

SEQ ID NO: 1343234 - DNA, 22 bp, Artificial Sequence
  chemically synthesized
ttttgctaagtaggaggtgagg

SEQ ID NO: 1343235 - DNA, 22 bp, Artificial Sequence
  chemically synthesized
cttttgctaagtaggaggtgag

SEQ ID NO: 1343236 - DNA, 22 bp, Artificial Sequence
  chemically synthesized
tcttttgctaagtaggaggtga

SEQ ID NO: 1343237 - DNA, 22 bp, Artificial Sequence
  chemically synthesized
actttcttttgctaagtaggag

SEQ ID NO: 1343238 - DNA, 22 bp, Artificial Sequence
  chemically synthesized
cactttcttttgctaagtagga

SEQ ID NO: 1343239 - DNA, 22 bp, Artificial Sequence
  chemically synthesized
ttttcctcacctcctacttagc

SEQ ID NO: 1343240 - DNA, 22 bp, Artificial Sequence
  chemically synthesized
tcactttcttttgctaagtagg

SEQ ID NO: 1343241 - DNA, 22 bp, Artificial Sequence
  chemically synthesized
tcctcacctcctacttagcaaa

SEQ ID NO: 1343242 - DNA, 22 bp, Artificial Sequence
  chemically synthesized
ttttcactttcttttgctaagt

SEQ ID NO: 1343243 - DNA, 22 bp, Artificial Sequence
  chemically synthesized
cctcacctcctacttagcaaaa

SEQ ID NO: 1343244 - DNA, 22 bp, Artificial Sequence
  chemically synthesized
ctcacctcctacttagcaaaag

SEQ ID NO: 1343245 - DNA, 22 bp, Artificial Sequence
  chemically synthesized
acctcctacttagcaaaagaaa

SEQ ID NO: 1343246 - DNA, 22 bp, Artificial Sequence
  chemically synthesized
ctacttagcaaaagaaagtgaa

SEQ ID NO: 1343247 - DNA, 22 bp, Artificial Sequence
  chemically synthesized
cttagcaaaagaaagtgaaaac

SEQ ID NO: 1343248 - DNA, 22 bp, Artificial Sequence
  chemically synthesized
agcaaaagaaagtgaaaacaat

SEQ ID NO: 1343249 - DNA, 22 bp, Artificial Sequence
  chemically synthesized
gcaaaagaaagtgaaaacaatg

SEQ ID NO: 1343250 - DNA, 22 bp, Artificial Sequence
  chemically synthesized
aaaataagaatgtcattgtttt

SEQ ID NO: 1343251 - DNA, 22 bp, Artificial Sequence
  chemically synthesized
aatcactaaaaataagaatgtc

SEQ ID NO: 1343252 - DNA, 22 bp, Artificial Sequence
  chemically synthesized
ttatttttagtgatttaattac

SEQ ID NO: 1343253 - DNA, 22 bp, Artificial Sequence
  chemically synthesized
atttttagtgatttaattacat

SEQ ID NO: 1343254 - DNA, 22 bp, Artificial Sequence
  chemically synthesized
tttttagtgatttaattacatt

SEQ ID NO: 1343255 - DNA, 22 bp, Artificial Sequence
  chemically synthesized
ttagtgatttaattacattttc

SEQ ID NO: 1343256 - DNA, 22 bp, Artificial Sequence
  chemically synthesized
tagtgatttaattacattttct

SEQ ID NO: 1343257 - DNA, 22 bp, Artificial Sequence
  chemically synthesized
agtgatttaattacattttctt

SEQ ID NO: 1343258 - DNA, 22 bp, Artificial Sequence
  chemically synthesized
gtgatttaattacattttctta

SEQ ID NO: 1343259 - DNA, 22 bp, Artificial Sequence
  chemically synthesized
aattacattttcttatccatgt

SEQ ID NO: 1343260 - DNA, 22 bp, Artificial Sequence
  chemically synthesized
attacattttcttatccatgtg

SEQ ID NO: 1343261 - DNA, 22 bp, Artificial Sequence
  chemically synthesized
gatgaagaaaatcacatggata

SEQ ID NO: 1343262 - DNA, 22 bp, Artificial Sequence
  chemically synthesized
cattttcttatccatgtgattt

SEQ ID NO: 1343263 - DNA, 22 bp, Artificial Sequence
  chemically synthesized
aattagatgaagaaaatcacat

SEQ ID NO: 1343264 - DNA, 22 bp, Artificial Sequence
  chemically synthesized
ttaaattagatgaagaaaatca

SEQ ID NO: 1343265 - DNA, 22 bp, Artificial Sequence
  chemically synthesized
tcttatccatgtgattttcttc

SEQ ID NO: 1343266 - DNA, 22 bp, Artificial Sequence
  chemically synthesized
gttaaattagatgaagaaaatc

SEQ ID NO: 1343267 - DNA, 22 bp, Artificial Sequence
  chemically synthesized
cttatccatgtgattttcttca

SEQ ID NO: 1343268 - DNA, 22 bp, Artificial Sequence
  chemically synthesized
tgttaaattagatgaagaaaat

SEQ ID NO: 1343269 - DNA, 22 bp, Artificial Sequence
  chemically synthesized
ttatccatgtgattttcttcat

SEQ ID NO: 1343270 - DNA, 22 bp, Artificial Sequence
  chemically synthesized
atccatgtgattttcttcatct

SEQ ID NO: 1343271 - DNA, 22 bp, Artificial Sequence
  chemically synthesized
tccatgtgattttcttcatcta

SEQ ID NO: 1343272 - DNA, 22 bp, Artificial Sequence
  chemically synthesized
ataattttgttaaattagatga

SEQ ID NO: 1343273 - DNA, 22 bp, Artificial Sequence
  chemically synthesized
tgataattttgttaaattagat

SEQ ID NO: 1343274 - DNA, 22 bp, Artificial Sequence
  chemically synthesized
tcttcatctaatttaacaaaat

SEQ ID NO: 1343275 - DNA, 22 bp, Artificial Sequence
  chemically synthesized
cttcatctaatttaacaaaatt

SEQ ID NO: 1343276 - DNA, 22 bp, Artificial Sequence
  chemically synthesized
ttcatctaatttaacaaaatta

SEQ ID NO: 1343277 - DNA, 22 bp, Artificial Sequence
  chemically synthesized
catctaatttaacaaaattatc

SEQ ID NO: 1343278 - DNA, 22 bp, Artificial Sequence
  chemically synthesized
atctaatttaacaaaattatca

SEQ ID NO: 1343279 - DNA, 22 bp, Artificial Sequence
  chemically synthesized
atttaacaaaattatcagagac

SEQ ID NO: 1343280 - DNA, 22 bp, Artificial Sequence
  chemically synthesized
aacaaaattatcagagacatgg

SEQ ID NO: 1343281 - DNA, 22 bp, Artificial Sequence
  chemically synthesized
acaaaattatcagagacatggt

SEQ ID NO: 1343282 - DNA, 22 bp, Artificial Sequence
  chemically synthesized
tcagagacatggtctgattaca

SEQ ID NO: 1343283 - DNA, 22 bp, Artificial Sequence
  chemically synthesized
gaataagaaagatgatatgtaa

SEQ ID NO: 1343284 - DNA, 22 bp, Artificial Sequence
  chemically synthesized
tggaataagaaagatgatatgt

SEQ ID NO: 1343285 - DNA, 22 bp, Artificial Sequence
  chemically synthesized
ctggaataagaaagatgatatg

SEQ ID NO: 1343286 - DNA, 22 bp, Artificial Sequence
  chemically synthesized
tacttctggaataagaaagatg

SEQ ID NO: 1343287 - DNA, 22 bp, Artificial Sequence
  chemically synthesized
gtacttctggaataagaaagat

SEQ ID NO: 1343288 - DNA, 22 bp, Artificial Sequence
  chemically synthesized
attacatatcatctttcttatt

SEQ ID NO: 1343289 - DNA, 22 bp, Artificial Sequence
  chemically synthesized
tcttgtacttctggaataagaa

SEQ ID NO: 1343290 - DNA, 22 bp, Artificial Sequence
  chemically synthesized
gtcttgtacttctggaataaga

SEQ ID NO: 1343291 - DNA, 22 bp, Artificial Sequence
  chemically synthesized
catatcatctttcttattccag

SEQ ID NO: 1343292 - DNA, 22 bp, Artificial Sequence
  chemically synthesized
tgtcttgtacttctggaataag

SEQ ID NO: 1343293 - DNA, 22 bp, Artificial Sequence
  chemically synthesized
gttttgtcttgtacttctggaa

SEQ ID NO: 1343294 - DNA, 22 bp, Artificial Sequence
  chemically synthesized
tcttattccagaagtacaagac

SEQ ID NO: 1343295 - DNA, 22 bp, Artificial Sequence
  chemically synthesized
cttattccagaagtacaagaca

SEQ ID NO: 1343296 - DNA, 22 bp, Artificial Sequence
  chemically synthesized
ttattccagaagtacaagacaa

SEQ ID NO: 1343297 - DNA, 22 bp, Artificial Sequence
  chemically synthesized
attccagaagtacaagacaaaa

SEQ ID NO: 1343298 - DNA, 22 bp, Artificial Sequence
  chemically synthesized
ttccagaagtacaagacaaaac

SEQ ID NO: 1343299 - DNA, 22 bp, Artificial Sequence
  chemically synthesized
cagaagtacaagacaaaactaa

SEQ ID NO: 1343300 - DNA, 22 bp, Artificial Sequence
  chemically synthesized
taagcagaaatcaaggttagtt

SEQ ID NO: 1343301 - DNA, 22 bp, Artificial Sequence
  chemically synthesized
accttgatttctgcttataatc

SEQ ID NO: 1343302 - DNA, 22 bp, Artificial Sequence
  chemically synthesized
gatttctgcttataatcttaca

SEQ ID NO: 1343303 - DNA, 22 bp, Artificial Sequence
  chemically synthesized
atttctgcttataatcttacat

SEQ ID NO: 1343304 - DNA, 22 bp, Artificial Sequence
  chemically synthesized
ctgcttataatcttacattctc

SEQ ID NO: 1343305 - DNA, 22 bp, Artificial Sequence
  chemically synthesized
tgcttataatcttacattctcc

SEQ ID NO: 1343306 - DNA, 22 bp, Artificial Sequence
  chemically synthesized
tgtgaatccatggggagaatgt

SEQ ID NO: 1343307 - DNA, 22 bp, Artificial Sequence
  chemically synthesized
cttataatcttacattctcccc

SEQ ID NO: 1343308 - DNA, 22 bp, Artificial Sequence
  chemically synthesized
ataatcttacattctccccatg

SEQ ID NO: 1343309 - DNA, 22 bp, Artificial Sequence
  chemically synthesized
taatcttacattctccccatgg

SEQ ID NO: 1343310 - DNA, 22 bp, Artificial Sequence
  chemically synthesized
acattctccccatggattcaca

SEQ ID NO: 1343311 - DNA, 22 bp, Artificial Sequence
  chemically synthesized
cattctccccatggattcacac

SEQ ID NO: 1343312 - DNA, 22 bp, Artificial Sequence
  chemically synthesized
tccccatggattcacacagctc

SEQ ID NO: 1343313 - DNA, 22 bp, Artificial Sequence
  chemically synthesized
cccatggattcacacagctcta

SEQ ID NO: 1343314 - DNA, 22 bp, Artificial Sequence
  chemically synthesized
gccacaaatcagggtagagctg

SEQ ID NO: 1343315 - DNA, 22 bp, Artificial Sequence
  chemically synthesized
ttagccacaaatcagggtagag

SEQ ID NO: 1343316 - DNA, 22 bp, Artificial Sequence
  chemically synthesized
ttattagccacaaatcagggta

SEQ ID NO: 1343317 - DNA, 22 bp, Artificial Sequence
  chemically synthesized
acacagctctaccctgatttgt

SEQ ID NO: 1343318 - DNA, 22 bp, Artificial Sequence
  chemically synthesized
ttgttattagccacaaatcagg

SEQ ID NO: 1343319 - DNA, 22 bp, Artificial Sequence
  chemically synthesized
aaattgttgttattagccacaa

SEQ ID NO: 1343320 - DNA, 22 bp, Artificial Sequence
  chemically synthesized
taccctgatttgtggctaataa

SEQ ID NO: 1343321 - DNA, 22 bp, Artificial Sequence
  chemically synthesized
ccctgatttgtggctaataaca

SEQ ID NO: 1343322 - DNA, 22 bp, Artificial Sequence
  chemically synthesized
atttgtggctaataacaacaat

SEQ ID NO: 1343323 - DNA, 22 bp, Artificial Sequence
  chemically synthesized
gtggctaataacaacaatttta

SEQ ID NO: 1343324 - DNA, 22 bp, Artificial Sequence
  chemically synthesized
tggctaataacaacaattttaa

SEQ ID NO: 1343325 - DNA, 22 bp, Artificial Sequence
  chemically synthesized
aaagaataggaaaattaaaatt

SEQ ID NO: 1343326 - DNA, 22 bp, Artificial Sequence
  chemically synthesized
ataacaacaattttaattttcc

SEQ ID NO: 1343327 - DNA, 22 bp, Artificial Sequence
  chemically synthesized
attaaaagaataggaaaattaa

SEQ ID NO: 1343328 - DNA, 22 bp, Artificial Sequence
  chemically synthesized
cattaaaagaataggaaaatta

SEQ ID NO: 1343329 - DNA, 22 bp, Artificial Sequence
  chemically synthesized
tcattaaaagaataggaaaatt

SEQ ID NO: 1343330 - DNA, 22 bp, Artificial Sequence
  chemically synthesized
ctttcattaaaagaataggaaa

SEQ ID NO: 1343331 - DNA, 22 bp, Artificial Sequence
  chemically synthesized
taattttcctattcttttaatg

SEQ ID NO: 1343332 - DNA, 22 bp, Artificial Sequence
  chemically synthesized
aattttcctattcttttaatga

SEQ ID NO: 1343333 - DNA, 22 bp, Artificial Sequence
  chemically synthesized
attttcctattcttttaatgaa

SEQ ID NO: 1343334 - DNA, 22 bp, Artificial Sequence
  chemically synthesized
tcctattcttttaatgaaagta

SEQ ID NO: 1343335 - DNA, 22 bp, Artificial Sequence
  chemically synthesized
cctattcttttaatgaaagtaa

SEQ ID NO: 1343336 - DNA, 22 bp, Artificial Sequence
  chemically synthesized
ctattcttttaatgaaagtaat

SEQ ID NO: 1343337 - DNA, 22 bp, Artificial Sequence
  chemically synthesized
ttcttttaatgaaagtaatatt

SEQ ID NO: 1343338 - DNA, 22 bp, Artificial Sequence
  chemically synthesized
ttttaatgaaagtaatattcct

SEQ ID NO: 1343339 - DNA, 22 bp, Artificial Sequence
  chemically synthesized
agagaagaagagaggaatatta

SEQ ID NO: 1343340 - DNA, 22 bp, Artificial Sequence
  chemically synthesized
cagagaagaagagaggaatatt

SEQ ID NO: 1343341 - DNA, 22 bp, Artificial Sequence
  chemically synthesized
ttaatgaaagtaatattcctct

SEQ ID NO: 1343342 - DNA, 22 bp, Artificial Sequence
  chemically synthesized
tcagagaagaagagaggaatat

SEQ ID NO: 1343343 - DNA, 22 bp, Artificial Sequence
  chemically synthesized
taatgaaagtaatattcctctc

SEQ ID NO: 1343344 - DNA, 22 bp, Artificial Sequence
  chemically synthesized
ttcagagaagaagagaggaata

SEQ ID NO: 1343345 - DNA, 22 bp, Artificial Sequence
  chemically synthesized
aatgaaagtaatattcctctct

SEQ ID NO: 1343346 - DNA, 22 bp, Artificial Sequence
  chemically synthesized
atgaaagtaatattcctctctt

SEQ ID NO: 1343347 - DNA, 22 bp, Artificial Sequence
  chemically synthesized
atttttcagagaagaagagagg

SEQ ID NO: 1343348 - DNA, 22 bp, Artificial Sequence
  chemically synthesized
ctctcttcttctctgaaaaatg

SEQ ID NO: 1343349 - DNA, 22 bp, Artificial Sequence
  chemically synthesized
tcttcttctctgaaaaatgaat

SEQ ID NO: 1343350 - DNA, 22 bp, Artificial Sequence
  chemically synthesized
ttcttctctgaaaaatgaatgc

SEQ ID NO: 1343351 - DNA, 22 bp, Artificial Sequence
  chemically synthesized
ccaaatcataaaggcattcatt

SEQ ID NO: 1343352 - DNA, 22 bp, Artificial Sequence
  chemically synthesized
cttctctgaaaaatgaatgcct

SEQ ID NO: 1343353 - DNA, 22 bp, Artificial Sequence
  chemically synthesized
ttctctgaaaaatgaatgcctt

SEQ ID NO: 1343354 - DNA, 22 bp, Artificial Sequence
  chemically synthesized
ctctgaaaaatgaatgccttta

SEQ ID NO: 1343355 - DNA, 22 bp, Artificial Sequence
  chemically synthesized
cctcccaaatcataaaggcatt

SEQ ID NO: 1343356 - DNA, 22 bp, Artificial Sequence
  chemically synthesized
tctgaaaaatgaatgcctttat

SEQ ID NO: 1343357 - DNA, 22 bp, Artificial Sequence
  chemically synthesized
ccctcccaaatcataaaggcat

SEQ ID NO: 1343358 - DNA, 22 bp, Artificial Sequence
  chemically synthesized
tccctcccaaatcataaaggca

SEQ ID NO: 1343359 - DNA, 22 bp, Artificial Sequence
  chemically synthesized
tgaaaaatgaatgcctttatga

SEQ ID NO: 1343360 - DNA, 22 bp, Artificial Sequence
  chemically synthesized
ttccctcccaaatcataaaggc

SEQ ID NO: 1343361 - DNA, 22 bp, Artificial Sequence
  chemically synthesized
aaaaatgaatgcctttatgatt

SEQ ID NO: 1343362 - DNA, 22 bp, Artificial Sequence
  chemically synthesized
tatgatttgggagggaaaaatt

SEQ ID NO: 1343363 - DNA, 22 bp, Artificial Sequence
  chemically synthesized
atgatttgggagggaaaaattc

SEQ ID NO: 1343364 - DNA, 22 bp, Artificial Sequence
  chemically synthesized
tgatttgggagggaaaaattct

SEQ ID NO: 1343365 - DNA, 22 bp, Artificial Sequence
  chemically synthesized
gggagggaaaaattctcctttg

SEQ ID NO: 1343366 - DNA, 22 bp, Artificial Sequence
  chemically synthesized
ggagggaaaaattctcctttgg

SEQ ID NO: 1343367 - DNA, 22 bp, Artificial Sequence
  chemically synthesized
aaggggaaggaaaacaccaaag

SEQ ID NO: 1343368 - DNA, 22 bp, Artificial Sequence
  chemically synthesized
tcctttggtgttttccttcccc

SEQ ID NO: 1343369 - DNA, 22 bp, Artificial Sequence
  chemically synthesized
ctttggtgttttccttcccctt

SEQ ID NO: 1343370 - DNA, 22 bp, Artificial Sequence
  chemically synthesized
tggtgttttccttccccttcag

SEQ ID NO: 1343371 - DNA, 22 bp, Artificial Sequence
  chemically synthesized
ggtgttttccttccccttcagt

SEQ ID NO: 1343372 - DNA, 22 bp, Artificial Sequence
  chemically synthesized
gtgttttccttccccttcagtt

SEQ ID NO: 1343373 - DNA, 22 bp, Artificial Sequence
  chemically synthesized
atagtgtgggtcaactgaaggg

SEQ ID NO: 1343374 - DNA, 22 bp, Artificial Sequence
  chemically synthesized
ttaatagtgtgggtcaactgaa

SEQ ID NO: 1343375 - DNA, 22 bp, Artificial Sequence
  chemically synthesized
tccttccccttcagttgaccca

SEQ ID NO: 1343376 - DNA, 22 bp, Artificial Sequence
  chemically synthesized
ccttccccttcagttgacccac

SEQ ID NO: 1343377 - DNA, 22 bp, Artificial Sequence
  chemically synthesized
cttccccttcagttgacccaca

SEQ ID NO: 1343378 - DNA, 22 bp, Artificial Sequence
  chemically synthesized
ccccttcagttgacccacacta

SEQ ID NO: 1343379 - DNA, 22 bp, Artificial Sequence
  chemically synthesized
cccttcagttgacccacactat

SEQ ID NO: 1343380 - DNA, 22 bp, Artificial Sequence
  chemically synthesized
tgaagattattaatagtgtggg

SEQ ID NO: 1343381 - DNA, 22 bp, Artificial Sequence
  chemically synthesized
cagttgacccacactattaata

SEQ ID NO: 1343382 - DNA, 22 bp, Artificial Sequence
  chemically synthesized
agttgacccacactattaataa

SEQ ID NO: 1343383 - DNA, 22 bp, Artificial Sequence
  chemically synthesized
atattgtgaagattattaatag

SEQ ID NO: 1343384 - DNA, 22 bp, Artificial Sequence
  chemically synthesized
acccacactattaataatcttc

SEQ ID NO: 1343385 - DNA, 22 bp, Artificial Sequence
  chemically synthesized
caacaatgattgatattgtgaa

SEQ ID NO: 1343386 - DNA, 22 bp, Artificial Sequence
  chemically synthesized
ttaataatcttcacaatatcaa

SEQ ID NO: 1343387 - DNA, 22 bp, Artificial Sequence
  chemically synthesized
agctgcaacaatgattgatatt

SEQ ID NO: 1343388 - DNA, 22 bp, Artificial Sequence
  chemically synthesized
ataatcttcacaatatcaatca

SEQ ID NO: 1343389 - DNA, 22 bp, Artificial Sequence
  chemically synthesized
tgtctaagctgcaacaatgatt

SEQ ID NO: 1343390 - DNA, 22 bp, Artificial Sequence
  chemically synthesized
cacaatatcaatcattgttgca

SEQ ID NO: 1343391 - DNA, 22 bp, Artificial Sequence
  chemically synthesized
acaatatcaatcattgttgcag

SEQ ID NO: 1343392 - DNA, 22 bp, Artificial Sequence
  chemically synthesized
tctatgtctaagctgcaacaat

SEQ ID NO: 1343393 - DNA, 22 bp, Artificial Sequence
  chemically synthesized
ataaacattgtctatgtctaag

SEQ ID NO: 1343394 - DNA, 22 bp, Artificial Sequence
  chemically synthesized
ttgcagcttagacatagacaat

SEQ ID NO: 1343395 - DNA, 22 bp, Artificial Sequence
  chemically synthesized
cagcttagacatagacaatgtt

SEQ ID NO: 1343396 - DNA, 22 bp, Artificial Sequence
  chemically synthesized
agacatagacaatgtttatgag

SEQ ID NO: 1343397 - DNA, 22 bp, Artificial Sequence
  chemically synthesized
gacatagacaatgtttatgagc

SEQ ID NO: 1343398 - DNA, 22 bp, Artificial Sequence
  chemically synthesized
aaaaaaaaaaaaaagagaaagg

SEQ ID NO: 1343399 - DNA, 22 bp, Artificial Sequence
  chemically synthesized
tctaaaaaaaaaaaaaaagaga

SEQ ID NO: 1343400 - DNA, 22 bp, Artificial Sequence
  chemically synthesized
tgtctaaaaaaaaaaaaaaaga

SEQ ID NO: 1343401 - DNA, 22 bp, Artificial Sequence
  chemically synthesized
atgagcctttctcttttttttt

SEQ ID NO: 1343402 - DNA, 22 bp, Artificial Sequence
  chemically synthesized
tgagcctttctctttttttttt

SEQ ID NO: 1343403 - DNA, 22 bp, Artificial Sequence
  chemically synthesized
tctctttttttttttttttaga

SEQ ID NO: 1343404 - DNA, 22 bp, Artificial Sequence
  chemically synthesized
ctctttttttttttttttagac

SEQ ID NO: 1343405 - DNA, 22 bp, Artificial Sequence
  chemically synthesized
tctttttttttttttttagaca

SEQ ID NO: 1343406 - DNA, 22 bp, Artificial Sequence
  chemically synthesized
tttttttttttttttagacaga

SEQ ID NO: 1343407 - DNA, 22 bp, Artificial Sequence
  chemically synthesized
tttttttttttttagacagagt

SEQ ID NO: 1343408 - DNA, 22 bp, Artificial Sequence
  chemically synthesized
ttttttttttttagacagagtc

SEQ ID NO: 1343409 - DNA, 22 bp, Artificial Sequence
  chemically synthesized
tttttttttttagacagagtct

SEQ ID NO: 1343410 - DNA, 22 bp, Artificial Sequence
  chemically synthesized
ggtgacagagcaagactctgtc

SEQ ID NO: 1343411 - DNA, 22 bp, Artificial Sequence
  chemically synthesized
ttttttttttagacagagtctt

SEQ ID NO: 1343412 - DNA, 22 bp, Artificial Sequence
  chemically synthesized
tttttttttagacagagtcttg

SEQ ID NO: 1343413 - DNA, 22 bp, Artificial Sequence
  chemically synthesized
ttttttttagacagagtcttgc

SEQ ID NO: 1343414 - DNA, 22 bp, Artificial Sequence
  chemically synthesized
tttttttagacagagtcttgct

SEQ ID NO: 1343415 - DNA, 22 bp, Artificial Sequence
  chemically synthesized
ttttttagacagagtcttgctc

SEQ ID NO: 1343416 - DNA, 22 bp, Artificial Sequence
  chemically synthesized
tttttagacagagtcttgctct

SEQ ID NO: 1343417 - DNA, 22 bp, Artificial Sequence
  chemically synthesized
ttttagacagagtcttgctctg

SEQ ID NO: 1343418 - DNA, 22 bp, Artificial Sequence
  chemically synthesized
cagcctgggtgacagagcaaga

SEQ ID NO: 1343419 - DNA, 22 bp, Artificial Sequence
  chemically synthesized
tttagacagagtcttgctctgt

SEQ ID NO: 1343420 - DNA, 22 bp, Artificial Sequence
  chemically synthesized
ttagacagagtcttgctctgtc

SEQ ID NO: 1343421 - DNA, 22 bp, Artificial Sequence
  chemically synthesized
tagacagagtcttgctctgtca

SEQ ID NO: 1343422 - DNA, 22 bp, Artificial Sequence
  chemically synthesized
agacagagtcttgctctgtcac

SEQ ID NO: 1343423 - DNA, 22 bp, Artificial Sequence
  chemically synthesized
gacagagtcttgctctgtcacc

SEQ ID NO: 1343424 - DNA, 22 bp, Artificial Sequence
  chemically synthesized
cactccagcctgggtgacagag

SEQ ID NO: 1343425 - DNA, 22 bp, Artificial Sequence
  chemically synthesized
agccactgcactccagcctggg

SEQ ID NO: 1343426 - DNA, 22 bp, Artificial Sequence
  chemically synthesized
gctctgtcacccaggctggagt

SEQ ID NO: 1343427 - DNA, 22 bp, Artificial Sequence
  chemically synthesized
ctctgtcacccaggctggagtg

SEQ ID NO: 1343428 - DNA, 22 bp, Artificial Sequence
  chemically synthesized
agattgagccactgcactccag

SEQ ID NO: 1343429 - DNA, 22 bp, Artificial Sequence
  chemically synthesized
tgtcacccaggctggagtgcag

SEQ ID NO: 1343430 - DNA, 22 bp, Artificial Sequence
  chemically synthesized
tcacccaggctggagtgcagtg

SEQ ID NO: 1343431 - DNA, 22 bp, Artificial Sequence
  chemically synthesized
cagtgagctgagattgagccac

SEQ ID NO: 1343432 - DNA, 22 bp, Artificial Sequence
  chemically synthesized
gagtgcagtggctcaatctcag

SEQ ID NO: 1343433 - DNA, 22 bp, Artificial Sequence
  chemically synthesized
ggaggcggaggttgcagtgagc

SEQ ID NO: 1343434 - DNA, 22 bp, Artificial Sequence
  chemically synthesized
aatctcagctcactgcaacctc

SEQ ID NO: 1343435 - DNA, 22 bp, Artificial Sequence
  chemically synthesized
aatctgggaggcggaggttgca

SEQ ID NO: 1343436 - DNA, 22 bp, Artificial Sequence
  chemically synthesized
gaatctgggaggcggaggttgc

SEQ ID NO: 1343437 - DNA, 22 bp, Artificial Sequence
  chemically synthesized
agctcactgcaacctccgcctc

SEQ ID NO: 1343438 - DNA, 22 bp, Artificial Sequence
  chemically synthesized
actgcaacctccgcctcccaga

SEQ ID NO: 1343439 - DNA, 22 bp, Artificial Sequence
  chemically synthesized
caacctccgcctcccagattca

SEQ ID NO: 1343440 - DNA, 22 bp, Artificial Sequence
  chemically synthesized
cgcctcccagattcaagcgatt

SEQ ID NO: 1343441 - DNA, 22 bp, Artificial Sequence
  chemically synthesized
ccagattcaagcgattctcctg

SEQ ID NO: 1343442 - DNA, 22 bp, Artificial Sequence
  chemically synthesized
aggaggccaaggcaggagaatc

SEQ ID NO: 1343443 - DNA, 22 bp, Artificial Sequence
  chemically synthesized
ctcaggaggccaaggcaggaga

SEQ ID NO: 1343444 - DNA, 22 bp, Artificial Sequence
  chemically synthesized
aagcgattctcctgccttggcc

SEQ ID NO: 1343445 - DNA, 22 bp, Artificial Sequence
  chemically synthesized
cagctactcaggaggccaaggc

SEQ ID NO: 1343446 - DNA, 22 bp, Artificial Sequence
  chemically synthesized
tagttccagctactcaggaggc

SEQ ID NO: 1343447 - DNA, 22 bp, Artificial Sequence
  chemically synthesized
tcctgccttggcctcctgagta

SEQ ID NO: 1343448 - DNA, 22 bp, Artificial Sequence
  chemically synthesized
ctgccttggcctcctgagtagc

SEQ ID NO: 1343449 - DNA, 22 bp, Artificial Sequence
  chemically synthesized
ccttggcctcctgagtagctgg

SEQ ID NO: 1343450 - DNA, 22 bp, Artificial Sequence
  chemically synthesized
ggcctcctgagtagctggaact

SEQ ID NO: 1343451 - DNA, 22 bp, Artificial Sequence
  chemically synthesized
gcctcctgagtagctggaacta

SEQ ID NO: 1343452 - DNA, 22 bp, Artificial Sequence
  chemically synthesized
ctgagtagctggaactacaggt

SEQ ID NO: 1343453 - DNA, 22 bp, Artificial Sequence
  chemically synthesized
agtagctggaactacaggtgcc

SEQ ID NO: 1343454 - DNA, 22 bp, Artificial Sequence
  chemically synthesized
ggtgtggtggcgggcacctgta

SEQ ID NO: 1343455 - DNA, 22 bp, Artificial Sequence
  chemically synthesized
gctgggtgtggtggcgggcacc

SEQ ID NO: 1343456 - DNA, 22 bp, Artificial Sequence
  chemically synthesized
gaactacaggtgcccgccacca

SEQ ID NO: 1343457 - DNA, 22 bp, Artificial Sequence
  chemically synthesized
caggtgcccgccaccacaccca

SEQ ID NO: 1343458 - DNA, 22 bp, Artificial Sequence
  chemically synthesized
aaaatacaaaaattagctgggt

SEQ ID NO: 1343459 - DNA, 22 bp, Artificial Sequence
  chemically synthesized
ttaaaaatacaaaaattagctg

SEQ ID NO: 1343460 - DNA, 22 bp, Artificial Sequence
  chemically synthesized
tattaaaaatacaaaaattagc

SEQ ID NO: 1343461 - DNA, 22 bp, Artificial Sequence
  chemically synthesized
atttttgtatttttaatagaga

SEQ ID NO: 1343462 - DNA, 22 bp, Artificial Sequence
  chemically synthesized
ttgtatttttaatagagatggg

SEQ ID NO: 1343463 - DNA, 22 bp, Artificial Sequence
  chemically synthesized
tgtatttttaatagagatgggg

SEQ ID NO: 1343464 - DNA, 22 bp, Artificial Sequence
  chemically synthesized
gtatttttaatagagatggggt

SEQ ID NO: 1343465 - DNA, 22 bp, Artificial Sequence
  chemically synthesized
tatttttaatagagatggggtt

SEQ ID NO: 1343466 - DNA, 22 bp, Artificial Sequence
  chemically synthesized
gccaacatggtgaaaccccatc

SEQ ID NO: 1343467 - DNA, 22 bp, Artificial Sequence
  chemically synthesized
ttaatagagatggggtttcacc

SEQ ID NO: 1343468 - DNA, 22 bp, Artificial Sequence
  chemically synthesized
taatagagatggggtttcacca

SEQ ID NO: 1343469 - DNA, 22 bp, Artificial Sequence
  chemically synthesized
aatagagatggggtttcaccat

SEQ ID NO: 1343470 - DNA, 22 bp, Artificial Sequence
  chemically synthesized
atagagatggggtttcaccatg

SEQ ID NO: 1343471 - DNA, 22 bp, Artificial Sequence
  chemically synthesized
aagaccagcctggccaacatgg

SEQ ID NO: 1343472 - DNA, 22 bp, Artificial Sequence
  chemically synthesized
caccatgttggccaggctggtc

SEQ ID NO: 1343473 - DNA, 22 bp, Artificial Sequence
  chemically synthesized
accatgttggccaggctggtct

SEQ ID NO: 1343474 - DNA, 22 bp, Artificial Sequence
  chemically synthesized
aggtcaggggttcaagaccagc

SEQ ID NO: 1343475 - DNA, 22 bp, Artificial Sequence
  chemically synthesized
gccaggctggtcttgaacccct

SEQ ID NO: 1343476 - DNA, 22 bp, Artificial Sequence
  chemically synthesized
gtcttgaacccctgacctcagg

SEQ ID NO: 1343477 - DNA, 22 bp, Artificial Sequence
  chemically synthesized
gaacccctgacctcaggtgatc

SEQ ID NO: 1343478 - DNA, 22 bp, Artificial Sequence
  chemically synthesized
aacccctgacctcaggtgatcc

SEQ ID NO: 1343479 - DNA, 22 bp, Artificial Sequence
  chemically synthesized
ggaggccaaagcaggtggatca

SEQ ID NO: 1343480 - DNA, 22 bp, Artificial Sequence
  chemically synthesized
gggaggccaaagcaggtggatc

SEQ ID NO: 1343481 - DNA, 22 bp, Artificial Sequence
  chemically synthesized
tgggaggccaaagcaggtggat

SEQ ID NO: 1343482 - DNA, 22 bp, Artificial Sequence
  chemically synthesized
acctcaggtgatccacctgctt

SEQ ID NO: 1343483 - DNA, 22 bp, Artificial Sequence
  chemically synthesized
aggtgatccacctgctttggcc

SEQ ID NO: 1343484 - DNA, 22 bp, Artificial Sequence
  chemically synthesized
caatcccagcactttgggaggc

SEQ ID NO: 1343485 - DNA, 22 bp, Artificial Sequence
  chemically synthesized
ctttggcctcccaaagtgctgg

SEQ ID NO: 1343486 - DNA, 22 bp, Artificial Sequence
  chemically synthesized
aaacctgcaatcccagcacttt

SEQ ID NO: 1343487 - DNA, 22 bp, Artificial Sequence
  chemically synthesized
tggcctcccaaagtgctgggat

SEQ ID NO: 1343488 - DNA, 22 bp, Artificial Sequence
  chemically synthesized
ggcctcccaaagtgctgggatt

SEQ ID NO: 1343489 - DNA, 22 bp, Artificial Sequence
  chemically synthesized
gcctcccaaagtgctgggattg

SEQ ID NO: 1343490 - DNA, 22 bp, Artificial Sequence
  chemically synthesized
ccaaagtgctgggattgcaggt

SEQ ID NO: 1343491 - DNA, 22 bp, Artificial Sequence
  chemically synthesized
ggtgcagtggttcaaacctgca

SEQ ID NO: 1343492 - DNA, 22 bp, Artificial Sequence
  chemically synthesized
gctgggtgcagtggttcaaacc

SEQ ID NO: 1343493 - DNA, 22 bp, Artificial Sequence
  chemically synthesized
ggattgcaggtttgaaccactg

SEQ ID NO: 1343494 - DNA, 22 bp, Artificial Sequence
  chemically synthesized
aaatgctggctgggtgcagtgg

SEQ ID NO: 1343495 - DNA, 22 bp, Artificial Sequence
  chemically synthesized
gaaatgctggctgggtgcagtg

SEQ ID NO: 1343496 - DNA, 22 bp, Artificial Sequence
  chemically synthesized
caggtttgaaccactgcaccca

SEQ ID NO: 1343497 - DNA, 22 bp, Artificial Sequence
  chemically synthesized
gatttgaaatgctggctgggtg

SEQ ID NO: 1343498 - DNA, 22 bp, Artificial Sequence
  chemically synthesized
gaaccactgcacccagccagca

SEQ ID NO: 1343499 - DNA, 22 bp, Artificial Sequence
  chemically synthesized
aaccactgcacccagccagcat

SEQ ID NO: 1343500 - DNA, 22 bp, Artificial Sequence
  chemically synthesized
cacccagccagcatttcaaatc

SEQ ID NO: 1343501 - DNA, 22 bp, Artificial Sequence
  chemically synthesized
tggtagcatctggatttgaaat

SEQ ID NO: 1343502 - DNA, 22 bp, Artificial Sequence
  chemically synthesized
ctgtggtagcatctggatttga

SEQ ID NO: 1343503 - DNA, 22 bp, Artificial Sequence
  chemically synthesized
caaatccagatgctaccacagg

SEQ ID NO: 1343504 - DNA, 22 bp, Artificial Sequence
  chemically synthesized
aaatccagatgctaccacagga

SEQ ID NO: 1343505 - DNA, 22 bp, Artificial Sequence
  chemically synthesized
aggcccagagcctcctgtggta

SEQ ID NO: 1343506 - DNA, 22 bp, Artificial Sequence
  chemically synthesized
aaggcccagagcctcctgtggt

SEQ ID NO: 1343507 - DNA, 22 bp, Artificial Sequence
  chemically synthesized
taaggcccagagcctcctgtgg

SEQ ID NO: 1343508 - DNA, 22 bp, Artificial Sequence
  chemically synthesized
tttaaggcccagagcctcctgt

SEQ ID NO: 1343509 - DNA, 22 bp, Artificial Sequence
  chemically synthesized
ctttaaggcccagagcctcctg

SEQ ID NO: 1343510 - DNA, 22 bp, Artificial Sequence
  chemically synthesized
catttctttaaggcccagagcc

SEQ ID NO: 1343511 - DNA, 22 bp, Artificial Sequence
  chemically synthesized
ccacaggaggctctgggcctta

SEQ ID NO: 1343512 - DNA, 22 bp, Artificial Sequence
  chemically synthesized
gctgcatttctttaaggcccag

SEQ ID NO: 1343513 - DNA, 22 bp, Artificial Sequence
  chemically synthesized
gctggctgcatttctttaaggc

SEQ ID NO: 1343514 - DNA, 22 bp, Artificial Sequence
  chemically synthesized
tgggccttaaagaaatgcagcc

SEQ ID NO: 1343515 - DNA, 22 bp, Artificial Sequence
  chemically synthesized
ggccttaaagaaatgcagccag

SEQ ID NO: 1343516 - DNA, 22 bp, Artificial Sequence
  chemically synthesized
aaagaaatgcagccagctagcc

SEQ ID NO: 1343517 - DNA, 22 bp, Artificial Sequence
  chemically synthesized
aagaaatgcagccagctagccg

SEQ ID NO: 1343518 - DNA, 22 bp, Artificial Sequence
  chemically synthesized
ggagtacagatacgagccacca

SEQ ID NO: 1343519 - DNA, 22 bp, Artificial Sequence
  chemically synthesized
gccgggcatggtggctcgtatc

SEQ ID NO: 1343520 - DNA, 22 bp, Artificial Sequence
  chemically synthesized
caaaatgctaggagtacagata

SEQ ID NO: 1343521 - DNA, 22 bp, Artificial Sequence
  chemically synthesized
ccaaaatgctaggagtacagat

SEQ ID NO: 1343522 - DNA, 22 bp, Artificial Sequence
  chemically synthesized
gccttccaaaatgctaggagta

SEQ ID NO: 1343523 - DNA, 22 bp, Artificial Sequence
  chemically synthesized
ggccttccaaaatgctaggagt

SEQ ID NO: 1343524 - DNA, 22 bp, Artificial Sequence
  chemically synthesized
gtatctgtactcctagcatttt

SEQ ID NO: 1343525 - DNA, 22 bp, Artificial Sequence
  chemically synthesized
ccaccttggccttccaaaatgc

SEQ ID NO: 1343526 - DNA, 22 bp, Artificial Sequence
  chemically synthesized
cccaccttggccttccaaaatg

SEQ ID NO: 1343527 - DNA, 22 bp, Artificial Sequence
  chemically synthesized
tactcctagcattttggaaggc

SEQ ID NO: 1343528 - DNA, 22 bp, Artificial Sequence
  chemically synthesized
ctagcattttggaaggccaagg

SEQ ID NO: 1343529 - DNA, 22 bp, Artificial Sequence
  chemically synthesized
aagtgatcttcccaccttggcc

SEQ ID NO: 1343530 - DNA, 22 bp, Artificial Sequence
  chemically synthesized
gcattttggaaggccaaggtgg

SEQ ID NO: 1343531 - DNA, 22 bp, Artificial Sequence
  chemically synthesized
ggcctcaagtgatcttcccacc

SEQ ID NO: 1343532 - DNA, 22 bp, Artificial Sequence
  chemically synthesized
tggaaggccaaggtgggaagat

SEQ ID NO: 1343533 - DNA, 22 bp, Artificial Sequence
  chemically synthesized
ggaaggccaaggtgggaagatc

SEQ ID NO: 1343534 - DNA, 22 bp, Artificial Sequence
  chemically synthesized
tgggcctcaagtgatcttccca

SEQ ID NO: 1343535 - DNA, 22 bp, Artificial Sequence
  chemically synthesized
gaaggccaaggtgggaagatca

SEQ ID NO: 1343536 - DNA, 22 bp, Artificial Sequence
  chemically synthesized
aaactctgggcctcaagtgatc

SEQ ID NO: 1343537 - DNA, 22 bp, Artificial Sequence
  chemically synthesized
gtctcaaactctgggcctcaag

SEQ ID NO: 1343538 - DNA, 22 bp, Artificial Sequence
  chemically synthesized
cccaggctggtctcaaactctg

SEQ ID NO: 1343539 - DNA, 22 bp, Artificial Sequence
  chemically synthesized
tgttgcccaggctggtctcaaa

SEQ ID NO: 1343540 - DNA, 22 bp, Artificial Sequence
  chemically synthesized
gaggcccagagtttgagaccag

SEQ ID NO: 1343541 - DNA, 22 bp, Artificial Sequence
  chemically synthesized
aggcccagagtttgagaccagc

SEQ ID NO: 1343542 - DNA, 22 bp, Artificial Sequence
  chemically synthesized
cctgtgttgcccaggctggtct

SEQ ID NO: 1343543 - DNA, 22 bp, Artificial Sequence
  chemically synthesized
gagaccagcctgggcaacacag

SEQ ID NO: 1343544 - DNA, 22 bp, Artificial Sequence
  chemically synthesized
agaccagcctgggcaacacagg

SEQ ID NO: 1343545 - DNA, 22 bp, Artificial Sequence
  chemically synthesized
tagagatggcatctccctgtgt

SEQ ID NO: 1343546 - DNA, 22 bp, Artificial Sequence
  chemically synthesized
gtagagatggcatctccctgtg

SEQ ID NO: 1343547 - DNA, 22 bp, Artificial Sequence
  chemically synthesized
tgtagagatggcatctccctgt

SEQ ID NO: 1343548 - DNA, 22 bp, Artificial Sequence
  chemically synthesized
tttgtagagatggcatctccct

SEQ ID NO: 1343549 - DNA, 22 bp, Artificial Sequence
  chemically synthesized
ctttgtagagatggcatctccc

SEQ ID NO: 1343550 - DNA, 22 bp, Artificial Sequence
  chemically synthesized
tctttgtagagatggcatctcc

SEQ ID NO: 1343551 - DNA, 22 bp, Artificial Sequence
  chemically synthesized
ttctttgtagagatggcatctc

SEQ ID NO: 1343552 - DNA, 22 bp, Artificial Sequence
  chemically synthesized
ggcaacacagggagatgccatc

SEQ ID NO: 1343553 - DNA, 22 bp, Artificial Sequence
  chemically synthesized
tttctttgtagagatggcatct

SEQ ID NO: 1343554 - DNA, 22 bp, Artificial Sequence
  chemically synthesized
ttttctttgtagagatggcatc

SEQ ID NO: 1343555 - DNA, 22 bp, Artificial Sequence
  chemically synthesized
tttttctttgtagagatggcat

SEQ ID NO: 1343556 - DNA, 22 bp, Artificial Sequence
  chemically synthesized
ttttttctttgtagagatggca

SEQ ID NO: 1343557 - DNA, 22 bp, Artificial Sequence
  chemically synthesized
tttttttctttgtagagatggc

SEQ ID NO: 1343558 - DNA, 22 bp, Artificial Sequence
  chemically synthesized
ttttttttctttgtagagatgg

SEQ ID NO: 1343559 - DNA, 22 bp, Artificial Sequence
  chemically synthesized
tttttttttctttgtagagatg

SEQ ID NO: 1343560 - DNA, 22 bp, Artificial Sequence
  chemically synthesized
ttttttttttctttgtagagat

SEQ ID NO: 1343561 - DNA, 22 bp, Artificial Sequence
  chemically synthesized
atttttttttttttctttgtag

SEQ ID NO: 1343562 - DNA, 22 bp, Artificial Sequence
  chemically synthesized
gttaatttttttttttttcttt

SEQ ID NO: 1343563 - DNA, 22 bp, Artificial Sequence
  chemically synthesized
tacaaagaaaaaaaaaaaaatt

SEQ ID NO: 1343564 - DNA, 22 bp, Artificial Sequence
  chemically synthesized
caaagaaaaaaaaaaaaattaa

SEQ ID NO: 1343565 - DNA, 22 bp, Artificial Sequence
  chemically synthesized
agcccatgcctggttaattttt

SEQ ID NO: 1343566 - DNA, 22 bp, Artificial Sequence
  chemically synthesized
cagcccatgcctggttaatttt

SEQ ID NO: 1343567 - DNA, 22 bp, Artificial Sequence
  chemically synthesized
tttcagcccatgcctggttaat

SEQ ID NO: 1343568 - DNA, 22 bp, Artificial Sequence
  chemically synthesized
ctgtttcagcccatgcctggtt

SEQ ID NO: 1343569 - DNA, 22 bp, Artificial Sequence
  chemically synthesized
aagtgatcctcctgtttcagcc

SEQ ID NO: 1343570 - DNA, 22 bp, Artificial Sequence
  chemically synthesized
accaggcatgggctgaaacagg

SEQ ID NO: 1343571 - DNA, 22 bp, Artificial Sequence
  chemically synthesized
ggctaaagtgatcctcctgttt

SEQ ID NO: 1343572 - DNA, 22 bp, Artificial Sequence
  chemically synthesized
ctgggctaaagtgatcctcctg

SEQ ID NO: 1343573 - DNA, 22 bp, Artificial Sequence
  chemically synthesized
aaactcctgggctaaagtgatc

SEQ ID NO: 1343574 - DNA, 22 bp, Artificial Sequence
  chemically synthesized
aaacaggaggatcactttagcc

SEQ ID NO: 1343575 - DNA, 22 bp, Artificial Sequence
  chemically synthesized
aagcctcaaactcctgggctaa

SEQ ID NO: 1343576 - DNA, 22 bp, Artificial Sequence
  chemically synthesized
actgaagcctcaaactcctggg

SEQ ID NO: 1343577 - DNA, 22 bp, Artificial Sequence
  chemically synthesized
ctcactgaagcctcaaactcct

SEQ ID NO: 1343578 - DNA, 22 bp, Artificial Sequence
  chemically synthesized
tagcccaggagtttgaggcttc

SEQ ID NO: 1343579 - DNA, 22 bp, Artificial Sequence
  chemically synthesized
agcccaggagtttgaggcttca

SEQ ID NO: 1343580 - DNA, 22 bp, Artificial Sequence
  chemically synthesized
gcccaggagtttgaggcttcag

SEQ ID NO: 1343581 - DNA, 22 bp, Artificial Sequence
  chemically synthesized
gaggcttcagtgagcagatcgc

SEQ ID NO: 1343582 - DNA, 22 bp, Artificial Sequence
  chemically synthesized
aagcgtggtggcgcgatctgct

SEQ ID NO: 1343583 - DNA, 22 bp, Artificial Sequence
  chemically synthesized
aggcttcagtgagcagatcgcg

SEQ ID NO: 1343584 - DNA, 22 bp, Artificial Sequence
  chemically synthesized
ggctgaagcgtggtggcgcgat

SEQ ID NO: 1343585 - DNA, 22 bp, Artificial Sequence
  chemically synthesized
gggctgaagcgtggtggcgcga

SEQ ID NO: 1343586 - DNA, 22 bp, Artificial Sequence
  chemically synthesized
cagtgagcagatcgcgccacca

SEQ ID NO: 1343587 - DNA, 22 bp, Artificial Sequence
  chemically synthesized
agtgagcagatcgcgccaccac

SEQ ID NO: 1343588 - DNA, 22 bp, Artificial Sequence
  chemically synthesized
tcacttgggctgaagcgtggtg

SEQ ID NO: 1343589 - DNA, 22 bp, Artificial Sequence
  chemically synthesized
tgtcacttgggctgaagcgtgg

SEQ ID NO: 1343590 - DNA, 22 bp, Artificial Sequence
  chemically synthesized
ctctgtcacttgggctgaagcg

SEQ ID NO: 1343591 - DNA, 22 bp, Artificial Sequence
  chemically synthesized
gctctgtcacttgggctgaagc

SEQ ID NO: 1343592 - DNA, 22 bp, Artificial Sequence
  chemically synthesized
gaaatgaggtcttgctctgtca

SEQ ID NO: 1343593 - DNA, 22 bp, Artificial Sequence
  chemically synthesized
agaaatgaggtcttgctctgtc

SEQ ID NO: 1343594 - DNA, 22 bp, Artificial Sequence
  chemically synthesized
tagaaatgaggtcttgctctgt

SEQ ID NO: 1343595 - DNA, 22 bp, Artificial Sequence
  chemically synthesized
cagcccaagtgacagagcaaga

SEQ ID NO: 1343596 - DNA, 22 bp, Artificial Sequence
  chemically synthesized
ttagaaatgaggtcttgctctg

SEQ ID NO: 1343597 - DNA, 22 bp, Artificial Sequence
  chemically synthesized
agcccaagtgacagagcaagac

SEQ ID NO: 1343598 - DNA, 22 bp, Artificial Sequence
  chemically synthesized
tttagaaatgaggtcttgctct

SEQ ID NO: 1343599 - DNA, 22 bp, Artificial Sequence
  chemically synthesized
ttttttagaaatgaggtcttgc

SEQ ID NO: 1343600 - DNA, 22 bp, Artificial Sequence
  chemically synthesized
attttttagaaatgaggtcttg

SEQ ID NO: 1343601 - DNA, 22 bp, Artificial Sequence
  chemically synthesized
tttattttttagaaatgaggtc

SEQ ID NO: 1343602 - DNA, 22 bp, Artificial Sequence
  chemically synthesized
atttattttttagaaatgaggt

SEQ ID NO: 1343603 - DNA, 22 bp, Artificial Sequence
  chemically synthesized
atttatttattttttagaaatg

SEQ ID NO: 1343604 - DNA, 22 bp, Artificial Sequence
  chemically synthesized
ttcatttatttattttttagaa

SEQ ID NO: 1343605 - DNA, 22 bp, Artificial Sequence
  chemically synthesized
attcatttatttattttttaga

SEQ ID NO: 1343606 - DNA, 22 bp, Artificial Sequence
  chemically synthesized
ttattcatttatttatttttta

SEQ ID NO: 1343607 - DNA, 22 bp, Artificial Sequence
  chemically synthesized
cttattcatttatttatttttt

SEQ ID NO: 1343608 - DNA, 22 bp, Artificial Sequence
  chemically synthesized
tcttattcatttatttattttt

SEQ ID NO: 1343609 - DNA, 22 bp, Artificial Sequence
  chemically synthesized
tttcttattcatttatttattt

SEQ ID NO: 1343610 - DNA, 22 bp, Artificial Sequence
  chemically synthesized
ctttcttattcatttatttatt

SEQ ID NO: 1343611 - DNA, 22 bp, Artificial Sequence
  chemically synthesized
atttctaaaaaataaataaatg

SEQ ID NO: 1343612 - DNA, 22 bp, Artificial Sequence
  chemically synthesized
catttctttcttattcatttat

SEQ ID NO: 1343613 - DNA, 22 bp, Artificial Sequence
  chemically synthesized
ctaaaaaataaataaatgaata

SEQ ID NO: 1343614 - DNA, 22 bp, Artificial Sequence
  chemically synthesized
taaaaaataaataaatgaataa

SEQ ID NO: 1343615 - DNA, 22 bp, Artificial Sequence
  chemically synthesized
aaaaataaataaatgaataaga

SEQ ID NO: 1343616 - DNA, 22 bp, Artificial Sequence
  chemically synthesized
caagtggctgcatttctttctt

SEQ ID NO: 1343617 - DNA, 22 bp, Artificial Sequence
  chemically synthesized
gttccaagtggctgcatttctt

SEQ ID NO: 1343618 - DNA, 22 bp, Artificial Sequence
  chemically synthesized
aaaaacagcattggttccaagt

SEQ ID NO: 1343619 - DNA, 22 bp, Artificial Sequence
  chemically synthesized
aaagatctgaaaaacagcattg

SEQ ID NO: 1343620 - DNA, 22 bp, Artificial Sequence
  chemically synthesized
ggaaccaatgctgtttttcaga

SEQ ID NO: 1343621 - DNA, 22 bp, Artificial Sequence
  chemically synthesized
gaaccaatgctgtttttcagat

SEQ ID NO: 1343622 - DNA, 22 bp, Artificial Sequence
  chemically synthesized
agaggctcaaagatctgaaaaa

SEQ ID NO: 1343623 - DNA, 22 bp, Artificial Sequence
  chemically synthesized
ctgagaggctcaaagatctgaa

SEQ ID NO: 1343624 - DNA, 22 bp, Artificial Sequence
  chemically synthesized
atgttactgagaggctcaaaga

SEQ ID NO: 1343625 - DNA, 22 bp, Artificial Sequence
  chemically synthesized
tttttcagatctttgagcctct

SEQ ID NO: 1343626 - DNA, 22 bp, Artificial Sequence
  chemically synthesized
attaatgttactgagaggctca

SEQ ID NO: 1343627 - DNA, 22 bp, Artificial Sequence
  chemically synthesized
aattaatgttactgagaggctc

SEQ ID NO: 1343628 - DNA, 22 bp, Artificial Sequence
  chemically synthesized
ttcagatctttgagcctctcag

SEQ ID NO: 1343629 - DNA, 22 bp, Artificial Sequence
  chemically synthesized
tcagatctttgagcctctcagt

SEQ ID NO: 1343630 - DNA, 22 bp, Artificial Sequence
  chemically synthesized
ttaattaatgttactgagaggc

SEQ ID NO: 1343631 - DNA, 22 bp, Artificial Sequence
  chemically synthesized
cagatctttgagcctctcagta

SEQ ID NO: 1343632 - DNA, 22 bp, Artificial Sequence
  chemically synthesized
agatctttgagcctctcagtaa

SEQ ID NO: 1343633 - DNA, 22 bp, Artificial Sequence
  chemically synthesized
tgagcctctcagtaacattaat

SEQ ID NO: 1343634 - DNA, 22 bp, Artificial Sequence
  chemically synthesized
ccagggttcttaattaatgtta

SEQ ID NO: 1343635 - DNA, 22 bp, Artificial Sequence
  chemically synthesized
gagcctctcagtaacattaatt

SEQ ID NO: 1343636 - DNA, 22 bp, Artificial Sequence
  chemically synthesized
accagggttcttaattaatgtt

SEQ ID NO: 1343637 - DNA, 22 bp, Artificial Sequence
  chemically synthesized
agcctctcagtaacattaatta

SEQ ID NO: 1343638 - DNA, 22 bp, Artificial Sequence
  chemically synthesized
tttaccagggttcttaattaat

SEQ ID NO: 1343639 - DNA, 22 bp, Artificial Sequence
  chemically synthesized
atttaccagggttcttaattaa

SEQ ID NO: 1343640 - DNA, 22 bp, Artificial Sequence
  chemically synthesized
tcagtaacattaattaagaacc

SEQ ID NO: 1343641 - DNA, 22 bp, Artificial Sequence
  chemically synthesized
agtaacattaattaagaaccct

SEQ ID NO: 1343642 - DNA, 22 bp, Artificial Sequence
  chemically synthesized
gtatatttatttaccagggttc

SEQ ID NO: 1343643 - DNA, 22 bp, Artificial Sequence
  chemically synthesized
gttagtatatttatttaccagg

SEQ ID NO: 1343644 - DNA, 22 bp, Artificial Sequence
  chemically synthesized
attaagaaccctggtaaataaa

SEQ ID NO: 1343645 - DNA, 22 bp, Artificial Sequence
  chemically synthesized
ccactggttagtatatttattt

SEQ ID NO: 1343646 - DNA, 22 bp, Artificial Sequence
  chemically synthesized
agaaccctggtaaataaatata

SEQ ID NO: 1343647 - DNA, 22 bp, Artificial Sequence
  chemically synthesized
gccactggttagtatatttatt

SEQ ID NO: 1343648 - DNA, 22 bp, Artificial Sequence
  chemically synthesized
ttgccactggttagtatattta

SEQ ID NO: 1343649 - DNA, 22 bp, Artificial Sequence
  chemically synthesized
ttcttgccactggttagtatat

SEQ ID NO: 1343650 - DNA, 22 bp, Artificial Sequence
  chemically synthesized
gtaaataaatatactaaccagt

SEQ ID NO: 1343651 - DNA, 22 bp, Artificial Sequence
  chemically synthesized
cagtcaattattcttgccactg

SEQ ID NO: 1343652 - DNA, 22 bp, Artificial Sequence
  chemically synthesized
gcagtcaattattcttgccact

SEQ ID NO: 1343653 - DNA, 22 bp, Artificial Sequence
  chemically synthesized
agccatttgcagtcaattattc

SEQ ID NO: 1343654 - DNA, 22 bp, Artificial Sequence
  chemically synthesized
accagtggcaagaataattgac

SEQ ID NO: 1343655 - DNA, 22 bp, Artificial Sequence
  chemically synthesized
actgcaaatggctgaatgtttt

SEQ ID NO: 1343656 - DNA, 22 bp, Artificial Sequence
  chemically synthesized
caaatggctgaatgttttatta

SEQ ID NO: 1343657 - DNA, 22 bp, Artificial Sequence
  chemically synthesized
aaaaaagtgaaaataataaaac

SEQ ID NO: 1343658 - DNA, 22 bp, Artificial Sequence
  chemically synthesized
aaaaaaagtgaaaataataaaa

SEQ ID NO: 1343659 - DNA, 22 bp, Artificial Sequence
  chemically synthesized
tttaaaaaaagtgaaaataata

SEQ ID NO: 1343660 - DNA, 22 bp, Artificial Sequence
  chemically synthesized
tatttaaaaaaagtgaaaataa

SEQ ID NO: 1343661 - DNA, 22 bp, Artificial Sequence
  chemically synthesized
ctatttaaaaaaagtgaaaata

SEQ ID NO: 1343662 - DNA, 22 bp, Artificial Sequence
  chemically synthesized
aatgttttattattttcacttt

SEQ ID NO: 1343663 - DNA, 22 bp, Artificial Sequence
  chemically synthesized
tattattttcactttttttaaa

SEQ ID NO: 1343664 - DNA, 22 bp, Artificial Sequence
  chemically synthesized
attattttcactttttttaaat

SEQ ID NO: 1343665 - DNA, 22 bp, Artificial Sequence
  chemically synthesized
tcaaaaacttctatttaaaaaa

SEQ ID NO: 1343666 - DNA, 22 bp, Artificial Sequence
  chemically synthesized
ttattttcactttttttaaata

SEQ ID NO: 1343667 - DNA, 22 bp, Artificial Sequence
  chemically synthesized
ttttcactttttttaaatagaa

SEQ ID NO: 1343668 - DNA, 22 bp, Artificial Sequence
  chemically synthesized
tgttgtcaaaaacttctattta

SEQ ID NO: 1343669 - DNA, 22 bp, Artificial Sequence
  chemically synthesized
atgttgtcaaaaacttctattt

SEQ ID NO: 1343670 - DNA, 22 bp, Artificial Sequence
  chemically synthesized
tcactttttttaaatagaagtt

SEQ ID NO: 1343671 - DNA, 22 bp, Artificial Sequence
  chemically synthesized
tatgttgtcaaaaacttctatt

SEQ ID NO: 1343672 - DNA, 22 bp, Artificial Sequence
  chemically synthesized
cactttttttaaatagaagttt

SEQ ID NO: 1343673 - DNA, 22 bp, Artificial Sequence
  chemically synthesized
actttttttaaatagaagtttt

SEQ ID NO: 1343674 - DNA, 22 bp, Artificial Sequence
  chemically synthesized
tttttaaatagaagtttttgac

SEQ ID NO: 1343675 - DNA, 22 bp, Artificial Sequence
  chemically synthesized
ttttaaatagaagtttttgaca

SEQ ID NO: 1343676 - DNA, 22 bp, Artificial Sequence
  chemically synthesized
tttaaatagaagtttttgacaa

SEQ ID NO: 1343677 - DNA, 22 bp, Artificial Sequence
  chemically synthesized
ttaaatagaagtttttgacaac

SEQ ID NO: 1343678 - DNA, 22 bp, Artificial Sequence
  chemically synthesized
taaatagaagtttttgacaaca

SEQ ID NO: 1343679 - DNA, 22 bp, Artificial Sequence
  chemically synthesized
aaatagaagtttttgacaacat

SEQ ID NO: 1343680 - DNA, 22 bp, Artificial Sequence
  chemically synthesized
ggtaaggcctttatgttgtcaa

SEQ ID NO: 1343681 - DNA, 22 bp, Artificial Sequence
  chemically synthesized
aatagaagtttttgacaacata

SEQ ID NO: 1343682 - DNA, 22 bp, Artificial Sequence
  chemically synthesized
gggtaaggcctttatgttgtca

SEQ ID NO: 1343683 - DNA, 22 bp, Artificial Sequence
  chemically synthesized
tgggtaaggcctttatgttgtc

SEQ ID NO: 1343684 - DNA, 22 bp, Artificial Sequence
  chemically synthesized
ctttgggtaaggcctttatgtt

SEQ ID NO: 1343685 - DNA, 22 bp, Artificial Sequence
  chemically synthesized
ttcctttgggtaaggcctttat

SEQ ID NO: 1343686 - DNA, 22 bp, Artificial Sequence
  chemically synthesized
ttattcctttgggtaaggcctt

SEQ ID NO: 1343687 - DNA, 22 bp, Artificial Sequence
  chemically synthesized
ttgacaacataaaggccttacc

SEQ ID NO: 1343688 - DNA, 22 bp, Artificial Sequence
  chemically synthesized
tgacaacataaaggccttaccc

SEQ ID NO: 1343689 - DNA, 22 bp, Artificial Sequence
  chemically synthesized
gacaacataaaggccttaccca

SEQ ID NO: 1343690 - DNA, 22 bp, Artificial Sequence
  chemically synthesized
ttgttattcctttgggtaaggc

SEQ ID NO: 1343691 - DNA, 22 bp, Artificial Sequence
  chemically synthesized
acaacataaaggccttacccaa

SEQ ID NO: 1343692 - DNA, 22 bp, Artificial Sequence
  chemically synthesized
ttattgttattcctttgggtaa

SEQ ID NO: 1343693 - DNA, 22 bp, Artificial Sequence
  chemically synthesized
attattattgttattcctttgg

SEQ ID NO: 1343694 - DNA, 22 bp, Artificial Sequence
  chemically synthesized
cattattattgttattcctttg

SEQ ID NO: 1343695 - DNA, 22 bp, Artificial Sequence
  chemically synthesized
tcattattattgttattccttt

SEQ ID NO: 1343696 - DNA, 22 bp, Artificial Sequence
  chemically synthesized
ttcattattattgttattcctt

SEQ ID NO: 1343697 - DNA, 22 bp, Artificial Sequence
  chemically synthesized
ttttcattattattgttattcc

SEQ ID NO: 1343698 - DNA, 22 bp, Artificial Sequence
  chemically synthesized
ctcttttcattattattgttat

SEQ ID NO: 1343699 - DNA, 22 bp, Artificial Sequence
  chemically synthesized
gctcttttcattattattgtta

SEQ ID NO: 1343700 - DNA, 22 bp, Artificial Sequence
  chemically synthesized
acccaaaggaataacaataata

SEQ ID NO: 1343701 - DNA, 22 bp, Artificial Sequence
  chemically synthesized
cccaaaggaataacaataataa

SEQ ID NO: 1343702 - DNA, 22 bp, Artificial Sequence
  chemically synthesized
tgaacacaatggatgcttgctc

SEQ ID NO: 1343703 - DNA, 22 bp, Artificial Sequence
  chemically synthesized
gtgaacacaatggatgcttgct

SEQ ID NO: 1343704 - DNA, 22 bp, Artificial Sequence
  chemically synthesized
tgtgaacacaatggatgcttgc

SEQ ID NO: 1343705 - DNA, 22 bp, Artificial Sequence
  chemically synthesized
tgattttgtgaacacaatggat

SEQ ID NO: 1343706 - DNA, 22 bp, Artificial Sequence
  chemically synthesized
tgtgattttgtgaacacaatgg

SEQ ID NO: 1343707 - DNA, 22 bp, Artificial Sequence
  chemically synthesized
atgtacatgtattctgtgattt

SEQ ID NO: 1343708 - DNA, 22 bp, Artificial Sequence
  chemically synthesized
gatgtacatgtattctgtgatt

SEQ ID NO: 1343709 - DNA, 22 bp, Artificial Sequence
  chemically synthesized
tgttcacaaaatcacagaatac

SEQ ID NO: 1343710 - DNA, 22 bp, Artificial Sequence
  chemically synthesized
atttgatgtacatgtattctgt

SEQ ID NO: 1343711 - DNA, 22 bp, Artificial Sequence
  chemically synthesized
catttgatgtacatgtattctg

SEQ ID NO: 1343712 - DNA, 22 bp, Artificial Sequence
  chemically synthesized
tcatttgatgtacatgtattct

SEQ ID NO: 1343713 - DNA, 22 bp, Artificial Sequence
  chemically synthesized
ttcatttgatgtacatgtattc

SEQ ID NO: 1343714 - DNA, 22 bp, Artificial Sequence
  chemically synthesized
acaaaatcacagaatacatgta

SEQ ID NO: 1343715 - DNA, 22 bp, Artificial Sequence
  chemically synthesized
tttttcatttgatgtacatgta

SEQ ID NO: 1343716 - DNA, 22 bp, Artificial Sequence
  chemically synthesized
agagatgaaaaaggattatttt

SEQ ID NO: 1343717 - DNA, 22 bp, Artificial Sequence
  chemically synthesized
tcagagatgaaaaaggattatt

SEQ ID NO: 1343718 - DNA, 22 bp, Artificial Sequence
  chemically synthesized
gagtattctcagagatgaaaaa

SEQ ID NO: 1343719 - DNA, 22 bp, Artificial Sequence
  chemically synthesized
ggagtattctcagagatgaaaa

SEQ ID NO: 1343720 - DNA, 22 bp, Artificial Sequence
  chemically synthesized
tggagtattctcagagatgaaa

SEQ ID NO: 1343721 - DNA, 22 bp, Artificial Sequence
  chemically synthesized
tttcatctctgagaatactcca

SEQ ID NO: 1343722 - DNA, 22 bp, Artificial Sequence
  chemically synthesized
ttcatctctgagaatactccaa

SEQ ID NO: 1343723 - DNA, 22 bp, Artificial Sequence
  chemically synthesized
tcatctctgagaatactccaaa

SEQ ID NO: 1343724 - DNA, 22 bp, Artificial Sequence
  chemically synthesized
agatggacaagttttggagtat

SEQ ID NO: 1343725 - DNA, 22 bp, Artificial Sequence
  chemically synthesized
catctctgagaatactccaaaa

SEQ ID NO: 1343726 - DNA, 22 bp, Artificial Sequence
  chemically synthesized
atctctgagaatactccaaaac

SEQ ID NO: 1343727 - DNA, 22 bp, Artificial Sequence
  chemically synthesized
atactcagatggacaagttttg

SEQ ID NO: 1343728 - DNA, 22 bp, Artificial Sequence
  chemically synthesized
tgagaatactccaaaacttgtc

SEQ ID NO: 1343729 - DNA, 22 bp, Artificial Sequence
  chemically synthesized
agaatactccaaaacttgtcca

SEQ ID NO: 1343730 - DNA, 22 bp, Artificial Sequence
  chemically synthesized
cattgatactcagatggacaag

SEQ ID NO: 1343731 - DNA, 22 bp, Artificial Sequence
  chemically synthesized
ccattgatactcagatggacaa

SEQ ID NO: 1343732 - DNA, 22 bp, Artificial Sequence
  chemically synthesized
tccattgatactcagatggaca

SEQ ID NO: 1343733 - DNA, 22 bp, Artificial Sequence
  chemically synthesized
caaaacttgtccatctgagtat

SEQ ID NO: 1343734 - DNA, 22 bp, Artificial Sequence
  chemically synthesized
gtccatctgagtatcaatggaa

SEQ ID NO: 1343735 - DNA, 22 bp, Artificial Sequence
  chemically synthesized
tccatctgagtatcaatggaaa

SEQ ID NO: 1343736 - DNA, 22 bp, Artificial Sequence
  chemically synthesized
ataaagagcaagattttccatt

SEQ ID NO: 1343737 - DNA, 22 bp, Artificial Sequence
  chemically synthesized
aataaagagcaagattttccat

SEQ ID NO: 1343738 - DNA, 22 bp, Artificial Sequence
  chemically synthesized
taataaagagcaagattttcca

SEQ ID NO: 1343739 - DNA, 22 bp, Artificial Sequence
  chemically synthesized
ttaataaagagcaagattttcc

SEQ ID NO: 1343740 - DNA, 22 bp, Artificial Sequence
  chemically synthesized
agtatcaatggaaaatcttgct

SEQ ID NO: 1343741 - DNA, 22 bp, Artificial Sequence
  chemically synthesized
cttttaataaagagcaagattt

SEQ ID NO: 1343742 - DNA, 22 bp, Artificial Sequence
  chemically synthesized
gtgaagaattccttttaataaa

SEQ ID NO: 1343743 - DNA, 22 bp, Artificial Sequence
  chemically synthesized
aacattagtgaagaattccttt

SEQ ID NO: 1343744 - DNA, 22 bp, Artificial Sequence
  chemically synthesized
gctctttattaaaaggaattct

SEQ ID NO: 1343745 - DNA, 22 bp, Artificial Sequence
  chemically synthesized
ctctttattaaaaggaattctt

SEQ ID NO: 1343746 - DNA, 22 bp, Artificial Sequence
  chemically synthesized
tgaacattagtgaagaattcct

SEQ ID NO: 1343747 - DNA, 22 bp, Artificial Sequence
  chemically synthesized
ctgaacattagtgaagaattcc

SEQ ID NO: 1343748 - DNA, 22 bp, Artificial Sequence
  chemically synthesized
tctgaacattagtgaagaattc

SEQ ID NO: 1343749 - DNA, 22 bp, Artificial Sequence
  chemically synthesized
tttattaaaaggaattcttcac

SEQ ID NO: 1343750 - DNA, 22 bp, Artificial Sequence
  chemically synthesized
ttctgaacattagtgaagaatt

SEQ ID NO: 1343751 - DNA, 22 bp, Artificial Sequence
  chemically synthesized
tattaaaaggaattcttcacta

SEQ ID NO: 1343752 - DNA, 22 bp, Artificial Sequence
  chemically synthesized
attaaaaggaattcttcactaa

SEQ ID NO: 1343753 - DNA, 22 bp, Artificial Sequence
  chemically synthesized
ttaaaaggaattcttcactaat

SEQ ID NO: 1343754 - DNA, 22 bp, Artificial Sequence
  chemically synthesized
agcttttctgaacattagtgaa

SEQ ID NO: 1343755 - DNA, 22 bp, Artificial Sequence
  chemically synthesized
aaaggaattcttcactaatgtt

SEQ ID NO: 1343756 - DNA, 22 bp, Artificial Sequence
  chemically synthesized
ctcagcttttctgaacattagt

SEQ ID NO: 1343757 - DNA, 22 bp, Artificial Sequence
  chemically synthesized
ttcactaatgttcagaaaagct

SEQ ID NO: 1343758 - DNA, 22 bp, Artificial Sequence
  chemically synthesized
cactaatgttcagaaaagctga

SEQ ID NO: 1343759 - DNA, 22 bp, Artificial Sequence
  chemically synthesized
actaatgttcagaaaagctgag

SEQ ID NO: 1343760 - DNA, 22 bp, Artificial Sequence
  chemically synthesized
atgttcagaaaagctgaggaat

SEQ ID NO: 1343761 - DNA, 22 bp, Artificial Sequence
  chemically synthesized
agaaaagctgaggaatgtactt

SEQ ID NO: 1343762 - DNA, 22 bp, Artificial Sequence
  chemically synthesized
gtagtgacggtagtgatgtaag

SEQ ID NO: 1343763 - DNA, 22 bp, Artificial Sequence
  chemically synthesized
tagtagtgacggtagtgatgta

SEQ ID NO: 1343764 - DNA, 22 bp, Artificial Sequence
  chemically synthesized
aggaatgtacttacatcactac

SEQ ID NO: 1343765 - DNA, 22 bp, Artificial Sequence
  chemically synthesized
acatcactaccgtcactactag

SEQ ID NO: 1343766 - DNA, 22 bp, Artificial Sequence
  chemically synthesized
catcactaccgtcactactaga

SEQ ID NO: 1343767 - DNA, 22 bp, Artificial Sequence
  chemically synthesized
gccaccagtgcatactctagta

SEQ ID NO: 1343768 - DNA, 22 bp, Artificial Sequence
  chemically synthesized
agccaccagtgcatactctagt

SEQ ID NO: 1343769 - DNA, 22 bp, Artificial Sequence
  chemically synthesized
tagccaccagtgcatactctag

SEQ ID NO: 1343770 - DNA, 22 bp, Artificial Sequence
  chemically synthesized
ccgtcactactagagtatgcac

SEQ ID NO: 1343771 - DNA, 22 bp, Artificial Sequence
  chemically synthesized
ggacattttagccaccagtgca

SEQ ID NO: 1343772 - DNA, 22 bp, Artificial Sequence
  chemically synthesized
ttaggacattttagccaccagt

SEQ ID NO: 1343773 - DNA, 22 bp, Artificial Sequence
  chemically synthesized
ctagagtatgcactggtggcta

SEQ ID NO: 1343774 - DNA, 22 bp, Artificial Sequence
  chemically synthesized
gagtatgcactggtggctaaaa

SEQ ID NO: 1343775 - DNA, 22 bp, Artificial Sequence
  chemically synthesized
aagaagttgttaggacatttta

SEQ ID NO: 1343776 - DNA, 22 bp, Artificial Sequence
  chemically synthesized
gtggctaaaatgtcctaacaac

SEQ ID NO: 1343777 - DNA, 22 bp, Artificial Sequence
  chemically synthesized
agccctgaagaagttgttagga

SEQ ID NO: 1343778 - DNA, 22 bp, Artificial Sequence
  chemically synthesized
gagccctgaagaagttgttagg

SEQ ID NO: 1343779 - DNA, 22 bp, Artificial Sequence
  chemically synthesized
aaatgtcctaacaacttcttca

SEQ ID NO: 1343780 - DNA, 22 bp, Artificial Sequence
  chemically synthesized
aaatatttgagccctgaagaag

SEQ ID NO: 1343781 - DNA, 22 bp, Artificial Sequence
  chemically synthesized
acaacttcttcagggctcaaat

SEQ ID NO: 1343782 - DNA, 22 bp, Artificial Sequence
  chemically synthesized
aaagccctaaaatatttgagcc

SEQ ID NO: 1343783 - DNA, 22 bp, Artificial Sequence
  chemically synthesized
aattcaaagccctaaaatattt

SEQ ID NO: 1343784 - DNA, 22 bp, Artificial Sequence
  chemically synthesized
cttcagggctcaaatattttag

SEQ ID NO: 1343785 - DNA, 22 bp, Artificial Sequence
  chemically synthesized
gaattcaaagccctaaaatatt

SEQ ID NO: 1343786 - DNA, 22 bp, Artificial Sequence
  chemically synthesized
ttcagggctcaaatattttagg

SEQ ID NO: 1343787 - DNA, 22 bp, Artificial Sequence
  chemically synthesized
tgaattcaaagccctaaaatat

SEQ ID NO: 1343788 - DNA, 22 bp, Artificial Sequence
  chemically synthesized
cagggctcaaatattttagggc

SEQ ID NO: 1343789 - DNA, 22 bp, Artificial Sequence
  chemically synthesized
agggctcaaatattttagggct

SEQ ID NO: 1343790 - DNA, 22 bp, Artificial Sequence
  chemically synthesized
cacatctttgaattcaaagccc

SEQ ID NO: 1343791 - DNA, 22 bp, Artificial Sequence
  chemically synthesized
acacatctttgaattcaaagcc

SEQ ID NO: 1343792 - DNA, 22 bp, Artificial Sequence
  chemically synthesized
aaatattttagggctttgaatt

SEQ ID NO: 1343793 - DNA, 22 bp, Artificial Sequence
  chemically synthesized
tacacatctttgaattcaaagc

SEQ ID NO: 1343794 - DNA, 22 bp, Artificial Sequence
  chemically synthesized
ttttacacatctttgaattcaa

SEQ ID NO: 1343795 - DNA, 22 bp, Artificial Sequence
  chemically synthesized
tattttacacatctttgaattc

SEQ ID NO: 1343796 - DNA, 22 bp, Artificial Sequence
  chemically synthesized
tagggctttgaattcaaagatg

SEQ ID NO: 1343797 - DNA, 22 bp, Artificial Sequence
  chemically synthesized
agggctttgaattcaaagatgt

SEQ ID NO: 1343798 - DNA, 22 bp, Artificial Sequence
  chemically synthesized
gggctttgaattcaaagatgtg

SEQ ID NO: 1343799 - DNA, 22 bp, Artificial Sequence
  chemically synthesized
tgaattcaaagatgtgtaaaat

SEQ ID NO: 1343800 - DNA, 22 bp, Artificial Sequence
  chemically synthesized
gaattcaaagatgtgtaaaata

SEQ ID NO: 1343801 - DNA, 22 bp, Artificial Sequence
  chemically synthesized
aattcaaagatgtgtaaaatag

SEQ ID NO: 1343802 - DNA, 22 bp, Artificial Sequence
  chemically synthesized
aagacagagactctattttaca

SEQ ID NO: 1343803 - DNA, 22 bp, Artificial Sequence
  chemically synthesized
gaagacagagactctattttac

SEQ ID NO: 1343804 - DNA, 22 bp, Artificial Sequence
  chemically synthesized
aaagatgtgtaaaatagagtct

SEQ ID NO: 1343805 - DNA, 22 bp, Artificial Sequence
  chemically synthesized
taaagtccttgaagacagagac

SEQ ID NO: 1343806 - DNA, 22 bp, Artificial Sequence
  chemically synthesized
tgtcttcaaggactttataact

SEQ ID NO: 1343807 - DNA, 22 bp, Artificial Sequence
  chemically synthesized
tcttcaaggactttataacttc

SEQ ID NO: 1343808 - DNA, 22 bp, Artificial Sequence
  chemically synthesized
caaggactttataacttctatg

SEQ ID NO: 1343809 - DNA, 22 bp, Artificial Sequence
  chemically synthesized
aaggactttataacttctatgc

SEQ ID NO: 1343810 - DNA, 22 bp, Artificial Sequence
  chemically synthesized
gcacataccatatgcatagaag

SEQ ID NO: 1343811 - DNA, 22 bp, Artificial Sequence
  chemically synthesized
tataacttctatgcatatggta

SEQ ID NO: 1343812 - DNA, 22 bp, Artificial Sequence
  chemically synthesized
ataacttctatgcatatggtat

SEQ ID NO: 1343813 - DNA, 22 bp, Artificial Sequence
  chemically synthesized
taacttctatgcatatggtatg

SEQ ID NO: 1343814 - DNA, 22 bp, Artificial Sequence
  chemically synthesized
catcatccacgctagcacatac

SEQ ID NO: 1343815 - DNA, 22 bp, Artificial Sequence
  chemically synthesized
ctatgcatatggtatgtgctag

SEQ ID NO: 1343816 - DNA, 22 bp, Artificial Sequence
  chemically synthesized
ccatcatccacgctagcacata

SEQ ID NO: 1343817 - DNA, 22 bp, Artificial Sequence
  chemically synthesized
tatgcatatggtatgtgctagc

SEQ ID NO: 1343818 - DNA, 22 bp, Artificial Sequence
  chemically synthesized
ttccatcatccacgctagcaca

SEQ ID NO: 1343819 - DNA, 22 bp, Artificial Sequence
  chemically synthesized
tgcatatggtatgtgctagcgt

SEQ ID NO: 1343820 - DNA, 22 bp, Artificial Sequence
  chemically synthesized
aatgtaactcttccatcatcca

SEQ ID NO: 1343821 - DNA, 22 bp, Artificial Sequence
  chemically synthesized
gcgtggatgatggaagagttac

SEQ ID NO: 1343822 - DNA, 22 bp, Artificial Sequence
  chemically synthesized
ccatggtgaaggttaaatgtaa

SEQ ID NO: 1343823 - DNA, 22 bp, Artificial Sequence
  chemically synthesized
ctgccatggtgaaggttaaatg

SEQ ID NO: 1343824 - DNA, 22 bp, Artificial Sequence
  chemically synthesized
cctgccatggtgaaggttaaat

SEQ ID NO: 1343825 - DNA, 22 bp, Artificial Sequence
  chemically synthesized
catttaaccttcaccatggcag

SEQ ID NO: 1343826 - DNA, 22 bp, Artificial Sequence
  chemically synthesized
ccccaataaatcttcctgccat

SEQ ID NO: 1343827 - DNA, 22 bp, Artificial Sequence
  chemically synthesized
aaccttcaccatggcaggaaga

SEQ ID NO: 1343828 - DNA, 22 bp, Artificial Sequence
  chemically synthesized
accttcaccatggcaggaagat

SEQ ID NO: 1343829 - DNA, 22 bp, Artificial Sequence
  chemically synthesized
tctcccccaataaatcttcctg

SEQ ID NO: 1343830 - DNA, 22 bp, Artificial Sequence
  chemically synthesized
atctcccccaataaatcttcct

SEQ ID NO: 1343831 - DNA, 22 bp, Artificial Sequence
  chemically synthesized
tatctcccccaataaatcttcc

SEQ ID NO: 1343832 - DNA, 22 bp, Artificial Sequence
  chemically synthesized
caccatggcaggaagatttatt

SEQ ID NO: 1343833 - DNA, 22 bp, Artificial Sequence
  chemically synthesized
accatggcaggaagatttattg

SEQ ID NO: 1343834 - DNA, 22 bp, Artificial Sequence
  chemically synthesized
aaagttttatctcccccaataa

SEQ ID NO: 1343835 - DNA, 22 bp, Artificial Sequence
  chemically synthesized
caaagttttatctcccccaata

SEQ ID NO: 1343836 - DNA, 22 bp, Artificial Sequence
  chemically synthesized
tcttcaaagttttatctccccc

SEQ ID NO: 1343837 - DNA, 22 bp, Artificial Sequence
  chemically synthesized
atcttcaaagttttatctcccc

SEQ ID NO: 1343838 - DNA, 22 bp, Artificial Sequence
  chemically synthesized
cttatcttcaaagttttatctc

SEQ ID NO: 1343839 - DNA, 22 bp, Artificial Sequence
  chemically synthesized
gcttatcttcaaagttttatct

SEQ ID NO: 1343840 - DNA, 22 bp, Artificial Sequence
  chemically synthesized
ttgcttatcttcaaagttttat

SEQ ID NO: 1343841 - DNA, 22 bp, Artificial Sequence
  chemically synthesized
attgggggagataaaactttga

SEQ ID NO: 1343842 - DNA, 22 bp, Artificial Sequence
  chemically synthesized
tcttgcttatcttcaaagtttt

SEQ ID NO: 1343843 - DNA, 22 bp, Artificial Sequence
  chemically synthesized
ttgggggagataaaactttgaa

SEQ ID NO: 1343844 - DNA, 22 bp, Artificial Sequence
  chemically synthesized
ggggagataaaactttgaagat

SEQ ID NO: 1343845 - DNA, 22 bp, Artificial Sequence
  chemically synthesized
gctctcttgcttatcttcaaag

SEQ ID NO: 1343846 - DNA, 22 bp, Artificial Sequence
  chemically synthesized
atctggctctcttgcttatctt

SEQ ID NO: 1343847 - DNA, 22 bp, Artificial Sequence
  chemically synthesized
aatctggctctcttgcttatct

SEQ ID NO: 1343848 - DNA, 22 bp, Artificial Sequence
  chemically synthesized
taatctggctctcttgcttatc

SEQ ID NO: 1343849 - DNA, 22 bp, Artificial Sequence
  chemically synthesized
ttaatctggctctcttgcttat

SEQ ID NO: 1343850 - DNA, 22 bp, Artificial Sequence
  chemically synthesized
tttttaatctggctctcttgct

SEQ ID NO: 1343851 - DNA, 22 bp, Artificial Sequence
  chemically synthesized
atttttaatctggctctcttgc

SEQ ID NO: 1343852 - DNA, 22 bp, Artificial Sequence
  chemically synthesized
tatttttaatctggctctcttg

SEQ ID NO: 1343853 - DNA, 22 bp, Artificial Sequence
  chemically synthesized
tgaagataagcaagagagccag

SEQ ID NO: 1343854 - DNA, 22 bp, Artificial Sequence
  chemically synthesized
gaagataagcaagagagccaga

SEQ ID NO: 1343855 - DNA, 22 bp, Artificial Sequence
  chemically synthesized
ttttatttttaatctggctctc

SEQ ID NO: 1343856 - DNA, 22 bp, Artificial Sequence
  chemically synthesized
aagataagcaagagagccagat

SEQ ID NO: 1343857 - DNA, 22 bp, Artificial Sequence
  chemically synthesized
gttttatttttaatctggctct

SEQ ID NO: 1343858 - DNA, 22 bp, Artificial Sequence
  chemically synthesized
tgttttatttttaatctggctc

SEQ ID NO: 1343859 - DNA, 22 bp, Artificial Sequence
  chemically synthesized
ctttgttttatttttaatctgg

SEQ ID NO: 1343860 - DNA, 22 bp, Artificial Sequence
  chemically synthesized
tactttgttttatttttaatct

SEQ ID NO: 1343861 - DNA, 22 bp, Artificial Sequence
  chemically synthesized
ctactttgttttatttttaatc

SEQ ID NO: 1343862 - DNA, 22 bp, Artificial Sequence
  chemically synthesized
cttctactttgttttattttta

SEQ ID NO: 1343863 - DNA, 22 bp, Artificial Sequence
  chemically synthesized
ctccttctactttgttttattt

SEQ ID NO: 1343864 - DNA, 22 bp, Artificial Sequence
  chemically synthesized
cctccttctactttgttttatt

SEQ ID NO: 1343865 - DNA, 22 bp, Artificial Sequence
  chemically synthesized
tcctccttctactttgttttat

SEQ ID NO: 1343866 - DNA, 22 bp, Artificial Sequence
  chemically synthesized
tttcctccttctactttgtttt

SEQ ID NO: 1343867 - DNA, 22 bp, Artificial Sequence
  chemically synthesized
aaaataaaacaaagtagaagga

SEQ ID NO: 1343868 - DNA, 22 bp, Artificial Sequence
  chemically synthesized
aaacacccattctttcctcctt

SEQ ID NO: 1343869 - DNA, 22 bp, Artificial Sequence
  chemically synthesized
gaaacacccattctttcctcct

SEQ ID NO: 1343870 - DNA, 22 bp, Artificial Sequence
  chemically synthesized
ttgaaacacccattctttcctc

SEQ ID NO: 1343871 - DNA, 22 bp, Artificial Sequence
  chemically synthesized
cttgaaacacccattctttcct

SEQ ID NO: 1343872 - DNA, 22 bp, Artificial Sequence
  chemically synthesized
tcttgaaacacccattctttcc

SEQ ID NO: 1343873 - DNA, 22 bp, Artificial Sequence
  chemically synthesized
ttcttgaaacacccattctttc

SEQ ID NO: 1343874 - DNA, 22 bp, Artificial Sequence
  chemically synthesized
tttttcttgaaacacccattct

SEQ ID NO: 1343875 - DNA, 22 bp, Artificial Sequence
  chemically synthesized
gtttttcttgaaacacccattc

SEQ ID NO: 1343876 - DNA, 22 bp, Artificial Sequence
  chemically synthesized
tatttgtttttcttgaaacacc

SEQ ID NO: 1343877 - DNA, 22 bp, Artificial Sequence
  chemically synthesized
caagaaaaacaaatataatgtg

SEQ ID NO: 1343878 - DNA, 22 bp, Artificial Sequence
  chemically synthesized
aagaaaaacaaatataatgtgc

SEQ ID NO: 1343879 - DNA, 22 bp, Artificial Sequence
  chemically synthesized
cccatcagcaagagcacattat

SEQ ID NO: 1343880 - DNA, 22 bp, Artificial Sequence
  chemically synthesized
ttgctgatgggtaattctttgt

SEQ ID NO: 1343881 - DNA, 22 bp, Artificial Sequence
  chemically synthesized
gctgatgggtaattctttgtgt

SEQ ID NO: 1343882 - DNA, 22 bp, Artificial Sequence
  chemically synthesized
ctgatgggtaattctttgtgta

SEQ ID NO: 1343883 - DNA, 22 bp, Artificial Sequence
  chemically synthesized
atgggtaattctttgtgtattt

SEQ ID NO: 1343884 - DNA, 22 bp, Artificial Sequence
  chemically synthesized
aataggagtatgaaaatacaca

SEQ ID NO: 1343885 - DNA, 22 bp, Artificial Sequence
  chemically synthesized
tttgtgtattttcatactccta

SEQ ID NO: 1343886 - DNA, 22 bp, Artificial Sequence
  chemically synthesized
tgtgtattttcatactcctatt

SEQ ID NO: 1343887 - DNA, 22 bp, Artificial Sequence
  chemically synthesized
gtgtattttcatactcctattt

SEQ ID NO: 1343888 - DNA, 22 bp, Artificial Sequence
  chemically synthesized
tgtattttcatactcctattta

SEQ ID NO: 1343889 - DNA, 22 bp, Artificial Sequence
  chemically synthesized
tcatactcctatttagtgtgta

SEQ ID NO: 1343890 - DNA, 22 bp, Artificial Sequence
  chemically synthesized
catactcctatttagtgtgtac

SEQ ID NO: 1343891 - DNA, 22 bp, Artificial Sequence
  chemically synthesized
tgagaaaaataggtacacacta

SEQ ID NO: 1343892 - DNA, 22 bp, Artificial Sequence
  chemically synthesized
atactcctatttagtgtgtacc

SEQ ID NO: 1343893 - DNA, 22 bp, Artificial Sequence
  chemically synthesized
ctatttagtgtgtacctatttt

SEQ ID NO: 1343894 - DNA, 22 bp, Artificial Sequence
  chemically synthesized
gatatactgtgagaaaaatagg

SEQ ID NO: 1343895 - DNA, 22 bp, Artificial Sequence
  chemically synthesized
tttagtgtgtacctatttttct

SEQ ID NO: 1343896 - DNA, 22 bp, Artificial Sequence
  chemically synthesized
cgatatactgtgagaaaaatag

SEQ ID NO: 1343897 - DNA, 22 bp, Artificial Sequence
  chemically synthesized
agtgtgtacctatttttctcac

SEQ ID NO: 1343898 - DNA, 22 bp, Artificial Sequence
  chemically synthesized
gtgtgtacctatttttctcaca

SEQ ID NO: 1343899 - DNA, 22 bp, Artificial Sequence
  chemically synthesized
tttttctcacagtatatcgaaa

SEQ ID NO: 1343900 - DNA, 22 bp, Artificial Sequence
  chemically synthesized
ttctcacagtatatcgaaatac

SEQ ID NO: 1343901 - DNA, 22 bp, Artificial Sequence
  chemically synthesized
tctcacagtatatcgaaatacg

SEQ ID NO: 1343902 - DNA, 22 bp, Artificial Sequence
  chemically synthesized
ctcacagtatatcgaaatacgc

SEQ ID NO: 1343903 - DNA, 22 bp, Artificial Sequence
  chemically synthesized
tcacagtatatcgaaatacgct

SEQ ID NO: 1343904 - DNA, 22 bp, Artificial Sequence
  chemically synthesized
acagtatatcgaaatacgctat

SEQ ID NO: 1343905 - DNA, 22 bp, Artificial Sequence
  chemically synthesized
cccgaggaagtcagataatagc

SEQ ID NO: 1343906 - DNA, 22 bp, Artificial Sequence
  chemically synthesized
acccgaggaagtcagataatag

SEQ ID NO: 1343907 - DNA, 22 bp, Artificial Sequence
  chemically synthesized
tagacttacccgaggaagtcag

SEQ ID NO: 1343908 - DNA, 22 bp, Artificial Sequence
  chemically synthesized
gtagacttacccgaggaagtca

SEQ ID NO: 1343909 - DNA, 22 bp, Artificial Sequence
  chemically synthesized
gtcttgtagacttacccgagga

SEQ ID NO: 1343910 - DNA, 22 bp, Artificial Sequence
  chemically synthesized
ggtcttgtagacttacccgagg

SEQ ID NO: 1343911 - DNA, 22 bp, Artificial Sequence
  chemically synthesized
ttatctgacttcctcgggtaag

SEQ ID NO: 1343912 - DNA, 22 bp, Artificial Sequence
  chemically synthesized
tctgacttcctcgggtaagtct

SEQ ID NO: 1343913 - DNA, 22 bp, Artificial Sequence
  chemically synthesized
tatatttggtcttgtagactta

SEQ ID NO: 1343914 - DNA, 22 bp, Artificial Sequence
  chemically synthesized
acttcctcgggtaagtctacaa

SEQ ID NO: 1343915 - DNA, 22 bp, Artificial Sequence
  chemically synthesized
ttgtatatttggtcttgtagac

SEQ ID NO: 1343916 - DNA, 22 bp, Artificial Sequence
  chemically synthesized
cctcgggtaagtctacaagacc

SEQ ID NO: 1343917 - DNA, 22 bp, Artificial Sequence
  chemically synthesized
ctcgggtaagtctacaagacca

SEQ ID NO: 1343918 - DNA, 22 bp, Artificial Sequence
  chemically synthesized
ttattgtatatttggtcttgta

SEQ ID NO: 1343919 - DNA, 22 bp, Artificial Sequence
  chemically synthesized
gttattgtatatttggtcttgt

SEQ ID NO: 1343920 - DNA, 22 bp, Artificial Sequence
  chemically synthesized
gggtaagtctacaagaccaaat

SEQ ID NO: 1343921 - DNA, 22 bp, Artificial Sequence
  chemically synthesized
aatagatttgttattgtatatt

SEQ ID NO: 1343922 - DNA, 22 bp, Artificial Sequence
  chemically synthesized
tcaatagatttgttattgtata

SEQ ID NO: 1343923 - DNA, 22 bp, Artificial Sequence
  chemically synthesized
ctcaatagatttgttattgtat

SEQ ID NO: 1343924 - DNA, 22 bp, Artificial Sequence
  chemically synthesized
caagaccaaatatacaataaca

SEQ ID NO: 1343925 - DNA, 22 bp, Artificial Sequence
  chemically synthesized
tatcttctcaatagatttgtta

SEQ ID NO: 1343926 - DNA, 22 bp, Artificial Sequence
  chemically synthesized
tgcatgtaaataactgtatctt

SEQ ID NO: 1343927 - DNA, 22 bp, Artificial Sequence
  chemically synthesized
tgtgcatgtaaataactgtatc

SEQ ID NO: 1343928 - DNA, 22 bp, Artificial Sequence
  chemically synthesized
ctgtgcatgtaaataactgtat

SEQ ID NO: 1343929 - DNA, 22 bp, Artificial Sequence
  chemically synthesized
ttgagaagatacagttatttac

SEQ ID NO: 1343930 - DNA, 22 bp, Artificial Sequence
  chemically synthesized
agaagatacagttatttacatg

SEQ ID NO: 1343931 - DNA, 22 bp, Artificial Sequence
  chemically synthesized
acaataaccttctgtgcatgta

SEQ ID NO: 1343932 - DNA, 22 bp, Artificial Sequence
  chemically synthesized
tcacaataaccttctgtgcatg

SEQ ID NO: 1343933 - DNA, 22 bp, Artificial Sequence
  chemically synthesized
ctcacaataaccttctgtgcat

SEQ ID NO: 1343934 - DNA, 22 bp, Artificial Sequence
  chemically synthesized
tttacatgcacagaaggttatt

SEQ ID NO: 1343935 - DNA, 22 bp, Artificial Sequence
  chemically synthesized
atagagtttctcacaataacct

SEQ ID NO: 1343936 - DNA, 22 bp, Artificial Sequence
  chemically synthesized
acatgcacagaaggttattgtg

SEQ ID NO: 1343937 - DNA, 22 bp, Artificial Sequence
  chemically synthesized
gatagagtttctcacaataacc

SEQ ID NO: 1343938 - DNA, 22 bp, Artificial Sequence
  chemically synthesized
catgcacagaaggttattgtga

SEQ ID NO: 1343939 - DNA, 22 bp, Artificial Sequence
  chemically synthesized
ttgtgagaaactctatcaaatg

SEQ ID NO: 1343940 - DNA, 22 bp, Artificial Sequence
  chemically synthesized
tgagaaactctatcaaatgccc

SEQ ID NO: 1343941 - DNA, 22 bp, Artificial Sequence
  chemically synthesized
tatcaaatgcccttgctgatat

SEQ ID NO: 1343942 - DNA, 22 bp, Artificial Sequence
  chemically synthesized
tgggtcaggccaatatcagcaa

SEQ ID NO: 1343943 - DNA, 22 bp, Artificial Sequence
  chemically synthesized
tcaaatgcccttgctgatattg

SEQ ID NO: 1343944 - DNA, 22 bp, Artificial Sequence
  chemically synthesized
aattgtgggtcaggccaatatc

SEQ ID NO: 1343945 - DNA, 22 bp, Artificial Sequence
  chemically synthesized
gaattgtgggtcaggccaatat

SEQ ID NO: 1343946 - DNA, 22 bp, Artificial Sequence
  chemically synthesized
gctgatattggcctgacccaca

SEQ ID NO: 1343947 - DNA, 22 bp, Artificial Sequence
  chemically synthesized
ctgatattggcctgacccacaa

SEQ ID NO: 1343948 - DNA, 22 bp, Artificial Sequence
  chemically synthesized
atattggcctgacccacaattc

SEQ ID NO: 1343949 - DNA, 22 bp, Artificial Sequence
  chemically synthesized
aaggtacccaaacgtttgaatt

SEQ ID NO: 1343950 - DNA, 22 bp, Artificial Sequence
  chemically synthesized
gcctgacccacaattcaaacgt

SEQ ID NO: 1343951 - DNA, 22 bp, Artificial Sequence
  chemically synthesized
gaaggtacccaaacgtttgaat

SEQ ID NO: 1343952 - DNA, 22 bp, Artificial Sequence
  chemically synthesized
ttgaaggtacccaaacgtttga

SEQ ID NO: 1343953 - DNA, 22 bp, Artificial Sequence
  chemically synthesized
cttgaaggtacccaaacgtttg

SEQ ID NO: 1343954 - DNA, 22 bp, Artificial Sequence
  chemically synthesized
tcttgaaggtacccaaacgttt

SEQ ID NO: 1343955 - DNA, 22 bp, Artificial Sequence
  chemically synthesized
acccacaattcaaacgtttggg

SEQ ID NO: 1343956 - DNA, 22 bp, Artificial Sequence
  chemically synthesized
aaacgtttgggtaccttcaaga

SEQ ID NO: 1343957 - DNA, 22 bp, Artificial Sequence
  chemically synthesized
aaaaatacagacattttcttga

SEQ ID NO: 1343958 - DNA, 22 bp, Artificial Sequence
  chemically synthesized
gggtaccttcaagaaaatgtct

SEQ ID NO: 1343959 - DNA, 22 bp, Artificial Sequence
  chemically synthesized
ggtaccttcaagaaaatgtctg

SEQ ID NO: 1343960 - DNA, 22 bp, Artificial Sequence
  chemically synthesized
aaaggacattaaaaaatacaga

SEQ ID NO: 1343961 - DNA, 22 bp, Artificial Sequence
  chemically synthesized
caaaggacattaaaaaatacag

SEQ ID NO: 1343962 - DNA, 22 bp, Artificial Sequence
  chemically synthesized
caagaaaatgtctgtatttttt

SEQ ID NO: 1343963 - DNA, 22 bp, Artificial Sequence
  chemically synthesized
aagaaaatgtctgtatttttta

SEQ ID NO: 1343964 - DNA, 22 bp, Artificial Sequence
  chemically synthesized
gagtaataatttcaaaggacat

SEQ ID NO: 1343965 - DNA, 22 bp, Artificial Sequence
  chemically synthesized
tattttttaatgtcctttgaaa

SEQ ID NO: 1343966 - DNA, 22 bp, Artificial Sequence
  chemically synthesized
tttaatgtcctttgaaattatt

SEQ ID NO: 1343967 - DNA, 22 bp, Artificial Sequence
  chemically synthesized
ttaatgtcctttgaaattatta

SEQ ID NO: 1343968 - DNA, 22 bp, Artificial Sequence
  chemically synthesized
taatgtcctttgaaattattac

SEQ ID NO: 1343969 - DNA, 22 bp, Artificial Sequence
  chemically synthesized
aatgtcctttgaaattattact

SEQ ID NO: 1343970 - DNA, 22 bp, Artificial Sequence
  chemically synthesized
atgtcctttgaaattattactc

SEQ ID NO: 1343971 - DNA, 22 bp, Artificial Sequence
  chemically synthesized
tcgtataatgcatgactagagt

SEQ ID NO: 1343972 - DNA, 22 bp, Artificial Sequence
  chemically synthesized
atcgtataatgcatgactagag

SEQ ID NO: 1343973 - DNA, 22 bp, Artificial Sequence
  chemically synthesized
tgaaattattactctagtcatg

SEQ ID NO: 1343974 - DNA, 22 bp, Artificial Sequence
  chemically synthesized
tatcgtataatgcatgactaga

SEQ ID NO: 1343975 - DNA, 22 bp, Artificial Sequence
  chemically synthesized
gaaattattactctagtcatgc

SEQ ID NO: 1343976 - DNA, 22 bp, Artificial Sequence
  chemically synthesized
ttatcgtataatgcatgactag

SEQ ID NO: 1343977 - DNA, 22 bp, Artificial Sequence
  chemically synthesized
aaattattactctagtcatgca

SEQ ID NO: 1343978 - DNA, 22 bp, Artificial Sequence
  chemically synthesized
ttactctagtcatgcattatac

SEQ ID NO: 1343979 - DNA, 22 bp, Artificial Sequence
  chemically synthesized
gtgtatcttttatcgtataatg

SEQ ID NO: 1343980 - DNA, 22 bp, Artificial Sequence
  chemically synthesized
ctctagtcatgcattatacgat

SEQ ID NO: 1343981 - DNA, 22 bp, Artificial Sequence
  chemically synthesized
cgtgtatcttttatcgtataat

SEQ ID NO: 1343982 - DNA, 22 bp, Artificial Sequence
  chemically synthesized
tagtcatgcattatacgataaa

SEQ ID NO: 1343983 - DNA, 22 bp, Artificial Sequence
  chemically synthesized
gtcatgcattatacgataaaag

SEQ ID NO: 1343984 - DNA, 22 bp, Artificial Sequence
  chemically synthesized
gacatcagtttcgtgtatcttt

SEQ ID NO: 1343985 - DNA, 22 bp, Artificial Sequence
  chemically synthesized
tacgataaaagatacacgaaac

SEQ ID NO: 1343986 - DNA, 22 bp, Artificial Sequence
  chemically synthesized
cattggacatcagtttcgtgta

SEQ ID NO: 1343987 - DNA, 22 bp, Artificial Sequence
  chemically synthesized
ttccattggacatcagtttcgt

SEQ ID NO: 1343988 - DNA, 22 bp, Artificial Sequence
  chemically synthesized
ctgttccattggacatcagttt

SEQ ID NO: 1343989 - DNA, 22 bp, Artificial Sequence
  chemically synthesized
actgttccattggacatcagtt

SEQ ID NO: 1343990 - DNA, 22 bp, Artificial Sequence
  chemically synthesized
tcaaagcttactgttccattgg

SEQ ID NO: 1343991 - DNA, 22 bp, Artificial Sequence
  chemically synthesized
atgtccaatggaacagtaagct

SEQ ID NO: 1343992 - DNA, 22 bp, Artificial Sequence
  chemically synthesized
taaagaatgtgaactgtcaaag

SEQ ID NO: 1343993 - DNA, 22 bp, Artificial Sequence
  chemically synthesized
tctataaagaatgtgaactgtc

SEQ ID NO: 1343994 - DNA, 22 bp, Artificial Sequence
  chemically synthesized
ttatctataaagaatgtgaact

SEQ ID NO: 1343995 - DNA, 22 bp, Artificial Sequence
  chemically synthesized
attatctataaagaatgtgaac

SEQ ID NO: 1343996 - DNA, 22 bp, Artificial Sequence
  chemically synthesized
tgacagttcacattctttatag

SEQ ID NO: 1343997 - DNA, 22 bp, Artificial Sequence
  chemically synthesized
gacagttcacattctttataga

SEQ ID NO: 1343998 - DNA, 22 bp, Artificial Sequence
  chemically synthesized
aacatcttattatctataaaga

SEQ ID NO: 1343999 - DNA, 22 bp, Artificial Sequence
  chemically synthesized
acagttcacattctttatagat

SEQ ID NO: 1344000 - DNA, 22 bp, Artificial Sequence
  chemically synthesized
aaacatcttattatctataaag

SEQ ID NO: 1344001 - DNA, 22 bp, Artificial Sequence
  chemically synthesized
acattctttatagataataaga

SEQ ID NO: 1344002 - DNA, 22 bp, Artificial Sequence
  chemically synthesized
tttatagataataagatgttta

SEQ ID NO: 1344003 - DNA, 22 bp, Artificial Sequence
  chemically synthesized
tatagataataagatgtttaaa

SEQ ID NO: 1344004 - DNA, 22 bp, Artificial Sequence
  chemically synthesized
atagataataagatgtttaaat

SEQ ID NO: 1344005 - DNA, 22 bp, Artificial Sequence
  chemically synthesized
tagataataagatgtttaaatt

SEQ ID NO: 1344006 - DNA, 22 bp, Artificial Sequence
  chemically synthesized
atacatcatggaaatgaattta

SEQ ID NO: 1344007 - DNA, 22 bp, Artificial Sequence
  chemically synthesized
aaattcatttccatgatgtatt

SEQ ID NO: 1344008 - DNA, 22 bp, Artificial Sequence
  chemically synthesized
aattcatttccatgatgtatta

SEQ ID NO: 1344009 - DNA, 22 bp, Artificial Sequence
  chemically synthesized
atttccatgatgtattagtttc

SEQ ID NO: 1344010 - DNA, 22 bp, Artificial Sequence
  chemically synthesized
acagcagccgcaggaaactaat

SEQ ID NO: 1344011 - DNA, 22 bp, Artificial Sequence
  chemically synthesized
aacagcagccgcaggaaactaa

SEQ ID NO: 1344012 - DNA, 22 bp, Artificial Sequence
  chemically synthesized
taacagcagccgcaggaaacta

SEQ ID NO: 1344013 - DNA, 22 bp, Artificial Sequence
  chemically synthesized
ccatgatgtattagtttcctgc

SEQ ID NO: 1344014 - DNA, 22 bp, Artificial Sequence
  chemically synthesized
ttaacagcagccgcaggaaact

SEQ ID NO: 1344015 - DNA, 22 bp, Artificial Sequence
  chemically synthesized
catgatgtattagtttcctgcg

SEQ ID NO: 1344016 - DNA, 22 bp, Artificial Sequence
  chemically synthesized
tttaacagcagccgcaggaaac

SEQ ID NO: 1344017 - DNA, 22 bp, Artificial Sequence
  chemically synthesized
tagtactttttaacagcagccg

SEQ ID NO: 1344018 - DNA, 22 bp, Artificial Sequence
  chemically synthesized
gtagtactttttaacagcagcc

SEQ ID NO: 1344019 - DNA, 22 bp, Artificial Sequence
  chemically synthesized
gtttcctgcggctgctgttaaa

SEQ ID NO: 1344020 - DNA, 22 bp, Artificial Sequence
  chemically synthesized
cctgcggctgctgttaaaaagt

SEQ ID NO: 1344021 - DNA, 22 bp, Artificial Sequence
  chemically synthesized
ctgcggctgctgttaaaaagta

SEQ ID NO: 1344022 - DNA, 22 bp, Artificial Sequence
  chemically synthesized
cccagtttgtagtactttttaa

SEQ ID NO: 1344023 - DNA, 22 bp, Artificial Sequence
  chemically synthesized
cggctgctgttaaaaagtacta

SEQ ID NO: 1344024 - DNA, 22 bp, Artificial Sequence
  chemically synthesized
ctgttaaaaagtactacaaact

SEQ ID NO: 1344025 - DNA, 22 bp, Artificial Sequence
  chemically synthesized
caaaccctacccagtttgtagt

SEQ ID NO: 1344026 - DNA, 22 bp, Artificial Sequence
  chemically synthesized
ttaaaaagtactacaaactggg

SEQ ID NO: 1344027 - DNA, 22 bp, Artificial Sequence
  chemically synthesized
aaaagtactacaaactgggtag

SEQ ID NO: 1344028 - DNA, 22 bp, Artificial Sequence
  chemically synthesized
caaactgggtagggtttgtagt

SEQ ID NO: 1344029 - DNA, 22 bp, Artificial Sequence
  chemically synthesized
aaaaacaaacaaacaactacaa

SEQ ID NO: 1344030 - DNA, 22 bp, Artificial Sequence
  chemically synthesized
ctaaaaaacaaacaaacaacta

SEQ ID NO: 1344031 - DNA, 22 bp, Artificial Sequence
  chemically synthesized
ggtagggtttgtagttgtttgt

SEQ ID NO: 1344032 - DNA, 22 bp, Artificial Sequence
  chemically synthesized
tcctaaaaaacaaacaaacaac

SEQ ID NO: 1344033 - DNA, 22 bp, Artificial Sequence
  chemically synthesized
ctcctaaaaaacaaacaaacaa

SEQ ID NO: 1344034 - DNA, 22 bp, Artificial Sequence
  chemically synthesized
gtagttgtttgtttgtttttta

SEQ ID NO: 1344035 - DNA, 22 bp, Artificial Sequence
  chemically synthesized
tagttgtttgtttgttttttag

SEQ ID NO: 1344036 - DNA, 22 bp, Artificial Sequence
  chemically synthesized
tttgtttgttttttaggagaaa

SEQ ID NO: 1344037 - DNA, 22 bp, Artificial Sequence
  chemically synthesized
ggagacaatatgtttctcctaa

SEQ ID NO: 1344038 - DNA, 22 bp, Artificial Sequence
  chemically synthesized
gtttgttttttaggagaaacat

SEQ ID NO: 1344039 - DNA, 22 bp, Artificial Sequence
  chemically synthesized
tttgttttttaggagaaacata

SEQ ID NO: 1344040 - DNA, 22 bp, Artificial Sequence
  chemically synthesized
gttttttaggagaaacatattg

SEQ ID NO: 1344041 - DNA, 22 bp, Artificial Sequence
  chemically synthesized
ttttttaggagaaacatattgt

SEQ ID NO: 1344042 - DNA, 22 bp, Artificial Sequence
  chemically synthesized
tttaggagaaacatattgtctc

SEQ ID NO: 1344043 - DNA, 22 bp, Artificial Sequence
  chemically synthesized
ttaggagaaacatattgtctcc

SEQ ID NO: 1344044 - DNA, 22 bp, Artificial Sequence
  chemically synthesized
taggagaaacatattgtctccc

SEQ ID NO: 1344045 - DNA, 22 bp, Artificial Sequence
  chemically synthesized
gccaccagaactgggagacaat

SEQ ID NO: 1344046 - DNA, 22 bp, Artificial Sequence
  chemically synthesized
aggagaaacatattgtctccca

SEQ ID NO: 1344047 - DNA, 22 bp, Artificial Sequence
  chemically synthesized
ggagaaacatattgtctcccag

SEQ ID NO: 1344048 - DNA, 22 bp, Artificial Sequence
  chemically synthesized
tagccaccagaactgggagaca

SEQ ID NO: 1344049 - DNA, 22 bp, Artificial Sequence
  chemically synthesized
ctagccaccagaactgggagac

SEQ ID NO: 1344050 - DNA, 22 bp, Artificial Sequence
  chemically synthesized
aacttctagccaccagaactgg

SEQ ID NO: 1344051 - DNA, 22 bp, Artificial Sequence
  chemically synthesized
gaacttctagccaccagaactg

SEQ ID NO: 1344052 - DNA, 22 bp, Artificial Sequence
  chemically synthesized
tgaacttctagccaccagaact

SEQ ID NO: 1344053 - DNA, 22 bp, Artificial Sequence
  chemically synthesized
attttgaacttctagccaccag

SEQ ID NO: 1344054 - DNA, 22 bp, Artificial Sequence
  chemically synthesized
gattttgaacttctagccacca

SEQ ID NO: 1344055 - DNA, 22 bp, Artificial Sequence
  chemically synthesized
tctcccagttctggtggctaga

SEQ ID NO: 1344056 - DNA, 22 bp, Artificial Sequence
  chemically synthesized
tgattttgaacttctagccacc

SEQ ID NO: 1344057 - DNA, 22 bp, Artificial Sequence
  chemically synthesized
ccagttctggtggctagaagtt

SEQ ID NO: 1344058 - DNA, 22 bp, Artificial Sequence
  chemically synthesized
atactttgattttgaacttcta

SEQ ID NO: 1344059 - DNA, 22 bp, Artificial Sequence
  chemically synthesized
ctaatactttgattttgaactt

SEQ ID NO: 1344060 - DNA, 22 bp, Artificial Sequence
  chemically synthesized
tggtggctagaagttcaaaatc

SEQ ID NO: 1344061 - DNA, 22 bp, Artificial Sequence
  chemically synthesized
gtggctagaagttcaaaatcaa

SEQ ID NO: 1344062 - DNA, 22 bp, Artificial Sequence
  chemically synthesized
gaagttcaaaatcaaagtatta

SEQ ID NO: 1344063 - DNA, 22 bp, Artificial Sequence
  chemically synthesized
aaaatcaaagtattagcagggc

SEQ ID NO: 1344064 - DNA, 22 bp, Artificial Sequence
  chemically synthesized
agtgagagcatggccctgctaa

SEQ ID NO: 1344065 - DNA, 22 bp, Artificial Sequence
  chemically synthesized
gagtattcagtgagagcatggc

SEQ ID NO: 1344066 - DNA, 22 bp, Artificial Sequence
  chemically synthesized
ctagagtattcagtgagagcat

SEQ ID NO: 1344067 - DNA, 22 bp, Artificial Sequence
  chemically synthesized
tcctagagtattcagtgagagc

SEQ ID NO: 1344068 - DNA, 22 bp, Artificial Sequence
  chemically synthesized
gcagggccatgctctcactgaa

SEQ ID NO: 1344069 - DNA, 22 bp, Artificial Sequence
  chemically synthesized
tctcctagagtattcagtgaga

SEQ ID NO: 1344070 - DNA, 22 bp, Artificial Sequence
  chemically synthesized
tcactgaatactctaggagaga

SEQ ID NO: 1344071 - DNA, 22 bp, Artificial Sequence
  chemically synthesized
actgaatactctaggagagagt

SEQ ID NO: 1344072 - DNA, 22 bp, Artificial Sequence
  chemically synthesized
aatactctaggagagagtctgt

SEQ ID NO: 1344073 - DNA, 22 bp, Artificial Sequence
  chemically synthesized
agaaagaggcacggaacagact

SEQ ID NO: 1344074 - DNA, 22 bp, Artificial Sequence
  chemically synthesized
taggagagagtctgttccgtgc

SEQ ID NO: 1344075 - DNA, 22 bp, Artificial Sequence
  chemically synthesized
ggagagagtctgttccgtgcct

SEQ ID NO: 1344076 - DNA, 22 bp, Artificial Sequence
  chemically synthesized
gcaataccagaagctaagaaag

SEQ ID NO: 1344077 - DNA, 22 bp, Artificial Sequence
  chemically synthesized
ttccgtgcctctttcttagctt

SEQ ID NO: 1344078 - DNA, 22 bp, Artificial Sequence
  chemically synthesized
ctggcaataccagaagctaaga

SEQ ID NO: 1344079 - DNA, 22 bp, Artificial Sequence
  chemically synthesized
cgtgcctctttcttagcttctg

SEQ ID NO: 1344080 - DNA, 22 bp, Artificial Sequence
  chemically synthesized
tttcttagcttctggtattgcc

SEQ ID NO: 1344081 - DNA, 22 bp, Artificial Sequence
  chemically synthesized
tcttagcttctggtattgccag

SEQ ID NO: 1344082 - DNA, 22 bp, Artificial Sequence
  chemically synthesized
cttagcttctggtattgccagc

SEQ ID NO: 1344083 - DNA, 22 bp, Artificial Sequence
  chemically synthesized
ttagcttctggtattgccagca

SEQ ID NO: 1344084 - DNA, 22 bp, Artificial Sequence
  chemically synthesized
agcttctggtattgccagcaat

SEQ ID NO: 1344085 - DNA, 22 bp, Artificial Sequence
  chemically synthesized
gcttctggtattgccagcaatc

SEQ ID NO: 1344086 - DNA, 22 bp, Artificial Sequence
  chemically synthesized
ctggtattgccagcaatccttg

SEQ ID NO: 1344087 - DNA, 22 bp, Artificial Sequence
  chemically synthesized
tggtattgccagcaatccttgc

SEQ ID NO: 1344088 - DNA, 22 bp, Artificial Sequence
  chemically synthesized
gtattgccagcaatccttgcca

SEQ ID NO: 1344089 - DNA, 22 bp, Artificial Sequence
  chemically synthesized
taagccaaagaatggcaaggat

SEQ ID NO: 1344090 - DNA, 22 bp, Artificial Sequence
  chemically synthesized
ccagcaatccttgccattcttt

SEQ ID NO: 1344091 - DNA, 22 bp, Artificial Sequence
  chemically synthesized
gccattctttggcttatagaca

SEQ ID NO: 1344092 - DNA, 22 bp, Artificial Sequence
  chemically synthesized
tcccgagtgacgtgtctataag

SEQ ID NO: 1344093 - DNA, 22 bp, Artificial Sequence
  chemically synthesized
ccattctttggcttatagacac

SEQ ID NO: 1344094 - DNA, 22 bp, Artificial Sequence
  chemically synthesized
tttggcttatagacacgtcact

SEQ ID NO: 1344095 - DNA, 22 bp, Artificial Sequence
  chemically synthesized
tggcttatagacacgtcactcg

SEQ ID NO: 1344096 - DNA, 22 bp, Artificial Sequence
  chemically synthesized
ggcttatagacacgtcactcgg

SEQ ID NO: 1344097 - DNA, 22 bp, Artificial Sequence
  chemically synthesized
gcttatagacacgtcactcggg

SEQ ID NO: 1344098 - DNA, 22 bp, Artificial Sequence
  chemically synthesized
atagacacgtcactcgggatag

SEQ ID NO: 1344099 - DNA, 22 bp, Artificial Sequence
  chemically synthesized
tagacacgtcactcgggatagc

SEQ ID NO: 1344100 - DNA, 22 bp, Artificial Sequence
  chemically synthesized
gggatagcctctgtcatatggg

SEQ ID NO: 1344101 - DNA, 22 bp, Artificial Sequence
  chemically synthesized
tgtcatatgggattctccctgt

SEQ ID NO: 1344102 - DNA, 22 bp, Artificial Sequence
  chemically synthesized
tcatatgggattctccctgtgt

SEQ ID NO: 1344103 - DNA, 22 bp, Artificial Sequence
  chemically synthesized
tccctgtgtgtcttctctgtat

SEQ ID NO: 1344104 - DNA, 22 bp, Artificial Sequence
  chemically synthesized
cctgtgtgtcttctctgtattt

SEQ ID NO: 1344105 - DNA, 22 bp, Artificial Sequence
  chemically synthesized
taagaagaagagaagaaataca

SEQ ID NO: 1344106 - DNA, 22 bp, Artificial Sequence
  chemically synthesized
tgtgtcttctctgtatttcttc

SEQ ID NO: 1344107 - DNA, 22 bp, Artificial Sequence
  chemically synthesized
ataagaagaagagaagaaatac

SEQ ID NO: 1344108 - DNA, 22 bp, Artificial Sequence
  chemically synthesized
ctctgtatttcttctcttcttc

SEQ ID NO: 1344109 - DNA, 22 bp, Artificial Sequence
  chemically synthesized
atgtccttataagaagaagaga

SEQ ID NO: 1344110 - DNA, 22 bp, Artificial Sequence
  chemically synthesized
tctgtatttcttctcttcttct

SEQ ID NO: 1344111 - DNA, 22 bp, Artificial Sequence
  chemically synthesized
tgtatttcttctcttcttctta

SEQ ID NO: 1344112 - DNA, 22 bp, Artificial Sequence
  chemically synthesized
tatttcttctcttcttcttata

SEQ ID NO: 1344113 - DNA, 22 bp, Artificial Sequence
  chemically synthesized
acatggctgatgtccttataag

SEQ ID NO: 1344114 - DNA, 22 bp, Artificial Sequence
  chemically synthesized
cttctcttcttcttataaggac

SEQ ID NO: 1344115 - DNA, 22 bp, Artificial Sequence
  chemically synthesized
ttctcttcttcttataaggaca

SEQ ID NO: 1344116 - DNA, 22 bp, Artificial Sequence
  chemically synthesized
ctcttcttcttataaggacatc

SEQ ID NO: 1344117 - DNA, 22 bp, Artificial Sequence
  chemically synthesized
tcttcttcttataaggacatca

SEQ ID NO: 1344118 - DNA, 22 bp, Artificial Sequence
  chemically synthesized
atctaacatggctgatgtcctt

SEQ ID NO: 1344119 - DNA, 22 bp, Artificial Sequence
  chemically synthesized
aatctaacatggctgatgtcct

SEQ ID NO: 1344120 - DNA, 22 bp, Artificial Sequence
  chemically synthesized
ttcttcttataaggacatcagc

SEQ ID NO: 1344121 - DNA, 22 bp, Artificial Sequence
  chemically synthesized
taatctaacatggctgatgtcc

SEQ ID NO: 1344122 - DNA, 22 bp, Artificial Sequence
  chemically synthesized
cttcttataaggacatcagcca

SEQ ID NO: 1344123 - DNA, 22 bp, Artificial Sequence
  chemically synthesized
ttcttataaggacatcagccat

SEQ ID NO: 1344124 - DNA, 22 bp, Artificial Sequence
  chemically synthesized
cttataaggacatcagccatgt

SEQ ID NO: 1344125 - DNA, 22 bp, Artificial Sequence
  chemically synthesized
ttataaggacatcagccatgtt

SEQ ID NO: 1344126 - DNA, 22 bp, Artificial Sequence
  chemically synthesized
ataaggacatcagccatgttag

SEQ ID NO: 1344127 - DNA, 22 bp, Artificial Sequence
  chemically synthesized
taaggacatcagccatgttaga

SEQ ID NO: 1344128 - DNA, 22 bp, Artificial Sequence
  chemically synthesized
gagtggggtgggcctttaatct

SEQ ID NO: 1344129 - DNA, 22 bp, Artificial Sequence
  chemically synthesized
gattaaaggcccaccccactcc

SEQ ID NO: 1344130 - DNA, 22 bp, Artificial Sequence
  chemically synthesized
agatgatgtcatattggagtgg

SEQ ID NO: 1344131 - DNA, 22 bp, Artificial Sequence
  chemically synthesized
aaggcccaccccactccaatat

SEQ ID NO: 1344132 - DNA, 22 bp, Artificial Sequence
  chemically synthesized
gttaagatgatgtcatattgga

SEQ ID NO: 1344133 - DNA, 22 bp, Artificial Sequence
  chemically synthesized
cagatgtaattagttaagatga

SEQ ID NO: 1344134 - DNA, 22 bp, Artificial Sequence
  chemically synthesized
gcagatgtaattagttaagatg

SEQ ID NO: 1344135 - DNA, 22 bp, Artificial Sequence
  chemically synthesized
caatatgacatcatcttaacta

SEQ ID NO: 1344136 - DNA, 22 bp, Artificial Sequence
  chemically synthesized
tgcagatgtaattagttaagat

SEQ ID NO: 1344137 - DNA, 22 bp, Artificial Sequence
  chemically synthesized
caaatggggtctttgcagatgt

SEQ ID NO: 1344138 - DNA, 22 bp, Artificial Sequence
  chemically synthesized
gcaaatggggtctttgcagatg

SEQ ID NO: 1344139 - DNA, 22 bp, Artificial Sequence
  chemically synthesized
aactaattacatctgcaaagac

SEQ ID NO: 1344140 - DNA, 22 bp, Artificial Sequence
  chemically synthesized
tttgcaaatggggtctttgcag

SEQ ID NO: 1344141 - DNA, 22 bp, Artificial Sequence
  chemically synthesized
actaattacatctgcaaagacc

SEQ ID NO: 1344142 - DNA, 22 bp, Artificial Sequence
  chemically synthesized
gtttgcaaatggggtctttgca

SEQ ID NO: 1344143 - DNA, 22 bp, Artificial Sequence
  chemically synthesized
tgtttgcaaatggggtctttgc

SEQ ID NO: 1344144 - DNA, 22 bp, Artificial Sequence
  chemically synthesized
ttgtttgcaaatggggtctttg

SEQ ID NO: 1344145 - DNA, 22 bp, Artificial Sequence
  chemically synthesized
attacatctgcaaagaccccat

SEQ ID NO: 1344146 - DNA, 22 bp, Artificial Sequence
  chemically synthesized
catctgcaaagaccccatttgc

SEQ ID NO: 1344147 - DNA, 22 bp, Artificial Sequence
  chemically synthesized
caaagaccccatttgcaaacaa

SEQ ID NO: 1344148 - DNA, 22 bp, Artificial Sequence
  chemically synthesized
aaaaatgtggtttttgtttgca

SEQ ID NO: 1344149 - DNA, 22 bp, Artificial Sequence
  chemically synthesized
caaaaatgtggtttttgtttgc

SEQ ID NO: 1344150 - DNA, 22 bp, Artificial Sequence
  chemically synthesized
gaacttcaaaaatgtggttttt

SEQ ID NO: 1344151 - DNA, 22 bp, Artificial Sequence
  chemically synthesized
tggaacttcaaaaatgtggttt

SEQ ID NO: 1344152 - DNA, 22 bp, Artificial Sequence
  chemically synthesized
ctggaacttcaaaaatgtggtt

SEQ ID NO: 1344153 - DNA, 22 bp, Artificial Sequence
  chemically synthesized
tctggaacttcaaaaatgtggt

SEQ ID NO: 1344154 - DNA, 22 bp, Artificial Sequence
  chemically synthesized
ttctggaacttcaaaaatgtgg

SEQ ID NO: 1344155 - DNA, 22 bp, Artificial Sequence
  chemically synthesized
gcaaacaaaaaccacatttttg

SEQ ID NO: 1344156 - DNA, 22 bp, Artificial Sequence
  chemically synthesized
caaacaaaaaccacatttttga

SEQ ID NO: 1344157 - DNA, 22 bp, Artificial Sequence
  chemically synthesized
atgtcttttctggaacttcaaa

SEQ ID NO: 1344158 - DNA, 22 bp, Artificial Sequence
  chemically synthesized
aaaattcatgtcttttctggaa

SEQ ID NO: 1344159 - DNA, 22 bp, Artificial Sequence
  chemically synthesized
ttgaagttccagaaaagacatg

SEQ ID NO: 1344160 - DNA, 22 bp, Artificial Sequence
  chemically synthesized
tgaagttccagaaaagacatga

SEQ ID NO: 1344161 - DNA, 22 bp, Artificial Sequence
  chemically synthesized
gaagttccagaaaagacatgaa

SEQ ID NO: 1344162 - DNA, 22 bp, Artificial Sequence
  chemically synthesized
aagttccagaaaagacatgaat

SEQ ID NO: 1344163 - DNA, 22 bp, Artificial Sequence
  chemically synthesized
gatagtgcaccctcaaaattca

SEQ ID NO: 1344164 - DNA, 22 bp, Artificial Sequence
  chemically synthesized
cagaaaagacatgaattttgag

SEQ ID NO: 1344165 - DNA, 22 bp, Artificial Sequence
  chemically synthesized
ggttagatagtgcaccctcaaa

SEQ ID NO: 1344166 - DNA, 22 bp, Artificial Sequence
  chemically synthesized
tcacgtgcactgggttagatag

SEQ ID NO: 1344167 - DNA, 22 bp, Artificial Sequence
  chemically synthesized
tgagggtgcactatctaaccca

SEQ ID NO: 1344168 - DNA, 22 bp, Artificial Sequence
  chemically synthesized
gagggtgcactatctaacccag

SEQ ID NO: 1344169 - DNA, 22 bp, Artificial Sequence
  chemically synthesized
agggtgcactatctaacccagt

SEQ ID NO: 1344170 - DNA, 22 bp, Artificial Sequence
  chemically synthesized
tgttatcacgtgcactgggtta

SEQ ID NO: 1344171 - DNA, 22 bp, Artificial Sequence
  chemically synthesized
aggattgtgttatcacgtgcac

SEQ ID NO: 1344172 - DNA, 22 bp, Artificial Sequence
  chemically synthesized
tctaacccagtgcacgtgataa

SEQ ID NO: 1344173 - DNA, 22 bp, Artificial Sequence
  chemically synthesized
attgaggattgtgttatcacgt

SEQ ID NO: 1344174 - DNA, 22 bp, Artificial Sequence
  chemically synthesized
acccagtgcacgtgataacaca

SEQ ID NO: 1344175 - DNA, 22 bp, Artificial Sequence
  chemically synthesized
acagcagtcagttcattgagga

SEQ ID NO: 1344176 - DNA, 22 bp, Artificial Sequence
  chemically synthesized
agagattgacagcagtcagttc

SEQ ID NO: 1344177 - DNA, 22 bp, Artificial Sequence
  chemically synthesized
aaaactgagagattgacagcag

SEQ ID NO: 1344178 - DNA, 22 bp, Artificial Sequence
  chemically synthesized
aatgaactgactgctgtcaatc

SEQ ID NO: 1344179 - DNA, 22 bp, Artificial Sequence
  chemically synthesized
actgctgtcaatctctcagttt

SEQ ID NO: 1344180 - DNA, 22 bp, Artificial Sequence
  chemically synthesized
agtagtggagttgaaaactgag

SEQ ID NO: 1344181 - DNA, 22 bp, Artificial Sequence
  chemically synthesized
ctgtcaatctctcagttttcaa

SEQ ID NO: 1344182 - DNA, 22 bp, Artificial Sequence
  chemically synthesized
tcaatctctcagttttcaactc

SEQ ID NO: 1344183 - DNA, 22 bp, Artificial Sequence
  chemically synthesized
tcagttttcaactccactactc

SEQ ID NO: 1344184 - DNA, 22 bp, Artificial Sequence
  chemically synthesized
gatgtagtagttgagtagtgga

SEQ ID NO: 1344185 - DNA, 22 bp, Artificial Sequence
  chemically synthesized
agttttcaactccactactcaa

SEQ ID NO: 1344186 - DNA, 22 bp, Artificial Sequence
  chemically synthesized
agttggatgtagtagttgagta

SEQ ID NO: 1344187 - DNA, 22 bp, Artificial Sequence
  chemically synthesized
tcaactccactactcaactact

SEQ ID NO: 1344188 - DNA, 22 bp, Artificial Sequence
  chemically synthesized
caactccactactcaactacta

SEQ ID NO: 1344189 - DNA, 22 bp, Artificial Sequence
  chemically synthesized
ctaagttggatgtagtagttga

SEQ ID NO: 1344190 - DNA, 22 bp, Artificial Sequence
  chemically synthesized
aactccactactcaactactac

SEQ ID NO: 1344191 - DNA, 22 bp, Artificial Sequence
  chemically synthesized
tctgctaagttggatgtagtag

SEQ ID NO: 1344192 - DNA, 22 bp, Artificial Sequence
  chemically synthesized
gtctgctaagttggatgtagta

SEQ ID NO: 1344193 - DNA, 22 bp, Artificial Sequence
  chemically synthesized
cactactcaactactacatcca

SEQ ID NO: 1344194 - DNA, 22 bp, Artificial Sequence
  chemically synthesized
tttgtctgctaagttggatgta

SEQ ID NO: 1344195 - DNA, 22 bp, Artificial Sequence
  chemically synthesized
gtttgtctgctaagttggatgt

SEQ ID NO: 1344196 - DNA, 22 bp, Artificial Sequence
  chemically synthesized
ctcaactactacatccaactta

SEQ ID NO: 1344197 - DNA, 22 bp, Artificial Sequence
  chemically synthesized
aactactacatccaacttagca

SEQ ID NO: 1344198 - DNA, 22 bp, Artificial Sequence
  chemically synthesized
ctacatccaacttagcagacaa

SEQ ID NO: 1344199 - DNA, 22 bp, Artificial Sequence
  chemically synthesized
catccaacttagcagacaaaca

SEQ ID NO: 1344200 - DNA, 22 bp, Artificial Sequence
  chemically synthesized
aatacatatatttgtttgtctg

SEQ ID NO: 1344201 - DNA, 22 bp, Artificial Sequence
  chemically synthesized
attcaatacatatatttgtttg

SEQ ID NO: 1344202 - DNA, 22 bp, Artificial Sequence
  chemically synthesized
tcattcaatacatatatttgtt

SEQ ID NO: 1344203 - DNA, 22 bp, Artificial Sequence
  chemically synthesized
ctcattcaatacatatatttgt

SEQ ID NO: 1344204 - DNA, 22 bp, Artificial Sequence
  chemically synthesized
agcagacaaacaaatatatgta

SEQ ID NO: 1344205 - DNA, 22 bp, Artificial Sequence
  chemically synthesized
tttctcattcaatacatatatt

SEQ ID NO: 1344206 - DNA, 22 bp, Artificial Sequence
  chemically synthesized
gcagacaaacaaatatatgtat

SEQ ID NO: 1344207 - DNA, 22 bp, Artificial Sequence
  chemically synthesized
gggactgtttctcattcaatac

SEQ ID NO: 1344208 - DNA, 22 bp, Artificial Sequence
  chemically synthesized
ccagctagggactgtttctcat

SEQ ID NO: 1344209 - DNA, 22 bp, Artificial Sequence
  chemically synthesized
accagctagggactgtttctca

SEQ ID NO: 1344210 - DNA, 22 bp, Artificial Sequence
  chemically synthesized
taccagctagggactgtttctc

SEQ ID NO: 1344211 - DNA, 22 bp, Artificial Sequence
  chemically synthesized
ttaccagctagggactgtttct

SEQ ID NO: 1344212 - DNA, 22 bp, Artificial Sequence
  chemically synthesized
cttttaccagctagggactgtt

SEQ ID NO: 1344213 - DNA, 22 bp, Artificial Sequence
  chemically synthesized
acttttaccagctagggactgt

SEQ ID NO: 1344214 - DNA, 22 bp, Artificial Sequence
  chemically synthesized
tacttttaccagctagggactg

SEQ ID NO: 1344215 - DNA, 22 bp, Artificial Sequence
  chemically synthesized
aatgagaaacagtccctagctg

SEQ ID NO: 1344216 - DNA, 22 bp, Artificial Sequence
  chemically synthesized
ctttacttttaccagctaggga

SEQ ID NO: 1344217 - DNA, 22 bp, Artificial Sequence
  chemically synthesized
gccctactttacttttaccagc

SEQ ID NO: 1344218 - DNA, 22 bp, Artificial Sequence
  chemically synthesized
ctggccctactttacttttacc

SEQ ID NO: 1344219 - DNA, 22 bp, Artificial Sequence
  chemically synthesized
gctggtaaaagtaaagtagggc

SEQ ID NO: 1344220 - DNA, 22 bp, Artificial Sequence
  chemically synthesized
gtaaaagtaaagtagggccagg

SEQ ID NO: 1344221 - DNA, 22 bp, Artificial Sequence
  chemically synthesized
caggcgtgagccaccgctcctg

SEQ ID NO: 1344222 - DNA, 22 bp, Artificial Sequence
  chemically synthesized
ggattacaggcgtgagccaccg

SEQ ID NO: 1344223 - DNA, 22 bp, Artificial Sequence
  chemically synthesized
ccaaagtgctgggattacaggc

SEQ ID NO: 1344224 - DNA, 22 bp, Artificial Sequence
  chemically synthesized
agcctcccaaagtgctgggatt

SEQ ID NO: 1344225 - DNA, 22 bp, Artificial Sequence
  chemically synthesized
acgcctgtaatcccagcacttt

SEQ ID NO: 1344226 - DNA, 22 bp, Artificial Sequence
  chemically synthesized
taatcccagcactttgggaggc

SEQ ID NO: 1344227 - DNA, 22 bp, Artificial Sequence
  chemically synthesized
aggtgatccacccacctcagcc

SEQ ID NO: 1344228 - DNA, 22 bp, Artificial Sequence
  chemically synthesized
acctcaggtgatccacccacct

SEQ ID NO: 1344229 - DNA, 22 bp, Artificial Sequence
  chemically synthesized
tgggaggctgaggtgggtggat

SEQ ID NO: 1344230 - DNA, 22 bp, Artificial Sequence
  chemically synthesized
gggaggctgaggtgggtggatc

SEQ ID NO: 1344231 - DNA, 22 bp, Artificial Sequence
  chemically synthesized
ggaggctgaggtgggtggatca

SEQ ID NO: 1344232 - DNA, 22 bp, Artificial Sequence
  chemically synthesized
caaccctgacctcaggtgatcc

SEQ ID NO: 1344233 - DNA, 22 bp, Artificial Sequence
  chemically synthesized
aggtgggtggatcacctgaggt

SEQ ID NO: 1344234 - DNA, 22 bp, Artificial Sequence
  chemically synthesized
tggtctccaaccctgacctcag

SEQ ID NO: 1344235 - DNA, 22 bp, Artificial Sequence
  chemically synthesized
gctgtggtctccaaccctgacc

SEQ ID NO: 1344236 - DNA, 22 bp, Artificial Sequence
  chemically synthesized
ccctggctgtggtctccaaccc

SEQ ID NO: 1344237 - DNA, 22 bp, Artificial Sequence
  chemically synthesized
aggtcagggttggagaccacag

SEQ ID NO: 1344238 - DNA, 22 bp, Artificial Sequence
  chemically synthesized
ccatgttaccctggctgtggtc

SEQ ID NO: 1344239 - DNA, 22 bp, Artificial Sequence
  chemically synthesized
gccatgttaccctggctgtggt

SEQ ID NO: 1344240 - DNA, 22 bp, Artificial Sequence
  chemically synthesized
tgccatgttaccctggctgtgg

SEQ ID NO: 1344241 - DNA, 22 bp, Artificial Sequence
  chemically synthesized
gagaccacagccagggtaacat

SEQ ID NO: 1344242 - DNA, 22 bp, Artificial Sequence
  chemically synthesized
gtagagatggggttttgccatg

SEQ ID NO: 1344243 - DNA, 22 bp, Artificial Sequence
  chemically synthesized
agtagagatggggttttgccat

SEQ ID NO: 1344244 - DNA, 22 bp, Artificial Sequence
  chemically synthesized
tagtagagatggggttttgcca

SEQ ID NO: 1344245 - DNA, 22 bp, Artificial Sequence
  chemically synthesized
ttagtagagatggggttttgcc

SEQ ID NO: 1344246 - DNA, 22 bp, Artificial Sequence
  chemically synthesized
tatttttagtagagatggggtt

SEQ ID NO: 1344247 - DNA, 22 bp, Artificial Sequence
  chemically synthesized
gtatttttagtagagatggggt

SEQ ID NO: 1344248 - DNA, 22 bp, Artificial Sequence
  chemically synthesized
tgtatttttagtagagatgggg

SEQ ID NO: 1344249 - DNA, 22 bp, Artificial Sequence
  chemically synthesized
ttgtatttttagtagagatggg

SEQ ID NO: 1344250 - DNA, 22 bp, Artificial Sequence
  chemically synthesized
atttttgtatttttagtagaga

SEQ ID NO: 1344251 - DNA, 22 bp, Artificial Sequence
  chemically synthesized
gctaatttttgtatttttagta

SEQ ID NO: 1344252 - DNA, 22 bp, Artificial Sequence
  chemically synthesized
tactaaaaatacaaaaattagc

SEQ ID NO: 1344253 - DNA, 22 bp, Artificial Sequence
  chemically synthesized
ctaaaaatacaaaaattagcca

SEQ ID NO: 1344254 - DNA, 22 bp, Artificial Sequence
  chemically synthesized
aaaatacaaaaattagccaggc

SEQ ID NO: 1344255 - DNA, 22 bp, Artificial Sequence
  chemically synthesized
caggagtgtgccaccatgcctg

SEQ ID NO: 1344256 - DNA, 22 bp, Artificial Sequence
  chemically synthesized
ggattacaggagtgtgccacca

SEQ ID NO: 1344257 - DNA, 22 bp, Artificial Sequence
  chemically synthesized
gccaggcatggtggcacactcc

SEQ ID NO: 1344258 - DNA, 22 bp, Artificial Sequence
  chemically synthesized
cagggtagctgggattacagga

SEQ ID NO: 1344259 - DNA, 22 bp, Artificial Sequence
  chemically synthesized
agcctccagggtagctgggatt

SEQ ID NO: 1344260 - DNA, 22 bp, Artificial Sequence
  chemically synthesized
ccgcctcagcctccagggtagc

SEQ ID NO: 1344261 - DNA, 22 bp, Artificial Sequence
  chemically synthesized
ctgtaatcccagctaccctgga

SEQ ID NO: 1344262 - DNA, 22 bp, Artificial Sequence
  chemically synthesized
tcccgcctcagcctccagggta

SEQ ID NO: 1344263 - DNA, 22 bp, Artificial Sequence
  chemically synthesized
taatcccagctaccctggaggc

SEQ ID NO: 1344264 - DNA, 22 bp, Artificial Sequence
  chemically synthesized
agcgattctcccgcctcagcct

SEQ ID NO: 1344265 - DNA, 22 bp, Artificial Sequence
  chemically synthesized
aagcgattctcccgcctcagcc

SEQ ID NO: 1344266 - DNA, 22 bp, Artificial Sequence
  chemically synthesized
ccctggaggctgaggcgggaga

SEQ ID NO: 1344267 - DNA, 22 bp, Artificial Sequence
  chemically synthesized
ggtttaagcgattctcccgcct

SEQ ID NO: 1344268 - DNA, 22 bp, Artificial Sequence
  chemically synthesized
ctgggtttaagcgattctcccg

SEQ ID NO: 1344269 - DNA, 22 bp, Artificial Sequence
  chemically synthesized
gaggctgaggcgggagaatcgc

SEQ ID NO: 1344270 - DNA, 22 bp, Artificial Sequence
  chemically synthesized
cacctcctgggtttaagcgatt

SEQ ID NO: 1344271 - DNA, 22 bp, Artificial Sequence
  chemically synthesized
aggcgggagaatcgcttaaacc

SEQ ID NO: 1344272 - DNA, 22 bp, Artificial Sequence
  chemically synthesized
caacctccacctcctgggttta

SEQ ID NO: 1344273 - DNA, 22 bp, Artificial Sequence
  chemically synthesized
actgcaacctccacctcctggg

SEQ ID NO: 1344274 - DNA, 22 bp, Artificial Sequence
  chemically synthesized
agctcactgcaacctccacctc

SEQ ID NO: 1344275 - DNA, 22 bp, Artificial Sequence
  chemically synthesized
aaacccaggaggtggaggttgc

SEQ ID NO: 1344276 - DNA, 22 bp, Artificial Sequence
  chemically synthesized
aacccaggaggtggaggttgca

SEQ ID NO: 1344277 - DNA, 22 bp, Artificial Sequence
  chemically synthesized
gagtgcaatggtgcgatctcag

SEQ ID NO: 1344278 - DNA, 22 bp, Artificial Sequence
  chemically synthesized
cagtgagctgagatcgcaccat

SEQ ID NO: 1344279 - DNA, 22 bp, Artificial Sequence
  chemically synthesized
ccaggctggagtgcaatggtgc

SEQ ID NO: 1344280 - DNA, 22 bp, Artificial Sequence
  chemically synthesized
tctcccaggctggagtgcaatg

SEQ ID NO: 1344281 - DNA, 22 bp, Artificial Sequence
  chemically synthesized
gtctcccaggctggagtgcaat

SEQ ID NO: 1344282 - DNA, 22 bp, Artificial Sequence
  chemically synthesized
agatcgcaccattgcactccag

SEQ ID NO: 1344283 - DNA, 22 bp, Artificial Sequence
  chemically synthesized
ttgtctcccaggctggagtgca

SEQ ID NO: 1344284 - DNA, 22 bp, Artificial Sequence
  chemically synthesized
actcttgtctcccaggctggag

SEQ ID NO: 1344285 - DNA, 22 bp, Artificial Sequence
  chemically synthesized
cactcttgtctcccaggctgga

SEQ ID NO: 1344286 - DNA, 22 bp, Artificial Sequence
  chemically synthesized
cactccagcctgggagacaaga

SEQ ID NO: 1344287 - DNA, 22 bp, Artificial Sequence
  chemically synthesized
agatggagtttcactcttgtct

SEQ ID NO: 1344288 - DNA, 22 bp, Artificial Sequence
  chemically synthesized
gagatggagtttcactcttgtc

SEQ ID NO: 1344289 - DNA, 22 bp, Artificial Sequence
  chemically synthesized
tgagatggagtttcactcttgt

SEQ ID NO: 1344290 - DNA, 22 bp, Artificial Sequence
  chemically synthesized
cagcctgggagacaagagtgaa

SEQ ID NO: 1344291 - DNA, 22 bp, Artificial Sequence
  chemically synthesized
ttgagatggagtttcactcttg

SEQ ID NO: 1344292 - DNA, 22 bp, Artificial Sequence
  chemically synthesized
tttgagatggagtttcactctt

SEQ ID NO: 1344293 - DNA, 22 bp, Artificial Sequence
  chemically synthesized
ttttgagatggagtttcactct

SEQ ID NO: 1344294 - DNA, 22 bp, Artificial Sequence
  chemically synthesized
tttttgagatggagtttcactc

SEQ ID NO: 1344295 - DNA, 22 bp, Artificial Sequence
  chemically synthesized
tttttttgagatggagtttcac

SEQ ID NO: 1344296 - DNA, 22 bp, Artificial Sequence
  chemically synthesized
ctttttttgagatggagtttca

SEQ ID NO: 1344297 - DNA, 22 bp, Artificial Sequence
  chemically synthesized
ggagacaagagtgaaactccat

SEQ ID NO: 1344298 - DNA, 22 bp, Artificial Sequence
  chemically synthesized
tctttttttgagatggagtttc

SEQ ID NO: 1344299 - DNA, 22 bp, Artificial Sequence
  chemically synthesized
ctttctttttttgagatggagt

SEQ ID NO: 1344300 - DNA, 22 bp, Artificial Sequence
  chemically synthesized
actttctttttttgagatggag

SEQ ID NO: 1344301 - DNA, 22 bp, Artificial Sequence
  chemically synthesized
atttactttctttttttgagat

SEQ ID NO: 1344302 - DNA, 22 bp, Artificial Sequence
  chemically synthesized
taatttactttctttttttgag

SEQ ID NO: 1344303 - DNA, 22 bp, Artificial Sequence
  chemically synthesized
tctaatttactttctttttttg

SEQ ID NO: 1344304 - DNA, 22 bp, Artificial Sequence
  chemically synthesized
tctctaatttactttctttttt

SEQ ID NO: 1344305 - DNA, 22 bp, Artificial Sequence
  chemically synthesized
ctctctaatttactttcttttt

SEQ ID NO: 1344306 - DNA, 22 bp, Artificial Sequence
  chemically synthesized
catctcaaaaaaagaaagtaaa

SEQ ID NO: 1344307 - DNA, 22 bp, Artificial Sequence
  chemically synthesized
gcttctctctaatttactttct

SEQ ID NO: 1344308 - DNA, 22 bp, Artificial Sequence
  chemically synthesized
agcttctctctaatttactttc

SEQ ID NO: 1344309 - DNA, 22 bp, Artificial Sequence
  chemically synthesized
tagcttctctctaatttacttt

SEQ ID NO: 1344310 - DNA, 22 bp, Artificial Sequence
  chemically synthesized
tttagcttctctctaatttact

SEQ ID NO: 1344311 - DNA, 22 bp, Artificial Sequence
  chemically synthesized
aaaaaaagaaagtaaattagag

SEQ ID NO: 1344312 - DNA, 22 bp, Artificial Sequence
  chemically synthesized
ctctttagcttctctctaattt

SEQ ID NO: 1344313 - DNA, 22 bp, Artificial Sequence
  chemically synthesized
actctttagcttctctctaatt

SEQ ID NO: 1344314 - DNA, 22 bp, Artificial Sequence
  chemically synthesized
atttactctttagcttctctct

SEQ ID NO: 1344315 - DNA, 22 bp, Artificial Sequence
  chemically synthesized
cctgatttactctttagcttct

SEQ ID NO: 1344316 - DNA, 22 bp, Artificial Sequence
  chemically synthesized
gagagaagctaaagagtaaatc

SEQ ID NO: 1344317 - DNA, 22 bp, Artificial Sequence
  chemically synthesized
cccagaaaatcctgcctgattt

SEQ ID NO: 1344318 - DNA, 22 bp, Artificial Sequence
  chemically synthesized
tgcccagaaaatcctgcctgat

SEQ ID NO: 1344319 - DNA, 22 bp, Artificial Sequence
  chemically synthesized
tctgcccagaaaatcctgcctg

SEQ ID NO: 1344320 - DNA, 22 bp, Artificial Sequence
  chemically synthesized
ctctgcccagaaaatcctgcct

SEQ ID NO: 1344321 - DNA, 22 bp, Artificial Sequence
  chemically synthesized
aagagtaaatcaggcaggattt

SEQ ID NO: 1344322 - DNA, 22 bp, Artificial Sequence
  chemically synthesized
tagccaagcatgacttctctgc

SEQ ID NO: 1344323 - DNA, 22 bp, Artificial Sequence
  chemically synthesized
atagccaagcatgacttctctg

SEQ ID NO: 1344324 - DNA, 22 bp, Artificial Sequence
  chemically synthesized
tatagccaagcatgacttctct

SEQ ID NO: 1344325 - DNA, 22 bp, Artificial Sequence
  chemically synthesized
tctgggcagagaagtcatgctt

SEQ ID NO: 1344326 - DNA, 22 bp, Artificial Sequence
  chemically synthesized
ctgggcagagaagtcatgcttg

SEQ ID NO: 1344327 - DNA, 22 bp, Artificial Sequence
  chemically synthesized
tgggcagagaagtcatgcttgg

SEQ ID NO: 1344328 - DNA, 22 bp, Artificial Sequence
  chemically synthesized
atagctttatagccaagcatga

SEQ ID NO: 1344329 - DNA, 22 bp, Artificial Sequence
  chemically synthesized
catagctttatagccaagcatg

SEQ ID NO: 1344330 - DNA, 22 bp, Artificial Sequence
  chemically synthesized
ggcagagaagtcatgcttggct

SEQ ID NO: 1344331 - DNA, 22 bp, Artificial Sequence
  chemically synthesized
tcatagctttatagccaagcat

SEQ ID NO: 1344332 - DNA, 22 bp, Artificial Sequence
  chemically synthesized
tgtactttcatagctttatagc

SEQ ID NO: 1344333 - DNA, 22 bp, Artificial Sequence
  chemically synthesized
tgtgtactttcatagctttata

SEQ ID NO: 1344334 - DNA, 22 bp, Artificial Sequence
  chemically synthesized
ctgtgtactttcatagctttat

SEQ ID NO: 1344335 - DNA, 22 bp, Artificial Sequence
  chemically synthesized
atttctgtgtactttcatagct

SEQ ID NO: 1344336 - DNA, 22 bp, Artificial Sequence
  chemically synthesized
gatttctgtgtactttcatagc

SEQ ID NO: 1344337 - DNA, 22 bp, Artificial Sequence
  chemically synthesized
ggctataaagctatgaaagtac

SEQ ID NO: 1344338 - DNA, 22 bp, Artificial Sequence
  chemically synthesized
gctataaagctatgaaagtaca

SEQ ID NO: 1344339 - DNA, 22 bp, Artificial Sequence
  chemically synthesized
tgtttgatttctgtgtactttc

SEQ ID NO: 1344340 - DNA, 22 bp, Artificial Sequence
  chemically synthesized
taaagctatgaaagtacacaga

SEQ ID NO: 1344341 - DNA, 22 bp, Artificial Sequence
  chemically synthesized
aatgagctatgtttgatttctg

SEQ ID NO: 1344342 - DNA, 22 bp, Artificial Sequence
  chemically synthesized
tgaaagtacacagaaatcaaac

SEQ ID NO: 1344343 - DNA, 22 bp, Artificial Sequence
  chemically synthesized
atctaaatgagctatgtttgat

SEQ ID NO: 1344344 - DNA, 22 bp, Artificial Sequence
  chemically synthesized
tgcctgatctaaatgagctatg

SEQ ID NO: 1344345 - DNA, 22 bp, Artificial Sequence
  chemically synthesized
taataattatgcctgatctaaa

SEQ ID NO: 1344346 - DNA, 22 bp, Artificial Sequence
  chemically synthesized
ttataataattatgcctgatct

SEQ ID NO: 1344347 - DNA, 22 bp, Artificial Sequence
  chemically synthesized
attataataattatgcctgatc

SEQ ID NO: 1344348 - DNA, 22 bp, Artificial Sequence
  chemically synthesized
tattataataattatgcctgat

SEQ ID NO: 1344349 - DNA, 22 bp, Artificial Sequence
  chemically synthesized
ttattataataattatgcctga

SEQ ID NO: 1344350 - DNA, 22 bp, Artificial Sequence
  chemically synthesized
tttattataataattatgcctg

SEQ ID NO: 1344351 - DNA, 22 bp, Artificial Sequence
  chemically synthesized
atttagatcaggcataattatt

SEQ ID NO: 1344352 - DNA, 22 bp, Artificial Sequence
  chemically synthesized
agatcaggcataattattataa

SEQ ID NO: 1344353 - DNA, 22 bp, Artificial Sequence
  chemically synthesized
gatcaggcataattattataat

SEQ ID NO: 1344354 - DNA, 22 bp, Artificial Sequence
  chemically synthesized
ttataataaaaagtcattatct

SEQ ID NO: 1344355 - DNA, 22 bp, Artificial Sequence
  chemically synthesized
tgtgaggccataagataatgac

SEQ ID NO: 1344356 - DNA, 22 bp, Artificial Sequence
  chemically synthesized
taataaaaagtcattatcttat

SEQ ID NO: 1344357 - DNA, 22 bp, Artificial Sequence
  chemically synthesized
tcttatggcctcacataatatt

SEQ ID NO: 1344358 - DNA, 22 bp, Artificial Sequence
  chemically synthesized
atggcctcacataatattattg

SEQ ID NO: 1344359 - DNA, 22 bp, Artificial Sequence
  chemically synthesized
tggcctcacataatattattgc

SEQ ID NO: 1344360 - DNA, 22 bp, Artificial Sequence
  chemically synthesized
acataatattattgcctatata

SEQ ID NO: 1344361 - DNA, 22 bp, Artificial Sequence
  chemically synthesized
tgaaggaccaacacagaaatat

SEQ ID NO: 1344362 - DNA, 22 bp, Artificial Sequence
  chemically synthesized
ttgcctatatatttctgtgttg

SEQ ID NO: 1344363 - DNA, 22 bp, Artificial Sequence
  chemically synthesized
cctatatatttctgtgttggtc

SEQ ID NO: 1344364 - DNA, 22 bp, Artificial Sequence
  chemically synthesized
tatatttctgtgttggtccttc

SEQ ID NO: 1344365 - DNA, 22 bp, Artificial Sequence
  chemically synthesized
ctgtgttggtccttcataatac

SEQ ID NO: 1344366 - DNA, 22 bp, Artificial Sequence
  chemically synthesized
tgtgttggtccttcataatact

SEQ ID NO: 1344367 - DNA, 22 bp, Artificial Sequence
  chemically synthesized
catgtaaatccaagtattatga

SEQ ID NO: 1344368 - DNA, 22 bp, Artificial Sequence
  chemically synthesized
tgttggtccttcataatacttg

SEQ ID NO: 1344369 - DNA, 22 bp, Artificial Sequence
  chemically synthesized
tgcatgtaaatccaagtattat

SEQ ID NO: 1344370 - DNA, 22 bp, Artificial Sequence
  chemically synthesized
gtccttcataatacttggattt

SEQ ID NO: 1344371 - DNA, 22 bp, Artificial Sequence
  chemically synthesized
cataatacttggatttacatgc

SEQ ID NO: 1344372 - DNA, 22 bp, Artificial Sequence
  chemically synthesized
ataatacttggatttacatgca

SEQ ID NO: 1344373 - DNA, 22 bp, Artificial Sequence
  chemically synthesized
ggatttacatgcagaattgtat

SEQ ID NO: 1344374 - DNA, 22 bp, Artificial Sequence
  chemically synthesized
gatttacatgcagaattgtata

SEQ ID NO: 1344375 - DNA, 22 bp, Artificial Sequence
  chemically synthesized
aaatatgatacagaaatataca

SEQ ID NO: 1344376 - DNA, 22 bp, Artificial Sequence
  chemically synthesized
acatgcagaattgtatatttct

SEQ ID NO: 1344377 - DNA, 22 bp, Artificial Sequence
  chemically synthesized
aaaatatgatacagaaatatac

SEQ ID NO: 1344378 - DNA, 22 bp, Artificial Sequence
  chemically synthesized
catgcagaattgtatatttctg

SEQ ID NO: 1344379 - DNA, 22 bp, Artificial Sequence
  chemically synthesized
cagagcacttaaaatatgatac

SEQ ID NO: 1344380 - DNA, 22 bp, Artificial Sequence
  chemically synthesized
tatatttctgtatcatatttta

SEQ ID NO: 1344381 - DNA, 22 bp, Artificial Sequence
  chemically synthesized
atgcattacagagcacttaaaa

SEQ ID NO: 1344382 - DNA, 22 bp, Artificial Sequence
  chemically synthesized
ctgtatcatattttaagtgctc

SEQ ID NO: 1344383 - DNA, 22 bp, Artificial Sequence
  chemically synthesized
tgtatcatattttaagtgctct

SEQ ID NO: 1344384 - DNA, 22 bp, Artificial Sequence
  chemically synthesized
tatcatattttaagtgctctgt

SEQ ID NO: 1344385 - DNA, 22 bp, Artificial Sequence
  chemically synthesized
gcaaataattaatgcattacag

SEQ ID NO: 1344386 - DNA, 22 bp, Artificial Sequence
  chemically synthesized
taagtgctctgtaatgcattaa

SEQ ID NO: 1344387 - DNA, 22 bp, Artificial Sequence
  chemically synthesized
aagtgctctgtaatgcattaat

SEQ ID NO: 1344388 - DNA, 22 bp, Artificial Sequence
  chemically synthesized
agtgctctgtaatgcattaatt

SEQ ID NO: 1344389 - DNA, 22 bp, Artificial Sequence
  chemically synthesized
catgaggctagcaaataattaa

SEQ ID NO: 1344390 - DNA, 22 bp, Artificial Sequence
  chemically synthesized
tgtaatgcattaattatttgct

SEQ ID NO: 1344391 - DNA, 22 bp, Artificial Sequence
  chemically synthesized
taatgcattaattatttgctag

SEQ ID NO: 1344392 - DNA, 22 bp, Artificial Sequence
  chemically synthesized
cagcctacatgaggctagcaaa

SEQ ID NO: 1344393 - DNA, 22 bp, Artificial Sequence
  chemically synthesized
attatttgctagcctcatgtag

SEQ ID NO: 1344394 - DNA, 22 bp, Artificial Sequence
  chemically synthesized
gagagctgcagcctacatgagg

SEQ ID NO: 1344395 - DNA, 22 bp, Artificial Sequence
  chemically synthesized
tttgctagcctcatgtaggctg

SEQ ID NO: 1344396 - DNA, 22 bp, Artificial Sequence
  chemically synthesized
gctagcctcatgtaggctgcag

SEQ ID NO: 1344397 - DNA, 22 bp, Artificial Sequence
  chemically synthesized
aaggctggagagctgcagccta

SEQ ID NO: 1344398 - DNA, 22 bp, Artificial Sequence
  chemically synthesized
ctagcctcatgtaggctgcagc

SEQ ID NO: 1344399 - DNA, 22 bp, Artificial Sequence
  chemically synthesized
aaaggctggagagctgcagcct

SEQ ID NO: 1344400 - DNA, 22 bp, Artificial Sequence
  chemically synthesized
gcctcatgtaggctgcagctct

SEQ ID NO: 1344401 - DNA, 22 bp, Artificial Sequence
  chemically synthesized
aacttaaaggctggagagctgc

SEQ ID NO: 1344402 - DNA, 22 bp, Artificial Sequence
  chemically synthesized
atgtaggctgcagctctccagc

SEQ ID NO: 1344403 - DNA, 22 bp, Artificial Sequence
  chemically synthesized
gcatatgactgaacttaaaggc

SEQ ID NO: 1344404 - DNA, 22 bp, Artificial Sequence
  chemically synthesized
cagctctccagcctttaagttc

SEQ ID NO: 1344405 - DNA, 22 bp, Artificial Sequence
  chemically synthesized
aggttggcatatgactgaactt

SEQ ID NO: 1344406 - DNA, 22 bp, Artificial Sequence
  chemically synthesized
caggttggcatatgactgaact

SEQ ID NO: 1344407 - DNA, 22 bp, Artificial Sequence
  chemically synthesized
tccagcctttaagttcagtcat

SEQ ID NO: 1344408 - DNA, 22 bp, Artificial Sequence
  chemically synthesized
ttcaggttggcatatgactgaa

SEQ ID NO: 1344409 - DNA, 22 bp, Artificial Sequence
  chemically synthesized
cagcctttaagttcagtcatat

SEQ ID NO: 1344410 - DNA, 22 bp, Artificial Sequence
  chemically synthesized
acgttcttcaggttggcatatg

SEQ ID NO: 1344411 - DNA, 22 bp, Artificial Sequence
  chemically synthesized
taagttcagtcatatgccaacc

SEQ ID NO: 1344412 - DNA, 22 bp, Artificial Sequence
  chemically synthesized
aagttcagtcatatgccaacct

SEQ ID NO: 1344413 - DNA, 22 bp, Artificial Sequence
  chemically synthesized
agttcagtcatatgccaacctg

SEQ ID NO: 1344414 - DNA, 22 bp, Artificial Sequence
  chemically synthesized
aatccctcacgttcttcaggtt

SEQ ID NO: 1344415 - DNA, 22 bp, Artificial Sequence
  chemically synthesized
agtcatatgccaacctgaagaa

SEQ ID NO: 1344416 - DNA, 22 bp, Artificial Sequence
  chemically synthesized
tcaatccctcacgttcttcagg

SEQ ID NO: 1344417 - DNA, 22 bp, Artificial Sequence
  chemically synthesized
tctcaatccctcacgttcttca

SEQ ID NO: 1344418 - DNA, 22 bp, Artificial Sequence
  chemically synthesized
agacactctctcaatccctcac

SEQ ID NO: 1344419 - DNA, 22 bp, Artificial Sequence
  chemically synthesized
aagacactctctcaatccctca

SEQ ID NO: 1344420 - DNA, 22 bp, Artificial Sequence
  chemically synthesized
atttaagacactctctcaatcc

SEQ ID NO: 1344421 - DNA, 22 bp, Artificial Sequence
  chemically synthesized
aagaacgtgagggattgagaga

SEQ ID NO: 1344422 - DNA, 22 bp, Artificial Sequence
  chemically synthesized
tcatttaagacactctctcaat

SEQ ID NO: 1344423 - DNA, 22 bp, Artificial Sequence
  chemically synthesized
tctcatttaagacactctctca

SEQ ID NO: 1344424 - DNA, 22 bp, Artificial Sequence
  chemically synthesized
ctctcatttaagacactctctc

SEQ ID NO: 1344425 - DNA, 22 bp, Artificial Sequence
  chemically synthesized
agagagtgtcttaaatgagaga

SEQ ID NO: 1344426 - DNA, 22 bp, Artificial Sequence
  chemically synthesized
gccaccatgggcttctctcatt

SEQ ID NO: 1344427 - DNA, 22 bp, Artificial Sequence
  chemically synthesized
atgaagctggccaccatgggct

SEQ ID NO: 1344428 - DNA, 22 bp, Artificial Sequence
  chemically synthesized
aaatgagagaagcccatggtgg

SEQ ID NO: 1344429 - DNA, 22 bp, Artificial Sequence
  chemically synthesized
tgatgaagctggccaccatggg

SEQ ID NO: 1344430 - DNA, 22 bp, Artificial Sequence
  chemically synthesized
aatgagagaagcccatggtggc

SEQ ID NO: 1344431 - DNA, 22 bp, Artificial Sequence
  chemically synthesized
ctgatgaagctggccaccatgg

SEQ ID NO: 1344432 - DNA, 22 bp, Artificial Sequence
  chemically synthesized
ggtttctgatgaagctggccac

SEQ ID NO: 1344433 - DNA, 22 bp, Artificial Sequence
  chemically synthesized
gcgaaaaccagagccacactag

SEQ ID NO: 1344434 - DNA, 22 bp, Artificial Sequence
  chemically synthesized
catcagaaacctagtgtggctc

SEQ ID NO: 1344435 - DNA, 22 bp, Artificial Sequence
  chemically synthesized
atcagaaacctagtgtggctct

SEQ ID NO: 1344436 - DNA, 22 bp, Artificial Sequence
  chemically synthesized
gtgtggctctggttttcgccag

SEQ ID NO: 1344437 - DNA, 22 bp, Artificial Sequence
  chemically synthesized
tggttttcgccaggttctttgt

SEQ ID NO: 1344438 - DNA, 22 bp, Artificial Sequence
  chemically synthesized
gttttcgccaggttctttgttc

SEQ ID NO: 1344439 - DNA, 22 bp, Artificial Sequence
  chemically synthesized
tcgccaggttctttgttccttg

SEQ ID NO: 1344440 - DNA, 22 bp, Artificial Sequence
  chemically synthesized
cgccaggttctttgttccttgt

SEQ ID NO: 1344441 - DNA, 22 bp, Artificial Sequence
  chemically synthesized
gccaggttctttgttccttgtg

SEQ ID NO: 1344442 - DNA, 22 bp, Artificial Sequence
  chemically synthesized
tttgttccttgtgactcattct

SEQ ID NO: 1344443 - DNA, 22 bp, Artificial Sequence
  chemically synthesized
tgttccttgtgactcattctct

SEQ ID NO: 1344444 - DNA, 22 bp, Artificial Sequence
  chemically synthesized
gttccttgtgactcattctctg

SEQ ID NO: 1344445 - DNA, 22 bp, Artificial Sequence
  chemically synthesized
ttccttgtgactcattctctgc

SEQ ID NO: 1344446 - DNA, 22 bp, Artificial Sequence
  chemically synthesized
cttgtgactcattctctgcctt

SEQ ID NO: 1344447 - DNA, 22 bp, Artificial Sequence
  chemically synthesized
gtgactcattctctgccttgca

SEQ ID NO: 1344448 - DNA, 22 bp, Artificial Sequence
  chemically synthesized
tgactcattctctgccttgcat

SEQ ID NO: 1344449 - DNA, 22 bp, Artificial Sequence
  chemically synthesized
aggggaccgaatagacaatgca

SEQ ID NO: 1344450 - DNA, 22 bp, Artificial Sequence
  chemically synthesized
attctctgccttgcattgtcta

SEQ ID NO: 1344451 - DNA, 22 bp, Artificial Sequence
  chemically synthesized
tctgccttgcattgtctattcg

SEQ ID NO: 1344452 - DNA, 22 bp, Artificial Sequence
  chemically synthesized
tgccttgcattgtctattcggt

SEQ ID NO: 1344453 - DNA, 22 bp, Artificial Sequence
  chemically synthesized
ccttgcattgtctattcggtcc

SEQ ID NO: 1344454 - DNA, 22 bp, Artificial Sequence
  chemically synthesized
ggacaggcctgaggggaccgaa

SEQ ID NO: 1344455 - DNA, 22 bp, Artificial Sequence
  chemically synthesized
gcattgtctattcggtcccctc

SEQ ID NO: 1344456 - DNA, 22 bp, Artificial Sequence
  chemically synthesized
cattgtctattcggtcccctca

SEQ ID NO: 1344457 - DNA, 22 bp, Artificial Sequence
  chemically synthesized
cagctaggacaggcctgagggg

SEQ ID NO: 1344458 - DNA, 22 bp, Artificial Sequence
  chemically synthesized
ccagctaggacaggcctgaggg

SEQ ID NO: 1344459 - DNA, 22 bp, Artificial Sequence
  chemically synthesized
tctattcggtcccctcaggcct

SEQ ID NO: 1344460 - DNA, 22 bp, Artificial Sequence
  chemically synthesized
tccagctaggacaggcctgagg

SEQ ID NO: 1344461 - DNA, 22 bp, Artificial Sequence
  chemically synthesized
tttccagctaggacaggcctga

SEQ ID NO: 1344462 - DNA, 22 bp, Artificial Sequence
  chemically synthesized
ttcggtcccctcaggcctgtcc

SEQ ID NO: 1344463 - DNA, 22 bp, Artificial Sequence
  chemically synthesized
ggtcccctcaggcctgtcctag

SEQ ID NO: 1344464 - DNA, 22 bp, Artificial Sequence
  chemically synthesized
aggcctgtcctagctggaaaga

SEQ ID NO: 1344465 - DNA, 22 bp, Artificial Sequence
  chemically synthesized
tcctagctggaaagagctctct

SEQ ID NO: 1344466 - DNA, 22 bp, Artificial Sequence
  chemically synthesized
gctggaaagagctctctttact

SEQ ID NO: 1344467 - DNA, 22 bp, Artificial Sequence
  chemically synthesized
gaaagagctctctttacttcct

SEQ ID NO: 1344468 - DNA, 22 bp, Artificial Sequence
  chemically synthesized
tctttacttcctgatcccatct

SEQ ID NO: 1344469 - DNA, 22 bp, Artificial Sequence
  chemically synthesized
tttacttcctgatcccatctgt

SEQ ID NO: 1344470 - DNA, 22 bp, Artificial Sequence
  chemically synthesized
tacttcctgatcccatctgttc

SEQ ID NO: 1344471 - DNA, 22 bp, Artificial Sequence
  chemically synthesized
acttcctgatcccatctgttcc

SEQ ID NO: 1344472 - DNA, 22 bp, Artificial Sequence
  chemically synthesized
cttcctgatcccatctgttcct

SEQ ID NO: 1344473 - DNA, 22 bp, Artificial Sequence
  chemically synthesized
cctgatcccatctgttccttga

SEQ ID NO: 1344474 - DNA, 22 bp, Artificial Sequence
  chemically synthesized
ctgatcccatctgttccttgac

SEQ ID NO: 1344475 - DNA, 22 bp, Artificial Sequence
  chemically synthesized
atcccatctgttccttgacctc

SEQ ID NO: 1344476 - DNA, 22 bp, Artificial Sequence
  chemically synthesized
ttccttgacctcccctctgacc

SEQ ID NO: 1344477 - DNA, 22 bp, Artificial Sequence
  chemically synthesized
cttgacctcccctctgacccac

SEQ ID NO: 1344478 - DNA, 22 bp, Artificial Sequence
  chemically synthesized
agcatgcccagtggtgggtcag

SEQ ID NO: 1344479 - DNA, 22 bp, Artificial Sequence
  chemically synthesized
gacctcccctctgacccaccac

SEQ ID NO: 1344480 - DNA, 22 bp, Artificial Sequence
  chemically synthesized
tgagcatgcccagtggtgggtc

SEQ ID NO: 1344481 - DNA, 22 bp, Artificial Sequence
  chemically synthesized
acctcccctctgacccaccact

SEQ ID NO: 1344482 - DNA, 22 bp, Artificial Sequence
  chemically synthesized
ttctgagcatgcccagtggtgg

SEQ ID NO: 1344483 - DNA, 22 bp, Artificial Sequence
  chemically synthesized
ccctctgacccaccactgggca

SEQ ID NO: 1344484 - DNA, 22 bp, Artificial Sequence
  chemically synthesized
ctattctgagcatgcccagtgg

SEQ ID NO: 1344485 - DNA, 22 bp, Artificial Sequence
  chemically synthesized
cctattctgagcatgcccagtg

SEQ ID NO: 1344486 - DNA, 22 bp, Artificial Sequence
  chemically synthesized
tgacccaccactgggcatgctc

SEQ ID NO: 1344487 - DNA, 22 bp, Artificial Sequence
  chemically synthesized
acccaccactgggcatgctcag

SEQ ID NO: 1344488 - DNA, 22 bp, Artificial Sequence
  chemically synthesized
tggcacaatttcctattctgag

SEQ ID NO: 1344489 - DNA, 22 bp, Artificial Sequence
  chemically synthesized
ttatggcacaatttcctattct

SEQ ID NO: 1344490 - DNA, 22 bp, Artificial Sequence
  chemically synthesized
ggcatgctcagaataggaaatt

SEQ ID NO: 1344491 - DNA, 22 bp, Artificial Sequence
  chemically synthesized
tctattatggcacaatttccta

SEQ ID NO: 1344492 - DNA, 22 bp, Artificial Sequence
  chemically synthesized
agaataggaaattgtgccataa

SEQ ID NO: 1344493 - DNA, 22 bp, Artificial Sequence
  chemically synthesized
tgccataatagataatcctgac

SEQ ID NO: 1344494 - DNA, 22 bp, Artificial Sequence
  chemically synthesized
acatgaagaaatggaacagagt

SEQ ID NO: 1344495 - DNA, 22 bp, Artificial Sequence
  chemically synthesized
actaacatgaagaaatggaaca

SEQ ID NO: 1344496 - DNA, 22 bp, Artificial Sequence
  chemically synthesized
acactctgttccatttcttcat

SEQ ID NO: 1344497 - DNA, 22 bp, Artificial Sequence
  chemically synthesized
aatggtaattaactaacatgaa

SEQ ID NO: 1344498 - DNA, 22 bp, Artificial Sequence
  chemically synthesized
tgttccatttcttcatgttagt

SEQ ID NO: 1344499 - DNA, 22 bp, Artificial Sequence
  chemically synthesized
gaatggtaattaactaacatga

SEQ ID NO: 1344500 - DNA, 22 bp, Artificial Sequence
  chemically synthesized
ttccatttcttcatgttagtta

SEQ ID NO: 1344501 - DNA, 22 bp, Artificial Sequence
  chemically synthesized
catttcttcatgttagttaatt

SEQ ID NO: 1344502 - DNA, 22 bp, Artificial Sequence
  chemically synthesized
aagaccttgaatggtaattaac

SEQ ID NO: 1344503 - DNA, 22 bp, Artificial Sequence
  chemically synthesized
cttcatgttagttaattaccat

SEQ ID NO: 1344504 - DNA, 22 bp, Artificial Sequence
  chemically synthesized
ttcatgttagttaattaccatt

SEQ ID NO: 1344505 - DNA, 22 bp, Artificial Sequence
  chemically synthesized
catgttagttaattaccattca

SEQ ID NO: 1344506 - DNA, 22 bp, Artificial Sequence
  chemically synthesized
atgttagttaattaccattcaa

SEQ ID NO: 1344507 - DNA, 22 bp, Artificial Sequence
  chemically synthesized
atgtaggcctcaagaccttgaa

SEQ ID NO: 1344508 - DNA, 22 bp, Artificial Sequence
  chemically synthesized
gttaattaccattcaaggtctt

SEQ ID NO: 1344509 - DNA, 22 bp, Artificial Sequence
  chemically synthesized
attaccattcaaggtcttgagg

SEQ ID NO: 1344510 - DNA, 22 bp, Artificial Sequence
  chemically synthesized
ccattcaaggtcttgaggccta

SEQ ID NO: 1344511 - DNA, 22 bp, Artificial Sequence
  chemically synthesized
agagcagttaatgtaggcctca

SEQ ID NO: 1344512 - DNA, 22 bp, Artificial Sequence
  chemically synthesized
aagagcagttaatgtaggcctc

SEQ ID NO: 1344513 - DNA, 22 bp, Artificial Sequence
  chemically synthesized
aaggtcttgaggcctacattaa

SEQ ID NO: 1344514 - DNA, 22 bp, Artificial Sequence
  chemically synthesized
acatttaagagcagttaatgta

SEQ ID NO: 1344515 - DNA, 22 bp, Artificial Sequence
  chemically synthesized
gaggcctacattaactgctctt

SEQ ID NO: 1344516 - DNA, 22 bp, Artificial Sequence
  chemically synthesized
aggcctacattaactgctctta

SEQ ID NO: 1344517 - DNA, 22 bp, Artificial Sequence
  chemically synthesized
cattaactgctcttaaatgtca

SEQ ID NO: 1344518 - DNA, 22 bp, Artificial Sequence
  chemically synthesized
actgctcttaaatgtcaggtct

SEQ ID NO: 1344519 - DNA, 22 bp, Artificial Sequence
  chemically synthesized
ctcttaaatgtcaggtctatgt

SEQ ID NO: 1344520 - DNA, 22 bp, Artificial Sequence
  chemically synthesized
ttaaatgtcaggtctatgtacc

SEQ ID NO: 1344521 - DNA, 22 bp, Artificial Sequence
  chemically synthesized
aaatgtcaggtctatgtaccta

SEQ ID NO: 1344522 - DNA, 22 bp, Artificial Sequence
  chemically synthesized
cataacaggcaataggtacata

SEQ ID NO: 1344523 - DNA, 22 bp, Artificial Sequence
  chemically synthesized
aatgtcaggtctatgtacctat

SEQ ID NO: 1344524 - DNA, 22 bp, Artificial Sequence
  chemically synthesized
ctccataacaggcaataggtac

SEQ ID NO: 1344525 - DNA, 22 bp, Artificial Sequence
  chemically synthesized
tgtacctattgcctgttatgga

SEQ ID NO: 1344526 - DNA, 22 bp, Artificial Sequence
  chemically synthesized
gtcaccaacaggcctgctccat

SEQ ID NO: 1344527 - DNA, 22 bp, Artificial Sequence
  chemically synthesized
ggtcaccaacaggcctgctcca

SEQ ID NO: 1344528 - DNA, 22 bp, Artificial Sequence
  chemically synthesized
tggtcaccaacaggcctgctcc

SEQ ID NO: 1344529 - DNA, 22 bp, Artificial Sequence
  chemically synthesized
ttgcctgttatggagcaggcct

SEQ ID NO: 1344530 - DNA, 22 bp, Artificial Sequence
  chemically synthesized
ctttggtcaccaacaggcctgc

SEQ ID NO: 1344531 - DNA, 22 bp, Artificial Sequence
  chemically synthesized
cctgttatggagcaggcctgtt

SEQ ID NO: 1344532 - DNA, 22 bp, Artificial Sequence
  chemically synthesized
ttatggagcaggcctgttggtg

SEQ ID NO: 1344533 - DNA, 22 bp, Artificial Sequence
  chemically synthesized
tgctgctttggtcaccaacagg

SEQ ID NO: 1344534 - DNA, 22 bp, Artificial Sequence
  chemically synthesized
tggagcaggcctgttggtgacc

SEQ ID NO: 1344535 - DNA, 22 bp, Artificial Sequence
  chemically synthesized
ggttatgctgctttggtcacca

SEQ ID NO: 1344536 - DNA, 22 bp, Artificial Sequence
  chemically synthesized
ttggtgaccaaagcagcataac

SEQ ID NO: 1344537 - DNA, 22 bp, Artificial Sequence
  chemically synthesized
gtgaccaaagcagcataaccta

SEQ ID NO: 1344538 - DNA, 22 bp, Artificial Sequence
  chemically synthesized
agcaacagatgctaggttatgc

SEQ ID NO: 1344539 - DNA, 22 bp, Artificial Sequence
  chemically synthesized
ggacatgatatctgagcaacag

SEQ ID NO: 1344540 - DNA, 22 bp, Artificial Sequence
  chemically synthesized
gcatctgttgctcagatatcat

SEQ ID NO: 1344541 - DNA, 22 bp, Artificial Sequence
  chemically synthesized
gggtgctgggacatgatatctg

SEQ ID NO: 1344542 - DNA, 22 bp, Artificial Sequence
  chemically synthesized
attggggtgctgggacatgata

SEQ ID NO: 1344543 - DNA, 22 bp, Artificial Sequence
  chemically synthesized
ttgctcagatatcatgtcccag

SEQ ID NO: 1344544 - DNA, 22 bp, Artificial Sequence
  chemically synthesized
ctcagatatcatgtcccagcac

SEQ ID NO: 1344545 - DNA, 22 bp, Artificial Sequence
  chemically synthesized
agatatcatgtcccagcacccc

SEQ ID NO: 1344546 - DNA, 22 bp, Artificial Sequence
  chemically synthesized
gggcaattaattggggtgctgg

SEQ ID NO: 1344547 - DNA, 22 bp, Artificial Sequence
  chemically synthesized
gggctagggcaattaattgggg

SEQ ID NO: 1344548 - DNA, 22 bp, Artificial Sequence
  chemically synthesized
gactagggctagggcaattaat

SEQ ID NO: 1344549 - DNA, 22 bp, Artificial Sequence
  chemically synthesized
gctagactagggctagggcaat

SEQ ID NO: 1344550 - DNA, 22 bp, Artificial Sequence
  chemically synthesized
aagactggctagactagggcta

SEQ ID NO: 1344551 - DNA, 22 bp, Artificial Sequence
  chemically synthesized
tgaagactggctagactagggc

SEQ ID NO: 1344552 - DNA, 22 bp, Artificial Sequence
  chemically synthesized
attgccctagccctagtctagc

SEQ ID NO: 1344553 - DNA, 22 bp, Artificial Sequence
  chemically synthesized
agttctgaagactggctagact

SEQ ID NO: 1344554 - DNA, 22 bp, Artificial Sequence
  chemically synthesized
ccctagccctagtctagccagt

SEQ ID NO: 1344555 - DNA, 22 bp, Artificial Sequence
  chemically synthesized
gccctagtctagccagtcttca

SEQ ID NO: 1344556 - DNA, 22 bp, Artificial Sequence
  chemically synthesized
gtctagccagtcttcagaactg

SEQ ID NO: 1344557 - DNA, 22 bp, Artificial Sequence
  chemically synthesized
gccagtcttcagaactgaatca

SEQ ID NO: 1344558 - DNA, 22 bp, Artificial Sequence
  chemically synthesized
catacagaccaaataaataatg

SEQ ID NO: 1344559 - DNA, 22 bp, Artificial Sequence
  chemically synthesized
cagaactgaatcattatttatt

SEQ ID NO: 1344560 - DNA, 22 bp, Artificial Sequence
  chemically synthesized
gcatacagaccaaataaataat

SEQ ID NO: 1344561 - DNA, 22 bp, Artificial Sequence
  chemically synthesized
agaactgaatcattatttattt

SEQ ID NO: 1344562 - DNA, 22 bp, Artificial Sequence
  chemically synthesized
gtttgcatacagaccaaataaa

SEQ ID NO: 1344563 - DNA, 22 bp, Artificial Sequence
  chemically synthesized
ggtttgcatacagaccaaataa

SEQ ID NO: 1344564 - DNA, 22 bp, Artificial Sequence
  chemically synthesized
aatcattatttatttggtctgt

SEQ ID NO: 1344565 - DNA, 22 bp, Artificial Sequence
  chemically synthesized
aatggggtttggtttgcataca

SEQ ID NO: 1344566 - DNA, 22 bp, Artificial Sequence
  chemically synthesized
tttatttggtctgtatgcaaac

SEQ ID NO: 1344567 - DNA, 22 bp, Artificial Sequence
  chemically synthesized
aaatggggtttggtttgcatac

SEQ ID NO: 1344568 - DNA, 22 bp, Artificial Sequence
  chemically synthesized
atttggtctgtatgcaaaccaa

SEQ ID NO: 1344569 - DNA, 22 bp, Artificial Sequence
  chemically synthesized
tttggtctgtatgcaaaccaaa

SEQ ID NO: 1344570 - DNA, 22 bp, Artificial Sequence
  chemically synthesized
ggtctgtatgcaaaccaaaccc

SEQ ID NO: 1344571 - DNA, 22 bp, Artificial Sequence
  chemically synthesized
gtctgtatgcaaaccaaacccc

SEQ ID NO: 1344572 - DNA, 22 bp, Artificial Sequence
  chemically synthesized
tatgcaaaccaaaccccattta

SEQ ID NO: 1344573 - DNA, 22 bp, Artificial Sequence
  chemically synthesized
ggtagatgaatgtgatttaaat

SEQ ID NO: 1344574 - DNA, 22 bp, Artificial Sequence
  chemically synthesized
aaatcacattcatctacccagg

SEQ ID NO: 1344575 - DNA, 22 bp, Artificial Sequence
  chemically synthesized
ataaatgagagtcctgggtaga

SEQ ID NO: 1344576 - DNA, 22 bp, Artificial Sequence
  chemically synthesized
aatcacattcatctacccagga

SEQ ID NO: 1344577 - DNA, 22 bp, Artificial Sequence
  chemically synthesized
attgataaatgagagtcctggg

SEQ ID NO: 1344578 - DNA, 22 bp, Artificial Sequence
  chemically synthesized
gattgataaatgagagtcctgg

SEQ ID NO: 1344579 - DNA, 22 bp, Artificial Sequence
  chemically synthesized
atctacccaggactctcattta

SEQ ID NO: 1344580 - DNA, 22 bp, Artificial Sequence
  chemically synthesized
cccaggactctcatttatcaat

SEQ ID NO: 1344581 - DNA, 22 bp, Artificial Sequence
  chemically synthesized
aaatgtcagtttgattgataaa

SEQ ID NO: 1344582 - DNA, 22 bp, Artificial Sequence
  chemically synthesized
aaaatgtcagtttgattgataa

SEQ ID NO: 1344583 - DNA, 22 bp, Artificial Sequence
  chemically synthesized
acatttaaaatgtcagtttgat

SEQ ID NO: 1344584 - DNA, 22 bp, Artificial Sequence
  chemically synthesized
tcatttatcaatcaaactgaca

SEQ ID NO: 1344585 - DNA, 22 bp, Artificial Sequence
  chemically synthesized
atttatcaatcaaactgacatt

SEQ ID NO: 1344586 - DNA, 22 bp, Artificial Sequence
  chemically synthesized
atctgacatttaaaatgtcagt

SEQ ID NO: 1344587 - DNA, 22 bp, Artificial Sequence
  chemically synthesized
atcaatcaaactgacattttaa

SEQ ID NO: 1344588 - DNA, 22 bp, Artificial Sequence
  chemically synthesized
tcaatcaaactgacattttaaa

SEQ ID NO: 1344589 - DNA, 22 bp, Artificial Sequence
  chemically synthesized
acattttaaatgtcagatgagt

SEQ ID NO: 1344590 - DNA, 22 bp, Artificial Sequence
  chemically synthesized
aaaggatataccataactcatc

SEQ ID NO: 1344591 - DNA, 22 bp, Artificial Sequence
  chemically synthesized
taaatgtcagatgagttatggt

SEQ ID NO: 1344592 - DNA, 22 bp, Artificial Sequence
  chemically synthesized
aaatgtcagatgagttatggta

SEQ ID NO: 1344593 - DNA, 22 bp, Artificial Sequence
  chemically synthesized
aatgtcagatgagttatggtat

SEQ ID NO: 1344594 - DNA, 22 bp, Artificial Sequence
  chemically synthesized
tcatgatcactcaaaggatata

SEQ ID NO: 1344595 - DNA, 22 bp, Artificial Sequence
  chemically synthesized
tggtatatcctttgagtgatca

SEQ ID NO: 1344596 - DNA, 22 bp, Artificial Sequence
  chemically synthesized
aatatgagggaatgttatcatg

SEQ ID NO: 1344597 - DNA, 22 bp, Artificial Sequence
  chemically synthesized
ctaaatatgagggaatgttatc

SEQ ID NO: 1344598 - DNA, 22 bp, Artificial Sequence
  chemically synthesized
tgagtgatcatgataacattcc

SEQ ID NO: 1344599 - DNA, 22 bp, Artificial Sequence
  chemically synthesized
gagtgatcatgataacattccc

SEQ ID NO: 1344600 - DNA, 22 bp, Artificial Sequence
  chemically synthesized
agtgatcatgataacattccct

SEQ ID NO: 1344601 - DNA, 22 bp, Artificial Sequence
  chemically synthesized
tctcctaaatatgagggaatgt

SEQ ID NO: 1344602 - DNA, 22 bp, Artificial Sequence
  chemically synthesized
atctcctaaatatgagggaatg

SEQ ID NO: 1344603 - DNA, 22 bp, Artificial Sequence
  chemically synthesized
cctcatatttaggagataaact

SEQ ID NO: 1344604 - DNA, 22 bp, Artificial Sequence
  chemically synthesized
atgtatgcagacagtttatctc

SEQ ID NO: 1344605 - DNA, 22 bp, Artificial Sequence
  chemically synthesized
atatttaggagataaactgtct

SEQ ID NO: 1344606 - DNA, 22 bp, Artificial Sequence
  chemically synthesized
aaaatattgatgtatgcagaca

SEQ ID NO: 1344607 - DNA, 22 bp, Artificial Sequence
  chemically synthesized
aggagataaactgtctgcatac

SEQ ID NO: 1344608 - DNA, 22 bp, Artificial Sequence
  chemically synthesized
aaaaatattgatgtatgcagac

SEQ ID NO: 1344609 - DNA, 22 bp, Artificial Sequence
  chemically synthesized
ggagataaactgtctgcataca

SEQ ID NO: 1344610 - DNA, 22 bp, Artificial Sequence
  chemically synthesized
ggtgtttaaaaatattgatgta

SEQ ID NO: 1344611 - DNA, 22 bp, Artificial Sequence
  chemically synthesized
cggtgtttaaaaatattgatgt

SEQ ID NO: 1344612 - DNA, 22 bp, Artificial Sequence
  chemically synthesized
cttcggtgtttaaaaatattga

SEQ ID NO: 1344613 - DNA, 22 bp, Artificial Sequence
  chemically synthesized
acttcggtgtttaaaaatattg

SEQ ID NO: 1344614 - DNA, 22 bp, Artificial Sequence
  chemically synthesized
tctgcatacatcaatattttta

SEQ ID NO: 1344615 - DNA, 22 bp, Artificial Sequence
  chemically synthesized
catacatcaatatttttaaaca

SEQ ID NO: 1344616 - DNA, 22 bp, Artificial Sequence
  chemically synthesized
acacttacttcggtgtttaaaa

SEQ ID NO: 1344617 - DNA, 22 bp, Artificial Sequence
  chemically synthesized
gacacttacttcggtgtttaaa

SEQ ID NO: 1344618 - DNA, 22 bp, Artificial Sequence
  chemically synthesized
tgacacttacttcggtgtttaa

SEQ ID NO: 1344619 - DNA, 22 bp, Artificial Sequence
  chemically synthesized
agacctttgacacttacttcgg

SEQ ID NO: 1344620 - DNA, 22 bp, Artificial Sequence
  chemically synthesized
cagacctttgacacttacttcg

SEQ ID NO: 1344621 - DNA, 22 bp, Artificial Sequence
  chemically synthesized
tcagacctttgacacttacttc

SEQ ID NO: 1344622 - DNA, 22 bp, Artificial Sequence
  chemically synthesized
ttaaacaccgaagtaagtgtca

SEQ ID NO: 1344623 - DNA, 22 bp, Artificial Sequence
  chemically synthesized
taaacaccgaagtaagtgtcaa

SEQ ID NO: 1344624 - DNA, 22 bp, Artificial Sequence
  chemically synthesized
attttcagacctttgacactta

SEQ ID NO: 1344625 - DNA, 22 bp, Artificial Sequence
  chemically synthesized
aaacaccgaagtaagtgtcaaa

SEQ ID NO: 1344626 - DNA, 22 bp, Artificial Sequence
  chemically synthesized
aacaccgaagtaagtgtcaaag

SEQ ID NO: 1344627 - DNA, 22 bp, Artificial Sequence
  chemically synthesized
atcattaattttcagacctttg

SEQ ID NO: 1344628 - DNA, 22 bp, Artificial Sequence
  chemically synthesized
catcattaattttcagaccttt

SEQ ID NO: 1344629 - DNA, 22 bp, Artificial Sequence
  chemically synthesized
aagtgataaatttcatcattaa

SEQ ID NO: 1344630 - DNA, 22 bp, Artificial Sequence
  chemically synthesized
aaaattaatgatgaaatttatc

SEQ ID NO: 1344631 - DNA, 22 bp, Artificial Sequence
  chemically synthesized
atgatgaaatttatcacttcag

SEQ ID NO: 1344632 - DNA, 22 bp, Artificial Sequence
  chemically synthesized
agcatgcagaatactgaagtga

SEQ ID NO: 1344633 - DNA, 22 bp, Artificial Sequence
  chemically synthesized
aagcatgcagaatactgaagtg

SEQ ID NO: 1344634 - DNA, 22 bp, Artificial Sequence
  chemically synthesized
taagcatgcagaatactgaagt

SEQ ID NO: 1344635 - DNA, 22 bp, Artificial Sequence
  chemically synthesized
ttaagcatgcagaatactgaag

SEQ ID NO: 1344636 - DNA, 22 bp, Artificial Sequence
  chemically synthesized
tcttttaagcatgcagaatact

SEQ ID NO: 1344637 - DNA, 22 bp, Artificial Sequence
  chemically synthesized
ctatcttttaagcatgcagaat

SEQ ID NO: 1344638 - DNA, 22 bp, Artificial Sequence
  chemically synthesized
atcacttcagtattctgcatgc

SEQ ID NO: 1344639 - DNA, 22 bp, Artificial Sequence
  chemically synthesized
tcacttcagtattctgcatgct

SEQ ID NO: 1344640 - DNA, 22 bp, Artificial Sequence
  chemically synthesized
cagtattctgcatgcttaaaag

SEQ ID NO: 1344641 - DNA, 22 bp, Artificial Sequence
  chemically synthesized
agtattctgcatgcttaaaaga

SEQ ID NO: 1344642 - DNA, 22 bp, Artificial Sequence
  chemically synthesized
tgcatgcttaaaagataggagt

SEQ ID NO: 1344643 - DNA, 22 bp, Artificial Sequence
  chemically synthesized
gaaggtaggtgtgactcctatc

SEQ ID NO: 1344644 - DNA, 22 bp, Artificial Sequence
  chemically synthesized
catgcttaaaagataggagtca

SEQ ID NO: 1344645 - DNA, 22 bp, Artificial Sequence
  chemically synthesized
ttggaaggtaggtgtgactcct

SEQ ID NO: 1344646 - DNA, 22 bp, Artificial Sequence
  chemically synthesized
aaaagataggagtcacacctac

SEQ ID NO: 1344647 - DNA, 22 bp, Artificial Sequence
  chemically synthesized
aaagataggagtcacacctacc

SEQ ID NO: 1344648 - DNA, 22 bp, Artificial Sequence
  chemically synthesized
taataggttattggaaggtagg

SEQ ID NO: 1344649 - DNA, 22 bp, Artificial Sequence
  chemically synthesized
ataataggttattggaaggtag

SEQ ID NO: 1344650 - DNA, 22 bp, Artificial Sequence
  chemically synthesized
ttataataggttattggaaggt

SEQ ID NO: 1344651 - DNA, 22 bp, Artificial Sequence
  chemically synthesized
gctcttataataggttattgga

SEQ ID NO: 1344652 - DNA, 22 bp, Artificial Sequence
  chemically synthesized
ggctcttataataggttattgg

SEQ ID NO: 1344653 - DNA, 22 bp, Artificial Sequence
  chemically synthesized
tggctcttataataggttattg

SEQ ID NO: 1344654 - DNA, 22 bp, Artificial Sequence
  chemically synthesized
ttggctcttataataggttatt

SEQ ID NO: 1344655 - DNA, 22 bp, Artificial Sequence
  chemically synthesized
ccttccaataacctattataag

SEQ ID NO: 1344656 - DNA, 22 bp, Artificial Sequence
  chemically synthesized
tcatttttggctcttataatag

SEQ ID NO: 1344657 - DNA, 22 bp, Artificial Sequence
  chemically synthesized
ccaataacctattataagagcc

SEQ ID NO: 1344658 - DNA, 22 bp, Artificial Sequence
  chemically synthesized
gctatcatttttggctcttata

SEQ ID NO: 1344659 - DNA, 22 bp, Artificial Sequence
  chemically synthesized
caataacctattataagagcca

SEQ ID NO: 1344660 - DNA, 22 bp, Artificial Sequence
  chemically synthesized
aatgttagctatcatttttggc

SEQ ID NO: 1344661 - DNA, 22 bp, Artificial Sequence
  chemically synthesized
gaatgttagctatcatttttgg

SEQ ID NO: 1344662 - DNA, 22 bp, Artificial Sequence
  chemically synthesized
tgaatgttagctatcatttttg

SEQ ID NO: 1344663 - DNA, 22 bp, Artificial Sequence
  chemically synthesized
ttataagagccaaaaatgatag

SEQ ID NO: 1344664 - DNA, 22 bp, Artificial Sequence
  chemically synthesized
gttttgaatgttagctatcatt

SEQ ID NO: 1344665 - DNA, 22 bp, Artificial Sequence
  chemically synthesized
taagagccaaaaatgatagcta

SEQ ID NO: 1344666 - DNA, 22 bp, Artificial Sequence
  chemically synthesized
tatgatagatacctagttttga

SEQ ID NO: 1344667 - DNA, 22 bp, Artificial Sequence
  chemically synthesized
ttgtatgatagatacctagttt

SEQ ID NO: 1344668 - DNA, 22 bp, Artificial Sequence
  chemically synthesized
gttgtatgatagatacctagtt

SEQ ID NO: 1344669 - DNA, 22 bp, Artificial Sequence
  chemically synthesized
acattcaaaactaggtatctat

SEQ ID NO: 1344670 - DNA, 22 bp, Artificial Sequence
  chemically synthesized
aaaactaggtatctatcataca

SEQ ID NO: 1344671 - DNA, 22 bp, Artificial Sequence
  chemically synthesized
taaaatatttgttgtatgatag

SEQ ID NO: 1344672 - DNA, 22 bp, Artificial Sequence
  chemically synthesized
gtaaaatatttgttgtatgata

SEQ ID NO: 1344673 - DNA, 22 bp, Artificial Sequence
  chemically synthesized
ggtatctatcatacaacaaata

SEQ ID NO: 1344674 - DNA, 22 bp, Artificial Sequence
  chemically synthesized
tcatacaacaaatattttacaa

SEQ ID NO: 1344675 - DNA, 22 bp, Artificial Sequence
  chemically synthesized
tatgagaacatatttgtaaaat

SEQ ID NO: 1344676 - DNA, 22 bp, Artificial Sequence
  chemically synthesized
tacaaatatgttctcatataat

SEQ ID NO: 1344677 - DNA, 22 bp, Artificial Sequence
  chemically synthesized
acaaatatgttctcatataata

SEQ ID NO: 1344678 - DNA, 22 bp, Artificial Sequence
  chemically synthesized
caaatatgttctcatataatat

SEQ ID NO: 1344679 - DNA, 22 bp, Artificial Sequence
  chemically synthesized
tcatataatattcatatcactg

SEQ ID NO: 1344680 - DNA, 22 bp, Artificial Sequence
  chemically synthesized
atataatattcatatcactgtt

SEQ ID NO: 1344681 - DNA, 22 bp, Artificial Sequence
  chemically synthesized
tgaagtgggaaaataacagtga

SEQ ID NO: 1344682 - DNA, 22 bp, Artificial Sequence
  chemically synthesized
atatcactgttattttcccact

SEQ ID NO: 1344683 - DNA, 22 bp, Artificial Sequence
  chemically synthesized
agcccgtgtctatgaagtggga

SEQ ID NO: 1344684 - DNA, 22 bp, Artificial Sequence
  chemically synthesized
actaagcccgtgtctatgaagt

SEQ ID NO: 1344685 - DNA, 22 bp, Artificial Sequence
  chemically synthesized
cactaagcccgtgtctatgaag

SEQ ID NO: 1344686 - DNA, 22 bp, Artificial Sequence
  chemically synthesized
ttattttcccacttcatagaca

SEQ ID NO: 1344687 - DNA, 22 bp, Artificial Sequence
  chemically synthesized
ttttcccacttcatagacacgg

SEQ ID NO: 1344688 - DNA, 22 bp, Artificial Sequence
  chemically synthesized
tcccacttcatagacacgggct

SEQ ID NO: 1344689 - DNA, 22 bp, Artificial Sequence
  chemically synthesized
cccacttcatagacacgggctt

SEQ ID NO: 1344690 - DNA, 22 bp, Artificial Sequence
  chemically synthesized
tgaaatttcactaagcccgtgt

SEQ ID NO: 1344691 - DNA, 22 bp, Artificial Sequence
  chemically synthesized
ccacttcatagacacgggctta

SEQ ID NO: 1344692 - DNA, 22 bp, Artificial Sequence
  chemically synthesized
catagacacgggcttagtgaaa

SEQ ID NO: 1344693 - DNA, 22 bp, Artificial Sequence
  chemically synthesized
atagacacgggcttagtgaaat

SEQ ID NO: 1344694 - DNA, 22 bp, Artificial Sequence
  chemically synthesized
aaaaagttatgaaatttcacta

SEQ ID NO: 1344695 - DNA, 22 bp, Artificial Sequence
  chemically synthesized
taatgttgaaaaagttatgaaa

SEQ ID NO: 1344696 - DNA, 22 bp, Artificial Sequence
  chemically synthesized
attgtaatgttgaaaaagttat

SEQ ID NO: 1344697 - DNA, 22 bp, Artificial Sequence
  chemically synthesized
agtgaaatttcataactttttc

SEQ ID NO: 1344698 - DNA, 22 bp, Artificial Sequence
  chemically synthesized
cattgtaatgttgaaaaagtta

SEQ ID NO: 1344699 - DNA, 22 bp, Artificial Sequence
  chemically synthesized
gtgaaatttcataactttttca

SEQ ID NO: 1344700 - DNA, 22 bp, Artificial Sequence
  chemically synthesized
tcattgtaatgttgaaaaagtt

SEQ ID NO: 1344701 - DNA, 22 bp, Artificial Sequence
  chemically synthesized
ttcattgtaatgttgaaaaagt

SEQ ID NO: 1344702 - DNA, 22 bp, Artificial Sequence
  chemically synthesized
cataactttttcaacattacaa

SEQ ID NO: 1344703 - DNA, 22 bp, Artificial Sequence
  chemically synthesized
agatatttttcattgtaatgtt

SEQ ID NO: 1344704 - DNA, 22 bp, Artificial Sequence
  chemically synthesized
ataactttttcaacattacaat

SEQ ID NO: 1344705 - DNA, 22 bp, Artificial Sequence
  chemically synthesized
tttcaacattacaatgaaaaat

SEQ ID NO: 1344706 - DNA, 22 bp, Artificial Sequence
  chemically synthesized
ttcaacattacaatgaaaaata

SEQ ID NO: 1344707 - DNA, 22 bp, Artificial Sequence
  chemically synthesized
aagaaactcagatatttttcat

SEQ ID NO: 1344708 - DNA, 22 bp, Artificial Sequence
  chemically synthesized
tcaacattacaatgaaaaatat

SEQ ID NO: 1344709 - DNA, 22 bp, Artificial Sequence
  chemically synthesized
caacattacaatgaaaaatatc

SEQ ID NO: 1344710 - DNA, 22 bp, Artificial Sequence
  chemically synthesized
aacattacaatgaaaaatatct

SEQ ID NO: 1344711 - DNA, 22 bp, Artificial Sequence
  chemically synthesized
caatgaaaaatatctgagtttc

SEQ ID NO: 1344712 - DNA, 22 bp, Artificial Sequence
  chemically synthesized
caacaggcaaagccactaaaga

SEQ ID NO: 1344713 - DNA, 22 bp, Artificial Sequence
  chemically synthesized
aggtctgcaacaggcaaagcca

SEQ ID NO: 1344714 - DNA, 22 bp, Artificial Sequence
  chemically synthesized
agtttctttagtggctttgcct

SEQ ID NO: 1344715 - DNA, 22 bp, Artificial Sequence
  chemically synthesized
ctttagtggctttgcctgttgc

SEQ ID NO: 1344716 - DNA, 22 bp, Artificial Sequence
  chemically synthesized
tttagtggctttgcctgttgca

SEQ ID NO: 1344717 - DNA, 22 bp, Artificial Sequence
  chemically synthesized
tagtggctttgcctgttgcaga

SEQ ID NO: 1344718 - DNA, 22 bp, Artificial Sequence
  chemically synthesized
agtggctttgcctgttgcagac

SEQ ID NO: 1344719 - DNA, 22 bp, Artificial Sequence
  chemically synthesized
gtggctttgcctgttgcagacc

SEQ ID NO: 1344720 - DNA, 22 bp, Artificial Sequence
  chemically synthesized
tgcctgttgcagacctcaattt

SEQ ID NO: 1344721 - DNA, 22 bp, Artificial Sequence
  chemically synthesized
gcctgttgcagacctcaatttt

SEQ ID NO: 1344722 - DNA, 22 bp, Artificial Sequence
  chemically synthesized
cctgttgcagacctcaattttt

SEQ ID NO: 1344723 - DNA, 22 bp, Artificial Sequence
  chemically synthesized
aagtataataaaaaaaaaattg

SEQ ID NO: 1344724 - DNA, 22 bp, Artificial Sequence
  chemically synthesized
aaagtataataaaaaaaaaatt

SEQ ID NO: 1344725 - DNA, 22 bp, Artificial Sequence
  chemically synthesized
ttgcagacctcaattttttttt

SEQ ID NO: 1344726 - DNA, 22 bp, Artificial Sequence
  chemically synthesized
cagacctcaattttttttttat

SEQ ID NO: 1344727 - DNA, 22 bp, Artificial Sequence
  chemically synthesized
aattttttttttattatacttt

SEQ ID NO: 1344728 - DNA, 22 bp, Artificial Sequence
  chemically synthesized
tttttttattatactttaaatt

SEQ ID NO: 1344729 - DNA, 22 bp, Artificial Sequence
  chemically synthesized
ttttttattatactttaaattc

SEQ ID NO: 1344730 - DNA, 22 bp, Artificial Sequence
  chemically synthesized
tttttattatactttaaattct

SEQ ID NO: 1344731 - DNA, 22 bp, Artificial Sequence
  chemically synthesized
cacatgtatcccagaatttaaa

SEQ ID NO: 1344732 - DNA, 22 bp, Artificial Sequence
  chemically synthesized
ttttattatactttaaattctg

SEQ ID NO: 1344733 - DNA, 22 bp, Artificial Sequence
  chemically synthesized
tttattatactttaaattctgg

SEQ ID NO: 1344734 - DNA, 22 bp, Artificial Sequence
  chemically synthesized
tgcacatgtatcccagaattta

SEQ ID NO: 1344735 - DNA, 22 bp, Artificial Sequence
  chemically synthesized
ttattatactttaaattctggg

SEQ ID NO: 1344736 - DNA, 22 bp, Artificial Sequence
  chemically synthesized
tattatactttaaattctggga

SEQ ID NO: 1344737 - DNA, 22 bp, Artificial Sequence
  chemically synthesized
attatactttaaattctgggat

SEQ ID NO: 1344738 - DNA, 22 bp, Artificial Sequence
  chemically synthesized
ttatactttaaattctgggata

SEQ ID NO: 1344739 - DNA, 22 bp, Artificial Sequence
  chemically synthesized
tactttaaattctgggatacat

SEQ ID NO: 1344740 - DNA, 22 bp, Artificial Sequence
  chemically synthesized
catgttctgcacatgtatccca

SEQ ID NO: 1344741 - DNA, 22 bp, Artificial Sequence
  chemically synthesized
taaattctgggatacatgtgca

SEQ ID NO: 1344742 - DNA, 22 bp, Artificial Sequence
  chemically synthesized
aaattctgggatacatgtgcag

SEQ ID NO: 1344743 - DNA, 22 bp, Artificial Sequence
  chemically synthesized
aattctgggatacatgtgcaga

SEQ ID NO: 1344744 - DNA, 22 bp, Artificial Sequence
  chemically synthesized
tgggatacatgtgcagaacatg

SEQ ID NO: 1344745 - DNA, 22 bp, Artificial Sequence
  chemically synthesized
tgtaacaaacctgcatgttctg

SEQ ID NO: 1344746 - DNA, 22 bp, Artificial Sequence
  chemically synthesized
ggatacatgtgcagaacatgca

SEQ ID NO: 1344747 - DNA, 22 bp, Artificial Sequence
  chemically synthesized
gttacataggtatacacatgcc

SEQ ID NO: 1344748 - DNA, 22 bp, Artificial Sequence
  chemically synthesized
ttacataggtatacacatgcca

SEQ ID NO: 1344749 - DNA, 22 bp, Artificial Sequence
  chemically synthesized
cataggtatacacatgccatgg

SEQ ID NO: 1344750 - DNA, 22 bp, Artificial Sequence
  chemically synthesized
atgggtgcagcaagccaccatg

SEQ ID NO: 1344751 - DNA, 22 bp, Artificial Sequence
  chemically synthesized
atgtagatgatgagttgatggg

SEQ ID NO: 1344752 - DNA, 22 bp, Artificial Sequence
  chemically synthesized
gctgcacccatcaactcatcat

SEQ ID NO: 1344753 - DNA, 22 bp, Artificial Sequence
  chemically synthesized
ctgcacccatcaactcatcatc

SEQ ID NO: 1344754 - DNA, 22 bp, Artificial Sequence
  chemically synthesized
cacccatcaactcatcatctac

SEQ ID NO: 1344755 - DNA, 22 bp, Artificial Sequence
  chemically synthesized
ggagaaatacctaatgtagatg

SEQ ID NO: 1344756 - DNA, 22 bp, Artificial Sequence
  chemically synthesized
atcatctacattaggtatttct

SEQ ID NO: 1344757 - DNA, 22 bp, Artificial Sequence
  chemically synthesized
tgggagggatagcattaggaga

SEQ ID NO: 1344758 - DNA, 22 bp, Artificial Sequence
  chemically synthesized
cattaggtatttctcctaatgc

SEQ ID NO: 1344759 - DNA, 22 bp, Artificial Sequence
  chemically synthesized
ggtatttctcctaatgctatcc

SEQ ID NO: 1344760 - DNA, 22 bp, Artificial Sequence
  chemically synthesized
ctcctaatgctatccctcccat

SEQ ID NO: 1344761 - DNA, 22 bp, Artificial Sequence
  chemically synthesized
tcctaatgctatccctcccata

SEQ ID NO: 1344762 - DNA, 22 bp, Artificial Sequence
  chemically synthesized
gtgggtgaggggctatgggagg

SEQ ID NO: 1344763 - DNA, 22 bp, Artificial Sequence
  chemically synthesized
ctaatgctatccctcccatagc

SEQ ID NO: 1344764 - DNA, 22 bp, Artificial Sequence
  chemically synthesized
ttggtgggtgaggggctatggg

SEQ ID NO: 1344765 - DNA, 22 bp, Artificial Sequence
  chemically synthesized
atgctatccctcccatagcccc

SEQ ID NO: 1344766 - DNA, 22 bp, Artificial Sequence
  chemically synthesized
tccctcccatagcccctcaccc

SEQ ID NO: 1344767 - DNA, 22 bp, Artificial Sequence
  chemically synthesized
gggcctgttggtgggtgagggg

SEQ ID NO: 1344768 - DNA, 22 bp, Artificial Sequence
  chemically synthesized
ccatagcccctcacccaccaac

SEQ ID NO: 1344769 - DNA, 22 bp, Artificial Sequence
  chemically synthesized
acccaccaacaggccccagtgt

SEQ ID NO: 1344770 - DNA, 22 bp, Artificial Sequence
  chemically synthesized
aacaatgagaacacatggacac

SEQ ID NO: 1344771 - DNA, 22 bp, Artificial Sequence
  chemically synthesized
tcctccctgtgtccatgtgttc

SEQ ID NO: 1344772 - DNA, 22 bp, Artificial Sequence
  chemically synthesized
ctccctgtgtccatgtgttctc

SEQ ID NO: 1344773 - DNA, 22 bp, Artificial Sequence
  chemically synthesized
cctgtgtccatgtgttctcatt

SEQ ID NO: 1344774 - DNA, 22 bp, Artificial Sequence
  chemically synthesized
tgtccatgtgttctcattgttc

SEQ ID NO: 1344775 - DNA, 22 bp, Artificial Sequence
  chemically synthesized
ataagtgggagttgaacaatga

SEQ ID NO: 1344776 - DNA, 22 bp, Artificial Sequence
  chemically synthesized
actcataagtgggagttgaaca

SEQ ID NO: 1344777 - DNA, 22 bp, Artificial Sequence
  chemically synthesized
tcactcataagtgggagttgaa

SEQ ID NO: 1344778 - DNA, 22 bp, Artificial Sequence
  chemically synthesized
tcattgttcaactcccacttat

SEQ ID NO: 1344779 - DNA, 22 bp, Artificial Sequence
  chemically synthesized
attgttcaactcccacttatga

SEQ ID NO: 1344780 - DNA, 22 bp, Artificial Sequence
  chemically synthesized
ttcaactcccacttatgagtga

SEQ ID NO: 1344781 - DNA, 22 bp, Artificial Sequence
  chemically synthesized
aactcccacttatgagtgagaa

SEQ ID NO: 1344782 - DNA, 22 bp, Artificial Sequence
  chemically synthesized
ccacttatgagtgagaacatgc

SEQ ID NO: 1344783 - DNA, 22 bp, Artificial Sequence
  chemically synthesized
atgagtgagaacatgcggtgtt

SEQ ID NO: 1344784 - DNA, 22 bp, Artificial Sequence
  chemically synthesized
tgagtgagaacatgcggtgttt

SEQ ID NO: 1344785 - DNA, 22 bp, Artificial Sequence
  chemically synthesized
acacaggaacaggaaaacaaac

SEQ ID NO: 1344786 - DNA, 22 bp, Artificial Sequence
  chemically synthesized
atcagactaacacaggaacagg

SEQ ID NO: 1344787 - DNA, 22 bp, Artificial Sequence
  chemically synthesized
tcatcagactaacacaggaaca

SEQ ID NO: 1344788 - DNA, 22 bp, Artificial Sequence
  chemically synthesized
gttttcctgttcctgtgttagt

SEQ ID NO: 1344789 - DNA, 22 bp, Artificial Sequence
  chemically synthesized
ttttcctgttcctgtgttagtc

SEQ ID NO: 1344790 - DNA, 22 bp, Artificial Sequence
  chemically synthesized
tcctgttcctgtgttagtctga

SEQ ID NO: 1344791 - DNA, 22 bp, Artificial Sequence
  chemically synthesized
cctgttcctgtgttagtctgat

SEQ ID NO: 1344792 - DNA, 22 bp, Artificial Sequence
  chemically synthesized
ctgttcctgtgttagtctgatg

SEQ ID NO: 1344793 - DNA, 22 bp, Artificial Sequence
  chemically synthesized
gaaaccatcattctcatcagac

SEQ ID NO: 1344794 - DNA, 22 bp, Artificial Sequence
  chemically synthesized
ttcctgtgttagtctgatgaga

SEQ ID NO: 1344795 - DNA, 22 bp, Artificial Sequence
  chemically synthesized
ctgtgttagtctgatgagaatg

SEQ ID NO: 1344796 - DNA, 22 bp, Artificial Sequence
  chemically synthesized
tgttagtctgatgagaatgatg

SEQ ID NO: 1344797 - DNA, 22 bp, Artificial Sequence
  chemically synthesized
gtctgatgagaatgatggtttc

SEQ ID NO: 1344798 - DNA, 22 bp, Artificial Sequence
  chemically synthesized
atgagaatgatggtttccagct

SEQ ID NO: 1344799 - DNA, 22 bp, Artificial Sequence
  chemically synthesized
caggaaaatggatgaagctgga

SEQ ID NO: 1344800 - DNA, 22 bp, Artificial Sequence
  chemically synthesized
gcaggaaaatggatgaagctgg

SEQ ID NO: 1344801 - DNA, 22 bp, Artificial Sequence
  chemically synthesized
tgcaggaaaatggatgaagctg

SEQ ID NO: 1344802 - DNA, 22 bp, Artificial Sequence
  chemically synthesized
gtgtcctttgcaggaaaatgga

SEQ ID NO: 1344803 - DNA, 22 bp, Artificial Sequence
  chemically synthesized
ccagcttcatccattttcctgc

SEQ ID NO: 1344804 - DNA, 22 bp, Artificial Sequence
  chemically synthesized
cagcttcatccattttcctgca

SEQ ID NO: 1344805 - DNA, 22 bp, Artificial Sequence
  chemically synthesized
catccattttcctgcaaaggac

SEQ ID NO: 1344806 - DNA, 22 bp, Artificial Sequence
  chemically synthesized
atccattttcctgcaaaggaca

SEQ ID NO: 1344807 - DNA, 22 bp, Artificial Sequence
  chemically synthesized
aaaaagatgtgttcgtgtcctt

SEQ ID NO: 1344808 - DNA, 22 bp, Artificial Sequence
  chemically synthesized
tcctgcaaaggacacgaacaca

SEQ ID NO: 1344809 - DNA, 22 bp, Artificial Sequence
  chemically synthesized
cctgcaaaggacacgaacacat

SEQ ID NO: 1344810 - DNA, 22 bp, Artificial Sequence
  chemically synthesized
ctgcaaaggacacgaacacatc

SEQ ID NO: 1344811 - DNA, 22 bp, Artificial Sequence
  chemically synthesized
caaaggacacgaacacatcttt

SEQ ID NO: 1344812 - DNA, 22 bp, Artificial Sequence
  chemically synthesized
cacagacattaaaaaagatgtg

SEQ ID NO: 1344813 - DNA, 22 bp, Artificial Sequence
  chemically synthesized
ttttaatgtctgtgtagtattc

SEQ ID NO: 1344814 - DNA, 22 bp, Artificial Sequence
  chemically synthesized
tttaatgtctgtgtagtattcc

SEQ ID NO: 1344815 - DNA, 22 bp, Artificial Sequence
  chemically synthesized
ttaatgtctgtgtagtattcca

SEQ ID NO: 1344816 - DNA, 22 bp, Artificial Sequence
  chemically synthesized
taatgtctgtgtagtattccat

SEQ ID NO: 1344817 - DNA, 22 bp, Artificial Sequence
  chemically synthesized
aatgtctgtgtagtattccatg

SEQ ID NO: 1344818 - DNA, 22 bp, Artificial Sequence
  chemically synthesized
atgtctgtgtagtattccatgg

SEQ ID NO: 1344819 - DNA, 22 bp, Artificial Sequence
  chemically synthesized
tgtagtattccatggtgtatat

SEQ ID NO: 1344820 - DNA, 22 bp, Artificial Sequence
  chemically synthesized
gataaagaaaatgtggcacata

SEQ ID NO: 1344821 - DNA, 22 bp, Artificial Sequence
  chemically synthesized
catggtgtatatgtgccacatt

SEQ ID NO: 1344822 - DNA, 22 bp, Artificial Sequence
  chemically synthesized
tctttatccagtctatcactga

SEQ ID NO: 1344823 - DNA, 22 bp, Artificial Sequence
  chemically synthesized
ctttatccagtctatcactgat

SEQ ID NO: 1344824 - DNA, 22 bp, Artificial Sequence
  chemically synthesized
tttatccagtctatcactgatg

SEQ ID NO: 1344825 - DNA, 22 bp, Artificial Sequence
  chemically synthesized
tatccagtctatcactgatggg

SEQ ID NO: 1344826 - DNA, 22 bp, Artificial Sequence
  chemically synthesized
atccagtctatcactgatgggc

SEQ ID NO: 1344827 - DNA, 22 bp, Artificial Sequence
  chemically synthesized
tccagtctatcactgatgggca

SEQ ID NO: 1344828 - DNA, 22 bp, Artificial Sequence
  chemically synthesized
gaaccaacccaaatgcccatca

SEQ ID NO: 1344829 - DNA, 22 bp, Artificial Sequence
  chemically synthesized
agaaccaacccaaatgcccatc

SEQ ID NO: 1344830 - DNA, 22 bp, Artificial Sequence
  chemically synthesized
tcactgatgggcatttgggttg

SEQ ID NO: 1344831 - DNA, 22 bp, Artificial Sequence
  chemically synthesized
atgggcatttgggttggttcta

SEQ ID NO: 1344832 - DNA, 22 bp, Artificial Sequence
  chemically synthesized
ccaagagcaaagacttagaacc

SEQ ID NO: 1344833 - DNA, 22 bp, Artificial Sequence
  chemically synthesized
ttcccaagagcaaagacttaga

SEQ ID NO: 1344834 - DNA, 22 bp, Artificial Sequence
  chemically synthesized
gggttggttctaagtctttgct

SEQ ID NO: 1344835 - DNA, 22 bp, Artificial Sequence
  chemically synthesized
ggttggttctaagtctttgctc

SEQ ID NO: 1344836 - DNA, 22 bp, Artificial Sequence
  chemically synthesized
cagcactattcccaagagcaaa

SEQ ID NO: 1344837 - DNA, 22 bp, Artificial Sequence
  chemically synthesized
gttctaagtctttgctcttggg

SEQ ID NO: 1344838 - DNA, 22 bp, Artificial Sequence
  chemically synthesized
ttgcagcactattcccaagagc

SEQ ID NO: 1344839 - DNA, 22 bp, Artificial Sequence
  chemically synthesized
attgcagcactattcccaagag

SEQ ID NO: 1344840 - DNA, 22 bp, Artificial Sequence
  chemically synthesized
taagtctttgctcttgggaata

SEQ ID NO: 1344841 - DNA, 22 bp, Artificial Sequence
  chemically synthesized
agtctttgctcttgggaatagt

SEQ ID NO: 1344842 - DNA, 22 bp, Artificial Sequence
  chemically synthesized
tgctcttgggaatagtgctgca

SEQ ID NO: 1344843 - DNA, 22 bp, Artificial Sequence
  chemically synthesized
gctcttgggaatagtgctgcaa

SEQ ID NO: 1344844 - DNA, 22 bp, Artificial Sequence
  chemically synthesized
ctcttgggaatagtgctgcaat

SEQ ID NO: 1344845 - DNA, 22 bp, Artificial Sequence
  chemically synthesized
ttgggaatagtgctgcaataaa

SEQ ID NO: 1344846 - DNA, 22 bp, Artificial Sequence
  chemically synthesized
gggaatagtgctgcaataaaca

SEQ ID NO: 1344847 - DNA, 22 bp, Artificial Sequence
  chemically synthesized
ggaatagtgctgcaataaacat

SEQ ID NO: 1344848 - DNA, 22 bp, Artificial Sequence
  chemically synthesized
taaagacacatgtacacgtatg

SEQ ID NO: 1344849 - DNA, 22 bp, Artificial Sequence
  chemically synthesized
ctataaagacacatgtacacgt

SEQ ID NO: 1344850 - DNA, 22 bp, Artificial Sequence
  chemically synthesized
caataaacatacgtgtacatgt

SEQ ID NO: 1344851 - DNA, 22 bp, Artificial Sequence
  chemically synthesized
tactataaagacacatgtacac

SEQ ID NO: 1344852 - DNA, 22 bp, Artificial Sequence
  chemically synthesized
taaatcattctactataaagac

SEQ ID NO: 1344853 - DNA, 22 bp, Artificial Sequence
  chemically synthesized
aaaggattataaatcattctac

SEQ ID NO: 1344854 - DNA, 22 bp, Artificial Sequence
  chemically synthesized
tatagtagaatgatttataatc

SEQ ID NO: 1344855 - DNA, 22 bp, Artificial Sequence
  chemically synthesized
atagtagaatgatttataatcc

SEQ ID NO: 1344856 - DNA, 22 bp, Artificial Sequence
  chemically synthesized
tagtagaatgatttataatcct

SEQ ID NO: 1344857 - DNA, 22 bp, Artificial Sequence
  chemically synthesized
ggtgtatactcaaaggattata

SEQ ID NO: 1344858 - DNA, 22 bp, Artificial Sequence
  chemically synthesized
ctgggtgtatactcaaaggatt

SEQ ID NO: 1344859 - DNA, 22 bp, Artificial Sequence
  chemically synthesized
ataatcctttgagtatacaccc

SEQ ID NO: 1344860 - DNA, 22 bp, Artificial Sequence
  chemically synthesized
taatcctttgagtatacaccca

SEQ ID NO: 1344861 - DNA, 22 bp, Artificial Sequence
  chemically synthesized
acccagcaatcccattactggg

SEQ ID NO: 1344862 - DNA, 22 bp, Artificial Sequence
  chemically synthesized
gacccagcaatcccattactgg

SEQ ID NO: 1344863 - DNA, 22 bp, Artificial Sequence
  chemically synthesized
tgagtatacacccagtaatggg

SEQ ID NO: 1344864 - DNA, 22 bp, Artificial Sequence
  chemically synthesized
gagtatacacccagtaatggga

SEQ ID NO: 1344865 - DNA, 22 bp, Artificial Sequence
  chemically synthesized
agtatacacccagtaatgggat

SEQ ID NO: 1344866 - DNA, 22 bp, Artificial Sequence
  chemically synthesized
gaaccagaaataccatttgacc

SEQ ID NO: 1344867 - DNA, 22 bp, Artificial Sequence
  chemically synthesized
ctgggtcaaatggtatttctgg

SEQ ID NO: 1344868 - DNA, 22 bp, Artificial Sequence
  chemically synthesized
aaggatctagaaccagaaatac

SEQ ID NO: 1344869 - DNA, 22 bp, Artificial Sequence
  chemically synthesized
ggtcaaatggtatttctggttc

SEQ ID NO: 1344870 - DNA, 22 bp, Artificial Sequence
  chemically synthesized
ctcaaggatctagaaccagaaa

SEQ ID NO: 1344871 - DNA, 22 bp, Artificial Sequence
  chemically synthesized
aggtatgcaattcctcaaggat

SEQ ID NO: 1344872 - DNA, 22 bp, Artificial Sequence
  chemically synthesized
ctggttctagatccttgaggaa

SEQ ID NO: 1344873 - DNA, 22 bp, Artificial Sequence
  chemically synthesized
tggttctagatccttgaggaat

SEQ ID NO: 1344874 - DNA, 22 bp, Artificial Sequence
  chemically synthesized
gttctagatccttgaggaattg

SEQ ID NO: 1344875 - DNA, 22 bp, Artificial Sequence
  chemically synthesized
aaaattgaggtatgcaattcct

SEQ ID NO: 1344876 - DNA, 22 bp, Artificial Sequence
  chemically synthesized
aaaaattgaggtatgcaattcc

SEQ ID NO: 1344877 - DNA, 22 bp, Artificial Sequence
  chemically synthesized
tagatccttgaggaattgcata

SEQ ID NO: 1344878 - DNA, 22 bp, Artificial Sequence
  chemically synthesized
gatccttgaggaattgcatacc

SEQ ID NO: 1344879 - DNA, 22 bp, Artificial Sequence
  chemically synthesized
tatttaaaaattgaggtatgca

SEQ ID NO: 1344880 - DNA, 22 bp, Artificial Sequence
  chemically synthesized
gaggaattgcatacctcaattt

SEQ ID NO: 1344881 - DNA, 22 bp, Artificial Sequence
  chemically synthesized
aattgtatttaaaaattgaggt

SEQ ID NO: 1344882 - DNA, 22 bp, Artificial Sequence
  chemically synthesized
aggaattgcatacctcaatttt

SEQ ID NO: 1344883 - DNA, 22 bp, Artificial Sequence
  chemically synthesized
aaattgtatttaaaaattgagg

SEQ ID NO: 1344884 - DNA, 22 bp, Artificial Sequence
  chemically synthesized
taaattgtatttaaaaattgag

SEQ ID NO: 1344885 - DNA, 22 bp, Artificial Sequence
  chemically synthesized
ttaaattgtatttaaaaattga

SEQ ID NO: 1344886 - DNA, 22 bp, Artificial Sequence
  chemically synthesized
tatttttaaattgtatttaaaa

SEQ ID NO: 1344887 - DNA, 22 bp, Artificial Sequence
  chemically synthesized
catacctcaatttttaaataca

SEQ ID NO: 1344888 - DNA, 22 bp, Artificial Sequence
  chemically synthesized
attgtatttttaaattgtattt

SEQ ID NO: 1344889 - DNA, 22 bp, Artificial Sequence
  chemically synthesized
aatttttaaatacaatttaaaa

SEQ ID NO: 1344890 - DNA, 22 bp, Artificial Sequence
  chemically synthesized
ttaaatacaatttaaaaataca

SEQ ID NO: 1344891 - DNA, 22 bp, Artificial Sequence
  chemically synthesized
taaatacaatttaaaaatacaa

SEQ ID NO: 1344892 - DNA, 22 bp, Artificial Sequence
  chemically synthesized
aaatacaatttaaaaatacaat

SEQ ID NO: 1344893 - DNA, 22 bp, Artificial Sequence
  chemically synthesized
aatacaatttaaaaatacaatc

SEQ ID NO: 1344894 - DNA, 22 bp, Artificial Sequence
  chemically synthesized
aaaaatacaatcaattttttat

SEQ ID NO: 1344895 - DNA, 22 bp, Artificial Sequence
  chemically synthesized
aatgtgatatagataaaaaatt

SEQ ID NO: 1344896 - DNA, 22 bp, Artificial Sequence
  chemically synthesized
aaaatacaatcaattttttatc

SEQ ID NO: 1344897 - DNA, 22 bp, Artificial Sequence
  chemically synthesized
gaggtaggcctgaatgtgatat

SEQ ID NO: 1344898 - DNA, 22 bp, Artificial Sequence
  chemically synthesized
agaggtaggcctgaatgtgata

SEQ ID NO: 1344899 - DNA, 22 bp, Artificial Sequence
  chemically synthesized
tagaggtaggcctgaatgtgat

SEQ ID NO: 1344900 - DNA, 22 bp, Artificial Sequence
  chemically synthesized
tttatctatatcacattcaggc

SEQ ID NO: 1344901 - DNA, 22 bp, Artificial Sequence
  chemically synthesized
ttatctatatcacattcaggcc

SEQ ID NO: 1344902 - DNA, 22 bp, Artificial Sequence
  chemically synthesized
tatctatatcacattcaggcct

SEQ ID NO: 1344903 - DNA, 22 bp, Artificial Sequence
  chemically synthesized
atctatatcacattcaggccta

SEQ ID NO: 1344904 - DNA, 22 bp, Artificial Sequence
  chemically synthesized
tctatatcacattcaggcctac

SEQ ID NO: 1344905 - DNA, 22 bp, Artificial Sequence
  chemically synthesized
tatactttagaggtaggcctga

SEQ ID NO: 1344906 - DNA, 22 bp, Artificial Sequence
  chemically synthesized
tatcacattcaggcctacctct

SEQ ID NO: 1344907 - DNA, 22 bp, Artificial Sequence
  chemically synthesized
tcattatatactttagaggtag

SEQ ID NO: 1344908 - DNA, 22 bp, Artificial Sequence
  chemically synthesized
aggcctacctctaaagtatata

SEQ ID NO: 1344909 - DNA, 22 bp, Artificial Sequence
  chemically synthesized
taaatcggggattgtcattata

SEQ ID NO: 1344910 - DNA, 22 bp, Artificial Sequence
  chemically synthesized
cctctaaagtatataatgacaa

SEQ ID NO: 1344911 - DNA, 22 bp, Artificial Sequence
  chemically synthesized
taaagtatataatgacaatccc

SEQ ID NO: 1344912 - DNA, 22 bp, Artificial Sequence
  chemically synthesized
aagtatataatgacaatccccg

SEQ ID NO: 1344913 - DNA, 22 bp, Artificial Sequence
  chemically synthesized
taagtggaaccattgtaaatcg

SEQ ID NO: 1344914 - DNA, 22 bp, Artificial Sequence
  chemically synthesized
caaagtcaaaaaattgtaagtg

SEQ ID NO: 1344915 - DNA, 22 bp, Artificial Sequence
  chemically synthesized
acaatggttccacttacaattt

SEQ ID NO: 1344916 - DNA, 22 bp, Artificial Sequence
  chemically synthesized
caatggttccacttacaatttt

SEQ ID NO: 1344917 - DNA, 22 bp, Artificial Sequence
  chemically synthesized
ataccattgcaaagtcaaaaaa

SEQ ID NO: 1344918 - DNA, 22 bp, Artificial Sequence
  chemically synthesized
cataccattgcaaagtcaaaaa

SEQ ID NO: 1344919 - DNA, 22 bp, Artificial Sequence
  chemically synthesized
cacttacaattttttgactttg

SEQ ID NO: 1344920 - DNA, 22 bp, Artificial Sequence
  chemically synthesized
tttcataccattgcaaagtcaa

SEQ ID NO: 1344921 - DNA, 22 bp, Artificial Sequence
  chemically synthesized
acaattttttgactttgcaatg

SEQ ID NO: 1344922 - DNA, 22 bp, Artificial Sequence
  chemically synthesized
caattttttgactttgcaatgg

SEQ ID NO: 1344923 - DNA, 22 bp, Artificial Sequence
  chemically synthesized
tttgactttgcaatggtatgaa

SEQ ID NO: 1344924 - DNA, 22 bp, Artificial Sequence
  chemically synthesized
aatgtgcactatttcataccat

SEQ ID NO: 1344925 - DNA, 22 bp, Artificial Sequence
  chemically synthesized
ttgactttgcaatggtatgaaa

SEQ ID NO: 1344926 - DNA, 22 bp, Artificial Sequence
  chemically synthesized
tgactttgcaatggtatgaaat

SEQ ID NO: 1344927 - DNA, 22 bp, Artificial Sequence
  chemically synthesized
gactttgcaatggtatgaaata

SEQ ID NO: 1344928 - DNA, 22 bp, Artificial Sequence
  chemically synthesized
ctgaatgtgcactatttcatac

SEQ ID NO: 1344929 - DNA, 22 bp, Artificial Sequence
  chemically synthesized
actttgcaatggtatgaaatag

SEQ ID NO: 1344930 - DNA, 22 bp, Artificial Sequence
  chemically synthesized
tactgaatgtgcactatttcat

SEQ ID NO: 1344931 - DNA, 22 bp, Artificial Sequence
  chemically synthesized
ctactgaatgtgcactatttca

SEQ ID NO: 1344932 - DNA, 22 bp, Artificial Sequence
  chemically synthesized
tgcaatggtatgaaatagtgca

SEQ ID NO: 1344933 - DNA, 22 bp, Artificial Sequence
  chemically synthesized
gcaatggtatgaaatagtgcac

SEQ ID NO: 1344934 - DNA, 22 bp, Artificial Sequence
  chemically synthesized
caatggtatgaaatagtgcaca

SEQ ID NO: 1344935 - DNA, 22 bp, Artificial Sequence
  chemically synthesized
aagtgtggtttctactgaatgt

SEQ ID NO: 1344936 - DNA, 22 bp, Artificial Sequence
  chemically synthesized
gaagtgtggtttctactgaatg

SEQ ID NO: 1344937 - DNA, 22 bp, Artificial Sequence
  chemically synthesized
tatggatacttgaagtgtggtt

SEQ ID NO: 1344938 - DNA, 22 bp, Artificial Sequence
  chemically synthesized
agtagaaaccacacttcaagta

SEQ ID NO: 1344939 - DNA, 22 bp, Artificial Sequence
  chemically synthesized
aagtgaaaaccagaatggttgt

SEQ ID NO: 1344940 - DNA, 22 bp, Artificial Sequence
  chemically synthesized
caagtatccatacaaccattct

SEQ ID NO: 1344941 - DNA, 22 bp, Artificial Sequence
  chemically synthesized
aaagtgaaaaccagaatggttg

SEQ ID NO: 1344942 - DNA, 22 bp, Artificial Sequence
  chemically synthesized
aagtatccatacaaccattctg

SEQ ID NO: 1344943 - DNA, 22 bp, Artificial Sequence
  chemically synthesized
tacttaaagtgaaaaccagaat

SEQ ID NO: 1344944 - DNA, 22 bp, Artificial Sequence
  chemically synthesized
agtactgtacttaaagtgaaaa

SEQ ID NO: 1344945 - DNA, 22 bp, Artificial Sequence
  chemically synthesized
ttcagtactgtacttaaagtga

SEQ ID NO: 1344946 - DNA, 22 bp, Artificial Sequence
  chemically synthesized
attcagtactgtacttaaagtg

SEQ ID NO: 1344947 - DNA, 22 bp, Artificial Sequence
  chemically synthesized
tattcagtactgtacttaaagt

SEQ ID NO: 1344948 - DNA, 22 bp, Artificial Sequence
  chemically synthesized
ttattcagtactgtacttaaag

SEQ ID NO: 1344949 - DNA, 22 bp, Artificial Sequence
  chemically synthesized
tggttttcactttaagtacagt

SEQ ID NO: 1344950 - DNA, 22 bp, Artificial Sequence
  chemically synthesized
gttttcactttaagtacagtac

SEQ ID NO: 1344951 - DNA, 22 bp, Artificial Sequence
  chemically synthesized
agtatcttttattcagtactgt

SEQ ID NO: 1344952 - DNA, 22 bp, Artificial Sequence
  chemically synthesized
tcactttaagtacagtactgaa

SEQ ID NO: 1344953 - DNA, 22 bp, Artificial Sequence
  chemically synthesized
cactttaagtacagtactgaat

SEQ ID NO: 1344954 - DNA, 22 bp, Artificial Sequence
  chemically synthesized
actttaagtacagtactgaata

SEQ ID NO: 1344955 - DNA, 22 bp, Artificial Sequence
  chemically synthesized
taagtacagtactgaataaaag

SEQ ID NO: 1344956 - DNA, 22 bp, Artificial Sequence
  chemically synthesized
aagtacagtactgaataaaaga

SEQ ID NO: 1344957 - DNA, 22 bp, Artificial Sequence
  chemically synthesized
agtacagtactgaataaaagat

SEQ ID NO: 1344958 - DNA, 22 bp, Artificial Sequence
  chemically synthesized
taataaagtgttgagtatcttt

SEQ ID NO: 1344959 - DNA, 22 bp, Artificial Sequence
  chemically synthesized
ataataaagtgttgagtatctt

SEQ ID NO: 1344960 - DNA, 22 bp, Artificial Sequence
  chemically synthesized
tataataaagtgttgagtatct

SEQ ID NO: 1344961 - DNA, 22 bp, Artificial Sequence
  chemically synthesized
ttttataataaagtgttgagta

SEQ ID NO: 1344962 - DNA, 22 bp, Artificial Sequence
  chemically synthesized
tattttataataaagtgttgag

SEQ ID NO: 1344963 - DNA, 22 bp, Artificial Sequence
  chemically synthesized
aataaaagatactcaacacttt

SEQ ID NO: 1344964 - DNA, 22 bp, Artificial Sequence
  chemically synthesized
aaattctattttataataaagt

SEQ ID NO: 1344965 - DNA, 22 bp, Artificial Sequence
  chemically synthesized
actcaaattctattttataata

SEQ ID NO: 1344966 - DNA, 22 bp, Artificial Sequence
  chemically synthesized
tctaactcaaattctattttat

SEQ ID NO: 1344967 - DNA, 22 bp, Artificial Sequence
  chemically synthesized
aacactttattataaaatagaa

SEQ ID NO: 1344968 - DNA, 22 bp, Artificial Sequence
  chemically synthesized
tattataaaatagaatttgagt

SEQ ID NO: 1344969 - DNA, 22 bp, Artificial Sequence
  chemically synthesized
attataaaatagaatttgagtt

SEQ ID NO: 1344970 - DNA, 22 bp, Artificial Sequence
  chemically synthesized
ttataaaatagaatttgagtta

SEQ ID NO: 1344971 - DNA, 22 bp, Artificial Sequence
  chemically synthesized
ggcaaaattatctaactcaaat

SEQ ID NO: 1344972 - DNA, 22 bp, Artificial Sequence
  chemically synthesized
gggcaaaattatctaactcaaa

SEQ ID NO: 1344973 - DNA, 22 bp, Artificial Sequence
  chemically synthesized
taaaatagaatttgagttagat

SEQ ID NO: 1344974 - DNA, 22 bp, Artificial Sequence
  chemically synthesized
tatttgggcaaaattatctaac

SEQ ID NO: 1344975 - DNA, 22 bp, Artificial Sequence
  chemically synthesized
gcctatatttgggcaaaattat

SEQ ID NO: 1344976 - DNA, 22 bp, Artificial Sequence
  chemically synthesized
gagttagataattttgcccaaa

SEQ ID NO: 1344977 - DNA, 22 bp, Artificial Sequence
  chemically synthesized
agttagataattttgcccaaat

SEQ ID NO: 1344978 - DNA, 22 bp, Artificial Sequence
  chemically synthesized
agattagcctatatttgggcaa

SEQ ID NO: 1344979 - DNA, 22 bp, Artificial Sequence
  chemically synthesized
gataattttgcccaaatatagg

SEQ ID NO: 1344980 - DNA, 22 bp, Artificial Sequence
  chemically synthesized
agaacactgagattagcctata

SEQ ID NO: 1344981 - DNA, 22 bp, Artificial Sequence
  chemically synthesized
tgcccaaatataggctaatctc

SEQ ID NO: 1344982 - DNA, 22 bp, Artificial Sequence
  chemically synthesized
gcccaaatataggctaatctca

SEQ ID NO: 1344983 - DNA, 22 bp, Artificial Sequence
  chemically synthesized
cccaaatataggctaatctcag

SEQ ID NO: 1344984 - DNA, 22 bp, Artificial Sequence
  chemically synthesized
atcatgctcagaacactgagat

SEQ ID NO: 1344985 - DNA, 22 bp, Artificial Sequence
  chemically synthesized
aatcatgctcagaacactgaga

SEQ ID NO: 1344986 - DNA, 22 bp, Artificial Sequence
  chemically synthesized
ccttaatcatgctcagaacact

SEQ ID NO: 1344987 - DNA, 22 bp, Artificial Sequence
  chemically synthesized
gcctaccttaatcatgctcaga

SEQ ID NO: 1344988 - DNA, 22 bp, Artificial Sequence
  chemically synthesized
atctcagtgttctgagcatgat

SEQ ID NO: 1344989 - DNA, 22 bp, Artificial Sequence
  chemically synthesized
gactagcctaccttaatcatgc

SEQ ID NO: 1344990 - DNA, 22 bp, Artificial Sequence
  chemically synthesized
agactagcctaccttaatcatg

SEQ ID NO: 1344991 - DNA, 22 bp, Artificial Sequence
  chemically synthesized
agtgttctgagcatgattaagg

SEQ ID NO: 1344992 - DNA, 22 bp, Artificial Sequence
  chemically synthesized
tgagcatgattaaggtaggcta

SEQ ID NO: 1344993 - DNA, 22 bp, Artificial Sequence
  chemically synthesized
agcatgattaaggtaggctagt

SEQ ID NO: 1344994 - DNA, 22 bp, Artificial Sequence
  chemically synthesized
ccaaacatcatagcttagacta

SEQ ID NO: 1344995 - DNA, 22 bp, Artificial Sequence
  chemically synthesized
aggtaggctagtctaagctatg

SEQ ID NO: 1344996 - DNA, 22 bp, Artificial Sequence
  chemically synthesized
atctaccaaacatcatagctta

SEQ ID NO: 1344997 - DNA, 22 bp, Artificial Sequence
  chemically synthesized
gtctaagctatgatgtttggta

SEQ ID NO: 1344998 - DNA, 22 bp, Artificial Sequence
  chemically synthesized
atatacctaatctaccaaacat

SEQ ID NO: 1344999 - DNA, 22 bp, Artificial Sequence
  chemically synthesized
aatatacctaatctaccaaaca

SEQ ID NO: 1345000 - DNA, 22 bp, Artificial Sequence
  chemically synthesized
agctatgatgtttggtagatta

SEQ ID NO: 1345001 - DNA, 22 bp, Artificial Sequence
  chemically synthesized
tgatgtttggtagattaggtat

SEQ ID NO: 1345002 - DNA, 22 bp, Artificial Sequence
  chemically synthesized
ggtagattaggtatattaaatg

SEQ ID NO: 1345003 - DNA, 22 bp, Artificial Sequence
  chemically synthesized
gtagattaggtatattaaatgc

SEQ ID NO: 1345004 - DNA, 22 bp, Artificial Sequence
  chemically synthesized
taagtggaaaatgcatttaata

SEQ ID NO: 1345005 - DNA, 22 bp, Artificial Sequence
  chemically synthesized
ggtatattaaatgcattttcca

SEQ ID NO: 1345006 - DNA, 22 bp, Artificial Sequence
  chemically synthesized
aaaatattataagtggaaaatg

SEQ ID NO: 1345007 - DNA, 22 bp, Artificial Sequence
  chemically synthesized
gaaaatattataagtggaaaat

SEQ ID NO: 1345008 - DNA, 22 bp, Artificial Sequence
  chemically synthesized
aatgcattttccacttataata

SEQ ID NO: 1345009 - DNA, 22 bp, Artificial Sequence
  chemically synthesized
tccacttataatattttcaaat

SEQ ID NO: 1345010 - DNA, 22 bp, Artificial Sequence
  chemically synthesized
ccacttataatattttcaaatt

SEQ ID NO: 1345011 - DNA, 22 bp, Artificial Sequence
  chemically synthesized
cacttataatattttcaaatta

SEQ ID NO: 1345012 - DNA, 22 bp, Artificial Sequence
  chemically synthesized
caataaacccaccataatttga

SEQ ID NO: 1345013 - DNA, 22 bp, Artificial Sequence
  chemically synthesized
ataatattttcaaattatggtg

SEQ ID NO: 1345014 - DNA, 22 bp, Artificial Sequence
  chemically synthesized
taatattttcaaattatggtgg

SEQ ID NO: 1345015 - DNA, 22 bp, Artificial Sequence
  chemically synthesized
tgttccaataaacccaccataa

SEQ ID NO: 1345016 - DNA, 22 bp, Artificial Sequence
  chemically synthesized
tcaaattatggtgggtttattg

SEQ ID NO: 1345017 - DNA, 22 bp, Artificial Sequence
  chemically synthesized
caaattatggtgggtttattgg

SEQ ID NO: 1345018 - DNA, 22 bp, Artificial Sequence
  chemically synthesized
aaattatggtgggtttattgga

SEQ ID NO: 1345019 - DNA, 22 bp, Artificial Sequence
  chemically synthesized
cagtggggttatgttccaataa

SEQ ID NO: 1345020 - DNA, 22 bp, Artificial Sequence
  chemically synthesized
acagtggggttatgttccaata

SEQ ID NO: 1345021 - DNA, 22 bp, Artificial Sequence
  chemically synthesized
tggtgggtttattggaacataa

SEQ ID NO: 1345022 - DNA, 22 bp, Artificial Sequence
  chemically synthesized
gacttacagtggggttatgttc

SEQ ID NO: 1345023 - DNA, 22 bp, Artificial Sequence
  chemically synthesized
attggaacataaccccactgta

SEQ ID NO: 1345024 - DNA, 22 bp, Artificial Sequence
  chemically synthesized
ttggaacataaccccactgtaa

SEQ ID NO: 1345025 - DNA, 22 bp, Artificial Sequence
  chemically synthesized
atatccctcgacttacagtggg

SEQ ID NO: 1345026 - DNA, 22 bp, Artificial Sequence
  chemically synthesized
gaacataaccccactgtaagtc

SEQ ID NO: 1345027 - DNA, 22 bp, Artificial Sequence
  chemically synthesized
ctgatatccctcgacttacagt

SEQ ID NO: 1345028 - DNA, 22 bp, Artificial Sequence
  chemically synthesized
aacgcgttgctgatatccctcg

SEQ ID NO: 1345029 - DNA, 22 bp, Artificial Sequence
  chemically synthesized
ctaaacgcgttgctgatatccc

SEQ ID NO: 1345030 - DNA, 22 bp, Artificial Sequence
  chemically synthesized
cctaaacgcgttgctgatatcc

SEQ ID NO: 1345031 - DNA, 22 bp, Artificial Sequence
  chemically synthesized
tcctaaacgcgttgctgatatc

SEQ ID NO: 1345032 - DNA, 22 bp, Artificial Sequence
  chemically synthesized
ttcctaaacgcgttgctgatat

SEQ ID NO: 1345033 - DNA, 22 bp, Artificial Sequence
  chemically synthesized
taagtcgagggatatcagcaac

SEQ ID NO: 1345034 - DNA, 22 bp, Artificial Sequence
  chemically synthesized
tttttcctaaacgcgttgctga

SEQ ID NO: 1345035 - DNA, 22 bp, Artificial Sequence
  chemically synthesized
tatttttcctaaacgcgttgct

SEQ ID NO: 1345036 - DNA, 22 bp, Artificial Sequence
  chemically synthesized
cctctatttttcctaaacgcgt

SEQ ID NO: 1345037 - DNA, 22 bp, Artificial Sequence
  chemically synthesized
gcctctatttttcctaaacgcg

SEQ ID NO: 1345038 - DNA, 22 bp, Artificial Sequence
  chemically synthesized
tgcctctatttttcctaaacgc

SEQ ID NO: 1345039 - DNA, 22 bp, Artificial Sequence
  chemically synthesized
gaggacactttgcctctatttt

SEQ ID NO: 1345040 - DNA, 22 bp, Artificial Sequence
  chemically synthesized
aggaaaaatagaggcaaagtgt

SEQ ID NO: 1345041 - DNA, 22 bp, Artificial Sequence
  chemically synthesized
ggaaaaatagaggcaaagtgtc

SEQ ID NO: 1345042 - DNA, 22 bp, Artificial Sequence
  chemically synthesized
agtccaccctagaggacacttt

SEQ ID NO: 1345043 - DNA, 22 bp, Artificial Sequence
  chemically synthesized
gtagctgagtccaccctagagg

SEQ ID NO: 1345044 - DNA, 22 bp, Artificial Sequence
  chemically synthesized
tggccctggtagctgagtccac

SEQ ID NO: 1345045 - DNA, 22 bp, Artificial Sequence
  chemically synthesized
ggctgtggccctggtagctgag

SEQ ID NO: 1345046 - DNA, 22 bp, Artificial Sequence
  chemically synthesized
tagggtggactcagctaccagg

SEQ ID NO: 1345047 - DNA, 22 bp, Artificial Sequence
  chemically synthesized
actaggctgtggccctggtagc

SEQ ID NO: 1345048 - DNA, 22 bp, Artificial Sequence
  chemically synthesized
gggtggactcagctaccagggc

SEQ ID NO: 1345049 - DNA, 22 bp, Artificial Sequence
  chemically synthesized
agctaccagggccacagcctag

SEQ ID NO: 1345050 - DNA, 22 bp, Artificial Sequence
  chemically synthesized
ccagggccacagcctagtcagg

SEQ ID NO: 1345051 - DNA, 22 bp, Artificial Sequence
  chemically synthesized
acataaaggcagtgtccctgac

SEQ ID NO: 1345052 - DNA, 22 bp, Artificial Sequence
  chemically synthesized
cacataaaggcagtgtccctga

SEQ ID NO: 1345053 - DNA, 22 bp, Artificial Sequence
  chemically synthesized
cttcacataaaggcagtgtccc

SEQ ID NO: 1345054 - DNA, 22 bp, Artificial Sequence
  chemically synthesized
ccttcacataaaggcagtgtcc

SEQ ID NO: 1345055 - DNA, 22 bp, Artificial Sequence
  chemically synthesized
gtcagggacactgcctttatgt

SEQ ID NO: 1345056 - DNA, 22 bp, Artificial Sequence
  chemically synthesized
aggaagtagagccttccttcac

SEQ ID NO: 1345057 - DNA, 22 bp, Artificial Sequence
  chemically synthesized
cctttatgtgaaggaaggctct

SEQ ID NO: 1345058 - DNA, 22 bp, Artificial Sequence
  chemically synthesized
ccctgaggaagtagagccttcc

SEQ ID NO: 1345059 - DNA, 22 bp, Artificial Sequence
  chemically synthesized
tatgtgaaggaaggctctactt

SEQ ID NO: 1345060 - DNA, 22 bp, Artificial Sequence
  chemically synthesized
atgtgaaggaaggctctacttc

SEQ ID NO: 1345061 - DNA, 22 bp, Artificial Sequence
  chemically synthesized
tgtgaaggaaggctctacttcc

SEQ ID NO: 1345062 - DNA, 22 bp, Artificial Sequence
  chemically synthesized
tgtctgccctgaggaagtagag

SEQ ID NO: 1345063 - DNA, 22 bp, Artificial Sequence
  chemically synthesized
atgggattgtgtctgccctgag

SEQ ID NO: 1345064 - DNA, 22 bp, Artificial Sequence
  chemically synthesized
tacttcctcagggcagacacaa

SEQ ID NO: 1345065 - DNA, 22 bp, Artificial Sequence
  chemically synthesized
cttcctcagggcagacacaatc

SEQ ID NO: 1345066 - DNA, 22 bp, Artificial Sequence
  chemically synthesized
cctcagggcagacacaatccca

SEQ ID NO: 1345067 - DNA, 22 bp, Artificial Sequence
  chemically synthesized
ctcagggcagacacaatcccat

SEQ ID NO: 1345068 - DNA, 22 bp, Artificial Sequence
  chemically synthesized
agggcagacacaatcccatgag

SEQ ID NO: 1345069 - DNA, 22 bp, Artificial Sequence
  chemically synthesized
taaaggcatccaagacacactc

SEQ ID NO: 1345070 - DNA, 22 bp, Artificial Sequence
  chemically synthesized
gtaaaggcatccaagacacact

SEQ ID NO: 1345071 - DNA, 22 bp, Artificial Sequence
  chemically synthesized
tgtaaaggcatccaagacacac

SEQ ID NO: 1345072 - DNA, 22 bp, Artificial Sequence
  chemically synthesized
aaatccagccctttgtaaaggc

SEQ ID NO: 1345073 - DNA, 22 bp, Artificial Sequence
  chemically synthesized
ggatgcctttacaaagggctgg

SEQ ID NO: 1345074 - DNA, 22 bp, Artificial Sequence
  chemically synthesized
gatgcctttacaaagggctgga

SEQ ID NO: 1345075 - DNA, 22 bp, Artificial Sequence
  chemically synthesized
tacaaagggctggatttcagtc

SEQ ID NO: 1345076 - DNA, 22 bp, Artificial Sequence
  chemically synthesized
acaaagggctggatttcagtcc

SEQ ID NO: 1345077 - DNA, 22 bp, Artificial Sequence
  chemically synthesized
caaagggctggatttcagtcct

SEQ ID NO: 1345078 - DNA, 22 bp, Artificial Sequence
  chemically synthesized
agaaggcaggtgaggactgaaa

SEQ ID NO: 1345079 - DNA, 22 bp, Artificial Sequence
  chemically synthesized
ggctgagaaggcaggtgaggac

SEQ ID NO: 1345080 - DNA, 22 bp, Artificial Sequence
  chemically synthesized
gatttcagtcctcacctgcctt

SEQ ID NO: 1345081 - DNA, 22 bp, Artificial Sequence
  chemically synthesized
cagtcctcacctgccttctcag

SEQ ID NO: 1345082 - DNA, 22 bp, Artificial Sequence
  chemically synthesized
agtcctcacctgccttctcagc

SEQ ID NO: 1345083 - DNA, 22 bp, Artificial Sequence
  chemically synthesized
catgcccaggcatgctcggctg

SEQ ID NO: 1345084 - DNA, 22 bp, Artificial Sequence
  chemically synthesized
acctgccttctcagccgagcat

SEQ ID NO: 1345085 - DNA, 22 bp, Artificial Sequence
  chemically synthesized
gcatgcccaggcatgctcggct

SEQ ID NO: 1345086 - DNA, 22 bp, Artificial Sequence
  chemically synthesized
tgcatgcccaggcatgctcggc

SEQ ID NO: 1345087 - DNA, 22 bp, Artificial Sequence
  chemically synthesized
ttgcatgcccaggcatgctcgg

SEQ ID NO: 1345088 - DNA, 22 bp, Artificial Sequence
  chemically synthesized
ccttctcagccgagcatgcctg

SEQ ID NO: 1345089 - DNA, 22 bp, Artificial Sequence
  chemically synthesized
tttttgcatgcccaggcatgct

SEQ ID NO: 1345090 - DNA, 22 bp, Artificial Sequence
  chemically synthesized
ctcagccgagcatgcctgggca

SEQ ID NO: 1345091 - DNA, 22 bp, Artificial Sequence
  chemically synthesized
tcagccgagcatgcctgggcat

SEQ ID NO: 1345092 - DNA, 22 bp, Artificial Sequence
  chemically synthesized
tgctatttttgcatgcccaggc

SEQ ID NO: 1345093 - DNA, 22 bp, Artificial Sequence
  chemically synthesized
agccgagcatgcctgggcatgc

SEQ ID NO: 1345094 - DNA, 22 bp, Artificial Sequence
  chemically synthesized
catgtaccattgtgctattttt

SEQ ID NO: 1345095 - DNA, 22 bp, Artificial Sequence
  chemically synthesized
ggcatgcaaaaatagcacaatg

SEQ ID NO: 1345096 - DNA, 22 bp, Artificial Sequence
  chemically synthesized
agggttccatgtaccattgtgc

SEQ ID NO: 1345097 - DNA, 22 bp, Artificial Sequence
  chemically synthesized
aagggttccatgtaccattgtg

SEQ ID NO: 1345098 - DNA, 22 bp, Artificial Sequence
  chemically synthesized
atggaatgtatttaagggttcc

SEQ ID NO: 1345099 - DNA, 22 bp, Artificial Sequence
  chemically synthesized
aatggaatgtatttaagggttc

SEQ ID NO: 1345100 - DNA, 22 bp, Artificial Sequence
  chemically synthesized
taatggaatgtatttaagggtt

SEQ ID NO: 1345101 - DNA, 22 bp, Artificial Sequence
  chemically synthesized
ttttaatggaatgtatttaagg

SEQ ID NO: 1345102 - DNA, 22 bp, Artificial Sequence
  chemically synthesized
gttttaatggaatgtatttaag

SEQ ID NO: 1345103 - DNA, 22 bp, Artificial Sequence
  chemically synthesized
tgtatttgttttaatggaatgt

SEQ ID NO: 1345104 - DNA, 22 bp, Artificial Sequence
  chemically synthesized
atgtatttgttttaatggaatg

SEQ ID NO: 1345105 - DNA, 22 bp, Artificial Sequence
  chemically synthesized
aaatacattccattaaaacaaa

SEQ ID NO: 1345106 - DNA, 22 bp, Artificial Sequence
  chemically synthesized
aatacattccattaaaacaaat

SEQ ID NO: 1345107 - DNA, 22 bp, Artificial Sequence
  chemically synthesized
ccaaatttatgtatttgtttta

SEQ ID NO: 1345108 - DNA, 22 bp, Artificial Sequence
  chemically synthesized
ccctgccaaatttatgtatttg

SEQ ID NO: 1345109 - DNA, 22 bp, Artificial Sequence
  chemically synthesized
gccctgccaaatttatgtattt

SEQ ID NO: 1345110 - DNA, 22 bp, Artificial Sequence
  chemically synthesized
tgccctgccaaatttatgtatt

SEQ ID NO: 1345111 - DNA, 22 bp, Artificial Sequence
  chemically synthesized
cattaaaacaaatacataaatt

SEQ ID NO: 1345112 - DNA, 22 bp, Artificial Sequence
  chemically synthesized
actttgccctgccaaatttatg

SEQ ID NO: 1345113 - DNA, 22 bp, Artificial Sequence
  chemically synthesized
aactttgccctgccaaatttat

SEQ ID NO: 1345114 - DNA, 22 bp, Artificial Sequence
  chemically synthesized
aaacaaatacataaatttggca

SEQ ID NO: 1345115 - DNA, 22 bp, Artificial Sequence
  chemically synthesized
aacttaactttgccctgccaaa

SEQ ID NO: 1345116 - DNA, 22 bp, Artificial Sequence
  chemically synthesized
taaacttaactttgccctgcca

SEQ ID NO: 1345117 - DNA, 22 bp, Artificial Sequence
  chemically synthesized
ctaaacttaactttgccctgcc

SEQ ID NO: 1345118 - DNA, 22 bp, Artificial Sequence
  chemically synthesized
ggcagggcaaagttaagtttag

SEQ ID NO: 1345119 - DNA, 22 bp, Artificial Sequence
  chemically synthesized
aataatagatttctaaacttaa

SEQ ID NO: 1345120 - DNA, 22 bp, Artificial Sequence
  chemically synthesized
gcagggcaaagttaagtttaga

SEQ ID NO: 1345121 - DNA, 22 bp, Artificial Sequence
  chemically synthesized
gaataatagatttctaaactta

SEQ ID NO: 1345122 - DNA, 22 bp, Artificial Sequence
  chemically synthesized
tgaataatagatttctaaactt

SEQ ID NO: 1345123 - DNA, 22 bp, Artificial Sequence
  chemically synthesized
ttgaataatagatttctaaact

SEQ ID NO: 1345124 - DNA, 22 bp, Artificial Sequence
  chemically synthesized
gcttttgaataatagatttcta

SEQ ID NO: 1345125 - DNA, 22 bp, Artificial Sequence
  chemically synthesized
ctggcttttgaataatagattt

SEQ ID NO: 1345126 - DNA, 22 bp, Artificial Sequence
  chemically synthesized
gctggcttttgaataatagatt

SEQ ID NO: 1345127 - DNA, 22 bp, Artificial Sequence
  chemically synthesized
agtttagaaatctattattcaa

SEQ ID NO: 1345128 - DNA, 22 bp, Artificial Sequence
  chemically synthesized
gaatccttgctggcttttgaat

SEQ ID NO: 1345129 - DNA, 22 bp, Artificial Sequence
  chemically synthesized
agaaatctattattcaaaagcc

SEQ ID NO: 1345130 - DNA, 22 bp, Artificial Sequence
  chemically synthesized
agaatccttgctggcttttgaa

SEQ ID NO: 1345131 - DNA, 22 bp, Artificial Sequence
  chemically synthesized
gaaatctattattcaaaagcca

SEQ ID NO: 1345132 - DNA, 22 bp, Artificial Sequence
  chemically synthesized
tagaatccttgctggcttttga

SEQ ID NO: 1345133 - DNA, 22 bp, Artificial Sequence
  chemically synthesized
ttattcaaaagccagcaaggat

SEQ ID NO: 1345134 - DNA, 22 bp, Artificial Sequence
  chemically synthesized
aaggactttagaatccttgctg

SEQ ID NO: 1345135 - DNA, 22 bp, Artificial Sequence
  chemically synthesized
ttcaaaagccagcaaggattct

SEQ ID NO: 1345136 - DNA, 22 bp, Artificial Sequence
  chemically synthesized
aaaagccagcaaggattctaaa

SEQ ID NO: 1345137 - DNA, 22 bp, Artificial Sequence
  chemically synthesized
agatcactgaaggactttagaa

SEQ ID NO: 1345138 - DNA, 22 bp, Artificial Sequence
  chemically synthesized
taaagtccttcagtgatcttag

SEQ ID NO: 1345139 - DNA, 22 bp, Artificial Sequence
  chemically synthesized
aaaagatcgcaatctaagatca

SEQ ID NO: 1345140 - DNA, 22 bp, Artificial Sequence
  chemically synthesized
aagtccttcagtgatcttagat

SEQ ID NO: 1345141 - DNA, 22 bp, Artificial Sequence
  chemically synthesized
caaaagatcgcaatctaagatc

SEQ ID NO: 1345142 - DNA, 22 bp, Artificial Sequence
  chemically synthesized
ttcaaaagatcgcaatctaaga

SEQ ID NO: 1345143 - DNA, 22 bp, Artificial Sequence
  chemically synthesized
cttcaaaagatcgcaatctaag

SEQ ID NO: 1345144 - DNA, 22 bp, Artificial Sequence
  chemically synthesized
cagtgatcttagattgcgatct

SEQ ID NO: 1345145 - DNA, 22 bp, Artificial Sequence
  chemically synthesized
agtgatcttagattgcgatctt

SEQ ID NO: 1345146 - DNA, 22 bp, Artificial Sequence
  chemically synthesized
atgtcttcttcaaaagatcgca

SEQ ID NO: 1345147 - DNA, 22 bp, Artificial Sequence
  chemically synthesized
aatgtcttcttcaaaagatcgc

SEQ ID NO: 1345148 - DNA, 22 bp, Artificial Sequence
  chemically synthesized
agattgcgatcttttgaagaag

SEQ ID NO: 1345149 - DNA, 22 bp, Artificial Sequence
  chemically synthesized
gattgcgatcttttgaagaaga

SEQ ID NO: 1345150 - DNA, 22 bp, Artificial Sequence
  chemically synthesized
gtatcatatttaatgtcttctt

SEQ ID NO: 1345151 - DNA, 22 bp, Artificial Sequence
  chemically synthesized
cgatcttttgaagaagacatta

SEQ ID NO: 1345152 - DNA, 22 bp, Artificial Sequence
  chemically synthesized
ttgaagaagacattaaatatga

SEQ ID NO: 1345153 - DNA, 22 bp, Artificial Sequence
  chemically synthesized
tgaagaagacattaaatatgat

SEQ ID NO: 1345154 - DNA, 22 bp, Artificial Sequence
  chemically synthesized
gaagaagacattaaatatgata

SEQ ID NO: 1345155 - DNA, 22 bp, Artificial Sequence
  chemically synthesized
aagaagacattaaatatgatac

SEQ ID NO: 1345156 - DNA, 22 bp, Artificial Sequence
  chemically synthesized
ataaatgaggtcagatattggt

SEQ ID NO: 1345157 - DNA, 22 bp, Artificial Sequence
  chemically synthesized
gataaatgaggtcagatattgg

SEQ ID NO: 1345158 - DNA, 22 bp, Artificial Sequence
  chemically synthesized
ttgataaatgaggtcagatatt

SEQ ID NO: 1345159 - DNA, 22 bp, Artificial Sequence
  chemically synthesized
aatatgataccaatatctgacc

SEQ ID NO: 1345160 - DNA, 22 bp, Artificial Sequence
  chemically synthesized
ctcttgataaatgaggtcagat

SEQ ID NO: 1345161 - DNA, 22 bp, Artificial Sequence
  chemically synthesized
cctcttgataaatgaggtcaga

SEQ ID NO: 1345162 - DNA, 22 bp, Artificial Sequence
  chemically synthesized
acatttcctcttgataaatgag

SEQ ID NO: 1345163 - DNA, 22 bp, Artificial Sequence
  chemically synthesized
acctcatttatcaagaggaaat

SEQ ID NO: 1345164 - DNA, 22 bp, Artificial Sequence
  chemically synthesized
agagaaactcacatttcctctt

SEQ ID NO: 1345165 - DNA, 22 bp, Artificial Sequence
  chemically synthesized
gagagaaactcacatttcctct

SEQ ID NO: 1345166 - DNA, 22 bp, Artificial Sequence
  chemically synthesized
tgagagaaactcacatttcctc

SEQ ID NO: 1345167 - DNA, 22 bp, Artificial Sequence
  chemically synthesized
atttatcaagaggaaatgtgag

SEQ ID NO: 1345168 - DNA, 22 bp, Artificial Sequence
  chemically synthesized
atcaagaggaaatgtgagtttc

SEQ ID NO: 1345169 - DNA, 22 bp, Artificial Sequence
  chemically synthesized
tcaagaggaaatgtgagtttct

SEQ ID NO: 1345170 - DNA, 22 bp, Artificial Sequence
  chemically synthesized
aacaccctttgagagaaactca

SEQ ID NO: 1345171 - DNA, 22 bp, Artificial Sequence
  chemically synthesized
ctcaacaccctttgagagaaac

SEQ ID NO: 1345172 - DNA, 22 bp, Artificial Sequence
  chemically synthesized
ctctcaaagggtgttgagtaga

SEQ ID NO: 1345173 - DNA, 22 bp, Artificial Sequence
  chemically synthesized
tctcaaagggtgttgagtagat

SEQ ID NO: 1345174 - DNA, 22 bp, Artificial Sequence
  chemically synthesized
tcaaagggtgttgagtagatat

SEQ ID NO: 1345175 - DNA, 22 bp, Artificial Sequence
  chemically synthesized
aaagggtgttgagtagatatca

SEQ ID NO: 1345176 - DNA, 22 bp, Artificial Sequence
  chemically synthesized
gagatagtaaacacgtgatatc

SEQ ID NO: 1345177 - DNA, 22 bp, Artificial Sequence
  chemically synthesized
ttagagatagtaaacacgtgat

SEQ ID NO: 1345178 - DNA, 22 bp, Artificial Sequence
  chemically synthesized
gttagagatagtaaacacgtga

SEQ ID NO: 1345179 - DNA, 22 bp, Artificial Sequence
  chemically synthesized
tttgttagagatagtaaacacg

SEQ ID NO: 1345180 - DNA, 22 bp, Artificial Sequence
  chemically synthesized
agtagatatcacgtgtttacta

SEQ ID NO: 1345181 - DNA, 22 bp, Artificial Sequence
  chemically synthesized
tgtttgttagagatagtaaaca

SEQ ID NO: 1345182 - DNA, 22 bp, Artificial Sequence
  chemically synthesized
gatgagttctgtttgttagaga

SEQ ID NO: 1345183 - DNA, 22 bp, Artificial Sequence
  chemically synthesized
tcatctggatgagttctgtttg

SEQ ID NO: 1345184 - DNA, 22 bp, Artificial Sequence
  chemically synthesized
actatctctaacaaacagaact

SEQ ID NO: 1345185 - DNA, 22 bp, Artificial Sequence
  chemically synthesized
ctatctctaacaaacagaactc

SEQ ID NO: 1345186 - DNA, 22 bp, Artificial Sequence
  chemically synthesized
tctctaacaaacagaactcatc

SEQ ID NO: 1345187 - DNA, 22 bp, Artificial Sequence
  chemically synthesized
taacaaacagaactcatccaga

SEQ ID NO: 1345188 - DNA, 22 bp, Artificial Sequence
  chemically synthesized
acaaacagaactcatccagatg

SEQ ID NO: 1345189 - DNA, 22 bp, Artificial Sequence
  chemically synthesized
atccagatgataatcttggtct

SEQ ID NO: 1345190 - DNA, 22 bp, Artificial Sequence
  chemically synthesized
gatcatcaccggcaggcaagac

SEQ ID NO: 1345191 - DNA, 22 bp, Artificial Sequence
  chemically synthesized
ctagatcatcaccggcaggcaa

SEQ ID NO: 1345192 - DNA, 22 bp, Artificial Sequence
  chemically synthesized
actagatcatcaccggcaggca

SEQ ID NO: 1345193 - DNA, 22 bp, Artificial Sequence
  chemically synthesized
ggtcttgcctgccggtgatgat

SEQ ID NO: 1345194 - DNA, 22 bp, Artificial Sequence
  chemically synthesized
taagtttactagatcatcaccg

SEQ ID NO: 1345195 - DNA, 22 bp, Artificial Sequence
  chemically synthesized
gtcttgcctgccggtgatgatc

SEQ ID NO: 1345196 - DNA, 22 bp, Artificial Sequence
  chemically synthesized
gcctgccggtgatgatctagta

SEQ ID NO: 1345197 - DNA, 22 bp, Artificial Sequence
  chemically synthesized
tgtctataagtttactagatca

SEQ ID NO: 1345198 - DNA, 22 bp, Artificial Sequence
  chemically synthesized
cctgccggtgatgatctagtaa

SEQ ID NO: 1345199 - DNA, 22 bp, Artificial Sequence
  chemically synthesized
ctgtgtctataagtttactaga

SEQ ID NO: 1345200 - DNA, 22 bp, Artificial Sequence
  chemically synthesized
ccggtgatgatctagtaaactt

SEQ ID NO: 1345201 - DNA, 22 bp, Artificial Sequence
  chemically synthesized
aaaaattgctgtgtctataagt

SEQ ID NO: 1345202 - DNA, 22 bp, Artificial Sequence
  chemically synthesized
ctaaaaaattgctgtgtctata

SEQ ID NO: 1345203 - DNA, 22 bp, Artificial Sequence
  chemically synthesized
gctaaaaaattgctgtgtctat

SEQ ID NO: 1345204 - DNA, 22 bp, Artificial Sequence
  chemically synthesized
gtaaacttatagacacagcaat

SEQ ID NO: 1345205 - DNA, 22 bp, Artificial Sequence
  chemically synthesized
aagtttgctaaaaaattgctgt

SEQ ID NO: 1345206 - DNA, 22 bp, Artificial Sequence
  chemically synthesized
aaagtttgctaaaaaattgctg

SEQ ID NO: 1345207 - DNA, 22 bp, Artificial Sequence
  chemically synthesized
tcttaaagtttgctaaaaaatt

SEQ ID NO: 1345208 - DNA, 22 bp, Artificial Sequence
  chemically synthesized
atagacacagcaattttttagc

SEQ ID NO: 1345209 - DNA, 22 bp, Artificial Sequence
  chemically synthesized
tagacacagcaattttttagca

SEQ ID NO: 1345210 - DNA, 22 bp, Artificial Sequence
  chemically synthesized
tactatcttaaagtttgctaaa

SEQ ID NO: 1345211 - DNA, 22 bp, Artificial Sequence
  chemically synthesized
ttatactatcttaaagtttgct

SEQ ID NO: 1345212 - DNA, 22 bp, Artificial Sequence
  chemically synthesized
gttatactatcttaaagtttgc

SEQ ID NO: 1345213 - DNA, 22 bp, Artificial Sequence
  chemically synthesized
tgttatactatcttaaagtttg

SEQ ID NO: 1345214 - DNA, 22 bp, Artificial Sequence
  chemically synthesized
aattttgttatactatcttaaa

SEQ ID NO: 1345215 - DNA, 22 bp, Artificial Sequence
  chemically synthesized
aaattttgttatactatcttaa

SEQ ID NO: 1345216 - DNA, 22 bp, Artificial Sequence
  chemically synthesized
tttagcaaactttaagatagta

SEQ ID NO: 1345217 - DNA, 22 bp, Artificial Sequence
  chemically synthesized
taaattttgttatactatctta

SEQ ID NO: 1345218 - DNA, 22 bp, Artificial Sequence
  chemically synthesized
ttagcaaactttaagatagtat

SEQ ID NO: 1345219 - DNA, 22 bp, Artificial Sequence
  chemically synthesized
tagcaaactttaagatagtata

SEQ ID NO: 1345220 - DNA, 22 bp, Artificial Sequence
  chemically synthesized
agcaaactttaagatagtataa

SEQ ID NO: 1345221 - DNA, 22 bp, Artificial Sequence
  chemically synthesized
gcaaactttaagatagtataac

SEQ ID NO: 1345222 - DNA, 22 bp, Artificial Sequence
  chemically synthesized
tctttaaattttgttatactat

SEQ ID NO: 1345223 - DNA, 22 bp, Artificial Sequence
  chemically synthesized
gtctttaaattttgttatacta

SEQ ID NO: 1345224 - DNA, 22 bp, Artificial Sequence
  chemically synthesized
tgtctttaaattttgttatact

SEQ ID NO: 1345225 - DNA, 22 bp, Artificial Sequence
  chemically synthesized
gttttgtctttaaattttgtta

SEQ ID NO: 1345226 - DNA, 22 bp, Artificial Sequence
  chemically synthesized
agttttgtctttaaattttgtt

SEQ ID NO: 1345227 - DNA, 22 bp, Artificial Sequence
  chemically synthesized
taagatagtataacaaaattta

SEQ ID NO: 1345228 - DNA, 22 bp, Artificial Sequence
  chemically synthesized
aagatagtataacaaaatttaa

SEQ ID NO: 1345229 - DNA, 22 bp, Artificial Sequence
  chemically synthesized
agatagtataacaaaatttaaa

SEQ ID NO: 1345230 - DNA, 22 bp, Artificial Sequence
  chemically synthesized
aaaatccttagttttgtcttta

SEQ ID NO: 1345231 - DNA, 22 bp, Artificial Sequence
  chemically synthesized
aaaaatccttagttttgtcttt

SEQ ID NO: 1345232 - DNA, 22 bp, Artificial Sequence
  chemically synthesized
aaggtttaaaaatccttagttt

SEQ ID NO: 1345233 - DNA, 22 bp, Artificial Sequence
  chemically synthesized
aaagacaaaactaaggattttt

SEQ ID NO: 1345234 - DNA, 22 bp, Artificial Sequence
  chemically synthesized
aagacaaaactaaggattttta

SEQ ID NO: 1345235 - DNA, 22 bp, Artificial Sequence
  chemically synthesized
aataagattaaaggtttaaaaa

SEQ ID NO: 1345236 - DNA, 22 bp, Artificial Sequence
  chemically synthesized
aaataagattaaaggtttaaaa

SEQ ID NO: 1345237 - DNA, 22 bp, Artificial Sequence
  chemically synthesized
atttaaataagattaaaggttt

SEQ ID NO: 1345238 - DNA, 22 bp, Artificial Sequence
  chemically synthesized
taatttaaataagattaaaggt

SEQ ID NO: 1345239 - DNA, 22 bp, Artificial Sequence
  chemically synthesized
aggatttttaaacctttaatct

SEQ ID NO: 1345240 - DNA, 22 bp, Artificial Sequence
  chemically synthesized
ttaaacctttaatcttatttaa

SEQ ID NO: 1345241 - DNA, 22 bp, Artificial Sequence
  chemically synthesized
taaacctttaatcttatttaaa

SEQ ID NO: 1345242 - DNA, 22 bp, Artificial Sequence
  chemically synthesized
atagagttctaatttaaataag

SEQ ID NO: 1345243 - DNA, 22 bp, Artificial Sequence
  chemically synthesized
aaacctttaatcttatttaaat

SEQ ID NO: 1345244 - DNA, 22 bp, Artificial Sequence
  chemically synthesized
aacctttaatcttatttaaatt

SEQ ID NO: 1345245 - DNA, 22 bp, Artificial Sequence
  chemically synthesized
attgatagagttctaatttaaa

SEQ ID NO: 1345246 - DNA, 22 bp, Artificial Sequence
  chemically synthesized
taatcttatttaaattagaact

SEQ ID NO: 1345247 - DNA, 22 bp, Artificial Sequence
  chemically synthesized
attcattgatagagttctaatt

SEQ ID NO: 1345248 - DNA, 22 bp, Artificial Sequence
  chemically synthesized
aatcttatttaaattagaactc

SEQ ID NO: 1345249 - DNA, 22 bp, Artificial Sequence
  chemically synthesized
aattcattgatagagttctaat

SEQ ID NO: 1345250 - DNA, 22 bp, Artificial Sequence
  chemically synthesized
atcttatttaaattagaactct

SEQ ID NO: 1345251 - DNA, 22 bp, Artificial Sequence
  chemically synthesized
atttaaattagaactctatcaa

SEQ ID NO: 1345252 - DNA, 22 bp, Artificial Sequence
  chemically synthesized
tttaaattagaactctatcaat

SEQ ID NO: 1345253 - DNA, 22 bp, Artificial Sequence
  chemically synthesized
gacatttaattcattgatagag

SEQ ID NO: 1345254 - DNA, 22 bp, Artificial Sequence
  chemically synthesized
aaattagaactctatcaatgaa

SEQ ID NO: 1345255 - DNA, 22 bp, Artificial Sequence
  chemically synthesized
aattagaactctatcaatgaat

SEQ ID NO: 1345256 - DNA, 22 bp, Artificial Sequence
  chemically synthesized
ggttggacatttaattcattga

SEQ ID NO: 1345257 - DNA, 22 bp, Artificial Sequence
  chemically synthesized
gaactctatcaatgaattaaat

SEQ ID NO: 1345258 - DNA, 22 bp, Artificial Sequence
  chemically synthesized
acacctaggttggacatttaat

SEQ ID NO: 1345259 - DNA, 22 bp, Artificial Sequence
  chemically synthesized
aacacctaggttggacatttaa

SEQ ID NO: 1345260 - DNA, 22 bp, Artificial Sequence
  chemically synthesized
taacacctaggttggacattta

SEQ ID NO: 1345261 - DNA, 22 bp, Artificial Sequence
  chemically synthesized
tatcaatgaattaaatgtccaa

SEQ ID NO: 1345262 - DNA, 22 bp, Artificial Sequence
  chemically synthesized
ttaacacctaggttggacattt

SEQ ID NO: 1345263 - DNA, 22 bp, Artificial Sequence
  chemically synthesized
tcaatgaattaaatgtccaacc

SEQ ID NO: 1345264 - DNA, 22 bp, Artificial Sequence
  chemically synthesized
aatgtccaacctaggtgttaaa

SEQ ID NO: 1345265 - DNA, 22 bp, Artificial Sequence
  chemically synthesized
gagtaatagagaatttttaaca

SEQ ID NO: 1345266 - DNA, 22 bp, Artificial Sequence
  chemically synthesized
ttagagtaatagagaattttta

SEQ ID NO: 1345267 - DNA, 22 bp, Artificial Sequence
  chemically synthesized
ggtgttaaaaattctctattac

SEQ ID NO: 1345268 - DNA, 22 bp, Artificial Sequence
  chemically synthesized
gggagaaattattagagtaata

SEQ ID NO: 1345269 - DNA, 22 bp, Artificial Sequence
  chemically synthesized
ggggagaaattattagagtaat

SEQ ID NO: 1345270 - DNA, 22 bp, Artificial Sequence
  chemically synthesized
aaaattctctattactctaata

SEQ ID NO: 1345271 - DNA, 22 bp, Artificial Sequence
  chemically synthesized
caaaatttggggagaaattatt

SEQ ID NO: 1345272 - DNA, 22 bp, Artificial Sequence
  chemically synthesized
tctattactctaataatttctc

SEQ ID NO: 1345273 - DNA, 22 bp, Artificial Sequence
  chemically synthesized
tattactctaataatttctccc

SEQ ID NO: 1345274 - DNA, 22 bp, Artificial Sequence
  chemically synthesized
ttactctaataatttctcccca

SEQ ID NO: 1345275 - DNA, 22 bp, Artificial Sequence
  chemically synthesized
ctctaataatttctccccaaat

SEQ ID NO: 1345276 - DNA, 22 bp, Artificial Sequence
  chemically synthesized
taataatttctccccaaatttt

SEQ ID NO: 1345277 - DNA, 22 bp, Artificial Sequence
  chemically synthesized
ataatttctccccaaattttgt

SEQ ID NO: 1345278 - DNA, 22 bp, Artificial Sequence
  chemically synthesized
gaatatcgaatatgttacaaaa

SEQ ID NO: 1345279 - DNA, 22 bp, Artificial Sequence
  chemically synthesized
tggaatatcgaatatgttacaa

SEQ ID NO: 1345280 - DNA, 22 bp, Artificial Sequence
  chemically synthesized
ctccccaaattttgtaacatat

SEQ ID NO: 1345281 - DNA, 22 bp, Artificial Sequence
  chemically synthesized
tccccaaattttgtaacatatt

SEQ ID NO: 1345282 - DNA, 22 bp, Artificial Sequence
  chemically synthesized
cccaaattttgtaacatattcg

SEQ ID NO: 1345283 - DNA, 22 bp, Artificial Sequence
  chemically synthesized
tgtaacatattcgatattccag

SEQ ID NO: 1345284 - DNA, 22 bp, Artificial Sequence
  chemically synthesized
gtaacatattcgatattccaga

SEQ ID NO: 1345285 - DNA, 22 bp, Artificial Sequence
  chemically synthesized
taacatattcgatattccagaa

SEQ ID NO: 1345286 - DNA, 22 bp, Artificial Sequence
  chemically synthesized
caatgcaaagagttctggaata

SEQ ID NO: 1345287 - DNA, 22 bp, Artificial Sequence
  chemically synthesized
ttacaatgcaaagagttctgga

SEQ ID NO: 1345288 - DNA, 22 bp, Artificial Sequence
  chemically synthesized
gatattccagaactctttgcat

SEQ ID NO: 1345289 - DNA, 22 bp, Artificial Sequence
  chemically synthesized
cagaactctttgcattgtaata

SEQ ID NO: 1345290 - DNA, 22 bp, Artificial Sequence
  chemically synthesized
atatgcaacaaaatgctattac

SEQ ID NO: 1345291 - DNA, 22 bp, Artificial Sequence
  chemically synthesized
catatgcaacaaaatgctatta

SEQ ID NO: 1345292 - DNA, 22 bp, Artificial Sequence
  chemically synthesized
tttgcattgtaatagcattttg

SEQ ID NO: 1345293 - DNA, 22 bp, Artificial Sequence
  chemically synthesized
tgcattgtaatagcattttgtt

SEQ ID NO: 1345294 - DNA, 22 bp, Artificial Sequence
  chemically synthesized
gcattgtaatagcattttgttg

SEQ ID NO: 1345295 - DNA, 22 bp, Artificial Sequence
  chemically synthesized
cattgtaatagcattttgttgc

SEQ ID NO: 1345296 - DNA, 22 bp, Artificial Sequence
  chemically synthesized
taatagcattttgttgcatatg

SEQ ID NO: 1345297 - DNA, 22 bp, Artificial Sequence
  chemically synthesized
atgagatacgtgacgtatttca

SEQ ID NO: 1345298 - DNA, 22 bp, Artificial Sequence
  chemically synthesized
aatgagatacgtgacgtatttc

SEQ ID NO: 1345299 - DNA, 22 bp, Artificial Sequence
  chemically synthesized
tgttgcatatgaaatacgtcac

SEQ ID NO: 1345300 - DNA, 22 bp, Artificial Sequence
  chemically synthesized
gttgcatatgaaatacgtcacg

SEQ ID NO: 1345301 - DNA, 22 bp, Artificial Sequence
  chemically synthesized
ttgcatatgaaatacgtcacgt

SEQ ID NO: 1345302 - DNA, 22 bp, Artificial Sequence
  chemically synthesized
gtatttaatgagatacgtgacg

SEQ ID NO: 1345303 - DNA, 22 bp, Artificial Sequence
  chemically synthesized
catatgaaatacgtcacgtatc

SEQ ID NO: 1345304 - DNA, 22 bp, Artificial Sequence
  chemically synthesized
agtatttaatgagatacgtgac

SEQ ID NO: 1345305 - DNA, 22 bp, Artificial Sequence
  chemically synthesized
tagtatttaatgagatacgtga

SEQ ID NO: 1345306 - DNA, 22 bp, Artificial Sequence
  chemically synthesized
ctttagtatttaatgagatacg

SEQ ID NO: 1345307 - DNA, 22 bp, Artificial Sequence
  chemically synthesized
gctttagtatttaatgagatac

SEQ ID NO: 1345308 - DNA, 22 bp, Artificial Sequence
  chemically synthesized
tgctttagtatttaatgagata

SEQ ID NO: 1345309 - DNA, 22 bp, Artificial Sequence
  chemically synthesized
atgttttgctttagtatttaat

SEQ ID NO: 1345310 - DNA, 22 bp, Artificial Sequence
  chemically synthesized
aatgttttgctttagtatttaa

SEQ ID NO: 1345311 - DNA, 22 bp, Artificial Sequence
  chemically synthesized
taatgttttgctttagtattta

SEQ ID NO: 1345312 - DNA, 22 bp, Artificial Sequence
  chemically synthesized
ctttaatgttttgctttagtat

SEQ ID NO: 1345313 - DNA, 22 bp, Artificial Sequence
  chemically synthesized
cctttaatgttttgctttagta

SEQ ID NO: 1345314 - DNA, 22 bp, Artificial Sequence
  chemically synthesized
tcctttaatgttttgctttagt

SEQ ID NO: 1345315 - DNA, 22 bp, Artificial Sequence
  chemically synthesized
ttcctttaatgttttgctttag

SEQ ID NO: 1345316 - DNA, 22 bp, Artificial Sequence
  chemically synthesized
attaaatactaaagcaaaacat

SEQ ID NO: 1345317 - DNA, 22 bp, Artificial Sequence
  chemically synthesized
aatactaaagcaaaacattaaa

SEQ ID NO: 1345318 - DNA, 22 bp, Artificial Sequence
  chemically synthesized
ggacagtaatttttcctttaat

SEQ ID NO: 1345319 - DNA, 22 bp, Artificial Sequence
  chemically synthesized
aagcaaaacattaaaggaaaaa

SEQ ID NO: 1345320 - DNA, 22 bp, Artificial Sequence
  chemically synthesized
taggattgggacagtaattttt

SEQ ID NO: 1345321 - DNA, 22 bp, Artificial Sequence
  chemically synthesized
atctgtaggattgggacagtaa

SEQ ID NO: 1345322 - DNA, 22 bp, Artificial Sequence
  chemically synthesized
aaggaaaaattactgtcccaat

SEQ ID NO: 1345323 - DNA, 22 bp, Artificial Sequence
  chemically synthesized
ctcatctgtaggattgggacag

SEQ ID NO: 1345324 - DNA, 22 bp, Artificial Sequence
  chemically synthesized
cctcatctgtaggattgggaca

SEQ ID NO: 1345325 - DNA, 22 bp, Artificial Sequence
  chemically synthesized
aatttcctcatctgtaggattg

SEQ ID NO: 1345326 - DNA, 22 bp, Artificial Sequence
  chemically synthesized
ctgtcccaatcctacagatgag

SEQ ID NO: 1345327 - DNA, 22 bp, Artificial Sequence
  chemically synthesized
agactcaatttcctcatctgta

SEQ ID NO: 1345328 - DNA, 22 bp, Artificial Sequence
  chemically synthesized
tcccaatcctacagatgaggaa

SEQ ID NO: 1345329 - DNA, 22 bp, Artificial Sequence
  chemically synthesized
tactgagactcaatttcctcat

SEQ ID NO: 1345330 - DNA, 22 bp, Artificial Sequence
  chemically synthesized
actatactgagactcaatttcc

SEQ ID NO: 1345331 - DNA, 22 bp, Artificial Sequence
  chemically synthesized
cagatgaggaaattgagtctca

SEQ ID NO: 1345332 - DNA, 22 bp, Artificial Sequence
  chemically synthesized
gaaagatgatctaactatactg

SEQ ID NO: 1345333 - DNA, 22 bp, Artificial Sequence
  chemically synthesized
agaaagatgatctaactatact

SEQ ID NO: 1345334 - DNA, 22 bp, Artificial Sequence
  chemically synthesized
ccttagaaagatgatctaacta

SEQ ID NO: 1345335 - DNA, 22 bp, Artificial Sequence
  chemically synthesized
cccttagaaagatgatctaact

SEQ ID NO: 1345336 - DNA, 22 bp, Artificial Sequence
  chemically synthesized
agtctcagtatagttagatcat

SEQ ID NO: 1345337 - DNA, 22 bp, Artificial Sequence
  chemically synthesized
tgtttcccttagaaagatgatc

SEQ ID NO: 1345338 - DNA, 22 bp, Artificial Sequence
  chemically synthesized
gtgtttcccttagaaagatgat

SEQ ID NO: 1345339 - DNA, 22 bp, Artificial Sequence
  chemically synthesized
agtatagttagatcatctttct

SEQ ID NO: 1345340 - DNA, 22 bp, Artificial Sequence
  chemically synthesized
gatcatctttctaagggaaaca

SEQ ID NO: 1345341 - DNA, 22 bp, Artificial Sequence
  chemically synthesized
ataaagacaaaagtcttgtgtt

SEQ ID NO: 1345342 - DNA, 22 bp, Artificial Sequence
  chemically synthesized
tctaagggaaacacaagacttt

SEQ ID NO: 1345343 - DNA, 22 bp, Artificial Sequence
  chemically synthesized
ctaagggaaacacaagactttt

SEQ ID NO: 1345344 - DNA, 22 bp, Artificial Sequence
  chemically synthesized
attgataaagacaaaagtcttg

SEQ ID NO: 1345345 - DNA, 22 bp, Artificial Sequence
  chemically synthesized
taagggaaacacaagacttttg

SEQ ID NO: 1345346 - DNA, 22 bp, Artificial Sequence
  chemically synthesized
agggaaacacaagacttttgtc

SEQ ID NO: 1345347 - DNA, 22 bp, Artificial Sequence
  chemically synthesized
ttgtctttatcaattagtcaca

SEQ ID NO: 1345348 - DNA, 22 bp, Artificial Sequence
  chemically synthesized
tgtctttatcaattagtcacat

SEQ ID NO: 1345349 - DNA, 22 bp, Artificial Sequence
  chemically synthesized
gtctttatcaattagtcacatc

SEQ ID NO: 1345350 - DNA, 22 bp, Artificial Sequence
  chemically synthesized
tctttatcaattagtcacatca

SEQ ID NO: 1345351 - DNA, 22 bp, Artificial Sequence
  chemically synthesized
aataaatgatataaatgatgtg

SEQ ID NO: 1345352 - DNA, 22 bp, Artificial Sequence
  chemically synthesized
tatcaattagtcacatcattta

SEQ ID NO: 1345353 - DNA, 22 bp, Artificial Sequence
  chemically synthesized
atcaattagtcacatcatttat

SEQ ID NO: 1345354 - DNA, 22 bp, Artificial Sequence
  chemically synthesized
tcaattagtcacatcatttata

SEQ ID NO: 1345355 - DNA, 22 bp, Artificial Sequence
  chemically synthesized
gtcacatcatttatatcattta

SEQ ID NO: 1345356 - DNA, 22 bp, Artificial Sequence
  chemically synthesized
gaacagtgctcaataaatgata

SEQ ID NO: 1345357 - DNA, 22 bp, Artificial Sequence
  chemically synthesized
agaacagtgctcaataaatgat

SEQ ID NO: 1345358 - DNA, 22 bp, Artificial Sequence
  chemically synthesized
atatcatttattgagcactgtt

SEQ ID NO: 1345359 - DNA, 22 bp, Artificial Sequence
  chemically synthesized
tgatacccttagaacagtgctc

SEQ ID NO: 1345360 - DNA, 22 bp, Artificial Sequence
  chemically synthesized
tatcatttattgagcactgttc

SEQ ID NO: 1345361 - DNA, 22 bp, Artificial Sequence
  chemically synthesized
gtgatacccttagaacagtgct

SEQ ID NO: 1345362 - DNA, 22 bp, Artificial Sequence
  chemically synthesized
attgagcactgttctaagggta

SEQ ID NO: 1345363 - DNA, 22 bp, Artificial Sequence
  chemically synthesized
ttgagcactgttctaagggtat

SEQ ID NO: 1345364 - DNA, 22 bp, Artificial Sequence
  chemically synthesized
agcactgttctaagggtatcac

SEQ ID NO: 1345365 - DNA, 22 bp, Artificial Sequence
  chemically synthesized
aaagagcagccgccatttgtga

SEQ ID NO: 1345366 - DNA, 22 bp, Artificial Sequence
  chemically synthesized
ttctaagggtatcacaaatggc

SEQ ID NO: 1345367 - DNA, 22 bp, Artificial Sequence
  chemically synthesized
taagggtatcacaaatggcggc

SEQ ID NO: 1345368 - DNA, 22 bp, Artificial Sequence
  chemically synthesized
agggtatcacaaatggcggctg

SEQ ID NO: 1345369 - DNA, 22 bp, Artificial Sequence
  chemically synthesized
atgattcaaagagcagccgcca

SEQ ID NO: 1345370 - DNA, 22 bp, Artificial Sequence
  chemically synthesized
ttgatgattcaaagagcagccg

SEQ ID NO: 1345371 - DNA, 22 bp, Artificial Sequence
  chemically synthesized
gactgttgatgattcaaagagc

SEQ ID NO: 1345372 - DNA, 22 bp, Artificial Sequence
  chemically synthesized
ttggactgttgatgattcaaag

SEQ ID NO: 1345373 - DNA, 22 bp, Artificial Sequence
  chemically synthesized
gttggactgttgatgattcaaa

SEQ ID NO: 1345374 - DNA, 22 bp, Artificial Sequence
  chemically synthesized
caccttgttggactgttgatga

SEQ ID NO: 1345375 - DNA, 22 bp, Artificial Sequence
  chemically synthesized
ctctttgaatcatcaacagtcc

SEQ ID NO: 1345376 - DNA, 22 bp, Artificial Sequence
  chemically synthesized
tttgaatcatcaacagtccaac

SEQ ID NO: 1345377 - DNA, 22 bp, Artificial Sequence
  chemically synthesized
tgaatcatcaacagtccaacaa

SEQ ID NO: 1345378 - DNA, 22 bp, Artificial Sequence
  chemically synthesized
gaatcatcaacagtccaacaag

SEQ ID NO: 1345379 - DNA, 22 bp, Artificial Sequence
  chemically synthesized
aatcatcaacagtccaacaagg

SEQ ID NO: 1345380 - DNA, 22 bp, Artificial Sequence
  chemically synthesized
taaacatggggaaaataacagc

SEQ ID NO: 1345381 - DNA, 22 bp, Artificial Sequence
  chemically synthesized
tgtaaacatggggaaaataaca

SEQ ID NO: 1345382 - DNA, 22 bp, Artificial Sequence
  chemically synthesized
ctgtaaacatggggaaaataac

SEQ ID NO: 1345383 - DNA, 22 bp, Artificial Sequence
  chemically synthesized
ttctgtaaacatggggaaaata

SEQ ID NO: 1345384 - DNA, 22 bp, Artificial Sequence
  chemically synthesized
cctcttctgtaaacatggggaa

SEQ ID NO: 1345385 - DNA, 22 bp, Artificial Sequence
  chemically synthesized
aatctacctcttctgtaaacat

SEQ ID NO: 1345386 - DNA, 22 bp, Artificial Sequence
  chemically synthesized
ttattttccccatgtttacaga

SEQ ID NO: 1345387 - DNA, 22 bp, Artificial Sequence
  chemically synthesized
ctcaatctacctcttctgtaaa

SEQ ID NO: 1345388 - DNA, 22 bp, Artificial Sequence
  chemically synthesized
ttttccccatgtttacagaaga

SEQ ID NO: 1345389 - DNA, 22 bp, Artificial Sequence
  chemically synthesized
ttcctcaatctacctcttctgt

SEQ ID NO: 1345390 - DNA, 22 bp, Artificial Sequence
  chemically synthesized
tccccatgtttacagaagaggt

SEQ ID NO: 1345391 - DNA, 22 bp, Artificial Sequence
  chemically synthesized
ccccatgtttacagaagaggta

SEQ ID NO: 1345392 - DNA, 22 bp, Artificial Sequence
  chemically synthesized
tgttcctcaatctacctcttct

SEQ ID NO: 1345393 - DNA, 22 bp, Artificial Sequence
  chemically synthesized
cccatgtttacagaagaggtag

SEQ ID NO: 1345394 - DNA, 22 bp, Artificial Sequence
  chemically synthesized
tctgttcctcaatctacctctt

SEQ ID NO: 1345395 - DNA, 22 bp, Artificial Sequence
  chemically synthesized
acctctctgttcctcaatctac

SEQ ID NO: 1345396 - DNA, 22 bp, Artificial Sequence
  chemically synthesized
aacctctctgttcctcaatcta

SEQ ID NO: 1345397 - DNA, 22 bp, Artificial Sequence
  chemically synthesized
acagaagaggtagattgaggaa

SEQ ID NO: 1345398 - DNA, 22 bp, Artificial Sequence
  chemically synthesized
cagaagaggtagattgaggaac

SEQ ID NO: 1345399 - DNA, 22 bp, Artificial Sequence
  chemically synthesized
tttaacctctctgttcctcaat

SEQ ID NO: 1345400 - DNA, 22 bp, Artificial Sequence
  chemically synthesized
ggcacattatttaacctctctg

SEQ ID NO: 1345401 - DNA, 22 bp, Artificial Sequence
  chemically synthesized
gggcacattatttaacctctct

SEQ ID NO: 1345402 - DNA, 22 bp, Artificial Sequence
  chemically synthesized
accttgggcacattatttaacc

SEQ ID NO: 1345403 - DNA, 22 bp, Artificial Sequence
  chemically synthesized
aggaacagagaggttaaataat

SEQ ID NO: 1345404 - DNA, 22 bp, Artificial Sequence
  chemically synthesized
gaccttgggcacattatttaac

SEQ ID NO: 1345405 - DNA, 22 bp, Artificial Sequence
  chemically synthesized
ccagcatttgaccttgggcaca

SEQ ID NO: 1345406 - DNA, 22 bp, Artificial Sequence
  chemically synthesized
taccagcatttgaccttgggca

SEQ ID NO: 1345407 - DNA, 22 bp, Artificial Sequence
  chemically synthesized
tctaccagcatttgaccttggg

SEQ ID NO: 1345408 - DNA, 22 bp, Artificial Sequence
  chemically synthesized
aataatgtgcccaaggtcaaat

SEQ ID NO: 1345409 - DNA, 22 bp, Artificial Sequence
  chemically synthesized
ttctctaccagcatttgacctt

SEQ ID NO: 1345410 - DNA, 22 bp, Artificial Sequence
  chemically synthesized
attctctaccagcatttgacct

SEQ ID NO: 1345411 - DNA, 22 bp, Artificial Sequence
  chemically synthesized
tattctctaccagcatttgacc

SEQ ID NO: 1345412 - DNA, 22 bp, Artificial Sequence
  chemically synthesized
atacataaaaaatggttttatt

SEQ ID NO: 1345413 - DNA, 22 bp, Artificial Sequence
  chemically synthesized
gtagagaataaaaccatttttt

SEQ ID NO: 1345414 - DNA, 22 bp, Artificial Sequence
  chemically synthesized
taagaaataggcactcatacat

SEQ ID NO: 1345415 - DNA, 22 bp, Artificial Sequence
  chemically synthesized
gtaagaaataggcactcataca

SEQ ID NO: 1345416 - DNA, 22 bp, Artificial Sequence
  chemically synthesized
tgtaagaaataggcactcatac

SEQ ID NO: 1345417 - DNA, 22 bp, Artificial Sequence
  chemically synthesized
tttatgtatgagtgcctatttc

SEQ ID NO: 1345418 - DNA, 22 bp, Artificial Sequence
  chemically synthesized
ttatgtatgagtgcctatttct

SEQ ID NO: 1345419 - DNA, 22 bp, Artificial Sequence
  chemically synthesized
tatgtatgagtgcctatttctt

SEQ ID NO: 1345420 - DNA, 22 bp, Artificial Sequence
  chemically synthesized
atgtatgagtgcctatttctta

SEQ ID NO: 1345421 - DNA, 22 bp, Artificial Sequence
  chemically synthesized
tgtatgagtgcctatttcttac

SEQ ID NO: 1345422 - DNA, 22 bp, Artificial Sequence
  chemically synthesized
aacataatatatataaagagtt

SEQ ID NO: 1345423 - DNA, 22 bp, Artificial Sequence
  chemically synthesized
tttcttacaaaactctttatat

SEQ ID NO: 1345424 - DNA, 22 bp, Artificial Sequence
  chemically synthesized
cttacaaaactctttatatata

SEQ ID NO: 1345425 - DNA, 22 bp, Artificial Sequence
  chemically synthesized
ttacaaaactctttatatatat

SEQ ID NO: 1345426 - DNA, 22 bp, Artificial Sequence
  chemically synthesized
acaaaactctttatatatatta

SEQ ID NO: 1345427 - DNA, 22 bp, Artificial Sequence
  chemically synthesized
aaatactgaacataatatatat

SEQ ID NO: 1345428 - DNA, 22 bp, Artificial Sequence
  chemically synthesized
caaaactctttatatatattat

SEQ ID NO: 1345429 - DNA, 22 bp, Artificial Sequence
  chemically synthesized
ctaaaatactgaacataatata

SEQ ID NO: 1345430 - DNA, 22 bp, Artificial Sequence
  chemically synthesized
gttcctaaaatactgaacataa

SEQ ID NO: 1345431 - DNA, 22 bp, Artificial Sequence
  chemically synthesized
tttatatatattatgttcagta

SEQ ID NO: 1345432 - DNA, 22 bp, Artificial Sequence
  chemically synthesized
tggttcctaaaatactgaacat

SEQ ID NO: 1345433 - DNA, 22 bp, Artificial Sequence
  chemically synthesized
ctggttcctaaaatactgaaca

SEQ ID NO: 1345434 - DNA, 22 bp, Artificial Sequence
  chemically synthesized
tatatatattatgttcagtatt

SEQ ID NO: 1345435 - DNA, 22 bp, Artificial Sequence
  chemically synthesized
tctggttcctaaaatactgaac

SEQ ID NO: 1345436 - DNA, 22 bp, Artificial Sequence
  chemically synthesized
atatatattatgttcagtattt

SEQ ID NO: 1345437 - DNA, 22 bp, Artificial Sequence
  chemically synthesized
tatatattatgttcagtatttt

SEQ ID NO: 1345438 - DNA, 22 bp, Artificial Sequence
  chemically synthesized
tgttcagtattttaggaaccag

SEQ ID NO: 1345439 - DNA, 22 bp, Artificial Sequence
  chemically synthesized
agtattttaggaaccagaaagg

SEQ ID NO: 1345440 - DNA, 22 bp, Artificial Sequence
  chemically synthesized
taggaaccagaaagggtgatat

SEQ ID NO: 1345441 - DNA, 22 bp, Artificial Sequence
  chemically synthesized
aggaaccagaaagggtgatatt

SEQ ID NO: 1345442 - DNA, 22 bp, Artificial Sequence
  chemically synthesized
ggaaccagaaagggtgatattg

SEQ ID NO: 1345443 - DNA, 22 bp, Artificial Sequence
  chemically synthesized
tcaataataaaatgggaataac

SEQ ID NO: 1345444 - DNA, 22 bp, Artificial Sequence
  chemically synthesized
atcaataataaaatgggaataa

SEQ ID NO: 1345445 - DNA, 22 bp, Artificial Sequence
  chemically synthesized
agatttatcaataataaaatgg

SEQ ID NO: 1345446 - DNA, 22 bp, Artificial Sequence
  chemically synthesized
ttattcccattttattattgat

SEQ ID NO: 1345447 - DNA, 22 bp, Artificial Sequence
  chemically synthesized
aacctcagatttatcaataata

SEQ ID NO: 1345448 - DNA, 22 bp, Artificial Sequence
  chemically synthesized
tcaacctcagatttatcaataa

SEQ ID NO: 1345449 - DNA, 22 bp, Artificial Sequence
  chemically synthesized
ttcccattttattattgataaa

SEQ ID NO: 1345450 - DNA, 22 bp, Artificial Sequence
  chemically synthesized
ctcaacctcagatttatcaata

SEQ ID NO: 1345451 - DNA, 22 bp, Artificial Sequence
  chemically synthesized
tctcaacctcagatttatcaat

SEQ ID NO: 1345452 - DNA, 22 bp, Artificial Sequence
  chemically synthesized
ccattttattattgataaatct

SEQ ID NO: 1345453 - DNA, 22 bp, Artificial Sequence
  chemically synthesized
acctttctcaacctcagattta

SEQ ID NO: 1345454 - DNA, 22 bp, Artificial Sequence
  chemically synthesized
aacctttctcaacctcagattt

SEQ ID NO: 1345455 - DNA, 22 bp, Artificial Sequence
  chemically synthesized
tattattgataaatctgaggtt

SEQ ID NO: 1345456 - DNA, 22 bp, Artificial Sequence
  chemically synthesized
attattgataaatctgaggttg

SEQ ID NO: 1345457 - DNA, 22 bp, Artificial Sequence
  chemically synthesized
tttaacctttctcaacctcaga

SEQ ID NO: 1345458 - DNA, 22 bp, Artificial Sequence
  chemically synthesized
ttattgataaatctgaggttga

SEQ ID NO: 1345459 - DNA, 22 bp, Artificial Sequence
  chemically synthesized
ttgataaatctgaggttgagaa

SEQ ID NO: 1345460 - DNA, 22 bp, Artificial Sequence
  chemically synthesized
tgttgtttaacctttctcaacc

SEQ ID NO: 1345461 - DNA, 22 bp, Artificial Sequence
  chemically synthesized
ataaatctgaggttgagaaagg

SEQ ID NO: 1345462 - DNA, 22 bp, Artificial Sequence
  chemically synthesized
gttgtgttgtttaacctttctc

SEQ ID NO: 1345463 - DNA, 22 bp, Artificial Sequence
  chemically synthesized
ggttgtgttgtttaacctttct

SEQ ID NO: 1345464 - DNA, 22 bp, Artificial Sequence
  chemically synthesized
aggttgagaaaggttaaacaac

SEQ ID NO: 1345465 - DNA, 22 bp, Artificial Sequence
  chemically synthesized
agaaaggttaaacaacacaacc

SEQ ID NO: 1345466 - DNA, 22 bp, Artificial Sequence
  chemically synthesized
gtcacgtaaatttggttgtgtt

SEQ ID NO: 1345467 - DNA, 22 bp, Artificial Sequence
  chemically synthesized
attagtcacgtaaatttggttg

SEQ ID NO: 1345468 - DNA, 22 bp, Artificial Sequence
  chemically synthesized
aacaacacaaccaaatttacgt

SEQ ID NO: 1345469 - DNA, 22 bp, Artificial Sequence
  chemically synthesized
tcactcattagtcacgtaaatt

SEQ ID NO: 1345470 - DNA, 22 bp, Artificial Sequence
  chemically synthesized
gttgtcactcattagtcacgta

SEQ ID NO: 1345471 - DNA, 22 bp, Artificial Sequence
  chemically synthesized
ctggttgtcactcattagtcac

SEQ ID NO: 1345472 - DNA, 22 bp, Artificial Sequence
  chemically synthesized
gattcctggttgtcactcatta

SEQ ID NO: 1345473 - DNA, 22 bp, Artificial Sequence
  chemically synthesized
acgtgactaatgagtgacaacc

SEQ ID NO: 1345474 - DNA, 22 bp, Artificial Sequence
  chemically synthesized
cgtgactaatgagtgacaacca

SEQ ID NO: 1345475 - DNA, 22 bp, Artificial Sequence
  chemically synthesized
atgagtgacaaccaggaatcga

SEQ ID NO: 1345476 - DNA, 22 bp, Artificial Sequence
  chemically synthesized
agaaacagcaaaaggtgggctc

SEQ ID NO: 1345477 - DNA, 22 bp, Artificial Sequence
  chemically synthesized
cagaaacagcaaaaggtgggct

SEQ ID NO: 1345478 - DNA, 22 bp, Artificial Sequence
  chemically synthesized
ggaagaatacatgtttcagaaa

SEQ ID NO: 1345479 - DNA, 22 bp, Artificial Sequence
  chemically synthesized
tgggaagaatacatgtttcaga

SEQ ID NO: 1345480 - DNA, 22 bp, Artificial Sequence
  chemically synthesized
ttctgggaagaatacatgtttc

SEQ ID NO: 1345481 - DNA, 22 bp, Artificial Sequence
  chemically synthesized
ttgctgtttctgaaacatgtat

SEQ ID NO: 1345482 - DNA, 22 bp, Artificial Sequence
  chemically synthesized
tgctgtttctgaaacatgtatt

SEQ ID NO: 1345483 - DNA, 22 bp, Artificial Sequence
  chemically synthesized
gctgtttctgaaacatgtattc

SEQ ID NO: 1345484 - DNA, 22 bp, Artificial Sequence
  chemically synthesized
ctgtttctgaaacatgtattct

SEQ ID NO: 1345485 - DNA, 22 bp, Artificial Sequence
  chemically synthesized
tttctgaaacatgtattcttcc

SEQ ID NO: 1345486 - DNA, 22 bp, Artificial Sequence
  chemically synthesized
aaggttattctgggaagaatac

SEQ ID NO: 1345487 - DNA, 22 bp, Artificial Sequence
  chemically synthesized
ctgaaacatgtattcttcccag

SEQ ID NO: 1345488 - DNA, 22 bp, Artificial Sequence
  chemically synthesized
tgaaacatgtattcttcccaga

SEQ ID NO: 1345489 - DNA, 22 bp, Artificial Sequence
  chemically synthesized
aaacatgtattcttcccagaat

SEQ ID NO: 1345490 - DNA, 22 bp, Artificial Sequence
  chemically synthesized
agagattaaaggttattctggg

SEQ ID NO: 1345491 - DNA, 22 bp, Artificial Sequence
  chemically synthesized
ttgagagattaaaggttattct

SEQ ID NO: 1345492 - DNA, 22 bp, Artificial Sequence
  chemically synthesized
ttattgagagattaaaggttat

SEQ ID NO: 1345493 - DNA, 22 bp, Artificial Sequence
  chemically synthesized
ttcccagaataacctttaatct

SEQ ID NO: 1345494 - DNA, 22 bp, Artificial Sequence
  chemically synthesized
cccagaataacctttaatctct

SEQ ID NO: 1345495 - DNA, 22 bp, Artificial Sequence
  chemically synthesized
ccagaataacctttaatctctc

SEQ ID NO: 1345496 - DNA, 22 bp, Artificial Sequence
  chemically synthesized
tatgagctgttattgagagatt

SEQ ID NO: 1345497 - DNA, 22 bp, Artificial Sequence
  chemically synthesized
taatctctcaataacagctcat

SEQ ID NO: 1345498 - DNA, 22 bp, Artificial Sequence
  chemically synthesized
aatctctcaataacagctcata

SEQ ID NO: 1345499 - DNA, 22 bp, Artificial Sequence
  chemically synthesized
atctctcaataacagctcatac

SEQ ID NO: 1345500 - DNA, 22 bp, Artificial Sequence
  chemically synthesized
tcaataacagctcatacaattc

SEQ ID NO: 1345501 - DNA, 22 bp, Artificial Sequence
  chemically synthesized
aataacagctcatacaattcct

SEQ ID NO: 1345502 - DNA, 22 bp, Artificial Sequence
  chemically synthesized
tgagatgggaaggaggaattgt

SEQ ID NO: 1345503 - DNA, 22 bp, Artificial Sequence
  chemically synthesized
gtgagatgggaaggaggaattg

SEQ ID NO: 1345504 - DNA, 22 bp, Artificial Sequence
  chemically synthesized
tgtgagatgggaaggaggaatt

SEQ ID NO: 1345505 - DNA, 22 bp, Artificial Sequence
  chemically synthesized
atacaattcctccttcccatct

SEQ ID NO: 1345506 - DNA, 22 bp, Artificial Sequence
  chemically synthesized
agaataggttttgtgagatggg

SEQ ID NO: 1345507 - DNA, 22 bp, Artificial Sequence
  chemically synthesized
ctccttcccatctcacaaaacc

SEQ ID NO: 1345508 - DNA, 22 bp, Artificial Sequence
  chemically synthesized
cttcccatctcacaaaacctat

SEQ ID NO: 1345509 - DNA, 22 bp, Artificial Sequence
  chemically synthesized
cccatctcacaaaacctattct

SEQ ID NO: 1345510 - DNA, 22 bp, Artificial Sequence
  chemically synthesized
ccatctcacaaaacctattctg

SEQ ID NO: 1345511 - DNA, 22 bp, Artificial Sequence
  chemically synthesized
gtggtagacatagagctcagaa

SEQ ID NO: 1345512 - DNA, 22 bp, Artificial Sequence
  chemically synthesized
acaaaacctattctgagctcta

SEQ ID NO: 1345513 - DNA, 22 bp, Artificial Sequence
  chemically synthesized
ttcgtggtagacatagagctca

SEQ ID NO: 1345514 - DNA, 22 bp, Artificial Sequence
  chemically synthesized
attcgtggtagacatagagctc

SEQ ID NO: 1345515 - DNA, 22 bp, Artificial Sequence
  chemically synthesized
ggcttattcgtggtagacatag

SEQ ID NO: 1345516 - DNA, 22 bp, Artificial Sequence
  chemically synthesized
gggcttattcgtggtagacata

SEQ ID NO: 1345517 - DNA, 22 bp, Artificial Sequence
  chemically synthesized
ttctgagctctatgtctaccac

SEQ ID NO: 1345518 - DNA, 22 bp, Artificial Sequence
  chemically synthesized
ttgggcttattcgtggtagaca

SEQ ID NO: 1345519 - DNA, 22 bp, Artificial Sequence
  chemically synthesized
tgagctctatgtctaccacgaa

SEQ ID NO: 1345520 - DNA, 22 bp, Artificial Sequence
  chemically synthesized
ctcttgggcttattcgtggtag

SEQ ID NO: 1345521 - DNA, 22 bp, Artificial Sequence
  chemically synthesized
agctctatgtctaccacgaata

SEQ ID NO: 1345522 - DNA, 22 bp, Artificial Sequence
  chemically synthesized
tactcttgggcttattcgtggt

SEQ ID NO: 1345523 - DNA, 22 bp, Artificial Sequence
  chemically synthesized
tctactcttgggcttattcgtg

SEQ ID NO: 1345524 - DNA, 22 bp, Artificial Sequence
  chemically synthesized
tctctactcttgggcttattcg

SEQ ID NO: 1345525 - DNA, 22 bp, Artificial Sequence
  chemically synthesized
tatgtctaccacgaataagccc

SEQ ID NO: 1345526 - DNA, 22 bp, Artificial Sequence
  chemically synthesized
tgtctaccacgaataagcccaa

SEQ ID NO: 1345527 - DNA, 22 bp, Artificial Sequence
  chemically synthesized
ccacgaataagcccaagagtag

SEQ ID NO: 1345528 - DNA, 22 bp, Artificial Sequence
  chemically synthesized
tgagataaattctctctactct

SEQ ID NO: 1345529 - DNA, 22 bp, Artificial Sequence
  chemically synthesized
gtgagataaattctctctactc

SEQ ID NO: 1345530 - DNA, 22 bp, Artificial Sequence
  chemically synthesized
aaaaggggtatacggtaagcct

SEQ ID NO: 1345531 - DNA, 22 bp, Artificial Sequence
  chemically synthesized
ttgaaaaggggtatacggtaag

SEQ ID NO: 1345532 - DNA, 22 bp, Artificial Sequence
  chemically synthesized
atctcacaaggcttaccgtata

SEQ ID NO: 1345533 - DNA, 22 bp, Artificial Sequence
  chemically synthesized
tctcacaaggcttaccgtatac

SEQ ID NO: 1345534 - DNA, 22 bp, Artificial Sequence
  chemically synthesized
acaaggcttaccgtatacccct

SEQ ID NO: 1345535 - DNA, 22 bp, Artificial Sequence
  chemically synthesized
accgtataccccttttcaataa

SEQ ID NO: 1345536 - DNA, 22 bp, Artificial Sequence
  chemically synthesized
ccgtataccccttttcaataat

SEQ ID NO: 1345537 - DNA, 22 bp, Artificial Sequence
  chemically synthesized
ttcaataatttttatcacatta

SEQ ID NO: 1345538 - DNA, 22 bp, Artificial Sequence
  chemically synthesized
tcaataatttttatcacattat

SEQ ID NO: 1345539 - DNA, 22 bp, Artificial Sequence
  chemically synthesized
caataatttttatcacattatt

SEQ ID NO: 1345540 - DNA, 22 bp, Artificial Sequence
  chemically synthesized
aataatttttatcacattattt

SEQ ID NO: 1345541 - DNA, 22 bp, Artificial Sequence
  chemically synthesized
aggaagagaaagagaaataatg

SEQ ID NO: 1345542 - DNA, 22 bp, Artificial Sequence
  chemically synthesized
actaaggaagagaaagagaaat

SEQ ID NO: 1345543 - DNA, 22 bp, Artificial Sequence
  chemically synthesized
ttatcacattatttctctttct

SEQ ID NO: 1345544 - DNA, 22 bp, Artificial Sequence
  chemically synthesized
tatcacattatttctctttctc

SEQ ID NO: 1345545 - DNA, 22 bp, Artificial Sequence
  chemically synthesized
ttgactaaggaagagaaagaga

SEQ ID NO: 1345546 - DNA, 22 bp, Artificial Sequence
  chemically synthesized
atcacattatttctctttctct

SEQ ID NO: 1345547 - DNA, 22 bp, Artificial Sequence
  chemically synthesized
tcacattatttctctttctctt

SEQ ID NO: 1345548 - DNA, 22 bp, Artificial Sequence
  chemically synthesized
aatgttgttgactaaggaagag

SEQ ID NO: 1345549 - DNA, 22 bp, Artificial Sequence
  chemically synthesized
tttctctttctcttccttagtc

SEQ ID NO: 1345550 - DNA, 22 bp, Artificial Sequence
  chemically synthesized
ctctttctcttccttagtcaac

SEQ ID NO: 1345551 - DNA, 22 bp, Artificial Sequence
  chemically synthesized
tctttctcttccttagtcaaca

SEQ ID NO: 1345552 - DNA, 22 bp, Artificial Sequence
  chemically synthesized
tttctcttccttagtcaacaac

SEQ ID NO: 1345553 - DNA, 22 bp, Artificial Sequence
  chemically synthesized
tctcttccttagtcaacaacat

SEQ ID NO: 1345554 - DNA, 22 bp, Artificial Sequence
  chemically synthesized
ctcttccttagtcaacaacatt

SEQ ID NO: 1345555 - DNA, 22 bp, Artificial Sequence
  chemically synthesized
aggagtaaattaaatgttgttg

SEQ ID NO: 1345556 - DNA, 22 bp, Artificial Sequence
  chemically synthesized
tcttccttagtcaacaacattt

SEQ ID NO: 1345557 - DNA, 22 bp, Artificial Sequence
  chemically synthesized
caggagtaaattaaatgttgtt

SEQ ID NO: 1345558 - DNA, 22 bp, Artificial Sequence
  chemically synthesized
ttccttagtcaacaacatttaa

SEQ ID NO: 1345559 - DNA, 22 bp, Artificial Sequence
  chemically synthesized
ccttagtcaacaacatttaatt

SEQ ID NO: 1345560 - DNA, 22 bp, Artificial Sequence
  chemically synthesized
cttagtcaacaacatttaattt

SEQ ID NO: 1345561 - DNA, 22 bp, Artificial Sequence
  chemically synthesized
agtcaacaacatttaatttact

SEQ ID NO: 1345562 - DNA, 22 bp, Artificial Sequence
  chemically synthesized
gtcaacaacatttaatttactc

SEQ ID NO: 1345563 - DNA, 22 bp, Artificial Sequence
  chemically synthesized
gtgtagggatagtttcaggagt

SEQ ID NO: 1345564 - DNA, 22 bp, Artificial Sequence
  chemically synthesized
agattagtgtagggatagtttc

SEQ ID NO: 1345565 - DNA, 22 bp, Artificial Sequence
  chemically synthesized
aatttactcctgaaactatccc

SEQ ID NO: 1345566 - DNA, 22 bp, Artificial Sequence
  chemically synthesized
cagattagtgtagggatagttt

SEQ ID NO: 1345567 - DNA, 22 bp, Artificial Sequence
  chemically synthesized
atttactcctgaaactatccct

SEQ ID NO: 1345568 - DNA, 22 bp, Artificial Sequence
  chemically synthesized
actcctgaaactatccctacac

SEQ ID NO: 1345569 - DNA, 22 bp, Artificial Sequence
  chemically synthesized
ctcctgaaactatccctacact

SEQ ID NO: 1345570 - DNA, 22 bp, Artificial Sequence
  chemically synthesized
acaacttcagattagtgtaggg

SEQ ID NO: 1345571 - DNA, 22 bp, Artificial Sequence
  chemically synthesized
aacaacttcagattagtgtagg

SEQ ID NO: 1345572 - DNA, 22 bp, Artificial Sequence
  chemically synthesized
ctgaaactatccctacactaat

SEQ ID NO: 1345573 - DNA, 22 bp, Artificial Sequence
  chemically synthesized
aaactatccctacactaatctg

SEQ ID NO: 1345574 - DNA, 22 bp, Artificial Sequence
  chemically synthesized
gtaatttaacaacttcagatta

SEQ ID NO: 1345575 - DNA, 22 bp, Artificial Sequence
  chemically synthesized
agtaatttaacaacttcagatt

SEQ ID NO: 1345576 - DNA, 22 bp, Artificial Sequence
  chemically synthesized
tccctacactaatctgaagttg

SEQ ID NO: 1345577 - DNA, 22 bp, Artificial Sequence
  chemically synthesized
cactaatctgaagttgttaaat

SEQ ID NO: 1345578 - DNA, 22 bp, Artificial Sequence
  chemically synthesized
atctgaagttgttaaattacta

SEQ ID NO: 1345579 - DNA, 22 bp, Artificial Sequence
  chemically synthesized
aagttgttaaattactaagtta

SEQ ID NO: 1345580 - DNA, 22 bp, Artificial Sequence
  chemically synthesized
gaaatatgaatgcaaaataact

SEQ ID NO: 1345581 - DNA, 22 bp, Artificial Sequence
  chemically synthesized
ttaaattactaagttattttgc

SEQ ID NO: 1345582 - DNA, 22 bp, Artificial Sequence
  chemically synthesized
ggaaatatgaatgcaaaataac

SEQ ID NO: 1345583 - DNA, 22 bp, Artificial Sequence
  chemically synthesized
tggaaatatgaatgcaaaataa

SEQ ID NO: 1345584 - DNA, 22 bp, Artificial Sequence
  chemically synthesized
aattactaagttattttgcatt

SEQ ID NO: 1345585 - DNA, 22 bp, Artificial Sequence
  chemically synthesized
attttggaaatatgaatgcaaa

SEQ ID NO: 1345586 - DNA, 22 bp, Artificial Sequence
  chemically synthesized
ctaagttattttgcattcatat

SEQ ID NO: 1345587 - DNA, 22 bp, Artificial Sequence
  chemically synthesized
agttattttgcattcatatttc

SEQ ID NO: 1345588 - DNA, 22 bp, Artificial Sequence
  chemically synthesized
gacaattaattttggaaatatg

SEQ ID NO: 1345589 - DNA, 22 bp, Artificial Sequence
  chemically synthesized
ggacaattaattttggaaatat

SEQ ID NO: 1345590 - DNA, 22 bp, Artificial Sequence
  chemically synthesized
ttttgcattcatatttccaaaa

SEQ ID NO: 1345591 - DNA, 22 bp, Artificial Sequence
  chemically synthesized
tgcattcatatttccaaaatta

SEQ ID NO: 1345592 - DNA, 22 bp, Artificial Sequence
  chemically synthesized
gcattcatatttccaaaattaa

SEQ ID NO: 1345593 - DNA, 22 bp, Artificial Sequence
  chemically synthesized
cattcatatttccaaaattaat

SEQ ID NO: 1345594 - DNA, 22 bp, Artificial Sequence
  chemically synthesized
atatttccaaaattaattgtcc

SEQ ID NO: 1345595 - DNA, 22 bp, Artificial Sequence
  chemically synthesized
agagatgaacttggacaattaa

SEQ ID NO: 1345596 - DNA, 22 bp, Artificial Sequence
  chemically synthesized
gagagatgaacttggacaatta

SEQ ID NO: 1345597 - DNA, 22 bp, Artificial Sequence
  chemically synthesized
tgagagatgaacttggacaatt

SEQ ID NO: 1345598 - DNA, 22 bp, Artificial Sequence
  chemically synthesized
ccaaaattaattgtccaagttc

SEQ ID NO: 1345599 - DNA, 22 bp, Artificial Sequence
  chemically synthesized
attttgagagatgaacttggac

SEQ ID NO: 1345600 - DNA, 22 bp, Artificial Sequence
  chemically synthesized
caaaattaattgtccaagttca

SEQ ID NO: 1345601 - DNA, 22 bp, Artificial Sequence
  chemically synthesized
cattttgagagatgaacttgga

SEQ ID NO: 1345602 - DNA, 22 bp, Artificial Sequence
  chemically synthesized
tttcattttgagagatgaactt

SEQ ID NO: 1345603 - DNA, 22 bp, Artificial Sequence
  chemically synthesized
attgtccaagttcatctctcaa

SEQ ID NO: 1345604 - DNA, 22 bp, Artificial Sequence
  chemically synthesized
aaattatttcattttgagagat

SEQ ID NO: 1345605 - DNA, 22 bp, Artificial Sequence
  chemically synthesized
tccaagttcatctctcaaaatg

SEQ ID NO: 1345606 - DNA, 22 bp, Artificial Sequence
  chemically synthesized
gctgaaattatttcattttgag

SEQ ID NO: 1345607 - DNA, 22 bp, Artificial Sequence
  chemically synthesized
tagctgaaattatttcattttg

SEQ ID NO: 1345608 - DNA, 22 bp, Artificial Sequence
  chemically synthesized
ctagctgaaattatttcatttt

SEQ ID NO: 1345609 - DNA, 22 bp, Artificial Sequence
  chemically synthesized
atttctagctgaaattatttca

SEQ ID NO: 1345610 - DNA, 22 bp, Artificial Sequence
  chemically synthesized
atctctcaaaatgaaataattt

SEQ ID NO: 1345611 - DNA, 22 bp, Artificial Sequence
  chemically synthesized
tcaaaatgaaataatttcagct

SEQ ID NO: 1345612 - DNA, 22 bp, Artificial Sequence
  chemically synthesized
aaaatgaaataatttcagctag

SEQ ID NO: 1345613 - DNA, 22 bp, Artificial Sequence
  chemically synthesized
tgccacagctcatttctagctg

SEQ ID NO: 1345614 - DNA, 22 bp, Artificial Sequence
  chemically synthesized
ctgtgccacagctcatttctag

SEQ ID NO: 1345615 - DNA, 22 bp, Artificial Sequence
  chemically synthesized
actgtgccacagctcatttcta

SEQ ID NO: 1345616 - DNA, 22 bp, Artificial Sequence
  chemically synthesized
cagctagaaatgagctgtggca

SEQ ID NO: 1345617 - DNA, 22 bp, Artificial Sequence
  chemically synthesized
agctagaaatgagctgtggcac

SEQ ID NO: 1345618 - DNA, 22 bp, Artificial Sequence
  chemically synthesized
gaaatgagctgtggcacagtaa

SEQ ID NO: 1345619 - DNA, 22 bp, Artificial Sequence
  chemically synthesized
cccatccaaaggcttactgtgc

SEQ ID NO: 1345620 - DNA, 22 bp, Artificial Sequence
  chemically synthesized
ccccatccaaaggcttactgtg

SEQ ID NO: 1345621 - DNA, 22 bp, Artificial Sequence
  chemically synthesized
ccttccccatccaaaggcttac

SEQ ID NO: 1345622 - DNA, 22 bp, Artificial Sequence
  chemically synthesized
tggcacagtaagcctttggatg

SEQ ID NO: 1345623 - DNA, 22 bp, Artificial Sequence
  chemically synthesized
taattaccttccccatccaaag

SEQ ID NO: 1345624 - DNA, 22 bp, Artificial Sequence
  chemically synthesized
cagaacaattataattaccttc

SEQ ID NO: 1345625 - DNA, 22 bp, Artificial Sequence
  chemically synthesized
tggatggggaaggtaattataa

SEQ ID NO: 1345626 - DNA, 22 bp, Artificial Sequence
  chemically synthesized
ggatggggaaggtaattataat

SEQ ID NO: 1345627 - DNA, 22 bp, Artificial Sequence
  chemically synthesized
gatggggaaggtaattataatt

SEQ ID NO: 1345628 - DNA, 22 bp, Artificial Sequence
  chemically synthesized
cataaccagagttacagaacaa

SEQ ID NO: 1345629 - DNA, 22 bp, Artificial Sequence
  chemically synthesized
taattgttctgtaactctggtt

SEQ ID NO: 1345630 - DNA, 22 bp, Artificial Sequence
  chemically synthesized
tccagatcatgttccataacca

SEQ ID NO: 1345631 - DNA, 22 bp, Artificial Sequence
  chemically synthesized
ttctgtaactctggttatggaa

SEQ ID NO: 1345632 - DNA, 22 bp, Artificial Sequence
  chemically synthesized
tgtaactctggttatggaacat

SEQ ID NO: 1345633 - DNA, 22 bp, Artificial Sequence
  chemically synthesized
actgtccagatcatgttccata

SEQ ID NO: 1345634 - DNA, 22 bp, Artificial Sequence
  chemically synthesized
taactctggttatggaacatga

SEQ ID NO: 1345635 - DNA, 22 bp, Artificial Sequence
  chemically synthesized
tcactgtccagatcatgttcca

SEQ ID NO: 1345636 - DNA, 22 bp, Artificial Sequence
  chemically synthesized
tggttatggaacatgatctgga

SEQ ID NO: 1345637 - DNA, 22 bp, Artificial Sequence
  chemically synthesized
gttatggaacatgatctggaca

SEQ ID NO: 1345638 - DNA, 22 bp, Artificial Sequence
  chemically synthesized
tccaactctcactgtccagatc

SEQ ID NO: 1345639 - DNA, 22 bp, Artificial Sequence
  chemically synthesized
tatccaactctcactgtccaga

SEQ ID NO: 1345640 - DNA, 22 bp, Artificial Sequence
  chemically synthesized
tggaacatgatctggacagtga

SEQ ID NO: 1345641 - DNA, 22 bp, Artificial Sequence
  chemically synthesized
tctatccaactctcactgtcca

SEQ ID NO: 1345642 - DNA, 22 bp, Artificial Sequence
  chemically synthesized
cctctctatccaactctcactg

SEQ ID NO: 1345643 - DNA, 22 bp, Artificial Sequence
  chemically synthesized
ccctctctatccaactctcact

SEQ ID NO: 1345644 - DNA, 22 bp, Artificial Sequence
  chemically synthesized
gacagtgagagttggatagaga

SEQ ID NO: 1345645 - DNA, 22 bp, Artificial Sequence
  chemically synthesized
cccccagtggcttccctctcta

SEQ ID NO: 1345646 - DNA, 22 bp, Artificial Sequence
  chemically synthesized
gtcacactacccccagtggctt

SEQ ID NO: 1345647 - DNA, 22 bp, Artificial Sequence
  chemically synthesized
gatagagagggaagccactggg

SEQ ID NO: 1345648 - DNA, 22 bp, Artificial Sequence
  chemically synthesized
agtcacactacccccagtggct

SEQ ID NO: 1345649 - DNA, 22 bp, Artificial Sequence
  chemically synthesized
aaacagtgtcttagtcacacta

SEQ ID NO: 1345650 - DNA, 22 bp, Artificial Sequence
  chemically synthesized
taaaacagtgtcttagtcacac

SEQ ID NO: 1345651 - DNA, 22 bp, Artificial Sequence
  chemically synthesized
ggggtagtgtgactaagacact

SEQ ID NO: 1345652 - DNA, 22 bp, Artificial Sequence
  chemically synthesized
agattctaaaacagtgtcttag

SEQ ID NO: 1345653 - DNA, 22 bp, Artificial Sequence
  chemically synthesized
atatcctcagattctaaaacag

SEQ ID NO: 1345654 - DNA, 22 bp, Artificial Sequence
  chemically synthesized
aactcatatcctcagattctaa

SEQ ID NO: 1345655 - DNA, 22 bp, Artificial Sequence
  chemically synthesized
gaactcatatcctcagattcta

SEQ ID NO: 1345656 - DNA, 22 bp, Artificial Sequence
  chemically synthesized
agacactgttttagaatctgag

SEQ ID NO: 1345657 - DNA, 22 bp, Artificial Sequence
  chemically synthesized
tggaacttgaactcatatcctc

SEQ ID NO: 1345658 - DNA, 22 bp, Artificial Sequence
  chemically synthesized
ttttagaatctgaggatatgag

SEQ ID NO: 1345659 - DNA, 22 bp, Artificial Sequence
  chemically synthesized
tagaatctgaggatatgagttc

SEQ ID NO: 1345660 - DNA, 22 bp, Artificial Sequence
  chemically synthesized
gctgtggaacttgaactcatat

SEQ ID NO: 1345661 - DNA, 22 bp, Artificial Sequence
  chemically synthesized
agaatctgaggatatgagttca

SEQ ID NO: 1345662 - DNA, 22 bp, Artificial Sequence
  chemically synthesized
gaatctgaggatatgagttcaa

SEQ ID NO: 1345663 - DNA, 22 bp, Artificial Sequence
  chemically synthesized
aggatatgagttcaagttccac

SEQ ID NO: 1345664 - DNA, 22 bp, Artificial Sequence
  chemically synthesized
gcaggtgttagctgtggaactt

SEQ ID NO: 1345665 - DNA, 22 bp, Artificial Sequence
  chemically synthesized
caaatctagcaggtgttagctg

SEQ ID NO: 1345666 - DNA, 22 bp, Artificial Sequence
  chemically synthesized
aagttccacagctaacacctgc

SEQ ID NO: 1345667 - DNA, 22 bp, Artificial Sequence
  chemically synthesized
cagactacaaatctagcaggtg

SEQ ID NO: 1345668 - DNA, 22 bp, Artificial Sequence
  chemically synthesized
acagactacaaatctagcaggt

SEQ ID NO: 1345669 - DNA, 22 bp, Artificial Sequence
  chemically synthesized
cacagctaacacctgctagatt

SEQ ID NO: 1345670 - DNA, 22 bp, Artificial Sequence
  chemically synthesized
acaacttacagactacaaatct

SEQ ID NO: 1345671 - DNA, 22 bp, Artificial Sequence
  chemically synthesized
gacaacttacagactacaaatc

SEQ ID NO: 1345672 - DNA, 22 bp, Artificial Sequence
  chemically synthesized
acacctgctagatttgtagtct

SEQ ID NO: 1345673 - DNA, 22 bp, Artificial Sequence
  chemically synthesized
aaatttgacaacttacagacta

SEQ ID NO: 1345674 - DNA, 22 bp, Artificial Sequence
  chemically synthesized
gaaatttgacaacttacagact

SEQ ID NO: 1345675 - DNA, 22 bp, Artificial Sequence
  chemically synthesized
tgaaatttgacaacttacagac

SEQ ID NO: 1345676 - DNA, 22 bp, Artificial Sequence
  chemically synthesized
ctagatttgtagtctgtaagtt

SEQ ID NO: 1345677 - DNA, 22 bp, Artificial Sequence
  chemically synthesized
tttgaaatttgacaacttacag

SEQ ID NO: 1345678 - DNA, 22 bp, Artificial Sequence
  chemically synthesized
gatttgtagtctgtaagttgtc

SEQ ID NO: 1345679 - DNA, 22 bp, Artificial Sequence
  chemically synthesized
gtagtctgtaagttgtcaaatt

SEQ ID NO: 1345680 - DNA, 22 bp, Artificial Sequence
  chemically synthesized
tagtctgtaagttgtcaaattt

SEQ ID NO: 1345681 - DNA, 22 bp, Artificial Sequence
  chemically synthesized
taagttgtcaaatttcaaagaa

SEQ ID NO: 1345682 - DNA, 22 bp, Artificial Sequence
  chemically synthesized
tccaagaggaatataagattct

SEQ ID NO: 1345683 - DNA, 22 bp, Artificial Sequence
  chemically synthesized
tcaaatttcaaagaatcttata

SEQ ID NO: 1345684 - DNA, 22 bp, Artificial Sequence
  chemically synthesized
atccaagaggaatataagattc

SEQ ID NO: 1345685 - DNA, 22 bp, Artificial Sequence
  chemically synthesized
ttatccaagaggaatataagat

SEQ ID NO: 1345686 - DNA, 22 bp, Artificial Sequence
  chemically synthesized
tctcttatccaagaggaatata

SEQ ID NO: 1345687 - DNA, 22 bp, Artificial Sequence
  chemically synthesized
caaagaatcttatattcctctt

SEQ ID NO: 1345688 - DNA, 22 bp, Artificial Sequence
  chemically synthesized
aaagaatcttatattcctcttg

SEQ ID NO: 1345689 - DNA, 22 bp, Artificial Sequence
  chemically synthesized
cctatctcttatccaagaggaa

SEQ ID NO: 1345690 - DNA, 22 bp, Artificial Sequence
  chemically synthesized
ttacctatctcttatccaagag

SEQ ID NO: 1345691 - DNA, 22 bp, Artificial Sequence
  chemically synthesized
attacctatctcttatccaaga

SEQ ID NO: 1345692 - DNA, 22 bp, Artificial Sequence
  chemically synthesized
tattacctatctcttatccaag

SEQ ID NO: 1345693 - DNA, 22 bp, Artificial Sequence
  chemically synthesized
ttattacctatctcttatccaa

SEQ ID NO: 1345694 - DNA, 22 bp, Artificial Sequence
  chemically synthesized
atattcctcttggataagagat

SEQ ID NO: 1345695 - DNA, 22 bp, Artificial Sequence
  chemically synthesized
tattcctcttggataagagata

SEQ ID NO: 1345696 - DNA, 22 bp, Artificial Sequence
  chemically synthesized
ctcttggataagagataggtaa

SEQ ID NO: 1345697 - DNA, 22 bp, Artificial Sequence
  chemically synthesized
ttggataagagataggtaataa

SEQ ID NO: 1345698 - DNA, 22 bp, Artificial Sequence
  chemically synthesized
tgccaggtagtttttattacct

SEQ ID NO: 1345699 - DNA, 22 bp, Artificial Sequence
  chemically synthesized
ggataagagataggtaataaaa

SEQ ID NO: 1345700 - DNA, 22 bp, Artificial Sequence
  chemically synthesized
gataagagataggtaataaaaa

SEQ ID NO: 1345701 - DNA, 22 bp, Artificial Sequence
  chemically synthesized
caaaaccatctgtgccaggtag

SEQ ID NO: 1345702 - DNA, 22 bp, Artificial Sequence
  chemically synthesized
tacaaaaccatctgtgccaggt

SEQ ID NO: 1345703 - DNA, 22 bp, Artificial Sequence
  chemically synthesized
ctacaaaaccatctgtgccagg

SEQ ID NO: 1345704 - DNA, 22 bp, Artificial Sequence
  chemically synthesized
tctacaaaaccatctgtgccag

SEQ ID NO: 1345705 - DNA, 22 bp, Artificial Sequence
  chemically synthesized
gattttctacaaaaccatctgt

SEQ ID NO: 1345706 - DNA, 22 bp, Artificial Sequence
  chemically synthesized
ttggattttctacaaaaccatc

SEQ ID NO: 1345707 - DNA, 22 bp, Artificial Sequence
  chemically synthesized
attggattttctacaaaaccat

SEQ ID NO: 1345708 - DNA, 22 bp, Artificial Sequence
  chemically synthesized
tattggattttctacaaaacca

SEQ ID NO: 1345709 - DNA, 22 bp, Artificial Sequence
  chemically synthesized
cctggcacagatggttttgtag

SEQ ID NO: 1345710 - DNA, 22 bp, Artificial Sequence
  chemically synthesized
ttttattggattttctacaaaa

SEQ ID NO: 1345711 - DNA, 22 bp, Artificial Sequence
  chemically synthesized
gcacagatggttttgtagaaaa

SEQ ID NO: 1345712 - DNA, 22 bp, Artificial Sequence
  chemically synthesized
cacagttattttattggatttt

SEQ ID NO: 1345713 - DNA, 22 bp, Artificial Sequence
  chemically synthesized
ccacagttattttattggattt

SEQ ID NO: 1345714 - DNA, 22 bp, Artificial Sequence
  chemically synthesized
tgtagaaaatccaataaaataa

SEQ ID NO: 1345715 - DNA, 22 bp, Artificial Sequence
  chemically synthesized
gtagaaaatccaataaaataac

SEQ ID NO: 1345716 - DNA, 22 bp, Artificial Sequence
  chemically synthesized
aaagtttccacagttattttat

SEQ ID NO: 1345717 - DNA, 22 bp, Artificial Sequence
  chemically synthesized
tagaaaatccaataaaataact

SEQ ID NO: 1345718 - DNA, 22 bp, Artificial Sequence
  chemically synthesized
caaagtttccacagttatttta

SEQ ID NO: 1345719 - DNA, 22 bp, Artificial Sequence
  chemically synthesized
aaaatttcaaagtttccacagt

SEQ ID NO: 1345720 - DNA, 22 bp, Artificial Sequence
  chemically synthesized
gaaaatttcaaagtttccacag

SEQ ID NO: 1345721 - DNA, 22 bp, Artificial Sequence
  chemically synthesized
atggcacttgaaaatttcaaag

SEQ ID NO: 1345722 - DNA, 22 bp, Artificial Sequence
  chemically synthesized
aatggcacttgaaaatttcaaa

SEQ ID NO: 1345723 - DNA, 22 bp, Artificial Sequence
  chemically synthesized
taatggcacttgaaaatttcaa

SEQ ID NO: 1345724 - DNA, 22 bp, Artificial Sequence
  chemically synthesized
tggaaactttgaaattttcaag

SEQ ID NO: 1345725 - DNA, 22 bp, Artificial Sequence
  chemically synthesized
atattttaatggcacttgaaaa

SEQ ID NO: 1345726 - DNA, 22 bp, Artificial Sequence
  chemically synthesized
gatattttaatggcacttgaaa

SEQ ID NO: 1345727 - DNA, 22 bp, Artificial Sequence
  chemically synthesized
tgaaattttcaagtgccattaa

SEQ ID NO: 1345728 - DNA, 22 bp, Artificial Sequence
  chemically synthesized
gtatttgatattttaatggcac

SEQ ID NO: 1345729 - DNA, 22 bp, Artificial Sequence
  chemically synthesized
gaaattttcaagtgccattaaa

SEQ ID NO: 1345730 - DNA, 22 bp, Artificial Sequence
  chemically synthesized
aaattttcaagtgccattaaaa

SEQ ID NO: 1345731 - DNA, 22 bp, Artificial Sequence
  chemically synthesized
aattggtatttgatattttaat

SEQ ID NO: 1345732 - DNA, 22 bp, Artificial Sequence
  chemically synthesized
tcaagtgccattaaaatatcaa

SEQ ID NO: 1345733 - DNA, 22 bp, Artificial Sequence
  chemically synthesized
ttaaattggtatttgatatttt

SEQ ID NO: 1345734 - DNA, 22 bp, Artificial Sequence
  chemically synthesized
caagtgccattaaaatatcaaa

SEQ ID NO: 1345735 - DNA, 22 bp, Artificial Sequence
  chemically synthesized
aagtgccattaaaatatcaaat

SEQ ID NO: 1345736 - DNA, 22 bp, Artificial Sequence
  chemically synthesized
attattaaattggtatttgata

SEQ ID NO: 1345737 - DNA, 22 bp, Artificial Sequence
  chemically synthesized
aaatatcaaataccaatttaat

SEQ ID NO: 1345738 - DNA, 22 bp, Artificial Sequence
  chemically synthesized
atcataagctaattattaaatt

SEQ ID NO: 1345739 - DNA, 22 bp, Artificial Sequence
  chemically synthesized
accatctgatcataagctaatt

SEQ ID NO: 1345740 - DNA, 22 bp, Artificial Sequence
  chemically synthesized
aataattagcttatgatcagat

SEQ ID NO: 1345741 - DNA, 22 bp, Artificial Sequence
  chemically synthesized
ataattagcttatgatcagatg

SEQ ID NO: 1345742 - DNA, 22 bp, Artificial Sequence
  chemically synthesized
gcttatgatcagatggttaggg

SEQ ID NO: 1345743 - DNA, 22 bp, Artificial Sequence
  chemically synthesized
ggcagtcaacgtccctaaccat

SEQ ID NO: 1345744 - DNA, 22 bp, Artificial Sequence
  chemically synthesized
cggcagtcaacgtccctaacca

SEQ ID NO: 1345745 - DNA, 22 bp, Artificial Sequence
  chemically synthesized
atgatcagatggttagggacgt

SEQ ID NO: 1345746 - DNA, 22 bp, Artificial Sequence
  chemically synthesized
tgatcagatggttagggacgtt

SEQ ID NO: 1345747 - DNA, 22 bp, Artificial Sequence
  chemically synthesized
aatatacacttcggcagtcaac

SEQ ID NO: 1345748 - DNA, 22 bp, Artificial Sequence
  chemically synthesized
gaatatacacttcggcagtcaa

SEQ ID NO: 1345749 - DNA, 22 bp, Artificial Sequence
  chemically synthesized
atttgaatatacacttcggcag

SEQ ID NO: 1345750 - DNA, 22 bp, Artificial Sequence
  chemically synthesized
gggacgttgactgccgaagtgt

SEQ ID NO: 1345751 - DNA, 22 bp, Artificial Sequence
  chemically synthesized
cattgatttgaatatacacttc

SEQ ID NO: 1345752 - DNA, 22 bp, Artificial Sequence
  chemically synthesized
tactgcattgatttgaatatac

SEQ ID NO: 1345753 - DNA, 22 bp, Artificial Sequence
  chemically synthesized
actgccgaagtgtatattcaaa

SEQ ID NO: 1345754 - DNA, 22 bp, Artificial Sequence
  chemically synthesized
ccgaagtgtatattcaaatcaa

SEQ ID NO: 1345755 - DNA, 22 bp, Artificial Sequence
  chemically synthesized
aagcctatactgcattgatttg

SEQ ID NO: 1345756 - DNA, 22 bp, Artificial Sequence
  chemically synthesized
aaagcctatactgcattgattt

SEQ ID NO: 1345757 - DNA, 22 bp, Artificial Sequence
  chemically synthesized
taaagcctatactgcattgatt

SEQ ID NO: 1345758 - DNA, 22 bp, Artificial Sequence
  chemically synthesized
ctttaaagcctatactgcattg

SEQ ID NO: 1345759 - DNA, 22 bp, Artificial Sequence
  chemically synthesized
gccctactttaaagcctatact

SEQ ID NO: 1345760 - DNA, 22 bp, Artificial Sequence
  chemically synthesized
ggccctactttaaagcctatac

SEQ ID NO: 1345761 - DNA, 22 bp, Artificial Sequence
  chemically synthesized
aaatcaatgcagtataggcttt

SEQ ID NO: 1345762 - DNA, 22 bp, Artificial Sequence
  chemically synthesized
tggccctactttaaagcctata

SEQ ID NO: 1345763 - DNA, 22 bp, Artificial Sequence
  chemically synthesized
atgctttggccctactttaaag

SEQ ID NO: 1345764 - DNA, 22 bp, Artificial Sequence
  chemically synthesized
catgctttggccctactttaaa

SEQ ID NO: 1345765 - DNA, 22 bp, Artificial Sequence
  chemically synthesized
aaatgcatttcatgctttggcc

SEQ ID NO: 1345766 - DNA, 22 bp, Artificial Sequence
  chemically synthesized
ttaaaatgcatttcatgctttg

SEQ ID NO: 1345767 - DNA, 22 bp, Artificial Sequence
  chemically synthesized
taaagtagggccaaagcatgaa

SEQ ID NO: 1345768 - DNA, 22 bp, Artificial Sequence
  chemically synthesized
attaaaatgcatttcatgcttt

SEQ ID NO: 1345769 - DNA, 22 bp, Artificial Sequence
  chemically synthesized
aaagtagggccaaagcatgaaa

SEQ ID NO: 1345770 - DNA, 22 bp, Artificial Sequence
  chemically synthesized
aagtagggccaaagcatgaaat

SEQ ID NO: 1345771 - DNA, 22 bp, Artificial Sequence
  chemically synthesized
gaagtgtacacttattaaaatg

SEQ ID NO: 1345772 - DNA, 22 bp, Artificial Sequence
  chemically synthesized
aaagaatcctagaagtgtacac

SEQ ID NO: 1345773 - DNA, 22 bp, Artificial Sequence
  chemically synthesized
caaagaatcctagaagtgtaca

SEQ ID NO: 1345774 - DNA, 22 bp, Artificial Sequence
  chemically synthesized
tcaaagaatcctagaagtgtac

SEQ ID NO: 1345775 - DNA, 22 bp, Artificial Sequence
  chemically synthesized
taataagtgtacacttctagga

SEQ ID NO: 1345776 - DNA, 22 bp, Artificial Sequence
  chemically synthesized
aataagtgtacacttctaggat

SEQ ID NO: 1345777 - DNA, 22 bp, Artificial Sequence
  chemically synthesized
aactttcaaagaatcctagaag

SEQ ID NO: 1345778 - DNA, 22 bp, Artificial Sequence
  chemically synthesized
ataagtgtacacttctaggatt

SEQ ID NO: 1345779 - DNA, 22 bp, Artificial Sequence
  chemically synthesized
caactttcaaagaatcctagaa

SEQ ID NO: 1345780 - DNA, 22 bp, Artificial Sequence
  chemically synthesized
tcaactttcaaagaatcctaga

SEQ ID NO: 1345781 - DNA, 22 bp, Artificial Sequence
  chemically synthesized
ttcaactttcaaagaatcctag

SEQ ID NO: 1345782 - DNA, 22 bp, Artificial Sequence
  chemically synthesized
tttcaactttcaaagaatccta

SEQ ID NO: 1345783 - DNA, 22 bp, Artificial Sequence
  chemically synthesized
ttttttcaactttcaaagaatc

SEQ ID NO: 1345784 - DNA, 22 bp, Artificial Sequence
  chemically synthesized
attattttttcaactttcaaag

SEQ ID NO: 1345785 - DNA, 22 bp, Artificial Sequence
  chemically synthesized
ctaattattttttcaactttca

SEQ ID NO: 1345786 - DNA, 22 bp, Artificial Sequence
  chemically synthesized
ctaggattctttgaaagttgaa

SEQ ID NO: 1345787 - DNA, 22 bp, Artificial Sequence
  chemically synthesized
actaattattttttcaactttc

SEQ ID NO: 1345788 - DNA, 22 bp, Artificial Sequence
  chemically synthesized
taggattctttgaaagttgaaa

SEQ ID NO: 1345789 - DNA, 22 bp, Artificial Sequence
  chemically synthesized
ttactaattattttttcaactt

SEQ ID NO: 1345790 - DNA, 22 bp, Artificial Sequence
  chemically synthesized
ggattctttgaaagttgaaaaa

SEQ ID NO: 1345791 - DNA, 22 bp, Artificial Sequence
  chemically synthesized
cttactaattattttttcaact

SEQ ID NO: 1345792 - DNA, 22 bp, Artificial Sequence
  chemically synthesized
tcttactaattattttttcaac

SEQ ID NO: 1345793 - DNA, 22 bp, Artificial Sequence
  chemically synthesized
tttgaaagttgaaaaaataatt

SEQ ID NO: 1345794 - DNA, 22 bp, Artificial Sequence
  chemically synthesized
cattttcttactaattattttt

SEQ ID NO: 1345795 - DNA, 22 bp, Artificial Sequence
  chemically synthesized
tgaaagttgaaaaaataattag

SEQ ID NO: 1345796 - DNA, 22 bp, Artificial Sequence
  chemically synthesized
gaaagttgaaaaaataattagt

SEQ ID NO: 1345797 - DNA, 22 bp, Artificial Sequence
  chemically synthesized
aaagttgaaaaaataattagta

SEQ ID NO: 1345798 - DNA, 22 bp, Artificial Sequence
  chemically synthesized
atctccattttcttactaatta

SEQ ID NO: 1345799 - DNA, 22 bp, Artificial Sequence
  chemically synthesized
catctccattttcttactaatt

SEQ ID NO: 1345800 - DNA, 22 bp, Artificial Sequence
  chemically synthesized
aaaaaataattagtaagaaaat

SEQ ID NO: 1345801 - DNA, 22 bp, Artificial Sequence
  chemically synthesized
gtgtagggcttcatctccattt

SEQ ID NO: 1345802 - DNA, 22 bp, Artificial Sequence
  chemically synthesized
gtaagaaaatggagatgaagcc

SEQ ID NO: 1345803 - DNA, 22 bp, Artificial Sequence
  chemically synthesized
tcatcctagtgtagggcttcat

SEQ ID NO: 1345804 - DNA, 22 bp, Artificial Sequence
  chemically synthesized
agtgctatcatcctagtgtagg

SEQ ID NO: 1345805 - DNA, 22 bp, Artificial Sequence
  chemically synthesized
taagtgctatcatcctagtgta

SEQ ID NO: 1345806 - DNA, 22 bp, Artificial Sequence
  chemically synthesized
ctaagtgctatcatcctagtgt

SEQ ID NO: 1345807 - DNA, 22 bp, Artificial Sequence
  chemically synthesized
tctaagtgctatcatcctagtg

SEQ ID NO: 1345808 - DNA, 22 bp, Artificial Sequence
  chemically synthesized
ttctaagtgctatcatcctagt

SEQ ID NO: 1345809 - DNA, 22 bp, Artificial Sequence
  chemically synthesized
tttctaagtgctatcatcctag

SEQ ID NO: 1345810 - DNA, 22 bp, Artificial Sequence
  chemically synthesized
tctttttctaagtgctatcatc

SEQ ID NO: 1345811 - DNA, 22 bp, Artificial Sequence
  chemically synthesized
atctttttctaagtgctatcat

SEQ ID NO: 1345812 - DNA, 22 bp, Artificial Sequence
  chemically synthesized
tatctttttctaagtgctatca

SEQ ID NO: 1345813 - DNA, 22 bp, Artificial Sequence
  chemically synthesized
ttatctttttctaagtgctatc

SEQ ID NO: 1345814 - DNA, 22 bp, Artificial Sequence
  chemically synthesized
cactaggatgatagcacttaga

SEQ ID NO: 1345815 - DNA, 22 bp, Artificial Sequence
  chemically synthesized
acttttatctttttctaagtgc

SEQ ID NO: 1345816 - DNA, 22 bp, Artificial Sequence
  chemically synthesized
ttcacttttatctttttctaag

SEQ ID NO: 1345817 - DNA, 22 bp, Artificial Sequence
  chemically synthesized
ggatgatagcacttagaaaaag

SEQ ID NO: 1345818 - DNA, 22 bp, Artificial Sequence
  chemically synthesized
acacatctattcacttttatct

SEQ ID NO: 1345819 - DNA, 22 bp, Artificial Sequence
  chemically synthesized
gacacatctattcacttttatc

SEQ ID NO: 1345820 - DNA, 22 bp, Artificial Sequence
  chemically synthesized
tgacacatctattcacttttat

SEQ ID NO: 1345821 - DNA, 22 bp, Artificial Sequence
  chemically synthesized
ttgacacatctattcactttta

SEQ ID NO: 1345822 - DNA, 22 bp, Artificial Sequence
  chemically synthesized
agaaaaagataaaagtgaatag

SEQ ID NO: 1345823 - DNA, 22 bp, Artificial Sequence
  chemically synthesized
cttttgacacatctattcactt

SEQ ID NO: 1345824 - DNA, 22 bp, Artificial Sequence
  chemically synthesized
gaaaaagataaaagtgaataga

SEQ ID NO: 1345825 - DNA, 22 bp, Artificial Sequence
  chemically synthesized
aatctgcttttgacacatctat

SEQ ID NO: 1345826 - DNA, 22 bp, Artificial Sequence
  chemically synthesized
ccattaaatctgcttttgacac

SEQ ID NO: 1345827 - DNA, 22 bp, Artificial Sequence
  chemically synthesized
tcaattcccattaaatctgctt

SEQ ID NO: 1345828 - DNA, 22 bp, Artificial Sequence
  chemically synthesized
gtcaattcccattaaatctgct

SEQ ID NO: 1345829 - DNA, 22 bp, Artificial Sequence
  chemically synthesized
tgtcaattcccattaaatctgc

SEQ ID NO: 1345830 - DNA, 22 bp, Artificial Sequence
  chemically synthesized
ttgtcaattcccattaaatctg

SEQ ID NO: 1345831 - DNA, 22 bp, Artificial Sequence
  chemically synthesized
tttgtcaattcccattaaatct

SEQ ID NO: 1345832 - DNA, 22 bp, Artificial Sequence
  chemically synthesized
gtccctttttgtcaattcccat

SEQ ID NO: 1345833 - DNA, 22 bp, Artificial Sequence
  chemically synthesized
aagtattcgtccctttttgtca

SEQ ID NO: 1345834 - DNA, 22 bp, Artificial Sequence
  chemically synthesized
caagtattcgtccctttttgtc

SEQ ID NO: 1345835 - DNA, 22 bp, Artificial Sequence
  chemically synthesized
aatgggaattgacaaaaaggga

SEQ ID NO: 1345836 - DNA, 22 bp, Artificial Sequence
  chemically synthesized
atgggaattgacaaaaagggac

SEQ ID NO: 1345837 - DNA, 22 bp, Artificial Sequence
  chemically synthesized
agtcagtttcaagtattcgtcc

SEQ ID NO: 1345838 - DNA, 22 bp, Artificial Sequence
  chemically synthesized
gagtcagtttcaagtattcgtc

SEQ ID NO: 1345839 - DNA, 22 bp, Artificial Sequence
  chemically synthesized
tgagtcagtttcaagtattcgt

SEQ ID NO: 1345840 - DNA, 22 bp, Artificial Sequence
  chemically synthesized
acaaaaagggacgaatacttga

SEQ ID NO: 1345841 - DNA, 22 bp, Artificial Sequence
  chemically synthesized
aaaatctttgagtcagtttcaa

SEQ ID NO: 1345842 - DNA, 22 bp, Artificial Sequence
  chemically synthesized
agactcaaaatctttgagtcag

SEQ ID NO: 1345843 - DNA, 22 bp, Artificial Sequence
  chemically synthesized
gaaactgactcaaagattttga

SEQ ID NO: 1345844 - DNA, 22 bp, Artificial Sequence
  chemically synthesized
aaactgactcaaagattttgag

SEQ ID NO: 1345845 - DNA, 22 bp, Artificial Sequence
  chemically synthesized
caatccctcagactcaaaatct

SEQ ID NO: 1345846 - DNA, 22 bp, Artificial Sequence
  chemically synthesized
ccaatccctcagactcaaaatc

SEQ ID NO: 1345847 - DNA, 22 bp, Artificial Sequence
  chemically synthesized
ttccaatccctcagactcaaaa

SEQ ID NO: 1345848 - DNA, 22 bp, Artificial Sequence
  chemically synthesized
actcaaagattttgagtctgag

SEQ ID NO: 1345849 - DNA, 22 bp, Artificial Sequence
  chemically synthesized
actcttccaatccctcagactc

SEQ ID NO: 1345850 - DNA, 22 bp, Artificial Sequence
  chemically synthesized
aaagattttgagtctgagggat

SEQ ID NO: 1345851 - DNA, 22 bp, Artificial Sequence
  chemically synthesized
tgagtctgagggattggaagag

SEQ ID NO: 1345852 - DNA, 22 bp, Artificial Sequence
  chemically synthesized
gagtctgagggattggaagagt

SEQ ID NO: 1345853 - DNA, 22 bp, Artificial Sequence
  chemically synthesized
agtctgagggattggaagagtc

SEQ ID NO: 1345854 - DNA, 22 bp, Artificial Sequence
  chemically synthesized
caacagcagtcccctgactctt

SEQ ID NO: 1345855 - DNA, 22 bp, Artificial Sequence
  chemically synthesized
ccaacagcagtcccctgactct

SEQ ID NO: 1345856 - DNA, 22 bp, Artificial Sequence
  chemically synthesized
agggattggaagagtcagggga

SEQ ID NO: 1345857 - DNA, 22 bp, Artificial Sequence
  chemically synthesized
ttccaacagcagtcccctgact

SEQ ID NO: 1345858 - DNA, 22 bp, Artificial Sequence
  chemically synthesized
ccactcttccaacagcagtccc

SEQ ID NO: 1345859 - DNA, 22 bp, Artificial Sequence
  chemically synthesized
gaagagtcaggggactgctgtt

SEQ ID NO: 1345860 - DNA, 22 bp, Artificial Sequence
  chemically synthesized
ctcccactcttccaacagcagt

SEQ ID NO: 1345861 - DNA, 22 bp, Artificial Sequence
  chemically synthesized
gctcccactcttccaacagcag

SEQ ID NO: 1345862 - DNA, 22 bp, Artificial Sequence
  chemically synthesized
tttgctcccactcttccaacag

SEQ ID NO: 1345863 - DNA, 22 bp, Artificial Sequence
  chemically synthesized
tatttgctcccactcttccaac

SEQ ID NO: 1345864 - DNA, 22 bp, Artificial Sequence
  chemically synthesized
attctatttgctcccactcttc

SEQ ID NO: 1345865 - DNA, 22 bp, Artificial Sequence
  chemically synthesized
tgattctatttgctcccactct

SEQ ID NO: 1345866 - DNA, 22 bp, Artificial Sequence
  chemically synthesized
ctgattctatttgctcccactc

SEQ ID NO: 1345867 - DNA, 22 bp, Artificial Sequence
  chemically synthesized
tctgattctatttgctcccact

SEQ ID NO: 1345868 - DNA, 22 bp, Artificial Sequence
  chemically synthesized
ctgttggaagagtgggagcaaa

SEQ ID NO: 1345869 - DNA, 22 bp, Artificial Sequence
  chemically synthesized
ttggaagagtgggagcaaatag

SEQ ID NO: 1345870 - DNA, 22 bp, Artificial Sequence
  chemically synthesized
gaagagtgggagcaaatagaat

SEQ ID NO: 1345871 - DNA, 22 bp, Artificial Sequence
  chemically synthesized
gtgtgtgcgtgtgttttctgat

SEQ ID NO: 1345872 - DNA, 22 bp, Artificial Sequence
  chemically synthesized
ggtgtgtgcgtgtgttttctga

SEQ ID NO: 1345873 - DNA, 22 bp, Artificial Sequence
  chemically synthesized
tggtgtgtgcgtgtgttttctg

SEQ ID NO: 1345874 - DNA, 22 bp, Artificial Sequence
  chemically synthesized
ttggtgtgtgcgtgtgttttct

SEQ ID NO: 1345875 - DNA, 22 bp, Artificial Sequence
  chemically synthesized
tttttggtgtgtgcgtgtgttt

SEQ ID NO: 1345876 - DNA, 22 bp, Artificial Sequence
  chemically synthesized
aaaatatccaaaaccagttatt

SEQ ID NO: 1345877 - DNA, 22 bp, Artificial Sequence
  chemically synthesized
tcaaaatatccaaaaccagtta

SEQ ID NO: 1345878 - DNA, 22 bp, Artificial Sequence
  chemically synthesized
tggctctcaaaatatccaaaac

SEQ ID NO: 1345879 - DNA, 22 bp, Artificial Sequence
  chemically synthesized
ggctatggctctcaaaatatcc

SEQ ID NO: 1345880 - DNA, 22 bp, Artificial Sequence
  chemically synthesized
gggctatggctctcaaaatatc

SEQ ID NO: 1345881 - DNA, 22 bp, Artificial Sequence
  chemically synthesized
tgggctatggctctcaaaatat

SEQ ID NO: 1345882 - DNA, 22 bp, Artificial Sequence
  chemically synthesized
ttgggctatggctctcaaaata

SEQ ID NO: 1345883 - DNA, 22 bp, Artificial Sequence
  chemically synthesized
gttttggatattttgagagcca

SEQ ID NO: 1345884 - DNA, 22 bp, Artificial Sequence
  chemically synthesized
gcttttgggctatggctctcaa

SEQ ID NO: 1345885 - DNA, 22 bp, Artificial Sequence
  chemically synthesized
agcttttgggctatggctctca

SEQ ID NO: 1345886 - DNA, 22 bp, Artificial Sequence
  chemically synthesized
tagcttttgggctatggctctc

SEQ ID NO: 1345887 - DNA, 22 bp, Artificial Sequence
  chemically synthesized
tggatattttgagagccatagc

SEQ ID NO: 1345888 - DNA, 22 bp, Artificial Sequence
  chemically synthesized
ggatattttgagagccatagcc

SEQ ID NO: 1345889 - DNA, 22 bp, Artificial Sequence
  chemically synthesized
gatattttgagagccatagccc

SEQ ID NO: 1345890 - DNA, 22 bp, Artificial Sequence
  chemically synthesized
tgagagccatagcccaaaagct

SEQ ID NO: 1345891 - DNA, 22 bp, Artificial Sequence
  chemically synthesized
gagagccatagcccaaaagcta

SEQ ID NO: 1345892 - DNA, 22 bp, Artificial Sequence
  chemically synthesized
agagccatagcccaaaagctaa

SEQ ID NO: 1345893 - DNA, 22 bp, Artificial Sequence
  chemically synthesized
aacatagaacagcctttagctt

SEQ ID NO: 1345894 - DNA, 22 bp, Artificial Sequence
  chemically synthesized
ataattcaacatagaacagcct

SEQ ID NO: 1345895 - DNA, 22 bp, Artificial Sequence
  chemically synthesized
gataattcaacatagaacagcc

SEQ ID NO: 1345896 - DNA, 22 bp, Artificial Sequence
  chemically synthesized
tgataattcaacatagaacagc

SEQ ID NO: 1345897 - DNA, 22 bp, Artificial Sequence
  chemically synthesized
aaggctgttctatgttgaatta

SEQ ID NO: 1345898 - DNA, 22 bp, Artificial Sequence
  chemically synthesized
ttctatgttgaattatcaaagc

SEQ ID NO: 1345899 - DNA, 22 bp, Artificial Sequence
  chemically synthesized
tatgttgaattatcaaagccac

SEQ ID NO: 1345900 - DNA, 22 bp, Artificial Sequence
  chemically synthesized
tgttgaattatcaaagccactt

SEQ ID NO: 1345901 - DNA, 22 bp, Artificial Sequence
  chemically synthesized
aattatcaaagccactttctga

SEQ ID NO: 1345902 - DNA, 22 bp, Artificial Sequence
  chemically synthesized
tcaaagccactttctgatctct

SEQ ID NO: 1345903 - DNA, 22 bp, Artificial Sequence
  chemically synthesized
aaaaaaaaaacagcataaaaac

SEQ ID NO: 1345904 - DNA, 22 bp, Artificial Sequence
  chemically synthesized
tctgatctctgtttttatgctg

SEQ ID NO: 1345905 - DNA, 22 bp, Artificial Sequence
  chemically synthesized
ctgatctctgtttttatgctgt

SEQ ID NO: 1345906 - DNA, 22 bp, Artificial Sequence
  chemically synthesized
tgatctctgtttttatgctgtt

SEQ ID NO: 1345907 - DNA, 22 bp, Artificial Sequence
  chemically synthesized
atctctgtttttatgctgtttt

SEQ ID NO: 1345908 - DNA, 22 bp, Artificial Sequence
  chemically synthesized
aaaatgctaaaaaaaaaaacag

SEQ ID NO: 1345909 - DNA, 22 bp, Artificial Sequence
  chemically synthesized
gaaaatgctaaaaaaaaaaaca

SEQ ID NO: 1345910 - DNA, 22 bp, Artificial Sequence
  chemically synthesized
tgtttttatgctgttttttttt

SEQ ID NO: 1345911 - DNA, 22 bp, Artificial Sequence
  chemically synthesized
tttttatgctgttttttttttt

SEQ ID NO: 1345912 - DNA, 22 bp, Artificial Sequence
  chemically synthesized
ttatgctgtttttttttttagc

SEQ ID NO: 1345913 - DNA, 22 bp, Artificial Sequence
  chemically synthesized
tatgctgtttttttttttagca

SEQ ID NO: 1345914 - DNA, 22 bp, Artificial Sequence
  chemically synthesized
atgctgtttttttttttagcat

SEQ ID NO: 1345915 - DNA, 22 bp, Artificial Sequence
  chemically synthesized
tgctgtttttttttttagcatt

SEQ ID NO: 1345916 - DNA, 22 bp, Artificial Sequence
  chemically synthesized
tttttttttttagcattttcaa

SEQ ID NO: 1345917 - DNA, 22 bp, Artificial Sequence
  chemically synthesized
agtgaggaaaaatttgaaaatg

SEQ ID NO: 1345918 - DNA, 22 bp, Artificial Sequence
  chemically synthesized
aagtgaggaaaaatttgaaaat

SEQ ID NO: 1345919 - DNA, 22 bp, Artificial Sequence
  chemically synthesized
ttttttttagcattttcaaatt

SEQ ID NO: 1345920 - DNA, 22 bp, Artificial Sequence
  chemically synthesized
tttttttagcattttcaaattt

SEQ ID NO: 1345921 - DNA, 22 bp, Artificial Sequence
  chemically synthesized
ttttttagcattttcaaatttt

SEQ ID NO: 1345922 - DNA, 22 bp, Artificial Sequence
  chemically synthesized
tttttagcattttcaaattttt

SEQ ID NO: 1345923 - DNA, 22 bp, Artificial Sequence
  chemically synthesized
ttttagcattttcaaatttttc

SEQ ID NO: 1345924 - DNA, 22 bp, Artificial Sequence
  chemically synthesized
tttagcattttcaaatttttcc

SEQ ID NO: 1345925 - DNA, 22 bp, Artificial Sequence
  chemically synthesized
ttagcattttcaaatttttcct

SEQ ID NO: 1345926 - DNA, 22 bp, Artificial Sequence
  chemically synthesized
tagcattttcaaatttttcctc

SEQ ID NO: 1345927 - DNA, 22 bp, Artificial Sequence
  chemically synthesized
agcattttcaaatttttcctca

SEQ ID NO: 1345928 - DNA, 22 bp, Artificial Sequence
  chemically synthesized
cagaatcttaagtgaggaaaaa

SEQ ID NO: 1345929 - DNA, 22 bp, Artificial Sequence
  chemically synthesized
gcattttcaaatttttcctcac

SEQ ID NO: 1345930 - DNA, 22 bp, Artificial Sequence
  chemically synthesized
acagaatcttaagtgaggaaaa

SEQ ID NO: 1345931 - DNA, 22 bp, Artificial Sequence
  chemically synthesized
tacagaatcttaagtgaggaaa

SEQ ID NO: 1345932 - DNA, 22 bp, Artificial Sequence
  chemically synthesized
tcaaatttttcctcacttaaga

SEQ ID NO: 1345933 - DNA, 22 bp, Artificial Sequence
  chemically synthesized
caaatttttcctcacttaagat

SEQ ID NO: 1345934 - DNA, 22 bp, Artificial Sequence
  chemically synthesized
aaatttttcctcacttaagatt

SEQ ID NO: 1345935 - DNA, 22 bp, Artificial Sequence
  chemically synthesized
ttcctcacttaagattctgtaa

SEQ ID NO: 1345936 - DNA, 22 bp, Artificial Sequence
  chemically synthesized
tcctcacttaagattctgtaaa

SEQ ID NO: 1345937 - DNA, 22 bp, Artificial Sequence
  chemically synthesized
cctcacttaagattctgtaaaa

SEQ ID NO: 1345938 - DNA, 22 bp, Artificial Sequence
  chemically synthesized
ctcacttaagattctgtaaaat

SEQ ID NO: 1345939 - DNA, 22 bp, Artificial Sequence
  chemically synthesized
acttaagattctgtaaaatttt

SEQ ID NO: 1345940 - DNA, 22 bp, Artificial Sequence
  chemically synthesized
aagattctgtaaaatttttatt

SEQ ID NO: 1345941 - DNA, 22 bp, Artificial Sequence
  chemically synthesized
agattctgtaaaatttttattg

SEQ ID NO: 1345942 - DNA, 22 bp, Artificial Sequence
  chemically synthesized
cacaagcatataagcaataaaa

SEQ ID NO: 1345943 - DNA, 22 bp, Artificial Sequence
  chemically synthesized
acacaagcatataagcaataaa

SEQ ID NO: 1345944 - DNA, 22 bp, Artificial Sequence
  chemically synthesized
ttacacaagcatataagcaata

SEQ ID NO: 1345945 - DNA, 22 bp, Artificial Sequence
  chemically synthesized
tgtaaaatttttattgcttata

SEQ ID NO: 1345946 - DNA, 22 bp, Artificial Sequence
  chemically synthesized
cttacacaagcatataagcaat

SEQ ID NO: 1345947 - DNA, 22 bp, Artificial Sequence
  chemically synthesized
taaaatttttattgcttatatg

SEQ ID NO: 1345948 - DNA, 22 bp, Artificial Sequence
  chemically synthesized
ttattgcttatatgcttgtgta

SEQ ID NO: 1345949 - DNA, 22 bp, Artificial Sequence
  chemically synthesized
tattgcttatatgcttgtgtaa

SEQ ID NO: 1345950 - DNA, 22 bp, Artificial Sequence
  chemically synthesized
attgcttatatgcttgtgtaag

SEQ ID NO: 1345951 - DNA, 22 bp, Artificial Sequence
  chemically synthesized
ttgcttatatgcttgtgtaaga

SEQ ID NO: 1345952 - DNA, 22 bp, Artificial Sequence
  chemically synthesized
cttatatgcttgtgtaagaaat

SEQ ID NO: 1345953 - DNA, 22 bp, Artificial Sequence
  chemically synthesized
atatgcttgtgtaagaaattca

SEQ ID NO: 1345954 - DNA, 22 bp, Artificial Sequence
  chemically synthesized
tatgcttgtgtaagaaattcat

SEQ ID NO: 1345955 - DNA, 22 bp, Artificial Sequence
  chemically synthesized
gagcacaatcacatgatatgaa

SEQ ID NO: 1345956 - DNA, 22 bp, Artificial Sequence
  chemically synthesized
ggagcacaatcacatgatatga

SEQ ID NO: 1345957 - DNA, 22 bp, Artificial Sequence
  chemically synthesized
gtgtaagaaattcatatcatgt

SEQ ID NO: 1345958 - DNA, 22 bp, Artificial Sequence
  chemically synthesized
tggagcacaatcacatgatatg

SEQ ID NO: 1345959 - DNA, 22 bp, Artificial Sequence
  chemically synthesized
tgtaagaaattcatatcatgtg

SEQ ID NO: 1345960 - DNA, 22 bp, Artificial Sequence
  chemically synthesized
ttggagcacaatcacatgatat

SEQ ID NO: 1345961 - DNA, 22 bp, Artificial Sequence
  chemically synthesized
aaaatttttggagcacaatcac

SEQ ID NO: 1345962 - DNA, 22 bp, Artificial Sequence
  chemically synthesized
ctaaaaatttttggagcacaat

SEQ ID NO: 1345963 - DNA, 22 bp, Artificial Sequence
  chemically synthesized
atatcatgtgattgtgctccaa

SEQ ID NO: 1345964 - DNA, 22 bp, Artificial Sequence
  chemically synthesized
tcctactaaaaatttttggagc

SEQ ID NO: 1345965 - DNA, 22 bp, Artificial Sequence
  chemically synthesized
ttatcctactaaaaatttttgg

SEQ ID NO: 1345966 - DNA, 22 bp, Artificial Sequence
  chemically synthesized
tgctccaaaaatttttagtagg

SEQ ID NO: 1345967 - DNA, 22 bp, Artificial Sequence
  chemically synthesized
caaaaatttttagtaggataat

SEQ ID NO: 1345968 - DNA, 22 bp, Artificial Sequence
  chemically synthesized
agaagcagtaaaatgctattat

SEQ ID NO: 1345969 - DNA, 22 bp, Artificial Sequence
  chemically synthesized
cagaagcagtaaaatgctatta

SEQ ID NO: 1345970 - DNA, 22 bp, Artificial Sequence
  chemically synthesized
tcagaagcagtaaaatgctatt

SEQ ID NO: 1345971 - DNA, 22 bp, Artificial Sequence
  chemically synthesized
ttagtaggataatagcatttta

SEQ ID NO: 1345972 - DNA, 22 bp, Artificial Sequence
  chemically synthesized
tagtaggataatagcattttac

SEQ ID NO: 1345973 - DNA, 22 bp, Artificial Sequence
  chemically synthesized
agtaggataatagcattttact

SEQ ID NO: 1345974 - DNA, 22 bp, Artificial Sequence
  chemically synthesized
gtaggataatagcattttactg

SEQ ID NO: 1345975 - DNA, 22 bp, Artificial Sequence
  chemically synthesized
caggtcattttcagaagcagta

SEQ ID NO: 1345976 - DNA, 22 bp, Artificial Sequence
  chemically synthesized
atattgcaggtcattttcagaa

SEQ ID NO: 1345977 - DNA, 22 bp, Artificial Sequence
  chemically synthesized
tactgcttctgaaaatgacctg

SEQ ID NO: 1345978 - DNA, 22 bp, Artificial Sequence
  chemically synthesized
actgcttctgaaaatgacctgc

SEQ ID NO: 1345979 - DNA, 22 bp, Artificial Sequence
  chemically synthesized
ctgcttctgaaaatgacctgca

SEQ ID NO: 1345980 - DNA, 22 bp, Artificial Sequence
  chemically synthesized
cttctgaaaatgacctgcaata

SEQ ID NO: 1345981 - DNA, 22 bp, Artificial Sequence
  chemically synthesized
ctgaaaatgacctgcaatatta

SEQ ID NO: 1345982 - DNA, 22 bp, Artificial Sequence
  chemically synthesized
tgaaaatgacctgcaatattag

SEQ ID NO: 1345983 - DNA, 22 bp, Artificial Sequence
  chemically synthesized
aaaatgacctgcaatattaggt

SEQ ID NO: 1345984 - DNA, 22 bp, Artificial Sequence
  chemically synthesized
atataacaaataataacctaat

SEQ ID NO: 1345985 - DNA, 22 bp, Artificial Sequence
  chemically synthesized
gacctaatataacaaataataa

SEQ ID NO: 1345986 - DNA, 22 bp, Artificial Sequence
  chemically synthesized
caatattaggttattatttgtt

SEQ ID NO: 1345987 - DNA, 22 bp, Artificial Sequence
  chemically synthesized
tagacctaatataacaaataat

SEQ ID NO: 1345988 - DNA, 22 bp, Artificial Sequence
  chemically synthesized
ctagacctaatataacaaataa

SEQ ID NO: 1345989 - DNA, 22 bp, Artificial Sequence
  chemically synthesized
tttctagacctaatataacaaa

SEQ ID NO: 1345990 - DNA, 22 bp, Artificial Sequence
  chemically synthesized
ggttattatttgttatattagg

SEQ ID NO: 1345991 - DNA, 22 bp, Artificial Sequence
  chemically synthesized
tgctgtttctagacctaatata

SEQ ID NO: 1345992 - DNA, 22 bp, Artificial Sequence
  chemically synthesized
atgctgtttctagacctaatat

SEQ ID NO: 1345993 - DNA, 22 bp, Artificial Sequence
  chemically synthesized
ttatttgttatattaggtctag

SEQ ID NO: 1345994 - DNA, 22 bp, Artificial Sequence
  chemically synthesized
tttgttatattaggtctagaaa

SEQ ID NO: 1345995 - DNA, 22 bp, Artificial Sequence
  chemically synthesized
gttatattaggtctagaaacag

SEQ ID NO: 1345996 - DNA, 22 bp, Artificial Sequence
  chemically synthesized
ttatattaggtctagaaacagc

SEQ ID NO: 1345997 - DNA, 22 bp, Artificial Sequence
  chemically synthesized
agtcaatagtttatgctgtttc

SEQ ID NO: 1345998 - DNA, 22 bp, Artificial Sequence
  chemically synthesized
tattaggtctagaaacagcata

SEQ ID NO: 1345999 - DNA, 22 bp, Artificial Sequence
  chemically synthesized
cagtcaatagtttatgctgttt

SEQ ID NO: 1346000 - DNA, 22 bp, Artificial Sequence
  chemically synthesized
ggtctagaaacagcataaacta

SEQ ID NO: 1346001 - DNA, 22 bp, Artificial Sequence
  chemically synthesized
gaaacagcataaactattgact

SEQ ID NO: 1346002 - DNA, 22 bp, Artificial Sequence
  chemically synthesized
aaatgtcaaacttcagtcaata

SEQ ID NO: 1346003 - DNA, 22 bp, Artificial Sequence
  chemically synthesized
aaaatgtcaaacttcagtcaat

SEQ ID NO: 1346004 - DNA, 22 bp, Artificial Sequence
  chemically synthesized
taaaatgtcaaacttcagtcaa

SEQ ID NO: 1346005 - DNA, 22 bp, Artificial Sequence
  chemically synthesized
gagaattttaaaatgtcaaact

SEQ ID NO: 1346006 - DNA, 22 bp, Artificial Sequence
  chemically synthesized
ttagagaattttaaaatgtcaa

SEQ ID NO: 1346007 - DNA, 22 bp, Artificial Sequence
  chemically synthesized
ttgactgaagtttgacatttta

SEQ ID NO: 1346008 - DNA, 22 bp, Artificial Sequence
  chemically synthesized
attagagaattttaaaatgtca

SEQ ID NO: 1346009 - DNA, 22 bp, Artificial Sequence
  chemically synthesized
actgaagtttgacattttaaaa

SEQ ID NO: 1346010 - DNA, 22 bp, Artificial Sequence
  chemically synthesized
cagtttattagagaattttaaa

SEQ ID NO: 1346011 - DNA, 22 bp, Artificial Sequence
  chemically synthesized
aagtttgacattttaaaattct

SEQ ID NO: 1346012 - DNA, 22 bp, Artificial Sequence
  chemically synthesized
ctccagtttattagagaatttt

SEQ ID NO: 1346013 - DNA, 22 bp, Artificial Sequence
  chemically synthesized
cctccagtttattagagaattt

SEQ ID NO: 1346014 - DNA, 22 bp, Artificial Sequence
  chemically synthesized
tcctccagtttattagagaatt

SEQ ID NO: 1346015 - DNA, 22 bp, Artificial Sequence
  chemically synthesized
gacattttaaaattctctaata

SEQ ID NO: 1346016 - DNA, 22 bp, Artificial Sequence
  chemically synthesized
acattttaaaattctctaataa

SEQ ID NO: 1346017 - DNA, 22 bp, Artificial Sequence
  chemically synthesized
taaaattctctaataaactgga

SEQ ID NO: 1346018 - DNA, 22 bp, Artificial Sequence
  chemically synthesized
aaaattctctaataaactggag

SEQ ID NO: 1346019 - DNA, 22 bp, Artificial Sequence
  chemically synthesized
aaattctctaataaactggagg

SEQ ID NO: 1346020 - DNA, 22 bp, Artificial Sequence
  chemically synthesized
cagcagaggtggactttcctcc

SEQ ID NO: 1346021 - DNA, 22 bp, Artificial Sequence
  chemically synthesized
tctaataaactggaggaaagtc

SEQ ID NO: 1346022 - DNA, 22 bp, Artificial Sequence
  chemically synthesized
taataaactggaggaaagtcca

SEQ ID NO: 1346023 - DNA, 22 bp, Artificial Sequence
  chemically synthesized
ataaactggaggaaagtccacc

SEQ ID NO: 1346024 - DNA, 22 bp, Artificial Sequence
  chemically synthesized
cagagttccagcagaggtggac

SEQ ID NO: 1346025 - DNA, 22 bp, Artificial Sequence
  chemically synthesized
gaggaaagtccacctctgctgg

SEQ ID NO: 1346026 - DNA, 22 bp, Artificial Sequence
  chemically synthesized
tgcactgcagagttccagcaga

SEQ ID NO: 1346027 - DNA, 22 bp, Artificial Sequence
  chemically synthesized
tgtgcactgcagagttccagca

SEQ ID NO: 1346028 - DNA, 22 bp, Artificial Sequence
  chemically synthesized
ctgtgcactgcagagttccagc

SEQ ID NO: 1346029 - DNA, 22 bp, Artificial Sequence
  chemically synthesized
ccttctgtgcactgcagagttc

SEQ ID NO: 1346030 - DNA, 22 bp, Artificial Sequence
  chemically synthesized
gccttctgtgcactgcagagtt

SEQ ID NO: 1346031 - DNA, 22 bp, Artificial Sequence
  chemically synthesized
tttgccttctgtgcactgcaga

SEQ ID NO: 1346032 - DNA, 22 bp, Artificial Sequence
  chemically synthesized
tgctggaactctgcagtgcaca

SEQ ID NO: 1346033 - DNA, 22 bp, Artificial Sequence
  chemically synthesized
ttatttgccttctgtgcactgc

SEQ ID NO: 1346034 - DNA, 22 bp, Artificial Sequence
  chemically synthesized
ctggaactctgcagtgcacaga

SEQ ID NO: 1346035 - DNA, 22 bp, Artificial Sequence
  chemically synthesized
gaactctgcagtgcacagaagg

SEQ ID NO: 1346036 - DNA, 22 bp, Artificial Sequence
  chemically synthesized
tgcagtgcacagaaggcaaata

SEQ ID NO: 1346037 - DNA, 22 bp, Artificial Sequence
  chemically synthesized
cagtgcacagaaggcaaataat

SEQ ID NO: 1346038 - DNA, 22 bp, Artificial Sequence
  chemically synthesized
agcgaagccatggcaggatagc

SEQ ID NO: 1346039 - DNA, 22 bp, Artificial Sequence
  chemically synthesized
tattaagcgaagccatggcagg

SEQ ID NO: 1346040 - DNA, 22 bp, Artificial Sequence
  chemically synthesized
gtattaagcgaagccatggcag

SEQ ID NO: 1346041 - DNA, 22 bp, Artificial Sequence
  chemically synthesized
ctatcctgccatggcttcgctt

SEQ ID NO: 1346042 - DNA, 22 bp, Artificial Sequence
  chemically synthesized
tacaaatttgtattaagcgaag

SEQ ID NO: 1346043 - DNA, 22 bp, Artificial Sequence
  chemically synthesized
tcctgccatggcttcgcttaat

SEQ ID NO: 1346044 - DNA, 22 bp, Artificial Sequence
  chemically synthesized
ccatggcttcgcttaatacaaa

SEQ ID NO: 1346045 - DNA, 22 bp, Artificial Sequence
  chemically synthesized
tatatattgtacaaatttgtat

SEQ ID NO: 1346046 - DNA, 22 bp, Artificial Sequence
  chemically synthesized
aattgtatatattgtacaaatt

SEQ ID NO: 1346047 - DNA, 22 bp, Artificial Sequence
  chemically synthesized
cgcttaatacaaatttgtacaa

SEQ ID NO: 1346048 - DNA, 22 bp, Artificial Sequence
  chemically synthesized
aaattgtatatattgtacaaat

SEQ ID NO: 1346049 - DNA, 22 bp, Artificial Sequence
  chemically synthesized
gcttaatacaaatttgtacaat

SEQ ID NO: 1346050 - DNA, 22 bp, Artificial Sequence
  chemically synthesized
taaattgtatatattgtacaaa

SEQ ID NO: 1346051 - DNA, 22 bp, Artificial Sequence
  chemically synthesized
ttaaattgtatatattgtacaa

SEQ ID NO: 1346052 - DNA, 22 bp, Artificial Sequence
  chemically synthesized
aatacaaatttgtacaatatat

SEQ ID NO: 1346053 - DNA, 22 bp, Artificial Sequence
  chemically synthesized
atacaaatttgtacaatatata

SEQ ID NO: 1346054 - DNA, 22 bp, Artificial Sequence
  chemically synthesized
atttttaaattgtatatattgt

SEQ ID NO: 1346055 - DNA, 22 bp, Artificial Sequence
  chemically synthesized
tgaattcatttttaaattgtat

SEQ ID NO: 1346056 - DNA, 22 bp, Artificial Sequence
  chemically synthesized
gtacaatatatacaatttaaaa

SEQ ID NO: 1346057 - DNA, 22 bp, Artificial Sequence
  chemically synthesized
tacaatatatacaatttaaaaa

SEQ ID NO: 1346058 - DNA, 22 bp, Artificial Sequence
  chemically synthesized
tgagaaaatagaaatgttatga

SEQ ID NO: 1346059 - DNA, 22 bp, Artificial Sequence
  chemically synthesized
atgagaaaatagaaatgttatg

SEQ ID NO: 1346060 - DNA, 22 bp, Artificial Sequence
  chemically synthesized
aaaaatgaattcataacatttc

SEQ ID NO: 1346061 - DNA, 22 bp, Artificial Sequence
  chemically synthesized
tatgagaaaatagaaatgttat

SEQ ID NO: 1346062 - DNA, 22 bp, Artificial Sequence
  chemically synthesized
aaaatgaattcataacatttct

SEQ ID NO: 1346063 - DNA, 22 bp, Artificial Sequence
  chemically synthesized
ataacatttctattttctcata

SEQ ID NO: 1346064 - DNA, 22 bp, Artificial Sequence
  chemically synthesized
acatatcacaatgttttatgag

SEQ ID NO: 1346065 - DNA, 22 bp, Artificial Sequence
  chemically synthesized
ctattttctcataaaacattgt

SEQ ID NO: 1346066 - DNA, 22 bp, Artificial Sequence
  chemically synthesized
gcctgacatatcacaatgtttt

SEQ ID NO: 1346067 - DNA, 22 bp, Artificial Sequence
  chemically synthesized
tattttctcataaaacattgtg

SEQ ID NO: 1346068 - DNA, 22 bp, Artificial Sequence
  chemically synthesized
ttttctcataaaacattgtgat

SEQ ID NO: 1346069 - DNA, 22 bp, Artificial Sequence
  chemically synthesized
ctggcctgacatatcacaatgt

SEQ ID NO: 1346070 - DNA, 22 bp, Artificial Sequence
  chemically synthesized
tctcataaaacattgtgatatg

SEQ ID NO: 1346071 - DNA, 22 bp, Artificial Sequence
  chemically synthesized
ttactggcctgacatatcacaa

SEQ ID NO: 1346072 - DNA, 22 bp, Artificial Sequence
  chemically synthesized
ctcataaaacattgtgatatgt

SEQ ID NO: 1346073 - DNA, 22 bp, Artificial Sequence
  chemically synthesized
tcataaaacattgtgatatgtc

SEQ ID NO: 1346074 - DNA, 22 bp, Artificial Sequence
  chemically synthesized
ataaaacattgtgatatgtcag

SEQ ID NO: 1346075 - DNA, 22 bp, Artificial Sequence
  chemically synthesized
acacctgttactggcctgacat

SEQ ID NO: 1346076 - DNA, 22 bp, Artificial Sequence
  chemically synthesized
cacacctgttactggcctgaca

SEQ ID NO: 1346077 - DNA, 22 bp, Artificial Sequence
  chemically synthesized
tcacacctgttactggcctgac

SEQ ID NO: 1346078 - DNA, 22 bp, Artificial Sequence
  chemically synthesized
tgatatgtcaggccagtaacag

SEQ ID NO: 1346079 - DNA, 22 bp, Artificial Sequence
  chemically synthesized
catcattttcacacctgttact

SEQ ID NO: 1346080 - DNA, 22 bp, Artificial Sequence
  chemically synthesized
attccatcattttcacacctgt

SEQ ID NO: 1346081 - DNA, 22 bp, Artificial Sequence
  chemically synthesized
gattccatcattttcacacctg

SEQ ID NO: 1346082 - DNA, 22 bp, Artificial Sequence
  chemically synthesized
tgaggatttgattccatcattt

SEQ ID NO: 1346083 - DNA, 22 bp, Artificial Sequence
  chemically synthesized
tgtgaggatttgattccatcat

SEQ ID NO: 1346084 - DNA, 22 bp, Artificial Sequence
  chemically synthesized
aacacgtattctgtgaggattt

SEQ ID NO: 1346085 - DNA, 22 bp, Artificial Sequence
  chemically synthesized
taaacacgtattctgtgaggat

SEQ ID NO: 1346086 - DNA, 22 bp, Artificial Sequence
  chemically synthesized
ttctaaacacgtattctgtgag

SEQ ID NO: 1346087 - DNA, 22 bp, Artificial Sequence
  chemically synthesized
aagaggtctgttctaaacacgt

SEQ ID NO: 1346088 - DNA, 22 bp, Artificial Sequence
  chemically synthesized
ctgaagaggtctgttctaaaca

SEQ ID NO: 1346089 - DNA, 22 bp, Artificial Sequence
  chemically synthesized
actgaagaggtctgttctaaac

SEQ ID NO: 1346090 - DNA, 22 bp, Artificial Sequence
  chemically synthesized
acagaatacgtgtttagaacag

SEQ ID NO: 1346091 - DNA, 22 bp, Artificial Sequence
  chemically synthesized
tactgaagaggtctgttctaaa

SEQ ID NO: 1346092 - DNA, 22 bp, Artificial Sequence
  chemically synthesized
tctttactgaagaggtctgttc

SEQ ID NO: 1346093 - DNA, 22 bp, Artificial Sequence
  chemically synthesized
aaagttgtctttactgaagagg

SEQ ID NO: 1346094 - DNA, 22 bp, Artificial Sequence
  chemically synthesized
aaaagttgtctttactgaagag

SEQ ID NO: 1346095 - DNA, 22 bp, Artificial Sequence
  chemically synthesized
taaaagttgtctttactgaaga

SEQ ID NO: 1346096 - DNA, 22 bp, Artificial Sequence
  chemically synthesized
ttaaaagttgtctttactgaag

SEQ ID NO: 1346097 - DNA, 22 bp, Artificial Sequence
  chemically synthesized
agaacagacctcttcagtaaag

SEQ ID NO: 1346098 - DNA, 22 bp, Artificial Sequence
  chemically synthesized
gaacagacctcttcagtaaaga

SEQ ID NO: 1346099 - DNA, 22 bp, Artificial Sequence
  chemically synthesized
tatttttaaaagttgtctttac

SEQ ID NO: 1346100 - DNA, 22 bp, Artificial Sequence
  chemically synthesized
ttcagtaaagacaacttttaaa

SEQ ID NO: 1346101 - DNA, 22 bp, Artificial Sequence
  chemically synthesized
cagtaaagacaacttttaaaaa

SEQ ID NO: 1346102 - DNA, 22 bp, Artificial Sequence
  chemically synthesized
agtaaagacaacttttaaaaat

SEQ ID NO: 1346103 - DNA, 22 bp, Artificial Sequence
  chemically synthesized
agccatcgtgcccggcctgtat

SEQ ID NO: 1346104 - DNA, 22 bp, Artificial Sequence
  chemically synthesized
gagccatcgtgcccggcctgta

SEQ ID NO: 1346105 - DNA, 22 bp, Artificial Sequence
  chemically synthesized
ttaaaaatacaggccgggcacg

SEQ ID NO: 1346106 - DNA, 22 bp, Artificial Sequence
  chemically synthesized
taaaaatacaggccgggcacga

SEQ ID NO: 1346107 - DNA, 22 bp, Artificial Sequence
  chemically synthesized
aaaaatacaggccgggcacgat

SEQ ID NO: 1346108 - DNA, 22 bp, Artificial Sequence
  chemically synthesized
cagacttgagccatcgtgcccg

SEQ ID NO: 1346109 - DNA, 22 bp, Artificial Sequence
  chemically synthesized
aaaatacaggccgggcacgatg

SEQ ID NO: 1346110 - DNA, 22 bp, Artificial Sequence
  chemically synthesized
ggattacagacttgagccatcg

SEQ ID NO: 1346111 - DNA, 22 bp, Artificial Sequence
  chemically synthesized
gcaaagtgctgggattacagac

SEQ ID NO: 1346112 - DNA, 22 bp, Artificial Sequence
  chemically synthesized
ggcctcgcaaagtgctgggatt

SEQ ID NO: 1346113 - DNA, 22 bp, Artificial Sequence
  chemically synthesized
aagtctgtaatcccagcacttt

SEQ ID NO: 1346114 - DNA, 22 bp, Artificial Sequence
  chemically synthesized
cctcggcctcgcaaagtgctgg

SEQ ID NO: 1346115 - DNA, 22 bp, Artificial Sequence
  chemically synthesized
taatcccagcactttgcgaggc

SEQ ID NO: 1346116 - DNA, 22 bp, Artificial Sequence
  chemically synthesized
gggtgatccacctgcctcggcc

SEQ ID NO: 1346117 - DNA, 22 bp, Artificial Sequence
  chemically synthesized
atctcgggtgatccacctgcct

SEQ ID NO: 1346118 - DNA, 22 bp, Artificial Sequence
  chemically synthesized
tgcgaggccgaggcaggtggat

SEQ ID NO: 1346119 - DNA, 22 bp, Artificial Sequence
  chemically synthesized
gcgaggccgaggcaggtggatc

SEQ ID NO: 1346120 - DNA, 22 bp, Artificial Sequence
  chemically synthesized
ctgatctcgggtgatccacctg

SEQ ID NO: 1346121 - DNA, 22 bp, Artificial Sequence
  chemically synthesized
cgaggccgaggcaggtggatca

SEQ ID NO: 1346122 - DNA, 22 bp, Artificial Sequence
  chemically synthesized
gaactcctgatctcgggtgatc

SEQ ID NO: 1346123 - DNA, 22 bp, Artificial Sequence
  chemically synthesized
gtctcgaactcctgatctcggg

SEQ ID NO: 1346124 - DNA, 22 bp, Artificial Sequence
  chemically synthesized
gccaggctggtctcgaactcct

SEQ ID NO: 1346125 - DNA, 22 bp, Artificial Sequence
  chemically synthesized
accatgttggccaggctggtct

SEQ ID NO: 1346126 - DNA, 22 bp, Artificial Sequence
  chemically synthesized
caccatgttggccaggctggtc

SEQ ID NO: 1346127 - DNA, 22 bp, Artificial Sequence
  chemically synthesized
gagaccagcctggccaacatgg

SEQ ID NO: 1346128 - DNA, 22 bp, Artificial Sequence
  chemically synthesized
gtagtgaaggagtttcaccatg

SEQ ID NO: 1346129 - DNA, 22 bp, Artificial Sequence
  chemically synthesized
agtagtgaaggagtttcaccat

SEQ ID NO: 1346130 - DNA, 22 bp, Artificial Sequence
  chemically synthesized
tagtagtgaaggagtttcacca

SEQ ID NO: 1346131 - DNA, 22 bp, Artificial Sequence
  chemically synthesized
ttagtagtgaaggagtttcacc

SEQ ID NO: 1346132 - DNA, 22 bp, Artificial Sequence
  chemically synthesized
gccaacatggtgaaactccttc

SEQ ID NO: 1346133 - DNA, 22 bp, Artificial Sequence
  chemically synthesized
tatttttagtagtgaaggagtt

SEQ ID NO: 1346134 - DNA, 22 bp, Artificial Sequence
  chemically synthesized
gtatttttagtagtgaaggagt

SEQ ID NO: 1346135 - DNA, 22 bp, Artificial Sequence
  chemically synthesized
tgtatttttagtagtgaaggag

SEQ ID NO: 1346136 - DNA, 22 bp, Artificial Sequence
  chemically synthesized
attttgtatttttagtagtgaa

SEQ ID NO: 1346137 - DNA, 22 bp, Artificial Sequence
  chemically synthesized
gctaattttgtatttttagtag

SEQ ID NO: 1346138 - DNA, 22 bp, Artificial Sequence
  chemically synthesized
cttcactactaaaaatacaaaa

SEQ ID NO: 1346139 - DNA, 22 bp, Artificial Sequence
  chemically synthesized
cactactaaaaatacaaaatta

SEQ ID NO: 1346140 - DNA, 22 bp, Artificial Sequence
  chemically synthesized
actactaaaaatacaaaattag

SEQ ID NO: 1346141 - DNA, 22 bp, Artificial Sequence
  chemically synthesized
ctaaaaatacaaaattagccag

SEQ ID NO: 1346142 - DNA, 22 bp, Artificial Sequence
  chemically synthesized
aaaatacaaaattagccaggca

SEQ ID NO: 1346143 - DNA, 22 bp, Artificial Sequence
  chemically synthesized
cagtcgtgtgccaccatgcctg

SEQ ID NO: 1346144 - DNA, 22 bp, Artificial Sequence
  chemically synthesized
ggactacagtcgtgtgccacca

SEQ ID NO: 1346145 - DNA, 22 bp, Artificial Sequence
  chemically synthesized
gccaggcatggtggcacacgac

SEQ ID NO: 1346146 - DNA, 22 bp, Artificial Sequence
  chemically synthesized
ccaggtacctgggactacagtc

SEQ ID NO: 1346147 - DNA, 22 bp, Artificial Sequence
  chemically synthesized
agcctcccaggtacctgggact

SEQ ID NO: 1346148 - DNA, 22 bp, Artificial Sequence
  chemically synthesized
cagcctcccaggtacctgggac

SEQ ID NO: 1346149 - DNA, 22 bp, Artificial Sequence
  chemically synthesized
cttcagcctcccaggtacctgg

SEQ ID NO: 1346150 - DNA, 22 bp, Artificial Sequence
  chemically synthesized
ctgcttcagcctcccaggtacc

SEQ ID NO: 1346151 - DNA, 22 bp, Artificial Sequence
  chemically synthesized
tcctgcttcagcctcccaggta

SEQ ID NO: 1346152 - DNA, 22 bp, Artificial Sequence
  chemically synthesized
tagtcccaggtacctgggaggc

SEQ ID NO: 1346153 - DNA, 22 bp, Artificial Sequence
  chemically synthesized
gcgattctcctgcttcagcctc

SEQ ID NO: 1346154 - DNA, 22 bp, Artificial Sequence
  chemically synthesized
tagcgattctcctgcttcagcc

SEQ ID NO: 1346155 - DNA, 22 bp, Artificial Sequence
  chemically synthesized
ggttctagcgattctcctgctt

SEQ ID NO: 1346156 - DNA, 22 bp, Artificial Sequence
  chemically synthesized
ctgggttctagcgattctcctg

SEQ ID NO: 1346157 - DNA, 22 bp, Artificial Sequence
  chemically synthesized
ggaggctgaagcaggagaatcg

SEQ ID NO: 1346158 - DNA, 22 bp, Artificial Sequence
  chemically synthesized
cgcctcctgggttctagcgatt

SEQ ID NO: 1346159 - DNA, 22 bp, Artificial Sequence
  chemically synthesized
aagcaggagaatcgctagaacc

SEQ ID NO: 1346160 - DNA, 22 bp, Artificial Sequence
  chemically synthesized
caacctccgcctcctgggttct

SEQ ID NO: 1346161 - DNA, 22 bp, Artificial Sequence
  chemically synthesized
actgcaacctccgcctcctggg

SEQ ID NO: 1346162 - DNA, 22 bp, Artificial Sequence
  chemically synthesized
gctcactgcaacctccgcctcc

SEQ ID NO: 1346163 - DNA, 22 bp, Artificial Sequence
  chemically synthesized
ggctcactgcaacctccgcctc

SEQ ID NO: 1346164 - DNA, 22 bp, Artificial Sequence
  chemically synthesized
gaacccaggaggcggaggttgc

SEQ ID NO: 1346165 - DNA, 22 bp, Artificial Sequence
  chemically synthesized
gagtgccgtggcacgatcttgg

SEQ ID NO: 1346166 - DNA, 22 bp, Artificial Sequence
  chemically synthesized
cagtgagccaagatcgtgccac

SEQ ID NO: 1346167 - DNA, 22 bp, Artificial Sequence
  chemically synthesized
cccaggctggagtgccgtggca

SEQ ID NO: 1346168 - DNA, 22 bp, Artificial Sequence
  chemically synthesized
ttgcccaggctggagtgccgtg

SEQ ID NO: 1346169 - DNA, 22 bp, Artificial Sequence
  chemically synthesized
tgttgcccaggctggagtgccg

SEQ ID NO: 1346170 - DNA, 22 bp, Artificial Sequence
  chemically synthesized
actctgttgcccaggctggagt

SEQ ID NO: 1346171 - DNA, 22 bp, Artificial Sequence
  chemically synthesized
agatggagtctcactctgttgc

SEQ ID NO: 1346172 - DNA, 22 bp, Artificial Sequence
  chemically synthesized
gagatggagtctcactctgttg

SEQ ID NO: 1346173 - DNA, 22 bp, Artificial Sequence
  chemically synthesized
tgagatggagtctcactctgtt

SEQ ID NO: 1346174 - DNA, 22 bp, Artificial Sequence
  chemically synthesized
ttgagatggagtctcactctgt

SEQ ID NO: 1346175 - DNA, 22 bp, Artificial Sequence
  chemically synthesized
cagcctgggcaacagagtgaga

SEQ ID NO: 1346176 - DNA, 22 bp, Artificial Sequence
  chemically synthesized
ggcaacagagtgagactccatc

SEQ ID NO: 1346177 - DNA, 22 bp, Artificial Sequence
  chemically synthesized
catctcaaaaatatatatgtgt

SEQ ID NO: 1346178 - DNA, 22 bp, Artificial Sequence
  chemically synthesized
aaaaatatatatgtgtgtatat

SEQ ID NO: 1346179 - DNA, 22 bp, Artificial Sequence
  chemically synthesized
tatctatatatatctatatcta

SEQ ID NO: 1346180 - DNA, 22 bp, Artificial Sequence
  chemically synthesized
tatatatctatatctatctcta

SEQ ID NO: 1346181 - DNA, 22 bp, Artificial Sequence
  chemically synthesized
tatctatctctatctatctatc

SEQ ID NO: 1346182 - DNA, 22 bp, Artificial Sequence
  chemically synthesized
tctctatctatctatctatcta

SEQ ID NO: 1346183 - DNA, 22 bp, Artificial Sequence
  chemically synthesized
tatctatctatctatctatcta

SEQ ID NO: 1346184 - DNA, 22 bp, Artificial Sequence
  chemically synthesized
tctatctatctatctatctatc

SEQ ID NO: 1346185 - DNA, 22 bp, Artificial Sequence
  chemically synthesized
tctatctatctatctatctatc

SEQ ID NO: 1346186 - DNA, 22 bp, Artificial Sequence
  chemically synthesized
tatagatagatagatagataga

SEQ ID NO: 1346187 - DNA, 22 bp, Artificial Sequence
  chemically synthesized
atatagatagatagatagatag

SEQ ID NO: 1346188 - DNA, 22 bp, Artificial Sequence
  chemically synthesized
tatatagatagatagatagata

SEQ ID NO: 1346189 - DNA, 22 bp, Artificial Sequence
  chemically synthesized
tctatctatctatctatctatc

SEQ ID NO: 1346190 - DNA, 22 bp, Artificial Sequence
  chemically synthesized
tctatctatctatctatctatc

SEQ ID NO: 1346191 - DNA, 22 bp, Artificial Sequence
  chemically synthesized
aaactttatatagatagataga

SEQ ID NO: 1346192 - DNA, 22 bp, Artificial Sequence
  chemically synthesized
ctaaaactttatatagatagat

SEQ ID NO: 1346193 - DNA, 22 bp, Artificial Sequence
  chemically synthesized
tctatctatctatctatctata

SEQ ID NO: 1346194 - DNA, 22 bp, Artificial Sequence
  chemically synthesized
tcctaaaactttatatagatag

SEQ ID NO: 1346195 - DNA, 22 bp, Artificial Sequence
  chemically synthesized
ctcctaaaactttatatagata

SEQ ID NO: 1346196 - DNA, 22 bp, Artificial Sequence
  chemically synthesized
tctatctatctatctatataaa

SEQ ID NO: 1346197 - DNA, 22 bp, Artificial Sequence
  chemically synthesized
tctatctatctatataaagttt

SEQ ID NO: 1346198 - DNA, 22 bp, Artificial Sequence
  chemically synthesized
agcagatttctcctaaaacttt

SEQ ID NO: 1346199 - DNA, 22 bp, Artificial Sequence
  chemically synthesized
tctatctatataaagttttagg

SEQ ID NO: 1346200 - DNA, 22 bp, Artificial Sequence
  chemically synthesized
tgagcagatttctcctaaaact

SEQ ID NO: 1346201 - DNA, 22 bp, Artificial Sequence
  chemically synthesized
tctatataaagttttaggagaa

SEQ ID NO: 1346202 - DNA, 22 bp, Artificial Sequence
  chemically synthesized
tataaagttttaggagaaatct

SEQ ID NO: 1346203 - DNA, 22 bp, Artificial Sequence
  chemically synthesized
taggagaaatctgctcagaatt

SEQ ID NO: 1346204 - DNA, 22 bp, Artificial Sequence
  chemically synthesized
aggagaaatctgctcagaattg

SEQ ID NO: 1346205 - DNA, 22 bp, Artificial Sequence
  chemically synthesized
ggagaaatctgctcagaattgc

SEQ ID NO: 1346206 - DNA, 22 bp, Artificial Sequence
  chemically synthesized
tgagtaagagaggaatgcaatt

SEQ ID NO: 1346207 - DNA, 22 bp, Artificial Sequence
  chemically synthesized
tcactatgagtaagagaggaat

SEQ ID NO: 1346208 - DNA, 22 bp, Artificial Sequence
  chemically synthesized
ctcagaattgcattcctctctt

SEQ ID NO: 1346209 - DNA, 22 bp, Artificial Sequence
  chemically synthesized
atcactatgagtaagagaggaa

SEQ ID NO: 1346210 - DNA, 22 bp, Artificial Sequence
  chemically synthesized
agaattgcattcctctcttact

SEQ ID NO: 1346211 - DNA, 22 bp, Artificial Sequence
  chemically synthesized
cattcctctcttactcatagtg

SEQ ID NO: 1346212 - DNA, 22 bp, Artificial Sequence
  chemically synthesized
cgaggtccccttatcactatga

SEQ ID NO: 1346213 - DNA, 22 bp, Artificial Sequence
  chemically synthesized
ctctcttactcatagtgataag

SEQ ID NO: 1346214 - DNA, 22 bp, Artificial Sequence
  chemically synthesized
gctacgaggtccccttatcact

SEQ ID NO: 1346215 - DNA, 22 bp, Artificial Sequence
  chemically synthesized
agctacgaggtccccttatcac

SEQ ID NO: 1346216 - DNA, 22 bp, Artificial Sequence
  chemically synthesized
tcttactcatagtgataagggg

SEQ ID NO: 1346217 - DNA, 22 bp, Artificial Sequence
  chemically synthesized
tagctacgaggtccccttatca

SEQ ID NO: 1346218 - DNA, 22 bp, Artificial Sequence
  chemically synthesized
ttagctacgaggtccccttatc

SEQ ID NO: 1346219 - DNA, 22 bp, Artificial Sequence
  chemically synthesized
ttactcatagtgataaggggac

SEQ ID NO: 1346220 - DNA, 22 bp, Artificial Sequence
  chemically synthesized
tttagctacgaggtccccttat

SEQ ID NO: 1346221 - DNA, 22 bp, Artificial Sequence
  chemically synthesized
actcatagtgataaggggacct

SEQ ID NO: 1346222 - DNA, 22 bp, Artificial Sequence
  chemically synthesized
ctcatagtgataaggggacctc

SEQ ID NO: 1346223 - DNA, 22 bp, Artificial Sequence
  chemically synthesized
atagtgataaggggacctcgta

SEQ ID NO: 1346224 - DNA, 22 bp, Artificial Sequence
  chemically synthesized
caagactttttagctacgaggt

SEQ ID NO: 1346225 - DNA, 22 bp, Artificial Sequence
  chemically synthesized
tacaagactttttagctacgag

SEQ ID NO: 1346226 - DNA, 22 bp, Artificial Sequence
  chemically synthesized
ctctacaagactttttagctac

SEQ ID NO: 1346227 - DNA, 22 bp, Artificial Sequence
  chemically synthesized
acctcctctacaagacttttta

SEQ ID NO: 1346228 - DNA, 22 bp, Artificial Sequence
  chemically synthesized
aacctcctctacaagacttttt

SEQ ID NO: 1346229 - DNA, 22 bp, Artificial Sequence
  chemically synthesized
taacctcctctacaagactttt

SEQ ID NO: 1346230 - DNA, 22 bp, Artificial Sequence
  chemically synthesized
ttaacctcctctacaagacttt

SEQ ID NO: 1346231 - DNA, 22 bp, Artificial Sequence
  chemically synthesized
gtagctaaaaagtcttgtagag

SEQ ID NO: 1346232 - DNA, 22 bp, Artificial Sequence
  chemically synthesized
aagaacttttaacctcctctac

SEQ ID NO: 1346233 - DNA, 22 bp, Artificial Sequence
  chemically synthesized
gaagaacttttaacctcctcta

SEQ ID NO: 1346234 - DNA, 22 bp, Artificial Sequence
  chemically synthesized
tgaagaacttttaacctcctct

SEQ ID NO: 1346235 - DNA, 22 bp, Artificial Sequence
  chemically synthesized
aaaagtcttgtagaggaggtta

SEQ ID NO: 1346236 - DNA, 22 bp, Artificial Sequence
  chemically synthesized
ctttgaagaacttttaacctcc

SEQ ID NO: 1346237 - DNA, 22 bp, Artificial Sequence
  chemically synthesized
actttgaagaacttttaacctc

SEQ ID NO: 1346238 - DNA, 22 bp, Artificial Sequence
  chemically synthesized
tactttgaagaacttttaacct

SEQ ID NO: 1346239 - DNA, 22 bp, Artificial Sequence
  chemically synthesized
ttactttgaagaacttttaacc

SEQ ID NO: 1346240 - DNA, 22 bp, Artificial Sequence
  chemically synthesized
gtagaggaggttaaaagttctt

SEQ ID NO: 1346241 - DNA, 22 bp, Artificial Sequence
  chemically synthesized
tagaggaggttaaaagttcttc

SEQ ID NO: 1346242 - DNA, 22 bp, Artificial Sequence
  chemically synthesized
agaatgtttttactttgaagaa

SEQ ID NO: 1346243 - DNA, 22 bp, Artificial Sequence
  chemically synthesized
gagttgagaatgtttttacttt

SEQ ID NO: 1346244 - DNA, 22 bp, Artificial Sequence
  chemically synthesized
aaagttcttcaaagtaaaaaca

SEQ ID NO: 1346245 - DNA, 22 bp, Artificial Sequence
  chemically synthesized
tggagttgagaatgtttttact

SEQ ID NO: 1346246 - DNA, 22 bp, Artificial Sequence
  chemically synthesized
ctggagttgagaatgtttttac

SEQ ID NO: 1346247 - DNA, 22 bp, Artificial Sequence
  chemically synthesized
tctggagttgagaatgttttta

SEQ ID NO: 1346248 - DNA, 22 bp, Artificial Sequence
  chemically synthesized
ttttctggagttgagaatgttt

SEQ ID NO: 1346249 - DNA, 22 bp, Artificial Sequence
  chemically synthesized
ttcaaagtaaaaacattctcaa

SEQ ID NO: 1346250 - DNA, 22 bp, Artificial Sequence
  chemically synthesized
caaagtaaaaacattctcaact

SEQ ID NO: 1346251 - DNA, 22 bp, Artificial Sequence
  chemically synthesized
aaagtaaaaacattctcaactc

SEQ ID NO: 1346252 - DNA, 22 bp, Artificial Sequence
  chemically synthesized
catgttgttttctggagttgag

SEQ ID NO: 1346253 - DNA, 22 bp, Artificial Sequence
  chemically synthesized
acatgttgttttctggagttga

SEQ ID NO: 1346254 - DNA, 22 bp, Artificial Sequence
  chemically synthesized
acttacatgttgttttctggag

SEQ ID NO: 1346255 - DNA, 22 bp, Artificial Sequence
  chemically synthesized
tcaactccagaaaacaacatgt

SEQ ID NO: 1346256 - DNA, 22 bp, Artificial Sequence
  chemically synthesized
aactccagaaaacaacatgtaa

SEQ ID NO: 1346257 - DNA, 22 bp, Artificial Sequence
  chemically synthesized
cagaaaacaacatgtaagtcaa

SEQ ID NO: 1346258 - DNA, 22 bp, Artificial Sequence
  chemically synthesized
gaaaacatgagtgggttgactt

SEQ ID NO: 1346259 - DNA, 22 bp, Artificial Sequence
  chemically synthesized
agaaaacatgagtgggttgact

SEQ ID NO: 1346260 - DNA, 22 bp, Artificial Sequence
  chemically synthesized
gcttagaaaacatgagtgggtt

SEQ ID NO: 1346261 - DNA, 22 bp, Artificial Sequence
  chemically synthesized
agatattggcttagaaaacatg

SEQ ID NO: 1346262 - DNA, 22 bp, Artificial Sequence
  chemically synthesized
taagatattggcttagaaaaca

SEQ ID NO: 1346263 - DNA, 22 bp, Artificial Sequence
  chemically synthesized
ctaagatattggcttagaaaac

SEQ ID NO: 1346264 - DNA, 22 bp, Artificial Sequence
  chemically synthesized
tctaagatattggcttagaaaa

SEQ ID NO: 1346265 - DNA, 22 bp, Artificial Sequence
  chemically synthesized
atgttttctaagccaatatctt

SEQ ID NO: 1346266 - DNA, 22 bp, Artificial Sequence
  chemically synthesized
tctaagccaatatcttagaaag

SEQ ID NO: 1346267 - DNA, 22 bp, Artificial Sequence
  chemically synthesized
ctaagccaatatcttagaaagt

SEQ ID NO: 1346268 - DNA, 22 bp, Artificial Sequence
  chemically synthesized
taagccaatatcttagaaagtt

SEQ ID NO: 1346269 - DNA, 22 bp, Artificial Sequence
  chemically synthesized
agccaatatcttagaaagttgt

SEQ ID NO: 1346270 - DNA, 22 bp, Artificial Sequence
  chemically synthesized
atgaggagtcgacaacaacttt

SEQ ID NO: 1346271 - DNA, 22 bp, Artificial Sequence
  chemically synthesized
agaaagttgttgtcgactcctc

SEQ ID NO: 1346272 - DNA, 22 bp, Artificial Sequence
  chemically synthesized
gaaagttgttgtcgactcctca

SEQ ID NO: 1346273 - DNA, 22 bp, Artificial Sequence
  chemically synthesized
tgggtagcagaggctcatgagg

SEQ ID NO: 1346274 - DNA, 22 bp, Artificial Sequence
  chemically synthesized
ttgtcgactcctcatgagcctc

SEQ ID NO: 1346275 - DNA, 22 bp, Artificial Sequence
  chemically synthesized
gctgtgggtagcagaggctcat

SEQ ID NO: 1346276 - DNA, 22 bp, Artificial Sequence
  chemically synthesized
tcgactcctcatgagcctctgc

SEQ ID NO: 1346277 - DNA, 22 bp, Artificial Sequence
  chemically synthesized
ctcatgagcctctgctacccac

SEQ ID NO: 1346278 - DNA, 22 bp, Artificial Sequence
  chemically synthesized
gcaacagattggctgtgggtag

SEQ ID NO: 1346279 - DNA, 22 bp, Artificial Sequence
  chemically synthesized
atgagcctctgctacccacagc

SEQ ID NO: 1346280 - DNA, 22 bp, Artificial Sequence
  chemically synthesized
agcaacagattggctgtgggta

SEQ ID NO: 1346281 - DNA, 22 bp, Artificial Sequence
  chemically synthesized
tgctacccacagccaatctgtt

SEQ ID NO: 1346282 - DNA, 22 bp, Artificial Sequence
  chemically synthesized
acaacatttagcaacagattgg

SEQ ID NO: 1346283 - DNA, 22 bp, Artificial Sequence
  chemically synthesized
ctacccacagccaatctgttgc

SEQ ID NO: 1346284 - DNA, 22 bp, Artificial Sequence
  chemically synthesized
cccacagccaatctgttgctaa

SEQ ID NO: 1346285 - DNA, 22 bp, Artificial Sequence
  chemically synthesized
ttgctaaatgttgtgaattctt

SEQ ID NO: 1346286 - DNA, 22 bp, Artificial Sequence
  chemically synthesized
ctaaatgttgtgaattcttttt

SEQ ID NO: 1346287 - DNA, 22 bp, Artificial Sequence
  chemically synthesized
aatgttgtgaattcttttttat

SEQ ID NO: 1346288 - DNA, 22 bp, Artificial Sequence
  chemically synthesized
agacatacaatacaataaaaaa

SEQ ID NO: 1346289 - DNA, 22 bp, Artificial Sequence
  chemically synthesized
ttaagacatacaatacaataaa

SEQ ID NO: 1346290 - DNA, 22 bp, Artificial Sequence
  chemically synthesized
tgaattcttttttattgtattg

SEQ ID NO: 1346291 - DNA, 22 bp, Artificial Sequence
  chemically synthesized
ttttttattgtattgtatgtct

SEQ ID NO: 1346292 - DNA, 22 bp, Artificial Sequence
  chemically synthesized
ttttattgtattgtatgtctta

SEQ ID NO: 1346293 - DNA, 22 bp, Artificial Sequence
  chemically synthesized
tttattgtattgtatgtcttaa

SEQ ID NO: 1346294 - DNA, 22 bp, Artificial Sequence
  chemically synthesized
ttattgtattgtatgtcttaat

SEQ ID NO: 1346295 - DNA, 22 bp, Artificial Sequence
  chemically synthesized
tattgtattgtatgtcttaata

SEQ ID NO: 1346296 - DNA, 22 bp, Artificial Sequence
  chemically synthesized
attgtattgtatgtcttaataa

SEQ ID NO: 1346297 - DNA, 22 bp, Artificial Sequence
  chemically synthesized
ttgtattgtatgtcttaataac

SEQ ID NO: 1346298 - DNA, 22 bp, Artificial Sequence
  chemically synthesized
tattgtatgtcttaataacttt

SEQ ID NO: 1346299 - DNA, 22 bp, Artificial Sequence
  chemically synthesized
gcaagtgaagaaaaaagttatt

SEQ ID NO: 1346300 - DNA, 22 bp, Artificial Sequence
  chemically synthesized
ggcaagtgaagaaaaaagttat

SEQ ID NO: 1346301 - DNA, 22 bp, Artificial Sequence
  chemically synthesized
tggcaagtgaagaaaaaagtta

SEQ ID NO: 1346302 - DNA, 22 bp, Artificial Sequence
  chemically synthesized
tatgtcttaataacttttttct

SEQ ID NO: 1346303 - DNA, 22 bp, Artificial Sequence
  chemically synthesized
ttttggcaagtgaagaaaaaag

SEQ ID NO: 1346304 - DNA, 22 bp, Artificial Sequence
  chemically synthesized
attttggcaagtgaagaaaaaa

SEQ ID NO: 1346305 - DNA, 22 bp, Artificial Sequence
  chemically synthesized
tattttggcaagtgaagaaaaa

SEQ ID NO: 1346306 - DNA, 22 bp, Artificial Sequence
  chemically synthesized
aataacttttttcttcacttgc

SEQ ID NO: 1346307 - DNA, 22 bp, Artificial Sequence
  chemically synthesized
ataacttttttcttcacttgcc

SEQ ID NO: 1346308 - DNA, 22 bp, Artificial Sequence
  chemically synthesized
ttttcttcacttgccaaaataa

SEQ ID NO: 1346309 - DNA, 22 bp, Artificial Sequence
  chemically synthesized
tttcttcacttgccaaaataaa

SEQ ID NO: 1346310 - DNA, 22 bp, Artificial Sequence
  chemically synthesized
ttcttcacttgccaaaataaaa

SEQ ID NO: 1346311 - DNA, 22 bp, Artificial Sequence
  chemically synthesized
tcttcacttgccaaaataaaat

SEQ ID NO: 1346312 - DNA, 22 bp, Artificial Sequence
  chemically synthesized
cttcacttgccaaaataaaatc

SEQ ID NO: 1346313 - DNA, 22 bp, Artificial Sequence
  chemically synthesized
ttcacttgccaaaataaaatcc

SEQ ID NO: 1346314 - DNA, 22 bp, Artificial Sequence
  chemically synthesized
cacttgccaaaataaaatccat

SEQ ID NO: 1346315 - DNA, 22 bp, Artificial Sequence
  chemically synthesized
acttgccaaaataaaatccata

SEQ ID NO: 1346316 - DNA, 22 bp, Artificial Sequence
  chemically synthesized
gccaaaataaaatccatatgct

SEQ ID NO: 1346317 - DNA, 22 bp, Artificial Sequence
  chemically synthesized
ccaaaataaaatccatatgctc

SEQ ID NO: 1346318 - DNA, 22 bp, Artificial Sequence
  chemically synthesized
gagaaccatgcagtagggtggg

SEQ ID NO: 1346319 - DNA, 22 bp, Artificial Sequence
  chemically synthesized
ctggagaaccatgcagtagggt

SEQ ID NO: 1346320 - DNA, 22 bp, Artificial Sequence
  chemically synthesized
actggagaaccatgcagtaggg

SEQ ID NO: 1346321 - DNA, 22 bp, Artificial Sequence
  chemically synthesized
tactggagaaccatgcagtagg

SEQ ID NO: 1346322 - DNA, 22 bp, Artificial Sequence
  chemically synthesized
cccccaccctactgcatggttc

SEQ ID NO: 1346323 - DNA, 22 bp, Artificial Sequence
  chemically synthesized
tagtctttactggagaaccatg

SEQ ID NO: 1346324 - DNA, 22 bp, Artificial Sequence
  chemically synthesized
ctgcatggttctccagtaaaga

SEQ ID NO: 1346325 - DNA, 22 bp, Artificial Sequence
  chemically synthesized
catggttctccagtaaagacta

SEQ ID NO: 1346326 - DNA, 22 bp, Artificial Sequence
  chemically synthesized
tccagtaaagactatagatatt

SEQ ID NO: 1346327 - DNA, 22 bp, Artificial Sequence
  chemically synthesized
cagtaaagactatagatatttt

SEQ ID NO: 1346328 - DNA, 22 bp, Artificial Sequence
  chemically synthesized
atatatataaataagcagaaaa

SEQ ID NO: 1346329 - DNA, 22 bp, Artificial Sequence
  chemically synthesized
aatatatataaataagcagaaa

SEQ ID NO: 1346330 - DNA, 22 bp, Artificial Sequence
  chemically synthesized
tagatattttttctgcttattt

SEQ ID NO: 1346331 - DNA, 22 bp, Artificial Sequence
  chemically synthesized
tttaatatatataaataagcag

SEQ ID NO: 1346332 - DNA, 22 bp, Artificial Sequence
  chemically synthesized
aaaatctatttaatatatataa

SEQ ID NO: 1346333 - DNA, 22 bp, Artificial Sequence
  chemically synthesized
tttctgcttatttatatatatt

SEQ ID NO: 1346334 - DNA, 22 bp, Artificial Sequence
  chemically synthesized
ttctgcttatttatatatatta

SEQ ID NO: 1346335 - DNA, 22 bp, Artificial Sequence
  chemically synthesized
tctgcttatttatatatattaa

SEQ ID NO: 1346336 - DNA, 22 bp, Artificial Sequence
  chemically synthesized
ctgcttatttatatatattaaa

SEQ ID NO: 1346337 - DNA, 22 bp, Artificial Sequence
  chemically synthesized
cctaaaaatctatttaatatat

SEQ ID NO: 1346338 - DNA, 22 bp, Artificial Sequence
  chemically synthesized
tgcttatttatatatattaaat

SEQ ID NO: 1346339 - DNA, 22 bp, Artificial Sequence
  chemically synthesized
cttatttatatatattaaatag

SEQ ID NO: 1346340 - DNA, 22 bp, Artificial Sequence
  chemically synthesized
ctgcctaaaaatctatttaata

SEQ ID NO: 1346341 - DNA, 22 bp, Artificial Sequence
  chemically synthesized
atttatatatattaaatagatt

SEQ ID NO: 1346342 - DNA, 22 bp, Artificial Sequence
  chemically synthesized
tttatatatattaaatagattt

SEQ ID NO: 1346343 - DNA, 22 bp, Artificial Sequence
  chemically synthesized
aaattactgcctaaaaatctat

SEQ ID NO: 1346344 - DNA, 22 bp, Artificial Sequence
  chemically synthesized
atatatattaaatagattttta

SEQ ID NO: 1346345 - DNA, 22 bp, Artificial Sequence
  chemically synthesized
caaattactgcctaaaaatcta

SEQ ID NO: 1346346 - DNA, 22 bp, Artificial Sequence
  chemically synthesized
tatatattaaatagatttttag

SEQ ID NO: 1346347 - DNA, 22 bp, Artificial Sequence
  chemically synthesized
tcaaattactgcctaaaaatct

SEQ ID NO: 1346348 - DNA, 22 bp, Artificial Sequence
  chemically synthesized
aatagatttttaggcagtaatt

SEQ ID NO: 1346349 - DNA, 22 bp, Artificial Sequence
  chemically synthesized
ttaggcagtaatttgaaaatca

SEQ ID NO: 1346350 - DNA, 22 bp, Artificial Sequence
  chemically synthesized
aaagagacaaagtgattttcaa

SEQ ID NO: 1346351 - DNA, 22 bp, Artificial Sequence
  chemically synthesized
taggcagtaatttgaaaatcac

SEQ ID NO: 1346352 - DNA, 22 bp, Artificial Sequence
  chemically synthesized
caaagagacaaagtgattttca

SEQ ID NO: 1346353 - DNA, 22 bp, Artificial Sequence
  chemically synthesized
aggcagtaatttgaaaatcact

SEQ ID NO: 1346354 - DNA, 22 bp, Artificial Sequence
  chemically synthesized
ggcagtaatttgaaaatcactt

SEQ ID NO: 1346355 - DNA, 22 bp, Artificial Sequence
  chemically synthesized
caacttcaaagagacaaagtga

SEQ ID NO: 1346356 - DNA, 22 bp, Artificial Sequence
  chemically synthesized
gcaacttcaaagagacaaagtg

SEQ ID NO: 1346357 - DNA, 22 bp, Artificial Sequence
  chemically synthesized
gaaaatcactttgtctctttga

SEQ ID NO: 1346358 - DNA, 22 bp, Artificial Sequence
  chemically synthesized
aaaatcactttgtctctttgaa

SEQ ID NO: 1346359 - DNA, 22 bp, Artificial Sequence
  chemically synthesized
taacaatttgcaacttcaaaga

SEQ ID NO: 1346360 - DNA, 22 bp, Artificial Sequence
  chemically synthesized
gtctataacaatttgcaacttc

SEQ ID NO: 1346361 - DNA, 22 bp, Artificial Sequence
  chemically synthesized
ggtctataacaatttgcaactt

SEQ ID NO: 1346362 - DNA, 22 bp, Artificial Sequence
  chemically synthesized
tgtctctttgaagttgcaaatt

SEQ ID NO: 1346363 - DNA, 22 bp, Artificial Sequence
  chemically synthesized
gtctctttgaagttgcaaattg

SEQ ID NO: 1346364 - DNA, 22 bp, Artificial Sequence
  chemically synthesized
tctctttgaagttgcaaattgt

SEQ ID NO: 1346365 - DNA, 22 bp, Artificial Sequence
  chemically synthesized
tttgaagttgcaaattgttata

SEQ ID NO: 1346366 - DNA, 22 bp, Artificial Sequence
  chemically synthesized
tgaagttgcaaattgttataga

SEQ ID NO: 1346367 - DNA, 22 bp, Artificial Sequence
  chemically synthesized
gaagttgcaaattgttatagac

SEQ ID NO: 1346368 - DNA, 22 bp, Artificial Sequence
  chemically synthesized
aagttgcaaattgttatagacc

SEQ ID NO: 1346369 - DNA, 22 bp, Artificial Sequence
  chemically synthesized
caaattgttatagaccaaggct

SEQ ID NO: 1346370 - DNA, 22 bp, Artificial Sequence
  chemically synthesized
tgggcatgaaccagccttggtc

SEQ ID NO: 1346371 - DNA, 22 bp, Artificial Sequence
  chemically synthesized
atgggcatgaaccagccttggt

SEQ ID NO: 1346372 - DNA, 22 bp, Artificial Sequence
  chemically synthesized
tatgggcatgaaccagccttgg

SEQ ID NO: 1346373 - DNA, 22 bp, Artificial Sequence
  chemically synthesized
ttatagaccaaggctggttcat

SEQ ID NO: 1346374 - DNA, 22 bp, Artificial Sequence
  chemically synthesized
tagaccaaggctggttcatgcc

SEQ ID NO: 1346375 - DNA, 22 bp, Artificial Sequence
  chemically synthesized
aacaacctttatgggcatgaac

SEQ ID NO: 1346376 - DNA, 22 bp, Artificial Sequence
  chemically synthesized
attaaacaacctttatgggcat

SEQ ID NO: 1346377 - DNA, 22 bp, Artificial Sequence
  chemically synthesized
gattaattaaacaacctttatg

SEQ ID NO: 1346378 - DNA, 22 bp, Artificial Sequence
  chemically synthesized
gttcatgcccataaaggttgtt

SEQ ID NO: 1346379 - DNA, 22 bp, Artificial Sequence
  chemically synthesized
atgcccataaaggttgtttaat

SEQ ID NO: 1346380 - DNA, 22 bp, Artificial Sequence
  chemically synthesized
tcatatcaaattcgattaatta

SEQ ID NO: 1346381 - DNA, 22 bp, Artificial Sequence
  chemically synthesized
tgtcatatcaaattcgattaat

SEQ ID NO: 1346382 - DNA, 22 bp, Artificial Sequence
  chemically synthesized
tttaattaatcgaatttgatat

SEQ ID NO: 1346383 - DNA, 22 bp, Artificial Sequence
  chemically synthesized
aattaatcgaatttgatatgac

SEQ ID NO: 1346384 - DNA, 22 bp, Artificial Sequence
  chemically synthesized
attaatcgaatttgatatgaca

SEQ ID NO: 1346385 - DNA, 22 bp, Artificial Sequence
  chemically synthesized
tgtgtaatactctgtcatatca

SEQ ID NO: 1346386 - DNA, 22 bp, Artificial Sequence
  chemically synthesized
gtgtgtaatactctgtcatatc

SEQ ID NO: 1346387 - DNA, 22 bp, Artificial Sequence
  chemically synthesized
tgtgtgtaatactctgtcatat

SEQ ID NO: 1346388 - DNA, 22 bp, Artificial Sequence
  chemically synthesized
atcgaatttgatatgacagagt

SEQ ID NO: 1346389 - DNA, 22 bp, Artificial Sequence
  chemically synthesized
ttttgtgtgtaatactctgtca

SEQ ID NO: 1346390 - DNA, 22 bp, Artificial Sequence
  chemically synthesized
gatatgacagagtattacacac

SEQ ID NO: 1346391 - DNA, 22 bp, Artificial Sequence
  chemically synthesized
atatgacagagtattacacaca

SEQ ID NO: 1346392 - DNA, 22 bp, Artificial Sequence
  chemically synthesized
cgtccactattttgtgtgtaat

SEQ ID NO: 1346393 - DNA, 22 bp, Artificial Sequence
  chemically synthesized
tgcatattccgtccactatttt

SEQ ID NO: 1346394 - DNA, 22 bp, Artificial Sequence
  chemically synthesized
gtgcatattccgtccactattt

SEQ ID NO: 1346395 - DNA, 22 bp, Artificial Sequence
  chemically synthesized
tgtgcatattccgtccactatt

SEQ ID NO: 1346396 - DNA, 22 bp, Artificial Sequence
  chemically synthesized
ttttgtgcatattccgtccact

SEQ ID NO: 1346397 - DNA, 22 bp, Artificial Sequence
  chemically synthesized
gttttgtgcatattccgtccac

SEQ ID NO: 1346398 - DNA, 22 bp, Artificial Sequence
  chemically synthesized
cacacaaaatagtggacggaat

SEQ ID NO: 1346399 - DNA, 22 bp, Artificial Sequence
  chemically synthesized
tgaaaaacttgttttgtgcata

SEQ ID NO: 1346400 - DNA, 22 bp, Artificial Sequence
  chemically synthesized
gtgaaaaacttgttttgtgcat

SEQ ID NO: 1346401 - DNA, 22 bp, Artificial Sequence
  chemically synthesized
tgtgaaaaacttgttttgtgca

SEQ ID NO: 1346402 - DNA, 22 bp, Artificial Sequence
  chemically synthesized
ttgtgaaaaacttgttttgtgc

SEQ ID NO: 1346403 - DNA, 22 bp, Artificial Sequence
  chemically synthesized
cttttgtgaaaaacttgttttg

SEQ ID NO: 1346404 - DNA, 22 bp, Artificial Sequence
  chemically synthesized
ccttttgtgaaaaacttgtttt

SEQ ID NO: 1346405 - DNA, 22 bp, Artificial Sequence
  chemically synthesized
acttccttttgtgaaaaacttg

SEQ ID NO: 1346406 - DNA, 22 bp, Artificial Sequence
  chemically synthesized
cacttccttttgtgaaaaactt

SEQ ID NO: 1346407 - DNA, 22 bp, Artificial Sequence
  chemically synthesized
tcacttccttttgtgaaaaact

SEQ ID NO: 1346408 - DNA, 22 bp, Artificial Sequence
  chemically synthesized
ttcacttccttttgtgaaaaac

SEQ ID NO: 1346409 - DNA, 22 bp, Artificial Sequence
  chemically synthesized
gcacaagcttttcacttccttt

SEQ ID NO: 1346410 - DNA, 22 bp, Artificial Sequence
  chemically synthesized
ggcacaagcttttcacttcctt

SEQ ID NO: 1346411 - DNA, 22 bp, Artificial Sequence
  chemically synthesized
ttcacaaaaggaagtgaaaagc

SEQ ID NO: 1346412 - DNA, 22 bp, Artificial Sequence
  chemically synthesized
tcacaaaaggaagtgaaaagct

SEQ ID NO: 1346413 - DNA, 22 bp, Artificial Sequence
  chemically synthesized
cacaaaaggaagtgaaaagctt

SEQ ID NO: 1346414 - DNA, 22 bp, Artificial Sequence
  chemically synthesized
acaaaaggaagtgaaaagcttg

SEQ ID NO: 1346415 - DNA, 22 bp, Artificial Sequence
  chemically synthesized
cacagatgaatttggcacaagc

SEQ ID NO: 1346416 - DNA, 22 bp, Artificial Sequence
  chemically synthesized
gtgttacacagatgaatttggc

SEQ ID NO: 1346417 - DNA, 22 bp, Artificial Sequence
  chemically synthesized
tagtgttacacagatgaatttg

SEQ ID NO: 1346418 - DNA, 22 bp, Artificial Sequence
  chemically synthesized
ctagtgttacacagatgaattt

SEQ ID NO: 1346419 - DNA, 22 bp, Artificial Sequence
  chemically synthesized
tttctagtgttacacagatgaa

SEQ ID NO: 1346420 - DNA, 22 bp, Artificial Sequence
  chemically synthesized
atttctagtgttacacagatga

SEQ ID NO: 1346421 - DNA, 22 bp, Artificial Sequence
  chemically synthesized
gtgccaaattcatctgtgtaac

SEQ ID NO: 1346422 - DNA, 22 bp, Artificial Sequence
  chemically synthesized
tgccaaattcatctgtgtaaca

SEQ ID NO: 1346423 - DNA, 22 bp, Artificial Sequence
  chemically synthesized
aaatatttatttctagtgttac

SEQ ID NO: 1346424 - DNA, 22 bp, Artificial Sequence
  chemically synthesized
aaaatatttatttctagtgtta

SEQ ID NO: 1346425 - DNA, 22 bp, Artificial Sequence
  chemically synthesized
taaaatatttatttctagtgtt

SEQ ID NO: 1346426 - DNA, 22 bp, Artificial Sequence
  chemically synthesized
ttaaaatatttatttctagtgt

SEQ ID NO: 1346427 - DNA, 22 bp, Artificial Sequence
  chemically synthesized
atctgtgtaacactagaaataa

SEQ ID NO: 1346428 - DNA, 22 bp, Artificial Sequence
  chemically synthesized
tgtaacactagaaataaatatt

SEQ ID NO: 1346429 - DNA, 22 bp, Artificial Sequence
  chemically synthesized
agcaataaatatatttttaaaa

SEQ ID NO: 1346430 - DNA, 22 bp, Artificial Sequence
  chemically synthesized
gaaataaatattttaaaaatat

SEQ ID NO: 1346431 - DNA, 22 bp, Artificial Sequence
  chemically synthesized
aactaagcaataaatatatttt

SEQ ID NO: 1346432 - DNA, 22 bp, Artificial Sequence
  chemically synthesized
aaactaagcaataaatatattt

SEQ ID NO: 1346433 - DNA, 22 bp, Artificial Sequence
  chemically synthesized
taaactaagcaataaatatatt

SEQ ID NO: 1346434 - DNA, 22 bp, Artificial Sequence
  chemically synthesized
ttaaactaagcaataaatatat

SEQ ID NO: 1346435 - DNA, 22 bp, Artificial Sequence
  chemically synthesized
tttaaactaagcaataaatata

SEQ ID NO: 1346436 - DNA, 22 bp, Artificial Sequence
  chemically synthesized
taaaaatatatttattgcttag

SEQ ID NO: 1346437 - DNA, 22 bp, Artificial Sequence
  chemically synthesized
aaaaatatatttattgcttagt

SEQ ID NO: 1346438 - DNA, 22 bp, Artificial Sequence
  chemically synthesized
aaaatatatttattgcttagtt

SEQ ID NO: 1346439 - DNA, 22 bp, Artificial Sequence
  chemically synthesized
agaaatggccagttttttaaac

SEQ ID NO: 1346440 - DNA, 22 bp, Artificial Sequence
  chemically synthesized
attgcttagtttaaaaaactgg

SEQ ID NO: 1346441 - DNA, 22 bp, Artificial Sequence
  chemically synthesized
ttgcttagtttaaaaaactggc

SEQ ID NO: 1346442 - DNA, 22 bp, Artificial Sequence
  chemically synthesized
aagctcagaaatggccagtttt

SEQ ID NO: 1346443 - DNA, 22 bp, Artificial Sequence
  chemically synthesized
aaagctcagaaatggccagttt

SEQ ID NO: 1346444 - DNA, 22 bp, Artificial Sequence
  chemically synthesized
cttagtttaaaaaactggccat

SEQ ID NO: 1346445 - DNA, 22 bp, Artificial Sequence
  chemically synthesized
agtttaaaaaactggccatttc

SEQ ID NO: 1346446 - DNA, 22 bp, Artificial Sequence
  chemically synthesized
gtttaaaaaactggccatttct

SEQ ID NO: 1346447 - DNA, 22 bp, Artificial Sequence
  chemically synthesized
aaaaaactggccatttctgagc

SEQ ID NO: 1346448 - DNA, 22 bp, Artificial Sequence
  chemically synthesized
aaaaactggccatttctgagct

SEQ ID NO: 1346449 - DNA, 22 bp, Artificial Sequence
  chemically synthesized
caatgatagcttaaagctcaga

SEQ ID NO: 1346450 - DNA, 22 bp, Artificial Sequence
  chemically synthesized
ccaatgatagcttaaagctcag

SEQ ID NO: 1346451 - DNA, 22 bp, Artificial Sequence
  chemically synthesized
gccatttctgagctttaagcta

SEQ ID NO: 1346452 - DNA, 22 bp, Artificial Sequence
  chemically synthesized
taaagcttccaatgatagctta

SEQ ID NO: 1346453 - DNA, 22 bp, Artificial Sequence
  chemically synthesized
ctgagctttaagctatcattgg

SEQ ID NO: 1346454 - DNA, 22 bp, Artificial Sequence
  chemically synthesized
tgagctttaagctatcattgga

SEQ ID NO: 1346455 - DNA, 22 bp, Artificial Sequence
  chemically synthesized
aattataaagcttccaatgata

SEQ ID NO: 1346456 - DNA, 22 bp, Artificial Sequence
  chemically synthesized
aaattataaagcttccaatgat

SEQ ID NO: 1346457 - DNA, 22 bp, Artificial Sequence
  chemically synthesized
agctttaagctatcattggaag

SEQ ID NO: 1346458 - DNA, 22 bp, Artificial Sequence
  chemically synthesized
taagctatcattggaagcttta

SEQ ID NO: 1346459 - DNA, 22 bp, Artificial Sequence
  chemically synthesized
aagctatcattggaagctttat

SEQ ID NO: 1346460 - DNA, 22 bp, Artificial Sequence
  chemically synthesized
agctatcattggaagctttata

SEQ ID NO: 1346461 - DNA, 22 bp, Artificial Sequence
  chemically synthesized
tcattggaagctttataattta

SEQ ID NO: 1346462 - DNA, 22 bp, Artificial Sequence
  chemically synthesized
gcaagcaaataaaaccttaaat

SEQ ID NO: 1346463 - DNA, 22 bp, Artificial Sequence
  chemically synthesized
gaagctttataatttaaggttt

SEQ ID NO: 1346464 - DNA, 22 bp, Artificial Sequence
  chemically synthesized
agcaagcaaataaaaccttaaa

SEQ ID NO: 1346465 - DNA, 22 bp, Artificial Sequence
  chemically synthesized
tatttagcaagcaaataaaacc

SEQ ID NO: 1346466 - DNA, 22 bp, Artificial Sequence
  chemically synthesized
tataatttaaggttttatttgc

SEQ ID NO: 1346467 - DNA, 22 bp, Artificial Sequence
  chemically synthesized
ataatttaaggttttatttgct

SEQ ID NO: 1346468 - DNA, 22 bp, Artificial Sequence
  chemically synthesized
taatttaaggttttatttgctt

SEQ ID NO: 1346469 - DNA, 22 bp, Artificial Sequence
  chemically synthesized
aattatatttagcaagcaaata

SEQ ID NO: 1346470 - DNA, 22 bp, Artificial Sequence
  chemically synthesized
aaggttttatttgcttgctaaa

SEQ ID NO: 1346471 - DNA, 22 bp, Artificial Sequence
  chemically synthesized
aggttttatttgcttgctaaat

SEQ ID NO: 1346472 - DNA, 22 bp, Artificial Sequence
  chemically synthesized
aacagctcaattatatttagca

SEQ ID NO: 1346473 - DNA, 22 bp, Artificial Sequence
  chemically synthesized
tatttgcttgctaaatataatt

SEQ ID NO: 1346474 - DNA, 22 bp, Artificial Sequence
  chemically synthesized
atttgcttgctaaatataattg

SEQ ID NO: 1346475 - DNA, 22 bp, Artificial Sequence
  chemically synthesized
tttgcttgctaaatataattga

SEQ ID NO: 1346476 - DNA, 22 bp, Artificial Sequence
  chemically synthesized
caattaaacagctcaattatat

SEQ ID NO: 1346477 - DNA, 22 bp, Artificial Sequence
  chemically synthesized
gcttgctaaatataattgagct

SEQ ID NO: 1346478 - DNA, 22 bp, Artificial Sequence
  chemically synthesized
cttgctaaatataattgagctg

SEQ ID NO: 1346479 - DNA, 22 bp, Artificial Sequence
  chemically synthesized
gctaaatataattgagctgttt

SEQ ID NO: 1346480 - DNA, 22 bp, Artificial Sequence
  chemically synthesized
aggattacaattaaacagctca

SEQ ID NO: 1346481 - DNA, 22 bp, Artificial Sequence
  chemically synthesized
ctaaatataattgagctgttta

SEQ ID NO: 1346482 - DNA, 22 bp, Artificial Sequence
  chemically synthesized
aatataattgagctgtttaatt

SEQ ID NO: 1346483 - DNA, 22 bp, Artificial Sequence
  chemically synthesized
agctgtttaattgtaatcctta

SEQ ID NO: 1346484 - DNA, 22 bp, Artificial Sequence
  chemically synthesized
aggagccaaggctaaggattac

SEQ ID NO: 1346485 - DNA, 22 bp, Artificial Sequence
  chemically synthesized
gctaaggagccaaggctaagga

SEQ ID NO: 1346486 - DNA, 22 bp, Artificial Sequence
  chemically synthesized
tttaattgtaatccttagcctt

SEQ ID NO: 1346487 - DNA, 22 bp, Artificial Sequence
  chemically synthesized
aattgtaatccttagccttggc

SEQ ID NO: 1346488 - DNA, 22 bp, Artificial Sequence
  chemically synthesized
attgtaatccttagccttggct

SEQ ID NO: 1346489 - DNA, 22 bp, Artificial Sequence
  chemically synthesized
cattggctaaggagccaaggct

SEQ ID NO: 1346490 - DNA, 22 bp, Artificial Sequence
  chemically synthesized
tacattggctaaggagccaagg

SEQ ID NO: 1346491 - DNA, 22 bp, Artificial Sequence
  chemically synthesized
taatccttagccttggctcctt

SEQ ID NO: 1346492 - DNA, 22 bp, Artificial Sequence
  chemically synthesized
agctctacattggctaaggagc

SEQ ID NO: 1346493 - DNA, 22 bp, Artificial Sequence
  chemically synthesized
ttaagctctacattggctaagg

SEQ ID NO: 1346494 - DNA, 22 bp, Artificial Sequence
  chemically synthesized
attaagctctacattggctaag

SEQ ID NO: 1346495 - DNA, 22 bp, Artificial Sequence
  chemically synthesized
agccttggctccttagccaatg

SEQ ID NO: 1346496 - DNA, 22 bp, Artificial Sequence
  chemically synthesized
gccttggctccttagccaatgt

SEQ ID NO: 1346497 - DNA, 22 bp, Artificial Sequence
  chemically synthesized
ggctccttagccaatgtagagc

SEQ ID NO: 1346498 - DNA, 22 bp, Artificial Sequence
  chemically synthesized
gctccttagccaatgtagagct

SEQ ID NO: 1346499 - DNA, 22 bp, Artificial Sequence
  chemically synthesized
aaggtgaatttattaagctcta

SEQ ID NO: 1346500 - DNA, 22 bp, Artificial Sequence
  chemically synthesized
cttagccaatgtagagcttaat

SEQ ID NO: 1346501 - DNA, 22 bp, Artificial Sequence
  chemically synthesized
agccaatgtagagcttaataaa

SEQ ID NO: 1346502 - DNA, 22 bp, Artificial Sequence
  chemically synthesized
gccaatgtagagcttaataaat

SEQ ID NO: 1346503 - DNA, 22 bp, Artificial Sequence
  chemically synthesized
ataatctaaaggtgaatttatt

SEQ ID NO: 1346504 - DNA, 22 bp, Artificial Sequence
  chemically synthesized
ttgataatctaaaggtgaattt

SEQ ID NO: 1346505 - DNA, 22 bp, Artificial Sequence
  chemically synthesized
ttattgataatctaaaggtgaa

SEQ ID NO: 1346506 - DNA, 22 bp, Artificial Sequence
  chemically synthesized
attattgataatctaaaggtga

SEQ ID NO: 1346507 - DNA, 22 bp, Artificial Sequence
  chemically synthesized
aataaattcacctttagattat

SEQ ID NO: 1346508 - DNA, 22 bp, Artificial Sequence
  chemically synthesized
ataaattcacctttagattatc

SEQ ID NO: 1346509 - DNA, 22 bp, Artificial Sequence
  chemically synthesized
ccatgtgtgtttattattgata

SEQ ID NO: 1346510 - DNA, 22 bp, Artificial Sequence
  chemically synthesized
accatgtgtgtttattattgat

SEQ ID NO: 1346511 - DNA, 22 bp, Artificial Sequence
  chemically synthesized
acctttagattatcaataataa

SEQ ID NO: 1346512 - DNA, 22 bp, Artificial Sequence
  chemically synthesized
taccatgtgtgtttattattga

SEQ ID NO: 1346513 - DNA, 22 bp, Artificial Sequence
  chemically synthesized
tagattatcaataataaacaca

SEQ ID NO: 1346514 - DNA, 22 bp, Artificial Sequence
  chemically synthesized
gattttaccatgtgtgtttatt

SEQ ID NO: 1346515 - DNA, 22 bp, Artificial Sequence
  chemically synthesized
agattatcaataataaacacac

SEQ ID NO: 1346516 - DNA, 22 bp, Artificial Sequence
  chemically synthesized
gattatcaataataaacacaca

SEQ ID NO: 1346517 - DNA, 22 bp, Artificial Sequence
  chemically synthesized
tcaataataaacacacatggta

SEQ ID NO: 1346518 - DNA, 22 bp, Artificial Sequence
  chemically synthesized
caatattagattttaccatgtg

SEQ ID NO: 1346519 - DNA, 22 bp, Artificial Sequence
  chemically synthesized
ttgcaatattagattttaccat

SEQ ID NO: 1346520 - DNA, 22 bp, Artificial Sequence
  chemically synthesized
cggactattgcaatattagatt

SEQ ID NO: 1346521 - DNA, 22 bp, Artificial Sequence
  chemically synthesized
acggactattgcaatattagat

SEQ ID NO: 1346522 - DNA, 22 bp, Artificial Sequence
  chemically synthesized
atattgcaatagtccgtaaact

SEQ ID NO: 1346523 - DNA, 22 bp, Artificial Sequence
  chemically synthesized
gaaagtaagcccggaagtttac

SEQ ID NO: 1346524 - DNA, 22 bp, Artificial Sequence
  chemically synthesized
agaaagtaagcccggaagttta

SEQ ID NO: 1346525 - DNA, 22 bp, Artificial Sequence
  chemically synthesized
tagaaagtaagcccggaagttt

SEQ ID NO: 1346526 - DNA, 22 bp, Artificial Sequence
  chemically synthesized
caatagtccgtaaacttccggg

SEQ ID NO: 1346527 - DNA, 22 bp, Artificial Sequence
  chemically synthesized
ttagaaagtaagcccggaagtt

SEQ ID NO: 1346528 - DNA, 22 bp, Artificial Sequence
  chemically synthesized
cttttagaaagtaagcccggaa

SEQ ID NO: 1346529 - DNA, 22 bp, Artificial Sequence
  chemically synthesized
tctgcttttagaaagtaagccc

SEQ ID NO: 1346530 - DNA, 22 bp, Artificial Sequence
  chemically synthesized
atctgcttttagaaagtaagcc

SEQ ID NO: 1346531 - DNA, 22 bp, Artificial Sequence
  chemically synthesized
cttatctgcttttagaaagtaa

SEQ ID NO: 1346532 - DNA, 22 bp, Artificial Sequence
  chemically synthesized
tgcttatctgcttttagaaagt

SEQ ID NO: 1346533 - DNA, 22 bp, Artificial Sequence
  chemically synthesized
ccgggcttactttctaaaagca

SEQ ID NO: 1346534 - DNA, 22 bp, Artificial Sequence
  chemically synthesized
cgggcttactttctaaaagcag

SEQ ID NO: 1346535 - DNA, 22 bp, Artificial Sequence
  chemically synthesized
aataactctgcttatctgcttt

SEQ ID NO: 1346536 - DNA, 22 bp, Artificial Sequence
  chemically synthesized
caataactctgcttatctgctt

SEQ ID NO: 1346537 - DNA, 22 bp, Artificial Sequence
  chemically synthesized
ttcaataactctgcttatctgc

SEQ ID NO: 1346538 - DNA, 22 bp, Artificial Sequence
  chemically synthesized
actttctaaaagcagataagca

SEQ ID NO: 1346539 - DNA, 22 bp, Artificial Sequence
  chemically synthesized
cttcaataactctgcttatctg

SEQ ID NO: 1346540 - DNA, 22 bp, Artificial Sequence
  chemically synthesized
ctttctaaaagcagataagcag

SEQ ID NO: 1346541 - DNA, 22 bp, Artificial Sequence
  chemically synthesized
ttcttcaataactctgcttatc

SEQ ID NO: 1346542 - DNA, 22 bp, Artificial Sequence
  chemically synthesized
tctaaaagcagataagcagagt

SEQ ID NO: 1346543 - DNA, 22 bp, Artificial Sequence
  chemically synthesized
ctaaaagcagataagcagagtt

SEQ ID NO: 1346544 - DNA, 22 bp, Artificial Sequence
  chemically synthesized
taaaagcagataagcagagtta

SEQ ID NO: 1346545 - DNA, 22 bp, Artificial Sequence
  chemically synthesized
aaagcagataagcagagttatt

SEQ ID NO: 1346546 - DNA, 22 bp, Artificial Sequence
  chemically synthesized
aaatatagacacacgattcttc

SEQ ID NO: 1346547 - DNA, 22 bp, Artificial Sequence
  chemically synthesized
tgaaatatagacacacgattct

SEQ ID NO: 1346548 - DNA, 22 bp, Artificial Sequence
  chemically synthesized
ttgaagaagaatcgtgtgtcta

SEQ ID NO: 1346549 - DNA, 22 bp, Artificial Sequence
  chemically synthesized
tgcctctgaaatatagacacac

SEQ ID NO: 1346550 - DNA, 22 bp, Artificial Sequence
  chemically synthesized
atgcctctgaaatatagacaca

SEQ ID NO: 1346551 - DNA, 22 bp, Artificial Sequence
  chemically synthesized
aagaagaatcgtgtgtctatat

SEQ ID NO: 1346552 - DNA, 22 bp, Artificial Sequence
  chemically synthesized
aaatgagtttatgcctctgaaa

SEQ ID NO: 1346553 - DNA, 22 bp, Artificial Sequence
  chemically synthesized
ctaaaatgagtttatgcctctg

SEQ ID NO: 1346554 - DNA, 22 bp, Artificial Sequence
  chemically synthesized
tatttcagaggcataaactcat

SEQ ID NO: 1346555 - DNA, 22 bp, Artificial Sequence
  chemically synthesized
cagaggcataaactcattttag

SEQ ID NO: 1346556 - DNA, 22 bp, Artificial Sequence
  chemically synthesized
agaggcataaactcattttagg

SEQ ID NO: 1346557 - DNA, 22 bp, Artificial Sequence
  chemically synthesized
tgaaagtagtgtagtaataatg

SEQ ID NO: 1346558 - DNA, 22 bp, Artificial Sequence
  chemically synthesized
attttaggagtcattattacta

SEQ ID NO: 1346559 - DNA, 22 bp, Artificial Sequence
  chemically synthesized
taggagtcattattactacact

SEQ ID NO: 1346560 - DNA, 22 bp, Artificial Sequence
  chemically synthesized
aggagtcattattactacacta

SEQ ID NO: 1346561 - DNA, 22 bp, Artificial Sequence
  chemically synthesized
ggagtcattattactacactac

SEQ ID NO: 1346562 - DNA, 22 bp, Artificial Sequence
  chemically synthesized
aaggtatgctgtgaaagtagtg

SEQ ID NO: 1346563 - DNA, 22 bp, Artificial Sequence
  chemically synthesized
attaaaggtatgctgtgaaagt

SEQ ID NO: 1346564 - DNA, 22 bp, Artificial Sequence
  chemically synthesized
gattaaaggtatgctgtgaaag

SEQ ID NO: 1346565 - DNA, 22 bp, Artificial Sequence
  chemically synthesized
ttactacactactttcacagca

SEQ ID NO: 1346566 - DNA, 22 bp, Artificial Sequence
  chemically synthesized
ctacactactttcacagcatac

SEQ ID NO: 1346567 - DNA, 22 bp, Artificial Sequence
  chemically synthesized
atacttgattaaaggtatgctg

SEQ ID NO: 1346568 - DNA, 22 bp, Artificial Sequence
  chemically synthesized
cactactttcacagcatacctt

SEQ ID NO: 1346569 - DNA, 22 bp, Artificial Sequence
  chemically synthesized
tgatacttgattaaaggtatgc

SEQ ID NO: 1346570 - DNA, 22 bp, Artificial Sequence
  chemically synthesized
ctgatacttgattaaaggtatg

SEQ ID NO: 1346571 - DNA, 22 bp, Artificial Sequence
  chemically synthesized
ctttcacagcatacctttaatc

SEQ ID NO: 1346572 - DNA, 22 bp, Artificial Sequence
  chemically synthesized
tttctgatacttgattaaaggt

SEQ ID NO: 1346573 - DNA, 22 bp, Artificial Sequence
  chemically synthesized
atttctgatacttgattaaagg

SEQ ID NO: 1346574 - DNA, 22 bp, Artificial Sequence
  chemically synthesized
tatttctgatacttgattaaag

SEQ ID NO: 1346575 - DNA, 22 bp, Artificial Sequence
  chemically synthesized
tcacagcatacctttaatcaag

SEQ ID NO: 1346576 - DNA, 22 bp, Artificial Sequence
  chemically synthesized
cacagcatacctttaatcaagt

SEQ ID NO: 1346577 - DNA, 22 bp, Artificial Sequence
  chemically synthesized
acagcatacctttaatcaagta

SEQ ID NO: 1346578 - DNA, 22 bp, Artificial Sequence
  chemically synthesized
ctttatttctgatacttgatta

SEQ ID NO: 1346579 - DNA, 22 bp, Artificial Sequence
  chemically synthesized
tactttatttctgatacttgat

SEQ ID NO: 1346580 - DNA, 22 bp, Artificial Sequence
  chemically synthesized
atgtgttctactttatttctga

SEQ ID NO: 1346581 - DNA, 22 bp, Artificial Sequence
  chemically synthesized
taatcaagtatcagaaataaag

SEQ ID NO: 1346582 - DNA, 22 bp, Artificial Sequence
  chemically synthesized
tgatgtgttctactttatttct

SEQ ID NO: 1346583 - DNA, 22 bp, Artificial Sequence
  chemically synthesized
aatcaagtatcagaaataaagt

SEQ ID NO: 1346584 - DNA, 22 bp, Artificial Sequence
  chemically synthesized
ctgatgtgttctactttatttc

SEQ ID NO: 1346585 - DNA, 22 bp, Artificial Sequence
  chemically synthesized
atcaagtatcagaaataaagta

SEQ ID NO: 1346586 - DNA, 22 bp, Artificial Sequence
  chemically synthesized
tctgatgtgttctactttattt

SEQ ID NO: 1346587 - DNA, 22 bp, Artificial Sequence
  chemically synthesized
ttttctgatgtgttctacttta

SEQ ID NO: 1346588 - DNA, 22 bp, Artificial Sequence
  chemically synthesized
attttctgatgtgttctacttt

SEQ ID NO: 1346589 - DNA, 22 bp, Artificial Sequence
  chemically synthesized
tcagaccacttattttctgatg

SEQ ID NO: 1346590 - DNA, 22 bp, Artificial Sequence
  chemically synthesized
atcagaccacttattttctgat

SEQ ID NO: 1346591 - DNA, 22 bp, Artificial Sequence
  chemically synthesized
tttatcagaccacttattttct

SEQ ID NO: 1346592 - DNA, 22 bp, Artificial Sequence
  chemically synthesized
aggtgtggtaaattgtttatca

SEQ ID NO: 1346593 - DNA, 22 bp, Artificial Sequence
  chemically synthesized
caggtgtggtaaattgtttatc

SEQ ID NO: 1346594 - DNA, 22 bp, Artificial Sequence
  chemically synthesized
catttcaggtgtggtaaattgt

SEQ ID NO: 1346595 - DNA, 22 bp, Artificial Sequence
  chemically synthesized
ataaacaatttaccacacctga

SEQ ID NO: 1346596 - DNA, 22 bp, Artificial Sequence
  chemically synthesized
gtatgaaagtctgcatttcagg

SEQ ID NO: 1346597 - DNA, 22 bp, Artificial Sequence
  chemically synthesized
cgtatgaaagtctgcatttcag

SEQ ID NO: 1346598 - DNA, 22 bp, Artificial Sequence
  chemically synthesized
tcgtatgaaagtctgcatttca

SEQ ID NO: 1346599 - DNA, 22 bp, Artificial Sequence
  chemically synthesized
ttcgtatgaaagtctgcatttc

SEQ ID NO: 1346600 - DNA, 22 bp, Artificial Sequence
  chemically synthesized
accacacctgaaatgcagactt

SEQ ID NO: 1346601 - DNA, 22 bp, Artificial Sequence
  chemically synthesized
ccacacctgaaatgcagacttt

SEQ ID NO: 1346602 - DNA, 22 bp, Artificial Sequence
  chemically synthesized
gaacatttttcgtatgaaagtc

SEQ ID NO: 1346603 - DNA, 22 bp, Artificial Sequence
  chemically synthesized
aaatgcagactttcatacgaaa

SEQ ID NO: 1346604 - DNA, 22 bp, Artificial Sequence
  chemically synthesized
tgctagaacatttttcgtatga

SEQ ID NO: 1346605 - DNA, 22 bp, Artificial Sequence
  chemically synthesized
ttgtgctagaacatttttcgta

SEQ ID NO: 1346606 - DNA, 22 bp, Artificial Sequence
  chemically synthesized
tcatacgaaaaatgttctagca

SEQ ID NO: 1346607 - DNA, 22 bp, Artificial Sequence
  chemically synthesized
tggaccctgttgtgctagaaca

SEQ ID NO: 1346608 - DNA, 22 bp, Artificial Sequence
  chemically synthesized
catacgaaaaatgttctagcac

SEQ ID NO: 1346609 - DNA, 22 bp, Artificial Sequence
  chemically synthesized
atacgaaaaatgttctagcaca

SEQ ID NO: 1346610 - DNA, 22 bp, Artificial Sequence
  chemically synthesized
cctgtggaccctgttgtgctag

SEQ ID NO: 1346611 - DNA, 22 bp, Artificial Sequence
  chemically synthesized
attgcctgtggaccctgttgtg

SEQ ID NO: 1346612 - DNA, 22 bp, Artificial Sequence
  chemically synthesized
ttgattgcctgtggaccctgtt

SEQ ID NO: 1346613 - DNA, 22 bp, Artificial Sequence
  chemically synthesized
tagcacaacagggtccacaggc

SEQ ID NO: 1346614 - DNA, 22 bp, Artificial Sequence
  chemically synthesized
gcacaacagggtccacaggcaa

SEQ ID NO: 1346615 - DNA, 22 bp, Artificial Sequence
  chemically synthesized
atagatcagcccaggagaagga

SEQ ID NO: 1346616 - DNA, 22 bp, Artificial Sequence
  chemically synthesized
ttctcttccttctcctgggctg

SEQ ID NO: 1346617 - DNA, 22 bp, Artificial Sequence
  chemically synthesized
tcttccttctcctgggctgatc

SEQ ID NO: 1346618 - DNA, 22 bp, Artificial Sequence
  chemically synthesized
gccatgctaatagatcagccca

SEQ ID NO: 1346619 - DNA, 22 bp, Artificial Sequence
  chemically synthesized
ttccttctcctgggctgatcta

SEQ ID NO: 1346620 - DNA, 22 bp, Artificial Sequence
  chemically synthesized
ttagccatgctaatagatcagc

SEQ ID NO: 1346621 - DNA, 22 bp, Artificial Sequence
  chemically synthesized
ccttctcctgggctgatctatt

SEQ ID NO: 1346622 - DNA, 22 bp, Artificial Sequence
  chemically synthesized
cttctcctgggctgatctatta

SEQ ID NO: 1346623 - DNA, 22 bp, Artificial Sequence
  chemically synthesized
ctcctgggctgatctattagca

SEQ ID NO: 1346624 - DNA, 22 bp, Artificial Sequence
  chemically synthesized
tcctgggctgatctattagcat

SEQ ID NO: 1346625 - DNA, 22 bp, Artificial Sequence
  chemically synthesized
ctgggctgatctattagcatgg

SEQ ID NO: 1346626 - DNA, 22 bp, Artificial Sequence
  chemically synthesized
ggctgatctattagcatggcta

SEQ ID NO: 1346627 - DNA, 22 bp, Artificial Sequence
  chemically synthesized
atctattagcatggctaataga

SEQ ID NO: 1346628 - DNA, 22 bp, Artificial Sequence
  chemically synthesized
taggagagtgcaatgatctatt

SEQ ID NO: 1346629 - DNA, 22 bp, Artificial Sequence
  chemically synthesized
ttagcatggctaatagatcatt

SEQ ID NO: 1346630 - DNA, 22 bp, Artificial Sequence
  chemically synthesized
tgtaggagagtgcaatgatcta

SEQ ID NO: 1346631 - DNA, 22 bp, Artificial Sequence
  chemically synthesized
gcatggctaatagatcattgca

SEQ ID NO: 1346632 - DNA, 22 bp, Artificial Sequence
  chemically synthesized
gcctctgtaggagagtgcaatg

SEQ ID NO: 1346633 - DNA, 22 bp, Artificial Sequence
  chemically synthesized
atagatcattgcactctcctac

SEQ ID NO: 1346634 - DNA, 22 bp, Artificial Sequence
  chemically synthesized
cactctcctacagaggccagat

SEQ ID NO: 1346635 - DNA, 22 bp, Artificial Sequence
  chemically synthesized
tcctacagaggccagatgggac

SEQ ID NO: 1346636 - DNA, 22 bp, Artificial Sequence
  chemically synthesized
aaatgtggagaagtcccatctg

SEQ ID NO: 1346637 - DNA, 22 bp, Artificial Sequence
  chemically synthesized
ctacagaggccagatgggactt

SEQ ID NO: 1346638 - DNA, 22 bp, Artificial Sequence
  chemically synthesized
cagaggccagatgggacttctc

SEQ ID NO: 1346639 - DNA, 22 bp, Artificial Sequence
  chemically synthesized
aactaaaatgtggagaagtccc

SEQ ID NO: 1346640 - DNA, 22 bp, Artificial Sequence
  chemically synthesized
gaactaaaatgtggagaagtcc

SEQ ID NO: 1346641 - DNA, 22 bp, Artificial Sequence
  chemically synthesized
ttgaactaaaatgtggagaagt

SEQ ID NO: 1346642 - DNA, 22 bp, Artificial Sequence
  chemically synthesized
cttgaactaaaatgtggagaag

SEQ ID NO: 1346643 - DNA, 22 bp, Artificial Sequence
  chemically synthesized
gtagtatcttcttgaactaaaa

SEQ ID NO: 1346644 - DNA, 22 bp, Artificial Sequence
  chemically synthesized
attggtagtatcttcttgaact

SEQ ID NO: 1346645 - DNA, 22 bp, Artificial Sequence
  chemically synthesized
ctccacattttagttcaagaag

SEQ ID NO: 1346646 - DNA, 22 bp, Artificial Sequence
  chemically synthesized
tccacattttagttcaagaaga

SEQ ID NO: 1346647 - DNA, 22 bp, Artificial Sequence
  chemically synthesized
cacattttagttcaagaagata

SEQ ID NO: 1346648 - DNA, 22 bp, Artificial Sequence
  chemically synthesized
attaattggtagtatcttcttg

SEQ ID NO: 1346649 - DNA, 22 bp, Artificial Sequence
  chemically synthesized
taattaattggtagtatcttct

SEQ ID NO: 1346650 - DNA, 22 bp, Artificial Sequence
  chemically synthesized
tagttcaagaagatactaccaa

SEQ ID NO: 1346651 - DNA, 22 bp, Artificial Sequence
  chemically synthesized
agttcaagaagatactaccaat

SEQ ID NO: 1346652 - DNA, 22 bp, Artificial Sequence
  chemically synthesized
gttcaagaagatactaccaatt

SEQ ID NO: 1346653 - DNA, 22 bp, Artificial Sequence
  chemically synthesized
aagaagatactaccaattaatt

SEQ ID NO: 1346654 - DNA, 22 bp, Artificial Sequence
  chemically synthesized
aagtgccaactctaattaattg

SEQ ID NO: 1346655 - DNA, 22 bp, Artificial Sequence
  chemically synthesized
ccaattaattagagttggcact

SEQ ID NO: 1346656 - DNA, 22 bp, Artificial Sequence
  chemically synthesized
attagagttggcacttgaggtt

SEQ ID NO: 1346657 - DNA, 22 bp, Artificial Sequence
  chemically synthesized
gagttggcacttgaggttatta

SEQ ID NO: 1346658 - DNA, 22 bp, Artificial Sequence
  chemically synthesized
gcacttgaggttattatttgct

SEQ ID NO: 1346659 - DNA, 22 bp, Artificial Sequence
  chemically synthesized
gaggttattatttgctttgctt

SEQ ID NO: 1346660 - DNA, 22 bp, Artificial Sequence
  chemically synthesized
aggttattatttgctttgcttt

SEQ ID NO: 1346661 - DNA, 22 bp, Artificial Sequence
  chemically synthesized
ttatttgctttgctttacttac

SEQ ID NO: 1346662 - DNA, 22 bp, Artificial Sequence
  chemically synthesized
tttgctttgctttacttacttt

SEQ ID NO: 1346663 - DNA, 22 bp, Artificial Sequence
  chemically synthesized
gctttgctttacttactttctt

SEQ ID NO: 1346664 - DNA, 22 bp, Artificial Sequence
  chemically synthesized
ctttgctttacttactttcttt

SEQ ID NO: 1346665 - DNA, 22 bp, Artificial Sequence
  chemically synthesized
tgctttacttactttctttctt

SEQ ID NO: 1346666 - DNA, 22 bp, Artificial Sequence
  chemically synthesized
gctttacttactttctttcttt

SEQ ID NO: 1346667 - DNA, 22 bp, Artificial Sequence
  chemically synthesized
ctttacttactttctttctttt

SEQ ID NO: 1346668 - DNA, 22 bp, Artificial Sequence
  chemically synthesized
tacttactttctttcttttttt

SEQ ID NO: 1346669 - DNA, 22 bp, Artificial Sequence
  chemically synthesized
acttactttctttctttttttt

SEQ ID NO: 1346670 - DNA, 22 bp, Artificial Sequence
  chemically synthesized
tatgcaaaaaaaaaaaaaaaga

SEQ ID NO: 1346671 - DNA, 22 bp, Artificial Sequence
  chemically synthesized
cttactttctttcttttttttt

SEQ ID NO: 1346672 - DNA, 22 bp, Artificial Sequence
  chemically synthesized
actttctttctttttttttttt

SEQ ID NO: 1346673 - DNA, 22 bp, Artificial Sequence
  chemically synthesized
ctttctttcttttttttttttt

SEQ ID NO: 1346674 - DNA, 22 bp, Artificial Sequence
  chemically synthesized
agtctgtatgcaaaaaaaaaaa

SEQ ID NO: 1346675 - DNA, 22 bp, Artificial Sequence
  chemically synthesized
tctttctttttttttttttttg

SEQ ID NO: 1346676 - DNA, 22 bp, Artificial Sequence
  chemically synthesized
ctttctttttttttttttttgc

SEQ ID NO: 1346677 - DNA, 22 bp, Artificial Sequence
  chemically synthesized
tttctttttttttttttttgca

SEQ ID NO: 1346678 - DNA, 22 bp, Artificial Sequence
  chemically synthesized
tctaagtctgtatgcaaaaaaa

SEQ ID NO: 1346679 - DNA, 22 bp, Artificial Sequence
  chemically synthesized
tctttttttttttttttgcata

SEQ ID NO: 1346680 - DNA, 22 bp, Artificial Sequence
  chemically synthesized
ctttttttttttttttgcatac

SEQ ID NO: 1346681 - DNA, 22 bp, Artificial Sequence
  chemically synthesized
tttttttttttttttgcataca

SEQ ID NO: 1346682 - DNA, 22 bp, Artificial Sequence
  chemically synthesized
gctgtctaagtctgtatgcaaa

SEQ ID NO: 1346683 - DNA, 22 bp, Artificial Sequence
  chemically synthesized
agctgtctaagtctgtatgcaa

SEQ ID NO: 1346684 - DNA, 22 bp, Artificial Sequence
  chemically synthesized
tttttttttttttgcatacaga

SEQ ID NO: 1346685 - DNA, 22 bp, Artificial Sequence
  chemically synthesized
ttttttttttttgcatacagac

SEQ ID NO: 1346686 - DNA, 22 bp, Artificial Sequence
  chemically synthesized
tttttttttttgcatacagact

SEQ ID NO: 1346687 - DNA, 22 bp, Artificial Sequence
  chemically synthesized
ttttttttttgcatacagactt

SEQ ID NO: 1346688 - DNA, 22 bp, Artificial Sequence
  chemically synthesized
atttagctgtctaagtctgtat

SEQ ID NO: 1346689 - DNA, 22 bp, Artificial Sequence
  chemically synthesized
tttttttttgcatacagactta

SEQ ID NO: 1346690 - DNA, 22 bp, Artificial Sequence
  chemically synthesized
aatttagctgtctaagtctgta

SEQ ID NO: 1346691 - DNA, 22 bp, Artificial Sequence
  chemically synthesized
ttttttttgcatacagacttag

SEQ ID NO: 1346692 - DNA, 22 bp, Artificial Sequence
  chemically synthesized
taatttagctgtctaagtctgt

SEQ ID NO: 1346693 - DNA, 22 bp, Artificial Sequence
  chemically synthesized
tttttttgcatacagacttaga

SEQ ID NO: 1346694 - DNA, 22 bp, Artificial Sequence
  chemically synthesized
ttttttgcatacagacttagac

SEQ ID NO: 1346695 - DNA, 22 bp, Artificial Sequence
  chemically synthesized
tttttgcatacagacttagaca

SEQ ID NO: 1346696 - DNA, 22 bp, Artificial Sequence
  chemically synthesized
ttttgcatacagacttagacag

SEQ ID NO: 1346697 - DNA, 22 bp, Artificial Sequence
  chemically synthesized
tttgcatacagacttagacagc

SEQ ID NO: 1346698 - DNA, 22 bp, Artificial Sequence
  chemically synthesized
ttgcatacagacttagacagct

SEQ ID NO: 1346699 - DNA, 22 bp, Artificial Sequence
  chemically synthesized
tgcatacagacttagacagcta

SEQ ID NO: 1346700 - DNA, 22 bp, Artificial Sequence
  chemically synthesized
gcatacagacttagacagctaa

SEQ ID NO: 1346701 - DNA, 22 bp, Artificial Sequence
  chemically synthesized
catacagacttagacagctaaa

SEQ ID NO: 1346702 - DNA, 22 bp, Artificial Sequence
  chemically synthesized
aatatgattttaatttagctgt

SEQ ID NO: 1346703 - DNA, 22 bp, Artificial Sequence
  chemically synthesized
agacagctaaattaaaatcata

SEQ ID NO: 1346704 - DNA, 22 bp, Artificial Sequence
  chemically synthesized
gacagctaaattaaaatcatat

SEQ ID NO: 1346705 - DNA, 22 bp, Artificial Sequence
  chemically synthesized
aaggagatgttcaatatgattt

SEQ ID NO: 1346706 - DNA, 22 bp, Artificial Sequence
  chemically synthesized
aattaaaatcatattgaacatc

SEQ ID NO: 1346707 - DNA, 22 bp, Artificial Sequence
  chemically synthesized
atatcacattgaaggagatgtt

SEQ ID NO: 1346708 - DNA, 22 bp, Artificial Sequence
  chemically synthesized
aaatcatattgaacatctcctt

SEQ ID NO: 1346709 - DNA, 22 bp, Artificial Sequence
  chemically synthesized
gaaatgtcctaatatcacattg

SEQ ID NO: 1346710 - DNA, 22 bp, Artificial Sequence
  chemically synthesized
aacatctccttcaatgtgatat

SEQ ID NO: 1346711 - DNA, 22 bp, Artificial Sequence
  chemically synthesized
tagaaatgtcctaatatcacat

SEQ ID NO: 1346712 - DNA, 22 bp, Artificial Sequence
  chemically synthesized
ctagaaatgtcctaatatcaca

SEQ ID NO: 1346713 - DNA, 22 bp, Artificial Sequence
  chemically synthesized
cttcaatgtgatattaggacat

SEQ ID NO: 1346714 - DNA, 22 bp, Artificial Sequence
  chemically synthesized
caatgtgatattaggacatttc

SEQ ID NO: 1346715 - DNA, 22 bp, Artificial Sequence
  chemically synthesized
aatgtgatattaggacatttct

SEQ ID NO: 1346716 - DNA, 22 bp, Artificial Sequence
  chemically synthesized
aagtaaacacttctagaaatgt

SEQ ID NO: 1346717 - DNA, 22 bp, Artificial Sequence
  chemically synthesized
tagattcaagtaaacacttcta

SEQ ID NO: 1346718 - DNA, 22 bp, Artificial Sequence
  chemically synthesized
ggacatttctagaagtgtttac

SEQ ID NO: 1346719 - DNA, 22 bp, Artificial Sequence
  chemically synthesized
aaaatctgtagattcaagtaaa

SEQ ID NO: 1346720 - DNA, 22 bp, Artificial Sequence
  chemically synthesized
ctagaagtgtttacttgaatct

SEQ ID NO: 1346721 - DNA, 22 bp, Artificial Sequence
  chemically synthesized
tagaagtgtttacttgaatcta

SEQ ID NO: 1346722 - DNA, 22 bp, Artificial Sequence
  chemically synthesized
gaagtgtttacttgaatctaca

SEQ ID NO: 1346723 - DNA, 22 bp, Artificial Sequence
  chemically synthesized
tagctcaaaatctgtagattca

SEQ ID NO: 1346724 - DNA, 22 bp, Artificial Sequence
  chemically synthesized
atagctcaaaatctgtagattc

SEQ ID NO: 1346725 - DNA, 22 bp, Artificial Sequence
  chemically synthesized
acttgaatctacagattttgag

SEQ ID NO: 1346726 - DNA, 22 bp, Artificial Sequence
  chemically synthesized
cttgaatctacagattttgagc

SEQ ID NO: 1346727 - DNA, 22 bp, Artificial Sequence
  chemically synthesized
aagtcccttatagctcaaaatc

SEQ ID NO: 1346728 - DNA, 22 bp, Artificial Sequence
  chemically synthesized
gaatctacagattttgagctat

SEQ ID NO: 1346729 - DNA, 22 bp, Artificial Sequence
  chemically synthesized
aatctacagattttgagctata

SEQ ID NO: 1346730 - DNA, 22 bp, Artificial Sequence
  chemically synthesized
aactcaagtcccttatagctca

SEQ ID NO: 1346731 - DNA, 22 bp, Artificial Sequence
  chemically synthesized
ctaaactcaagtcccttatagc

SEQ ID NO: 1346732 - DNA, 22 bp, Artificial Sequence
  chemically synthesized
cagattttgagctataagggac

SEQ ID NO: 1346733 - DNA, 22 bp, Artificial Sequence
  chemically synthesized
aattcctaaactcaagtccctt

SEQ ID NO: 1346734 - DNA, 22 bp, Artificial Sequence
  chemically synthesized
tgagctataagggacttgagtt

SEQ ID NO: 1346735 - DNA, 22 bp, Artificial Sequence
  chemically synthesized
gagctataagggacttgagttt

SEQ ID NO: 1346736 - DNA, 22 bp, Artificial Sequence
  chemically synthesized
aactaaattcctaaactcaagt

SEQ ID NO: 1346737 - DNA, 22 bp, Artificial Sequence
  chemically synthesized
agctataagggacttgagttta

SEQ ID NO: 1346738 - DNA, 22 bp, Artificial Sequence
  chemically synthesized
aaactaaattcctaaactcaag

SEQ ID NO: 1346739 - DNA, 22 bp, Artificial Sequence
  chemically synthesized
taagggacttgagtttaggaat

SEQ ID NO: 1346740 - DNA, 22 bp, Artificial Sequence
  chemically synthesized
gtcaaatttaaactaaattcct

SEQ ID NO: 1346741 - DNA, 22 bp, Artificial Sequence
  chemically synthesized
ttagtcaaatttaaactaaatt

SEQ ID NO: 1346742 - DNA, 22 bp, Artificial Sequence
  chemically synthesized
gagtttaggaatttagtttaaa

SEQ ID NO: 1346743 - DNA, 22 bp, Artificial Sequence
  chemically synthesized
agtttaggaatttagtttaaat

SEQ ID NO: 1346744 - DNA, 22 bp, Artificial Sequence
  chemically synthesized
tatgctattagtcaaatttaaa

SEQ ID NO: 1346745 - DNA, 22 bp, Artificial Sequence
  chemically synthesized
aggaatttagtttaaatttgac

SEQ ID NO: 1346746 - DNA, 22 bp, Artificial Sequence
  chemically synthesized
ggaatttagtttaaatttgact

SEQ ID NO: 1346747 - DNA, 22 bp, Artificial Sequence
  chemically synthesized
agtttaaatttgactaatagca

SEQ ID NO: 1346748 - DNA, 22 bp, Artificial Sequence
  chemically synthesized
gtttaaatttgactaatagcat

SEQ ID NO: 1346749 - DNA, 22 bp, Artificial Sequence
  chemically synthesized
aggtagaaaactgtatgctatt

SEQ ID NO: 1346750 - DNA, 22 bp, Artificial Sequence
  chemically synthesized
aaatttgactaatagcatacag

SEQ ID NO: 1346751 - DNA, 22 bp, Artificial Sequence
  chemically synthesized
aatttgactaatagcatacagt

SEQ ID NO: 1346752 - DNA, 22 bp, Artificial Sequence
  chemically synthesized
ggctgaggtagaaaactgtatg

SEQ ID NO: 1346753 - DNA, 22 bp, Artificial Sequence
  chemically synthesized
gactaatagcatacagttttct

SEQ ID NO: 1346754 - DNA, 22 bp, Artificial Sequence
  chemically synthesized
ttaggctgaggtagaaaactgt

SEQ ID NO: 1346755 - DNA, 22 bp, Artificial Sequence
  chemically synthesized
actaatagcatacagttttcta

SEQ ID NO: 1346756 - DNA, 22 bp, Artificial Sequence
  chemically synthesized
attaggctgaggtagaaaactg

SEQ ID NO: 1346757 - DNA, 22 bp, Artificial Sequence
  chemically synthesized
atagcatacagttttctacctc

SEQ ID NO: 1346758 - DNA, 22 bp, Artificial Sequence
  chemically synthesized
gagtcagtgagtttattaggct

SEQ ID NO: 1346759 - DNA, 22 bp, Artificial Sequence
  chemically synthesized
ttagagtcagtgagtttattag

SEQ ID NO: 1346760 - DNA, 22 bp, Artificial Sequence
  chemically synthesized
tctacctcagcctaataaactc

SEQ ID NO: 1346761 - DNA, 22 bp, Artificial Sequence
  chemically synthesized
ctacctcagcctaataaactca

SEQ ID NO: 1346762 - DNA, 22 bp, Artificial Sequence
  chemically synthesized
tacctcagcctaataaactcac

SEQ ID NO: 1346763 - DNA, 22 bp, Artificial Sequence
  chemically synthesized
gttattagagtcagtgagttta

SEQ ID NO: 1346764 - DNA, 22 bp, Artificial Sequence
  chemically synthesized
cctcagcctaataaactcactg

SEQ ID NO: 1346765 - DNA, 22 bp, Artificial Sequence
  chemically synthesized
agcctaataaactcactgactc

SEQ ID NO: 1346766 - DNA, 22 bp, Artificial Sequence
  chemically synthesized
aaattcgttattagagtcagtg

SEQ ID NO: 1346767 - DNA, 22 bp, Artificial Sequence
  chemically synthesized
caaattcgttattagagtcagt

SEQ ID NO: 1346768 - DNA, 22 bp, Artificial Sequence
  chemically synthesized
tcaaattcgttattagagtcag

SEQ ID NO: 1346769 - DNA, 22 bp, Artificial Sequence
  chemically synthesized
ttcaaattcgttattagagtca

SEQ ID NO: 1346770 - DNA, 22 bp, Artificial Sequence
  chemically synthesized
ataaactcactgactctaataa

SEQ ID NO: 1346771 - DNA, 22 bp, Artificial Sequence
  chemically synthesized
tttttcaaattcgttattagag

SEQ ID NO: 1346772 - DNA, 22 bp, Artificial Sequence
  chemically synthesized
actgactctaataacgaatttg

SEQ ID NO: 1346773 - DNA, 22 bp, Artificial Sequence
  chemically synthesized
actctaataacgaatttgaaaa

SEQ ID NO: 1346774 - DNA, 22 bp, Artificial Sequence
  chemically synthesized
aggacatgttgtttttcaaatt

SEQ ID NO: 1346775 - DNA, 22 bp, Artificial Sequence
  chemically synthesized
taataacgaatttgaaaaacaa

SEQ ID NO: 1346776 - DNA, 22 bp, Artificial Sequence
  chemically synthesized
ataacgaatttgaaaaacaaca

SEQ ID NO: 1346777 - DNA, 22 bp, Artificial Sequence
  chemically synthesized
tcaggatgctaaggacatgttg

SEQ ID NO: 1346778 - DNA, 22 bp, Artificial Sequence
  chemically synthesized
gtcaggatgctaaggacatgtt

SEQ ID NO: 1346779 - DNA, 22 bp, Artificial Sequence
  chemically synthesized
gaaaaacaacatgtccttagca

SEQ ID NO: 1346780 - DNA, 22 bp, Artificial Sequence
  chemically synthesized
aaaaacaacatgtccttagcat

SEQ ID NO: 1346781 - DNA, 22 bp, Artificial Sequence
  chemically synthesized
tgggtttgtcaggatgctaagg

SEQ ID NO: 1346782 - DNA, 22 bp, Artificial Sequence
  chemically synthesized
tgtgggtttgtcaggatgctaa

SEQ ID NO: 1346783 - DNA, 22 bp, Artificial Sequence
  chemically synthesized
agcatcctgacaaacccacaga

SEQ ID NO: 1346784 - DNA, 22 bp, Artificial Sequence
  chemically synthesized
gcatcctgacaaacccacagaa

SEQ ID NO: 1346785 - DNA, 22 bp, Artificial Sequence
  chemically synthesized
acaaacccacagaactgctgct

SEQ ID NO: 1346786 - DNA, 22 bp, Artificial Sequence
  chemically synthesized
acatgtaggaggaaggagcagc

SEQ ID NO: 1346787 - DNA, 22 bp, Artificial Sequence
  chemically synthesized
aaacccaaactgacatgtagga

SEQ ID NO: 1346788 - DNA, 22 bp, Artificial Sequence
  chemically synthesized
ctgctccttcctcctacatgtc

SEQ ID NO: 1346789 - DNA, 22 bp, Artificial Sequence
  chemically synthesized
ctccttcctcctacatgtcagt

SEQ ID NO: 1346790 - DNA, 22 bp, Artificial Sequence
  chemically synthesized
cttcctcctacatgtcagtttg

SEQ ID NO: 1346791 - DNA, 22 bp, Artificial Sequence
  chemically synthesized
cctcctacatgtcagtttgggt

SEQ ID NO: 1346792 - DNA, 22 bp, Artificial Sequence
  chemically synthesized
ctcctacatgtcagtttgggtt

SEQ ID NO: 1346793 - DNA, 22 bp, Artificial Sequence
  chemically synthesized
tcatgcaatgctgaaacccaaa

SEQ ID NO: 1346794 - DNA, 22 bp, Artificial Sequence
  chemically synthesized
ctacatgtcagtttgggtttca

SEQ ID NO: 1346795 - DNA, 22 bp, Artificial Sequence
  chemically synthesized
gtcatgcaatgctgaaacccaa

SEQ ID NO: 1346796 - DNA, 22 bp, Artificial Sequence
  chemically synthesized
tgtcatgcaatgctgaaaccca

SEQ ID NO: 1346797 - DNA, 22 bp, Artificial Sequence
  chemically synthesized
ttgtcatgcaatgctgaaaccc

SEQ ID NO: 1346798 - DNA, 22 bp, Artificial Sequence
  chemically synthesized
catgtcagtttgggtttcagca

SEQ ID NO: 1346799 - DNA, 22 bp, Artificial Sequence
  chemically synthesized
agatttttgtcatgcaatgctg

SEQ ID NO: 1346800 - DNA, 22 bp, Artificial Sequence
  chemically synthesized
gggtttcagcattgcatgacaa

SEQ ID NO: 1346801 - DNA, 22 bp, Artificial Sequence
  chemically synthesized
ggtttcagcattgcatgacaaa

SEQ ID NO: 1346802 - DNA, 22 bp, Artificial Sequence
  chemically synthesized
cagcattgcatgacaaaaatct

SEQ ID NO: 1346803 - DNA, 22 bp, Artificial Sequence
  chemically synthesized
agcattgcatgacaaaaatctc

SEQ ID NO: 1346804 - DNA, 22 bp, Artificial Sequence
  chemically synthesized
acacataaagaaaattgagatt

SEQ ID NO: 1346805 - DNA, 22 bp, Artificial Sequence
  chemically synthesized
taacacataaagaaaattgaga

SEQ ID NO: 1346806 - DNA, 22 bp, Artificial Sequence
  chemically synthesized
catgacaaaaatctcaattttc

SEQ ID NO: 1346807 - DNA, 22 bp, Artificial Sequence
  chemically synthesized
ctaacacataaagaaaattgag

SEQ ID NO: 1346808 - DNA, 22 bp, Artificial Sequence
  chemically synthesized
tgaacttctaacacataaagaa

SEQ ID NO: 1346809 - DNA, 22 bp, Artificial Sequence
  chemically synthesized
caattatgaacttctaacacat

SEQ ID NO: 1346810 - DNA, 22 bp, Artificial Sequence
  chemically synthesized
ccaattatgaacttctaacaca

SEQ ID NO: 1346811 - DNA, 22 bp, Artificial Sequence
  chemically synthesized
aattttctttatgtgttagaag

SEQ ID NO: 1346812 - DNA, 22 bp, Artificial Sequence
  chemically synthesized
tctttatgtgttagaagttcat

SEQ ID NO: 1346813 - DNA, 22 bp, Artificial Sequence
  chemically synthesized
acacttccaattatgaacttct

SEQ ID NO: 1346814 - DNA, 22 bp, Artificial Sequence
  chemically synthesized
ctttatgtgttagaagttcata

SEQ ID NO: 1346815 - DNA, 22 bp, Artificial Sequence
  chemically synthesized
tttatgtgttagaagttcataa

SEQ ID NO: 1346816 - DNA, 22 bp, Artificial Sequence
  chemically synthesized
ttcacacttccaattatgaact

SEQ ID NO: 1346817 - DNA, 22 bp, Artificial Sequence
  chemically synthesized
tatgtgttagaagttcataatt

SEQ ID NO: 1346818 - DNA, 22 bp, Artificial Sequence
  chemically synthesized
attcacacttccaattatgaac

SEQ ID NO: 1346819 - DNA, 22 bp, Artificial Sequence
  chemically synthesized
atgtgttagaagttcataattg

SEQ ID NO: 1346820 - DNA, 22 bp, Artificial Sequence
  chemically synthesized
tattcacacttccaattatgaa

SEQ ID NO: 1346821 - DNA, 22 bp, Artificial Sequence
  chemically synthesized
tgtgttagaagttcataattgg

SEQ ID NO: 1346822 - DNA, 22 bp, Artificial Sequence
  chemically synthesized
ttattcacacttccaattatga

SEQ ID NO: 1346823 - DNA, 22 bp, Artificial Sequence
  chemically synthesized
acttttattcacacttccaatt

SEQ ID NO: 1346824 - DNA, 22 bp, Artificial Sequence
  chemically synthesized
gaagttcataattggaagtgtg

SEQ ID NO: 1346825 - DNA, 22 bp, Artificial Sequence
  chemically synthesized
ccctaacttttattcacacttc

SEQ ID NO: 1346826 - DNA, 22 bp, Artificial Sequence
  chemically synthesized
cccctaacttttattcacactt

SEQ ID NO: 1346827 - DNA, 22 bp, Artificial Sequence
  chemically synthesized
tcccctaacttttattcacact

SEQ ID NO: 1346828 - DNA, 22 bp, Artificial Sequence
  chemically synthesized
ttcccctaacttttattcacac

SEQ ID NO: 1346829 - DNA, 22 bp, Artificial Sequence
  chemically synthesized
ataattggaagtgtgaataaaa

SEQ ID NO: 1346830 - DNA, 22 bp, Artificial Sequence
  chemically synthesized
agtcatttttcccctaactttt

SEQ ID NO: 1346831 - DNA, 22 bp, Artificial Sequence
  chemically synthesized
gaagtgtgaataaaagttaggg

SEQ ID NO: 1346832 - DNA, 22 bp, Artificial Sequence
  chemically synthesized
aagtcatttttcccctaacttt

SEQ ID NO: 1346833 - DNA, 22 bp, Artificial Sequence
  chemically synthesized
aagtttaagtcatttttcccct

SEQ ID NO: 1346834 - DNA, 22 bp, Artificial Sequence
  chemically synthesized
ctgaagtttaagtcatttttcc

SEQ ID NO: 1346835 - DNA, 22 bp, Artificial Sequence
  chemically synthesized
ctgctgaagtttaagtcatttt

SEQ ID NO: 1346836 - DNA, 22 bp, Artificial Sequence
  chemically synthesized
ctgctgctgaagtttaagtcat

SEQ ID NO: 1346837 - DNA, 22 bp, Artificial Sequence
  chemically synthesized
cctgctgctgaagtttaagtca

SEQ ID NO: 1346838 - DNA, 22 bp, Artificial Sequence
  chemically synthesized
tcctgctgctgaagtttaagtc

SEQ ID NO: 1346839 - DNA, 22 bp, Artificial Sequence
  chemically synthesized
ttcctgctgctgaagtttaagt

SEQ ID NO: 1346840 - DNA, 22 bp, Artificial Sequence
  chemically synthesized
ggggaaaaatgacttaaacttc

SEQ ID NO: 1346841 - DNA, 22 bp, Artificial Sequence
  chemically synthesized
tcttttcctgctgctgaagttt

SEQ ID NO: 1346842 - DNA, 22 bp, Artificial Sequence
  chemically synthesized
aaacttcagcagcaggaaaaga

SEQ ID NO: 1346843 - DNA, 22 bp, Artificial Sequence
  chemically synthesized
aacttcagcagcaggaaaagat

SEQ ID NO: 1346844 - DNA, 22 bp, Artificial Sequence
  chemically synthesized
cagcagcaggaaaagataatct

SEQ ID NO: 1346845 - DNA, 22 bp, Artificial Sequence
  chemically synthesized
gacagacagtaaagattatctt

SEQ ID NO: 1346846 - DNA, 22 bp, Artificial Sequence
  chemically synthesized
agcagcaggaaaagataatctt

SEQ ID NO: 1346847 - DNA, 22 bp, Artificial Sequence
  chemically synthesized
aaactagacagacagtaaagat

SEQ ID NO: 1346848 - DNA, 22 bp, Artificial Sequence
  chemically synthesized
taaaactagacagacagtaaag

SEQ ID NO: 1346849 - DNA, 22 bp, Artificial Sequence
  chemically synthesized
gatgctctaaaactagacagac

SEQ ID NO: 1346850 - DNA, 22 bp, Artificial Sequence
  chemically synthesized
ttggatgctctaaaactagaca

SEQ ID NO: 1346851 - DNA, 22 bp, Artificial Sequence
  chemically synthesized
attggatgctctaaaactagac

SEQ ID NO: 1346852 - DNA, 22 bp, Artificial Sequence
  chemically synthesized
tttattggatgctctaaaacta

SEQ ID NO: 1346853 - DNA, 22 bp, Artificial Sequence
  chemically synthesized
tactgtctgtctagttttagag

SEQ ID NO: 1346854 - DNA, 22 bp, Artificial Sequence
  chemically synthesized
gtttattggatgctctaaaact

SEQ ID NO: 1346855 - DNA, 22 bp, Artificial Sequence
  chemically synthesized
actgtctgtctagttttagagc

SEQ ID NO: 1346856 - DNA, 22 bp, Artificial Sequence
  chemically synthesized
ctgtctgtctagttttagagca

SEQ ID NO: 1346857 - DNA, 22 bp, Artificial Sequence
  chemically synthesized
ttgtttattggatgctctaaaa

SEQ ID NO: 1346858 - DNA, 22 bp, Artificial Sequence
  chemically synthesized
tctgtctagttttagagcatcc

SEQ ID NO: 1346859 - DNA, 22 bp, Artificial Sequence
  chemically synthesized
tctagttttagagcatccaata

SEQ ID NO: 1346860 - DNA, 22 bp, Artificial Sequence
  chemically synthesized
atggatgttcttgtttattgga

SEQ ID NO: 1346861 - DNA, 22 bp, Artificial Sequence
  chemically synthesized
gttttagagcatccaataaaca

SEQ ID NO: 1346862 - DNA, 22 bp, Artificial Sequence
  chemically synthesized
gatggatgttcttgtttattgg

SEQ ID NO: 1346863 - DNA, 22 bp, Artificial Sequence
  chemically synthesized
tgatggatgttcttgtttattg

SEQ ID NO: 1346864 - DNA, 22 bp, Artificial Sequence
  chemically synthesized
ttgatggatgttcttgtttatt

SEQ ID NO: 1346865 - DNA, 22 bp, Artificial Sequence
  chemically synthesized
tttgatggatgttcttgtttat

SEQ ID NO: 1346866 - DNA, 22 bp, Artificial Sequence
  chemically synthesized
tagagcatccaataaacaagaa

SEQ ID NO: 1346867 - DNA, 22 bp, Artificial Sequence
  chemically synthesized
agagcatccaataaacaagaac

SEQ ID NO: 1346868 - DNA, 22 bp, Artificial Sequence
  chemically synthesized
gagcatccaataaacaagaaca

SEQ ID NO: 1346869 - DNA, 22 bp, Artificial Sequence
  chemically synthesized
aagccaccaaagagttttttga

SEQ ID NO: 1346870 - DNA, 22 bp, Artificial Sequence
  chemically synthesized
ctcaagccaccaaagagttttt

SEQ ID NO: 1346871 - DNA, 22 bp, Artificial Sequence
  chemically synthesized
cctcaagccaccaaagagtttt

SEQ ID NO: 1346872 - DNA, 22 bp, Artificial Sequence
  chemically synthesized
cccacatttcctcaagccacca

SEQ ID NO: 1346873 - DNA, 22 bp, Artificial Sequence
  chemically synthesized
aggcactccccacatttcctca

SEQ ID NO: 1346874 - DNA, 22 bp, Artificial Sequence
  chemically synthesized
tttggtggcttgaggaaatgtg

SEQ ID NO: 1346875 - DNA, 22 bp, Artificial Sequence
  chemically synthesized
tggtggcttgaggaaatgtggg

SEQ ID NO: 1346876 - DNA, 22 bp, Artificial Sequence
  chemically synthesized
ggtggcttgaggaaatgtgggg

SEQ ID NO: 1346877 - DNA, 22 bp, Artificial Sequence
  chemically synthesized
gtggcttgaggaaatgtgggga

SEQ ID NO: 1346878 - DNA, 22 bp, Artificial Sequence
  chemically synthesized
gaggaaatgtggggagtgcctg

SEQ ID NO: 1346879 - DNA, 22 bp, Artificial Sequence
  chemically synthesized
aggaaatgtggggagtgcctga

SEQ ID NO: 1346880 - DNA, 22 bp, Artificial Sequence
  chemically synthesized
acaagaaggatagcgtgatact

SEQ ID NO: 1346881 - DNA, 22 bp, Artificial Sequence
  chemically synthesized
cacaagaaggatagcgtgatac

SEQ ID NO: 1346882 - DNA, 22 bp, Artificial Sequence
  chemically synthesized
tcaaaaatttcacaagaaggat

SEQ ID NO: 1346883 - DNA, 22 bp, Artificial Sequence
  chemically synthesized
agtatcacgctatccttcttgt

SEQ ID NO: 1346884 - DNA, 22 bp, Artificial Sequence
  chemically synthesized
tccttcttgtgaaatttttgat

SEQ ID NO: 1346885 - DNA, 22 bp, Artificial Sequence
  chemically synthesized
cagacatgtattatcaaaaatt

SEQ ID NO: 1346886 - DNA, 22 bp, Artificial Sequence
  chemically synthesized
ctacagacatgtattatcaaaa

SEQ ID NO: 1346887 - DNA, 22 bp, Artificial Sequence
  chemically synthesized
actacagacatgtattatcaaa

SEQ ID NO: 1346888 - DNA, 22 bp, Artificial Sequence
  chemically synthesized
cttgtgaaatttttgataatac

SEQ ID NO: 1346889 - DNA, 22 bp, Artificial Sequence
  chemically synthesized
ttgtgaaatttttgataataca

SEQ ID NO: 1346890 - DNA, 22 bp, Artificial Sequence
  chemically synthesized
gtgaaatttttgataatacatg

SEQ ID NO: 1346891 - DNA, 22 bp, Artificial Sequence
  chemically synthesized
tgaaatttttgataatacatgt

SEQ ID NO: 1346892 - DNA, 22 bp, Artificial Sequence
  chemically synthesized
tgaatcatgcttactacagaca

SEQ ID NO: 1346893 - DNA, 22 bp, Artificial Sequence
  chemically synthesized
ttgataatacatgtctgtagta

SEQ ID NO: 1346894 - DNA, 22 bp, Artificial Sequence
  chemically synthesized
tgataatacatgtctgtagtaa

SEQ ID NO: 1346895 - DNA, 22 bp, Artificial Sequence
  chemically synthesized
gataatacatgtctgtagtaag

SEQ ID NO: 1346896 - DNA, 22 bp, Artificial Sequence
  chemically synthesized
ataatacatgtctgtagtaagc

SEQ ID NO: 1346897 - DNA, 22 bp, Artificial Sequence
  chemically synthesized
gtagttgtgaatcatgcttact

SEQ ID NO: 1346898 - DNA, 22 bp, Artificial Sequence
  chemically synthesized
gttagtagttgtgaatcatgct

SEQ ID NO: 1346899 - DNA, 22 bp, Artificial Sequence
  chemically synthesized
agttagtagttgtgaatcatgc

SEQ ID NO: 1346900 - DNA, 22 bp, Artificial Sequence
  chemically synthesized
tttagttagtagttgtgaatca

SEQ ID NO: 1346901 - DNA, 22 bp, Artificial Sequence
  chemically synthesized
tagtaagcatgattcacaacta

SEQ ID NO: 1346902 - DNA, 22 bp, Artificial Sequence
  chemically synthesized
taaattgtttagttagtagttg

SEQ ID NO: 1346903 - DNA, 22 bp, Artificial Sequence
  chemically synthesized
gaattataaattgtttagttag

SEQ ID NO: 1346904 - DNA, 22 bp, Artificial Sequence
  chemically synthesized
ttggaattataaattgtttagt

SEQ ID NO: 1346905 - DNA, 22 bp, Artificial Sequence
  chemically synthesized
acaactactaactaaacaattt

SEQ ID NO: 1346906 - DNA, 22 bp, Artificial Sequence
  chemically synthesized
ctaactaaacaatttataattc

SEQ ID NO: 1346907 - DNA, 22 bp, Artificial Sequence
  chemically synthesized
ggtgaaattgttggaattataa

SEQ ID NO: 1346908 - DNA, 22 bp, Artificial Sequence
  chemically synthesized
aggtgaaattgttggaattata

SEQ ID NO: 1346909 - DNA, 22 bp, Artificial Sequence
  chemically synthesized
actaaacaatttataattccaa

SEQ ID NO: 1346910 - DNA, 22 bp, Artificial Sequence
  chemically synthesized
aacaatttataattccaacaat

SEQ ID NO: 1346911 - DNA, 22 bp, Artificial Sequence
  chemically synthesized
tgtaatttaggtgaaattgttg

SEQ ID NO: 1346912 - DNA, 22 bp, Artificial Sequence
  chemically synthesized
gtgtaatttaggtgaaattgtt

SEQ ID NO: 1346913 - DNA, 22 bp, Artificial Sequence
  chemically synthesized
tgtgtaatttaggtgaaattgt

SEQ ID NO: 1346914 - DNA, 22 bp, Artificial Sequence
  chemically synthesized
ataattccaacaatttcaccta

SEQ ID NO: 1346915 - DNA, 22 bp, Artificial Sequence
  chemically synthesized
taattccaacaatttcacctaa

SEQ ID NO: 1346916 - DNA, 22 bp, Artificial Sequence
  chemically synthesized
caacaatttcacctaaattaca

SEQ ID NO: 1346917 - DNA, 22 bp, Artificial Sequence
  chemically synthesized
aacacacctttgtgtaatttag

SEQ ID NO: 1346918 - DNA, 22 bp, Artificial Sequence
  chemically synthesized
taaacacacctttgtgtaattt

SEQ ID NO: 1346919 - DNA, 22 bp, Artificial Sequence
  chemically synthesized
cacctaaattacacaaaggtgt

SEQ ID NO: 1346920 - DNA, 22 bp, Artificial Sequence
  chemically synthesized
tatattctaaacacacctttgt

SEQ ID NO: 1346921 - DNA, 22 bp, Artificial Sequence
  chemically synthesized
acctaaattacacaaaggtgtg

SEQ ID NO: 1346922 - DNA, 22 bp, Artificial Sequence
  chemically synthesized
ctgtatattctaaacacacctt

SEQ ID NO: 1346923 - DNA, 22 bp, Artificial Sequence
  chemically synthesized
tcctgtatattctaaacacacc

SEQ ID NO: 1346924 - DNA, 22 bp, Artificial Sequence
  chemically synthesized
aattacacaaaggtgtgtttag

SEQ ID NO: 1346925 - DNA, 22 bp, Artificial Sequence
  chemically synthesized
ttctcctgtatattctaaacac

SEQ ID NO: 1346926 - DNA, 22 bp, Artificial Sequence
  chemically synthesized
cacaaaggtgtgtttagaatat

SEQ ID NO: 1346927 - DNA, 22 bp, Artificial Sequence
  chemically synthesized
gctattctcctgtatattctaa

SEQ ID NO: 1346928 - DNA, 22 bp, Artificial Sequence
  chemically synthesized
atactggctattctcctgtata

SEQ ID NO: 1346929 - DNA, 22 bp, Artificial Sequence
  chemically synthesized
catactggctattctcctgtat

SEQ ID NO: 1346930 - DNA, 22 bp, Artificial Sequence
  chemically synthesized
tcatactggctattctcctgta

SEQ ID NO: 1346931 - DNA, 22 bp, Artificial Sequence
  chemically synthesized
ttcatactggctattctcctgt

SEQ ID NO: 1346932 - DNA, 22 bp, Artificial Sequence
  chemically synthesized
tttcatactggctattctcctg

SEQ ID NO: 1346933 - DNA, 22 bp, Artificial Sequence
  chemically synthesized
ttttcatactggctattctcct

SEQ ID NO: 1346934 - DNA, 22 bp, Artificial Sequence
  chemically synthesized
tttttcatactggctattctcc

SEQ ID NO: 1346935 - DNA, 22 bp, Artificial Sequence
  chemically synthesized
ttttttcatactggctattctc

SEQ ID NO: 1346936 - DNA, 22 bp, Artificial Sequence
  chemically synthesized
agaatatacaggagaatagcca

SEQ ID NO: 1346937 - DNA, 22 bp, Artificial Sequence
  chemically synthesized
gaatatacaggagaatagccag

SEQ ID NO: 1346938 - DNA, 22 bp, Artificial Sequence
  chemically synthesized
aatacatttttttttcatactg

SEQ ID NO: 1346939 - DNA, 22 bp, Artificial Sequence
  chemically synthesized
tgaatacatttttttttcatac

SEQ ID NO: 1346940 - DNA, 22 bp, Artificial Sequence
  chemically synthesized
tctgaatacatttttttttcat

SEQ ID NO: 1346941 - DNA, 22 bp, Artificial Sequence
  chemically synthesized
ctctgaatacatttttttttca

SEQ ID NO: 1346942 - DNA, 22 bp, Artificial Sequence
  chemically synthesized
tctctgaatacatttttttttc

SEQ ID NO: 1346943 - DNA, 22 bp, Artificial Sequence
  chemically synthesized
ttctctgaatacattttttttt

SEQ ID NO: 1346944 - DNA, 22 bp, Artificial Sequence
  chemically synthesized
tcttttctctgaatacattttt

SEQ ID NO: 1346945 - DNA, 22 bp, Artificial Sequence
  chemically synthesized
gtcttttctctgaatacatttt

SEQ ID NO: 1346946 - DNA, 22 bp, Artificial Sequence
  chemically synthesized
tttgtcttttctctgaatacat

SEQ ID NO: 1346947 - DNA, 22 bp, Artificial Sequence
  chemically synthesized
tattatttgtcttttctctgaa

SEQ ID NO: 1346948 - DNA, 22 bp, Artificial Sequence
  chemically synthesized
agctgtattatttgtcttttct

SEQ ID NO: 1346949 - DNA, 22 bp, Artificial Sequence
  chemically synthesized
ctgagctgtattatttgtcttt

SEQ ID NO: 1346950 - DNA, 22 bp, Artificial Sequence
  chemically synthesized
attcctgagctgtattatttgt

SEQ ID NO: 1346951 - DNA, 22 bp, Artificial Sequence
  chemically synthesized
cattcctgagctgtattatttg

SEQ ID NO: 1346952 - DNA, 22 bp, Artificial Sequence
  chemically synthesized
agagaaaagacaaataatacag

SEQ ID NO: 1346953 - DNA, 22 bp, Artificial Sequence
  chemically synthesized
agaaacatttcattcctgagct

SEQ ID NO: 1346954 - DNA, 22 bp, Artificial Sequence
  chemically synthesized
gctgagaaacatttcattcctg

SEQ ID NO: 1346955 - DNA, 22 bp, Artificial Sequence
  chemically synthesized
agctgagaaacatttcattcct

SEQ ID NO: 1346956 - DNA, 22 bp, Artificial Sequence
  chemically synthesized
tgtcgtcccttagctgagaaac

SEQ ID NO: 1346957 - DNA, 22 bp, Artificial Sequence
  chemically synthesized
aggaatgaaatgtttctcagct

SEQ ID NO: 1346958 - DNA, 22 bp, Artificial Sequence
  chemically synthesized
tgatcctatgtcgtcccttagc

SEQ ID NO: 1346959 - DNA, 22 bp, Artificial Sequence
  chemically synthesized
ctcagctaagggacgacatagg

SEQ ID NO: 1346960 - DNA, 22 bp, Artificial Sequence
  chemically synthesized
tcagctaagggacgacatagga

SEQ ID NO: 1346961 - DNA, 22 bp, Artificial Sequence
  chemically synthesized
gatgaattgtgatcctatgtcg

SEQ ID NO: 1346962 - DNA, 22 bp, Artificial Sequence
  chemically synthesized
agctaagggacgacataggatc

SEQ ID NO: 1346963 - DNA, 22 bp, Artificial Sequence
  chemically synthesized
agggacgacataggatcacaat

SEQ ID NO: 1346964 - DNA, 22 bp, Artificial Sequence
  chemically synthesized
cggaaaaaacacctagatgaat

SEQ ID NO: 1346965 - DNA, 22 bp, Artificial Sequence
  chemically synthesized
aaagcaactgcggaaaaaacac

SEQ ID NO: 1346966 - DNA, 22 bp, Artificial Sequence
  chemically synthesized
atctaggtgttttttccgcagt

SEQ ID NO: 1346967 - DNA, 22 bp, Artificial Sequence
  chemically synthesized
ggtgttttttccgcagttgctt

SEQ ID NO: 1346968 - DNA, 22 bp, Artificial Sequence
  chemically synthesized
tataaatatgtactgaaagcaa

SEQ ID NO: 1346969 - DNA, 22 bp, Artificial Sequence
  chemically synthesized
gtataaatatgtactgaaagca

SEQ ID NO: 1346970 - DNA, 22 bp, Artificial Sequence
  chemically synthesized
tttccgcagttgctttcagtac

SEQ ID NO: 1346971 - DNA, 22 bp, Artificial Sequence
  chemically synthesized
ttccgcagttgctttcagtaca

SEQ ID NO: 1346972 - DNA, 22 bp, Artificial Sequence
  chemically synthesized
tttgtataaatatgtactgaaa

SEQ ID NO: 1346973 - DNA, 22 bp, Artificial Sequence
  chemically synthesized
tccgcagttgctttcagtacat

SEQ ID NO: 1346974 - DNA, 22 bp, Artificial Sequence
  chemically synthesized
ccgcagttgctttcagtacata

SEQ ID NO: 1346975 - DNA, 22 bp, Artificial Sequence
  chemically synthesized
tgtttgtataaatatgtactga

SEQ ID NO: 1346976 - DNA, 22 bp, Artificial Sequence
  chemically synthesized
cgcagttgctttcagtacatat

SEQ ID NO: 1346977 - DNA, 22 bp, Artificial Sequence
  chemically synthesized
ttctgtttgtataaatatgtac

SEQ ID NO: 1346978 - DNA, 22 bp, Artificial Sequence
  chemically synthesized
attctgtttgtataaatatgta

SEQ ID NO: 1346979 - DNA, 22 bp, Artificial Sequence
  chemically synthesized
tattctgtttgtataaatatgt

SEQ ID NO: 1346980 - DNA, 22 bp, Artificial Sequence
  chemically synthesized
ttattctgtttgtataaatatg

SEQ ID NO: 1346981 - DNA, 22 bp, Artificial Sequence
  chemically synthesized
ttttattctgtttgtataaata

SEQ ID NO: 1346982 - DNA, 22 bp, Artificial Sequence
  chemically synthesized
ctttcagtacatatttatacaa

SEQ ID NO: 1346983 - DNA, 22 bp, Artificial Sequence
  chemically synthesized
cttttattctgtttgtataaat

SEQ ID NO: 1346984 - DNA, 22 bp, Artificial Sequence
  chemically synthesized
tcagtacatatttatacaaaca

SEQ ID NO: 1346985 - DNA, 22 bp, Artificial Sequence
  chemically synthesized
cagtacatatttatacaaacag

SEQ ID NO: 1346986 - DNA, 22 bp, Artificial Sequence
  chemically synthesized
agtacatatttatacaaacaga

SEQ ID NO: 1346987 - DNA, 22 bp, Artificial Sequence
  chemically synthesized
cggtacttcttttattctgttt

SEQ ID NO: 1346988 - DNA, 22 bp, Artificial Sequence
  chemically synthesized
gttccggtacttcttttattct

SEQ ID NO: 1346989 - DNA, 22 bp, Artificial Sequence
  chemically synthesized
ggttccggtacttcttttattc

SEQ ID NO: 1346990 - DNA, 22 bp, Artificial Sequence
  chemically synthesized
atacaaacagaataaaagaagt

SEQ ID NO: 1346991 - DNA, 22 bp, Artificial Sequence
  chemically synthesized
tttggttccggtacttctttta

SEQ ID NO: 1346992 - DNA, 22 bp, Artificial Sequence
  chemically synthesized
tacaaacagaataaaagaagta

SEQ ID NO: 1346993 - DNA, 22 bp, Artificial Sequence
  chemically synthesized
atttggttccggtacttctttt

SEQ ID NO: 1346994 - DNA, 22 bp, Artificial Sequence
  chemically synthesized
cttatttggttccggtacttct

SEQ ID NO: 1346995 - DNA, 22 bp, Artificial Sequence
  chemically synthesized
ctacttatttggttccggtact

SEQ ID NO: 1346996 - DNA, 22 bp, Artificial Sequence
  chemically synthesized
actacttatttggttccggtac

SEQ ID NO: 1346997 - DNA, 22 bp, Artificial Sequence
  chemically synthesized
tttactacttatttggttccgg

SEQ ID NO: 1346998 - DNA, 22 bp, Artificial Sequence
  chemically synthesized
gtttactacttatttggttccg

SEQ ID NO: 1346999 - DNA, 22 bp, Artificial Sequence
  chemically synthesized
tgtttactacttatttggttcc

SEQ ID NO: 1347000 - DNA, 22 bp, Artificial Sequence
  chemically synthesized
cccctttgtttactacttattt

SEQ ID NO: 1347001 - DNA, 22 bp, Artificial Sequence
  chemically synthesized
ccccctttgtttactacttatt

SEQ ID NO: 1347002 - DNA, 22 bp, Artificial Sequence
  chemically synthesized
tccccctttgtttactacttat

SEQ ID NO: 1347003 - DNA, 22 bp, Artificial Sequence
  chemically synthesized
tttccccctttgtttactactt

SEQ ID NO: 1347004 - DNA, 22 bp, Artificial Sequence
  chemically synthesized
caaaatcatctctttccccctt

SEQ ID NO: 1347005 - DNA, 22 bp, Artificial Sequence
  chemically synthesized
caaattacaaaatcatctcttt

SEQ ID NO: 1347006 - DNA, 22 bp, Artificial Sequence
  chemically synthesized
tgcatgagcattgcaaattaca

SEQ ID NO: 1347007 - DNA, 22 bp, Artificial Sequence
  chemically synthesized
tgtgcatgagcattgcaaatta

SEQ ID NO: 1347008 - DNA, 22 bp, Artificial Sequence
  chemically synthesized
ctgtgcatgagcattgcaaatt

SEQ ID NO: 1347009 - DNA, 22 bp, Artificial Sequence
  chemically synthesized
tctgtgcatgagcattgcaaat

SEQ ID NO: 1347010 - DNA, 22 bp, Artificial Sequence
  chemically synthesized
ttttctgtgcatgagcattgca

SEQ ID NO: 1347011 - DNA, 22 bp, Artificial Sequence
  chemically synthesized
attttctgtgcatgagcattgc

SEQ ID NO: 1347012 - DNA, 22 bp, Artificial Sequence
  chemically synthesized
tattttctgtgcatgagcattg

SEQ ID NO: 1347013 - DNA, 22 bp, Artificial Sequence
  chemically synthesized
tgtaatttgcaatgctcatgca

SEQ ID NO: 1347014 - DNA, 22 bp, Artificial Sequence
  chemically synthesized
gtaatttgcaatgctcatgcac

SEQ ID NO: 1347015 - DNA, 22 bp, Artificial Sequence
  chemically synthesized
attttattttctgtgcatgagc

SEQ ID NO: 1347016 - DNA, 22 bp, Artificial Sequence
  chemically synthesized
taatttgcaatgctcatgcaca

SEQ ID NO: 1347017 - DNA, 22 bp, Artificial Sequence
  chemically synthesized
cattttattttctgtgcatgag

SEQ ID NO: 1347018 - DNA, 22 bp, Artificial Sequence
  chemically synthesized
ccttcattttattttctgtgca

SEQ ID NO: 1347019 - DNA, 22 bp, Artificial Sequence
  chemically synthesized
gcaatgctcatgcacagaaaat

SEQ ID NO: 1347020 - DNA, 22 bp, Artificial Sequence
  chemically synthesized
caatgctcatgcacagaaaata

SEQ ID NO: 1347021 - DNA, 22 bp, Artificial Sequence
  chemically synthesized
ttaccttcattttattttctgt

SEQ ID NO: 1347022 - DNA, 22 bp, Artificial Sequence
  chemically synthesized
ttattaccttcattttattttc

SEQ ID NO: 1347023 - DNA, 22 bp, Artificial Sequence
  chemically synthesized
atgcacagaaaataaaatgaag

SEQ ID NO: 1347024 - DNA, 22 bp, Artificial Sequence
  chemically synthesized
tgctattattaccttcatttta

SEQ ID NO: 1347025 - DNA, 22 bp, Artificial Sequence
  chemically synthesized
gtgctattattaccttcatttt

SEQ ID NO: 1347026 - DNA, 22 bp, Artificial Sequence
  chemically synthesized
tgtgctattattaccttcattt

SEQ ID NO: 1347027 - DNA, 22 bp, Artificial Sequence
  chemically synthesized
ttgtgctattattaccttcatt

SEQ ID NO: 1347028 - DNA, 22 bp, Artificial Sequence
  chemically synthesized
tttgtgctattattaccttcat

SEQ ID NO: 1347029 - DNA, 22 bp, Artificial Sequence
  chemically synthesized
tttttgtgctattattaccttc

SEQ ID NO: 1347030 - DNA, 22 bp, Artificial Sequence
  chemically synthesized
ctttttgtgctattattacctt

SEQ ID NO: 1347031 - DNA, 22 bp, Artificial Sequence
  chemically synthesized
tctttttgtgctattattacct

SEQ ID NO: 1347032 - DNA, 22 bp, Artificial Sequence
  chemically synthesized
ttttctttttgtgctattatta

SEQ ID NO: 1347033 - DNA, 22 bp, Artificial Sequence
  chemically synthesized
gttttctttttgtgctattatt

SEQ ID NO: 1347034 - DNA, 22 bp, Artificial Sequence
  chemically synthesized
atgcccttgttttctttttgtg

SEQ ID NO: 1347035 - DNA, 22 bp, Artificial Sequence
  chemically synthesized
gatgcccttgttttctttttgt

SEQ ID NO: 1347036 - DNA, 22 bp, Artificial Sequence
  chemically synthesized
cttgatgcccttgttttctttt

SEQ ID NO: 1347037 - DNA, 22 bp, Artificial Sequence
  chemically synthesized
acttgatgcccttgttttcttt

SEQ ID NO: 1347038 - DNA, 22 bp, Artificial Sequence
  chemically synthesized
ttacttgatgcccttgttttct

SEQ ID NO: 1347039 - DNA, 22 bp, Artificial Sequence
  chemically synthesized
cttacttgatgcccttgttttc

SEQ ID NO: 1347040 - DNA, 22 bp, Artificial Sequence
  chemically synthesized
ttcttacttgatgcccttgttt

SEQ ID NO: 1347041 - DNA, 22 bp, Artificial Sequence
  chemically synthesized
ctcttcttacttgatgcccttg

SEQ ID NO: 1347042 - DNA, 22 bp, Artificial Sequence
  chemically synthesized
cctcttcttacttgatgccctt

SEQ ID NO: 1347043 - DNA, 22 bp, Artificial Sequence
  chemically synthesized
ttcctcttcttacttgatgccc

SEQ ID NO: 1347044 - DNA, 22 bp, Artificial Sequence
  chemically synthesized
cttcctcttcttacttgatgcc

SEQ ID NO: 1347045 - DNA, 22 bp, Artificial Sequence
  chemically synthesized
tcttcctcttcttacttgatgc

SEQ ID NO: 1347046 - DNA, 22 bp, Artificial Sequence
  chemically synthesized
gttttcttcctcttcttacttg

SEQ ID NO: 1347047 - DNA, 22 bp, Artificial Sequence
  chemically synthesized
ggttttcttcctcttcttactt

SEQ ID NO: 1347048 - DNA, 22 bp, Artificial Sequence
  chemically synthesized
tggttttcttcctcttcttact

SEQ ID NO: 1347049 - DNA, 22 bp, Artificial Sequence
  chemically synthesized
tgtgttttggttttcttcctct

SEQ ID NO: 1347050 - DNA, 22 bp, Artificial Sequence
  chemically synthesized
tcctgtgtgttttggttttctt

SEQ ID NO: 1347051 - DNA, 22 bp, Artificial Sequence
  chemically synthesized
gtcctgtgtgttttggttttct

SEQ ID NO: 1347052 - DNA, 22 bp, Artificial Sequence
  chemically synthesized
ttgtcctgtgtgttttggtttt

SEQ ID NO: 1347053 - DNA, 22 bp, Artificial Sequence
  chemically synthesized
cttgtcctgtgtgttttggttt

SEQ ID NO: 1347054 - DNA, 22 bp, Artificial Sequence
  chemically synthesized
acgccccatcttcttgtcctgt

SEQ ID NO: 1347055 - DNA, 22 bp, Artificial Sequence
  chemically synthesized
aacgccccatcttcttgtcctg

SEQ ID NO: 1347056 - DNA, 22 bp, Artificial Sequence
  chemically synthesized
taacgccccatcttcttgtcct

SEQ ID NO: 1347057 - DNA, 22 bp, Artificial Sequence
  chemically synthesized
ttttaacgccccatcttcttgt

SEQ ID NO: 1347058 - DNA, 22 bp, Artificial Sequence
  chemically synthesized
gttttaacgccccatcttcttg

SEQ ID NO: 1347059 - DNA, 22 bp, Artificial Sequence
  chemically synthesized
ttgttttaacgccccatcttct

SEQ ID NO: 1347060 - DNA, 22 bp, Artificial Sequence
  chemically synthesized
cttgttttaacgccccatcttc

SEQ ID NO: 1347061 - DNA, 22 bp, Artificial Sequence
  chemically synthesized
tcttgttttaacgccccatctt

SEQ ID NO: 1347062 - DNA, 22 bp, Artificial Sequence
  chemically synthesized
gagctttcttgttttaacgccc

SEQ ID NO: 1347063 - DNA, 22 bp, Artificial Sequence
  chemically synthesized
cactagagctttcttgttttaa

SEQ ID NO: 1347064 - DNA, 22 bp, Artificial Sequence
  chemically synthesized
ctccactagagctttcttgttt

SEQ ID NO: 1347065 - DNA, 22 bp, Artificial Sequence
  chemically synthesized
ctgctccactagagctttcttg

SEQ ID NO: 1347066 - DNA, 22 bp, Artificial Sequence
  chemically synthesized
agttactgctccactagagctt

SEQ ID NO: 1347067 - DNA, 22 bp, Artificial Sequence
  chemically synthesized
aaacaagaaagctctagtggag

SEQ ID NO: 1347068 - DNA, 22 bp, Artificial Sequence
  chemically synthesized
ccctcagttactgctccactag

SEQ ID NO: 1347069 - DNA, 22 bp, Artificial Sequence
  chemically synthesized
accctcagttactgctccacta

SEQ ID NO: 1347070 - DNA, 22 bp, Artificial Sequence
  chemically synthesized
taccctcagttactgctccact

SEQ ID NO: 1347071 - DNA, 22 bp, Artificial Sequence
  chemically synthesized
ctttaccctcagttactgctcc

SEQ ID NO: 1347072 - DNA, 22 bp, Artificial Sequence
  chemically synthesized
cctttaccctcagttactgctc

SEQ ID NO: 1347073 - DNA, 22 bp, Artificial Sequence
  chemically synthesized
tagtggagcagtaactgagggt

SEQ ID NO: 1347074 - DNA, 22 bp, Artificial Sequence
  chemically synthesized
agcgcttcctttaccctcagtt

SEQ ID NO: 1347075 - DNA, 22 bp, Artificial Sequence
  chemically synthesized
gagcgcttcctttaccctcagt

SEQ ID NO: 1347076 - DNA, 22 bp, Artificial Sequence
  chemically synthesized
gtggagcagtaactgagggtaa

SEQ ID NO: 1347077 - DNA, 22 bp, Artificial Sequence
  chemically synthesized
tacatcaaaacttgagcgcttc

SEQ ID NO: 1347078 - DNA, 22 bp, Artificial Sequence
  chemically synthesized
agggtaaaggaagcgctcaagt

SEQ ID NO: 1347079 - DNA, 22 bp, Artificial Sequence
  chemically synthesized
ctatacatcaaaacttgagcgc

SEQ ID NO: 1347080 - DNA, 22 bp, Artificial Sequence
  chemically synthesized
cctatacatcaaaacttgagcg

SEQ ID NO: 1347081 - DNA, 22 bp, Artificial Sequence
  chemically synthesized
cttcctatacatcaaaacttga

SEQ ID NO: 1347082 - DNA, 22 bp, Artificial Sequence
  chemically synthesized
gcttcctatacatcaaaacttg

SEQ ID NO: 1347083 - DNA, 22 bp, Artificial Sequence
  chemically synthesized
tgcttcctatacatcaaaactt

SEQ ID NO: 1347084 - DNA, 22 bp, Artificial Sequence
  chemically synthesized
tttgcttcctatacatcaaaac

SEQ ID NO: 1347085 - DNA, 22 bp, Artificial Sequence
  chemically synthesized
ctttgcttcctatacatcaaaa

SEQ ID NO: 1347086 - DNA, 22 bp, Artificial Sequence
  chemically synthesized
ccttctttgcttcctatacatc

SEQ ID NO: 1347087 - DNA, 22 bp, Artificial Sequence
  chemically synthesized
aagttttgatgtataggaagca

SEQ ID NO: 1347088 - DNA, 22 bp, Artificial Sequence
  chemically synthesized
agttaccttctttgcttcctat

SEQ ID NO: 1347089 - DNA, 22 bp, Artificial Sequence
  chemically synthesized
cagttaccttctttgcttccta

SEQ ID NO: 1347090 - DNA, 22 bp, Artificial Sequence
  chemically synthesized
tcagttaccttctttgcttcct

SEQ ID NO: 1347091 - DNA, 22 bp, Artificial Sequence
  chemically synthesized
tgatgtataggaagcaaagaag

SEQ ID NO: 1347092 - DNA, 22 bp, Artificial Sequence
  chemically synthesized
gatgtataggaagcaaagaagg

SEQ ID NO: 1347093 - DNA, 22 bp, Artificial Sequence
  chemically synthesized
atgtataggaagcaaagaaggt

SEQ ID NO: 1347094 - DNA, 22 bp, Artificial Sequence
  chemically synthesized
atcactttcagttaccttcttt

SEQ ID NO: 1347095 - DNA, 22 bp, Artificial Sequence
  chemically synthesized
ccaaaacaacatcattaatcac

SEQ ID NO: 1347096 - DNA, 22 bp, Artificial Sequence
  chemically synthesized
ttgccaaaacaacatcattaat

SEQ ID NO: 1347097 - DNA, 22 bp, Artificial Sequence
  chemically synthesized
tgttgccaaaacaacatcatta

SEQ ID NO: 1347098 - DNA, 22 bp, Artificial Sequence
  chemically synthesized
ttctgttgccaaaacaacatca

SEQ ID NO: 1347099 - DNA, 22 bp, Artificial Sequence
  chemically synthesized
aaagtgattaatgatgttgttt

SEQ ID NO: 1347100 - DNA, 22 bp, Artificial Sequence
  chemically synthesized
ctattctgttgccaaaacaaca

SEQ ID NO: 1347101 - DNA, 22 bp, Artificial Sequence
  chemically synthesized
atctgctattctgttgccaaaa

SEQ ID NO: 1347102 - DNA, 22 bp, Artificial Sequence
  chemically synthesized
aatctgctattctgttgccaaa

SEQ ID NO: 1347103 - DNA, 22 bp, Artificial Sequence
  chemically synthesized
atgatgttgttttggcaacaga

SEQ ID NO: 1347104 - DNA, 22 bp, Artificial Sequence
  chemically synthesized
cccttaatctgctattctgttg

SEQ ID NO: 1347105 - DNA, 22 bp, Artificial Sequence
  chemically synthesized
ttttggcaacagaatagcagat

SEQ ID NO: 1347106 - DNA, 22 bp, Artificial Sequence
  chemically synthesized
tggcaacagaatagcagattaa

SEQ ID NO: 1347107 - DNA, 22 bp, Artificial Sequence
  chemically synthesized
agaaagctgcccttaatctgct

SEQ ID NO: 1347108 - DNA, 22 bp, Artificial Sequence
  chemically synthesized
ggcaacagaatagcagattaag

SEQ ID NO: 1347109 - DNA, 22 bp, Artificial Sequence
  chemically synthesized
gcaacagaatagcagattaagg

SEQ ID NO: 1347110 - DNA, 22 bp, Artificial Sequence
  chemically synthesized
caatcagttcagaaagctgccc

SEQ ID NO: 1347111 - DNA, 22 bp, Artificial Sequence
  chemically synthesized
ccaatcagttcagaaagctgcc

SEQ ID NO: 1347112 - DNA, 22 bp, Artificial Sequence
  chemically synthesized
tccaatcagttcagaaagctgc

SEQ ID NO: 1347113 - DNA, 22 bp, Artificial Sequence
  chemically synthesized
agggcagctttctgaactgatt

SEQ ID NO: 1347114 - DNA, 22 bp, Artificial Sequence
  chemically synthesized
agcatcctttccaatcagttca

SEQ ID NO: 1347115 - DNA, 22 bp, Artificial Sequence
  chemically synthesized
cagcatcctttccaatcagttc

SEQ ID NO: 1347116 - DNA, 22 bp, Artificial Sequence
  chemically synthesized
cttcagcatcctttccaatcag

SEQ ID NO: 1347117 - DNA, 22 bp, Artificial Sequence
  chemically synthesized
ccttcagcatcctttccaatca

SEQ ID NO: 1347118 - DNA, 22 bp, Artificial Sequence
  chemically synthesized
cttccttcagcatcctttccaa

SEQ ID NO: 1347119 - DNA, 22 bp, Artificial Sequence
  chemically synthesized
ccttccttcagcatcctttcca

SEQ ID NO: 1347120 - DNA, 22 bp, Artificial Sequence
  chemically synthesized
tctgaactgattggaaaggatg

SEQ ID NO: 1347121 - DNA, 22 bp, Artificial Sequence
  chemically synthesized
tccttccttcagcatcctttcc

SEQ ID NO: 1347122 - DNA, 22 bp, Artificial Sequence
  chemically synthesized
ctgaactgattggaaaggatgc

SEQ ID NO: 1347123 - DNA, 22 bp, Artificial Sequence
  chemically synthesized
tgaactgattggaaaggatgct

SEQ ID NO: 1347124 - DNA, 22 bp, Artificial Sequence
  chemically synthesized
aactgattggaaaggatgctga

SEQ ID NO: 1347125 - DNA, 22 bp, Artificial Sequence
  chemically synthesized
agcacctttccttccttcagca

SEQ ID NO: 1347126 - DNA, 22 bp, Artificial Sequence
  chemically synthesized
attggaaaggatgctgaaggaa

SEQ ID NO: 1347127 - DNA, 22 bp, Artificial Sequence
  chemically synthesized
gaaaggatgctgaaggaaggaa

SEQ ID NO: 1347128 - DNA, 22 bp, Artificial Sequence
  chemically synthesized
ccacactgagcacctttccttc

SEQ ID NO: 1347129 - DNA, 22 bp, Artificial Sequence
  chemically synthesized
cccacactgagcacctttcctt

SEQ ID NO: 1347130 - DNA, 22 bp, Artificial Sequence
  chemically synthesized
cgatttcccacactgagcacct

SEQ ID NO: 1347131 - DNA, 22 bp, Artificial Sequence
  chemically synthesized
aaggaaggaaaggtgctcagtg

SEQ ID NO: 1347132 - DNA, 22 bp, Artificial Sequence
  chemically synthesized
ccatctccgatttcccacactg

SEQ ID NO: 1347133 - DNA, 22 bp, Artificial Sequence
  chemically synthesized
tatcctgccatctccgatttcc

SEQ ID NO: 1347134 - DNA, 22 bp, Artificial Sequence
  chemically synthesized
ctgtatcctgccatctccgatt

SEQ ID NO: 1347135 - DNA, 22 bp, Artificial Sequence
  chemically synthesized
agtgtgggaaatcggagatggc

SEQ ID NO: 1347136 - DNA, 22 bp, Artificial Sequence
  chemically synthesized
gtattcctgtatcctgccatct

SEQ ID NO: 1347137 - DNA, 22 bp, Artificial Sequence
  chemically synthesized
acctggtattcctgtatcctgc

SEQ ID NO: 1347138 - DNA, 22 bp, Artificial Sequence
  chemically synthesized
gacctggtattcctgtatcctg

SEQ ID NO: 1347139 - DNA, 22 bp, Artificial Sequence
  chemically synthesized
ttgacctggtattcctgtatcc

SEQ ID NO: 1347140 - DNA, 22 bp, Artificial Sequence
  chemically synthesized
tcttgacctggtattcctgtat

SEQ ID NO: 1347141 - DNA, 22 bp, Artificial Sequence
  chemically synthesized
agatctctcttgacctggtatt

SEQ ID NO: 1347142 - DNA, 22 bp, Artificial Sequence
  chemically synthesized
ctgagatctctcttgacctggt

SEQ ID NO: 1347143 - DNA, 22 bp, Artificial Sequence
  chemically synthesized
gaatatactactgagatctctc

SEQ ID NO: 1347144 - DNA, 22 bp, Artificial Sequence
  chemically synthesized
aaacctagaatatactactgag

SEQ ID NO: 1347145 - DNA, 22 bp, Artificial Sequence
  chemically synthesized
aaaacctagaatatactactga

SEQ ID NO: 1347146 - DNA, 22 bp, Artificial Sequence
  chemically synthesized
taaaacctagaatatactactg

SEQ ID NO: 1347147 - DNA, 22 bp, Artificial Sequence
  chemically synthesized
ttaaaacctagaatatactact

SEQ ID NO: 1347148 - DNA, 22 bp, Artificial Sequence
  chemically synthesized
tatttttaaaacctagaatata

SEQ ID NO: 1347149 - DNA, 22 bp, Artificial Sequence
  chemically synthesized
cattatatttttaaaacctaga

SEQ ID NO: 1347150 - DNA, 22 bp, Artificial Sequence
  chemically synthesized
agtagtatattctaggttttaa

SEQ ID NO: 1347151 - DNA, 22 bp, Artificial Sequence
  chemically synthesized
tatcaatcactccattatattt

SEQ ID NO: 1347152 - DNA, 22 bp, Artificial Sequence
  chemically synthesized
taggttttaaaaatataatgga

SEQ ID NO: 1347153 - DNA, 22 bp, Artificial Sequence
  chemically synthesized
ggttttaaaaatataatggagt

SEQ ID NO: 1347154 - DNA, 22 bp, Artificial Sequence
  chemically synthesized
aaactatatcaatcactccatt

SEQ ID NO: 1347155 - DNA, 22 bp, Artificial Sequence
  chemically synthesized
taaaaatataatggagtgattg

SEQ ID NO: 1347156 - DNA, 22 bp, Artificial Sequence
  chemically synthesized
ttcaaactatatcaatcactcc

SEQ ID NO: 1347157 - DNA, 22 bp, Artificial Sequence
  chemically synthesized
aaaaatataatggagtgattga

SEQ ID NO: 1347158 - DNA, 22 bp, Artificial Sequence
  chemically synthesized
aaaatataatggagtgattgat

SEQ ID NO: 1347159 - DNA, 22 bp, Artificial Sequence
  chemically synthesized
ctattcaaactatatcaatcac

SEQ ID NO: 1347160 - DNA, 22 bp, Artificial Sequence
  chemically synthesized
gactactattcaaactatatca

SEQ ID NO: 1347161 - DNA, 22 bp, Artificial Sequence
  chemically synthesized
acacctagactactattcaaac

SEQ ID NO: 1347162 - DNA, 22 bp, Artificial Sequence
  chemically synthesized
taacacctagactactattcaa

SEQ ID NO: 1347163 - DNA, 22 bp, Artificial Sequence
  chemically synthesized
ctaacacctagactactattca

SEQ ID NO: 1347164 - DNA, 22 bp, Artificial Sequence
  chemically synthesized
tctaacacctagactactattc

SEQ ID NO: 1347165 - DNA, 22 bp, Artificial Sequence
  chemically synthesized
tttctaacacctagactactat

SEQ ID NO: 1347166 - DNA, 22 bp, Artificial Sequence
  chemically synthesized
atatagtttgaatagtagtcta

SEQ ID NO: 1347167 - DNA, 22 bp, Artificial Sequence
  chemically synthesized
tgtctctttctaacacctagac

SEQ ID NO: 1347168 - DNA, 22 bp, Artificial Sequence
  chemically synthesized
gaatagtagtctaggtgttaga

SEQ ID NO: 1347169 - DNA, 22 bp, Artificial Sequence
  chemically synthesized
aatagtagtctaggtgttagaa

SEQ ID NO: 1347170 - DNA, 22 bp, Artificial Sequence
  chemically synthesized
agctgtgtctctttctaacacc

SEQ ID NO: 1347171 - DNA, 22 bp, Artificial Sequence
  chemically synthesized
ttgagctgtgtctctttctaac

SEQ ID NO: 1347172 - DNA, 22 bp, Artificial Sequence
  chemically synthesized
ggtgttagaaagagacacagct

SEQ ID NO: 1347173 - DNA, 22 bp, Artificial Sequence
  chemically synthesized
ataatgatattgttgagctgtg

SEQ ID NO: 1347174 - DNA, 22 bp, Artificial Sequence
  chemically synthesized
gaaagagacacagctcaacaat

SEQ ID NO: 1347175 - DNA, 22 bp, Artificial Sequence
  chemically synthesized
agcgatgattgataatgatatt

SEQ ID NO: 1347176 - DNA, 22 bp, Artificial Sequence
  chemically synthesized
tcagcgatgattgataatgata

SEQ ID NO: 1347177 - DNA, 22 bp, Artificial Sequence
  chemically synthesized
ctcagcgatgattgataatgat

SEQ ID NO: 1347178 - DNA, 22 bp, Artificial Sequence
  chemically synthesized
tctcagcgatgattgataatga

SEQ ID NO: 1347179 - DNA, 22 bp, Artificial Sequence
  chemically synthesized
ttctcagcgatgattgataatg

SEQ ID NO: 1347180 - DNA, 22 bp, Artificial Sequence
  chemically synthesized
aacaatatcattatcaatcatc

SEQ ID NO: 1347181 - DNA, 22 bp, Artificial Sequence
  chemically synthesized
ccttttctcagcgatgattgat

SEQ ID NO: 1347182 - DNA, 22 bp, Artificial Sequence
  chemically synthesized
gccttttctcagcgatgattga

SEQ ID NO: 1347183 - DNA, 22 bp, Artificial Sequence
  chemically synthesized
cttgccttttctcagcgatgat

SEQ ID NO: 1347184 - DNA, 22 bp, Artificial Sequence
  chemically synthesized
ctccttgccttttctcagcgat

SEQ ID NO: 1347185 - DNA, 22 bp, Artificial Sequence
  chemically synthesized
aattactccttgccttttctca

SEQ ID NO: 1347186 - DNA, 22 bp, Artificial Sequence
  chemically synthesized
tcaatcatcgctgagaaaaggc

SEQ ID NO: 1347187 - DNA, 22 bp, Artificial Sequence
  chemically synthesized
ttaaattactccttgccttttc

SEQ ID NO: 1347188 - DNA, 22 bp, Artificial Sequence
  chemically synthesized
ctgttaaattactccttgcctt

SEQ ID NO: 1347189 - DNA, 22 bp, Artificial Sequence
  chemically synthesized
tcattcctgttaaattactcct

SEQ ID NO: 1347190 - DNA, 22 bp, Artificial Sequence
  chemically synthesized
atcattcctgttaaattactcc

SEQ ID NO: 1347191 - DNA, 22 bp, Artificial Sequence
  chemically synthesized
agaaaaggcaaggagtaattta

SEQ ID NO: 1347192 - DNA, 22 bp, Artificial Sequence
  chemically synthesized
taagcttatcattcctgttaaa

SEQ ID NO: 1347193 - DNA, 22 bp, Artificial Sequence
  chemically synthesized
ctgtaagcttatcattcctgtt

SEQ ID NO: 1347194 - DNA, 22 bp, Artificial Sequence
  chemically synthesized
cctgtaagcttatcattcctgt

SEQ ID NO: 1347195 - DNA, 22 bp, Artificial Sequence
  chemically synthesized
atttcctgtaagcttatcattc

SEQ ID NO: 1347196 - DNA, 22 bp, Artificial Sequence
  chemically synthesized
aatttcctgtaagcttatcatt

SEQ ID NO: 1347197 - DNA, 22 bp, Artificial Sequence
  chemically synthesized
taatttcctgtaagcttatcat

SEQ ID NO: 1347198 - DNA, 22 bp, Artificial Sequence
  chemically synthesized
ttaatttcctgtaagcttatca

SEQ ID NO: 1347199 - DNA, 22 bp, Artificial Sequence
  chemically synthesized
aacaggaatgataagcttacag

SEQ ID NO: 1347200 - DNA, 22 bp, Artificial Sequence
  chemically synthesized
acttttaatttcctgtaagctt

SEQ ID NO: 1347201 - DNA, 22 bp, Artificial Sequence
  chemically synthesized
acaggaatgataagcttacagg

SEQ ID NO: 1347202 - DNA, 22 bp, Artificial Sequence
  chemically synthesized
cacttttaatttcctgtaagct

SEQ ID NO: 1347203 - DNA, 22 bp, Artificial Sequence
  chemically synthesized
tttcacttttaatttcctgtaa

SEQ ID NO: 1347204 - DNA, 22 bp, Artificial Sequence
  chemically synthesized
atttcacttttaatttcctgta

SEQ ID NO: 1347205 - DNA, 22 bp, Artificial Sequence
  chemically synthesized
atatatcttatttcacttttaa

SEQ ID NO: 1347206 - DNA, 22 bp, Artificial Sequence
  chemically synthesized
tcatatatcttatttcactttt

SEQ ID NO: 1347207 - DNA, 22 bp, Artificial Sequence
  chemically synthesized
ctcatatatcttatttcacttt

SEQ ID NO: 1347208 - DNA, 22 bp, Artificial Sequence
  chemically synthesized
acaggaaattaaaagtgaaata

SEQ ID NO: 1347209 - DNA, 22 bp, Artificial Sequence
  chemically synthesized
caggaaattaaaagtgaaataa

SEQ ID NO: 1347210 - DNA, 22 bp, Artificial Sequence
  chemically synthesized
acatcttctcatatatcttatt

SEQ ID NO: 1347211 - DNA, 22 bp, Artificial Sequence
  chemically synthesized
tcacatcttctcatatatctta

SEQ ID NO: 1347212 - DNA, 22 bp, Artificial Sequence
  chemically synthesized
ctcacatcttctcatatatctt

SEQ ID NO: 1347213 - DNA, 22 bp, Artificial Sequence
  chemically synthesized
tctcacatcttctcatatatct

SEQ ID NO: 1347214 - DNA, 22 bp, Artificial Sequence
  chemically synthesized
aaagtgaaataagatatatgag

SEQ ID NO: 1347215 - DNA, 22 bp, Artificial Sequence
  chemically synthesized
tttctcacatcttctcatatat

SEQ ID NO: 1347216 - DNA, 22 bp, Artificial Sequence
  chemically synthesized
atctctttctcacatcttctca

SEQ ID NO: 1347217 - DNA, 22 bp, Artificial Sequence
  chemically synthesized
ttaatctctttctcacatcttc

SEQ ID NO: 1347218 - DNA, 22 bp, Artificial Sequence
  chemically synthesized
aagaataatcctgttaatctct

SEQ ID NO: 1347219 - DNA, 22 bp, Artificial Sequence
  chemically synthesized
aaagaataatcctgttaatctc

SEQ ID NO: 1347220 - DNA, 22 bp, Artificial Sequence
  chemically synthesized
taaagaataatcctgttaatct

SEQ ID NO: 1347221 - DNA, 22 bp, Artificial Sequence
  chemically synthesized
catgttttaaagaataatcctg

SEQ ID NO: 1347222 - DNA, 22 bp, Artificial Sequence
  chemically synthesized
ccatgttttaaagaataatcct

SEQ ID NO: 1347223 - DNA, 22 bp, Artificial Sequence
  chemically synthesized
cttccatgttttaaagaataat

SEQ ID NO: 1347224 - DNA, 22 bp, Artificial Sequence
  chemically synthesized
acttccatgttttaaagaataa

SEQ ID NO: 1347225 - DNA, 22 bp, Artificial Sequence
  chemically synthesized
acaggattattctttaaaacat

SEQ ID NO: 1347226 - DNA, 22 bp, Artificial Sequence
  chemically synthesized
aaatttacttccatgttttaaa

SEQ ID NO: 1347227 - DNA, 22 bp, Artificial Sequence
  chemically synthesized
tcaaatttacttccatgtttta

SEQ ID NO: 1347228 - DNA, 22 bp, Artificial Sequence
  chemically synthesized
ctcaaatttacttccatgtttt

SEQ ID NO: 1347229 - DNA, 22 bp, Artificial Sequence
  chemically synthesized
ttctttaaaacatggaagtaaa

SEQ ID NO: 1347230 - DNA, 22 bp, Artificial Sequence
  chemically synthesized
tttaaaacatggaagtaaattt

SEQ ID NO: 1347231 - DNA, 22 bp, Artificial Sequence
  chemically synthesized
taaaacatggaagtaaatttga

SEQ ID NO: 1347232 - DNA, 22 bp, Artificial Sequence
  chemically synthesized
aaaacatggaagtaaatttgag

SEQ ID NO: 1347233 - DNA, 22 bp, Artificial Sequence
  chemically synthesized
aaacatggaagtaaatttgaga

SEQ ID NO: 1347234 - DNA, 22 bp, Artificial Sequence
  chemically synthesized
gaaagggaaatgtttctcaaat

SEQ ID NO: 1347235 - DNA, 22 bp, Artificial Sequence
  chemically synthesized
ggaaagggaaatgtttctcaaa

SEQ ID NO: 1347236 - DNA, 22 bp, Artificial Sequence
  chemically synthesized
tttggaaagggaaatgtttctc

SEQ ID NO: 1347237 - DNA, 22 bp, Artificial Sequence
  chemically synthesized
ttatttggaaagggaaatgttt

SEQ ID NO: 1347238 - DNA, 22 bp, Artificial Sequence
  chemically synthesized
gagaaacatttccctttccaaa

SEQ ID NO: 1347239 - DNA, 22 bp, Artificial Sequence
  chemically synthesized
agaaacatttccctttccaaat

SEQ ID NO: 1347240 - DNA, 22 bp, Artificial Sequence
  chemically synthesized
ggagtatgggttattatttgga

SEQ ID NO: 1347241 - DNA, 22 bp, Artificial Sequence
  chemically synthesized
aggagtatgggttattatttgg

SEQ ID NO: 1347242 - DNA, 22 bp, Artificial Sequence
  chemically synthesized
atttaggagtatgggttattat

SEQ ID NO: 1347243 - DNA, 22 bp, Artificial Sequence
  chemically synthesized
aatttaggagtatgggttatta

SEQ ID NO: 1347244 - DNA, 22 bp, Artificial Sequence
  chemically synthesized
ccctttccaaataataacccat

SEQ ID NO: 1347245 - DNA, 22 bp, Artificial Sequence
  chemically synthesized
taatttaggagtatgggttatt

SEQ ID NO: 1347246 - DNA, 22 bp, Artificial Sequence
  chemically synthesized
cctttccaaataataacccata

SEQ ID NO: 1347247 - DNA, 22 bp, Artificial Sequence
  chemically synthesized
tccaaataataacccatactcc

SEQ ID NO: 1347248 - DNA, 22 bp, Artificial Sequence
  chemically synthesized
ccaaataataacccatactcct

SEQ ID NO: 1347249 - DNA, 22 bp, Artificial Sequence
  chemically synthesized
caaataataacccatactccta

SEQ ID NO: 1347250 - DNA, 22 bp, Artificial Sequence
  chemically synthesized
accataagttttaatttaggag

SEQ ID NO: 1347251 - DNA, 22 bp, Artificial Sequence
  chemically synthesized
caccataagttttaatttagga

SEQ ID NO: 1347252 - DNA, 22 bp, Artificial Sequence
  chemically synthesized
tttcaccataagttttaattta

SEQ ID NO: 1347253 - DNA, 22 bp, Artificial Sequence
  chemically synthesized
tattatttcaccataagtttta

SEQ ID NO: 1347254 - DNA, 22 bp, Artificial Sequence
  chemically synthesized
tgctgtattatttcaccataag

SEQ ID NO: 1347255 - DNA, 22 bp, Artificial Sequence
  chemically synthesized
ctaaattaaaacttatggtgaa

SEQ ID NO: 1347256 - DNA, 22 bp, Artificial Sequence
  chemically synthesized
aattaaaacttatggtgaaata

SEQ ID NO: 1347257 - DNA, 22 bp, Artificial Sequence
  chemically synthesized
aaacttatggtgaaataataca

SEQ ID NO: 1347258 - DNA, 22 bp, Artificial Sequence
  chemically synthesized
atggtgaaataatacagcataa

SEQ ID NO: 1347259 - DNA, 22 bp, Artificial Sequence
  chemically synthesized
tggtgaaataatacagcataat

SEQ ID NO: 1347260 - DNA, 22 bp, Artificial Sequence
  chemically synthesized
atccgtatgtagaaaattatgc

SEQ ID NO: 1347261 - DNA, 22 bp, Artificial Sequence
  chemically synthesized
aattcatccgtatgtagaaaat

SEQ ID NO: 1347262 - DNA, 22 bp, Artificial Sequence
  chemically synthesized
ctgaattcatccgtatgtagaa

SEQ ID NO: 1347263 - DNA, 22 bp, Artificial Sequence
  chemically synthesized
actgaattcatccgtatgtaga

SEQ ID NO: 1347264 - DNA, 22 bp, Artificial Sequence
  chemically synthesized
cttactgaattcatccgtatgt

SEQ ID NO: 1347265 - DNA, 22 bp, Artificial Sequence
  chemically synthesized
tccttactgaattcatccgtat

SEQ ID NO: 1347266 - DNA, 22 bp, Artificial Sequence
  chemically synthesized
ctccttactgaattcatccgta

SEQ ID NO: 1347267 - DNA, 22 bp, Artificial Sequence
  chemically synthesized
tctacatacggatgaattcagt

SEQ ID NO: 1347268 - DNA, 22 bp, Artificial Sequence
  chemically synthesized
ctacatacggatgaattcagta

SEQ ID NO: 1347269 - DNA, 22 bp, Artificial Sequence
  chemically synthesized
agtatttctccttactgaattc

SEQ ID NO: 1347270 - DNA, 22 bp, Artificial Sequence
  chemically synthesized
tacatacggatgaattcagtaa

SEQ ID NO: 1347271 - DNA, 22 bp, Artificial Sequence
  chemically synthesized
catacggatgaattcagtaagg

SEQ ID NO: 1347272 - DNA, 22 bp, Artificial Sequence
  chemically synthesized
gaaattaagtatttctccttac

SEQ ID NO: 1347273 - DNA, 22 bp, Artificial Sequence
  chemically synthesized
agaaattaagtatttctcctta

SEQ ID NO: 1347274 - DNA, 22 bp, Artificial Sequence
  chemically synthesized
tagaaattaagtatttctcctt

SEQ ID NO: 1347275 - DNA, 22 bp, Artificial Sequence
  chemically synthesized
ttagaaattaagtatttctcct

SEQ ID NO: 1347276 - DNA, 22 bp, Artificial Sequence
  chemically synthesized
aatttttagaaattaagtattt

SEQ ID NO: 1347277 - DNA, 22 bp, Artificial Sequence
  chemically synthesized
caatttttagaaattaagtatt

SEQ ID NO: 1347278 - DNA, 22 bp, Artificial Sequence
  chemically synthesized
tcaatttttagaaattaagtat

SEQ ID NO: 1347279 - DNA, 22 bp, Artificial Sequence
  chemically synthesized
agtaaggagaaatacttaattt

SEQ ID NO: 1347280 - DNA, 22 bp, Artificial Sequence
  chemically synthesized
cgctttcaatttttagaaatta

SEQ ID NO: 1347281 - DNA, 22 bp, Artificial Sequence
  chemically synthesized
gcgctttcaatttttagaaatt

SEQ ID NO: 1347282 - DNA, 22 bp, Artificial Sequence
  chemically synthesized
tgcgctttcaatttttagaaat

SEQ ID NO: 1347283 - DNA, 22 bp, Artificial Sequence
  chemically synthesized
aatttctaaaaattgaaagcgc

SEQ ID NO: 1347284 - DNA, 22 bp, Artificial Sequence
  chemically synthesized
atttctaaaaattgaaagcgca

SEQ ID NO: 1347285 - DNA, 22 bp, Artificial Sequence
  chemically synthesized
ctaaaaattgaaagcgcaaagt

SEQ ID NO: 1347286 - DNA, 22 bp, Artificial Sequence
  chemically synthesized
caaatcaaaataactttgcgct

SEQ ID NO: 1347287 - DNA, 22 bp, Artificial Sequence
  chemically synthesized
taaaaattgaaagcgcaaagtt

SEQ ID NO: 1347288 - DNA, 22 bp, Artificial Sequence
  chemically synthesized
acaaatcaaaataactttgcgc

SEQ ID NO: 1347289 - DNA, 22 bp, Artificial Sequence
  chemically synthesized
tacaaatcaaaataactttgcg

SEQ ID NO: 1347290 - DNA, 22 bp, Artificial Sequence
  chemically synthesized
aaaattgaaagcgcaaagttat

SEQ ID NO: 1347291 - DNA, 22 bp, Artificial Sequence
  chemically synthesized
aaaactttacaaatcaaaataa

SEQ ID NO: 1347292 - DNA, 22 bp, Artificial Sequence
  chemically synthesized
aaagcgcaaagttattttgatt

SEQ ID NO: 1347293 - DNA, 22 bp, Artificial Sequence
  chemically synthesized
ttttgatttgtaaagttttcag

SEQ ID NO: 1347294 - DNA, 22 bp, Artificial Sequence
  chemically synthesized
atagaggaatgatctgaaaact

SEQ ID NO: 1347295 - DNA, 22 bp, Artificial Sequence
  chemically synthesized
aatagaggaatgatctgaaaac

SEQ ID NO: 1347296 - DNA, 22 bp, Artificial Sequence
  chemically synthesized
tgatttgtaaagttttcagatc

SEQ ID NO: 1347297 - DNA, 22 bp, Artificial Sequence
  chemically synthesized
gatttgtaaagttttcagatca

SEQ ID NO: 1347298 - DNA, 22 bp, Artificial Sequence
  chemically synthesized
atttgtaaagttttcagatcat

SEQ ID NO: 1347299 - DNA, 22 bp, Artificial Sequence
  chemically synthesized
atatttaatagaggaatgatct

SEQ ID NO: 1347300 - DNA, 22 bp, Artificial Sequence
  chemically synthesized
gtaaagttttcagatcattcct

SEQ ID NO: 1347301 - DNA, 22 bp, Artificial Sequence
  chemically synthesized
taaagttttcagatcattcctc

SEQ ID NO: 1347302 - DNA, 22 bp, Artificial Sequence
  chemically synthesized
tcagatcattcctctattaaat

SEQ ID NO: 1347303 - DNA, 22 bp, Artificial Sequence
  chemically synthesized
cagatcattcctctattaaata

SEQ ID NO: 1347304 - DNA, 22 bp, Artificial Sequence
  chemically synthesized
agatcattcctctattaaatat

SEQ ID NO: 1347305 - DNA, 22 bp, Artificial Sequence
  chemically synthesized
ctctattaaatatcagtgactt

SEQ ID NO: 1347306 - DNA, 22 bp, Artificial Sequence
  chemically synthesized
tattaaatatcagtgactttgc

SEQ ID NO: 1347307 - DNA, 22 bp, Artificial Sequence
  chemically synthesized
aaaaagtagtaagcaaagtcac

SEQ ID NO: 1347308 - DNA, 22 bp, Artificial Sequence
  chemically synthesized
ttaaatatcagtgactttgctt

SEQ ID NO: 1347309 - DNA, 22 bp, Artificial Sequence
  chemically synthesized
aatatcagtgactttgcttact

SEQ ID NO: 1347310 - DNA, 22 bp, Artificial Sequence
  chemically synthesized
tgcttactactttttcaggtat

SEQ ID NO: 1347311 - DNA, 22 bp, Artificial Sequence
  chemically synthesized
gcttactactttttcaggtatt

SEQ ID NO: 1347312 - DNA, 22 bp, Artificial Sequence
  chemically synthesized
cttactactttttcaggtattg

SEQ ID NO: 1347313 - DNA, 22 bp, Artificial Sequence
  chemically synthesized
gatacataccccacaatacctg

SEQ ID NO: 1347314 - DNA, 22 bp, Artificial Sequence
  chemically synthesized
ggatacataccccacaatacct

SEQ ID NO: 1347315 - DNA, 22 bp, Artificial Sequence
  chemically synthesized
actactttttcaggtattgtgg

SEQ ID NO: 1347316 - DNA, 22 bp, Artificial Sequence
  chemically synthesized
tggatacataccccacaatacc

SEQ ID NO: 1347317 - DNA, 22 bp, Artificial Sequence
  chemically synthesized
ctactttttcaggtattgtggg

SEQ ID NO: 1347318 - DNA, 22 bp, Artificial Sequence
  chemically synthesized
ttggatacataccccacaatac

SEQ ID NO: 1347319 - DNA, 22 bp, Artificial Sequence
  chemically synthesized
tttggatacataccccacaata

SEQ ID NO: 1347320 - DNA, 22 bp, Artificial Sequence
  chemically synthesized
ttttggatacataccccacaat

SEQ ID NO: 1347321 - DNA, 22 bp, Artificial Sequence
  chemically synthesized
ctttttcaggtattgtggggta

SEQ ID NO: 1347322 - DNA, 22 bp, Artificial Sequence
  chemically synthesized
tttcaggtattgtggggtatgt

SEQ ID NO: 1347323 - DNA, 22 bp, Artificial Sequence
  chemically synthesized
ttcaggtattgtggggtatgta

SEQ ID NO: 1347324 - DNA, 22 bp, Artificial Sequence
  chemically synthesized
tcaggtattgtggggtatgtat

SEQ ID NO: 1347325 - DNA, 22 bp, Artificial Sequence
  chemically synthesized
caggtattgtggggtatgtatc

SEQ ID NO: 1347326 - DNA, 22 bp, Artificial Sequence
  chemically synthesized
aggtattgtggggtatgtatcc

SEQ ID NO: 1347327 - DNA, 22 bp, Artificial Sequence
  chemically synthesized
tggggtatgtatccaaaaaagt

SEQ ID NO: 1347328 - DNA, 22 bp, Artificial Sequence
  chemically synthesized
aaaaatagacataaatgcataa

SEQ ID NO: 1347329 - DNA, 22 bp, Artificial Sequence
  chemically synthesized
aaaaaatagacataaatgcata

SEQ ID NO: 1347330 - DNA, 22 bp, Artificial Sequence
  chemically synthesized
taaaaaatagacataaatgcat

SEQ ID NO: 1347331 - DNA, 22 bp, Artificial Sequence
  chemically synthesized
cctgatttatgcatttatgtct

SEQ ID NO: 1347332 - DNA, 22 bp, Artificial Sequence
  chemically synthesized
atttatgcatttatgtctattt

SEQ ID NO: 1347333 - DNA, 22 bp, Artificial Sequence
  chemically synthesized
atgcatttatgtctatttttta

SEQ ID NO: 1347334 - DNA, 22 bp, Artificial Sequence
  chemically synthesized
tgcatttatgtctattttttaa

SEQ ID NO: 1347335 - DNA, 22 bp, Artificial Sequence
  chemically synthesized
tagaagaagcaatgttttaaaa

SEQ ID NO: 1347336 - DNA, 22 bp, Artificial Sequence
  chemically synthesized
atgtctattttttaaaacattg

SEQ ID NO: 1347337 - DNA, 22 bp, Artificial Sequence
  chemically synthesized
tgtctattttttaaaacattgc

SEQ ID NO: 1347338 - DNA, 22 bp, Artificial Sequence
  chemically synthesized
ttttttaaaacattgcttcttc

SEQ ID NO: 1347339 - DNA, 22 bp, Artificial Sequence
  chemically synthesized
tttaaaacattgcttcttctat

SEQ ID NO: 1347340 - DNA, 22 bp, Artificial Sequence
  chemically synthesized
ttaaaacattgcttcttctata

SEQ ID NO: 1347341 - DNA, 22 bp, Artificial Sequence
  chemically synthesized
taaaacattgcttcttctataa

SEQ ID NO: 1347342 - DNA, 22 bp, Artificial Sequence
  chemically synthesized
aaaacattgcttcttctataat

SEQ ID NO: 1347343 - DNA, 22 bp, Artificial Sequence
  chemically synthesized
aaaagaggagaaattatagaag

SEQ ID NO: 1347344 - DNA, 22 bp, Artificial Sequence
  chemically synthesized
aaacattgcttcttctataatt

SEQ ID NO: 1347345 - DNA, 22 bp, Artificial Sequence
  chemically synthesized
aactgaaaagaggagaaattat

SEQ ID NO: 1347346 - DNA, 22 bp, Artificial Sequence
  chemically synthesized
gaactgaaaagaggagaaatta

SEQ ID NO: 1347347 - DNA, 22 bp, Artificial Sequence
  chemically synthesized
tgaactgaaaagaggagaaatt

SEQ ID NO: 1347348 - DNA, 22 bp, Artificial Sequence
  chemically synthesized
cttcttctataatttctcctct

SEQ ID NO: 1347349 - DNA, 22 bp, Artificial Sequence
  chemically synthesized
tttgaactgaaaagaggagaaa

SEQ ID NO: 1347350 - DNA, 22 bp, Artificial Sequence
  chemically synthesized
cttctataatttctcctctttt

SEQ ID NO: 1347351 - DNA, 22 bp, Artificial Sequence
  chemically synthesized
ttctataatttctcctcttttc

SEQ ID NO: 1347352 - DNA, 22 bp, Artificial Sequence
  chemically synthesized
cattctttgaactgaaaagagg

SEQ ID NO: 1347353 - DNA, 22 bp, Artificial Sequence
  chemically synthesized
ctataatttctcctcttttcag

SEQ ID NO: 1347354 - DNA, 22 bp, Artificial Sequence
  chemically synthesized
tataatttctcctcttttcagt

SEQ ID NO: 1347355 - DNA, 22 bp, Artificial Sequence
  chemically synthesized
taatttctcctcttttcagttc

SEQ ID NO: 1347356 - DNA, 22 bp, Artificial Sequence
  chemically synthesized
tattccattctttgaactgaaa

SEQ ID NO: 1347357 - DNA, 22 bp, Artificial Sequence
  chemically synthesized
ctcctcttttcagttcaaagaa

SEQ ID NO: 1347358 - DNA, 22 bp, Artificial Sequence
  chemically synthesized
tactatattccattctttgaac

SEQ ID NO: 1347359 - DNA, 22 bp, Artificial Sequence
  chemically synthesized
tcctcttttcagttcaaagaat

SEQ ID NO: 1347360 - DNA, 22 bp, Artificial Sequence
  chemically synthesized
gtactatattccattctttgaa

SEQ ID NO: 1347361 - DNA, 22 bp, Artificial Sequence
  chemically synthesized
tgtactatattccattctttga

SEQ ID NO: 1347362 - DNA, 22 bp, Artificial Sequence
  chemically synthesized
ctcttttcagttcaaagaatgg

SEQ ID NO: 1347363 - DNA, 22 bp, Artificial Sequence
  chemically synthesized
tttgtactatattccattcttt

SEQ ID NO: 1347364 - DNA, 22 bp, Artificial Sequence
  chemically synthesized
ttttcagttcaaagaatggaat

SEQ ID NO: 1347365 - DNA, 22 bp, Artificial Sequence
  chemically synthesized
ttcagttcaaagaatggaatat

SEQ ID NO: 1347366 - DNA, 22 bp, Artificial Sequence
  chemically synthesized
tcagttcaaagaatggaatata

SEQ ID NO: 1347367 - DNA, 22 bp, Artificial Sequence
  chemically synthesized
cagttcaaagaatggaatatag

SEQ ID NO: 1347368 - DNA, 22 bp, Artificial Sequence
  chemically synthesized
agttcaaagaatggaatatagt

SEQ ID NO: 1347369 - DNA, 22 bp, Artificial Sequence
  chemically synthesized
aaggttctttgtactatattcc

SEQ ID NO: 1347370 - DNA, 22 bp, Artificial Sequence
  chemically synthesized
ttcaaggttctttgtactatat

SEQ ID NO: 1347371 - DNA, 22 bp, Artificial Sequence
  chemically synthesized
gttcaaggttctttgtactata

SEQ ID NO: 1347372 - DNA, 22 bp, Artificial Sequence
  chemically synthesized
aaagaatggaatatagtacaaa

SEQ ID NO: 1347373 - DNA, 22 bp, Artificial Sequence
  chemically synthesized
tgttcaaggttctttgtactat

SEQ ID NO: 1347374 - DNA, 22 bp, Artificial Sequence
  chemically synthesized
ttgttcaaggttctttgtacta

SEQ ID NO: 1347375 - DNA, 22 bp, Artificial Sequence
  chemically synthesized
tttgttcaaggttctttgtact

SEQ ID NO: 1347376 - DNA, 22 bp, Artificial Sequence
  chemically synthesized
agaaataaagcccagccatgac

SEQ ID NO: 1347377 - DNA, 22 bp, Artificial Sequence
  chemically synthesized
gaacaaaaagtcatggctgggc

SEQ ID NO: 1347378 - DNA, 22 bp, Artificial Sequence
  chemically synthesized
aacaaaaagtcatggctgggct

SEQ ID NO: 1347379 - DNA, 22 bp, Artificial Sequence
  chemically synthesized
ggctttatttctgaatatacat

SEQ ID NO: 1347380 - DNA, 22 bp, Artificial Sequence
  chemically synthesized
tatttctgaatatacatacata

SEQ ID NO: 1347381 - DNA, 22 bp, Artificial Sequence
  chemically synthesized
atttctgaatatacatacatac

SEQ ID NO: 1347382 - DNA, 22 bp, Artificial Sequence
  chemically synthesized
tttctgaatatacatacataca

SEQ ID NO: 1347383 - DNA, 22 bp, Artificial Sequence
  chemically synthesized
ctgaatatacatacatacatat

SEQ ID NO: 1347384 - DNA, 22 bp, Artificial Sequence
  chemically synthesized
tgaatatacatacatacatata

SEQ ID NO: 1347385 - DNA, 22 bp, Artificial Sequence
  chemically synthesized
aatatacatacatacatatata

SEQ ID NO: 1347386 - DNA, 22 bp, Artificial Sequence
  chemically synthesized
aggaaaaaaaatatatatatat

SEQ ID NO: 1347387 - DNA, 22 bp, Artificial Sequence
  chemically synthesized
aatgaatacacactgaggaaaa

SEQ ID NO: 1347388 - DNA, 22 bp, Artificial Sequence
  chemically synthesized
actcaatgaatacacactgagg

SEQ ID NO: 1347389 - DNA, 22 bp, Artificial Sequence
  chemically synthesized
aggttcactcaatgaatacaca

SEQ ID NO: 1347390 - DNA, 22 bp, Artificial Sequence
  chemically synthesized
tttttcctcagtgtgtattcat

SEQ ID NO: 1347391 - DNA, 22 bp, Artificial Sequence
  chemically synthesized
ttttcctcagtgtgtattcatt

SEQ ID NO: 1347392 - DNA, 22 bp, Artificial Sequence
  chemically synthesized
tttcctcagtgtgtattcattg

SEQ ID NO: 1347393 - DNA, 22 bp, Artificial Sequence
  chemically synthesized
ttcctcagtgtgtattcattga

SEQ ID NO: 1347394 - DNA, 22 bp, Artificial Sequence
  chemically synthesized
attcaggttcactcaatgaata

SEQ ID NO: 1347395 - DNA, 22 bp, Artificial Sequence
  chemically synthesized
tcctcagtgtgtattcattgag

SEQ ID NO: 1347396 - DNA, 22 bp, Artificial Sequence
  chemically synthesized
cctcagtgtgtattcattgagt

SEQ ID NO: 1347397 - DNA, 22 bp, Artificial Sequence
  chemically synthesized
ctcagtgtgtattcattgagtg

SEQ ID NO: 1347398 - DNA, 22 bp, Artificial Sequence
  chemically synthesized
ctcattcaggttcactcaatga

SEQ ID NO: 1347399 - DNA, 22 bp, Artificial Sequence
  chemically synthesized
agtgtgtattcattgagtgaac

SEQ ID NO: 1347400 - DNA, 22 bp, Artificial Sequence
  chemically synthesized
aattgctcattcaggttcactc

SEQ ID NO: 1347401 - DNA, 22 bp, Artificial Sequence
  chemically synthesized
aaattgctcattcaggttcact

SEQ ID NO: 1347402 - DNA, 22 bp, Artificial Sequence
  chemically synthesized
attgagtgaacctgaatgagca

SEQ ID NO: 1347403 - DNA, 22 bp, Artificial Sequence
  chemically synthesized
gacagtttaaattgctcattca

SEQ ID NO: 1347404 - DNA, 22 bp, Artificial Sequence
  chemically synthesized
agtgaacctgaatgagcaattt

SEQ ID NO: 1347405 - DNA, 22 bp, Artificial Sequence
  chemically synthesized
aatgagcaatttaaactgtcta

SEQ ID NO: 1347406 - DNA, 22 bp, Artificial Sequence
  chemically synthesized
gtaaaaggcagcctagacagtt

SEQ ID NO: 1347407 - DNA, 22 bp, Artificial Sequence
  chemically synthesized
atagactagtaaaaggcagcct

SEQ ID NO: 1347408 - DNA, 22 bp, Artificial Sequence
  chemically synthesized
gatagactagtaaaaggcagcc

SEQ ID NO: 1347409 - DNA, 22 bp, Artificial Sequence
  chemically synthesized
aaactgtctaggctgcctttta

SEQ ID NO: 1347410 - DNA, 22 bp, Artificial Sequence
  chemically synthesized
aactgtctaggctgccttttac

SEQ ID NO: 1347411 - DNA, 22 bp, Artificial Sequence
  chemically synthesized
tttgatagactagtaaaaggca

SEQ ID NO: 1347412 - DNA, 22 bp, Artificial Sequence
  chemically synthesized
atttgatagactagtaaaaggc

SEQ ID NO: 1347413 - DNA, 22 bp, Artificial Sequence
  chemically synthesized
tatttgatagactagtaaaagg

SEQ ID NO: 1347414 - DNA, 22 bp, Artificial Sequence
  chemically synthesized
ttatttgatagactagtaaaag

SEQ ID NO: 1347415 - DNA, 22 bp, Artificial Sequence
  chemically synthesized
tctaggctgccttttactagtc

SEQ ID NO: 1347416 - DNA, 22 bp, Artificial Sequence
  chemically synthesized
ttttatttgatagactagtaaa

SEQ ID NO: 1347417 - DNA, 22 bp, Artificial Sequence
  chemically synthesized
ggctgccttttactagtctatc

SEQ ID NO: 1347418 - DNA, 22 bp, Artificial Sequence
  chemically synthesized
attcttttatttgatagactag

SEQ ID NO: 1347419 - DNA, 22 bp, Artificial Sequence
  chemically synthesized
ccttttactagtctatcaaata

SEQ ID NO: 1347420 - DNA, 22 bp, Artificial Sequence
  chemically synthesized
ttactagtctatcaaataaaag

SEQ ID NO: 1347421 - DNA, 22 bp, Artificial Sequence
  chemically synthesized
tactagtctatcaaataaaaga

SEQ ID NO: 1347422 - DNA, 22 bp, Artificial Sequence
  chemically synthesized
actagtctatcaaataaaagaa

SEQ ID NO: 1347423 - DNA, 22 bp, Artificial Sequence
  chemically synthesized
agtagaaattaattcttttatt

SEQ ID NO: 1347424 - DNA, 22 bp, Artificial Sequence
  chemically synthesized
ctagtctatcaaataaaagaat

SEQ ID NO: 1347425 - DNA, 22 bp, Artificial Sequence
  chemically synthesized
gagtagaaattaattcttttat

SEQ ID NO: 1347426 - DNA, 22 bp, Artificial Sequence
  chemically synthesized
gtctatcaaataaaagaattaa

SEQ ID NO: 1347427 - DNA, 22 bp, Artificial Sequence
  chemically synthesized
tttgagtagaaattaattcttt

SEQ ID NO: 1347428 - DNA, 22 bp, Artificial Sequence
  chemically synthesized
atttgagtagaaattaattctt

SEQ ID NO: 1347429 - DNA, 22 bp, Artificial Sequence
  chemically synthesized
tcaaataaaagaattaatttct

SEQ ID NO: 1347430 - DNA, 22 bp, Artificial Sequence
  chemically synthesized
gatttatttgagtagaaattaa

SEQ ID NO: 1347431 - DNA, 22 bp, Artificial Sequence
  chemically synthesized
tagatttatttgagtagaaatt

SEQ ID NO: 1347432 - DNA, 22 bp, Artificial Sequence
  chemically synthesized
ctagatttatttgagtagaaat

SEQ ID NO: 1347433 - DNA, 22 bp, Artificial Sequence
  chemically synthesized
atagccttctagatttatttga

SEQ ID NO: 1347434 - DNA, 22 bp, Artificial Sequence
  chemically synthesized
atttctactcaaataaatctag

SEQ ID NO: 1347435 - DNA, 22 bp, Artificial Sequence
  chemically synthesized
ctactcaaataaatctagaagg

SEQ ID NO: 1347436 - DNA, 22 bp, Artificial Sequence
  chemically synthesized
tactcaaataaatctagaaggc

SEQ ID NO: 1347437 - DNA, 22 bp, Artificial Sequence
  chemically synthesized
ctcaaataaatctagaaggcta

SEQ ID NO: 1347438 - DNA, 22 bp, Artificial Sequence
  chemically synthesized
atatcccattaatagccttcta

SEQ ID NO: 1347439 - DNA, 22 bp, Artificial Sequence
  chemically synthesized
aaataaatctagaaggctatta

SEQ ID NO: 1347440 - DNA, 22 bp, Artificial Sequence
  chemically synthesized
aatgtgttaatatcccattaat

SEQ ID NO: 1347441 - DNA, 22 bp, Artificial Sequence
  chemically synthesized
aaatgtgttaatatcccattaa

SEQ ID NO: 1347442 - DNA, 22 bp, Artificial Sequence
  chemically synthesized
taaatgtgttaatatcccatta

SEQ ID NO: 1347443 - DNA, 22 bp, Artificial Sequence
  chemically synthesized
ttaaatgtgttaatatcccatt

SEQ ID NO: 1347444 - DNA, 22 bp, Artificial Sequence
  chemically synthesized
gaaggctattaatgggatatta

SEQ ID NO: 1347445 - DNA, 22 bp, Artificial Sequence
  chemically synthesized
aaccacttttaaatgtgttaat

SEQ ID NO: 1347446 - DNA, 22 bp, Artificial Sequence
  chemically synthesized
aaaccacttttaaatgtgttaa

SEQ ID NO: 1347447 - DNA, 22 bp, Artificial Sequence
  chemically synthesized
ttaatgggatattaacacattt

SEQ ID NO: 1347448 - DNA, 22 bp, Artificial Sequence
  chemically synthesized
taaaccacttttaaatgtgtta

SEQ ID NO: 1347449 - DNA, 22 bp, Artificial Sequence
  chemically synthesized
atgggatattaacacatttaaa

SEQ ID NO: 1347450 - DNA, 22 bp, Artificial Sequence
  chemically synthesized
ctttaaaccacttttaaatgtg

SEQ ID NO: 1347451 - DNA, 22 bp, Artificial Sequence
  chemically synthesized
tactttaaaccacttttaaatg

SEQ ID NO: 1347452 - DNA, 22 bp, Artificial Sequence
  chemically synthesized
ctactttaaaccacttttaaat

SEQ ID NO: 1347453 - DNA, 22 bp, Artificial Sequence
  chemically synthesized
tctactttaaaccacttttaaa

SEQ ID NO: 1347454 - DNA, 22 bp, Artificial Sequence
  chemically synthesized
ttctactttaaaccacttttaa

SEQ ID NO: 1347455 - DNA, 22 bp, Artificial Sequence
  chemically synthesized
tttctactttaaaccactttta

SEQ ID NO: 1347456 - DNA, 22 bp, Artificial Sequence
  chemically synthesized
acacatttaaaagtggtttaaa

SEQ ID NO: 1347457 - DNA, 22 bp, Artificial Sequence
  chemically synthesized
aaaagtggtttaaagtagaaaa

SEQ ID NO: 1347458 - DNA, 22 bp, Artificial Sequence
  chemically synthesized
aaagtggtttaaagtagaaaaa

SEQ ID NO: 1347459 - DNA, 22 bp, Artificial Sequence
  chemically synthesized
aaagtagaaaaagcaccatcga

SEQ ID NO: 1347460 - DNA, 22 bp, Artificial Sequence
  chemically synthesized
aagtagaaaaagcaccatcgat

SEQ ID NO: 1347461 - DNA, 22 bp, Artificial Sequence
  chemically synthesized
tggaatggataagcaaatcagt

SEQ ID NO: 1347462 - DNA, 22 bp, Artificial Sequence
  chemically synthesized
gtggaatggataagcaaatcag

SEQ ID NO: 1347463 - DNA, 22 bp, Artificial Sequence
  chemically synthesized
atttgtggaatggataagcaaa

SEQ ID NO: 1347464 - DNA, 22 bp, Artificial Sequence
  chemically synthesized
aatttgtggaatggataagcaa

SEQ ID NO: 1347465 - DNA, 22 bp, Artificial Sequence
  chemically synthesized
atttgcttatccattccacaaa

SEQ ID NO: 1347466 - DNA, 22 bp, Artificial Sequence
  chemically synthesized
gcttatccattccacaaattaa

SEQ ID NO: 1347467 - DNA, 22 bp, Artificial Sequence
  chemically synthesized
catagtaggtacttaatttgtg

SEQ ID NO: 1347468 - DNA, 22 bp, Artificial Sequence
  chemically synthesized
cttatccattccacaaattaag

SEQ ID NO: 1347469 - DNA, 22 bp, Artificial Sequence
  chemically synthesized
ctccatagtaggtacttaattt

SEQ ID NO: 1347470 - DNA, 22 bp, Artificial Sequence
  chemically synthesized
atccattccacaaattaagtac

SEQ ID NO: 1347471 - DNA, 22 bp, Artificial Sequence
  chemically synthesized
tccattccacaaattaagtacc

SEQ ID NO: 1347472 - DNA, 22 bp, Artificial Sequence
  chemically synthesized
cacaaattaagtacctactatg

SEQ ID NO: 1347473 - DNA, 22 bp, Artificial Sequence
  chemically synthesized
agtacctactatggagcagatg

SEQ ID NO: 1347474 - DNA, 22 bp, Artificial Sequence
  chemically synthesized
tcccagaaccaagacagcatct

SEQ ID NO: 1347475 - DNA, 22 bp, Artificial Sequence
  chemically synthesized
ctatggagcagatgctgtcttg

SEQ ID NO: 1347476 - DNA, 22 bp, Artificial Sequence
  chemically synthesized
tggagcagatgctgtcttggtt

SEQ ID NO: 1347477 - DNA, 22 bp, Artificial Sequence
  chemically synthesized
atagatgttgtcccagaaccaa

SEQ ID NO: 1347478 - DNA, 22 bp, Artificial Sequence
  chemically synthesized
tcttggttctgggacaacatct

SEQ ID NO: 1347479 - DNA, 22 bp, Artificial Sequence
  chemically synthesized
agtgtcattcatagatgttgtc

SEQ ID NO: 1347480 - DNA, 22 bp, Artificial Sequence
  chemically synthesized
cagtgtcattcatagatgttgt

SEQ ID NO: 1347481 - DNA, 22 bp, Artificial Sequence
  chemically synthesized
ggttctgggacaacatctatga

SEQ ID NO: 1347482 - DNA, 22 bp, Artificial Sequence
  chemically synthesized
gttctgggacaacatctatgaa

SEQ ID NO: 1347483 - DNA, 22 bp, Artificial Sequence
  chemically synthesized
tgggacaacatctatgaatgac

SEQ ID NO: 1347484 - DNA, 22 bp, Artificial Sequence
  chemically synthesized
ggacaacatctatgaatgacac

SEQ ID NO: 1347485 - DNA, 22 bp, Artificial Sequence
  chemically synthesized
ataggagagcagggacaatttc

SEQ ID NO: 1347486 - DNA, 22 bp, Artificial Sequence
  chemically synthesized
tgaatgacactgaaattgtccc

SEQ ID NO: 1347487 - DNA, 22 bp, Artificial Sequence
  chemically synthesized
aaattgtccctgctctcctatc

SEQ ID NO: 1347488 - DNA, 22 bp, Artificial Sequence
  chemically synthesized
ataataccaatacctgatagga

SEQ ID NO: 1347489 - DNA, 22 bp, Artificial Sequence
  chemically synthesized
aataataccaatacctgatagg

SEQ ID NO: 1347490 - DNA, 22 bp, Artificial Sequence
  chemically synthesized
taataataccaatacctgatag

SEQ ID NO: 1347491 - DNA, 22 bp, Artificial Sequence
  chemically synthesized
tccctgctctcctatcaggtat

SEQ ID NO: 1347492 - DNA, 22 bp, Artificial Sequence
  chemically synthesized
ttaataataccaatacctgata

SEQ ID NO: 1347493 - DNA, 22 bp, Artificial Sequence
  chemically synthesized
ctctcctatcaggtattggtat

SEQ ID NO: 1347494 - DNA, 22 bp, Artificial Sequence
  chemically synthesized
tcctatcaggtattggtattat

SEQ ID NO: 1347495 - DNA, 22 bp, Artificial Sequence
  chemically synthesized
ctatcaggtattggtattatta

SEQ ID NO: 1347496 - DNA, 22 bp, Artificial Sequence
  chemically synthesized
tcaggtattggtattattaaaa

SEQ ID NO: 1347497 - DNA, 22 bp, Artificial Sequence
  chemically synthesized
agaaatacgtcagtttttaata

SEQ ID NO: 1347498 - DNA, 22 bp, Artificial Sequence
  chemically synthesized
tcagaaatacgtcagtttttaa

SEQ ID NO: 1347499 - DNA, 22 bp, Artificial Sequence
  chemically synthesized
ctcagaaatacgtcagttttta

SEQ ID NO: 1347500 - DNA, 22 bp, Artificial Sequence
  chemically synthesized
gtattattaaaaactgacgtat

SEQ ID NO: 1347501 - DNA, 22 bp, Artificial Sequence
  chemically synthesized
aggacttctcagaaatacgtca

SEQ ID NO: 1347502 - DNA, 22 bp, Artificial Sequence
  chemically synthesized
tcaggacttctcagaaatacgt

SEQ ID NO: 1347503 - DNA, 22 bp, Artificial Sequence
  chemically synthesized
ttaaaaactgacgtatttctga

SEQ ID NO: 1347504 - DNA, 22 bp, Artificial Sequence
  chemically synthesized
aaaactgacgtatttctgagaa

SEQ ID NO: 1347505 - DNA, 22 bp, Artificial Sequence
  chemically synthesized
acgtatttctgagaagtcctga

SEQ ID NO: 1347506 - DNA, 22 bp, Artificial Sequence
  chemically synthesized
cagaaagaattctcaggacttc

SEQ ID NO: 1347507 - DNA, 22 bp, Artificial Sequence
  chemically synthesized
ctacagaaagaattctcaggac

SEQ ID NO: 1347508 - DNA, 22 bp, Artificial Sequence
  chemically synthesized
ctactacagaaagaattctcag

SEQ ID NO: 1347509 - DNA, 22 bp, Artificial Sequence
  chemically synthesized
cctactacagaaagaattctca

SEQ ID NO: 1347510 - DNA, 22 bp, Artificial Sequence
  chemically synthesized
ctgagaagtcctgagaattctt

SEQ ID NO: 1347511 - DNA, 22 bp, Artificial Sequence
  chemically synthesized
tgagaagtcctgagaattcttt

SEQ ID NO: 1347512 - DNA, 22 bp, Artificial Sequence
  chemically synthesized
tttcctactacagaaagaattc

SEQ ID NO: 1347513 - DNA, 22 bp, Artificial Sequence
  chemically synthesized
agaagtcctgagaattctttct

SEQ ID NO: 1347514 - DNA, 22 bp, Artificial Sequence
  chemically synthesized
aagcgttgtttcctactacaga

SEQ ID NO: 1347515 - DNA, 22 bp, Artificial Sequence
  chemically synthesized
agaattctttctgtagtaggaa

SEQ ID NO: 1347516 - DNA, 22 bp, Artificial Sequence
  chemically synthesized
ttcaagcgttgtttcctactac

SEQ ID NO: 1347517 - DNA, 22 bp, Artificial Sequence
  chemically synthesized
tttctgtagtaggaaacaacgc

SEQ ID NO: 1347518 - DNA, 22 bp, Artificial Sequence
  chemically synthesized
tctgtagtaggaaacaacgctt

SEQ ID NO: 1347519 - DNA, 22 bp, Artificial Sequence
  chemically synthesized
ctgtagtaggaaacaacgcttg

SEQ ID NO: 1347520 - DNA, 22 bp, Artificial Sequence
  chemically synthesized
tgtagtaggaaacaacgcttga

SEQ ID NO: 1347521 - DNA, 22 bp, Artificial Sequence
  chemically synthesized
agcagaaattattcaagcgttg

SEQ ID NO: 1347522 - DNA, 22 bp, Artificial Sequence
  chemically synthesized
cagcagaaattattcaagcgtt

SEQ ID NO: 1347523 - DNA, 22 bp, Artificial Sequence
  chemically synthesized
tagtaggaaacaacgcttgaat

SEQ ID NO: 1347524 - DNA, 22 bp, Artificial Sequence
  chemically synthesized
ttcagcagaaattattcaagcg

SEQ ID NO: 1347525 - DNA, 22 bp, Artificial Sequence
  chemically synthesized
aatgttcttcagcagaaattat

SEQ ID NO: 1347526 - DNA, 22 bp, Artificial Sequence
  chemically synthesized
aaatgttcttcagcagaaatta

SEQ ID NO: 1347527 - DNA, 22 bp, Artificial Sequence
  chemically synthesized
taaatgttcttcagcagaaatt

SEQ ID NO: 1347528 - DNA, 22 bp, Artificial Sequence
  chemically synthesized
ttaaatgttcttcagcagaaat

SEQ ID NO: 1347529 - DNA, 22 bp, Artificial Sequence
  chemically synthesized
tgtttttaaatgttcttcagca

SEQ ID NO: 1347530 - DNA, 22 bp, Artificial Sequence
  chemically synthesized
gaataatttctgctgaagaaca

SEQ ID NO: 1347531 - DNA, 22 bp, Artificial Sequence
  chemically synthesized
aataatttctgctgaagaacat

SEQ ID NO: 1347532 - DNA, 22 bp, Artificial Sequence
  chemically synthesized
ataactgtgtttttaaatgttc

SEQ ID NO: 1347533 - DNA, 22 bp, Artificial Sequence
  chemically synthesized
cataactgtgtttttaaatgtt

SEQ ID NO: 1347534 - DNA, 22 bp, Artificial Sequence
  chemically synthesized
tcataactgtgtttttaaatgt

SEQ ID NO: 1347535 - DNA, 22 bp, Artificial Sequence
  chemically synthesized
ctgctgaagaacatttaaaaac

SEQ ID NO: 1347536 - DNA, 22 bp, Artificial Sequence
  chemically synthesized
tgctgaagaacatttaaaaaca

SEQ ID NO: 1347537 - DNA, 22 bp, Artificial Sequence
  chemically synthesized
ctgaagaacatttaaaaacaca

SEQ ID NO: 1347538 - DNA, 22 bp, Artificial Sequence
  chemically synthesized
cagctttcataactgtgttttt

SEQ ID NO: 1347539 - DNA, 22 bp, Artificial Sequence
  chemically synthesized
aagaacatttaaaaacacagtt

SEQ ID NO: 1347540 - DNA, 22 bp, Artificial Sequence
  chemically synthesized
tccagctttcataactgtgttt

SEQ ID NO: 1347541 - DNA, 22 bp, Artificial Sequence
  chemically synthesized
ctctccagctttcataactgtg

SEQ ID NO: 1347542 - DNA, 22 bp, Artificial Sequence
  chemically synthesized
aaaaacacagttatgaaagctg

SEQ ID NO: 1347543 - DNA, 22 bp, Artificial Sequence
  chemically synthesized
aaaacacagttatgaaagctgg

SEQ ID NO: 1347544 - DNA, 22 bp, Artificial Sequence
  chemically synthesized
tgaaagctggagagtaatccat

SEQ ID NO: 1347545 - DNA, 22 bp, Artificial Sequence
  chemically synthesized
aagcaaggacaataatatggat

SEQ ID NO: 1347546 - DNA, 22 bp, Artificial Sequence
  chemically synthesized
gagagtaatccatattattgtc

SEQ ID NO: 1347547 - DNA, 22 bp, Artificial Sequence
  chemically synthesized
ttgtccttgcttcagtttattt

SEQ ID NO: 1347548 - DNA, 22 bp, Artificial Sequence
  chemically synthesized
tccttgcttcagtttatttttc

SEQ ID NO: 1347549 - DNA, 22 bp, Artificial Sequence
  chemically synthesized
gcttcagtttatttttctatta

SEQ ID NO: 1347550 - DNA, 22 bp, Artificial Sequence
  chemically synthesized
cttcagtttatttttctattat

SEQ ID NO: 1347551 - DNA, 22 bp, Artificial Sequence
  chemically synthesized
aaatgcataaaataataataga

SEQ ID NO: 1347552 - DNA, 22 bp, Artificial Sequence
  chemically synthesized
cagtttatttttctattattat

SEQ ID NO: 1347553 - DNA, 22 bp, Artificial Sequence
  chemically synthesized
agtttatttttctattattatt

SEQ ID NO: 1347554 - DNA, 22 bp, Artificial Sequence
  chemically synthesized
cattaaaatgcataaaataata

SEQ ID NO: 1347555 - DNA, 22 bp, Artificial Sequence
  chemically synthesized
atttttctattattattttatg

SEQ ID NO: 1347556 - DNA, 22 bp, Artificial Sequence
  chemically synthesized
tttttctattattattttatgc

SEQ ID NO: 1347557 - DNA, 22 bp, Artificial Sequence
  chemically synthesized
cctacattaaaatgcataaaat

SEQ ID NO: 1347558 - DNA, 22 bp, Artificial Sequence
  chemically synthesized
acctacattaaaatgcataaaa

SEQ ID NO: 1347559 - DNA, 22 bp, Artificial Sequence
  chemically synthesized
ttctattattattttatgcatt

SEQ ID NO: 1347560 - DNA, 22 bp, Artificial Sequence
  chemically synthesized
tctattattattttatgcattt

SEQ ID NO: 1347561 - DNA, 22 bp, Artificial Sequence
  chemically synthesized
ctattattattttatgcatttt

SEQ ID NO: 1347562 - DNA, 22 bp, Artificial Sequence
  chemically synthesized
tattattattttatgcatttta

SEQ ID NO: 1347563 - DNA, 22 bp, Artificial Sequence
  chemically synthesized
gtttacctacattaaaatgcat

SEQ ID NO: 1347564 - DNA, 22 bp, Artificial Sequence
  chemically synthesized
ttattattttatgcattttaat

SEQ ID NO: 1347565 - DNA, 22 bp, Artificial Sequence
  chemically synthesized
ttattttatgcattttaatgta

SEQ ID NO: 1347566 - DNA, 22 bp, Artificial Sequence
  chemically synthesized
ttttatgcattttaatgtaggt

SEQ ID NO: 1347567 - DNA, 22 bp, Artificial Sequence
  chemically synthesized
tatgcattttaatgtaggtaaa

SEQ ID NO: 1347568 - DNA, 22 bp, Artificial Sequence
  chemically synthesized
aatcgaagttagtttacctaca

SEQ ID NO: 1347569 - DNA, 22 bp, Artificial Sequence
  chemically synthesized
atgcattttaatgtaggtaaac

SEQ ID NO: 1347570 - DNA, 22 bp, Artificial Sequence
  chemically synthesized
tgcattttaatgtaggtaaact

SEQ ID NO: 1347571 - DNA, 22 bp, Artificial Sequence
  chemically synthesized
taatgtaggtaaactaacttcg

SEQ ID NO: 1347572 - DNA, 22 bp, Artificial Sequence
  chemically synthesized
aatgtaggtaaactaacttcga

SEQ ID NO: 1347573 - DNA, 22 bp, Artificial Sequence
  chemically synthesized
atgtaggtaaactaacttcgat

SEQ ID NO: 1347574 - DNA, 22 bp, Artificial Sequence
  chemically synthesized
tgcaaggagaaagacctaaatc

SEQ ID NO: 1347575 - DNA, 22 bp, Artificial Sequence
  chemically synthesized
aagttgtgcaaggagaaagacc

SEQ ID NO: 1347576 - DNA, 22 bp, Artificial Sequence
  chemically synthesized
acttcgatttaggtctttctcc

SEQ ID NO: 1347577 - DNA, 22 bp, Artificial Sequence
  chemically synthesized
cctgaagttgtgcaaggagaaa

SEQ ID NO: 1347578 - DNA, 22 bp, Artificial Sequence
  chemically synthesized
cgatttaggtctttctccttgc

SEQ ID NO: 1347579 - DNA, 22 bp, Artificial Sequence
  chemically synthesized
gatttaggtctttctccttgca

SEQ ID NO: 1347580 - DNA, 22 bp, Artificial Sequence
  chemically synthesized
aggtctttctccttgcacaact

SEQ ID NO: 1347581 - DNA, 22 bp, Artificial Sequence
  chemically synthesized
ggtctttctccttgcacaactt

SEQ ID NO: 1347582 - DNA, 22 bp, Artificial Sequence
  chemically synthesized
tgaacagtcctccctgaagttg

SEQ ID NO: 1347583 - DNA, 22 bp, Artificial Sequence
  chemically synthesized
tctccttgcacaacttcaggga

SEQ ID NO: 1347584 - DNA, 22 bp, Artificial Sequence
  chemically synthesized
tatgaacagtcctccctgaagt

SEQ ID NO: 1347585 - DNA, 22 bp, Artificial Sequence
  chemically synthesized
ctccttgcacaacttcagggag

SEQ ID NO: 1347586 - DNA, 22 bp, Artificial Sequence
  chemically synthesized
ctatgaacagtcctccctgaag

SEQ ID NO: 1347587 - DNA, 22 bp, Artificial Sequence
  chemically synthesized
tccttgcacaacttcagggagg

SEQ ID NO: 1347588 - DNA, 22 bp, Artificial Sequence
  chemically synthesized
tctatgaacagtcctccctgaa

SEQ ID NO: 1347589 - DNA, 22 bp, Artificial Sequence
  chemically synthesized
cttgcacaacttcagggaggac

SEQ ID NO: 1347590 - DNA, 22 bp, Artificial Sequence
  chemically synthesized
gcacaacttcagggaggactgt

SEQ ID NO: 1347591 - DNA, 22 bp, Artificial Sequence
  chemically synthesized
tattttctatgaacagtcctcc

SEQ ID NO: 1347592 - DNA, 22 bp, Artificial Sequence
  chemically synthesized
cacaacttcagggaggactgtt

SEQ ID NO: 1347593 - DNA, 22 bp, Artificial Sequence
  chemically synthesized
aagttatattttctatgaacag

SEQ ID NO: 1347594 - DNA, 22 bp, Artificial Sequence
  chemically synthesized
caagttatattttctatgaaca

SEQ ID NO: 1347595 - DNA, 22 bp, Artificial Sequence
  chemically synthesized
tcaagttatattttctatgaac

SEQ ID NO: 1347596 - DNA, 22 bp, Artificial Sequence
  chemically synthesized
cagggaggactgttcatagaaa

SEQ ID NO: 1347597 - DNA, 22 bp, Artificial Sequence
  chemically synthesized
agggaggactgttcatagaaaa

SEQ ID NO: 1347598 - DNA, 22 bp, Artificial Sequence
  chemically synthesized
ttcatagaaaatataacttgaa

SEQ ID NO: 1347599 - DNA, 22 bp, Artificial Sequence
  chemically synthesized
aaggacacaattttcaagttat

SEQ ID NO: 1347600 - DNA, 22 bp, Artificial Sequence
  chemically synthesized
atagaaaatataacttgaaaat

SEQ ID NO: 1347601 - DNA, 22 bp, Artificial Sequence
  chemically synthesized
gtgcataaattcaaggacacaa

SEQ ID NO: 1347602 - DNA, 22 bp, Artificial Sequence
  chemically synthesized
agtgcataaattcaaggacaca

SEQ ID NO: 1347603 - DNA, 22 bp, Artificial Sequence
  chemically synthesized
gaaaattgtgtccttgaattta

SEQ ID NO: 1347604 - DNA, 22 bp, Artificial Sequence
  chemically synthesized
aaaattgtgtccttgaatttat

SEQ ID NO: 1347605 - DNA, 22 bp, Artificial Sequence
  chemically synthesized
tgtccttgaatttatgcactaa

SEQ ID NO: 1347606 - DNA, 22 bp, Artificial Sequence
  chemically synthesized
aagcagtaccatttagtgcata

SEQ ID NO: 1347607 - DNA, 22 bp, Artificial Sequence
  chemically synthesized
gaatttatgcactaaatggtac

SEQ ID NO: 1347608 - DNA, 22 bp, Artificial Sequence
  chemically synthesized
aatttatgcactaaatggtact

SEQ ID NO: 1347609 - DNA, 22 bp, Artificial Sequence
  chemically synthesized
atgcactaaatggtactgcttc

SEQ ID NO: 1347610 - DNA, 22 bp, Artificial Sequence
  chemically synthesized
tgcactaaatggtactgcttca

SEQ ID NO: 1347611 - DNA, 22 bp, Artificial Sequence
  chemically synthesized
aagaatatgaattgaagcagta

SEQ ID NO: 1347612 - DNA, 22 bp, Artificial Sequence
  chemically synthesized
aatggtactgcttcaattcata

SEQ ID NO: 1347613 - DNA, 22 bp, Artificial Sequence
  chemically synthesized
gtcgaattgaagaatatgaatt

SEQ ID NO: 1347614 - DNA, 22 bp, Artificial Sequence
  chemically synthesized
ctagtcgaattgaagaatatga

SEQ ID NO: 1347615 - DNA, 22 bp, Artificial Sequence
  chemically synthesized
cttcaattcatattcttcaatt

SEQ ID NO: 1347616 - DNA, 22 bp, Artificial Sequence
  chemically synthesized
caattcatattcttcaattcga

SEQ ID NO: 1347617 - DNA, 22 bp, Artificial Sequence
  chemically synthesized
aattcatattcttcaattcgac

SEQ ID NO: 1347618 - DNA, 22 bp, Artificial Sequence
  chemically synthesized
aaataattactagtcgaattga

SEQ ID NO: 1347619 - DNA, 22 bp, Artificial Sequence
  chemically synthesized
caaataattactagtcgaattg

SEQ ID NO: 1347620 - DNA, 22 bp, Artificial Sequence
  chemically synthesized
tcaaataattactagtcgaatt

SEQ ID NO: 1347621 - DNA, 22 bp, Artificial Sequence
  chemically synthesized
atattcttcaattcgactagta

SEQ ID NO: 1347622 - DNA, 22 bp, Artificial Sequence
  chemically synthesized
aaaatctttcaaataattacta

SEQ ID NO: 1347623 - DNA, 22 bp, Artificial Sequence
  chemically synthesized
ttcaattcgactagtaattatt

SEQ ID NO: 1347624 - DNA, 22 bp, Artificial Sequence
  chemically synthesized
caattcgactagtaattatttg

SEQ ID NO: 1347625 - DNA, 22 bp, Artificial Sequence
  chemically synthesized
aattcgactagtaattatttga

SEQ ID NO: 1347626 - DNA, 22 bp, Artificial Sequence
  chemically synthesized
taaagttaaaaatctttcaaat

SEQ ID NO: 1347627 - DNA, 22 bp, Artificial Sequence
  chemically synthesized
gactagtaattatttgaaagat

SEQ ID NO: 1347628 - DNA, 22 bp, Artificial Sequence
  chemically synthesized
gtaattatttgaaagattttta

SEQ ID NO: 1347629 - DNA, 22 bp, Artificial Sequence
  chemically synthesized
aaattataaagttaaaaatctt

SEQ ID NO: 1347630 - DNA, 22 bp, Artificial Sequence
  chemically synthesized
caaattataaagttaaaaatct

SEQ ID NO: 1347631 - DNA, 22 bp, Artificial Sequence
  chemically synthesized
tcaaattataaagttaaaaatc

SEQ ID NO: 1347632 - DNA, 22 bp, Artificial Sequence
  chemically synthesized
tttcaaattataaagttaaaaa

SEQ ID NO: 1347633 - DNA, 22 bp, Artificial Sequence
  chemically synthesized
ctttcaaattataaagttaaaa

SEQ ID NO: 1347634 - DNA, 22 bp, Artificial Sequence
  chemically synthesized
tttgaaagatttttaactttat

SEQ ID NO: 1347635 - DNA, 22 bp, Artificial Sequence
  chemically synthesized
atttctttcaaattataaagtt

SEQ ID NO: 1347636 - DNA, 22 bp, Artificial Sequence
  chemically synthesized
gaaagatttttaactttataat

SEQ ID NO: 1347637 - DNA, 22 bp, Artificial Sequence
  chemically synthesized
aaagatttttaactttataatt

SEQ ID NO: 1347638 - DNA, 22 bp, Artificial Sequence
  chemically synthesized
ttaactttataatttgaaagaa

SEQ ID NO: 1347639 - DNA, 22 bp, Artificial Sequence
  chemically synthesized
taactttataatttgaaagaaa

SEQ ID NO: 1347640 - DNA, 22 bp, Artificial Sequence
  chemically synthesized
atataagtctaatttctttcaa

SEQ ID NO: 1347641 - DNA, 22 bp, Artificial Sequence
  chemically synthesized
aactttataatttgaaagaaat

SEQ ID NO: 1347642 - DNA, 22 bp, Artificial Sequence
  chemically synthesized
catataagtctaatttctttca

SEQ ID NO: 1347643 - DNA, 22 bp, Artificial Sequence
  chemically synthesized
actttataatttgaaagaaatt

SEQ ID NO: 1347644 - DNA, 22 bp, Artificial Sequence
  chemically synthesized
tcatataagtctaatttctttc

SEQ ID NO: 1347645 - DNA, 22 bp, Artificial Sequence
  chemically synthesized
tataatttgaaagaaattagac

SEQ ID NO: 1347646 - DNA, 22 bp, Artificial Sequence
  chemically synthesized
ataatttgaaagaaattagact

SEQ ID NO: 1347647 - DNA, 22 bp, Artificial Sequence
  chemically synthesized
taatttgaaagaaattagactt

SEQ ID NO: 1347648 - DNA, 22 bp, Artificial Sequence
  chemically synthesized
caactttcatataagtctaatt

SEQ ID NO: 1347649 - DNA, 22 bp, Artificial Sequence
  chemically synthesized
acaactttcatataagtctaat

SEQ ID NO: 1347650 - DNA, 22 bp, Artificial Sequence
  chemically synthesized
tacaactttcatataagtctaa

SEQ ID NO: 1347651 - DNA, 22 bp, Artificial Sequence
  chemically synthesized
ttacaactttcatataagtcta

SEQ ID NO: 1347652 - DNA, 22 bp, Artificial Sequence
  chemically synthesized
gaaagaaattagacttatatga

SEQ ID NO: 1347653 - DNA, 22 bp, Artificial Sequence
  chemically synthesized
aaagaaattagacttatatgaa

SEQ ID NO: 1347654 - DNA, 22 bp, Artificial Sequence
  chemically synthesized
aatttttacaactttcatataa

SEQ ID NO: 1347655 - DNA, 22 bp, Artificial Sequence
  chemically synthesized
gacttatatgaaagttgtaaaa

SEQ ID NO: 1347656 - DNA, 22 bp, Artificial Sequence
  chemically synthesized
gaatatgtgattcaatttttac

SEQ ID NO: 1347657 - DNA, 22 bp, Artificial Sequence
  chemically synthesized
atatgaaagttgtaaaaattga

SEQ ID NO: 1347658 - DNA, 22 bp, Artificial Sequence
  chemically synthesized
tatgaaagttgtaaaaattgaa

SEQ ID NO: 1347659 - DNA, 22 bp, Artificial Sequence
  chemically synthesized
taaaaattgaatcacatattct

SEQ ID NO: 1347660 - DNA, 22 bp, Artificial Sequence
  chemically synthesized
ggtgaaggatacattagaatat

SEQ ID NO: 1347661 - DNA, 22 bp, Artificial Sequence
  chemically synthesized
tgggtgaaggatacattagaat

SEQ ID NO: 1347662 - DNA, 22 bp, Artificial Sequence
  chemically synthesized
aatcacatattctaatgtatcc

SEQ ID NO: 1347663 - DNA, 22 bp, Artificial Sequence
  chemically synthesized
taatgtatccttcacccagaat

SEQ ID NO: 1347664 - DNA, 22 bp, Artificial Sequence
  chemically synthesized
atgtatccttcacccagaattt

SEQ ID NO: 1347665 - DNA, 22 bp, Artificial Sequence
  chemically synthesized
agataaagtaaaaaaaaattct

SEQ ID NO: 1347666 - DNA, 22 bp, Artificial Sequence
  chemically synthesized
aagataaagtaaaaaaaaattc

SEQ ID NO: 1347667 - DNA, 22 bp, Artificial Sequence
  chemically synthesized
tatttaagataaagtaaaaaaa

SEQ ID NO: 1347668 - DNA, 22 bp, Artificial Sequence
  chemically synthesized
cacccagaatttttttttactt

SEQ ID NO: 1347669 - DNA, 22 bp, Artificial Sequence
  chemically synthesized
acccagaatttttttttacttt

SEQ ID NO: 1347670 - DNA, 22 bp, Artificial Sequence
  chemically synthesized
ttttttactttatcttaaatat

SEQ ID NO: 1347671 - DNA, 22 bp, Artificial Sequence
  chemically synthesized
tttttactttatcttaaatata

SEQ ID NO: 1347672 - DNA, 22 bp, Artificial Sequence
  chemically synthesized
ttttactttatcttaaatataa

SEQ ID NO: 1347673 - DNA, 22 bp, Artificial Sequence
  chemically synthesized
tttactttatcttaaatataat

SEQ ID NO: 1347674 - DNA, 22 bp, Artificial Sequence
  chemically synthesized
ttactttatcttaaatataatt

SEQ ID NO: 1347675 - DNA, 22 bp, Artificial Sequence
  chemically synthesized
tactttatcttaaatataattt

SEQ ID NO: 1347676 - DNA, 22 bp, Artificial Sequence
  chemically synthesized
actttatcttaaatataatttc

SEQ ID NO: 1347677 - DNA, 22 bp, Artificial Sequence
  chemically synthesized
ctttatcttaaatataatttct

SEQ ID NO: 1347678 - DNA, 22 bp, Artificial Sequence
  chemically synthesized
aaatacagacaaaaagaaatta

SEQ ID NO: 1347679 - DNA, 22 bp, Artificial Sequence
  chemically synthesized
tatcttaaatataatttctttt

SEQ ID NO: 1347680 - DNA, 22 bp, Artificial Sequence
  chemically synthesized
atcttaaatataatttcttttt

SEQ ID NO: 1347681 - DNA, 22 bp, Artificial Sequence
  chemically synthesized
taaaatacagacaaaaagaaat

SEQ ID NO: 1347682 - DNA, 22 bp, Artificial Sequence
  chemically synthesized
tcttaaatataatttctttttg

SEQ ID NO: 1347683 - DNA, 22 bp, Artificial Sequence
  chemically synthesized
actctaaaatacagacaaaaag

SEQ ID NO: 1347684 - DNA, 22 bp, Artificial Sequence
  chemically synthesized
aaatataatttctttttgtctg

SEQ ID NO: 1347685 - DNA, 22 bp, Artificial Sequence
  chemically synthesized
aatataatttctttttgtctgt

SEQ ID NO: 1347686 - DNA, 22 bp, Artificial Sequence
  chemically synthesized
agtagaaattgactctaaaata

SEQ ID NO: 1347687 - DNA, 22 bp, Artificial Sequence
  chemically synthesized
ctttttgtctgtattttagagt

SEQ ID NO: 1347688 - DNA, 22 bp, Artificial Sequence
  chemically synthesized
tttttgtctgtattttagagtc

SEQ ID NO: 1347689 - DNA, 22 bp, Artificial Sequence
  chemically synthesized
tgagtagaaattgactctaaaa

SEQ ID NO: 1347690 - DNA, 22 bp, Artificial Sequence
  chemically synthesized
ctgagtagaaattgactctaaa

SEQ ID NO: 1347691 - DNA, 22 bp, Artificial Sequence
  chemically synthesized
tttgtctgtattttagagtcaa

SEQ ID NO: 1347692 - DNA, 22 bp, Artificial Sequence
  chemically synthesized
ttgtctgtattttagagtcaat

SEQ ID NO: 1347693 - DNA, 22 bp, Artificial Sequence
  chemically synthesized
ttctgagtagaaattgactcta

SEQ ID NO: 1347694 - DNA, 22 bp, Artificial Sequence
  chemically synthesized
tgtctgtattttagagtcaatt

SEQ ID NO: 1347695 - DNA, 22 bp, Artificial Sequence
  chemically synthesized
gtctgtattttagagtcaattt

SEQ ID NO: 1347696 - DNA, 22 bp, Artificial Sequence
  chemically synthesized
tctgtattttagagtcaatttc

SEQ ID NO: 1347697 - DNA, 22 bp, Artificial Sequence
  chemically synthesized
ttcttctgagtagaaattgact

SEQ ID NO: 1347698 - DNA, 22 bp, Artificial Sequence
  chemically synthesized
gttcttctgagtagaaattgac

SEQ ID NO: 1347699 - DNA, 22 bp, Artificial Sequence
  chemically synthesized
tattttagagtcaatttctact

SEQ ID NO: 1347700 - DNA, 22 bp, Artificial Sequence
  chemically synthesized
tatacttgttcttctgagtaga

SEQ ID NO: 1347701 - DNA, 22 bp, Artificial Sequence
  chemically synthesized
tagagtcaatttctactcagaa

SEQ ID NO: 1347702 - DNA, 22 bp, Artificial Sequence
  chemically synthesized
agagtcaatttctactcagaag

SEQ ID NO: 1347703 - DNA, 22 bp, Artificial Sequence
  chemically synthesized
gagtcaatttctactcagaaga

SEQ ID NO: 1347704 - DNA, 22 bp, Artificial Sequence
  chemically synthesized
attatatacttgttcttctgag

SEQ ID NO: 1347705 - DNA, 22 bp, Artificial Sequence
  chemically synthesized
cattatatacttgttcttctga

SEQ ID NO: 1347706 - DNA, 22 bp, Artificial Sequence
  chemically synthesized
tcattatatacttgttcttctg

SEQ ID NO: 1347707 - DNA, 22 bp, Artificial Sequence
  chemically synthesized
ttcattatatacttgttcttct

SEQ ID NO: 1347708 - DNA, 22 bp, Artificial Sequence
  chemically synthesized
ctactcagaagaacaagtatat

SEQ ID NO: 1347709 - DNA, 22 bp, Artificial Sequence
  chemically synthesized
tactcagaagaacaagtatata

SEQ ID NO: 1347710 - DNA, 22 bp, Artificial Sequence
  chemically synthesized
acagtttttcattatatacttg

SEQ ID NO: 1347711 - DNA, 22 bp, Artificial Sequence
  chemically synthesized
aacagtttttcattatatactt

SEQ ID NO: 1347712 - DNA, 22 bp, Artificial Sequence
  chemically synthesized
ctcagaagaacaagtatataat

SEQ ID NO: 1347713 - DNA, 22 bp, Artificial Sequence
  chemically synthesized
taacagtttttcattatatact

SEQ ID NO: 1347714 - DNA, 22 bp, Artificial Sequence
  chemically synthesized
agaagaacaagtatataatgaa

SEQ ID NO: 1347715 - DNA, 22 bp, Artificial Sequence
  chemically synthesized
tgccacacacattttaacagtt

SEQ ID NO: 1347716 - DNA, 22 bp, Artificial Sequence
  chemically synthesized
tgtgccacacacattttaacag

SEQ ID NO: 1347717 - DNA, 22 bp, Artificial Sequence
  chemically synthesized
ctgtgccacacacattttaaca

SEQ ID NO: 1347718 - DNA, 22 bp, Artificial Sequence
  chemically synthesized
tctgtgccacacacattttaac

SEQ ID NO: 1347719 - DNA, 22 bp, Artificial Sequence
  chemically synthesized
ttctgtgccacacacattttaa

SEQ ID NO: 1347720 - DNA, 22 bp, Artificial Sequence
  chemically synthesized
aaaatcatttttctgtgccaca

SEQ ID NO: 1347721 - DNA, 22 bp, Artificial Sequence
  chemically synthesized
ttaaaatgtgtgtggcacagaa

SEQ ID NO: 1347722 - DNA, 22 bp, Artificial Sequence
  chemically synthesized
tcaaaatcatttttctgtgcca

SEQ ID NO: 1347723 - DNA, 22 bp, Artificial Sequence
  chemically synthesized
aaatgtgtgtggcacagaaaaa

SEQ ID NO: 1347724 - DNA, 22 bp, Artificial Sequence
  chemically synthesized
ctctcaaaatcatttttctgtg

SEQ ID NO: 1347725 - DNA, 22 bp, Artificial Sequence
  chemically synthesized
actctcaaaatcatttttctgt

SEQ ID NO: 1347726 - DNA, 22 bp, Artificial Sequence
  chemically synthesized
tactctcaaaatcatttttctg

SEQ ID NO: 1347727 - DNA, 22 bp, Artificial Sequence
  chemically synthesized
aaattttactctcaaaatcatt

SEQ ID NO: 1347728 - DNA, 22 bp, Artificial Sequence
  chemically synthesized
catgctcaaattttactctcaa

SEQ ID NO: 1347729 - DNA, 22 bp, Artificial Sequence
  chemically synthesized
ccatgctcaaattttactctca

SEQ ID NO: 1347730 - DNA, 22 bp, Artificial Sequence
  chemically synthesized
tccatgctcaaattttactctc

SEQ ID NO: 1347731 - DNA, 22 bp, Artificial Sequence
  chemically synthesized
ttccatgctcaaattttactct

SEQ ID NO: 1347732 - DNA, 22 bp, Artificial Sequence
  chemically synthesized
ttttccatgctcaaattttact

SEQ ID NO: 1347733 - DNA, 22 bp, Artificial Sequence
  chemically synthesized
cttttccatgctcaaattttac

SEQ ID NO: 1347734 - DNA, 22 bp, Artificial Sequence
  chemically synthesized
tgagagtaaaatttgagcatgg

SEQ ID NO: 1347735 - DNA, 22 bp, Artificial Sequence
  chemically synthesized
gagagtaaaatttgagcatgga

SEQ ID NO: 1347736 - DNA, 22 bp, Artificial Sequence
  chemically synthesized
agagtaaaatttgagcatggaa

SEQ ID NO: 1347737 - DNA, 22 bp, Artificial Sequence
  chemically synthesized
agtcatcttcttttccatgctc

SEQ ID NO: 1347738 - DNA, 22 bp, Artificial Sequence
  chemically synthesized
gagcatggaaaagaagatgact

SEQ ID NO: 1347739 - DNA, 22 bp, Artificial Sequence
  chemically synthesized
agcatggaaaagaagatgactt

SEQ ID NO: 1347740 - DNA, 22 bp, Artificial Sequence
  chemically synthesized
aatataagtataataattaagt

SEQ ID NO: 1347741 - DNA, 22 bp, Artificial Sequence
  chemically synthesized
gaatataagtataataattaag

SEQ ID NO: 1347742 - DNA, 22 bp, Artificial Sequence
  chemically synthesized
tgcttgaatataagtataataa

SEQ ID NO: 1347743 - DNA, 22 bp, Artificial Sequence
  chemically synthesized
gtcccctgtgcttgaatataag

SEQ ID NO: 1347744 - DNA, 22 bp, Artificial Sequence
  chemically synthesized
ggtcccctgtgcttgaatataa

SEQ ID NO: 1347745 - DNA, 22 bp, Artificial Sequence
  chemically synthesized
aattattatacttatattcaag

SEQ ID NO: 1347746 - DNA, 22 bp, Artificial Sequence
  chemically synthesized
tggtcccctgtgcttgaatata

SEQ ID NO: 1347747 - DNA, 22 bp, Artificial Sequence
  chemically synthesized
attattatacttatattcaagc

SEQ ID NO: 1347748 - DNA, 22 bp, Artificial Sequence
  chemically synthesized
ttatacttatattcaagcacag

SEQ ID NO: 1347749 - DNA, 22 bp, Artificial Sequence
  chemically synthesized
tacttatattcaagcacagggg

SEQ ID NO: 1347750 - DNA, 22 bp, Artificial Sequence
  chemically synthesized
agaaaagttttggtcccctgtg

SEQ ID NO: 1347751 - DNA, 22 bp, Artificial Sequence
  chemically synthesized
atattcaagcacaggggaccaa

SEQ ID NO: 1347752 - DNA, 22 bp, Artificial Sequence
  chemically synthesized
ctgagaaaagttttggtcccct

SEQ ID NO: 1347753 - DNA, 22 bp, Artificial Sequence
  chemically synthesized
tattcaagcacaggggaccaaa

SEQ ID NO: 1347754 - DNA, 22 bp, Artificial Sequence
  chemically synthesized
aagcacaggggaccaaaacttt

SEQ ID NO: 1347755 - DNA, 22 bp, Artificial Sequence
  chemically synthesized
gacatgatattgctgagaaaag

SEQ ID NO: 1347756 - DNA, 22 bp, Artificial Sequence
  chemically synthesized
ctagacatgatattgctgagaa

SEQ ID NO: 1347757 - DNA, 22 bp, Artificial Sequence
  chemically synthesized
actagacatgatattgctgaga

SEQ ID NO: 1347758 - DNA, 22 bp, Artificial Sequence
  chemically synthesized
ttactagacatgatattgctga

SEQ ID NO: 1347759 - DNA, 22 bp, Artificial Sequence
  chemically synthesized
ctcttactagacatgatattgc

SEQ ID NO: 1347760 - DNA, 22 bp, Artificial Sequence
  chemically synthesized
tgctcttactagacatgatatt

SEQ ID NO: 1347761 - DNA, 22 bp, Artificial Sequence
  chemically synthesized
ctctgctcttactagacatgat

SEQ ID NO: 1347762 - DNA, 22 bp, Artificial Sequence
  chemically synthesized
ttctcagcaatatcatgtctag

SEQ ID NO: 1347763 - DNA, 22 bp, Artificial Sequence
  chemically synthesized
cctctgctcttactagacatga

SEQ ID NO: 1347764 - DNA, 22 bp, Artificial Sequence
  chemically synthesized
tctcagcaatatcatgtctagt

SEQ ID NO: 1347765 - DNA, 22 bp, Artificial Sequence
  chemically synthesized
tcctctgctcttactagacatg

SEQ ID NO: 1347766 - DNA, 22 bp, Artificial Sequence
  chemically synthesized
ctcagcaatatcatgtctagta

SEQ ID NO: 1347767 - DNA, 22 bp, Artificial Sequence
  chemically synthesized
tcagcaatatcatgtctagtaa

SEQ ID NO: 1347768 - DNA, 22 bp, Artificial Sequence
  chemically synthesized
agcaatatcatgtctagtaaga

SEQ ID NO: 1347769 - DNA, 22 bp, Artificial Sequence
  chemically synthesized
aatattttcctctgctcttact

SEQ ID NO: 1347770 - DNA, 22 bp, Artificial Sequence
  chemically synthesized
aaatattttcctctgctcttac

SEQ ID NO: 1347771 - DNA, 22 bp, Artificial Sequence
  chemically synthesized
taaatattttcctctgctctta

SEQ ID NO: 1347772 - DNA, 22 bp, Artificial Sequence
  chemically synthesized
ttaaatattttcctctgctctt

SEQ ID NO: 1347773 - DNA, 22 bp, Artificial Sequence
  chemically synthesized
gtaagagcagaggaaaatattt

SEQ ID NO: 1347774 - DNA, 22 bp, Artificial Sequence
  chemically synthesized
ccaagtccaagcttttaaatat

SEQ ID NO: 1347775 - DNA, 22 bp, Artificial Sequence
  chemically synthesized
ttcccaagtccaagcttttaaa

SEQ ID NO: 1347776 - DNA, 22 bp, Artificial Sequence
  chemically synthesized
gttcccaagtccaagcttttaa

SEQ ID NO: 1347777 - DNA, 22 bp, Artificial Sequence
  chemically synthesized
tgttcccaagtccaagctttta

SEQ ID NO: 1347778 - DNA, 22 bp, Artificial Sequence
  chemically synthesized
ggccattttgttcccaagtcca

SEQ ID NO: 1347779 - DNA, 22 bp, Artificial Sequence
  chemically synthesized
tgggccattttgttcccaagtc

SEQ ID NO: 1347780 - DNA, 22 bp, Artificial Sequence
  chemically synthesized
aaaagcttggacttgggaacaa

SEQ ID NO: 1347781 - DNA, 22 bp, Artificial Sequence
  chemically synthesized
aaagcttggacttgggaacaaa

SEQ ID NO: 1347782 - DNA, 22 bp, Artificial Sequence
  chemically synthesized
ggacttgggaacaaaatggccc

SEQ ID NO: 1347783 - DNA, 22 bp, Artificial Sequence
  chemically synthesized
gacttgggaacaaaatggccca

SEQ ID NO: 1347784 - DNA, 22 bp, Artificial Sequence
  chemically synthesized
gggaacaaaatggcccagagtc

SEQ ID NO: 1347785 - DNA, 22 bp, Artificial Sequence
  chemically synthesized
ggaacaaaatggcccagagtca

SEQ ID NO: 1347786 - DNA, 22 bp, Artificial Sequence
  chemically synthesized
ataagtggtaaatgggaagtga

SEQ ID NO: 1347787 - DNA, 22 bp, Artificial Sequence
  chemically synthesized
aaggccacaccattcataagtg

SEQ ID NO: 1347788 - DNA, 22 bp, Artificial Sequence
  chemically synthesized
cccatttaccacttatgaatgg

SEQ ID NO: 1347789 - DNA, 22 bp, Artificial Sequence
  chemically synthesized
ccatttaccacttatgaatggt

SEQ ID NO: 1347790 - DNA, 22 bp, Artificial Sequence
  chemically synthesized
accacttatgaatggtgtggcc

SEQ ID NO: 1347791 - DNA, 22 bp, Artificial Sequence
  chemically synthesized
ccacttatgaatggtgtggcct

SEQ ID NO: 1347792 - DNA, 22 bp, Artificial Sequence
  chemically synthesized
atgagcatgctgaaggccacac

SEQ ID NO: 1347793 - DNA, 22 bp, Artificial Sequence
  chemically synthesized
atgaatggtgtggccttcagca

SEQ ID NO: 1347794 - DNA, 22 bp, Artificial Sequence
  chemically synthesized
tgaatggtgtggccttcagcat

SEQ ID NO: 1347795 - DNA, 22 bp, Artificial Sequence
  chemically synthesized
aatggttaatgagcatgctgaa

SEQ ID NO: 1347796 - DNA, 22 bp, Artificial Sequence
  chemically synthesized
agacactgaatggttaatgagc

SEQ ID NO: 1347797 - DNA, 22 bp, Artificial Sequence
  chemically synthesized
aagacactgaatggttaatgag

SEQ ID NO: 1347798 - DNA, 22 bp, Artificial Sequence
  chemically synthesized
cagcatgctcattaaccattca

SEQ ID NO: 1347799 - DNA, 22 bp, Artificial Sequence
  chemically synthesized
agcatgctcattaaccattcag

SEQ ID NO: 1347800 - DNA, 22 bp, Artificial Sequence
  chemically synthesized
cacaaaaggaatttaagacact

SEQ ID NO: 1347801 - DNA, 22 bp, Artificial Sequence
  chemically synthesized
attaaccattcagtgtcttaaa

SEQ ID NO: 1347802 - DNA, 22 bp, Artificial Sequence
  chemically synthesized
acacaaaaggaatttaagacac

SEQ ID NO: 1347803 - DNA, 22 bp, Artificial Sequence
  chemically synthesized
tacacaaaaggaatttaagaca

SEQ ID NO: 1347804 - DNA, 22 bp, Artificial Sequence
  chemically synthesized
tttacacaaaaggaatttaaga

SEQ ID NO: 1347805 - DNA, 22 bp, Artificial Sequence
  chemically synthesized
accattcagtgtcttaaattcc

SEQ ID NO: 1347806 - DNA, 22 bp, Artificial Sequence
  chemically synthesized
tctttacacaaaaggaatttaa

SEQ ID NO: 1347807 - DNA, 22 bp, Artificial Sequence
  chemically synthesized
tctctttacacaaaaggaattt

SEQ ID NO: 1347808 - DNA, 22 bp, Artificial Sequence
  chemically synthesized
agtgtcttaaattccttttgtg

SEQ ID NO: 1347809 - DNA, 22 bp, Artificial Sequence
  chemically synthesized
aaattccttttgtgtaaagaga

SEQ ID NO: 1347810 - DNA, 22 bp, Artificial Sequence
  chemically synthesized
aattccttttgtgtaaagagag

SEQ ID NO: 1347811 - DNA, 22 bp, Artificial Sequence
  chemically synthesized
cttttgtgtaaagagagaatat

SEQ ID NO: 1347812 - DNA, 22 bp, Artificial Sequence
  chemically synthesized
aatgatatatgataatattctc

SEQ ID NO: 1347813 - DNA, 22 bp, Artificial Sequence
  chemically synthesized
ttgtgtaaagagagaatattat

SEQ ID NO: 1347814 - DNA, 22 bp, Artificial Sequence
  chemically synthesized
aaatgatatatgataatattct

SEQ ID NO: 1347815 - DNA, 22 bp, Artificial Sequence
  chemically synthesized
tgtgtaaagagagaatattatc

SEQ ID NO: 1347816 - DNA, 22 bp, Artificial Sequence
  chemically synthesized
taaatgatatatgataatattc

SEQ ID NO: 1347817 - DNA, 22 bp, Artificial Sequence
  chemically synthesized
gtgtaaagagagaatattatca

SEQ ID NO: 1347818 - DNA, 22 bp, Artificial Sequence
  chemically synthesized
tgtaaagagagaatattatcat

SEQ ID NO: 1347819 - DNA, 22 bp, Artificial Sequence
  chemically synthesized
taaagcctttaaatgatatatg

SEQ ID NO: 1347820 - DNA, 22 bp, Artificial Sequence
  chemically synthesized
ataaagcctttaaatgatatat

SEQ ID NO: 1347821 - DNA, 22 bp, Artificial Sequence
  chemically synthesized
tataaagcctttaaatgatata

SEQ ID NO: 1347822 - DNA, 22 bp, Artificial Sequence
  chemically synthesized
atctttataaagcctttaaatg

SEQ ID NO: 1347823 - DNA, 22 bp, Artificial Sequence
  chemically synthesized
aatctttataaagcctttaaat

SEQ ID NO: 1347824 - DNA, 22 bp, Artificial Sequence
  chemically synthesized
tcatatatcatttaaaggcttt

SEQ ID NO: 1347825 - DNA, 22 bp, Artificial Sequence
  chemically synthesized
atttaatctttataaagccttt

SEQ ID NO: 1347826 - DNA, 22 bp, Artificial Sequence
  chemically synthesized
actcatttaatctttataaagc

SEQ ID NO: 1347827 - DNA, 22 bp, Artificial Sequence
  chemically synthesized
aaaggctttataaagattaaat

SEQ ID NO: 1347828 - DNA, 22 bp, Artificial Sequence
  chemically synthesized
aaggctttataaagattaaatg

SEQ ID NO: 1347829 - DNA, 22 bp, Artificial Sequence
  chemically synthesized
taaatattaactcatttaatct

SEQ ID NO: 1347830 - DNA, 22 bp, Artificial Sequence
  chemically synthesized
ataaatattaactcatttaatc

SEQ ID NO: 1347831 - DNA, 22 bp, Artificial Sequence
  chemically synthesized
tataaatattaactcatttaat

SEQ ID NO: 1347832 - DNA, 22 bp, Artificial Sequence
  chemically synthesized
tataaagattaaatgagttaat

SEQ ID NO: 1347833 - DNA, 22 bp, Artificial Sequence
  chemically synthesized
ataaagattaaatgagttaata

SEQ ID NO: 1347834 - DNA, 22 bp, Artificial Sequence
  chemically synthesized
taaagattaaatgagttaatat

SEQ ID NO: 1347835 - DNA, 22 bp, Artificial Sequence
  chemically synthesized
agcactttataaatattaactc

SEQ ID NO: 1347836 - DNA, 22 bp, Artificial Sequence
  chemically synthesized
taagcactttataaatattaac

SEQ ID NO: 1347837 - DNA, 22 bp, Artificial Sequence
  chemically synthesized
ctaagcactttataaatattaa

SEQ ID NO: 1347838 - DNA, 22 bp, Artificial Sequence
  chemically synthesized
tctaagcactttataaatatta

SEQ ID NO: 1347839 - DNA, 22 bp, Artificial Sequence
  chemically synthesized
ttctaagcactttataaatatt

SEQ ID NO: 1347840 - DNA, 22 bp, Artificial Sequence
  chemically synthesized
tttctaagcactttataaatat

SEQ ID NO: 1347841 - DNA, 22 bp, Artificial Sequence
  chemically synthesized
aatgagttaatatttataaagt

SEQ ID NO: 1347842 - DNA, 22 bp, Artificial Sequence
  chemically synthesized
atatttataaagtgcttagaaa

SEQ ID NO: 1347843 - DNA, 22 bp, Artificial Sequence
  chemically synthesized
tgtgccagacattttttctaag

SEQ ID NO: 1347844 - DNA, 22 bp, Artificial Sequence
  chemically synthesized
ctgtgtgccagacattttttct

SEQ ID NO: 1347845 - DNA, 22 bp, Artificial Sequence
  chemically synthesized
ataaagtgcttagaaaaaatgt

SEQ ID NO: 1347846 - DNA, 22 bp, Artificial Sequence
  chemically synthesized
actgtgtgccagacattttttc

SEQ ID NO: 1347847 - DNA, 22 bp, Artificial Sequence
  chemically synthesized
taaagtgcttagaaaaaatgtc

SEQ ID NO: 1347848 - DNA, 22 bp, Artificial Sequence
  chemically synthesized
atggtgcttactgtgtgccaga

SEQ ID NO: 1347849 - DNA, 22 bp, Artificial Sequence
  chemically synthesized
agaaaaaatgtctggcacacag

SEQ ID NO: 1347850 - DNA, 22 bp, Artificial Sequence
  chemically synthesized
gaaaaaatgtctggcacacagt

SEQ ID NO: 1347851 - DNA, 22 bp, Artificial Sequence
  chemically synthesized
tcaagccattaatggtgcttac

SEQ ID NO: 1347852 - DNA, 22 bp, Artificial Sequence
  chemically synthesized
atcaagccattaatggtgctta

SEQ ID NO: 1347853 - DNA, 22 bp, Artificial Sequence
  chemically synthesized
tatcaagccattaatggtgctt

SEQ ID NO: 1347854 - DNA, 22 bp, Artificial Sequence
  chemically synthesized
ttatcaagccattaatggtgct

SEQ ID NO: 1347855 - DNA, 22 bp, Artificial Sequence
  chemically synthesized
gcacacagtaagcaccattaat

SEQ ID NO: 1347856 - DNA, 22 bp, Artificial Sequence
  chemically synthesized
cttttatcaagccattaatggt

SEQ ID NO: 1347857 - DNA, 22 bp, Artificial Sequence
  chemically synthesized
tcaaattacttttatcaagcca

SEQ ID NO: 1347858 - DNA, 22 bp, Artificial Sequence
  chemically synthesized
cctgtcaaattacttttatcaa

SEQ ID NO: 1347859 - DNA, 22 bp, Artificial Sequence
  chemically synthesized
acctgtcaaattacttttatca

SEQ ID NO: 1347860 - DNA, 22 bp, Artificial Sequence
  chemically synthesized
gtttacctgtcaaattactttt

SEQ ID NO: 1347861 - DNA, 22 bp, Artificial Sequence
  chemically synthesized
atggcttgataaaagtaatttg

SEQ ID NO: 1347862 - DNA, 22 bp, Artificial Sequence
  chemically synthesized
ttggtttacctgtcaaattact

SEQ ID NO: 1347863 - DNA, 22 bp, Artificial Sequence
  chemically synthesized
gataaaagtaatttgacaggta

SEQ ID NO: 1347864 - DNA, 22 bp, Artificial Sequence
  chemically synthesized
ataaaagtaatttgacaggtaa

SEQ ID NO: 1347865 - DNA, 22 bp, Artificial Sequence
  chemically synthesized
caaaatagaaagagtactgttg

SEQ ID NO: 1347866 - DNA, 22 bp, Artificial Sequence
  chemically synthesized
gacaggtaaaccaacagtactc

SEQ ID NO: 1347867 - DNA, 22 bp, Artificial Sequence
  chemically synthesized
acaggtaaaccaacagtactct

SEQ ID NO: 1347868 - DNA, 22 bp, Artificial Sequence
  chemically synthesized
acattacaaaatagaaagagta

SEQ ID NO: 1347869 - DNA, 22 bp, Artificial Sequence
  chemically synthesized
gacattacaaaatagaaagagt

SEQ ID NO: 1347870 - DNA, 22 bp, Artificial Sequence
  chemically synthesized
tttctattttgtaatgtcaaat

SEQ ID NO: 1347871 - DNA, 22 bp, Artificial Sequence
  chemically synthesized
aagtgtagccatgatttgacat

SEQ ID NO: 1347872 - DNA, 22 bp, Artificial Sequence
  chemically synthesized
tctattttgtaatgtcaaatca

SEQ ID NO: 1347873 - DNA, 22 bp, Artificial Sequence
  chemically synthesized
ctattttgtaatgtcaaatcat

SEQ ID NO: 1347874 - DNA, 22 bp, Artificial Sequence
  chemically synthesized
tattttgtaatgtcaaatcatg

SEQ ID NO: 1347875 - DNA, 22 bp, Artificial Sequence
  chemically synthesized
ttttgtaatgtcaaatcatggc

SEQ ID NO: 1347876 - DNA, 22 bp, Artificial Sequence
  chemically synthesized
agagttcaagtgtagccatgat

SEQ ID NO: 1347877 - DNA, 22 bp, Artificial Sequence
  chemically synthesized
tgtaatgtcaaatcatggctac

SEQ ID NO: 1347878 - DNA, 22 bp, Artificial Sequence
  chemically synthesized
gtaatgtcaaatcatggctaca

SEQ ID NO: 1347879 - DNA, 22 bp, Artificial Sequence
  chemically synthesized
taatgtcaaatcatggctacac

SEQ ID NO: 1347880 - DNA, 22 bp, Artificial Sequence
  chemically synthesized
tctcagagttcaagtgtagcca

SEQ ID NO: 1347881 - DNA, 22 bp, Artificial Sequence
  chemically synthesized
atctcagagttcaagtgtagcc

SEQ ID NO: 1347882 - DNA, 22 bp, Artificial Sequence
  chemically synthesized
tatctcagagttcaagtgtagc

SEQ ID NO: 1347883 - DNA, 22 bp, Artificial Sequence
  chemically synthesized
tttatctcagagttcaagtgta

SEQ ID NO: 1347884 - DNA, 22 bp, Artificial Sequence
  chemically synthesized
tctttatctcagagttcaagtg

SEQ ID NO: 1347885 - DNA, 22 bp, Artificial Sequence
  chemically synthesized
ctctttatctcagagttcaagt

SEQ ID NO: 1347886 - DNA, 22 bp, Artificial Sequence
  chemically synthesized
tctctttatctcagagttcaag

SEQ ID NO: 1347887 - DNA, 22 bp, Artificial Sequence
  chemically synthesized
cacttgaactctgagataaaga

SEQ ID NO: 1347888 - DNA, 22 bp, Artificial Sequence
  chemically synthesized
gaactctgagataaagagaaag

SEQ ID NO: 1347889 - DNA, 22 bp, Artificial Sequence
  chemically synthesized
catgcccccaatctttctcttt

SEQ ID NO: 1347890 - DNA, 22 bp, Artificial Sequence
  chemically synthesized
aactctgagataaagagaaaga

SEQ ID NO: 1347891 - DNA, 22 bp, Artificial Sequence
  chemically synthesized
ccatgcccccaatctttctctt

SEQ ID NO: 1347892 - DNA, 22 bp, Artificial Sequence
  chemically synthesized
ttccatgcccccaatctttctc

SEQ ID NO: 1347893 - DNA, 22 bp, Artificial Sequence
  chemically synthesized
tgagataaagagaaagattggg

SEQ ID NO: 1347894 - DNA, 22 bp, Artificial Sequence
  chemically synthesized
ctcttccatgcccccaatcttt

SEQ ID NO: 1347895 - DNA, 22 bp, Artificial Sequence
  chemically synthesized
agataaagagaaagattggggg

SEQ ID NO: 1347896 - DNA, 22 bp, Artificial Sequence
  chemically synthesized
ggggcatggaagagtagcgtgt

SEQ ID NO: 1347897 - DNA, 22 bp, Artificial Sequence
  chemically synthesized
aatatatacacacacaaacaca

SEQ ID NO: 1347898 - DNA, 22 bp, Artificial Sequence
  chemically synthesized
acacctaaatatatacacacac

SEQ ID NO: 1347899 - DNA, 22 bp, Artificial Sequence
  chemically synthesized
aacacctaaatatatacacaca

SEQ ID NO: 1347900 - DNA, 22 bp, Artificial Sequence
  chemically synthesized
taacacctaaatatatacacac

SEQ ID NO: 1347901 - DNA, 22 bp, Artificial Sequence
  chemically synthesized
gtgtgtgtatatatttaggtgt

SEQ ID NO: 1347902 - DNA, 22 bp, Artificial Sequence
  chemically synthesized
tgtgtgtatatatttaggtgtt

SEQ ID NO: 1347903 - DNA, 22 bp, Artificial Sequence
  chemically synthesized
gataaaatattttaacacctaa

SEQ ID NO: 1347904 - DNA, 22 bp, Artificial Sequence
  chemically synthesized
agataaaatattttaacaccta

SEQ ID NO: 1347905 - DNA, 22 bp, Artificial Sequence
  chemically synthesized
cggaaacttagataaaatattt

SEQ ID NO: 1347906 - DNA, 22 bp, Artificial Sequence
  chemically synthesized
aggtgttaaaatattttatcta

SEQ ID NO: 1347907 - DNA, 22 bp, Artificial Sequence
  chemically synthesized
ggtgttaaaatattttatctaa

SEQ ID NO: 1347908 - DNA, 22 bp, Artificial Sequence
  chemically synthesized
tgcagaattccggaaacttaga

SEQ ID NO: 1347909 - DNA, 22 bp, Artificial Sequence
  chemically synthesized
aaatattttatctaagtttccg

SEQ ID NO: 1347910 - DNA, 22 bp, Artificial Sequence
  chemically synthesized
cattgtgcagaattccggaaac

SEQ ID NO: 1347911 - DNA, 22 bp, Artificial Sequence
  chemically synthesized
actacattgtgcagaattccgg

SEQ ID NO: 1347912 - DNA, 22 bp, Artificial Sequence
  chemically synthesized
tatctaagtttccggaattctg

SEQ ID NO: 1347913 - DNA, 22 bp, Artificial Sequence
  chemically synthesized
cactacattgtgcagaattccg

SEQ ID NO: 1347914 - DNA, 22 bp, Artificial Sequence
  chemically synthesized
atctaagtttccggaattctgc

SEQ ID NO: 1347915 - DNA, 22 bp, Artificial Sequence
  chemically synthesized
tcactacattgtgcagaattcc

SEQ ID NO: 1347916 - DNA, 22 bp, Artificial Sequence
  chemically synthesized
tctaagtttccggaattctgca

SEQ ID NO: 1347917 - DNA, 22 bp, Artificial Sequence
  chemically synthesized
ttttcactacattgtgcagaat

SEQ ID NO: 1347918 - DNA, 22 bp, Artificial Sequence
  chemically synthesized
attttcactacattgtgcagaa

SEQ ID NO: 1347919 - DNA, 22 bp, Artificial Sequence
  chemically synthesized
agtttccggaattctgcacaat

SEQ ID NO: 1347920 - DNA, 22 bp, Artificial Sequence
  chemically synthesized
ccggaattctgcacaatgtagt

SEQ ID NO: 1347921 - DNA, 22 bp, Artificial Sequence
  chemically synthesized
cggaattctgcacaatgtagtg

SEQ ID NO: 1347922 - DNA, 22 bp, Artificial Sequence
  chemically synthesized
ccaatttattttcactacattg

SEQ ID NO: 1347923 - DNA, 22 bp, Artificial Sequence
  chemically synthesized
accaatttattttcactacatt

SEQ ID NO: 1347924 - DNA, 22 bp, Artificial Sequence
  chemically synthesized
taccaatttattttcactacat

SEQ ID NO: 1347925 - DNA, 22 bp, Artificial Sequence
  chemically synthesized
tgcacaatgtagtgaaaataaa

SEQ ID NO: 1347926 - DNA, 22 bp, Artificial Sequence
  chemically synthesized
cacaatgtagtgaaaataaatt

SEQ ID NO: 1347927 - DNA, 22 bp, Artificial Sequence
  chemically synthesized
gccataaacgtgattttaccaa

SEQ ID NO: 1347928 - DNA, 22 bp, Artificial Sequence
  chemically synthesized
ccattagccataaacgtgattt

SEQ ID NO: 1347929 - DNA, 22 bp, Artificial Sequence
  chemically synthesized
gccattagccataaacgtgatt

SEQ ID NO: 1347930 - DNA, 22 bp, Artificial Sequence
  chemically synthesized
gtaaaatcacgtttatggctaa

SEQ ID NO: 1347931 - DNA, 22 bp, Artificial Sequence
  chemically synthesized
tatatatgtttgccattagcca

SEQ ID NO: 1347932 - DNA, 22 bp, Artificial Sequence
  chemically synthesized
ccacattgtatatatgtttgcc

SEQ ID NO: 1347933 - DNA, 22 bp, Artificial Sequence
  chemically synthesized
atggctaatggcaaacatatat

SEQ ID NO: 1347934 - DNA, 22 bp, Artificial Sequence
  chemically synthesized
tggctaatggcaaacatatata

SEQ ID NO: 1347935 - DNA, 22 bp, Artificial Sequence
  chemically synthesized
atggcaaacatatatacaatgt

SEQ ID NO: 1347936 - DNA, 22 bp, Artificial Sequence
  chemically synthesized
gaagtagtaattgccacattgt

SEQ ID NO: 1347937 - DNA, 22 bp, Artificial Sequence
  chemically synthesized
ggaagtagtaattgccacattg

SEQ ID NO: 1347938 - DNA, 22 bp, Artificial Sequence
  chemically synthesized
tggaagtagtaattgccacatt

SEQ ID NO: 1347939 - DNA, 22 bp, Artificial Sequence
  chemically synthesized
aacagtattttggaagtagtaa

SEQ ID NO: 1347940 - DNA, 22 bp, Artificial Sequence
  chemically synthesized
ttcaacagtattttggaagtag

SEQ ID NO: 1347941 - DNA, 22 bp, Artificial Sequence
  chemically synthesized
gttcaacagtattttggaagta

SEQ ID NO: 1347942 - DNA, 22 bp, Artificial Sequence
  chemically synthesized
tgttcaacagtattttggaagt

SEQ ID NO: 1347943 - DNA, 22 bp, Artificial Sequence
  chemically synthesized
ttgttcaacagtattttggaag

SEQ ID NO: 1347944 - DNA, 22 bp, Artificial Sequence
  chemically synthesized
tttgttcaacagtattttggaa

SEQ ID NO: 1347945 - DNA, 22 bp, Artificial Sequence
  chemically synthesized
ttttttgttcaacagtattttg

SEQ ID NO: 1347946 - DNA, 22 bp, Artificial Sequence
  chemically synthesized
ctacttccaaaatactgttgaa

SEQ ID NO: 1347947 - DNA, 22 bp, Artificial Sequence
  chemically synthesized
cttccaaaatactgttgaacaa

SEQ ID NO: 1347948 - DNA, 22 bp, Artificial Sequence
  chemically synthesized
ccaaaatactgttgaacaaaaa

SEQ ID NO: 1347949 - DNA, 22 bp, Artificial Sequence
  chemically synthesized
caaaatactgttgaacaaaaaa

SEQ ID NO: 1347950 - DNA, 22 bp, Artificial Sequence
  chemically synthesized
ttgaacaaaaaataactttatt

SEQ ID NO: 1347951 - DNA, 22 bp, Artificial Sequence
  chemically synthesized
aaaaatatatagtaaataaagt

SEQ ID NO: 1347952 - DNA, 22 bp, Artificial Sequence
  chemically synthesized
aacaaaaaataactttatttac

SEQ ID NO: 1347953 - DNA, 22 bp, Artificial Sequence
  chemically synthesized
atgttaaaaaatatatagtaaa

SEQ ID NO: 1347954 - DNA, 22 bp, Artificial Sequence
  chemically synthesized
tgatgttaaaaaatatatagta

SEQ ID NO: 1347955 - DNA, 22 bp, Artificial Sequence
  chemically synthesized
ctgatgttaaaaaatatatagt

SEQ ID NO: 1347956 - DNA, 22 bp, Artificial Sequence
  chemically synthesized
tctgatgttaaaaaatatatag

SEQ ID NO: 1347957 - DNA, 22 bp, Artificial Sequence
  chemically synthesized
tttctgatgttaaaaaatatat

SEQ ID NO: 1347958 - DNA, 22 bp, Artificial Sequence
  chemically synthesized
tatttactatatattttttaac

SEQ ID NO: 1347959 - DNA, 22 bp, Artificial Sequence
  chemically synthesized
atttactatatattttttaaca

SEQ ID NO: 1347960 - DNA, 22 bp, Artificial Sequence
  chemically synthesized
tttactatatattttttaacat

SEQ ID NO: 1347961 - DNA, 22 bp, Artificial Sequence
  chemically synthesized
actatatattttttaacatcag

SEQ ID NO: 1347962 - DNA, 22 bp, Artificial Sequence
  chemically synthesized
ctatatattttttaacatcaga

SEQ ID NO: 1347963 - DNA, 22 bp, Artificial Sequence
  chemically synthesized
tatattttttaacatcagaaag

SEQ ID NO: 1347964 - DNA, 22 bp, Artificial Sequence
  chemically synthesized
taggatcccaacgttctttctg

SEQ ID NO: 1347965 - DNA, 22 bp, Artificial Sequence
  chemically synthesized
tttaacatcagaaagaacgttg

SEQ ID NO: 1347966 - DNA, 22 bp, Artificial Sequence
  chemically synthesized
ttaacatcagaaagaacgttgg

SEQ ID NO: 1347967 - DNA, 22 bp, Artificial Sequence
  chemically synthesized
taacatcagaaagaacgttggg

SEQ ID NO: 1347968 - DNA, 22 bp, Artificial Sequence
  chemically synthesized
aacatcagaaagaacgttggga

SEQ ID NO: 1347969 - DNA, 22 bp, Artificial Sequence
  chemically synthesized
acatcagaaagaacgttgggat

SEQ ID NO: 1347970 - DNA, 22 bp, Artificial Sequence
  chemically synthesized
gcaggattgtaggatcccaacg

SEQ ID NO: 1347971 - DNA, 22 bp, Artificial Sequence
  chemically synthesized
ggcaggattgtaggatcccaac

SEQ ID NO: 1347972 - DNA, 22 bp, Artificial Sequence
  chemically synthesized
ggatcctacaatcctgccaaat

SEQ ID NO: 1347973 - DNA, 22 bp, Artificial Sequence
  chemically synthesized
caatcctgccaaatcttgattt

SEQ ID NO: 1347974 - DNA, 22 bp, Artificial Sequence
  chemically synthesized
ccaaatcttgattttgacctgt

SEQ ID NO: 1347975 - DNA, 22 bp, Artificial Sequence
  chemically synthesized
caatcccagtaccatacaggtc

SEQ ID NO: 1347976 - DNA, 22 bp, Artificial Sequence
  chemically synthesized
gattttgacctgtatggtactg

SEQ ID NO: 1347977 - DNA, 22 bp, Artificial Sequence
  chemically synthesized
attttgacctgtatggtactgg

SEQ ID NO: 1347978 - DNA, 22 bp, Artificial Sequence
  chemically synthesized
agcccactacaatcccagtacc

SEQ ID NO: 1347979 - DNA, 22 bp, Artificial Sequence
  chemically synthesized
tgacctgtatggtactgggatt

SEQ ID NO: 1347980 - DNA, 22 bp, Artificial Sequence
  chemically synthesized
gacctgtatggtactgggattg

SEQ ID NO: 1347981 - DNA, 22 bp, Artificial Sequence
  chemically synthesized
acctgtatggtactgggattgt

SEQ ID NO: 1347982 - DNA, 22 bp, Artificial Sequence
  chemically synthesized
tatggtactgggattgtagtgg

SEQ ID NO: 1347983 - DNA, 22 bp, Artificial Sequence
  chemically synthesized
ggattgtagtgggctcaggtgt

SEQ ID NO: 1347984 - DNA, 22 bp, Artificial Sequence
  chemically synthesized
aaaggtcaacaaaacacctgag

SEQ ID NO: 1347985 - DNA, 22 bp, Artificial Sequence
  chemically synthesized
tagtgggctcaggtgttttgtt

SEQ ID NO: 1347986 - DNA, 22 bp, Artificial Sequence
  chemically synthesized
ataattcaaaggtcaacaaaac

SEQ ID NO: 1347987 - DNA, 22 bp, Artificial Sequence
  chemically synthesized
aggtgttttgttgacctttgaa

SEQ ID NO: 1347988 - DNA, 22 bp, Artificial Sequence
  chemically synthesized
agagtatggctaataattcaaa

SEQ ID NO: 1347989 - DNA, 22 bp, Artificial Sequence
  chemically synthesized
cagagtatggctaataattcaa

SEQ ID NO: 1347990 - DNA, 22 bp, Artificial Sequence
  chemically synthesized
tcagagtatggctaataattca

SEQ ID NO: 1347991 - DNA, 22 bp, Artificial Sequence
  chemically synthesized
tgttgacctttgaattattagc

SEQ ID NO: 1347992 - DNA, 22 bp, Artificial Sequence
  chemically synthesized
gttgacctttgaattattagcc

SEQ ID NO: 1347993 - DNA, 22 bp, Artificial Sequence
  chemically synthesized
ttgacctttgaattattagcca

SEQ ID NO: 1347994 - DNA, 22 bp, Artificial Sequence
  chemically synthesized
acctttgaattattagccatac

SEQ ID NO: 1347995 - DNA, 22 bp, Artificial Sequence
  chemically synthesized
aaaaacaactttcagagtatgg

SEQ ID NO: 1347996 - DNA, 22 bp, Artificial Sequence
  chemically synthesized
tgaattattagccatactctga

SEQ ID NO: 1347997 - DNA, 22 bp, Artificial Sequence
  chemically synthesized
caaaaacaactttcagagtatg

SEQ ID NO: 1347998 - DNA, 22 bp, Artificial Sequence
  chemically synthesized
gaattattagccatactctgaa

SEQ ID NO: 1347999 - DNA, 22 bp, Artificial Sequence
  chemically synthesized
aattattagccatactctgaaa

SEQ ID NO: 1348000 - DNA, 22 bp, Artificial Sequence
  chemically synthesized
aatttcaaaaacaactttcaga

SEQ ID NO: 1348001 - DNA, 22 bp, Artificial Sequence
  chemically synthesized
ttagccatactctgaaagttgt

SEQ ID NO: 1348002 - DNA, 22 bp, Artificial Sequence
  chemically synthesized
gccatactctgaaagttgtttt

SEQ ID NO: 1348003 - DNA, 22 bp, Artificial Sequence
  chemically synthesized
ggattcaatttcaaaaacaact

SEQ ID NO: 1348004 - DNA, 22 bp, Artificial Sequence
  chemically synthesized
taggattcaatttcaaaaacaa

SEQ ID NO: 1348005 - DNA, 22 bp, Artificial Sequence
  chemically synthesized
ctaggattcaatttcaaaaaca

SEQ ID NO: 1348006 - DNA, 22 bp, Artificial Sequence
  chemically synthesized
tctaggattcaatttcaaaaac

SEQ ID NO: 1348007 - DNA, 22 bp, Artificial Sequence
  chemically synthesized
tgaaagttgtttttgaaattga

SEQ ID NO: 1348008 - DNA, 22 bp, Artificial Sequence
  chemically synthesized
aaagttgtttttgaaattgaat

SEQ ID NO: 1348009 - DNA, 22 bp, Artificial Sequence
  chemically synthesized
tttttgaaattgaatcctagaa

SEQ ID NO: 1348010 - DNA, 22 bp, Artificial Sequence
  chemically synthesized
tatatcaggaattttctaggat

SEQ ID NO: 1348011 - DNA, 22 bp, Artificial Sequence
  chemically synthesized
ttgaaattgaatcctagaaaat

SEQ ID NO: 1348012 - DNA, 22 bp, Artificial Sequence
  chemically synthesized
tgaaattgaatcctagaaaatt

SEQ ID NO: 1348013 - DNA, 22 bp, Artificial Sequence
  chemically synthesized
gaaattgaatcctagaaaattc

SEQ ID NO: 1348014 - DNA, 22 bp, Artificial Sequence
  chemically synthesized
aaattgaatcctagaaaattcc

SEQ ID NO: 1348015 - DNA, 22 bp, Artificial Sequence
  chemically synthesized
aatcctagaaaattcctgatat

SEQ ID NO: 1348016 - DNA, 22 bp, Artificial Sequence
  chemically synthesized
caaaaaaaaaagctatatatca

SEQ ID NO: 1348017 - DNA, 22 bp, Artificial Sequence
  chemically synthesized
ccaaaaaaaaaagctatatatc

SEQ ID NO: 1348018 - DNA, 22 bp, Artificial Sequence
  chemically synthesized
gaaaattcctgatatatagctt

SEQ ID NO: 1348019 - DNA, 22 bp, Artificial Sequence
  chemically synthesized
ctgatatatagctttttttttt

SEQ ID NO: 1348020 - DNA, 22 bp, Artificial Sequence
  chemically synthesized
aatgcaagtttccaaaaaaaaa

SEQ ID NO: 1348021 - DNA, 22 bp, Artificial Sequence
  chemically synthesized
atatatagcttttttttttgga

SEQ ID NO: 1348022 - DNA, 22 bp, Artificial Sequence
  chemically synthesized
tctgaatgcaagtttccaaaaa

SEQ ID NO: 1348023 - DNA, 22 bp, Artificial Sequence
  chemically synthesized
ttttttttggaaacttgcattc

SEQ ID NO: 1348024 - DNA, 22 bp, Artificial Sequence
  chemically synthesized
tttttttggaaacttgcattca

SEQ ID NO: 1348025 - DNA, 22 bp, Artificial Sequence
  chemically synthesized
ttttttggaaacttgcattcag

SEQ ID NO: 1348026 - DNA, 22 bp, Artificial Sequence
  chemically synthesized
tttttggaaacttgcattcaga

SEQ ID NO: 1348027 - DNA, 22 bp, Artificial Sequence
  chemically synthesized
agacccaaattatctgaatgca

SEQ ID NO: 1348028 - DNA, 22 bp, Artificial Sequence
  chemically synthesized
ttttggaaacttgcattcagat

SEQ ID NO: 1348029 - DNA, 22 bp, Artificial Sequence
  chemically synthesized
aagacccaaattatctgaatgc

SEQ ID NO: 1348030 - DNA, 22 bp, Artificial Sequence
  chemically synthesized
tttggaaacttgcattcagata

SEQ ID NO: 1348031 - DNA, 22 bp, Artificial Sequence
  chemically synthesized
ttggaaacttgcattcagataa

SEQ ID NO: 1348032 - DNA, 22 bp, Artificial Sequence
  chemically synthesized
tggaaacttgcattcagataat

SEQ ID NO: 1348033 - DNA, 22 bp, Artificial Sequence
  chemically synthesized
ggaaacttgcattcagataatt

SEQ ID NO: 1348034 - DNA, 22 bp, Artificial Sequence
  chemically synthesized
ccttaagacccaaattatctga

SEQ ID NO: 1348035 - DNA, 22 bp, Artificial Sequence
  chemically synthesized
gaaacttgcattcagataattt

SEQ ID NO: 1348036 - DNA, 22 bp, Artificial Sequence
  chemically synthesized
accttaagacccaaattatctg

SEQ ID NO: 1348037 - DNA, 22 bp, Artificial Sequence
  chemically synthesized
aatttaccttaagacccaaatt

SEQ ID NO: 1348038 - DNA, 22 bp, Artificial Sequence
  chemically synthesized
aaatttaccttaagacccaaat

SEQ ID NO: 1348039 - DNA, 22 bp, Artificial Sequence
  chemically synthesized
gcattcagataatttgggtctt

SEQ ID NO: 1348040 - DNA, 22 bp, Artificial Sequence
  chemically synthesized
cattcagataatttgggtctta

SEQ ID NO: 1348041 - DNA, 22 bp, Artificial Sequence
  chemically synthesized
atttaaatttaccttaagaccc

SEQ ID NO: 1348042 - DNA, 22 bp, Artificial Sequence
  chemically synthesized
agataatttgggtcttaaggta

SEQ ID NO: 1348043 - DNA, 22 bp, Artificial Sequence
  chemically synthesized
aatagggttaatttaaatttac

SEQ ID NO: 1348044 - DNA, 22 bp, Artificial Sequence
  chemically synthesized
gggtcttaaggtaaatttaaat

SEQ ID NO: 1348045 - DNA, 22 bp, Artificial Sequence
  chemically synthesized
taaatagggttaatttaaattt

SEQ ID NO: 1348046 - DNA, 22 bp, Artificial Sequence
  chemically synthesized
ggtcttaaggtaaatttaaatt

SEQ ID NO: 1348047 - DNA, 22 bp, Artificial Sequence
  chemically synthesized
ctaaatagggttaatttaaatt

SEQ ID NO: 1348048 - DNA, 22 bp, Artificial Sequence
  chemically synthesized
aaggtaaatttaaattaaccct

SEQ ID NO: 1348049 - DNA, 22 bp, Artificial Sequence
  chemically synthesized
acgtttctaaatagggttaatt

SEQ ID NO: 1348050 - DNA, 22 bp, Artificial Sequence
  chemically synthesized
aggtaaatttaaattaacccta

SEQ ID NO: 1348051 - DNA, 22 bp, Artificial Sequence
  chemically synthesized
gacgtttctaaatagggttaat

SEQ ID NO: 1348052 - DNA, 22 bp, Artificial Sequence
  chemically synthesized
cttgacgtttctaaatagggtt

SEQ ID NO: 1348053 - DNA, 22 bp, Artificial Sequence
  chemically synthesized
ccttgacgtttctaaatagggt

SEQ ID NO: 1348054 - DNA, 22 bp, Artificial Sequence
  chemically synthesized
atttccttgacgtttctaaata

SEQ ID NO: 1348055 - DNA, 22 bp, Artificial Sequence
  chemically synthesized
aatttccttgacgtttctaaat

SEQ ID NO: 1348056 - DNA, 22 bp, Artificial Sequence
  chemically synthesized
aaattaaccctatttagaaacg

SEQ ID NO: 1348057 - DNA, 22 bp, Artificial Sequence
  chemically synthesized
aattaaccctatttagaaacgt

SEQ ID NO: 1348058 - DNA, 22 bp, Artificial Sequence
  chemically synthesized
accctatttagaaacgtcaagg

SEQ ID NO: 1348059 - DNA, 22 bp, Artificial Sequence
  chemically synthesized
atatgtttaatttccttgacgt

SEQ ID NO: 1348060 - DNA, 22 bp, Artificial Sequence
  chemically synthesized
aatatgtttaatttccttgacg

SEQ ID NO: 1348061 - DNA, 22 bp, Artificial Sequence
  chemically synthesized
taatatgtttaatttccttgac

SEQ ID NO: 1348062 - DNA, 22 bp, Artificial Sequence
  chemically synthesized
tttaatatgtttaatttccttg

SEQ ID NO: 1348063 - DNA, 22 bp, Artificial Sequence
  chemically synthesized
tttagaaacgtcaaggaaatta

SEQ ID NO: 1348064 - DNA, 22 bp, Artificial Sequence
  chemically synthesized
agaaacgtcaaggaaattaaac

SEQ ID NO: 1348065 - DNA, 22 bp, Artificial Sequence
  chemically synthesized
gaaacgtcaaggaaattaaaca

SEQ ID NO: 1348066 - DNA, 22 bp, Artificial Sequence
  chemically synthesized
tatatgtgacaccaatatctct

SEQ ID NO: 1348067 - DNA, 22 bp, Artificial Sequence
  chemically synthesized
gtatatgtgacaccaatatctc

SEQ ID NO: 1348068 - DNA, 22 bp, Artificial Sequence
  chemically synthesized
aacatattaaagagatattggt

SEQ ID NO: 1348069 - DNA, 22 bp, Artificial Sequence
  chemically synthesized
aagagatattggtgtcacatat

SEQ ID NO: 1348070 - DNA, 22 bp, Artificial Sequence
  chemically synthesized
atgtaagtttgtatatgtgaca

SEQ ID NO: 1348071 - DNA, 22 bp, Artificial Sequence
  chemically synthesized
aagaaggctcatgtaagtttgt

SEQ ID NO: 1348072 - DNA, 22 bp, Artificial Sequence
  chemically synthesized
gtgtcacatatacaaacttaca

SEQ ID NO: 1348073 - DNA, 22 bp, Artificial Sequence
  chemically synthesized
ctaaagaaggctcatgtaagtt

SEQ ID NO: 1348074 - DNA, 22 bp, Artificial Sequence
  chemically synthesized
cctaaagaaggctcatgtaagt

SEQ ID NO: 1348075 - DNA, 22 bp, Artificial Sequence
  chemically synthesized
ttcctaaagaaggctcatgtaa

SEQ ID NO: 1348076 - DNA, 22 bp, Artificial Sequence
  chemically synthesized
cttcctaaagaaggctcatgta

SEQ ID NO: 1348077 - DNA, 22 bp, Artificial Sequence
  chemically synthesized
cttcttcctaaagaaggctcat

SEQ ID NO: 1348078 - DNA, 22 bp, Artificial Sequence
  chemically synthesized
gcttcttcctaaagaaggctca

SEQ ID NO: 1348079 - DNA, 22 bp, Artificial Sequence
  chemically synthesized
cttgcttcttcctaaagaaggc

SEQ ID NO: 1348080 - DNA, 22 bp, Artificial Sequence
  chemically synthesized
tctgcttgcttcttcctaaaga

SEQ ID NO: 1348081 - DNA, 22 bp, Artificial Sequence
  chemically synthesized
atctgcttgcttcttcctaaag

SEQ ID NO: 1348082 - DNA, 22 bp, Artificial Sequence
  chemically synthesized
acatgagccttctttaggaaga

SEQ ID NO: 1348083 - DNA, 22 bp, Artificial Sequence
  chemically synthesized
catgagccttctttaggaagaa

SEQ ID NO: 1348084 - DNA, 22 bp, Artificial Sequence
  chemically synthesized
atttatctgcttgcttcttcct

SEQ ID NO: 1348085 - DNA, 22 bp, Artificial Sequence
  chemically synthesized
catttatctgcttgcttcttcc

SEQ ID NO: 1348086 - DNA, 22 bp, Artificial Sequence
  chemically synthesized
tcatttatctgcttgcttcttc

SEQ ID NO: 1348087 - DNA, 22 bp, Artificial Sequence
  chemically synthesized
attttcatttatctgcttgctt

SEQ ID NO: 1348088 - DNA, 22 bp, Artificial Sequence
  chemically synthesized
ctttaggaagaagcaagcagat

SEQ ID NO: 1348089 - DNA, 22 bp, Artificial Sequence
  chemically synthesized
taattttcatttatctgcttgc

SEQ ID NO: 1348090 - DNA, 22 bp, Artificial Sequence
  chemically synthesized
tttaggaagaagcaagcagata

SEQ ID NO: 1348091 - DNA, 22 bp, Artificial Sequence
  chemically synthesized
ctaattttcatttatctgcttg

SEQ ID NO: 1348092 - DNA, 22 bp, Artificial Sequence
  chemically synthesized
tctaattttcatttatctgctt

SEQ ID NO: 1348093 - DNA, 22 bp, Artificial Sequence
  chemically synthesized
taggaagaagcaagcagataaa

SEQ ID NO: 1348094 - DNA, 22 bp, Artificial Sequence
  chemically synthesized
ttctaattttcatttatctgct

SEQ ID NO: 1348095 - DNA, 22 bp, Artificial Sequence
  chemically synthesized
aggaagaagcaagcagataaat

SEQ ID NO: 1348096 - DNA, 22 bp, Artificial Sequence
  chemically synthesized
ggaagaagcaagcagataaatg

SEQ ID NO: 1348097 - DNA, 22 bp, Artificial Sequence
  chemically synthesized
aatatttttctaattttcattt

SEQ ID NO: 1348098 - DNA, 22 bp, Artificial Sequence
  chemically synthesized
cacaattcaatatttttctaat

SEQ ID NO: 1348099 - DNA, 22 bp, Artificial Sequence
  chemically synthesized
ccacaattcaatatttttctaa

SEQ ID NO: 1348100 - DNA, 22 bp, Artificial Sequence
  chemically synthesized
tccacaattcaatatttttcta

SEQ ID NO: 1348101 - DNA, 22 bp, Artificial Sequence
  chemically synthesized
ttttccacaattcaatattttt

SEQ ID NO: 1348102 - DNA, 22 bp, Artificial Sequence
  chemically synthesized
tgttttccacaattcaatattt

SEQ ID NO: 1348103 - DNA, 22 bp, Artificial Sequence
  chemically synthesized
ctgttttccacaattcaatatt

SEQ ID NO: 1348104 - DNA, 22 bp, Artificial Sequence
  chemically synthesized
acttctgttttccacaattcaa

SEQ ID NO: 1348105 - DNA, 22 bp, Artificial Sequence
  chemically synthesized
gaaaaatattgaattgtggaaa

SEQ ID NO: 1348106 - DNA, 22 bp, Artificial Sequence
  chemically synthesized
attgacttctgttttccacaat

SEQ ID NO: 1348107 - DNA, 22 bp, Artificial Sequence
  chemically synthesized
ctcattgacttctgttttccac

SEQ ID NO: 1348108 - DNA, 22 bp, Artificial Sequence
  chemically synthesized
cctcattgacttctgttttcca

SEQ ID NO: 1348109 - DNA, 22 bp, Artificial Sequence
  chemically synthesized
tcctcattgacttctgttttcc

SEQ ID NO: 1348110 - DNA, 22 bp, Artificial Sequence
  chemically synthesized
ttcctcattgacttctgttttc

SEQ ID NO: 1348111 - DNA, 22 bp, Artificial Sequence
  chemically synthesized
atttttcctcattgacttctgt

SEQ ID NO: 1348112 - DNA, 22 bp, Artificial Sequence
  chemically synthesized
aattgtggaaaacagaagtcaa

SEQ ID NO: 1348113 - DNA, 22 bp, Artificial Sequence
  chemically synthesized
ctaatttttcctcattgacttc

SEQ ID NO: 1348114 - DNA, 22 bp, Artificial Sequence
  chemically synthesized
tggaaaacagaagtcaatgagg

SEQ ID NO: 1348115 - DNA, 22 bp, Artificial Sequence
  chemically synthesized
attactaatttttcctcattga

SEQ ID NO: 1348116 - DNA, 22 bp, Artificial Sequence
  chemically synthesized
gattaattactaatttttcctc

SEQ ID NO: 1348117 - DNA, 22 bp, Artificial Sequence
  chemically synthesized
cattggattaattactaatttt

SEQ ID NO: 1348118 - DNA, 22 bp, Artificial Sequence
  chemically synthesized
agagtactacattggattaatt

SEQ ID NO: 1348119 - DNA, 22 bp, Artificial Sequence
  chemically synthesized
gtaattaatccaatgtagtact

SEQ ID NO: 1348120 - DNA, 22 bp, Artificial Sequence
  chemically synthesized
atccaatgtagtactctgagat

SEQ ID NO: 1348121 - DNA, 22 bp, Artificial Sequence
  chemically synthesized
aaggcatcatcaatgatctcag

SEQ ID NO: 1348122 - DNA, 22 bp, Artificial Sequence
  chemically synthesized
ccagccacactcaaggcatcat

SEQ ID NO: 1348123 - DNA, 22 bp, Artificial Sequence
  chemically synthesized
tgagatcattgatgatgccttg

SEQ ID NO: 1348124 - DNA, 22 bp, Artificial Sequence
  chemically synthesized
agatcattgatgatgccttgag

SEQ ID NO: 1348125 - DNA, 22 bp, Artificial Sequence
  chemically synthesized
atgatgccttgagtgtggctgg

SEQ ID NO: 1348126 - DNA, 22 bp, Artificial Sequence
  chemically synthesized
gagtgtggctgggagtctacct

SEQ ID NO: 1348127 - DNA, 22 bp, Artificial Sequence
  chemically synthesized
agtgtggctgggagtctacctg

SEQ ID NO: 1348128 - DNA, 22 bp, Artificial Sequence
  chemically synthesized
cccatcaataatccaggtagac

SEQ ID NO: 1348129 - DNA, 22 bp, Artificial Sequence
  chemically synthesized
tccccatcaataatccaggtag

SEQ ID NO: 1348130 - DNA, 22 bp, Artificial Sequence
  chemically synthesized
ctccccatcaataatccaggta

SEQ ID NO: 1348131 - DNA, 22 bp, Artificial Sequence
  chemically synthesized
ggagtctacctggattattgat

SEQ ID NO: 1348132 - DNA, 22 bp, Artificial Sequence
  chemically synthesized
cctggattattgatggggagaa

SEQ ID NO: 1348133 - DNA, 22 bp, Artificial Sequence
  chemically synthesized
gattattgatggggagaaactt

SEQ ID NO: 1348134 - DNA, 22 bp, Artificial Sequence
  chemically synthesized
tcaccatgatcatcaaaagttt

SEQ ID NO: 1348135 - DNA, 22 bp, Artificial Sequence
  chemically synthesized
ttgatggggagaaacttttgat

SEQ ID NO: 1348136 - DNA, 22 bp, Artificial Sequence
  chemically synthesized
gtcaccatgatcatcaaaagtt

SEQ ID NO: 1348137 - DNA, 22 bp, Artificial Sequence
  chemically synthesized
tgtcaccatgatcatcaaaagt

SEQ ID NO: 1348138 - DNA, 22 bp, Artificial Sequence
  chemically synthesized
atggggagaaacttttgatgat

SEQ ID NO: 1348139 - DNA, 22 bp, Artificial Sequence
  chemically synthesized
attttgtcaccatgatcatcaa

SEQ ID NO: 1348140 - DNA, 22 bp, Artificial Sequence
  chemically synthesized
gattttgtcaccatgatcatca

SEQ ID NO: 1348141 - DNA, 22 bp, Artificial Sequence
  chemically synthesized
tgattttgtcaccatgatcatc

SEQ ID NO: 1348142 - DNA, 22 bp, Artificial Sequence
  chemically synthesized
tttgattttgtcaccatgatca

SEQ ID NO: 1348143 - DNA, 22 bp, Artificial Sequence
  chemically synthesized
tctttgattttgtcaccatgat

SEQ ID NO: 1348144 - DNA, 22 bp, Artificial Sequence
  chemically synthesized
ctctttgattttgtcaccatga

SEQ ID NO: 1348145 - DNA, 22 bp, Artificial Sequence
  chemically synthesized
ttgatgatcatggtgacaaaat

SEQ ID NO: 1348146 - DNA, 22 bp, Artificial Sequence
  chemically synthesized
tgatgatcatggtgacaaaatc

SEQ ID NO: 1348147 - DNA, 22 bp, Artificial Sequence
  chemically synthesized
cgccttctctttgattttgtca

SEQ ID NO: 1348148 - DNA, 22 bp, Artificial Sequence
  chemically synthesized
gatgatcatggtgacaaaatca

SEQ ID NO: 1348149 - DNA, 22 bp, Artificial Sequence
  chemically synthesized
acgccttctctttgattttgtc

SEQ ID NO: 1348150 - DNA, 22 bp, Artificial Sequence
  chemically synthesized
atgatcatggtgacaaaatcaa

SEQ ID NO: 1348151 - DNA, 22 bp, Artificial Sequence
  chemically synthesized
tacgccttctctttgattttgt

SEQ ID NO: 1348152 - DNA, 22 bp, Artificial Sequence
  chemically synthesized
tatcctttacgccttctctttg

SEQ ID NO: 1348153 - DNA, 22 bp, Artificial Sequence
  chemically synthesized
gggaatataactgtatccttta

SEQ ID NO: 1348154 - DNA, 22 bp, Artificial Sequence
  chemically synthesized
agggaatataactgtatccttt

SEQ ID NO: 1348155 - DNA, 22 bp, Artificial Sequence
  chemically synthesized
cttagggaatataactgtatcc

SEQ ID NO: 1348156 - DNA, 22 bp, Artificial Sequence
  chemically synthesized
acttagggaatataactgtatc

SEQ ID NO: 1348157 - DNA, 22 bp, Artificial Sequence
  chemically synthesized
tacttagggaatataactgtat

SEQ ID NO: 1348158 - DNA, 22 bp, Artificial Sequence
  chemically synthesized
ttttacttagggaatataactg

SEQ ID NO: 1348159 - DNA, 22 bp, Artificial Sequence
  chemically synthesized
attattttacttagggaatata

SEQ ID NO: 1348160 - DNA, 22 bp, Artificial Sequence
  chemically synthesized
taactaattattttacttaggg

SEQ ID NO: 1348161 - DNA, 22 bp, Artificial Sequence
  chemically synthesized
aatcctataactaattatttta

SEQ ID NO: 1348162 - DNA, 22 bp, Artificial Sequence
  chemically synthesized
tattccctaagtaaaataatta

SEQ ID NO: 1348163 - DNA, 22 bp, Artificial Sequence
  chemically synthesized
tcaatcctataactaattattt

SEQ ID NO: 1348164 - DNA, 22 bp, Artificial Sequence
  chemically synthesized
cctaagtaaaataattagttat

SEQ ID NO: 1348165 - DNA, 22 bp, Artificial Sequence
  chemically synthesized
aaattctcaatcctataactaa

SEQ ID NO: 1348166 - DNA, 22 bp, Artificial Sequence
  chemically synthesized
gaaattctcaatcctataacta

SEQ ID NO: 1348167 - DNA, 22 bp, Artificial Sequence
  chemically synthesized
agtaaaataattagttatagga

SEQ ID NO: 1348168 - DNA, 22 bp, Artificial Sequence
  chemically synthesized
tttgaaattctcaatcctataa

SEQ ID NO: 1348169 - DNA, 22 bp, Artificial Sequence
  chemically synthesized
atttgaaattctcaatcctata

SEQ ID NO: 1348170 - DNA, 22 bp, Artificial Sequence
  chemically synthesized
tatttgaaattctcaatcctat

SEQ ID NO: 1348171 - DNA, 22 bp, Artificial Sequence
  chemically synthesized
ttatttgaaattctcaatccta

SEQ ID NO: 1348172 - DNA, 22 bp, Artificial Sequence
  chemically synthesized
tttatttgaaattctcaatcct

SEQ ID NO: 1348173 - DNA, 22 bp, Artificial Sequence
  chemically synthesized
ctttttatttgaaattctcaat

SEQ ID NO: 1348174 - DNA, 22 bp, Artificial Sequence
  chemically synthesized
gttataggattgagaatttcaa

SEQ ID NO: 1348175 - DNA, 22 bp, Artificial Sequence
  chemically synthesized
catattgctttttatttgaaat

SEQ ID NO: 1348176 - DNA, 22 bp, Artificial Sequence
  chemically synthesized
taggattgagaatttcaaataa

SEQ ID NO: 1348177 - DNA, 22 bp, Artificial Sequence
  chemically synthesized
ccatattgctttttatttgaaa

SEQ ID NO: 1348178 - DNA, 22 bp, Artificial Sequence
  chemically synthesized
tccatattgctttttatttgaa

SEQ ID NO: 1348179 - DNA, 22 bp, Artificial Sequence
  chemically synthesized
ttccatattgctttttatttga

SEQ ID NO: 1348180 - DNA, 22 bp, Artificial Sequence
  chemically synthesized
agaatttcaaataaaaagcaat

SEQ ID NO: 1348181 - DNA, 22 bp, Artificial Sequence
  chemically synthesized
caaataaaaagcaatatggaaa

SEQ ID NO: 1348182 - DNA, 22 bp, Artificial Sequence
  chemically synthesized
aaataaaaagcaatatggaaaa

SEQ ID NO: 1348183 - DNA, 22 bp, Artificial Sequence
  chemically synthesized
tataataaatgcttttccatat

SEQ ID NO: 1348184 - DNA, 22 bp, Artificial Sequence
  chemically synthesized
atataataaatgcttttccata

SEQ ID NO: 1348185 - DNA, 22 bp, Artificial Sequence
  chemically synthesized
tttatataataaatgcttttcc

SEQ ID NO: 1348186 - DNA, 22 bp, Artificial Sequence
  chemically synthesized
cattatttatataataaatgct

SEQ ID NO: 1348187 - DNA, 22 bp, Artificial Sequence
  chemically synthesized
tgccagttacattatttatata

SEQ ID NO: 1348188 - DNA, 22 bp, Artificial Sequence
  chemically synthesized
tgtgccagttacattatttata

SEQ ID NO: 1348189 - DNA, 22 bp, Artificial Sequence
  chemically synthesized
tgttctgtgccagttacattat

SEQ ID NO: 1348190 - DNA, 22 bp, Artificial Sequence
  chemically synthesized
tgtgttctgtgccagttacatt

SEQ ID NO: 1348191 - DNA, 22 bp, Artificial Sequence
  chemically synthesized
attatataaataatgtaactgg

SEQ ID NO: 1348192 - DNA, 22 bp, Artificial Sequence
  chemically synthesized
ctgtgttctgtgccagttacat

SEQ ID NO: 1348193 - DNA, 22 bp, Artificial Sequence
  chemically synthesized
ttatataaataatgtaactggc

SEQ ID NO: 1348194 - DNA, 22 bp, Artificial Sequence
  chemically synthesized
tataaataatgtaactggcaca

SEQ ID NO: 1348195 - DNA, 22 bp, Artificial Sequence
  chemically synthesized
atgcatttctgtgttctgtgcc

SEQ ID NO: 1348196 - DNA, 22 bp, Artificial Sequence
  chemically synthesized
aaaaggtattcatgcatttctg

SEQ ID NO: 1348197 - DNA, 22 bp, Artificial Sequence
  chemically synthesized
gcacagaacacagaaatgcatg

SEQ ID NO: 1348198 - DNA, 22 bp, Artificial Sequence
  chemically synthesized
gaaattcaaaaggtattcatgc

SEQ ID NO: 1348199 - DNA, 22 bp, Artificial Sequence
  chemically synthesized
ggaaattcaaaaggtattcatg

SEQ ID NO: 1348200 - DNA, 22 bp, Artificial Sequence
  chemically synthesized
tttggaaattcaaaaggtattc

SEQ ID NO: 1348201 - DNA, 22 bp, Artificial Sequence
  chemically synthesized
atttggaaattcaaaaggtatt

SEQ ID NO: 1348202 - DNA, 22 bp, Artificial Sequence
  chemically synthesized
tcttatttggaaattcaaaagg

SEQ ID NO: 1348203 - DNA, 22 bp, Artificial Sequence
  chemically synthesized
acaggaatctatcttatttgga

SEQ ID NO: 1348204 - DNA, 22 bp, Artificial Sequence
  chemically synthesized
ttgaatttccaaataagataga

SEQ ID NO: 1348205 - DNA, 22 bp, Artificial Sequence
  chemically synthesized
tgaatttccaaataagatagat

SEQ ID NO: 1348206 - DNA, 22 bp, Artificial Sequence
  chemically synthesized
gaatttccaaataagatagatt

SEQ ID NO: 1348207 - DNA, 22 bp, Artificial Sequence
  chemically synthesized
aatttccaaataagatagattc

SEQ ID NO: 1348208 - DNA, 22 bp, Artificial Sequence
  chemically synthesized
gagagttgacaggaatctatct

SEQ ID NO: 1348209 - DNA, 22 bp, Artificial Sequence
  chemically synthesized
tagagagttgacaggaatctat

SEQ ID NO: 1348210 - DNA, 22 bp, Artificial Sequence
  chemically synthesized
ctagagagttgacaggaatcta

SEQ ID NO: 1348211 - DNA, 22 bp, Artificial Sequence
  chemically synthesized
ccaaataagatagattcctgtc

SEQ ID NO: 1348212 - DNA, 22 bp, Artificial Sequence
  chemically synthesized
caaataagatagattcctgtca

SEQ ID NO: 1348213 - DNA, 22 bp, Artificial Sequence
  chemically synthesized
tcttctagagagttgacaggaa

SEQ ID NO: 1348214 - DNA, 22 bp, Artificial Sequence
  chemically synthesized
ctgtcaactctctagaagatag

SEQ ID NO: 1348215 - DNA, 22 bp, Artificial Sequence
  chemically synthesized
tcaactctctagaagataggtt

SEQ ID NO: 1348216 - DNA, 22 bp, Artificial Sequence
  chemically synthesized
tctagaagataggttttttttt

SEQ ID NO: 1348217 - DNA, 22 bp, Artificial Sequence
  chemically synthesized
tagaagataggttttttttttt

SEQ ID NO: 1348218 - DNA, 22 bp, Artificial Sequence
  chemically synthesized
gaagataggtttttttttttgc

SEQ ID NO: 1348219 - DNA, 22 bp, Artificial Sequence
  chemically synthesized
tgcatgcaagagaatcaataga

SEQ ID NO: 1348220 - DNA, 22 bp, Artificial Sequence
  chemically synthesized
ttttttttgcctctattgattc

SEQ ID NO: 1348221 - DNA, 22 bp, Artificial Sequence
  chemically synthesized
gtgcatgcaagagaatcaatag

SEQ ID NO: 1348222 - DNA, 22 bp, Artificial Sequence
  chemically synthesized
tttttttgcctctattgattct

SEQ ID NO: 1348223 - DNA, 22 bp, Artificial Sequence
  chemically synthesized
tgtgcatgcaagagaatcaata

SEQ ID NO: 1348224 - DNA, 22 bp, Artificial Sequence
  chemically synthesized
ttttttgcctctattgattctc

SEQ ID NO: 1348225 - DNA, 22 bp, Artificial Sequence
  chemically synthesized
tttttgcctctattgattctct

SEQ ID NO: 1348226 - DNA, 22 bp, Artificial Sequence
  chemically synthesized
ttttgcctctattgattctctt

SEQ ID NO: 1348227 - DNA, 22 bp, Artificial Sequence
  chemically synthesized
tttgcctctattgattctcttg

SEQ ID NO: 1348228 - DNA, 22 bp, Artificial Sequence
  chemically synthesized
ttgcctctattgattctcttgc

SEQ ID NO: 1348229 - DNA, 22 bp, Artificial Sequence
  chemically synthesized
tgcctctattgattctcttgca

SEQ ID NO: 1348230 - DNA, 22 bp, Artificial Sequence
  chemically synthesized
gcctctattgattctcttgcat

SEQ ID NO: 1348231 - DNA, 22 bp, Artificial Sequence
  chemically synthesized
cctctattgattctcttgcatg

SEQ ID NO: 1348232 - DNA, 22 bp, Artificial Sequence
  chemically synthesized
aaagactttgtgcatgcaagag

SEQ ID NO: 1348233 - DNA, 22 bp, Artificial Sequence
  chemically synthesized
tattgattctcttgcatgcaca

SEQ ID NO: 1348234 - DNA, 22 bp, Artificial Sequence
  chemically synthesized
ttgattctcttgcatgcacaaa

SEQ ID NO: 1348235 - DNA, 22 bp, Artificial Sequence
  chemically synthesized
attctcttgcatgcacaaagtc

SEQ ID NO: 1348236 - DNA, 22 bp, Artificial Sequence
  chemically synthesized
tcttgcatgcacaaagtctttg

SEQ ID NO: 1348237 - DNA, 22 bp, Artificial Sequence
  chemically synthesized
ttgcatgcacaaagtctttgaa

SEQ ID NO: 1348238 - DNA, 22 bp, Artificial Sequence
  chemically synthesized
gcatgcacaaagtctttgaata

SEQ ID NO: 1348239 - DNA, 22 bp, Artificial Sequence
  chemically synthesized
atgagaaacaaatattcaaaga

SEQ ID NO: 1348240 - DNA, 22 bp, Artificial Sequence
  chemically synthesized
catgcacaaagtctttgaatat

SEQ ID NO: 1348241 - DNA, 22 bp, Artificial Sequence
  chemically synthesized
aaggtaaatctgatgagaaaca

SEQ ID NO: 1348242 - DNA, 22 bp, Artificial Sequence
  chemically synthesized
ttgaaggtaaatctgatgagaa

SEQ ID NO: 1348243 - DNA, 22 bp, Artificial Sequence
  chemically synthesized
tgaatatttgtttctcatcaga

SEQ ID NO: 1348244 - DNA, 22 bp, Artificial Sequence
  chemically synthesized
gaatatttgtttctcatcagat

SEQ ID NO: 1348245 - DNA, 22 bp, Artificial Sequence
  chemically synthesized
aatatttgtttctcatcagatt

SEQ ID NO: 1348246 - DNA, 22 bp, Artificial Sequence
  chemically synthesized
gtttctcatcagatttaccttc

SEQ ID NO: 1348247 - DNA, 22 bp, Artificial Sequence
  chemically synthesized
tttctcatcagatttaccttca

SEQ ID NO: 1348248 - DNA, 22 bp, Artificial Sequence
  chemically synthesized
ctcatcagatttaccttcaaca

SEQ ID NO: 1348249 - DNA, 22 bp, Artificial Sequence
  chemically synthesized
tcatcagatttaccttcaacag

SEQ ID NO: 1348250 - DNA, 22 bp, Artificial Sequence
  chemically synthesized
ggaggccccaatactgttgaag

SEQ ID NO: 1348251 - DNA, 22 bp, Artificial Sequence
  chemically synthesized
atcagatttaccttcaacagta

SEQ ID NO: 1348252 - DNA, 22 bp, Artificial Sequence
  chemically synthesized
accttcaacagtattggggcct

SEQ ID NO: 1348253 - DNA, 22 bp, Artificial Sequence
  chemically synthesized
ccttcaacagtattggggcctc

SEQ ID NO: 1348254 - DNA, 22 bp, Artificial Sequence
  chemically synthesized
caacagtattggggcctcccaa

SEQ ID NO: 1348255 - DNA, 22 bp, Artificial Sequence
  chemically synthesized
aacagtattggggcctcccaat

SEQ ID NO: 1348256 - DNA, 22 bp, Artificial Sequence
  chemically synthesized
ggtaataaaagcatgtatgtaa

SEQ ID NO: 1348257 - DNA, 22 bp, Artificial Sequence
  chemically synthesized
gggcctcccaattacatacatg

SEQ ID NO: 1348258 - DNA, 22 bp, Artificial Sequence
  chemically synthesized
attgggtaataaaagcatgtat

SEQ ID NO: 1348259 - DNA, 22 bp, Artificial Sequence
  chemically synthesized
ttcattgggtaataaaagcatg

SEQ ID NO: 1348260 - DNA, 22 bp, Artificial Sequence
  chemically synthesized
ccaattacatacatgcttttat

SEQ ID NO: 1348261 - DNA, 22 bp, Artificial Sequence
  chemically synthesized
tgttcattgggtaataaaagca

SEQ ID NO: 1348262 - DNA, 22 bp, Artificial Sequence
  chemically synthesized
ctgttcattgggtaataaaagc

SEQ ID NO: 1348263 - DNA, 22 bp, Artificial Sequence
  chemically synthesized
tctgttcattgggtaataaaag

SEQ ID NO: 1348264 - DNA, 22 bp, Artificial Sequence
  chemically synthesized
ttctgttcattgggtaataaaa

SEQ ID NO: 1348265 - DNA, 22 bp, Artificial Sequence
  chemically synthesized
tttctgttcattgggtaataaa

SEQ ID NO: 1348266 - DNA, 22 bp, Artificial Sequence
  chemically synthesized
ttttctgttcattgggtaataa

SEQ ID NO: 1348267 - DNA, 22 bp, Artificial Sequence
  chemically synthesized
catacatgcttttattacccaa

SEQ ID NO: 1348268 - DNA, 22 bp, Artificial Sequence
  chemically synthesized
tttttctgttcattgggtaata

SEQ ID NO: 1348269 - DNA, 22 bp, Artificial Sequence
  chemically synthesized
ttttttttctgttcattgggta

SEQ ID NO: 1348270 - DNA, 22 bp, Artificial Sequence
  chemically synthesized
ttattacccaatgaacagaaaa

SEQ ID NO: 1348271 - DNA, 22 bp, Artificial Sequence
  chemically synthesized
tattacccaatgaacagaaaaa

SEQ ID NO: 1348272 - DNA, 22 bp, Artificial Sequence
  chemically synthesized
attacccaatgaacagaaaaaa

SEQ ID NO: 1348273 - DNA, 22 bp, Artificial Sequence
  chemically synthesized
ttacccaatgaacagaaaaaaa

SEQ ID NO: 1348274 - DNA, 22 bp, Artificial Sequence
  chemically synthesized
cccaatgaacagaaaaaaaaca

SEQ ID NO: 1348275 - DNA, 22 bp, Artificial Sequence
  chemically synthesized
aaataatatgaacagtaattgt

SEQ ID NO: 1348276 - DNA, 22 bp, Artificial Sequence
  chemically synthesized
agttgaaataatatgaacagta

SEQ ID NO: 1348277 - DNA, 22 bp, Artificial Sequence
  chemically synthesized
cagttgaaataatatgaacagt

SEQ ID NO: 1348278 - DNA, 22 bp, Artificial Sequence
  chemically synthesized
atttcagttgaaataatatgaa

SEQ ID NO: 1348279 - DNA, 22 bp, Artificial Sequence
  chemically synthesized
gatttcagttgaaataatatga

SEQ ID NO: 1348280 - DNA, 22 bp, Artificial Sequence
  chemically synthesized
ctgttcatattatttcaactga

SEQ ID NO: 1348281 - DNA, 22 bp, Artificial Sequence
  chemically synthesized
acaagcttgatttcagttgaaa

SEQ ID NO: 1348282 - DNA, 22 bp, Artificial Sequence
  chemically synthesized
aacaagcttgatttcagttgaa

SEQ ID NO: 1348283 - DNA, 22 bp, Artificial Sequence
  chemically synthesized
taacaagcttgatttcagttga

SEQ ID NO: 1348284 - DNA, 22 bp, Artificial Sequence
  chemically synthesized
ttcatattatttcaactgaaat

SEQ ID NO: 1348285 - DNA, 22 bp, Artificial Sequence
  chemically synthesized
ttaacaagcttgatttcagttg

SEQ ID NO: 1348286 - DNA, 22 bp, Artificial Sequence
  chemically synthesized
atattatttcaactgaaatcaa

SEQ ID NO: 1348287 - DNA, 22 bp, Artificial Sequence
  chemically synthesized
tttcaactgaaatcaagcttgt

SEQ ID NO: 1348288 - DNA, 22 bp, Artificial Sequence
  chemically synthesized
tgagagagcttttaacaagctt

SEQ ID NO: 1348289 - DNA, 22 bp, Artificial Sequence
  chemically synthesized
caactgaaatcaagcttgttaa

SEQ ID NO: 1348290 - DNA, 22 bp, Artificial Sequence
  chemically synthesized
aactgaaatcaagcttgttaaa

SEQ ID NO: 1348291 - DNA, 22 bp, Artificial Sequence
  chemically synthesized
aaatcaagcttgttaaaagctc

SEQ ID NO: 1348292 - DNA, 22 bp, Artificial Sequence
  chemically synthesized
acaattgtgagagagcttttaa

SEQ ID NO: 1348293 - DNA, 22 bp, Artificial Sequence
  chemically synthesized
gttaaaagctctctcacaattg

SEQ ID NO: 1348294 - DNA, 22 bp, Artificial Sequence
  chemically synthesized
ttaaaagctctctcacaattgt

SEQ ID NO: 1348295 - DNA, 22 bp, Artificial Sequence
  chemically synthesized
aaagctctctcacaattgttaa

SEQ ID NO: 1348296 - DNA, 22 bp, Artificial Sequence
  chemically synthesized
caaatgtacaaaattaacaatt

SEQ ID NO: 1348297 - DNA, 22 bp, Artificial Sequence
  chemically synthesized
gcaaatgtacaaaattaacaat

SEQ ID NO: 1348298 - DNA, 22 bp, Artificial Sequence
  chemically synthesized
tgcaaatgtacaaaattaacaa

SEQ ID NO: 1348299 - DNA, 22 bp, Artificial Sequence
  chemically synthesized
ttgcaaatgtacaaaattaaca

SEQ ID NO: 1348300 - DNA, 22 bp, Artificial Sequence
  chemically synthesized
tctcacaattgttaattttgta

SEQ ID NO: 1348301 - DNA, 22 bp, Artificial Sequence
  chemically synthesized
atttttgcaaatgtacaaaatt

SEQ ID NO: 1348302 - DNA, 22 bp, Artificial Sequence
  chemically synthesized
tcacaattgttaattttgtaca

SEQ ID NO: 1348303 - DNA, 22 bp, Artificial Sequence
  chemically synthesized
acaattgttaattttgtacatt

SEQ ID NO: 1348304 - DNA, 22 bp, Artificial Sequence
  chemically synthesized
ttgatttttgcaaatgtacaaa

SEQ ID NO: 1348305 - DNA, 22 bp, Artificial Sequence
  chemically synthesized
gctattgatttttgcaaatgta

SEQ ID NO: 1348306 - DNA, 22 bp, Artificial Sequence
  chemically synthesized
tagctattgatttttgcaaatg

SEQ ID NO: 1348307 - DNA, 22 bp, Artificial Sequence
  chemically synthesized
ttaattttgtacatttgcaaaa

SEQ ID NO: 1348308 - DNA, 22 bp, Artificial Sequence
  chemically synthesized
ctagctattgatttttgcaaat

SEQ ID NO: 1348309 - DNA, 22 bp, Artificial Sequence
  chemically synthesized
tctagctattgatttttgcaaa

SEQ ID NO: 1348310 - DNA, 22 bp, Artificial Sequence
  chemically synthesized
attttgtacatttgcaaaaatc

SEQ ID NO: 1348311 - DNA, 22 bp, Artificial Sequence
  chemically synthesized
tgtacatttgcaaaaatcaata

SEQ ID NO: 1348312 - DNA, 22 bp, Artificial Sequence
  chemically synthesized
gtacatttgcaaaaatcaatag

SEQ ID NO: 1348313 - DNA, 22 bp, Artificial Sequence
  chemically synthesized
tacatttgcaaaaatcaatagc

SEQ ID NO: 1348314 - DNA, 22 bp, Artificial Sequence
  chemically synthesized
gtaaattttctagctattgatt

SEQ ID NO: 1348315 - DNA, 22 bp, Artificial Sequence
  chemically synthesized
gcaaaaatcaatagctagaaaa

SEQ ID NO: 1348316 - DNA, 22 bp, Artificial Sequence
  chemically synthesized
gtgtctagtaaattttctagct

SEQ ID NO: 1348317 - DNA, 22 bp, Artificial Sequence
  chemically synthesized
caaaaatcaatagctagaaaat

SEQ ID NO: 1348318 - DNA, 22 bp, Artificial Sequence
  chemically synthesized
cgtgtctagtaaattttctagc

SEQ ID NO: 1348319 - DNA, 22 bp, Artificial Sequence
  chemically synthesized
agaggccttcgtgtctagtaaa

SEQ ID NO: 1348320 - DNA, 22 bp, Artificial Sequence
  chemically synthesized
cagaggccttcgtgtctagtaa

SEQ ID NO: 1348321 - DNA, 22 bp, Artificial Sequence
  chemically synthesized
tttcagaggccttcgtgtctag

SEQ ID NO: 1348322 - DNA, 22 bp, Artificial Sequence
  chemically synthesized
gaaaatttactagacacgaagg

SEQ ID NO: 1348323 - DNA, 22 bp, Artificial Sequence
  chemically synthesized
tattgtttcagaggccttcgtg

SEQ ID NO: 1348324 - DNA, 22 bp, Artificial Sequence
  chemically synthesized
gtattgtttcagaggccttcgt

SEQ ID NO: 1348325 - DNA, 22 bp, Artificial Sequence
  chemically synthesized
actagacacgaaggcctctgaa

SEQ ID NO: 1348326 - DNA, 22 bp, Artificial Sequence
  chemically synthesized
ctagacacgaaggcctctgaaa

SEQ ID NO: 1348327 - DNA, 22 bp, Artificial Sequence
  chemically synthesized
gacacgaaggcctctgaaacaa

SEQ ID NO: 1348328 - DNA, 22 bp, Artificial Sequence
  chemically synthesized
gggcataaagatcatttgtatt

SEQ ID NO: 1348329 - DNA, 22 bp, Artificial Sequence
  chemically synthesized
tgaaacaatacaaatgatcttt

SEQ ID NO: 1348330 - DNA, 22 bp, Artificial Sequence
  chemically synthesized
aaacaatacaaatgatctttat

SEQ ID NO: 1348331 - DNA, 22 bp, Artificial Sequence
  chemically synthesized
gtagccctagggcataaagatc

SEQ ID NO: 1348332 - DNA, 22 bp, Artificial Sequence
  chemically synthesized
tcaataaattcgtagccctagg

SEQ ID NO: 1348333 - DNA, 22 bp, Artificial Sequence
  chemically synthesized
atcaataaattcgtagccctag

SEQ ID NO: 1348334 - DNA, 22 bp, Artificial Sequence
  chemically synthesized
accttatcaataaattcgtagc

SEQ ID NO: 1348335 - DNA, 22 bp, Artificial Sequence
  chemically synthesized
tatgccctagggctacgaattt

SEQ ID NO: 1348336 - DNA, 22 bp, Artificial Sequence
  chemically synthesized
atgccctagggctacgaattta

SEQ ID NO: 1348337 - DNA, 22 bp, Artificial Sequence
  chemically synthesized
tgccctagggctacgaatttat

SEQ ID NO: 1348338 - DNA, 22 bp, Artificial Sequence
  chemically synthesized
ttaaccttatcaataaattcgt

SEQ ID NO: 1348339 - DNA, 22 bp, Artificial Sequence
  chemically synthesized
gggctacgaatttattgataag

SEQ ID NO: 1348340 - DNA, 22 bp, Artificial Sequence
  chemically synthesized
cccaaggattgttaaccttatc

SEQ ID NO: 1348341 - DNA, 22 bp, Artificial Sequence
  chemically synthesized
cgaatttattgataaggttaac

SEQ ID NO: 1348342 - DNA, 22 bp, Artificial Sequence
  chemically synthesized
tcattacccaaggattgttaac

SEQ ID NO: 1348343 - DNA, 22 bp, Artificial Sequence
  chemically synthesized
attgataaggttaacaatcctt

SEQ ID NO: 1348344 - DNA, 22 bp, Artificial Sequence
  chemically synthesized
ttgataaggttaacaatccttg

SEQ ID NO: 1348345 - DNA, 22 bp, Artificial Sequence
  chemically synthesized
ataaggttaacaatccttgggt

SEQ ID NO: 1348346 - DNA, 22 bp, Artificial Sequence
  chemically synthesized
acaatccttgggtaatgacagc

SEQ ID NO: 1348347 - DNA, 22 bp, Artificial Sequence
  chemically synthesized
agaagagaagtaagctgtcatt

SEQ ID NO: 1348348 - DNA, 22 bp, Artificial Sequence
  chemically synthesized
gattcagaagagaagtaagctg

SEQ ID NO: 1348349 - DNA, 22 bp, Artificial Sequence
  chemically synthesized
gggtaatgacagcttacttctc

SEQ ID NO: 1348350 - DNA, 22 bp, Artificial Sequence
  chemically synthesized
ggtaatgacagcttacttctct

SEQ ID NO: 1348351 - DNA, 22 bp, Artificial Sequence
  chemically synthesized
ggctagattcagaagagaagta

SEQ ID NO: 1348352 - DNA, 22 bp, Artificial Sequence
  chemically synthesized
aggctagattcagaagagaagt

SEQ ID NO: 1348353 - DNA, 22 bp, Artificial Sequence
  chemically synthesized
taggctagattcagaagagaag

SEQ ID NO: 1348354 - DNA, 22 bp, Artificial Sequence
  chemically synthesized
atggaatctttaggctagattc

SEQ ID NO: 1348355 - DNA, 22 bp, Artificial Sequence
  chemically synthesized
acttctcttctgaatctagcct

SEQ ID NO: 1348356 - DNA, 22 bp, Artificial Sequence
  chemically synthesized
aatggaatctttaggctagatt

SEQ ID NO: 1348357 - DNA, 22 bp, Artificial Sequence
  chemically synthesized
cttctcttctgaatctagccta

SEQ ID NO: 1348358 - DNA, 22 bp, Artificial Sequence
  chemically synthesized
ctcttctgaatctagcctaaag

SEQ ID NO: 1348359 - DNA, 22 bp, Artificial Sequence
  chemically synthesized
tcttctgaatctagcctaaaga

SEQ ID NO: 1348360 - DNA, 22 bp, Artificial Sequence
  chemically synthesized
ttctgaatctagcctaaagatt

SEQ ID NO: 1348361 - DNA, 22 bp, Artificial Sequence
  chemically synthesized
ctgaatctagcctaaagattcc

SEQ ID NO: 1348362 - DNA, 22 bp, Artificial Sequence
  chemically synthesized
tgaatctagcctaaagattcca

SEQ ID NO: 1348363 - DNA, 22 bp, Artificial Sequence
  chemically synthesized
gaaatatatttaatggaatctt

SEQ ID NO: 1348364 - DNA, 22 bp, Artificial Sequence
  chemically synthesized
aatctagcctaaagattccatt

SEQ ID NO: 1348365 - DNA, 22 bp, Artificial Sequence
  chemically synthesized
agaaatatatttaatggaatct

SEQ ID NO: 1348366 - DNA, 22 bp, Artificial Sequence
  chemically synthesized
tttagaaatatatttaatggaa

SEQ ID NO: 1348367 - DNA, 22 bp, Artificial Sequence
  chemically synthesized
gcctaaagattccattaaatat

SEQ ID NO: 1348368 - DNA, 22 bp, Artificial Sequence
  chemically synthesized
ttgtttagaaatatatttaatg

SEQ ID NO: 1348369 - DNA, 22 bp, Artificial Sequence
  chemically synthesized
gttgtttagaaatatatttaat

SEQ ID NO: 1348370 - DNA, 22 bp, Artificial Sequence
  chemically synthesized
tgttgtttagaaatatatttaa

SEQ ID NO: 1348371 - DNA, 22 bp, Artificial Sequence
  chemically synthesized
ttgttgtttagaaatatattta

SEQ ID NO: 1348372 - DNA, 22 bp, Artificial Sequence
  chemically synthesized
aagattccattaaatatatttc

SEQ ID NO: 1348373 - DNA, 22 bp, Artificial Sequence
  chemically synthesized
gacatttttgttgtttagaaat

SEQ ID NO: 1348374 - DNA, 22 bp, Artificial Sequence
  chemically synthesized
cattaaatatatttctaaacaa

SEQ ID NO: 1348375 - DNA, 22 bp, Artificial Sequence
  chemically synthesized
atctagacatttttgttgttta

SEQ ID NO: 1348376 - DNA, 22 bp, Artificial Sequence
  chemically synthesized
aatatatttctaaacaacaaaa

SEQ ID NO: 1348377 - DNA, 22 bp, Artificial Sequence
  chemically synthesized
tcatctagacatttttgttgtt

SEQ ID NO: 1348378 - DNA, 22 bp, Artificial Sequence
  chemically synthesized
gactctcatctagacatttttg

SEQ ID NO: 1348379 - DNA, 22 bp, Artificial Sequence
  chemically synthesized
agactctcatctagacattttt

SEQ ID NO: 1348380 - DNA, 22 bp, Artificial Sequence
  chemically synthesized
ctaaacaacaaaaatgtctaga

SEQ ID NO: 1348381 - DNA, 22 bp, Artificial Sequence
  chemically synthesized
taaacaacaaaaatgtctagat

SEQ ID NO: 1348382 - DNA, 22 bp, Artificial Sequence
  chemically synthesized
aacaacaaaaatgtctagatga

SEQ ID NO: 1348383 - DNA, 22 bp, Artificial Sequence
  chemically synthesized
aaatcagtttagactctcatct

SEQ ID NO: 1348384 - DNA, 22 bp, Artificial Sequence
  chemically synthesized
gaaatcagtttagactctcatc

SEQ ID NO: 1348385 - DNA, 22 bp, Artificial Sequence
  chemically synthesized
gatgagagtctaaactgatttc

SEQ ID NO: 1348386 - DNA, 22 bp, Artificial Sequence
  chemically synthesized
aagcaaacacttgaaatcagtt

SEQ ID NO: 1348387 - DNA, 22 bp, Artificial Sequence
  chemically synthesized
gaagcaaacacttgaaatcagt

SEQ ID NO: 1348388 - DNA, 22 bp, Artificial Sequence
  chemically synthesized
tgaagcaaacacttgaaatcag

SEQ ID NO: 1348389 - DNA, 22 bp, Artificial Sequence
  chemically synthesized
tcctttgaagcaaacacttgaa

SEQ ID NO: 1348390 - DNA, 22 bp, Artificial Sequence
  chemically synthesized
gtcctttgaagcaaacacttga

SEQ ID NO: 1348391 - DNA, 22 bp, Artificial Sequence
  chemically synthesized
tgtcctttgaagcaaacacttg

SEQ ID NO: 1348392 - DNA, 22 bp, Artificial Sequence
  chemically synthesized
aactgatttcaagtgtttgctt

SEQ ID NO: 1348393 - DNA, 22 bp, Artificial Sequence
  chemically synthesized
ttttgtcctttgaagcaaacac

SEQ ID NO: 1348394 - DNA, 22 bp, Artificial Sequence
  chemically synthesized
gttttgtcctttgaagcaaaca

SEQ ID NO: 1348395 - DNA, 22 bp, Artificial Sequence
  chemically synthesized
tgttttgtcctttgaagcaaac

SEQ ID NO: 1348396 - DNA, 22 bp, Artificial Sequence
  chemically synthesized
atttcaagtgtttgcttcaaag

SEQ ID NO: 1348397 - DNA, 22 bp, Artificial Sequence
  chemically synthesized
tctttgttttgtcctttgaagc

SEQ ID NO: 1348398 - DNA, 22 bp, Artificial Sequence
  chemically synthesized
caagtgtttgcttcaaaggaca

SEQ ID NO: 1348399 - DNA, 22 bp, Artificial Sequence
  chemically synthesized
aagtgtttgcttcaaaggacaa

SEQ ID NO: 1348400 - DNA, 22 bp, Artificial Sequence
  chemically synthesized
gcttcaaaggacaaaacaaaga

SEQ ID NO: 1348401 - DNA, 22 bp, Artificial Sequence
  chemically synthesized
cttcaaaggacaaaacaaagac

SEQ ID NO: 1348402 - DNA, 22 bp, Artificial Sequence
  chemically synthesized
gaagggagcatctgtctttgtt

SEQ ID NO: 1348403 - DNA, 22 bp, Artificial Sequence
  chemically synthesized
caaaggacaaaacaaagacaga

SEQ ID NO: 1348404 - DNA, 22 bp, Artificial Sequence
  chemically synthesized
aaaggacaaaacaaagacagat

SEQ ID NO: 1348405 - DNA, 22 bp, Artificial Sequence
  chemically synthesized
gctggaagggagcatctgtctt

SEQ ID NO: 1348406 - DNA, 22 bp, Artificial Sequence
  chemically synthesized
agtcattggctggaagggagca

SEQ ID NO: 1348407 - DNA, 22 bp, Artificial Sequence
  chemically synthesized
tctaagtcattggctggaaggg

SEQ ID NO: 1348408 - DNA, 22 bp, Artificial Sequence
  chemically synthesized
atatggattgtctaagtcattg

SEQ ID NO: 1348409 - DNA, 22 bp, Artificial Sequence
  chemically synthesized
aatatggattgtctaagtcatt

SEQ ID NO: 1348410 - DNA, 22 bp, Artificial Sequence
  chemically synthesized
taatatggattgtctaagtcat

SEQ ID NO: 1348411 - DNA, 22 bp, Artificial Sequence
  chemically synthesized
ccttccagccaatgacttagac

SEQ ID NO: 1348412 - DNA, 22 bp, Artificial Sequence
  chemically synthesized
ccagccaatgacttagacaatc

SEQ ID NO: 1348413 - DNA, 22 bp, Artificial Sequence
  chemically synthesized
cagccaatgacttagacaatcc

SEQ ID NO: 1348414 - DNA, 22 bp, Artificial Sequence
  chemically synthesized
aatctttaatatggattgtcta

SEQ ID NO: 1348415 - DNA, 22 bp, Artificial Sequence
  chemically synthesized
caatctttaatatggattgtct

SEQ ID NO: 1348416 - DNA, 22 bp, Artificial Sequence
  chemically synthesized
acttcaatctttaatatggatt

SEQ ID NO: 1348417 - DNA, 22 bp, Artificial Sequence
  chemically synthesized
agacaatccatattaaagattg

SEQ ID NO: 1348418 - DNA, 22 bp, Artificial Sequence
  chemically synthesized
gacaatccatattaaagattga

SEQ ID NO: 1348419 - DNA, 22 bp, Artificial Sequence
  chemically synthesized
gtatatcatgaccattgacttc

SEQ ID NO: 1348420 - DNA, 22 bp, Artificial Sequence
  chemically synthesized
aagattgaagtcaatggtcatg

SEQ ID NO: 1348421 - DNA, 22 bp, Artificial Sequence
  chemically synthesized
cccaacctagtatatcatgacc

SEQ ID NO: 1348422 - DNA, 22 bp, Artificial Sequence
  chemically synthesized
aagtcaatggtcatgatatact

SEQ ID NO: 1348423 - DNA, 22 bp, Artificial Sequence
  chemically synthesized
aagccagattgcccaacctagt

SEQ ID NO: 1348424 - DNA, 22 bp, Artificial Sequence
  chemically synthesized
ggttgggcaatctggcttgaat

SEQ ID NO: 1348425 - DNA, 22 bp, Artificial Sequence
  chemically synthesized
aaccagtcaatgtcacattcaa

SEQ ID NO: 1348426 - DNA, 22 bp, Artificial Sequence
  chemically synthesized
ggcaatctggcttgaatgtgac

SEQ ID NO: 1348427 - DNA, 22 bp, Artificial Sequence
  chemically synthesized
aaaccagtcaatgtcacattca

SEQ ID NO: 1348428 - DNA, 22 bp, Artificial Sequence
  chemically synthesized
aaaatttaaaccagtcaatgtc

SEQ ID NO: 1348429 - DNA, 22 bp, Artificial Sequence
  chemically synthesized
gcttgaatgtgacattgactgg

SEQ ID NO: 1348430 - DNA, 22 bp, Artificial Sequence
  chemically synthesized
attcaaaatttaaaccagtcaa

SEQ ID NO: 1348431 - DNA, 22 bp, Artificial Sequence
  chemically synthesized
gaatgtgacattgactggttta

SEQ ID NO: 1348432 - DNA, 22 bp, Artificial Sequence
  chemically synthesized
aatgtgacattgactggtttaa

SEQ ID NO: 1348433 - DNA, 22 bp, Artificial Sequence
  chemically synthesized
agagaacattaattcaaaattt

SEQ ID NO: 1348434 - DNA, 22 bp, Artificial Sequence
  chemically synthesized
gagagaacattaattcaaaatt

SEQ ID NO: 1348435 - DNA, 22 bp, Artificial Sequence
  chemically synthesized
tgagagaacattaattcaaaat

SEQ ID NO: 1348436 - DNA, 22 bp, Artificial Sequence
  chemically synthesized
actggtttaaattttgaattaa

SEQ ID NO: 1348437 - DNA, 22 bp, Artificial Sequence
  chemically synthesized
gtttaaattttgaattaatgtt

SEQ ID NO: 1348438 - DNA, 22 bp, Artificial Sequence
  chemically synthesized
aaattttgaattaatgttctct

SEQ ID NO: 1348439 - DNA, 22 bp, Artificial Sequence
  chemically synthesized
aattttgaattaatgttctctc

SEQ ID NO: 1348440 - DNA, 22 bp, Artificial Sequence
  chemically synthesized
atggatgaaatattttgagaga

SEQ ID NO: 1348441 - DNA, 22 bp, Artificial Sequence
  chemically synthesized
tgaattaatgttctctcaaaat

SEQ ID NO: 1348442 - DNA, 22 bp, Artificial Sequence
  chemically synthesized
gaattaatgttctctcaaaata

SEQ ID NO: 1348443 - DNA, 22 bp, Artificial Sequence
  chemically synthesized
aattaatgttctctcaaaatat

SEQ ID NO: 1348444 - DNA, 22 bp, Artificial Sequence
  chemically synthesized
atgttctctcaaaatatttcat

SEQ ID NO: 1348445 - DNA, 22 bp, Artificial Sequence
  chemically synthesized
tctcaaaatatttcatccatca

SEQ ID NO: 1348446 - DNA, 22 bp, Artificial Sequence
  chemically synthesized
tcaaaatatttcatccatcagt

SEQ ID NO: 1348447 - DNA, 22 bp, Artificial Sequence
  chemically synthesized
aaaatatttcatccatcagttg

SEQ ID NO: 1348448 - DNA, 22 bp, Artificial Sequence
  chemically synthesized
catccatcagttggtttattta

SEQ ID NO: 1348449 - DNA, 22 bp, Artificial Sequence
  chemically synthesized
atccatcagttggtttatttac

SEQ ID NO: 1348450 - DNA, 22 bp, Artificial Sequence
  chemically synthesized
gtaaataataagtgtaaataaa

SEQ ID NO: 1348451 - DNA, 22 bp, Artificial Sequence
  chemically synthesized
gtttatttacacttattattta

SEQ ID NO: 1348452 - DNA, 22 bp, Artificial Sequence
  chemically synthesized
tgtcagtaattggtaaataata

SEQ ID NO: 1348453 - DNA, 22 bp, Artificial Sequence
  chemically synthesized
atttacacttattatttaccaa

SEQ ID NO: 1348454 - DNA, 22 bp, Artificial Sequence
  chemically synthesized
tttacacttattatttaccaat

SEQ ID NO: 1348455 - DNA, 22 bp, Artificial Sequence
  chemically synthesized
acacttattatttaccaattac

SEQ ID NO: 1348456 - DNA, 22 bp, Artificial Sequence
  chemically synthesized
gcacctatgtcagtaattggta

SEQ ID NO: 1348457 - DNA, 22 bp, Artificial Sequence
  chemically synthesized
cacttattatttaccaattact

SEQ ID NO: 1348458 - DNA, 22 bp, Artificial Sequence
  chemically synthesized
attatttaccaattactgacat

SEQ ID NO: 1348459 - DNA, 22 bp, Artificial Sequence
  chemically synthesized
ttatttaccaattactgacata

SEQ ID NO: 1348460 - DNA, 22 bp, Artificial Sequence
  chemically synthesized
cgtgttagcacctatgtcagta

SEQ ID NO: 1348461 - DNA, 22 bp, Artificial Sequence
  chemically synthesized
tttaccaattactgacataggt

SEQ ID NO: 1348462 - DNA, 22 bp, Artificial Sequence
  chemically synthesized
ctgcgtgttagcacctatgtca

SEQ ID NO: 1348463 - DNA, 22 bp, Artificial Sequence
  chemically synthesized
gctgcgtgttagcacctatgtc

SEQ ID NO: 1348464 - DNA, 22 bp, Artificial Sequence
  chemically synthesized
tgctgcgtgttagcacctatgt

SEQ ID NO: 1348465 - DNA, 22 bp, Artificial Sequence
  chemically synthesized
accaattactgacataggtgct

SEQ ID NO: 1348466 - DNA, 22 bp, Artificial Sequence
  chemically synthesized
ttgctgcgtgttagcacctatg

SEQ ID NO: 1348467 - DNA, 22 bp, Artificial Sequence
  chemically synthesized
ccaattactgacataggtgcta

SEQ ID NO: 1348468 - DNA, 22 bp, Artificial Sequence
  chemically synthesized
aaagtttttgctgcgtgttagc

SEQ ID NO: 1348469 - DNA, 22 bp, Artificial Sequence
  chemically synthesized
ctgacataggtgctaacacgca

SEQ ID NO: 1348470 - DNA, 22 bp, Artificial Sequence
  chemically synthesized
aaaagtttttgctgcgtgttag

SEQ ID NO: 1348471 - DNA, 22 bp, Artificial Sequence
  chemically synthesized
taaaagtttttgctgcgtgtta

SEQ ID NO: 1348472 - DNA, 22 bp, Artificial Sequence
  chemically synthesized
acataggtgctaacacgcagca

SEQ ID NO: 1348473 - DNA, 22 bp, Artificial Sequence
  chemically synthesized
acacgcagcaaaaacttttaaa

SEQ ID NO: 1348474 - DNA, 22 bp, Artificial Sequence
  chemically synthesized
aaaaggaaatacaaataaaaat

SEQ ID NO: 1348475 - DNA, 22 bp, Artificial Sequence
  chemically synthesized
ttaaaattatttttatttgtat

SEQ ID NO: 1348476 - DNA, 22 bp, Artificial Sequence
  chemically synthesized
taaaattatttttatttgtatt

SEQ ID NO: 1348477 - DNA, 22 bp, Artificial Sequence
  chemically synthesized
aaaattatttttatttgtattt

SEQ ID NO: 1348478 - DNA, 22 bp, Artificial Sequence
  chemically synthesized
aaattaaaaaggaaatacaaat

SEQ ID NO: 1348479 - DNA, 22 bp, Artificial Sequence
  chemically synthesized
aaattatttttatttgtatttc

SEQ ID NO: 1348480 - DNA, 22 bp, Artificial Sequence
  chemically synthesized
ttaaaattaaaaaggaaataca

SEQ ID NO: 1348481 - DNA, 22 bp, Artificial Sequence
  chemically synthesized
tttttatttgtatttccttttt

SEQ ID NO: 1348482 - DNA, 22 bp, Artificial Sequence
  chemically synthesized
aagctattaaaattaaaaagga

SEQ ID NO: 1348483 - DNA, 22 bp, Artificial Sequence
  chemically synthesized
ttatttgtatttcctttttaat

SEQ ID NO: 1348484 - DNA, 22 bp, Artificial Sequence
  chemically synthesized
tatttgtatttcctttttaatt

SEQ ID NO: 1348485 - DNA, 22 bp, Artificial Sequence
  chemically synthesized
atttgtatttcctttttaattt

SEQ ID NO: 1348486 - DNA, 22 bp, Artificial Sequence
  chemically synthesized
tttgtatttcctttttaatttt

SEQ ID NO: 1348487 - DNA, 22 bp, Artificial Sequence
  chemically synthesized
gtatttcctttttaattttaat

SEQ ID NO: 1348488 - DNA, 22 bp, Artificial Sequence
  chemically synthesized
tatttcctttttaattttaata

SEQ ID NO: 1348489 - DNA, 22 bp, Artificial Sequence
  chemically synthesized
cacccctaaagctattaaaatt

SEQ ID NO: 1348490 - DNA, 22 bp, Artificial Sequence
  chemically synthesized
ccacccctaaagctattaaaat

SEQ ID NO: 1348491 - DNA, 22 bp, Artificial Sequence
  chemically synthesized
cctttttaattttaatagcttt

SEQ ID NO: 1348492 - DNA, 22 bp, Artificial Sequence
  chemically synthesized
ctttttaattttaatagcttta

SEQ ID NO: 1348493 - DNA, 22 bp, Artificial Sequence
  chemically synthesized
tttaattttaatagctttaggg

SEQ ID NO: 1348494 - DNA, 22 bp, Artificial Sequence
  chemically synthesized
ttaattttaatagctttagggg

SEQ ID NO: 1348495 - DNA, 22 bp, Artificial Sequence
  chemically synthesized
taattttaatagctttaggggt

SEQ ID NO: 1348496 - DNA, 22 bp, Artificial Sequence
  chemically synthesized
aattttaatagctttaggggtg

SEQ ID NO: 1348497 - DNA, 22 bp, Artificial Sequence
  chemically synthesized
attttaatagctttaggggtgg

SEQ ID NO: 1348498 - DNA, 22 bp, Artificial Sequence
  chemically synthesized
taatagctttaggggtggaagt

SEQ ID NO: 1348499 - DNA, 22 bp, Artificial Sequence
  chemically synthesized
aatagctttaggggtggaagtg

SEQ ID NO: 1348500 - DNA, 22 bp, Artificial Sequence
  chemically synthesized
atagctttaggggtggaagtgg

SEQ ID NO: 1348501 - DNA, 22 bp, Artificial Sequence
  chemically synthesized
tgtaacaaaaaaccacttccac

SEQ ID NO: 1348502 - DNA, 22 bp, Artificial Sequence
  chemically synthesized
gtgtaacaaaaaaccacttcca

SEQ ID NO: 1348503 - DNA, 22 bp, Artificial Sequence
  chemically synthesized
atttgtgtaacaaaaaaccact

SEQ ID NO: 1348504 - DNA, 22 bp, Artificial Sequence
  chemically synthesized
taggggtggaagtggttttttg

SEQ ID NO: 1348505 - DNA, 22 bp, Artificial Sequence
  chemically synthesized
aggggtggaagtggttttttgt

SEQ ID NO: 1348506 - DNA, 22 bp, Artificial Sequence
  chemically synthesized
ggggtggaagtggttttttgtt

SEQ ID NO: 1348507 - DNA, 22 bp, Artificial Sequence
  chemically synthesized
tagaactcatttgtgtaacaaa

SEQ ID NO: 1348508 - DNA, 22 bp, Artificial Sequence
  chemically synthesized
accactatagaactcatttgtg

SEQ ID NO: 1348509 - DNA, 22 bp, Artificial Sequence
  chemically synthesized
tttgttacacaaatgagttcta

SEQ ID NO: 1348510 - DNA, 22 bp, Artificial Sequence
  chemically synthesized
ttgttacacaaatgagttctat

SEQ ID NO: 1348511 - DNA, 22 bp, Artificial Sequence
  chemically synthesized
tgttacacaaatgagttctata

SEQ ID NO: 1348512 - DNA, 22 bp, Artificial Sequence
  chemically synthesized
agaattcaccactatagaactc

SEQ ID NO: 1348513 - DNA, 22 bp, Artificial Sequence
  chemically synthesized
gttacacaaatgagttctatag

SEQ ID NO: 1348514 - DNA, 22 bp, Artificial Sequence
  chemically synthesized
ttacacaaatgagttctatagt

SEQ ID NO: 1348515 - DNA, 22 bp, Artificial Sequence
  chemically synthesized
cacaaatgagttctatagtggt

SEQ ID NO: 1348516 - DNA, 22 bp, Artificial Sequence
  chemically synthesized
aaatctcagaattcaccactat

SEQ ID NO: 1348517 - DNA, 22 bp, Artificial Sequence
  chemically synthesized
tatagtggtgaattctgagatt

SEQ ID NO: 1348518 - DNA, 22 bp, Artificial Sequence
  chemically synthesized
tagtggtgaattctgagatttt

SEQ ID NO: 1348519 - DNA, 22 bp, Artificial Sequence
  chemically synthesized
aggtgacaggtgcactaaaatc

SEQ ID NO: 1348520 - DNA, 22 bp, Artificial Sequence
  chemically synthesized
ctcaggtgacaggtgcactaaa

SEQ ID NO: 1348521 - DNA, 22 bp, Artificial Sequence
  chemically synthesized
tgagattttagtgcacctgtca

SEQ ID NO: 1348522 - DNA, 22 bp, Artificial Sequence
  chemically synthesized
agattttagtgcacctgtcacc

SEQ ID NO: 1348523 - DNA, 22 bp, Artificial Sequence
  chemically synthesized
tagtgcacctgtcacctgagta

SEQ ID NO: 1348524 - DNA, 22 bp, Artificial Sequence
  chemically synthesized
agtgcacctgtcacctgagtag

SEQ ID NO: 1348525 - DNA, 22 bp, Artificial Sequence
  chemically synthesized
gtgcacctgtcacctgagtagg

SEQ ID NO: 1348526 - DNA, 22 bp, Artificial Sequence
  chemically synthesized
ggtacaatataccctactcagg

SEQ ID NO: 1348527 - DNA, 22 bp, Artificial Sequence
  chemically synthesized
tcacctgagtagggtatattgt

SEQ ID NO: 1348528 - DNA, 22 bp, Artificial Sequence
  chemically synthesized
agtagggtatattgtacctaat

SEQ ID NO: 1348529 - DNA, 22 bp, Artificial Sequence
  chemically synthesized
aaaaaaaggacacattaggtac

SEQ ID NO: 1348530 - DNA, 22 bp, Artificial Sequence
  chemically synthesized
gcgattaaaaaaaaggacacat

SEQ ID NO: 1348531 - DNA, 22 bp, Artificial Sequence
  chemically synthesized
tacctaatgtgtcctttttttt

SEQ ID NO: 1348532 - DNA, 22 bp, Artificial Sequence
  chemically synthesized
atgtgtccttttttttaatcgc

SEQ ID NO: 1348533 - DNA, 22 bp, Artificial Sequence
  chemically synthesized
ggaggggggctagcgattaaaa

SEQ ID NO: 1348534 - DNA, 22 bp, Artificial Sequence
  chemically synthesized
taggaggggggctagcgattaa

SEQ ID NO: 1348535 - DNA, 22 bp, Artificial Sequence
  chemically synthesized
ttttttaatcgctagcccccct

SEQ ID NO: 1348536 - DNA, 22 bp, Artificial Sequence
  chemically synthesized
tttttaatcgctagcccccctc

SEQ ID NO: 1348537 - DNA, 22 bp, Artificial Sequence
  chemically synthesized
ttttaatcgctagcccccctcc

SEQ ID NO: 1348538 - DNA, 22 bp, Artificial Sequence
  chemically synthesized
tttaatcgctagcccccctcct

SEQ ID NO: 1348539 - DNA, 22 bp, Artificial Sequence
  chemically synthesized
atcaagagttctaggagggggg

SEQ ID NO: 1348540 - DNA, 22 bp, Artificial Sequence
  chemically synthesized
ttaatcgctagcccccctccta

SEQ ID NO: 1348541 - DNA, 22 bp, Artificial Sequence
  chemically synthesized
taatcgctagcccccctcctag

SEQ ID NO: 1348542 - DNA, 22 bp, Artificial Sequence
  chemically synthesized
aatcgctagcccccctcctaga

SEQ ID NO: 1348543 - DNA, 22 bp, Artificial Sequence
  chemically synthesized
atcgctagcccccctcctagaa

SEQ ID NO: 1348544 - DNA, 22 bp, Artificial Sequence
  chemically synthesized
aattcatcaagagttctaggag

SEQ ID NO: 1348545 - DNA, 22 bp, Artificial Sequence
  chemically synthesized
tgaattcatcaagagttctagg

SEQ ID NO: 1348546 - DNA, 22 bp, Artificial Sequence
  chemically synthesized
gcccccctcctagaactcttga

SEQ ID NO: 1348547 - DNA, 22 bp, Artificial Sequence
  chemically synthesized
gattctgaattcatcaagagtt

SEQ ID NO: 1348548 - DNA, 22 bp, Artificial Sequence
  chemically synthesized
cctagattctgaattcatcaag

SEQ ID NO: 1348549 - DNA, 22 bp, Artificial Sequence
  chemically synthesized
tccctagattctgaattcatca

SEQ ID NO: 1348550 - DNA, 22 bp, Artificial Sequence
  chemically synthesized
ctccctagattctgaattcatc

SEQ ID NO: 1348551 - DNA, 22 bp, Artificial Sequence
  chemically synthesized
ctagaactcttgatgaattcag

SEQ ID NO: 1348552 - DNA, 22 bp, Artificial Sequence
  chemically synthesized
tctccctagattctgaattcat

SEQ ID NO: 1348553 - DNA, 22 bp, Artificial Sequence
  chemically synthesized
gaactcttgatgaattcagaat

SEQ ID NO: 1348554 - DNA, 22 bp, Artificial Sequence
  chemically synthesized
actttctccctagattctgaat

SEQ ID NO: 1348555 - DNA, 22 bp, Artificial Sequence
  chemically synthesized
tgactttctccctagattctga

SEQ ID NO: 1348556 - DNA, 22 bp, Artificial Sequence
  chemically synthesized
ctgactttctccctagattctg

SEQ ID NO: 1348557 - DNA, 22 bp, Artificial Sequence
  chemically synthesized
tctgactttctccctagattct

SEQ ID NO: 1348558 - DNA, 22 bp, Artificial Sequence
  chemically synthesized
ttgatgaattcagaatctaggg

SEQ ID NO: 1348559 - DNA, 22 bp, Artificial Sequence
  chemically synthesized
ttctgactttctccctagattc

SEQ ID NO: 1348560 - DNA, 22 bp, Artificial Sequence
  chemically synthesized
gatgaattcagaatctagggag

SEQ ID NO: 1348561 - DNA, 22 bp, Artificial Sequence
  chemically synthesized
atgaattcagaatctagggaga

SEQ ID NO: 1348562 - DNA, 22 bp, Artificial Sequence
  chemically synthesized
cttttctgactttctccctaga

SEQ ID NO: 1348563 - DNA, 22 bp, Artificial Sequence
  chemically synthesized
attgcttttctgactttctccc

SEQ ID NO: 1348564 - DNA, 22 bp, Artificial Sequence
  chemically synthesized
agaatctagggagaaagtcaga

SEQ ID NO: 1348565 - DNA, 22 bp, Artificial Sequence
  chemically synthesized
actgattgcttttctgactttc

SEQ ID NO: 1348566 - DNA, 22 bp, Artificial Sequence
  chemically synthesized
tattgactgattgcttttctga

SEQ ID NO: 1348567 - DNA, 22 bp, Artificial Sequence
  chemically synthesized
gggagaaagtcagaaaagcaat

SEQ ID NO: 1348568 - DNA, 22 bp, Artificial Sequence
  chemically synthesized
cgttgtattgactgattgcttt

SEQ ID NO: 1348569 - DNA, 22 bp, Artificial Sequence
  chemically synthesized
tactacgttgtattgactgatt

SEQ ID NO: 1348570 - DNA, 22 bp, Artificial Sequence
  chemically synthesized
tgtactacgttgtattgactga

SEQ ID NO: 1348571 - DNA, 22 bp, Artificial Sequence
  chemically synthesized
ctctgtactacgttgtattgac

SEQ ID NO: 1348572 - DNA, 22 bp, Artificial Sequence
  chemically synthesized
cctctgtactacgttgtattga

SEQ ID NO: 1348573 - DNA, 22 bp, Artificial Sequence
  chemically synthesized
tcctctgtactacgttgtattg

SEQ ID NO: 1348574 - DNA, 22 bp, Artificial Sequence
  chemically synthesized
agagattttcctctgtactacg

SEQ ID NO: 1348575 - DNA, 22 bp, Artificial Sequence
  chemically synthesized
ttcagagattttcctctgtact

SEQ ID NO: 1348576 - DNA, 22 bp, Artificial Sequence
  chemically synthesized
catggaagtctattcagagatt

SEQ ID NO: 1348577 - DNA, 22 bp, Artificial Sequence
  chemically synthesized
gttacatggaagtctattcaga

SEQ ID NO: 1348578 - DNA, 22 bp, Artificial Sequence
  chemically synthesized
agtaggcattggttacatggaa

SEQ ID NO: 1348579 - DNA, 22 bp, Artificial Sequence
  chemically synthesized
tgaatagacttccatgtaacca

SEQ ID NO: 1348580 - DNA, 22 bp, Artificial Sequence
  chemically synthesized
cctgagtaggcattggttacat

SEQ ID NO: 1348581 - DNA, 22 bp, Artificial Sequence
  chemically synthesized
aatagacttccatgtaaccaat

SEQ ID NO: 1348582 - DNA, 22 bp, Artificial Sequence
  chemically synthesized
gcaaattacctgagtaggcatt

SEQ ID NO: 1348583 - DNA, 22 bp, Artificial Sequence
  chemically synthesized
ccatgtaaccaatgcctactca

SEQ ID NO: 1348584 - DNA, 22 bp, Artificial Sequence
  chemically synthesized
catgtaaccaatgcctactcag

SEQ ID NO: 1348585 - DNA, 22 bp, Artificial Sequence
  chemically synthesized
atctggcaaattacctgagtag

SEQ ID NO: 1348586 - DNA, 22 bp, Artificial Sequence
  chemically synthesized
ttaatctggcaaattacctgag

SEQ ID NO: 1348587 - DNA, 22 bp, Artificial Sequence
  chemically synthesized
gttaatctggcaaattacctga

SEQ ID NO: 1348588 - DNA, 22 bp, Artificial Sequence
  chemically synthesized
ctcaggtaatttgccagattaa

SEQ ID NO: 1348589 - DNA, 22 bp, Artificial Sequence
  chemically synthesized
aggtaatttgccagattaacaa

SEQ ID NO: 1348590 - DNA, 22 bp, Artificial Sequence
  chemically synthesized
agaggaaatgcagggtgtttgt

SEQ ID NO: 1348591 - DNA, 22 bp, Artificial Sequence
  chemically synthesized
cagaggaaatgcagggtgtttg

SEQ ID NO: 1348592 - DNA, 22 bp, Artificial Sequence
  chemically synthesized
tcagaggaaatgcagggtgttt

SEQ ID NO: 1348593 - DNA, 22 bp, Artificial Sequence
  chemically synthesized
gccagattaacaaacaccctgc

SEQ ID NO: 1348594 - DNA, 22 bp, Artificial Sequence
  chemically synthesized
ttcagaggaaatgcagggtgtt

SEQ ID NO: 1348595 - DNA, 22 bp, Artificial Sequence
  chemically synthesized
ccagattaacaaacaccctgca

SEQ ID NO: 1348596 - DNA, 22 bp, Artificial Sequence
  chemically synthesized
acaaacaccctgcatttcctct

SEQ ID NO: 1348597 - DNA, 22 bp, Artificial Sequence
  chemically synthesized
gccaatgtacttttcagaggaa

SEQ ID NO: 1348598 - DNA, 22 bp, Artificial Sequence
  chemically synthesized
ggcattagccaatgtacttttc

SEQ ID NO: 1348599 - DNA, 22 bp, Artificial Sequence
  chemically synthesized
catttcctctgaaaagtacatt

SEQ ID NO: 1348600 - DNA, 22 bp, Artificial Sequence
  chemically synthesized
ccctgggcattagccaatgtac

SEQ ID NO: 1348601 - DNA, 22 bp, Artificial Sequence
  chemically synthesized
gccctgggcattagccaatgta

SEQ ID NO: 1348602 - DNA, 22 bp, Artificial Sequence
  chemically synthesized
cctctgaaaagtacattggcta

SEQ ID NO: 1348603 - DNA, 22 bp, Artificial Sequence
  chemically synthesized
ctctgaaaagtacattggctaa

SEQ ID NO: 1348604 - DNA, 22 bp, Artificial Sequence
  chemically synthesized
tgaaaagtacattggctaatgc

SEQ ID NO: 1348605 - DNA, 22 bp, Artificial Sequence
  chemically synthesized
aaaagtacattggctaatgccc

SEQ ID NO: 1348606 - DNA, 22 bp, Artificial Sequence
  chemically synthesized
aaagtatccatcttgccctggg

SEQ ID NO: 1348607 - DNA, 22 bp, Artificial Sequence
  chemically synthesized
cctaaaagtatccatcttgccc

SEQ ID NO: 1348608 - DNA, 22 bp, Artificial Sequence
  chemically synthesized
gctaatgcccagggcaagatgg

SEQ ID NO: 1348609 - DNA, 22 bp, Artificial Sequence
  chemically synthesized
atgcccagggcaagatggatac

SEQ ID NO: 1348610 - DNA, 22 bp, Artificial Sequence
  chemically synthesized
agtattacctaaaagtatccat

SEQ ID NO: 1348611 - DNA, 22 bp, Artificial Sequence
  chemically synthesized
ccaatgagttgagtattaccta

SEQ ID NO: 1348612 - DNA, 22 bp, Artificial Sequence
  chemically synthesized
atgggtctaccaatgagttgag

SEQ ID NO: 1348613 - DNA, 22 bp, Artificial Sequence
  chemically synthesized
ttaggtaatactcaactcattg

SEQ ID NO: 1348614 - DNA, 22 bp, Artificial Sequence
  chemically synthesized
taggtaatactcaactcattgg

SEQ ID NO: 1348615 - DNA, 22 bp, Artificial Sequence
  chemically synthesized
aggtaatactcaactcattggt

SEQ ID NO: 1348616 - DNA, 22 bp, Artificial Sequence
  chemically synthesized
ggtaatactcaactcattggta

SEQ ID NO: 1348617 - DNA, 22 bp, Artificial Sequence
  chemically synthesized
aactcattggtagacccatgag

SEQ ID NO: 1348618 - DNA, 22 bp, Artificial Sequence
  chemically synthesized
tgagagcggaacctcatgggtc

SEQ ID NO: 1348619 - DNA, 22 bp, Artificial Sequence
  chemically synthesized
gtgagagcggaacctcatgggt

SEQ ID NO: 1348620 - DNA, 22 bp, Artificial Sequence
  chemically synthesized
attggtagacccatgaggttcc

SEQ ID NO: 1348621 - DNA, 22 bp, Artificial Sequence
  chemically synthesized
aacttgtgagagcggaacctca

SEQ ID NO: 1348622 - DNA, 22 bp, Artificial Sequence
  chemically synthesized
gtagacccatgaggttccgctc

SEQ ID NO: 1348623 - DNA, 22 bp, Artificial Sequence
  chemically synthesized
ggtacatactcaacttgtgaga

SEQ ID NO: 1348624 - DNA, 22 bp, Artificial Sequence
  chemically synthesized
gggtacatactcaacttgtgag

SEQ ID NO: 1348625 - DNA, 22 bp, Artificial Sequence
  chemically synthesized
tgggtacatactcaacttgtga

SEQ ID NO: 1348626 - DNA, 22 bp, Artificial Sequence
  chemically synthesized
ttgggtacatactcaacttgtg

SEQ ID NO: 1348627 - DNA, 22 bp, Artificial Sequence
  chemically synthesized
gcttttgggtacatactcaact

SEQ ID NO: 1348628 - DNA, 22 bp, Artificial Sequence
  chemically synthesized
cgctctcacaagttgagtatgt

SEQ ID NO: 1348629 - DNA, 22 bp, Artificial Sequence
  chemically synthesized
agttagcttttgggtacatact

SEQ ID NO: 1348630 - DNA, 22 bp, Artificial Sequence
  chemically synthesized
tcacaagttgagtatgtaccca

SEQ ID NO: 1348631 - DNA, 22 bp, Artificial Sequence
  chemically synthesized
acaagttgagtatgtacccaaa

SEQ ID NO: 1348632 - DNA, 22 bp, Artificial Sequence
  chemically synthesized
actaagttagcttttgggtaca

SEQ ID NO: 1348633 - DNA, 22 bp, Artificial Sequence
  chemically synthesized
aactaagttagcttttgggtac

SEQ ID NO: 1348634 - DNA, 22 bp, Artificial Sequence
  chemically synthesized
gcttaactaagttagcttttgg

SEQ ID NO: 1348635 - DNA, 22 bp, Artificial Sequence
  chemically synthesized
agtatgtacccaaaagctaact

SEQ ID NO: 1348636 - DNA, 22 bp, Artificial Sequence
  chemically synthesized
taactggcttaactaagttagc

SEQ ID NO: 1348637 - DNA, 22 bp, Artificial Sequence
  chemically synthesized
gaaataattataactggcttaa

SEQ ID NO: 1348638 - DNA, 22 bp, Artificial Sequence
  chemically synthesized
tagaaataattataactggctt

SEQ ID NO: 1348639 - DNA, 22 bp, Artificial Sequence
  chemically synthesized
acttagttaagccagttataat

SEQ ID NO: 1348640 - DNA, 22 bp, Artificial Sequence
  chemically synthesized
agttaagccagttataattatt

SEQ ID NO: 1348641 - DNA, 22 bp, Artificial Sequence
  chemically synthesized
tgtaactctagaaataattata

SEQ ID NO: 1348642 - DNA, 22 bp, Artificial Sequence
  chemically synthesized
gttaagccagttataattattt

SEQ ID NO: 1348643 - DNA, 22 bp, Artificial Sequence
  chemically synthesized
atgtaactctagaaataattat

SEQ ID NO: 1348644 - DNA, 22 bp, Artificial Sequence
  chemically synthesized
tatgtaactctagaaataatta

SEQ ID NO: 1348645 - DNA, 22 bp, Artificial Sequence
  chemically synthesized
agccagttataattatttctag

SEQ ID NO: 1348646 - DNA, 22 bp, Artificial Sequence
  chemically synthesized
ataatctttatgtaactctaga

SEQ ID NO: 1348647 - DNA, 22 bp, Artificial Sequence
  chemically synthesized
taattatttctagagttacata

SEQ ID NO: 1348648 - DNA, 22 bp, Artificial Sequence
  chemically synthesized
agttgataatctttatgtaact

SEQ ID NO: 1348649 - DNA, 22 bp, Artificial Sequence
  chemically synthesized
cagttgataatctttatgtaac

SEQ ID NO: 1348650 - DNA, 22 bp, Artificial Sequence
  chemically synthesized
tcagttgataatctttatgtaa

SEQ ID NO: 1348651 - DNA, 22 bp, Artificial Sequence
  chemically synthesized
ttcagttgataatctttatgta

SEQ ID NO: 1348652 - DNA, 22 bp, Artificial Sequence
  chemically synthesized
tttctagagttacataaagatt

SEQ ID NO: 1348653 - DNA, 22 bp, Artificial Sequence
  chemically synthesized
ctagagttacataaagattatc

SEQ ID NO: 1348654 - DNA, 22 bp, Artificial Sequence
  chemically synthesized
catttttcagttgataatcttt

SEQ ID NO: 1348655 - DNA, 22 bp, Artificial Sequence
  chemically synthesized
tagagttacataaagattatca

SEQ ID NO: 1348656 - DNA, 22 bp, Artificial Sequence
  chemically synthesized
acatttttcagttgataatctt

SEQ ID NO: 1348657 - DNA, 22 bp, Artificial Sequence
  chemically synthesized
gagttacataaagattatcaac

SEQ ID NO: 1348658 - DNA, 22 bp, Artificial Sequence
  chemically synthesized
cataaagattatcaactgaaaa

SEQ ID NO: 1348659 - DNA, 22 bp, Artificial Sequence
  chemically synthesized
atggagcttacatttttcagtt

SEQ ID NO: 1348660 - DNA, 22 bp, Artificial Sequence
  chemically synthesized
catggagcttacatttttcagt

SEQ ID NO: 1348661 - DNA, 22 bp, Artificial Sequence
  chemically synthesized
gtcttcatggagcttacatttt

SEQ ID NO: 1348662 - DNA, 22 bp, Artificial Sequence
  chemically synthesized
tcaactgaaaaatgtaagctcc

SEQ ID NO: 1348663 - DNA, 22 bp, Artificial Sequence
  chemically synthesized
aaaaatgtaagctccatgaaga

SEQ ID NO: 1348664 - DNA, 22 bp, Artificial Sequence
  chemically synthesized
ggaacggcaaagccctcgtctt

SEQ ID NO: 1348665 - DNA, 22 bp, Artificial Sequence
  chemically synthesized
gggaacggcaaagccctcgtct

SEQ ID NO: 1348666 - DNA, 22 bp, Artificial Sequence
  chemically synthesized
cttgggaacggcaaagccctcg

SEQ ID NO: 1348667 - DNA, 22 bp, Artificial Sequence
  chemically synthesized
catgaagacgagggctttgccg

SEQ ID NO: 1348668 - DNA, 22 bp, Artificial Sequence
  chemically synthesized
gttacttgggaacggcaaagcc

SEQ ID NO: 1348669 - DNA, 22 bp, Artificial Sequence
  chemically synthesized
gtctagttacttgggaacggca

SEQ ID NO: 1348670 - DNA, 22 bp, Artificial Sequence
  chemically synthesized
agcaggatctagtctagttact

SEQ ID NO: 1348671 - DNA, 22 bp, Artificial Sequence
  chemically synthesized
tgccgttcccaagtaactagac

SEQ ID NO: 1348672 - DNA, 22 bp, Artificial Sequence
  chemically synthesized
gccgttcccaagtaactagact

SEQ ID NO: 1348673 - DNA, 22 bp, Artificial Sequence
  chemically synthesized
ccgttcccaagtaactagacta

SEQ ID NO: 1348674 - DNA, 22 bp, Artificial Sequence
  chemically synthesized
ccaagtaactagactagatcct

SEQ ID NO: 1348675 - DNA, 22 bp, Artificial Sequence
  chemically synthesized
ataaatattaagcaggatctag

SEQ ID NO: 1348676 - DNA, 22 bp, Artificial Sequence
  chemically synthesized
aataaatattaagcaggatcta

SEQ ID NO: 1348677 - DNA, 22 bp, Artificial Sequence
  chemically synthesized
gactagatcctgcttaatattt

SEQ ID NO: 1348678 - DNA, 22 bp, Artificial Sequence
  chemically synthesized
gatcctgcttaatatttattaa

SEQ ID NO: 1348679 - DNA, 22 bp, Artificial Sequence
  chemically synthesized
taagtgtatgacttaataaata

SEQ ID NO: 1348680 - DNA, 22 bp, Artificial Sequence
  chemically synthesized
gtaagtgtatgacttaataaat

SEQ ID NO: 1348681 - DNA, 22 bp, Artificial Sequence
  chemically synthesized
tgtaagtgtatgacttaataaa

SEQ ID NO: 1348682 - DNA, 22 bp, Artificial Sequence
  chemically synthesized
ttgtaagtgtatgacttaataa

SEQ ID NO: 1348683 - DNA, 22 bp, Artificial Sequence
  chemically synthesized
cttaatatttattaagtcatac

SEQ ID NO: 1348684 - DNA, 22 bp, Artificial Sequence
  chemically synthesized
aatatttattaagtcatacact

SEQ ID NO: 1348685 - DNA, 22 bp, Artificial Sequence
  chemically synthesized
atatttattaagtcatacactt

SEQ ID NO: 1348686 - DNA, 22 bp, Artificial Sequence
  chemically synthesized
attaagtcatacacttacaaaa

SEQ ID NO: 1348687 - DNA, 22 bp, Artificial Sequence
  chemically synthesized
ttaagtcatacacttacaaaag

SEQ ID NO: 1348688 - DNA, 22 bp, Artificial Sequence
  chemically synthesized
cataaataaaaacttttgtaag

SEQ ID NO: 1348689 - DNA, 22 bp, Artificial Sequence
  chemically synthesized
gcataaataaaaacttttgtaa

SEQ ID NO: 1348690 - DNA, 22 bp, Artificial Sequence
  chemically synthesized
tgcataaataaaaacttttgta

SEQ ID NO: 1348691 - DNA, 22 bp, Artificial Sequence
  chemically synthesized
agtcatacacttacaaaagttt

SEQ ID NO: 1348692 - DNA, 22 bp, Artificial Sequence
  chemically synthesized
gattttgcataaataaaaactt

SEQ ID NO: 1348693 - DNA, 22 bp, Artificial Sequence
  chemically synthesized
agattttgcataaataaaaact

SEQ ID NO: 1348694 - DNA, 22 bp, Artificial Sequence
  chemically synthesized
agtttagattttgcataaataa

SEQ ID NO: 1348695 - DNA, 22 bp, Artificial Sequence
  chemically synthesized
acaaaagtttttatttatgcaa

SEQ ID NO: 1348696 - DNA, 22 bp, Artificial Sequence
  chemically synthesized
caaaagtttttatttatgcaaa

SEQ ID NO: 1348697 - DNA, 22 bp, Artificial Sequence
  chemically synthesized
caacattcagtttagattttgc

SEQ ID NO: 1348698 - DNA, 22 bp, Artificial Sequence
  chemically synthesized
tacaacattcagtttagatttt

SEQ ID NO: 1348699 - DNA, 22 bp, Artificial Sequence
  chemically synthesized
ctacaacattcagtttagattt

SEQ ID NO: 1348700 - DNA, 22 bp, Artificial Sequence
  chemically synthesized
ttatttatgcaaaatctaaact

SEQ ID NO: 1348701 - DNA, 22 bp, Artificial Sequence
  chemically synthesized
tatttatgcaaaatctaaactg

SEQ ID NO: 1348702 - DNA, 22 bp, Artificial Sequence
  chemically synthesized
atttatgcaaaatctaaactga

SEQ ID NO: 1348703 - DNA, 22 bp, Artificial Sequence
  chemically synthesized
tttctacaacattcagtttaga

SEQ ID NO: 1348704 - DNA, 22 bp, Artificial Sequence
  chemically synthesized
tttatgcaaaatctaaactgaa

SEQ ID NO: 1348705 - DNA, 22 bp, Artificial Sequence
  chemically synthesized
atgcaaaatctaaactgaatgt

SEQ ID NO: 1348706 - DNA, 22 bp, Artificial Sequence
  chemically synthesized
attatttctacaacattcagtt

SEQ ID NO: 1348707 - DNA, 22 bp, Artificial Sequence
  chemically synthesized
tgcaaaatctaaactgaatgtt

SEQ ID NO: 1348708 - DNA, 22 bp, Artificial Sequence
  chemically synthesized
ttgattatttctacaacattca

SEQ ID NO: 1348709 - DNA, 22 bp, Artificial Sequence
  chemically synthesized
attgattatttctacaacattc

SEQ ID NO: 1348710 - DNA, 22 bp, Artificial Sequence
  chemically synthesized
aactgaatgttgtagaaataat

SEQ ID NO: 1348711 - DNA, 22 bp, Artificial Sequence
  chemically synthesized
caaccatatttattgattattt

SEQ ID NO: 1348712 - DNA, 22 bp, Artificial Sequence
  chemically synthesized
gcaaccatatttattgattatt

SEQ ID NO: 1348713 - DNA, 22 bp, Artificial Sequence
  chemically synthesized
aatgttgtagaaataatcaata

SEQ ID NO: 1348714 - DNA, 22 bp, Artificial Sequence
  chemically synthesized
tgcaaccatatttattgattat

SEQ ID NO: 1348715 - DNA, 22 bp, Artificial Sequence
  chemically synthesized
tagaaataatcaataaatatgg

SEQ ID NO: 1348716 - DNA, 22 bp, Artificial Sequence
  chemically synthesized
aatcattttgcaaccatattta

SEQ ID NO: 1348717 - DNA, 22 bp, Artificial Sequence
  chemically synthesized
gaatcattttgcaaccatattt

SEQ ID NO: 1348718 - DNA, 22 bp, Artificial Sequence
  chemically synthesized
tccaagcatttgaatcattttg

SEQ ID NO: 1348719 - DNA, 22 bp, Artificial Sequence
  chemically synthesized
tctgtccaagcatttgaatcat

SEQ ID NO: 1348720 - DNA, 22 bp, Artificial Sequence
  chemically synthesized
gtctgtccaagcatttgaatca

SEQ ID NO: 1348721 - DNA, 22 bp, Artificial Sequence
  chemically synthesized
catttgtctgtccaagcatttg

SEQ ID NO: 1348722 - DNA, 22 bp, Artificial Sequence
  chemically synthesized
acatttgtctgtccaagcattt

SEQ ID NO: 1348723 - DNA, 22 bp, Artificial Sequence
  chemically synthesized
caaaatgattcaaatgcttgga

SEQ ID NO: 1348724 - DNA, 22 bp, Artificial Sequence
  chemically synthesized
tacatttgtctgtccaagcatt

SEQ ID NO: 1348725 - DNA, 22 bp, Artificial Sequence
  chemically synthesized
ataaaattttacatttgtctgt

SEQ ID NO: 1348726 - DNA, 22 bp, Artificial Sequence
  chemically synthesized
aataaaattttacatttgtctg

SEQ ID NO: 1348727 - DNA, 22 bp, Artificial Sequence
  chemically synthesized
aaatgcttggacagacaaatgt

SEQ ID NO: 1348728 - DNA, 22 bp, Artificial Sequence
  chemically synthesized
taataaaattttacatttgtct

SEQ ID NO: 1348729 - DNA, 22 bp, Artificial Sequence
  chemically synthesized
ttaataaaattttacatttgtc

SEQ ID NO: 1348730 - DNA, 22 bp, Artificial Sequence
  chemically synthesized
tttttaataaaattttacattt

SEQ ID NO: 1348731 - DNA, 22 bp, Artificial Sequence
  chemically synthesized
ttatttttaataaaattttaca

SEQ ID NO: 1348732 - DNA, 22 bp, Artificial Sequence
  chemically synthesized
ggacagacaaatgtaaaatttt

SEQ ID NO: 1348733 - DNA, 22 bp, Artificial Sequence
  chemically synthesized
attatttttaataaaattttac

SEQ ID NO: 1348734 - DNA, 22 bp, Artificial Sequence
  chemically synthesized
gacagacaaatgtaaaatttta

SEQ ID NO: 1348735 - DNA, 22 bp, Artificial Sequence
  chemically synthesized
tattatttttaataaaatttta

SEQ ID NO: 1348736 - DNA, 22 bp, Artificial Sequence
  chemically synthesized
ttattatttttaataaaatttt

SEQ ID NO: 1348737 - DNA, 22 bp, Artificial Sequence
  chemically synthesized
aagatttttattatttttaata

SEQ ID NO: 1348738 - DNA, 22 bp, Artificial Sequence
  chemically synthesized
tattaaaaataataaaaatctt

SEQ ID NO: 1348739 - DNA, 22 bp, Artificial Sequence
  chemically synthesized
cacatagaactaaagattttta

SEQ ID NO: 1348740 - DNA, 22 bp, Artificial Sequence
  chemically synthesized
attaaaaataataaaaatcttt

SEQ ID NO: 1348741 - DNA, 22 bp, Artificial Sequence
  chemically synthesized
ttaaaaataataaaaatcttta

SEQ ID NO: 1348742 - DNA, 22 bp, Artificial Sequence
  chemically synthesized
aaaataataaaaatctttagtt

SEQ ID NO: 1348743 - DNA, 22 bp, Artificial Sequence
  chemically synthesized
tgaagcaatctgcacatagaac

SEQ ID NO: 1348744 - DNA, 22 bp, Artificial Sequence
  chemically synthesized
gtgaagcaatctgcacatagaa

SEQ ID NO: 1348745 - DNA, 22 bp, Artificial Sequence
  chemically synthesized
tagttctatgtgcagattgctt

SEQ ID NO: 1348746 - DNA, 22 bp, Artificial Sequence
  chemically synthesized
agttctatgtgcagattgcttc

SEQ ID NO: 1348747 - DNA, 22 bp, Artificial Sequence
  chemically synthesized
gttctatgtgcagattgcttca

SEQ ID NO: 1348748 - DNA, 22 bp, Artificial Sequence
  chemically synthesized
tatgtgcagattgcttcacaaa

SEQ ID NO: 1348749 - DNA, 22 bp, Artificial Sequence
  chemically synthesized
tgtgcagattgcttcacaaata

SEQ ID NO: 1348750 - DNA, 22 bp, Artificial Sequence
  chemically synthesized
aatgagaaataaaagatatttg

SEQ ID NO: 1348751 - DNA, 22 bp, Artificial Sequence
  chemically synthesized
tatctgaatgagaaataaaaga

SEQ ID NO: 1348752 - DNA, 22 bp, Artificial Sequence
  chemically synthesized
cttcacaaatatcttttatttc

SEQ ID NO: 1348753 - DNA, 22 bp, Artificial Sequence
  chemically synthesized
atatctgaatgagaaataaaag

SEQ ID NO: 1348754 - DNA, 22 bp, Artificial Sequence
  chemically synthesized
tatatctgaatgagaaataaaa

SEQ ID NO: 1348755 - DNA, 22 bp, Artificial Sequence
  chemically synthesized
cacaaatatcttttatttctca

SEQ ID NO: 1348756 - DNA, 22 bp, Artificial Sequence
  chemically synthesized
tttatatctgaatgagaaataa

SEQ ID NO: 1348757 - DNA, 22 bp, Artificial Sequence
  chemically synthesized
acaaatatcttttatttctcat

SEQ ID NO: 1348758 - DNA, 22 bp, Artificial Sequence
  chemically synthesized
ctttatatctgaatgagaaata

SEQ ID NO: 1348759 - DNA, 22 bp, Artificial Sequence
  chemically synthesized
agtttctttatatctgaatgag

SEQ ID NO: 1348760 - DNA, 22 bp, Artificial Sequence
  chemically synthesized
cagtttctttatatctgaatga

SEQ ID NO: 1348761 - DNA, 22 bp, Artificial Sequence
  chemically synthesized
ttatttctcattcagatataaa

SEQ ID NO: 1348762 - DNA, 22 bp, Artificial Sequence
  chemically synthesized
tatttctcattcagatataaag

SEQ ID NO: 1348763 - DNA, 22 bp, Artificial Sequence
  chemically synthesized
cagtttcagtttctttatatct

SEQ ID NO: 1348764 - DNA, 22 bp, Artificial Sequence
  chemically synthesized
atttctcattcagatataaaga

SEQ ID NO: 1348765 - DNA, 22 bp, Artificial Sequence
  chemically synthesized
ccagtttcagtttctttatatc

SEQ ID NO: 1348766 - DNA, 22 bp, Artificial Sequence
  chemically synthesized
tttctcattcagatataaagaa

SEQ ID NO: 1348767 - DNA, 22 bp, Artificial Sequence
  chemically synthesized
ctcattcagatataaagaaact

SEQ ID NO: 1348768 - DNA, 22 bp, Artificial Sequence
  chemically synthesized
tcattcagatataaagaaactg

SEQ ID NO: 1348769 - DNA, 22 bp, Artificial Sequence
  chemically synthesized
taatttccagtttcagtttctt

SEQ ID NO: 1348770 - DNA, 22 bp, Artificial Sequence
  chemically synthesized
attcagatataaagaaactgaa

SEQ ID NO: 1348771 - DNA, 22 bp, Artificial Sequence
  chemically synthesized
agatataaagaaactgaaactg

SEQ ID NO: 1348772 - DNA, 22 bp, Artificial Sequence
  chemically synthesized
gcataatctataatttccagtt

SEQ ID NO: 1348773 - DNA, 22 bp, Artificial Sequence
  chemically synthesized
atagctagcataatctataatt

SEQ ID NO: 1348774 - DNA, 22 bp, Artificial Sequence
  chemically synthesized
ctcatagctagcataatctata

SEQ ID NO: 1348775 - DNA, 22 bp, Artificial Sequence
  chemically synthesized
aaactggaaattatagattatg

SEQ ID NO: 1348776 - DNA, 22 bp, Artificial Sequence
  chemically synthesized
ttgctcatagctagcataatct

SEQ ID NO: 1348777 - DNA, 22 bp, Artificial Sequence
  chemically synthesized
tattgctcatagctagcataat

SEQ ID NO: 1348778 - DNA, 22 bp, Artificial Sequence
  chemically synthesized
gaaattatagattatgctagct

SEQ ID NO: 1348779 - DNA, 22 bp, Artificial Sequence
  chemically synthesized
tagattatgctagctatgagca

SEQ ID NO: 1348780 - DNA, 22 bp, Artificial Sequence
  chemically synthesized
gatcatagttctattgctcata

SEQ ID NO: 1348781 - DNA, 22 bp, Artificial Sequence
  chemically synthesized
ggatcatagttctattgctcat

SEQ ID NO: 1348782 - DNA, 22 bp, Artificial Sequence
  chemically synthesized
tgctagctatgagcaatagaac

SEQ ID NO: 1348783 - DNA, 22 bp, Artificial Sequence
  chemically synthesized
tgtggcttggatcatagttcta

SEQ ID NO: 1348784 - DNA, 22 bp, Artificial Sequence
  chemically synthesized
gctatgagcaatagaactatga

SEQ ID NO: 1348785 - DNA, 22 bp, Artificial Sequence
  chemically synthesized
cctatgtggcttggatcatagt

SEQ ID NO: 1348786 - DNA, 22 bp, Artificial Sequence
  chemically synthesized
tgagcaatagaactatgatcca

SEQ ID NO: 1348787 - DNA, 22 bp, Artificial Sequence
  chemically synthesized
aaattacctatgtggcttggat

SEQ ID NO: 1348788 - DNA, 22 bp, Artificial Sequence
  chemically synthesized
tgatccaagccacataggtaat

SEQ ID NO: 1348789 - DNA, 22 bp, Artificial Sequence
  chemically synthesized
taatgtgggtatcagacaaatt

SEQ ID NO: 1348790 - DNA, 22 bp, Artificial Sequence
  chemically synthesized
gtaatgtgggtatcagacaaat

SEQ ID NO: 1348791 - DNA, 22 bp, Artificial Sequence
  chemically synthesized
tttgtaatgtgggtatcagaca

SEQ ID NO: 1348792 - DNA, 22 bp, Artificial Sequence
  chemically synthesized
attatttgtaatgtgggtatca

SEQ ID NO: 1348793 - DNA, 22 bp, Artificial Sequence
  chemically synthesized
tcattatttgtaatgtgggtat

SEQ ID NO: 1348794 - DNA, 22 bp, Artificial Sequence
  chemically synthesized
taatttgtctgatacccacatt

SEQ ID NO: 1348795 - DNA, 22 bp, Artificial Sequence
  chemically synthesized
ctcattatttgtaatgtgggta

SEQ ID NO: 1348796 - DNA, 22 bp, Artificial Sequence
  chemically synthesized
aatttgtctgatacccacatta

SEQ ID NO: 1348797 - DNA, 22 bp, Artificial Sequence
  chemically synthesized
atttgtctgatacccacattac

SEQ ID NO: 1348798 - DNA, 22 bp, Artificial Sequence
  chemically synthesized
gtctgatacccacattacaaat

SEQ ID NO: 1348799 - DNA, 22 bp, Artificial Sequence
  chemically synthesized
tctgatacccacattacaaata

SEQ ID NO: 1348800 - DNA, 22 bp, Artificial Sequence
  chemically synthesized
cccatttctcattatttgtaat

SEQ ID NO: 1348801 - DNA, 22 bp, Artificial Sequence
  chemically synthesized
acccatttctcattatttgtaa

SEQ ID NO: 1348802 - DNA, 22 bp, Artificial Sequence
  chemically synthesized
tacccatttctcattatttgta

SEQ ID NO: 1348803 - DNA, 22 bp, Artificial Sequence
  chemically synthesized
atacccacattacaaataatga

SEQ ID NO: 1348804 - DNA, 22 bp, Artificial Sequence
  chemically synthesized
gttttacccatttctcattatt

SEQ ID NO: 1348805 - DNA, 22 bp, Artificial Sequence
  chemically synthesized
caaataatgagaaatgggtaaa

SEQ ID NO: 1348806 - DNA, 22 bp, Artificial Sequence
  chemically synthesized
agtaaaatacagtatggatgtt

SEQ ID NO: 1348807 - DNA, 22 bp, Artificial Sequence
  chemically synthesized
gttaagtaaaatacagtatgga

SEQ ID NO: 1348808 - DNA, 22 bp, Artificial Sequence
  chemically synthesized
ggttaagtaaaatacagtatgg

SEQ ID NO: 1348809 - DNA, 22 bp, Artificial Sequence
  chemically synthesized
tttggttaagtaaaatacagta

SEQ ID NO: 1348810 - DNA, 22 bp, Artificial Sequence
  chemically synthesized
acatccatactgtattttactt

SEQ ID NO: 1348811 - DNA, 22 bp, Artificial Sequence
  chemically synthesized
ggatctgtttggttaagtaaaa

SEQ ID NO: 1348812 - DNA, 22 bp, Artificial Sequence
  chemically synthesized
gggatctgtttggttaagtaaa

SEQ ID NO: 1348813 - DNA, 22 bp, Artificial Sequence
  chemically synthesized
tattttacttaaccaaacagat

SEQ ID NO: 1348814 - DNA, 22 bp, Artificial Sequence
  chemically synthesized
tacttaaccaaacagatcccaa

SEQ ID NO: 1348815 - DNA, 22 bp, Artificial Sequence
  chemically synthesized
aaatgatagtatttgggatctg

SEQ ID NO: 1348816 - DNA, 22 bp, Artificial Sequence
  chemically synthesized
acttaaccaaacagatcccaaa

SEQ ID NO: 1348817 - DNA, 22 bp, Artificial Sequence
  chemically synthesized
gaaatgatagtatttgggatct

SEQ ID NO: 1348818 - DNA, 22 bp, Artificial Sequence
  chemically synthesized
cttaaccaaacagatcccaaat

SEQ ID NO: 1348819 - DNA, 22 bp, Artificial Sequence
  chemically synthesized
aaccaaacagatcccaaatact

SEQ ID NO: 1348820 - DNA, 22 bp, Artificial Sequence
  chemically synthesized
accaaacagatcccaaatacta

SEQ ID NO: 1348821 - DNA, 22 bp, Artificial Sequence
  chemically synthesized
catcttgaaatgatagtatttg

SEQ ID NO: 1348822 - DNA, 22 bp, Artificial Sequence
  chemically synthesized
tatgcgttgcatcttgaaatga

SEQ ID NO: 1348823 - DNA, 22 bp, Artificial Sequence
  chemically synthesized
atatgcgttgcatcttgaaatg

SEQ ID NO: 1348824 - DNA, 22 bp, Artificial Sequence
  chemically synthesized
tatatgcgttgcatcttgaaat

SEQ ID NO: 1348825 - DNA, 22 bp, Artificial Sequence
  chemically synthesized
tcatttcaagatgcaacgcata

SEQ ID NO: 1348826 - DNA, 22 bp, Artificial Sequence
  chemically synthesized
aataataattttatatgcgttg

SEQ ID NO: 1348827 - DNA, 22 bp, Artificial Sequence
  chemically synthesized
caagatgcaacgcatataaaat

SEQ ID NO: 1348828 - DNA, 22 bp, Artificial Sequence
  chemically synthesized
aagatgcaacgcatataaaatt

SEQ ID NO: 1348829 - DNA, 22 bp, Artificial Sequence
  chemically synthesized
gtgtaaaaataatatgaaagat

SEQ ID NO: 1348830 - DNA, 22 bp, Artificial Sequence
  chemically synthesized
agtgtaaaaataatatgaaaga

SEQ ID NO: 1348831 - DNA, 22 bp, Artificial Sequence
  chemically synthesized
ttattgagatctttcatattat

SEQ ID NO: 1348832 - DNA, 22 bp, Artificial Sequence
  chemically synthesized
ttgagatctttcatattatttt

SEQ ID NO: 1348833 - DNA, 22 bp, Artificial Sequence
  chemically synthesized
aagacttagtgtaaaaataata

SEQ ID NO: 1348834 - DNA, 22 bp, Artificial Sequence
  chemically synthesized
gaagacttagtgtaaaaataat

SEQ ID NO: 1348835 - DNA, 22 bp, Artificial Sequence
  chemically synthesized
agatctttcatattatttttac

SEQ ID NO: 1348836 - DNA, 22 bp, Artificial Sequence
  chemically synthesized
tgaagacttagtgtaaaaataa

SEQ ID NO: 1348837 - DNA, 22 bp, Artificial Sequence
  chemically synthesized
gactttgaagacttagtgtaaa

SEQ ID NO: 1348838 - DNA, 22 bp, Artificial Sequence
  chemically synthesized
tcatattatttttacactaagt

SEQ ID NO: 1348839 - DNA, 22 bp, Artificial Sequence
  chemically synthesized
catattatttttacactaagtc

SEQ ID NO: 1348840 - DNA, 22 bp, Artificial Sequence
  chemically synthesized
atattatttttacactaagtct

SEQ ID NO: 1348841 - DNA, 22 bp, Artificial Sequence
  chemically synthesized
tttttacactaagtcttcaaag

SEQ ID NO: 1348842 - DNA, 22 bp, Artificial Sequence
  chemically synthesized
ttacactaagtcttcaaagtcc

SEQ ID NO: 1348843 - DNA, 22 bp, Artificial Sequence
  chemically synthesized
tacactaagtcttcaaagtcca

SEQ ID NO: 1348844 - DNA, 22 bp, Artificial Sequence
  chemically synthesized
acactaagtcttcaaagtccag

SEQ ID NO: 1348845 - DNA, 22 bp, Artificial Sequence
  chemically synthesized
cactaagtcttcaaagtccagt

SEQ ID NO: 1348846 - DNA, 22 bp, Artificial Sequence
  chemically synthesized
taaatgtaaaatacacactgga

SEQ ID NO: 1348847 - DNA, 22 bp, Artificial Sequence
  chemically synthesized
agtcttcaaagtccagtgtgta

SEQ ID NO: 1348848 - DNA, 22 bp, Artificial Sequence
  chemically synthesized
caaagtccagtgtgtattttac

SEQ ID NO: 1348849 - DNA, 22 bp, Artificial Sequence
  chemically synthesized
aaagtccagtgtgtattttaca

SEQ ID NO: 1348850 - DNA, 22 bp, Artificial Sequence
  chemically synthesized
agaggtactataaatgtaaaat

SEQ ID NO: 1348851 - DNA, 22 bp, Artificial Sequence
  chemically synthesized
gcatgaattgagaggtactata

SEQ ID NO: 1348852 - DNA, 22 bp, Artificial Sequence
  chemically synthesized
tacatttatagtacctctcaat

SEQ ID NO: 1348853 - DNA, 22 bp, Artificial Sequence
  chemically synthesized
acatttatagtacctctcaatt

SEQ ID NO: 1348854 - DNA, 22 bp, Artificial Sequence
  chemically synthesized
catttatagtacctctcaattc

SEQ ID NO: 1348855 - DNA, 22 bp, Artificial Sequence
  chemically synthesized
gaatgtagctagcatgaattga

SEQ ID NO: 1348856 - DNA, 22 bp, Artificial Sequence
  chemically synthesized
atagtacctctcaattcatgct

SEQ ID NO: 1348857 - DNA, 22 bp, Artificial Sequence
  chemically synthesized
tagtacctctcaattcatgcta

SEQ ID NO: 1348858 - DNA, 22 bp, Artificial Sequence
  chemically synthesized
tggccattggaatgtagctagc

SEQ ID NO: 1348859 - DNA, 22 bp, Artificial Sequence
  chemically synthesized
tcaattcatgctagctacattc

SEQ ID NO: 1348860 - DNA, 22 bp, Artificial Sequence
  chemically synthesized
aattcatgctagctacattcca

SEQ ID NO: 1348861 - DNA, 22 bp, Artificial Sequence
  chemically synthesized
ccatctatggccattggaatgt

SEQ ID NO: 1348862 - DNA, 22 bp, Artificial Sequence
  chemically synthesized
gccatctatggccattggaatg

SEQ ID NO: 1348863 - DNA, 22 bp, Artificial Sequence
  chemically synthesized
atgctagctacattccaatggc

SEQ ID NO: 1348864 - DNA, 22 bp, Artificial Sequence
  chemically synthesized
gctacattccaatggccataga

SEQ ID NO: 1348865 - DNA, 22 bp, Artificial Sequence
  chemically synthesized
cattccaatggccatagatggc

SEQ ID NO: 1348866 - DNA, 22 bp, Artificial Sequence
  chemically synthesized
agtatggtagccacttgccatc

SEQ ID NO: 1348867 - DNA, 22 bp, Artificial Sequence
  chemically synthesized
caatggccatagatggcaagtg

SEQ ID NO: 1348868 - DNA, 22 bp, Artificial Sequence
  chemically synthesized
tgaagttcagtatggtagccac

SEQ ID NO: 1348869 - DNA, 22 bp, Artificial Sequence
  chemically synthesized
tgtgaagttcagtatggtagcc

SEQ ID NO: 1348870 - DNA, 22 bp, Artificial Sequence
  chemically synthesized
ctgtgaagttcagtatggtagc

SEQ ID NO: 1348871 - DNA, 22 bp, Artificial Sequence
  chemically synthesized
cttctgtgaagttcagtatggt

SEQ ID NO: 1348872 - DNA, 22 bp, Artificial Sequence
  chemically synthesized
tctacttctgtgaagttcagta

SEQ ID NO: 1348873 - DNA, 22 bp, Artificial Sequence
  chemically synthesized
ccatactgaacttcacagaagt

SEQ ID NO: 1348874 - DNA, 22 bp, Artificial Sequence
  chemically synthesized
aacttcacagaagtagacaata

SEQ ID NO: 1348875 - DNA, 22 bp, Artificial Sequence
  chemically synthesized
cagaaatcacatccatattgtc

SEQ ID NO: 1348876 - DNA, 22 bp, Artificial Sequence
  chemically synthesized
acagaaatcacatccatattgt

SEQ ID NO: 1348877 - DNA, 22 bp, Artificial Sequence
  chemically synthesized
cacagaagtagacaatatggat

SEQ ID NO: 1348878 - DNA, 22 bp, Artificial Sequence
  chemically synthesized
acagaagtagacaatatggatg

SEQ ID NO: 1348879 - DNA, 22 bp, Artificial Sequence
  chemically synthesized
ttacagaaatcacatccatatt

SEQ ID NO: 1348880 - DNA, 22 bp, Artificial Sequence
  chemically synthesized
cttacagaaatcacatccatat

SEQ ID NO: 1348881 - DNA, 22 bp, Artificial Sequence
  chemically synthesized
tcttacagaaatcacatccata

SEQ ID NO: 1348882 - DNA, 22 bp, Artificial Sequence
  chemically synthesized
tttcttacagaaatcacatcca

SEQ ID NO: 1348883 - DNA, 22 bp, Artificial Sequence
  chemically synthesized
tctttcttacagaaatcacatc

SEQ ID NO: 1348884 - DNA, 22 bp, Artificial Sequence
  chemically synthesized
ctctttcttacagaaatcacat

SEQ ID NO: 1348885 - DNA, 22 bp, Artificial Sequence
  chemically synthesized
tctctttcttacagaaatcaca

SEQ ID NO: 1348886 - DNA, 22 bp, Artificial Sequence
  chemically synthesized
ttctctttcttacagaaatcac

SEQ ID NO: 1348887 - DNA, 22 bp, Artificial Sequence
  chemically synthesized
tttttctctttcttacagaaat

SEQ ID NO: 1348888 - DNA, 22 bp, Artificial Sequence
  chemically synthesized
gagtgagattatttttctcttt

SEQ ID NO: 1348889 - DNA, 22 bp, Artificial Sequence
  chemically synthesized
ctgtaagaaagagaaaaataat

SEQ ID NO: 1348890 - DNA, 22 bp, Artificial Sequence
  chemically synthesized
tgtaagaaagagaaaaataatc

SEQ ID NO: 1348891 - DNA, 22 bp, Artificial Sequence
  chemically synthesized
taagaaagagaaaaataatctc

SEQ ID NO: 1348892 - DNA, 22 bp, Artificial Sequence
  chemically synthesized
acagattagagtgagattattt

SEQ ID NO: 1348893 - DNA, 22 bp, Artificial Sequence
  chemically synthesized
cagaaattcacagattagagtg

SEQ ID NO: 1348894 - DNA, 22 bp, Artificial Sequence
  chemically synthesized
ctacagaaattcacagattaga

SEQ ID NO: 1348895 - DNA, 22 bp, Artificial Sequence
  chemically synthesized
atacctactacagaaattcaca

SEQ ID NO: 1348896 - DNA, 22 bp, Artificial Sequence
  chemically synthesized
actctaatctgtgaatttctgt

SEQ ID NO: 1348897 - DNA, 22 bp, Artificial Sequence
  chemically synthesized
gacctcatacctactacagaaa

SEQ ID NO: 1348898 - DNA, 22 bp, Artificial Sequence
  chemically synthesized
taatctgtgaatttctgtagta

SEQ ID NO: 1348899 - DNA, 22 bp, Artificial Sequence
  chemically synthesized
atctgtgaatttctgtagtagg

SEQ ID NO: 1348900 - DNA, 22 bp, Artificial Sequence
  chemically synthesized
tgaatttctgtagtaggtatga

SEQ ID NO: 1348901 - DNA, 22 bp, Artificial Sequence
  chemically synthesized
ctgtagtaggtatgaggtctag

SEQ ID NO: 1348902 - DNA, 22 bp, Artificial Sequence
  chemically synthesized
tgtagtaggtatgaggtctagg

SEQ ID NO: 1348903 - DNA, 22 bp, Artificial Sequence
  chemically synthesized
tagtaggtatgaggtctaggtc

SEQ ID NO: 1348904 - DNA, 22 bp, Artificial Sequence
  chemically synthesized
ggtctatgtacattttgtttgt

SEQ ID NO: 1348905 - DNA, 22 bp, Artificial Sequence
  chemically synthesized
tgtacattttgtttgtccgtgg

SEQ ID NO: 1348906 - DNA, 22 bp, Artificial Sequence
  chemically synthesized
gatcaatgggacatccacggac

SEQ ID NO: 1348907 - DNA, 22 bp, Artificial Sequence
  chemically synthesized
tgtttgtccgtggatgtcccat

SEQ ID NO: 1348908 - DNA, 22 bp, Artificial Sequence
  chemically synthesized
gtttgtccgtggatgtcccatt

SEQ ID NO: 1348909 - DNA, 22 bp, Artificial Sequence
  chemically synthesized
tttgtccgtggatgtcccattg

SEQ ID NO: 1348910 - DNA, 22 bp, Artificial Sequence
  chemically synthesized
gtccgtggatgtcccattgatc

SEQ ID NO: 1348911 - DNA, 22 bp, Artificial Sequence
  chemically synthesized
tccgtggatgtcccattgatcc

SEQ ID NO: 1348912 - DNA, 22 bp, Artificial Sequence
  chemically synthesized
aacaaatggtgctggatcaatg

SEQ ID NO: 1348913 - DNA, 22 bp, Artificial Sequence
  chemically synthesized
caacaaatggtgctggatcaat

SEQ ID NO: 1348914 - DNA, 22 bp, Artificial Sequence
  chemically synthesized
tcaacaaatggtgctggatcaa

SEQ ID NO: 1348915 - DNA, 22 bp, Artificial Sequence
  chemically synthesized
atccagcaccatttgttgaaaa

SEQ ID NO: 1348916 - DNA, 22 bp, Artificial Sequence
  chemically synthesized
agtggaggaagagtagtgtttt

SEQ ID NO: 1348917 - DNA, 22 bp, Artificial Sequence
  chemically synthesized
gttgaaaacactactcttcctc

SEQ ID NO: 1348918 - DNA, 22 bp, Artificial Sequence
  chemically synthesized
ttgaaaacactactcttcctcc

SEQ ID NO: 1348919 - DNA, 22 bp, Artificial Sequence
  chemically synthesized
aaaataaattcagtggaggaag

SEQ ID NO: 1348920 - DNA, 22 bp, Artificial Sequence
  chemically synthesized
aaaacactactcttcctccact

SEQ ID NO: 1348921 - DNA, 22 bp, Artificial Sequence
  chemically synthesized
caaaataaattcagtggaggaa

SEQ ID NO: 1348922 - DNA, 22 bp, Artificial Sequence
  chemically synthesized
ctcttcctccactgaatttatt

SEQ ID NO: 1348923 - DNA, 22 bp, Artificial Sequence
  chemically synthesized
acaaagtttcaaaataaattca

SEQ ID NO: 1348924 - DNA, 22 bp, Artificial Sequence
  chemically synthesized
gacaaagtttcaaaataaattc

SEQ ID NO: 1348925 - DNA, 22 bp, Artificial Sequence
  chemically synthesized
tgacaaagtttcaaaataaatt

SEQ ID NO: 1348926 - DNA, 22 bp, Artificial Sequence
  chemically synthesized
ttcctccactgaatttattttg

SEQ ID NO: 1348927 - DNA, 22 bp, Artificial Sequence
  chemically synthesized
ttgacaaagtttcaaaataaat

SEQ ID NO: 1348928 - DNA, 22 bp, Artificial Sequence
  chemically synthesized
cctccactgaatttattttgaa

SEQ ID NO: 1348929 - DNA, 22 bp, Artificial Sequence
  chemically synthesized
ctccactgaatttattttgaaa

SEQ ID NO: 1348930 - DNA, 22 bp, Artificial Sequence
  chemically synthesized
cactgaatttattttgaaactt

SEQ ID NO: 1348931 - DNA, 22 bp, Artificial Sequence
  chemically synthesized
aatttattttgaaactttgtca

SEQ ID NO: 1348932 - DNA, 22 bp, Artificial Sequence
  chemically synthesized
attttgaaactttgtcaaaaat

SEQ ID NO: 1348933 - DNA, 22 bp, Artificial Sequence
  chemically synthesized
ttttgaaactttgtcaaaaata

SEQ ID NO: 1348934 - DNA, 22 bp, Artificial Sequence
  chemically synthesized
tgaaactttgtcaaaaatatgt

SEQ ID NO: 1348935 - DNA, 22 bp, Artificial Sequence
  chemically synthesized
gaaactttgtcaaaaatatgtt

SEQ ID NO: 1348936 - DNA, 22 bp, Artificial Sequence
  chemically synthesized
aaactttgtcaaaaatatgttg

SEQ ID NO: 1348937 - DNA, 22 bp, Artificial Sequence
  chemically synthesized
tgtcaaaaatatgttgggcata

SEQ ID NO: 1348938 - DNA, 22 bp, Artificial Sequence
  chemically synthesized
gtcaaaaatatgttgggcatat

SEQ ID NO: 1348939 - DNA, 22 bp, Artificial Sequence
  chemically synthesized
tcaaaaatatgttgggcatatt

SEQ ID NO: 1348940 - DNA, 22 bp, Artificial Sequence
  chemically synthesized
gaaacatacccacacaaatatg

SEQ ID NO: 1348941 - DNA, 22 bp, Artificial Sequence
  chemically synthesized
ggcatatttgtgtgggtatgtt

SEQ ID NO: 1348942 - DNA, 22 bp, Artificial Sequence
  chemically synthesized
aacagaataaagagtctagaaa

SEQ ID NO: 1348943 - DNA, 22 bp, Artificial Sequence
  chemically synthesized
gtgtgggtatgtttctagactc

SEQ ID NO: 1348944 - DNA, 22 bp, Artificial Sequence
  chemically synthesized
tgtgggtatgtttctagactct

SEQ ID NO: 1348945 - DNA, 22 bp, Artificial Sequence
  chemically synthesized
ctagactctttattctgttcaa

SEQ ID NO: 1348946 - DNA, 22 bp, Artificial Sequence
  chemically synthesized
tagactctttattctgttcaat

SEQ ID NO: 1348947 - DNA, 22 bp, Artificial Sequence
  chemically synthesized
acacatagatcaattgaacaga

SEQ ID NO: 1348948 - DNA, 22 bp, Artificial Sequence
  chemically synthesized
gactctttattctgttcaattg

SEQ ID NO: 1348949 - DNA, 22 bp, Artificial Sequence
  chemically synthesized
tttattctgttcaattgatcta

SEQ ID NO: 1348950 - DNA, 22 bp, Artificial Sequence
  chemically synthesized
tattctgttcaattgatctatg

SEQ ID NO: 1348951 - DNA, 22 bp, Artificial Sequence
  chemically synthesized
attctgttcaattgatctatgt

SEQ ID NO: 1348952 - DNA, 22 bp, Artificial Sequence
  chemically synthesized
ttctgttcaattgatctatgtg

SEQ ID NO: 1348953 - DNA, 22 bp, Artificial Sequence
  chemically synthesized
tcagaaggattgacacatagat

SEQ ID NO: 1348954 - DNA, 22 bp, Artificial Sequence
  chemically synthesized
tgttcaattgatctatgtgtca

SEQ ID NO: 1348955 - DNA, 22 bp, Artificial Sequence
  chemically synthesized
ttcaattgatctatgtgtcaat

SEQ ID NO: 1348956 - DNA, 22 bp, Artificial Sequence
  chemically synthesized
tattgtcagaaggattgacaca

SEQ ID NO: 1348957 - DNA, 22 bp, Artificial Sequence
  chemically synthesized
aattgatctatgtgtcaatcct

SEQ ID NO: 1348958 - DNA, 22 bp, Artificial Sequence
  chemically synthesized
tgttatattgtcagaaggattg

SEQ ID NO: 1348959 - DNA, 22 bp, Artificial Sequence
  chemically synthesized
atctatgtgtcaatccttctga

SEQ ID NO: 1348960 - DNA, 22 bp, Artificial Sequence
  chemically synthesized
tgtgtcaatccttctgacaata

SEQ ID NO: 1348961 - DNA, 22 bp, Artificial Sequence
  chemically synthesized
ctgacaatataacacaatattt

SEQ ID NO: 1348962 - DNA, 22 bp, Artificial Sequence
  chemically synthesized
tgacaatataacacaatatttg

SEQ ID NO: 1348963 - DNA, 22 bp, Artificial Sequence
  chemically synthesized
acaatataacacaatatttgtt

SEQ ID NO: 1348964 - DNA, 22 bp, Artificial Sequence
  chemically synthesized
ccacataaccacagcaacaaat

SEQ ID NO: 1348965 - DNA, 22 bp, Artificial Sequence
  chemically synthesized
accacataaccacagcaacaaa

SEQ ID NO: 1348966 - DNA, 22 bp, Artificial Sequence
  chemically synthesized
aaacttaccacataaccacagc

SEQ ID NO: 1348967 - DNA, 22 bp, Artificial Sequence
  chemically synthesized
aaaacttaccacataaccacag

SEQ ID NO: 1348968 - DNA, 22 bp, Artificial Sequence
  chemically synthesized
taaaacttaccacataaccaca

SEQ ID NO: 1348969 - DNA, 22 bp, Artificial Sequence
  chemically synthesized
attttaaaacttaccacataac

SEQ ID NO: 1348970 - DNA, 22 bp, Artificial Sequence
  chemically synthesized
gttgctgtggttatgtggtaag

SEQ ID NO: 1348971 - DNA, 22 bp, Artificial Sequence
  chemically synthesized
ttgctgtggttatgtggtaagt

SEQ ID NO: 1348972 - DNA, 22 bp, Artificial Sequence
  chemically synthesized
ctgtggttatgtggtaagtttt

SEQ ID NO: 1348973 - DNA, 22 bp, Artificial Sequence
  chemically synthesized
tggttatgtggtaagttttaaa

SEQ ID NO: 1348974 - DNA, 22 bp, Artificial Sequence
  chemically synthesized
tacaataagatctgattttaaa

SEQ ID NO: 1348975 - DNA, 22 bp, Artificial Sequence
  chemically synthesized
atacaataagatctgattttaa

SEQ ID NO: 1348976 - DNA, 22 bp, Artificial Sequence
  chemically synthesized
tgtggtaagttttaaaatcaga

SEQ ID NO: 1348977 - DNA, 22 bp, Artificial Sequence
  chemically synthesized
agcttatacaataagatctgat

SEQ ID NO: 1348978 - DNA, 22 bp, Artificial Sequence
  chemically synthesized
ttaagcttatacaataagatct

SEQ ID NO: 1348979 - DNA, 22 bp, Artificial Sequence
  chemically synthesized
taaaatcagatcttattgtata

SEQ ID NO: 1348980 - DNA, 22 bp, Artificial Sequence
  chemically synthesized
aaaatcagatcttattgtataa

SEQ ID NO: 1348981 - DNA, 22 bp, Artificial Sequence
  chemically synthesized
aaatcagatcttattgtataag

SEQ ID NO: 1348982 - DNA, 22 bp, Artificial Sequence
  chemically synthesized
tatgttgttaagcttatacaat

SEQ ID NO: 1348983 - DNA, 22 bp, Artificial Sequence
  chemically synthesized
agtaacattatatgttgttaag

SEQ ID NO: 1348984 - DNA, 22 bp, Artificial Sequence
  chemically synthesized
cagtaacattatatgttgttaa

SEQ ID NO: 1348985 - DNA, 22 bp, Artificial Sequence
  chemically synthesized
attgtataagcttaacaacata

SEQ ID NO: 1348986 - DNA, 22 bp, Artificial Sequence
  chemically synthesized
ttgtataagcttaacaacatat

SEQ ID NO: 1348987 - DNA, 22 bp, Artificial Sequence
  chemically synthesized
tataagcttaacaacatataat

SEQ ID NO: 1348988 - DNA, 22 bp, Artificial Sequence
  chemically synthesized
tcatttcagtaacattatatgt

SEQ ID NO: 1348989 - DNA, 22 bp, Artificial Sequence
  chemically synthesized
aacaacatataatgttactgaa

SEQ ID NO: 1348990 - DNA, 22 bp, Artificial Sequence
  chemically synthesized
acaacatataatgttactgaaa

SEQ ID NO: 1348991 - DNA, 22 bp, Artificial Sequence
  chemically synthesized
cggaagttatcatttcagtaac

SEQ ID NO: 1348992 - DNA, 22 bp, Artificial Sequence
  chemically synthesized
cccaaattgcggaagttatcat

SEQ ID NO: 1348993 - DNA, 22 bp, Artificial Sequence
  chemically synthesized
ccccaaattgcggaagttatca

SEQ ID NO: 1348994 - DNA, 22 bp, Artificial Sequence
  chemically synthesized
tccccaaattgcggaagttatc

SEQ ID NO: 1348995 - DNA, 22 bp, Artificial Sequence
  chemically synthesized
ttccccaaattgcggaagttat

SEQ ID NO: 1348996 - DNA, 22 bp, Artificial Sequence
  chemically synthesized
tttccccaaattgcggaagtta

SEQ ID NO: 1348997 - DNA, 22 bp, Artificial Sequence
  chemically synthesized
ctgaaatgataacttccgcaat

SEQ ID NO: 1348998 - DNA, 22 bp, Artificial Sequence
  chemically synthesized
ttttttccccaaattgcggaag

SEQ ID NO: 1348999 - DNA, 22 bp, Artificial Sequence
  chemically synthesized
aaatgataacttccgcaatttg

SEQ ID NO: 1349000 - DNA, 22 bp, Artificial Sequence
  chemically synthesized
gtctgttttttccccaaattgc

SEQ ID NO: 1349001 - DNA, 22 bp, Artificial Sequence
  chemically synthesized
ccgcaatttggggaaaaaacag

SEQ ID NO: 1349002 - DNA, 22 bp, Artificial Sequence
  chemically synthesized
aatccatctggtctgttttttc

SEQ ID NO: 1349003 - DNA, 22 bp, Artificial Sequence
  chemically synthesized
cgcaatttggggaaaaaacaga

SEQ ID NO: 1349004 - DNA, 22 bp, Artificial Sequence
  chemically synthesized
ggggaaaaaacagaccagatgg

SEQ ID NO: 1349005 - DNA, 22 bp, Artificial Sequence
  chemically synthesized
gggaaaaaacagaccagatgga

SEQ ID NO: 1349006 - DNA, 22 bp, Artificial Sequence
  chemically synthesized
aaggagtgttcaatccatctgg

SEQ ID NO: 1349007 - DNA, 22 bp, Artificial Sequence
  chemically synthesized
aaaggagtgttcaatccatctg

SEQ ID NO: 1349008 - DNA, 22 bp, Artificial Sequence
  chemically synthesized
agagagagagagagagtttaaa

SEQ ID NO: 1349009 - DNA, 22 bp, Artificial Sequence
  chemically synthesized
aacactcctttaaactctctct

SEQ ID NO: 1349010 - DNA, 22 bp, Artificial Sequence
  chemically synthesized
gacagctgagagagagagagag

SEQ ID NO: 1349011 - DNA, 22 bp, Artificial Sequence
  chemically synthesized
agacagctgagagagagagaga

SEQ ID NO: 1349012 - DNA, 22 bp, Artificial Sequence
  chemically synthesized
ctttaaactctctctctctctc

SEQ ID NO: 1349013 - DNA, 22 bp, Artificial Sequence
  chemically synthesized
taaactctctctctctctctca

SEQ ID NO: 1349014 - DNA, 22 bp, Artificial Sequence
  chemically synthesized
aaactctctctctctctctcag

SEQ ID NO: 1349015 - DNA, 22 bp, Artificial Sequence
  chemically synthesized
aactctctctctctctctcagc

SEQ ID NO: 1349016 - DNA, 22 bp, Artificial Sequence
  chemically synthesized
aggcatttagacagctgagaga

SEQ ID NO: 1349017 - DNA, 22 bp, Artificial Sequence
  chemically synthesized
gaggcatttagacagctgagag

SEQ ID NO: 1349018 - DNA, 22 bp, Artificial Sequence
  chemically synthesized
tgaggcatttagacagctgaga

SEQ ID NO: 1349019 - DNA, 22 bp, Artificial Sequence
  chemically synthesized
tctctctctctctcagctgtct

SEQ ID NO: 1349020 - DNA, 22 bp, Artificial Sequence
  chemically synthesized
tctctctctctcagctgtctaa

SEQ ID NO: 1349021 - DNA, 22 bp, Artificial Sequence
  chemically synthesized
cattttgaggcatttagacagc

SEQ ID NO: 1349022 - DNA, 22 bp, Artificial Sequence
  chemically synthesized
tctctctctcagctgtctaaat

SEQ ID NO: 1349023 - DNA, 22 bp, Artificial Sequence
  chemically synthesized
ccattttgaggcatttagacag

SEQ ID NO: 1349024 - DNA, 22 bp, Artificial Sequence
  chemically synthesized
tctctctcagctgtctaaatgc

SEQ ID NO: 1349025 - DNA, 22 bp, Artificial Sequence
  chemically synthesized
tctctcagctgtctaaatgcct

SEQ ID NO: 1349026 - DNA, 22 bp, Artificial Sequence
  chemically synthesized
aatttccattttgaggcattta

SEQ ID NO: 1349027 - DNA, 22 bp, Artificial Sequence
  chemically synthesized
tctcagctgtctaaatgcctca

SEQ ID NO: 1349028 - DNA, 22 bp, Artificial Sequence
  chemically synthesized
tcagctgtctaaatgcctcaaa

SEQ ID NO: 1349029 - DNA, 22 bp, Artificial Sequence
  chemically synthesized
ttgaatttccattttgaggcat

SEQ ID NO: 1349030 - DNA, 22 bp, Artificial Sequence
  chemically synthesized
agctgtctaaatgcctcaaaat

SEQ ID NO: 1349031 - DNA, 22 bp, Artificial Sequence
  chemically synthesized
atctgttgaatttccattttga

SEQ ID NO: 1349032 - DNA, 22 bp, Artificial Sequence
  chemically synthesized
tctaaatgcctcaaaatggaaa

SEQ ID NO: 1349033 - DNA, 22 bp, Artificial Sequence
  chemically synthesized
tcatctgttgaatttccatttt

SEQ ID NO: 1349034 - DNA, 22 bp, Artificial Sequence
  chemically synthesized
aatgcctcaaaatggaaattca

SEQ ID NO: 1349035 - DNA, 22 bp, Artificial Sequence
  chemically synthesized
aaaatggaaattcaacagatga

SEQ ID NO: 1349036 - DNA, 22 bp, Artificial Sequence
  chemically synthesized
aataagaagctctcatctgttg

SEQ ID NO: 1349037 - DNA, 22 bp, Artificial Sequence
  chemically synthesized
tcaataagaagctctcatctgt

SEQ ID NO: 1349038 - DNA, 22 bp, Artificial Sequence
  chemically synthesized
ctcaataagaagctctcatctg

SEQ ID NO: 1349039 - DNA, 22 bp, Artificial Sequence
  chemically synthesized
tctcaataagaagctctcatct

SEQ ID NO: 1349040 - DNA, 22 bp, Artificial Sequence
  chemically synthesized
ccctttctcaataagaagctct

SEQ ID NO: 1349041 - DNA, 22 bp, Artificial Sequence
  chemically synthesized
cccctttctcaataagaagctc

SEQ ID NO: 1349042 - DNA, 22 bp, Artificial Sequence
  chemically synthesized
aacagatgagagcttcttattg

SEQ ID NO: 1349043 - DNA, 22 bp, Artificial Sequence
  chemically synthesized
cttcccctttctcaataagaag

SEQ ID NO: 1349044 - DNA, 22 bp, Artificial Sequence
  chemically synthesized
ctacttcccctttctcaataag

SEQ ID NO: 1349045 - DNA, 22 bp, Artificial Sequence
  chemically synthesized
ccctactacttcccctttctca

SEQ ID NO: 1349046 - DNA, 22 bp, Artificial Sequence
  chemically synthesized
cttattgagaaaggggaagtag

SEQ ID NO: 1349047 - DNA, 22 bp, Artificial Sequence
  chemically synthesized
ttattgagaaaggggaagtagt

SEQ ID NO: 1349048 - DNA, 22 bp, Artificial Sequence
  chemically synthesized
attgagaaaggggaagtagtag

SEQ ID NO: 1349049 - DNA, 22 bp, Artificial Sequence
  chemically synthesized
ttgagaaaggggaagtagtagg

SEQ ID NO: 1349050 - DNA, 22 bp, Artificial Sequence
  chemically synthesized
agaaaggggaagtagtagggga

SEQ ID NO: 1349051 - DNA, 22 bp, Artificial Sequence
  chemically synthesized
aaaccagagaggtggtcaaaat

SEQ ID NO: 1349052 - DNA, 22 bp, Artificial Sequence
  chemically synthesized
caaaccagagaggtggtcaaaa

SEQ ID NO: 1349053 - DNA, 22 bp, Artificial Sequence
  chemically synthesized
ttttgaccacctctctggtttg

SEQ ID NO: 1349054 - DNA, 22 bp, Artificial Sequence
  chemically synthesized
tgaccacctctctggtttgaaa

SEQ ID NO: 1349055 - DNA, 22 bp, Artificial Sequence
  chemically synthesized
aacccccagaggtttcaaacca

SEQ ID NO: 1349056 - DNA, 22 bp, Artificial Sequence
  chemically synthesized
gaccacctctctggtttgaaac

SEQ ID NO: 1349057 - DNA, 22 bp, Artificial Sequence
  chemically synthesized
aaacccccagaggtttcaaacc

SEQ ID NO: 1349058 - DNA, 22 bp, Artificial Sequence
  chemically synthesized
accacctctctggtttgaaacc

SEQ ID NO: 1349059 - DNA, 22 bp, Artificial Sequence
  chemically synthesized
ttaaacccccagaggtttcaaa

SEQ ID NO: 1349060 - DNA, 22 bp, Artificial Sequence
  chemically synthesized
tcttaaacccccagaggtttca

SEQ ID NO: 1349061 - DNA, 22 bp, Artificial Sequence
  chemically synthesized
ctcttaaacccccagaggtttc

SEQ ID NO: 1349062 - DNA, 22 bp, Artificial Sequence
  chemically synthesized
tctcttaaacccccagaggttt

SEQ ID NO: 1349063 - DNA, 22 bp, Artificial Sequence
  chemically synthesized
ttctcttaaacccccagaggtt

SEQ ID NO: 1349064 - DNA, 22 bp, Artificial Sequence
  chemically synthesized
tctggtttgaaacctctggggg

SEQ ID NO: 1349065 - DNA, 22 bp, Artificial Sequence
  chemically synthesized
cttttctcttaaacccccagag

SEQ ID NO: 1349066 - DNA, 22 bp, Artificial Sequence
  chemically synthesized
tggtttgaaacctctgggggtt

SEQ ID NO: 1349067 - DNA, 22 bp, Artificial Sequence
  chemically synthesized
gtttgaaacctctgggggttta

SEQ ID NO: 1349068 - DNA, 22 bp, Artificial Sequence
  chemically synthesized
aatctccttttctcttaaaccc

SEQ ID NO: 1349069 - DNA, 22 bp, Artificial Sequence
  chemically synthesized
gaaacctctgggggtttaagag

SEQ ID NO: 1349070 - DNA, 22 bp, Artificial Sequence
  chemically synthesized
gaatctccttttctcttaaacc

SEQ ID NO: 1349071 - DNA, 22 bp, Artificial Sequence
  chemically synthesized
aaacctctgggggtttaagaga

SEQ ID NO: 1349072 - DNA, 22 bp, Artificial Sequence
  chemically synthesized
tgggggtttaagagaaaaggag

SEQ ID NO: 1349073 - DNA, 22 bp, Artificial Sequence
  chemically synthesized
ggggtttaagagaaaaggagat

SEQ ID NO: 1349074 - DNA, 22 bp, Artificial Sequence
  chemically synthesized
agccatatcttgaatctccttt

SEQ ID NO: 1349075 - DNA, 22 bp, Artificial Sequence
  chemically synthesized
aagagaaaaggagattcaagat

SEQ ID NO: 1349076 - DNA, 22 bp, Artificial Sequence
  chemically synthesized
aaactaagccatatcttgaatc

SEQ ID NO: 1349077 - DNA, 22 bp, Artificial Sequence
  chemically synthesized
agagaaaaggagattcaagata

SEQ ID NO: 1349078 - DNA, 22 bp, Artificial Sequence
  chemically synthesized
acattaaaactaagccatatct

SEQ ID NO: 1349079 - DNA, 22 bp, Artificial Sequence
  chemically synthesized
tagcattaacattaaaactaag

SEQ ID NO: 1349080 - DNA, 22 bp, Artificial Sequence
  chemically synthesized
aagatatggcttagttttaatg

SEQ ID NO: 1349081 - DNA, 22 bp, Artificial Sequence
  chemically synthesized
ctgtagcattaacattaaaact

SEQ ID NO: 1349082 - DNA, 22 bp, Artificial Sequence
  chemically synthesized
tactactgtagcattaacatta

SEQ ID NO: 1349083 - DNA, 22 bp, Artificial Sequence
  chemically synthesized
agttttaatgttaatgctacag

SEQ ID NO: 1349084 - DNA, 22 bp, Artificial Sequence
  chemically synthesized
gttttaatgttaatgctacagt

SEQ ID NO: 1349085 - DNA, 22 bp, Artificial Sequence
  chemically synthesized
taatgttaatgctacagtagta

SEQ ID NO: 1349086 - DNA, 22 bp, Artificial Sequence
  chemically synthesized
aatgttaatgctacagtagtac

SEQ ID NO: 1349087 - DNA, 22 bp, Artificial Sequence
  chemically synthesized
atgttaatgctacagtagtaca

SEQ ID NO: 1349088 - DNA, 22 bp, Artificial Sequence
  chemically synthesized
atgctacagtagtacagctggg

SEQ ID NO: 1349089 - DNA, 22 bp, Artificial Sequence
  chemically synthesized
cagtagtacagctgggacttgt

SEQ ID NO: 1349090 - DNA, 22 bp, Artificial Sequence
  chemically synthesized
agtaaatgtaggacaagtccca

SEQ ID NO: 1349091 - DNA, 22 bp, Artificial Sequence
  chemically synthesized
tcagtaaatgtaggacaagtcc

SEQ ID NO: 1349092 - DNA, 22 bp, Artificial Sequence
  chemically synthesized
gagttctcagtaaatgtaggac

SEQ ID NO: 1349093 - DNA, 22 bp, Artificial Sequence
  chemically synthesized
ggacttgtcctacatttactga

SEQ ID NO: 1349094 - DNA, 22 bp, Artificial Sequence
  chemically synthesized
gtaaattagagttctcagtaaa

SEQ ID NO: 1349095 - DNA, 22 bp, Artificial Sequence
  chemically synthesized
cgtaaattagagttctcagtaa

SEQ ID NO: 1349096 - DNA, 22 bp, Artificial Sequence
  chemically synthesized
tcgtaaattagagttctcagta

SEQ ID NO: 1349097 - DNA, 22 bp, Artificial Sequence
  chemically synthesized
gtcctacatttactgagaactc

SEQ ID NO: 1349098 - DNA, 22 bp, Artificial Sequence
  chemically synthesized
tcctacatttactgagaactct

SEQ ID NO: 1349099 - DNA, 22 bp, Artificial Sequence
  chemically synthesized
gttttcgtaaattagagttctc

SEQ ID NO: 1349100 - DNA, 22 bp, Artificial Sequence
  chemically synthesized
catttactgagaactctaattt

SEQ ID NO: 1349101 - DNA, 22 bp, Artificial Sequence
  chemically synthesized
ggatctagttttcgtaaattag

SEQ ID NO: 1349102 - DNA, 22 bp, Artificial Sequence
  chemically synthesized
actgagaactctaatttacgaa

SEQ ID NO: 1349103 - DNA, 22 bp, Artificial Sequence
  chemically synthesized
ctgagaactctaatttacgaaa

SEQ ID NO: 1349104 - DNA, 22 bp, Artificial Sequence
  chemically synthesized
agaactctaatttacgaaaact

SEQ ID NO: 1349105 - DNA, 22 bp, Artificial Sequence
  chemically synthesized
agaatgctaggatctagttttc

SEQ ID NO: 1349106 - DNA, 22 bp, Artificial Sequence
  chemically synthesized
cagaatgctaggatctagtttt

SEQ ID NO: 1349107 - DNA, 22 bp, Artificial Sequence
  chemically synthesized
tcagaatgctaggatctagttt

SEQ ID NO: 1349108 - DNA, 22 bp, Artificial Sequence
  chemically synthesized
taatttacgaaaactagatcct

SEQ ID NO: 1349109 - DNA, 22 bp, Artificial Sequence
  chemically synthesized
ctttcagaatgctaggatctag

SEQ ID NO: 1349110 - DNA, 22 bp, Artificial Sequence
  chemically synthesized
atttacgaaaactagatcctag

SEQ ID NO: 1349111 - DNA, 22 bp, Artificial Sequence
  chemically synthesized
acgaaaactagatcctagcatt

SEQ ID NO: 1349112 - DNA, 22 bp, Artificial Sequence
  chemically synthesized
cgaaaactagatcctagcattc

SEQ ID NO: 1349113 - DNA, 22 bp, Artificial Sequence
  chemically synthesized
aaatctgctttcagaatgctag

SEQ ID NO: 1349114 - DNA, 22 bp, Artificial Sequence
  chemically synthesized
gatcctagcattctgaaagcag

SEQ ID NO: 1349115 - DNA, 22 bp, Artificial Sequence
  chemically synthesized
gaggtctcaaatctgctttcag

SEQ ID NO: 1349116 - DNA, 22 bp, Artificial Sequence
  chemically synthesized
agaggtctcaaatctgctttca

SEQ ID NO: 1349117 - DNA, 22 bp, Artificial Sequence
  chemically synthesized
tagaggtctcaaatctgctttc

SEQ ID NO: 1349118 - DNA, 22 bp, Artificial Sequence
  chemically synthesized
gcattctgaaagcagatttgag

SEQ ID NO: 1349119 - DNA, 22 bp, Artificial Sequence
  chemically synthesized
tgaaagcagatttgagacctct

SEQ ID NO: 1349120 - DNA, 22 bp, Artificial Sequence
  chemically synthesized
aaagcagatttgagacctctaa

SEQ ID NO: 1349121 - DNA, 22 bp, Artificial Sequence
  chemically synthesized
taaaagaaatagctttagaggt

SEQ ID NO: 1349122 - DNA, 22 bp, Artificial Sequence
  chemically synthesized
gagacctctaaagctatttctt

SEQ ID NO: 1349123 - DNA, 22 bp, Artificial Sequence
  chemically synthesized
agacctctaaagctatttcttt

SEQ ID NO: 1349124 - DNA, 22 bp, Artificial Sequence
  chemically synthesized
taaagctatttcttttacagtt

SEQ ID NO: 1349125 - DNA, 22 bp, Artificial Sequence
  chemically synthesized
aagctatttcttttacagtttt

SEQ ID NO: 1349126 - DNA, 22 bp, Artificial Sequence
  chemically synthesized
caaccaaaggtggaaaaaactg

SEQ ID NO: 1349127 - DNA, 22 bp, Artificial Sequence
  chemically synthesized
tttcttttacagttttttccac

SEQ ID NO: 1349128 - DNA, 22 bp, Artificial Sequence
  chemically synthesized
cttttacagttttttccacctt

SEQ ID NO: 1349129 - DNA, 22 bp, Artificial Sequence
  chemically synthesized
ttttacagttttttccaccttt

SEQ ID NO: 1349130 - DNA, 22 bp, Artificial Sequence
  chemically synthesized
ttacagttttttccacctttgg

SEQ ID NO: 1349131 - DNA, 22 bp, Artificial Sequence
  chemically synthesized
tacagttttttccacctttggt

SEQ ID NO: 1349132 - DNA, 22 bp, Artificial Sequence
  chemically synthesized
acagttttttccacctttggtt

SEQ ID NO: 1349133 - DNA, 22 bp, Artificial Sequence
  chemically synthesized
cagttttttccacctttggttg

SEQ ID NO: 1349134 - DNA, 22 bp, Artificial Sequence
  chemically synthesized
tttccacctttggttgcagtct

SEQ ID NO: 1349135 - DNA, 22 bp, Artificial Sequence
  chemically synthesized
ttccacctttggttgcagtcta

SEQ ID NO: 1349136 - DNA, 22 bp, Artificial Sequence
  chemically synthesized
tccacctttggttgcagtctat

SEQ ID NO: 1349137 - DNA, 22 bp, Artificial Sequence
  chemically synthesized
ccacctttggttgcagtctatt

SEQ ID NO: 1349138 - DNA, 22 bp, Artificial Sequence
  chemically synthesized
cacctttggttgcagtctattg

SEQ ID NO: 1349139 - DNA, 22 bp, Artificial Sequence
  chemically synthesized
tggttgcagtctattgtattgt

SEQ ID NO: 1349140 - DNA, 22 bp, Artificial Sequence
  chemically synthesized
ggttgcagtctattgtattgtc

SEQ ID NO: 1349141 - DNA, 22 bp, Artificial Sequence
  chemically synthesized
gttgcagtctattgtattgtcc

SEQ ID NO: 1349142 - DNA, 22 bp, Artificial Sequence
  chemically synthesized
cagtctattgtattgtcctgat

SEQ ID NO: 1349143 - DNA, 22 bp, Artificial Sequence
  chemically synthesized
ttgtattgtcctgattcttttt

SEQ ID NO: 1349144 - DNA, 22 bp, Artificial Sequence
  chemically synthesized
cgagtaggtgaaaaaaagaatc

SEQ ID NO: 1349145 - DNA, 22 bp, Artificial Sequence
  chemically synthesized
tattgtcctgattctttttttc

SEQ ID NO: 1349146 - DNA, 22 bp, Artificial Sequence
  chemically synthesized
tcctgattctttttttcaccta

SEQ ID NO: 1349147 - DNA, 22 bp, Artificial Sequence
  chemically synthesized
agaataacctacgagtaggtga

SEQ ID NO: 1349148 - DNA, 22 bp, Artificial Sequence
  chemically synthesized
attctttttttcacctactcgt

SEQ ID NO: 1349149 - DNA, 22 bp, Artificial Sequence
  chemically synthesized
tttttttcacctactcgtaggt

SEQ ID NO: 1349150 - DNA, 22 bp, Artificial Sequence
  chemically synthesized
tttttcacctactcgtaggtta

SEQ ID NO: 1349151 - DNA, 22 bp, Artificial Sequence
  chemically synthesized
ttttcacctactcgtaggttat

SEQ ID NO: 1349152 - DNA, 22 bp, Artificial Sequence
  chemically synthesized
aagtgattaagaataacctacg

SEQ ID NO: 1349153 - DNA, 22 bp, Artificial Sequence
  chemically synthesized
tttcacctactcgtaggttatt

SEQ ID NO: 1349154 - DNA, 22 bp, Artificial Sequence
  chemically synthesized
caagtgattaagaataacctac

SEQ ID NO: 1349155 - DNA, 22 bp, Artificial Sequence
  chemically synthesized
ttcacctactcgtaggttattc

SEQ ID NO: 1349156 - DNA, 22 bp, Artificial Sequence
  chemically synthesized
tcacctactcgtaggttattct

SEQ ID NO: 1349157 - DNA, 22 bp, Artificial Sequence
  chemically synthesized
cacctactcgtaggttattctt

SEQ ID NO: 1349158 - DNA, 22 bp, Artificial Sequence
  chemically synthesized
acctactcgtaggttattctta

SEQ ID NO: 1349159 - DNA, 22 bp, Artificial Sequence
  chemically synthesized
gtttcaagtgattaagaataac

SEQ ID NO: 1349160 - DNA, 22 bp, Artificial Sequence
  chemically synthesized
ctcgtaggttattcttaatcac

SEQ ID NO: 1349161 - DNA, 22 bp, Artificial Sequence
  chemically synthesized
gtaggttattcttaatcacttg

SEQ ID NO: 1349162 - DNA, 22 bp, Artificial Sequence
  chemically synthesized
ttcttaatcacttgaaaccaac

SEQ ID NO: 1349163 - DNA, 22 bp, Artificial Sequence
  chemically synthesized
ttaatcacttgaaaccaaccac

SEQ ID NO: 1349164 - DNA, 22 bp, Artificial Sequence
  chemically synthesized
aatcacttgaaaccaaccactt

SEQ ID NO: 1349165 - DNA, 22 bp, Artificial Sequence
  chemically synthesized
atcacttgaaaccaaccacttc

SEQ ID NO: 1349166 - DNA, 22 bp, Artificial Sequence
  chemically synthesized
gaaaccaaccacttctatgtat

SEQ ID NO: 1349167 - DNA, 22 bp, Artificial Sequence
  chemically synthesized
aaaccaaccacttctatgtata

SEQ ID NO: 1349168 - DNA, 22 bp, Artificial Sequence
  chemically synthesized
tgagggaaaggaagcaaaaatc

SEQ ID NO: 1349169 - DNA, 22 bp, Artificial Sequence
  chemically synthesized
ctatgtatatgatttttgcttc

SEQ ID NO: 1349170 - DNA, 22 bp, Artificial Sequence
  chemically synthesized
tatgtatatgatttttgcttcc

SEQ ID NO: 1349171 - DNA, 22 bp, Artificial Sequence
  chemically synthesized
tgtatatgatttttgcttcctt

SEQ ID NO: 1349172 - DNA, 22 bp, Artificial Sequence
  chemically synthesized
agggatctgtgagggaaaggaa

SEQ ID NO: 1349173 - DNA, 22 bp, Artificial Sequence
  chemically synthesized
ttgcttcctttccctcacagat

SEQ ID NO: 1349174 - DNA, 22 bp, Artificial Sequence
  chemically synthesized
tgcttcctttccctcacagatc

SEQ ID NO: 1349175 - DNA, 22 bp, Artificial Sequence
  chemically synthesized
gcttcctttccctcacagatcc

SEQ ID NO: 1349176 - DNA, 22 bp, Artificial Sequence
  chemically synthesized
cttcctttccctcacagatccc

SEQ ID NO: 1349177 - DNA, 22 bp, Artificial Sequence
  chemically synthesized
cctttccctcacagatccctca

SEQ ID NO: 1349178 - DNA, 22 bp, Artificial Sequence
  chemically synthesized
ctttccctcacagatccctcag

SEQ ID NO: 1349179 - DNA, 22 bp, Artificial Sequence
  chemically synthesized
tccctcacagatccctcaggta

SEQ ID NO: 1349180 - DNA, 22 bp, Artificial Sequence
  chemically synthesized
ccctcacagatccctcaggtac

SEQ ID NO: 1349181 - DNA, 22 bp, Artificial Sequence
  chemically synthesized
cctcacagatccctcaggtacc

SEQ ID NO: 1349182 - DNA, 22 bp, Artificial Sequence
  chemically synthesized
aaagtataagacagggtacctg

SEQ ID NO: 1349183 - DNA, 22 bp, Artificial Sequence
  chemically synthesized
acagatccctcaggtaccctgt

SEQ ID NO: 1349184 - DNA, 22 bp, Artificial Sequence
  chemically synthesized
ctaaaagtataagacagggtac

SEQ ID NO: 1349185 - DNA, 22 bp, Artificial Sequence
  chemically synthesized
actaaaagtataagacagggta

SEQ ID NO: 1349186 - DNA, 22 bp, Artificial Sequence
  chemically synthesized
catgacttactaaaagtataag

SEQ ID NO: 1349187 - DNA, 22 bp, Artificial Sequence
  chemically synthesized
aggtaccctgtcttatactttt

SEQ ID NO: 1349188 - DNA, 22 bp, Artificial Sequence
  chemically synthesized
gcatgacttactaaaagtataa

SEQ ID NO: 1349189 - DNA, 22 bp, Artificial Sequence
  chemically synthesized
tgcatgacttactaaaagtata

SEQ ID NO: 1349190 - DNA, 22 bp, Artificial Sequence
  chemically synthesized
ttttgcatgacttactaaaagt

SEQ ID NO: 1349191 - DNA, 22 bp, Artificial Sequence
  chemically synthesized
aattattttgcatgacttacta

SEQ ID NO: 1349192 - DNA, 22 bp, Artificial Sequence
  chemically synthesized
tcttatacttttagtaagtcat

SEQ ID NO: 1349193 - DNA, 22 bp, Artificial Sequence
  chemically synthesized
tcaattattttgcatgacttac

SEQ ID NO: 1349194 - DNA, 22 bp, Artificial Sequence
  chemically synthesized
ctcaattattttgcatgactta

SEQ ID NO: 1349195 - DNA, 22 bp, Artificial Sequence
  chemically synthesized
atacttttagtaagtcatgcaa

SEQ ID NO: 1349196 - DNA, 22 bp, Artificial Sequence
  chemically synthesized
tacttttagtaagtcatgcaaa

SEQ ID NO: 1349197 - DNA, 22 bp, Artificial Sequence
  chemically synthesized
atttctcaattattttgcatga

SEQ ID NO: 1349198 - DNA, 22 bp, Artificial Sequence
  chemically synthesized
ttagtaagtcatgcaaaataat

SEQ ID NO: 1349199 - DNA, 22 bp, Artificial Sequence
  chemically synthesized
tagtaagtcatgcaaaataatt

SEQ ID NO: 1349200 - DNA, 22 bp, Artificial Sequence
  chemically synthesized
agtaagtcatgcaaaataattg

SEQ ID NO: 1349201 - DNA, 22 bp, Artificial Sequence
  chemically synthesized
gtaagtcatgcaaaataattga

SEQ ID NO: 1349202 - DNA, 22 bp, Artificial Sequence
  chemically synthesized
catgactcatttctcaattatt

SEQ ID NO: 1349203 - DNA, 22 bp, Artificial Sequence
  chemically synthesized
agaaatgagtcatgcaatttat

SEQ ID NO: 1349204 - DNA, 22 bp, Artificial Sequence
  chemically synthesized
ataaaatgcagcaataaattgc

SEQ ID NO: 1349205 - DNA, 22 bp, Artificial Sequence
  chemically synthesized
aataaaatgcagcaataaattg

SEQ ID NO: 1349206 - DNA, 22 bp, Artificial Sequence
  chemically synthesized
atttaataaaatgcagcaataa

SEQ ID NO: 1349207 - DNA, 22 bp, Artificial Sequence
  chemically synthesized
taatttaataaaatgcagcaat

SEQ ID NO: 1349208 - DNA, 22 bp, Artificial Sequence
  chemically synthesized
accactctaatttaataaaatg

SEQ ID NO: 1349209 - DNA, 22 bp, Artificial Sequence
  chemically synthesized
attgctgcattttattaaatta

SEQ ID NO: 1349210 - DNA, 22 bp, Artificial Sequence
  chemically synthesized
ttgctgcattttattaaattag

SEQ ID NO: 1349211 - DNA, 22 bp, Artificial Sequence
  chemically synthesized
ctgcattttattaaattagagt

SEQ ID NO: 1349212 - DNA, 22 bp, Artificial Sequence
  chemically synthesized
cattttattaaattagagtggt

SEQ ID NO: 1349213 - DNA, 22 bp, Artificial Sequence
  chemically synthesized
tattaaattagagtggtcagat

SEQ ID NO: 1349214 - DNA, 22 bp, Artificial Sequence
  chemically synthesized
attaaattagagtggtcagata

SEQ ID NO: 1349215 - DNA, 22 bp, Artificial Sequence
  chemically synthesized
tcagtaaaagtatatctgacca

SEQ ID NO: 1349216 - DNA, 22 bp, Artificial Sequence
  chemically synthesized
ttaaattagagtggtcagatat

SEQ ID NO: 1349217 - DNA, 22 bp, Artificial Sequence
  chemically synthesized
tgtcagtaaaagtatatctgac

SEQ ID NO: 1349218 - DNA, 22 bp, Artificial Sequence
  chemically synthesized
aattagagtggtcagatatact

SEQ ID NO: 1349219 - DNA, 22 bp, Artificial Sequence
  chemically synthesized
gagtggtcagatatacttttac

SEQ ID NO: 1349220 - DNA, 22 bp, Artificial Sequence
  chemically synthesized
aagacagtaaaatccaaatctc

SEQ ID NO: 1349221 - DNA, 22 bp, Artificial Sequence
  chemically synthesized
caagacagtaaaatccaaatct

SEQ ID NO: 1349222 - DNA, 22 bp, Artificial Sequence
  chemically synthesized
ttactgacagagatttggattt

SEQ ID NO: 1349223 - DNA, 22 bp, Artificial Sequence
  chemically synthesized
tactgacagagatttggatttt

SEQ ID NO: 1349224 - DNA, 22 bp, Artificial Sequence
  chemically synthesized
tttcaagacagtaaaatccaaa

SEQ ID NO: 1349225 - DNA, 22 bp, Artificial Sequence
  chemically synthesized
actgacagagatttggatttta

SEQ ID NO: 1349226 - DNA, 22 bp, Artificial Sequence
  chemically synthesized
ctgacagagatttggattttac

SEQ ID NO: 1349227 - DNA, 22 bp, Artificial Sequence
  chemically synthesized
tgtttcaagacagtaaaatcca

SEQ ID NO: 1349228 - DNA, 22 bp, Artificial Sequence
  chemically synthesized
ctgtttcaagacagtaaaatcc

SEQ ID NO: 1349229 - DNA, 22 bp, Artificial Sequence
  chemically synthesized
acagagatttggattttactgt

SEQ ID NO: 1349230 - DNA, 22 bp, Artificial Sequence
  chemically synthesized
ttctgtttcaagacagtaaaat

SEQ ID NO: 1349231 - DNA, 22 bp, Artificial Sequence
  chemically synthesized
tcttctgtttcaagacagtaaa

SEQ ID NO: 1349232 - DNA, 22 bp, Artificial Sequence
  chemically synthesized
tctcttctgtttcaagacagta

SEQ ID NO: 1349233 - DNA, 22 bp, Artificial Sequence
  chemically synthesized
ctctctcttctgtttcaagaca

SEQ ID NO: 1349234 - DNA, 22 bp, Artificial Sequence
  chemically synthesized
gctctctcttctgtttcaagac

SEQ ID NO: 1349235 - DNA, 22 bp, Artificial Sequence
  chemically synthesized
tgctctctcttctgtttcaaga

SEQ ID NO: 1349236 - DNA, 22 bp, Artificial Sequence
  chemically synthesized
ggattttactgtcttgaaacag

SEQ ID NO: 1349237 - DNA, 22 bp, Artificial Sequence
  chemically synthesized
gattttactgtcttgaaacaga

SEQ ID NO: 1349238 - DNA, 22 bp, Artificial Sequence
  chemically synthesized
tactgtcttgaaacagaagaga

SEQ ID NO: 1349239 - DNA, 22 bp, Artificial Sequence
  chemically synthesized
accattttgctctctcttctgt

SEQ ID NO: 1349240 - DNA, 22 bp, Artificial Sequence
  chemically synthesized
actgtcttgaaacagaagagag

SEQ ID NO: 1349241 - DNA, 22 bp, Artificial Sequence
  chemically synthesized
aaccattttgctctctcttctg

SEQ ID NO: 1349242 - DNA, 22 bp, Artificial Sequence
  chemically synthesized
ctgtcttgaaacagaagagaga

SEQ ID NO: 1349243 - DNA, 22 bp, Artificial Sequence
  chemically synthesized
ttaaccattttgctctctcttc

SEQ ID NO: 1349244 - DNA, 22 bp, Artificial Sequence
  chemically synthesized
cttaaccattttgctctctctt

SEQ ID NO: 1349245 - DNA, 22 bp, Artificial Sequence
  chemically synthesized
tcttgaaacagaagagagagca

SEQ ID NO: 1349246 - DNA, 22 bp, Artificial Sequence
  chemically synthesized
gaaacagaagagagagcaaaat

SEQ ID NO: 1349247 - DNA, 22 bp, Artificial Sequence
  chemically synthesized
aaacagaagagagagcaaaatg

SEQ ID NO: 1349248 - DNA, 22 bp, Artificial Sequence
  chemically synthesized
atcaccttcttaaccattttgc

SEQ ID NO: 1349249 - DNA, 22 bp, Artificial Sequence
  chemically synthesized
tcatcaccttcttaaccatttt

SEQ ID NO: 1349250 - DNA, 22 bp, Artificial Sequence
  chemically synthesized
ctcatcaccttcttaaccattt

SEQ ID NO: 1349251 - DNA, 22 bp, Artificial Sequence
  chemically synthesized
tctcatcaccttcttaaccatt

SEQ ID NO: 1349252 - DNA, 22 bp, Artificial Sequence
  chemically synthesized
attttctcatcaccttcttaac

SEQ ID NO: 1349253 - DNA, 22 bp, Artificial Sequence
  chemically synthesized
cataaatgtcagttcattttct

SEQ ID NO: 1349254 - DNA, 22 bp, Artificial Sequence
  chemically synthesized
agaaggtgatgagaaaatgaac

SEQ ID NO: 1349255 - DNA, 22 bp, Artificial Sequence
  chemically synthesized
ttacataaatgtcagttcattt

SEQ ID NO: 1349256 - DNA, 22 bp, Artificial Sequence
  chemically synthesized
ataataaggcactgttacataa

SEQ ID NO: 1349257 - DNA, 22 bp, Artificial Sequence
  chemically synthesized
acatttatgtaacagtgcctta

SEQ ID NO: 1349258 - DNA, 22 bp, Artificial Sequence
  chemically synthesized
atgtaacagtgccttattatta

SEQ ID NO: 1349259 - DNA, 22 bp, Artificial Sequence
  chemically synthesized
tgtaacagtgccttattattaa

SEQ ID NO: 1349260 - DNA, 22 bp, Artificial Sequence
  chemically synthesized
attattaatatatggttggtgc

SEQ ID NO: 1349261 - DNA, 22 bp, Artificial Sequence
  chemically synthesized
ttattaatatatggttggtgct

SEQ ID NO: 1349262 - DNA, 22 bp, Artificial Sequence
  chemically synthesized
ttaatatatggttggtgctgtg

SEQ ID NO: 1349263 - DNA, 22 bp, Artificial Sequence
  chemically synthesized
aaagggtacaaagcacagcacc

SEQ ID NO: 1349264 - DNA, 22 bp, Artificial Sequence
  chemically synthesized
atatatggttggtgctgtgctt

SEQ ID NO: 1349265 - DNA, 22 bp, Artificial Sequence
  chemically synthesized
tcaaagggtacaaagcacagca

SEQ ID NO: 1349266 - DNA, 22 bp, Artificial Sequence
  chemically synthesized
gtgctgtgctttgtaccctttg

SEQ ID NO: 1349267 - DNA, 22 bp, Artificial Sequence
  chemically synthesized
gatcacaaaatatctctcaaag

SEQ ID NO: 1349268 - DNA, 22 bp, Artificial Sequence
  chemically synthesized
tgctttgtaccctttgagagat

SEQ ID NO: 1349269 - DNA, 22 bp, Artificial Sequence
  chemically synthesized
tgtaccctttgagagatatttt

SEQ ID NO: 1349270 - DNA, 22 bp, Artificial Sequence
  chemically synthesized
gtaccctttgagagatattttg

SEQ ID NO: 1349271 - DNA, 22 bp, Artificial Sequence
  chemically synthesized
taccctttgagagatattttgt

SEQ ID NO: 1349272 - DNA, 22 bp, Artificial Sequence
  chemically synthesized
taaaattggatcacaaaatatc

SEQ ID NO: 1349273 - DNA, 22 bp, Artificial Sequence
  chemically synthesized
tctataaaattggatcacaaaa

SEQ ID NO: 1349274 - DNA, 22 bp, Artificial Sequence
  chemically synthesized
tgagagatattttgtgatccaa

SEQ ID NO: 1349275 - DNA, 22 bp, Artificial Sequence
  chemically synthesized
ctatctataaaattggatcaca

SEQ ID NO: 1349276 - DNA, 22 bp, Artificial Sequence
  chemically synthesized
gagagatattttgtgatccaat

SEQ ID NO: 1349277 - DNA, 22 bp, Artificial Sequence
  chemically synthesized
cctatctataaaattggatcac

SEQ ID NO: 1349278 - DNA, 22 bp, Artificial Sequence
  chemically synthesized
agagatattttgtgatccaatt

SEQ ID NO: 1349279 - DNA, 22 bp, Artificial Sequence
  chemically synthesized
tcctatctataaaattggatca

SEQ ID NO: 1349280 - DNA, 22 bp, Artificial Sequence
  chemically synthesized
ttcctatctataaaattggatc

SEQ ID NO: 1349281 - DNA, 22 bp, Artificial Sequence
  chemically synthesized
tgtgatccaattttatagatag

SEQ ID NO: 1349282 - DNA, 22 bp, Artificial Sequence
  chemically synthesized
gagatccttttcctatctataa

SEQ ID NO: 1349283 - DNA, 22 bp, Artificial Sequence
  chemically synthesized
gtgatccaattttatagatagg

SEQ ID NO: 1349284 - DNA, 22 bp, Artificial Sequence
  chemically synthesized
agagatccttttcctatctata

SEQ ID NO: 1349285 - DNA, 22 bp, Artificial Sequence
  chemically synthesized
tgatccaattttatagatagga

SEQ ID NO: 1349286 - DNA, 22 bp, Artificial Sequence
  chemically synthesized
aatatttagagatccttttcct

SEQ ID NO: 1349287 - DNA, 22 bp, Artificial Sequence
  chemically synthesized
tatagataggaaaaggatctct

SEQ ID NO: 1349288 - DNA, 22 bp, Artificial Sequence
  chemically synthesized
atagataggaaaaggatctcta

SEQ ID NO: 1349289 - DNA, 22 bp, Artificial Sequence
  chemically synthesized
tagataggaaaaggatctctaa

SEQ ID NO: 1349290 - DNA, 22 bp, Artificial Sequence
  chemically synthesized
caaaactgaatatttagagatc

SEQ ID NO: 1349291 - DNA, 22 bp, Artificial Sequence
  chemically synthesized
gaacatcagttccaaaactgaa

SEQ ID NO: 1349292 - DNA, 22 bp, Artificial Sequence
  chemically synthesized
gttagaacatcagttccaaaac

SEQ ID NO: 1349293 - DNA, 22 bp, Artificial Sequence
  chemically synthesized
taaatattcagttttggaactg

SEQ ID NO: 1349294 - DNA, 22 bp, Artificial Sequence
  chemically synthesized
aatattcagttttggaactgat

SEQ ID NO: 1349295 - DNA, 22 bp, Artificial Sequence
  chemically synthesized
agttttggaactgatgttctaa

SEQ ID NO: 1349296 - DNA, 22 bp, Artificial Sequence
  chemically synthesized
tggaactgatgttctaaccagg

SEQ ID NO: 1349297 - DNA, 22 bp, Artificial Sequence
  chemically synthesized
aagtcaggatgacctggttaga

SEQ ID NO: 1349298 - DNA, 22 bp, Artificial Sequence
  chemically synthesized
ggaactgatgttctaaccaggt

SEQ ID NO: 1349299 - DNA, 22 bp, Artificial Sequence
  chemically synthesized
caagtcaggatgacctggttag

SEQ ID NO: 1349300 - DNA, 22 bp, Artificial Sequence
  chemically synthesized
gaactgatgttctaaccaggtc

SEQ ID NO: 1349301 - DNA, 22 bp, Artificial Sequence
  chemically synthesized
aaatttcaagtcaggatgacct

SEQ ID NO: 1349302 - DNA, 22 bp, Artificial Sequence
  chemically synthesized
atgttctaaccaggtcatcctg

SEQ ID NO: 1349303 - DNA, 22 bp, Artificial Sequence
  chemically synthesized
taaccaggtcatcctgacttga

SEQ ID NO: 1349304 - DNA, 22 bp, Artificial Sequence
  chemically synthesized
accaggtcatcctgacttgaaa

SEQ ID NO: 1349305 - DNA, 22 bp, Artificial Sequence
  chemically synthesized
acttgaaatttcaggtgattcc

SEQ ID NO: 1349306 - DNA, 22 bp, Artificial Sequence
  chemically synthesized
gaaatttcaggtgattccctca

SEQ ID NO: 1349307 - DNA, 22 bp, Artificial Sequence
  chemically synthesized
aaatttcaggtgattccctcat

SEQ ID NO: 1349308 - DNA, 22 bp, Artificial Sequence
  chemically synthesized
cgtcaagatgcatcatgaggga

SEQ ID NO: 1349309 - DNA, 22 bp, Artificial Sequence
  chemically synthesized
gcgtcaagatgcatcatgaggg

SEQ ID NO: 1349310 - DNA, 22 bp, Artificial Sequence
  chemically synthesized
caggtgattccctcatgatgca

SEQ ID NO: 1349311 - DNA, 22 bp, Artificial Sequence
  chemically synthesized
tttgcgtcaagatgcatcatga

SEQ ID NO: 1349312 - DNA, 22 bp, Artificial Sequence
  chemically synthesized
aggtgattccctcatgatgcat

SEQ ID NO: 1349313 - DNA, 22 bp, Artificial Sequence
  chemically synthesized
gtttgcgtcaagatgcatcatg

SEQ ID NO: 1349314 - DNA, 22 bp, Artificial Sequence
  chemically synthesized
tgtttgcgtcaagatgcatcat

SEQ ID NO: 1349315 - DNA, 22 bp, Artificial Sequence
  chemically synthesized
ttgtttgcgtcaagatgcatca

SEQ ID NO: 1349316 - DNA, 22 bp, Artificial Sequence
  chemically synthesized
tttgtttgcgtcaagatgcatc

SEQ ID NO: 1349317 - DNA, 22 bp, Artificial Sequence
  chemically synthesized
cctcatgatgcatcttgacgca

SEQ ID NO: 1349318 - DNA, 22 bp, Artificial Sequence
  chemically synthesized
agtacattttttgtttgcgtca

SEQ ID NO: 1349319 - DNA, 22 bp, Artificial Sequence
  chemically synthesized
atgatgcatcttgacgcaaaca

SEQ ID NO: 1349320 - DNA, 22 bp, Artificial Sequence
  chemically synthesized
gacgcaaacaaaaaatgtactg

SEQ ID NO: 1349321 - DNA, 22 bp, Artificial Sequence
  chemically synthesized
taataatatattcagtacattt

SEQ ID NO: 1349322 - DNA, 22 bp, Artificial Sequence
  chemically synthesized
acgcaaacaaaaaatgtactga

SEQ ID NO: 1349323 - DNA, 22 bp, Artificial Sequence
  chemically synthesized
ataataatatattcagtacatt

SEQ ID NO: 1349324 - DNA, 22 bp, Artificial Sequence
  chemically synthesized
acatttataataatatattcag

SEQ ID NO: 1349325 - DNA, 22 bp, Artificial Sequence
  chemically synthesized
ctcacatttataataatatatt

SEQ ID NO: 1349326 - DNA, 22 bp, Artificial Sequence
  chemically synthesized
gttactcacatttataataata

SEQ ID NO: 1349327 - DNA, 22 bp, Artificial Sequence
  chemically synthesized
tagttactcacatttataataa

SEQ ID NO: 1349328 - DNA, 22 bp, Artificial Sequence
  chemically synthesized
ctagttactcacatttataata

SEQ ID NO: 1349329 - DNA, 22 bp, Artificial Sequence
  chemically synthesized
aatatattattataaatgtgag

SEQ ID NO: 1349330 - DNA, 22 bp, Artificial Sequence
  chemically synthesized
ccatgcatttctagttactcac

SEQ ID NO: 1349331 - DNA, 22 bp, Artificial Sequence
  chemically synthesized
cccatgcatttctagttactca

SEQ ID NO: 1349332 - DNA, 22 bp, Artificial Sequence
  chemically synthesized
tcccatgcatttctagttactc

SEQ ID NO: 1349333 - DNA, 22 bp, Artificial Sequence
  chemically synthesized
ttataaatgtgagtaactagaa

SEQ ID NO: 1349334 - DNA, 22 bp, Artificial Sequence
  chemically synthesized
tttcccatgcatttctagttac

SEQ ID NO: 1349335 - DNA, 22 bp, Artificial Sequence
  chemically synthesized
ctttcccatgcatttctagtta

SEQ ID NO: 1349336 - DNA, 22 bp, Artificial Sequence
  chemically synthesized
taaatgtgagtaactagaaatg

SEQ ID NO: 1349337 - DNA, 22 bp, Artificial Sequence
  chemically synthesized
ttctttcccatgcatttctagt

SEQ ID NO: 1349338 - DNA, 22 bp, Artificial Sequence
  chemically synthesized
ccctcttctttcccatgcattt

SEQ ID NO: 1349339 - DNA, 22 bp, Artificial Sequence
  chemically synthesized
ctcccctcttctttcccatgca

SEQ ID NO: 1349340 - DNA, 22 bp, Artificial Sequence
  chemically synthesized
cctcccctcttctttcccatgc

SEQ ID NO: 1349341 - DNA, 22 bp, Artificial Sequence
  chemically synthesized
tcctcccctcttctttcccatg

SEQ ID NO: 1349342 - DNA, 22 bp, Artificial Sequence
  chemically synthesized
ttcctcccctcttctttcccat

SEQ ID NO: 1349343 - DNA, 22 bp, Artificial Sequence
  chemically synthesized
ttttcctcccctcttctttccc

SEQ ID NO: 1349344 - DNA, 22 bp, Artificial Sequence
  chemically synthesized
gaaatgcatgggaaagaagagg

SEQ ID NO: 1349345 - DNA, 22 bp, Artificial Sequence
  chemically synthesized
ctcttttcctcccctcttcttt

SEQ ID NO: 1349346 - DNA, 22 bp, Artificial Sequence
  chemically synthesized
actcttttcctcccctcttctt

SEQ ID NO: 1349347 - DNA, 22 bp, Artificial Sequence
  chemically synthesized
tactcttttcctcccctcttct

SEQ ID NO: 1349348 - DNA, 22 bp, Artificial Sequence
  chemically synthesized
ttactcttttcctcccctcttc

SEQ ID NO: 1349349 - DNA, 22 bp, Artificial Sequence
  chemically synthesized
tttactcttttcctcccctctt

SEQ ID NO: 1349350 - DNA, 22 bp, Artificial Sequence
  chemically synthesized
ctttttactcttttcctcccct

SEQ ID NO: 1349351 - DNA, 22 bp, Artificial Sequence
  chemically synthesized
atattcctttttactcttttcc

SEQ ID NO: 1349352 - DNA, 22 bp, Artificial Sequence
  chemically synthesized
aatattcctttttactcttttc

SEQ ID NO: 1349353 - DNA, 22 bp, Artificial Sequence
  chemically synthesized
tttaatattcctttttactctt

SEQ ID NO: 1349354 - DNA, 22 bp, Artificial Sequence
  chemically synthesized
gtttaatattcctttttactct

SEQ ID NO: 1349355 - DNA, 22 bp, Artificial Sequence
  chemically synthesized
aatacatttgtttaatattcct

SEQ ID NO: 1349356 - DNA, 22 bp, Artificial Sequence
  chemically synthesized
ttgaatacatttgtttaatatt

SEQ ID NO: 1349357 - DNA, 22 bp, Artificial Sequence
  chemically synthesized
gttgaatacatttgtttaatat

SEQ ID NO: 1349358 - DNA, 22 bp, Artificial Sequence
  chemically synthesized
aataaaggtttgttgaatacat

SEQ ID NO: 1349359 - DNA, 22 bp, Artificial Sequence
  chemically synthesized
aacaaatgtattcaacaaacct

SEQ ID NO: 1349360 - DNA, 22 bp, Artificial Sequence
  chemically synthesized
aacaaacctttattgagtgtct

SEQ ID NO: 1349361 - DNA, 22 bp, Artificial Sequence
  chemically synthesized
gaacatagccagccatataata

SEQ ID NO: 1349362 - DNA, 22 bp, Artificial Sequence
  chemically synthesized
tattgagtgtctattatatggc

SEQ ID NO: 1349363 - DNA, 22 bp, Artificial Sequence
  chemically synthesized
attgagtgtctattatatggct

SEQ ID NO: 1349364 - DNA, 22 bp, Artificial Sequence
  chemically synthesized
ttgagtgtctattatatggctg

SEQ ID NO: 1349365 - DNA, 22 bp, Artificial Sequence
  chemically synthesized
agtgtctattatatggctggct

SEQ ID NO: 1349366 - DNA, 22 bp, Artificial Sequence
  chemically synthesized
cagtacctagaacatagccagc

SEQ ID NO: 1349367 - DNA, 22 bp, Artificial Sequence
  chemically synthesized
ttatatggctggctatgttcta

SEQ ID NO: 1349368 - DNA, 22 bp, Artificial Sequence
  chemically synthesized
tatggctggctatgttctaggt

SEQ ID NO: 1349369 - DNA, 22 bp, Artificial Sequence
  chemically synthesized
ccacacctccagtacctagaac

SEQ ID NO: 1349370 - DNA, 22 bp, Artificial Sequence
  chemically synthesized
gctatgttctaggtactggagg

SEQ ID NO: 1349371 - DNA, 22 bp, Artificial Sequence
  chemically synthesized
ccaagttaccacacctccagta

SEQ ID NO: 1349372 - DNA, 22 bp, Artificial Sequence
  chemically synthesized
cccaagttaccacacctccagt

SEQ ID NO: 1349373 - DNA, 22 bp, Artificial Sequence
  chemically synthesized
tcccaagttaccacacctccag

SEQ ID NO: 1349374 - DNA, 22 bp, Artificial Sequence
  chemically synthesized
tgttctaggtactggaggtgtg

SEQ ID NO: 1349375 - DNA, 22 bp, Artificial Sequence
  chemically synthesized
taggtactggaggtgtggtaac

SEQ ID NO: 1349376 - DNA, 22 bp, Artificial Sequence
  chemically synthesized
ggtactggaggtgtggtaactt

SEQ ID NO: 1349377 - DNA, 22 bp, Artificial Sequence
  chemically synthesized
ataaaattttcccaagttacca

SEQ ID NO: 1349378 - DNA, 22 bp, Artificial Sequence
  chemically synthesized
gaggtgtggtaacttgggaaaa

SEQ ID NO: 1349379 - DNA, 22 bp, Artificial Sequence
  chemically synthesized
taatatatgttgataaaatttt

SEQ ID NO: 1349380 - DNA, 22 bp, Artificial Sequence
  chemically synthesized
gggaaaattttatcaacatata

SEQ ID NO: 1349381 - DNA, 22 bp, Artificial Sequence
  chemically synthesized
ggaaaattttatcaacatatat

SEQ ID NO: 1349382 - DNA, 22 bp, Artificial Sequence
  chemically synthesized
tgcagaaaatactgtaatatat

SEQ ID NO: 1349383 - DNA, 22 bp, Artificial Sequence
  chemically synthesized
tatcaacatatattacagtatt

SEQ ID NO: 1349384 - DNA, 22 bp, Artificial Sequence
  chemically synthesized
atcaacatatattacagtattt

SEQ ID NO: 1349385 - DNA, 22 bp, Artificial Sequence
  chemically synthesized
tcaacatatattacagtatttt

SEQ ID NO: 1349386 - DNA, 22 bp, Artificial Sequence
  chemically synthesized
cagtattttctgcataattccc

SEQ ID NO: 1349387 - DNA, 22 bp, Artificial Sequence
  chemically synthesized
tctgcataattccccgccatac

SEQ ID NO: 1349388 - DNA, 22 bp, Artificial Sequence
  chemically synthesized
ctgcataattccccgccatact

SEQ ID NO: 1349389 - DNA, 22 bp, Artificial Sequence
  chemically synthesized
aaaggaaataaaagtatggcgg

SEQ ID NO: 1349390 - DNA, 22 bp, Artificial Sequence
  chemically synthesized
tgcataattccccgccatactt

SEQ ID NO: 1349391 - DNA, 22 bp, Artificial Sequence
  chemically synthesized
cataattccccgccatactttt

SEQ ID NO: 1349392 - DNA, 22 bp, Artificial Sequence
  chemically synthesized
tgaattcaaaggaaataaaagt

SEQ ID NO: 1349393 - DNA, 22 bp, Artificial Sequence
  chemically synthesized
cccgccatacttttatttcctt

SEQ ID NO: 1349394 - DNA, 22 bp, Artificial Sequence
  chemically synthesized
atggaaactgtgaattcaaagg

SEQ ID NO: 1349395 - DNA, 22 bp, Artificial Sequence
  chemically synthesized
aatggaaactgtgaattcaaag

SEQ ID NO: 1349396 - DNA, 22 bp, Artificial Sequence
  chemically synthesized
taatggaaactgtgaattcaaa

SEQ ID NO: 1349397 - DNA, 22 bp, Artificial Sequence
  chemically synthesized
ttttaatggaaactgtgaattc

SEQ ID NO: 1349398 - DNA, 22 bp, Artificial Sequence
  chemically synthesized
ttatttcctttgaattcacagt

SEQ ID NO: 1349399 - DNA, 22 bp, Artificial Sequence
  chemically synthesized
tatttcctttgaattcacagtt

SEQ ID NO: 1349400 - DNA, 22 bp, Artificial Sequence
  chemically synthesized
atttcctttgaattcacagttt

SEQ ID NO: 1349401 - DNA, 22 bp, Artificial Sequence
  chemically synthesized
tttcctttgaattcacagtttc

SEQ ID NO: 1349402 - DNA, 22 bp, Artificial Sequence
  chemically synthesized
cctttgaattcacagtttccat

SEQ ID NO: 1349403 - DNA, 22 bp, Artificial Sequence
  chemically synthesized
ctttgaattcacagtttccatt

SEQ ID NO: 1349404 - DNA, 22 bp, Artificial Sequence
  chemically synthesized
aataaattattttaatggaaac

SEQ ID NO: 1349405 - DNA, 22 bp, Artificial Sequence
  chemically synthesized
tgaattcacagtttccattaaa

SEQ ID NO: 1349406 - DNA, 22 bp, Artificial Sequence
  chemically synthesized
gaattcacagtttccattaaaa

SEQ ID NO: 1349407 - DNA, 22 bp, Artificial Sequence
  chemically synthesized
aattcacagtttccattaaaat

SEQ ID NO: 1349408 - DNA, 22 bp, Artificial Sequence
  chemically synthesized
actcaataaattattttaatgg

SEQ ID NO: 1349409 - DNA, 22 bp, Artificial Sequence
  chemically synthesized
aactcaataaattattttaatg

SEQ ID NO: 1349410 - DNA, 22 bp, Artificial Sequence
  chemically synthesized
taactcaataaattattttaat

SEQ ID NO: 1349411 - DNA, 22 bp, Artificial Sequence
  chemically synthesized
acagtttccattaaaataattt

SEQ ID NO: 1349412 - DNA, 22 bp, Artificial Sequence
  chemically synthesized
ggctttaactcaataaattatt

SEQ ID NO: 1349413 - DNA, 22 bp, Artificial Sequence
  chemically synthesized
taggctttaactcaataaatta

SEQ ID NO: 1349414 - DNA, 22 bp, Artificial Sequence
  chemically synthesized
ccattaaaataatttattgagt

SEQ ID NO: 1349415 - DNA, 22 bp, Artificial Sequence
  chemically synthesized
cattaaaataatttattgagtt

SEQ ID NO: 1349416 - DNA, 22 bp, Artificial Sequence
  chemically synthesized
tgctctaggctttaactcaata

SEQ ID NO: 1349417 - DNA, 22 bp, Artificial Sequence
  chemically synthesized
aaataatttattgagttaaagc

SEQ ID NO: 1349418 - DNA, 22 bp, Artificial Sequence
  chemically synthesized
tctatgctctaggctttaactc

SEQ ID NO: 1349419 - DNA, 22 bp, Artificial Sequence
  chemically synthesized
cctgtctatgctctaggcttta

SEQ ID NO: 1349420 - DNA, 22 bp, Artificial Sequence
  chemically synthesized
attgagttaaagcctagagcat

SEQ ID NO: 1349421 - DNA, 22 bp, Artificial Sequence
  chemically synthesized
ttgagttaaagcctagagcata

SEQ ID NO: 1349422 - DNA, 22 bp, Artificial Sequence
  chemically synthesized
aaaagttgcctgtctatgctct

SEQ ID NO: 1349423 - DNA, 22 bp, Artificial Sequence
  chemically synthesized
agttaaagcctagagcatagac

SEQ ID NO: 1349424 - DNA, 22 bp, Artificial Sequence
  chemically synthesized
gaaaagttgcctgtctatgctc

SEQ ID NO: 1349425 - DNA, 22 bp, Artificial Sequence
  chemically synthesized
tgaaaagttgcctgtctatgct

SEQ ID NO: 1349426 - DNA, 22 bp, Artificial Sequence
  chemically synthesized
aagcctagagcatagacaggca

SEQ ID NO: 1349427 - DNA, 22 bp, Artificial Sequence
  chemically synthesized
tggtatctttgaaaagttgcct

SEQ ID NO: 1349428 - DNA, 22 bp, Artificial Sequence
  chemically synthesized
gagcatagacaggcaacttttc

SEQ ID NO: 1349429 - DNA, 22 bp, Artificial Sequence
  chemically synthesized
ttatggtatctttgaaaagttg

SEQ ID NO: 1349430 - DNA, 22 bp, Artificial Sequence
  chemically synthesized
attatggtatctttgaaaagtt

SEQ ID NO: 1349431 - DNA, 22 bp, Artificial Sequence
  chemically synthesized
ttcaaagataccataataagtt

SEQ ID NO: 1349432 - DNA, 22 bp, Artificial Sequence
  chemically synthesized
tcaaagataccataataagttt

SEQ ID NO: 1349433 - DNA, 22 bp, Artificial Sequence
  chemically synthesized
caaagataccataataagtttt

SEQ ID NO: 1349434 - DNA, 22 bp, Artificial Sequence
  chemically synthesized
aaagataccataataagttttt

SEQ ID NO: 1349435 - DNA, 22 bp, Artificial Sequence
  chemically synthesized
aaaaatgagtaaataaaaactt

SEQ ID NO: 1349436 - DNA, 22 bp, Artificial Sequence
  chemically synthesized
caaaaatgagtaaataaaaact

SEQ ID NO: 1349437 - DNA, 22 bp, Artificial Sequence
  chemically synthesized
tcaaaaatgagtaaataaaaac

SEQ ID NO: 1349438 - DNA, 22 bp, Artificial Sequence
  chemically synthesized
tttcaaaaatgagtaaataaaa

SEQ ID NO: 1349439 - DNA, 22 bp, Artificial Sequence
  chemically synthesized
ctttcaaaaatgagtaaataaa

SEQ ID NO: 1349440 - DNA, 22 bp, Artificial Sequence
  chemically synthesized
gtccttctttcaaaaatgagta

SEQ ID NO: 1349441 - DNA, 22 bp, Artificial Sequence
  chemically synthesized
ttatttactcatttttgaaaga

SEQ ID NO: 1349442 - DNA, 22 bp, Artificial Sequence
  chemically synthesized
tatttactcatttttgaaagaa

SEQ ID NO: 1349443 - DNA, 22 bp, Artificial Sequence
  chemically synthesized
atttactcatttttgaaagaag

SEQ ID NO: 1349444 - DNA, 22 bp, Artificial Sequence
  chemically synthesized
tttactcatttttgaaagaagg

SEQ ID NO: 1349445 - DNA, 22 bp, Artificial Sequence
  chemically synthesized
actcatttttgaaagaaggact

SEQ ID NO: 1349446 - DNA, 22 bp, Artificial Sequence
  chemically synthesized
ctcatttttgaaagaaggacta

SEQ ID NO: 1349447 - DNA, 22 bp, Artificial Sequence
  chemically synthesized
atttttgaaagaaggactagtc

SEQ ID NO: 1349448 - DNA, 22 bp, Artificial Sequence
  chemically synthesized
tggccagcatccgactagtcct

SEQ ID NO: 1349449 - DNA, 22 bp, Artificial Sequence
  chemically synthesized
atggccagcatccgactagtcc

SEQ ID NO: 1349450 - DNA, 22 bp, Artificial Sequence
  chemically synthesized
ttgaaagaaggactagtcggat

SEQ ID NO: 1349451 - DNA, 22 bp, Artificial Sequence
  chemically synthesized
tttatggccagcatccgactag

SEQ ID NO: 1349452 - DNA, 22 bp, Artificial Sequence
  chemically synthesized
tgaaagaaggactagtcggatg

SEQ ID NO: 1349453 - DNA, 22 bp, Artificial Sequence
  chemically synthesized
gaaagaaggactagtcggatgc

SEQ ID NO: 1349454 - DNA, 22 bp, Artificial Sequence
  chemically synthesized
aaagaaggactagtcggatgct

SEQ ID NO: 1349455 - DNA, 22 bp, Artificial Sequence
  chemically synthesized
gcccctgtttatggccagcatc

SEQ ID NO: 1349456 - DNA, 22 bp, Artificial Sequence
  chemically synthesized
agcccctgtttatggccagcat

SEQ ID NO: 1349457 - DNA, 22 bp, Artificial Sequence
  chemically synthesized
tagcccctgtttatggccagca

SEQ ID NO: 1349458 - DNA, 22 bp, Artificial Sequence
  chemically synthesized
gtcggatgctggccataaacag

SEQ ID NO: 1349459 - DNA, 22 bp, Artificial Sequence
  chemically synthesized
gccataaacaggggctaaaatt

SEQ ID NO: 1349460 - DNA, 22 bp, Artificial Sequence
  chemically synthesized
gtggaaatggaaagatggatga

SEQ ID NO: 1349461 - DNA, 22 bp, Artificial Sequence
  chemically synthesized
cattggtggaaatggaaagatg

SEQ ID NO: 1349462 - DNA, 22 bp, Artificial Sequence
  chemically synthesized
aaatttcatccatctttccatt

SEQ ID NO: 1349463 - DNA, 22 bp, Artificial Sequence
  chemically synthesized
cacctccattggtggaaatgga

SEQ ID NO: 1349464 - DNA, 22 bp, Artificial Sequence
  chemically synthesized
catccatctttccatttccacc

SEQ ID NO: 1349465 - DNA, 22 bp, Artificial Sequence
  chemically synthesized
tacacctccattggtggaaatg

SEQ ID NO: 1349466 - DNA, 22 bp, Artificial Sequence
  chemically synthesized
atccatctttccatttccacca

SEQ ID NO: 1349467 - DNA, 22 bp, Artificial Sequence
  chemically synthesized
caactctacacctccattggtg

SEQ ID NO: 1349468 - DNA, 22 bp, Artificial Sequence
  chemically synthesized
tccatttccaccaatggaggtg

SEQ ID NO: 1349469 - DNA, 22 bp, Artificial Sequence
  chemically synthesized
attccaactctacacctccatt

SEQ ID NO: 1349470 - DNA, 22 bp, Artificial Sequence
  chemically synthesized
ccatttccaccaatggaggtgt

SEQ ID NO: 1349471 - DNA, 22 bp, Artificial Sequence
  chemically synthesized
cattccaactctacacctccat

SEQ ID NO: 1349472 - DNA, 22 bp, Artificial Sequence
  chemically synthesized
catttccaccaatggaggtgta

SEQ ID NO: 1349473 - DNA, 22 bp, Artificial Sequence
  chemically synthesized
acttcattccaactctacacct

SEQ ID NO: 1349474 - DNA, 22 bp, Artificial Sequence
  chemically synthesized
aacttcattccaactctacacc

SEQ ID NO: 1349475 - DNA, 22 bp, Artificial Sequence
  chemically synthesized
ccaccaatggaggtgtagagtt

SEQ ID NO: 1349476 - DNA, 22 bp, Artificial Sequence
  chemically synthesized
caccaatggaggtgtagagttg

SEQ ID NO: 1349477 - DNA, 22 bp, Artificial Sequence
  chemically synthesized
gtcacttaacttcattccaact

SEQ ID NO: 1349478 - DNA, 22 bp, Artificial Sequence
  chemically synthesized
ggtcacttaacttcattccaac

SEQ ID NO: 1349479 - DNA, 22 bp, Artificial Sequence
  chemically synthesized
aagaggcttggtcacttaactt

SEQ ID NO: 1349480 - DNA, 22 bp, Artificial Sequence
  chemically synthesized
tcaagaggcttggtcacttaac

SEQ ID NO: 1349481 - DNA, 22 bp, Artificial Sequence
  chemically synthesized
tctcaagaggcttggtcactta

SEQ ID NO: 1349482 - DNA, 22 bp, Artificial Sequence
  chemically synthesized
gaatgaagttaagtgaccaagc

SEQ ID NO: 1349483 - DNA, 22 bp, Artificial Sequence
  chemically synthesized
acctctctcaagaggcttggtc

SEQ ID NO: 1349484 - DNA, 22 bp, Artificial Sequence
  chemically synthesized
cacctctctcaagaggcttggt

SEQ ID NO: 1349485 - DNA, 22 bp, Artificial Sequence
  chemically synthesized
agtgaccaagcctcttgagaga

SEQ ID NO: 1349486 - DNA, 22 bp, Artificial Sequence
  chemically synthesized
agatatccttcacctctctcaa

SEQ ID NO: 1349487 - DNA, 22 bp, Artificial Sequence
  chemically synthesized
ctgagatatccttcacctctct

SEQ ID NO: 1349488 - DNA, 22 bp, Artificial Sequence
  chemically synthesized
ttcctgagatatccttcacctc

SEQ ID NO: 1349489 - DNA, 22 bp, Artificial Sequence
  chemically synthesized
attcctgagatatccttcacct

SEQ ID NO: 1349490 - DNA, 22 bp, Artificial Sequence
  chemically synthesized
cttattcctgagatatccttca

SEQ ID NO: 1349491 - DNA, 22 bp, Artificial Sequence
  chemically synthesized
ttgagagaggtgaaggatatct

SEQ ID NO: 1349492 - DNA, 22 bp, Artificial Sequence
  chemically synthesized
gagagaggtgaaggatatctca

SEQ ID NO: 1349493 - DNA, 22 bp, Artificial Sequence
  chemically synthesized
gttgcttattcctgagatatcc

SEQ ID NO: 1349494 - DNA, 22 bp, Artificial Sequence
  chemically synthesized
agagaggtgaaggatatctcag

SEQ ID NO: 1349495 - DNA, 22 bp, Artificial Sequence
  chemically synthesized
ctagttgcttattcctgagata

SEQ ID NO: 1349496 - DNA, 22 bp, Artificial Sequence
  chemically synthesized
ttgctagttgcttattcctgag

SEQ ID NO: 1349497 - DNA, 22 bp, Artificial Sequence
  chemically synthesized
tctattgctagttgcttattcc

SEQ ID NO: 1349498 - DNA, 22 bp, Artificial Sequence
  chemically synthesized
gtctattgctagttgcttattc

SEQ ID NO: 1349499 - DNA, 22 bp, Artificial Sequence
  chemically synthesized
tgtctattgctagttgcttatt

SEQ ID NO: 1349500 - DNA, 22 bp, Artificial Sequence
  chemically synthesized
ctttgtctattgctagttgctt

SEQ ID NO: 1349501 - DNA, 22 bp, Artificial Sequence
  chemically synthesized
tcctttgtctattgctagttgc

SEQ ID NO: 1349502 - DNA, 22 bp, Artificial Sequence
  chemically synthesized
ctcctttgtctattgctagttg

SEQ ID NO: 1349503 - DNA, 22 bp, Artificial Sequence
  chemically synthesized
tctcctttgtctattgctagtt

SEQ ID NO: 1349504 - DNA, 22 bp, Artificial Sequence
  chemically synthesized
ttctcctttgtctattgctagt

SEQ ID NO: 1349505 - DNA, 22 bp, Artificial Sequence
  chemically synthesized
aggaataagcaactagcaatag

SEQ ID NO: 1349506 - DNA, 22 bp, Artificial Sequence
  chemically synthesized
gatttttctcctttgtctattg

SEQ ID NO: 1349507 - DNA, 22 bp, Artificial Sequence
  chemically synthesized
cgatttttctcctttgtctatt

SEQ ID NO: 1349508 - DNA, 22 bp, Artificial Sequence
  chemically synthesized
tttcgatttttctcctttgtct

SEQ ID NO: 1349509 - DNA, 22 bp, Artificial Sequence
  chemically synthesized
tgtttcgatttttctcctttgt

SEQ ID NO: 1349510 - DNA, 22 bp, Artificial Sequence
  chemically synthesized
tctgtttcgatttttctccttt

SEQ ID NO: 1349511 - DNA, 22 bp, Artificial Sequence
  chemically synthesized
tctctgtttcgatttttctcct

SEQ ID NO: 1349512 - DNA, 22 bp, Artificial Sequence
  chemically synthesized
gcaatagacaaaggagaaaaat

SEQ ID NO: 1349513 - DNA, 22 bp, Artificial Sequence
  chemically synthesized
ctctctgtttcgatttttctcc

SEQ ID NO: 1349514 - DNA, 22 bp, Artificial Sequence
  chemically synthesized
tctctctgtttcgatttttctc

SEQ ID NO: 1349515 - DNA, 22 bp, Artificial Sequence
  chemically synthesized
tttctctctgtttcgatttttc

SEQ ID NO: 1349516 - DNA, 22 bp, Artificial Sequence
  chemically synthesized
gcagtggtggatggggaatgga

SEQ ID NO: 1349517 - DNA, 22 bp, Artificial Sequence
  chemically synthesized
ggcagtggtggatggggaatgg

SEQ ID NO: 1349518 - DNA, 22 bp, Artificial Sequence
  chemically synthesized
ggtgctgtccattccccatcca

SEQ ID NO: 1349519 - DNA, 22 bp, Artificial Sequence
  chemically synthesized
gtgctgtccattccccatccac

SEQ ID NO: 1349520 - DNA, 22 bp, Artificial Sequence
  chemically synthesized
tccattccccatccaccactgc

SEQ ID NO: 1349521 - DNA, 22 bp, Artificial Sequence
  chemically synthesized
tataagtatgtttggcagtggt

SEQ ID NO: 1349522 - DNA, 22 bp, Artificial Sequence
  chemically synthesized
cccatccaccactgccaaacat

SEQ ID NO: 1349523 - DNA, 22 bp, Artificial Sequence
  chemically synthesized
agtggccagagttgtataagta

SEQ ID NO: 1349524 - DNA, 22 bp, Artificial Sequence
  chemically synthesized
gagtggccagagttgtataagt

SEQ ID NO: 1349525 - DNA, 22 bp, Artificial Sequence
  chemically synthesized
ccaaacatacttatacaactct

SEQ ID NO: 1349526 - DNA, 22 bp, Artificial Sequence
  chemically synthesized
ggtagtttgagtggccagagtt

SEQ ID NO: 1349527 - DNA, 22 bp, Artificial Sequence
  chemically synthesized
aggtagtttgagtggccagagt

SEQ ID NO: 1349528 - DNA, 22 bp, Artificial Sequence
  chemically synthesized
atttaggtagtttgagtggcca

SEQ ID NO: 1349529 - DNA, 22 bp, Artificial Sequence
  chemically synthesized
atacaactctggccactcaaac

SEQ ID NO: 1349530 - DNA, 22 bp, Artificial Sequence
  chemically synthesized
tacaactctggccactcaaact

SEQ ID NO: 1349531 - DNA, 22 bp, Artificial Sequence
  chemically synthesized
gctcatttaggtagtttgagtg

SEQ ID NO: 1349532 - DNA, 22 bp, Artificial Sequence
  chemically synthesized
tggccactcaaactacctaaat

SEQ ID NO: 1349533 - DNA, 22 bp, Artificial Sequence
  chemically synthesized
gccactcaaactacctaaatga

SEQ ID NO: 1349534 - DNA, 22 bp, Artificial Sequence
  chemically synthesized
atcgaagttggctcatttaggt

SEQ ID NO: 1349535 - DNA, 22 bp, Artificial Sequence
  chemically synthesized
catcgaagttggctcatttagg

SEQ ID NO: 1349536 - DNA, 22 bp, Artificial Sequence
  chemically synthesized
tttcatcgaagttggctcattt

SEQ ID NO: 1349537 - DNA, 22 bp, Artificial Sequence
  chemically synthesized
gtttcatcgaagttggctcatt

SEQ ID NO: 1349538 - DNA, 22 bp, Artificial Sequence
  chemically synthesized
aaactacctaaatgagccaact

SEQ ID NO: 1349539 - DNA, 22 bp, Artificial Sequence
  chemically synthesized
cctaaatgagccaacttcgatg

SEQ ID NO: 1349540 - DNA, 22 bp, Artificial Sequence
  chemically synthesized
aatgagccaacttcgatgaaac

SEQ ID NO: 1349541 - DNA, 22 bp, Artificial Sequence
  chemically synthesized
ccaatagtgtttgtttcatcga

SEQ ID NO: 1349542 - DNA, 22 bp, Artificial Sequence
  chemically synthesized
tcccaatagtgtttgtttcatc

SEQ ID NO: 1349543 - DNA, 22 bp, Artificial Sequence
  chemically synthesized
cgatgaaacaaacactattggg

SEQ ID NO: 1349544 - DNA, 22 bp, Artificial Sequence
  chemically synthesized
gatgaaacaaacactattggga

SEQ ID NO: 1349545 - DNA, 22 bp, Artificial Sequence
  chemically synthesized
ccacgggagtgtaatctctccc

SEQ ID NO: 1349546 - DNA, 22 bp, Artificial Sequence
  chemically synthesized
atactaccacgggagtgtaatc

SEQ ID NO: 1349547 - DNA, 22 bp, Artificial Sequence
  chemically synthesized
gatactaccacgggagtgtaat

SEQ ID NO: 1349548 - DNA, 22 bp, Artificial Sequence
  chemically synthesized
ttgggagagattacactcccgt

SEQ ID NO: 1349549 - DNA, 22 bp, Artificial Sequence
  chemically synthesized
cttgatactaccacgggagtgt

SEQ ID NO: 1349550 - DNA, 22 bp, Artificial Sequence
  chemically synthesized
acttgatactaccacgggagtg

SEQ ID NO: 1349551 - DNA, 22 bp, Artificial Sequence
  chemically synthesized
ggagagattacactcccgtggt

SEQ ID NO: 1349552 - DNA, 22 bp, Artificial Sequence
  chemically synthesized
cactcccgtggtagtatcaagt

SEQ ID NO: 1349553 - DNA, 22 bp, Artificial Sequence
  chemically synthesized
ccgtggtagtatcaagtaagat

SEQ ID NO: 1349554 - DNA, 22 bp, Artificial Sequence
  chemically synthesized
aatgcaggataagatcttactt

SEQ ID NO: 1349555 - DNA, 22 bp, Artificial Sequence
  chemically synthesized
atgcgttaaatgcaggataaga

SEQ ID NO: 1349556 - DNA, 22 bp, Artificial Sequence
  chemically synthesized
ctaatgcgttaaatgcaggata

SEQ ID NO: 1349557 - DNA, 22 bp, Artificial Sequence
  chemically synthesized
ctcctaatgcgttaaatgcagg

SEQ ID NO: 1349558 - DNA, 22 bp, Artificial Sequence
  chemically synthesized
cctcctaatgcgttaaatgcag

SEQ ID NO: 1349559 - DNA, 22 bp, Artificial Sequence
  chemically synthesized
atcctgcatttaacgcattagg

SEQ ID NO: 1349560 - DNA, 22 bp, Artificial Sequence
  chemically synthesized
tcctgcatttaacgcattagga

SEQ ID NO: 1349561 - DNA, 22 bp, Artificial Sequence
  chemically synthesized
gtgaaatacttcctcctaatgc

SEQ ID NO: 1349562 - DNA, 22 bp, Artificial Sequence
  chemically synthesized
ctggtgaaatacttcctcctaa

SEQ ID NO: 1349563 - DNA, 22 bp, Artificial Sequence
  chemically synthesized
catttaacgcattaggaggaag

SEQ ID NO: 1349564 - DNA, 22 bp, Artificial Sequence
  chemically synthesized
gctactggtgaaatacttcctc

SEQ ID NO: 1349565 - DNA, 22 bp, Artificial Sequence
  chemically synthesized
agctactggtgaaatacttcct

SEQ ID NO: 1349566 - DNA, 22 bp, Artificial Sequence
  chemically synthesized
aacgcattaggaggaagtattt

SEQ ID NO: 1349567 - DNA, 22 bp, Artificial Sequence
  chemically synthesized
tagctactggtgaaatacttcc

SEQ ID NO: 1349568 - DNA, 22 bp, Artificial Sequence
  chemically synthesized
acgcattaggaggaagtatttc

SEQ ID NO: 1349569 - DNA, 22 bp, Artificial Sequence
  chemically synthesized
ttagctactggtgaaatacttc

SEQ ID NO: 1349570 - DNA, 22 bp, Artificial Sequence
  chemically synthesized
ggaggaagtatttcaccagtag

SEQ ID NO: 1349571 - DNA, 22 bp, Artificial Sequence
  chemically synthesized
ataatgtttttagctactggtg

SEQ ID NO: 1349572 - DNA, 22 bp, Artificial Sequence
  chemically synthesized
gactaataatgtttttagctac

SEQ ID NO: 1349573 - DNA, 22 bp, Artificial Sequence
  chemically synthesized
atgttagactaataatgttttt

SEQ ID NO: 1349574 - DNA, 22 bp, Artificial Sequence
  chemically synthesized
caccagtagctaaaaacattat

SEQ ID NO: 1349575 - DNA, 22 bp, Artificial Sequence
  chemically synthesized
accagtagctaaaaacattatt

SEQ ID NO: 1349576 - DNA, 22 bp, Artificial Sequence
  chemically synthesized
aaaacattattagtctaacatt

SEQ ID NO: 1349577 - DNA, 22 bp, Artificial Sequence
  chemically synthesized
atagaaacagttaatgttagac

SEQ ID NO: 1349578 - DNA, 22 bp, Artificial Sequence
  chemically synthesized
gatagaaacagttaatgttaga

SEQ ID NO: 1349579 - DNA, 22 bp, Artificial Sequence
  chemically synthesized
tgatagaaacagttaatgttag

SEQ ID NO: 1349580 - DNA, 22 bp, Artificial Sequence
  chemically synthesized
ttagtctaacattaactgtttc

SEQ ID NO: 1349581 - DNA, 22 bp, Artificial Sequence
  chemically synthesized
aatccctttgatagaaacagtt

SEQ ID NO: 1349582 - DNA, 22 bp, Artificial Sequence
  chemically synthesized
gtctaacattaactgtttctat

SEQ ID NO: 1349583 - DNA, 22 bp, Artificial Sequence
  chemically synthesized
acattaactgtttctatcaaag

SEQ ID NO: 1349584 - DNA, 22 bp, Artificial Sequence
  chemically synthesized
actgtttctatcaaagggattt

SEQ ID NO: 1349585 - DNA, 22 bp, Artificial Sequence
  chemically synthesized
atgtcatgtaattaaatccctt

SEQ ID NO: 1349586 - DNA, 22 bp, Artificial Sequence
  chemically synthesized
aatgtcatgtaattaaatccct

SEQ ID NO: 1349587 - DNA, 22 bp, Artificial Sequence
  chemically synthesized
tttctatcaaagggatttaatt

SEQ ID NO: 1349588 - DNA, 22 bp, Artificial Sequence
  chemically synthesized
tttaatgtcatgtaattaaatc

SEQ ID NO: 1349589 - DNA, 22 bp, Artificial Sequence
  chemically synthesized
ctatcaaagggatttaattaca

SEQ ID NO: 1349590 - DNA, 22 bp, Artificial Sequence
  chemically synthesized
tatcaaagggatttaattacat

SEQ ID NO: 1349591 - DNA, 22 bp, Artificial Sequence
  chemically synthesized
tcaaagggatttaattacatga

SEQ ID NO: 1349592 - DNA, 22 bp, Artificial Sequence
  chemically synthesized
aattacatgacattaaatagta

SEQ ID NO: 1349593 - DNA, 22 bp, Artificial Sequence
  chemically synthesized
attacatgacattaaatagtac

SEQ ID NO: 1349594 - DNA, 22 bp, Artificial Sequence
  chemically synthesized
tatacaagtgcatgtactattt

SEQ ID NO: 1349595 - DNA, 22 bp, Artificial Sequence
  chemically synthesized
gtatacaagtgcatgtactatt

SEQ ID NO: 1349596 - DNA, 22 bp, Artificial Sequence
  chemically synthesized
catgacattaaatagtacatgc

SEQ ID NO: 1349597 - DNA, 22 bp, Artificial Sequence
  chemically synthesized
tttgtatacaagtgcatgtact

SEQ ID NO: 1349598 - DNA, 22 bp, Artificial Sequence
  chemically synthesized
aatagtacatgcacttgtatac

SEQ ID NO: 1349599 - DNA, 22 bp, Artificial Sequence
  chemically synthesized
agaaaaaaattatttgtataca

SEQ ID NO: 1349600 - DNA, 22 bp, Artificial Sequence
  chemically synthesized
ttgagaaaaaaattatttgtat

SEQ ID NO: 1349601 - DNA, 22 bp, Artificial Sequence
  chemically synthesized
gttgagaaaaaaattatttgta

SEQ ID NO: 1349602 - DNA, 22 bp, Artificial Sequence
  chemically synthesized
tgtttgttgagaaaaaaattat

SEQ ID NO: 1349603 - DNA, 22 bp, Artificial Sequence
  chemically synthesized
tgtgtttgttgagaaaaaaatt

SEQ ID NO: 1349604 - DNA, 22 bp, Artificial Sequence
  chemically synthesized
ctgtgtttgttgagaaaaaaat

SEQ ID NO: 1349605 - DNA, 22 bp, Artificial Sequence
  chemically synthesized
gtatacaaataatttttttctc

SEQ ID NO: 1349606 - DNA, 22 bp, Artificial Sequence
  chemically synthesized
tatacaaataatttttttctca

SEQ ID NO: 1349607 - DNA, 22 bp, Artificial Sequence
  chemically synthesized
tttctgtgtttgttgagaaaaa

SEQ ID NO: 1349608 - DNA, 22 bp, Artificial Sequence
  chemically synthesized
ttatttctgtgtttgttgagaa

SEQ ID NO: 1349609 - DNA, 22 bp, Artificial Sequence
  chemically synthesized
attatttctgtgtttgttgaga

SEQ ID NO: 1349610 - DNA, 22 bp, Artificial Sequence
  chemically synthesized
tattatttctgtgtttgttgag

SEQ ID NO: 1349611 - DNA, 22 bp, Artificial Sequence
  chemically synthesized
ttttattatttctgtgtttgtt

SEQ ID NO: 1349612 - DNA, 22 bp, Artificial Sequence
  chemically synthesized
tattttattatttctgtgtttg

SEQ ID NO: 1349613 - DNA, 22 bp, Artificial Sequence
  chemically synthesized
tctattttattatttctgtgtt

SEQ ID NO: 1349614 - DNA, 22 bp, Artificial Sequence
  chemically synthesized
ttttctcaacaaacacagaaat

SEQ ID NO: 1349615 - DNA, 22 bp, Artificial Sequence
  chemically synthesized
ctctattttattatttctgtgt

SEQ ID NO: 1349616 - DNA, 22 bp, Artificial Sequence
  chemically synthesized
tttctcaacaaacacagaaata

SEQ ID NO: 1349617 - DNA, 22 bp, Artificial Sequence
  chemically synthesized
tctctattttattatttctgtg

SEQ ID NO: 1349618 - DNA, 22 bp, Artificial Sequence
  chemically synthesized
ttctcaacaaacacagaaataa

SEQ ID NO: 1349619 - DNA, 22 bp, Artificial Sequence
  chemically synthesized
ttctctattttattatttctgt

SEQ ID NO: 1349620 - DNA, 22 bp, Artificial Sequence
  chemically synthesized
tctcaacaaacacagaaataat

SEQ ID NO: 1349621 - DNA, 22 bp, Artificial Sequence
  chemically synthesized
ctcaacaaacacagaaataata

SEQ ID NO: 1349622 - DNA, 22 bp, Artificial Sequence
  chemically synthesized
tcaacaaacacagaaataataa

SEQ ID NO: 1349623 - DNA, 22 bp, Artificial Sequence
  chemically synthesized
aacaaacacagaaataataaaa

SEQ ID NO: 1349624 - DNA, 22 bp, Artificial Sequence
  chemically synthesized
gtcttttctctattttattatt

SEQ ID NO: 1349625 - DNA, 22 bp, Artificial Sequence
  chemically synthesized
tcacctagtcttttctctattt

SEQ ID NO: 1349626 - DNA, 22 bp, Artificial Sequence
  chemically synthesized
aatatatgtgatctgtcaccta

SEQ ID NO: 1349627 - DNA, 22 bp, Artificial Sequence
  chemically synthesized
tggcaagtatctcaatatatgt

SEQ ID NO: 1349628 - DNA, 22 bp, Artificial Sequence
  chemically synthesized
ggtgacagatcacatatattga

SEQ ID NO: 1349629 - DNA, 22 bp, Artificial Sequence
  chemically synthesized
atggcaagtatctcaatatatg

SEQ ID NO: 1349630 - DNA, 22 bp, Artificial Sequence
  chemically synthesized
accttatggcaagtatctcaat

SEQ ID NO: 1349631 - DNA, 22 bp, Artificial Sequence
  chemically synthesized
atcagtctcaccttatggcaag

SEQ ID NO: 1349632 - DNA, 22 bp, Artificial Sequence
  chemically synthesized
agatacttgccataaggtgaga

SEQ ID NO: 1349633 - DNA, 22 bp, Artificial Sequence
  chemically synthesized
aagaaggatgttgatcagtctc

SEQ ID NO: 1349634 - DNA, 22 bp, Artificial Sequence
  chemically synthesized
gaagaaggatgttgatcagtct

SEQ ID NO: 1349635 - DNA, 22 bp, Artificial Sequence
  chemically synthesized
gccataaggtgagactgatcaa

SEQ ID NO: 1349636 - DNA, 22 bp, Artificial Sequence
  chemically synthesized
ccataaggtgagactgatcaac

SEQ ID NO: 1349637 - DNA, 22 bp, Artificial Sequence
  chemically synthesized
tatccttgaagaaggatgttga

SEQ ID NO: 1349638 - DNA, 22 bp, Artificial Sequence
  chemically synthesized
atatccttgaagaaggatgttg

SEQ ID NO: 1349639 - DNA, 22 bp, Artificial Sequence
  chemically synthesized
tatatccttgaagaaggatgtt

SEQ ID NO: 1349640 - DNA, 22 bp, Artificial Sequence
  chemically synthesized
ttatatccttgaagaaggatgt

SEQ ID NO: 1349641 - DNA, 22 bp, Artificial Sequence
  chemically synthesized
aatttttatatccttgaagaag

SEQ ID NO: 1349642 - DNA, 22 bp, Artificial Sequence
  chemically synthesized
atcaacatccttcttcaaggat

SEQ ID NO: 1349643 - DNA, 22 bp, Artificial Sequence
  chemically synthesized
agtaaattaaatttttatatcc

SEQ ID NO: 1349644 - DNA, 22 bp, Artificial Sequence
  chemically synthesized
taagtaaattaaatttttatat

SEQ ID NO: 1349645 - DNA, 22 bp, Artificial Sequence
  chemically synthesized
cttcaaggatataaaaatttaa

SEQ ID NO: 1349646 - DNA, 22 bp, Artificial Sequence
  chemically synthesized
ttcaaggatataaaaatttaat

SEQ ID NO: 1349647 - DNA, 22 bp, Artificial Sequence
  chemically synthesized
caaggatataaaaatttaattt

SEQ ID NO: 1349648 - DNA, 22 bp, Artificial Sequence
  chemically synthesized
aaggatataaaaatttaattta

SEQ ID NO: 1349649 - DNA, 22 bp, Artificial Sequence
  chemically synthesized
aaaccccctctaagtaaattaa

SEQ ID NO: 1349650 - DNA, 22 bp, Artificial Sequence
  chemically synthesized
tgaaaccccctctaagtaaatt

SEQ ID NO: 1349651 - DNA, 22 bp, Artificial Sequence
  chemically synthesized
ctgaaaccccctctaagtaaat

SEQ ID NO: 1349652 - DNA, 22 bp, Artificial Sequence
  chemically synthesized
gtaatttctgaaaccccctcta

SEQ ID NO: 1349653 - DNA, 22 bp, Artificial Sequence
  chemically synthesized
aatttacttagagggggtttca

SEQ ID NO: 1349654 - DNA, 22 bp, Artificial Sequence
  chemically synthesized
atttacttagagggggtttcag

SEQ ID NO: 1349655 - DNA, 22 bp, Artificial Sequence
  chemically synthesized
aattagtaatttctgaaacccc

SEQ ID NO: 1349656 - DNA, 22 bp, Artificial Sequence
  chemically synthesized
caattagtaatttctgaaaccc

SEQ ID NO: 1349657 - DNA, 22 bp, Artificial Sequence
  chemically synthesized
tcaattagtaatttctgaaacc

SEQ ID NO: 1349658 - DNA, 22 bp, Artificial Sequence
  chemically synthesized
acttagagggggtttcagaaat

SEQ ID NO: 1349659 - DNA, 22 bp, Artificial Sequence
  chemically synthesized
cttagagggggtttcagaaatt

SEQ ID NO: 1349660 - DNA, 22 bp, Artificial Sequence
  chemically synthesized
agagggggtttcagaaattact

SEQ ID NO: 1349661 - DNA, 22 bp, Artificial Sequence
  chemically synthesized
gagggggtttcagaaattacta

SEQ ID NO: 1349662 - DNA, 22 bp, Artificial Sequence
  chemically synthesized
agtaagatctttcaattagtaa

SEQ ID NO: 1349663 - DNA, 22 bp, Artificial Sequence
  chemically synthesized
ttaagtaagatctttcaattag

SEQ ID NO: 1349664 - DNA, 22 bp, Artificial Sequence
  chemically synthesized
gttaagtaagatctttcaatta

SEQ ID NO: 1349665 - DNA, 22 bp, Artificial Sequence
  chemically synthesized
cagaaattactaattgaaagat

SEQ ID NO: 1349666 - DNA, 22 bp, Artificial Sequence
  chemically synthesized
agaaattactaattgaaagatc

SEQ ID NO: 1349667 - DNA, 22 bp, Artificial Sequence
  chemically synthesized
ctaattgaaagatcttacttaa

SEQ ID NO: 1349668 - DNA, 22 bp, Artificial Sequence
  chemically synthesized
attgaaagatcttacttaacaa

SEQ ID NO: 1349669 - DNA, 22 bp, Artificial Sequence
  chemically synthesized
atgtaaaaaaaatttgttaagt

SEQ ID NO: 1349670 - DNA, 22 bp, Artificial Sequence
  chemically synthesized
taatgtaaaaaaaatttgttaa

SEQ ID NO: 1349671 - DNA, 22 bp, Artificial Sequence
  chemically synthesized
aaagatcttacttaacaaattt

SEQ ID NO: 1349672 - DNA, 22 bp, Artificial Sequence
  chemically synthesized
ctaatgtaaaaaaaatttgtta

SEQ ID NO: 1349673 - DNA, 22 bp, Artificial Sequence
  chemically synthesized
tctaatgtaaaaaaaatttgtt

SEQ ID NO: 1349674 - DNA, 22 bp, Artificial Sequence
  chemically synthesized
ttctaatgtaaaaaaaatttgt

SEQ ID NO: 1349675 - DNA, 22 bp, Artificial Sequence
  chemically synthesized
tttctaatgtaaaaaaaatttg

SEQ ID NO: 1349676 - DNA, 22 bp, Artificial Sequence
  chemically synthesized
attttttctaatgtaaaaaaaa

SEQ ID NO: 1349677 - DNA, 22 bp, Artificial Sequence
  chemically synthesized
acttaacaaattttttttacat

SEQ ID NO: 1349678 - DNA, 22 bp, Artificial Sequence
  chemically synthesized
tgattttttctaatgtaaaaaa

SEQ ID NO: 1349679 - DNA, 22 bp, Artificial Sequence
  chemically synthesized
cttaacaaattttttttacatt

SEQ ID NO: 1349680 - DNA, 22 bp, Artificial Sequence
  chemically synthesized
aacaaattttttttacattaga

SEQ ID NO: 1349681 - DNA, 22 bp, Artificial Sequence
  chemically synthesized
acaaattttttttacattagaa

SEQ ID NO: 1349682 - DNA, 22 bp, Artificial Sequence
  chemically synthesized
ccaagttctgattttttctaat

SEQ ID NO: 1349683 - DNA, 22 bp, Artificial Sequence
  chemically synthesized
accaagttctgattttttctaa

SEQ ID NO: 1349684 - DNA, 22 bp, Artificial Sequence
  chemically synthesized
tttttacattagaaaaaatcag

SEQ ID NO: 1349685 - DNA, 22 bp, Artificial Sequence
  chemically synthesized
ttttacattagaaaaaatcaga

SEQ ID NO: 1349686 - DNA, 22 bp, Artificial Sequence
  chemically synthesized
tttacattagaaaaaatcagaa

SEQ ID NO: 1349687 - DNA, 22 bp, Artificial Sequence
  chemically synthesized
ttacattagaaaaaatcagaac

SEQ ID NO: 1349688 - DNA, 22 bp, Artificial Sequence
  chemically synthesized
tacattagaaaaaatcagaact

SEQ ID NO: 1349689 - DNA, 22 bp, Artificial Sequence
  chemically synthesized
acattagaaaaaatcagaactt

SEQ ID NO: 1349690 - DNA, 22 bp, Artificial Sequence
  chemically synthesized
cattagaaaaaatcagaacttg

SEQ ID NO: 1349691 - DNA, 22 bp, Artificial Sequence
  chemically synthesized
gaaaaaatcagaacttggtaaa

SEQ ID NO: 1349692 - DNA, 22 bp, Artificial Sequence
  chemically synthesized
atagtgacaagaggatttacca

SEQ ID NO: 1349693 - DNA, 22 bp, Artificial Sequence
  chemically synthesized
ctaatagtgacaagaggattta

SEQ ID NO: 1349694 - DNA, 22 bp, Artificial Sequence
  chemically synthesized
actaatagtgacaagaggattt

SEQ ID NO: 1349695 - DNA, 22 bp, Artificial Sequence
  chemically synthesized
tactaatagtgacaagaggatt

SEQ ID NO: 1349696 - DNA, 22 bp, Artificial Sequence
  chemically synthesized
ggtaaatcctcttgtcactatt

SEQ ID NO: 1349697 - DNA, 22 bp, Artificial Sequence
  chemically synthesized
gtaaatcctcttgtcactatta

SEQ ID NO: 1349698 - DNA, 22 bp, Artificial Sequence
  chemically synthesized
acatgattttactaatagtgac

SEQ ID NO: 1349699 - DNA, 22 bp, Artificial Sequence
  chemically synthesized
attaacatgattttactaatag

SEQ ID NO: 1349700 - DNA, 22 bp, Artificial Sequence
  chemically synthesized
gactaattaacatgattttact

SEQ ID NO: 1349701 - DNA, 22 bp, Artificial Sequence
  chemically synthesized
ttgtcactattagtaaaatcat

SEQ ID NO: 1349702 - DNA, 22 bp, Artificial Sequence
  chemically synthesized
ggactaattaacatgattttac

SEQ ID NO: 1349703 - DNA, 22 bp, Artificial Sequence
  chemically synthesized
tggactaattaacatgatttta

SEQ ID NO: 1349704 - DNA, 22 bp, Artificial Sequence
  chemically synthesized
gtcactattagtaaaatcatgt

SEQ ID NO: 1349705 - DNA, 22 bp, Artificial Sequence
  chemically synthesized
tcactattagtaaaatcatgtt

SEQ ID NO: 1349706 - DNA, 22 bp, Artificial Sequence
  chemically synthesized
ttagtaaaatcatgttaattag

SEQ ID NO: 1349707 - DNA, 22 bp, Artificial Sequence
  chemically synthesized
gtaaaatcatgttaattagtcc

SEQ ID NO: 1349708 - DNA, 22 bp, Artificial Sequence
  chemically synthesized
aaataaagttttggactaatta

SEQ ID NO: 1349709 - DNA, 22 bp, Artificial Sequence
  chemically synthesized
attagtccaaaactttatttta

SEQ ID NO: 1349710 - DNA, 22 bp, Artificial Sequence
  chemically synthesized
gtccaaaactttattttaatac

SEQ ID NO: 1349711 - DNA, 22 bp, Artificial Sequence
  chemically synthesized
aagtataggaaaagtatagtgt

SEQ ID NO: 1349712 - DNA, 22 bp, Artificial Sequence
  chemically synthesized
tattttaatacactatactttt

SEQ ID NO: 1349713 - DNA, 22 bp, Artificial Sequence
  chemically synthesized
attttaatacactatacttttc

SEQ ID NO: 1349714 - DNA, 22 bp, Artificial Sequence
  chemically synthesized
actgaagtataggaaaagtata

SEQ ID NO: 1349715 - DNA, 22 bp, Artificial Sequence
  chemically synthesized
ttttaatacactatacttttcc

SEQ ID NO: 1349716 - DNA, 22 bp, Artificial Sequence
  chemically synthesized
ttgactgaagtataggaaaagt

SEQ ID NO: 1349717 - DNA, 22 bp, Artificial Sequence
  chemically synthesized
taatacactatacttttcctat

SEQ ID NO: 1349718 - DNA, 22 bp, Artificial Sequence
  chemically synthesized
aatacactatacttttcctata

SEQ ID NO: 1349719 - DNA, 22 bp, Artificial Sequence
  chemically synthesized
atacactatacttttcctatac

SEQ ID NO: 1349720 - DNA, 22 bp, Artificial Sequence
  chemically synthesized
agttattgactgaagtatagga

SEQ ID NO: 1349721 - DNA, 22 bp, Artificial Sequence
  chemically synthesized
tacttttcctatacttcagtca

SEQ ID NO: 1349722 - DNA, 22 bp, Artificial Sequence
  chemically synthesized
ttcctatacttcagtcaataac

SEQ ID NO: 1349723 - DNA, 22 bp, Artificial Sequence
  chemically synthesized
tcctatacttcagtcaataact

SEQ ID NO: 1349724 - DNA, 22 bp, Artificial Sequence
  chemically synthesized
cctatacttcagtcaataactt

SEQ ID NO: 1349725 - DNA, 22 bp, Artificial Sequence
  chemically synthesized
ctatacttcagtcaataactta

SEQ ID NO: 1349726 - DNA, 22 bp, Artificial Sequence
  chemically synthesized
tacttcagtcaataacttagtt

SEQ ID NO: 1349727 - DNA, 22 bp, Artificial Sequence
  chemically synthesized
tagaaaaccacaaactaagtta

SEQ ID NO: 1349728 - DNA, 22 bp, Artificial Sequence
  chemically synthesized
cagtcaataacttagtttgtgg

SEQ ID NO: 1349729 - DNA, 22 bp, Artificial Sequence
  chemically synthesized
aattatagaaaaccacaaacta

SEQ ID NO: 1349730 - DNA, 22 bp, Artificial Sequence
  chemically synthesized
agtcaataacttagtttgtggt

SEQ ID NO: 1349731 - DNA, 22 bp, Artificial Sequence
  chemically synthesized
gtgattgaattatagaaaacca

SEQ ID NO: 1349732 - DNA, 22 bp, Artificial Sequence
  chemically synthesized
agtgattgaattatagaaaacc

SEQ ID NO: 1349733 - DNA, 22 bp, Artificial Sequence
  chemically synthesized
agtttgtggttttctataattc

SEQ ID NO: 1349734 - DNA, 22 bp, Artificial Sequence
  chemically synthesized
gtttgtggttttctataattca

SEQ ID NO: 1349735 - DNA, 22 bp, Artificial Sequence
  chemically synthesized
aataaacttagtgattgaatta

SEQ ID NO: 1349736 - DNA, 22 bp, Artificial Sequence
  chemically synthesized
gtggttttctataattcaatca

SEQ ID NO: 1349737 - DNA, 22 bp, Artificial Sequence
  chemically synthesized
tggttttctataattcaatcac

SEQ ID NO: 1349738 - DNA, 22 bp, Artificial Sequence
  chemically synthesized
taaataaacttagtgattgaat

SEQ ID NO: 1349739 - DNA, 22 bp, Artificial Sequence
  chemically synthesized
tctaaataaacttagtgattga

SEQ ID NO: 1349740 - DNA, 22 bp, Artificial Sequence
  chemically synthesized
ctctaaataaacttagtgattg

SEQ ID NO: 1349741 - DNA, 22 bp, Artificial Sequence
  chemically synthesized
tctctaaataaacttagtgatt

SEQ ID NO: 1349742 - DNA, 22 bp, Artificial Sequence
  chemically synthesized
ttctctaaataaacttagtgat

SEQ ID NO: 1349743 - DNA, 22 bp, Artificial Sequence
  chemically synthesized
tctataattcaatcactaagtt

SEQ ID NO: 1349744 - DNA, 22 bp, Artificial Sequence
  chemically synthesized
ctataattcaatcactaagttt

SEQ ID NO: 1349745 - DNA, 22 bp, Artificial Sequence
  chemically synthesized
tataattcaatcactaagttta

SEQ ID NO: 1349746 - DNA, 22 bp, Artificial Sequence
  chemically synthesized
taattcaatcactaagtttatt

SEQ ID NO: 1349747 - DNA, 22 bp, Artificial Sequence
  chemically synthesized
aggatatttttctctaaataaa

SEQ ID NO: 1349748 - DNA, 22 bp, Artificial Sequence
  chemically synthesized
aatcactaagtttatttagaga

SEQ ID NO: 1349749 - DNA, 22 bp, Artificial Sequence
  chemically synthesized
caagttaaggatatttttctct

SEQ ID NO: 1349750 - DNA, 22 bp, Artificial Sequence
  chemically synthesized
agtttatttagagaaaaatatc

SEQ ID NO: 1349751 - DNA, 22 bp, Artificial Sequence
  chemically synthesized
gactccaagttaaggatatttt

SEQ ID NO: 1349752 - DNA, 22 bp, Artificial Sequence
  chemically synthesized
atttagagaaaaatatccttaa

SEQ ID NO: 1349753 - DNA, 22 bp, Artificial Sequence
  chemically synthesized
tttagagaaaaatatccttaac

SEQ ID NO: 1349754 - DNA, 22 bp, Artificial Sequence
  chemically synthesized
agagaaaaatatccttaacttg

SEQ ID NO: 1349755 - DNA, 22 bp, Artificial Sequence
  chemically synthesized
gagaaaaatatccttaacttgg

SEQ ID NO: 1349756 - DNA, 22 bp, Artificial Sequence
  chemically synthesized
aaagaccactggactccaagtt

SEQ ID NO: 1349757 - DNA, 22 bp, Artificial Sequence
  chemically synthesized
ggagattcaaagaccactggac

SEQ ID NO: 1349758 - DNA, 22 bp, Artificial Sequence
  chemically synthesized
gggagattcaaagaccactgga

SEQ ID NO: 1349759 - DNA, 22 bp, Artificial Sequence
  chemically synthesized
tgggagattcaaagaccactgg

SEQ ID NO: 1349760 - DNA, 22 bp, Artificial Sequence
  chemically synthesized
aacttggagtccagtggtcttt

SEQ ID NO: 1349761 - DNA, 22 bp, Artificial Sequence
  chemically synthesized
acttggagtccagtggtctttg

SEQ ID NO: 1349762 - DNA, 22 bp, Artificial Sequence
  chemically synthesized
ggagtccagtggtctttgaatc

SEQ ID NO: 1349763 - DNA, 22 bp, Artificial Sequence
  chemically synthesized
gagtccagtggtctttgaatct

SEQ ID NO: 1349764 - DNA, 22 bp, Artificial Sequence
  chemically synthesized
catatattttgggagattcaaa

SEQ ID NO: 1349765 - DNA, 22 bp, Artificial Sequence
  chemically synthesized
tgaatctcccaaaatatatgca

SEQ ID NO: 1349766 - DNA, 22 bp, Artificial Sequence
  chemically synthesized
gaatctcccaaaatatatgcaa

SEQ ID NO: 1349767 - DNA, 22 bp, Artificial Sequence
  chemically synthesized
aatctcccaaaatatatgcaat

SEQ ID NO: 1349768 - DNA, 22 bp, Artificial Sequence
  chemically synthesized
ccaaaatatatgcaatatttta

SEQ ID NO: 1349769 - DNA, 22 bp, Artificial Sequence
  chemically synthesized
atgatgtacacacatggacata

SEQ ID NO: 1349770 - DNA, 22 bp, Artificial Sequence
  chemically synthesized
tactcatgatgtacacacatgg

SEQ ID NO: 1349771 - DNA, 22 bp, Artificial Sequence
  chemically synthesized
tatgtccatgtgtgtacatcat

SEQ ID NO: 1349772 - DNA, 22 bp, Artificial Sequence
  chemically synthesized
atgtccatgtgtgtacatcatg

SEQ ID NO: 1349773 - DNA, 22 bp, Artificial Sequence
  chemically synthesized
tgtccatgtgtgtacatcatga

SEQ ID NO: 1349774 - DNA, 22 bp, Artificial Sequence
  chemically synthesized
aaaatcaaatgtaaacacagaa

SEQ ID NO: 1349775 - DNA, 22 bp, Artificial Sequence
  chemically synthesized
aaaaatcaaatgtaaacacaga

SEQ ID NO: 1349776 - DNA, 22 bp, Artificial Sequence
  chemically synthesized
taaaaatcaaatgtaaacacag

SEQ ID NO: 1349777 - DNA, 22 bp, Artificial Sequence
  chemically synthesized
ttaaaaatcaaatgtaaacaca

SEQ ID NO: 1349778 - DNA, 22 bp, Artificial Sequence
  chemically synthesized
tttaaaaatcaaatgtaaacac

SEQ ID NO: 1349779 - DNA, 22 bp, Artificial Sequence
  chemically synthesized
tgtgtttacatttgatttttaa

SEQ ID NO: 1349780 - DNA, 22 bp, Artificial Sequence
  chemically synthesized
tgtttacatttgatttttaaaa

SEQ ID NO: 1349781 - DNA, 22 bp, Artificial Sequence
  chemically synthesized
acatttgatttttaaaaagatg

SEQ ID NO: 1349782 - DNA, 22 bp, Artificial Sequence
  chemically synthesized
catttgatttttaaaaagatgc

SEQ ID NO: 1349783 - DNA, 22 bp, Artificial Sequence
  chemically synthesized
gagggtaaacatgcatcttttt

SEQ ID NO: 1349784 - DNA, 22 bp, Artificial Sequence
  chemically synthesized
gttggagggtaaacatgcatct

SEQ ID NO: 1349785 - DNA, 22 bp, Artificial Sequence
  chemically synthesized
gatttttaaaaagatgcatgtt

SEQ ID NO: 1349786 - DNA, 22 bp, Artificial Sequence
  chemically synthesized
agttggagggtaaacatgcatc

SEQ ID NO: 1349787 - DNA, 22 bp, Artificial Sequence
  chemically synthesized
atttttaaaaagatgcatgttt

SEQ ID NO: 1349788 - DNA, 22 bp, Artificial Sequence
  chemically synthesized
tagttggagggtaaacatgcat

SEQ ID NO: 1349789 - DNA, 22 bp, Artificial Sequence
  chemically synthesized
ttaaaaagatgcatgtttaccc

SEQ ID NO: 1349790 - DNA, 22 bp, Artificial Sequence
  chemically synthesized
taaaaagatgcatgtttaccct

SEQ ID NO: 1349791 - DNA, 22 bp, Artificial Sequence
  chemically synthesized
aaaaagatgcatgtttaccctc

SEQ ID NO: 1349792 - DNA, 22 bp, Artificial Sequence
  chemically synthesized
aaaagatgcatgtttaccctcc

SEQ ID NO: 1349793 - DNA, 22 bp, Artificial Sequence
  chemically synthesized
atgattttagttggagggtaaa

SEQ ID NO: 1349794 - DNA, 22 bp, Artificial Sequence
  chemically synthesized
aaacaataaattcatgatttta

SEQ ID NO: 1349795 - DNA, 22 bp, Artificial Sequence
  chemically synthesized
aaaacaataaattcatgatttt

SEQ ID NO: 1349796 - DNA, 22 bp, Artificial Sequence
  chemically synthesized
accctccaactaaaatcatgaa

SEQ ID NO: 1349797 - DNA, 22 bp, Artificial Sequence
  chemically synthesized
ccctccaactaaaatcatgaat

SEQ ID NO: 1349798 - DNA, 22 bp, Artificial Sequence
  chemically synthesized
aatttaaaacaataaattcatg

SEQ ID NO: 1349799 - DNA, 22 bp, Artificial Sequence
  chemically synthesized
aaatttaaaacaataaattcat

SEQ ID NO: 1349800 - DNA, 22 bp, Artificial Sequence
  chemically synthesized
caactaaaatcatgaatttatt

SEQ ID NO: 1349801 - DNA, 22 bp, Artificial Sequence
  chemically synthesized
taaatttaaaacaataaattca

SEQ ID NO: 1349802 - DNA, 22 bp, Artificial Sequence
  chemically synthesized
ttaaatttaaaacaataaattc

SEQ ID NO: 1349803 - DNA, 22 bp, Artificial Sequence
  chemically synthesized
aaatcatgaatttattgtttta

SEQ ID NO: 1349804 - DNA, 22 bp, Artificial Sequence
  chemically synthesized
gccaacttttaaatttaaaaca

SEQ ID NO: 1349805 - DNA, 22 bp, Artificial Sequence
  chemically synthesized
agccaacttttaaatttaaaac

SEQ ID NO: 1349806 - DNA, 22 bp, Artificial Sequence
  chemically synthesized
attgttttaaatttaaaagttg

SEQ ID NO: 1349807 - DNA, 22 bp, Artificial Sequence
  chemically synthesized
ttgttttaaatttaaaagttgg

SEQ ID NO: 1349808 - DNA, 22 bp, Artificial Sequence
  chemically synthesized
ttttaaatttaaaagttggcta

SEQ ID NO: 1349809 - DNA, 22 bp, Artificial Sequence
  chemically synthesized
taaatttaaaagttggctaaat

SEQ ID NO: 1349810 - DNA, 22 bp, Artificial Sequence
  chemically synthesized
aaatttaaaagttggctaaatg

SEQ ID NO: 1349811 - DNA, 22 bp, Artificial Sequence
  chemically synthesized
aatttaaaagttggctaaatgg

SEQ ID NO: 1349812 - DNA, 22 bp, Artificial Sequence
  chemically synthesized
aaaagttggctaaatggctatg

SEQ ID NO: 1349813 - DNA, 22 bp, Artificial Sequence
  chemically synthesized
aaagttggctaaatggctatga

SEQ ID NO: 1349814 - DNA, 22 bp, Artificial Sequence
  chemically synthesized
atgaaaatacataaacatcata

SEQ ID NO: 1349815 - DNA, 22 bp, Artificial Sequence
  chemically synthesized
gatgaaaatacataaacatcat

SEQ ID NO: 1349816 - DNA, 22 bp, Artificial Sequence
  chemically synthesized
gctaaatggctatgatgtttat

SEQ ID NO: 1349817 - DNA, 22 bp, Artificial Sequence
  chemically synthesized
tgatgaaaatacataaacatca

SEQ ID NO: 1349818 - DNA, 22 bp, Artificial Sequence
  chemically synthesized
ttgatgaaaatacataaacatc

SEQ ID NO: 1349819 - DNA, 22 bp, Artificial Sequence
  chemically synthesized
aatggctatgatgtttatgtat

SEQ ID NO: 1349820 - DNA, 22 bp, Artificial Sequence
  chemically synthesized
cccttttgatgaaaatacataa

SEQ ID NO: 1349821 - DNA, 22 bp, Artificial Sequence
  chemically synthesized
tgatgtttatgtattttcatca

SEQ ID NO: 1349822 - DNA, 22 bp, Artificial Sequence
  chemically synthesized
atgtattttcatcaaaagggta

SEQ ID NO: 1349823 - DNA, 22 bp, Artificial Sequence
  chemically synthesized
tgtattttcatcaaaagggtag

SEQ ID NO: 1349824 - DNA, 22 bp, Artificial Sequence
  chemically synthesized
gaaataaaacacaaacaactac

SEQ ID NO: 1349825 - DNA, 22 bp, Artificial Sequence
  chemically synthesized
tcatcaaaagggtagttgtttg

SEQ ID NO: 1349826 - DNA, 22 bp, Artificial Sequence
  chemically synthesized
ggaaataaaacacaaacaacta

SEQ ID NO: 1349827 - DNA, 22 bp, Artificial Sequence
  chemically synthesized
catcaaaagggtagttgtttgt

SEQ ID NO: 1349828 - DNA, 22 bp, Artificial Sequence
  chemically synthesized
atcaaaagggtagttgtttgtg

SEQ ID NO: 1349829 - DNA, 22 bp, Artificial Sequence
  chemically synthesized
tttgtgttttatttccaagtct

SEQ ID NO: 1349830 - DNA, 22 bp, Artificial Sequence
  chemically synthesized
tacatcaagtcatagacttgga

SEQ ID NO: 1349831 - DNA, 22 bp, Artificial Sequence
  chemically synthesized
gtacatcaagtcatagacttgg

SEQ ID NO: 1349832 - DNA, 22 bp, Artificial Sequence
  chemically synthesized
gtgttttatttccaagtctatg

SEQ ID NO: 1349833 - DNA, 22 bp, Artificial Sequence
  chemically synthesized
tgtacatcaagtcatagacttg

SEQ ID NO: 1349834 - DNA, 22 bp, Artificial Sequence
  chemically synthesized
tgttttatttccaagtctatga

SEQ ID NO: 1349835 - DNA, 22 bp, Artificial Sequence
  chemically synthesized
ttgtacatcaagtcatagactt

SEQ ID NO: 1349836 - DNA, 22 bp, Artificial Sequence
  chemically synthesized
tatttccaagtctatgacttga

SEQ ID NO: 1349837 - DNA, 22 bp, Artificial Sequence
  chemically synthesized
atttccaagtctatgacttgat

SEQ ID NO: 1349838 - DNA, 22 bp, Artificial Sequence
  chemically synthesized
tttccaagtctatgacttgatg

SEQ ID NO: 1349839 - DNA, 22 bp, Artificial Sequence
  chemically synthesized
ccaagtctatgacttgatgtac

SEQ ID NO: 1349840 - DNA, 22 bp, Artificial Sequence
  chemically synthesized
caagtctatgacttgatgtaca

SEQ ID NO: 1349841 - DNA, 22 bp, Artificial Sequence
  chemically synthesized
tgacttgatgtacaaaaacctt

SEQ ID NO: 1349842 - DNA, 22 bp, Artificial Sequence
  chemically synthesized
gggtacgatacagtgtaaaggt

SEQ ID NO: 1349843 - DNA, 22 bp, Artificial Sequence
  chemically synthesized
gatgtacaaaaacctttacact

SEQ ID NO: 1349844 - DNA, 22 bp, Artificial Sequence
  chemically synthesized
ggggtacgatacagtgtaaagg

SEQ ID NO: 1349845 - DNA, 22 bp, Artificial Sequence
  chemically synthesized
atgtacaaaaacctttacactg

SEQ ID NO: 1349846 - DNA, 22 bp, Artificial Sequence
  chemically synthesized
tggggtacgatacagtgtaaag

SEQ ID NO: 1349847 - DNA, 22 bp, Artificial Sequence
  chemically synthesized
ttggggtacgatacagtgtaaa

SEQ ID NO: 1349848 - DNA, 22 bp, Artificial Sequence
  chemically synthesized
agtatgtttttggggtacgata

SEQ ID NO: 1349849 - DNA, 22 bp, Artificial Sequence
  chemically synthesized
tacactgtatcgtaccccaaaa

SEQ ID NO: 1349850 - DNA, 22 bp, Artificial Sequence
  chemically synthesized
acactgtatcgtaccccaaaaa

SEQ ID NO: 1349851 - DNA, 22 bp, Artificial Sequence
  chemically synthesized
aatctgagtatgtttttggggt

SEQ ID NO: 1349852 - DNA, 22 bp, Artificial Sequence
  chemically synthesized
cactgtatcgtaccccaaaaac

SEQ ID NO: 1349853 - DNA, 22 bp, Artificial Sequence
  chemically synthesized
gaatctgagtatgtttttgggg

SEQ ID NO: 1349854 - DNA, 22 bp, Artificial Sequence
  chemically synthesized
tgaatctgagtatgtttttggg

SEQ ID NO: 1349855 - DNA, 22 bp, Artificial Sequence
  chemically synthesized
ttgaatctgagtatgtttttgg

SEQ ID NO: 1349856 - DNA, 22 bp, Artificial Sequence
  chemically synthesized
ttttgaatctgagtatgttttt

SEQ ID NO: 1349857 - DNA, 22 bp, Artificial Sequence
  chemically synthesized
tatcgtaccccaaaaacatact

SEQ ID NO: 1349858 - DNA, 22 bp, Artificial Sequence
  chemically synthesized
tcttttgaatctgagtatgttt

SEQ ID NO: 1349859 - DNA, 22 bp, Artificial Sequence
  chemically synthesized
tctcttttgaatctgagtatgt

SEQ ID NO: 1349860 - DNA, 22 bp, Artificial Sequence
  chemically synthesized
ctctctcttttgaatctgagta

SEQ ID NO: 1349861 - DNA, 22 bp, Artificial Sequence
  chemically synthesized
attcctctctcttttgaatctg

SEQ ID NO: 1349862 - DNA, 22 bp, Artificial Sequence
  chemically synthesized
taattcctctctcttttgaatc

SEQ ID NO: 1349863 - DNA, 22 bp, Artificial Sequence
  chemically synthesized
ctaattcctctctcttttgaat

SEQ ID NO: 1349864 - DNA, 22 bp, Artificial Sequence
  chemically synthesized
tctaattcctctctcttttgaa

SEQ ID NO: 1349865 - DNA, 22 bp, Artificial Sequence
  chemically synthesized
ttctaattcctctctcttttga

SEQ ID NO: 1349866 - DNA, 22 bp, Artificial Sequence
  chemically synthesized
tttttctaattcctctctcttt

SEQ ID NO: 1349867 - DNA, 22 bp, Artificial Sequence
  chemically synthesized
attatttttctaattcctctct

SEQ ID NO: 1349868 - DNA, 22 bp, Artificial Sequence
  chemically synthesized
agattcaaaagagagaggaatt

SEQ ID NO: 1349869 - DNA, 22 bp, Artificial Sequence
  chemically synthesized
cattatttttctaattcctctc

SEQ ID NO: 1349870 - DNA, 22 bp, Artificial Sequence
  chemically synthesized
aaaagagagaggaattagaaaa

SEQ ID NO: 1349871 - DNA, 22 bp, Artificial Sequence
  chemically synthesized
aaatgtttcattatttttctaa

SEQ ID NO: 1349872 - DNA, 22 bp, Artificial Sequence
  chemically synthesized
aactgaaatgtttcattatttt

SEQ ID NO: 1349873 - DNA, 22 bp, Artificial Sequence
  chemically synthesized
aaactgaaatgtttcattattt

SEQ ID NO: 1349874 - DNA, 22 bp, Artificial Sequence
  chemically synthesized
taaactgaaatgtttcattatt

SEQ ID NO: 1349875 - DNA, 22 bp, Artificial Sequence
  chemically synthesized
gaaaaataatgaaacatttcag

SEQ ID NO: 1349876 - DNA, 22 bp, Artificial Sequence
  chemically synthesized
agaagacactttaaactgaaat

SEQ ID NO: 1349877 - DNA, 22 bp, Artificial Sequence
  chemically synthesized
ccactgagaagacactttaaac

SEQ ID NO: 1349878 - DNA, 22 bp, Artificial Sequence
  chemically synthesized
aatctgccactgagaagacact

SEQ ID NO: 1349879 - DNA, 22 bp, Artificial Sequence
  chemically synthesized
cagtttaaagtgtcttctcagt

SEQ ID NO: 1349880 - DNA, 22 bp, Artificial Sequence
  chemically synthesized
agtttaaagtgtcttctcagtg

SEQ ID NO: 1349881 - DNA, 22 bp, Artificial Sequence
  chemically synthesized
aaagtgtcttctcagtggcaga

SEQ ID NO: 1349882 - DNA, 22 bp, Artificial Sequence
  chemically synthesized
aagtgtcttctcagtggcagat

SEQ ID NO: 1349883 - DNA, 22 bp, Artificial Sequence
  chemically synthesized
ctcagtggcagattcagtgtat

SEQ ID NO: 1349884 - DNA, 22 bp, Artificial Sequence
  chemically synthesized
tcagtggcagattcagtgtatt

SEQ ID NO: 1349885 - DNA, 22 bp, Artificial Sequence
  chemically synthesized
agtggcagattcagtgtattca

SEQ ID NO: 1349886 - DNA, 22 bp, Artificial Sequence
  chemically synthesized
gaagaagcaaaagtaatgaata

SEQ ID NO: 1349887 - DNA, 22 bp, Artificial Sequence
  chemically synthesized
tagaagaagcaaaagtaatgaa

SEQ ID NO: 1349888 - DNA, 22 bp, Artificial Sequence
  chemically synthesized
atctctagaagaagcaaaagta

SEQ ID NO: 1349889 - DNA, 22 bp, Artificial Sequence
  chemically synthesized
agtgtattcattacttttgctt

SEQ ID NO: 1349890 - DNA, 22 bp, Artificial Sequence
  chemically synthesized
aatctctagaagaagcaaaagt

SEQ ID NO: 1349891 - DNA, 22 bp, Artificial Sequence
  chemically synthesized
taatctctagaagaagcaaaag

SEQ ID NO: 1349892 - DNA, 22 bp, Artificial Sequence
  chemically synthesized
tgcactttaatctctagaagaa

SEQ ID NO: 1349893 - DNA, 22 bp, Artificial Sequence
  chemically synthesized
attacttttgcttcttctagag

SEQ ID NO: 1349894 - DNA, 22 bp, Artificial Sequence
  chemically synthesized
cttttgcttcttctagagatta

SEQ ID NO: 1349895 - DNA, 22 bp, Artificial Sequence
  chemically synthesized
gattatgcactttaatctctag

SEQ ID NO: 1349896 - DNA, 22 bp, Artificial Sequence
  chemically synthesized
ttgcttcttctagagattaaag

SEQ ID NO: 1349897 - DNA, 22 bp, Artificial Sequence
  chemically synthesized
tgcttcttctagagattaaagt

SEQ ID NO: 1349898 - DNA, 22 bp, Artificial Sequence
  chemically synthesized
gcttcttctagagattaaagtg

SEQ ID NO: 1349899 - DNA, 22 bp, Artificial Sequence
  chemically synthesized
cttcttctagagattaaagtgc

SEQ ID NO: 1349900 - DNA, 22 bp, Artificial Sequence
  chemically synthesized
tgagattagattatgcacttta

SEQ ID NO: 1349901 - DNA, 22 bp, Artificial Sequence
  chemically synthesized
cttctagagattaaagtgcata

SEQ ID NO: 1349902 - DNA, 22 bp, Artificial Sequence
  chemically synthesized
atgagattagattatgcacttt

SEQ ID NO: 1349903 - DNA, 22 bp, Artificial Sequence
  chemically synthesized
ttctagagattaaagtgcataa

SEQ ID NO: 1349904 - DNA, 22 bp, Artificial Sequence
  chemically synthesized
ctagagattaaagtgcataatc

SEQ ID NO: 1349905 - DNA, 22 bp, Artificial Sequence
  chemically synthesized
tttatgagattagattatgcac

SEQ ID NO: 1349906 - DNA, 22 bp, Artificial Sequence
  chemically synthesized
tagagattaaagtgcataatct

SEQ ID NO: 1349907 - DNA, 22 bp, Artificial Sequence
  chemically synthesized
gagattaaagtgcataatctaa

SEQ ID NO: 1349908 - DNA, 22 bp, Artificial Sequence
  chemically synthesized
ctgtttatgagattagattatg

SEQ ID NO: 1349909 - DNA, 22 bp, Artificial Sequence
  chemically synthesized
gctactgtttatgagattagat

SEQ ID NO: 1349910 - DNA, 22 bp, Artificial Sequence
  chemically synthesized
aagtgcataatctaatctcata

SEQ ID NO: 1349911 - DNA, 22 bp, Artificial Sequence
  chemically synthesized
agccagtatgaattagctactg

SEQ ID NO: 1349912 - DNA, 22 bp, Artificial Sequence
  chemically synthesized
atctcataaacagtagctaatt

SEQ ID NO: 1349913 - DNA, 22 bp, Artificial Sequence
  chemically synthesized
ttaagccagtatgaattagcta

SEQ ID NO: 1349914 - DNA, 22 bp, Artificial Sequence
  chemically synthesized
tattaagccagtatgaattagc

SEQ ID NO: 1349915 - DNA, 22 bp, Artificial Sequence
  chemically synthesized
ctattaagccagtatgaattag

SEQ ID NO: 1349916 - DNA, 22 bp, Artificial Sequence
  chemically synthesized
ataaacagtagctaattcatac

SEQ ID NO: 1349917 - DNA, 22 bp, Artificial Sequence
  chemically synthesized
atcttctattaagccagtatga

SEQ ID NO: 1349918 - DNA, 22 bp, Artificial Sequence
  chemically synthesized
ccaactgatcttctattaagcc

SEQ ID NO: 1349919 - DNA, 22 bp, Artificial Sequence
  chemically synthesized
attcatactggcttaatagaag

SEQ ID NO: 1349920 - DNA, 22 bp, Artificial Sequence
  chemically synthesized
ttcccaactgatcttctattaa

SEQ ID NO: 1349921 - DNA, 22 bp, Artificial Sequence
  chemically synthesized
ttattcccaactgatcttctat

SEQ ID NO: 1349922 - DNA, 22 bp, Artificial Sequence
  chemically synthesized
atactggcttaatagaagatca

SEQ ID NO: 1349923 - DNA, 22 bp, Artificial Sequence
  chemically synthesized
attattcccaactgatcttcta

SEQ ID NO: 1349924 - DNA, 22 bp, Artificial Sequence
  chemically synthesized
gcttaatagaagatcagttggg

SEQ ID NO: 1349925 - DNA, 22 bp, Artificial Sequence
  chemically synthesized
tcgagcttattattcccaactg

SEQ ID NO: 1349926 - DNA, 22 bp, Artificial Sequence
  chemically synthesized
aatagaagatcagttgggaata

SEQ ID NO: 1349927 - DNA, 22 bp, Artificial Sequence
  chemically synthesized
tatcgagcttattattcccaac

SEQ ID NO: 1349928 - DNA, 22 bp, Artificial Sequence
  chemically synthesized
atagaagatcagttgggaataa

SEQ ID NO: 1349929 - DNA, 22 bp, Artificial Sequence
  chemically synthesized
tcattctatcgagcttattatt

SEQ ID NO: 1349930 - DNA, 22 bp, Artificial Sequence
  chemically synthesized
ggaataataagctcgatagaat

SEQ ID NO: 1349931 - DNA, 22 bp, Artificial Sequence
  chemically synthesized
cagtaataatgttatcattcta

SEQ ID NO: 1349932 - DNA, 22 bp, Artificial Sequence
  chemically synthesized
agaattccagtaataatgttat

SEQ ID NO: 1349933 - DNA, 22 bp, Artificial Sequence
  chemically synthesized
tgagaattccagtaataatgtt

SEQ ID NO: 1349934 - DNA, 22 bp, Artificial Sequence
  chemically synthesized
gatagaatgataacattattac

SEQ ID NO: 1349935 - DNA, 22 bp, Artificial Sequence
  chemically synthesized
ctgagaattccagtaataatgt

SEQ ID NO: 1349936 - DNA, 22 bp, Artificial Sequence
  chemically synthesized
ttctgagaattccagtaataat

SEQ ID NO: 1349937 - DNA, 22 bp, Artificial Sequence
  chemically synthesized
ccaagttcttctgagaattcca

SEQ ID NO: 1349938 - DNA, 22 bp, Artificial Sequence
  chemically synthesized
gattgccaagttcttctgagaa

SEQ ID NO: 1349939 - DNA, 22 bp, Artificial Sequence
  chemically synthesized
ggattgccaagttcttctgaga

SEQ ID NO: 1349940 - DNA, 22 bp, Artificial Sequence
  chemically synthesized
ttactggaattctcagaagaac

SEQ ID NO: 1349941 - DNA, 22 bp, Artificial Sequence
  chemically synthesized
cttggattgccaagttcttctg

SEQ ID NO: 1349942 - DNA, 22 bp, Artificial Sequence
  chemically synthesized
gcttggattgccaagttcttct

SEQ ID NO: 1349943 - DNA, 22 bp, Artificial Sequence
  chemically synthesized
ctggaattctcagaagaacttg

SEQ ID NO: 1349944 - DNA, 22 bp, Artificial Sequence
  chemically synthesized
gaattctcagaagaacttggca

SEQ ID NO: 1349945 - DNA, 22 bp, Artificial Sequence
  chemically synthesized
tccatcttgcttggattgccaa

SEQ ID NO: 1349946 - DNA, 22 bp, Artificial Sequence
  chemically synthesized
atccatcttgcttggattgcca

SEQ ID NO: 1349947 - DNA, 22 bp, Artificial Sequence
  chemically synthesized
tcagaagaacttggcaatccaa

SEQ ID NO: 1349948 - DNA, 22 bp, Artificial Sequence
  chemically synthesized
agaagaacttggcaatccaagc

SEQ ID NO: 1349949 - DNA, 22 bp, Artificial Sequence
  chemically synthesized
gtcttatccatcttgcttggat

SEQ ID NO: 1349950 - DNA, 22 bp, Artificial Sequence
  chemically synthesized
ttagtcttatccatcttgcttg

SEQ ID NO: 1349951 - DNA, 22 bp, Artificial Sequence
  chemically synthesized
attagtcttatccatcttgctt

SEQ ID NO: 1349952 - DNA, 22 bp, Artificial Sequence
  chemically synthesized
tattagtcttatccatcttgct

SEQ ID NO: 1349953 - DNA, 22 bp, Artificial Sequence
  chemically synthesized
ggcaatccaagcaagatggata

SEQ ID NO: 1349954 - DNA, 22 bp, Artificial Sequence
  chemically synthesized
gcaatccaagcaagatggataa

SEQ ID NO: 1349955 - DNA, 22 bp, Artificial Sequence
  chemically synthesized
taatattttattagtcttatcc

SEQ ID NO: 1349956 - DNA, 22 bp, Artificial Sequence
  chemically synthesized
gtaatattttattagtcttatc

SEQ ID NO: 1349957 - DNA, 22 bp, Artificial Sequence
  chemically synthesized
tgtaatattttattagtcttat

SEQ ID NO: 1349958 - DNA, 22 bp, Artificial Sequence
  chemically synthesized
tttgtaatattttattagtctt

SEQ ID NO: 1349959 - DNA, 22 bp, Artificial Sequence
  chemically synthesized
ttctttgtaatattttattagt

SEQ ID NO: 1349960 - DNA, 22 bp, Artificial Sequence
  chemically synthesized
attctttgtaatattttattag

SEQ ID NO: 1349961 - DNA, 22 bp, Artificial Sequence
  chemically synthesized
tattctttgtaatattttatta

SEQ ID NO: 1349962 - DNA, 22 bp, Artificial Sequence
  chemically synthesized
tttattctttgtaatattttat

SEQ ID NO: 1349963 - DNA, 22 bp, Artificial Sequence
  chemically synthesized
ctttattctttgtaatatttta

SEQ ID NO: 1349964 - DNA, 22 bp, Artificial Sequence
  chemically synthesized
tctttattctttgtaatatttt

SEQ ID NO: 1349965 - DNA, 22 bp, Artificial Sequence
  chemically synthesized
ttctttattctttgtaatattt

SEQ ID NO: 1349966 - DNA, 22 bp, Artificial Sequence
  chemically synthesized
tttctttattctttgtaatatt

SEQ ID NO: 1349967 - DNA, 22 bp, Artificial Sequence
  chemically synthesized
actttttctttattctttgtaa

SEQ ID NO: 1349968 - DNA, 22 bp, Artificial Sequence
  chemically synthesized
aactttttctttattctttgta

SEQ ID NO: 1349969 - DNA, 22 bp, Artificial Sequence
  chemically synthesized
ataaaatattacaaagaataaa

SEQ ID NO: 1349970 - DNA, 22 bp, Artificial Sequence
  chemically synthesized
tcataaatcttaactttttctt

SEQ ID NO: 1349971 - DNA, 22 bp, Artificial Sequence
  chemically synthesized
caaagaataaagaaaaagttaa

SEQ ID NO: 1349972 - DNA, 22 bp, Artificial Sequence
  chemically synthesized
agatttatgatagtctatttat

SEQ ID NO: 1349973 - DNA, 22 bp, Artificial Sequence
  chemically synthesized
atgatagtctatttatgtttct

SEQ ID NO: 1349974 - DNA, 22 bp, Artificial Sequence
  chemically synthesized
tgatagtctatttatgtttctg

SEQ ID NO: 1349975 - DNA, 22 bp, Artificial Sequence
  chemically synthesized
tatgacataataacagaaacat

SEQ ID NO: 1349976 - DNA, 22 bp, Artificial Sequence
  chemically synthesized
tggtattatatgacataataac

SEQ ID NO: 1349977 - DNA, 22 bp, Artificial Sequence
  chemically synthesized
tttatgtttctgttattatgtc

SEQ ID NO: 1349978 - DNA, 22 bp, Artificial Sequence
  chemically synthesized
atggtattatatgacataataa

SEQ ID NO: 1349979 - DNA, 22 bp, Artificial Sequence
  chemically synthesized
atgtttctgttattatgtcata

SEQ ID NO: 1349980 - DNA, 22 bp, Artificial Sequence
  chemically synthesized
tgtttctgttattatgtcatat

SEQ ID NO: 1349981 - DNA, 22 bp, Artificial Sequence
  chemically synthesized
agcttatggtattatatgacat

SEQ ID NO: 1349982 - DNA, 22 bp, Artificial Sequence
  chemically synthesized
ctgttattatgtcatataatac

SEQ ID NO: 1349983 - DNA, 22 bp, Artificial Sequence
  chemically synthesized
cctcagcttatggtattatatg

SEQ ID NO: 1349984 - DNA, 22 bp, Artificial Sequence
  chemically synthesized
tgttattatgtcatataatacc

SEQ ID NO: 1349985 - DNA, 22 bp, Artificial Sequence
  chemically synthesized
ttattatgtcatataataccat

SEQ ID NO: 1349986 - DNA, 22 bp, Artificial Sequence
  chemically synthesized
ttatgtcatataataccataag

SEQ ID NO: 1349987 - DNA, 22 bp, Artificial Sequence
  chemically synthesized
tgtcatataataccataagctg

SEQ ID NO: 1349988 - DNA, 22 bp, Artificial Sequence
  chemically synthesized
tatgaattacctcagcttatgg

SEQ ID NO: 1349989 - DNA, 22 bp, Artificial Sequence
  chemically synthesized
gtgaaatgtagaacagactata

SEQ ID NO: 1349990 - DNA, 22 bp, Artificial Sequence
  chemically synthesized
ggtgaaatgtagaacagactat

SEQ ID NO: 1349991 - DNA, 22 bp, Artificial Sequence
  chemically synthesized
aggtaattcatatagtctgttc

SEQ ID NO: 1349992 - DNA, 22 bp, Artificial Sequence
  chemically synthesized
atatagtctgttctacatttca

SEQ ID NO: 1349993 - DNA, 22 bp, Artificial Sequence
  chemically synthesized
agggtgatttggtgaaatgtag

SEQ ID NO: 1349994 - DNA, 22 bp, Artificial Sequence
  chemically synthesized
ttaagggtgatttggtgaaatg

SEQ ID NO: 1349995 - DNA, 22 bp, Artificial Sequence
  chemically synthesized
gttattaagggtgatttggtga

SEQ ID NO: 1349996 - DNA, 22 bp, Artificial Sequence
  chemically synthesized
agttattaagggtgatttggtg

SEQ ID NO: 1349997 - DNA, 22 bp, Artificial Sequence
  chemically synthesized
ttctacatttcaccaaatcacc

SEQ ID NO: 1349998 - DNA, 22 bp, Artificial Sequence
  chemically synthesized
tacatttcaccaaatcaccctt

SEQ ID NO: 1349999 - DNA, 22 bp, Artificial Sequence
  chemically synthesized
tcgtttagttattaagggtgat

SEQ ID NO: 1350000 - DNA, 22 bp, Artificial Sequence
  chemically synthesized
catttcaccaaatcacccttaa

SEQ ID NO: 1350001 - DNA, 22 bp, Artificial Sequence
  chemically synthesized
atcgtttagttattaagggtga

SEQ ID NO: 1350002 - DNA, 22 bp, Artificial Sequence
  chemically synthesized
tatcgtttagttattaagggtg

SEQ ID NO: 1350003 - DNA, 22 bp, Artificial Sequence
  chemically synthesized
caccaaatcacccttaataact

SEQ ID NO: 1350004 - DNA, 22 bp, Artificial Sequence
  chemically synthesized
accaaatcacccttaataacta

SEQ ID NO: 1350005 - DNA, 22 bp, Artificial Sequence
  chemically synthesized
tcactttatcgtttagttatta

SEQ ID NO: 1350006 - DNA, 22 bp, Artificial Sequence
  chemically synthesized
atcactttatcgtttagttatt

SEQ ID NO: 1350007 - DNA, 22 bp, Artificial Sequence
  chemically synthesized
tatcactttatcgtttagttat

SEQ ID NO: 1350008 - DNA, 22 bp, Artificial Sequence
  chemically synthesized
aattttatcactttatcgttta

SEQ ID NO: 1350009 - DNA, 22 bp, Artificial Sequence
  chemically synthesized
gaattttatcactttatcgttt

SEQ ID NO: 1350010 - DNA, 22 bp, Artificial Sequence
  chemically synthesized
aataactaaacgataaagtgat

SEQ ID NO: 1350011 - DNA, 22 bp, Artificial Sequence
  chemically synthesized
ataactaaacgataaagtgata

SEQ ID NO: 1350012 - DNA, 22 bp, Artificial Sequence
  chemically synthesized
aacgataaagtgataaaattca

SEQ ID NO: 1350013 - DNA, 22 bp, Artificial Sequence
  chemically synthesized
caacacagtgtcttgaatttta

SEQ ID NO: 1350014 - DNA, 22 bp, Artificial Sequence
  chemically synthesized
ccaacacagtgtcttgaatttt

SEQ ID NO: 1350015 - DNA, 22 bp, Artificial Sequence
  chemically synthesized
tccaacacagtgtcttgaattt

SEQ ID NO: 1350016 - DNA, 22 bp, Artificial Sequence
  chemically synthesized
ttttccaacacagtgtcttgaa

SEQ ID NO: 1350017 - DNA, 22 bp, Artificial Sequence
  chemically synthesized
attttccaacacagtgtcttga

SEQ ID NO: 1350018 - DNA, 22 bp, Artificial Sequence
  chemically synthesized
ttattttccaacacagtgtctt

SEQ ID NO: 1350019 - DNA, 22 bp, Artificial Sequence
  chemically synthesized
ccctcttattttccaacacagt

SEQ ID NO: 1350020 - DNA, 22 bp, Artificial Sequence
  chemically synthesized
tgccctcttattttccaacaca

SEQ ID NO: 1350021 - DNA, 22 bp, Artificial Sequence
  chemically synthesized
cctctgccctcttattttccaa

SEQ ID NO: 1350022 - DNA, 22 bp, Artificial Sequence
  chemically synthesized
aagacactgtgttggaaaataa

SEQ ID NO: 1350023 - DNA, 22 bp, Artificial Sequence
  chemically synthesized
ccctctgccctcttattttcca

SEQ ID NO: 1350024 - DNA, 22 bp, Artificial Sequence
  chemically synthesized
tccctctgccctcttattttcc

SEQ ID NO: 1350025 - DNA, 22 bp, Artificial Sequence
  chemically synthesized
ctttccctctgccctcttattt

SEQ ID NO: 1350026 - DNA, 22 bp, Artificial Sequence
  chemically synthesized
tgttggaaaataagagggcaga

SEQ ID NO: 1350027 - DNA, 22 bp, Artificial Sequence
  chemically synthesized
gaaaataagagggcagagggaa

SEQ ID NO: 1350028 - DNA, 22 bp, Artificial Sequence
  chemically synthesized
tcatccaagctcctttccctct

SEQ ID NO: 1350029 - DNA, 22 bp, Artificial Sequence
  chemically synthesized
atcatccaagctcctttccctc

SEQ ID NO: 1350030 - DNA, 22 bp, Artificial Sequence
  chemically synthesized
tttatcatccaagctcctttcc

SEQ ID NO: 1350031 - DNA, 22 bp, Artificial Sequence
  chemically synthesized
ttatttatcatccaagctcctt

SEQ ID NO: 1350032 - DNA, 22 bp, Artificial Sequence
  chemically synthesized
attattatttatcatccaagct

SEQ ID NO: 1350033 - DNA, 22 bp, Artificial Sequence
  chemically synthesized
gagttaattattatttatcatc

SEQ ID NO: 1350034 - DNA, 22 bp, Artificial Sequence
  chemically synthesized
gaaattggagttaattattatt

SEQ ID NO: 1350035 - DNA, 22 bp, Artificial Sequence
  chemically synthesized
agaaattggagttaattattat

SEQ ID NO: 1350036 - DNA, 22 bp, Artificial Sequence
  chemically synthesized
ggatgataaataataattaact

SEQ ID NO: 1350037 - DNA, 22 bp, Artificial Sequence
  chemically synthesized
gatgataaataataattaactc

SEQ ID NO: 1350038 - DNA, 22 bp, Artificial Sequence
  chemically synthesized
aggtccttagaaattggagtta

SEQ ID NO: 1350039 - DNA, 22 bp, Artificial Sequence
  chemically synthesized
aaggtccttagaaattggagtt

SEQ ID NO: 1350040 - DNA, 22 bp, Artificial Sequence
  chemically synthesized
taaggtccttagaaattggagt

SEQ ID NO: 1350041 - DNA, 22 bp, Artificial Sequence
  chemically synthesized
actccaatttctaaggacctta

SEQ ID NO: 1350042 - DNA, 22 bp, Artificial Sequence
  chemically synthesized
acaaccagattttaaggtcctt

SEQ ID NO: 1350043 - DNA, 22 bp, Artificial Sequence
  chemically synthesized
ttgacaaccagattttaaggtc

SEQ ID NO: 1350044 - DNA, 22 bp, Artificial Sequence
  chemically synthesized
caatttctaaggaccttaaaat

SEQ ID NO: 1350045 - DNA, 22 bp, Artificial Sequence
  chemically synthesized
attgacaaccagattttaaggt

SEQ ID NO: 1350046 - DNA, 22 bp, Artificial Sequence
  chemically synthesized
ctaaggaccttaaaatctggtt

SEQ ID NO: 1350047 - DNA, 22 bp, Artificial Sequence
  chemically synthesized
atgtttattgacaaccagattt

SEQ ID NO: 1350048 - DNA, 22 bp, Artificial Sequence
  chemically synthesized
taaggaccttaaaatctggttg

SEQ ID NO: 1350049 - DNA, 22 bp, Artificial Sequence
  chemically synthesized
aggaccttaaaatctggttgtc

SEQ ID NO: 1350050 - DNA, 22 bp, Artificial Sequence
  chemically synthesized
tgtgtattgatgtttattgaca

SEQ ID NO: 1350051 - DNA, 22 bp, Artificial Sequence
  chemically synthesized
atgtgtattgatgtttattgac

SEQ ID NO: 1350052 - DNA, 22 bp, Artificial Sequence
  chemically synthesized
aaaatctggttgtcaataaaca

SEQ ID NO: 1350053 - DNA, 22 bp, Artificial Sequence
  chemically synthesized
tatgtgtattgatgtttattga

SEQ ID NO: 1350054 - DNA, 22 bp, Artificial Sequence
  chemically synthesized
aaatctggttgtcaataaacat

SEQ ID NO: 1350055 - DNA, 22 bp, Artificial Sequence
  chemically synthesized
ttatgtgtattgatgtttattg

SEQ ID NO: 1350056 - DNA, 22 bp, Artificial Sequence
  chemically synthesized
gttgtcaataaacatcaataca

SEQ ID NO: 1350057 - DNA, 22 bp, Artificial Sequence
  chemically synthesized
tcaataaacatcaatacacata

SEQ ID NO: 1350058 - DNA, 22 bp, Artificial Sequence
  chemically synthesized
tatagatacaataatttttatg

SEQ ID NO: 1350059 - DNA, 22 bp, Artificial Sequence
  chemically synthesized
atatagatacaataatttttat

SEQ ID NO: 1350060 - DNA, 22 bp, Artificial Sequence
  chemically synthesized
ccaatcttatatagatacaata

SEQ ID NO: 1350061 - DNA, 22 bp, Artificial Sequence
  chemically synthesized
tagttaccaatcttatatagat

SEQ ID NO: 1350062 - DNA, 22 bp, Artificial Sequence
  chemically synthesized
gtagttaccaatcttatataga

SEQ ID NO: 1350063 - DNA, 22 bp, Artificial Sequence
  chemically synthesized
tgtagttaccaatcttatatag

SEQ ID NO: 1350064 - DNA, 22 bp, Artificial Sequence
  chemically synthesized
ttgtagttaccaatcttatata

SEQ ID NO: 1350065 - DNA, 22 bp, Artificial Sequence
  chemically synthesized
tttgtagttaccaatcttatat

SEQ ID NO: 1350066 - DNA, 22 bp, Artificial Sequence
  chemically synthesized
ttttgtagttaccaatcttata

SEQ ID NO: 1350067 - DNA, 22 bp, Artificial Sequence
  chemically synthesized
tttttgtagttaccaatcttat

SEQ ID NO: 1350068 - DNA, 22 bp, Artificial Sequence
  chemically synthesized
ttttttgtagttaccaatctta

SEQ ID NO: 1350069 - DNA, 22 bp, Artificial Sequence
  chemically synthesized
ttgtatctatataagattggta

SEQ ID NO: 1350070 - DNA, 22 bp, Artificial Sequence
  chemically synthesized
tttttttgtagttaccaatctt

SEQ ID NO: 1350071 - DNA, 22 bp, Artificial Sequence
  chemically synthesized
ttttttttgtagttaccaatct

SEQ ID NO: 1350072 - DNA, 22 bp, Artificial Sequence
  chemically synthesized
tttttttttgtagttaccaatc

SEQ ID NO: 1350073 - DNA, 22 bp, Artificial Sequence
  chemically synthesized
tatctatataagattggtaact

SEQ ID NO: 1350074 - DNA, 22 bp, Artificial Sequence
  chemically synthesized
ttttttttttgtagttaccaat

SEQ ID NO: 1350075 - DNA, 22 bp, Artificial Sequence
  chemically synthesized
tttttttttttgtagttaccaa

SEQ ID NO: 1350076 - DNA, 22 bp, Artificial Sequence
  chemically synthesized
ttttttttttttgtagttacca

SEQ ID NO: 1350077 - DNA, 22 bp, Artificial Sequence
  chemically synthesized
tttttttttttttgtagttacc

SEQ ID NO: 1350078 - DNA, 22 bp, Artificial Sequence
  chemically synthesized
ttttttttttttttgtagttac

SEQ ID NO: 1350079 - DNA, 22 bp, Artificial Sequence
  chemically synthesized
tttttttttttttttgtagtta

SEQ ID NO: 1350080 - DNA, 22 bp, Artificial Sequence
  chemically synthesized
tataagattggtaactacaaaa

SEQ ID NO: 1350081 - DNA, 22 bp, Artificial Sequence
  chemically synthesized
ttttttttttttttttgtagtt

SEQ ID NO: 1350082 - DNA, 22 bp, Artificial Sequence
  chemically synthesized
tttttttttttttttttgtagt

SEQ ID NO: 1350083 - DNA, 22 bp, Artificial Sequence
  chemically synthesized
ttttttttttttttttttgtag

SEQ ID NO: 1350084 - DNA, 22 bp, Artificial Sequence
  chemically synthesized
ttttttttttttttttttttgt

SEQ ID NO: 1350085 - DNA, 22 bp, Artificial Sequence
  chemically synthesized
gtaactacaaaaaaaaaaaaaa

SEQ ID NO: 1350086 - DNA, 22 bp, Artificial Sequence
  chemically synthesized
gggattcttttttttttttttt

SEQ ID NO: 1350087 - DNA, 22 bp, Artificial Sequence
  chemically synthesized
tggggattcttttttttttttt

SEQ ID NO: 1350088 - DNA, 22 bp, Artificial Sequence
  chemically synthesized
caaaaaaaaaaaaaaaaaaaag

SEQ ID NO: 1350089 - DNA, 22 bp, Artificial Sequence
  chemically synthesized
gggattctggggattctttttt

SEQ ID NO: 1350090 - DNA, 22 bp, Artificial Sequence
  chemically synthesized
cagggtctggggattctgggga

SEQ ID NO: 1350091 - DNA, 22 bp, Artificial Sequence
  chemically synthesized
tgcagggtctggggattctggg

SEQ ID NO: 1350092 - DNA, 22 bp, Artificial Sequence
  chemically synthesized
aatcccaattctgcagggtctg

SEQ ID NO: 1350093 - DNA, 22 bp, Artificial Sequence
  chemically synthesized
ccctcaatcccaattctgcagg

SEQ ID NO: 1350094 - DNA, 22 bp, Artificial Sequence
  chemically synthesized
taccctcaatcccaattctgca

SEQ ID NO: 1350095 - DNA, 22 bp, Artificial Sequence
  chemically synthesized
tcattctaccctcaatcccaat

SEQ ID NO: 1350096 - DNA, 22 bp, Artificial Sequence
  chemically synthesized
gtcattctaccctcaatcccaa

SEQ ID NO: 1350097 - DNA, 22 bp, Artificial Sequence
  chemically synthesized
cagaattgggattgagggtaga

SEQ ID NO: 1350098 - DNA, 22 bp, Artificial Sequence
  chemically synthesized
tgaggacccttgtcattctacc

SEQ ID NO: 1350099 - DNA, 22 bp, Artificial Sequence
  chemically synthesized
ggattgagggtagaatgacaag

SEQ ID NO: 1350100 - DNA, 22 bp, Artificial Sequence
  chemically synthesized
tcagctgtgaggacccttgtca

SEQ ID NO: 1350101 - DNA, 22 bp, Artificial Sequence
  chemically synthesized
agggtagaatgacaagggtcct

SEQ ID NO: 1350102 - DNA, 22 bp, Artificial Sequence
  chemically synthesized
ccatgattgtcagctgtgagga

SEQ ID NO: 1350103 - DNA, 22 bp, Artificial Sequence
  chemically synthesized
tcgttcccatgattgtcagctg

SEQ ID NO: 1350104 - DNA, 22 bp, Artificial Sequence
  chemically synthesized
gtcgttcccatgattgtcagct

SEQ ID NO: 1350105 - DNA, 22 bp, Artificial Sequence
  chemically synthesized
cttgtcgttcccatgattgtca

SEQ ID NO: 1350106 - DNA, 22 bp, Artificial Sequence
  chemically synthesized
tccttgtcgttcccatgattgt

SEQ ID NO: 1350107 - DNA, 22 bp, Artificial Sequence
  chemically synthesized
ttctccttgtcgttcccatgat

SEQ ID NO: 1350108 - DNA, 22 bp, Artificial Sequence
  chemically synthesized
gttctccttgtcgttcccatga

SEQ ID NO: 1350109 - DNA, 22 bp, Artificial Sequence
  chemically synthesized
acagctgacaatcatgggaacg

SEQ ID NO: 1350110 - DNA, 22 bp, Artificial Sequence
  chemically synthesized
tgttctccttgtcgttcccatg

SEQ ID NO: 1350111 - DNA, 22 bp, Artificial Sequence
  chemically synthesized
ttgttctccttgtcgttcccat

SEQ ID NO: 1350112 - DNA, 22 bp, Artificial Sequence
  chemically synthesized
acaatcatgggaacgacaagga

SEQ ID NO: 1350113 - DNA, 22 bp, Artificial Sequence
  chemically synthesized
agaagtgtgaaatgtcttttgt

SEQ ID NO: 1350114 - DNA, 22 bp, Artificial Sequence
  chemically synthesized
gagaagtgtgaaatgtcttttg

SEQ ID NO: 1350115 - DNA, 22 bp, Artificial Sequence
  chemically synthesized
tgagaagtgtgaaatgtctttt

SEQ ID NO: 1350116 - DNA, 22 bp, Artificial Sequence
  chemically synthesized
tttgagaagtgtgaaatgtctt

SEQ ID NO: 1350117 - DNA, 22 bp, Artificial Sequence
  chemically synthesized
aaaacaggtagtaatctctttg

SEQ ID NO: 1350118 - DNA, 22 bp, Artificial Sequence
  chemically synthesized
cacacttctcaaagagattact

SEQ ID NO: 1350119 - DNA, 22 bp, Artificial Sequence
  chemically synthesized
acacttctcaaagagattacta

SEQ ID NO: 1350120 - DNA, 22 bp, Artificial Sequence
  chemically synthesized
ctcaaagagattactacctgtt

SEQ ID NO: 1350121 - DNA, 22 bp, Artificial Sequence
  chemically synthesized
tcaaagagattactacctgttt

SEQ ID NO: 1350122 - DNA, 22 bp, Artificial Sequence
  chemically synthesized
aaagagattactacctgttttg

SEQ ID NO: 1350123 - DNA, 22 bp, Artificial Sequence
  chemically synthesized
acaagtgatcctcaaaacaggt

SEQ ID NO: 1350124 - DNA, 22 bp, Artificial Sequence
  chemically synthesized
ctgacaagtgatcctcaaaaca

SEQ ID NO: 1350125 - DNA, 22 bp, Artificial Sequence
  chemically synthesized
ctacctgttttgaggatcactt

SEQ ID NO: 1350126 - DNA, 22 bp, Artificial Sequence
  chemically synthesized
cctgttttgaggatcacttgtc

SEQ ID NO: 1350127 - DNA, 22 bp, Artificial Sequence
  chemically synthesized
ttttgaggatcacttgtcagga

SEQ ID NO: 1350128 - DNA, 22 bp, Artificial Sequence
  chemically synthesized
tgaggatcacttgtcaggagtg

SEQ ID NO: 1350129 - DNA, 22 bp, Artificial Sequence
  chemically synthesized
gaggatcacttgtcaggagtgc

SEQ ID NO: 1350130 - DNA, 22 bp, Artificial Sequence
  chemically synthesized
aggatcacttgtcaggagtgca

SEQ ID NO: 1350131 - DNA, 22 bp, Artificial Sequence
  chemically synthesized
catagtcacagaagatgcactc

SEQ ID NO: 1350132 - DNA, 22 bp, Artificial Sequence
  chemically synthesized
gtcaggagtgcatcttctgtga

SEQ ID NO: 1350133 - DNA, 22 bp, Artificial Sequence
  chemically synthesized
tcaggagtgcatcttctgtgac

SEQ ID NO: 1350134 - DNA, 22 bp, Artificial Sequence
  chemically synthesized
accaccctgcatagtcacagaa

SEQ ID NO: 1350135 - DNA, 22 bp, Artificial Sequence
  chemically synthesized
cctgaccaccctgcatagtcac

SEQ ID NO: 1350136 - DNA, 22 bp, Artificial Sequence
  chemically synthesized
acctgaccaccctgcatagtca

SEQ ID NO: 1350137 - DNA, 22 bp, Artificial Sequence
  chemically synthesized
tacctgaccaccctgcatagtc

SEQ ID NO: 1350138 - DNA, 22 bp, Artificial Sequence
  chemically synthesized
ttacctgaccaccctgcatagt

SEQ ID NO: 1350139 - DNA, 22 bp, Artificial Sequence
  chemically synthesized
cttttacctgaccaccctgcat

SEQ ID NO: 1350140 - DNA, 22 bp, Artificial Sequence
  chemically synthesized
ccttttacctgaccaccctgca

SEQ ID NO: 1350141 - DNA, 22 bp, Artificial Sequence
  chemically synthesized
ctgtgactatgcagggtggtca

SEQ ID NO: 1350142 - DNA, 22 bp, Artificial Sequence
  chemically synthesized
tgtgactatgcagggtggtcag

SEQ ID NO: 1350143 - DNA, 22 bp, Artificial Sequence
  chemically synthesized
tgactatgcagggtggtcaggt

SEQ ID NO: 1350144 - DNA, 22 bp, Artificial Sequence
  chemically synthesized
tagtaacttccttttacctgac

SEQ ID NO: 1350145 - DNA, 22 bp, Artificial Sequence
  chemically synthesized
tgcagggtggtcaggtaaaagg

SEQ ID NO: 1350146 - DNA, 22 bp, Artificial Sequence
  chemically synthesized
ctgtagtaacttccttttacct

SEQ ID NO: 1350147 - DNA, 22 bp, Artificial Sequence
  chemically synthesized
actgtagtaacttccttttacc

SEQ ID NO: 1350148 - DNA, 22 bp, Artificial Sequence
  chemically synthesized
tactgtagtaacttccttttac

SEQ ID NO: 1350149 - DNA, 22 bp, Artificial Sequence
  chemically synthesized
atcaccatcctttactgtagta

SEQ ID NO: 1350150 - DNA, 22 bp, Artificial Sequence
  chemically synthesized
ctcatcaccatcctttactgta

SEQ ID NO: 1350151 - DNA, 22 bp, Artificial Sequence
  chemically synthesized
accattcctcatcaccatcctt

SEQ ID NO: 1350152 - DNA, 22 bp, Artificial Sequence
  chemically synthesized
ctacagtaaaggatggtgatga

SEQ ID NO: 1350153 - DNA, 22 bp, Artificial Sequence
  chemically synthesized
cagtaaaggatggtgatgagga

SEQ ID NO: 1350154 - DNA, 22 bp, Artificial Sequence
  chemically synthesized
gaaactcaccattcctcatcac

SEQ ID NO: 1350155 - DNA, 22 bp, Artificial Sequence
  chemically synthesized
cagtgacctggaaactcaccat

SEQ ID NO: 1350156 - DNA, 22 bp, Artificial Sequence
  chemically synthesized
ccagtgacctggaaactcacca

SEQ ID NO: 1350157 - DNA, 22 bp, Artificial Sequence
  chemically synthesized
agtttccagtgacctggaaact

SEQ ID NO: 1350158 - DNA, 22 bp, Artificial Sequence
  chemically synthesized
cagtttccagtgacctggaaac

SEQ ID NO: 1350159 - DNA, 22 bp, Artificial Sequence
  chemically synthesized
tcagtttccagtgacctggaaa

SEQ ID NO: 1350160 - DNA, 22 bp, Artificial Sequence
  chemically synthesized
ataggagactttcagtttccag

SEQ ID NO: 1350161 - DNA, 22 bp, Artificial Sequence
  chemically synthesized
ccaggtcactggaaactgaaag

SEQ ID NO: 1350162 - DNA, 22 bp, Artificial Sequence
  chemically synthesized
caggtcactggaaactgaaagt

SEQ ID NO: 1350163 - DNA, 22 bp, Artificial Sequence
  chemically synthesized
gagttcataggagactttcagt

SEQ ID NO: 1350164 - DNA, 22 bp, Artificial Sequence
  chemically synthesized
tcgagttcataggagactttca

SEQ ID NO: 1350165 - DNA, 22 bp, Artificial Sequence
  chemically synthesized
ctcgagttcataggagactttc

SEQ ID NO: 1350166 - DNA, 22 bp, Artificial Sequence
  chemically synthesized
gaaactgaaagtctcctatgaa

SEQ ID NO: 1350167 - DNA, 22 bp, Artificial Sequence
  chemically synthesized
cggcttctcgagttcataggag

SEQ ID NO: 1350168 - DNA, 22 bp, Artificial Sequence
  chemically synthesized
gcggcttctcgagttcatagga

SEQ ID NO: 1350169 - DNA, 22 bp, Artificial Sequence
  chemically synthesized
tgcggcttctcgagttcatagg

SEQ ID NO: 1350170 - DNA, 22 bp, Artificial Sequence
  chemically synthesized
gttttgcggcttctcgagttca

SEQ ID NO: 1350171 - DNA, 22 bp, Artificial Sequence
  chemically synthesized
aaagtctcctatgaactcgaga

SEQ ID NO: 1350172 - DNA, 22 bp, Artificial Sequence
  chemically synthesized
ggttttgcggcttctcgagttc

SEQ ID NO: 1350173 - DNA, 22 bp, Artificial Sequence
  chemically synthesized
cttggttttgcggcttctcgag

SEQ ID NO: 1350174 - DNA, 22 bp, Artificial Sequence
  chemically synthesized
ccttggttttgcggcttctcga

SEQ ID NO: 1350175 - DNA, 22 bp, Artificial Sequence
  chemically synthesized
ttccttggttttgcggcttctc

SEQ ID NO: 1350176 - DNA, 22 bp, Artificial Sequence
  chemically synthesized
ctatgaactcgagaagccgcaa

SEQ ID NO: 1350177 - DNA, 22 bp, Artificial Sequence
  chemically synthesized
tcttccttggttttgcggcttc

SEQ ID NO: 1350178 - DNA, 22 bp, Artificial Sequence
  chemically synthesized
ctcttccttggttttgcggctt

SEQ ID NO: 1350179 - DNA, 22 bp, Artificial Sequence
  chemically synthesized
tctcttccttggttttgcggct

SEQ ID NO: 1350180 - DNA, 22 bp, Artificial Sequence
  chemically synthesized
tgaactcgagaagccgcaaaac

SEQ ID NO: 1350181 - DNA, 22 bp, Artificial Sequence
  chemically synthesized
tttctcttccttggttttgcgg

SEQ ID NO: 1350182 - DNA, 22 bp, Artificial Sequence
  chemically synthesized
ctctttctcttccttggttttg

SEQ ID NO: 1350183 - DNA, 22 bp, Artificial Sequence
  chemically synthesized
gagaagccgcaaaaccaaggaa

SEQ ID NO: 1350184 - DNA, 22 bp, Artificial Sequence
  chemically synthesized
taaaattactctttctcttcct

SEQ ID NO: 1350185 - DNA, 22 bp, Artificial Sequence
  chemically synthesized
ttataaaattactctttctctt

SEQ ID NO: 1350186 - DNA, 22 bp, Artificial Sequence
  chemically synthesized
attataaaattactctttctct

SEQ ID NO: 1350187 - DNA, 22 bp, Artificial Sequence
  chemically synthesized
tataataaatgttgctgtggat

SEQ ID NO: 1350188 - DNA, 22 bp, Artificial Sequence
  chemically synthesized
ataataaatgttgctgtggatt

SEQ ID NO: 1350189 - DNA, 22 bp, Artificial Sequence
  chemically synthesized
taataaatgttgctgtggattt

SEQ ID NO: 1350190 - DNA, 22 bp, Artificial Sequence
  chemically synthesized
aaacagatatgaagaaatccac

SEQ ID NO: 1350191 - DNA, 22 bp, Artificial Sequence
  chemically synthesized
ctgtggatttcttcatatctgt

SEQ ID NO: 1350192 - DNA, 22 bp, Artificial Sequence
  chemically synthesized
aaaagtgttaaaacagatatga

SEQ ID NO: 1350193 - DNA, 22 bp, Artificial Sequence
  chemically synthesized
tggatttcttcatatctgtttt

SEQ ID NO: 1350194 - DNA, 22 bp, Artificial Sequence
  chemically synthesized
aataactcaaaagtgttaaaac

SEQ ID NO: 1350195 - DNA, 22 bp, Artificial Sequence
  chemically synthesized
aaataactcaaaagtgttaaaa

SEQ ID NO: 1350196 - DNA, 22 bp, Artificial Sequence
  chemically synthesized
cttcatatctgttttaacactt

SEQ ID NO: 1350197 - DNA, 22 bp, Artificial Sequence
  chemically synthesized
ttcatatctgttttaacacttt

SEQ ID NO: 1350198 - DNA, 22 bp, Artificial Sequence
  chemically synthesized
catatctgttttaacacttttg

SEQ ID NO: 1350199 - DNA, 22 bp, Artificial Sequence
  chemically synthesized
atatctgttttaacacttttga

SEQ ID NO: 1350200 - DNA, 22 bp, Artificial Sequence
  chemically synthesized
ttttaacacttttgagttattt

SEQ ID NO: 1350201 - DNA, 22 bp, Artificial Sequence
  chemically synthesized
taacacttttgagttatttaag

SEQ ID NO: 1350202 - DNA, 22 bp, Artificial Sequence
  chemically synthesized
agtagtcacacacttaaataac

SEQ ID NO: 1350203 - DNA, 22 bp, Artificial Sequence
  chemically synthesized
aacacttttgagttatttaagt

SEQ ID NO: 1350204 - DNA, 22 bp, Artificial Sequence
  chemically synthesized
acacttttgagttatttaagtg

SEQ ID NO: 1350205 - DNA, 22 bp, Artificial Sequence
  chemically synthesized
attaagtagtcacacacttaaa

SEQ ID NO: 1350206 - DNA, 22 bp, Artificial Sequence
  chemically synthesized
ttgagttatttaagtgtgtgac

SEQ ID NO: 1350207 - DNA, 22 bp, Artificial Sequence
  chemically synthesized
tgagttatttaagtgtgtgact

SEQ ID NO: 1350208 - DNA, 22 bp, Artificial Sequence
  chemically synthesized
gagttatttaagtgtgtgacta

SEQ ID NO: 1350209 - DNA, 22 bp, Artificial Sequence
  chemically synthesized
agttatttaagtgtgtgactac

SEQ ID NO: 1350210 - DNA, 22 bp, Artificial Sequence
  chemically synthesized
tttaagtgtgtgactacttaat

SEQ ID NO: 1350211 - DNA, 22 bp, Artificial Sequence
  chemically synthesized
aagtgtgtgactacttaattaa

SEQ ID NO: 1350212 - DNA, 22 bp, Artificial Sequence
  chemically synthesized
agtgtgtgactacttaattaat

SEQ ID NO: 1350213 - DNA, 22 bp, Artificial Sequence
  chemically synthesized
aaaacaacaataacaaaaatta

SEQ ID NO: 1350214 - DNA, 22 bp, Artificial Sequence
  chemically synthesized
cttaattaatttttgttattgt

SEQ ID NO: 1350215 - DNA, 22 bp, Artificial Sequence
  chemically synthesized
aattaatttttgttattgttgt

SEQ ID NO: 1350216 - DNA, 22 bp, Artificial Sequence
  chemically synthesized
attaatttttgttattgttgtt

SEQ ID NO: 1350217 - DNA, 22 bp, Artificial Sequence
  chemically synthesized
atttttgttattgttgttttga

SEQ ID NO: 1350218 - DNA, 22 bp, Artificial Sequence
  chemically synthesized
ggtagatgccacattcaaaaca

SEQ ID NO: 1350219 - DNA, 22 bp, Artificial Sequence
  chemically synthesized
gggtagatgccacattcaaaac

SEQ ID NO: 1350220 - DNA, 22 bp, Artificial Sequence
  chemically synthesized
ttgttattgttgttttgaatgt

SEQ ID NO: 1350221 - DNA, 22 bp, Artificial Sequence
  chemically synthesized
tgggtagatgccacattcaaaa

SEQ ID NO: 1350222 - DNA, 22 bp, Artificial Sequence
  chemically synthesized
tgttattgttgttttgaatgtg

SEQ ID NO: 1350223 - DNA, 22 bp, Artificial Sequence
  chemically synthesized
gttattgttgttttgaatgtgg

SEQ ID NO: 1350224 - DNA, 22 bp, Artificial Sequence
  chemically synthesized
ttattgttgttttgaatgtggc

SEQ ID NO: 1350225 - DNA, 22 bp, Artificial Sequence
  chemically synthesized
ttgttgttttgaatgtggcatc

SEQ ID NO: 1350226 - DNA, 22 bp, Artificial Sequence
  chemically synthesized
ttgttttgaatgtggcatctac

SEQ ID NO: 1350227 - DNA, 22 bp, Artificial Sequence
  chemically synthesized
ttttgaatgtggcatctaccca

SEQ ID NO: 1350228 - DNA, 22 bp, Artificial Sequence
  chemically synthesized
tgaatgtggcatctacccaaaa

SEQ ID NO: 1350229 - DNA, 22 bp, Artificial Sequence
  chemically synthesized
gaatgtggcatctacccaaaat

SEQ ID NO: 1350230 - DNA, 22 bp, Artificial Sequence
  chemically synthesized
aatgtggcatctacccaaaatt

SEQ ID NO: 1350231 - DNA, 22 bp, Artificial Sequence
  chemically synthesized
taaatacagagaccaatgcagt

SEQ ID NO: 1350232 - DNA, 22 bp, Artificial Sequence
  chemically synthesized
cccaaaattggactgcattggt

SEQ ID NO: 1350233 - DNA, 22 bp, Artificial Sequence
  chemically synthesized
gtaaatacagagaccaatgcag

SEQ ID NO: 1350234 - DNA, 22 bp, Artificial Sequence
  chemically synthesized
gactgcattggtctctgtattt

SEQ ID NO: 1350235 - DNA, 22 bp, Artificial Sequence
  chemically synthesized
cattggtctctgtatttacaag

SEQ ID NO: 1350236 - DNA, 22 bp, Artificial Sequence
  chemically synthesized
gtctctgtatttacaaggctta

SEQ ID NO: 1350237 - DNA, 22 bp, Artificial Sequence
  chemically synthesized
atatatgcaaatataagccttg

SEQ ID NO: 1350238 - DNA, 22 bp, Artificial Sequence
  chemically synthesized
tgtatttacaaggcttatattt

SEQ ID NO: 1350239 - DNA, 22 bp, Artificial Sequence
  chemically synthesized
agttaatatatgcaaatataag

SEQ ID NO: 1350240 - DNA, 22 bp, Artificial Sequence
  chemically synthesized
tatttacaaggcttatatttgc

SEQ ID NO: 1350241 - DNA, 22 bp, Artificial Sequence
  chemically synthesized
cattaagttaatatatgcaaat

SEQ ID NO: 1350242 - DNA, 22 bp, Artificial Sequence
  chemically synthesized
acaaggcttatatttgcatata

SEQ ID NO: 1350243 - DNA, 22 bp, Artificial Sequence
  chemically synthesized
caaggcttatatttgcatatat

SEQ ID NO: 1350244 - DNA, 22 bp, Artificial Sequence
  chemically synthesized
tgtattgcattaagttaatata

SEQ ID NO: 1350245 - DNA, 22 bp, Artificial Sequence
  chemically synthesized
atatttgcatatattaacttaa

SEQ ID NO: 1350246 - DNA, 22 bp, Artificial Sequence
  chemically synthesized
ttatgtattgcattaagttaat

SEQ ID NO: 1350247 - DNA, 22 bp, Artificial Sequence
  chemically synthesized
tatttgcatatattaacttaat

SEQ ID NO: 1350248 - DNA, 22 bp, Artificial Sequence
  chemically synthesized
gttgttatgtattgcattaagt

SEQ ID NO: 1350249 - DNA, 22 bp, Artificial Sequence
  chemically synthesized
gcatatattaacttaatgcaat

SEQ ID NO: 1350250 - DNA, 22 bp, Artificial Sequence
  chemically synthesized
catatattaacttaatgcaata

SEQ ID NO: 1350251 - DNA, 22 bp, Artificial Sequence
  chemically synthesized
atctggttgttatgtattgcat

SEQ ID NO: 1350252 - DNA, 22 bp, Artificial Sequence
  chemically synthesized
ttcatctggttgttatgtattg

SEQ ID NO: 1350253 - DNA, 22 bp, Artificial Sequence
  chemically synthesized
acttaatgcaatacataacaac

SEQ ID NO: 1350254 - DNA, 22 bp, Artificial Sequence
  chemically synthesized
gattgttcatctggttgttatg

SEQ ID NO: 1350255 - DNA, 22 bp, Artificial Sequence
  chemically synthesized
aatgcaatacataacaaccaga

SEQ ID NO: 1350256 - DNA, 22 bp, Artificial Sequence
  chemically synthesized
atgcaatacataacaaccagat

SEQ ID NO: 1350257 - DNA, 22 bp, Artificial Sequence
  chemically synthesized
tatctggattgttcatctggtt

SEQ ID NO: 1350258 - DNA, 22 bp, Artificial Sequence
  chemically synthesized
ccctatatctggattgttcatc

SEQ ID NO: 1350259 - DNA, 22 bp, Artificial Sequence
  chemically synthesized
cccctatatctggattgttcat

SEQ ID NO: 1350260 - DNA, 22 bp, Artificial Sequence
  chemically synthesized
tcccctatatctggattgttca

SEQ ID NO: 1350261 - DNA, 22 bp, Artificial Sequence
  chemically synthesized
tccatcccagtacaaggtgtaa

SEQ ID NO: 1350262 - DNA, 22 bp, Artificial Sequence
  chemically synthesized
gtccatcccagtacaaggtgta

SEQ ID NO: 1350263 - DNA, 22 bp, Artificial Sequence
  chemically synthesized
cttgtccatcccagtacaaggt

SEQ ID NO: 1350264 - DNA, 22 bp, Artificial Sequence
  chemically synthesized
agtcctccttgtccatcccagt

SEQ ID NO: 1350265 - DNA, 22 bp, Artificial Sequence
  chemically synthesized
caccttgtactgggatggacaa

SEQ ID NO: 1350266 - DNA, 22 bp, Artificial Sequence
  chemically synthesized
attaagtcctccttgtccatcc

SEQ ID NO: 1350267 - DNA, 22 bp, Artificial Sequence
  chemically synthesized
aattaagtcctccttgtccatc

SEQ ID NO: 1350268 - DNA, 22 bp, Artificial Sequence
  chemically synthesized
cttaattaagtcctccttgtcc

SEQ ID NO: 1350269 - DNA, 22 bp, Artificial Sequence
  chemically synthesized
gtactgggatggacaaggagga

SEQ ID NO: 1350270 - DNA, 22 bp, Artificial Sequence
  chemically synthesized
tactgggatggacaaggaggac

SEQ ID NO: 1350271 - DNA, 22 bp, Artificial Sequence
  chemically synthesized
aattccttaattaagtcctcct

SEQ ID NO: 1350272 - DNA, 22 bp, Artificial Sequence
  chemically synthesized
taaattccttaattaagtcctc

SEQ ID NO: 1350273 - DNA, 22 bp, Artificial Sequence
  chemically synthesized
ggatggacaaggaggacttaat

SEQ ID NO: 1350274 - DNA, 22 bp, Artificial Sequence
  chemically synthesized
tctaaattccttaattaagtcc

SEQ ID NO: 1350275 - DNA, 22 bp, Artificial Sequence
  chemically synthesized
ctctaaattccttaattaagtc

SEQ ID NO: 1350276 - DNA, 22 bp, Artificial Sequence
  chemically synthesized
agcttctctaaattccttaatt

SEQ ID NO: 1350277 - DNA, 22 bp, Artificial Sequence
  chemically synthesized
atgactgagcttctctaaattc

SEQ ID NO: 1350278 - DNA, 22 bp, Artificial Sequence
  chemically synthesized
catgactgagcttctctaaatt

SEQ ID NO: 1350279 - DNA, 22 bp, Artificial Sequence
  chemically synthesized
aattaaggaatttagagaagct

SEQ ID NO: 1350280 - DNA, 22 bp, Artificial Sequence
  chemically synthesized
atttcatgactgagcttctcta

SEQ ID NO: 1350281 - DNA, 22 bp, Artificial Sequence
  chemically synthesized
attaaggaatttagagaagctc

SEQ ID NO: 1350282 - DNA, 22 bp, Artificial Sequence
  chemically synthesized
aggaatttagagaagctcagtc

SEQ ID NO: 1350283 - DNA, 22 bp, Artificial Sequence
  chemically synthesized
ccctaatttcatgactgagctt

SEQ ID NO: 1350284 - DNA, 22 bp, Artificial Sequence
  chemically synthesized
accctaatttcatgactgagct

SEQ ID NO: 1350285 - DNA, 22 bp, Artificial Sequence
  chemically synthesized
aagtttaccctaatttcatgac

SEQ ID NO: 1350286 - DNA, 22 bp, Artificial Sequence
  chemically synthesized
agagaagctcagtcatgaaatt

SEQ ID NO: 1350287 - DNA, 22 bp, Artificial Sequence
  chemically synthesized
gaagtttaccctaatttcatga

SEQ ID NO: 1350288 - DNA, 22 bp, Artificial Sequence
  chemically synthesized
gagaagctcagtcatgaaatta

SEQ ID NO: 1350289 - DNA, 22 bp, Artificial Sequence
  chemically synthesized
tttgaagtttaccctaatttca

SEQ ID NO: 1350290 - DNA, 22 bp, Artificial Sequence
  chemically synthesized
gtttgaagtttaccctaatttc

SEQ ID NO: 1350291 - DNA, 22 bp, Artificial Sequence
  chemically synthesized
ttgtttgaagtttaccctaatt

SEQ ID NO: 1350292 - DNA, 22 bp, Artificial Sequence
  chemically synthesized
cttgtttgaagtttaccctaat

SEQ ID NO: 1350293 - DNA, 22 bp, Artificial Sequence
  chemically synthesized
tcttgtttgaagtttaccctaa

SEQ ID NO: 1350294 - DNA, 22 bp, Artificial Sequence
  chemically synthesized
ttcttgtttgaagtttacccta

SEQ ID NO: 1350295 - DNA, 22 bp, Artificial Sequence
  chemically synthesized
agtcatgaaattagggtaaact

SEQ ID NO: 1350296 - DNA, 22 bp, Artificial Sequence
  chemically synthesized
tttcttgtttgaagtttaccct

SEQ ID NO: 1350297 - DNA, 22 bp, Artificial Sequence
  chemically synthesized
ttttcttgtttgaagtttaccc

SEQ ID NO: 1350298 - DNA, 22 bp, Artificial Sequence
  chemically synthesized
tttttttcttgtttgaagttta

SEQ ID NO: 1350299 - DNA, 22 bp, Artificial Sequence
  chemically synthesized
atttttttcttgtttgaagttt

SEQ ID NO: 1350300 - DNA, 22 bp, Artificial Sequence
  chemically synthesized
tatttttttcttgtttgaagtt

SEQ ID NO: 1350301 - DNA, 22 bp, Artificial Sequence
  chemically synthesized
ttatttttttcttgtttgaagt

SEQ ID NO: 1350302 - DNA, 22 bp, Artificial Sequence
  chemically synthesized
tttatttttttcttgtttgaag

SEQ ID NO: 1350303 - DNA, 22 bp, Artificial Sequence
  chemically synthesized
ttttatttttttcttgtttgaa

SEQ ID NO: 1350304 - DNA, 22 bp, Artificial Sequence
  chemically synthesized
gggtaaacttcaaacaagaaaa

SEQ ID NO: 1350305 - DNA, 22 bp, Artificial Sequence
  chemically synthesized
aacccatccttttttatttttt

SEQ ID NO: 1350306 - DNA, 22 bp, Artificial Sequence
  chemically synthesized
caacccatccttttttattttt

SEQ ID NO: 1350307 - DNA, 22 bp, Artificial Sequence
  chemically synthesized
caaacaagaaaaaaataaaaaa

SEQ ID NO: 1350308 - DNA, 22 bp, Artificial Sequence
  chemically synthesized
aaacaagaaaaaaataaaaaag

SEQ ID NO: 1350309 - DNA, 22 bp, Artificial Sequence
  chemically synthesized
gtttcaacccatccttttttat

SEQ ID NO: 1350310 - DNA, 22 bp, Artificial Sequence
  chemically synthesized
ccctagtttcaacccatccttt

SEQ ID NO: 1350311 - DNA, 22 bp, Artificial Sequence
  chemically synthesized
aatcctaccctagtttcaaccc

SEQ ID NO: 1350312 - DNA, 22 bp, Artificial Sequence
  chemically synthesized
caatcctaccctagtttcaacc

SEQ ID NO: 1350313 - DNA, 22 bp, Artificial Sequence
  chemically synthesized
tttcaatcctaccctagtttca

SEQ ID NO: 1350314 - DNA, 22 bp, Artificial Sequence
  chemically synthesized
atttcaatcctaccctagtttc

SEQ ID NO: 1350315 - DNA, 22 bp, Artificial Sequence
  chemically synthesized
ttatttcaatcctaccctagtt

SEQ ID NO: 1350316 - DNA, 22 bp, Artificial Sequence
  chemically synthesized
cttatttcaatcctaccctagt

SEQ ID NO: 1350317 - DNA, 22 bp, Artificial Sequence
  chemically synthesized
cttcttatttcaatcctaccct

SEQ ID NO: 1350318 - DNA, 22 bp, Artificial Sequence
  chemically synthesized
ccttcttatttcaatcctaccc

SEQ ID NO: 1350319 - DNA, 22 bp, Artificial Sequence
  chemically synthesized
tttccttcttatttcaatccta

SEQ ID NO: 1350320 - DNA, 22 bp, Artificial Sequence
  chemically synthesized
aaactagggtaggattgaaata

SEQ ID NO: 1350321 - DNA, 22 bp, Artificial Sequence
  chemically synthesized
atctatttccttcttatttcaa

SEQ ID NO: 1350322 - DNA, 22 bp, Artificial Sequence
  chemically synthesized
gggtaggattgaaataagaagg

SEQ ID NO: 1350323 - DNA, 22 bp, Artificial Sequence
  chemically synthesized
atgttcatctatttccttctta

SEQ ID NO: 1350324 - DNA, 22 bp, Artificial Sequence
  chemically synthesized
taatgttcatctatttccttct

SEQ ID NO: 1350325 - DNA, 22 bp, Artificial Sequence
  chemically synthesized
tctctaatgttcatctatttcc

SEQ ID NO: 1350326 - DNA, 22 bp, Artificial Sequence
  chemically synthesized
aaataagaaggaaatagatgaa

SEQ ID NO: 1350327 - DNA, 22 bp, Artificial Sequence
  chemically synthesized
agtgattatctctaatgttcat

SEQ ID NO: 1350328 - DNA, 22 bp, Artificial Sequence
  chemically synthesized
aagtgattatctctaatgttca

SEQ ID NO: 1350329 - DNA, 22 bp, Artificial Sequence
  chemically synthesized
acttaagtgattatctctaatg

SEQ ID NO: 1350330 - DNA, 22 bp, Artificial Sequence
  chemically synthesized
cacttaagtgattatctctaat

SEQ ID NO: 1350331 - DNA, 22 bp, Artificial Sequence
  chemically synthesized
tcacttaagtgattatctctaa

SEQ ID NO: 1350332 - DNA, 22 bp, Artificial Sequence
  chemically synthesized
tgttttcacttaagtgattatc

SEQ ID NO: 1350333 - DNA, 22 bp, Artificial Sequence
  chemically synthesized
atgttttcacttaagtgattat

SEQ ID NO: 1350334 - DNA, 22 bp, Artificial Sequence
  chemically synthesized
tatgttttcacttaagtgatta

SEQ ID NO: 1350335 - DNA, 22 bp, Artificial Sequence
  chemically synthesized
aattttatgttttcacttaagt

SEQ ID NO: 1350336 - DNA, 22 bp, Artificial Sequence
  chemically synthesized
tcaattttatgttttcacttaa

SEQ ID NO: 1350337 - DNA, 22 bp, Artificial Sequence
  chemically synthesized
gagataatcacttaagtgaaaa

SEQ ID NO: 1350338 - DNA, 22 bp, Artificial Sequence
  chemically synthesized
aagtgaaaacataaaattgaga

SEQ ID NO: 1350339 - DNA, 22 bp, Artificial Sequence
  chemically synthesized
atgataaggcattctcaatttt

SEQ ID NO: 1350340 - DNA, 22 bp, Artificial Sequence
  chemically synthesized
agtgaaaacataaaattgagaa

SEQ ID NO: 1350341 - DNA, 22 bp, Artificial Sequence
  chemically synthesized
catgataaggcattctcaattt

SEQ ID NO: 1350342 - DNA, 22 bp, Artificial Sequence
  chemically synthesized
atgcatgaatttcatgataagg

SEQ ID NO: 1350343 - DNA, 22 bp, Artificial Sequence
  chemically synthesized
catgcatgaatttcatgataag

SEQ ID NO: 1350344 - DNA, 22 bp, Artificial Sequence
  chemically synthesized
agaatgccttatcatgaaattc

SEQ ID NO: 1350345 - DNA, 22 bp, Artificial Sequence
  chemically synthesized
atcatgaaattcatgcatgaaa

SEQ ID NO: 1350346 - DNA, 22 bp, Artificial Sequence
  chemically synthesized
tcatgaaattcatgcatgaaat

SEQ ID NO: 1350347 - DNA, 22 bp, Artificial Sequence
  chemically synthesized
atgcatgaaattctgtcatgcc

SEQ ID NO: 1350348 - DNA, 22 bp, Artificial Sequence
  chemically synthesized
aacagatcaacaggcatgacag

SEQ ID NO: 1350349 - DNA, 22 bp, Artificial Sequence
  chemically synthesized
aaacagatcaacaggcatgaca

SEQ ID NO: 1350350 - DNA, 22 bp, Artificial Sequence
  chemically synthesized
taaacagatcaacaggcatgac

SEQ ID NO: 1350351 - DNA, 22 bp, Artificial Sequence
  chemically synthesized
ttaaacagatcaacaggcatga

SEQ ID NO: 1350352 - DNA, 22 bp, Artificial Sequence
  chemically synthesized
tttaaacagatcaacaggcatg

SEQ ID NO: 1350353 - DNA, 22 bp, Artificial Sequence
  chemically synthesized
ttttttaaacagatcaacaggc

SEQ ID NO: 1350354 - DNA, 22 bp, Artificial Sequence
  chemically synthesized
ttattttttaaacagatcaaca

SEQ ID NO: 1350355 - DNA, 22 bp, Artificial Sequence
  chemically synthesized
tgtcatgcctgttgatctgttt

SEQ ID NO: 1350356 - DNA, 22 bp, Artificial Sequence
  chemically synthesized
ctattattttttaaacagatca

SEQ ID NO: 1350357 - DNA, 22 bp, Artificial Sequence
  chemically synthesized
tcatgcctgttgatctgtttaa

SEQ ID NO: 1350358 - DNA, 22 bp, Artificial Sequence
  chemically synthesized
tggctactattattttttaaac

SEQ ID NO: 1350359 - DNA, 22 bp, Artificial Sequence
  chemically synthesized
gtggctactattattttttaaa

SEQ ID NO: 1350360 - DNA, 22 bp, Artificial Sequence
  chemically synthesized
ttgatctgtttaaaaaataata

SEQ ID NO: 1350361 - DNA, 22 bp, Artificial Sequence
  chemically synthesized
atctgtttaaaaaataatagta

SEQ ID NO: 1350362 - DNA, 22 bp, Artificial Sequence
  chemically synthesized
agaatatttgtggctactatta

SEQ ID NO: 1350363 - DNA, 22 bp, Artificial Sequence
  chemically synthesized
gagaatatttgtggctactatt

SEQ ID NO: 1350364 - DNA, 22 bp, Artificial Sequence
  chemically synthesized
tttaaaaaataatagtagccac

SEQ ID NO: 1350365 - DNA, 22 bp, Artificial Sequence
  chemically synthesized
aaaaaataatagtagccacaaa

SEQ ID NO: 1350366 - DNA, 22 bp, Artificial Sequence
  chemically synthesized
aaaaataatagtagccacaaat

SEQ ID NO: 1350367 - DNA, 22 bp, Artificial Sequence
  chemically synthesized
gatgcatgatcatttgagaata

SEQ ID NO: 1350368 - DNA, 22 bp, Artificial Sequence
  chemically synthesized
gggtccacaagattcgatgcat

SEQ ID NO: 1350369 - DNA, 22 bp, Artificial Sequence
  chemically synthesized
ggggtccacaagattcgatgca

SEQ ID NO: 1350370 - DNA, 22 bp, Artificial Sequence
  chemically synthesized
tcaaatgatcatgcatcgaatc

SEQ ID NO: 1350371 - DNA, 22 bp, Artificial Sequence
  chemically synthesized
ttggggtccacaagattcgatg

SEQ ID NO: 1350372 - DNA, 22 bp, Artificial Sequence
  chemically synthesized
aaatgatcatgcatcgaatctt

SEQ ID NO: 1350373 - DNA, 22 bp, Artificial Sequence
  chemically synthesized
ctcttggggtccacaagattcg

SEQ ID NO: 1350374 - DNA, 22 bp, Artificial Sequence
  chemically synthesized
gggatatgattactcttggggt

SEQ ID NO: 1350375 - DNA, 22 bp, Artificial Sequence
  chemically synthesized
agggatatgattactcttgggg

SEQ ID NO: 1350376 - DNA, 22 bp, Artificial Sequence
  chemically synthesized
ccttagggatatgattactctt

SEQ ID NO: 1350377 - DNA, 22 bp, Artificial Sequence
  chemically synthesized
gtggaccccaagagtaatcata

SEQ ID NO: 1350378 - DNA, 22 bp, Artificial Sequence
  chemically synthesized
tggaccccaagagtaatcatat

SEQ ID NO: 1350379 - DNA, 22 bp, Artificial Sequence
  chemically synthesized
gctcccttagggatatgattac

SEQ ID NO: 1350380 - DNA, 22 bp, Artificial Sequence
  chemically synthesized
agctcccttagggatatgatta

SEQ ID NO: 1350381 - DNA, 22 bp, Artificial Sequence
  chemically synthesized
tttagctcccttagggatatga

SEQ ID NO: 1350382 - DNA, 22 bp, Artificial Sequence
  chemically synthesized
atacgttatttagctcccttag

SEQ ID NO: 1350383 - DNA, 22 bp, Artificial Sequence
  chemically synthesized
cactcatacgttatttagctcc

SEQ ID NO: 1350384 - DNA, 22 bp, Artificial Sequence
  chemically synthesized
agggagctaaataacgtatgag

SEQ ID NO: 1350385 - DNA, 22 bp, Artificial Sequence
  chemically synthesized
caatagacatctacactcatac

SEQ ID NO: 1350386 - DNA, 22 bp, Artificial Sequence
  chemically synthesized
cattgcaatagacatctacact

SEQ ID NO: 1350387 - DNA, 22 bp, Artificial Sequence
  chemically synthesized
aataacgtatgagtgtagatgt

SEQ ID NO: 1350388 - DNA, 22 bp, Artificial Sequence
  chemically synthesized
aaaaactgcattgcaatagaca

SEQ ID NO: 1350389 - DNA, 22 bp, Artificial Sequence
  chemically synthesized
gaaaaactgcattgcaatagac

SEQ ID NO: 1350390 - DNA, 22 bp, Artificial Sequence
  chemically synthesized
tgaaaaactgcattgcaataga

SEQ ID NO: 1350391 - DNA, 22 bp, Artificial Sequence
  chemically synthesized
tcaatggcattttgaaaaactg

SEQ ID NO: 1350392 - DNA, 22 bp, Artificial Sequence
  chemically synthesized
ttgcaatgcagtttttcaaaat

SEQ ID NO: 1350393 - DNA, 22 bp, Artificial Sequence
  chemically synthesized
caatgcagtttttcaaaatgcc

SEQ ID NO: 1350394 - DNA, 22 bp, Artificial Sequence
  chemically synthesized
ttcaaaatgccattgacaattt

SEQ ID NO: 1350395 - DNA, 22 bp, Artificial Sequence
  chemically synthesized
aaggaagtcaacaaattgtcaa

SEQ ID NO: 1350396 - DNA, 22 bp, Artificial Sequence
  chemically synthesized
tcaaaatgccattgacaatttg

SEQ ID NO: 1350397 - DNA, 22 bp, Artificial Sequence
  chemically synthesized
gaaggaagtcaacaaattgtca

SEQ ID NO: 1350398 - DNA, 22 bp, Artificial Sequence
  chemically synthesized
caaaatgccattgacaatttgt

SEQ ID NO: 1350399 - DNA, 22 bp, Artificial Sequence
  chemically synthesized
aaaatgccattgacaatttgtt

SEQ ID NO: 1350400 - DNA, 22 bp, Artificial Sequence
  chemically synthesized
agccaaccttgaaggaagtcaa

SEQ ID NO: 1350401 - DNA, 22 bp, Artificial Sequence
  chemically synthesized
acaatttgttgacttccttcaa

SEQ ID NO: 1350402 - DNA, 22 bp, Artificial Sequence
  chemically synthesized
gttgacttccttcaaggttggc

SEQ ID NO: 1350403 - DNA, 22 bp, Artificial Sequence
  chemically synthesized
ttgacttccttcaaggttggct

SEQ ID NO: 1350404 - DNA, 22 bp, Artificial Sequence
  chemically synthesized
agaaagaaagctaagccaacct

SEQ ID NO: 1350405 - DNA, 22 bp, Artificial Sequence
  chemically synthesized
acttccttcaaggttggcttag

SEQ ID NO: 1350406 - DNA, 22 bp, Artificial Sequence
  chemically synthesized
ccttcaaggttggcttagcttt

SEQ ID NO: 1350407 - DNA, 22 bp, Artificial Sequence
  chemically synthesized
cttcaaggttggcttagctttc

SEQ ID NO: 1350408 - DNA, 22 bp, Artificial Sequence
  chemically synthesized
gaggctgagaaagaaagctaag

SEQ ID NO: 1350409 - DNA, 22 bp, Artificial Sequence
  chemically synthesized
ggaggctgagaaagaaagctaa

SEQ ID NO: 1350410 - DNA, 22 bp, Artificial Sequence
  chemically synthesized
tggaggctgagaaagaaagcta

SEQ ID NO: 1350411 - DNA, 22 bp, Artificial Sequence
  chemically synthesized
caaggttggcttagctttcttt

SEQ ID NO: 1350412 - DNA, 22 bp, Artificial Sequence
  chemically synthesized
ttggaggctgagaaagaaagct

SEQ ID NO: 1350413 - DNA, 22 bp, Artificial Sequence
  chemically synthesized
aaggttggcttagctttctttc

SEQ ID NO: 1350414 - DNA, 22 bp, Artificial Sequence
  chemically synthesized
gcttagctttctttctcagcct

SEQ ID NO: 1350415 - DNA, 22 bp, Artificial Sequence
  chemically synthesized
atagccttttggaggctgagaa

SEQ ID NO: 1350416 - DNA, 22 bp, Artificial Sequence
  chemically synthesized
gatagccttttggaggctgaga

SEQ ID NO: 1350417 - DNA, 22 bp, Artificial Sequence
  chemically synthesized
agctttctttctcagcctccaa

SEQ ID NO: 1350418 - DNA, 22 bp, Artificial Sequence
  chemically synthesized
gctttctttctcagcctccaaa

SEQ ID NO: 1350419 - DNA, 22 bp, Artificial Sequence
  chemically synthesized
tctttctcagcctccaaaaggc

SEQ ID NO: 1350420 - DNA, 22 bp, Artificial Sequence
  chemically synthesized
ctttctcagcctccaaaaggct

SEQ ID NO: 1350421 - DNA, 22 bp, Artificial Sequence
  chemically synthesized
tttctcagcctccaaaaggcta

SEQ ID NO: 1350422 - DNA, 22 bp, Artificial Sequence
  chemically synthesized
tctcagcctccaaaaggctatc

SEQ ID NO: 1350423 - DNA, 22 bp, Artificial Sequence
  chemically synthesized
catgggaaacttgatagccttt

SEQ ID NO: 1350424 - DNA, 22 bp, Artificial Sequence
  chemically synthesized
ctcagcctccaaaaggctatca

SEQ ID NO: 1350425 - DNA, 22 bp, Artificial Sequence
  chemically synthesized
tcagcctccaaaaggctatcaa

SEQ ID NO: 1350426 - DNA, 22 bp, Artificial Sequence
  chemically synthesized
agcctccaaaaggctatcaagt

SEQ ID NO: 1350427 - DNA, 22 bp, Artificial Sequence
  chemically synthesized
aaagaactacatgggaaacttg

SEQ ID NO: 1350428 - DNA, 22 bp, Artificial Sequence
  chemically synthesized
caaaaggctatcaagtttccca

SEQ ID NO: 1350429 - DNA, 22 bp, Artificial Sequence
  chemically synthesized
tcaagtttcccatgtagttctt

SEQ ID NO: 1350430 - DNA, 22 bp, Artificial Sequence
  chemically synthesized
cccatgtagttctttgagatga

SEQ ID NO: 1350431 - DNA, 22 bp, Artificial Sequence
  chemically synthesized
ccatgtagttctttgagatgat

SEQ ID NO: 1350432 - DNA, 22 bp, Artificial Sequence
  chemically synthesized
ccaaaacatagatcgatcatct

SEQ ID NO: 1350433 - DNA, 22 bp, Artificial Sequence
  chemically synthesized
ctcccaaaacatagatcgatca

SEQ ID NO: 1350434 - DNA, 22 bp, Artificial Sequence
  chemically synthesized
tttgagatgatcgatctatgtt

SEQ ID NO: 1350435 - DNA, 22 bp, Artificial Sequence
  chemically synthesized
caactcctcccaaaacatagat

SEQ ID NO: 1350436 - DNA, 22 bp, Artificial Sequence
  chemically synthesized
tgagatgatcgatctatgtttt

SEQ ID NO: 1350437 - DNA, 22 bp, Artificial Sequence
  chemically synthesized
gcaactcctcccaaaacataga

SEQ ID NO: 1350438 - DNA, 22 bp, Artificial Sequence
  chemically synthesized
gagatgatcgatctatgttttg

SEQ ID NO: 1350439 - DNA, 22 bp, Artificial Sequence
  chemically synthesized
tgcaactcctcccaaaacatag

SEQ ID NO: 1350440 - DNA, 22 bp, Artificial Sequence
  chemically synthesized
agatgatcgatctatgttttgg

SEQ ID NO: 1350441 - DNA, 22 bp, Artificial Sequence
  chemically synthesized
atatattttgcaactcctccca

SEQ ID NO: 1350442 - DNA, 22 bp, Artificial Sequence
  chemically synthesized
tatctcatatattttgcaactc

SEQ ID NO: 1350443 - DNA, 22 bp, Artificial Sequence
  chemically synthesized
tgttttgggaggagttgcaaaa

SEQ ID NO: 1350444 - DNA, 22 bp, Artificial Sequence
  chemically synthesized
tgggaggagttgcaaaatatat

SEQ ID NO: 1350445 - DNA, 22 bp, Artificial Sequence
  chemically synthesized
gggaggagttgcaaaatatatg

SEQ ID NO: 1350446 - DNA, 22 bp, Artificial Sequence
  chemically synthesized
ggaggagttgcaaaatatatga

SEQ ID NO: 1350447 - DNA, 22 bp, Artificial Sequence
  chemically synthesized
atacagaaggtggctatatctc

SEQ ID NO: 1350448 - DNA, 22 bp, Artificial Sequence
  chemically synthesized
caaaatatatgagatatagcca

SEQ ID NO: 1350449 - DNA, 22 bp, Artificial Sequence
  chemically synthesized
tgatacagaaggtggctatatc

SEQ ID NO: 1350450 - DNA, 22 bp, Artificial Sequence
  chemically synthesized
ctgatacagaaggtggctatat

SEQ ID NO: 1350451 - DNA, 22 bp, Artificial Sequence
  chemically synthesized
ataacccaagagggaatccttc

SEQ ID NO: 1350452 - DNA, 22 bp, Artificial Sequence
  chemically synthesized
tgataacccaagagggaatcct

SEQ ID NO: 1350453 - DNA, 22 bp, Artificial Sequence
  chemically synthesized
ctgtatcagaaggattccctct

SEQ ID NO: 1350454 - DNA, 22 bp, Artificial Sequence
  chemically synthesized
tgtatcagaaggattccctctt

SEQ ID NO: 1350455 - DNA, 22 bp, Artificial Sequence
  chemically synthesized
ttctgataacccaagagggaat

SEQ ID NO: 1350456 - DNA, 22 bp, Artificial Sequence
  chemically synthesized
tatcagaaggattccctcttgg

SEQ ID NO: 1350457 - DNA, 22 bp, Artificial Sequence
  chemically synthesized
attgttctgataacccaagagg

SEQ ID NO: 1350458 - DNA, 22 bp, Artificial Sequence
  chemically synthesized
gattgttctgataacccaagag

SEQ ID NO: 1350459 - DNA, 22 bp, Artificial Sequence
  chemically synthesized
tgattgttctgataacccaaga

SEQ ID NO: 1350460 - DNA, 22 bp, Artificial Sequence
  chemically synthesized
tttgattgttctgataacccaa

SEQ ID NO: 1350461 - DNA, 22 bp, Artificial Sequence
  chemically synthesized
ctttgattgttctgataaccca

SEQ ID NO: 1350462 - DNA, 22 bp, Artificial Sequence
  chemically synthesized
cctcttgggttatcagaacaat

SEQ ID NO: 1350463 - DNA, 22 bp, Artificial Sequence
  chemically synthesized
ttgggttatcagaacaatcaaa

SEQ ID NO: 1350464 - DNA, 22 bp, Artificial Sequence
  chemically synthesized
gggttatcagaacaatcaaaga

SEQ ID NO: 1350465 - DNA, 22 bp, Artificial Sequence
  chemically synthesized
ggttatcagaacaatcaaagaa

SEQ ID NO: 1350466 - DNA, 22 bp, Artificial Sequence
  chemically synthesized
cagtaatcagatagcttctttg

SEQ ID NO: 1350467 - DNA, 22 bp, Artificial Sequence
  chemically synthesized
tcagaacaatcaaagaagctat

SEQ ID NO: 1350468 - DNA, 22 bp, Artificial Sequence
  chemically synthesized
ctccagtaatcagatagcttct

SEQ ID NO: 1350469 - DNA, 22 bp, Artificial Sequence
  chemically synthesized
tcctccagtaatcagatagctt

SEQ ID NO: 1350470 - DNA, 22 bp, Artificial Sequence
  chemically synthesized
tgtcagtctctcctccagtaat

SEQ ID NO: 1350471 - DNA, 22 bp, Artificial Sequence
  chemically synthesized
atgtcagtctctcctccagtaa

SEQ ID NO: 1350472 - DNA, 22 bp, Artificial Sequence
  chemically synthesized
tatgtcagtctctcctccagta

SEQ ID NO: 1350473 - DNA, 22 bp, Artificial Sequence
  chemically synthesized
tctgattactggaggagagact

SEQ ID NO: 1350474 - DNA, 22 bp, Artificial Sequence
  chemically synthesized
caattttatgtcagtctctcct

SEQ ID NO: 1350475 - DNA, 22 bp, Artificial Sequence
  chemically synthesized
attactggaggagagactgaca

SEQ ID NO: 1350476 - DNA, 22 bp, Artificial Sequence
  chemically synthesized
aaaactacaattttatgtcagt

SEQ ID NO: 1350477 - DNA, 22 bp, Artificial Sequence
  chemically synthesized
ctggaggagagactgacataaa

SEQ ID NO: 1350478 - DNA, 22 bp, Artificial Sequence
  chemically synthesized
gaggagagactgacataaaatt

SEQ ID NO: 1350479 - DNA, 22 bp, Artificial Sequence
  chemically synthesized
acaagaagttaaaaactacaat

SEQ ID NO: 1350480 - DNA, 22 bp, Artificial Sequence
  chemically synthesized
cacaagaagttaaaaactacaa

SEQ ID NO: 1350481 - DNA, 22 bp, Artificial Sequence
  chemically synthesized
tcacaagaagttaaaaactaca

SEQ ID NO: 1350482 - DNA, 22 bp, Artificial Sequence
  chemically synthesized
acataaaattgtagtttttaac

SEQ ID NO: 1350483 - DNA, 22 bp, Artificial Sequence
  chemically synthesized
acaactttcacaagaagttaaa

SEQ ID NO: 1350484 - DNA, 22 bp, Artificial Sequence
  chemically synthesized
tcacaactttcacaagaagtta

SEQ ID NO: 1350485 - DNA, 22 bp, Artificial Sequence
  chemically synthesized
tagtttttaacttcttgtgaaa

SEQ ID NO: 1350486 - DNA, 22 bp, Artificial Sequence
  chemically synthesized
ttaacttcttgtgaaagttgtg

SEQ ID NO: 1350487 - DNA, 22 bp, Artificial Sequence
  chemically synthesized
taacttcttgtgaaagttgtga

SEQ ID NO: 1350488 - DNA, 22 bp, Artificial Sequence
  chemically synthesized
aacttcttgtgaaagttgtgag

SEQ ID NO: 1350489 - DNA, 22 bp, Artificial Sequence
  chemically synthesized
acttcttgtgaaagttgtgaga

SEQ ID NO: 1350490 - DNA, 22 bp, Artificial Sequence
  chemically synthesized
catgcagtgtcaagctctcaca

SEQ ID NO: 1350491 - DNA, 22 bp, Artificial Sequence
  chemically synthesized
cttgtgaaagttgtgagagctt

SEQ ID NO: 1350492 - DNA, 22 bp, Artificial Sequence
  chemically synthesized
ttgtgaaagttgtgagagcttg

SEQ ID NO: 1350493 - DNA, 22 bp, Artificial Sequence
  chemically synthesized
ctgcatgcagtgtcaagctctc

SEQ ID NO: 1350494 - DNA, 22 bp, Artificial Sequence
  chemically synthesized
gtgaaagttgtgagagcttgac

SEQ ID NO: 1350495 - DNA, 22 bp, Artificial Sequence
  chemically synthesized
tgaaagttgtgagagcttgaca

SEQ ID NO: 1350496 - DNA, 22 bp, Artificial Sequence
  chemically synthesized
ctcctgcatgcagtgtcaagct

SEQ ID NO: 1350497 - DNA, 22 bp, Artificial Sequence
  chemically synthesized
agttactcctgcatgcagtgtc

SEQ ID NO: 1350498 - DNA, 22 bp, Artificial Sequence
  chemically synthesized
aagttactcctgcatgcagtgt

SEQ ID NO: 1350499 - DNA, 22 bp, Artificial Sequence
  chemically synthesized
tgagagcttgacactgcatgca

SEQ ID NO: 1350500 - DNA, 22 bp, Artificial Sequence
  chemically synthesized
ttaagttactcctgcatgcagt

SEQ ID NO: 1350501 - DNA, 22 bp, Artificial Sequence
  chemically synthesized
ttcttaagttactcctgcatgc

SEQ ID NO: 1350502 - DNA, 22 bp, Artificial Sequence
  chemically synthesized
gacactgcatgcaggagtaact

SEQ ID NO: 1350503 - DNA, 22 bp, Artificial Sequence
  chemically synthesized
acactgcatgcaggagtaactt

SEQ ID NO: 1350504 - DNA, 22 bp, Artificial Sequence
  chemically synthesized
catgcaggagtaacttaagaac

SEQ ID NO: 1350505 - DNA, 22 bp, Artificial Sequence
  chemically synthesized
aaagccacagagggaagattgt

SEQ ID NO: 1350506 - DNA, 22 bp, Artificial Sequence
  chemically synthesized
caaagccacagagggaagattg

SEQ ID NO: 1350507 - DNA, 22 bp, Artificial Sequence
  chemically synthesized
aagaacaatcttccctctgtgg

SEQ ID NO: 1350508 - DNA, 22 bp, Artificial Sequence
  chemically synthesized
agaacaatcttccctctgtggc

SEQ ID NO: 1350509 - DNA, 22 bp, Artificial Sequence
  chemically synthesized
tcccacatggggtgatttcaaa

SEQ ID NO: 1350510 - DNA, 22 bp, Artificial Sequence
  chemically synthesized
ccctctgtggctttgaaatcac

SEQ ID NO: 1350511 - DNA, 22 bp, Artificial Sequence
  chemically synthesized
cctctgtggctttgaaatcacc

SEQ ID NO: 1350512 - DNA, 22 bp, Artificial Sequence
  chemically synthesized
tgtggctttgaaatcaccccat

SEQ ID NO: 1350513 - DNA, 22 bp, Artificial Sequence
  chemically synthesized
tagttatcccacatggggtgat

SEQ ID NO: 1350514 - DNA, 22 bp, Artificial Sequence
  chemically synthesized
gtagttatcccacatggggtga

SEQ ID NO: 1350515 - DNA, 22 bp, Artificial Sequence
  chemically synthesized
tggctttgaaatcaccccatgt

SEQ ID NO: 1350516 - DNA, 22 bp, Artificial Sequence
  chemically synthesized
tgaaatcaccccatgtgggata

SEQ ID NO: 1350517 - DNA, 22 bp, Artificial Sequence
  chemically synthesized
gaaatcaccccatgtgggataa

SEQ ID NO: 1350518 - DNA, 22 bp, Artificial Sequence
  chemically synthesized
aaatcaccccatgtgggataac

SEQ ID NO: 1350519 - DNA, 22 bp, Artificial Sequence
  chemically synthesized
caacaataacaggccttgtagt

SEQ ID NO: 1350520 - DNA, 22 bp, Artificial Sequence
  chemically synthesized
ccaacaataacaggccttgtag

SEQ ID NO: 1350521 - DNA, 22 bp, Artificial Sequence
  chemically synthesized
ttccaacaataacaggccttgt

SEQ ID NO: 1350522 - DNA, 22 bp, Artificial Sequence
  chemically synthesized
gctcttccaacaataacaggcc

SEQ ID NO: 1350523 - DNA, 22 bp, Artificial Sequence
  chemically synthesized
agctcttccaacaataacaggc

SEQ ID NO: 1350524 - DNA, 22 bp, Artificial Sequence
  chemically synthesized
cttagctcttccaacaataaca

SEQ ID NO: 1350525 - DNA, 22 bp, Artificial Sequence
  chemically synthesized
ttgcttagctcttccaacaata

SEQ ID NO: 1350526 - DNA, 22 bp, Artificial Sequence
  chemically synthesized
caaggcctgttattgttggaag

SEQ ID NO: 1350527 - DNA, 22 bp, Artificial Sequence
  chemically synthesized
aactattgcttagctcttccaa

SEQ ID NO: 1350528 - DNA, 22 bp, Artificial Sequence
  chemically synthesized
aaactattgcttagctcttcca

SEQ ID NO: 1350529 - DNA, 22 bp, Artificial Sequence
  chemically synthesized
taaactattgcttagctcttcc

SEQ ID NO: 1350530 - DNA, 22 bp, Artificial Sequence
  chemically synthesized
tttaaactattgcttagctctt

SEQ ID NO: 1350531 - DNA, 22 bp, Artificial Sequence
  chemically synthesized
ttattgttggaagagctaagca

SEQ ID NO: 1350532 - DNA, 22 bp, Artificial Sequence
  chemically synthesized
tctttaaactattgcttagctc

SEQ ID NO: 1350533 - DNA, 22 bp, Artificial Sequence
  chemically synthesized
ttgttggaagagctaagcaata

SEQ ID NO: 1350534 - DNA, 22 bp, Artificial Sequence
  chemically synthesized
gttctctttaaactattgctta

SEQ ID NO: 1350535 - DNA, 22 bp, Artificial Sequence
  chemically synthesized
ttggaagagctaagcaatagtt

SEQ ID NO: 1350536 - DNA, 22 bp, Artificial Sequence
  chemically synthesized
gaagagctaagcaatagtttaa

SEQ ID NO: 1350537 - DNA, 22 bp, Artificial Sequence
  chemically synthesized
taacaaatctagttctctttaa

SEQ ID NO: 1350538 - DNA, 22 bp, Artificial Sequence
  chemically synthesized
gtaacaaatctagttctcttta

SEQ ID NO: 1350539 - DNA, 22 bp, Artificial Sequence
  chemically synthesized
tgtaacaaatctagttctcttt

SEQ ID NO: 1350540 - DNA, 22 bp, Artificial Sequence
  chemically synthesized
agcaatagtttaaagagaacta

SEQ ID NO: 1350541 - DNA, 22 bp, Artificial Sequence
  chemically synthesized
ttgtaacaaatctagttctctt

SEQ ID NO: 1350542 - DNA, 22 bp, Artificial Sequence
  chemically synthesized
atttttgtaacaaatctagttc

SEQ ID NO: 1350543 - DNA, 22 bp, Artificial Sequence
  chemically synthesized
gatttttgtaacaaatctagtt

SEQ ID NO: 1350544 - DNA, 22 bp, Artificial Sequence
  chemically synthesized
aaagagaactagatttgttaca

SEQ ID NO: 1350545 - DNA, 22 bp, Artificial Sequence
  chemically synthesized
aagagaactagatttgttacaa

SEQ ID NO: 1350546 - DNA, 22 bp, Artificial Sequence
  chemically synthesized
ggcagccatcttgatttttgta

SEQ ID NO: 1350547 - DNA, 22 bp, Artificial Sequence
  chemically synthesized
aggcagccatcttgatttttgt

SEQ ID NO: 1350548 - DNA, 22 bp, Artificial Sequence
  chemically synthesized
taggcagccatcttgatttttg

SEQ ID NO: 1350549 - DNA, 22 bp, Artificial Sequence
  chemically synthesized
gatttgttacaaaaatcaagat

SEQ ID NO: 1350550 - DNA, 22 bp, Artificial Sequence
  chemically synthesized
aattttaggcagccatcttgat

SEQ ID NO: 1350551 - DNA, 22 bp, Artificial Sequence
  chemically synthesized
gttacaaaaatcaagatggctg

SEQ ID NO: 1350552 - DNA, 22 bp, Artificial Sequence
  chemically synthesized
ttacaaaaatcaagatggctgc

SEQ ID NO: 1350553 - DNA, 22 bp, Artificial Sequence
  chemically synthesized
caaaaatcaagatggctgccta

SEQ ID NO: 1350554 - DNA, 22 bp, Artificial Sequence
  chemically synthesized
gtatgttgaattttaggcagcc

SEQ ID NO: 1350555 - DNA, 22 bp, Artificial Sequence
  chemically synthesized
cctaaaattcaacatactaggc

SEQ ID NO: 1350556 - DNA, 22 bp, Artificial Sequence
  chemically synthesized
aaattcaacatactaggcctat

SEQ ID NO: 1350557 - DNA, 22 bp, Artificial Sequence
  chemically synthesized
ggcataatatacgtaaataggc

SEQ ID NO: 1350558 - DNA, 22 bp, Artificial Sequence
  chemically synthesized
gggcataatatacgtaaatagg

SEQ ID NO: 1350559 - DNA, 22 bp, Artificial Sequence
  chemically synthesized
aacatactaggcctatttacgt

SEQ ID NO: 1350560 - DNA, 22 bp, Artificial Sequence
  chemically synthesized
ggcctatttacgtatattatgc

SEQ ID NO: 1350561 - DNA, 22 bp, Artificial Sequence
  chemically synthesized
ccagccaagtgccttgggcata

SEQ ID NO: 1350562 - DNA, 22 bp, Artificial Sequence
  chemically synthesized
tttacgtatattatgcccaagg

SEQ ID NO: 1350563 - DNA, 22 bp, Artificial Sequence
  chemically synthesized
acgtatattatgcccaaggcac

SEQ ID NO: 1350564 - DNA, 22 bp, Artificial Sequence
  chemically synthesized
cgtatattatgcccaaggcact

SEQ ID NO: 1350565 - DNA, 22 bp, Artificial Sequence
  chemically synthesized
tattaccagccaagtgccttgg

SEQ ID NO: 1350566 - DNA, 22 bp, Artificial Sequence
  chemically synthesized
gcccctgtattaccagccaagt

SEQ ID NO: 1350567 - DNA, 22 bp, Artificial Sequence
  chemically synthesized
agcccctgtattaccagccaag

SEQ ID NO: 1350568 - DNA, 22 bp, Artificial Sequence
  chemically synthesized
tgcccaaggcacttggctggta

SEQ ID NO: 1350569 - DNA, 22 bp, Artificial Sequence
  chemically synthesized
tttagcccctgtattaccagcc

SEQ ID NO: 1350570 - DNA, 22 bp, Artificial Sequence
  chemically synthesized
gtttagcccctgtattaccagc

SEQ ID NO: 1350571 - DNA, 22 bp, Artificial Sequence
  chemically synthesized
tgtttagcccctgtattaccag

SEQ ID NO: 1350572 - DNA, 22 bp, Artificial Sequence
  chemically synthesized
tttgtttagcccctgtattacc

SEQ ID NO: 1350573 - DNA, 22 bp, Artificial Sequence
  chemically synthesized
ctttgtttagcccctgtattac

SEQ ID NO: 1350574 - DNA, 22 bp, Artificial Sequence
  chemically synthesized
tctttgtttagcccctgtatta

SEQ ID NO: 1350575 - DNA, 22 bp, Artificial Sequence
  chemically synthesized
tttctttgtttagcccctgtat

SEQ ID NO: 1350576 - DNA, 22 bp, Artificial Sequence
  chemically synthesized
ctttctttgtttagcccctgta

SEQ ID NO: 1350577 - DNA, 22 bp, Artificial Sequence
  chemically synthesized
tctttctttgtttagcccctgt

SEQ ID NO: 1350578 - DNA, 22 bp, Artificial Sequence
  chemically synthesized
ggctggtaatacaggggctaaa

SEQ ID NO: 1350579 - DNA, 22 bp, Artificial Sequence
  chemically synthesized
gctggtaatacaggggctaaac

SEQ ID NO: 1350580 - DNA, 22 bp, Artificial Sequence
  chemically synthesized
attttctttctttgtttagccc

SEQ ID NO: 1350581 - DNA, 22 bp, Artificial Sequence
  chemically synthesized
gtaatacaggggctaaacaaag

SEQ ID NO: 1350582 - DNA, 22 bp, Artificial Sequence
  chemically synthesized
ggcaagaactaattttctttct

SEQ ID NO: 1350583 - DNA, 22 bp, Artificial Sequence
  chemically synthesized
cctaggcaagaactaattttct

SEQ ID NO: 1350584 - DNA, 22 bp, Artificial Sequence
  chemically synthesized
ccctaggcaagaactaattttc

SEQ ID NO: 1350585 - DNA, 22 bp, Artificial Sequence
  chemically synthesized
aacaaagaaagaaaattagttc

SEQ ID NO: 1350586 - DNA, 22 bp, Artificial Sequence
  chemically synthesized
cttccctaggcaagaactaatt

SEQ ID NO: 1350587 - DNA, 22 bp, Artificial Sequence
  chemically synthesized
ctccttccctaggcaagaacta

SEQ ID NO: 1350588 - DNA, 22 bp, Artificial Sequence
  chemically synthesized
cctccttccctaggcaagaact

SEQ ID NO: 1350589 - DNA, 22 bp, Artificial Sequence
  chemically synthesized
tcctccttccctaggcaagaac

SEQ ID NO: 1350590 - DNA, 22 bp, Artificial Sequence
  chemically synthesized
ttcctccttccctaggcaagaa

SEQ ID NO: 1350591 - DNA, 22 bp, Artificial Sequence
  chemically synthesized
cttttcctccttccctaggcaa

SEQ ID NO: 1350592 - DNA, 22 bp, Artificial Sequence
  chemically synthesized
ttccttttcctccttccctagg

SEQ ID NO: 1350593 - DNA, 22 bp, Artificial Sequence
  chemically synthesized
gttcttgcctagggaaggagga

SEQ ID NO: 1350594 - DNA, 22 bp, Artificial Sequence
  chemically synthesized
ttgcctagggaaggaggaaaag

SEQ ID NO: 1350595 - DNA, 22 bp, Artificial Sequence
  chemically synthesized
aataaattattccttttcctcc

SEQ ID NO: 1350596 - DNA, 22 bp, Artificial Sequence
  chemically synthesized
gcctagggaaggaggaaaagga

SEQ ID NO: 1350597 - DNA, 22 bp, Artificial Sequence
  chemically synthesized
cctagggaaggaggaaaaggaa

SEQ ID NO: 1350598 - DNA, 22 bp, Artificial Sequence
  chemically synthesized
gtactcaataaattattccttt

SEQ ID NO: 1350599 - DNA, 22 bp, Artificial Sequence
  chemically synthesized
gggaaggaggaaaaggaataat

SEQ ID NO: 1350600 - DNA, 22 bp, Artificial Sequence
  chemically synthesized
attgagtaccaattatacacta

SEQ ID NO: 1350601 - DNA, 22 bp, Artificial Sequence
  chemically synthesized
ttgagtaccaattatacactat

SEQ ID NO: 1350602 - DNA, 22 bp, Artificial Sequence
  chemically synthesized
agtaccaattatacactatgcc

SEQ ID NO: 1350603 - DNA, 22 bp, Artificial Sequence
  chemically synthesized
gatgacataaatataaagggca

SEQ ID NO: 1350604 - DNA, 22 bp, Artificial Sequence
  chemically synthesized
tacactatgccctttatattta

SEQ ID NO: 1350605 - DNA, 22 bp, Artificial Sequence
  chemically synthesized
tgcattggatgacataaatata

SEQ ID NO: 1350606 - DNA, 22 bp, Artificial Sequence
  chemically synthesized
gtgcattggatgacataaatat

SEQ ID NO: 1350607 - DNA, 22 bp, Artificial Sequence
  chemically synthesized
tgtgcattggatgacataaata

SEQ ID NO: 1350608 - DNA, 22 bp, Artificial Sequence
  chemically synthesized
tgccctttatatttatgtcatc

SEQ ID NO: 1350609 - DNA, 22 bp, Artificial Sequence
  chemically synthesized
tatatttatgtcatccaatgca

SEQ ID NO: 1350610 - DNA, 22 bp, Artificial Sequence
  chemically synthesized
atatttatgtcatccaatgcac

SEQ ID NO: 1350611 - DNA, 22 bp, Artificial Sequence
  chemically synthesized
tatttatgtcatccaatgcaca

SEQ ID NO: 1350612 - DNA, 22 bp, Artificial Sequence
  chemically synthesized
aatcataataaagctttgtgca

SEQ ID NO: 1350613 - DNA, 22 bp, Artificial Sequence
  chemically synthesized
atgtcatccaatgcacaaagct

SEQ ID NO: 1350614 - DNA, 22 bp, Artificial Sequence
  chemically synthesized
tgtcatccaatgcacaaagctt

SEQ ID NO: 1350615 - DNA, 22 bp, Artificial Sequence
  chemically synthesized
ctaaatcataataaagctttgt

SEQ ID NO: 1350616 - DNA, 22 bp, Artificial Sequence
  chemically synthesized
cctaaatcataataaagctttg

SEQ ID NO: 1350617 - DNA, 22 bp, Artificial Sequence
  chemically synthesized
taaagtgagtataatatttcct

SEQ ID NO: 1350618 - DNA, 22 bp, Artificial Sequence
  chemically synthesized
tattatgatttaggaaatatta

SEQ ID NO: 1350619 - DNA, 22 bp, Artificial Sequence
  chemically synthesized
attatgatttaggaaatattat

SEQ ID NO: 1350620 - DNA, 22 bp, Artificial Sequence
  chemically synthesized
ttatgatttaggaaatattata

SEQ ID NO: 1350621 - DNA, 22 bp, Artificial Sequence
  chemically synthesized
ctgtaaagtgagtataatattt

SEQ ID NO: 1350622 - DNA, 22 bp, Artificial Sequence
  chemically synthesized
cctgtaaagtgagtataatatt

SEQ ID NO: 1350623 - DNA, 22 bp, Artificial Sequence
  chemically synthesized
tcctgtaaagtgagtataatat

SEQ ID NO: 1350624 - DNA, 22 bp, Artificial Sequence
  chemically synthesized
tgatttaggaaatattatactc

SEQ ID NO: 1350625 - DNA, 22 bp, Artificial Sequence
  chemically synthesized
ttcctgtaaagtgagtataata

SEQ ID NO: 1350626 - DNA, 22 bp, Artificial Sequence
  chemically synthesized
tttcctgtaaagtgagtataat

SEQ ID NO: 1350627 - DNA, 22 bp, Artificial Sequence
  chemically synthesized
ttttcctgtaaagtgagtataa

SEQ ID NO: 1350628 - DNA, 22 bp, Artificial Sequence
  chemically synthesized
aggaaatattatactcacttta

SEQ ID NO: 1350629 - DNA, 22 bp, Artificial Sequence
  chemically synthesized
ggaaatattatactcactttac

SEQ ID NO: 1350630 - DNA, 22 bp, Artificial Sequence
  chemically synthesized
atggtgcttttttcctgtaaag

SEQ ID NO: 1350631 - DNA, 22 bp, Artificial Sequence
  chemically synthesized
catggtgcttttttcctgtaaa

SEQ ID NO: 1350632 - DNA, 22 bp, Artificial Sequence
  chemically synthesized
acttcatggtgcttttttcctg

SEQ ID NO: 1350633 - DNA, 22 bp, Artificial Sequence
  chemically synthesized
tactcactttacaggaaaaaag

SEQ ID NO: 1350634 - DNA, 22 bp, Artificial Sequence
  chemically synthesized
cacttcatggtgcttttttcct

SEQ ID NO: 1350635 - DNA, 22 bp, Artificial Sequence
  chemically synthesized
tcacttcatggtgcttttttcc

SEQ ID NO: 1350636 - DNA, 22 bp, Artificial Sequence
  chemically synthesized
ttcacttcatggtgcttttttc

SEQ ID NO: 1350637 - DNA, 22 bp, Artificial Sequence
  chemically synthesized
ttttcacttcatggtgcttttt

SEQ ID NO: 1350638 - DNA, 22 bp, Artificial Sequence
  chemically synthesized
actttacaggaaaaaagcacca

SEQ ID NO: 1350639 - DNA, 22 bp, Artificial Sequence
  chemically synthesized
tacaggaaaaaagcaccatgaa

SEQ ID NO: 1350640 - DNA, 22 bp, Artificial Sequence
  chemically synthesized
acaggaaaaaagcaccatgaag

SEQ ID NO: 1350641 - DNA, 22 bp, Artificial Sequence
  chemically synthesized
caggaaaaaagcaccatgaagt

SEQ ID NO: 1350642 - DNA, 22 bp, Artificial Sequence
  chemically synthesized
tagtcaatgttcttttcacttc

SEQ ID NO: 1350643 - DNA, 22 bp, Artificial Sequence
  chemically synthesized
tgtagtcaatgttcttttcact

SEQ ID NO: 1350644 - DNA, 22 bp, Artificial Sequence
  chemically synthesized
actctgtagtcaatgttctttt

SEQ ID NO: 1350645 - DNA, 22 bp, Artificial Sequence
  chemically synthesized
aggtgtgtctgactctgtagtc

SEQ ID NO: 1350646 - DNA, 22 bp, Artificial Sequence
  chemically synthesized
aaactcaggtgtgtctgactct

SEQ ID NO: 1350647 - DNA, 22 bp, Artificial Sequence
  chemically synthesized
caaactcaggtgtgtctgactc

SEQ ID NO: 1350648 - DNA, 22 bp, Artificial Sequence
  chemically synthesized
actacagagtcagacacacctg

SEQ ID NO: 1350649 - DNA, 22 bp, Artificial Sequence
  chemically synthesized
cagagtcagacacacctgagtt

SEQ ID NO: 1350650 - DNA, 22 bp, Artificial Sequence
  chemically synthesized
agccacacttcaaactcaggtg

SEQ ID NO: 1350651 - DNA, 22 bp, Artificial Sequence
  chemically synthesized
agaggctaagccacacttcaaa

SEQ ID NO: 1350652 - DNA, 22 bp, Artificial Sequence
  chemically synthesized
ttaagaggctaagccacacttc

SEQ ID NO: 1350653 - DNA, 22 bp, Artificial Sequence
  chemically synthesized
gaactattaagaggctaagcca

SEQ ID NO: 1350654 - DNA, 22 bp, Artificial Sequence
  chemically synthesized
agtttgaagtgtggcttagcct

SEQ ID NO: 1350655 - DNA, 22 bp, Artificial Sequence
  chemically synthesized
agaactattaagaggctaagcc

SEQ ID NO: 1350656 - DNA, 22 bp, Artificial Sequence
  chemically synthesized
ttagaactattaagaggctaag

SEQ ID NO: 1350657 - DNA, 22 bp, Artificial Sequence
  chemically synthesized
cttagaactattaagaggctaa

SEQ ID NO: 1350658 - DNA, 22 bp, Artificial Sequence
  chemically synthesized
tcttagaactattaagaggcta

SEQ ID NO: 1350659 - DNA, 22 bp, Artificial Sequence
  chemically synthesized
gaagtgtggcttagcctcttaa

SEQ ID NO: 1350660 - DNA, 22 bp, Artificial Sequence
  chemically synthesized
aagtgtggcttagcctcttaat

SEQ ID NO: 1350661 - DNA, 22 bp, Artificial Sequence
  chemically synthesized
ctttcttagaactattaagagg

SEQ ID NO: 1350662 - DNA, 22 bp, Artificial Sequence
  chemically synthesized
aattcctttcttagaactatta

SEQ ID NO: 1350663 - DNA, 22 bp, Artificial Sequence
  chemically synthesized
agcctcttaatagttctaagaa

SEQ ID NO: 1350664 - DNA, 22 bp, Artificial Sequence
  chemically synthesized
gcctcttaatagttctaagaaa

SEQ ID NO: 1350665 - DNA, 22 bp, Artificial Sequence
  chemically synthesized
gaagaggttaaattcctttctt

SEQ ID NO: 1350666 - DNA, 22 bp, Artificial Sequence
  chemically synthesized
ttaatagttctaagaaaggaat

SEQ ID NO: 1350667 - DNA, 22 bp, Artificial Sequence
  chemically synthesized
aatagttctaagaaaggaattt

SEQ ID NO: 1350668 - DNA, 22 bp, Artificial Sequence
  chemically synthesized
atagttctaagaaaggaattta

SEQ ID NO: 1350669 - DNA, 22 bp, Artificial Sequence
  chemically synthesized
gcctcgaagaggttaaattcct

SEQ ID NO: 1350670 - DNA, 22 bp, Artificial Sequence
  chemically synthesized
taagaaaggaatttaacctctt

SEQ ID NO: 1350671 - DNA, 22 bp, Artificial Sequence
  chemically synthesized
agaaaggaatttaacctcttcg

SEQ ID NO: 1350672 - DNA, 22 bp, Artificial Sequence
  chemically synthesized
atcagaaaactggcctcgaaga

SEQ ID NO: 1350673 - DNA, 22 bp, Artificial Sequence
  chemically synthesized
ctaatcagaaaactggcctcga

SEQ ID NO: 1350674 - DNA, 22 bp, Artificial Sequence
  chemically synthesized
actaatcagaaaactggcctcg

SEQ ID NO: 1350675 - DNA, 22 bp, Artificial Sequence
  chemically synthesized
tactaatcagaaaactggcctc

SEQ ID NO: 1350676 - DNA, 22 bp, Artificial Sequence
  chemically synthesized
aacctcttcgaggccagttttc

SEQ ID NO: 1350677 - DNA, 22 bp, Artificial Sequence
  chemically synthesized
ttttactaatcagaaaactggc

SEQ ID NO: 1350678 - DNA, 22 bp, Artificial Sequence
  chemically synthesized
acctcttcgaggccagttttct

SEQ ID NO: 1350679 - DNA, 22 bp, Artificial Sequence
  chemically synthesized
cctgttttactaatcagaaaac

SEQ ID NO: 1350680 - DNA, 22 bp, Artificial Sequence
  chemically synthesized
ccctgttttactaatcagaaaa

SEQ ID NO: 1350681 - DNA, 22 bp, Artificial Sequence
  chemically synthesized
ttcgaggccagttttctgatta

SEQ ID NO: 1350682 - DNA, 22 bp, Artificial Sequence
  chemically synthesized
cgaggccagttttctgattagt

SEQ ID NO: 1350683 - DNA, 22 bp, Artificial Sequence
  chemically synthesized
gaggccagttttctgattagta

SEQ ID NO: 1350684 - DNA, 22 bp, Artificial Sequence
  chemically synthesized
tctgattagtaaaacagggaag

SEQ ID NO: 1350685 - DNA, 22 bp, Artificial Sequence
  chemically synthesized
ctgattagtaaaacagggaagc

SEQ ID NO: 1350686 - DNA, 22 bp, Artificial Sequence
  chemically synthesized
tgattagtaaaacagggaagca

SEQ ID NO: 1350687 - DNA, 22 bp, Artificial Sequence
  chemically synthesized
attagtaaaacagggaagcata

SEQ ID NO: 1350688 - DNA, 22 bp, Artificial Sequence
  chemically synthesized
acaatagaaggtaatatgcttc

SEQ ID NO: 1350689 - DNA, 22 bp, Artificial Sequence
  chemically synthesized
cacaatagaaggtaatatgctt

SEQ ID NO: 1350690 - DNA, 22 bp, Artificial Sequence
  chemically synthesized
gtaaaacagggaagcatattac

SEQ ID NO: 1350691 - DNA, 22 bp, Artificial Sequence
  chemically synthesized
cttcacaatagaaggtaatatg

SEQ ID NO: 1350692 - DNA, 22 bp, Artificial Sequence
  chemically synthesized
ctccttcacaatagaaggtaat

SEQ ID NO: 1350693 - DNA, 22 bp, Artificial Sequence
  chemically synthesized
gctccttcacaatagaaggtaa

SEQ ID NO: 1350694 - DNA, 22 bp, Artificial Sequence
  chemically synthesized
ccttctattgtgaaggagcaaa

SEQ ID NO: 1350695 - DNA, 22 bp, Artificial Sequence
  chemically synthesized
ctattgtgaaggagcaaatacc

SEQ ID NO: 1350696 - DNA, 22 bp, Artificial Sequence
  chemically synthesized
tattgtgaaggagcaaataccg

SEQ ID NO: 1350697 - DNA, 22 bp, Artificial Sequence
  chemically synthesized
ttgtgaaggagcaaataccggc

SEQ ID NO: 1350698 - DNA, 22 bp, Artificial Sequence
  chemically synthesized
caaaacagcatagccggtattt

SEQ ID NO: 1350699 - DNA, 22 bp, Artificial Sequence
  chemically synthesized
tgaaggagcaaataccggctat

SEQ ID NO: 1350700 - DNA, 22 bp, Artificial Sequence
  chemically synthesized
actgcaaaacagcatagccggt

SEQ ID NO: 1350701 - DNA, 22 bp, Artificial Sequence
  chemically synthesized
atatgaatgttaactgcaaaac

SEQ ID NO: 1350702 - DNA, 22 bp, Artificial Sequence
  chemically synthesized
catatgaatgttaactgcaaaa

SEQ ID NO: 1350703 - DNA, 22 bp, Artificial Sequence
  chemically synthesized
tcatatgaatgttaactgcaaa

SEQ ID NO: 1350704 - DNA, 22 bp, Artificial Sequence
  chemically synthesized
tgctgttttgcagttaacattc

SEQ ID NO: 1350705 - DNA, 22 bp, Artificial Sequence
  chemically synthesized
tacctttcatatgaatgttaac

SEQ ID NO: 1350706 - DNA, 22 bp, Artificial Sequence
  chemically synthesized
atacctttcatatgaatgttaa

SEQ ID NO: 1350707 - DNA, 22 bp, Artificial Sequence
  chemically synthesized
ttttgcagttaacattcatatg

SEQ ID NO: 1350708 - DNA, 22 bp, Artificial Sequence
  chemically synthesized
tcttatacctttcatatgaatg

SEQ ID NO: 1350709 - DNA, 22 bp, Artificial Sequence
  chemically synthesized
tgcagttaacattcatatgaaa

SEQ ID NO: 1350710 - DNA, 22 bp, Artificial Sequence
  chemically synthesized
ttatcttatacctttcatatga

SEQ ID NO: 1350711 - DNA, 22 bp, Artificial Sequence
  chemically synthesized
gcagttaacattcatatgaaag

SEQ ID NO: 1350712 - DNA, 22 bp, Artificial Sequence
  chemically synthesized
cagttaacattcatatgaaagg

SEQ ID NO: 1350713 - DNA, 22 bp, Artificial Sequence
  chemically synthesized
ttattatcttatacctttcata

SEQ ID NO: 1350714 - DNA, 22 bp, Artificial Sequence
  chemically synthesized
attattatcttatacctttcat

SEQ ID NO: 1350715 - DNA, 22 bp, Artificial Sequence
  chemically synthesized
cttattattatcttataccttt

SEQ ID NO: 1350716 - DNA, 22 bp, Artificial Sequence
  chemically synthesized
acattcatatgaaaggtataag

SEQ ID NO: 1350717 - DNA, 22 bp, Artificial Sequence
  chemically synthesized
acttattattatcttatacctt

SEQ ID NO: 1350718 - DNA, 22 bp, Artificial Sequence
  chemically synthesized
tacttattattatcttatacct

SEQ ID NO: 1350719 - DNA, 22 bp, Artificial Sequence
  chemically synthesized
atatgaaaggtataagataata

SEQ ID NO: 1350720 - DNA, 22 bp, Artificial Sequence
  chemically synthesized
ataaaataatacattttactta

SEQ ID NO: 1350721 - DNA, 22 bp, Artificial Sequence
  chemically synthesized
aataaaataatacattttactt

SEQ ID NO: 1350722 - DNA, 22 bp, Artificial Sequence
  chemically synthesized
gaacatgatatacatttaataa

SEQ ID NO: 1350723 - DNA, 22 bp, Artificial Sequence
  chemically synthesized
ttttattaaatgtatatcatgt

SEQ ID NO: 1350724 - DNA, 22 bp, Artificial Sequence
  chemically synthesized
tattaaatgtatatcatgttcc

SEQ ID NO: 1350725 - DNA, 22 bp, Artificial Sequence
  chemically synthesized
attaaatgtatatcatgttcca

SEQ ID NO: 1350726 - DNA, 22 bp, Artificial Sequence
  chemically synthesized
ttaaatgtatatcatgttccag

SEQ ID NO: 1350727 - DNA, 22 bp, Artificial Sequence
  chemically synthesized
gcatataataaggtctggaaca

SEQ ID NO: 1350728 - DNA, 22 bp, Artificial Sequence
  chemically synthesized
aatgtatatcatgttccagacc

SEQ ID NO: 1350729 - DNA, 22 bp, Artificial Sequence
  chemically synthesized
agcatataataaggtctggaac

SEQ ID NO: 1350730 - DNA, 22 bp, Artificial Sequence
  chemically synthesized
cagaccttattatatgctaaga

SEQ ID NO: 1350731 - DNA, 22 bp, Artificial Sequence
  chemically synthesized
attatatgctaagacttttcca

SEQ ID NO: 1350732 - DNA, 22 bp, Artificial Sequence
  chemically synthesized
ttatatgctaagacttttccat

SEQ ID NO: 1350733 - DNA, 22 bp, Artificial Sequence
  chemically synthesized
aatgagataatatatggaaaag

SEQ ID NO: 1350734 - DNA, 22 bp, Artificial Sequence
  chemically synthesized
tatgctaagacttttccatata

SEQ ID NO: 1350735 - DNA, 22 bp, Artificial Sequence
  chemically synthesized
agacttttccatatattatctc

SEQ ID NO: 1350736 - DNA, 22 bp, Artificial Sequence
  chemically synthesized
tgaagattaaatgagataatat

SEQ ID NO: 1350737 - DNA, 22 bp, Artificial Sequence
  chemically synthesized
ctatgaagattaaatgagataa

SEQ ID NO: 1350738 - DNA, 22 bp, Artificial Sequence
  chemically synthesized
ttccatatattatctcatttaa

SEQ ID NO: 1350739 - DNA, 22 bp, Artificial Sequence
  chemically synthesized
tccatatattatctcatttaat

SEQ ID NO: 1350740 - DNA, 22 bp, Artificial Sequence
  chemically synthesized
gttgctatgaagattaaatgag

SEQ ID NO: 1350741 - DNA, 22 bp, Artificial Sequence
  chemically synthesized
ccatatattatctcatttaatc

SEQ ID NO: 1350742 - DNA, 22 bp, Artificial Sequence
  chemically synthesized
catatattatctcatttaatct

SEQ ID NO: 1350743 - DNA, 22 bp, Artificial Sequence
  chemically synthesized
acctggttgctatgaagattaa

SEQ ID NO: 1350744 - DNA, 22 bp, Artificial Sequence
  chemically synthesized
ctcacctggttgctatgaagat

SEQ ID NO: 1350745 - DNA, 22 bp, Artificial Sequence
  chemically synthesized
tctcatttaatcttcatagcaa

SEQ ID NO: 1350746 - DNA, 22 bp, Artificial Sequence
  chemically synthesized
atttaatcttcatagcaaccag

SEQ ID NO: 1350747 - DNA, 22 bp, Artificial Sequence
  chemically synthesized
gcccctcctcacctggttgcta

SEQ ID NO: 1350748 - DNA, 22 bp, Artificial Sequence
  chemically synthesized
ctggcccctcctcacctggttg

SEQ ID NO: 1350749 - DNA, 22 bp, Artificial Sequence
  chemically synthesized
aatcttcatagcaaccaggtga

SEQ ID NO: 1350750 - DNA, 22 bp, Artificial Sequence
  chemically synthesized
atcttcatagcaaccaggtgag

SEQ ID NO: 1350751 - DNA, 22 bp, Artificial Sequence
  chemically synthesized
catagcaaccaggtgaggaggg

SEQ ID NO: 1350752 - DNA, 22 bp, Artificial Sequence
  chemically synthesized
atagcaaccaggtgaggagggg

SEQ ID NO: 1350753 - DNA, 22 bp, Artificial Sequence
  chemically synthesized
taaaataatggaaaaattcctg

SEQ ID NO: 1350754 - DNA, 22 bp, Artificial Sequence
  chemically synthesized
actgtaaaataatggaaaaatt

SEQ ID NO: 1350755 - DNA, 22 bp, Artificial Sequence
  chemically synthesized
aactgtaaaataatggaaaaat

SEQ ID NO: 1350756 - DNA, 22 bp, Artificial Sequence
  chemically synthesized
cttaactgtaaaataatggaaa

SEQ ID NO: 1350757 - DNA, 22 bp, Artificial Sequence
  chemically synthesized
ccttaactgtaaaataatggaa

SEQ ID NO: 1350758 - DNA, 22 bp, Artificial Sequence
  chemically synthesized
gtttccttaactgtaaaataat

SEQ ID NO: 1350759 - DNA, 22 bp, Artificial Sequence
  chemically synthesized
agtttccttaactgtaaaataa

SEQ ID NO: 1350760 - DNA, 22 bp, Artificial Sequence
  chemically synthesized
tagtttccttaactgtaaaata

SEQ ID NO: 1350761 - DNA, 22 bp, Artificial Sequence
  chemically synthesized
agctttagtttccttaactgta

SEQ ID NO: 1350762 - DNA, 22 bp, Artificial Sequence
  chemically synthesized
ttccattattttacagttaagg

SEQ ID NO: 1350763 - DNA, 22 bp, Artificial Sequence
  chemically synthesized
tccattattttacagttaagga

SEQ ID NO: 1350764 - DNA, 22 bp, Artificial Sequence
  chemically synthesized
ccattattttacagttaaggaa

SEQ ID NO: 1350765 - DNA, 22 bp, Artificial Sequence
  chemically synthesized
cattattttacagttaaggaaa

SEQ ID NO: 1350766 - DNA, 22 bp, Artificial Sequence
  chemically synthesized
aatctgagctttagtttcctta

SEQ ID NO: 1350767 - DNA, 22 bp, Artificial Sequence
  chemically synthesized
aaatctgagctttagtttcctt

SEQ ID NO: 1350768 - DNA, 22 bp, Artificial Sequence
  chemically synthesized
taaatctgagctttagtttcct

SEQ ID NO: 1350769 - DNA, 22 bp, Artificial Sequence
  chemically synthesized
ttttacagttaaggaaactaaa

SEQ ID NO: 1350770 - DNA, 22 bp, Artificial Sequence
  chemically synthesized
tttaaatctgagctttagtttc

SEQ ID NO: 1350771 - DNA, 22 bp, Artificial Sequence
  chemically synthesized
ctttaaatctgagctttagttt

SEQ ID NO: 1350772 - DNA, 22 bp, Artificial Sequence
  chemically synthesized
tacagttaaggaaactaaagct

SEQ ID NO: 1350773 - DNA, 22 bp, Artificial Sequence
  chemically synthesized
acagttaaggaaactaaagctc

SEQ ID NO: 1350774 - DNA, 22 bp, Artificial Sequence
  chemically synthesized
cagttaaggaaactaaagctca

SEQ ID NO: 1350775 - DNA, 22 bp, Artificial Sequence
  chemically synthesized
aggaaactaaagctcagattta

SEQ ID NO: 1350776 - DNA, 22 bp, Artificial Sequence
  chemically synthesized
cacccaggtttctttaaatctg

SEQ ID NO: 1350777 - DNA, 22 bp, Artificial Sequence
  chemically synthesized
actgcacccaggtttctttaaa

SEQ ID NO: 1350778 - DNA, 22 bp, Artificial Sequence
  chemically synthesized
gactgcacccaggtttctttaa

SEQ ID NO: 1350779 - DNA, 22 bp, Artificial Sequence
  chemically synthesized
aagctcagatttaaagaaacct

SEQ ID NO: 1350780 - DNA, 22 bp, Artificial Sequence
  chemically synthesized
atttgactgcacccaggtttct

SEQ ID NO: 1350781 - DNA, 22 bp, Artificial Sequence
  chemically synthesized
gatttgactgcacccaggtttc

SEQ ID NO: 1350782 - DNA, 22 bp, Artificial Sequence
  chemically synthesized
tgatttgactgcacccaggttt

SEQ ID NO: 1350783 - DNA, 22 bp, Artificial Sequence
  chemically synthesized
ttgatttgactgcacccaggtt

SEQ ID NO: 1350784 - DNA, 22 bp, Artificial Sequence
  chemically synthesized
agatttaaagaaacctgggtgc

SEQ ID NO: 1350785 - DNA, 22 bp, Artificial Sequence
  chemically synthesized
tttgatttgactgcacccaggt

SEQ ID NO: 1350786 - DNA, 22 bp, Artificial Sequence
  chemically synthesized
ttttgatttgactgcacccagg

SEQ ID NO: 1350787 - DNA, 22 bp, Artificial Sequence
  chemically synthesized
aaagaaacctgggtgcagtcaa

SEQ ID NO: 1350788 - DNA, 22 bp, Artificial Sequence
  chemically synthesized
atcttttttgatttgactgcac

SEQ ID NO: 1350789 - DNA, 22 bp, Artificial Sequence
  chemically synthesized
aagaaacctgggtgcagtcaaa

SEQ ID NO: 1350790 - DNA, 22 bp, Artificial Sequence
  chemically synthesized
aatcttttttgatttgactgca

SEQ ID NO: 1350791 - DNA, 22 bp, Artificial Sequence
  chemically synthesized
agccacttaatcttttttgatt

SEQ ID NO: 1350792 - DNA, 22 bp, Artificial Sequence
  chemically synthesized
ggtgcagtcaaatcaaaaaaga

SEQ ID NO: 1350793 - DNA, 22 bp, Artificial Sequence
  chemically synthesized
atgccggttcagccacttaatc

SEQ ID NO: 1350794 - DNA, 22 bp, Artificial Sequence
  chemically synthesized
agtggctgaaccggcatgagct

SEQ ID NO: 1350795 - DNA, 22 bp, Artificial Sequence
  chemically synthesized
agatgagagcacgatatagctc

SEQ ID NO: 1350796 - DNA, 22 bp, Artificial Sequence
  chemically synthesized
tgagatgagagcacgatatagc

SEQ ID NO: 1350797 - DNA, 22 bp, Artificial Sequence
  chemically synthesized
aaccggcatgagctatatcgtg

SEQ ID NO: 1350798 - DNA, 22 bp, Artificial Sequence
  chemically synthesized
tctgagatgagagcacgatata

SEQ ID NO: 1350799 - DNA, 22 bp, Artificial Sequence
  chemically synthesized
tgcgaaaggctctctgagatga

SEQ ID NO: 1350800 - DNA, 22 bp, Artificial Sequence
  chemically synthesized
tatcgtgctctcatctcagaga

SEQ ID NO: 1350801 - DNA, 22 bp, Artificial Sequence
  chemically synthesized
agatgtctatgcgaaaggctct

SEQ ID NO: 1350802 - DNA, 22 bp, Artificial Sequence
  chemically synthesized
tcatctcagagagcctttcgca

SEQ ID NO: 1350803 - DNA, 22 bp, Artificial Sequence
  chemically synthesized
ctcagatgtctatgcgaaaggc

SEQ ID NO: 1350804 - DNA, 22 bp, Artificial Sequence
  chemically synthesized
atctcagagagcctttcgcata

SEQ ID NO: 1350805 - DNA, 22 bp, Artificial Sequence
  chemically synthesized
ctcctcagatgtctatgcgaaa

SEQ ID NO: 1350806 - DNA, 22 bp, Artificial Sequence
  chemically synthesized
ttcctcctcagatgtctatgcg

SEQ ID NO: 1350807 - DNA, 22 bp, Artificial Sequence
  chemically synthesized
agagagcctttcgcatagacat

SEQ ID NO: 1350808 - DNA, 22 bp, Artificial Sequence
  chemically synthesized
gttcctcctcagatgtctatgc

SEQ ID NO: 1350809 - DNA, 22 bp, Artificial Sequence
  chemically synthesized
tgttcctcctcagatgtctatg

SEQ ID NO: 1350810 - DNA, 22 bp, Artificial Sequence
  chemically synthesized
ccctttgttcctcctcagatgt

SEQ ID NO: 1350811 - DNA, 22 bp, Artificial Sequence
  chemically synthesized
ttaccctttgttcctcctcaga

SEQ ID NO: 1350812 - DNA, 22 bp, Artificial Sequence
  chemically synthesized
tcgcatagacatctgaggagga

SEQ ID NO: 1350813 - DNA, 22 bp, Artificial Sequence
  chemically synthesized
cgcatagacatctgaggaggaa

SEQ ID NO: 1350814 - DNA, 22 bp, Artificial Sequence
  chemically synthesized
gcatagacatctgaggaggaac

SEQ ID NO: 1350815 - DNA, 22 bp, Artificial Sequence
  chemically synthesized
ttgttaccctttgttcctcctc

SEQ ID NO: 1350816 - DNA, 22 bp, Artificial Sequence
  chemically synthesized
ttattgttaccctttgttcctc

SEQ ID NO: 1350817 - DNA, 22 bp, Artificial Sequence
  chemically synthesized
aggaggaacaaagggtaacaat

SEQ ID NO: 1350818 - DNA, 22 bp, Artificial Sequence
  chemically synthesized
aaaatcaggagggtcagagaaa

SEQ ID NO: 1350819 - DNA, 22 bp, Artificial Sequence
  chemically synthesized
gaaaatcaggagggtcagagaa

SEQ ID NO: 1350820 - DNA, 22 bp, Artificial Sequence
  chemically synthesized
gcttgaaaatcaggagggtcag

SEQ ID NO: 1350821 - DNA, 22 bp, Artificial Sequence
  chemically synthesized
tttctctgaccctcctgatttt

SEQ ID NO: 1350822 - DNA, 22 bp, Artificial Sequence
  chemically synthesized
tctctgaccctcctgattttca

SEQ ID NO: 1350823 - DNA, 22 bp, Artificial Sequence
  chemically synthesized
ctctgaccctcctgattttcaa

SEQ ID NO: 1350824 - DNA, 22 bp, Artificial Sequence
  chemically synthesized
tctgaccctcctgattttcaag

SEQ ID NO: 1350825 - DNA, 22 bp, Artificial Sequence
  chemically synthesized
tgaccctcctgattttcaagcc

SEQ ID NO: 1350826 - DNA, 22 bp, Artificial Sequence
  chemically synthesized
accctcctgattttcaagccag

SEQ ID NO: 1350827 - DNA, 22 bp, Artificial Sequence
  chemically synthesized
ctgattttcaagccagcccctt

SEQ ID NO: 1350828 - DNA, 22 bp, Artificial Sequence
  chemically synthesized
aagtgggcatgtggaaggggct

SEQ ID NO: 1350829 - DNA, 22 bp, Artificial Sequence
  chemically synthesized
attttcaagccagccccttcca

SEQ ID NO: 1350830 - DNA, 22 bp, Artificial Sequence
  chemically synthesized
tcaagccagccccttccacatg

SEQ ID NO: 1350831 - DNA, 22 bp, Artificial Sequence
  chemically synthesized
caagccagccccttccacatgc

SEQ ID NO: 1350832 - DNA, 22 bp, Artificial Sequence
  chemically synthesized
aagccagccccttccacatgcc

SEQ ID NO: 1350833 - DNA, 22 bp, Artificial Sequence
  chemically synthesized
gcaagggttgaagtgggcatgt

SEQ ID NO: 1350834 - DNA, 22 bp, Artificial Sequence
  chemically synthesized
ggcaagggttgaagtgggcatg

SEQ ID NO: 1350835 - DNA, 22 bp, Artificial Sequence
  chemically synthesized
ccacatgcccacttcaaccctt

SEQ ID NO: 1350836 - DNA, 22 bp, Artificial Sequence
  chemically synthesized
cacatgcccacttcaacccttg

SEQ ID NO: 1350837 - DNA, 22 bp, Artificial Sequence
  chemically synthesized
atacacaagaatcttggcaagg

SEQ ID NO: 1350838 - DNA, 22 bp, Artificial Sequence
  chemically synthesized
ctcatacacaagaatcttggca

SEQ ID NO: 1350839 - DNA, 22 bp, Artificial Sequence
  chemically synthesized
caacccttgccaagattcttgt

SEQ ID NO: 1350840 - DNA, 22 bp, Artificial Sequence
  chemically synthesized
aacccttgccaagattcttgtg

SEQ ID NO: 1350841 - DNA, 22 bp, Artificial Sequence
  chemically synthesized
gccaagattcttgtgtatgagt

SEQ ID NO: 1350842 - DNA, 22 bp, Artificial Sequence
  chemically synthesized
ggtaacagagttactcatacac

SEQ ID NO: 1350843 - DNA, 22 bp, Artificial Sequence
  chemically synthesized
ccaagattcttgtgtatgagta

SEQ ID NO: 1350844 - DNA, 22 bp, Artificial Sequence
  chemically synthesized
gactaggtaacagagttactca

SEQ ID NO: 1350845 - DNA, 22 bp, Artificial Sequence
  chemically synthesized
ttgtgtatgagtaactctgtta

SEQ ID NO: 1350846 - DNA, 22 bp, Artificial Sequence
  chemically synthesized
gtgtatgagtaactctgttacc

SEQ ID NO: 1350847 - DNA, 22 bp, Artificial Sequence
  chemically synthesized
tgtatgagtaactctgttacct

SEQ ID NO: 1350848 - DNA, 22 bp, Artificial Sequence
  chemically synthesized
atgcaaaactagactaggtaac

SEQ ID NO: 1350849 - DNA, 22 bp, Artificial Sequence
  chemically synthesized
tgttacctagtctagttttgca

SEQ ID NO: 1350850 - DNA, 22 bp, Artificial Sequence
  chemically synthesized
ttacctagtctagttttgcatg

SEQ ID NO: 1350851 - DNA, 22 bp, Artificial Sequence
  chemically synthesized
cctagtctagttttgcatgaat

SEQ ID NO: 1350852 - DNA, 22 bp, Artificial Sequence
  chemically synthesized
aagaggaacagggattcatgca

SEQ ID NO: 1350853 - DNA, 22 bp, Artificial Sequence
  chemically synthesized
gaagaggaacagggattcatgc

SEQ ID NO: 1350854 - DNA, 22 bp, Artificial Sequence
  chemically synthesized
gtctagttttgcatgaatccct

SEQ ID NO: 1350855 - DNA, 22 bp, Artificial Sequence
  chemically synthesized
gttttgcatgaatccctgttcc

SEQ ID NO: 1350856 - DNA, 22 bp, Artificial Sequence
  chemically synthesized
tgcatgaatccctgttcctctt

SEQ ID NO: 1350857 - DNA, 22 bp, Artificial Sequence
  chemically synthesized
aagaagtgcttgaagaggaaca

SEQ ID NO: 1350858 - DNA, 22 bp, Artificial Sequence
  chemically synthesized
gcatgaatccctgttcctcttc

SEQ ID NO: 1350859 - DNA, 22 bp, Artificial Sequence
  chemically synthesized
catgaatccctgttcctcttca

SEQ ID NO: 1350860 - DNA, 22 bp, Artificial Sequence
  chemically synthesized
aagctaaagaagtgcttgaaga

SEQ ID NO: 1350861 - DNA, 22 bp, Artificial Sequence
  chemically synthesized
ttcctcttcaagcacttcttta

SEQ ID NO: 1350862 - DNA, 22 bp, Artificial Sequence
  chemically synthesized
gaaaacctgaagctaaagaagt

SEQ ID NO: 1350863 - DNA, 22 bp, Artificial Sequence
  chemically synthesized
ctcttcaagcacttctttagct

SEQ ID NO: 1350864 - DNA, 22 bp, Artificial Sequence
  chemically synthesized
ttcaagcacttctttagcttca

SEQ ID NO: 1350865 - DNA, 22 bp, Artificial Sequence
  chemically synthesized
caagcacttctttagcttcagg

SEQ ID NO: 1350866 - DNA, 22 bp, Artificial Sequence
  chemically synthesized
cagattagaaaacctgaagcta

SEQ ID NO: 1350867 - DNA, 22 bp, Artificial Sequence
  chemically synthesized
aagcacttctttagcttcaggt

SEQ ID NO: 1350868 - DNA, 22 bp, Artificial Sequence
  chemically synthesized
ccagattagaaaacctgaagct

SEQ ID NO: 1350869 - DNA, 22 bp, Artificial Sequence
  chemically synthesized
ctttagcttcaggttttctaat

SEQ ID NO: 1350870 - DNA, 22 bp, Artificial Sequence
  chemically synthesized
tttagcttcaggttttctaatc

SEQ ID NO: 1350871 - DNA, 22 bp, Artificial Sequence
  chemically synthesized
tagcttcaggttttctaatctg

SEQ ID NO: 1350872 - DNA, 22 bp, Artificial Sequence
  chemically synthesized
agcttcaggttttctaatctgg

SEQ ID NO: 1350873 - DNA, 22 bp, Artificial Sequence
  chemically synthesized
gcttcaggttttctaatctgga

SEQ ID NO: 1350874 - DNA, 22 bp, Artificial Sequence
  chemically synthesized
agaaacagaagtttccagatta

SEQ ID NO: 1350875 - DNA, 22 bp, Artificial Sequence
  chemically synthesized
caggttttctaatctggaaact

SEQ ID NO: 1350876 - DNA, 22 bp, Artificial Sequence
  chemically synthesized
aggttttctaatctggaaactt

SEQ ID NO: 1350877 - DNA, 22 bp, Artificial Sequence
  chemically synthesized
attcagaaacagaagtttccag

SEQ ID NO: 1350878 - DNA, 22 bp, Artificial Sequence
  chemically synthesized
tctaatctggaaacttctgttt

SEQ ID NO: 1350879 - DNA, 22 bp, Artificial Sequence
  chemically synthesized
ctaatctggaaacttctgtttc

SEQ ID NO: 1350880 - DNA, 22 bp, Artificial Sequence
  chemically synthesized
aggtctaattcagaaacagaag

SEQ ID NO: 1350881 - DNA, 22 bp, Artificial Sequence
  chemically synthesized
taatctggaaacttctgtttct

SEQ ID NO: 1350882 - DNA, 22 bp, Artificial Sequence
  chemically synthesized
atctggaaacttctgtttctga

SEQ ID NO: 1350883 - DNA, 22 bp, Artificial Sequence
  chemically synthesized
gttcaggtctaattcagaaaca

SEQ ID NO: 1350884 - DNA, 22 bp, Artificial Sequence
  chemically synthesized
gaaacttctgtttctgaattag

SEQ ID NO: 1350885 - DNA, 22 bp, Artificial Sequence
  chemically synthesized
aattagttcaggtctaattcag

SEQ ID NO: 1350886 - DNA, 22 bp, Artificial Sequence
  chemically synthesized
ctgtttctgaattagacctgaa

SEQ ID NO: 1350887 - DNA, 22 bp, Artificial Sequence
  chemically synthesized
tgtttctgaattagacctgaac

SEQ ID NO: 1350888 - DNA, 22 bp, Artificial Sequence
  chemically synthesized
acagcctaaattagttcaggtc

SEQ ID NO: 1350889 - DNA, 22 bp, Artificial Sequence
  chemically synthesized
tttctgaattagacctgaacta

SEQ ID NO: 1350890 - DNA, 22 bp, Artificial Sequence
  chemically synthesized
gacagcctaaattagttcaggt

SEQ ID NO: 1350891 - DNA, 22 bp, Artificial Sequence
  chemically synthesized
tgacagcctaaattagttcagg

SEQ ID NO: 1350892 - DNA, 22 bp, Artificial Sequence
  chemically synthesized
ttgacagcctaaattagttcag

SEQ ID NO: 1350893 - DNA, 22 bp, Artificial Sequence
  chemically synthesized
ctgaattagacctgaactaatt

SEQ ID NO: 1350894 - DNA, 22 bp, Artificial Sequence
  chemically synthesized
tgaattagacctgaactaattt

SEQ ID NO: 1350895 - DNA, 22 bp, Artificial Sequence
  chemically synthesized
aattagacctgaactaatttag

SEQ ID NO: 1350896 - DNA, 22 bp, Artificial Sequence
  chemically synthesized
gacctgaactaatttaggctgt

SEQ ID NO: 1350897 - DNA, 22 bp, Artificial Sequence
  chemically synthesized
aagacacaaaccttttgacagc

SEQ ID NO: 1350898 - DNA, 22 bp, Artificial Sequence
  chemically synthesized
aactaatttaggctgtcaaaag

SEQ ID NO: 1350899 - DNA, 22 bp, Artificial Sequence
  chemically synthesized
caagacacaaaccttttgacag

SEQ ID NO: 1350900 - DNA, 22 bp, Artificial Sequence
  chemically synthesized
atttaggctgtcaaaaggtttg

SEQ ID NO: 1350901 - DNA, 22 bp, Artificial Sequence
  chemically synthesized
aggctgtcaaaaggtttgtgtc

SEQ ID NO: 1350902 - DNA, 22 bp, Artificial Sequence
  chemically synthesized
ggctgtcaaaaggtttgtgtct

SEQ ID NO: 1350903 - DNA, 22 bp, Artificial Sequence
  chemically synthesized
aggggaagtttcaagacacaaa

SEQ ID NO: 1350904 - DNA, 22 bp, Artificial Sequence
  chemically synthesized
tcaaaaggtttgtgtcttgaaa

SEQ ID NO: 1350905 - DNA, 22 bp, Artificial Sequence
  chemically synthesized
cgactcaggggaagtttcaaga

SEQ ID NO: 1350906 - DNA, 22 bp, Artificial Sequence
  chemically synthesized
ttccgactcaggggaagtttca

SEQ ID NO: 1350907 - DNA, 22 bp, Artificial Sequence
  chemically synthesized
ttgttccgactcaggggaagtt

SEQ ID NO: 1350908 - DNA, 22 bp, Artificial Sequence
  chemically synthesized
attgttccgactcaggggaagt

SEQ ID NO: 1350909 - DNA, 22 bp, Artificial Sequence
  chemically synthesized
gtgtcttgaaacttcccctgag

SEQ ID NO: 1350910 - DNA, 22 bp, Artificial Sequence
  chemically synthesized
tgtcttgaaacttcccctgagt

SEQ ID NO: 1350911 - DNA, 22 bp, Artificial Sequence
  chemically synthesized
gaaacttcccctgagtcggaac

SEQ ID NO: 1350912 - DNA, 22 bp, Artificial Sequence
  chemically synthesized
aaacttcccctgagtcggaaca

SEQ ID NO: 1350913 - DNA, 22 bp, Artificial Sequence
  chemically synthesized
tgcacaatatttattgttccga

SEQ ID NO: 1350914 - DNA, 22 bp, Artificial Sequence
  chemically synthesized
atgcacaatatttattgttccg

SEQ ID NO: 1350915 - DNA, 22 bp, Artificial Sequence
  chemically synthesized
cccctgagtcggaacaataaat

SEQ ID NO: 1350916 - DNA, 22 bp, Artificial Sequence
  chemically synthesized
tttatgcacaatatttattgtt

SEQ ID NO: 1350917 - DNA, 22 bp, Artificial Sequence
  chemically synthesized
ccctgagtcggaacaataaata

SEQ ID NO: 1350918 - DNA, 22 bp, Artificial Sequence
  chemically synthesized
tatttatgcacaatatttattg

SEQ ID NO: 1350919 - DNA, 22 bp, Artificial Sequence
  chemically synthesized
ctatttatgcacaatatttatt

SEQ ID NO: 1350920 - DNA, 22 bp, Artificial Sequence
  chemically synthesized
agtcggaacaataaatattgtg

SEQ ID NO: 1350921 - DNA, 22 bp, Artificial Sequence
  chemically synthesized
agtttctatttatgcacaatat

SEQ ID NO: 1350922 - DNA, 22 bp, Artificial Sequence
  chemically synthesized
agctgagtttctatttatgcac

SEQ ID NO: 1350923 - DNA, 22 bp, Artificial Sequence
  chemically synthesized
cagctgagtttctatttatgca

SEQ ID NO: 1350924 - DNA, 22 bp, Artificial Sequence
  chemically synthesized
tttcagctgagtttctatttat

SEQ ID NO: 1350925 - DNA, 22 bp, Artificial Sequence
  chemically synthesized
atttcagctgagtttctattta

SEQ ID NO: 1350926 - DNA, 22 bp, Artificial Sequence
  chemically synthesized
cttatttcagctgagtttctat

SEQ ID NO: 1350927 - DNA, 22 bp, Artificial Sequence
  chemically synthesized
tccttatttcagctgagtttct

SEQ ID NO: 1350928 - DNA, 22 bp, Artificial Sequence
  chemically synthesized
ctccttatttcagctgagtttc

SEQ ID NO: 1350929 - DNA, 22 bp, Artificial Sequence
  chemically synthesized
tgcataaatagaaactcagctg

SEQ ID NO: 1350930 - DNA, 22 bp, Artificial Sequence
  chemically synthesized
ttctccttatttcagctgagtt

SEQ ID NO: 1350931 - DNA, 22 bp, Artificial Sequence
  chemically synthesized
actcttctccttatttcagctg

SEQ ID NO: 1350932 - DNA, 22 bp, Artificial Sequence
  chemically synthesized
cattaactcttctccttatttc

SEQ ID NO: 1350933 - DNA, 22 bp, Artificial Sequence
  chemically synthesized
acattaactcttctccttattt

SEQ ID NO: 1350934 - DNA, 22 bp, Artificial Sequence
  chemically synthesized
tacattaactcttctccttatt

SEQ ID NO: 1350935 - DNA, 22 bp, Artificial Sequence
  chemically synthesized
ttacattaactcttctccttat

SEQ ID NO: 1350936 - DNA, 22 bp, Artificial Sequence
  chemically synthesized
tttacattaactcttctcctta

SEQ ID NO: 1350937 - DNA, 22 bp, Artificial Sequence
  chemically synthesized
ttttacattaactcttctcctt

SEQ ID NO: 1350938 - DNA, 22 bp, Artificial Sequence
  chemically synthesized
tttttacattaactcttctcct

SEQ ID NO: 1350939 - DNA, 22 bp, Artificial Sequence
  chemically synthesized
ttttttacattaactcttctcc

SEQ ID NO: 1350940 - DNA, 22 bp, Artificial Sequence
  chemically synthesized
agctgaaataaggagaagagtt

SEQ ID NO: 1350941 - DNA, 22 bp, Artificial Sequence
  chemically synthesized
tttttttacattaactcttctc

SEQ ID NO: 1350942 - DNA, 22 bp, Artificial Sequence
  chemically synthesized
ttttttttacattaactcttct

SEQ ID NO: 1350943 - DNA, 22 bp, Artificial Sequence
  chemically synthesized
tttttttttacattaactcttc

SEQ ID NO: 1350944 - DNA, 22 bp, Artificial Sequence
  chemically synthesized
ttttttttttacattaactctt

SEQ ID NO: 1350945 - DNA, 22 bp, Artificial Sequence
  chemically synthesized
tttttttttttacattaactct

SEQ ID NO: 1350946 - DNA, 22 bp, Artificial Sequence
  chemically synthesized
aaataaggagaagagttaatgt

SEQ ID NO: 1350947 - DNA, 22 bp, Artificial Sequence
  chemically synthesized
gttttttttttttttacattaa

SEQ ID NO: 1350948 - DNA, 22 bp, Artificial Sequence
  chemically synthesized
tacgtatacctggttttttttt

SEQ ID NO: 1350949 - DNA, 22 bp, Artificial Sequence
  chemically synthesized
atgtaaaaaaaaaaaaaaccag

SEQ ID NO: 1350950 - DNA, 22 bp, Artificial Sequence
  chemically synthesized
acaatataattatacgtatacc

SEQ ID NO: 1350951 - DNA, 22 bp, Artificial Sequence
  chemically synthesized
gttgacaatataattatacgta

SEQ ID NO: 1350952 - DNA, 22 bp, Artificial Sequence
  chemically synthesized
agttgacaatataattatacgt

SEQ ID NO: 1350953 - DNA, 22 bp, Artificial Sequence
  chemically synthesized
tagttgacaatataattatacg

SEQ ID NO: 1350954 - DNA, 22 bp, Artificial Sequence
  chemically synthesized
ttagttgacaatataattatac

SEQ ID NO: 1350955 - DNA, 22 bp, Artificial Sequence
  chemically synthesized
tttagttgacaatataattata

SEQ ID NO: 1350956 - DNA, 22 bp, Artificial Sequence
  chemically synthesized
ttttttagttgacaatataatt

SEQ ID NO: 1350957 - DNA, 22 bp, Artificial Sequence
  chemically synthesized
attttttagttgacaatataat

SEQ ID NO: 1350958 - DNA, 22 bp, Artificial Sequence
  chemically synthesized
tattttttagttgacaatataa

SEQ ID NO: 1350959 - DNA, 22 bp, Artificial Sequence
  chemically synthesized
attttattttttagttgacaat

SEQ ID NO: 1350960 - DNA, 22 bp, Artificial Sequence
  chemically synthesized
cattttattttttagttgacaa

SEQ ID NO: 1350961 - DNA, 22 bp, Artificial Sequence
  chemically synthesized
tttcattttattttttagttga

SEQ ID NO: 1350962 - DNA, 22 bp, Artificial Sequence
  chemically synthesized
atttcattttattttttagttg

SEQ ID NO: 1350963 - DNA, 22 bp, Artificial Sequence
  chemically synthesized
tatttcattttattttttagtt

SEQ ID NO: 1350964 - DNA, 22 bp, Artificial Sequence
  chemically synthesized
ttatttcattttattttttagt

SEQ ID NO: 1350965 - DNA, 22 bp, Artificial Sequence
  chemically synthesized
tattgtcaactaaaaaataaaa

SEQ ID NO: 1350966 - DNA, 22 bp, Artificial Sequence
  chemically synthesized
tcaactaaaaaataaaatgaaa

SEQ ID NO: 1350967 - DNA, 22 bp, Artificial Sequence
  chemically synthesized
aaaaataaaatgaaataaaagc

SEQ ID NO: 1350968 - DNA, 22 bp, Artificial Sequence
  chemically synthesized
aatccacgtatgaagccgaagc

SEQ ID NO: 1350969 - DNA, 22 bp, Artificial Sequence
  chemically synthesized
tgaatccctgaatccacgtatg

SEQ ID NO: 1350970 - DNA, 22 bp, Artificial Sequence
  chemically synthesized
gtgaatccctgaatccacgtat

SEQ ID NO: 1350971 - DNA, 22 bp, Artificial Sequence
  chemically synthesized
ttgtgaatccctgaatccacgt

SEQ ID NO: 1350972 - DNA, 22 bp, Artificial Sequence
  chemically synthesized
tcttgtgaatccctgaatccac

SEQ ID NO: 1350973 - DNA, 22 bp, Artificial Sequence
  chemically synthesized
cggcttcatacgtggattcagg

SEQ ID NO: 1350974 - DNA, 22 bp, Artificial Sequence
  chemically synthesized
ggcttcatacgtggattcaggg

SEQ ID NO: 1350975 - DNA, 22 bp, Artificial Sequence
  chemically synthesized
ctctcttgtgaatccctgaatc

SEQ ID NO: 1350976 - DNA, 22 bp, Artificial Sequence
  chemically synthesized
catacgtggattcagggattca

SEQ ID NO: 1350977 - DNA, 22 bp, Artificial Sequence
  chemically synthesized
atacgtggattcagggattcac

SEQ ID NO: 1350978 - DNA, 22 bp, Artificial Sequence
  chemically synthesized
caaacctgctctcttgtgaatc

SEQ ID NO: 1350979 - DNA, 22 bp, Artificial Sequence
  chemically synthesized
gtggctgcaaacctgctctctt

SEQ ID NO: 1350980 - DNA, 22 bp, Artificial Sequence
  chemically synthesized
cgtggctgcaaacctgctctct

SEQ ID NO: 1350981 - DNA, 22 bp, Artificial Sequence
  chemically synthesized
agggattcacaagagagcaggt

SEQ ID NO: 1350982 - DNA, 22 bp, Artificial Sequence
  chemically synthesized
tcgtggctgcaaacctgctctc

SEQ ID NO: 1350983 - DNA, 22 bp, Artificial Sequence
  chemically synthesized
ttcgtggctgcaaacctgctct

SEQ ID NO: 1350984 - DNA, 22 bp, Artificial Sequence
  chemically synthesized
tttcgtggctgcaaacctgctc

SEQ ID NO: 1350985 - DNA, 22 bp, Artificial Sequence
  chemically synthesized
ctttttcgtggctgcaaacctg

SEQ ID NO: 1350986 - DNA, 22 bp, Artificial Sequence
  chemically synthesized
gctttttcgtggctgcaaacct

SEQ ID NO: 1350987 - DNA, 22 bp, Artificial Sequence
  chemically synthesized
acaagagagcaggtttgcagcc

SEQ ID NO: 1350988 - DNA, 22 bp, Artificial Sequence
  chemically synthesized
tgcttgctttttcgtggctgca

SEQ ID NO: 1350989 - DNA, 22 bp, Artificial Sequence
  chemically synthesized
tgtgcttgctttttcgtggctg

SEQ ID NO: 1350990 - DNA, 22 bp, Artificial Sequence
  chemically synthesized
ctgtgcttgctttttcgtggct

SEQ ID NO: 1350991 - DNA, 22 bp, Artificial Sequence
  chemically synthesized
gcagccacgaaaaagcaagcac

SEQ ID NO: 1350992 - DNA, 22 bp, Artificial Sequence
  chemically synthesized
cagccacgaaaaagcaagcaca

SEQ ID NO: 1350993 - DNA, 22 bp, Artificial Sequence
  chemically synthesized
agtgtgcacatgagcgcacaca

SEQ ID NO: 1350994 - DNA, 22 bp, Artificial Sequence
  chemically synthesized
gagtgtgcacatgagcgcacac

SEQ ID NO: 1350995 - DNA, 22 bp, Artificial Sequence
  chemically synthesized
catcaacagcttgagtgtgcac

SEQ ID NO: 1350996 - DNA, 22 bp, Artificial Sequence
  chemically synthesized
tgttccatcaacagcttgagtg

SEQ ID NO: 1350997 - DNA, 22 bp, Artificial Sequence
  chemically synthesized
atgtgcacactcaagctgttga

SEQ ID NO: 1350998 - DNA, 22 bp, Artificial Sequence
  chemically synthesized
acaaatgctatgttccatcaac

SEQ ID NO: 1350999 - DNA, 22 bp, Artificial Sequence
  chemically synthesized
actcacaaatgctatgttccat

SEQ ID NO: 1351000 - DNA, 22 bp, Artificial Sequence
  chemically synthesized
cactcacaaatgctatgttcca

SEQ ID NO: 1351001 - DNA, 22 bp, Artificial Sequence
  chemically synthesized
aagctgttgatggaacatagca

SEQ ID NO: 1351002 - DNA, 22 bp, Artificial Sequence
  chemically synthesized
atcccttcactcacaaatgcta

SEQ ID NO: 1351003 - DNA, 22 bp, Artificial Sequence
  chemically synthesized
ttgatggaacatagcatttgtg

SEQ ID NO: 1351004 - DNA, 22 bp, Artificial Sequence
  chemically synthesized
catcccttcactcacaaatgct

SEQ ID NO: 1351005 - DNA, 22 bp, Artificial Sequence
  chemically synthesized
tcatcccttcactcacaaatgc

SEQ ID NO: 1351006 - DNA, 22 bp, Artificial Sequence
  chemically synthesized
atggaacatagcatttgtgagt

SEQ ID NO: 1351007 - DNA, 22 bp, Artificial Sequence
  chemically synthesized
attttcatcccttcactcacaa

SEQ ID NO: 1351008 - DNA, 22 bp, Artificial Sequence
  chemically synthesized
taattttcatcccttcactcac

SEQ ID NO: 1351009 - DNA, 22 bp, Artificial Sequence
  chemically synthesized
ttctaattttcatcccttcact

SEQ ID NO: 1351010 - DNA, 22 bp, Artificial Sequence
  chemically synthesized
gcctattctaattttcatccct

SEQ ID NO: 1351011 - DNA, 22 bp, Artificial Sequence
  chemically synthesized
gtgagtgaagggatgaaaatta

SEQ ID NO: 1351012 - DNA, 22 bp, Artificial Sequence
  chemically synthesized
tgagtgaagggatgaaaattag

SEQ ID NO: 1351013 - DNA, 22 bp, Artificial Sequence
  chemically synthesized
cgcctggcctattctaattttc

SEQ ID NO: 1351014 - DNA, 22 bp, Artificial Sequence
  chemically synthesized
caggcgtgagccactgcgcctg

SEQ ID NO: 1351015 - DNA, 22 bp, Artificial Sequence
  chemically synthesized
gaataggccaggcgcagtggct

SEQ ID NO: 1351016 - DNA, 22 bp, Artificial Sequence
  chemically synthesized
ggattacaggcgtgagccactg

SEQ ID NO: 1351017 - DNA, 22 bp, Artificial Sequence
  chemically synthesized
ccaaagtgctgggattacaggc

SEQ ID NO: 1351018 - DNA, 22 bp, Artificial Sequence
  chemically synthesized
cccaaagtgctgggattacagg

SEQ ID NO: 1351019 - DNA, 22 bp, Artificial Sequence
  chemically synthesized
gcttcccaaagtgctgggatta

SEQ ID NO: 1351020 - DNA, 22 bp, Artificial Sequence
  chemically synthesized
ggcttcccaaagtgctgggatt

SEQ ID NO: 1351021 - DNA, 22 bp, Artificial Sequence
  chemically synthesized
acgcctgtaatcccagcacttt

SEQ ID NO: 1351022 - DNA, 22 bp, Artificial Sequence
  chemically synthesized
taatcccagcactttgggaagc

SEQ ID NO: 1351023 - DNA, 22 bp, Artificial Sequence
  chemically synthesized
acgtcaaatgatccacccgcct

SEQ ID NO: 1351024 - DNA, 22 bp, Artificial Sequence
  chemically synthesized
tgggaagccaaggcgggtggat

SEQ ID NO: 1351025 - DNA, 22 bp, Artificial Sequence
  chemically synthesized
gggaagccaaggcgggtggatc

SEQ ID NO: 1351026 - DNA, 22 bp, Artificial Sequence
  chemically synthesized
ctgacgtcaaatgatccacccg

SEQ ID NO: 1351027 - DNA, 22 bp, Artificial Sequence
  chemically synthesized
ggaagccaaggcgggtggatca

SEQ ID NO: 1351028 - DNA, 22 bp, Artificial Sequence
  chemically synthesized
aactcctgacgtcaaatgatcc

SEQ ID NO: 1351029 - DNA, 22 bp, Artificial Sequence
  chemically synthesized
gaactcctgacgtcaaatgatc

SEQ ID NO: 1351030 - DNA, 22 bp, Artificial Sequence
  chemically synthesized
gtcttgaactcctgacgtcaaa

SEQ ID NO: 1351031 - DNA, 22 bp, Artificial Sequence
  chemically synthesized
gcaaggctggtcttgaactcct

SEQ ID NO: 1351032 - DNA, 22 bp, Artificial Sequence
  chemically synthesized
gacgtcaggagttcaagaccag

SEQ ID NO: 1351033 - DNA, 22 bp, Artificial Sequence
  chemically synthesized
acgtcaggagttcaagaccagc

SEQ ID NO: 1351034 - DNA, 22 bp, Artificial Sequence
  chemically synthesized
accatgttggcaaggctggtct

SEQ ID NO: 1351035 - DNA, 22 bp, Artificial Sequence
  chemically synthesized
caccatgttggcaaggctggtc

SEQ ID NO: 1351036 - DNA, 22 bp, Artificial Sequence
  chemically synthesized
aagaccagccttgccaacatgg

SEQ ID NO: 1351037 - DNA, 22 bp, Artificial Sequence
  chemically synthesized
gtagagatggggtttcaccatg

SEQ ID NO: 1351038 - DNA, 22 bp, Artificial Sequence
  chemically synthesized
agtagagatggggtttcaccat

SEQ ID NO: 1351039 - DNA, 22 bp, Artificial Sequence
  chemically synthesized
tagtagagatggggtttcacca

SEQ ID NO: 1351040 - DNA, 22 bp, Artificial Sequence
  chemically synthesized
ttagtagagatggggtttcacc

SEQ ID NO: 1351041 - DNA, 22 bp, Artificial Sequence
  chemically synthesized
gccaacatggtgaaaccccatc

SEQ ID NO: 1351042 - DNA, 22 bp, Artificial Sequence
  chemically synthesized
ccaacatggtgaaaccccatct

SEQ ID NO: 1351043 - DNA, 22 bp, Artificial Sequence
  chemically synthesized
tatttttagtagagatggggtt

SEQ ID NO: 1351044 - DNA, 22 bp, Artificial Sequence
  chemically synthesized
gtatttttagtagagatggggt

SEQ ID NO: 1351045 - DNA, 22 bp, Artificial Sequence
  chemically synthesized
tgtatttttagtagagatgggg

SEQ ID NO: 1351046 - DNA, 22 bp, Artificial Sequence
  chemically synthesized
ttgtatttttagtagagatggg

SEQ ID NO: 1351047 - DNA, 22 bp, Artificial Sequence
  chemically synthesized
atttttgtatttttagtagaga

SEQ ID NO: 1351048 - DNA, 22 bp, Artificial Sequence
  chemically synthesized
tactaaaaatacaaaaattagc

SEQ ID NO: 1351049 - DNA, 22 bp, Artificial Sequence
  chemically synthesized
ctaaaaatacaaaaattagccg

SEQ ID NO: 1351050 - DNA, 22 bp, Artificial Sequence
  chemically synthesized
aaaatacaaaaattagccggtc

SEQ ID NO: 1351051 - DNA, 22 bp, Artificial Sequence
  chemically synthesized
caagtggagcgccaccatgacc

SEQ ID NO: 1351052 - DNA, 22 bp, Artificial Sequence
  chemically synthesized
ggattacaagtggagcgccacc

SEQ ID NO: 1351053 - DNA, 22 bp, Artificial Sequence
  chemically synthesized
gccggtcatggtggcgctccac

SEQ ID NO: 1351054 - DNA, 22 bp, Artificial Sequence
  chemically synthesized
ccgagtagctgggattacaagt

SEQ ID NO: 1351055 - DNA, 22 bp, Artificial Sequence
  chemically synthesized
agcctcccgagtagctgggatt

SEQ ID NO: 1351056 - DNA, 22 bp, Artificial Sequence
  chemically synthesized
cctcagcctcccgagtagctgg

SEQ ID NO: 1351057 - DNA, 22 bp, Artificial Sequence
  chemically synthesized
cacttgtaatcccagctactcg

SEQ ID NO: 1351058 - DNA, 22 bp, Artificial Sequence
  chemically synthesized
tcctgcctcagcctcccgagta

SEQ ID NO: 1351059 - DNA, 22 bp, Artificial Sequence
  chemically synthesized
gtaatcccagctactcgggagg

SEQ ID NO: 1351060 - DNA, 22 bp, Artificial Sequence
  chemically synthesized
taatcccagctactcgggaggc

SEQ ID NO: 1351061 - DNA, 22 bp, Artificial Sequence
  chemically synthesized
aagcaattgtcctgcctcagcc

SEQ ID NO: 1351062 - DNA, 22 bp, Artificial Sequence
  chemically synthesized
ctcgggaggctgaggcaggaca

SEQ ID NO: 1351063 - DNA, 22 bp, Artificial Sequence
  chemically synthesized
gattcaagcaattgtcctgcct

SEQ ID NO: 1351064 - DNA, 22 bp, Artificial Sequence
  chemically synthesized
gggaggctgaggcaggacaatt

SEQ ID NO: 1351065 - DNA, 22 bp, Artificial Sequence
  chemically synthesized
ctggattcaagcaattgtcctg

SEQ ID NO: 1351066 - DNA, 22 bp, Artificial Sequence
  chemically synthesized
cgcctgctggattcaagcaatt

SEQ ID NO: 1351067 - DNA, 22 bp, Artificial Sequence
  chemically synthesized
aggcaggacaattgcttgaatc

SEQ ID NO: 1351068 - DNA, 22 bp, Artificial Sequence
  chemically synthesized
caacctccgcctgctggattca

SEQ ID NO: 1351069 - DNA, 22 bp, Artificial Sequence
  chemically synthesized
actgcaacctccgcctgctgga

SEQ ID NO: 1351070 - DNA, 22 bp, Artificial Sequence
  chemically synthesized
ggctcactgcaacctccgcctg

SEQ ID NO: 1351071 - DNA, 22 bp, Artificial Sequence
  chemically synthesized
cttgaatccagcaggcggaggt

SEQ ID NO: 1351072 - DNA, 22 bp, Artificial Sequence
  chemically synthesized
gaatccagcaggcggaggttgc

SEQ ID NO: 1351073 - DNA, 22 bp, Artificial Sequence
  chemically synthesized
aatccagcaggcggaggttgca

SEQ ID NO: 1351074 - DNA, 22 bp, Artificial Sequence
  chemically synthesized
cagtgagccgagatcatgccat

SEQ ID NO: 1351075 - DNA, 22 bp, Artificial Sequence
  chemically synthesized
tagcccaggccgcagtgcaatg

SEQ ID NO: 1351076 - DNA, 22 bp, Artificial Sequence
  chemically synthesized
gtagcccaggccgcagtgcaat

SEQ ID NO: 1351077 - DNA, 22 bp, Artificial Sequence
  chemically synthesized
ttgtagcccaggccgcagtgca

SEQ ID NO: 1351078 - DNA, 22 bp, Artificial Sequence
  chemically synthesized
ctcttgtagcccaggccgcagt

SEQ ID NO: 1351079 - DNA, 22 bp, Artificial Sequence
  chemically synthesized
gctcttgtagcccaggccgcag

SEQ ID NO: 1351080 - DNA, 22 bp, Artificial Sequence
  chemically synthesized
tgctcttgtagcccaggccgca

SEQ ID NO: 1351081 - DNA, 22 bp, Artificial Sequence
  chemically synthesized
cactgcggcctgggctacaaga

SEQ ID NO: 1351082 - DNA, 22 bp, Artificial Sequence
  chemically synthesized
agacacagttttgctcttgtag

SEQ ID NO: 1351083 - DNA, 22 bp, Artificial Sequence
  chemically synthesized
gagacacagttttgctcttgta

SEQ ID NO: 1351084 - DNA, 22 bp, Artificial Sequence
  chemically synthesized
tgagacacagttttgctcttgt

SEQ ID NO: 1351085 - DNA, 22 bp, Artificial Sequence
  chemically synthesized
cggcctgggctacaagagcaaa

SEQ ID NO: 1351086 - DNA, 22 bp, Artificial Sequence
  chemically synthesized
ttgagacacagttttgctcttg

SEQ ID NO: 1351087 - DNA, 22 bp, Artificial Sequence
  chemically synthesized
tttgagacacagttttgctctt

SEQ ID NO: 1351088 - DNA, 22 bp, Artificial Sequence
  chemically synthesized
ttttttgagacacagttttgct

SEQ ID NO: 1351089 - DNA, 22 bp, Artificial Sequence
  chemically synthesized
attttttgagacacagttttgc

SEQ ID NO: 1351090 - DNA, 22 bp, Artificial Sequence
  chemically synthesized
tattttttgagacacagttttg

SEQ ID NO: 1351091 - DNA, 22 bp, Artificial Sequence
  chemically synthesized
ggctacaagagcaaaactgtgt

SEQ ID NO: 1351092 - DNA, 22 bp, Artificial Sequence
  chemically synthesized
ttttattttttgagacacagtt

SEQ ID NO: 1351093 - DNA, 22 bp, Artificial Sequence
  chemically synthesized
attttattttttgagacacagt

SEQ ID NO: 1351094 - DNA, 22 bp, Artificial Sequence
  chemically synthesized
tattttattttttgagacacag

SEQ ID NO: 1351095 - DNA, 22 bp, Artificial Sequence
  chemically synthesized
caagagcaaaactgtgtctcaa

SEQ ID NO: 1351096 - DNA, 22 bp, Artificial Sequence
  chemically synthesized
ttattttattttttgagacaca

SEQ ID NO: 1351097 - DNA, 22 bp, Artificial Sequence
  chemically synthesized
tttattttattttttgagacac

SEQ ID NO: 1351098 - DNA, 22 bp, Artificial Sequence
  chemically synthesized
tttttattttattttttgagac

SEQ ID NO: 1351099 - DNA, 22 bp, Artificial Sequence
  chemically synthesized
tctttttattttattttttgag

SEQ ID NO: 1351100 - DNA, 22 bp, Artificial Sequence
  chemically synthesized
ctctttttattttattttttga

SEQ ID NO: 1351101 - DNA, 22 bp, Artificial Sequence
  chemically synthesized
tctctttttattttattttttg

SEQ ID NO: 1351102 - DNA, 22 bp, Artificial Sequence
  chemically synthesized
tgtctcaaaaaataaaataaaa

SEQ ID NO: 1351103 - DNA, 22 bp, Artificial Sequence
  chemically synthesized
agcactttctctttttatttta

SEQ ID NO: 1351104 - DNA, 22 bp, Artificial Sequence
  chemically synthesized
gagcactttctctttttatttt

SEQ ID NO: 1351105 - DNA, 22 bp, Artificial Sequence
  chemically synthesized
tgagcactttctctttttattt

SEQ ID NO: 1351106 - DNA, 22 bp, Artificial Sequence
  chemically synthesized
ttgagcactttctctttttatt

SEQ ID NO: 1351107 - DNA, 22 bp, Artificial Sequence
  chemically synthesized
ttttgagcactttctcttttta

SEQ ID NO: 1351108 - DNA, 22 bp, Artificial Sequence
  chemically synthesized
aaaaaataaaataaaaagagaa

SEQ ID NO: 1351109 - DNA, 22 bp, Artificial Sequence
  chemically synthesized
tcttttgagcactttctctttt

SEQ ID NO: 1351110 - DNA, 22 bp, Artificial Sequence
  chemically synthesized
ctcttttgagcactttctcttt

SEQ ID NO: 1351111 - DNA, 22 bp, Artificial Sequence
  chemically synthesized
acacagtttctcttttgagcac

SEQ ID NO: 1351112 - DNA, 22 bp, Artificial Sequence
  chemically synthesized
cacacagtttctcttttgagca

SEQ ID NO: 1351113 - DNA, 22 bp, Artificial Sequence
  chemically synthesized
tccccttcacacagtttctctt

SEQ ID NO: 1351114 - DNA, 22 bp, Artificial Sequence
  chemically synthesized
aactgtccccttcacacagttt

SEQ ID NO: 1351115 - DNA, 22 bp, Artificial Sequence
  chemically synthesized
aaaagagaaactgtgtgaaggg

SEQ ID NO: 1351116 - DNA, 22 bp, Artificial Sequence
  chemically synthesized
cccaagccctaaactgtcccct

SEQ ID NO: 1351117 - DNA, 22 bp, Artificial Sequence
  chemically synthesized
ccccaagccctaaactgtcccc

SEQ ID NO: 1351118 - DNA, 22 bp, Artificial Sequence
  chemically synthesized
tccccaagccctaaactgtccc

SEQ ID NO: 1351119 - DNA, 22 bp, Artificial Sequence
  chemically synthesized
ttttccccaagccctaaactgt

SEQ ID NO: 1351120 - DNA, 22 bp, Artificial Sequence
  chemically synthesized
gttttccccaagccctaaactg

SEQ ID NO: 1351121 - DNA, 22 bp, Artificial Sequence
  chemically synthesized
tgtgaaggggacagtttagggc

SEQ ID NO: 1351122 - DNA, 22 bp, Artificial Sequence
  chemically synthesized
tgttttccccaagccctaaact

SEQ ID NO: 1351123 - DNA, 22 bp, Artificial Sequence
  chemically synthesized
ttttgttttccccaagccctaa

SEQ ID NO: 1351124 - DNA, 22 bp, Artificial Sequence
  chemically synthesized
gttttgttttccccaagcccta

SEQ ID NO: 1351125 - DNA, 22 bp, Artificial Sequence
  chemically synthesized
ttgttttgttttccccaagccc

SEQ ID NO: 1351126 - DNA, 22 bp, Artificial Sequence
  chemically synthesized
agggcttggggaaaacaaaaca

SEQ ID NO: 1351127 - DNA, 22 bp, Artificial Sequence
  chemically synthesized
gggcttggggaaaacaaaacaa

SEQ ID NO: 1351128 - DNA, 22 bp, Artificial Sequence
  chemically synthesized
ggtgagatcgcattcttgtttt

SEQ ID NO: 1351129 - DNA, 22 bp, Artificial Sequence
  chemically synthesized
taggtgagatcgcattcttgtt

SEQ ID NO: 1351130 - DNA, 22 bp, Artificial Sequence
  chemically synthesized
ggggaaaacaaaacaagaatgc

SEQ ID NO: 1351131 - DNA, 22 bp, Artificial Sequence
  chemically synthesized
gggaaaacaaaacaagaatgcg

SEQ ID NO: 1351132 - DNA, 22 bp, Artificial Sequence
  chemically synthesized
gtctctaggtgagatcgcattc

SEQ ID NO: 1351133 - DNA, 22 bp, Artificial Sequence
  chemically synthesized
tgggatcatgtggaaattggtc

SEQ ID NO: 1351134 - DNA, 22 bp, Artificial Sequence
  chemically synthesized
cctgtgggatcatgtggaaatt

SEQ ID NO: 1351135 - DNA, 22 bp, Artificial Sequence
  chemically synthesized
acctagagaccaatttccacat

SEQ ID NO: 1351136 - DNA, 22 bp, Artificial Sequence
  chemically synthesized
gagaccaatttccacatgatcc

SEQ ID NO: 1351137 - DNA, 22 bp, Artificial Sequence
  chemically synthesized
cagagctccctgtgggatcatg

SEQ ID NO: 1351138 - DNA, 22 bp, Artificial Sequence
  chemically synthesized
ccctccagagctccctgtggga

SEQ ID NO: 1351139 - DNA, 22 bp, Artificial Sequence
  chemically synthesized
gccctccagagctccctgtggg

SEQ ID NO: 1351140 - DNA, 22 bp, Artificial Sequence
  chemically synthesized
ccacatgatcccacagggagct

SEQ ID NO: 1351141 - DNA, 22 bp, Artificial Sequence
  chemically synthesized
cacatgatcccacagggagctc

SEQ ID NO: 1351142 - DNA, 22 bp, Artificial Sequence
  chemically synthesized
ggatgcaatttgccctccagag

SEQ ID NO: 1351143 - DNA, 22 bp, Artificial Sequence
  chemically synthesized
tgggatgcaatttgccctccag

SEQ ID NO: 1351144 - DNA, 22 bp, Artificial Sequence
  chemically synthesized
tggagggcaaattgcatcccag

SEQ ID NO: 1351145 - DNA, 22 bp, Artificial Sequence
  chemically synthesized
gagggcaaattgcatcccagag

SEQ ID NO: 1351146 - DNA, 22 bp, Artificial Sequence
  chemically synthesized
ccacaaggtgagatcagctctg

SEQ ID NO: 1351147 - DNA, 22 bp, Artificial Sequence
  chemically synthesized
gccacaaggtgagatcagctct

SEQ ID NO: 1351148 - DNA, 22 bp, Artificial Sequence
  chemically synthesized
catcccagagctgatctcacct

SEQ ID NO: 1351149 - DNA, 22 bp, Artificial Sequence
  chemically synthesized
atctcaccttgtggcaaatggg

SEQ ID NO: 1351150 - DNA, 22 bp, Artificial Sequence
  chemically synthesized
accttgtggcaaatgggttgga

SEQ ID NO: 1351151 - DNA, 22 bp, Artificial Sequence
  chemically synthesized
aaagtacaagagtccaacccat

SEQ ID NO: 1351152 - DNA, 22 bp, Artificial Sequence
  chemically synthesized
gtggcaaatgggttggactctt

SEQ ID NO: 1351153 - DNA, 22 bp, Artificial Sequence
  chemically synthesized
tggcaaatgggttggactcttg

SEQ ID NO: 1351154 - DNA, 22 bp, Artificial Sequence
  chemically synthesized
caaccaacgactgaaagtacaa

SEQ ID NO: 1351155 - DNA, 22 bp, Artificial Sequence
  chemically synthesized
gcaaccaacgactgaaagtaca

SEQ ID NO: 1351156 - DNA, 22 bp, Artificial Sequence
  chemically synthesized
gactcttgtactttcagtcgtt

SEQ ID NO: 1351157 - DNA, 22 bp, Artificial Sequence
  chemically synthesized
aggtcagtttgcaaccaacgac

SEQ ID NO: 1351158 - DNA, 22 bp, Artificial Sequence
  chemically synthesized
ttgtactttcagtcgttggttg

SEQ ID NO: 1351159 - DNA, 22 bp, Artificial Sequence
  chemically synthesized
gtactttcagtcgttggttgca

SEQ ID NO: 1351160 - DNA, 22 bp, Artificial Sequence
  chemically synthesized
tactttcagtcgttggttgcaa

SEQ ID NO: 1351161 - DNA, 22 bp, Artificial Sequence
  chemically synthesized
tcagtcgttggttgcaaactga

SEQ ID NO: 1351162 - DNA, 22 bp, Artificial Sequence
  chemically synthesized
cagtcgttggttgcaaactgac

SEQ ID NO: 1351163 - DNA, 22 bp, Artificial Sequence
  chemically synthesized
agtcgttggttgcaaactgacc

SEQ ID NO: 1351164 - DNA, 22 bp, Artificial Sequence
  chemically synthesized
gttgcaaactgacctgaggtgg

SEQ ID NO: 1351165 - DNA, 22 bp, Artificial Sequence
  chemically synthesized
caaactgacctgaggtggggca

SEQ ID NO: 1351166 - DNA, 22 bp, Artificial Sequence
  chemically synthesized
aaaggccatatgtgccccacct

SEQ ID NO: 1351167 - DNA, 22 bp, Artificial Sequence
  chemically synthesized
acctgaggtggggcacatatgg

SEQ ID NO: 1351168 - DNA, 22 bp, Artificial Sequence
  chemically synthesized
aggtggggcacatatggccttt

SEQ ID NO: 1351169 - DNA, 22 bp, Artificial Sequence
  chemically synthesized
aagaaagccaggagcctgaaag

SEQ ID NO: 1351170 - DNA, 22 bp, Artificial Sequence
  chemically synthesized
ccctgaagaaagccaggagcct

SEQ ID NO: 1351171 - DNA, 22 bp, Artificial Sequence
  chemically synthesized
accctgaagaaagccaggagcc

SEQ ID NO: 1351172 - DNA, 22 bp, Artificial Sequence
  chemically synthesized
ttaccctgaagaaagccaggag

SEQ ID NO: 1351173 - DNA, 22 bp, Artificial Sequence
  chemically synthesized
ttcttaccctgaagaaagccag

SEQ ID NO: 1351174 - DNA, 22 bp, Artificial Sequence
  chemically synthesized
gttcttaccctgaagaaagcca

SEQ ID NO: 1351175 - DNA, 22 bp, Artificial Sequence
  chemically synthesized
tcaggctcctggctttcttcag

SEQ ID NO: 1351176 - DNA, 22 bp, Artificial Sequence
  chemically synthesized
caggctcctggctttcttcagg

SEQ ID NO: 1351177 - DNA, 22 bp, Artificial Sequence
  chemically synthesized
aggctcctggctttcttcaggg

SEQ ID NO: 1351178 - DNA, 22 bp, Artificial Sequence
  chemically synthesized
cagagacttgttcttaccctga

SEQ ID NO: 1351179 - DNA, 22 bp, Artificial Sequence
  chemically synthesized
ctggctttcttcagggtaagaa

SEQ ID NO: 1351180 - DNA, 22 bp, Artificial Sequence
  chemically synthesized
tccagagacttgttcttaccct

SEQ ID NO: 1351181 - DNA, 22 bp, Artificial Sequence
  chemically synthesized
ctccagagacttgttcttaccc

SEQ ID NO: 1351182 - DNA, 22 bp, Artificial Sequence
  chemically synthesized
gctttcttcagggtaagaacaa

SEQ ID NO: 1351183 - DNA, 22 bp, Artificial Sequence
  chemically synthesized
cttctccagagacttgttctta

SEQ ID NO: 1351184 - DNA, 22 bp, Artificial Sequence
  chemically synthesized
ccttctccagagacttgttctt

SEQ ID NO: 1351185 - DNA, 22 bp, Artificial Sequence
  chemically synthesized
tcttcagggtaagaacaagtct

SEQ ID NO: 1351186 - DNA, 22 bp, Artificial Sequence
  chemically synthesized
cttcagggtaagaacaagtctc

SEQ ID NO: 1351187 - DNA, 22 bp, Artificial Sequence
  chemically synthesized
cttccttctccagagacttgtt

SEQ ID NO: 1351188 - DNA, 22 bp, Artificial Sequence
  chemically synthesized
ttcagggtaagaacaagtctct

SEQ ID NO: 1351189 - DNA, 22 bp, Artificial Sequence
  chemically synthesized
cagggtaagaacaagtctctgg

SEQ ID NO: 1351190 - DNA, 22 bp, Artificial Sequence
  chemically synthesized
agggtaagaacaagtctctgga

SEQ ID NO: 1351191 - DNA, 22 bp, Artificial Sequence
  chemically synthesized
cccacagctgcttccttctcca

SEQ ID NO: 1351192 - DNA, 22 bp, Artificial Sequence
  chemically synthesized
ttgcccacagctgcttccttct

SEQ ID NO: 1351193 - DNA, 22 bp, Artificial Sequence
  chemically synthesized
gttgcccacagctgcttccttc

SEQ ID NO: 1351194 - DNA, 22 bp, Artificial Sequence
  chemically synthesized
tggagaaggaagcagctgtggg

SEQ ID NO: 1351195 - DNA, 22 bp, Artificial Sequence
  chemically synthesized
ggagtgcttgttgcccacagct

SEQ ID NO: 1351196 - DNA, 22 bp, Artificial Sequence
  chemically synthesized
gagaaggaagcagctgtgggca

SEQ ID NO: 1351197 - DNA, 22 bp, Artificial Sequence
  chemically synthesized
ctgggagtgcttgttgcccaca

SEQ ID NO: 1351198 - DNA, 22 bp, Artificial Sequence
  chemically synthesized
gctgctgggagtgcttgttgcc

SEQ ID NO: 1351199 - DNA, 22 bp, Artificial Sequence
  chemically synthesized
tgggcaacaagcactcccagca

SEQ ID NO: 1351200 - DNA, 22 bp, Artificial Sequence
  chemically synthesized
ccagcagctaggggatgggtgt

SEQ ID NO: 1351201 - DNA, 22 bp, Artificial Sequence
  chemically synthesized
aagtccccatcaccaggtagca

SEQ ID NO: 1351202 - DNA, 22 bp, Artificial Sequence
  chemically synthesized
ggggatgggtgtgctacctggt

SEQ ID NO: 1351203 - DNA, 22 bp, Artificial Sequence
  chemically synthesized
ctgaagtccccatcaccaggta

SEQ ID NO: 1351204 - DNA, 22 bp, Artificial Sequence
  chemically synthesized
tactgaagtccccatcaccagg

SEQ ID NO: 1351205 - DNA, 22 bp, Artificial Sequence
  chemically synthesized
atatgttctactgaagtcccca

SEQ ID NO: 1351206 - DNA, 22 bp, Artificial Sequence
  chemically synthesized
cctggtgatggggacttcagta

SEQ ID NO: 1351207 - DNA, 22 bp, Artificial Sequence
  chemically synthesized
gtgatggggacttcagtagaac

SEQ ID NO: 1351208 - DNA, 22 bp, Artificial Sequence
  chemically synthesized
gtgggcactgatatgttctact

SEQ ID NO: 1351209 - DNA, 22 bp, Artificial Sequence
  chemically synthesized
tagtgggcactgatatgttcta

SEQ ID NO: 1351210 - DNA, 22 bp, Artificial Sequence
  chemically synthesized
actctagtgggcactgatatgt

SEQ ID NO: 1351211 - DNA, 22 bp, Artificial Sequence
  chemically synthesized
tgactctagtgggcactgatat

SEQ ID NO: 1351212 - DNA, 22 bp, Artificial Sequence
  chemically synthesized
tctgactctagtgggcactgat

SEQ ID NO: 1351213 - DNA, 22 bp, Artificial Sequence
  chemically synthesized
cagtagaacatatcagtgccca

SEQ ID NO: 1351214 - DNA, 22 bp, Artificial Sequence
  chemically synthesized
agtagaacatatcagtgcccac

SEQ ID NO: 1351215 - DNA, 22 bp, Artificial Sequence
  chemically synthesized
tctctgactctagtgggcactg

SEQ ID NO: 1351216 - DNA, 22 bp, Artificial Sequence
  chemically synthesized
agacccaaatcaattctctctg

SEQ ID NO: 1351217 - DNA, 22 bp, Artificial Sequence
  chemically synthesized
aagacccaaatcaattctctct

SEQ ID NO: 1351218 - DNA, 22 bp, Artificial Sequence
  chemically synthesized
taagacccaaatcaattctctc

SEQ ID NO: 1351219 - DNA, 22 bp, Artificial Sequence
  chemically synthesized
tctttaagacccaaatcaattc

SEQ ID NO: 1351220 - DNA, 22 bp, Artificial Sequence
  chemically synthesized
gagtcagagagaattgatttgg

SEQ ID NO: 1351221 - DNA, 22 bp, Artificial Sequence
  chemically synthesized
tatactgtctttaagacccaaa

SEQ ID NO: 1351222 - DNA, 22 bp, Artificial Sequence
  chemically synthesized
gtatactgtctttaagacccaa

SEQ ID NO: 1351223 - DNA, 22 bp, Artificial Sequence
  chemically synthesized
cgtttgtatactgtctttaaga

SEQ ID NO: 1351224 - DNA, 22 bp, Artificial Sequence
  chemically synthesized
ccgtttgtatactgtctttaag

SEQ ID NO: 1351225 - DNA, 22 bp, Artificial Sequence
  chemically synthesized
atttgggtcttaaagacagtat

SEQ ID NO: 1351226 - DNA, 22 bp, Artificial Sequence
  chemically synthesized
gggtcttaaagacagtatacaa

SEQ ID NO: 1351227 - DNA, 22 bp, Artificial Sequence
  chemically synthesized
ggtcttaaagacagtatacaaa

SEQ ID NO: 1351228 - DNA, 22 bp, Artificial Sequence
  chemically synthesized
aaagacagtatacaaacggaaa

SEQ ID NO: 1351229 - DNA, 22 bp, Artificial Sequence
  chemically synthesized
aagacagtatacaaacggaaat

SEQ ID NO: 1351230 - DNA, 22 bp, Artificial Sequence
  chemically synthesized
aaaaaaataaataaaacaaaat

SEQ ID NO: 1351231 - DNA, 22 bp, Artificial Sequence
  chemically synthesized
tctcaaaaaaataaataaaaca

SEQ ID NO: 1351232 - DNA, 22 bp, Artificial Sequence
  chemically synthesized
tattttattttgttttatttat

SEQ ID NO: 1351233 - DNA, 22 bp, Artificial Sequence
  chemically synthesized
attttattttgttttatttatt

SEQ ID NO: 1351234 - DNA, 22 bp, Artificial Sequence
  chemically synthesized
ttttattttgttttatttattt

SEQ ID NO: 1351235 - DNA, 22 bp, Artificial Sequence
  chemically synthesized
tattttgttttatttatttttt

SEQ ID NO: 1351236 - DNA, 22 bp, Artificial Sequence
  chemically synthesized
attttgttttatttattttttt

SEQ ID NO: 1351237 - DNA, 22 bp, Artificial Sequence
  chemically synthesized
ttttgttttatttatttttttg

SEQ ID NO: 1351238 - DNA, 22 bp, Artificial Sequence
  chemically synthesized
tgttttatttatttttttgaga

SEQ ID NO: 1351239 - DNA, 22 bp, Artificial Sequence
  chemically synthesized
gttttatttatttttttgagac

SEQ ID NO: 1351240 - DNA, 22 bp, Artificial Sequence
  chemically synthesized
ttttatttatttttttgagaca

SEQ ID NO: 1351241 - DNA, 22 bp, Artificial Sequence
  chemically synthesized
tatttatttttttgagacaggg

SEQ ID NO: 1351242 - DNA, 22 bp, Artificial Sequence
  chemically synthesized
atttatttttttgagacagggt

SEQ ID NO: 1351243 - DNA, 22 bp, Artificial Sequence
  chemically synthesized
tttatttttttgagacagggtc

SEQ ID NO: 1351244 - DNA, 22 bp, Artificial Sequence
  chemically synthesized
agtgacagagtgagaccctgtc

SEQ ID NO: 1351245 - DNA, 22 bp, Artificial Sequence
  chemically synthesized
atttttttgagacagggtctca

SEQ ID NO: 1351246 - DNA, 22 bp, Artificial Sequence
  chemically synthesized
tttttttgagacagggtctcac

SEQ ID NO: 1351247 - DNA, 22 bp, Artificial Sequence
  chemically synthesized
ttttgagacagggtctcactct

SEQ ID NO: 1351248 - DNA, 22 bp, Artificial Sequence
  chemically synthesized
tttgagacagggtctcactctg

SEQ ID NO: 1351249 - DNA, 22 bp, Artificial Sequence
  chemically synthesized
cagcctgagtgacagagtgaga

SEQ ID NO: 1351250 - DNA, 22 bp, Artificial Sequence
  chemically synthesized
ttgagacagggtctcactctgt

SEQ ID NO: 1351251 - DNA, 22 bp, Artificial Sequence
  chemically synthesized
tgagacagggtctcactctgtc

SEQ ID NO: 1351252 - DNA, 22 bp, Artificial Sequence
  chemically synthesized
gagacagggtctcactctgtca

SEQ ID NO: 1351253 - DNA, 22 bp, Artificial Sequence
  chemically synthesized
agacagggtctcactctgtcac

SEQ ID NO: 1351254 - DNA, 22 bp, Artificial Sequence
  chemically synthesized
cactccagcctgagtgacagag

SEQ ID NO: 1351255 - DNA, 22 bp, Artificial Sequence
  chemically synthesized
caccactgcactccagcctgag

SEQ ID NO: 1351256 - DNA, 22 bp, Artificial Sequence
  chemically synthesized
actctgtcactcaggctggagt

SEQ ID NO: 1351257 - DNA, 22 bp, Artificial Sequence
  chemically synthesized
tgtcactcaggctggagtgcag

SEQ ID NO: 1351258 - DNA, 22 bp, Artificial Sequence
  chemically synthesized
tcactcaggctggagtgcagtg

SEQ ID NO: 1351259 - DNA, 22 bp, Artificial Sequence
  chemically synthesized
aggctggagtgcagtggtgcaa

SEQ ID NO: 1351260 - DNA, 22 bp, Artificial Sequence
  chemically synthesized
cagtgagccgagattgcaccac

SEQ ID NO: 1351261 - DNA, 22 bp, Artificial Sequence
  chemically synthesized
gagtgcagtggtgcaatctcgg

SEQ ID NO: 1351262 - DNA, 22 bp, Artificial Sequence
  chemically synthesized
aaccagggaggcggcagttgca

SEQ ID NO: 1351263 - DNA, 22 bp, Artificial Sequence
  chemically synthesized
gaaccagggaggcggcagttgc

SEQ ID NO: 1351264 - DNA, 22 bp, Artificial Sequence
  chemically synthesized
ggctcactgcaactgccgcctc

SEQ ID NO: 1351265 - DNA, 22 bp, Artificial Sequence
  chemically synthesized
actgcaactgccgcctccctgg

SEQ ID NO: 1351266 - DNA, 22 bp, Artificial Sequence
  chemically synthesized
caactgccgcctccctggttca

SEQ ID NO: 1351267 - DNA, 22 bp, Artificial Sequence
  chemically synthesized
aggcaggacaaccacttgaacc

SEQ ID NO: 1351268 - DNA, 22 bp, Artificial Sequence
  chemically synthesized
ccgcctccctggttcaagtggt

SEQ ID NO: 1351269 - DNA, 22 bp, Artificial Sequence
  chemically synthesized
cctggttcaagtggttgtcctg

SEQ ID NO: 1351270 - DNA, 22 bp, Artificial Sequence
  chemically synthesized
gggaggctgaggcaggacaacc

SEQ ID NO: 1351271 - DNA, 22 bp, Artificial Sequence
  chemically synthesized
ctagggaggctgaggcaggaca

SEQ ID NO: 1351272 - DNA, 22 bp, Artificial Sequence
  chemically synthesized
gttcaagtggttgtcctgcctc

SEQ ID NO: 1351273 - DNA, 22 bp, Artificial Sequence
  chemically synthesized
aagtggttgtcctgcctcagcc

SEQ ID NO: 1351274 - DNA, 22 bp, Artificial Sequence
  chemically synthesized
taatcccagctactagggaggc

SEQ ID NO: 1351275 - DNA, 22 bp, Artificial Sequence
  chemically synthesized
tcctgcctcagcctccctagta

SEQ ID NO: 1351276 - DNA, 22 bp, Artificial Sequence
  chemically synthesized
cctcagcctccctagtagctgg

SEQ ID NO: 1351277 - DNA, 22 bp, Artificial Sequence
  chemically synthesized
agcctccctagtagctgggatt

SEQ ID NO: 1351278 - DNA, 22 bp, Artificial Sequence
  chemically synthesized
cctagtagctgggattacaggt

SEQ ID NO: 1351279 - DNA, 22 bp, Artificial Sequence
  chemically synthesized
gtagctgggattacaggtgcgc

SEQ ID NO: 1351280 - DNA, 22 bp, Artificial Sequence
  chemically synthesized
gtcgggcatggtggtgcgcacc

SEQ ID NO: 1351281 - DNA, 22 bp, Artificial Sequence
  chemically synthesized
ggattacaggtgcgcaccacca

SEQ ID NO: 1351282 - DNA, 22 bp, Artificial Sequence
  chemically synthesized
caggtgcgcaccaccatgcccg

SEQ ID NO: 1351283 - DNA, 22 bp, Artificial Sequence
  chemically synthesized
aaaatacaaaaaattagtcggg

SEQ ID NO: 1351284 - DNA, 22 bp, Artificial Sequence
  chemically synthesized
ctaaaaatacaaaaaattagtc

SEQ ID NO: 1351285 - DNA, 22 bp, Artificial Sequence
  chemically synthesized
tactaaaaatacaaaaaattag

SEQ ID NO: 1351286 - DNA, 22 bp, Artificial Sequence
  chemically synthesized
attttttgtatttttagtagag

SEQ ID NO: 1351287 - DNA, 22 bp, Artificial Sequence
  chemically synthesized
tttgtatttttagtagagacgg

SEQ ID NO: 1351288 - DNA, 22 bp, Artificial Sequence
  chemically synthesized
ttgtatttttagtagagacggg

SEQ ID NO: 1351289 - DNA, 22 bp, Artificial Sequence
  chemically synthesized
tgtatttttagtagagacgggg

SEQ ID NO: 1351290 - DNA, 22 bp, Artificial Sequence
  chemically synthesized
gtatttttagtagagacggggt

SEQ ID NO: 1351291 - DNA, 22 bp, Artificial Sequence
  chemically synthesized
tatttttagtagagacggggtt

SEQ ID NO: 1351292 - DNA, 22 bp, Artificial Sequence
  chemically synthesized
gccaacatggtgaaaccccgtc

SEQ ID NO: 1351293 - DNA, 22 bp, Artificial Sequence
  chemically synthesized
ttagtagagacggggtttcacc

SEQ ID NO: 1351294 - DNA, 22 bp, Artificial Sequence
  chemically synthesized
tagtagagacggggtttcacca

SEQ ID NO: 1351295 - DNA, 22 bp, Artificial Sequence
  chemically synthesized
agtagagacggggtttcaccat

SEQ ID NO: 1351296 - DNA, 22 bp, Artificial Sequence
  chemically synthesized
gtagagacggggtttcaccatg

SEQ ID NO: 1351297 - DNA, 22 bp, Artificial Sequence
  chemically synthesized
gagaccaacctggccaacatgg

SEQ ID NO: 1351298 - DNA, 22 bp, Artificial Sequence
  chemically synthesized
caccatgttggccaggttggtc

SEQ ID NO: 1351299 - DNA, 22 bp, Artificial Sequence
  chemically synthesized
accatgttggccaggttggtct

SEQ ID NO: 1351300 - DNA, 22 bp, Artificial Sequence
  chemically synthesized
aggccaggagttcgagaccaac

SEQ ID NO: 1351301 - DNA, 22 bp, Artificial Sequence
  chemically synthesized
gaggccaggagttcgagaccaa

SEQ ID NO: 1351302 - DNA, 22 bp, Artificial Sequence
  chemically synthesized
gccaggttggtctcgaactcct

SEQ ID NO: 1351303 - DNA, 22 bp, Artificial Sequence
  chemically synthesized
gtctcgaactcctggcctcaaa

SEQ ID NO: 1351304 - DNA, 22 bp, Artificial Sequence
  chemically synthesized
aggcgggtggatcatttgaggc

SEQ ID NO: 1351305 - DNA, 22 bp, Artificial Sequence
  chemically synthesized
gaactcctggcctcaaatgatc

SEQ ID NO: 1351306 - DNA, 22 bp, Artificial Sequence
  chemically synthesized
ggagtctgaggcgggtggatca

SEQ ID NO: 1351307 - DNA, 22 bp, Artificial Sequence
  chemically synthesized
ctggcctcaaatgatccacccg

SEQ ID NO: 1351308 - DNA, 22 bp, Artificial Sequence
  chemically synthesized
gggagtctgaggcgggtggatc

SEQ ID NO: 1351309 - DNA, 22 bp, Artificial Sequence
  chemically synthesized
tgggagtctgaggcgggtggat

SEQ ID NO: 1351310 - DNA, 22 bp, Artificial Sequence
  chemically synthesized
gcctcaaatgatccacccgcct

SEQ ID NO: 1351311 - DNA, 22 bp, Artificial Sequence
  chemically synthesized
aaatgatccacccgcctcagac

SEQ ID NO: 1351312 - DNA, 22 bp, Artificial Sequence
  chemically synthesized
taatcccaggactttgggagtc

SEQ ID NO: 1351313 - DNA, 22 bp, Artificial Sequence
  chemically synthesized
acgcctgtaatcccaggacttt

SEQ ID NO: 1351314 - DNA, 22 bp, Artificial Sequence
  chemically synthesized
agactcccaaagtcctgggatt

SEQ ID NO: 1351315 - DNA, 22 bp, Artificial Sequence
  chemically synthesized
ccaaagtcctgggattacaggc

SEQ ID NO: 1351316 - DNA, 22 bp, Artificial Sequence
  chemically synthesized
ggattacaggcgtgagccaccg

SEQ ID NO: 1351317 - DNA, 22 bp, Artificial Sequence
  chemically synthesized
caggcgtgagccaccgcgcccg

SEQ ID NO: 1351318 - DNA, 22 bp, Artificial Sequence
  chemically synthesized
taataaaataaaataaggtcgg

SEQ ID NO: 1351319 - DNA, 22 bp, Artificial Sequence
  chemically synthesized
ttataataaaataaaataaggt

SEQ ID NO: 1351320 - DNA, 22 bp, Artificial Sequence
  chemically synthesized
attataataaaataaaataagg

SEQ ID NO: 1351321 - DNA, 22 bp, Artificial Sequence
  chemically synthesized
ttattataataaaataaaataa

SEQ ID NO: 1351322 - DNA, 22 bp, Artificial Sequence
  chemically synthesized
cttattataataaaataaaata

SEQ ID NO: 1351323 - DNA, 22 bp, Artificial Sequence
  chemically synthesized
tcttcttattataataaaataa

SEQ ID NO: 1351324 - DNA, 22 bp, Artificial Sequence
  chemically synthesized
tgttgtcttcttattataataa

SEQ ID NO: 1351325 - DNA, 22 bp, Artificial Sequence
  chemically synthesized
atgttgtcttcttattataata

SEQ ID NO: 1351326 - DNA, 22 bp, Artificial Sequence
  chemically synthesized
attttattttattataataaga

SEQ ID NO: 1351327 - DNA, 22 bp, Artificial Sequence
  chemically synthesized
ttttattttattataataagaa

SEQ ID NO: 1351328 - DNA, 22 bp, Artificial Sequence
  chemically synthesized
tattttattataataagaagac

SEQ ID NO: 1351329 - DNA, 22 bp, Artificial Sequence
  chemically synthesized
attttattataataagaagaca

SEQ ID NO: 1351330 - DNA, 22 bp, Artificial Sequence
  chemically synthesized
ttttattataataagaagacaa

SEQ ID NO: 1351331 - DNA, 22 bp, Artificial Sequence
  chemically synthesized
tattataataagaagacaacat

SEQ ID NO: 1351332 - DNA, 22 bp, Artificial Sequence
  chemically synthesized
attataataagaagacaacata

SEQ ID NO: 1351333 - DNA, 22 bp, Artificial Sequence
  chemically synthesized
ttataataagaagacaacataa

SEQ ID NO: 1351334 - DNA, 22 bp, Artificial Sequence
  chemically synthesized
agagagtagatcttatgttgtc

SEQ ID NO: 1351335 - DNA, 22 bp, Artificial Sequence
  chemically synthesized
taataagaagacaacataagat

SEQ ID NO: 1351336 - DNA, 22 bp, Artificial Sequence
  chemically synthesized
ttaagagagtagatcttatgtt

SEQ ID NO: 1351337 - DNA, 22 bp, Artificial Sequence
  chemically synthesized
gttaagagagtagatcttatgt

SEQ ID NO: 1351338 - DNA, 22 bp, Artificial Sequence
  chemically synthesized
aacatttgttaagagagtagat

SEQ ID NO: 1351339 - DNA, 22 bp, Artificial Sequence
  chemically synthesized
aaacatttgttaagagagtaga

SEQ ID NO: 1351340 - DNA, 22 bp, Artificial Sequence
  chemically synthesized
tatacttaaacatttgttaaga

SEQ ID NO: 1351341 - DNA, 22 bp, Artificial Sequence
  chemically synthesized
ctctcttaacaaatgtttaagt

SEQ ID NO: 1351342 - DNA, 22 bp, Artificial Sequence
  chemically synthesized
tcttaacaaatgtttaagtata

SEQ ID NO: 1351343 - DNA, 22 bp, Artificial Sequence
  chemically synthesized
ttaacaaatgtttaagtataca

SEQ ID NO: 1351344 - DNA, 22 bp, Artificial Sequence
  chemically synthesized
acaataccgtattgtatactta

SEQ ID NO: 1351345 - DNA, 22 bp, Artificial Sequence
  chemically synthesized
aacaaatgtttaagtatacaat

SEQ ID NO: 1351346 - DNA, 22 bp, Artificial Sequence
  chemically synthesized
acaaatgtttaagtatacaata

SEQ ID NO: 1351347 - DNA, 22 bp, Artificial Sequence
  chemically synthesized
tagttaacaataccgtattgta

SEQ ID NO: 1351348 - DNA, 22 bp, Artificial Sequence
  chemically synthesized
aagtatacaatacggtattgtt

SEQ ID NO: 1351349 - DNA, 22 bp, Artificial Sequence
  chemically synthesized
agtatacaatacggtattgtta

SEQ ID NO: 1351350 - DNA, 22 bp, Artificial Sequence
  chemically synthesized
cacaacagtgtgcctgtagtta

SEQ ID NO: 1351351 - DNA, 22 bp, Artificial Sequence
  chemically synthesized
ttgcacaacagtgtgcctgtag

SEQ ID NO: 1351352 - DNA, 22 bp, Artificial Sequence
  chemically synthesized
ttaactacaggcacactgttgt

SEQ ID NO: 1351353 - DNA, 22 bp, Artificial Sequence
  chemically synthesized
gatatctgttgcacaacagtgt

SEQ ID NO: 1351354 - DNA, 22 bp, Artificial Sequence
  chemically synthesized
tggatatctgttgcacaacagt

SEQ ID NO: 1351355 - DNA, 22 bp, Artificial Sequence
  chemically synthesized
actacaggcacactgttgtgca

SEQ ID NO: 1351356 - DNA, 22 bp, Artificial Sequence
  chemically synthesized
caggcacactgttgtgcaacag

SEQ ID NO: 1351357 - DNA, 22 bp, Artificial Sequence
  chemically synthesized
ttgtgcaacagatatccagaac

SEQ ID NO: 1351358 - DNA, 22 bp, Artificial Sequence
  chemically synthesized
taaaaaatgagtaggttctgga

SEQ ID NO: 1351359 - DNA, 22 bp, Artificial Sequence
  chemically synthesized
tgcaacagatatccagaaccta

SEQ ID NO: 1351360 - DNA, 22 bp, Artificial Sequence
  chemically synthesized
agttataaaaaatgagtaggtt

SEQ ID NO: 1351361 - DNA, 22 bp, Artificial Sequence
  chemically synthesized
cagttataaaaaatgagtaggt

SEQ ID NO: 1351362 - DNA, 22 bp, Artificial Sequence
  chemically synthesized
ctcattttttataactgaaact

SEQ ID NO: 1351363 - DNA, 22 bp, Artificial Sequence
  chemically synthesized
tcaacagatatcaagtttcagt

SEQ ID NO: 1351364 - DNA, 22 bp, Artificial Sequence
  chemically synthesized
attttttataactgaaacttga

SEQ ID NO: 1351365 - DNA, 22 bp, Artificial Sequence
  chemically synthesized
tttataactgaaacttgatatc

SEQ ID NO: 1351366 - DNA, 22 bp, Artificial Sequence
  chemically synthesized
ccgttgtcaacagatatcaagt

SEQ ID NO: 1351367 - DNA, 22 bp, Artificial Sequence
  chemically synthesized
ttataactgaaacttgatatct

SEQ ID NO: 1351368 - DNA, 22 bp, Artificial Sequence
  chemically synthesized
cccgttgtcaacagatatcaag

SEQ ID NO: 1351369 - DNA, 22 bp, Artificial Sequence
  chemically synthesized
tataactgaaacttgatatctg

SEQ ID NO: 1351370 - DNA, 22 bp, Artificial Sequence
  chemically synthesized
ataactgaaacttgatatctgt

SEQ ID NO: 1351371 - DNA, 22 bp, Artificial Sequence
  chemically synthesized
taactgaaacttgatatctgtt

SEQ ID NO: 1351372 - DNA, 22 bp, Artificial Sequence
  chemically synthesized
aaacttgatatctgttgacaac

SEQ ID NO: 1351373 - DNA, 22 bp, Artificial Sequence
  chemically synthesized
aagaaaatatttcccgttgtca

SEQ ID NO: 1351374 - DNA, 22 bp, Artificial Sequence
  chemically synthesized
gatatctgttgacaacgggaaa

SEQ ID NO: 1351375 - DNA, 22 bp, Artificial Sequence
  chemically synthesized
atatctgttgacaacgggaaat

SEQ ID NO: 1351376 - DNA, 22 bp, Artificial Sequence
  chemically synthesized
ttgacaacgggaaatattttct

SEQ ID NO: 1351377 - DNA, 22 bp, Artificial Sequence
  chemically synthesized
acaacgggaaatattttcttta

SEQ ID NO: 1351378 - DNA, 22 bp, Artificial Sequence
  chemically synthesized
atatcatgagactaaagaaaat

SEQ ID NO: 1351379 - DNA, 22 bp, Artificial Sequence
  chemically synthesized
aatatcatgagactaaagaaaa

SEQ ID NO: 1351380 - DNA, 22 bp, Artificial Sequence
  chemically synthesized
taatatcatgagactaaagaaa

SEQ ID NO: 1351381 - DNA, 22 bp, Artificial Sequence
  chemically synthesized
ttaatatcatgagactaaagaa

SEQ ID NO: 1351382 - DNA, 22 bp, Artificial Sequence
  chemically synthesized
agatacatttttaatatcatga

SEQ ID NO: 1351383 - DNA, 22 bp, Artificial Sequence
  chemically synthesized
tctttagtctcatgatattaaa

SEQ ID NO: 1351384 - DNA, 22 bp, Artificial Sequence
  chemically synthesized
ctttagtctcatgatattaaaa

SEQ ID NO: 1351385 - DNA, 22 bp, Artificial Sequence
  chemically synthesized
tttagtctcatgatattaaaaa

SEQ ID NO: 1351386 - DNA, 22 bp, Artificial Sequence
  chemically synthesized
tagtctcatgatattaaaaatg

SEQ ID NO: 1351387 - DNA, 22 bp, Artificial Sequence
  chemically synthesized
agtctcatgatattaaaaatgt

SEQ ID NO: 1351388 - DNA, 22 bp, Artificial Sequence
  chemically synthesized
gtctcatgatattaaaaatgta

SEQ ID NO: 1351389 - DNA, 22 bp, Artificial Sequence
  chemically synthesized
atgatattaaaaatgtatctga

SEQ ID NO: 1351390 - DNA, 22 bp, Artificial Sequence
  chemically synthesized
aaaatcataaattcagatacat

SEQ ID NO: 1351391 - DNA, 22 bp, Artificial Sequence
  chemically synthesized
tctaaaaatcataaattcagat

SEQ ID NO: 1351392 - DNA, 22 bp, Artificial Sequence
  chemically synthesized
atctaaaaatcataaattcaga

SEQ ID NO: 1351393 - DNA, 22 bp, Artificial Sequence
  chemically synthesized
tatctaaaaatcataaattcag

SEQ ID NO: 1351394 - DNA, 22 bp, Artificial Sequence
  chemically synthesized
aaaatgtatctgaatttatgat

SEQ ID NO: 1351395 - DNA, 22 bp, Artificial Sequence
  chemically synthesized
tgagtgctttatctaaaaatca

SEQ ID NO: 1351396 - DNA, 22 bp, Artificial Sequence
  chemically synthesized
tatgagtgctttatctaaaaat

SEQ ID NO: 1351397 - DNA, 22 bp, Artificial Sequence
  chemically synthesized
aatttatgatttttagataaag

SEQ ID NO: 1351398 - DNA, 22 bp, Artificial Sequence
  chemically synthesized
atgatttttagataaagcactc

SEQ ID NO: 1351399 - DNA, 22 bp, Artificial Sequence
  chemically synthesized
tgatttttagataaagcactca

SEQ ID NO: 1351400 - DNA, 22 bp, Artificial Sequence
  chemically synthesized
cccaatagtctctatgagtgct

SEQ ID NO: 1351401 - DNA, 22 bp, Artificial Sequence
  chemically synthesized
gcccaatagtctctatgagtgc

SEQ ID NO: 1351402 - DNA, 22 bp, Artificial Sequence
  chemically synthesized
tgcccaatagtctctatgagtg

SEQ ID NO: 1351403 - DNA, 22 bp, Artificial Sequence
  chemically synthesized
ttagataaagcactcatagaga

SEQ ID NO: 1351404 - DNA, 22 bp, Artificial Sequence
  chemically synthesized
tagataaagcactcatagagac

SEQ ID NO: 1351405 - DNA, 22 bp, Artificial Sequence
  chemically synthesized
agataaagcactcatagagact

SEQ ID NO: 1351406 - DNA, 22 bp, Artificial Sequence
  chemically synthesized
gataaagcactcatagagacta

SEQ ID NO: 1351407 - DNA, 22 bp, Artificial Sequence
  chemically synthesized
gtattttgcccaatagtctcta

SEQ ID NO: 1351408 - DNA, 22 bp, Artificial Sequence
  chemically synthesized
ttcgtattttgcccaatagtct

SEQ ID NO: 1351409 - DNA, 22 bp, Artificial Sequence
  chemically synthesized
atagagactattgggcaaaata

SEQ ID NO: 1351410 - DNA, 22 bp, Artificial Sequence
  chemically synthesized
ttgggcaaaatacgaacagatg

SEQ ID NO: 1351411 - DNA, 22 bp, Artificial Sequence
  chemically synthesized
gagaaatcaatacatctgttcg

SEQ ID NO: 1351412 - DNA, 22 bp, Artificial Sequence
  chemically synthesized
ggagaaatcaatacatctgttc

SEQ ID NO: 1351413 - DNA, 22 bp, Artificial Sequence
  chemically synthesized
ggcaaaatacgaacagatgtat

SEQ ID NO: 1351414 - DNA, 22 bp, Artificial Sequence
  chemically synthesized
gaacccttggagaaatcaatac

SEQ ID NO: 1351415 - DNA, 22 bp, Artificial Sequence
  chemically synthesized
ggaacccttggagaaatcaata

SEQ ID NO: 1351416 - DNA, 22 bp, Artificial Sequence
  chemically synthesized
cagtttggaacccttggagaaa

SEQ ID NO: 1351417 - DNA, 22 bp, Artificial Sequence
  chemically synthesized
aaattccagtttggaacccttg

SEQ ID NO: 1351418 - DNA, 22 bp, Artificial Sequence
  chemically synthesized
aaaattccagtttggaaccctt

SEQ ID NO: 1351419 - DNA, 22 bp, Artificial Sequence
  chemically synthesized
taaaattccagtttggaaccct

SEQ ID NO: 1351420 - DNA, 22 bp, Artificial Sequence
  chemically synthesized
ttaaaattccagtttggaaccc

SEQ ID NO: 1351421 - DNA, 22 bp, Artificial Sequence
  chemically synthesized
tttaaaattccagtttggaacc

SEQ ID NO: 1351422 - DNA, 22 bp, Artificial Sequence
  chemically synthesized
atttctccaagggttccaaact

SEQ ID NO: 1351423 - DNA, 22 bp, Artificial Sequence
  chemically synthesized
ctccaagggttccaaactggaa

SEQ ID NO: 1351424 - DNA, 22 bp, Artificial Sequence
  chemically synthesized
tccaagggttccaaactggaat

SEQ ID NO: 1351425 - DNA, 22 bp, Artificial Sequence
  chemically synthesized
aagttttttaaaattccagttt

SEQ ID NO: 1351426 - DNA, 22 bp, Artificial Sequence
  chemically synthesized
caagggttccaaactggaattt

SEQ ID NO: 1351427 - DNA, 22 bp, Artificial Sequence
  chemically synthesized
actcaagttttttaaaattcca

SEQ ID NO: 1351428 - DNA, 22 bp, Artificial Sequence
  chemically synthesized
aactcaagttttttaaaattcc

SEQ ID NO: 1351429 - DNA, 22 bp, Artificial Sequence
  chemically synthesized
caaactggaattttaaaaaact

SEQ ID NO: 1351430 - DNA, 22 bp, Artificial Sequence
  chemically synthesized
gaattttaaaaaacttgagtta

SEQ ID NO: 1351431 - DNA, 22 bp, Artificial Sequence
  chemically synthesized
aatatgcatgaatcttaactca

SEQ ID NO: 1351432 - DNA, 22 bp, Artificial Sequence
  chemically synthesized
taaaaaacttgagttaagattc

SEQ ID NO: 1351433 - DNA, 22 bp, Artificial Sequence
  chemically synthesized
ctaaatatgcatgaatcttaac

SEQ ID NO: 1351434 - DNA, 22 bp, Artificial Sequence
  chemically synthesized
aaaaaacttgagttaagattca

SEQ ID NO: 1351435 - DNA, 22 bp, Artificial Sequence
  chemically synthesized
aaaaacttgagttaagattcat

SEQ ID NO: 1351436 - DNA, 22 bp, Artificial Sequence
  chemically synthesized
ttactaaatatgcatgaatctt

SEQ ID NO: 1351437 - DNA, 22 bp, Artificial Sequence
  chemically synthesized
ggttgttactaaatatgcatga

SEQ ID NO: 1351438 - DNA, 22 bp, Artificial Sequence
  chemically synthesized
gagttaagattcatgcatattt

SEQ ID NO: 1351439 - DNA, 22 bp, Artificial Sequence
  chemically synthesized
agttaagattcatgcatattta

SEQ ID NO: 1351440 - DNA, 22 bp, Artificial Sequence
  chemically synthesized
ctaggttgttactaaatatgca

SEQ ID NO: 1351441 - DNA, 22 bp, Artificial Sequence
  chemically synthesized
agattcatgcatatttagtaac

SEQ ID NO: 1351442 - DNA, 22 bp, Artificial Sequence
  chemically synthesized
atgcatatttagtaacaaccta

SEQ ID NO: 1351443 - DNA, 22 bp, Artificial Sequence
  chemically synthesized
agggcatacatccgtgttacta

SEQ ID NO: 1351444 - DNA, 22 bp, Artificial Sequence
  chemically synthesized
agtaacaacctagtaacacgga

SEQ ID NO: 1351445 - DNA, 22 bp, Artificial Sequence
  chemically synthesized
tgagggcatacatccgtgttac

SEQ ID NO: 1351446 - DNA, 22 bp, Artificial Sequence
  chemically synthesized
gtaacaacctagtaacacggat

SEQ ID NO: 1351447 - DNA, 22 bp, Artificial Sequence
  chemically synthesized
tctgagggcatacatccgtgtt

SEQ ID NO: 1351448 - DNA, 22 bp, Artificial Sequence
  chemically synthesized
ccattctctgagggcatacatc

SEQ ID NO: 1351449 - DNA, 22 bp, Artificial Sequence
  chemically synthesized
gtaacacggatgtatgccctca

SEQ ID NO: 1351450 - DNA, 22 bp, Artificial Sequence
  chemically synthesized
attcccattctctgagggcata

SEQ ID NO: 1351451 - DNA, 22 bp, Artificial Sequence
  chemically synthesized
tgattcccattctctgagggca

SEQ ID NO: 1351452 - DNA, 22 bp, Artificial Sequence
  chemically synthesized
gattctgattcccattctctga

SEQ ID NO: 1351453 - DNA, 22 bp, Artificial Sequence
  chemically synthesized
agattctgattcccattctctg

SEQ ID NO: 1351454 - DNA, 22 bp, Artificial Sequence
  chemically synthesized
tagattctgattcccattctct

SEQ ID NO: 1351455 - DNA, 22 bp, Artificial Sequence
  chemically synthesized
agagaatgggaatcagaatcta

SEQ ID NO: 1351456 - DNA, 22 bp, Artificial Sequence
  chemically synthesized
gtgacaatactttagattctga

SEQ ID NO: 1351457 - DNA, 22 bp, Artificial Sequence
  chemically synthesized
tagtgacaatactttagattct

SEQ ID NO: 1351458 - DNA, 22 bp, Artificial Sequence
  chemically synthesized
aatctctagtgacaatacttta

SEQ ID NO: 1351459 - DNA, 22 bp, Artificial Sequence
  chemically synthesized
caatctctagtgacaatacttt

SEQ ID NO: 1351460 - DNA, 22 bp, Artificial Sequence
  chemically synthesized
tttcaatctctagtgacaatac

SEQ ID NO: 1351461 - DNA, 22 bp, Artificial Sequence
  chemically synthesized
gtttcaatctctagtgacaata

SEQ ID NO: 1351462 - DNA, 22 bp, Artificial Sequence
  chemically synthesized
tgtttcaatctctagtgacaat

SEQ ID NO: 1351463 - DNA, 22 bp, Artificial Sequence
  chemically synthesized
aaagctttgtttcaatctctag

SEQ ID NO: 1351464 - DNA, 22 bp, Artificial Sequence
  chemically synthesized
aagtattgtcactagagattga

SEQ ID NO: 1351465 - DNA, 22 bp, Artificial Sequence
  chemically synthesized
gagttgaaagctttgtttcaat

SEQ ID NO: 1351466 - DNA, 22 bp, Artificial Sequence
  chemically synthesized
tcactagagattgaaacaaagc

SEQ ID NO: 1351467 - DNA, 22 bp, Artificial Sequence
  chemically synthesized
gagattgaaacaaagctttcaa

SEQ ID NO: 1351468 - DNA, 22 bp, Artificial Sequence
  chemically synthesized
taacaattggagttgaaagctt

SEQ ID NO: 1351469 - DNA, 22 bp, Artificial Sequence
  chemically synthesized
ataacaattggagttgaaagct

SEQ ID NO: 1351470 - DNA, 22 bp, Artificial Sequence
  chemically synthesized
tataacaattggagttgaaagc

SEQ ID NO: 1351471 - DNA, 22 bp, Artificial Sequence
  chemically synthesized
ttataacaattggagttgaaag

SEQ ID NO: 1351472 - DNA, 22 bp, Artificial Sequence
  chemically synthesized
ttttataacaattggagttgaa

SEQ ID NO: 1351473 - DNA, 22 bp, Artificial Sequence
  chemically synthesized
cttttataacaattggagttga

SEQ ID NO: 1351474 - DNA, 22 bp, Artificial Sequence
  chemically synthesized
aaacaaagctttcaactccaat

SEQ ID NO: 1351475 - DNA, 22 bp, Artificial Sequence
  chemically synthesized
cttcttttataacaattggagt

SEQ ID NO: 1351476 - DNA, 22 bp, Artificial Sequence
  chemically synthesized
attccttcttttataacaattg

SEQ ID NO: 1351477 - DNA, 22 bp, Artificial Sequence
  chemically synthesized
tcaactccaattgttataaaag

SEQ ID NO: 1351478 - DNA, 22 bp, Artificial Sequence
  chemically synthesized
caactccaattgttataaaaga

SEQ ID NO: 1351479 - DNA, 22 bp, Artificial Sequence
  chemically synthesized
aactccaattgttataaaagaa

SEQ ID NO: 1351480 - DNA, 22 bp, Artificial Sequence
  chemically synthesized
caattgttataaaagaaggaat

SEQ ID NO: 1351481 - DNA, 22 bp, Artificial Sequence
  chemically synthesized
tgtcaaaatagtctaattcctt

SEQ ID NO: 1351482 - DNA, 22 bp, Artificial Sequence
  chemically synthesized
ttataaaagaaggaattagact

SEQ ID NO: 1351483 - DNA, 22 bp, Artificial Sequence
  chemically synthesized
taaaagaaggaattagactatt

SEQ ID NO: 1351484 - DNA, 22 bp, Artificial Sequence
  chemically synthesized
cagtggattatgtcaaaatagt

SEQ ID NO: 1351485 - DNA, 22 bp, Artificial Sequence
  chemically synthesized
gcagtggattatgtcaaaatag

SEQ ID NO: 1351486 - DNA, 22 bp, Artificial Sequence
  chemically synthesized
ccttgcagtggattatgtcaaa

SEQ ID NO: 1351487 - DNA, 22 bp, Artificial Sequence
  chemically synthesized
cccttgcagtggattatgtcaa

SEQ ID NO: 1351488 - DNA, 22 bp, Artificial Sequence
  chemically synthesized
tcccttgcagtggattatgtca

SEQ ID NO: 1351489 - DNA, 22 bp, Artificial Sequence
  chemically synthesized
ctttcccttgcagtggattatg

SEQ ID NO: 1351490 - DNA, 22 bp, Artificial Sequence
  chemically synthesized
gactattttgacataatccact

SEQ ID NO: 1351491 - DNA, 22 bp, Artificial Sequence
  chemically synthesized
actttcccttgcagtggattat

SEQ ID NO: 1351492 - DNA, 22 bp, Artificial Sequence
  chemically synthesized
cttactttcccttgcagtggat

SEQ ID NO: 1351493 - DNA, 22 bp, Artificial Sequence
  chemically synthesized
ttttgacataatccactgcaag

SEQ ID NO: 1351494 - DNA, 22 bp, Artificial Sequence
  chemically synthesized
tgcttactttcccttgcagtgg

SEQ ID NO: 1351495 - DNA, 22 bp, Artificial Sequence
  chemically synthesized
ctgcttactttcccttgcagtg

SEQ ID NO: 1351496 - DNA, 22 bp, Artificial Sequence
  chemically synthesized
tgacataatccactgcaaggga

SEQ ID NO: 1351497 - DNA, 22 bp, Artificial Sequence
  chemically synthesized
gacataatccactgcaagggaa

SEQ ID NO: 1351498 - DNA, 22 bp, Artificial Sequence
  chemically synthesized
acataatccactgcaagggaaa

SEQ ID NO: 1351499 - DNA, 22 bp, Artificial Sequence
  chemically synthesized
gatatttctgcttactttccct

SEQ ID NO: 1351500 - DNA, 22 bp, Artificial Sequence
  chemically synthesized
caagggaaagtaagcagaaata

SEQ ID NO: 1351501 - DNA, 22 bp, Artificial Sequence
  chemically synthesized
caaatcccactggatatttctg

SEQ ID NO: 1351502 - DNA, 22 bp, Artificial Sequence
  chemically synthesized
ctccaaatcccactggatattt

SEQ ID NO: 1351503 - DNA, 22 bp, Artificial Sequence
  chemically synthesized
cctccaaatcccactggatatt

SEQ ID NO: 1351504 - DNA, 22 bp, Artificial Sequence
  chemically synthesized
tcctccaaatcccactggatat

SEQ ID NO: 1351505 - DNA, 22 bp, Artificial Sequence
  chemically synthesized
cacagctttcctccaaatccca

SEQ ID NO: 1351506 - DNA, 22 bp, Artificial Sequence
  chemically synthesized
acacagctttcctccaaatccc

SEQ ID NO: 1351507 - DNA, 22 bp, Artificial Sequence
  chemically synthesized
tacacagctttcctccaaatcc

SEQ ID NO: 1351508 - DNA, 22 bp, Artificial Sequence
  chemically synthesized
agaagcgccctttacacagctt

SEQ ID NO: 1351509 - DNA, 22 bp, Artificial Sequence
  chemically synthesized
aagaagcgccctttacacagct

SEQ ID NO: 1351510 - DNA, 22 bp, Artificial Sequence
  chemically synthesized
ggaggaaagctgtgtaaagggc

SEQ ID NO: 1351511 - DNA, 22 bp, Artificial Sequence
  chemically synthesized
gaggaaagctgtgtaaagggcg

SEQ ID NO: 1351512 - DNA, 22 bp, Artificial Sequence
  chemically synthesized
tccaatttaagaagcgcccttt

SEQ ID NO: 1351513 - DNA, 22 bp, Artificial Sequence
  chemically synthesized
gtccaatttaagaagcgccctt

SEQ ID NO: 1351514 - DNA, 22 bp, Artificial Sequence
  chemically synthesized
tgtaaagggcgcttcttaaatt

SEQ ID NO: 1351515 - DNA, 22 bp, Artificial Sequence
  chemically synthesized
cagcagagtgaaagggtttgtc

SEQ ID NO: 1351516 - DNA, 22 bp, Artificial Sequence
  chemically synthesized
cttaaattggacaaaccctttc

SEQ ID NO: 1351517 - DNA, 22 bp, Artificial Sequence
  chemically synthesized
ttaaattggacaaaccctttca

SEQ ID NO: 1351518 - DNA, 22 bp, Artificial Sequence
  chemically synthesized
aaattggacaaaccctttcact

SEQ ID NO: 1351519 - DNA, 22 bp, Artificial Sequence
  chemically synthesized
aattggacaaaccctttcactc

SEQ ID NO: 1351520 - DNA, 22 bp, Artificial Sequence
  chemically synthesized
gacaaaccctttcactctgctg

SEQ ID NO: 1351521 - DNA, 22 bp, Artificial Sequence
  chemically synthesized
caggtgtcaggaaggactccag

SEQ ID NO: 1351522 - DNA, 22 bp, Artificial Sequence
  chemically synthesized
ccaggtgtcaggaaggactcca

SEQ ID NO: 1351523 - DNA, 22 bp, Artificial Sequence
  chemically synthesized
tccaggtgtcaggaaggactcc

SEQ ID NO: 1351524 - DNA, 22 bp, Artificial Sequence
  chemically synthesized
tcactctgctggagtccttcct

SEQ ID NO: 1351525 - DNA, 22 bp, Artificial Sequence
  chemically synthesized
tttccaggtgtcaggaaggact

SEQ ID NO: 1351526 - DNA, 22 bp, Artificial Sequence
  chemically synthesized
cactctgctggagtccttcctg

SEQ ID NO: 1351527 - DNA, 22 bp, Artificial Sequence
  chemically synthesized
actctgctggagtccttcctga

SEQ ID NO: 1351528 - DNA, 22 bp, Artificial Sequence
  chemically synthesized
tgctggagtccttcctgacacc

SEQ ID NO: 1351529 - DNA, 22 bp, Artificial Sequence
  chemically synthesized
cagcctctttccaggtgtcagg

SEQ ID NO: 1351530 - DNA, 22 bp, Artificial Sequence
  chemically synthesized
ctggagtccttcctgacacctg

SEQ ID NO: 1351531 - DNA, 22 bp, Artificial Sequence
  chemically synthesized
gagtccttcctgacacctggaa

SEQ ID NO: 1351532 - DNA, 22 bp, Artificial Sequence
  chemically synthesized
gacctccagcctctttccaggt

SEQ ID NO: 1351533 - DNA, 22 bp, Artificial Sequence
  chemically synthesized
ctggacctccagcctctttcca

SEQ ID NO: 1351534 - DNA, 22 bp, Artificial Sequence
  chemically synthesized
cctgacacctggaaagaggctg

SEQ ID NO: 1351535 - DNA, 22 bp, Artificial Sequence
  chemically synthesized
ctgacacctggaaagaggctgg

SEQ ID NO: 1351536 - DNA, 22 bp, Artificial Sequence
  chemically synthesized
acacctggaaagaggctggagg

SEQ ID NO: 1351537 - DNA, 22 bp, Artificial Sequence
  chemically synthesized
aaatggctgctggacctccagc

SEQ ID NO: 1351538 - DNA, 22 bp, Artificial Sequence
  chemically synthesized
tctaaaatggctgctggacctc

SEQ ID NO: 1351539 - DNA, 22 bp, Artificial Sequence
  chemically synthesized
gaaagaggctggaggtccagca

SEQ ID NO: 1351540 - DNA, 22 bp, Artificial Sequence
  chemically synthesized
gaggtccagcagccattttaga

SEQ ID NO: 1351541 - DNA, 22 bp, Artificial Sequence
  chemically synthesized
gatgtaacatcattgtctaaaa

SEQ ID NO: 1351542 - DNA, 22 bp, Artificial Sequence
  chemically synthesized
cgatgtaacatcattgtctaaa

SEQ ID NO: 1351543 - DNA, 22 bp, Artificial Sequence
  chemically synthesized
ggtcttcgatgtaacatcattg

SEQ ID NO: 1351544 - DNA, 22 bp, Artificial Sequence
  chemically synthesized
cggtcttcgatgtaacatcatt

SEQ ID NO: 1351545 - DNA, 22 bp, Artificial Sequence
  chemically synthesized
tcggtcttcgatgtaacatcat

SEQ ID NO: 1351546 - DNA, 22 bp, Artificial Sequence
  chemically synthesized
tagacaatgatgttacatcgaa

SEQ ID NO: 1351547 - DNA, 22 bp, Artificial Sequence
  chemically synthesized
agacaatgatgttacatcgaag

SEQ ID NO: 1351548 - DNA, 22 bp, Artificial Sequence
  chemically synthesized
gacaatgatgttacatcgaaga

SEQ ID NO: 1351549 - DNA, 22 bp, Artificial Sequence
  chemically synthesized
tgcaactttcggtcttcgatgt

SEQ ID NO: 1351550 - DNA, 22 bp, Artificial Sequence
  chemically synthesized
tgtgcaactttcggtcttcgat

SEQ ID NO: 1351551 - DNA, 22 bp, Artificial Sequence
  chemically synthesized
ctgtgcaactttcggtcttcga

SEQ ID NO: 1351552 - DNA, 22 bp, Artificial Sequence
  chemically synthesized
tctgtgcaactttcggtcttcg

SEQ ID NO: 1351553 - DNA, 22 bp, Artificial Sequence
  chemically synthesized
catctttctgtgcaactttcgg

SEQ ID NO: 1351554 - DNA, 22 bp, Artificial Sequence
  chemically synthesized
ccatctttctgtgcaactttcg

SEQ ID NO: 1351555 - DNA, 22 bp, Artificial Sequence
  chemically synthesized
catcgaagaccgaaagttgcac

SEQ ID NO: 1351556 - DNA, 22 bp, Artificial Sequence
  chemically synthesized
cacagaaagatggaaggttcct

SEQ ID NO: 1351557 - DNA, 22 bp, Artificial Sequence
  chemically synthesized
ctgggtccttgaccaccatggc

SEQ ID NO: 1351558 - DNA, 22 bp, Artificial Sequence
  chemically synthesized
ccggtagagcagggccatggtg

SEQ ID NO: 1351559 - DNA, 22 bp, Artificial Sequence
  chemically synthesized
ggtccttgaccaccatggccct

SEQ ID NO: 1351560 - DNA, 22 bp, Artificial Sequence
  chemically synthesized
gaccaccatggccctgctctac

SEQ ID NO: 1351561 - DNA, 22 bp, Artificial Sequence
  chemically synthesized
accaccatggccctgctctacc

SEQ ID NO: 1351562 - DNA, 22 bp, Artificial Sequence
  chemically synthesized
gaagcagtacattgccggtaga

SEQ ID NO: 1351563 - DNA, 22 bp, Artificial Sequence
  chemically synthesized
cagctggaagcagtacattgcc

SEQ ID NO: 1351564 - DNA, 22 bp, Artificial Sequence
  chemically synthesized
ctctaccggcaatgtactgctt

SEQ ID NO: 1351565 - DNA, 22 bp, Artificial Sequence
  chemically synthesized
taccggcaatgtactgcttcca

SEQ ID NO: 1351566 - DNA, 22 bp, Artificial Sequence
  chemically synthesized
ccggcaatgtactgcttccagc

SEQ ID NO: 1351567 - DNA, 22 bp, Artificial Sequence
  chemically synthesized
ccacatgagtgagctccagctg

SEQ ID NO: 1351568 - DNA, 22 bp, Artificial Sequence
  chemically synthesized
gccacatgagtgagctccagct

SEQ ID NO: 1351569 - DNA, 22 bp, Artificial Sequence
  chemically synthesized
ccttgccacatgagtgagctcc

SEQ ID NO: 1351570 - DNA, 22 bp, Artificial Sequence
  chemically synthesized
cttccagctggagctcactcat

SEQ ID NO: 1351571 - DNA, 22 bp, Artificial Sequence
  chemically synthesized
ttgccttgccacatgagtgagc

SEQ ID NO: 1351572 - DNA, 22 bp, Artificial Sequence
  chemically synthesized
gttgccttgccacatgagtgag

SEQ ID NO: 1351573 - DNA, 22 bp, Artificial Sequence
  chemically synthesized
ccagctggagctcactcatgtg

SEQ ID NO: 1351574 - DNA, 22 bp, Artificial Sequence
  chemically synthesized
cagctggagctcactcatgtgg

SEQ ID NO: 1351575 - DNA, 22 bp, Artificial Sequence
  chemically synthesized
gagctcactcatgtggcaaggc

SEQ ID NO: 1351576 - DNA, 22 bp, Artificial Sequence
  chemically synthesized
agtaagagagatttgttgcctt

SEQ ID NO: 1351577 - DNA, 22 bp, Artificial Sequence
  chemically synthesized
actcatgtggcaaggcaacaaa

SEQ ID NO: 1351578 - DNA, 22 bp, Artificial Sequence
  chemically synthesized
atgtggcaaggcaacaaatctc

SEQ ID NO: 1351579 - DNA, 22 bp, Artificial Sequence
  chemically synthesized
tcttacttaacacacttctatt

SEQ ID NO: 1351580 - DNA, 22 bp, Artificial Sequence
  chemically synthesized
ttacttaacacacttctatttc

SEQ ID NO: 1351581 - DNA, 22 bp, Artificial Sequence
  chemically synthesized
acttaacacacttctatttctg

SEQ ID NO: 1351582 - DNA, 22 bp, Artificial Sequence
  chemically synthesized
cttaacacacttctatttctgg

SEQ ID NO: 1351583 - DNA, 22 bp, Artificial Sequence
  chemically synthesized
cgtgtatcagaaatccagaaat

SEQ ID NO: 1351584 - DNA, 22 bp, Artificial Sequence
  chemically synthesized
aacacacttctatttctggatt

SEQ ID NO: 1351585 - DNA, 22 bp, Artificial Sequence
  chemically synthesized
acacacttctatttctggattt

SEQ ID NO: 1351586 - DNA, 22 bp, Artificial Sequence
  chemically synthesized
gctgcgtgtatcagaaatccag

SEQ ID NO: 1351587 - DNA, 22 bp, Artificial Sequence
  chemically synthesized
ggctgcgtgtatcagaaatcca

SEQ ID NO: 1351588 - DNA, 22 bp, Artificial Sequence
  chemically synthesized
ctatttctggatttctgataca

SEQ ID NO: 1351589 - DNA, 22 bp, Artificial Sequence
  chemically synthesized
ggtttggctgcgtgtatcagaa

SEQ ID NO: 1351590 - DNA, 22 bp, Artificial Sequence
  chemically synthesized
tatttctggatttctgatacac

SEQ ID NO: 1351591 - DNA, 22 bp, Artificial Sequence
  chemically synthesized
tttctggatttctgatacacgc

SEQ ID NO: 1351592 - DNA, 22 bp, Artificial Sequence
  chemically synthesized
ctggatttctgatacacgcagc

SEQ ID NO: 1351593 - DNA, 22 bp, Artificial Sequence
  chemically synthesized
tggatttctgatacacgcagcc

SEQ ID NO: 1351594 - DNA, 22 bp, Artificial Sequence
  chemically synthesized
gatttctgatacacgcagccaa

SEQ ID NO: 1351595 - DNA, 22 bp, Artificial Sequence
  chemically synthesized
ctgatacacgcagccaaaccca

SEQ ID NO: 1351596 - DNA, 22 bp, Artificial Sequence
  chemically synthesized
tgatacacgcagccaaacccaa

SEQ ID NO: 1351597 - DNA, 22 bp, Artificial Sequence
  chemically synthesized
atacacgcagccaaacccaatc

SEQ ID NO: 1351598 - DNA, 22 bp, Artificial Sequence
  chemically synthesized
aaaaatgagtgcatcaggtagg

SEQ ID NO: 1351599 - DNA, 22 bp, Artificial Sequence
  chemically synthesized
agtattaaaaaatgagtgcatc

SEQ ID NO: 1351600 - DNA, 22 bp, Artificial Sequence
  chemically synthesized
gagtattaaaaaatgagtgcat

SEQ ID NO: 1351601 - DNA, 22 bp, Artificial Sequence
  chemically synthesized
tgagtattaaaaaatgagtgca

SEQ ID NO: 1351602 - DNA, 22 bp, Artificial Sequence
  chemically synthesized
ccattttgagtattaaaaaatg

SEQ ID NO: 1351603 - DNA, 22 bp, Artificial Sequence
  chemically synthesized
cctgatgcactcattttttaat

SEQ ID NO: 1351604 - DNA, 22 bp, Artificial Sequence
  chemically synthesized
atgcactcattttttaatactc

SEQ ID NO: 1351605 - DNA, 22 bp, Artificial Sequence
  chemically synthesized
attttttaatactcaaaatggg

SEQ ID NO: 1351606 - DNA, 22 bp, Artificial Sequence
  chemically synthesized
tttaatactcaaaatgggaact

SEQ ID NO: 1351607 - DNA, 22 bp, Artificial Sequence
  chemically synthesized
ttaatactcaaaatgggaacta

SEQ ID NO: 1351608 - DNA, 22 bp, Artificial Sequence
  chemically synthesized
taatactcaaaatgggaactat

SEQ ID NO: 1351609 - DNA, 22 bp, Artificial Sequence
  chemically synthesized
aatactcaaaatgggaactatc

SEQ ID NO: 1351610 - DNA, 22 bp, Artificial Sequence
  chemically synthesized
atactcaaaatgggaactatct

SEQ ID NO: 1351611 - DNA, 22 bp, Artificial Sequence
  chemically synthesized
aaaatgggaactatcttaccat

SEQ ID NO: 1351612 - DNA, 22 bp, Artificial Sequence
  chemically synthesized
aggtgtaacaaaaagtgataat

SEQ ID NO: 1351613 - DNA, 22 bp, Artificial Sequence
  chemically synthesized
tcttaccattatcactttttgt

SEQ ID NO: 1351614 - DNA, 22 bp, Artificial Sequence
  chemically synthesized
accattatcactttttgttaca

SEQ ID NO: 1351615 - DNA, 22 bp, Artificial Sequence
  chemically synthesized
ccattatcactttttgttacac

SEQ ID NO: 1351616 - DNA, 22 bp, Artificial Sequence
  chemically synthesized
aggaaaatctgaggtgtaacaa

SEQ ID NO: 1351617 - DNA, 22 bp, Artificial Sequence
  chemically synthesized
caggaaaatctgaggtgtaaca

SEQ ID NO: 1351618 - DNA, 22 bp, Artificial Sequence
  chemically synthesized
tcaggaaaatctgaggtgtaac

SEQ ID NO: 1351619 - DNA, 22 bp, Artificial Sequence
  chemically synthesized
ttcaggaaaatctgaggtgtaa

SEQ ID NO: 1351620 - DNA, 22 bp, Artificial Sequence
  chemically synthesized
tttcaggaaaatctgaggtgta

SEQ ID NO: 1351621 - DNA, 22 bp, Artificial Sequence
  chemically synthesized
tcactttttgttacacctcaga

SEQ ID NO: 1351622 - DNA, 22 bp, Artificial Sequence
  chemically synthesized
tttgttacacctcagattttcc

SEQ ID NO: 1351623 - DNA, 22 bp, Artificial Sequence
  chemically synthesized
ttgttacacctcagattttcct

SEQ ID NO: 1351624 - DNA, 22 bp, Artificial Sequence
  chemically synthesized
tgttacacctcagattttcctg

SEQ ID NO: 1351625 - DNA, 22 bp, Artificial Sequence
  chemically synthesized
gttacacctcagattttcctga

SEQ ID NO: 1351626 - DNA, 22 bp, Artificial Sequence
  chemically synthesized
ttacacctcagattttcctgaa

SEQ ID NO: 1351627 - DNA, 22 bp, Artificial Sequence
  chemically synthesized
acaatgcactttttcaggaaaa

SEQ ID NO: 1351628 - DNA, 22 bp, Artificial Sequence
  chemically synthesized
gacaatgcactttttcaggaaa

SEQ ID NO: 1351629 - DNA, 22 bp, Artificial Sequence
  chemically synthesized
tgacaatgcactttttcaggaa

SEQ ID NO: 1351630 - DNA, 22 bp, Artificial Sequence
  chemically synthesized
cacctcagattttcctgaaaaa

SEQ ID NO: 1351631 - DNA, 22 bp, Artificial Sequence
  chemically synthesized
agattttcctgaaaaagtgcat

SEQ ID NO: 1351632 - DNA, 22 bp, Artificial Sequence
  chemically synthesized
tcctgaaaaagtgcattgtcaa

SEQ ID NO: 1351633 - DNA, 22 bp, Artificial Sequence
  chemically synthesized
cctgaaaaagtgcattgtcaaa

SEQ ID NO: 1351634 - DNA, 22 bp, Artificial Sequence
  chemically synthesized
ctgaaaaagtgcattgtcaaaa

SEQ ID NO: 1351635 - DNA, 22 bp, Artificial Sequence
  chemically synthesized
aaaataatgatatgttttgaca

SEQ ID NO: 1351636 - DNA, 22 bp, Artificial Sequence
  chemically synthesized
aaaaagtgcattgtcaaaacat

SEQ ID NO: 1351637 - DNA, 22 bp, Artificial Sequence
  chemically synthesized
aaaaataatgatatgttttgac

SEQ ID NO: 1351638 - DNA, 22 bp, Artificial Sequence
  chemically synthesized
taaaaataatgatatgttttga

SEQ ID NO: 1351639 - DNA, 22 bp, Artificial Sequence
  chemically synthesized
ttttaaaaataatgatatgttt

SEQ ID NO: 1351640 - DNA, 22 bp, Artificial Sequence
  chemically synthesized
gttttaaaaataatgatatgtt

SEQ ID NO: 1351641 - DNA, 22 bp, Artificial Sequence
  chemically synthesized
tgttttaaaaataatgatatgt

SEQ ID NO: 1351642 - DNA, 22 bp, Artificial Sequence
  chemically synthesized
tttgttttaaaaataatgatat

SEQ ID NO: 1351643 - DNA, 22 bp, Artificial Sequence
  chemically synthesized
tcaaaacatatcattattttta

SEQ ID NO: 1351644 - DNA, 22 bp, Artificial Sequence
  chemically synthesized
tacactctttgttttaaaaata

SEQ ID NO: 1351645 - DNA, 22 bp, Artificial Sequence
  chemically synthesized
atacactctttgttttaaaaat

SEQ ID NO: 1351646 - DNA, 22 bp, Artificial Sequence
  chemically synthesized
ataatacatttatacactcttt

SEQ ID NO: 1351647 - DNA, 22 bp, Artificial Sequence
  chemically synthesized
aataatacatttatacactctt

SEQ ID NO: 1351648 - DNA, 22 bp, Artificial Sequence
  chemically synthesized
tttttaaaacaaagagtgtata

SEQ ID NO: 1351649 - DNA, 22 bp, Artificial Sequence
  chemically synthesized
ttaaaacaaagagtgtataaat

SEQ ID NO: 1351650 - DNA, 22 bp, Artificial Sequence
  chemically synthesized
taaaacaaagagtgtataaatg

SEQ ID NO: 1351651 - DNA, 22 bp, Artificial Sequence
  chemically synthesized
aaaacaaagagtgtataaatgt

SEQ ID NO: 1351652 - DNA, 22 bp, Artificial Sequence
  chemically synthesized
aaacaaagagtgtataaatgta

SEQ ID NO: 1351653 - DNA, 22 bp, Artificial Sequence
  chemically synthesized
atgtatttaataatacatttat

SEQ ID NO: 1351654 - DNA, 22 bp, Artificial Sequence
  chemically synthesized
aatgtatttaataatacattta

SEQ ID NO: 1351655 - DNA, 22 bp, Artificial Sequence
  chemically synthesized
taatgtatttaataatacattt

SEQ ID NO: 1351656 - DNA, 22 bp, Artificial Sequence
  chemically synthesized
gttttaatgtatttaataatac

SEQ ID NO: 1351657 - DNA, 22 bp, Artificial Sequence
  chemically synthesized
tctggttttaatgtatttaata

SEQ ID NO: 1351658 - DNA, 22 bp, Artificial Sequence
  chemically synthesized
gtctggttttaatgtatttaat

SEQ ID NO: 1351659 - DNA, 22 bp, Artificial Sequence
  chemically synthesized
tgtctggttttaatgtatttaa

SEQ ID NO: 1351660 - DNA, 22 bp, Artificial Sequence
  chemically synthesized
tgagcctttgtctggttttaat

SEQ ID NO: 1351661 - DNA, 22 bp, Artificial Sequence
  chemically synthesized
atgagcctttgtctggttttaa

SEQ ID NO: 1351662 - DNA, 22 bp, Artificial Sequence
  chemically synthesized
ttaaatacattaaaaccagaca

SEQ ID NO: 1351663 - DNA, 22 bp, Artificial Sequence
  chemically synthesized
atttatgagcctttgtctggtt

SEQ ID NO: 1351664 - DNA, 22 bp, Artificial Sequence
  chemically synthesized
aatacattaaaaccagacaaag

SEQ ID NO: 1351665 - DNA, 22 bp, Artificial Sequence
  chemically synthesized
cattaatttatgagcctttgtc

SEQ ID NO: 1351666 - DNA, 22 bp, Artificial Sequence
  chemically synthesized
gcattaatttatgagcctttgt

SEQ ID NO: 1351667 - DNA, 22 bp, Artificial Sequence
  chemically synthesized
aaaccagacaaaggctcataaa

SEQ ID NO: 1351668 - DNA, 22 bp, Artificial Sequence
  chemically synthesized
cacacgtttgcattaatttatg

SEQ ID NO: 1351669 - DNA, 22 bp, Artificial Sequence
  chemically synthesized
ttccacacgtttgcattaattt

SEQ ID NO: 1351670 - DNA, 22 bp, Artificial Sequence
  chemically synthesized
ataaattaatgcaaacgtgtgg

SEQ ID NO: 1351671 - DNA, 22 bp, Artificial Sequence
  chemically synthesized
tgtgatgaaactattccacacg

SEQ ID NO: 1351672 - DNA, 22 bp, Artificial Sequence
  chemically synthesized
gtgtgatgaaactattccacac

SEQ ID NO: 1351673 - DNA, 22 bp, Artificial Sequence
  chemically synthesized
atgcaaacgtgtggaatagttt

SEQ ID NO: 1351674 - DNA, 22 bp, Artificial Sequence
  chemically synthesized
acttgtgtgatgaaactattcc

SEQ ID NO: 1351675 - DNA, 22 bp, Artificial Sequence
  chemically synthesized
cacttgtgtgatgaaactattc

SEQ ID NO: 1351676 - DNA, 22 bp, Artificial Sequence
  chemically synthesized
tcacttgtgtgatgaaactatt

SEQ ID NO: 1351677 - DNA, 22 bp, Artificial Sequence
  chemically synthesized
attttcacttgtgtgatgaaac

SEQ ID NO: 1351678 - DNA, 22 bp, Artificial Sequence
  chemically synthesized
aattttcacttgtgtgatgaaa

SEQ ID NO: 1351679 - DNA, 22 bp, Artificial Sequence
  chemically synthesized
catcacacaagtgaaaattaaa

SEQ ID NO: 1351680 - DNA, 22 bp, Artificial Sequence
  chemically synthesized
atcacacaagtgaaaattaaat

SEQ ID NO: 1351681 - DNA, 22 bp, Artificial Sequence
  chemically synthesized
tggcagagcagtccaatttaat

SEQ ID NO: 1351682 - DNA, 22 bp, Artificial Sequence
  chemically synthesized
ttatggcagagcagtccaattt

SEQ ID NO: 1351683 - DNA, 22 bp, Artificial Sequence
  chemically synthesized
attatggcagagcagtccaatt

SEQ ID NO: 1351684 - DNA, 22 bp, Artificial Sequence
  chemically synthesized
tattatggcagagcagtccaat

SEQ ID NO: 1351685 - DNA, 22 bp, Artificial Sequence
  chemically synthesized
aattggactgctctgccataat

SEQ ID NO: 1351686 - DNA, 22 bp, Artificial Sequence
  chemically synthesized
gactgctctgccataataaagc

SEQ ID NO: 1351687 - DNA, 22 bp, Artificial Sequence
  chemically synthesized
aaagcaggcaaacagagcttta

SEQ ID NO: 1351688 - DNA, 22 bp, Artificial Sequence
  chemically synthesized
ctctgccataataaagctctgt

SEQ ID NO: 1351689 - DNA, 22 bp, Artificial Sequence
  chemically synthesized
caaagcaggcaaacagagcttt

SEQ ID NO: 1351690 - DNA, 22 bp, Artificial Sequence
  chemically synthesized
tgccataataaagctctgtttg

SEQ ID NO: 1351691 - DNA, 22 bp, Artificial Sequence
  chemically synthesized
atttcaaagcaggcaaacagag

SEQ ID NO: 1351692 - DNA, 22 bp, Artificial Sequence
  chemically synthesized
ccataataaagctctgtttgcc

SEQ ID NO: 1351693 - DNA, 22 bp, Artificial Sequence
  chemically synthesized
catttcaaagcaggcaaacaga

SEQ ID NO: 1351694 - DNA, 22 bp, Artificial Sequence
  chemically synthesized
tcatttcaaagcaggcaaacag

SEQ ID NO: 1351695 - DNA, 22 bp, Artificial Sequence
  chemically synthesized
ttcatttcaaagcaggcaaaca

SEQ ID NO: 1351696 - DNA, 22 bp, Artificial Sequence
  chemically synthesized
catgatgcttttcatttcaaag

SEQ ID NO: 1351697 - DNA, 22 bp, Artificial Sequence
  chemically synthesized
tgtttgcctgctttgaaatgaa

SEQ ID NO: 1351698 - DNA, 22 bp, Artificial Sequence
  chemically synthesized
tttgcctgctttgaaatgaaaa

SEQ ID NO: 1351699 - DNA, 22 bp, Artificial Sequence
  chemically synthesized
gcctgctttgaaatgaaaagca

SEQ ID NO: 1351700 - DNA, 22 bp, Artificial Sequence
  chemically synthesized
cctgctttgaaatgaaaagcat

SEQ ID NO: 1351701 - DNA, 22 bp, Artificial Sequence
  chemically synthesized
ctttgaaatgaaaagcatcatg

SEQ ID NO: 1351702 - DNA, 22 bp, Artificial Sequence
  chemically synthesized
tgaaatgaaaagcatcatgcaa

SEQ ID NO: 1351703 - DNA, 22 bp, Artificial Sequence
  chemically synthesized
gaaatgaaaagcatcatgcaac

SEQ ID NO: 1351704 - DNA, 22 bp, Artificial Sequence
  chemically synthesized
aaatgaaaagcatcatgcaact

SEQ ID NO: 1351705 - DNA, 22 bp, Artificial Sequence
  chemically synthesized
aaagaaacgcagcagtaaaagt

SEQ ID NO: 1351706 - DNA, 22 bp, Artificial Sequence
  chemically synthesized
caaagaaacgcagcagtaaaag

SEQ ID NO: 1351707 - DNA, 22 bp, Artificial Sequence
  chemically synthesized
tcaaagaaacgcagcagtaaaa

SEQ ID NO: 1351708 - DNA, 22 bp, Artificial Sequence
  chemically synthesized
ttcaaagaaacgcagcagtaaa

SEQ ID NO: 1351709 - DNA, 22 bp, Artificial Sequence
  chemically synthesized
gtacttttcaaagaaacgcagc

SEQ ID NO: 1351710 - DNA, 22 bp, Artificial Sequence
  chemically synthesized
ggtacttttcaaagaaacgcag

SEQ ID NO: 1351711 - DNA, 22 bp, Artificial Sequence
  chemically synthesized
ttactgctgcgtttctttgaaa

SEQ ID NO: 1351712 - DNA, 22 bp, Artificial Sequence
  chemically synthesized
tactgctgcgtttctttgaaaa

SEQ ID NO: 1351713 - DNA, 22 bp, Artificial Sequence
  chemically synthesized
actgctgcgtttctttgaaaag

SEQ ID NO: 1351714 - DNA, 22 bp, Artificial Sequence
  chemically synthesized
ctgctgcgtttctttgaaaagt

SEQ ID NO: 1351715 - DNA, 22 bp, Artificial Sequence
  chemically synthesized
ctgcgtttctttgaaaagtacc

SEQ ID NO: 1351716 - DNA, 22 bp, Artificial Sequence
  chemically synthesized
agaagagagatttggtactttt

SEQ ID NO: 1351717 - DNA, 22 bp, Artificial Sequence
  chemically synthesized
cgtttctttgaaaagtaccaaa

SEQ ID NO: 1351718 - DNA, 22 bp, Artificial Sequence
  chemically synthesized
ctttgaaaagtaccaaatctct

SEQ ID NO: 1351719 - DNA, 22 bp, Artificial Sequence
  chemically synthesized
tttgaaaagtaccaaatctctc

SEQ ID NO: 1351720 - DNA, 22 bp, Artificial Sequence
  chemically synthesized
tgaaaagtaccaaatctctctt

SEQ ID NO: 1351721 - DNA, 22 bp, Artificial Sequence
  chemically synthesized
gaaaagtaccaaatctctcttc

SEQ ID NO: 1351722 - DNA, 22 bp, Artificial Sequence
  chemically synthesized
aaaagtaccaaatctctcttct

SEQ ID NO: 1351723 - DNA, 22 bp, Artificial Sequence
  chemically synthesized
aaaaagacaagagcaactcaga

SEQ ID NO: 1351724 - DNA, 22 bp, Artificial Sequence
  chemically synthesized
tactcaaaaagacaagagcaac

SEQ ID NO: 1351725 - DNA, 22 bp, Artificial Sequence
  chemically synthesized
atactcaaaaagacaagagcaa

SEQ ID NO: 1351726 - DNA, 22 bp, Artificial Sequence
  chemically synthesized
tcttctgagttgctcttgtctt

SEQ ID NO: 1351727 - DNA, 22 bp, Artificial Sequence
  chemically synthesized
ttctgagttgctcttgtctttt

SEQ ID NO: 1351728 - DNA, 22 bp, Artificial Sequence
  chemically synthesized
ctgagttgctcttgtctttttg

SEQ ID NO: 1351729 - DNA, 22 bp, Artificial Sequence
  chemically synthesized
tgagttgctcttgtctttttga

SEQ ID NO: 1351730 - DNA, 22 bp, Artificial Sequence
  chemically synthesized
agttgctcttgtctttttgagt

SEQ ID NO: 1351731 - DNA, 22 bp, Artificial Sequence
  chemically synthesized
ctcttgtctttttgagtataag

SEQ ID NO: 1351732 - DNA, 22 bp, Artificial Sequence
  chemically synthesized
ttgtctttttgagtataaggta

SEQ ID NO: 1351733 - DNA, 22 bp, Artificial Sequence
  chemically synthesized
gtctttttgagtataaggtatt

SEQ ID NO: 1351734 - DNA, 22 bp, Artificial Sequence
  chemically synthesized
tctttttgagtataaggtattt

SEQ ID NO: 1351735 - DNA, 22 bp, Artificial Sequence
  chemically synthesized
tcccagtggtaataaatacctt

SEQ ID NO: 1351736 - DNA, 22 bp, Artificial Sequence
  chemically synthesized
atcccagtggtaataaatacct

SEQ ID NO: 1351737 - DNA, 22 bp, Artificial Sequence
  chemically synthesized
tatcccagtggtaataaatacc

SEQ ID NO: 1351738 - DNA, 22 bp, Artificial Sequence
  chemically synthesized
tttgagtataaggtatttatta

SEQ ID NO: 1351739 - DNA, 22 bp, Artificial Sequence
  chemically synthesized
ttatcccagtggtaataaatac

SEQ ID NO: 1351740 - DNA, 22 bp, Artificial Sequence
  chemically synthesized
ttgagtataaggtatttattac

SEQ ID NO: 1351741 - DNA, 22 bp, Artificial Sequence
  chemically synthesized
tgagtataaggtatttattacc

SEQ ID NO: 1351742 - DNA, 22 bp, Artificial Sequence
  chemically synthesized
gagtataaggtatttattacca

SEQ ID NO: 1351743 - DNA, 22 bp, Artificial Sequence
  chemically synthesized
tttttatcccagtggtaataaa

SEQ ID NO: 1351744 - DNA, 22 bp, Artificial Sequence
  chemically synthesized
agtataaggtatttattaccac

SEQ ID NO: 1351745 - DNA, 22 bp, Artificial Sequence
  chemically synthesized
tgtttttatcccagtggtaata

SEQ ID NO: 1351746 - DNA, 22 bp, Artificial Sequence
  chemically synthesized
attaccactgggataaaaacag

SEQ ID NO: 1351747 - DNA, 22 bp, Artificial Sequence
  chemically synthesized
ttaccactgggataaaaacaga

SEQ ID NO: 1351748 - DNA, 22 bp, Artificial Sequence
  chemically synthesized
ccactgggataaaaacagaatg

SEQ ID NO: 1351749 - DNA, 22 bp, Artificial Sequence
  chemically synthesized
catcatgtgaccatcaacattc

SEQ ID NO: 1351750 - DNA, 22 bp, Artificial Sequence
  chemically synthesized
ggataaaaacagaatgttgatg

SEQ ID NO: 1351751 - DNA, 22 bp, Artificial Sequence
  chemically synthesized
cctgcatcatgtgaccatcaac

SEQ ID NO: 1351752 - DNA, 22 bp, Artificial Sequence
  chemically synthesized
aaatcccagctgcctgcatcat

SEQ ID NO: 1351753 - DNA, 22 bp, Artificial Sequence
  chemically synthesized
atggtcacatgatgcaggcagc

SEQ ID NO: 1351754 - DNA, 22 bp, Artificial Sequence
  chemically synthesized
agttgaaatcccagctgcctgc

SEQ ID NO: 1351755 - DNA, 22 bp, Artificial Sequence
  chemically synthesized
gagttgaaatcccagctgcctg

SEQ ID NO: 1351756 - DNA, 22 bp, Artificial Sequence
  chemically synthesized
accttgagttgaaatcccagct

SEQ ID NO: 1351757 - DNA, 22 bp, Artificial Sequence
  chemically synthesized
agggtccagtgactgaccttga

SEQ ID NO: 1351758 - DNA, 22 bp, Artificial Sequence
  chemically synthesized
ggatttcaactcaaggtcagtc

SEQ ID NO: 1351759 - DNA, 22 bp, Artificial Sequence
  chemically synthesized
cctgagggtccagtgactgacc

SEQ ID NO: 1351760 - DNA, 22 bp, Artificial Sequence
  chemically synthesized
caactcaaggtcagtcactgga

SEQ ID NO: 1351761 - DNA, 22 bp, Artificial Sequence
  chemically synthesized
gctgcctgagggtccagtgact

SEQ ID NO: 1351762 - DNA, 22 bp, Artificial Sequence
  chemically synthesized
aactcaaggtcagtcactggac

SEQ ID NO: 1351763 - DNA, 22 bp, Artificial Sequence
  chemically synthesized
tctggctgcctgagggtccagt

SEQ ID NO: 1351764 - DNA, 22 bp, Artificial Sequence
  chemically synthesized
aaggtcagtcactggaccctca

SEQ ID NO: 1351765 - DNA, 22 bp, Artificial Sequence
  chemically synthesized
gaccctcaggcagccagatagt

SEQ ID NO: 1351766 - DNA, 22 bp, Artificial Sequence
  chemically synthesized
gcaaaaaataaacaacactatc

SEQ ID NO: 1351767 - DNA, 22 bp, Artificial Sequence
  chemically synthesized
ggcaaaaaataaacaacactat

SEQ ID NO: 1351768 - DNA, 22 bp, Artificial Sequence
  chemically synthesized
aggcagccagatagtgttgttt

SEQ ID NO: 1351769 - DNA, 22 bp, Artificial Sequence
  chemically synthesized
aaggcatcatcaatttggcaaa

SEQ ID NO: 1351770 - DNA, 22 bp, Artificial Sequence
  chemically synthesized
tttattttttgccaaattgatg

SEQ ID NO: 1351771 - DNA, 22 bp, Artificial Sequence
  chemically synthesized
aaggctaaaggcatcatcaatt

SEQ ID NO: 1351772 - DNA, 22 bp, Artificial Sequence
  chemically synthesized
attttttgccaaattgatgatg

SEQ ID NO: 1351773 - DNA, 22 bp, Artificial Sequence
  chemically synthesized
aaaggctaaaggcatcatcaat

SEQ ID NO: 1351774 - DNA, 22 bp, Artificial Sequence
  chemically synthesized
ttttttgccaaattgatgatgc

SEQ ID NO: 1351775 - DNA, 22 bp, Artificial Sequence
  chemically synthesized
tttaaaggctaaaggcatcatc

SEQ ID NO: 1351776 - DNA, 22 bp, Artificial Sequence
  chemically synthesized
tttgccaaattgatgatgcctt

SEQ ID NO: 1351777 - DNA, 22 bp, Artificial Sequence
  chemically synthesized
atttaaaggctaaaggcatcat

SEQ ID NO: 1351778 - DNA, 22 bp, Artificial Sequence
  chemically synthesized
ttgccaaattgatgatgccttt

SEQ ID NO: 1351779 - DNA, 22 bp, Artificial Sequence
  chemically synthesized
tgccaaattgatgatgccttta

SEQ ID NO: 1351780 - DNA, 22 bp, Artificial Sequence
  chemically synthesized
gccaaattgatgatgcctttag

SEQ ID NO: 1351781 - DNA, 22 bp, Artificial Sequence
  chemically synthesized
cttatttaaaggctaaaggcat

SEQ ID NO: 1351782 - DNA, 22 bp, Artificial Sequence
  chemically synthesized
ccaaattgatgatgcctttagc

SEQ ID NO: 1351783 - DNA, 22 bp, Artificial Sequence
  chemically synthesized
atgatgcctttagcctttaaat

SEQ ID NO: 1351784 - DNA, 22 bp, Artificial Sequence
  chemically synthesized
atcatagtcagtgctccttatt

SEQ ID NO: 1351785 - DNA, 22 bp, Artificial Sequence
  chemically synthesized
aatcatagtcagtgctccttat

SEQ ID NO: 1351786 - DNA, 22 bp, Artificial Sequence
  chemically synthesized
tagcctttaaataaggagcact

SEQ ID NO: 1351787 - DNA, 22 bp, Artificial Sequence
  chemically synthesized
agcctttaaataaggagcactg

SEQ ID NO: 1351788 - DNA, 22 bp, Artificial Sequence
  chemically synthesized
gcctttaaataaggagcactga

SEQ ID NO: 1351789 - DNA, 22 bp, Artificial Sequence
  chemically synthesized
taaataaggagcactgactatg

SEQ ID NO: 1351790 - DNA, 22 bp, Artificial Sequence
  chemically synthesized
aaataaggagcactgactatga

SEQ ID NO: 1351791 - DNA, 22 bp, Artificial Sequence
  chemically synthesized
aataaggagcactgactatgat

SEQ ID NO: 1351792 - DNA, 22 bp, Artificial Sequence
  chemically synthesized
ggacaaaatttaatcatagtca

SEQ ID NO: 1351793 - DNA, 22 bp, Artificial Sequence
  chemically synthesized
aggacaaaatttaatcatagtc

SEQ ID NO: 1351794 - DNA, 22 bp, Artificial Sequence
  chemically synthesized
taggacaaaatttaatcatagt

SEQ ID NO: 1351795 - DNA, 22 bp, Artificial Sequence
  chemically synthesized
tttaggacaaaatttaatcata

SEQ ID NO: 1351796 - DNA, 22 bp, Artificial Sequence
  chemically synthesized
actatgattaaattttgtccta

SEQ ID NO: 1351797 - DNA, 22 bp, Artificial Sequence
  chemically synthesized
tgattaaattttgtcctaaaga

SEQ ID NO: 1351798 - DNA, 22 bp, Artificial Sequence
  chemically synthesized
gagtgtgaaatatctctttagg

SEQ ID NO: 1351799 - DNA, 22 bp, Artificial Sequence
  chemically synthesized
aattttgtcctaaagagatatt

SEQ ID NO: 1351800 - DNA, 22 bp, Artificial Sequence
  chemically synthesized
tgtattagagtgtgaaatatct

SEQ ID NO: 1351801 - DNA, 22 bp, Artificial Sequence
  chemically synthesized
tgtcctaaagagatatttcaca

SEQ ID NO: 1351802 - DNA, 22 bp, Artificial Sequence
  chemically synthesized
tatgtattagagtgtgaaatat

SEQ ID NO: 1351803 - DNA, 22 bp, Artificial Sequence
  chemically synthesized
gtcctaaagagatatttcacac

SEQ ID NO: 1351804 - DNA, 22 bp, Artificial Sequence
  chemically synthesized
tcctaaagagatatttcacact

SEQ ID NO: 1351805 - DNA, 22 bp, Artificial Sequence
  chemically synthesized
aagagatatttcacactctaat

SEQ ID NO: 1351806 - DNA, 22 bp, Artificial Sequence
  chemically synthesized
atgagatacattctatgtatta

SEQ ID NO: 1351807 - DNA, 22 bp, Artificial Sequence
  chemically synthesized
aatgagatacattctatgtatt

SEQ ID NO: 1351808 - DNA, 22 bp, Artificial Sequence
  chemically synthesized
taatgagatacattctatgtat

SEQ ID NO: 1351809 - DNA, 22 bp, Artificial Sequence
  chemically synthesized
cacactctaatacatagaatgt

SEQ ID NO: 1351810 - DNA, 22 bp, Artificial Sequence
  chemically synthesized
acactctaatacatagaatgta

SEQ ID NO: 1351811 - DNA, 22 bp, Artificial Sequence
  chemically synthesized
caattttaatgagatacattct

SEQ ID NO: 1351812 - DNA, 22 bp, Artificial Sequence
  chemically synthesized
ttacaattttaatgagatacat

SEQ ID NO: 1351813 - DNA, 22 bp, Artificial Sequence
  chemically synthesized
taatacatagaatgtatctcat

SEQ ID NO: 1351814 - DNA, 22 bp, Artificial Sequence
  chemically synthesized
tgttacaattttaatgagatac

SEQ ID NO: 1351815 - DNA, 22 bp, Artificial Sequence
  chemically synthesized
atacatagaatgtatctcatta

SEQ ID NO: 1351816 - DNA, 22 bp, Artificial Sequence
  chemically synthesized
ctctgttacaattttaatgaga

SEQ ID NO: 1351817 - DNA, 22 bp, Artificial Sequence
  chemically synthesized
actctgttacaattttaatgag

SEQ ID NO: 1351818 - DNA, 22 bp, Artificial Sequence
  chemically synthesized
ttactctgttacaattttaatg

SEQ ID NO: 1351819 - DNA, 22 bp, Artificial Sequence
  chemically synthesized
cttactctgttacaattttaat

SEQ ID NO: 1351820 - DNA, 22 bp, Artificial Sequence
  chemically synthesized
tcttactctgttacaattttaa

SEQ ID NO: 1351821 - DNA, 22 bp, Artificial Sequence
  chemically synthesized
ttcttactctgttacaatttta

SEQ ID NO: 1351822 - DNA, 22 bp, Artificial Sequence
  chemically synthesized
attaaaattgtaacagagtaag

SEQ ID NO: 1351823 - DNA, 22 bp, Artificial Sequence
  chemically synthesized
aagtaagcttttcttactctgt

SEQ ID NO: 1351824 - DNA, 22 bp, Artificial Sequence
  chemically synthesized
tgaagtaagcttttcttactct

SEQ ID NO: 1351825 - DNA, 22 bp, Artificial Sequence
  chemically synthesized
aaattgtaacagagtaagaaaa

SEQ ID NO: 1351826 - DNA, 22 bp, Artificial Sequence
  chemically synthesized
taacagagtaagaaaagcttac

SEQ ID NO: 1351827 - DNA, 22 bp, Artificial Sequence
  chemically synthesized
agagatctctgaagtaagcttt

SEQ ID NO: 1351828 - DNA, 22 bp, Artificial Sequence
  chemically synthesized
tgagagatctctgaagtaagct

SEQ ID NO: 1351829 - DNA, 22 bp, Artificial Sequence
  chemically synthesized
ctgagagatctctgaagtaagc

SEQ ID NO: 1351830 - DNA, 22 bp, Artificial Sequence
  chemically synthesized
tctgagagatctctgaagtaag

SEQ ID NO: 1351831 - DNA, 22 bp, Artificial Sequence
  chemically synthesized
ttctgagagatctctgaagtaa

SEQ ID NO: 1351832 - DNA, 22 bp, Artificial Sequence
  chemically synthesized
tttctgagagatctctgaagta

SEQ ID NO: 1351833 - DNA, 22 bp, Artificial Sequence
  chemically synthesized
ttttctgagagatctctgaagt

SEQ ID NO: 1351834 - DNA, 22 bp, Artificial Sequence
  chemically synthesized
caatttttttctgagagatctc

SEQ ID NO: 1351835 - DNA, 22 bp, Artificial Sequence
  chemically synthesized
tactccaatttttttctgagag

SEQ ID NO: 1351836 - DNA, 22 bp, Artificial Sequence
  chemically synthesized
acttcagagatctctcagaaaa

SEQ ID NO: 1351837 - DNA, 22 bp, Artificial Sequence
  chemically synthesized
cttcagagatctctcagaaaaa

SEQ ID NO: 1351838 - DNA, 22 bp, Artificial Sequence
  chemically synthesized
cagagatctctcagaaaaaaat

SEQ ID NO: 1351839 - DNA, 22 bp, Artificial Sequence
  chemically synthesized
agagatctctcagaaaaaaatt

SEQ ID NO: 1351840 - DNA, 22 bp, Artificial Sequence
  chemically synthesized
aggctgtactccaatttttttc

SEQ ID NO: 1351841 - DNA, 22 bp, Artificial Sequence
  chemically synthesized
caggctgtactccaattttttt

SEQ ID NO: 1351842 - DNA, 22 bp, Artificial Sequence
  chemically synthesized
tcagaaaaaaattggagtacag

SEQ ID NO: 1351843 - DNA, 22 bp, Artificial Sequence
  chemically synthesized
gataacttcaggctgtactcca

SEQ ID NO: 1351844 - DNA, 22 bp, Artificial Sequence
  chemically synthesized
agataacttcaggctgtactcc

SEQ ID NO: 1351845 - DNA, 22 bp, Artificial Sequence
  chemically synthesized
agaaaaaaattggagtacagcc

SEQ ID NO: 1351846 - DNA, 22 bp, Artificial Sequence
  chemically synthesized
tagataacttcaggctgtactc

SEQ ID NO: 1351847 - DNA, 22 bp, Artificial Sequence
  chemically synthesized
ttttagataacttcaggctgta

SEQ ID NO: 1351848 - DNA, 22 bp, Artificial Sequence
  chemically synthesized
attattttagataacttcaggc

SEQ ID NO: 1351849 - DNA, 22 bp, Artificial Sequence
  chemically synthesized
gagtacagcctgaagttatcta

SEQ ID NO: 1351850 - DNA, 22 bp, Artificial Sequence
  chemically synthesized
catgctgattattttagataac

SEQ ID NO: 1351851 - DNA, 22 bp, Artificial Sequence
  chemically synthesized
catggttccatgctgattattt

SEQ ID NO: 1351852 - DNA, 22 bp, Artificial Sequence
  chemically synthesized
aagttatctaaaataatcagca

SEQ ID NO: 1351853 - DNA, 22 bp, Artificial Sequence
  chemically synthesized
aaatctgcatggttccatgctg

SEQ ID NO: 1351854 - DNA, 22 bp, Artificial Sequence
  chemically synthesized
tctaaaataatcagcatggaac

SEQ ID NO: 1351855 - DNA, 22 bp, Artificial Sequence
  chemically synthesized
caaatctgcatggttccatgct

SEQ ID NO: 1351856 - DNA, 22 bp, Artificial Sequence
  chemically synthesized
aaataatcagcatggaaccatg

SEQ ID NO: 1351857 - DNA, 22 bp, Artificial Sequence
  chemically synthesized
atttcaaatctgcatggttcca

SEQ ID NO: 1351858 - DNA, 22 bp, Artificial Sequence
  chemically synthesized
tcatctgatttcaaatctgcat

SEQ ID NO: 1351859 - DNA, 22 bp, Artificial Sequence
  chemically synthesized
gtcatctgatttcaaatctgca

SEQ ID NO: 1351860 - DNA, 22 bp, Artificial Sequence
  chemically synthesized
aaagtacatgtttgtcatctga

SEQ ID NO: 1351861 - DNA, 22 bp, Artificial Sequence
  chemically synthesized
gaaagtacatgtttgtcatctg

SEQ ID NO: 1351862 - DNA, 22 bp, Artificial Sequence
  chemically synthesized
tgaaagtacatgtttgtcatct

SEQ ID NO: 1351863 - DNA, 22 bp, Artificial Sequence
  chemically synthesized
gaaatcagatgacaaacatgta

SEQ ID NO: 1351864 - DNA, 22 bp, Artificial Sequence
  chemically synthesized
atgctttgaaagtacatgtttg

SEQ ID NO: 1351865 - DNA, 22 bp, Artificial Sequence
  chemically synthesized
aaatcagatgacaaacatgtac

SEQ ID NO: 1351866 - DNA, 22 bp, Artificial Sequence
  chemically synthesized
aaatgttcatgctttgaaagta

SEQ ID NO: 1351867 - DNA, 22 bp, Artificial Sequence
  chemically synthesized
caaatgttcatgctttgaaagt

SEQ ID NO: 1351868 - DNA, 22 bp, Artificial Sequence
  chemically synthesized
tcaaatgttcatgctttgaaag

SEQ ID NO: 1351869 - DNA, 22 bp, Artificial Sequence
  chemically synthesized
ttttcaaatgttcatgctttga

SEQ ID NO: 1351870 - DNA, 22 bp, Artificial Sequence
  chemically synthesized
ctgttttcaaatgttcatgctt

SEQ ID NO: 1351871 - DNA, 22 bp, Artificial Sequence
  chemically synthesized
tcaaagcatgaacatttgaaaa

SEQ ID NO: 1351872 - DNA, 22 bp, Artificial Sequence
  chemically synthesized
caaagcatgaacatttgaaaac

SEQ ID NO: 1351873 - DNA, 22 bp, Artificial Sequence
  chemically synthesized
atgcaagttactgttttcaaat

SEQ ID NO: 1351874 - DNA, 22 bp, Artificial Sequence
  chemically synthesized
aaagcatgaacatttgaaaaca

SEQ ID NO: 1351875 - DNA, 22 bp, Artificial Sequence
  chemically synthesized
gaaactgatgcaagttactgtt

SEQ ID NO: 1351876 - DNA, 22 bp, Artificial Sequence
  chemically synthesized
agaaactgatgcaagttactgt

SEQ ID NO: 1351877 - DNA, 22 bp, Artificial Sequence
  chemically synthesized
gtttagaaactgatgcaagtta

SEQ ID NO: 1351878 - DNA, 22 bp, Artificial Sequence
  chemically synthesized
gaaaacagtaacttgcatcagt

SEQ ID NO: 1351879 - DNA, 22 bp, Artificial Sequence
  chemically synthesized
aaaacagtaacttgcatcagtt

SEQ ID NO: 1351880 - DNA, 22 bp, Artificial Sequence
  chemically synthesized
aatccctcgtttagaaactgat

SEQ ID NO: 1351881 - DNA, 22 bp, Artificial Sequence
  chemically synthesized
cattaaatccctcgtttagaaa

SEQ ID NO: 1351882 - DNA, 22 bp, Artificial Sequence
  chemically synthesized
gcatcagtttctaaacgaggga

SEQ ID NO: 1351883 - DNA, 22 bp, Artificial Sequence
  chemically synthesized
catcagtttctaaacgagggat

SEQ ID NO: 1351884 - DNA, 22 bp, Artificial Sequence
  chemically synthesized
atagttacattaaatccctcgt

SEQ ID NO: 1351885 - DNA, 22 bp, Artificial Sequence
  chemically synthesized
tgatagttacattaaatccctc

SEQ ID NO: 1351886 - DNA, 22 bp, Artificial Sequence
  chemically synthesized
ttctgatagttacattaaatcc

SEQ ID NO: 1351887 - DNA, 22 bp, Artificial Sequence
  chemically synthesized
ctaaacgagggatttaatgtaa

SEQ ID NO: 1351888 - DNA, 22 bp, Artificial Sequence
  chemically synthesized
taaacgagggatttaatgtaac

SEQ ID NO: 1351889 - DNA, 22 bp, Artificial Sequence
  chemically synthesized
attattctgatagttacattaa

SEQ ID NO: 1351890 - DNA, 22 bp, Artificial Sequence
  chemically synthesized
aacgagggatttaatgtaacta

SEQ ID NO: 1351891 - DNA, 22 bp, Artificial Sequence
  chemically synthesized
acactgattattctgatagtta

SEQ ID NO: 1351892 - DNA, 22 bp, Artificial Sequence
  chemically synthesized
aatgtaactatcagaataatca

SEQ ID NO: 1351893 - DNA, 22 bp, Artificial Sequence
  chemically synthesized
agtatctcacactgattattct

SEQ ID NO: 1351894 - DNA, 22 bp, Artificial Sequence
  chemically synthesized
atgtaactatcagaataatcag

SEQ ID NO: 1351895 - DNA, 22 bp, Artificial Sequence
  chemically synthesized
cagtatctcacactgattattc

SEQ ID NO: 1351896 - DNA, 22 bp, Artificial Sequence
  chemically synthesized
tatttcagtatctcacactgat

SEQ ID NO: 1351897 - DNA, 22 bp, Artificial Sequence
  chemically synthesized
atatttcagtatctcacactga

SEQ ID NO: 1351898 - DNA, 22 bp, Artificial Sequence
  chemically synthesized
tatatttcagtatctcacactg

SEQ ID NO: 1351899 - DNA, 22 bp, Artificial Sequence
  chemically synthesized
tcagaataatcagtgtgagata

SEQ ID NO: 1351900 - DNA, 22 bp, Artificial Sequence
  chemically synthesized
aattttatatttcagtatctca

SEQ ID NO: 1351901 - DNA, 22 bp, Artificial Sequence
  chemically synthesized
aagacccaaattcaattttata

SEQ ID NO: 1351902 - DNA, 22 bp, Artificial Sequence
  chemically synthesized
tgaagacccaaattcaatttta

SEQ ID NO: 1351903 - DNA, 22 bp, Artificial Sequence
  chemically synthesized
attctgaagacccaaattcaat

SEQ ID NO: 1351904 - DNA, 22 bp, Artificial Sequence
  chemically synthesized
taattctgaagacccaaattca

SEQ ID NO: 1351905 - DNA, 22 bp, Artificial Sequence
  chemically synthesized
aaatataaaattgaatttgggt

SEQ ID NO: 1351906 - DNA, 22 bp, Artificial Sequence
  chemically synthesized
ctaattctgaagacccaaattc

SEQ ID NO: 1351907 - DNA, 22 bp, Artificial Sequence
  chemically synthesized
agtttctaattctgaagaccca

SEQ ID NO: 1351908 - DNA, 22 bp, Artificial Sequence
  chemically synthesized
ttaagtttctaattctgaagac

SEQ ID NO: 1351909 - DNA, 22 bp, Artificial Sequence
  chemically synthesized
tgttaagtttctaattctgaag

SEQ ID NO: 1351910 - DNA, 22 bp, Artificial Sequence
  chemically synthesized
ctgttaagtttctaattctgaa

SEQ ID NO: 1351911 - DNA, 22 bp, Artificial Sequence
  chemically synthesized
tctgttaagtttctaattctga

SEQ ID NO: 1351912 - DNA, 22 bp, Artificial Sequence
  chemically synthesized
aatttgggtcttcagaattaga

SEQ ID NO: 1351913 - DNA, 22 bp, Artificial Sequence
  chemically synthesized
ttctgttaagtttctaattctg

SEQ ID NO: 1351914 - DNA, 22 bp, Artificial Sequence
  chemically synthesized
tttctgttaagtttctaattct

SEQ ID NO: 1351915 - DNA, 22 bp, Artificial Sequence
  chemically synthesized
ctttttctgttaagtttctaat

SEQ ID NO: 1351916 - DNA, 22 bp, Artificial Sequence
  chemically synthesized
gggtcttcagaattagaaactt

SEQ ID NO: 1351917 - DNA, 22 bp, Artificial Sequence
  chemically synthesized
ggtcttcagaattagaaactta

SEQ ID NO: 1351918 - DNA, 22 bp, Artificial Sequence
  chemically synthesized
cagaattagaaacttaacagaa

SEQ ID NO: 1351919 - DNA, 22 bp, Artificial Sequence
  chemically synthesized
agaattagaaacttaacagaaa

SEQ ID NO: 1351920 - DNA, 22 bp, Artificial Sequence
  chemically synthesized
caatgacctcctttttctgtta

SEQ ID NO: 1351921 - DNA, 22 bp, Artificial Sequence
  chemically synthesized
tacaatgacctcctttttctgt

SEQ ID NO: 1351922 - DNA, 22 bp, Artificial Sequence
  chemically synthesized
ctacaatgacctcctttttctg

SEQ ID NO: 1351923 - DNA, 22 bp, Artificial Sequence
  chemically synthesized
gaaacttaacagaaaaaggagg

SEQ ID NO: 1351924 - DNA, 22 bp, Artificial Sequence
  chemically synthesized
gtaacatttctacaatgacctc

SEQ ID NO: 1351925 - DNA, 22 bp, Artificial Sequence
  chemically synthesized
aacagaaaaaggaggtcattgt

SEQ ID NO: 1351926 - DNA, 22 bp, Artificial Sequence
  chemically synthesized
cgtaacatttctacaatgacct

SEQ ID NO: 1351927 - DNA, 22 bp, Artificial Sequence
  chemically synthesized
acagaaaaaggaggtcattgta

SEQ ID NO: 1351928 - DNA, 22 bp, Artificial Sequence
  chemically synthesized
tttcgtaacatttctacaatga

SEQ ID NO: 1351929 - DNA, 22 bp, Artificial Sequence
  chemically synthesized
tagaaatgttacgaaataattt

SEQ ID NO: 1351930 - DNA, 22 bp, Artificial Sequence
  chemically synthesized
ggcataaaaacaaaattatttc

SEQ ID NO: 1351931 - DNA, 22 bp, Artificial Sequence
  chemically synthesized
aattaggcataaaaacaaaatt

SEQ ID NO: 1351932 - DNA, 22 bp, Artificial Sequence
  chemically synthesized
taaattaggcataaaaacaaaa

SEQ ID NO: 1351933 - DNA, 22 bp, Artificial Sequence
  chemically synthesized
ctaaattaggcataaaaacaaa

SEQ ID NO: 1351934 - DNA, 22 bp, Artificial Sequence
  chemically synthesized
cgaaataattttgtttttatgc

SEQ ID NO: 1351935 - DNA, 22 bp, Artificial Sequence
  chemically synthesized
aatttctaaattaggcataaaa

SEQ ID NO: 1351936 - DNA, 22 bp, Artificial Sequence
  chemically synthesized
tgtttttatgcctaatttagaa

SEQ ID NO: 1351937 - DNA, 22 bp, Artificial Sequence
  chemically synthesized
gtttttatgcctaatttagaaa

SEQ ID NO: 1351938 - DNA, 22 bp, Artificial Sequence
  chemically synthesized
tttttatgcctaatttagaaat

SEQ ID NO: 1351939 - DNA, 22 bp, Artificial Sequence
  chemically synthesized
ttatgcctaatttagaaattga

SEQ ID NO: 1351940 - DNA, 22 bp, Artificial Sequence
  chemically synthesized
tatgcctaatttagaaattgaa

SEQ ID NO: 1351941 - DNA, 22 bp, Artificial Sequence
  chemically synthesized
atgcctaatttagaaattgaat

SEQ ID NO: 1351942 - DNA, 22 bp, Artificial Sequence
  chemically synthesized
tgcctaatttagaaattgaatg

SEQ ID NO: 1351943 - DNA, 22 bp, Artificial Sequence
  chemically synthesized
atttagaaattgaatgggccgg

SEQ ID NO: 1351944 - DNA, 22 bp, Artificial Sequence
  chemically synthesized
agaaattgaatgggccgggtgc

SEQ ID NO: 1351945 - DNA, 22 bp, Artificial Sequence
  chemically synthesized
gaaattgaatgggccgggtgcg

SEQ ID NO: 1351946 - DNA, 22 bp, Artificial Sequence
  chemically synthesized
cagtggtgagccatcgcacccg

SEQ ID NO: 1351947 - DNA, 22 bp, Artificial Sequence
  chemically synthesized
aatgggccgggtgcgatggctc

SEQ ID NO: 1351948 - DNA, 22 bp, Artificial Sequence
  chemically synthesized
agattacagtggtgagccatcg

SEQ ID NO: 1351949 - DNA, 22 bp, Artificial Sequence
  chemically synthesized
ccaaagtgctgagattacagtg

SEQ ID NO: 1351950 - DNA, 22 bp, Artificial Sequence
  chemically synthesized
ggcctcccaaagtgctgagatt

SEQ ID NO: 1351951 - DNA, 22 bp, Artificial Sequence
  chemically synthesized
accactgtaatctcagcacttt

SEQ ID NO: 1351952 - DNA, 22 bp, Artificial Sequence
  chemically synthesized
taatctcagcactttgggaggc

SEQ ID NO: 1351953 - DNA, 22 bp, Artificial Sequence
  chemically synthesized
gtgatccgcccgcctcggcctc

SEQ ID NO: 1351954 - DNA, 22 bp, Artificial Sequence
  chemically synthesized
agcactttgggaggccgaggcg

SEQ ID NO: 1351955 - DNA, 22 bp, Artificial Sequence
  chemically synthesized
acctcgtgatccgcccgcctcg

SEQ ID NO: 1351956 - DNA, 22 bp, Artificial Sequence
  chemically synthesized
ctgacctcgtgatccgcccgcc

SEQ ID NO: 1351957 - DNA, 22 bp, Artificial Sequence
  chemically synthesized
tgggaggccgaggcgggcggat

SEQ ID NO: 1351958 - DNA, 22 bp, Artificial Sequence
  chemically synthesized
gggaggccgaggcgggcggatc

SEQ ID NO: 1351959 - DNA, 22 bp, Artificial Sequence
  chemically synthesized
ggaggccgaggcgggcggatca

SEQ ID NO: 1351960 - DNA, 22 bp, Artificial Sequence
  chemically synthesized
gatctcctgacctcgtgatccg

SEQ ID NO: 1351961 - DNA, 22 bp, Artificial Sequence
  chemically synthesized
gccaggatggtctcgatctcct

SEQ ID NO: 1351962 - DNA, 22 bp, Artificial Sequence
  chemically synthesized
cgttagccaggatggtctcgat

SEQ ID NO: 1351963 - DNA, 22 bp, Artificial Sequence
  chemically synthesized
actgcgttagccaggatggtct

SEQ ID NO: 1351964 - DNA, 22 bp, Artificial Sequence
  chemically synthesized
cactgcgttagccaggatggtc

SEQ ID NO: 1351965 - DNA, 22 bp, Artificial Sequence
  chemically synthesized
gtagaaacggggtttcactgcg

SEQ ID NO: 1351966 - DNA, 22 bp, Artificial Sequence
  chemically synthesized
agtagaaacggggtttcactgc

SEQ ID NO: 1351967 - DNA, 22 bp, Artificial Sequence
  chemically synthesized
tagtagaaacggggtttcactg

SEQ ID NO: 1351968 - DNA, 22 bp, Artificial Sequence
  chemically synthesized
ttagtagaaacggggtttcact

SEQ ID NO: 1351969 - DNA, 22 bp, Artificial Sequence
  chemically synthesized
gctaacgcagtgaaaccccgtt

SEQ ID NO: 1351970 - DNA, 22 bp, Artificial Sequence
  chemically synthesized
tatttttagtagaaacggggtt

SEQ ID NO: 1351971 - DNA, 22 bp, Artificial Sequence
  chemically synthesized
gtatttttagtagaaacggggt

SEQ ID NO: 1351972 - DNA, 22 bp, Artificial Sequence
  chemically synthesized
tgtatttttagtagaaacgggg

SEQ ID NO: 1351973 - DNA, 22 bp, Artificial Sequence
  chemically synthesized
acgcagtgaaaccccgtttcta

SEQ ID NO: 1351974 - DNA, 22 bp, Artificial Sequence
  chemically synthesized
ttgtatttttagtagaaacggg

SEQ ID NO: 1351975 - DNA, 22 bp, Artificial Sequence
  chemically synthesized
tttgtatttttagtagaaacgg

SEQ ID NO: 1351976 - DNA, 22 bp, Artificial Sequence
  chemically synthesized
ttttgtatttttagtagaaacg

SEQ ID NO: 1351977 - DNA, 22 bp, Artificial Sequence
  chemically synthesized
atttttttgtatttttagtaga

SEQ ID NO: 1351978 - DNA, 22 bp, Artificial Sequence
  chemically synthesized
ctactaaaaatacaaaaaaatt

SEQ ID NO: 1351979 - DNA, 22 bp, Artificial Sequence
  chemically synthesized
tactaaaaatacaaaaaaatta

SEQ ID NO: 1351980 - DNA, 22 bp, Artificial Sequence
  chemically synthesized
ctaaaaatacaaaaaaattagc

SEQ ID NO: 1351981 - DNA, 22 bp, Artificial Sequence
  chemically synthesized
aaaatacaaaaaaattagccgg

SEQ ID NO: 1351982 - DNA, 22 bp, Artificial Sequence
  chemically synthesized
caggcgcccgccaccacgcccg

SEQ ID NO: 1351983 - DNA, 22 bp, Artificial Sequence
  chemically synthesized
ggactacaggcgcccgccacca

SEQ ID NO: 1351984 - DNA, 22 bp, Artificial Sequence
  chemically synthesized
gccgggcgtggtggcgggcgcc

SEQ ID NO: 1351985 - DNA, 22 bp, Artificial Sequence
  chemically synthesized
ccgagtagctgggactacaggc

SEQ ID NO: 1351986 - DNA, 22 bp, Artificial Sequence
  chemically synthesized
aggctcccgagtagctgggact

SEQ ID NO: 1351987 - DNA, 22 bp, Artificial Sequence
  chemically synthesized
cctcaggctcccgagtagctgg

SEQ ID NO: 1351988 - DNA, 22 bp, Artificial Sequence
  chemically synthesized
ctgcctcaggctcccgagtagc

SEQ ID NO: 1351989 - DNA, 22 bp, Artificial Sequence
  chemically synthesized
tcctgcctcaggctcccgagta

SEQ ID NO: 1351990 - DNA, 22 bp, Artificial Sequence
  chemically synthesized
tagtcccagctactcgggagcc

SEQ ID NO: 1351991 - DNA, 22 bp, Artificial Sequence
  chemically synthesized
acgccattctcctgcctcaggc

SEQ ID NO: 1351992 - DNA, 22 bp, Artificial Sequence
  chemically synthesized
ctcgggagcctgaggcaggaga

SEQ ID NO: 1351993 - DNA, 22 bp, Artificial Sequence
  chemically synthesized
gggagcctgaggcaggagaatg

SEQ ID NO: 1351994 - DNA, 22 bp, Artificial Sequence
  chemically synthesized
ccaggttcacgccattctcctg

SEQ ID NO: 1351995 - DNA, 22 bp, Artificial Sequence
  chemically synthesized
cgcctcccaggttcacgccatt

SEQ ID NO: 1351996 - DNA, 22 bp, Artificial Sequence
  chemically synthesized
aggcaggagaatggcgtgaacc

SEQ ID NO: 1351997 - DNA, 22 bp, Artificial Sequence
  chemically synthesized
caagctccgcctcccaggttca

SEQ ID NO: 1351998 - DNA, 22 bp, Artificial Sequence
  chemically synthesized
actgcaagctccgcctcccagg

SEQ ID NO: 1351999 - DNA, 22 bp, Artificial Sequence
  chemically synthesized
ggctcactgcaagctccgcctc

SEQ ID NO: 1352000 - DNA, 22 bp, Artificial Sequence
  chemically synthesized
ggaggcggagcttgcagtgagc

SEQ ID NO: 1352001 - DNA, 22 bp, Artificial Sequence
  chemically synthesized
gagtgcagtggcgcgatctcgg

SEQ ID NO: 1352002 - DNA, 22 bp, Artificial Sequence
  chemically synthesized
gcagtgagccgagatcgcgcca

SEQ ID NO: 1352003 - DNA, 22 bp, Artificial Sequence
  chemically synthesized
cagtgagccgagatcgcgccac

SEQ ID NO: 1352004 - DNA, 22 bp, Artificial Sequence
  chemically synthesized
tcacccaggctagagtgcagtg

SEQ ID NO: 1352005 - DNA, 22 bp, Artificial Sequence
  chemically synthesized
tgtcacccaggctagagtgcag

SEQ ID NO: 1352006 - DNA, 22 bp, Artificial Sequence
  chemically synthesized
gctctgtcacccaggctagagt

SEQ ID NO: 1352007 - DNA, 22 bp, Artificial Sequence
  chemically synthesized
cactctagcctgggtgacagag

SEQ ID NO: 1352008 - DNA, 22 bp, Artificial Sequence
  chemically synthesized
agacggagtctcgctctgtcac

SEQ ID NO: 1352009 - DNA, 22 bp, Artificial Sequence
  chemically synthesized
gagacggagtctcgctctgtca

SEQ ID NO: 1352010 - DNA, 22 bp, Artificial Sequence
  chemically synthesized
tgagacggagtctcgctctgtc

SEQ ID NO: 1352011 - DNA, 22 bp, Artificial Sequence
  chemically synthesized
ttgagacggagtctcgctctgt

SEQ ID NO: 1352012 - DNA, 22 bp, Artificial Sequence
  chemically synthesized
tagcctgggtgacagagcgaga

SEQ ID NO: 1352013 - DNA, 22 bp, Artificial Sequence
  chemically synthesized
tttgagacggagtctcgctctg

SEQ ID NO: 1352014 - DNA, 22 bp, Artificial Sequence
  chemically synthesized
ttttgagacggagtctcgctct

SEQ ID NO: 1352015 - DNA, 22 bp, Artificial Sequence
  chemically synthesized
gcctgggtgacagagcgagact

SEQ ID NO: 1352016 - DNA, 22 bp, Artificial Sequence
  chemically synthesized
tttttgagacggagtctcgctc

SEQ ID NO: 1352017 - DNA, 22 bp, Artificial Sequence
  chemically synthesized
ttttttgagacggagtctcgct

SEQ ID NO: 1352018 - DNA, 22 bp, Artificial Sequence
  chemically synthesized
tttttttgagacggagtctcgc

SEQ ID NO: 1352019 - DNA, 22 bp, Artificial Sequence
  chemically synthesized
ttttttttgagacggagtctcg

SEQ ID NO: 1352020 - DNA, 22 bp, Artificial Sequence
  chemically synthesized
tttttttttgagacggagtctc

SEQ ID NO: 1352021 - DNA, 22 bp, Artificial Sequence
  chemically synthesized
ggtgacagagcgagactccgtc

SEQ ID NO: 1352022 - DNA, 22 bp, Artificial Sequence
  chemically synthesized
ttttttttttgagacggagtct

SEQ ID NO: 1352023 - DNA, 22 bp, Artificial Sequence
  chemically synthesized
tttttttttttgagacggagtc

SEQ ID NO: 1352024 - DNA, 22 bp, Artificial Sequence
  chemically synthesized
tttttttttttttgagacggag

SEQ ID NO: 1352025 - DNA, 22 bp, Artificial Sequence
  chemically synthesized
ctttttttttttttgagacgga

SEQ ID NO: 1352026 - DNA, 22 bp, Artificial Sequence
  chemically synthesized
tctttttttttttttgagacgg

SEQ ID NO: 1352027 - DNA, 22 bp, Artificial Sequence
  chemically synthesized
tttctttttttttttttgagac

SEQ ID NO: 1352028 - DNA, 22 bp, Artificial Sequence
  chemically synthesized
ctttctttttttttttttgaga

SEQ ID NO: 1352029 - DNA, 22 bp, Artificial Sequence
  chemically synthesized
tctttctttttttttttttgag

SEQ ID NO: 1352030 - DNA, 22 bp, Artificial Sequence
  chemically synthesized
ttctttctttttttttttttga

SEQ ID NO: 1352031 - DNA, 22 bp, Artificial Sequence
  chemically synthesized
ttttctttcttttttttttttt

SEQ ID NO: 1352032 - DNA, 22 bp, Artificial Sequence
  chemically synthesized
cttttctttctttttttttttt

SEQ ID NO: 1352033 - DNA, 22 bp, Artificial Sequence
  chemically synthesized
cgtctcaaaaaaaaaaaaagaa

SEQ ID NO: 1352034 - DNA, 22 bp, Artificial Sequence
  chemically synthesized
aatttcttttctttcttttttt

SEQ ID NO: 1352035 - DNA, 22 bp, Artificial Sequence
  chemically synthesized
attcaatttcttttctttcttt

SEQ ID NO: 1352036 - DNA, 22 bp, Artificial Sequence
  chemically synthesized
cattcaatttcttttctttctt

SEQ ID NO: 1352037 - DNA, 22 bp, Artificial Sequence
  chemically synthesized
aaaaaaaaaaaaagaaagaaaa

SEQ ID NO: 1352038 - DNA, 22 bp, Artificial Sequence
  chemically synthesized
tcattcaatttcttttctttct

SEQ ID NO: 1352039 - DNA, 22 bp, Artificial Sequence
  chemically synthesized
tcaatgaactttcattcaattt

SEQ ID NO: 1352040 - DNA, 22 bp, Artificial Sequence
  chemically synthesized
cattatcaatgaactttcattc

SEQ ID NO: 1352041 - DNA, 22 bp, Artificial Sequence
  chemically synthesized
tgcattatcaatgaactttcat

SEQ ID NO: 1352042 - DNA, 22 bp, Artificial Sequence
  chemically synthesized
gaatctctgcattatcaatgaa

SEQ ID NO: 1352043 - DNA, 22 bp, Artificial Sequence
  chemically synthesized
agaatctctgcattatcaatga

SEQ ID NO: 1352044 - DNA, 22 bp, Artificial Sequence
  chemically synthesized
tagaatctctgcattatcaatg

SEQ ID NO: 1352045 - DNA, 22 bp, Artificial Sequence
  chemically synthesized
aatgaaagttcattgataatgc

SEQ ID NO: 1352046 - DNA, 22 bp, Artificial Sequence
  chemically synthesized
ttttagaatctctgcattatca

SEQ ID NO: 1352047 - DNA, 22 bp, Artificial Sequence
  chemically synthesized
attttagaatctctgcattatc

SEQ ID NO: 1352048 - DNA, 22 bp, Artificial Sequence
  chemically synthesized
catttattttagaatctctgca

SEQ ID NO: 1352049 - DNA, 22 bp, Artificial Sequence
  chemically synthesized
attgataatgcagagattctaa

SEQ ID NO: 1352050 - DNA, 22 bp, Artificial Sequence
  chemically synthesized
gctacatttattttagaatctc

SEQ ID NO: 1352051 - DNA, 22 bp, Artificial Sequence
  chemically synthesized
ggctacatttattttagaatct

SEQ ID NO: 1352052 - DNA, 22 bp, Artificial Sequence
  chemically synthesized
tggctacatttattttagaatc

SEQ ID NO: 1352053 - DNA, 22 bp, Artificial Sequence
  chemically synthesized
ttggctacatttattttagaat

SEQ ID NO: 1352054 - DNA, 22 bp, Artificial Sequence
  chemically synthesized
ataatgcagagattctaaaata

SEQ ID NO: 1352055 - DNA, 22 bp, Artificial Sequence
  chemically synthesized
tttttggctacatttattttag

SEQ ID NO: 1352056 - DNA, 22 bp, Artificial Sequence
  chemically synthesized
atttttggctacatttatttta

SEQ ID NO: 1352057 - DNA, 22 bp, Artificial Sequence
  chemically synthesized
tatttttggctacatttatttt

SEQ ID NO: 1352058 - DNA, 22 bp, Artificial Sequence
  chemically synthesized
gctttatttttggctacattta

SEQ ID NO: 1352059 - DNA, 22 bp, Artificial Sequence
  chemically synthesized
attggctttatttttggctaca

SEQ ID NO: 1352060 - DNA, 22 bp, Artificial Sequence
  chemically synthesized
taaaataaatgtagccaaaaat

SEQ ID NO: 1352061 - DNA, 22 bp, Artificial Sequence
  chemically synthesized
aaataaatgtagccaaaaataa

SEQ ID NO: 1352062 - DNA, 22 bp, Artificial Sequence
  chemically synthesized
gtatgctgattggctttatttt

SEQ ID NO: 1352063 - DNA, 22 bp, Artificial Sequence
  chemically synthesized
ggtatgctgattggctttattt

SEQ ID NO: 1352064 - DNA, 22 bp, Artificial Sequence
  chemically synthesized
tggtatgctgattggctttatt

SEQ ID NO: 1352065 - DNA, 22 bp, Artificial Sequence
  chemically synthesized
taatagttttggtatgctgatt

SEQ ID NO: 1352066 - DNA, 22 bp, Artificial Sequence
  chemically synthesized
agattgtaatagttttggtatg

SEQ ID NO: 1352067 - DNA, 22 bp, Artificial Sequence
  chemically synthesized
taagattgtaatagttttggta

SEQ ID NO: 1352068 - DNA, 22 bp, Artificial Sequence
  chemically synthesized
ctaagattgtaatagttttggt

SEQ ID NO: 1352069 - DNA, 22 bp, Artificial Sequence
  chemically synthesized
aaaatcataatggatttctaag

SEQ ID NO: 1352070 - DNA, 22 bp, Artificial Sequence
  chemically synthesized
aaaaatcataatggatttctaa

SEQ ID NO: 1352071 - DNA, 22 bp, Artificial Sequence
  chemically synthesized
taaaaatcataatggatttcta

SEQ ID NO: 1352072 - DNA, 22 bp, Artificial Sequence
  chemically synthesized
ttaaaaatcataatggatttct

SEQ ID NO: 1352073 - DNA, 22 bp, Artificial Sequence
  chemically synthesized
tttaaaaatcataatggatttc

SEQ ID NO: 1352074 - DNA, 22 bp, Artificial Sequence
  chemically synthesized
ttacaatcttagaaatccatta

SEQ ID NO: 1352075 - DNA, 22 bp, Artificial Sequence
  chemically synthesized
caatcttagaaatccattatga

SEQ ID NO: 1352076 - DNA, 22 bp, Artificial Sequence
  chemically synthesized
agaaatccattatgatttttaa

SEQ ID NO: 1352077 - DNA, 22 bp, Artificial Sequence
  chemically synthesized
gaaatccattatgatttttaaa

SEQ ID NO: 1352078 - DNA, 22 bp, Artificial Sequence
  chemically synthesized
tgatttttaaaaagtgcttttt

SEQ ID NO: 1352079 - DNA, 22 bp, Artificial Sequence
  chemically synthesized
agaggaaaaaaaaaaaaaaagc

SEQ ID NO: 1352080 - DNA, 22 bp, Artificial Sequence
  chemically synthesized
ttaaaaagtgcttttttttttt

SEQ ID NO: 1352081 - DNA, 22 bp, Artificial Sequence
  chemically synthesized
taaaaagtgctttttttttttt

SEQ ID NO: 1352082 - DNA, 22 bp, Artificial Sequence
  chemically synthesized
aaaaagtgcttttttttttttt

SEQ ID NO: 1352083 - DNA, 22 bp, Artificial Sequence
  chemically synthesized
aaaagtgctttttttttttttt

SEQ ID NO: 1352084 - DNA, 22 bp, Artificial Sequence
  chemically synthesized
catctcagaggaaaaaaaaaaa

SEQ ID NO: 1352085 - DNA, 22 bp, Artificial Sequence
  chemically synthesized
tttttttttttttcctctgaga

SEQ ID NO: 1352086 - DNA, 22 bp, Artificial Sequence
  chemically synthesized
ttttttttttttcctctgagat

SEQ ID NO: 1352087 - DNA, 22 bp, Artificial Sequence
  chemically synthesized
tttttttttttcctctgagatg

SEQ ID NO: 1352088 - DNA, 22 bp, Artificial Sequence
  chemically synthesized
ttttttttttcctctgagatgg

SEQ ID NO: 1352089 - DNA, 22 bp, Artificial Sequence
  chemically synthesized
tttttttttcctctgagatgga

SEQ ID NO: 1352090 - DNA, 22 bp, Artificial Sequence
  chemically synthesized
ttttttttcctctgagatggag

SEQ ID NO: 1352091 - DNA, 22 bp, Artificial Sequence
  chemically synthesized
tttttttcctctgagatggagt

SEQ ID NO: 1352092 - DNA, 22 bp, Artificial Sequence
  chemically synthesized
ttttttcctctgagatggagtt

SEQ ID NO: 1352093 - DNA, 22 bp, Artificial Sequence
  chemically synthesized
tttttcctctgagatggagttt

SEQ ID NO: 1352094 - DNA, 22 bp, Artificial Sequence
  chemically synthesized
ttttcctctgagatggagtttc

SEQ ID NO: 1352095 - DNA, 22 bp, Artificial Sequence
  chemically synthesized
ggcgacaagagcgaaactccat

SEQ ID NO: 1352096 - DNA, 22 bp, Artificial Sequence
  chemically synthesized
tttcctctgagatggagtttcg

SEQ ID NO: 1352097 - DNA, 22 bp, Artificial Sequence
  chemically synthesized
ttcctctgagatggagtttcgc

SEQ ID NO: 1352098 - DNA, 22 bp, Artificial Sequence
  chemically synthesized
tcctctgagatggagtttcgct

SEQ ID NO: 1352099 - DNA, 22 bp, Artificial Sequence
  chemically synthesized
cctctgagatggagtttcgctc

SEQ ID NO: 1352100 - DNA, 22 bp, Artificial Sequence
  chemically synthesized
ctctgagatggagtttcgctct

SEQ ID NO: 1352101 - DNA, 22 bp, Artificial Sequence
  chemically synthesized
cagcctgggcgacaagagcgaa

SEQ ID NO: 1352102 - DNA, 22 bp, Artificial Sequence
  chemically synthesized
tgagatggagtttcgctcttgt

SEQ ID NO: 1352103 - DNA, 22 bp, Artificial Sequence
  chemically synthesized
agatggagtttcgctcttgtcg

SEQ ID NO: 1352104 - DNA, 22 bp, Artificial Sequence
  chemically synthesized
ccctccagcctgggcgacaaga

SEQ ID NO: 1352105 - DNA, 22 bp, Artificial Sequence
  chemically synthesized
cgctcttgtcgcccaggctgga

SEQ ID NO: 1352106 - DNA, 22 bp, Artificial Sequence
  chemically synthesized
gctcttgtcgcccaggctggag

SEQ ID NO: 1352107 - DNA, 22 bp, Artificial Sequence
  chemically synthesized
ttgtcgcccaggctggagggca

SEQ ID NO: 1352108 - DNA, 22 bp, Artificial Sequence
  chemically synthesized
gtcgcccaggctggagggcaat

SEQ ID NO: 1352109 - DNA, 22 bp, Artificial Sequence
  chemically synthesized
tcgcccaggctggagggcaatg

SEQ ID NO: 1352110 - DNA, 22 bp, Artificial Sequence
  chemically synthesized
aggtgagatcgtgccattgccc

SEQ ID NO: 1352111 - DNA, 22 bp, Artificial Sequence
  chemically synthesized
gagggcaatggcacgatctcac

SEQ ID NO: 1352112 - DNA, 22 bp, Artificial Sequence
  chemically synthesized
gagacggaggttgaggtgagat

SEQ ID NO: 1352113 - DNA, 22 bp, Artificial Sequence
  chemically synthesized
aaccctggagacggaggttgag

SEQ ID NO: 1352114 - DNA, 22 bp, Artificial Sequence
  chemically synthesized
gaaccctggagacggaggttga

SEQ ID NO: 1352115 - DNA, 22 bp, Artificial Sequence
  chemically synthesized
cttgaaccctggagacggaggt

SEQ ID NO: 1352116 - DNA, 22 bp, Artificial Sequence
  chemically synthesized
acctcaacctccgtctccaggg

SEQ ID NO: 1352117 - DNA, 22 bp, Artificial Sequence
  chemically synthesized
aacctccgtctccagggttcaa

SEQ ID NO: 1352118 - DNA, 22 bp, Artificial Sequence
  chemically synthesized
aggcaggagaattgcttgaacc

SEQ ID NO: 1352119 - DNA, 22 bp, Artificial Sequence
  chemically synthesized
cgtctccagggttcaagcaatt

SEQ ID NO: 1352120 - DNA, 22 bp, Artificial Sequence
  chemically synthesized
cagggttcaagcaattctcctg

SEQ ID NO: 1352121 - DNA, 22 bp, Artificial Sequence
  chemically synthesized
aggaagctgaggcaggagaatt

SEQ ID NO: 1352122 - DNA, 22 bp, Artificial Sequence
  chemically synthesized
ctcaggaagctgaggcaggaga

SEQ ID NO: 1352123 - DNA, 22 bp, Artificial Sequence
  chemically synthesized
aagcaattctcctgcctcagct

SEQ ID NO: 1352124 - DNA, 22 bp, Artificial Sequence
  chemically synthesized
taatcccagctactcaggaagc

SEQ ID NO: 1352125 - DNA, 22 bp, Artificial Sequence
  chemically synthesized
tcctgcctcagcttcctgagta

SEQ ID NO: 1352126 - DNA, 22 bp, Artificial Sequence
  chemically synthesized
ctgcctcagcttcctgagtagc

SEQ ID NO: 1352127 - DNA, 22 bp, Artificial Sequence
  chemically synthesized
cctcagcttcctgagtagctgg

SEQ ID NO: 1352128 - DNA, 22 bp, Artificial Sequence
  chemically synthesized
agcttcctgagtagctgggatt

SEQ ID NO: 1352129 - DNA, 22 bp, Artificial Sequence
  chemically synthesized
cctgagtagctgggattacagg

SEQ ID NO: 1352130 - DNA, 22 bp, Artificial Sequence
  chemically synthesized
ctgagtagctgggattacaggt

SEQ ID NO: 1352131 - DNA, 22 bp, Artificial Sequence
  chemically synthesized
agtagctgggattacaggtgtg

SEQ ID NO: 1352132 - DNA, 22 bp, Artificial Sequence
  chemically synthesized
gccaggcgtggtggtgcacacc

SEQ ID NO: 1352133 - DNA, 22 bp, Artificial Sequence
  chemically synthesized
ggattacaggtgtgcaccacca

SEQ ID NO: 1352134 - DNA, 22 bp, Artificial Sequence
  chemically synthesized
caggtgtgcaccaccacgcctg

SEQ ID NO: 1352135 - DNA, 22 bp, Artificial Sequence
  chemically synthesized
aaaatacaaaattagccaggcg

SEQ ID NO: 1352136 - DNA, 22 bp, Artificial Sequence
  chemically synthesized
ctaaaaatacaaaattagccag

SEQ ID NO: 1352137 - DNA, 22 bp, Artificial Sequence
  chemically synthesized
tactaaaaatacaaaattagcc

SEQ ID NO: 1352138 - DNA, 22 bp, Artificial Sequence
  chemically synthesized
gctaattttgtatttttagtag

SEQ ID NO: 1352139 - DNA, 22 bp, Artificial Sequence
  chemically synthesized
attttgtatttttagtagagat

SEQ ID NO: 1352140 - DNA, 22 bp, Artificial Sequence
  chemically synthesized
tgtatttttagtagagatgggg

SEQ ID NO: 1352141 - DNA, 22 bp, Artificial Sequence
  chemically synthesized
gtatttttagtagagatggggt

SEQ ID NO: 1352142 - DNA, 22 bp, Artificial Sequence
  chemically synthesized
tatttttagtagagatggggtt

SEQ ID NO: 1352143 - DNA, 22 bp, Artificial Sequence
  chemically synthesized
accaacatggtgaaaccccatc

SEQ ID NO: 1352144 - DNA, 22 bp, Artificial Sequence
  chemically synthesized
ttagtagagatggggtttcacc

SEQ ID NO: 1352145 - DNA, 22 bp, Artificial Sequence
  chemically synthesized
tagtagagatggggtttcacca

SEQ ID NO: 1352146 - DNA, 22 bp, Artificial Sequence
  chemically synthesized
agtagagatggggtttcaccat

SEQ ID NO: 1352147 - DNA, 22 bp, Artificial Sequence
  chemically synthesized
gtagagatggggtttcaccatg

SEQ ID NO: 1352148 - DNA, 22 bp, Artificial Sequence
  chemically synthesized
agaccagcctgaccaacatggt

SEQ ID NO: 1352149 - DNA, 22 bp, Artificial Sequence
  chemically synthesized
gagaccagcctgaccaacatgg

SEQ ID NO: 1352150 - DNA, 22 bp, Artificial Sequence
  chemically synthesized
caccatgttggtcaggctggtc

SEQ ID NO: 1352151 - DNA, 22 bp, Artificial Sequence
  chemically synthesized
accatgttggtcaggctggtct

SEQ ID NO: 1352152 - DNA, 22 bp, Artificial Sequence
  chemically synthesized
agatcaggagtttgagaccagc

SEQ ID NO: 1352153 - DNA, 22 bp, Artificial Sequence
  chemically synthesized
cagatcaggagtttgagaccag

SEQ ID NO: 1352154 - DNA, 22 bp, Artificial Sequence
  chemically synthesized
gtcaggctggtctcaaactcct

SEQ ID NO: 1352155 - DNA, 22 bp, Artificial Sequence
  chemically synthesized
gtctcaaactcctgatctgaag

SEQ ID NO: 1352156 - DNA, 22 bp, Artificial Sequence
  chemically synthesized
aaactcctgatctgaagtgatc

SEQ ID NO: 1352157 - DNA, 22 bp, Artificial Sequence
  chemically synthesized
ggaggccaaggtgggcagatca

SEQ ID NO: 1352158 - DNA, 22 bp, Artificial Sequence
  chemically synthesized
ctgatctgaagtgatctgccca

SEQ ID NO: 1352159 - DNA, 22 bp, Artificial Sequence
  chemically synthesized
gggaggccaaggtgggcagatc

SEQ ID NO: 1352160 - DNA, 22 bp, Artificial Sequence
  chemically synthesized
tgggaggccaaggtgggcagat

SEQ ID NO: 1352161 - DNA, 22 bp, Artificial Sequence
  chemically synthesized
atctgaagtgatctgcccacct

SEQ ID NO: 1352162 - DNA, 22 bp, Artificial Sequence
  chemically synthesized
aagtgatctgcccaccttggcc

SEQ ID NO: 1352163 - DNA, 22 bp, Artificial Sequence
  chemically synthesized
taatcccagcactttgggaggc

SEQ ID NO: 1352164 - DNA, 22 bp, Artificial Sequence
  chemically synthesized
cccaccttggcctcccaaagtg

SEQ ID NO: 1352165 - DNA, 22 bp, Artificial Sequence
  chemically synthesized
acgcctgtaatcccagcacttt

SEQ ID NO: 1352166 - DNA, 22 bp, Artificial Sequence
  chemically synthesized
ggcctcccaaagtgctgggatt

SEQ ID NO: 1352167 - DNA, 22 bp, Artificial Sequence
  chemically synthesized
gcctcccaaagtgctgggatta

SEQ ID NO: 1352168 - DNA, 22 bp, Artificial Sequence
  chemically synthesized
agtggctcacgcctgtaatccc

SEQ ID NO: 1352169 - DNA, 22 bp, Artificial Sequence
  chemically synthesized
ccaaagtgctgggattacaggc

SEQ ID NO: 1352170 - DNA, 22 bp, Artificial Sequence
  chemically synthesized
ggccgggctcagtggctcacgc

SEQ ID NO: 1352171 - DNA, 22 bp, Artificial Sequence
  chemically synthesized
cggccgggctcagtggctcacg

SEQ ID NO: 1352172 - DNA, 22 bp, Artificial Sequence
  chemically synthesized
tcggccgggctcagtggctcac

SEQ ID NO: 1352173 - DNA, 22 bp, Artificial Sequence
  chemically synthesized
ggattacaggcgtgagccactg

SEQ ID NO: 1352174 - DNA, 22 bp, Artificial Sequence
  chemically synthesized
ttcggccgggctcagtggctca

SEQ ID NO: 1352175 - DNA, 22 bp, Artificial Sequence
  chemically synthesized
caggcgtgagccactgagcccg

SEQ ID NO: 1352176 - DNA, 22 bp, Artificial Sequence
  chemically synthesized
agcccggccgaaaagtgctata

SEQ ID NO: 1352177 - DNA, 22 bp, Artificial Sequence
  chemically synthesized
agaataataaatagtagggaat

SEQ ID NO: 1352178 - DNA, 22 bp, Artificial Sequence
  chemically synthesized
cagaataataaatagtagggaa

SEQ ID NO: 1352179 - DNA, 22 bp, Artificial Sequence
  chemically synthesized
tcagaataataaatagtaggga

SEQ ID NO: 1352180 - DNA, 22 bp, Artificial Sequence
  chemically synthesized
tttcagaataataaatagtagg

SEQ ID NO: 1352181 - DNA, 22 bp, Artificial Sequence
  chemically synthesized
tattgctattccctactattta

SEQ ID NO: 1352182 - DNA, 22 bp, Artificial Sequence
  chemically synthesized
ctattccctactatttattatt

SEQ ID NO: 1352183 - DNA, 22 bp, Artificial Sequence
  chemically synthesized
ttccctactatttattattctg

SEQ ID NO: 1352184 - DNA, 22 bp, Artificial Sequence
  chemically synthesized
cctactatttattattctgaaa

SEQ ID NO: 1352185 - DNA, 22 bp, Artificial Sequence
  chemically synthesized
ctatttattattctgaaagaga

SEQ ID NO: 1352186 - DNA, 22 bp, Artificial Sequence
  chemically synthesized
aacatgtgatatgtctctttca

SEQ ID NO: 1352187 - DNA, 22 bp, Artificial Sequence
  chemically synthesized
aaacatgtgatatgtctctttc

SEQ ID NO: 1352188 - DNA, 22 bp, Artificial Sequence
  chemically synthesized
tttattattctgaaagagacat

SEQ ID NO: 1352189 - DNA, 22 bp, Artificial Sequence
  chemically synthesized
attattctgaaagagacatatc

SEQ ID NO: 1352190 - DNA, 22 bp, Artificial Sequence
  chemically synthesized
ttattctgaaagagacatatca

SEQ ID NO: 1352191 - DNA, 22 bp, Artificial Sequence
  chemically synthesized
aatgtttaaacatgtgatatgt

SEQ ID NO: 1352192 - DNA, 22 bp, Artificial Sequence
  chemically synthesized
ttctgaaagagacatatcacat

SEQ ID NO: 1352193 - DNA, 22 bp, Artificial Sequence
  chemically synthesized
aaatgtttaaacatgtgatatg

SEQ ID NO: 1352194 - DNA, 22 bp, Artificial Sequence
  chemically synthesized
tgaaagagacatatcacatgtt

SEQ ID NO: 1352195 - DNA, 22 bp, Artificial Sequence
  chemically synthesized
tttaaatgtttaaacatgtgat

SEQ ID NO: 1352196 - DNA, 22 bp, Artificial Sequence
  chemically synthesized
aaagagacatatcacatgttta

SEQ ID NO: 1352197 - DNA, 22 bp, Artificial Sequence
  chemically synthesized
gttatttaaatgtttaaacatg

SEQ ID NO: 1352198 - DNA, 22 bp, Artificial Sequence
  chemically synthesized
ttcgttatttaaatgtttaaac

SEQ ID NO: 1352199 - DNA, 22 bp, Artificial Sequence
  chemically synthesized
gttcgttatttaaatgtttaaa

SEQ ID NO: 1352200 - DNA, 22 bp, Artificial Sequence
  chemically synthesized
aaacatttaaataacgaacaaa

SEQ ID NO: 1352201 - DNA, 22 bp, Artificial Sequence
  chemically synthesized
aacatttaaataacgaacaaac

SEQ ID NO: 1352202 - DNA, 22 bp, Artificial Sequence
  chemically synthesized
aaataacgaacaaacctcctgg

SEQ ID NO: 1352203 - DNA, 22 bp, Artificial Sequence
  chemically synthesized
aataacgaacaaacctcctggg

SEQ ID NO: 1352204 - DNA, 22 bp, Artificial Sequence
  chemically synthesized
aaaagtgcgtgataaatatgat

SEQ ID NO: 1352205 - DNA, 22 bp, Artificial Sequence
  chemically synthesized
aaaaagtgcgtgataaatatga

SEQ ID NO: 1352206 - DNA, 22 bp, Artificial Sequence
  chemically synthesized
taaaaagtgcgtgataaatatg

SEQ ID NO: 1352207 - DNA, 22 bp, Artificial Sequence
  chemically synthesized
ctgggatcatcatatttatcac

SEQ ID NO: 1352208 - DNA, 22 bp, Artificial Sequence
  chemically synthesized
tttaaaaagtgcgtgataaata

SEQ ID NO: 1352209 - DNA, 22 bp, Artificial Sequence
  chemically synthesized
ctttaaaaagtgcgtgataaat

SEQ ID NO: 1352210 - DNA, 22 bp, Artificial Sequence
  chemically synthesized
tctttaaaaagtgcgtgataaa

SEQ ID NO: 1352211 - DNA, 22 bp, Artificial Sequence
  chemically synthesized
ggatcatcatatttatcacgca

SEQ ID NO: 1352212 - DNA, 22 bp, Artificial Sequence
  chemically synthesized
attttctttaaaaagtgcgtga

SEQ ID NO: 1352213 - DNA, 22 bp, Artificial Sequence
  chemically synthesized
gattttctttaaaaagtgcgtg

SEQ ID NO: 1352214 - DNA, 22 bp, Artificial Sequence
  chemically synthesized
atcacgcactttttaaagaaaa

SEQ ID NO: 1352215 - DNA, 22 bp, Artificial Sequence
  chemically synthesized
tcacgcactttttaaagaaaat

SEQ ID NO: 1352216 - DNA, 22 bp, Artificial Sequence
  chemically synthesized
tataaacagaagcatgtttgat

SEQ ID NO: 1352217 - DNA, 22 bp, Artificial Sequence
  chemically synthesized
gtataaacagaagcatgtttga

SEQ ID NO: 1352218 - DNA, 22 bp, Artificial Sequence
  chemically synthesized
tttaaagaaaatcaaacatgct

SEQ ID NO: 1352219 - DNA, 22 bp, Artificial Sequence
  chemically synthesized
ttaaagaaaatcaaacatgctt

SEQ ID NO: 1352220 - DNA, 22 bp, Artificial Sequence
  chemically synthesized
taaagaaaatcaaacatgcttc

SEQ ID NO: 1352221 - DNA, 22 bp, Artificial Sequence
  chemically synthesized
aaagaaaatcaaacatgcttct

SEQ ID NO: 1352222 - DNA, 22 bp, Artificial Sequence
  chemically synthesized
aagaaaatcaaacatgcttctg

SEQ ID NO: 1352223 - DNA, 22 bp, Artificial Sequence
  chemically synthesized
gaatgggaataaatttgtataa

SEQ ID NO: 1352224 - DNA, 22 bp, Artificial Sequence
  chemically synthesized
agaatgggaataaatttgtata

SEQ ID NO: 1352225 - DNA, 22 bp, Artificial Sequence
  chemically synthesized
ctgtttatacaaatttattccc

SEQ ID NO: 1352226 - DNA, 22 bp, Artificial Sequence
  chemically synthesized
tgtttatacaaatttattccca

SEQ ID NO: 1352227 - DNA, 22 bp, Artificial Sequence
  chemically synthesized
tttatacaaatttattcccatt

SEQ ID NO: 1352228 - DNA, 22 bp, Artificial Sequence
  chemically synthesized
atacaaatttattcccattcta

SEQ ID NO: 1352229 - DNA, 22 bp, Artificial Sequence
  chemically synthesized
tacaaatttattcccattctaa

SEQ ID NO: 1352230 - DNA, 22 bp, Artificial Sequence
  chemically synthesized
taaaataaatatttagaatggg

SEQ ID NO: 1352231 - DNA, 22 bp, Artificial Sequence
  chemically synthesized
gtaaaataaatatttagaatgg

SEQ ID NO: 1352232 - DNA, 22 bp, Artificial Sequence
  chemically synthesized
tttgtaaaataaatatttagaa

SEQ ID NO: 1352233 - DNA, 22 bp, Artificial Sequence
  chemically synthesized
tgtttgtaaaataaatatttag

SEQ ID NO: 1352234 - DNA, 22 bp, Artificial Sequence
  chemically synthesized
attcccattctaaatatttatt

SEQ ID NO: 1352235 - DNA, 22 bp, Artificial Sequence
  chemically synthesized
ttcccattctaaatatttattt

SEQ ID NO: 1352236 - DNA, 22 bp, Artificial Sequence
  chemically synthesized
ccattctaaatatttattttac

SEQ ID NO: 1352237 - DNA, 22 bp, Artificial Sequence
  chemically synthesized
taaatatttattttacaaacag

SEQ ID NO: 1352238 - DNA, 22 bp, Artificial Sequence
  chemically synthesized
aatatttattttacaaacagaa

SEQ ID NO: 1352239 - DNA, 22 bp, Artificial Sequence
  chemically synthesized
attttacaaacagaatactttc

SEQ ID NO: 1352240 - DNA, 22 bp, Artificial Sequence
  chemically synthesized
ttttacaaacagaatactttct

SEQ ID NO: 1352241 - DNA, 22 bp, Artificial Sequence
  chemically synthesized
tacaaacagaatactttcttat

SEQ ID NO: 1352242 - DNA, 22 bp, Artificial Sequence
  chemically synthesized
acaaacagaatactttcttata

SEQ ID NO: 1352243 - DNA, 22 bp, Artificial Sequence
  chemically synthesized
caaacagaatactttcttatat

SEQ ID NO: 1352244 - DNA, 22 bp, Artificial Sequence
  chemically synthesized
atgtagcccaagaatataagaa

SEQ ID NO: 1352245 - DNA, 22 bp, Artificial Sequence
  chemically synthesized
tcttatattcttgggctacatg

SEQ ID NO: 1352246 - DNA, 22 bp, Artificial Sequence
  chemically synthesized
ataataatgattcatgtagccc

SEQ ID NO: 1352247 - DNA, 22 bp, Artificial Sequence
  chemically synthesized
cttatattcttgggctacatga

SEQ ID NO: 1352248 - DNA, 22 bp, Artificial Sequence
  chemically synthesized
ttatattcttgggctacatgaa

SEQ ID NO: 1352249 - DNA, 22 bp, Artificial Sequence
  chemically synthesized
ttgataataatgattcatgtag

SEQ ID NO: 1352250 - DNA, 22 bp, Artificial Sequence
  chemically synthesized
atattcttgggctacatgaatc

SEQ ID NO: 1352251 - DNA, 22 bp, Artificial Sequence
  chemically synthesized
tattcttgggctacatgaatca

SEQ ID NO: 1352252 - DNA, 22 bp, Artificial Sequence
  chemically synthesized
tgttgataataatgattcatgt

SEQ ID NO: 1352253 - DNA, 22 bp, Artificial Sequence
  chemically synthesized
ctgttgataataatgattcatg

SEQ ID NO: 1352254 - DNA, 22 bp, Artificial Sequence
  chemically synthesized
ttgggctacatgaatcattatt

SEQ ID NO: 1352255 - DNA, 22 bp, Artificial Sequence
  chemically synthesized
gggctacatgaatcattattat

SEQ ID NO: 1352256 - DNA, 22 bp, Artificial Sequence
  chemically synthesized
ggctacatgaatcattattatc

SEQ ID NO: 1352257 - DNA, 22 bp, Artificial Sequence
  chemically synthesized
catgaatcattattatcaacag

SEQ ID NO: 1352258 - DNA, 22 bp, Artificial Sequence
  chemically synthesized
taatgacagacacccttctgtt

SEQ ID NO: 1352259 - DNA, 22 bp, Artificial Sequence
  chemically synthesized
ctgtaatgacagacacccttct

SEQ ID NO: 1352260 - DNA, 22 bp, Artificial Sequence
  chemically synthesized
cctgtaatgacagacacccttc

SEQ ID NO: 1352261 - DNA, 22 bp, Artificial Sequence
  chemically synthesized
ttatcaacagaagggtgtctgt

SEQ ID NO: 1352262 - DNA, 22 bp, Artificial Sequence
  chemically synthesized
tgcttcctgtaatgacagacac

SEQ ID NO: 1352263 - DNA, 22 bp, Artificial Sequence
  chemically synthesized
tcaacagaagggtgtctgtcat

SEQ ID NO: 1352264 - DNA, 22 bp, Artificial Sequence
  chemically synthesized
aaaagtatacaagtattgtgct

SEQ ID NO: 1352265 - DNA, 22 bp, Artificial Sequence
  chemically synthesized
tcattacaggaagcacaatact

SEQ ID NO: 1352266 - DNA, 22 bp, Artificial Sequence
  chemically synthesized
caggaagcacaatacttgtata

SEQ ID NO: 1352267 - DNA, 22 bp, Artificial Sequence
  chemically synthesized
gtatacttttgagggttactca

SEQ ID NO: 1352268 - DNA, 22 bp, Artificial Sequence
  chemically synthesized
tatacttttgagggttactcac

SEQ ID NO: 1352269 - DNA, 22 bp, Artificial Sequence
  chemically synthesized
ttgagggttactcacacacacg

SEQ ID NO: 1352270 - DNA, 22 bp, Artificial Sequence
  chemically synthesized
tgagggttactcacacacacgc

SEQ ID NO: 1352271 - DNA, 22 bp, Artificial Sequence
  chemically synthesized
gagggttactcacacacacgcg

SEQ ID NO: 1352272 - DNA, 22 bp, Artificial Sequence
  chemically synthesized
agggttactcacacacacgcgc

SEQ ID NO: 1352273 - DNA, 22 bp, Artificial Sequence
  chemically synthesized
ctcacacacacgcgcacacaca

SEQ ID NO: 1352274 - DNA, 22 bp, Artificial Sequence
  chemically synthesized
acacacacgcgcacacacacat

SEQ ID NO: 1352275 - DNA, 22 bp, Artificial Sequence
  chemically synthesized
tgtgtatgtgtgtgcatgtgtg

SEQ ID NO: 1352276 - DNA, 22 bp, Artificial Sequence
  chemically synthesized
tgtgtgtatgtgtgtgcatgtg

SEQ ID NO: 1352277 - DNA, 22 bp, Artificial Sequence
  chemically synthesized
taggtcccaaactctgtgtgta

SEQ ID NO: 1352278 - DNA, 22 bp, Artificial Sequence
  chemically synthesized
gtaggtcccaaactctgtgtgt

SEQ ID NO: 1352279 - DNA, 22 bp, Artificial Sequence
  chemically synthesized
taaagtcttgtaggtcccaaac

SEQ ID NO: 1352280 - DNA, 22 bp, Artificial Sequence
  chemically synthesized
gggacctacaagactttataat

SEQ ID NO: 1352281 - DNA, 22 bp, Artificial Sequence
  chemically synthesized
ggacctacaagactttataatc

SEQ ID NO: 1352282 - DNA, 22 bp, Artificial Sequence
  chemically synthesized
caagactttataatcttattat

SEQ ID NO: 1352283 - DNA, 22 bp, Artificial Sequence
  chemically synthesized
tataatcttattatgcctgcta

SEQ ID NO: 1352284 - DNA, 22 bp, Artificial Sequence
  chemically synthesized
ataatcttattatgcctgctac

SEQ ID NO: 1352285 - DNA, 22 bp, Artificial Sequence
  chemically synthesized
taatcttattatgcctgctacc

SEQ ID NO: 1352286 - DNA, 22 bp, Artificial Sequence
  chemically synthesized
attatgcctgctacccatttca

SEQ ID NO: 1352287 - DNA, 22 bp, Artificial Sequence
  chemically synthesized
ttatgcctgctacccatttcat

SEQ ID NO: 1352288 - DNA, 22 bp, Artificial Sequence
  chemically synthesized
tgcctgctacccatttcatctt

SEQ ID NO: 1352289 - DNA, 22 bp, Artificial Sequence
  chemically synthesized
ctacccatttcatcttcttctt

SEQ ID NO: 1352290 - DNA, 22 bp, Artificial Sequence
  chemically synthesized
cccatttcatcttcttcttcac

SEQ ID NO: 1352291 - DNA, 22 bp, Artificial Sequence
  chemically synthesized
catcttcttcttcactgtttgt

SEQ ID NO: 1352292 - DNA, 22 bp, Artificial Sequence
  chemically synthesized
atcttcttcttcactgtttgtc

SEQ ID NO: 1352293 - DNA, 22 bp, Artificial Sequence
  chemically synthesized
cttcttcactgtttgtcttgtt

SEQ ID NO: 1352294 - DNA, 22 bp, Artificial Sequence
  chemically synthesized
ttcttcactgtttgtcttgttg

SEQ ID NO: 1352295 - DNA, 22 bp, Artificial Sequence
  chemically synthesized
cttcactgtttgtcttgttgta

SEQ ID NO: 1352296 - DNA, 22 bp, Artificial Sequence
  chemically synthesized
ttcactgtttgtcttgttgtat

SEQ ID NO: 1352297 - DNA, 22 bp, Artificial Sequence
  chemically synthesized
cactgtttgtcttgttgtatct

SEQ ID NO: 1352298 - DNA, 22 bp, Artificial Sequence
  chemically synthesized
actgtttgtcttgttgtatctc

SEQ ID NO: 1352299 - DNA, 22 bp, Artificial Sequence
  chemically synthesized
tttgtcttgttgtatctctgtt

SEQ ID NO: 1352300 - DNA, 22 bp, Artificial Sequence
  chemically synthesized
gtcttgttgtatctctgttcgt

SEQ ID NO: 1352301 - DNA, 22 bp, Artificial Sequence
  chemically synthesized
tcttgttgtatctctgttcgtt

SEQ ID NO: 1352302 - DNA, 22 bp, Artificial Sequence
  chemically synthesized
gttgtatctctgttcgttgtgg

SEQ ID NO: 1352303 - DNA, 22 bp, Artificial Sequence
  chemically synthesized
ttgtatctctgttcgttgtggc

SEQ ID NO: 1352304 - DNA, 22 bp, Artificial Sequence
  chemically synthesized
tatctctgttcgttgtggccta

SEQ ID NO: 1352305 - DNA, 22 bp, Artificial Sequence
  chemically synthesized
tgttcgttgtggcctacccacc

SEQ ID NO: 1352306 - DNA, 22 bp, Artificial Sequence
  chemically synthesized
ttcgttgtggcctacccacccc

SEQ ID NO: 1352307 - DNA, 22 bp, Artificial Sequence
  chemically synthesized
tcagagaggagcaggggtgggt

SEQ ID NO: 1352308 - DNA, 22 bp, Artificial Sequence
  chemically synthesized
gttgtggcctacccacccctgc

SEQ ID NO: 1352309 - DNA, 22 bp, Artificial Sequence
  chemically synthesized
tggcctacccacccctgctcct

SEQ ID NO: 1352310 - DNA, 22 bp, Artificial Sequence
  chemically synthesized
aacccaaaactgtcagagagga

SEQ ID NO: 1352311 - DNA, 22 bp, Artificial Sequence
  chemically synthesized
cccacccctgctcctctctgac

SEQ ID NO: 1352312 - DNA, 22 bp, Artificial Sequence
  chemically synthesized
ctcctctctgacagttttgggt

SEQ ID NO: 1352313 - DNA, 22 bp, Artificial Sequence
  chemically synthesized
ctctctgacagttttgggttga

SEQ ID NO: 1352314 - DNA, 22 bp, Artificial Sequence
  chemically synthesized
tctgacagttttgggttgaact

SEQ ID NO: 1352315 - DNA, 22 bp, Artificial Sequence
  chemically synthesized
tgacagttttgggttgaactta

SEQ ID NO: 1352316 - DNA, 22 bp, Artificial Sequence
  chemically synthesized
acagttttgggttgaacttacc

SEQ ID NO: 1352317 - DNA, 22 bp, Artificial Sequence
  chemically synthesized
gaaccagagccaggtaagttca

SEQ ID NO: 1352318 - DNA, 22 bp, Artificial Sequence
  chemically synthesized
ctggaaccagagccaggtaagt

SEQ ID NO: 1352319 - DNA, 22 bp, Artificial Sequence
  chemically synthesized
tgggttgaacttacctggctct

SEQ ID NO: 1352320 - DNA, 22 bp, Artificial Sequence
  chemically synthesized
gggttgaacttacctggctctg

SEQ ID NO: 1352321 - DNA, 22 bp, Artificial Sequence
  chemically synthesized
ggttgaacttacctggctctgg

SEQ ID NO: 1352322 - DNA, 22 bp, Artificial Sequence
  chemically synthesized
aacttacctggctctggttcca

SEQ ID NO: 1352323 - DNA, 22 bp, Artificial Sequence
  chemically synthesized
acctggctctggttccaggagt

SEQ ID NO: 1352324 - DNA, 22 bp, Artificial Sequence
  chemically synthesized
catcagacacccactcctggaa

SEQ ID NO: 1352325 - DNA, 22 bp, Artificial Sequence
  chemically synthesized
cctggctctggttccaggagtg

SEQ ID NO: 1352326 - DNA, 22 bp, Artificial Sequence
  chemically synthesized
gctctggttccaggagtgggtg

SEQ ID NO: 1352327 - DNA, 22 bp, Artificial Sequence
  chemically synthesized
tggttccaggagtgggtgtctg

SEQ ID NO: 1352328 - DNA, 22 bp, Artificial Sequence
  chemically synthesized
ggcaggttccatcagacaccca

SEQ ID NO: 1352329 - DNA, 22 bp, Artificial Sequence
  chemically synthesized
gttccaggagtgggtgtctgat

SEQ ID NO: 1352330 - DNA, 22 bp, Artificial Sequence
  chemically synthesized
attgggcaggttccatcagaca

SEQ ID NO: 1352331 - DNA, 22 bp, Artificial Sequence
  chemically synthesized
caggagtgggtgtctgatggaa

SEQ ID NO: 1352332 - DNA, 22 bp, Artificial Sequence
  chemically synthesized
tgattgggcaggttccatcaga

SEQ ID NO: 1352333 - DNA, 22 bp, Artificial Sequence
  chemically synthesized
aggagtacagtgttctgattgg

SEQ ID NO: 1352334 - DNA, 22 bp, Artificial Sequence
  chemically synthesized
atggaacctgcccaatcagaac

SEQ ID NO: 1352335 - DNA, 22 bp, Artificial Sequence
  chemically synthesized
gttcaggagtacagtgttctga

SEQ ID NO: 1352336 - DNA, 22 bp, Artificial Sequence
  chemically synthesized
cccaatcagaacactgtactcc

SEQ ID NO: 1352337 - DNA, 22 bp, Artificial Sequence
  chemically synthesized
aatcaatcaacctagttcagga

SEQ ID NO: 1352338 - DNA, 22 bp, Artificial Sequence
  chemically synthesized
ctgaatcaatcaacctagttca

SEQ ID NO: 1352339 - DNA, 22 bp, Artificial Sequence
  chemically synthesized
tactcctgaactaggttgattg

SEQ ID NO: 1352340 - DNA, 22 bp, Artificial Sequence
  chemically synthesized
cacattcctgaatcaatcaacc

SEQ ID NO: 1352341 - DNA, 22 bp, Artificial Sequence
  chemically synthesized
ctgaactaggttgattgattca

SEQ ID NO: 1352342 - DNA, 22 bp, Artificial Sequence
  chemically synthesized
aactaggttgattgattcagga

SEQ ID NO: 1352343 - DNA, 22 bp, Artificial Sequence
  chemically synthesized
ggttgattgattcaggaatgtg

SEQ ID NO: 1352344 - DNA, 22 bp, Artificial Sequence
  chemically synthesized
aagaaatcacctacacattcct

SEQ ID NO: 1352345 - DNA, 22 bp, Artificial Sequence
  chemically synthesized
tgaagaaatcacctacacattc

SEQ ID NO: 1352346 - DNA, 22 bp, Artificial Sequence
  chemically synthesized
attgattcaggaatgtgtaggt

SEQ ID NO: 1352347 - DNA, 22 bp, Artificial Sequence
  chemically synthesized
actctgaagaaatcacctacac

SEQ ID NO: 1352348 - DNA, 22 bp, Artificial Sequence
  chemically synthesized
attcaggaatgtgtaggtgatt

SEQ ID NO: 1352349 - DNA, 22 bp, Artificial Sequence
  chemically synthesized
aggaatgtgtaggtgatttctt

SEQ ID NO: 1352350 - DNA, 22 bp, Artificial Sequence
  chemically synthesized
taattgactctgaagaaatcac

SEQ ID NO: 1352351 - DNA, 22 bp, Artificial Sequence
  chemically synthesized
gtaattgactctgaagaaatca

SEQ ID NO: 1352352 - DNA, 22 bp, Artificial Sequence
  chemically synthesized
cttgtaattgactctgaagaaa

SEQ ID NO: 1352353 - DNA, 22 bp, Artificial Sequence
  chemically synthesized
ggattacttgtaattgactctg

SEQ ID NO: 1352354 - DNA, 22 bp, Artificial Sequence
  chemically synthesized
cttcagagtcaattacaagtaa

SEQ ID NO: 1352355 - DNA, 22 bp, Artificial Sequence
  chemically synthesized
ttcagagtcaattacaagtaat

SEQ ID NO: 1352356 - DNA, 22 bp, Artificial Sequence
  chemically synthesized
cagagtcaattacaagtaatcc

SEQ ID NO: 1352357 - DNA, 22 bp, Artificial Sequence
  chemically synthesized
agagtcaattacaagtaatcct

SEQ ID NO: 1352358 - DNA, 22 bp, Artificial Sequence
  chemically synthesized
caacagaagacctaggattact

SEQ ID NO: 1352359 - DNA, 22 bp, Artificial Sequence
  chemically synthesized
tccaacagaagacctaggatta

SEQ ID NO: 1352360 - DNA, 22 bp, Artificial Sequence
  chemically synthesized
tctccaacagaagacctaggat

SEQ ID NO: 1352361 - DNA, 22 bp, Artificial Sequence
  chemically synthesized
caagtaatcctaggtcttctgt

SEQ ID NO: 1352362 - DNA, 22 bp, Artificial Sequence
  chemically synthesized
ggtcttctgttggagagaatgg

SEQ ID NO: 1352363 - DNA, 22 bp, Artificial Sequence
  chemically synthesized
ctgttggagagaatggtgtttt

SEQ ID NO: 1352364 - DNA, 22 bp, Artificial Sequence
  chemically synthesized
caatagaaaatgaaaacaccat

SEQ ID NO: 1352365 - DNA, 22 bp, Artificial Sequence
  chemically synthesized
tgttggagagaatggtgttttc

SEQ ID NO: 1352366 - DNA, 22 bp, Artificial Sequence
  chemically synthesized
ttggagagaatggtgttttcat

SEQ ID NO: 1352367 - DNA, 22 bp, Artificial Sequence
  chemically synthesized
aattccaatagaaaatgaaaac

SEQ ID NO: 1352368 - DNA, 22 bp, Artificial Sequence
  chemically synthesized
gagagaatggtgttttcatttt

SEQ ID NO: 1352369 - DNA, 22 bp, Artificial Sequence
  chemically synthesized
tacctcaattccaatagaaaat

SEQ ID NO: 1352370 - DNA, 22 bp, Artificial Sequence
  chemically synthesized
tatcattgtacctcaattccaa

SEQ ID NO: 1352371 - DNA, 22 bp, Artificial Sequence
  chemically synthesized
atatcattgtacctcaattcca

SEQ ID NO: 1352372 - DNA, 22 bp, Artificial Sequence
  chemically synthesized
tcattttctattggaattgagg

SEQ ID NO: 1352373 - DNA, 22 bp, Artificial Sequence
  chemically synthesized
cattttctattggaattgaggt

SEQ ID NO: 1352374 - DNA, 22 bp, Artificial Sequence
  chemically synthesized
attttctattggaattgaggta

SEQ ID NO: 1352375 - DNA, 22 bp, Artificial Sequence
  chemically synthesized
gacttatatcattgtacctcaa

SEQ ID NO: 1352376 - DNA, 22 bp, Artificial Sequence
  chemically synthesized
agacttatatcattgtacctca

SEQ ID NO: 1352377 - DNA, 22 bp, Artificial Sequence
  chemically synthesized
tctattggaattgaggtacaat

SEQ ID NO: 1352378 - DNA, 22 bp, Artificial Sequence
  chemically synthesized
ctattggaattgaggtacaatg

SEQ ID NO: 1352379 - DNA, 22 bp, Artificial Sequence
  chemically synthesized
tattggaattgaggtacaatga

SEQ ID NO: 1352380 - DNA, 22 bp, Artificial Sequence
  chemically synthesized
ttggaattgaggtacaatgata

SEQ ID NO: 1352381 - DNA, 22 bp, Artificial Sequence
  chemically synthesized
gtcttagacttatatcattgta

SEQ ID NO: 1352382 - DNA, 22 bp, Artificial Sequence
  chemically synthesized
gaattgaggtacaatgatataa

SEQ ID NO: 1352383 - DNA, 22 bp, Artificial Sequence
  chemically synthesized
ttagtcttagacttatatcatt

SEQ ID NO: 1352384 - DNA, 22 bp, Artificial Sequence
  chemically synthesized
aggtacaatgatataagtctaa

SEQ ID NO: 1352385 - DNA, 22 bp, Artificial Sequence
  chemically synthesized
gatatgggacccattattagtc

SEQ ID NO: 1352386 - DNA, 22 bp, Artificial Sequence
  chemically synthesized
tcgatatgggacccattattag

SEQ ID NO: 1352387 - DNA, 22 bp, Artificial Sequence
  chemically synthesized
tctctcgatatgggacccatta

SEQ ID NO: 1352388 - DNA, 22 bp, Artificial Sequence
  chemically synthesized
agactaataatgggtcccatat

SEQ ID NO: 1352389 - DNA, 22 bp, Artificial Sequence
  chemically synthesized
gacattatctctcgatatggga

SEQ ID NO: 1352390 - DNA, 22 bp, Artificial Sequence
  chemically synthesized
agacattatctctcgatatggg

SEQ ID NO: 1352391 - DNA, 22 bp, Artificial Sequence
  chemically synthesized
ttagacattatctctcgatatg

SEQ ID NO: 1352392 - DNA, 22 bp, Artificial Sequence
  chemically synthesized
ataatgggtcccatatcgagag

SEQ ID NO: 1352393 - DNA, 22 bp, Artificial Sequence
  chemically synthesized
aaaaaaaaaaaaaaaaaagctc

SEQ ID NO: 1352394 - DNA, 22 bp, Artificial Sequence
  chemically synthesized
aaaaaaaaaaaaaaaaaaagct

SEQ ID NO: 1352395 - DNA, 22 bp, Artificial Sequence
  chemically synthesized
ttaaaaaaaaaaaaaaaaaaag

SEQ ID NO: 1352396 - DNA, 22 bp, Artificial Sequence
  chemically synthesized
agagcttttttttttttttttt

SEQ ID NO: 1352397 - DNA, 22 bp, Artificial Sequence
  chemically synthesized
aaaggctcttaaaaaaaaaaaa

SEQ ID NO: 1352398 - DNA, 22 bp, Artificial Sequence
  chemically synthesized
caaaggctcttaaaaaaaaaaa

SEQ ID NO: 1352399 - DNA, 22 bp, Artificial Sequence
  chemically synthesized
tcaaaggctcttaaaaaaaaaa

SEQ ID NO: 1352400 - DNA, 22 bp, Artificial Sequence
  chemically synthesized
tttttttttttttttttaagag

SEQ ID NO: 1352401 - DNA, 22 bp, Artificial Sequence
  chemically synthesized
tgttttcaaaggctcttaaaaa

SEQ ID NO: 1352402 - DNA, 22 bp, Artificial Sequence
  chemically synthesized
ttttttttttttttttaagagc

SEQ ID NO: 1352403 - DNA, 22 bp, Artificial Sequence
  chemically synthesized
tttttttttttttttaagagcc

SEQ ID NO: 1352404 - DNA, 22 bp, Artificial Sequence
  chemically synthesized
ttttttttttttttaagagcct

SEQ ID NO: 1352405 - DNA, 22 bp, Artificial Sequence
  chemically synthesized
tttttttttttttaagagcctt

SEQ ID NO: 1352406 - DNA, 22 bp, Artificial Sequence
  chemically synthesized
ttttttttttttaagagccttt

SEQ ID NO: 1352407 - DNA, 22 bp, Artificial Sequence
  chemically synthesized
cactgtgttttcaaaggctctt

SEQ ID NO: 1352408 - DNA, 22 bp, Artificial Sequence
  chemically synthesized
tttttttttttaagagcctttg

SEQ ID NO: 1352409 - DNA, 22 bp, Artificial Sequence
  chemically synthesized
ttttttttttaagagcctttga

SEQ ID NO: 1352410 - DNA, 22 bp, Artificial Sequence
  chemically synthesized
tccactgtgttttcaaaggctc

SEQ ID NO: 1352411 - DNA, 22 bp, Artificial Sequence
  chemically synthesized
tttttttttaagagcctttgaa

SEQ ID NO: 1352412 - DNA, 22 bp, Artificial Sequence
  chemically synthesized
ctccactgtgttttcaaaggct

SEQ ID NO: 1352413 - DNA, 22 bp, Artificial Sequence
  chemically synthesized
ttttttttaagagcctttgaaa

SEQ ID NO: 1352414 - DNA, 22 bp, Artificial Sequence
  chemically synthesized
tctccactgtgttttcaaaggc

SEQ ID NO: 1352415 - DNA, 22 bp, Artificial Sequence
  chemically synthesized
tttttttaagagcctttgaaaa

SEQ ID NO: 1352416 - DNA, 22 bp, Artificial Sequence
  chemically synthesized
ttttttaagagcctttgaaaac

SEQ ID NO: 1352417 - DNA, 22 bp, Artificial Sequence
  chemically synthesized
tttttaagagcctttgaaaaca

SEQ ID NO: 1352418 - DNA, 22 bp, Artificial Sequence
  chemically synthesized
ttttaagagcctttgaaaacac

SEQ ID NO: 1352419 - DNA, 22 bp, Artificial Sequence
  chemically synthesized
tttaagagcctttgaaaacaca

SEQ ID NO: 1352420 - DNA, 22 bp, Artificial Sequence
  chemically synthesized
ttaagagcctttgaaaacacag

SEQ ID NO: 1352421 - DNA, 22 bp, Artificial Sequence
  chemically synthesized
accctttctccactgtgttttc

SEQ ID NO: 1352422 - DNA, 22 bp, Artificial Sequence
  chemically synthesized
taagagcctttgaaaacacagt

SEQ ID NO: 1352423 - DNA, 22 bp, Artificial Sequence
  chemically synthesized
aagagcctttgaaaacacagtg

SEQ ID NO: 1352424 - DNA, 22 bp, Artificial Sequence
  chemically synthesized
tcaccctttctccactgtgttt

SEQ ID NO: 1352425 - DNA, 22 bp, Artificial Sequence
  chemically synthesized
agagcctttgaaaacacagtgg

SEQ ID NO: 1352426 - DNA, 22 bp, Artificial Sequence
  chemically synthesized
tctcaccctttctccactgtgt

SEQ ID NO: 1352427 - DNA, 22 bp, Artificial Sequence
  chemically synthesized
tgaaaacacagtggagaaaggg

SEQ ID NO: 1352428 - DNA, 22 bp, Artificial Sequence
  chemically synthesized
gaaaacacagtggagaaagggt

SEQ ID NO: 1352429 - DNA, 22 bp, Artificial Sequence
  chemically synthesized
aaaacacagtggagaaagggtg

SEQ ID NO: 1352430 - DNA, 22 bp, Artificial Sequence
  chemically synthesized
gcccagtacctctctcaccctt

SEQ ID NO: 1352431 - DNA, 22 bp, Artificial Sequence
  chemically synthesized
aagtgatgtcacctagcccagt

SEQ ID NO: 1352432 - DNA, 22 bp, Artificial Sequence
  chemically synthesized
ggatctcaagtgatgtcaccta

SEQ ID NO: 1352433 - DNA, 22 bp, Artificial Sequence
  chemically synthesized
gggatctcaagtgatgtcacct

SEQ ID NO: 1352434 - DNA, 22 bp, Artificial Sequence
  chemically synthesized
tgggatctcaagtgatgtcacc

SEQ ID NO: 1352435 - DNA, 22 bp, Artificial Sequence
  chemically synthesized
gttttgggatctcaagtgatgt

SEQ ID NO: 1352436 - DNA, 22 bp, Artificial Sequence
  chemically synthesized
ggctaggtgacatcacttgaga

SEQ ID NO: 1352437 - DNA, 22 bp, Artificial Sequence
  chemically synthesized
ggtgacatcacttgagatccca

SEQ ID NO: 1352438 - DNA, 22 bp, Artificial Sequence
  chemically synthesized
agatacagttagttttgggatc

SEQ ID NO: 1352439 - DNA, 22 bp, Artificial Sequence
  chemically synthesized
cagatacagttagttttgggat

SEQ ID NO: 1352440 - DNA, 22 bp, Artificial Sequence
  chemically synthesized
cttcagatacagttagttttgg

SEQ ID NO: 1352441 - DNA, 22 bp, Artificial Sequence
  chemically synthesized
acttcagatacagttagttttg

SEQ ID NO: 1352442 - DNA, 22 bp, Artificial Sequence
  chemically synthesized
cttacttcagatacagttagtt

SEQ ID NO: 1352443 - DNA, 22 bp, Artificial Sequence
  chemically synthesized
gagatcccaaaactaactgtat

SEQ ID NO: 1352444 - DNA, 22 bp, Artificial Sequence
  chemically synthesized
agatcccaaaactaactgtatc

SEQ ID NO: 1352445 - DNA, 22 bp, Artificial Sequence
  chemically synthesized
actgtatctgaagtaagtaata

SEQ ID NO: 1352446 - DNA, 22 bp, Artificial Sequence
  chemically synthesized
tatctgaagtaagtaatacctc

SEQ ID NO: 1352447 - DNA, 22 bp, Artificial Sequence
  chemically synthesized
aagtaagtaatacctcttcact

SEQ ID NO: 1352448 - DNA, 22 bp, Artificial Sequence
  chemically synthesized
atgtaacgaaaaagtgaagagg

SEQ ID NO: 1352449 - DNA, 22 bp, Artificial Sequence
  chemically synthesized
ctcatgtaacgaaaaagtgaag

SEQ ID NO: 1352450 - DNA, 22 bp, Artificial Sequence
  chemically synthesized
gctcatgtaacgaaaaagtgaa

SEQ ID NO: 1352451 - DNA, 22 bp, Artificial Sequence
  chemically synthesized
tgctcatgtaacgaaaaagtga

SEQ ID NO: 1352452 - DNA, 22 bp, Artificial Sequence
  chemically synthesized
ctttgctcatgtaacgaaaaag

SEQ ID NO: 1352453 - DNA, 22 bp, Artificial Sequence
  chemically synthesized
cctttgctcatgtaacgaaaaa

SEQ ID NO: 1352454 - DNA, 22 bp, Artificial Sequence
  chemically synthesized
ttcactttttcgttacatgagc

SEQ ID NO: 1352455 - DNA, 22 bp, Artificial Sequence
  chemically synthesized
cactttttcgttacatgagcaa

SEQ ID NO: 1352456 - DNA, 22 bp, Artificial Sequence
  chemically synthesized
actttttcgttacatgagcaaa

SEQ ID NO: 1352457 - DNA, 22 bp, Artificial Sequence
  chemically synthesized
tttcgttacatgagcaaaggaa

SEQ ID NO: 1352458 - DNA, 22 bp, Artificial Sequence
  chemically synthesized
ttcgttacatgagcaaaggaaa

SEQ ID NO: 1352459 - DNA, 22 bp, Artificial Sequence
  chemically synthesized
tcgttacatgagcaaaggaaac

SEQ ID NO: 1352460 - DNA, 22 bp, Artificial Sequence
  chemically synthesized
agaaaaaaaaaagtttcctttg

SEQ ID NO: 1352461 - DNA, 22 bp, Artificial Sequence
  chemically synthesized
cgttacatgagcaaaggaaact

SEQ ID NO: 1352462 - DNA, 22 bp, Artificial Sequence
  chemically synthesized
aagaaaaaaaaaagtttccttt

SEQ ID NO: 1352463 - DNA, 22 bp, Artificial Sequence
  chemically synthesized
gttacatgagcaaaggaaactt

SEQ ID NO: 1352464 - DNA, 22 bp, Artificial Sequence
  chemically synthesized
catgagcaaaggaaactttttt

SEQ ID NO: 1352465 - DNA, 22 bp, Artificial Sequence
  chemically synthesized
gcaaaccagtttaagaaaaaaa

SEQ ID NO: 1352466 - DNA, 22 bp, Artificial Sequence
  chemically synthesized
caaaaacctagcaaaccagttt

SEQ ID NO: 1352467 - DNA, 22 bp, Artificial Sequence
  chemically synthesized
ttttttttcttaaactggtttg

SEQ ID NO: 1352468 - DNA, 22 bp, Artificial Sequence
  chemically synthesized
acaaaaacctagcaaaccagtt

SEQ ID NO: 1352469 - DNA, 22 bp, Artificial Sequence
  chemically synthesized
tttttttcttaaactggtttgc

SEQ ID NO: 1352470 - DNA, 22 bp, Artificial Sequence
  chemically synthesized
ttttttcttaaactggtttgct

SEQ ID NO: 1352471 - DNA, 22 bp, Artificial Sequence
  chemically synthesized
tttttcttaaactggtttgcta

SEQ ID NO: 1352472 - DNA, 22 bp, Artificial Sequence
  chemically synthesized
ttttcttaaactggtttgctag

SEQ ID NO: 1352473 - DNA, 22 bp, Artificial Sequence
  chemically synthesized
atttacaaaaacctagcaaacc

SEQ ID NO: 1352474 - DNA, 22 bp, Artificial Sequence
  chemically synthesized
tttcttaaactggtttgctagg

SEQ ID NO: 1352475 - DNA, 22 bp, Artificial Sequence
  chemically synthesized
ttcttaaactggtttgctaggt

SEQ ID NO: 1352476 - DNA, 22 bp, Artificial Sequence
  chemically synthesized
tcttaaactggtttgctaggtt

SEQ ID NO: 1352477 - DNA, 22 bp, Artificial Sequence
  chemically synthesized
ctaatttacaaaaacctagcaa

SEQ ID NO: 1352478 - DNA, 22 bp, Artificial Sequence
  chemically synthesized
cttaaactggtttgctaggttt

SEQ ID NO: 1352479 - DNA, 22 bp, Artificial Sequence
  chemically synthesized
ttaaactggtttgctaggtttt

SEQ ID NO: 1352480 - DNA, 22 bp, Artificial Sequence
  chemically synthesized
tgctaatttacaaaaacctagc

SEQ ID NO: 1352481 - DNA, 22 bp, Artificial Sequence
  chemically synthesized
ctgctaatttacaaaaacctag

SEQ ID NO: 1352482 - DNA, 22 bp, Artificial Sequence
  chemically synthesized
aaactggtttgctaggtttttg

SEQ ID NO: 1352483 - DNA, 22 bp, Artificial Sequence
  chemically synthesized
aactggtttgctaggtttttgt

SEQ ID NO: 1352484 - DNA, 22 bp, Artificial Sequence
  chemically synthesized
gtttgctaggtttttgtaaatt

SEQ ID NO: 1352485 - DNA, 22 bp, Artificial Sequence
  chemically synthesized
gctaggtttttgtaaattagca

SEQ ID NO: 1352486 - DNA, 22 bp, Artificial Sequence
  chemically synthesized
ctaggtttttgtaaattagcag

SEQ ID NO: 1352487 - DNA, 22 bp, Artificial Sequence
  chemically synthesized
ggtttttgtaaattagcagaaa

SEQ ID NO: 1352488 - DNA, 22 bp, Artificial Sequence
  chemically synthesized
ttgtaaattagcagaaatggtg

SEQ ID NO: 1352489 - DNA, 22 bp, Artificial Sequence
  chemically synthesized
tgtaaattagcagaaatggtgc

SEQ ID NO: 1352490 - DNA, 22 bp, Artificial Sequence
  chemically synthesized
gtaaattagcagaaatggtgct

SEQ ID NO: 1352491 - DNA, 22 bp, Artificial Sequence
  chemically synthesized
taaattagcagaaatggtgctt

SEQ ID NO: 1352492 - DNA, 22 bp, Artificial Sequence
  chemically synthesized
gcagaaatggtgcttacataca

SEQ ID NO: 1352493 - DNA, 22 bp, Artificial Sequence
  chemically synthesized
acatacacacatatatgtatgt

SEQ ID NO: 1352494 - DNA, 22 bp, Artificial Sequence
  chemically synthesized
catacacacatatatgtatgta

SEQ ID NO: 1352495 - DNA, 22 bp, Artificial Sequence
  chemically synthesized
aaccaaaatatacatacataca

SEQ ID NO: 1352496 - DNA, 22 bp, Artificial Sequence
  chemically synthesized
atctcaaccaaaatatacatac

SEQ ID NO: 1352497 - DNA, 22 bp, Artificial Sequence
  chemically synthesized
aatctcaaccaaaatatacata

SEQ ID NO: 1352498 - DNA, 22 bp, Artificial Sequence
  chemically synthesized
ttaatctcaaccaaaatataca

SEQ ID NO: 1352499 - DNA, 22 bp, Artificial Sequence
  chemically synthesized
cttaatctcaaccaaaatatac

SEQ ID NO: 1352500 - DNA, 22 bp, Artificial Sequence
  chemically synthesized
tttcttaatctcaaccaaaata

SEQ ID NO: 1352501 - DNA, 22 bp, Artificial Sequence
  chemically synthesized
tatttcttaatctcaaccaaaa

SEQ ID NO: 1352502 - DNA, 22 bp, Artificial Sequence
  chemically synthesized
ggtctctatttcttaatctcaa

SEQ ID NO: 1352503 - DNA, 22 bp, Artificial Sequence
  chemically synthesized
gaacctaggtctctatttctta

SEQ ID NO: 1352504 - DNA, 22 bp, Artificial Sequence
  chemically synthesized
tggttgagattaagaaatagag

SEQ ID NO: 1352505 - DNA, 22 bp, Artificial Sequence
  chemically synthesized
ggttgagattaagaaatagaga

SEQ ID NO: 1352506 - DNA, 22 bp, Artificial Sequence
  chemically synthesized
gttgagattaagaaatagagac

SEQ ID NO: 1352507 - DNA, 22 bp, Artificial Sequence
  chemically synthesized
agattaagaaatagagacctag

SEQ ID NO: 1352508 - DNA, 22 bp, Artificial Sequence
  chemically synthesized
tatcattagaacctaggtctct

SEQ ID NO: 1352509 - DNA, 22 bp, Artificial Sequence
  chemically synthesized
agaaatagagacctaggttcta

SEQ ID NO: 1352510 - DNA, 22 bp, Artificial Sequence
  chemically synthesized
gtcagttatatcattagaacct

SEQ ID NO: 1352511 - DNA, 22 bp, Artificial Sequence
  chemically synthesized
agtcagttatatcattagaacc

SEQ ID NO: 1352512 - DNA, 22 bp, Artificial Sequence
  chemically synthesized
tagtcagttatatcattagaac

SEQ ID NO: 1352513 - DNA, 22 bp, Artificial Sequence
  chemically synthesized
tctttagtcagttatatcatta

SEQ ID NO: 1352514 - DNA, 22 bp, Artificial Sequence
  chemically synthesized
atctttagtcagttatatcatt

SEQ ID NO: 1352515 - DNA, 22 bp, Artificial Sequence
  chemically synthesized
tatctttagtcagttatatcat

SEQ ID NO: 1352516 - DNA, 22 bp, Artificial Sequence
  chemically synthesized
attttatctttagtcagttata

SEQ ID NO: 1352517 - DNA, 22 bp, Artificial Sequence
  chemically synthesized
ggttctaatgatataactgact

SEQ ID NO: 1352518 - DNA, 22 bp, Artificial Sequence
  chemically synthesized
gattaattttatctttagtcag

SEQ ID NO: 1352519 - DNA, 22 bp, Artificial Sequence
  chemically synthesized
taatgatataactgactaaaga

SEQ ID NO: 1352520 - DNA, 22 bp, Artificial Sequence
  chemically synthesized
atgatataactgactaaagata

SEQ ID NO: 1352521 - DNA, 22 bp, Artificial Sequence
  chemically synthesized
aataattggattaattttatct

SEQ ID NO: 1352522 - DNA, 22 bp, Artificial Sequence
  chemically synthesized
caataattggattaattttatc

SEQ ID NO: 1352523 - DNA, 22 bp, Artificial Sequence
  chemically synthesized
tcaataattggattaattttat

SEQ ID NO: 1352524 - DNA, 22 bp, Artificial Sequence
  chemically synthesized
actaaagataaaattaatccaa

SEQ ID NO: 1352525 - DNA, 22 bp, Artificial Sequence
  chemically synthesized
aaactttcaataattggattaa

SEQ ID NO: 1352526 - DNA, 22 bp, Artificial Sequence
  chemically synthesized
aagataaaattaatccaattat

SEQ ID NO: 1352527 - DNA, 22 bp, Artificial Sequence
  chemically synthesized
aggtgctgaaactttcaataat

SEQ ID NO: 1352528 - DNA, 22 bp, Artificial Sequence
  chemically synthesized
atccaattattgaaagtttcag

SEQ ID NO: 1352529 - DNA, 22 bp, Artificial Sequence
  chemically synthesized
aagaggcaactgaggtgctgaa

SEQ ID NO: 1352530 - DNA, 22 bp, Artificial Sequence
  chemically synthesized
aaagaggcaactgaggtgctga

SEQ ID NO: 1352531 - DNA, 22 bp, Artificial Sequence
  chemically synthesized
ttgaaagtttcagcacctcagt

SEQ ID NO: 1352532 - DNA, 22 bp, Artificial Sequence
  chemically synthesized
tttaaagaggcaactgaggtgc

SEQ ID NO: 1352533 - DNA, 22 bp, Artificial Sequence
  chemically synthesized
aaagtttcagcacctcagttgc

SEQ ID NO: 1352534 - DNA, 22 bp, Artificial Sequence
  chemically synthesized
attgtttaaagaggcaactgag

SEQ ID NO: 1352535 - DNA, 22 bp, Artificial Sequence
  chemically synthesized
actcattgtttaaagaggcaac

SEQ ID NO: 1352536 - DNA, 22 bp, Artificial Sequence
  chemically synthesized
cagcacctcagttgcctcttta

SEQ ID NO: 1352537 - DNA, 22 bp, Artificial Sequence
  chemically synthesized
agcacctcagttgcctctttaa

SEQ ID NO: 1352538 - DNA, 22 bp, Artificial Sequence
  chemically synthesized
actaactcattgtttaaagagg

SEQ ID NO: 1352539 - DNA, 22 bp, Artificial Sequence
  chemically synthesized
agttgcctctttaaacaatgag

SEQ ID NO: 1352540 - DNA, 22 bp, Artificial Sequence
  chemically synthesized
cctctttaaacaatgagttagt

SEQ ID NO: 1352541 - DNA, 22 bp, Artificial Sequence
  chemically synthesized
tttaaacaatgagttagttaga

SEQ ID NO: 1352542 - DNA, 22 bp, Artificial Sequence
  chemically synthesized
tcagtcatgtaatctaactaac

SEQ ID NO: 1352543 - DNA, 22 bp, Artificial Sequence
  chemically synthesized
taaacaatgagttagttagatt

SEQ ID NO: 1352544 - DNA, 22 bp, Artificial Sequence
  chemically synthesized
aaacaatgagttagttagatta

SEQ ID NO: 1352545 - DNA, 22 bp, Artificial Sequence
  chemically synthesized
aacaatgagttagttagattac

SEQ ID NO: 1352546 - DNA, 22 bp, Artificial Sequence
  chemically synthesized
gacaactgtcagtcatgtaatc

SEQ ID NO: 1352547 - DNA, 22 bp, Artificial Sequence
  chemically synthesized
gatctagacaactgtcagtcat

SEQ ID NO: 1352548 - DNA, 22 bp, Artificial Sequence
  chemically synthesized
agatctagacaactgtcagtca

SEQ ID NO: 1352549 - DNA, 22 bp, Artificial Sequence
  chemically synthesized
gttagattacatgactgacagt

SEQ ID NO: 1352550 - DNA, 22 bp, Artificial Sequence
  chemically synthesized
tagatctagacaactgtcagtc

SEQ ID NO: 1352551 - DNA, 22 bp, Artificial Sequence
  chemically synthesized
gattacatgactgacagttgtc

SEQ ID NO: 1352552 - DNA, 22 bp, Artificial Sequence
  chemically synthesized
catgactgacagttgtctagat

SEQ ID NO: 1352553 - DNA, 22 bp, Artificial Sequence
  chemically synthesized
gatccaatgattttagatctag

SEQ ID NO: 1352554 - DNA, 22 bp, Artificial Sequence
  chemically synthesized
acagttgtctagatctaaaatc

SEQ ID NO: 1352555 - DNA, 22 bp, Artificial Sequence
  chemically synthesized
attggatccaatgattttagat

SEQ ID NO: 1352556 - DNA, 22 bp, Artificial Sequence
  chemically synthesized
tctagatctaaaatcattggat

SEQ ID NO: 1352557 - DNA, 22 bp, Artificial Sequence
  chemically synthesized
gatctaaaatcattggatccaa

SEQ ID NO: 1352558 - DNA, 22 bp, Artificial Sequence
  chemically synthesized
atgaaaatcaattgattggatc

SEQ ID NO: 1352559 - DNA, 22 bp, Artificial Sequence
  chemically synthesized
aaatcattggatccaatcaatt

SEQ ID NO: 1352560 - DNA, 22 bp, Artificial Sequence
  chemically synthesized
attcatgaaaatcaattgattg

SEQ ID NO: 1352561 - DNA, 22 bp, Artificial Sequence
  chemically synthesized
ttcattcatgaaaatcaattga

SEQ ID NO: 1352562 - DNA, 22 bp, Artificial Sequence
  chemically synthesized
gttcattcatgaaaatcaattg

SEQ ID NO: 1352563 - DNA, 22 bp, Artificial Sequence
  chemically synthesized
tgttcattcatgaaaatcaatt

SEQ ID NO: 1352564 - DNA, 22 bp, Artificial Sequence
  chemically synthesized
gatccaatcaattgattttcat

SEQ ID NO: 1352565 - DNA, 22 bp, Artificial Sequence
  chemically synthesized
aatgtctttgttcattcatgaa

SEQ ID NO: 1352566 - DNA, 22 bp, Artificial Sequence
  chemically synthesized
aaatgtctttgttcattcatga

SEQ ID NO: 1352567 - DNA, 22 bp, Artificial Sequence
  chemically synthesized
cagatttaaatgtctttgttca

SEQ ID NO: 1352568 - DNA, 22 bp, Artificial Sequence
  chemically synthesized
attttcatgaatgaacaaagac

SEQ ID NO: 1352569 - DNA, 22 bp, Artificial Sequence
  chemically synthesized
ccagatttaaatgtctttgttc

SEQ ID NO: 1352570 - DNA, 22 bp, Artificial Sequence
  chemically synthesized
cttccagatttaaatgtctttg

SEQ ID NO: 1352571 - DNA, 22 bp, Artificial Sequence
  chemically synthesized
tcatgaatgaacaaagacattt

SEQ ID NO: 1352572 - DNA, 22 bp, Artificial Sequence
  chemically synthesized
acttccagatttaaatgtcttt

SEQ ID NO: 1352573 - DNA, 22 bp, Artificial Sequence
  chemically synthesized
catgaatgaacaaagacattta

SEQ ID NO: 1352574 - DNA, 22 bp, Artificial Sequence
  chemically synthesized
atgaatgaacaaagacatttaa

SEQ ID NO: 1352575 - DNA, 22 bp, Artificial Sequence
  chemically synthesized
atagaacttacttccagattta

SEQ ID NO: 1352576 - DNA, 22 bp, Artificial Sequence
  chemically synthesized
aatagaacttacttccagattt

SEQ ID NO: 1352577 - DNA, 22 bp, Artificial Sequence
  chemically synthesized
ggtttaatagaacttacttcca

SEQ ID NO: 1352578 - DNA, 22 bp, Artificial Sequence
  chemically synthesized
aaatctggaagtaagttctatt

SEQ ID NO: 1352579 - DNA, 22 bp, Artificial Sequence
  chemically synthesized
aatctggaagtaagttctatta

SEQ ID NO: 1352580 - DNA, 22 bp, Artificial Sequence
  chemically synthesized
tcaagatactaggtttaataga

SEQ ID NO: 1352581 - DNA, 22 bp, Artificial Sequence
  chemically synthesized
gaagtaagttctattaaaccta

SEQ ID NO: 1352582 - DNA, 22 bp, Artificial Sequence
  chemically synthesized
gggttatcaagatactaggttt

SEQ ID NO: 1352583 - DNA, 22 bp, Artificial Sequence
  chemically synthesized
gcctggggttatcaagatacta

SEQ ID NO: 1352584 - DNA, 22 bp, Artificial Sequence
  chemically synthesized
tattaaacctagtatcttgata

SEQ ID NO: 1352585 - DNA, 22 bp, Artificial Sequence
  chemically synthesized
tctggcctggggttatcaagat

SEQ ID NO: 1352586 - DNA, 22 bp, Artificial Sequence
  chemically synthesized
ttaaacctagtatcttgataac

SEQ ID NO: 1352587 - DNA, 22 bp, Artificial Sequence
  chemically synthesized
atctggcctggggttatcaaga

SEQ ID NO: 1352588 - DNA, 22 bp, Artificial Sequence
  chemically synthesized
tatctggcctggggttatcaag

SEQ ID NO: 1352589 - DNA, 22 bp, Artificial Sequence
  chemically synthesized
aacctagtatcttgataacccc

SEQ ID NO: 1352590 - DNA, 22 bp, Artificial Sequence
  chemically synthesized
tagttttatctggcctggggtt

SEQ ID NO: 1352591 - DNA, 22 bp, Artificial Sequence
  chemically synthesized
atagttttatctggcctggggt

SEQ ID NO: 1352592 - DNA, 22 bp, Artificial Sequence
  chemically synthesized
gtatcttgataaccccaggcca

SEQ ID NO: 1352593 - DNA, 22 bp, Artificial Sequence
  chemically synthesized
tatagttttatctggcctgggg

SEQ ID NO: 1352594 - DNA, 22 bp, Artificial Sequence
  chemically synthesized
ttatagttttatctggcctggg

SEQ ID NO: 1352595 - DNA, 22 bp, Artificial Sequence
  chemically synthesized
tttatagttttatctggcctgg

SEQ ID NO: 1352596 - DNA, 22 bp, Artificial Sequence
  chemically synthesized
ttttatagttttatctggcctg

SEQ ID NO: 1352597 - DNA, 22 bp, Artificial Sequence
  chemically synthesized
tttttatagttttatctggcct

SEQ ID NO: 1352598 - DNA, 22 bp, Artificial Sequence
  chemically synthesized
ttttttatagttttatctggcc

SEQ ID NO: 1352599 - DNA, 22 bp, Artificial Sequence
  chemically synthesized
tttttttatagttttatctggc

SEQ ID NO: 1352600 - DNA, 22 bp, Artificial Sequence
  chemically synthesized
gataaccccaggccagataaaa

SEQ ID NO: 1352601 - DNA, 22 bp, Artificial Sequence
  chemically synthesized
ataaccccaggccagataaaac

SEQ ID NO: 1352602 - DNA, 22 bp, Artificial Sequence
  chemically synthesized
atatagagaccagtcatttttt

SEQ ID NO: 1352603 - DNA, 22 bp, Artificial Sequence
  chemically synthesized
taaaaaaaaaatgactggtctc

SEQ ID NO: 1352604 - DNA, 22 bp, Artificial Sequence
  chemically synthesized
taaaatggtgcccatcgactga

SEQ ID NO: 1352605 - DNA, 22 bp, Artificial Sequence
  chemically synthesized
gtctctatatcagtcgatgggc

SEQ ID NO: 1352606 - DNA, 22 bp, Artificial Sequence
  chemically synthesized
actataaaatggtgcccatcga

SEQ ID NO: 1352607 - DNA, 22 bp, Artificial Sequence
  chemically synthesized
tatatcagtcgatgggcaccat

SEQ ID NO: 1352608 - DNA, 22 bp, Artificial Sequence
  chemically synthesized
tatcagtcgatgggcaccattt

SEQ ID NO: 1352609 - DNA, 22 bp, Artificial Sequence
  chemically synthesized
aaataaattaactataaaatgg

SEQ ID NO: 1352610 - DNA, 22 bp, Artificial Sequence
  chemically synthesized
ctgaaataaattaactataaaa

SEQ ID NO: 1352611 - DNA, 22 bp, Artificial Sequence
  chemically synthesized
ccatgttcctgaaataaattaa

SEQ ID NO: 1352612 - DNA, 22 bp, Artificial Sequence
  chemically synthesized
taactgccatgttcctgaaata

SEQ ID NO: 1352613 - DNA, 22 bp, Artificial Sequence
  chemically synthesized
tatagttaatttatttcaggaa

SEQ ID NO: 1352614 - DNA, 22 bp, Artificial Sequence
  chemically synthesized
atagttaatttatttcaggaac

SEQ ID NO: 1352615 - DNA, 22 bp, Artificial Sequence
  chemically synthesized
tagttaatttatttcaggaaca

SEQ ID NO: 1352616 - DNA, 22 bp, Artificial Sequence
  chemically synthesized
tgttataactgccatgttcctg

SEQ ID NO: 1352617 - DNA, 22 bp, Artificial Sequence
  chemically synthesized
atttatttcaggaacatggcag

SEQ ID NO: 1352618 - DNA, 22 bp, Artificial Sequence
  chemically synthesized
cctgtgttataactgccatgtt

SEQ ID NO: 1352619 - DNA, 22 bp, Artificial Sequence
  chemically synthesized
atttcaggaacatggcagttat

SEQ ID NO: 1352620 - DNA, 22 bp, Artificial Sequence
  chemically synthesized
tttcaggaacatggcagttata

SEQ ID NO: 1352621 - DNA, 22 bp, Artificial Sequence
  chemically synthesized
tagttacctgtgttataactgc

SEQ ID NO: 1352622 - DNA, 22 bp, Artificial Sequence
  chemically synthesized
caggaacatggcagttataaca

SEQ ID NO: 1352623 - DNA, 22 bp, Artificial Sequence
  chemically synthesized
aggaacatggcagttataacac

SEQ ID NO: 1352624 - DNA, 22 bp, Artificial Sequence
  chemically synthesized
tcctatagttacctgtgttata

SEQ ID NO: 1352625 - DNA, 22 bp, Artificial Sequence
  chemically synthesized
gtcctatagttacctgtgttat

SEQ ID NO: 1352626 - DNA, 22 bp, Artificial Sequence
  chemically synthesized
ccagcttgtcctatagttacct

SEQ ID NO: 1352627 - DNA, 22 bp, Artificial Sequence
  chemically synthesized
accagcttgtcctatagttacc

SEQ ID NO: 1352628 - DNA, 22 bp, Artificial Sequence
  chemically synthesized
taacacaggtaactataggaca

SEQ ID NO: 1352629 - DNA, 22 bp, Artificial Sequence
  chemically synthesized
caatgaggtttaccagcttgtc

SEQ ID NO: 1352630 - DNA, 22 bp, Artificial Sequence
  chemically synthesized
cctacaatgaggtttaccagct

SEQ ID NO: 1352631 - DNA, 22 bp, Artificial Sequence
  chemically synthesized
taggacaagctggtaaacctca

SEQ ID NO: 1352632 - DNA, 22 bp, Artificial Sequence
  chemically synthesized
agtgattacctacaatgaggtt

SEQ ID NO: 1352633 - DNA, 22 bp, Artificial Sequence
  chemically synthesized
agctcagtgattacctacaatg

SEQ ID NO: 1352634 - DNA, 22 bp, Artificial Sequence
  chemically synthesized
gtaaacctcattgtaggtaatc

SEQ ID NO: 1352635 - DNA, 22 bp, Artificial Sequence
  chemically synthesized
cctgagctcagtgattacctac

SEQ ID NO: 1352636 - DNA, 22 bp, Artificial Sequence
  chemically synthesized
cctccctgagctcagtgattac

SEQ ID NO: 1352637 - DNA, 22 bp, Artificial Sequence
  chemically synthesized
attgtaggtaatcactgagctc

SEQ ID NO: 1352638 - DNA, 22 bp, Artificial Sequence
  chemically synthesized
taggtaatcactgagctcaggg

SEQ ID NO: 1352639 - DNA, 22 bp, Artificial Sequence
  chemically synthesized
tccaccacatcatgctacctcc

SEQ ID NO: 1352640 - DNA, 22 bp, Artificial Sequence
  chemically synthesized
ttatccaccacatcatgctacc

SEQ ID NO: 1352641 - DNA, 22 bp, Artificial Sequence
  chemically synthesized
agctcagggaggtagcatgatg

SEQ ID NO: 1352642 - DNA, 22 bp, Artificial Sequence
  chemically synthesized
ctgttatccaccacatcatgct

SEQ ID NO: 1352643 - DNA, 22 bp, Artificial Sequence
  chemically synthesized
gctgttatccaccacatcatgc

SEQ ID NO: 1352644 - DNA, 22 bp, Artificial Sequence
  chemically synthesized
agggaggtagcatgatgtggtg

SEQ ID NO: 1352645 - DNA, 22 bp, Artificial Sequence
  chemically synthesized
tcccttgctgttatccaccaca

SEQ ID NO: 1352646 - DNA, 22 bp, Artificial Sequence
  chemically synthesized
cctatcccttgctgttatccac

SEQ ID NO: 1352647 - DNA, 22 bp, Artificial Sequence
  chemically synthesized
ccctatcccttgctgttatcca

SEQ ID NO: 1352648 - DNA, 22 bp, Artificial Sequence
  chemically synthesized
cttccctatcccttgctgttat

SEQ ID NO: 1352649 - DNA, 22 bp, Artificial Sequence
  chemically synthesized
tccttccctatcccttgctgtt

SEQ ID NO: 1352650 - DNA, 22 bp, Artificial Sequence
  chemically synthesized
ctccttccctatcccttgctgt

SEQ ID NO: 1352651 - DNA, 22 bp, Artificial Sequence
  chemically synthesized
tctccttccctatcccttgctg

SEQ ID NO: 1352652 - DNA, 22 bp, Artificial Sequence
  chemically synthesized
aaagtcaaactttctccttccc

SEQ ID NO: 1352653 - DNA, 22 bp, Artificial Sequence
  chemically synthesized
gaaagtcaaactttctccttcc

SEQ ID NO: 1352654 - DNA, 22 bp, Artificial Sequence
  chemically synthesized
tgaaagtcaaactttctccttc

SEQ ID NO: 1352655 - DNA, 22 bp, Artificial Sequence
  chemically synthesized
gactttgaaagtcaaactttct

SEQ ID NO: 1352656 - DNA, 22 bp, Artificial Sequence
  chemically synthesized
gaattagactttgaaagtcaaa

SEQ ID NO: 1352657 - DNA, 22 bp, Artificial Sequence
  chemically synthesized
agttagaattagactttgaaag

SEQ ID NO: 1352658 - DNA, 22 bp, Artificial Sequence
  chemically synthesized
tgagttagaattagactttgaa

SEQ ID NO: 1352659 - DNA, 22 bp, Artificial Sequence
  chemically synthesized
gactttcaaagtctaattctaa

SEQ ID NO: 1352660 - DNA, 22 bp, Artificial Sequence
  chemically synthesized
actttcaaagtctaattctaac

SEQ ID NO: 1352661 - DNA, 22 bp, Artificial Sequence
  chemically synthesized
tcaaagtctaattctaactcag

SEQ ID NO: 1352662 - DNA, 22 bp, Artificial Sequence
  chemically synthesized
caaagtctaattctaactcaga

SEQ ID NO: 1352663 - DNA, 22 bp, Artificial Sequence
  chemically synthesized
cagatgaagaattctgagttag

SEQ ID NO: 1352664 - DNA, 22 bp, Artificial Sequence
  chemically synthesized
aaagtctaattctaactcagaa

SEQ ID NO: 1352665 - DNA, 22 bp, Artificial Sequence
  chemically synthesized
acagatgaagaattctgagtta

SEQ ID NO: 1352666 - DNA, 22 bp, Artificial Sequence
  chemically synthesized
tacagatgaagaattctgagtt

SEQ ID NO: 1352667 - DNA, 22 bp, Artificial Sequence
  chemically synthesized
ccattttacagatgaagaattc

SEQ ID NO: 1352668 - DNA, 22 bp, Artificial Sequence
  chemically synthesized
attctaactcagaattcttcat

SEQ ID NO: 1352669 - DNA, 22 bp, Artificial Sequence
  chemically synthesized
ttcccattttacagatgaagaa

SEQ ID NO: 1352670 - DNA, 22 bp, Artificial Sequence
  chemically synthesized
taactcagaattcttcatctgt

SEQ ID NO: 1352671 - DNA, 22 bp, Artificial Sequence
  chemically synthesized
ttgttcccattttacagatgaa

SEQ ID NO: 1352672 - DNA, 22 bp, Artificial Sequence
  chemically synthesized
actcagaattcttcatctgtaa

SEQ ID NO: 1352673 - DNA, 22 bp, Artificial Sequence
  chemically synthesized
ttattgttcccattttacagat

SEQ ID NO: 1352674 - DNA, 22 bp, Artificial Sequence
  chemically synthesized
agaattcttcatctgtaaaatg

SEQ ID NO: 1352675 - DNA, 22 bp, Artificial Sequence
  chemically synthesized
ttcatctgtaaaatgggaacaa

SEQ ID NO: 1352676 - DNA, 22 bp, Artificial Sequence
  chemically synthesized
catctgtaaaatgggaacaata

SEQ ID NO: 1352677 - DNA, 22 bp, Artificial Sequence
  chemically synthesized
tgagagagctattattgttccc

SEQ ID NO: 1352678 - DNA, 22 bp, Artificial Sequence
  chemically synthesized
atctgtaaaatgggaacaataa

SEQ ID NO: 1352679 - DNA, 22 bp, Artificial Sequence
  chemically synthesized
taaaatgggaacaataatagct

SEQ ID NO: 1352680 - DNA, 22 bp, Artificial Sequence
  chemically synthesized
ggacaagcctgtgagagagcta

SEQ ID NO: 1352681 - DNA, 22 bp, Artificial Sequence
  chemically synthesized
aggacaagcctgtgagagagct

SEQ ID NO: 1352682 - DNA, 22 bp, Artificial Sequence
  chemically synthesized
tgtgagtaaatacttaggacaa

SEQ ID NO: 1352683 - DNA, 22 bp, Artificial Sequence
  chemically synthesized
tctcacaggcttgtcctaagta

SEQ ID NO: 1352684 - DNA, 22 bp, Artificial Sequence
  chemically synthesized
tcacaggcttgtcctaagtatt

SEQ ID NO: 1352685 - DNA, 22 bp, Artificial Sequence
  chemically synthesized
acaggcttgtcctaagtattta

SEQ ID NO: 1352686 - DNA, 22 bp, Artificial Sequence
  chemically synthesized
tgtatattatgtgagtaaatac

SEQ ID NO: 1352687 - DNA, 22 bp, Artificial Sequence
  chemically synthesized
gtgtatattatgtgagtaaata

SEQ ID NO: 1352688 - DNA, 22 bp, Artificial Sequence
  chemically synthesized
tgtgtatattatgtgagtaaat

SEQ ID NO: 1352689 - DNA, 22 bp, Artificial Sequence
  chemically synthesized
gtcctaagtatttactcacata

SEQ ID NO: 1352690 - DNA, 22 bp, Artificial Sequence
  chemically synthesized
tcctaagtatttactcacataa

SEQ ID NO: 1352691 - DNA, 22 bp, Artificial Sequence
  chemically synthesized
agtatttactcacataatatac

SEQ ID NO: 1352692 - DNA, 22 bp, Artificial Sequence
  chemically synthesized
taataagagctttgtgtatatt

SEQ ID NO: 1352693 - DNA, 22 bp, Artificial Sequence
  chemically synthesized
actcacataatatacacaaagc

SEQ ID NO: 1352694 - DNA, 22 bp, Artificial Sequence
  chemically synthesized
ctcacataatatacacaaagct

SEQ ID NO: 1352695 - DNA, 22 bp, Artificial Sequence
  chemically synthesized
cgtactgtaataagagctttgt

SEQ ID NO: 1352696 - DNA, 22 bp, Artificial Sequence
  chemically synthesized
acataatatacacaaagctctt

SEQ ID NO: 1352697 - DNA, 22 bp, Artificial Sequence
  chemically synthesized
tgctacgtactgtaataagagc

SEQ ID NO: 1352698 - DNA, 22 bp, Artificial Sequence
  chemically synthesized
gtgctacgtactgtaataagag

SEQ ID NO: 1352699 - DNA, 22 bp, Artificial Sequence
  chemically synthesized
tgtgctacgtactgtaataaga

SEQ ID NO: 1352700 - DNA, 22 bp, Artificial Sequence
  chemically synthesized
ctttgtgctacgtactgtaata

SEQ ID NO: 1352701 - DNA, 22 bp, Artificial Sequence
  chemically synthesized
actttgtgctacgtactgtaat

SEQ ID NO: 1352702 - DNA, 22 bp, Artificial Sequence
  chemically synthesized
agtacttactttgtgctacgta

SEQ ID NO: 1352703 - DNA, 22 bp, Artificial Sequence
  chemically synthesized
gagtacttactttgtgctacgt

SEQ ID NO: 1352704 - DNA, 22 bp, Artificial Sequence
  chemically synthesized
tgagtacttactttgtgctacg

SEQ ID NO: 1352705 - DNA, 22 bp, Artificial Sequence
  chemically synthesized
ttattacagtacgtagcacaaa

SEQ ID NO: 1352706 - DNA, 22 bp, Artificial Sequence
  chemically synthesized
attacagtacgtagcacaaagt

SEQ ID NO: 1352707 - DNA, 22 bp, Artificial Sequence
  chemically synthesized
ttacagtacgtagcacaaagta

SEQ ID NO: 1352708 - DNA, 22 bp, Artificial Sequence
  chemically synthesized
cagtacgtagcacaaagtaagt

SEQ ID NO: 1352709 - DNA, 22 bp, Artificial Sequence
  chemically synthesized
ataatgacatatggcaaatttt

SEQ ID NO: 1352710 - DNA, 22 bp, Artificial Sequence
  chemically synthesized
cgcagctaataatgacatatgg

SEQ ID NO: 1352711 - DNA, 22 bp, Artificial Sequence
  chemically synthesized
aaaatttgccatatgtcattat

SEQ ID NO: 1352712 - DNA, 22 bp, Artificial Sequence
  chemically synthesized
gccatatgtcattattagctgc

SEQ ID NO: 1352713 - DNA, 22 bp, Artificial Sequence
  chemically synthesized
ccatatgtcattattagctgcg

SEQ ID NO: 1352714 - DNA, 22 bp, Artificial Sequence
  chemically synthesized
gtcagtgcaatagctccgcagc

SEQ ID NO: 1352715 - DNA, 22 bp, Artificial Sequence
  chemically synthesized
ggtcagtgcaatagctccgcag

SEQ ID NO: 1352716 - DNA, 22 bp, Artificial Sequence
  chemically synthesized
ttagctgcggagctattgcact

SEQ ID NO: 1352717 - DNA, 22 bp, Artificial Sequence
  chemically synthesized
aagcacttggtcagtgcaatag

SEQ ID NO: 1352718 - DNA, 22 bp, Artificial Sequence
  chemically synthesized
caagcacttggtcagtgcaata

SEQ ID NO: 1352719 - DNA, 22 bp, Artificial Sequence
  chemically synthesized
tcaagcacttggtcagtgcaat

SEQ ID NO: 1352720 - DNA, 22 bp, Artificial Sequence
  chemically synthesized
gctgcggagctattgcactgac

SEQ ID NO: 1352721 - DNA, 22 bp, Artificial Sequence
  chemically synthesized
ttcaagcacttggtcagtgcaa

SEQ ID NO: 1352722 - DNA, 22 bp, Artificial Sequence
  chemically synthesized
tttcaagcacttggtcagtgca

SEQ ID NO: 1352723 - DNA, 22 bp, Artificial Sequence
  chemically synthesized
cggagctattgcactgaccaag

SEQ ID NO: 1352724 - DNA, 22 bp, Artificial Sequence
  chemically synthesized
ttttttcaagcacttggtcagt

SEQ ID NO: 1352725 - DNA, 22 bp, Artificial Sequence
  chemically synthesized
gttttttcaagcacttggtcag

SEQ ID NO: 1352726 - DNA, 22 bp, Artificial Sequence
  chemically synthesized
ttgcactgaccaagtgcttgaa

SEQ ID NO: 1352727 - DNA, 22 bp, Artificial Sequence
  chemically synthesized
cactgaccaagtgcttgaaaaa

SEQ ID NO: 1352728 - DNA, 22 bp, Artificial Sequence
  chemically synthesized
accaagtgcttgaaaaaacaaa

SEQ ID NO: 1352729 - DNA, 22 bp, Artificial Sequence
  chemically synthesized
acgccaaaggaaatgatttgtt

SEQ ID NO: 1352730 - DNA, 22 bp, Artificial Sequence
  chemically synthesized
acactcacgccaaaggaaatga

SEQ ID NO: 1352731 - DNA, 22 bp, Artificial Sequence
  chemically synthesized
gaaaaaacaaatcatttccttt

SEQ ID NO: 1352732 - DNA, 22 bp, Artificial Sequence
  chemically synthesized
aaaaaacaaatcatttcctttg

SEQ ID NO: 1352733 - DNA, 22 bp, Artificial Sequence
  chemically synthesized
tgcattaacactcacgccaaag

SEQ ID NO: 1352734 - DNA, 22 bp, Artificial Sequence
  chemically synthesized
tgtgcattaacactcacgccaa

SEQ ID NO: 1352735 - DNA, 22 bp, Artificial Sequence
  chemically synthesized
aaagcctctgtgcattaacact

SEQ ID NO: 1352736 - DNA, 22 bp, Artificial Sequence
  chemically synthesized
cctttggcgtgagtgttaatgc

SEQ ID NO: 1352737 - DNA, 22 bp, Artificial Sequence
  chemically synthesized
caaagcctctgtgcattaacac

SEQ ID NO: 1352738 - DNA, 22 bp, Artificial Sequence
  chemically synthesized
ctttggcgtgagtgttaatgca

SEQ ID NO: 1352739 - DNA, 22 bp, Artificial Sequence
  chemically synthesized
tcaaagcctctgtgcattaaca

SEQ ID NO: 1352740 - DNA, 22 bp, Artificial Sequence
  chemically synthesized
ttcaaagcctctgtgcattaac

SEQ ID NO: 1352741 - DNA, 22 bp, Artificial Sequence
  chemically synthesized
tggcgtgagtgttaatgcacag

SEQ ID NO: 1352742 - DNA, 22 bp, Artificial Sequence
  chemically synthesized
ggcgtgagtgttaatgcacaga

SEQ ID NO: 1352743 - DNA, 22 bp, Artificial Sequence
  chemically synthesized
gcgtgagtgttaatgcacagag

SEQ ID NO: 1352744 - DNA, 22 bp, Artificial Sequence
  chemically synthesized
acatagtatttttcaaagcctc

SEQ ID NO: 1352745 - DNA, 22 bp, Artificial Sequence
  chemically synthesized
cacatagtatttttcaaagcct

SEQ ID NO: 1352746 - DNA, 22 bp, Artificial Sequence
  chemically synthesized
tcacatagtatttttcaaagcc

SEQ ID NO: 1352747 - DNA, 22 bp, Artificial Sequence
  chemically synthesized
atgcacagaggctttgaaaaat

SEQ ID NO: 1352748 - DNA, 22 bp, Artificial Sequence
  chemically synthesized
atgactttcacatagtattttt

SEQ ID NO: 1352749 - DNA, 22 bp, Artificial Sequence
  chemically synthesized
aatgactttcacatagtatttt

SEQ ID NO: 1352750 - DNA, 22 bp, Artificial Sequence
  chemically synthesized
taatgactttcacatagtattt

SEQ ID NO: 1352751 - DNA, 22 bp, Artificial Sequence
  chemically synthesized
ttaatgactttcacatagtatt

SEQ ID NO: 1352752 - DNA, 22 bp, Artificial Sequence
  chemically synthesized
tttaatgactttcacatagtat

SEQ ID NO: 1352753 - DNA, 22 bp, Artificial Sequence
  chemically synthesized
ttttaatgactttcacatagta

SEQ ID NO: 1352754 - DNA, 22 bp, Artificial Sequence
  chemically synthesized
tttttaatgactttcacatagt

SEQ ID NO: 1352755 - DNA, 22 bp, Artificial Sequence
  chemically synthesized
tttttttaatgactttcacata

SEQ ID NO: 1352756 - DNA, 22 bp, Artificial Sequence
  chemically synthesized
ctttttttaatgactttcacat

SEQ ID NO: 1352757 - DNA, 22 bp, Artificial Sequence
  chemically synthesized
tgaaaaatactatgtgaaagtc

SEQ ID NO: 1352758 - DNA, 22 bp, Artificial Sequence
  chemically synthesized
tctttttttaatgactttcaca

SEQ ID NO: 1352759 - DNA, 22 bp, Artificial Sequence
  chemically synthesized
gaaaaatactatgtgaaagtca

SEQ ID NO: 1352760 - DNA, 22 bp, Artificial Sequence
  chemically synthesized
aaaaatactatgtgaaagtcat

SEQ ID NO: 1352761 - DNA, 22 bp, Artificial Sequence
  chemically synthesized
agaggttttctttttttaatga

SEQ ID NO: 1352762 - DNA, 22 bp, Artificial Sequence
  chemically synthesized
ctgagaggttttctttttttaa

SEQ ID NO: 1352763 - DNA, 22 bp, Artificial Sequence
  chemically synthesized
tgtgaaagtcattaaaaaaaga

SEQ ID NO: 1352764 - DNA, 22 bp, Artificial Sequence
  chemically synthesized
atctgctgagaggttttctttt

SEQ ID NO: 1352765 - DNA, 22 bp, Artificial Sequence
  chemically synthesized
aaaaaagaaaacctctcagcag

SEQ ID NO: 1352766 - DNA, 22 bp, Artificial Sequence
  chemically synthesized
aaggaagctaatctgctgagag

SEQ ID NO: 1352767 - DNA, 22 bp, Artificial Sequence
  chemically synthesized
caaaggttgaaggaagctaatc

SEQ ID NO: 1352768 - DNA, 22 bp, Artificial Sequence
  chemically synthesized
acaaaggttgaaggaagctaat

SEQ ID NO: 1352769 - DNA, 22 bp, Artificial Sequence
  chemically synthesized
tcagcagattagcttccttcaa

SEQ ID NO: 1352770 - DNA, 22 bp, Artificial Sequence
  chemically synthesized
agcagattagcttccttcaacc

SEQ ID NO: 1352771 - DNA, 22 bp, Artificial Sequence
  chemically synthesized
gcttccttcaacctttgtaaga

SEQ ID NO: 1352772 - DNA, 22 bp, Artificial Sequence
  chemically synthesized
ccttcaacctttgtaagatcct

SEQ ID NO: 1352773 - DNA, 22 bp, Artificial Sequence
  chemically synthesized
gccgtcaaaagcaggatcttac

SEQ ID NO: 1352774 - DNA, 22 bp, Artificial Sequence
  chemically synthesized
cttcaacctttgtaagatcctg

SEQ ID NO: 1352775 - DNA, 22 bp, Artificial Sequence
  chemically synthesized
caacctttgtaagatcctgctt

SEQ ID NO: 1352776 - DNA, 22 bp, Artificial Sequence
  chemically synthesized
aacctttgtaagatcctgcttt

SEQ ID NO: 1352777 - DNA, 22 bp, Artificial Sequence
  chemically synthesized
ggttggccgtcaaaagcaggat

SEQ ID NO: 1352778 - DNA, 22 bp, Artificial Sequence
  chemically synthesized
tgtaagatcctgcttttgacgg

SEQ ID NO: 1352779 - DNA, 22 bp, Artificial Sequence
  chemically synthesized
gtaagatcctgcttttgacggc

SEQ ID NO: 1352780 - DNA, 22 bp, Artificial Sequence
  chemically synthesized
taagatcctgcttttgacggcc

SEQ ID NO: 1352781 - DNA, 22 bp, Artificial Sequence
  chemically synthesized
cttttgacggccaacccagtgc

SEQ ID NO: 1352782 - DNA, 22 bp, Artificial Sequence
  chemically synthesized
ttgacggccaacccagtgcttt

SEQ ID NO: 1352783 - DNA, 22 bp, Artificial Sequence
  chemically synthesized
tgacggccaacccagtgctttc

SEQ ID NO: 1352784 - DNA, 22 bp, Artificial Sequence
  chemically synthesized
gacggccaacccagtgctttcc

SEQ ID NO: 1352785 - DNA, 22 bp, Artificial Sequence
  chemically synthesized
acggccaacccagtgctttcca

SEQ ID NO: 1352786 - DNA, 22 bp, Artificial Sequence
  chemically synthesized
tccacactttctcacacattgc

SEQ ID NO: 1352787 - DNA, 22 bp, Artificial Sequence
  chemically synthesized
ccacactttctcacacattgcc

SEQ ID NO: 1352788 - DNA, 22 bp, Artificial Sequence
  chemically synthesized
cacactttctcacacattgcct

SEQ ID NO: 1352789 - DNA, 22 bp, Artificial Sequence
  chemically synthesized
accagaaataacaggcaatgtg

SEQ ID NO: 1352790 - DNA, 22 bp, Artificial Sequence
  chemically synthesized
ctgaccagaaataacaggcaat

SEQ ID NO: 1352791 - DNA, 22 bp, Artificial Sequence
  chemically synthesized
cctgaccagaaataacaggcaa

SEQ ID NO: 1352792 - DNA, 22 bp, Artificial Sequence
  chemically synthesized
tcctgaccagaaataacaggca

SEQ ID NO: 1352793 - DNA, 22 bp, Artificial Sequence
  chemically synthesized
tctcacacattgcctgttattt

SEQ ID NO: 1352794 - DNA, 22 bp, Artificial Sequence
  chemically synthesized
ctcacacattgcctgttatttc

SEQ ID NO: 1352795 - DNA, 22 bp, Artificial Sequence
  chemically synthesized
ttttcctgaccagaaataacag

SEQ ID NO: 1352796 - DNA, 22 bp, Artificial Sequence
  chemically synthesized
tcacacattgcctgttatttct

SEQ ID NO: 1352797 - DNA, 22 bp, Artificial Sequence
  chemically synthesized
attttcctgaccagaaataaca

SEQ ID NO: 1352798 - DNA, 22 bp, Artificial Sequence
  chemically synthesized
acacattgcctgttatttctgg

SEQ ID NO: 1352799 - DNA, 22 bp, Artificial Sequence
  chemically synthesized
tttattttcctgaccagaaata

SEQ ID NO: 1352800 - DNA, 22 bp, Artificial Sequence
  chemically synthesized
atttattttcctgaccagaaat

SEQ ID NO: 1352801 - DNA, 22 bp, Artificial Sequence
  chemically synthesized
tttatttattttcctgaccaga

SEQ ID NO: 1352802 - DNA, 22 bp, Artificial Sequence
  chemically synthesized
atttatttattttcctgaccag

SEQ ID NO: 1352803 - DNA, 22 bp, Artificial Sequence
  chemically synthesized
cctgttatttctggtcaggaaa

SEQ ID NO: 1352804 - DNA, 22 bp, Artificial Sequence
  chemically synthesized
ttatttctggtcaggaaaataa

SEQ ID NO: 1352805 - DNA, 22 bp, Artificial Sequence
  chemically synthesized
tttctggtcaggaaaataaata

SEQ ID NO: 1352806 - DNA, 22 bp, Artificial Sequence
  chemically synthesized
ctggtcaggaaaataaataaat

SEQ ID NO: 1352807 - DNA, 22 bp, Artificial Sequence
  chemically synthesized
tggtcaggaaaataaataaata

SEQ ID NO: 1352808 - DNA, 22 bp, Artificial Sequence
  chemically synthesized
gtcaggaaaataaataaataag

SEQ ID NO: 1352809 - DNA, 22 bp, Artificial Sequence
  chemically synthesized
gccagatgggcacttatttatt

SEQ ID NO: 1352810 - DNA, 22 bp, Artificial Sequence
  chemically synthesized
ggccagatgggcacttatttat

SEQ ID NO: 1352811 - DNA, 22 bp, Artificial Sequence
  chemically synthesized
atataaaggtggaaaaatactt

SEQ ID NO: 1352812 - DNA, 22 bp, Artificial Sequence
  chemically synthesized
gttcatataaaggtggaaaaat

SEQ ID NO: 1352813 - DNA, 22 bp, Artificial Sequence
  chemically synthesized
tggttcatataaaggtggaaaa

SEQ ID NO: 1352814 - DNA, 22 bp, Artificial Sequence
  chemically synthesized
ctggttcatataaaggtggaaa

SEQ ID NO: 1352815 - DNA, 22 bp, Artificial Sequence
  chemically synthesized
gccaagtatttttccaccttta

SEQ ID NO: 1352816 - DNA, 22 bp, Artificial Sequence
  chemically synthesized
gtatttctggttcatataaagg

SEQ ID NO: 1352817 - DNA, 22 bp, Artificial Sequence
  chemically synthesized
ttccacctttatatgaaccaga

SEQ ID NO: 1352818 - DNA, 22 bp, Artificial Sequence
  chemically synthesized
tccacctttatatgaaccagaa

SEQ ID NO: 1352819 - DNA, 22 bp, Artificial Sequence
  chemically synthesized
ccacctttatatgaaccagaaa

SEQ ID NO: 1352820 - DNA, 22 bp, Artificial Sequence
  chemically synthesized
cacctttatatgaaccagaaat

SEQ ID NO: 1352821 - DNA, 22 bp, Artificial Sequence
  chemically synthesized
gaaacaattggtatttctggtt

SEQ ID NO: 1352822 - DNA, 22 bp, Artificial Sequence
  chemically synthesized
tatatgaaccagaaataccaat

SEQ ID NO: 1352823 - DNA, 22 bp, Artificial Sequence
  chemically synthesized
atatgaaccagaaataccaatt

SEQ ID NO: 1352824 - DNA, 22 bp, Artificial Sequence
  chemically synthesized
tatgaaccagaaataccaattg

SEQ ID NO: 1352825 - DNA, 22 bp, Artificial Sequence
  chemically synthesized
gggaatacacattagaaacaat

SEQ ID NO: 1352826 - DNA, 22 bp, Artificial Sequence
  chemically synthesized
catctggggaatacacattaga

SEQ ID NO: 1352827 - DNA, 22 bp, Artificial Sequence
  chemically synthesized
tttctaatgtgtattccccaga

SEQ ID NO: 1352828 - DNA, 22 bp, Artificial Sequence
  chemically synthesized
ctaatgtgtattccccagatgc

SEQ ID NO: 1352829 - DNA, 22 bp, Artificial Sequence
  chemically synthesized
taatgtgtattccccagatgca

SEQ ID NO: 1352830 - DNA, 22 bp, Artificial Sequence
  chemically synthesized
atgtgtattccccagatgcaat

SEQ ID NO: 1352831 - DNA, 22 bp, Artificial Sequence
  chemically synthesized
taaatagaggataagtattgca

SEQ ID NO: 1352832 - DNA, 22 bp, Artificial Sequence
  chemically synthesized
gctgtaaatagaggataagtat

SEQ ID NO: 1352833 - DNA, 22 bp, Artificial Sequence
  chemically synthesized
agctgtaaatagaggataagta

SEQ ID NO: 1352834 - DNA, 22 bp, Artificial Sequence
  chemically synthesized
cccagatgcaatacttatcctc

SEQ ID NO: 1352835 - DNA, 22 bp, Artificial Sequence
  chemically synthesized
atcctctatttacagctaagcc

SEQ ID NO: 1352836 - DNA, 22 bp, Artificial Sequence
  chemically synthesized
tcctctatttacagctaagcca

SEQ ID NO: 1352837 - DNA, 22 bp, Artificial Sequence
  chemically synthesized
cacagtaatcagtggcttagct

SEQ ID NO: 1352838 - DNA, 22 bp, Artificial Sequence
  chemically synthesized
ccacagtaatcagtggcttagc

SEQ ID NO: 1352839 - DNA, 22 bp, Artificial Sequence
  chemically synthesized
tccacagtaatcagtggcttag

SEQ ID NO: 1352840 - DNA, 22 bp, Artificial Sequence
  chemically synthesized
tatttacagctaagccactgat

SEQ ID NO: 1352841 - DNA, 22 bp, Artificial Sequence
  chemically synthesized
tttacagctaagccactgatta

SEQ ID NO: 1352842 - DNA, 22 bp, Artificial Sequence
  chemically synthesized
acagctaagccactgattactg

SEQ ID NO: 1352843 - DNA, 22 bp, Artificial Sequence
  chemically synthesized
cagctaagccactgattactgt

SEQ ID NO: 1352844 - DNA, 22 bp, Artificial Sequence
  chemically synthesized
acaatattttccacagtaatca

SEQ ID NO: 1352845 - DNA, 22 bp, Artificial Sequence
  chemically synthesized
ctgacaatattttccacagtaa

SEQ ID NO: 1352846 - DNA, 22 bp, Artificial Sequence
  chemically synthesized
gctgacaatattttccacagta

SEQ ID NO: 1352847 - DNA, 22 bp, Artificial Sequence
  chemically synthesized
agccactgattactgtggaaaa

SEQ ID NO: 1352848 - DNA, 22 bp, Artificial Sequence
  chemically synthesized
attactgtggaaaatattgtca

SEQ ID NO: 1352849 - DNA, 22 bp, Artificial Sequence
  chemically synthesized
gggtatggtttgctgacaatat

SEQ ID NO: 1352850 - DNA, 22 bp, Artificial Sequence
  chemically synthesized
ggggtatggtttgctgacaata

SEQ ID NO: 1352851 - DNA, 22 bp, Artificial Sequence
  chemically synthesized
tggggtatggtttgctgacaat

SEQ ID NO: 1352852 - DNA, 22 bp, Artificial Sequence
  chemically synthesized
ctgtggaaaatattgtcagcaa

SEQ ID NO: 1352853 - DNA, 22 bp, Artificial Sequence
  chemically synthesized
tggaaaatattgtcagcaaacc

SEQ ID NO: 1352854 - DNA, 22 bp, Artificial Sequence
  chemically synthesized
acagcaatacattttggggtat

SEQ ID NO: 1352855 - DNA, 22 bp, Artificial Sequence
  chemically synthesized
cacagcaatacattttggggta

SEQ ID NO: 1352856 - DNA, 22 bp, Artificial Sequence
  chemically synthesized
tcagcaaaccataccccaaaat

SEQ ID NO: 1352857 - DNA, 22 bp, Artificial Sequence
  chemically synthesized
tcacagcaatacattttggggt

SEQ ID NO: 1352858 - DNA, 22 bp, Artificial Sequence
  chemically synthesized
ccctttcacagcaatacatttt

SEQ ID NO: 1352859 - DNA, 22 bp, Artificial Sequence
  chemically synthesized
cccctttcacagcaatacattt

SEQ ID NO: 1352860 - DNA, 22 bp, Artificial Sequence
  chemically synthesized
tcccctttcacagcaatacatt

SEQ ID NO: 1352861 - DNA, 22 bp, Artificial Sequence
  chemically synthesized
ttcccctttcacagcaatacat

SEQ ID NO: 1352862 - DNA, 22 bp, Artificial Sequence
  chemically synthesized
tttcccctttcacagcaataca

SEQ ID NO: 1352863 - DNA, 22 bp, Artificial Sequence
  chemically synthesized
ttttcccctttcacagcaatac

SEQ ID NO: 1352864 - DNA, 22 bp, Artificial Sequence
  chemically synthesized
taatatttttttcccctttcac

SEQ ID NO: 1352865 - DNA, 22 bp, Artificial Sequence
  chemically synthesized
gtaatatttttttcccctttca

SEQ ID NO: 1352866 - DNA, 22 bp, Artificial Sequence
  chemically synthesized
tgtaatatttttttcccctttc

SEQ ID NO: 1352867 - DNA, 22 bp, Artificial Sequence
  chemically synthesized
ttttgtaatatttttttcccct

SEQ ID NO: 1352868 - DNA, 22 bp, Artificial Sequence
  chemically synthesized
gttttgtaatatttttttcccc

SEQ ID NO: 1352869 - DNA, 22 bp, Artificial Sequence
  chemically synthesized
tgttttgtaatatttttttccc

SEQ ID NO: 1352870 - DNA, 22 bp, Artificial Sequence
  chemically synthesized
ctgtgaaaggggaaaaaaatat

SEQ ID NO: 1352871 - DNA, 22 bp, Artificial Sequence
  chemically synthesized
tgaaaggggaaaaaaatattac

SEQ ID NO: 1352872 - DNA, 22 bp, Artificial Sequence
  chemically synthesized
gggttttgttttgtaatatttt

SEQ ID NO: 1352873 - DNA, 22 bp, Artificial Sequence
  chemically synthesized
agggttttgttttgtaatattt

SEQ ID NO: 1352874 - DNA, 22 bp, Artificial Sequence
  chemically synthesized
ggtttagggttttgttttgtaa

SEQ ID NO: 1352875 - DNA, 22 bp, Artificial Sequence
  chemically synthesized
tcgattcggtttagggttttgt

SEQ ID NO: 1352876 - DNA, 22 bp, Artificial Sequence
  chemically synthesized
ttatcgattcggtttagggttt

SEQ ID NO: 1352877 - DNA, 22 bp, Artificial Sequence
  chemically synthesized
caaaacaaaaccctaaaccgaa

SEQ ID NO: 1352878 - DNA, 22 bp, Artificial Sequence
  chemically synthesized
tccaagacatgagtgctgttat

SEQ ID NO: 1352879 - DNA, 22 bp, Artificial Sequence
  chemically synthesized
aaccgaatcgataacagcactc

SEQ ID NO: 1352880 - DNA, 22 bp, Artificial Sequence
  chemically synthesized
taaatctatccaagacatgagt

SEQ ID NO: 1352881 - DNA, 22 bp, Artificial Sequence
  chemically synthesized
tgtaaatctatccaagacatga

SEQ ID NO: 1352882 - DNA, 22 bp, Artificial Sequence
  chemically synthesized
ctgtaaatctatccaagacatg

SEQ ID NO: 1352883 - DNA, 22 bp, Artificial Sequence
  chemically synthesized
tctgtaaatctatccaagacat

SEQ ID NO: 1352884 - DNA, 22 bp, Artificial Sequence
  chemically synthesized
tttctgtaaatctatccaagac

SEQ ID NO: 1352885 - DNA, 22 bp, Artificial Sequence
  chemically synthesized
tctttctgtaaatctatccaag

SEQ ID NO: 1352886 - DNA, 22 bp, Artificial Sequence
  chemically synthesized
ctctttctgtaaatctatccaa

SEQ ID NO: 1352887 - DNA, 22 bp, Artificial Sequence
  chemically synthesized
atgtcttggatagatttacaga

SEQ ID NO: 1352888 - DNA, 22 bp, Artificial Sequence
  chemically synthesized
ggatagatttacagaaagagaa

SEQ ID NO: 1352889 - DNA, 22 bp, Artificial Sequence
  chemically synthesized
gatagatttacagaaagagaag

SEQ ID NO: 1352890 - DNA, 22 bp, Artificial Sequence
  chemically synthesized
acagaaagagaaggacgtcgct

SEQ ID NO: 1352891 - DNA, 22 bp, Artificial Sequence
  chemically synthesized
gcaaataaaaatagcgacgtcc

SEQ ID NO: 1352892 - DNA, 22 bp, Artificial Sequence
  chemically synthesized
cagaaagagaaggacgtcgcta

SEQ ID NO: 1352893 - DNA, 22 bp, Artificial Sequence
  chemically synthesized
agcaaataaaaatagcgacgtc

SEQ ID NO: 1352894 - DNA, 22 bp, Artificial Sequence
  chemically synthesized
ttagcaaataaaaatagcgacg

SEQ ID NO: 1352895 - DNA, 22 bp, Artificial Sequence
  chemically synthesized
tttttatttgctaagagatgtt

SEQ ID NO: 1352896 - DNA, 22 bp, Artificial Sequence
  chemically synthesized
atataaaaaaaggcaacatctc

SEQ ID NO: 1352897 - DNA, 22 bp, Artificial Sequence
  chemically synthesized
ttatttgctaagagatgttgcc

SEQ ID NO: 1352898 - DNA, 22 bp, Artificial Sequence
  chemically synthesized
aatataaaaaaaggcaacatct

SEQ ID NO: 1352899 - DNA, 22 bp, Artificial Sequence
  chemically synthesized
tatttgctaagagatgttgcct

SEQ ID NO: 1352900 - DNA, 22 bp, Artificial Sequence
  chemically synthesized
taatataaaaaaaggcaacatc

SEQ ID NO: 1352901 - DNA, 22 bp, Artificial Sequence
  chemically synthesized
atttgctaagagatgttgcctt

SEQ ID NO: 1352902 - DNA, 22 bp, Artificial Sequence
  chemically synthesized
tttgctaagagatgttgccttt

SEQ ID NO: 1352903 - DNA, 22 bp, Artificial Sequence
  chemically synthesized
gctaagagatgttgcctttttt

SEQ ID NO: 1352904 - DNA, 22 bp, Artificial Sequence
  chemically synthesized
ctaagagatgttgccttttttt

SEQ ID NO: 1352905 - DNA, 22 bp, Artificial Sequence
  chemically synthesized
aatattttaatataaaaaaagg

SEQ ID NO: 1352906 - DNA, 22 bp, Artificial Sequence
  chemically synthesized
aaatattttaatataaaaaaag

SEQ ID NO: 1352907 - DNA, 22 bp, Artificial Sequence
  chemically synthesized
agagatgttgcctttttttata

SEQ ID NO: 1352908 - DNA, 22 bp, Artificial Sequence
  chemically synthesized
taaatattttaatataaaaaaa

SEQ ID NO: 1352909 - DNA, 22 bp, Artificial Sequence
  chemically synthesized
cctttttttatattaaaatatt

SEQ ID NO: 1352910 - DNA, 22 bp, Artificial Sequence
  chemically synthesized
tttttatattaaaatatttaaa

SEQ ID NO: 1352911 - DNA, 22 bp, Artificial Sequence
  chemically synthesized
ttttatattaaaatatttaaag

SEQ ID NO: 1352912 - DNA, 22 bp, Artificial Sequence
  chemically synthesized
tttatattaaaatatttaaagt

SEQ ID NO: 1352913 - DNA, 22 bp, Artificial Sequence
  chemically synthesized
ttatattaaaatatttaaagtt

SEQ ID NO: 1352914 - DNA, 22 bp, Artificial Sequence
  chemically synthesized
tatattaaaatatttaaagtta

SEQ ID NO: 1352915 - DNA, 22 bp, Artificial Sequence
  chemically synthesized
atattaaaatatttaaagttac

SEQ ID NO: 1352916 - DNA, 22 bp, Artificial Sequence
  chemically synthesized
tattaaaatatttaaagttact

SEQ ID NO: 1352917 - DNA, 22 bp, Artificial Sequence
  chemically synthesized
aaatatttaaagttacttctct

SEQ ID NO: 1352918 - DNA, 22 bp, Artificial Sequence
  chemically synthesized
aaaagaaacagatcaatcagag

SEQ ID NO: 1352919 - DNA, 22 bp, Artificial Sequence
  chemically synthesized
aaagttacttctctgattgatc

SEQ ID NO: 1352920 - DNA, 22 bp, Artificial Sequence
  chemically synthesized
aagttacttctctgattgatct

SEQ ID NO: 1352921 - DNA, 22 bp, Artificial Sequence
  chemically synthesized
tgtctcaaaagaaacagatcaa

SEQ ID NO: 1352922 - DNA, 22 bp, Artificial Sequence
  chemically synthesized
cttctctgattgatctgtttct

SEQ ID NO: 1352923 - DNA, 22 bp, Artificial Sequence
  chemically synthesized
ctctgattgatctgtttctttt

SEQ ID NO: 1352924 - DNA, 22 bp, Artificial Sequence
  chemically synthesized
tctgattgatctgtttcttttg

SEQ ID NO: 1352925 - DNA, 22 bp, Artificial Sequence
  chemically synthesized
tgattgatctgtttcttttgag

SEQ ID NO: 1352926 - DNA, 22 bp, Artificial Sequence
  chemically synthesized
attgatctgtttcttttgagac

SEQ ID NO: 1352927 - DNA, 22 bp, Artificial Sequence
  chemically synthesized
atctgtttcttttgagacataa

SEQ ID NO: 1352928 - DNA, 22 bp, Artificial Sequence
  chemically synthesized
ggcaacagagcaagattatgtc

SEQ ID NO: 1352929 - DNA, 22 bp, Artificial Sequence
  chemically synthesized
gggcaacagagcaagattatgt

SEQ ID NO: 1352930 - DNA, 22 bp, Artificial Sequence
  chemically synthesized
tttcttttgagacataatcttg

SEQ ID NO: 1352931 - DNA, 22 bp, Artificial Sequence
  chemically synthesized
cttttgagacataatcttgctc

SEQ ID NO: 1352932 - DNA, 22 bp, Artificial Sequence
  chemically synthesized
ttttgagacataatcttgctct

SEQ ID NO: 1352933 - DNA, 22 bp, Artificial Sequence
  chemically synthesized
caacttgggcaacagagcaaga

SEQ ID NO: 1352934 - DNA, 22 bp, Artificial Sequence
  chemically synthesized
ttgagacataatcttgctctgt

SEQ ID NO: 1352935 - DNA, 22 bp, Artificial Sequence
  chemically synthesized
tgagacataatcttgctctgtt

SEQ ID NO: 1352936 - DNA, 22 bp, Artificial Sequence
  chemically synthesized
gagacataatcttgctctgttg

SEQ ID NO: 1352937 - DNA, 22 bp, Artificial Sequence
  chemically synthesized
agacataatcttgctctgttgc

SEQ ID NO: 1352938 - DNA, 22 bp, Artificial Sequence
  chemically synthesized
cattccaacttgggcaacagag

SEQ ID NO: 1352939 - DNA, 22 bp, Artificial Sequence
  chemically synthesized
accattgcattccaacttgggc

SEQ ID NO: 1352940 - DNA, 22 bp, Artificial Sequence
  chemically synthesized
gctctgttgcccaagttggaat

SEQ ID NO: 1352941 - DNA, 22 bp, Artificial Sequence
  chemically synthesized
ctctgttgcccaagttggaatg

SEQ ID NO: 1352942 - DNA, 22 bp, Artificial Sequence
  chemically synthesized
tgttgcccaagttggaatgcaa

SEQ ID NO: 1352943 - DNA, 22 bp, Artificial Sequence
  chemically synthesized
ttgcccaagttggaatgcaatg

SEQ ID NO: 1352944 - DNA, 22 bp, Artificial Sequence
  chemically synthesized
cccaagttggaatgcaatggtg

SEQ ID NO: 1352945 - DNA, 22 bp, Artificial Sequence
  chemically synthesized
cagtgagtcatgatctcaccat

SEQ ID NO: 1352946 - DNA, 22 bp, Artificial Sequence
  chemically synthesized
gaatgcaatggtgagatcatga

SEQ ID NO: 1352947 - DNA, 22 bp, Artificial Sequence
  chemically synthesized
ggaggtcaaggctacagtgagt

SEQ ID NO: 1352948 - DNA, 22 bp, Artificial Sequence
  chemically synthesized
gagcctaggaggtcaaggctac

SEQ ID NO: 1352949 - DNA, 22 bp, Artificial Sequence
  chemically synthesized
actgtagccttgacctcctagg

SEQ ID NO: 1352950 - DNA, 22 bp, Artificial Sequence
  chemically synthesized
tagccttgacctcctaggctcc

SEQ ID NO: 1352951 - DNA, 22 bp, Artificial Sequence
  chemically synthesized
aggcaggaggatcactggagcc

SEQ ID NO: 1352952 - DNA, 22 bp, Artificial Sequence
  chemically synthesized
gacctcctaggctccagtgatc

SEQ ID NO: 1352953 - DNA, 22 bp, Artificial Sequence
  chemically synthesized
acctcctaggctccagtgatcc

SEQ ID NO: 1352954 - DNA, 22 bp, Artificial Sequence
  chemically synthesized
ctaggctccagtgatcctcctg

SEQ ID NO: 1352955 - DNA, 22 bp, Artificial Sequence
  chemically synthesized
aggaggctgaggcaggaggatc

SEQ ID NO: 1352956 - DNA, 22 bp, Artificial Sequence
  chemically synthesized
ggctccagtgatcctcctgcct

SEQ ID NO: 1352957 - DNA, 22 bp, Artificial Sequence
  chemically synthesized
ctcaggaggctgaggcaggagg

SEQ ID NO: 1352958 - DNA, 22 bp, Artificial Sequence
  chemically synthesized
cagtgatcctcctgcctcagcc

SEQ ID NO: 1352959 - DNA, 22 bp, Artificial Sequence
  chemically synthesized
tagtcccacctactcaggaggc

SEQ ID NO: 1352960 - DNA, 22 bp, Artificial Sequence
  chemically synthesized
ctgcctcagcctcctgagtagg

SEQ ID NO: 1352961 - DNA, 22 bp, Artificial Sequence
  chemically synthesized
cctcagcctcctgagtaggtgg

SEQ ID NO: 1352962 - DNA, 22 bp, Artificial Sequence
  chemically synthesized
agcctcctgagtaggtgggact

SEQ ID NO: 1352963 - DNA, 22 bp, Artificial Sequence
  chemically synthesized
ctgagtaggtgggactataggc

SEQ ID NO: 1352964 - DNA, 22 bp, Artificial Sequence
  chemically synthesized
agtaggtgggactataggcgtg

SEQ ID NO: 1352965 - DNA, 22 bp, Artificial Sequence
  chemically synthesized
taggcgtgttgtcactatgcct

SEQ ID NO: 1352966 - DNA, 22 bp, Artificial Sequence
  chemically synthesized
tcactatgcctggctcatttct

SEQ ID NO: 1352967 - DNA, 22 bp, Artificial Sequence
  chemically synthesized
caaaaaaaaaatgaaaagaaat

SEQ ID NO: 1352968 - DNA, 22 bp, Artificial Sequence
  chemically synthesized
tgcctggctcatttcttttcat

SEQ ID NO: 1352969 - DNA, 22 bp, Artificial Sequence
  chemically synthesized
tacaaaaaaaaaatgaaaagaa

SEQ ID NO: 1352970 - DNA, 22 bp, Artificial Sequence
  chemically synthesized
atctctacaaaaaaaaaatgaa

SEQ ID NO: 1352971 - DNA, 22 bp, Artificial Sequence
  chemically synthesized
gctcatttcttttcattttttt

SEQ ID NO: 1352972 - DNA, 22 bp, Artificial Sequence
  chemically synthesized
atttcttttcattttttttttg

SEQ ID NO: 1352973 - DNA, 22 bp, Artificial Sequence
  chemically synthesized
cttttcattttttttttgtaga

SEQ ID NO: 1352974 - DNA, 22 bp, Artificial Sequence
  chemically synthesized
ttttcattttttttttgtagag

SEQ ID NO: 1352975 - DNA, 22 bp, Artificial Sequence
  chemically synthesized
ttcattttttttttgtagagat

SEQ ID NO: 1352976 - DNA, 22 bp, Artificial Sequence
  chemically synthesized
tcattttttttttgtagagatg

SEQ ID NO: 1352977 - DNA, 22 bp, Artificial Sequence
  chemically synthesized
cattttttttttgtagagatga

SEQ ID NO: 1352978 - DNA, 22 bp, Artificial Sequence
  chemically synthesized
attttttttttgtagagatgag

SEQ ID NO: 1352979 - DNA, 22 bp, Artificial Sequence
  chemically synthesized
tttttttgtagagatgaggtct

SEQ ID NO: 1352980 - DNA, 22 bp, Artificial Sequence
  chemically synthesized
gacaacagagtgagacctcatc

SEQ ID NO: 1352981 - DNA, 22 bp, Artificial Sequence
  chemically synthesized
ttttttgtagagatgaggtctc

SEQ ID NO: 1352982 - DNA, 22 bp, Artificial Sequence
  chemically synthesized
tttttgtagagatgaggtctca

SEQ ID NO: 1352983 - DNA, 22 bp, Artificial Sequence
  chemically synthesized
ttttgtagagatgaggtctcac

SEQ ID NO: 1352984 - DNA, 22 bp, Artificial Sequence
  chemically synthesized
tttgtagagatgaggtctcact

SEQ ID NO: 1352985 - DNA, 22 bp, Artificial Sequence
  chemically synthesized
ttgtagagatgaggtctcactc

SEQ ID NO: 1352986 - DNA, 22 bp, Artificial Sequence
  chemically synthesized
tgtagagatgaggtctcactct

SEQ ID NO: 1352987 - DNA, 22 bp, Artificial Sequence
  chemically synthesized
gtagagatgaggtctcactctg

SEQ ID NO: 1352988 - DNA, 22 bp, Artificial Sequence
  chemically synthesized
tagagatgaggtctcactctgt

SEQ ID NO: 1352989 - DNA, 22 bp, Artificial Sequence
  chemically synthesized
aagaccaccctggacaacagag

SEQ ID NO: 1352990 - DNA, 22 bp, Artificial Sequence
  chemically synthesized
actctgttgtccagggtggtct

SEQ ID NO: 1352991 - DNA, 22 bp, Artificial Sequence
  chemically synthesized
agcccaggagttcaagaccacc

SEQ ID NO: 1352992 - DNA, 22 bp, Artificial Sequence
  chemically synthesized
gagcccaggagttcaagaccac

SEQ ID NO: 1352993 - DNA, 22 bp, Artificial Sequence
  chemically synthesized
tgttgtccagggtggtcttgaa

SEQ ID NO: 1352994 - DNA, 22 bp, Artificial Sequence
  chemically synthesized
ttgtccagggtggtcttgaact

SEQ ID NO: 1352995 - DNA, 22 bp, Artificial Sequence
  chemically synthesized
tccagggtggtcttgaactcct

SEQ ID NO: 1352996 - DNA, 22 bp, Artificial Sequence
  chemically synthesized
gaactcctgggctcaagggatc

SEQ ID NO: 1352997 - DNA, 22 bp, Artificial Sequence
  chemically synthesized
aactcctgggctcaagggatcc

SEQ ID NO: 1352998 - DNA, 22 bp, Artificial Sequence
  chemically synthesized
ctgggctcaagggatcctctct

SEQ ID NO: 1352999 - DNA, 22 bp, Artificial Sequence
  chemically synthesized
ggaggccaaggagagagaggat

SEQ ID NO: 1353000 - DNA, 22 bp, Artificial Sequence
  chemically synthesized
gggaggccaaggagagagagga

SEQ ID NO: 1353001 - DNA, 22 bp, Artificial Sequence
  chemically synthesized
ggctcaagggatcctctctctc

SEQ ID NO: 1353002 - DNA, 22 bp, Artificial Sequence
  chemically synthesized
tgggaggccaaggagagagagg

SEQ ID NO: 1353003 - DNA, 22 bp, Artificial Sequence
  chemically synthesized
aagggatcctctctctccttgg

SEQ ID NO: 1353004 - DNA, 22 bp, Artificial Sequence
  chemically synthesized
taatgccagtactttgggaggc

SEQ ID NO: 1353005 - DNA, 22 bp, Artificial Sequence
  chemically synthesized
tctctccttggcctcccaaagt

SEQ ID NO: 1353006 - DNA, 22 bp, Artificial Sequence
  chemically synthesized
tctccttggcctcccaaagtac

SEQ ID NO: 1353007 - DNA, 22 bp, Artificial Sequence
  chemically synthesized
tccttggcctcccaaagtactg

SEQ ID NO: 1353008 - DNA, 22 bp, Artificial Sequence
  chemically synthesized
atgcctataatgccagtacttt

SEQ ID NO: 1353009 - DNA, 22 bp, Artificial Sequence
  chemically synthesized
cttggcctcccaaagtactggc

SEQ ID NO: 1353010 - DNA, 22 bp, Artificial Sequence
  chemically synthesized
ggcctcccaaagtactggcatt

SEQ ID NO: 1353011 - DNA, 22 bp, Artificial Sequence
  chemically synthesized
gcctcccaaagtactggcatta

SEQ ID NO: 1353012 - DNA, 22 bp, Artificial Sequence
  chemically synthesized
ccaaagtactggcattataggc

SEQ ID NO: 1353013 - DNA, 22 bp, Artificial Sequence
  chemically synthesized
ggtgtggtggctcatgcctata

SEQ ID NO: 1353014 - DNA, 22 bp, Artificial Sequence
  chemically synthesized
gcattataggcatgagccacca

SEQ ID NO: 1353015 - DNA, 22 bp, Artificial Sequence
  chemically synthesized
taggcatgagccaccacaccca

SEQ ID NO: 1353016 - DNA, 22 bp, Artificial Sequence
  chemically synthesized
agaaatcagagtggctgggtgt

SEQ ID NO: 1353017 - DNA, 22 bp, Artificial Sequence
  chemically synthesized
agactcagaaatcagagtggct

SEQ ID NO: 1353018 - DNA, 22 bp, Artificial Sequence
  chemically synthesized
attaagactcagaaatcagagt

SEQ ID NO: 1353019 - DNA, 22 bp, Artificial Sequence
  chemically synthesized
gattaagactcagaaatcagag

SEQ ID NO: 1353020 - DNA, 22 bp, Artificial Sequence
  chemically synthesized
tgattaagactcagaaatcaga

SEQ ID NO: 1353021 - DNA, 22 bp, Artificial Sequence
  chemically synthesized
ctttgattaagactcagaaatc

SEQ ID NO: 1353022 - DNA, 22 bp, Artificial Sequence
  chemically synthesized
ctactttgattaagactcagaa

SEQ ID NO: 1353023 - DNA, 22 bp, Artificial Sequence
  chemically synthesized
gctactttgattaagactcaga

SEQ ID NO: 1353024 - DNA, 22 bp, Artificial Sequence
  chemically synthesized
tgatttctgagtcttaatcaaa

SEQ ID NO: 1353025 - DNA, 22 bp, Artificial Sequence
  chemically synthesized
taagtttgctactttgattaag

SEQ ID NO: 1353026 - DNA, 22 bp, Artificial Sequence
  chemically synthesized
ataagtttgctactttgattaa

SEQ ID NO: 1353027 - DNA, 22 bp, Artificial Sequence
  chemically synthesized
atttctgagtcttaatcaaagt

SEQ ID NO: 1353028 - DNA, 22 bp, Artificial Sequence
  chemically synthesized
tataagtttgctactttgatta

SEQ ID NO: 1353029 - DNA, 22 bp, Artificial Sequence
  chemically synthesized
ctttataagtttgctactttga

SEQ ID NO: 1353030 - DNA, 22 bp, Artificial Sequence
  chemically synthesized
ctgagtcttaatcaaagtagca

SEQ ID NO: 1353031 - DNA, 22 bp, Artificial Sequence
  chemically synthesized
tgagtcttaatcaaagtagcaa

SEQ ID NO: 1353032 - DNA, 22 bp, Artificial Sequence
  chemically synthesized
agtcttaatcaaagtagcaaac

SEQ ID NO: 1353033 - DNA, 22 bp, Artificial Sequence
  chemically synthesized
aatcaaagtagcaaacttataa

SEQ ID NO: 1353034 - DNA, 22 bp, Artificial Sequence
  chemically synthesized
atcaaagtagcaaacttataaa

SEQ ID NO: 1353035 - DNA, 22 bp, Artificial Sequence
  chemically synthesized
gcatgtgatgaaatcactactt

SEQ ID NO: 1353036 - DNA, 22 bp, Artificial Sequence
  chemically synthesized
atattggcatgtgatgaaatca

SEQ ID NO: 1353037 - DNA, 22 bp, Artificial Sequence
  chemically synthesized
ataaagtagtgatttcatcaca

SEQ ID NO: 1353038 - DNA, 22 bp, Artificial Sequence
  chemically synthesized
ttaatattggcatgtgatgaaa

SEQ ID NO: 1353039 - DNA, 22 bp, Artificial Sequence
  chemically synthesized
taaagtagtgatttcatcacat

SEQ ID NO: 1353040 - DNA, 22 bp, Artificial Sequence
  chemically synthesized
gttaatattggcatgtgatgaa

SEQ ID NO: 1353041 - DNA, 22 bp, Artificial Sequence
  chemically synthesized
tgttaatattggcatgtgatga

SEQ ID NO: 1353042 - DNA, 22 bp, Artificial Sequence
  chemically synthesized
tttgttaatattggcatgtgat

SEQ ID NO: 1353043 - DNA, 22 bp, Artificial Sequence
  chemically synthesized
ctttgttaatattggcatgtga

SEQ ID NO: 1353044 - DNA, 22 bp, Artificial Sequence
  chemically synthesized
tctttgttaatattggcatgtg

SEQ ID NO: 1353045 - DNA, 22 bp, Artificial Sequence
  chemically synthesized
ttctttgttaatattggcatgt

SEQ ID NO: 1353046 - DNA, 22 bp, Artificial Sequence
  chemically synthesized
tttctttgttaatattggcatg

SEQ ID NO: 1353047 - DNA, 22 bp, Artificial Sequence
  chemically synthesized
ctttttctttgttaatattggc

SEQ ID NO: 1353048 - DNA, 22 bp, Artificial Sequence
  chemically synthesized
cctttttctttgttaatattgg

SEQ ID NO: 1353049 - DNA, 22 bp, Artificial Sequence
  chemically synthesized
ttcctttttctttgttaatatt

SEQ ID NO: 1353050 - DNA, 22 bp, Artificial Sequence
  chemically synthesized
catcacatgccaatattaacaa

SEQ ID NO: 1353051 - DNA, 22 bp, Artificial Sequence
  chemically synthesized
atcacatgccaatattaacaaa

SEQ ID NO: 1353052 - DNA, 22 bp, Artificial Sequence
  chemically synthesized
ctcttcctttttctttgttaat

SEQ ID NO: 1353053 - DNA, 22 bp, Artificial Sequence
  chemically synthesized
tactcttcctttttctttgtta

SEQ ID NO: 1353054 - DNA, 22 bp, Artificial Sequence
  chemically synthesized
ctactcttcctttttctttgtt

SEQ ID NO: 1353055 - DNA, 22 bp, Artificial Sequence
  chemically synthesized
tctactcttcctttttctttgt

SEQ ID NO: 1353056 - DNA, 22 bp, Artificial Sequence
  chemically synthesized
ttctactcttcctttttctttg

SEQ ID NO: 1353057 - DNA, 22 bp, Artificial Sequence
  chemically synthesized
tttctactcttcctttttcttt

SEQ ID NO: 1353058 - DNA, 22 bp, Artificial Sequence
  chemically synthesized
ttttctactcttcctttttctt

SEQ ID NO: 1353059 - DNA, 22 bp, Artificial Sequence
  chemically synthesized
tttttctactcttcctttttct

SEQ ID NO: 1353060 - DNA, 22 bp, Artificial Sequence
  chemically synthesized
acaaagaaaaaggaagagtaga

SEQ ID NO: 1353061 - DNA, 22 bp, Artificial Sequence
  chemically synthesized
tggagttttttttctactcttc

SEQ ID NO: 1353062 - DNA, 22 bp, Artificial Sequence
  chemically synthesized
cagtatcagttatggagttttt

SEQ ID NO: 1353063 - DNA, 22 bp, Artificial Sequence
  chemically synthesized
acagtatcagttatggagtttt

SEQ ID NO: 1353064 - DNA, 22 bp, Artificial Sequence
  chemically synthesized
tacagtatcagttatggagttt

SEQ ID NO: 1353065 - DNA, 22 bp, Artificial Sequence
  chemically synthesized
gaaaaatattttacagtatcag

SEQ ID NO: 1353066 - DNA, 22 bp, Artificial Sequence
  chemically synthesized
cataactgatactgtaaaatat

SEQ ID NO: 1353067 - DNA, 22 bp, Artificial Sequence
  chemically synthesized
tgcaaattagaaaaatatttta

SEQ ID NO: 1353068 - DNA, 22 bp, Artificial Sequence
  chemically synthesized
atgcaaattagaaaaatatttt

SEQ ID NO: 1353069 - DNA, 22 bp, Artificial Sequence
  chemically synthesized
tatgcaaattagaaaaatattt

SEQ ID NO: 1353070 - DNA, 22 bp, Artificial Sequence
  chemically synthesized
atactgtaaaatatttttctaa

SEQ ID NO: 1353071 - DNA, 22 bp, Artificial Sequence
  chemically synthesized
atatctttatgcaaattagaaa

SEQ ID NO: 1353072 - DNA, 22 bp, Artificial Sequence
  chemically synthesized
taaaatatttttctaatttgca

SEQ ID NO: 1353073 - DNA, 22 bp, Artificial Sequence
  chemically synthesized
gggtagaactgatatctttatg

SEQ ID NO: 1353074 - DNA, 22 bp, Artificial Sequence
  chemically synthesized
ttctaatttgcataaagatatc

SEQ ID NO: 1353075 - DNA, 22 bp, Artificial Sequence
  chemically synthesized
tctaatttgcataaagatatca

SEQ ID NO: 1353076 - DNA, 22 bp, Artificial Sequence
  chemically synthesized
ctaatttgcataaagatatcag

SEQ ID NO: 1353077 - DNA, 22 bp, Artificial Sequence
  chemically synthesized
taatttgcataaagatatcagt

SEQ ID NO: 1353078 - DNA, 22 bp, Artificial Sequence
  chemically synthesized
atttgcataaagatatcagttc

SEQ ID NO: 1353079 - DNA, 22 bp, Artificial Sequence
  chemically synthesized
gcataaagatatcagttctacc

SEQ ID NO: 1353080 - DNA, 22 bp, Artificial Sequence
  chemically synthesized
taaatatactagggtagaactg

SEQ ID NO: 1353081 - DNA, 22 bp, Artificial Sequence
  chemically synthesized
cataaagatatcagttctaccc

SEQ ID NO: 1353082 - DNA, 22 bp, Artificial Sequence
  chemically synthesized
gtaaatatactagggtagaact

SEQ ID NO: 1353083 - DNA, 22 bp, Artificial Sequence
  chemically synthesized
tcatatcttgtaaatatactag

SEQ ID NO: 1353084 - DNA, 22 bp, Artificial Sequence
  chemically synthesized
taccctagtatatttacaagat

SEQ ID NO: 1353085 - DNA, 22 bp, Artificial Sequence
  chemically synthesized
gtgaattgtcatatcttgtaaa

SEQ ID NO: 1353086 - DNA, 22 bp, Artificial Sequence
  chemically synthesized
ccctagtatatttacaagatat

SEQ ID NO: 1353087 - DNA, 22 bp, Artificial Sequence
  chemically synthesized
gtatatttacaagatatgacaa

SEQ ID NO: 1353088 - DNA, 22 bp, Artificial Sequence
  chemically synthesized
aaatgtaaatgttagtgaattg

SEQ ID NO: 1353089 - DNA, 22 bp, Artificial Sequence
  chemically synthesized
acaagatatgacaattcactaa

SEQ ID NO: 1353090 - DNA, 22 bp, Artificial Sequence
  chemically synthesized
caagatatgacaattcactaac

SEQ ID NO: 1353091 - DNA, 22 bp, Artificial Sequence
  chemically synthesized
tatgaattaaaatgtaaatgtt

SEQ ID NO: 1353092 - DNA, 22 bp, Artificial Sequence
  chemically synthesized
gttatatgaattaaaatgtaaa

SEQ ID NO: 1353093 - DNA, 22 bp, Artificial Sequence
  chemically synthesized
actaacatttacattttaattc

SEQ ID NO: 1353094 - DNA, 22 bp, Artificial Sequence
  chemically synthesized
caaactggttatatgaattaaa

SEQ ID NO: 1353095 - DNA, 22 bp, Artificial Sequence
  chemically synthesized
acaaactggttatatgaattaa

SEQ ID NO: 1353096 - DNA, 22 bp, Artificial Sequence
  chemically synthesized
acatttacattttaattcatat

SEQ ID NO: 1353097 - DNA, 22 bp, Artificial Sequence
  chemically synthesized
ttacaaactggttatatgaatt

SEQ ID NO: 1353098 - DNA, 22 bp, Artificial Sequence
  chemically synthesized
tcttacaaactggttatatgaa

SEQ ID NO: 1353099 - DNA, 22 bp, Artificial Sequence
  chemically synthesized
ctcttacaaactggttatatga

SEQ ID NO: 1353100 - DNA, 22 bp, Artificial Sequence
  chemically synthesized
acattttaattcatataaccag

SEQ ID NO: 1353101 - DNA, 22 bp, Artificial Sequence
  chemically synthesized
cattttaattcatataaccagt

SEQ ID NO: 1353102 - DNA, 22 bp, Artificial Sequence
  chemically synthesized
cttctcttacaaactggttata

SEQ ID NO: 1353103 - DNA, 22 bp, Artificial Sequence
  chemically synthesized
taattcatataaccagtttgta

SEQ ID NO: 1353104 - DNA, 22 bp, Artificial Sequence
  chemically synthesized
aattcatataaccagtttgtaa

SEQ ID NO: 1353105 - DNA, 22 bp, Artificial Sequence
  chemically synthesized
attcatataaccagtttgtaag

SEQ ID NO: 1353106 - DNA, 22 bp, Artificial Sequence
  chemically synthesized
ataggattccttctcttacaaa

SEQ ID NO: 1353107 - DNA, 22 bp, Artificial Sequence
  chemically synthesized
gataggattccttctcttacaa

SEQ ID NO: 1353108 - DNA, 22 bp, Artificial Sequence
  chemically synthesized
atataaccagtttgtaagagaa

SEQ ID NO: 1353109 - DNA, 22 bp, Artificial Sequence
  chemically synthesized
cttgataggattccttctctta

SEQ ID NO: 1353110 - DNA, 22 bp, Artificial Sequence
  chemically synthesized
ccttgataggattccttctctt

SEQ ID NO: 1353111 - DNA, 22 bp, Artificial Sequence
  chemically synthesized
tccttgataggattccttctct

SEQ ID NO: 1353112 - DNA, 22 bp, Artificial Sequence
  chemically synthesized
ttttccttgataggattccttc

SEQ ID NO: 1353113 - DNA, 22 bp, Artificial Sequence
  chemically synthesized
attttccttgataggattcctt

SEQ ID NO: 1353114 - DNA, 22 bp, Artificial Sequence
  chemically synthesized
gtaagagaaggaatcctatcaa

SEQ ID NO: 1353115 - DNA, 22 bp, Artificial Sequence
  chemically synthesized
taagagaaggaatcctatcaag

SEQ ID NO: 1353116 - DNA, 22 bp, Artificial Sequence
  chemically synthesized
taggcttattttccttgatagg

SEQ ID NO: 1353117 - DNA, 22 bp, Artificial Sequence
  chemically synthesized
tgtaggcttattttccttgata

SEQ ID NO: 1353118 - DNA, 22 bp, Artificial Sequence
  chemically synthesized
ctgtaggcttattttccttgat

SEQ ID NO: 1353119 - DNA, 22 bp, Artificial Sequence
  chemically synthesized
tctgtaggcttattttccttga

SEQ ID NO: 1353120 - DNA, 22 bp, Artificial Sequence
  chemically synthesized
gttttctgtaggcttattttcc

SEQ ID NO: 1353121 - DNA, 22 bp, Artificial Sequence
  chemically synthesized
tcaaggaaaataagcctacaga

SEQ ID NO: 1353122 - DNA, 22 bp, Artificial Sequence
  chemically synthesized
tcacaaaaagttagttttctgt

SEQ ID NO: 1353123 - DNA, 22 bp, Artificial Sequence
  chemically synthesized
atcacaaaaagttagttttctg

SEQ ID NO: 1353124 - DNA, 22 bp, Artificial Sequence
  chemically synthesized
tatcacaaaaagttagttttct

SEQ ID NO: 1353125 - DNA, 22 bp, Artificial Sequence
  chemically synthesized
cagaaaactaactttttgtgat

SEQ ID NO: 1353126 - DNA, 22 bp, Artificial Sequence
  chemically synthesized
taaaatcattttatcacaaaaa

SEQ ID NO: 1353127 - DNA, 22 bp, Artificial Sequence
  chemically synthesized
ataaaatcattttatcacaaaa

SEQ ID NO: 1353128 - DNA, 22 bp, Artificial Sequence
  chemically synthesized
tataaaatcattttatcacaaa

SEQ ID NO: 1353129 - DNA, 22 bp, Artificial Sequence
  chemically synthesized
tcagctttataaaatcatttta

SEQ ID NO: 1353130 - DNA, 22 bp, Artificial Sequence
  chemically synthesized
actttttgtgataaaatgattt

SEQ ID NO: 1353131 - DNA, 22 bp, Artificial Sequence
  chemically synthesized
ttgtcagctttataaaatcatt

SEQ ID NO: 1353132 - DNA, 22 bp, Artificial Sequence
  chemically synthesized
attgtcagctttataaaatcat

SEQ ID NO: 1353133 - DNA, 22 bp, Artificial Sequence
  chemically synthesized
tttgtgataaaatgattttata

SEQ ID NO: 1353134 - DNA, 22 bp, Artificial Sequence
  chemically synthesized
ttgtgataaaatgattttataa

SEQ ID NO: 1353135 - DNA, 22 bp, Artificial Sequence
  chemically synthesized
tgtgataaaatgattttataaa

SEQ ID NO: 1353136 - DNA, 22 bp, Artificial Sequence
  chemically synthesized
gtgataaaatgattttataaag

SEQ ID NO: 1353137 - DNA, 22 bp, Artificial Sequence
  chemically synthesized
tgataaaatgattttataaagc

SEQ ID NO: 1353138 - DNA, 22 bp, Artificial Sequence
  chemically synthesized
aatgcttattgtcagctttata

SEQ ID NO: 1353139 - DNA, 22 bp, Artificial Sequence
  chemically synthesized
aaatgcttattgtcagctttat

SEQ ID NO: 1353140 - DNA, 22 bp, Artificial Sequence
  chemically synthesized
taaatgcttattgtcagcttta

SEQ ID NO: 1353141 - DNA, 22 bp, Artificial Sequence
  chemically synthesized
tttaaatgcttattgtcagctt

SEQ ID NO: 1353142 - DNA, 22 bp, Artificial Sequence
  chemically synthesized
ctttaaatgcttattgtcagct

SEQ ID NO: 1353143 - DNA, 22 bp, Artificial Sequence
  chemically synthesized
gtacttctttaaatgcttattg

SEQ ID NO: 1353144 - DNA, 22 bp, Artificial Sequence
  chemically synthesized
tataaagctgacaataagcatt

SEQ ID NO: 1353145 - DNA, 22 bp, Artificial Sequence
  chemically synthesized
ataaagctgacaataagcattt

SEQ ID NO: 1353146 - DNA, 22 bp, Artificial Sequence
  chemically synthesized
tagtacttctttaaatgcttat

SEQ ID NO: 1353147 - DNA, 22 bp, Artificial Sequence
  chemically synthesized
taaagctgacaataagcattta

SEQ ID NO: 1353148 - DNA, 22 bp, Artificial Sequence
  chemically synthesized
atgttctagtacttctttaaat

SEQ ID NO: 1353149 - DNA, 22 bp, Artificial Sequence
  chemically synthesized
acaataagcatttaaagaagta

SEQ ID NO: 1353150 - DNA, 22 bp, Artificial Sequence
  chemically synthesized
aaggttcatgttctagtacttc

SEQ ID NO: 1353151 - DNA, 22 bp, Artificial Sequence
  chemically synthesized
aaagaagtactagaacatgaac

SEQ ID NO: 1353152 - DNA, 22 bp, Artificial Sequence
  chemically synthesized
aagaagtactagaacatgaacc

SEQ ID NO: 1353153 - DNA, 22 bp, Artificial Sequence
  chemically synthesized
gatatgtgttaaaggttcatgt

SEQ ID NO: 1353154 - DNA, 22 bp, Artificial Sequence
  chemically synthesized
gaacatgaacctttaacacata

SEQ ID NO: 1353155 - DNA, 22 bp, Artificial Sequence
  chemically synthesized
aaacagtagattggatatgtgt

SEQ ID NO: 1353156 - DNA, 22 bp, Artificial Sequence
  chemically synthesized
taaaacagtagattggatatgt

SEQ ID NO: 1353157 - DNA, 22 bp, Artificial Sequence
  chemically synthesized
ctaaaacagtagattggatatg

SEQ ID NO: 1353158 - DNA, 22 bp, Artificial Sequence
  chemically synthesized
tctaaaacagtagattggatat

SEQ ID NO: 1353159 - DNA, 22 bp, Artificial Sequence
  chemically synthesized
ttctaaaacagtagattggata

SEQ ID NO: 1353160 - DNA, 22 bp, Artificial Sequence
  chemically synthesized
tttctaaaacagtagattggat

SEQ ID NO: 1353161 - DNA, 22 bp, Artificial Sequence
  chemically synthesized
taacacatatccaatctactgt

SEQ ID NO: 1353162 - DNA, 22 bp, Artificial Sequence
  chemically synthesized
attttttctaaaacagtagatt

SEQ ID NO: 1353163 - DNA, 22 bp, Artificial Sequence
  chemically synthesized
aacacatatccaatctactgtt

SEQ ID NO: 1353164 - DNA, 22 bp, Artificial Sequence
  chemically synthesized
aattttttctaaaacagtagat

SEQ ID NO: 1353165 - DNA, 22 bp, Artificial Sequence
  chemically synthesized
acacatatccaatctactgttt

SEQ ID NO: 1353166 - DNA, 22 bp, Artificial Sequence
  chemically synthesized
ttaattttttctaaaacagtag

SEQ ID NO: 1353167 - DNA, 22 bp, Artificial Sequence
  chemically synthesized
attcttaattttttctaaaaca

SEQ ID NO: 1353168 - DNA, 22 bp, Artificial Sequence
  chemically synthesized
ctgttttagaaaaaattaagaa

SEQ ID NO: 1353169 - DNA, 22 bp, Artificial Sequence
  chemically synthesized
cagaaaaactcattcttaattt

SEQ ID NO: 1353170 - DNA, 22 bp, Artificial Sequence
  chemically synthesized
gcagaaaaactcattcttaatt

SEQ ID NO: 1353171 - DNA, 22 bp, Artificial Sequence
  chemically synthesized
tgcagaaaaactcattcttaat

SEQ ID NO: 1353172 - DNA, 22 bp, Artificial Sequence
  chemically synthesized
ttttagaaaaaattaagaatga

SEQ ID NO: 1353173 - DNA, 22 bp, Artificial Sequence
  chemically synthesized
ttgcagaaaaactcattcttaa

SEQ ID NO: 1353174 - DNA, 22 bp, Artificial Sequence
  chemically synthesized
tagaaaaaattaagaatgagtt

SEQ ID NO: 1353175 - DNA, 22 bp, Artificial Sequence
  chemically synthesized
agaaaaaattaagaatgagttt

SEQ ID NO: 1353176 - DNA, 22 bp, Artificial Sequence
  chemically synthesized
gaaaaaattaagaatgagtttt

SEQ ID NO: 1353177 - DNA, 22 bp, Artificial Sequence
  chemically synthesized
catacatttttgcagaaaaact

SEQ ID NO: 1353178 - DNA, 22 bp, Artificial Sequence
  chemically synthesized
cgttgcatacatttttgcagaa

SEQ ID NO: 1353179 - DNA, 22 bp, Artificial Sequence
  chemically synthesized
agaatgagtttttctgcaaaaa

SEQ ID NO: 1353180 - DNA, 22 bp, Artificial Sequence
  chemically synthesized
gcgttgcatacatttttgcaga

SEQ ID NO: 1353181 - DNA, 22 bp, Artificial Sequence
  chemically synthesized
gaatttgcgttgcatacatttt

SEQ ID NO: 1353182 - DNA, 22 bp, Artificial Sequence
  chemically synthesized
ttctgcaaaaatgtatgcaacg

SEQ ID NO: 1353183 - DNA, 22 bp, Artificial Sequence
  chemically synthesized
aactagaatttgcgttgcatac

SEQ ID NO: 1353184 - DNA, 22 bp, Artificial Sequence
  chemically synthesized
tctgcaaaaatgtatgcaacgc

SEQ ID NO: 1353185 - DNA, 22 bp, Artificial Sequence
  chemically synthesized
aaactagaatttgcgttgcata

SEQ ID NO: 1353186 - DNA, 22 bp, Artificial Sequence
  chemically synthesized
ctgcaaaaatgtatgcaacgca

SEQ ID NO: 1353187 - DNA, 22 bp, Artificial Sequence
  chemically synthesized
taaactagaatttgcgttgcat

SEQ ID NO: 1353188 - DNA, 22 bp, Artificial Sequence
  chemically synthesized
tgcaaaaatgtatgcaacgcaa

SEQ ID NO: 1353189 - DNA, 22 bp, Artificial Sequence
  chemically synthesized
caaaaatgtatgcaacgcaaat

SEQ ID NO: 1353190 - DNA, 22 bp, Artificial Sequence
  chemically synthesized
cgctttaaactagaatttgcgt

SEQ ID NO: 1353191 - DNA, 22 bp, Artificial Sequence
  chemically synthesized
caggatattccgctttaaacta

SEQ ID NO: 1353192 - DNA, 22 bp, Artificial Sequence
  chemically synthesized
gattacaggatattccgcttta

SEQ ID NO: 1353193 - DNA, 22 bp, Artificial Sequence
  chemically synthesized
ttagattacaggatattccgct

SEQ ID NO: 1353194 - DNA, 22 bp, Artificial Sequence
  chemically synthesized
attagattacaggatattccgc

SEQ ID NO: 1353195 - DNA, 22 bp, Artificial Sequence
  chemically synthesized
tagtttaaagcggaatatcctg

SEQ ID NO: 1353196 - DNA, 22 bp, Artificial Sequence
  chemically synthesized
gtttaaagcggaatatcctgta

SEQ ID NO: 1353197 - DNA, 22 bp, Artificial Sequence
  chemically synthesized
catatttattagattacaggat

SEQ ID NO: 1353198 - DNA, 22 bp, Artificial Sequence
  chemically synthesized
aaagcggaatatcctgtaatct

SEQ ID NO: 1353199 - DNA, 22 bp, Artificial Sequence
  chemically synthesized
aagcggaatatcctgtaatcta

SEQ ID NO: 1353200 - DNA, 22 bp, Artificial Sequence
  chemically synthesized
taaaaaatcatctccatattta

SEQ ID NO: 1353201 - DNA, 22 bp, Artificial Sequence
  chemically synthesized
taatctaataaatatggagatg

SEQ ID NO: 1353202 - DNA, 22 bp, Artificial Sequence
  chemically synthesized
catcactataaaaaatcatctc

SEQ ID NO: 1353203 - DNA, 22 bp, Artificial Sequence
  chemically synthesized
ataaatatggagatgatttttt

SEQ ID NO: 1353204 - DNA, 22 bp, Artificial Sequence
  chemically synthesized
gcccattacatcactataaaaa

SEQ ID NO: 1353205 - DNA, 22 bp, Artificial Sequence
  chemically synthesized
aaggtacaatctagcccattac

SEQ ID NO: 1353206 - DNA, 22 bp, Artificial Sequence
  chemically synthesized
tttatagtgatgtaatgggcta

SEQ ID NO: 1353207 - DNA, 22 bp, Artificial Sequence
  chemically synthesized
ttatagtgatgtaatgggctag

SEQ ID NO: 1353208 - DNA, 22 bp, Artificial Sequence
  chemically synthesized
tatagtgatgtaatgggctaga

SEQ ID NO: 1353209 - DNA, 22 bp, Artificial Sequence
  chemically synthesized
atagtgatgtaatgggctagat

SEQ ID NO: 1353210 - DNA, 22 bp, Artificial Sequence
  chemically synthesized
tagtgatgtaatgggctagatt

SEQ ID NO: 1353211 - DNA, 22 bp, Artificial Sequence
  chemically synthesized
ccataagtctaaaggtacaatc

SEQ ID NO: 1353212 - DNA, 22 bp, Artificial Sequence
  chemically synthesized
ttcccataagtctaaaggtaca

SEQ ID NO: 1353213 - DNA, 22 bp, Artificial Sequence
  chemically synthesized
attcccataagtctaaaggtac

SEQ ID NO: 1353214 - DNA, 22 bp, Artificial Sequence
  chemically synthesized
tattcccataagtctaaaggta

SEQ ID NO: 1353215 - DNA, 22 bp, Artificial Sequence
  chemically synthesized
ttattcccataagtctaaaggt

SEQ ID NO: 1353216 - DNA, 22 bp, Artificial Sequence
  chemically synthesized
gattgtacctttagacttatgg

SEQ ID NO: 1353217 - DNA, 22 bp, Artificial Sequence
  chemically synthesized
tacctttagacttatgggaata

SEQ ID NO: 1353218 - DNA, 22 bp, Artificial Sequence
  chemically synthesized
ggaaataatatttttattccca

SEQ ID NO: 1353219 - DNA, 22 bp, Artificial Sequence
  chemically synthesized
tagacttatgggaataaaaata

SEQ ID NO: 1353220 - DNA, 22 bp, Artificial Sequence
  chemically synthesized
agacttatgggaataaaaatat

SEQ ID NO: 1353221 - DNA, 22 bp, Artificial Sequence
  chemically synthesized
gacttatgggaataaaaatatt

SEQ ID NO: 1353222 - DNA, 22 bp, Artificial Sequence
  chemically synthesized
aaattaggaaataatattttta

SEQ ID NO: 1353223 - DNA, 22 bp, Artificial Sequence
  chemically synthesized
gaaattaggaaataatattttt

SEQ ID NO: 1353224 - DNA, 22 bp, Artificial Sequence
  chemically synthesized
tgaaattaggaaataatatttt

SEQ ID NO: 1353225 - DNA, 22 bp, Artificial Sequence
  chemically synthesized
atgggaataaaaatattatttc

SEQ ID NO: 1353226 - DNA, 22 bp, Artificial Sequence
  chemically synthesized
tgggaataaaaatattatttcc

SEQ ID NO: 1353227 - DNA, 22 bp, Artificial Sequence
  chemically synthesized
aaatagttttgaaattaggaaa

SEQ ID NO: 1353228 - DNA, 22 bp, Artificial Sequence
  chemically synthesized
aaaatagttttgaaattaggaa

SEQ ID NO: 1353229 - DNA, 22 bp, Artificial Sequence
  chemically synthesized
aaagatttaaaatagttttgaa

SEQ ID NO: 1353230 - DNA, 22 bp, Artificial Sequence
  chemically synthesized
aaaagatttaaaatagttttga

SEQ ID NO: 1353231 - DNA, 22 bp, Artificial Sequence
  chemically synthesized
tttcctaatttcaaaactattt

SEQ ID NO: 1353232 - DNA, 22 bp, Artificial Sequence
  chemically synthesized
cctaatttcaaaactattttaa

SEQ ID NO: 1353233 - DNA, 22 bp, Artificial Sequence
  chemically synthesized
ctaatttcaaaactattttaaa

SEQ ID NO: 1353234 - DNA, 22 bp, Artificial Sequence
  chemically synthesized
atttcaaaactattttaaatct

SEQ ID NO: 1353235 - DNA, 22 bp, Artificial Sequence
  chemically synthesized
gtagaatttaaaagatttaaaa

SEQ ID NO: 1353236 - DNA, 22 bp, Artificial Sequence
  chemically synthesized
agtagaatttaaaagatttaaa

SEQ ID NO: 1353237 - DNA, 22 bp, Artificial Sequence
  chemically synthesized
caaaactattttaaatctttta

SEQ ID NO: 1353238 - DNA, 22 bp, Artificial Sequence
  chemically synthesized
aaaactattttaaatcttttaa

SEQ ID NO: 1353239 - DNA, 22 bp, Artificial Sequence
  chemically synthesized
atttagtagaatttaaaagatt

SEQ ID NO: 1353240 - DNA, 22 bp, Artificial Sequence
  chemically synthesized
aatttagtagaatttaaaagat

SEQ ID NO: 1353241 - DNA, 22 bp, Artificial Sequence
  chemically synthesized
tttaatttagtagaatttaaaa

SEQ ID NO: 1353242 - DNA, 22 bp, Artificial Sequence
  chemically synthesized
atttaatttagtagaatttaaa

SEQ ID NO: 1353243 - DNA, 22 bp, Artificial Sequence
  chemically synthesized
ttttaaatcttttaaattctac

SEQ ID NO: 1353244 - DNA, 22 bp, Artificial Sequence
  chemically synthesized
ttatttaatttagtagaattta

SEQ ID NO: 1353245 - DNA, 22 bp, Artificial Sequence
  chemically synthesized
cttatttaatttagtagaattt

SEQ ID NO: 1353246 - DNA, 22 bp, Artificial Sequence
  chemically synthesized
tcttatttaatttagtagaatt

SEQ ID NO: 1353247 - DNA, 22 bp, Artificial Sequence
  chemically synthesized
taaatcttttaaattctactaa

SEQ ID NO: 1353248 - DNA, 22 bp, Artificial Sequence
  chemically synthesized
aaatcttttaaattctactaaa

SEQ ID NO: 1353249 - DNA, 22 bp, Artificial Sequence
  chemically synthesized
aatcttttaaattctactaaat

SEQ ID NO: 1353250 - DNA, 22 bp, Artificial Sequence
  chemically synthesized
ttttcttatttaatttagtaga

SEQ ID NO: 1353251 - DNA, 22 bp, Artificial Sequence
  chemically synthesized
attttcttatttaatttagtag

SEQ ID NO: 1353252 - DNA, 22 bp, Artificial Sequence
  chemically synthesized
tattttcttatttaatttagta

SEQ ID NO: 1353253 - DNA, 22 bp, Artificial Sequence
  chemically synthesized
ttaaattctactaaattaaata

SEQ ID NO: 1353254 - DNA, 22 bp, Artificial Sequence
  chemically synthesized
taaattctactaaattaaataa

SEQ ID NO: 1353255 - DNA, 22 bp, Artificial Sequence
  chemically synthesized
aaattctactaaattaaataag

SEQ ID NO: 1353256 - DNA, 22 bp, Artificial Sequence
  chemically synthesized
aaattttattttcttatttaat

SEQ ID NO: 1353257 - DNA, 22 bp, Artificial Sequence
  chemically synthesized
aattctactaaattaaataaga

SEQ ID NO: 1353258 - DNA, 22 bp, Artificial Sequence
  chemically synthesized
actcaaattttattttcttatt

SEQ ID NO: 1353259 - DNA, 22 bp, Artificial Sequence
  chemically synthesized
tactaaattaaataagaaaata

SEQ ID NO: 1353260 - DNA, 22 bp, Artificial Sequence
  chemically synthesized
ctaaattaaataagaaaataaa

SEQ ID NO: 1353261 - DNA, 22 bp, Artificial Sequence
  chemically synthesized
aattaaataagaaaataaaatt

SEQ ID NO: 1353262 - DNA, 22 bp, Artificial Sequence
  chemically synthesized
agtggctaactcaaattttatt

SEQ ID NO: 1353263 - DNA, 22 bp, Artificial Sequence
  chemically synthesized
gagtggctaactcaaattttat

SEQ ID NO: 1353264 - DNA, 22 bp, Artificial Sequence
  chemically synthesized
aataagaaaataaaatttgagt

SEQ ID NO: 1353265 - DNA, 22 bp, Artificial Sequence
  chemically synthesized
tttgagtggctaactcaaattt

SEQ ID NO: 1353266 - DNA, 22 bp, Artificial Sequence
  chemically synthesized
ctgtttgagtggctaactcaaa

SEQ ID NO: 1353267 - DNA, 22 bp, Artificial Sequence
  chemically synthesized
gagttagccactcaaacaggag

SEQ ID NO: 1353268 - DNA, 22 bp, Artificial Sequence
  chemically synthesized
agttagccactcaaacaggaga

SEQ ID NO: 1353269 - DNA, 22 bp, Artificial Sequence
  chemically synthesized
aatcagaataacaaatctcctg

SEQ ID NO: 1353270 - DNA, 22 bp, Artificial Sequence
  chemically synthesized
aaatcagaataacaaatctcct

SEQ ID NO: 1353271 - DNA, 22 bp, Artificial Sequence
  chemically synthesized
gccactcaaacaggagatttgt

SEQ ID NO: 1353272 - DNA, 22 bp, Artificial Sequence
  chemically synthesized
taaatcagaataacaaatctcc

SEQ ID NO: 1353273 - DNA, 22 bp, Artificial Sequence
  chemically synthesized
ttaaatcagaataacaaatctc

SEQ ID NO: 1353274 - DNA, 22 bp, Artificial Sequence
  chemically synthesized
tttttaaatcagaataacaaat

SEQ ID NO: 1353275 - DNA, 22 bp, Artificial Sequence
  chemically synthesized
aaacaggagatttgttattctg

SEQ ID NO: 1353276 - DNA, 22 bp, Artificial Sequence
  chemically synthesized
ccaaaggcaattgtttttaaat

SEQ ID NO: 1353277 - DNA, 22 bp, Artificial Sequence
  chemically synthesized
gttattctgatttaaaaacaat

SEQ ID NO: 1353278 - DNA, 22 bp, Artificial Sequence
  chemically synthesized
ttaccaaaggcaattgttttta

SEQ ID NO: 1353279 - DNA, 22 bp, Artificial Sequence
  chemically synthesized
ttattctgatttaaaaacaatt

SEQ ID NO: 1353280 - DNA, 22 bp, Artificial Sequence
  chemically synthesized
ttctgatttaaaaacaattgcc

SEQ ID NO: 1353281 - DNA, 22 bp, Artificial Sequence
  chemically synthesized
tgatttaaaaacaattgccttt

SEQ ID NO: 1353282 - DNA, 22 bp, Artificial Sequence
  chemically synthesized
atttaaaaacaattgcctttgg

SEQ ID NO: 1353283 - DNA, 22 bp, Artificial Sequence
  chemically synthesized
agagtgattgttaccaaaggca

SEQ ID NO: 1353284 - DNA, 22 bp, Artificial Sequence
  chemically synthesized
gagagtgattgttaccaaaggc

SEQ ID NO: 1353285 - DNA, 22 bp, Artificial Sequence
  chemically synthesized
aaaaacaattgcctttggtaac

SEQ ID NO: 1353286 - DNA, 22 bp, Artificial Sequence
  chemically synthesized
aaaacaattgcctttggtaaca

SEQ ID NO: 1353287 - DNA, 22 bp, Artificial Sequence
  chemically synthesized
tttgagagtgattgttaccaaa

SEQ ID NO: 1353288 - DNA, 22 bp, Artificial Sequence
  chemically synthesized
gaactgtttgagagtgattgtt

SEQ ID NO: 1353289 - DNA, 22 bp, Artificial Sequence
  chemically synthesized
tcgaactgtttgagagtgattg

SEQ ID NO: 1353290 - DNA, 22 bp, Artificial Sequence
  chemically synthesized
ctcgaactgtttgagagtgatt

SEQ ID NO: 1353291 - DNA, 22 bp, Artificial Sequence
  chemically synthesized
cctttggtaacaatcactctca

SEQ ID NO: 1353292 - DNA, 22 bp, Artificial Sequence
  chemically synthesized
tctcgaactgtttgagagtgat

SEQ ID NO: 1353293 - DNA, 22 bp, Artificial Sequence
  chemically synthesized
ttctcgaactgtttgagagtga

SEQ ID NO: 1353294 - DNA, 22 bp, Artificial Sequence
  chemically synthesized
tggtaacaatcactctcaaaca

SEQ ID NO: 1353295 - DNA, 22 bp, Artificial Sequence
  chemically synthesized
ggtaacaatcactctcaaacag

SEQ ID NO: 1353296 - DNA, 22 bp, Artificial Sequence
  chemically synthesized
gtaacaatcactctcaaacagt

SEQ ID NO: 1353297 - DNA, 22 bp, Artificial Sequence
  chemically synthesized
tcaaacagttcgagaaaaatat

SEQ ID NO: 1353298 - DNA, 22 bp, Artificial Sequence
  chemically synthesized
aaacagttcgagaaaaatatat

SEQ ID NO: 1353299 - DNA, 22 bp, Artificial Sequence
  chemically synthesized
cccatgaatatatacatacata

SEQ ID NO: 1353300 - DNA, 22 bp, Artificial Sequence
  chemically synthesized
gcccatgaatatatacatacat

SEQ ID NO: 1353301 - DNA, 22 bp, Artificial Sequence
  chemically synthesized
gagaaaaatatatgtatgtata

SEQ ID NO: 1353302 - DNA, 22 bp, Artificial Sequence
  chemically synthesized
cttgcccatgaatatatacata

SEQ ID NO: 1353303 - DNA, 22 bp, Artificial Sequence
  chemically synthesized
tccttgcccatgaatatataca

SEQ ID NO: 1353304 - DNA, 22 bp, Artificial Sequence
  chemically synthesized
ctccttgcccatgaatatatac

SEQ ID NO: 1353305 - DNA, 22 bp, Artificial Sequence
  chemically synthesized
aatccttctccttgcccatgaa

SEQ ID NO: 1353306 - DNA, 22 bp, Artificial Sequence
  chemically synthesized
taaatccttctccttgcccatg

SEQ ID NO: 1353307 - DNA, 22 bp, Artificial Sequence
  chemically synthesized
ctaaatccttctccttgcccat

SEQ ID NO: 1353308 - DNA, 22 bp, Artificial Sequence
  chemically synthesized
tctaaatccttctccttgccca

SEQ ID NO: 1353309 - DNA, 22 bp, Artificial Sequence
  chemically synthesized
ttctaaatccttctccttgccc

SEQ ID NO: 1353310 - DNA, 22 bp, Artificial Sequence
  chemically synthesized
cttttctaaatccttctccttg

SEQ ID NO: 1353311 - DNA, 22 bp, Artificial Sequence
  chemically synthesized
tccttttctaaatccttctcct

SEQ ID NO: 1353312 - DNA, 22 bp, Artificial Sequence
  chemically synthesized
ctccttttctaaatccttctcc

SEQ ID NO: 1353313 - DNA, 22 bp, Artificial Sequence
  chemically synthesized
tctccttttctaaatccttctc

SEQ ID NO: 1353314 - DNA, 22 bp, Artificial Sequence
  chemically synthesized
atgggcaaggagaaggatttag

SEQ ID NO: 1353315 - DNA, 22 bp, Artificial Sequence
  chemically synthesized
gaaaaattttctccttttctaa

SEQ ID NO: 1353316 - DNA, 22 bp, Artificial Sequence
  chemically synthesized
agaaaaattttctccttttcta

SEQ ID NO: 1353317 - DNA, 22 bp, Artificial Sequence
  chemically synthesized
agaaaaggagaaaatttttcta

SEQ ID NO: 1353318 - DNA, 22 bp, Artificial Sequence
  chemically synthesized
atcaccgaaacttagaaaaatt

SEQ ID NO: 1353319 - DNA, 22 bp, Artificial Sequence
  chemically synthesized
gaaaaggagaaaatttttctaa

SEQ ID NO: 1353320 - DNA, 22 bp, Artificial Sequence
  chemically synthesized
caattgatcaccgaaacttaga

SEQ ID NO: 1353321 - DNA, 22 bp, Artificial Sequence
  chemically synthesized
attccaattgatcaccgaaact

SEQ ID NO: 1353322 - DNA, 22 bp, Artificial Sequence
  chemically synthesized
cattccaattgatcaccgaaac

SEQ ID NO: 1353323 - DNA, 22 bp, Artificial Sequence
  chemically synthesized
tcattccaattgatcaccgaaa

SEQ ID NO: 1353324 - DNA, 22 bp, Artificial Sequence
  chemically synthesized
ttctaagtttcggtgatcaatt

SEQ ID NO: 1353325 - DNA, 22 bp, Artificial Sequence
  chemically synthesized
tctaagtttcggtgatcaattg

SEQ ID NO: 1353326 - DNA, 22 bp, Artificial Sequence
  chemically synthesized
acactttcattccaattgatca

SEQ ID NO: 1353327 - DNA, 22 bp, Artificial Sequence
  chemically synthesized
ctaagtttcggtgatcaattgg

SEQ ID NO: 1353328 - DNA, 22 bp, Artificial Sequence
  chemically synthesized
cacactttcattccaattgatc

SEQ ID NO: 1353329 - DNA, 22 bp, Artificial Sequence
  chemically synthesized
taagtttcggtgatcaattgga

SEQ ID NO: 1353330 - DNA, 22 bp, Artificial Sequence
  chemically synthesized
agtttcggtgatcaattggaat

SEQ ID NO: 1353331 - DNA, 22 bp, Artificial Sequence
  chemically synthesized
cggtgatcaattggaatgaaag

SEQ ID NO: 1353332 - DNA, 22 bp, Artificial Sequence
  chemically synthesized
ggtgatcaattggaatgaaagt

SEQ ID NO: 1353333 - DNA, 22 bp, Artificial Sequence
  chemically synthesized
aaggtaatttcacactttcatt

SEQ ID NO: 1353334 - DNA, 22 bp, Artificial Sequence
  chemically synthesized
ctgaaggtaatttcacactttc

SEQ ID NO: 1353335 - DNA, 22 bp, Artificial Sequence
  chemically synthesized
gaatgaaagtgtgaaattacct

SEQ ID NO: 1353336 - DNA, 22 bp, Artificial Sequence
  chemically synthesized
acaacactgctgaaggtaattt

SEQ ID NO: 1353337 - DNA, 22 bp, Artificial Sequence
  chemically synthesized
gttgacaacactgctgaaggta

SEQ ID NO: 1353338 - DNA, 22 bp, Artificial Sequence
  chemically synthesized
agttgacaacactgctgaaggt

SEQ ID NO: 1353339 - DNA, 22 bp, Artificial Sequence
  chemically synthesized
agtttagttgacaacactgctg

SEQ ID NO: 1353340 - DNA, 22 bp, Artificial Sequence
  chemically synthesized
ccttcagcagtgttgtcaacta

SEQ ID NO: 1353341 - DNA, 22 bp, Artificial Sequence
  chemically synthesized
cagcagtgttgtcaactaaact

SEQ ID NO: 1353342 - DNA, 22 bp, Artificial Sequence
  chemically synthesized
agcagtgttgtcaactaaactc

SEQ ID NO: 1353343 - DNA, 22 bp, Artificial Sequence
  chemically synthesized
agacagaaagtgctgagtttag

SEQ ID NO: 1353344 - DNA, 22 bp, Artificial Sequence
  chemically synthesized
ttgagacagaaagtgctgagtt

SEQ ID NO: 1353345 - DNA, 22 bp, Artificial Sequence
  chemically synthesized
tcaactaaactcagcactttct

SEQ ID NO: 1353346 - DNA, 22 bp, Artificial Sequence
  chemically synthesized
aactcagcactttctgtctcaa

SEQ ID NO: 1353347 - DNA, 22 bp, Artificial Sequence
  chemically synthesized
agtgtgcacctgttgagacaga

SEQ ID NO: 1353348 - DNA, 22 bp, Artificial Sequence
  chemically synthesized
gagtgtgcacctgttgagacag

SEQ ID NO: 1353349 - DNA, 22 bp, Artificial Sequence
  chemically synthesized
agcactttctgtctcaacaggt

SEQ ID NO: 1353350 - DNA, 22 bp, Artificial Sequence
  chemically synthesized
gtgggcttgagtgtgcacctgt

SEQ ID NO: 1353351 - DNA, 22 bp, Artificial Sequence
  chemically synthesized
tctgtctcaacaggtgcacact

SEQ ID NO: 1353352 - DNA, 22 bp, Artificial Sequence
  chemically synthesized
ctgtctcaacaggtgcacactc

SEQ ID NO: 1353353 - DNA, 22 bp, Artificial Sequence
  chemically synthesized
tgtctcaacaggtgcacactca

SEQ ID NO: 1353354 - DNA, 22 bp, Artificial Sequence
  chemically synthesized
tctcaacaggtgcacactcaag

SEQ ID NO: 1353355 - DNA, 22 bp, Artificial Sequence
  chemically synthesized
agagttggtgggcttgagtgtg

SEQ ID NO: 1353356 - DNA, 22 bp, Artificial Sequence
  chemically synthesized
aacaggtgcacactcaagccca

SEQ ID NO: 1353357 - DNA, 22 bp, Artificial Sequence
  chemically synthesized
acaaatagctgagagttggtgg

SEQ ID NO: 1353358 - DNA, 22 bp, Artificial Sequence
  chemically synthesized
gacaaatagctgagagttggtg

SEQ ID NO: 1353359 - DNA, 22 bp, Artificial Sequence
  chemically synthesized
tgacaaatagctgagagttggt

SEQ ID NO: 1353360 - DNA, 22 bp, Artificial Sequence
  chemically synthesized
gctttgacaaatagctgagagt

SEQ ID NO: 1353361 - DNA, 22 bp, Artificial Sequence
  chemically synthesized
agctttgacaaatagctgagag

SEQ ID NO: 1353362 - DNA, 22 bp, Artificial Sequence
  chemically synthesized
aagcccaccaactctcagctat

SEQ ID NO: 1353363 - DNA, 22 bp, Artificial Sequence
  chemically synthesized
cttagctttgacaaatagctga

SEQ ID NO: 1353364 - DNA, 22 bp, Artificial Sequence
  chemically synthesized
ccttagctttgacaaatagctg

SEQ ID NO: 1353365 - DNA, 22 bp, Artificial Sequence
  chemically synthesized
tccttagctttgacaaatagct

SEQ ID NO: 1353366 - DNA, 22 bp, Artificial Sequence
  chemically synthesized
ttccttagctttgacaaatagc

SEQ ID NO: 1353367 - DNA, 22 bp, Artificial Sequence
  chemically synthesized
tttccttagctttgacaaatag

SEQ ID NO: 1353368 - DNA, 22 bp, Artificial Sequence
  chemically synthesized
tctttttccttagctttgacaa

SEQ ID NO: 1353369 - DNA, 22 bp, Artificial Sequence
  chemically synthesized
tcagctatttgtcaaagctaag

SEQ ID NO: 1353370 - DNA, 22 bp, Artificial Sequence
  chemically synthesized
gctatctttttccttagctttg

SEQ ID NO: 1353371 - DNA, 22 bp, Artificial Sequence
  chemically synthesized
agctatttgtcaaagctaagga

SEQ ID NO: 1353372 - DNA, 22 bp, Artificial Sequence
  chemically synthesized
tttgtcaaagctaaggaaaaag

SEQ ID NO: 1353373 - DNA, 22 bp, Artificial Sequence
  chemically synthesized
gtcaaagctaaggaaaaagata

SEQ ID NO: 1353374 - DNA, 22 bp, Artificial Sequence
  chemically synthesized
tcaaagctaaggaaaaagatag

SEQ ID NO: 1353375 - DNA, 22 bp, Artificial Sequence
  chemically synthesized
tgtggggactggctatcttttt

SEQ ID NO: 1353376 - DNA, 22 bp, Artificial Sequence
  chemically synthesized
aggaaaaagatagccagtcccc

SEQ ID NO: 1353377 - DNA, 22 bp, Artificial Sequence
  chemically synthesized
tagtggcagccagaggcgcagc

SEQ ID NO: 1353378 - DNA, 22 bp, Artificial Sequence
  chemically synthesized
gtagtggcagccagaggcgcag

SEQ ID NO: 1353379 - DNA, 22 bp, Artificial Sequence
  chemically synthesized
tgtagtggcagccagaggcgca

SEQ ID NO: 1353380 - DNA, 22 bp, Artificial Sequence
  chemically synthesized
ttgtagtggcagccagaggcgc

SEQ ID NO: 1353381 - DNA, 22 bp, Artificial Sequence
  chemically synthesized
ttttgtagtggcagccagaggc

SEQ ID NO: 1353382 - DNA, 22 bp, Artificial Sequence
  chemically synthesized
attcttttgtagtggcagccag

SEQ ID NO: 1353383 - DNA, 22 bp, Artificial Sequence
  chemically synthesized
cgcctctggctgccactacaaa

SEQ ID NO: 1353384 - DNA, 22 bp, Artificial Sequence
  chemically synthesized
tggctgccactacaaaagaatg

SEQ ID NO: 1353385 - DNA, 22 bp, Artificial Sequence
  chemically synthesized
gctgccactacaaaagaatgag

SEQ ID NO: 1353386 - DNA, 22 bp, Artificial Sequence
  chemically synthesized
aaaatagccgagcctcattctt

SEQ ID NO: 1353387 - DNA, 22 bp, Artificial Sequence
  chemically synthesized
ccactacaaaagaatgaggctc

SEQ ID NO: 1353388 - DNA, 22 bp, Artificial Sequence
  chemically synthesized
caaaagaatgaggctcggctat

SEQ ID NO: 1353389 - DNA, 22 bp, Artificial Sequence
  chemically synthesized
ccccaaacctaaaaatagccga

SEQ ID NO: 1353390 - DNA, 22 bp, Artificial Sequence
  chemically synthesized
cctaccccaaacctaaaaatag

SEQ ID NO: 1353391 - DNA, 22 bp, Artificial Sequence
  chemically synthesized
attgcctaccccaaacctaaaa

SEQ ID NO: 1353392 - DNA, 22 bp, Artificial Sequence
  chemically synthesized
gctgattgcctaccccaaacct

SEQ ID NO: 1353393 - DNA, 22 bp, Artificial Sequence
  chemically synthesized
ggctgattgcctaccccaaacc

SEQ ID NO: 1353394 - DNA, 22 bp, Artificial Sequence
  chemically synthesized
ggctatttttaggtttggggta

SEQ ID NO: 1353395 - DNA, 22 bp, Artificial Sequence
  chemically synthesized
tttttaggtttggggtaggcaa

SEQ ID NO: 1353396 - DNA, 22 bp, Artificial Sequence
  chemically synthesized
agatttggctgattgcctaccc

SEQ ID NO: 1353397 - DNA, 22 bp, Artificial Sequence
  chemically synthesized
ttaggtttggggtaggcaatca

SEQ ID NO: 1353398 - DNA, 22 bp, Artificial Sequence
  chemically synthesized
ctgagatttggctgattgccta

SEQ ID NO: 1353399 - DNA, 22 bp, Artificial Sequence
  chemically synthesized
taggtttggggtaggcaatcag

SEQ ID NO: 1353400 - DNA, 22 bp, Artificial Sequence
  chemically synthesized
aggtttggggtaggcaatcagc

SEQ ID NO: 1353401 - DNA, 22 bp, Artificial Sequence
  chemically synthesized
ggtttggggtaggcaatcagcc

SEQ ID NO: 1353402 - DNA, 22 bp, Artificial Sequence
  chemically synthesized
ggggtaggcaatcagccaaatc

SEQ ID NO: 1353403 - DNA, 22 bp, Artificial Sequence
  chemically synthesized
tggtgctgctgagatttggctg

SEQ ID NO: 1353404 - DNA, 22 bp, Artificial Sequence
  chemically synthesized
gggtaggcaatcagccaaatct

SEQ ID NO: 1353405 - DNA, 22 bp, Artificial Sequence
  chemically synthesized
gtggtgctgctgagatttggct

SEQ ID NO: 1353406 - DNA, 22 bp, Artificial Sequence
  chemically synthesized
ttgtggtgctgctgagatttgg

SEQ ID NO: 1353407 - DNA, 22 bp, Artificial Sequence
  chemically synthesized
agcacatgctcttgtggtgctg

SEQ ID NO: 1353408 - DNA, 22 bp, Artificial Sequence
  chemically synthesized
tctcagcacatgctcttgtggt

SEQ ID NO: 1353409 - DNA, 22 bp, Artificial Sequence
  chemically synthesized
agttatctcagcacatgctctt

SEQ ID NO: 1353410 - DNA, 22 bp, Artificial Sequence
  chemically synthesized
agcagcaccacaagagcatgtg

SEQ ID NO: 1353411 - DNA, 22 bp, Artificial Sequence
  chemically synthesized
aagtctcagttatctcagcaca

SEQ ID NO: 1353412 - DNA, 22 bp, Artificial Sequence
  chemically synthesized
taaagtctcagttatctcagca

SEQ ID NO: 1353413 - DNA, 22 bp, Artificial Sequence
  chemically synthesized
aactctaaagtctcagttatct

SEQ ID NO: 1353414 - DNA, 22 bp, Artificial Sequence
  chemically synthesized
gttcaactctaaagtctcagtt

SEQ ID NO: 1353415 - DNA, 22 bp, Artificial Sequence
  chemically synthesized
agataactgagactttagagtt

SEQ ID NO: 1353416 - DNA, 22 bp, Artificial Sequence
  chemically synthesized
gtggagtcctggttcaactcta

SEQ ID NO: 1353417 - DNA, 22 bp, Artificial Sequence
  chemically synthesized
agactttagagttgaaccagga

SEQ ID NO: 1353418 - DNA, 22 bp, Artificial Sequence
  chemically synthesized
ggaggctggtggagtcctggtt

SEQ ID NO: 1353419 - DNA, 22 bp, Artificial Sequence
  chemically synthesized
tagagttgaaccaggactccac

SEQ ID NO: 1353420 - DNA, 22 bp, Artificial Sequence
  chemically synthesized
agagttgaaccaggactccacc

SEQ ID NO: 1353421 - DNA, 22 bp, Artificial Sequence
  chemically synthesized
gagttgaaccaggactccacca

SEQ ID NO: 1353422 - DNA, 22 bp, Artificial Sequence
  chemically synthesized
aaccaggactccaccagcctcc

SEQ ID NO: 1353423 - DNA, 22 bp, Artificial Sequence
  chemically synthesized
ggcaggaagttgggaggctggt

SEQ ID NO: 1353424 - DNA, 22 bp, Artificial Sequence
  chemically synthesized
ggtgtctaggcaggaagttggg

SEQ ID NO: 1353425 - DNA, 22 bp, Artificial Sequence
  chemically synthesized
caccagcctcccaacttcctgc

SEQ ID NO: 1353426 - DNA, 22 bp, Artificial Sequence
  chemically synthesized
ccaacttcctgcctagacaccc

SEQ ID NO: 1353427 - DNA, 22 bp, Artificial Sequence
  chemically synthesized
cctgcctagacacccaaccctg

SEQ ID NO: 1353428 - DNA, 22 bp, Artificial Sequence
  chemically synthesized
ctgcctagacacccaaccctgt

SEQ ID NO: 1353429 - DNA, 22 bp, Artificial Sequence
  chemically synthesized
cctagacacccaaccctgtgtt

SEQ ID NO: 1353430 - DNA, 22 bp, Artificial Sequence
  chemically synthesized
gacacccaaccctgtgttctca

SEQ ID NO: 1353431 - DNA, 22 bp, Artificial Sequence
  chemically synthesized
gtgaccacagaaatgagaacac

SEQ ID NO: 1353432 - DNA, 22 bp, Artificial Sequence
  chemically synthesized
ggtgaccacagaaatgagaaca

SEQ ID NO: 1353433 - DNA, 22 bp, Artificial Sequence
  chemically synthesized
tgttctcatttctgtggtcacc

SEQ ID NO: 1353434 - DNA, 22 bp, Artificial Sequence
  chemically synthesized
tcatttctgtggtcaccaagtc

SEQ ID NO: 1353435 - DNA, 22 bp, Artificial Sequence
  chemically synthesized
atttctgtggtcaccaagtcac

SEQ ID NO: 1353436 - DNA, 22 bp, Artificial Sequence
  chemically synthesized
ctgtggtcaccaagtcacctgt

SEQ ID NO: 1353437 - DNA, 22 bp, Artificial Sequence
  chemically synthesized
tgtggtcaccaagtcacctgtg

SEQ ID NO: 1353438 - DNA, 22 bp, Artificial Sequence
  chemically synthesized
tggtcaccaagtcacctgtggc

SEQ ID NO: 1353439 - DNA, 22 bp, Artificial Sequence
  chemically synthesized
gcggatcatgatgaaagccaca

SEQ ID NO: 1353440 - DNA, 22 bp, Artificial Sequence
  chemically synthesized
cgcggatcatgatgaaagccac

SEQ ID NO: 1353441 - DNA, 22 bp, Artificial Sequence
  chemically synthesized
tggctttcatcatgatccgcga

SEQ ID NO: 1353442 - DNA, 22 bp, Artificial Sequence
  chemically synthesized
tcatcatgatccgcgaaatcta

SEQ ID NO: 1353443 - DNA, 22 bp, Artificial Sequence
  chemically synthesized
catcatgatccgcgaaatctac

SEQ ID NO: 1353444 - DNA, 22 bp, Artificial Sequence
  chemically synthesized
atcatgatccgcgaaatctaca

SEQ ID NO: 1353445 - DNA, 22 bp, Artificial Sequence
  chemically synthesized
ggaaaagcacagaaatgtagat

SEQ ID NO: 1353446 - DNA, 22 bp, Artificial Sequence
  chemically synthesized
catttctgtgcttttcccagct

SEQ ID NO: 1353447 - DNA, 22 bp, Artificial Sequence
  chemically synthesized
taacaggagaggagctgggaaa

SEQ ID NO: 1353448 - DNA, 22 bp, Artificial Sequence
  chemically synthesized
ctgtgcttttcccagctcctct

SEQ ID NO: 1353449 - DNA, 22 bp, Artificial Sequence
  chemically synthesized
tgtgcttttcccagctcctctc

SEQ ID NO: 1353450 - DNA, 22 bp, Artificial Sequence
  chemically synthesized
tgcttttcccagctcctctcct

SEQ ID NO: 1353451 - DNA, 22 bp, Artificial Sequence
  chemically synthesized
ttcccagctcctctcctgttac

SEQ ID NO: 1353452 - DNA, 22 bp, Artificial Sequence
  chemically synthesized
tcccagctcctctcctgttaca

SEQ ID NO: 1353453 - DNA, 22 bp, Artificial Sequence
  chemically synthesized
cccagctcctctcctgttacaa

SEQ ID NO: 1353454 - DNA, 22 bp, Artificial Sequence
  chemically synthesized
ccagctcctctcctgttacaac

SEQ ID NO: 1353455 - DNA, 22 bp, Artificial Sequence
  chemically synthesized
gagataagaaatgaaagttgta

SEQ ID NO: 1353456 - DNA, 22 bp, Artificial Sequence
  chemically synthesized
ctctcctgttacaactttcatt

SEQ ID NO: 1353457 - DNA, 22 bp, Artificial Sequence
  chemically synthesized
tcctgttacaactttcatttct

SEQ ID NO: 1353458 - DNA, 22 bp, Artificial Sequence
  chemically synthesized
ctgttacaactttcatttctta

SEQ ID NO: 1353459 - DNA, 22 bp, Artificial Sequence
  chemically synthesized
aaggtctagagataagaaatga

SEQ ID NO: 1353460 - DNA, 22 bp, Artificial Sequence
  chemically synthesized
caaggtctagagataagaaatg

SEQ ID NO: 1353461 - DNA, 22 bp, Artificial Sequence
  chemically synthesized
ttacaactttcatttcttatct

SEQ ID NO: 1353462 - DNA, 22 bp, Artificial Sequence
  chemically synthesized
caactttcatttcttatctcta

SEQ ID NO: 1353463 - DNA, 22 bp, Artificial Sequence
  chemically synthesized
atggcttcaaggtctagagata

SEQ ID NO: 1353464 - DNA, 22 bp, Artificial Sequence
  chemically synthesized
catggcttcaaggtctagagat

SEQ ID NO: 1353465 - DNA, 22 bp, Artificial Sequence
  chemically synthesized
tcatttcttatctctagacctt

SEQ ID NO: 1353466 - DNA, 22 bp, Artificial Sequence
  chemically synthesized
catttcttatctctagaccttg

SEQ ID NO: 1353467 - DNA, 22 bp, Artificial Sequence
  chemically synthesized
atttcttatctctagaccttga

SEQ ID NO: 1353468 - DNA, 22 bp, Artificial Sequence
  chemically synthesized
cttatctctagaccttgaagcc

SEQ ID NO: 1353469 - DNA, 22 bp, Artificial Sequence
  chemically synthesized
ttatctctagaccttgaagcca

SEQ ID NO: 1353470 - DNA, 22 bp, Artificial Sequence
  chemically synthesized
atctctagaccttgaagccatg

SEQ ID NO: 1353471 - DNA, 22 bp, Artificial Sequence
  chemically synthesized
tctctagaccttgaagccatga

SEQ ID NO: 1353472 - DNA, 22 bp, Artificial Sequence
  chemically synthesized
ataaggaaaatttcatggcttc

SEQ ID NO: 1353473 - DNA, 22 bp, Artificial Sequence
  chemically synthesized
tagaccttgaagccatgaaatt

SEQ ID NO: 1353474 - DNA, 22 bp, Artificial Sequence
  chemically synthesized
gaccttgaagccatgaaatttt

SEQ ID NO: 1353475 - DNA, 22 bp, Artificial Sequence
  chemically synthesized
gaagccatgaaattttccttat

SEQ ID NO: 1353476 - DNA, 22 bp, Artificial Sequence
  chemically synthesized
aagccatgaaattttccttatt

SEQ ID NO: 1353477 - DNA, 22 bp, Artificial Sequence
  chemically synthesized
agtaaaggaactaataaggaaa

SEQ ID NO: 1353478 - DNA, 22 bp, Artificial Sequence
  chemically synthesized
ttgagtaaaggaactaataagg

SEQ ID NO: 1353479 - DNA, 22 bp, Artificial Sequence
  chemically synthesized
gttgagtaaaggaactaataag

SEQ ID NO: 1353480 - DNA, 22 bp, Artificial Sequence
  chemically synthesized
cttgttgagtaaaggaactaat

SEQ ID NO: 1353481 - DNA, 22 bp, Artificial Sequence
  chemically synthesized
ccttgttgagtaaaggaactaa

SEQ ID NO: 1353482 - DNA, 22 bp, Artificial Sequence
  chemically synthesized
tccttgttgagtaaaggaacta

SEQ ID NO: 1353483 - DNA, 22 bp, Artificial Sequence
  chemically synthesized
ttccttgttgagtaaaggaact

SEQ ID NO: 1353484 - DNA, 22 bp, Artificial Sequence
  chemically synthesized
tttccttgttgagtaaaggaac

SEQ ID NO: 1353485 - DNA, 22 bp, Artificial Sequence
  chemically synthesized
ttttccttgttgagtaaaggaa

SEQ ID NO: 1353486 - DNA, 22 bp, Artificial Sequence
  chemically synthesized
tttttccttgttgagtaaagga

SEQ ID NO: 1353487 - DNA, 22 bp, Artificial Sequence
  chemically synthesized
tccttattagttcctttactca

SEQ ID NO: 1353488 - DNA, 22 bp, Artificial Sequence
  chemically synthesized
ttttttccttgttgagtaaagg

SEQ ID NO: 1353489 - DNA, 22 bp, Artificial Sequence
  chemically synthesized
ccttattagttcctttactcaa

SEQ ID NO: 1353490 - DNA, 22 bp, Artificial Sequence
  chemically synthesized
tttttttccttgttgagtaaag

SEQ ID NO: 1353491 - DNA, 22 bp, Artificial Sequence
  chemically synthesized
cttattagttcctttactcaac

SEQ ID NO: 1353492 - DNA, 22 bp, Artificial Sequence
  chemically synthesized
ttttttttccttgttgagtaaa

SEQ ID NO: 1353493 - DNA, 22 bp, Artificial Sequence
  chemically synthesized
attagttcctttactcaacaag

SEQ ID NO: 1353494 - DNA, 22 bp, Artificial Sequence
  chemically synthesized
ttagttcctttactcaacaagg

SEQ ID NO: 1353495 - DNA, 22 bp, Artificial Sequence
  chemically synthesized
aggtttttttttttccttgttg

SEQ ID NO: 1353496 - DNA, 22 bp, Artificial Sequence
  chemically synthesized
gttcctttactcaacaaggaaa

SEQ ID NO: 1353497 - DNA, 22 bp, Artificial Sequence
  chemically synthesized
tgaggtttttttttttccttgt

SEQ ID NO: 1353498 - DNA, 22 bp, Artificial Sequence
  chemically synthesized
ctttactcaacaaggaaaaaaa

SEQ ID NO: 1353499 - DNA, 22 bp, Artificial Sequence
  chemically synthesized
tactcaacaaggaaaaaaaaaa

SEQ ID NO: 1353500 - DNA, 22 bp, Artificial Sequence
  chemically synthesized
actcaacaaggaaaaaaaaaaa

SEQ ID NO: 1353501 - DNA, 22 bp, Artificial Sequence
  chemically synthesized
ctcaacaaggaaaaaaaaaaac

SEQ ID NO: 1353502 - DNA, 22 bp, Artificial Sequence
  chemically synthesized
cagagtgttctgaggttttttt

SEQ ID NO: 1353503 - DNA, 22 bp, Artificial Sequence
  chemically synthesized
aacaaggaaaaaaaaaaacctc

SEQ ID NO: 1353504 - DNA, 22 bp, Artificial Sequence
  chemically synthesized
tagaagcagctgcagagtgttc

SEQ ID NO: 1353505 - DNA, 22 bp, Artificial Sequence
  chemically synthesized
atagaagcagctgcagagtgtt

SEQ ID NO: 1353506 - DNA, 22 bp, Artificial Sequence
  chemically synthesized
tatagaagcagctgcagagtgt

SEQ ID NO: 1353507 - DNA, 22 bp, Artificial Sequence
  chemically synthesized
tttatagaagcagctgcagagt

SEQ ID NO: 1353508 - DNA, 22 bp, Artificial Sequence
  chemically synthesized
ctttatagaagcagctgcagag

SEQ ID NO: 1353509 - DNA, 22 bp, Artificial Sequence
  chemically synthesized
tctttatagaagcagctgcaga

SEQ ID NO: 1353510 - DNA, 22 bp, Artificial Sequence
  chemically synthesized
ctttctttatagaagcagctgc

SEQ ID NO: 1353511 - DNA, 22 bp, Artificial Sequence
  chemically synthesized
agaacactctgcagctgcttct

SEQ ID NO: 1353512 - DNA, 22 bp, Artificial Sequence
  chemically synthesized
tgcagctgcttctataaagaaa

SEQ ID NO: 1353513 - DNA, 22 bp, Artificial Sequence
  chemically synthesized
aacccacactgctttctttata

SEQ ID NO: 1353514 - DNA, 22 bp, Artificial Sequence
  chemically synthesized
cagctgcttctataaagaaagc

SEQ ID NO: 1353515 - DNA, 22 bp, Artificial Sequence
  chemically synthesized
cttctataaagaaagcagtgtg

SEQ ID NO: 1353516 - DNA, 22 bp, Artificial Sequence
  chemically synthesized
ctataaagaaagcagtgtgggt

SEQ ID NO: 1353517 - DNA, 22 bp, Artificial Sequence
  chemically synthesized
taaacaaattaaacccacactg

SEQ ID NO: 1353518 - DNA, 22 bp, Artificial Sequence
  chemically synthesized
tataaagaaagcagtgtgggtt

SEQ ID NO: 1353519 - DNA, 22 bp, Artificial Sequence
  chemically synthesized
taaagaaagcagtgtgggttta

SEQ ID NO: 1353520 - DNA, 22 bp, Artificial Sequence
  chemically synthesized
atgaaatgaaggacagattata

SEQ ID NO: 1353521 - DNA, 22 bp, Artificial Sequence
  chemically synthesized
aatgaaatgaaggacagattat

SEQ ID NO: 1353522 - DNA, 22 bp, Artificial Sequence
  chemically synthesized
aatttgtttataatctgtcctt

SEQ ID NO: 1353523 - DNA, 22 bp, Artificial Sequence
  chemically synthesized
atttgtttataatctgtccttc

SEQ ID NO: 1353524 - DNA, 22 bp, Artificial Sequence
  chemically synthesized
gaggcttaatgaaatgaaggac

SEQ ID NO: 1353525 - DNA, 22 bp, Artificial Sequence
  chemically synthesized
gtttataatctgtccttcattt

SEQ ID NO: 1353526 - DNA, 22 bp, Artificial Sequence
  chemically synthesized
agaggcttaatgaaatgaagga

SEQ ID NO: 1353527 - DNA, 22 bp, Artificial Sequence
  chemically synthesized
tttataatctgtccttcatttc

SEQ ID NO: 1353528 - DNA, 22 bp, Artificial Sequence
  chemically synthesized
ataatctgtccttcatttcatt

SEQ ID NO: 1353529 - DNA, 22 bp, Artificial Sequence
  chemically synthesized
taatctgtccttcatttcatta

SEQ ID NO: 1353530 - DNA, 22 bp, Artificial Sequence
  chemically synthesized
tccttcatttcattaagcctct

SEQ ID NO: 1353531 - DNA, 22 bp, Artificial Sequence
  chemically synthesized
catttcattaagcctctaagtc

SEQ ID NO: 1353532 - DNA, 22 bp, Artificial Sequence
  chemically synthesized
atttcattaagcctctaagtca

SEQ ID NO: 1353533 - DNA, 22 bp, Artificial Sequence
  chemically synthesized
cattaagcctctaagtcatggc

SEQ ID NO: 1353534 - DNA, 22 bp, Artificial Sequence
  chemically synthesized
attaagcctctaagtcatggcc

SEQ ID NO: 1353535 - DNA, 22 bp, Artificial Sequence
  chemically synthesized
agcctctaagtcatggccattg

SEQ ID NO: 1353536 - DNA, 22 bp, Artificial Sequence
  chemically synthesized
agcacagtggtagcaatggcca

SEQ ID NO: 1353537 - DNA, 22 bp, Artificial Sequence
  chemically synthesized
aagcacagtggtagcaatggcc

SEQ ID NO: 1353538 - DNA, 22 bp, Artificial Sequence
  chemically synthesized
taagcacagtggtagcaatggc

SEQ ID NO: 1353539 - DNA, 22 bp, Artificial Sequence
  chemically synthesized
ttaagcacagtggtagcaatgg

SEQ ID NO: 1353540 - DNA, 22 bp, Artificial Sequence
  chemically synthesized
taagtcatggccattgctacca

SEQ ID NO: 1353541 - DNA, 22 bp, Artificial Sequence
  chemically synthesized
tttttaagcacagtggtagcaa

SEQ ID NO: 1353542 - DNA, 22 bp, Artificial Sequence
  chemically synthesized
agtcatggccattgctaccact

SEQ ID NO: 1353543 - DNA, 22 bp, Artificial Sequence
  chemically synthesized
gtttttaagcacagtggtagca

SEQ ID NO: 1353544 - DNA, 22 bp, Artificial Sequence
  chemically synthesized
ttgtttttaagcacagtggtag

SEQ ID NO: 1353545 - DNA, 22 bp, Artificial Sequence
  chemically synthesized
tcttgtttttaagcacagtggt

SEQ ID NO: 1353546 - DNA, 22 bp, Artificial Sequence
  chemically synthesized
ctcttgtttttaagcacagtgg

SEQ ID NO: 1353547 - DNA, 22 bp, Artificial Sequence
  chemically synthesized
tctcttgtttttaagcacagtg

SEQ ID NO: 1353548 - DNA, 22 bp, Artificial Sequence
  chemically synthesized
ttctcttgtttttaagcacagt

SEQ ID NO: 1353549 - DNA, 22 bp, Artificial Sequence
  chemically synthesized
acttttctcttgtttttaagca

SEQ ID NO: 1353550 - DNA, 22 bp, Artificial Sequence
  chemically synthesized
ctaccactgtgcttaaaaacaa

SEQ ID NO: 1353551 - DNA, 22 bp, Artificial Sequence
  chemically synthesized
ccactgtgcttaaaaacaagag

SEQ ID NO: 1353552 - DNA, 22 bp, Artificial Sequence
  chemically synthesized
taagcattcacttttctcttgt

SEQ ID NO: 1353553 - DNA, 22 bp, Artificial Sequence
  chemically synthesized
ataagcattcacttttctcttg

SEQ ID NO: 1353554 - DNA, 22 bp, Artificial Sequence
  chemically synthesized
tataagcattcacttttctctt

SEQ ID NO: 1353555 - DNA, 22 bp, Artificial Sequence
  chemically synthesized
tgcttaaaaacaagagaaaagt

SEQ ID NO: 1353556 - DNA, 22 bp, Artificial Sequence
  chemically synthesized
tttataagcattcacttttctc

SEQ ID NO: 1353557 - DNA, 22 bp, Artificial Sequence
  chemically synthesized
aaaaacaagagaaaagtgaatg

SEQ ID NO: 1353558 - DNA, 22 bp, Artificial Sequence
  chemically synthesized
aaaacaagagaaaagtgaatgc

SEQ ID NO: 1353559 - DNA, 22 bp, Artificial Sequence
  chemically synthesized
ccactctttataagcattcact

SEQ ID NO: 1353560 - DNA, 22 bp, Artificial Sequence
  chemically synthesized
tacctgccactctttataagca

SEQ ID NO: 1353561 - DNA, 22 bp, Artificial Sequence
  chemically synthesized
ttgtacctgccactctttataa

SEQ ID NO: 1353562 - DNA, 22 bp, Artificial Sequence
  chemically synthesized
tacatcagttattgtacctgcc

SEQ ID NO: 1353563 - DNA, 22 bp, Artificial Sequence
  chemically synthesized
gtacatcagttattgtacctgc

SEQ ID NO: 1353564 - DNA, 22 bp, Artificial Sequence
  chemically synthesized
tgtacatcagttattgtacctg

SEQ ID NO: 1353565 - DNA, 22 bp, Artificial Sequence
  chemically synthesized
ataaagagtggcaggtacaata

SEQ ID NO: 1353566 - DNA, 22 bp, Artificial Sequence
  chemically synthesized
taaagagtggcaggtacaataa

SEQ ID NO: 1353567 - DNA, 22 bp, Artificial Sequence
  chemically synthesized
tttgtacatcagttattgtacc

SEQ ID NO: 1353568 - DNA, 22 bp, Artificial Sequence
  chemically synthesized
ctttgtacatcagttattgtac

SEQ ID NO: 1353569 - DNA, 22 bp, Artificial Sequence
  chemically synthesized
cttctttgtacatcagttattg

SEQ ID NO: 1353570 - DNA, 22 bp, Artificial Sequence
  chemically synthesized
ccttctttgtacatcagttatt

SEQ ID NO: 1353571 - DNA, 22 bp, Artificial Sequence
  chemically synthesized
tccttctttgtacatcagttat

SEQ ID NO: 1353572 - DNA, 22 bp, Artificial Sequence
  chemically synthesized
tgttttccttctttgtacatca

SEQ ID NO: 1353573 - DNA, 22 bp, Artificial Sequence
  chemically synthesized
atgtacaaagaaggaaaacaca

SEQ ID NO: 1353574 - DNA, 22 bp, Artificial Sequence
  chemically synthesized
tcaaaacacagtaatctgtgtt

SEQ ID NO: 1353575 - DNA, 22 bp, Artificial Sequence
  chemically synthesized
actatcaaaacacagtaatctg

SEQ ID NO: 1353576 - DNA, 22 bp, Artificial Sequence
  chemically synthesized
aactatcaaaacacagtaatct

SEQ ID NO: 1353577 - DNA, 22 bp, Artificial Sequence
  chemically synthesized
taactatcaaaacacagtaatc

SEQ ID NO: 1353578 - DNA, 22 bp, Artificial Sequence
  chemically synthesized
ttaactatcaaaacacagtaat

SEQ ID NO: 1353579 - DNA, 22 bp, Artificial Sequence
  chemically synthesized
ccttttaactatcaaaacacag

SEQ ID NO: 1353580 - DNA, 22 bp, Artificial Sequence
  chemically synthesized
gctcccttttaactatcaaaac

SEQ ID NO: 1353581 - DNA, 22 bp, Artificial Sequence
  chemically synthesized
tggctcccttttaactatcaaa

SEQ ID NO: 1353582 - DNA, 22 bp, Artificial Sequence
  chemically synthesized
ttctggctcccttttaactatc

SEQ ID NO: 1353583 - DNA, 22 bp, Artificial Sequence
  chemically synthesized
ctgtgttttgatagttaaaagg

SEQ ID NO: 1353584 - DNA, 22 bp, Artificial Sequence
  chemically synthesized
cctattctggctcccttttaac

SEQ ID NO: 1353585 - DNA, 22 bp, Artificial Sequence
  chemically synthesized
tgttttgatagttaaaagggag

SEQ ID NO: 1353586 - DNA, 22 bp, Artificial Sequence
  chemically synthesized
gctccctattctggctcccttt

SEQ ID NO: 1353587 - DNA, 22 bp, Artificial Sequence
  chemically synthesized
agctccctattctggctccctt

SEQ ID NO: 1353588 - DNA, 22 bp, Artificial Sequence
  chemically synthesized
tgatagttaaaagggagccaga

SEQ ID NO: 1353589 - DNA, 22 bp, Artificial Sequence
  chemically synthesized
gatagttaaaagggagccagaa

SEQ ID NO: 1353590 - DNA, 22 bp, Artificial Sequence
  chemically synthesized
cttagctccctattctggctcc

SEQ ID NO: 1353591 - DNA, 22 bp, Artificial Sequence
  chemically synthesized
atagttaaaagggagccagaat

SEQ ID NO: 1353592 - DNA, 22 bp, Artificial Sequence
  chemically synthesized
aaagggagccagaatagggagc

SEQ ID NO: 1353593 - DNA, 22 bp, Artificial Sequence
  chemically synthesized
atatcagactccttagctccct

SEQ ID NO: 1353594 - DNA, 22 bp, Artificial Sequence
  chemically synthesized
ttgatatcagactccttagctc

SEQ ID NO: 1353595 - DNA, 22 bp, Artificial Sequence
  chemically synthesized
aggagtctgatatcaatagcgt

SEQ ID NO: 1353596 - DNA, 22 bp, Artificial Sequence
  chemically synthesized
aacaaaggtaaaataatgtacg

SEQ ID NO: 1353597 - DNA, 22 bp, Artificial Sequence
  chemically synthesized
atatcaatagcgtacattattt

SEQ ID NO: 1353598 - DNA, 22 bp, Artificial Sequence
  chemically synthesized
gatcagcattcaacaaaggtaa

SEQ ID NO: 1353599 - DNA, 22 bp, Artificial Sequence
  chemically synthesized
tggatcagcattcaacaaaggt

SEQ ID NO: 1353600 - DNA, 22 bp, Artificial Sequence
  chemically synthesized
ctggatcagcattcaacaaagg

SEQ ID NO: 1353601 - DNA, 22 bp, Artificial Sequence
  chemically synthesized
accttctggatcagcattcaac

SEQ ID NO: 1353602 - DNA, 22 bp, Artificial Sequence
  chemically synthesized
ttttacctttgttgaatgctga

SEQ ID NO: 1353603 - DNA, 22 bp, Artificial Sequence
  chemically synthesized
tacctttgttgaatgctgatcc

SEQ ID NO: 1353604 - DNA, 22 bp, Artificial Sequence
  chemically synthesized
acctttgttgaatgctgatcca

SEQ ID NO: 1353605 - DNA, 22 bp, Artificial Sequence
  chemically synthesized
cctttgttgaatgctgatccag

SEQ ID NO: 1353606 - DNA, 22 bp, Artificial Sequence
  chemically synthesized
gacatattaaccttctggatca

SEQ ID NO: 1353607 - DNA, 22 bp, Artificial Sequence
  chemically synthesized
agacatattaaccttctggatc

SEQ ID NO: 1353608 - DNA, 22 bp, Artificial Sequence
  chemically synthesized
tgttgaatgctgatccagaagg

SEQ ID NO: 1353609 - DNA, 22 bp, Artificial Sequence
  chemically synthesized
gttgaatgctgatccagaaggt

SEQ ID NO: 1353610 - DNA, 22 bp, Artificial Sequence
  chemically synthesized
ttagacatattaaccttctgga

SEQ ID NO: 1353611 - DNA, 22 bp, Artificial Sequence
  chemically synthesized
ttgaatgctgatccagaaggtt

SEQ ID NO: 1353612 - DNA, 22 bp, Artificial Sequence
  chemically synthesized
aatgctgatccagaaggttaat

SEQ ID NO: 1353613 - DNA, 22 bp, Artificial Sequence
  chemically synthesized
atccagaaggttaatatgtcta

SEQ ID NO: 1353614 - DNA, 22 bp, Artificial Sequence
  chemically synthesized
acaaatgcacattcttagacat

SEQ ID NO: 1353615 - DNA, 22 bp, Artificial Sequence
  chemically synthesized
cacaaatgcacattcttagaca

SEQ ID NO: 1353616 - DNA, 22 bp, Artificial Sequence
  chemically synthesized
atatgtctaagaatgtgcattt

SEQ ID NO: 1353617 - DNA, 22 bp, Artificial Sequence
  chemically synthesized
gcacatagggaaatttcacaaa

SEQ ID NO: 1353618 - DNA, 22 bp, Artificial Sequence
  chemically synthesized
agaatgtgcatttgtgaaattt

SEQ ID NO: 1353619 - DNA, 22 bp, Artificial Sequence
  chemically synthesized
tgctagcacatagggaaatttc

SEQ ID NO: 1353620 - DNA, 22 bp, Artificial Sequence
  chemically synthesized
gtgagattatgctagcacatag

SEQ ID NO: 1353621 - DNA, 22 bp, Artificial Sequence
  chemically synthesized
gtgaaatttccctatgtgctag

SEQ ID NO: 1353622 - DNA, 22 bp, Artificial Sequence
  chemically synthesized
tgaaatttccctatgtgctagc

SEQ ID NO: 1353623 - DNA, 22 bp, Artificial Sequence
  chemically synthesized
ccctatgtgctagcataatctc

SEQ ID NO: 1353624 - DNA, 22 bp, Artificial Sequence
  chemically synthesized
cctatgtgctagcataatctca

SEQ ID NO: 1353625 - DNA, 22 bp, Artificial Sequence
  chemically synthesized
tgtgctagcataatctcactag

SEQ ID NO: 1353626 - DNA, 22 bp, Artificial Sequence
  chemically synthesized
atggaaatcatgcaacacctag

SEQ ID NO: 1353627 - DNA, 22 bp, Artificial Sequence
  chemically synthesized
gcataatctcactaggtgttgc

SEQ ID NO: 1353628 - DNA, 22 bp, Artificial Sequence
  chemically synthesized
ctcatggaaatcatgcaacacc

SEQ ID NO: 1353629 - DNA, 22 bp, Artificial Sequence
  chemically synthesized
cctcatggaaatcatgcaacac

SEQ ID NO: 1353630 - DNA, 22 bp, Artificial Sequence
  chemically synthesized
tcctcatggaaatcatgcaaca

SEQ ID NO: 1353631 - DNA, 22 bp, Artificial Sequence
  chemically synthesized
actaggtgttgcatgatttcca

SEQ ID NO: 1353632 - DNA, 22 bp, Artificial Sequence
  chemically synthesized
ggtgttgcatgatttccatgag

SEQ ID NO: 1353633 - DNA, 22 bp, Artificial Sequence
  chemically synthesized
aaacccagctttcctcatggaa

SEQ ID NO: 1353634 - DNA, 22 bp, Artificial Sequence
  chemically synthesized
cactaaaacccagctttcctca

SEQ ID NO: 1353635 - DNA, 22 bp, Artificial Sequence
  chemically synthesized
catgatttccatgaggaaagct

SEQ ID NO: 1353636 - DNA, 22 bp, Artificial Sequence
  chemically synthesized
ttccactaaaacccagctttcc

SEQ ID NO: 1353637 - DNA, 22 bp, Artificial Sequence
  chemically synthesized
attccactaaaacccagctttc

SEQ ID NO: 1353638 - DNA, 22 bp, Artificial Sequence
  chemically synthesized
ccatgaggaaagctgggtttta

SEQ ID NO: 1353639 - DNA, 22 bp, Artificial Sequence
  chemically synthesized
catgaggaaagctgggttttag

SEQ ID NO: 1353640 - DNA, 22 bp, Artificial Sequence
  chemically synthesized
atgtagaataatttattccact

SEQ ID NO: 1353641 - DNA, 22 bp, Artificial Sequence
  chemically synthesized
ggttttagtggaataaattatt

SEQ ID NO: 1353642 - DNA, 22 bp, Artificial Sequence
  chemically synthesized
tagtggaataaattattctaca

SEQ ID NO: 1353643 - DNA, 22 bp, Artificial Sequence
  chemically synthesized
agtggaataaattattctacat

SEQ ID NO: 1353644 - DNA, 22 bp, Artificial Sequence
  chemically synthesized
gtggaataaattattctacatt

SEQ ID NO: 1353645 - DNA, 22 bp, Artificial Sequence
  chemically synthesized
tgagaagacaaaaaaatctaat

SEQ ID NO: 1353646 - DNA, 22 bp, Artificial Sequence
  chemically synthesized
ttctacattagatttttttgtc

SEQ ID NO: 1353647 - DNA, 22 bp, Artificial Sequence
  chemically synthesized
tacattagatttttttgtcttc

SEQ ID NO: 1353648 - DNA, 22 bp, Artificial Sequence
  chemically synthesized
cattagatttttttgtcttctc

SEQ ID NO: 1353649 - DNA, 22 bp, Artificial Sequence
  chemically synthesized
gatttttttgtcttctcataac

SEQ ID NO: 1353650 - DNA, 22 bp, Artificial Sequence
  chemically synthesized
caaataaaaaacagttatgaga

SEQ ID NO: 1353651 - DNA, 22 bp, Artificial Sequence
  chemically synthesized
acaaataaaaaacagttatgag

SEQ ID NO: 1353652 - DNA, 22 bp, Artificial Sequence
  chemically synthesized
ttttgtcttctcataactgttt

SEQ ID NO: 1353653 - DNA, 22 bp, Artificial Sequence
  chemically synthesized
tttacaaataaaaaacagttat

SEQ ID NO: 1353654 - DNA, 22 bp, Artificial Sequence
  chemically synthesized
tttgtcttctcataactgtttt

SEQ ID NO: 1353655 - DNA, 22 bp, Artificial Sequence
  chemically synthesized
gtttacaaataaaaaacagtta

SEQ ID NO: 1353656 - DNA, 22 bp, Artificial Sequence
  chemically synthesized
ttgtcttctcataactgttttt

SEQ ID NO: 1353657 - DNA, 22 bp, Artificial Sequence
  chemically synthesized
tgtttacaaataaaaaacagtt

SEQ ID NO: 1353658 - DNA, 22 bp, Artificial Sequence
  chemically synthesized
tgtcttctcataactgtttttt

SEQ ID NO: 1353659 - DNA, 22 bp, Artificial Sequence
  chemically synthesized
ttgtttacaaataaaaaacagt

SEQ ID NO: 1353660 - DNA, 22 bp, Artificial Sequence
  chemically synthesized
gtcttctcataactgtttttta

SEQ ID NO: 1353661 - DNA, 22 bp, Artificial Sequence
  chemically synthesized
tcttctcataactgttttttat

SEQ ID NO: 1353662 - DNA, 22 bp, Artificial Sequence
  chemically synthesized
ctcataactgttttttatttgt

SEQ ID NO: 1353663 - DNA, 22 bp, Artificial Sequence
  chemically synthesized
tcataactgttttttatttgta

SEQ ID NO: 1353664 - DNA, 22 bp, Artificial Sequence
  chemically synthesized
ataactgttttttatttgtaaa

SEQ ID NO: 1353665 - DNA, 22 bp, Artificial Sequence
  chemically synthesized
ttttttatttgtaaacaaaagt

SEQ ID NO: 1353666 - DNA, 22 bp, Artificial Sequence
  chemically synthesized
tttatttgtaaacaaaagtaca

SEQ ID NO: 1353667 - DNA, 22 bp, Artificial Sequence
  chemically synthesized
ttatttgtaaacaaaagtacat

SEQ ID NO: 1353668 - DNA, 22 bp, Artificial Sequence
  chemically synthesized
tatttgtaaacaaaagtacatg

SEQ ID NO: 1353669 - DNA, 22 bp, Artificial Sequence
  chemically synthesized
atttgtaaacaaaagtacatgc

SEQ ID NO: 1353670 - DNA, 22 bp, Artificial Sequence
  chemically synthesized
tttgtaaacaaaagtacatgca

SEQ ID NO: 1353671 - DNA, 22 bp, Artificial Sequence
  chemically synthesized
gtaaacaaaagtacatgcacac

SEQ ID NO: 1353672 - DNA, 22 bp, Artificial Sequence
  chemically synthesized
taaacaaaagtacatgcacaca

SEQ ID NO: 1353673 - DNA, 22 bp, Artificial Sequence
  chemically synthesized
aggataccgtaaatgtgtgcat

SEQ ID NO: 1353674 - DNA, 22 bp, Artificial Sequence
  chemically synthesized
atagcaatacctgaggataccg

SEQ ID NO: 1353675 - DNA, 22 bp, Artificial Sequence
  chemically synthesized
gatagcaatacctgaggatacc

SEQ ID NO: 1353676 - DNA, 22 bp, Artificial Sequence
  chemically synthesized
tgatagcaatacctgaggatac

SEQ ID NO: 1353677 - DNA, 22 bp, Artificial Sequence
  chemically synthesized
ttttgatagcaatacctgagga

SEQ ID NO: 1353678 - DNA, 22 bp, Artificial Sequence
  chemically synthesized
ctgttttgatagcaatacctga

SEQ ID NO: 1353679 - DNA, 22 bp, Artificial Sequence
  chemically synthesized
acggtatcctcaggtattgcta

SEQ ID NO: 1353680 - DNA, 22 bp, Artificial Sequence
  chemically synthesized
ttactgttttgatagcaatacc

SEQ ID NO: 1353681 - DNA, 22 bp, Artificial Sequence
  chemically synthesized
cggtatcctcaggtattgctat

SEQ ID NO: 1353682 - DNA, 22 bp, Artificial Sequence
  chemically synthesized
attactgttttgatagcaatac

SEQ ID NO: 1353683 - DNA, 22 bp, Artificial Sequence
  chemically synthesized
tattactgttttgatagcaata

SEQ ID NO: 1353684 - DNA, 22 bp, Artificial Sequence
  chemically synthesized
ttttattactgttttgatagca

SEQ ID NO: 1353685 - DNA, 22 bp, Artificial Sequence
  chemically synthesized
aggtattgctatcaaaacagta

SEQ ID NO: 1353686 - DNA, 22 bp, Artificial Sequence
  chemically synthesized
ctatcaaaacagtaataaaata

SEQ ID NO: 1353687 - DNA, 22 bp, Artificial Sequence
  chemically synthesized
tcaaaacagtaataaaataacg

SEQ ID NO: 1353688 - DNA, 22 bp, Artificial Sequence
  chemically synthesized
aaaaagaatagtgcgttatttt

SEQ ID NO: 1353689 - DNA, 22 bp, Artificial Sequence
  chemically synthesized
acaacaaaaaaaaatcattaaa

SEQ ID NO: 1353690 - DNA, 22 bp, Artificial Sequence
  chemically synthesized
ttcttttttaatgatttttttt

SEQ ID NO: 1353691 - DNA, 22 bp, Artificial Sequence
  chemically synthesized
ttttttaatgatttttttttgt

SEQ ID NO: 1353692 - DNA, 22 bp, Artificial Sequence
  chemically synthesized
atgtcagttcacaacaaaaaaa

SEQ ID NO: 1353693 - DNA, 22 bp, Artificial Sequence
  chemically synthesized
ttttaatgatttttttttgttg

SEQ ID NO: 1353694 - DNA, 22 bp, Artificial Sequence
  chemically synthesized
tttaatgatttttttttgttgt

SEQ ID NO: 1353695 - DNA, 22 bp, Artificial Sequence
  chemically synthesized
ttaatgatttttttttgttgtg

SEQ ID NO: 1353696 - DNA, 22 bp, Artificial Sequence
  chemically synthesized
taatgatttttttttgttgtga

SEQ ID NO: 1353697 - DNA, 22 bp, Artificial Sequence
  chemically synthesized
aatgatttttttttgttgtgaa

SEQ ID NO: 1353698 - DNA, 22 bp, Artificial Sequence
  chemically synthesized
atgatttttttttgttgtgaac

SEQ ID NO: 1353699 - DNA, 22 bp, Artificial Sequence
  chemically synthesized
ttttttgttgtgaactgacatg

SEQ ID NO: 1353700 - DNA, 22 bp, Artificial Sequence
  chemically synthesized
tttttgttgtgaactgacatga

SEQ ID NO: 1353701 - DNA, 22 bp, Artificial Sequence
  chemically synthesized
gtatatgaaagctcatgtcagt

SEQ ID NO: 1353702 - DNA, 22 bp, Artificial Sequence
  chemically synthesized
ttttgttgtgaactgacatgag

SEQ ID NO: 1353703 - DNA, 22 bp, Artificial Sequence
  chemically synthesized
cgtatatgaaagctcatgtcag

SEQ ID NO: 1353704 - DNA, 22 bp, Artificial Sequence
  chemically synthesized
tttgttgtgaactgacatgagc

SEQ ID NO: 1353705 - DNA, 22 bp, Artificial Sequence
  chemically synthesized
ttgttgtgaactgacatgagct

SEQ ID NO: 1353706 - DNA, 22 bp, Artificial Sequence
  chemically synthesized
tgttgtgaactgacatgagctt

SEQ ID NO: 1353707 - DNA, 22 bp, Artificial Sequence
  chemically synthesized
gttgtgaactgacatgagcttt

SEQ ID NO: 1353708 - DNA, 22 bp, Artificial Sequence
  chemically synthesized
ttgtgaactgacatgagctttc

SEQ ID NO: 1353709 - DNA, 22 bp, Artificial Sequence
  chemically synthesized
tgaactgacatgagctttcata

SEQ ID NO: 1353710 - DNA, 22 bp, Artificial Sequence
  chemically synthesized
aaaatcggatttcgtatatgaa

SEQ ID NO: 1353711 - DNA, 22 bp, Artificial Sequence
  chemically synthesized
caaaatcggatttcgtatatga

SEQ ID NO: 1353712 - DNA, 22 bp, Artificial Sequence
  chemically synthesized
acatgagctttcatatacgaaa

SEQ ID NO: 1353713 - DNA, 22 bp, Artificial Sequence
  chemically synthesized
tatttcaaaatcggatttcgta

SEQ ID NO: 1353714 - DNA, 22 bp, Artificial Sequence
  chemically synthesized
atatttcaaaatcggatttcgt

SEQ ID NO: 1353715 - DNA, 22 bp, Artificial Sequence
  chemically synthesized
tcatatacgaaatccgattttg

SEQ ID NO: 1353716 - DNA, 22 bp, Artificial Sequence
  chemically synthesized
catatacgaaatccgattttga

SEQ ID NO: 1353717 - DNA, 22 bp, Artificial Sequence
  chemically synthesized
atatacgaaatccgattttgaa

SEQ ID NO: 1353718 - DNA, 22 bp, Artificial Sequence
  chemically synthesized
aaaataaatgtgccttatattt

SEQ ID NO: 1353719 - DNA, 22 bp, Artificial Sequence
  chemically synthesized
caaaataaatgtgccttatatt

SEQ ID NO: 1353720 - DNA, 22 bp, Artificial Sequence
  chemically synthesized
atttcaaaataaatgtgcctta

SEQ ID NO: 1353721 - DNA, 22 bp, Artificial Sequence
  chemically synthesized
ttaatttcaaaataaatgtgcc

SEQ ID NO: 1353722 - DNA, 22 bp, Artificial Sequence
  chemically synthesized
tgaaatataaggcacatttatt

SEQ ID NO: 1353723 - DNA, 22 bp, Artificial Sequence
  chemically synthesized
gaaatataaggcacatttattt

SEQ ID NO: 1353724 - DNA, 22 bp, Artificial Sequence
  chemically synthesized
aaatataaggcacatttatttt

SEQ ID NO: 1353725 - DNA, 22 bp, Artificial Sequence
  chemically synthesized
cctattaatttcaaaataaatg

SEQ ID NO: 1353726 - DNA, 22 bp, Artificial Sequence
  chemically synthesized
gattccctattaatttcaaaat

SEQ ID NO: 1353727 - DNA, 22 bp, Artificial Sequence
  chemically synthesized
acctagattccctattaatttc

SEQ ID NO: 1353728 - DNA, 22 bp, Artificial Sequence
  chemically synthesized
gacctagattccctattaattt

SEQ ID NO: 1353729 - DNA, 22 bp, Artificial Sequence
  chemically synthesized
tttgacctagattccctattaa

SEQ ID NO: 1353730 - DNA, 22 bp, Artificial Sequence
  chemically synthesized
gtttgacctagattccctatta

SEQ ID NO: 1353731 - DNA, 22 bp, Artificial Sequence
  chemically synthesized
tgtttgacctagattccctatt

SEQ ID NO: 1353732 - DNA, 22 bp, Artificial Sequence
  chemically synthesized
attttgaaattaatagggaatc

SEQ ID NO: 1353733 - DNA, 22 bp, Artificial Sequence
  chemically synthesized
ttttgaaattaatagggaatct

SEQ ID NO: 1353734 - DNA, 22 bp, Artificial Sequence
  chemically synthesized
ctttgtttgacctagattccct

SEQ ID NO: 1353735 - DNA, 22 bp, Artificial Sequence
  chemically synthesized
gctttgtttgacctagattccc

SEQ ID NO: 1353736 - DNA, 22 bp, Artificial Sequence
  chemically synthesized
tgaaattaatagggaatctagg

SEQ ID NO: 1353737 - DNA, 22 bp, Artificial Sequence
  chemically synthesized
tgctttgtttgacctagattcc

SEQ ID NO: 1353738 - DNA, 22 bp, Artificial Sequence
  chemically synthesized
gaaattaatagggaatctaggt

SEQ ID NO: 1353739 - DNA, 22 bp, Artificial Sequence
  chemically synthesized
aaattaatagggaatctaggtc

SEQ ID NO: 1353740 - DNA, 22 bp, Artificial Sequence
  chemically synthesized
gctttgctttgtttgacctaga

SEQ ID NO: 1353741 - DNA, 22 bp, Artificial Sequence
  chemically synthesized
ggctttgctttgtttgacctag

SEQ ID NO: 1353742 - DNA, 22 bp, Artificial Sequence
  chemically synthesized
atagggaatctaggtcaaacaa

SEQ ID NO: 1353743 - DNA, 22 bp, Artificial Sequence
  chemically synthesized
aggtttggctttgctttgtttg

SEQ ID NO: 1353744 - DNA, 22 bp, Artificial Sequence
  chemically synthesized
taaaattaaggtttggctttgc

SEQ ID NO: 1353745 - DNA, 22 bp, Artificial Sequence
  chemically synthesized
ggtcaaacaaagcaaagccaaa

SEQ ID NO: 1353746 - DNA, 22 bp, Artificial Sequence
  chemically synthesized
tgtaaaattaaggtttggcttt

SEQ ID NO: 1353747 - DNA, 22 bp, Artificial Sequence
  chemically synthesized
tagaggtagaacagttctgtaa

SEQ ID NO: 1353748 - DNA, 22 bp, Artificial Sequence
  chemically synthesized
gtagaggtagaacagttctgta

SEQ ID NO: 1353749 - DNA, 22 bp, Artificial Sequence
  chemically synthesized
tgtagaggtagaacagttctgt

SEQ ID NO: 1353750 - DNA, 22 bp, Artificial Sequence
  chemically synthesized
ttgtagaggtagaacagttctg

SEQ ID NO: 1353751 - DNA, 22 bp, Artificial Sequence
  chemically synthesized
tttgtagaggtagaacagttct

SEQ ID NO: 1353752 - DNA, 22 bp, Artificial Sequence
  chemically synthesized
aattttacagaactgttctacc

SEQ ID NO: 1353753 - DNA, 22 bp, Artificial Sequence
  chemically synthesized
attttacagaactgttctacct

SEQ ID NO: 1353754 - DNA, 22 bp, Artificial Sequence
  chemically synthesized
agtgactttttgtagaggtaga

SEQ ID NO: 1353755 - DNA, 22 bp, Artificial Sequence
  chemically synthesized
tacagaactgttctacctctac

SEQ ID NO: 1353756 - DNA, 22 bp, Artificial Sequence
  chemically synthesized
gagtgactttttgtagaggtag

SEQ ID NO: 1353757 - DNA, 22 bp, Artificial Sequence
  chemically synthesized
acagaactgttctacctctaca

SEQ ID NO: 1353758 - DNA, 22 bp, Artificial Sequence
  chemically synthesized
tgagtgactttttgtagaggta

SEQ ID NO: 1353759 - DNA, 22 bp, Artificial Sequence
  chemically synthesized
cagaactgttctacctctacaa

SEQ ID NO: 1353760 - DNA, 22 bp, Artificial Sequence
  chemically synthesized
ttttgagtgactttttgtagag

SEQ ID NO: 1353761 - DNA, 22 bp, Artificial Sequence
  chemically synthesized
ttctacctctacaaaaagtcac

SEQ ID NO: 1353762 - DNA, 22 bp, Artificial Sequence
  chemically synthesized
aacaattgttttgagtgacttt

SEQ ID NO: 1353763 - DNA, 22 bp, Artificial Sequence
  chemically synthesized
tacctctacaaaaagtcactca

SEQ ID NO: 1353764 - DNA, 22 bp, Artificial Sequence
  chemically synthesized
aaacaattgttttgagtgactt

SEQ ID NO: 1353765 - DNA, 22 bp, Artificial Sequence
  chemically synthesized
cctctacaaaaagtcactcaaa

SEQ ID NO: 1353766 - DNA, 22 bp, Artificial Sequence
  chemically synthesized
tacaaaaagtcactcaaaacaa

SEQ ID NO: 1353767 - DNA, 22 bp, Artificial Sequence
  chemically synthesized
caaaaagtcactcaaaacaatt

SEQ ID NO: 1353768 - DNA, 22 bp, Artificial Sequence
  chemically synthesized
cacacaatttaaacaattgttt

SEQ ID NO: 1353769 - DNA, 22 bp, Artificial Sequence
  chemically synthesized
ttgcacacaatttaaacaattg

SEQ ID NO: 1353770 - DNA, 22 bp, Artificial Sequence
  chemically synthesized
aaaacaattgtttaaattgtgt

SEQ ID NO: 1353771 - DNA, 22 bp, Artificial Sequence
  chemically synthesized
aagataattattgcacacaatt

SEQ ID NO: 1353772 - DNA, 22 bp, Artificial Sequence
  chemically synthesized
caagataattattgcacacaat

SEQ ID NO: 1353773 - DNA, 22 bp, Artificial Sequence
  chemically synthesized
tcaagataattattgcacacaa

SEQ ID NO: 1353774 - DNA, 22 bp, Artificial Sequence
  chemically synthesized
tttaaattgtgtgcaataatta

SEQ ID NO: 1353775 - DNA, 22 bp, Artificial Sequence
  chemically synthesized
aaattgtgtgcaataattatct

SEQ ID NO: 1353776 - DNA, 22 bp, Artificial Sequence
  chemically synthesized
aattgtgtgcaataattatctt

SEQ ID NO: 1353777 - DNA, 22 bp, Artificial Sequence
  chemically synthesized
aaatgcattttcaagataatta

SEQ ID NO: 1353778 - DNA, 22 bp, Artificial Sequence
  chemically synthesized
tgtgcaataattatcttgaaaa

SEQ ID NO: 1353779 - DNA, 22 bp, Artificial Sequence
  chemically synthesized
taggaacatgttaaaatgcatt

SEQ ID NO: 1353780 - DNA, 22 bp, Artificial Sequence
  chemically synthesized
ataggaacatgttaaaatgcat

SEQ ID NO: 1353781 - DNA, 22 bp, Artificial Sequence
  chemically synthesized
tcttgaaaatgcattttaacat

SEQ ID NO: 1353782 - DNA, 22 bp, Artificial Sequence
  chemically synthesized
tatttataggaacatgttaaaa

SEQ ID NO: 1353783 - DNA, 22 bp, Artificial Sequence
  chemically synthesized
gaaaatgcattttaacatgttc

SEQ ID NO: 1353784 - DNA, 22 bp, Artificial Sequence
  chemically synthesized
aaaatgcattttaacatgttcc

SEQ ID NO: 1353785 - DNA, 22 bp, Artificial Sequence
  chemically synthesized
gtcatatggaattatatttata

SEQ ID NO: 1353786 - DNA, 22 bp, Artificial Sequence
  chemically synthesized
taacatgttcctataaatataa

SEQ ID NO: 1353787 - DNA, 22 bp, Artificial Sequence
  chemically synthesized
agtcatatggaattatatttat

SEQ ID NO: 1353788 - DNA, 22 bp, Artificial Sequence
  chemically synthesized
aacatgttcctataaatataat

SEQ ID NO: 1353789 - DNA, 22 bp, Artificial Sequence
  chemically synthesized
acatgttcctataaatataatt

SEQ ID NO: 1353790 - DNA, 22 bp, Artificial Sequence
  chemically synthesized
atcttagtcatatggaattata

SEQ ID NO: 1353791 - DNA, 22 bp, Artificial Sequence
  chemically synthesized
catcttagtcatatggaattat

SEQ ID NO: 1353792 - DNA, 22 bp, Artificial Sequence
  chemically synthesized
tcatcttagtcatatggaatta

SEQ ID NO: 1353793 - DNA, 22 bp, Artificial Sequence
  chemically synthesized
ctataaatataattccatatga

SEQ ID NO: 1353794 - DNA, 22 bp, Artificial Sequence
  chemically synthesized
ttttcatcttagtcatatggaa

SEQ ID NO: 1353795 - DNA, 22 bp, Artificial Sequence
  chemically synthesized
taaatataattccatatgacta

SEQ ID NO: 1353796 - DNA, 22 bp, Artificial Sequence
  chemically synthesized
ttattttcatcttagtcatatg

SEQ ID NO: 1353797 - DNA, 22 bp, Artificial Sequence
  chemically synthesized
attattttcatcttagtcatat

SEQ ID NO: 1353798 - DNA, 22 bp, Artificial Sequence
  chemically synthesized
tttattattttcatcttagtca

SEQ ID NO: 1353799 - DNA, 22 bp, Artificial Sequence
  chemically synthesized
atttattattttcatcttagtc

SEQ ID NO: 1353800 - DNA, 22 bp, Artificial Sequence
  chemically synthesized
tatttattattttcatcttagt

SEQ ID NO: 1353801 - DNA, 22 bp, Artificial Sequence
  chemically synthesized
ttttatttattattttcatctt

SEQ ID NO: 1353802 - DNA, 22 bp, Artificial Sequence
  chemically synthesized
catatgactaagatgaaaataa

SEQ ID NO: 1353803 - DNA, 22 bp, Artificial Sequence
  chemically synthesized
ttattttatttattattttcat

SEQ ID NO: 1353804 - DNA, 22 bp, Artificial Sequence
  chemically synthesized
cactattattttatttattatt

SEQ ID NO: 1353805 - DNA, 22 bp, Artificial Sequence
  chemically synthesized
ttccactattattttatttatt

SEQ ID NO: 1353806 - DNA, 22 bp, Artificial Sequence
  chemically synthesized
attccactattattttatttat

SEQ ID NO: 1353807 - DNA, 22 bp, Artificial Sequence
  chemically synthesized
agatgaaaataataaataaaat

SEQ ID NO: 1353808 - DNA, 22 bp, Artificial Sequence
  chemically synthesized
tattccactattattttattta

SEQ ID NO: 1353809 - DNA, 22 bp, Artificial Sequence
  chemically synthesized
atactttatttcctattttgat

SEQ ID NO: 1353810 - DNA, 22 bp, Artificial Sequence
  chemically synthesized
gaataatggggataaaatcaaa

SEQ ID NO: 1353811 - DNA, 22 bp, Artificial Sequence
  chemically synthesized
tatttcctattttgattttatc

SEQ ID NO: 1353812 - DNA, 22 bp, Artificial Sequence
  chemically synthesized
tggaataatggggataaaatca

SEQ ID NO: 1353813 - DNA, 22 bp, Artificial Sequence
  chemically synthesized
atttcctattttgattttatcc

SEQ ID NO: 1353814 - DNA, 22 bp, Artificial Sequence
  chemically synthesized
tttcctattttgattttatccc

SEQ ID NO: 1353815 - DNA, 22 bp, Artificial Sequence
  chemically synthesized
ttctggaataatggggataaaa

SEQ ID NO: 1353816 - DNA, 22 bp, Artificial Sequence
  chemically synthesized
gttctggaataatggggataaa

SEQ ID NO: 1353817 - DNA, 22 bp, Artificial Sequence
  chemically synthesized
cctattttgattttatccccat

SEQ ID NO: 1353818 - DNA, 22 bp, Artificial Sequence
  chemically synthesized
ctattttgattttatccccatt

SEQ ID NO: 1353819 - DNA, 22 bp, Artificial Sequence
  chemically synthesized
ttttgattttatccccattatt

SEQ ID NO: 1353820 - DNA, 22 bp, Artificial Sequence
  chemically synthesized
aatttgttctggaataatgggg

SEQ ID NO: 1353821 - DNA, 22 bp, Artificial Sequence
  chemically synthesized
tgattttatccccattattcca

SEQ ID NO: 1353822 - DNA, 22 bp, Artificial Sequence
  chemically synthesized
gattttatccccattattccag

SEQ ID NO: 1353823 - DNA, 22 bp, Artificial Sequence
  chemically synthesized
attttatccccattattccaga

SEQ ID NO: 1353824 - DNA, 22 bp, Artificial Sequence
  chemically synthesized
ccatattgaatttgttctggaa

SEQ ID NO: 1353825 - DNA, 22 bp, Artificial Sequence
  chemically synthesized
tatccccattattccagaacaa

SEQ ID NO: 1353826 - DNA, 22 bp, Artificial Sequence
  chemically synthesized
atccccattattccagaacaaa

SEQ ID NO: 1353827 - DNA, 22 bp, Artificial Sequence
  chemically synthesized
tccccattattccagaacaaat

SEQ ID NO: 1353828 - DNA, 22 bp, Artificial Sequence
  chemically synthesized
tctgccatattgaatttgttct

SEQ ID NO: 1353829 - DNA, 22 bp, Artificial Sequence
  chemically synthesized
atctgccatattgaatttgttc

SEQ ID NO: 1353830 - DNA, 22 bp, Artificial Sequence
  chemically synthesized
caatttatctgccatattgaat

SEQ ID NO: 1353831 - DNA, 22 bp, Artificial Sequence
  chemically synthesized
ttccagaacaaattcaatatgg

SEQ ID NO: 1353832 - DNA, 22 bp, Artificial Sequence
  chemically synthesized
gcaatttatctgccatattgaa

SEQ ID NO: 1353833 - DNA, 22 bp, Artificial Sequence
  chemically synthesized
cagaacaaattcaatatggcag

SEQ ID NO: 1353834 - DNA, 22 bp, Artificial Sequence
  chemically synthesized
aatatggcagataaattgcaag

SEQ ID NO: 1353835 - DNA, 22 bp, Artificial Sequence
  chemically synthesized
caaggatttattttttctttct

SEQ ID NO: 1353836 - DNA, 22 bp, Artificial Sequence
  chemically synthesized
aaaaaaaaaaaaaaaaaaaaag

SEQ ID NO: 1353837 - DNA, 22 bp, Artificial Sequence
  chemically synthesized
attttttctttctttttttttt

SEQ ID NO: 1353838 - DNA, 22 bp, Artificial Sequence
  chemically synthesized
ttttttctttcttttttttttt

SEQ ID NO: 1353839 - DNA, 22 bp, Artificial Sequence
  chemically synthesized
tctcaaaaaaaaaaaaaaaaaa

SEQ ID NO: 1353840 - DNA, 22 bp, Artificial Sequence
  chemically synthesized
tttctttctttttttttttttt

SEQ ID NO: 1353841 - DNA, 22 bp, Artificial Sequence
  chemically synthesized
ttctttcttttttttttttttt

SEQ ID NO: 1353842 - DNA, 22 bp, Artificial Sequence
  chemically synthesized
tgtctcaaaaaaaaaaaaaaaa

SEQ ID NO: 1353843 - DNA, 22 bp, Artificial Sequence
  chemically synthesized
tctttctttttttttttttttt

SEQ ID NO: 1353844 - DNA, 22 bp, Artificial Sequence
  chemically synthesized
ctttcttttttttttttttttt

SEQ ID NO: 1353845 - DNA, 22 bp, Artificial Sequence
  chemically synthesized
tttctttttttttttttttttt

SEQ ID NO: 1353846 - DNA, 22 bp, Artificial Sequence
  chemically synthesized
tctttttttttttttttttttt

SEQ ID NO: 1353847 - DNA, 22 bp, Artificial Sequence
  chemically synthesized
cttttttttttttttttttttt

SEQ ID NO: 1353848 - DNA, 22 bp, Artificial Sequence
  chemically synthesized
tttttttttttttttttttttg

SEQ ID NO: 1353849 - DNA, 22 bp, Artificial Sequence
  chemically synthesized
tttttttttttttttttttgag

SEQ ID NO: 1353850 - DNA, 22 bp, Artificial Sequence
  chemically synthesized
ttttttttttttttttttgaga

SEQ ID NO: 1353851 - DNA, 22 bp, Artificial Sequence
  chemically synthesized
tttttttttttttttttgagac

SEQ ID NO: 1353852 - DNA, 22 bp, Artificial Sequence
  chemically synthesized
ttttttttttttttttgagaca

SEQ ID NO: 1353853 - DNA, 22 bp, Artificial Sequence
  chemically synthesized
tttttttttttttttgagacag

SEQ ID NO: 1353854 - DNA, 22 bp, Artificial Sequence
  chemically synthesized
ttttttttttttttgagacaga

SEQ ID NO: 1353855 - DNA, 22 bp, Artificial Sequence
  chemically synthesized
tttttttttttttgagacagag

SEQ ID NO: 1353856 - DNA, 22 bp, Artificial Sequence
  chemically synthesized
ttttttttttttgagacagagt

SEQ ID NO: 1353857 - DNA, 22 bp, Artificial Sequence
  chemically synthesized
tttttttttttgagacagagtc

SEQ ID NO: 1353858 - DNA, 22 bp, Artificial Sequence
  chemically synthesized
ttttttttttgagacagagtct

SEQ ID NO: 1353859 - DNA, 22 bp, Artificial Sequence
  chemically synthesized
ggcgacagagcgagactctgtc

SEQ ID NO: 1353860 - DNA, 22 bp, Artificial Sequence
  chemically synthesized
tttttttttgagacagagtctc

SEQ ID NO: 1353861 - DNA, 22 bp, Artificial Sequence
  chemically synthesized
ttttttttgagacagagtctcg

SEQ ID NO: 1353862 - DNA, 22 bp, Artificial Sequence
  chemically synthesized
tttttttgagacagagtctcgc

SEQ ID NO: 1353863 - DNA, 22 bp, Artificial Sequence
  chemically synthesized
ttttttgagacagagtctcgct

SEQ ID NO: 1353864 - DNA, 22 bp, Artificial Sequence
  chemically synthesized
tttttgagacagagtctcgctc

SEQ ID NO: 1353865 - DNA, 22 bp, Artificial Sequence
  chemically synthesized
ttttgagacagagtctcgctct

SEQ ID NO: 1353866 - DNA, 22 bp, Artificial Sequence
  chemically synthesized
tttgagacagagtctcgctctg

SEQ ID NO: 1353867 - DNA, 22 bp, Artificial Sequence
  chemically synthesized
cagcctgggcgacagagcgaga

SEQ ID NO: 1353868 - DNA, 22 bp, Artificial Sequence
  chemically synthesized
ttgagacagagtctcgctctgt

SEQ ID NO: 1353869 - DNA, 22 bp, Artificial Sequence
  chemically synthesized
tgagacagagtctcgctctgtc

SEQ ID NO: 1353870 - DNA, 22 bp, Artificial Sequence
  chemically synthesized
gagacagagtctcgctctgtcg

SEQ ID NO: 1353871 - DNA, 22 bp, Artificial Sequence
  chemically synthesized
agacagagtctcgctctgtcgc

SEQ ID NO: 1353872 - DNA, 22 bp, Artificial Sequence
  chemically synthesized
gctctgtcgcccaggctggagt

SEQ ID NO: 1353873 - DNA, 22 bp, Artificial Sequence
  chemically synthesized
tgtcgcccaggctggagtgcca

SEQ ID NO: 1353874 - DNA, 22 bp, Artificial Sequence
  chemically synthesized
tcgcccaggctggagtgccatg

SEQ ID NO: 1353875 - DNA, 22 bp, Artificial Sequence
  chemically synthesized
cggtgagccaagatcgtgccat

SEQ ID NO: 1353876 - DNA, 22 bp, Artificial Sequence
  chemically synthesized
gagtgccatggcacgatcttgg

SEQ ID NO: 1353877 - DNA, 22 bp, Artificial Sequence
  chemically synthesized
aacccaggaggtggaggttgcg

SEQ ID NO: 1353878 - DNA, 22 bp, Artificial Sequence
  chemically synthesized
gaacccaggaggtggaggttgc

SEQ ID NO: 1353879 - DNA, 22 bp, Artificial Sequence
  chemically synthesized
ggctcaccgcaacctccacctc

SEQ ID NO: 1353880 - DNA, 22 bp, Artificial Sequence
  chemically synthesized
gctcaccgcaacctccacctcc

SEQ ID NO: 1353881 - DNA, 22 bp, Artificial Sequence
  chemically synthesized
accgcaacctccacctcctggg

SEQ ID NO: 1353882 - DNA, 22 bp, Artificial Sequence
  chemically synthesized
aggcaggagaatcgcttgaacc

SEQ ID NO: 1353883 - DNA, 22 bp, Artificial Sequence
  chemically synthesized
cacctcctgggttcaagcgatt

SEQ ID NO: 1353884 - DNA, 22 bp, Artificial Sequence
  chemically synthesized
ctgggttcaagcgattctcctg

SEQ ID NO: 1353885 - DNA, 22 bp, Artificial Sequence
  chemically synthesized
aggaggctgaggcaggagaatc

SEQ ID NO: 1353886 - DNA, 22 bp, Artificial Sequence
  chemically synthesized
ggttcaagcgattctcctgcct

SEQ ID NO: 1353887 - DNA, 22 bp, Artificial Sequence
  chemically synthesized
ctcaggaggctgaggcaggaga

SEQ ID NO: 1353888 - DNA, 22 bp, Artificial Sequence
  chemically synthesized
aagcgattctcctgcctcagcc

SEQ ID NO: 1353889 - DNA, 22 bp, Artificial Sequence
  chemically synthesized
taatcccagctactcaggaggc

SEQ ID NO: 1353890 - DNA, 22 bp, Artificial Sequence
  chemically synthesized
tcctgcctcagcctcctgagta

SEQ ID NO: 1353891 - DNA, 22 bp, Artificial Sequence
  chemically synthesized
ctgcctcagcctcctgagtagc

SEQ ID NO: 1353892 - DNA, 22 bp, Artificial Sequence
  chemically synthesized
cctcagcctcctgagtagctgg

SEQ ID NO: 1353893 - DNA, 22 bp, Artificial Sequence
  chemically synthesized
agcctcctgagtagctgggatt

SEQ ID NO: 1353894 - DNA, 22 bp, Artificial Sequence
  chemically synthesized
ctgagtagctgggattacaggc

SEQ ID NO: 1353895 - DNA, 22 bp, Artificial Sequence
  chemically synthesized
agtagctgggattacaggcatg

SEQ ID NO: 1353896 - DNA, 22 bp, Artificial Sequence
  chemically synthesized
gccgggcgtggtggtgcatgcc

SEQ ID NO: 1353897 - DNA, 22 bp, Artificial Sequence
  chemically synthesized
ggattacaggcatgcaccacca

SEQ ID NO: 1353898 - DNA, 22 bp, Artificial Sequence
  chemically synthesized
caggcatgcaccaccacgcccg

SEQ ID NO: 1353899 - DNA, 22 bp, Artificial Sequence
  chemically synthesized
gtaaaaatacaaaaattagccg

SEQ ID NO: 1353900 - DNA, 22 bp, Artificial Sequence
  chemically synthesized
tagtaaaaatacaaaaattagc

SEQ ID NO: 1353901 - DNA, 22 bp, Artificial Sequence
  chemically synthesized
atttttgtatttttactagaga

SEQ ID NO: 1353902 - DNA, 22 bp, Artificial Sequence
  chemically synthesized
ttgtatttttactagagatggg

SEQ ID NO: 1353903 - DNA, 22 bp, Artificial Sequence
  chemically synthesized
tgtatttttactagagatgggg

SEQ ID NO: 1353904 - DNA, 22 bp, Artificial Sequence
  chemically synthesized
gtatttttactagagatggggt

SEQ ID NO: 1353905 - DNA, 22 bp, Artificial Sequence
  chemically synthesized
tatttttactagagatggggtt

SEQ ID NO: 1353906 - DNA, 22 bp, Artificial Sequence
  chemically synthesized
accaacatggtgaaaccccatc

SEQ ID NO: 1353907 - DNA, 22 bp, Artificial Sequence
  chemically synthesized
ttactagagatggggtttcacc

SEQ ID NO: 1353908 - DNA, 22 bp, Artificial Sequence
  chemically synthesized
tactagagatggggtttcacca

SEQ ID NO: 1353909 - DNA, 22 bp, Artificial Sequence
  chemically synthesized
actagagatggggtttcaccat

SEQ ID NO: 1353910 - DNA, 22 bp, Artificial Sequence
  chemically synthesized
ctagagatggggtttcaccatg

SEQ ID NO: 1353911 - DNA, 22 bp, Artificial Sequence
  chemically synthesized
gagatggggtttcaccatgttg

SEQ ID NO: 1353912 - DNA, 22 bp, Artificial Sequence
  chemically synthesized
gagaccagcctgaccaacatgg

SEQ ID NO: 1353913 - DNA, 22 bp, Artificial Sequence
  chemically synthesized
caccatgttggtcaggctggtc

SEQ ID NO: 1353914 - DNA, 22 bp, Artificial Sequence
  chemically synthesized
accatgttggtcaggctggtct

SEQ ID NO: 1353915 - DNA, 22 bp, Artificial Sequence
  chemically synthesized
gtcaggctggtctcgaactcct

SEQ ID NO: 1353916 - DNA, 22 bp, Artificial Sequence
  chemically synthesized
gtctcgaactcctgacctcgtg

SEQ ID NO: 1353917 - DNA, 22 bp, Artificial Sequence
  chemically synthesized
gaactcctgacctcgtgatgct

SEQ ID NO: 1353918 - DNA, 22 bp, Artificial Sequence
  chemically synthesized
ggaggccgaggtgggagcatca

SEQ ID NO: 1353919 - DNA, 22 bp, Artificial Sequence
  chemically synthesized
gggaggccgaggtgggagcatc

SEQ ID NO: 1353920 - DNA, 22 bp, Artificial Sequence
  chemically synthesized
tgggaggccgaggtgggagcat

SEQ ID NO: 1353921 - DNA, 22 bp, Artificial Sequence
  chemically synthesized
ctgacctcgtgatgctcccacc

SEQ ID NO: 1353922 - DNA, 22 bp, Artificial Sequence
  chemically synthesized
acctcgtgatgctcccacctcg

SEQ ID NO: 1353923 - DNA, 22 bp, Artificial Sequence
  chemically synthesized
gtgatgctcccacctcggcctc

SEQ ID NO: 1353924 - DNA, 22 bp, Artificial Sequence
  chemically synthesized
taatcccagcactttgggaggc

SEQ ID NO: 1353925 - DNA, 22 bp, Artificial Sequence
  chemically synthesized
ccacctcggcctcccaaagtgc

SEQ ID NO: 1353926 - DNA, 22 bp, Artificial Sequence
  chemically synthesized
acatctgtaatcccagcacttt

SEQ ID NO: 1353927 - DNA, 22 bp, Artificial Sequence
  chemically synthesized
ggcctcccaaagtgctgggatt

SEQ ID NO: 1353928 - DNA, 22 bp, Artificial Sequence
  chemically synthesized
ccaaagtgctgggattacagat

SEQ ID NO: 1353929 - DNA, 22 bp, Artificial Sequence
  chemically synthesized
ggccgggcgcggtggctcacat

SEQ ID NO: 1353930 - DNA, 22 bp, Artificial Sequence
  chemically synthesized
ggattacagatgtgagccaccg

SEQ ID NO: 1353931 - DNA, 22 bp, Artificial Sequence
  chemically synthesized
ctgggccgggcgcggtggctca

SEQ ID NO: 1353932 - DNA, 22 bp, Artificial Sequence
  chemically synthesized
gctgggccgggcgcggtggctc

SEQ ID NO: 1353933 - DNA, 22 bp, Artificial Sequence
  chemically synthesized
cagatgtgagccaccgcgcccg

SEQ ID NO: 1353934 - DNA, 22 bp, Artificial Sequence
  chemically synthesized
aaaataaatccttgctgggccg

SEQ ID NO: 1353935 - DNA, 22 bp, Artificial Sequence
  chemically synthesized
cctgaaaataaatccttgctgg

SEQ ID NO: 1353936 - DNA, 22 bp, Artificial Sequence
  chemically synthesized
gctccctgaaaataaatccttg

SEQ ID NO: 1353937 - DNA, 22 bp, Artificial Sequence
  chemically synthesized
cataatactggctccctgaaaa

SEQ ID NO: 1353938 - DNA, 22 bp, Artificial Sequence
  chemically synthesized
tgcataatactggctccctgaa

SEQ ID NO: 1353939 - DNA, 22 bp, Artificial Sequence
  chemically synthesized
atctctgcataatactggctcc

SEQ ID NO: 1353940 - DNA, 22 bp, Artificial Sequence
  chemically synthesized
attttcagggagccagtattat

SEQ ID NO: 1353941 - DNA, 22 bp, Artificial Sequence
  chemically synthesized
ttttcagggagccagtattatg

SEQ ID NO: 1353942 - DNA, 22 bp, Artificial Sequence
  chemically synthesized
tcagggagccagtattatgcag

SEQ ID NO: 1353943 - DNA, 22 bp, Artificial Sequence
  chemically synthesized
cagggagccagtattatgcaga

SEQ ID NO: 1353944 - DNA, 22 bp, Artificial Sequence
  chemically synthesized
agggagccagtattatgcagag

SEQ ID NO: 1353945 - DNA, 22 bp, Artificial Sequence
  chemically synthesized
aagcaggctgatctctgcataa

SEQ ID NO: 1353946 - DNA, 22 bp, Artificial Sequence
  chemically synthesized
taaagcaggctgatctctgcat

SEQ ID NO: 1353947 - DNA, 22 bp, Artificial Sequence
  chemically synthesized
ctaaagcaggctgatctctgca

SEQ ID NO: 1353948 - DNA, 22 bp, Artificial Sequence
  chemically synthesized
tctaaagcaggctgatctctgc

SEQ ID NO: 1353949 - DNA, 22 bp, Artificial Sequence
  chemically synthesized
tattttctaaagcaggctgatc

SEQ ID NO: 1353950 - DNA, 22 bp, Artificial Sequence
  chemically synthesized
tgcagagatcagcctgctttag

SEQ ID NO: 1353951 - DNA, 22 bp, Artificial Sequence
  chemically synthesized
atgagagacactgtattttcta

SEQ ID NO: 1353952 - DNA, 22 bp, Artificial Sequence
  chemically synthesized
attcatgagagacactgtattt

SEQ ID NO: 1353953 - DNA, 22 bp, Artificial Sequence
  chemically synthesized
ctttagaaaatacagtgtctct

SEQ ID NO: 1353954 - DNA, 22 bp, Artificial Sequence
  chemically synthesized
tagaaaatacagtgtctctcat

SEQ ID NO: 1353955 - DNA, 22 bp, Artificial Sequence
  chemically synthesized
agaaaatacagtgtctctcatg

SEQ ID NO: 1353956 - DNA, 22 bp, Artificial Sequence
  chemically synthesized
gaaaatacagtgtctctcatga

SEQ ID NO: 1353957 - DNA, 22 bp, Artificial Sequence
  chemically synthesized
gcaaatggtgcactcattcatg

SEQ ID NO: 1353958 - DNA, 22 bp, Artificial Sequence
  chemically synthesized
ggcaaatggtgcactcattcat

SEQ ID NO: 1353959 - DNA, 22 bp, Artificial Sequence
  chemically synthesized
tggcaaatggtgcactcattca

SEQ ID NO: 1353960 - DNA, 22 bp, Artificial Sequence
  chemically synthesized
ttggcaaatggtgcactcattc

SEQ ID NO: 1353961 - DNA, 22 bp, Artificial Sequence
  chemically synthesized
tttttggcaaatggtgcactca

SEQ ID NO: 1353962 - DNA, 22 bp, Artificial Sequence
  chemically synthesized
tcatgaatgagtgcaccatttg

SEQ ID NO: 1353963 - DNA, 22 bp, Artificial Sequence
  chemically synthesized
atgaatgagtgcaccatttgcc

SEQ ID NO: 1353964 - DNA, 22 bp, Artificial Sequence
  chemically synthesized
agaagaagatacaatagattat

SEQ ID NO: 1353965 - DNA, 22 bp, Artificial Sequence
  chemically synthesized
gccaaaaataatctattgtatc

SEQ ID NO: 1353966 - DNA, 22 bp, Artificial Sequence
  chemically synthesized
gcctgagaagaagatacaatag

SEQ ID NO: 1353967 - DNA, 22 bp, Artificial Sequence
  chemically synthesized
ccaaaaataatctattgtatct

SEQ ID NO: 1353968 - DNA, 22 bp, Artificial Sequence
  chemically synthesized
ttggcctgagaagaagatacaa

SEQ ID NO: 1353969 - DNA, 22 bp, Artificial Sequence
  chemically synthesized
attattggcctgagaagaagat

SEQ ID NO: 1353970 - DNA, 22 bp, Artificial Sequence
  chemically synthesized
aattattggcctgagaagaaga

SEQ ID NO: 1353971 - DNA, 22 bp, Artificial Sequence
  chemically synthesized
taattattggcctgagaagaag

SEQ ID NO: 1353972 - DNA, 22 bp, Artificial Sequence
  chemically synthesized
ttaattattggcctgagaagaa

SEQ ID NO: 1353973 - DNA, 22 bp, Artificial Sequence
  chemically synthesized
ttgtatcttcttctcaggccaa

SEQ ID NO: 1353974 - DNA, 22 bp, Artificial Sequence
  chemically synthesized
tatcttcttctcaggccaataa

SEQ ID NO: 1353975 - DNA, 22 bp, Artificial Sequence
  chemically synthesized
cttctcaggccaataattaaaa

SEQ ID NO: 1353976 - DNA, 22 bp, Artificial Sequence
  chemically synthesized
ttctcaggccaataattaaaaa

SEQ ID NO: 1353977 - DNA, 22 bp, Artificial Sequence
  chemically synthesized
gagtataatacatttttaatta

SEQ ID NO: 1353978 - DNA, 22 bp, Artificial Sequence
  chemically synthesized
ggagtataatacatttttaatt

SEQ ID NO: 1353979 - DNA, 22 bp, Artificial Sequence
  chemically synthesized
ctcaggccaataattaaaaatg

SEQ ID NO: 1353980 - DNA, 22 bp, Artificial Sequence
  chemically synthesized
tggagtataatacatttttaat

SEQ ID NO: 1353981 - DNA, 22 bp, Artificial Sequence
  chemically synthesized
tcaggccaataattaaaaatgt

SEQ ID NO: 1353982 - DNA, 22 bp, Artificial Sequence
  chemically synthesized
tttggagtataatacattttta

SEQ ID NO: 1353983 - DNA, 22 bp, Artificial Sequence
  chemically synthesized
aggccaataattaaaaatgtat

SEQ ID NO: 1353984 - DNA, 22 bp, Artificial Sequence
  chemically synthesized
ctttggagtataatacattttt

SEQ ID NO: 1353985 - DNA, 22 bp, Artificial Sequence
  chemically synthesized
tctttggagtataatacatttt

SEQ ID NO: 1353986 - DNA, 22 bp, Artificial Sequence
  chemically synthesized
ttctttggagtataatacattt

SEQ ID NO: 1353987 - DNA, 22 bp, Artificial Sequence
  chemically synthesized
cgtttttctttggagtataata

SEQ ID NO: 1353988 - DNA, 22 bp, Artificial Sequence
  chemically synthesized
acgtttttctttggagtataat

SEQ ID NO: 1353989 - DNA, 22 bp, Artificial Sequence
  chemically synthesized
tttacgtttttctttggagtat

SEQ ID NO: 1353990 - DNA, 22 bp, Artificial Sequence
  chemically synthesized
atttacgtttttctttggagta

SEQ ID NO: 1353991 - DNA, 22 bp, Artificial Sequence
  chemically synthesized
aaaatgtattatactccaaaga

SEQ ID NO: 1353992 - DNA, 22 bp, Artificial Sequence
  chemically synthesized
tatttacgtttttctttggagt

SEQ ID NO: 1353993 - DNA, 22 bp, Artificial Sequence
  chemically synthesized
ttatttacgtttttctttggag

SEQ ID NO: 1353994 - DNA, 22 bp, Artificial Sequence
  chemically synthesized
tttatttacgtttttctttgga

SEQ ID NO: 1353995 - DNA, 22 bp, Artificial Sequence
  chemically synthesized
ttttatttacgtttttctttgg

SEQ ID NO: 1353996 - DNA, 22 bp, Artificial Sequence
  chemically synthesized
tcttttttatttacgtttttct

SEQ ID NO: 1353997 - DNA, 22 bp, Artificial Sequence
  chemically synthesized
tactccaaagaaaaacgtaaat

SEQ ID NO: 1353998 - DNA, 22 bp, Artificial Sequence
  chemically synthesized
caggattgtcttttttatttac

SEQ ID NO: 1353999 - DNA, 22 bp, Artificial Sequence
  chemically synthesized
caaagaaaaacgtaaataaaaa

SEQ ID NO: 1354000 - DNA, 22 bp, Artificial Sequence
  chemically synthesized
acaggattgtcttttttattta

SEQ ID NO: 1354001 - DNA, 22 bp, Artificial Sequence
  chemically synthesized
tacaggattgtcttttttattt

SEQ ID NO: 1354002 - DNA, 22 bp, Artificial Sequence
  chemically synthesized
tagagatacaataaccatataa

SEQ ID NO: 1354003 - DNA, 22 bp, Artificial Sequence
  chemically synthesized
gtagagatacaataaccatata

SEQ ID NO: 1354004 - DNA, 22 bp, Artificial Sequence
  chemically synthesized
tgtagagatacaataaccatat

SEQ ID NO: 1354005 - DNA, 22 bp, Artificial Sequence
  chemically synthesized
ttgtagagatacaataaccata

SEQ ID NO: 1354006 - DNA, 22 bp, Artificial Sequence
  chemically synthesized
taaaattatatggttattgtat

SEQ ID NO: 1354007 - DNA, 22 bp, Artificial Sequence
  chemically synthesized
aaaacgtttttgtagagataca

SEQ ID NO: 1354008 - DNA, 22 bp, Artificial Sequence
  chemically synthesized
tatggttattgtatctctacaa

SEQ ID NO: 1354009 - DNA, 22 bp, Artificial Sequence
  chemically synthesized
caatattaaaaacgtttttgta

SEQ ID NO: 1354010 - DNA, 22 bp, Artificial Sequence
  chemically synthesized
acaatattaaaaacgtttttgt

SEQ ID NO: 1354011 - DNA, 22 bp, Artificial Sequence
  chemically synthesized
tacaatattaaaaacgtttttg

SEQ ID NO: 1354012 - DNA, 22 bp, Artificial Sequence
  chemically synthesized
ttgtatctctacaaaaacgttt

SEQ ID NO: 1354013 - DNA, 22 bp, Artificial Sequence
  chemically synthesized
tatctctacaaaaacgttttta

SEQ ID NO: 1354014 - DNA, 22 bp, Artificial Sequence
  chemically synthesized
tacaaaaacgtttttaatattg

SEQ ID NO: 1354015 - DNA, 22 bp, Artificial Sequence
  chemically synthesized
caaaaacgtttttaatattgta

SEQ ID NO: 1354016 - DNA, 22 bp, Artificial Sequence
  chemically synthesized
tgtaaataatatattttacaat

SEQ ID NO: 1354017 - DNA, 22 bp, Artificial Sequence
  chemically synthesized
atgtaaataatatattttacaa

SEQ ID NO: 1354018 - DNA, 22 bp, Artificial Sequence
  chemically synthesized
ttaatattgtaaaatatattat

SEQ ID NO: 1354019 - DNA, 22 bp, Artificial Sequence
  chemically synthesized
taatattgtaaaatatattatt

SEQ ID NO: 1354020 - DNA, 22 bp, Artificial Sequence
  chemically synthesized
catatttatgtaaataatatat

SEQ ID NO: 1354021 - DNA, 22 bp, Artificial Sequence
  chemically synthesized
aatattgtaaaatatattattt

SEQ ID NO: 1354022 - DNA, 22 bp, Artificial Sequence
  chemically synthesized
acatatttatgtaaataatata

SEQ ID NO: 1354023 - DNA, 22 bp, Artificial Sequence
  chemically synthesized
atattgtaaaatatattattta

SEQ ID NO: 1354024 - DNA, 22 bp, Artificial Sequence
  chemically synthesized
taaaatatattatttacataaa

SEQ ID NO: 1354025 - DNA, 22 bp, Artificial Sequence
  chemically synthesized
aatgtttacatatttatgtaaa

SEQ ID NO: 1354026 - DNA, 22 bp, Artificial Sequence
  chemically synthesized
gaatgtttacatatttatgtaa

SEQ ID NO: 1354027 - DNA, 22 bp, Artificial Sequence
  chemically synthesized
aatttgaatgtttacatattta

SEQ ID NO: 1354028 - DNA, 22 bp, Artificial Sequence
  chemically synthesized
ctcaatttgaatgtttacatat

SEQ ID NO: 1354029 - DNA, 22 bp, Artificial Sequence
  chemically synthesized
tttacataaatatgtaaacatt

SEQ ID NO: 1354030 - DNA, 22 bp, Artificial Sequence
  chemically synthesized
ctcctcaatttgaatgtttaca

SEQ ID NO: 1354031 - DNA, 22 bp, Artificial Sequence
  chemically synthesized
gctcctcaatttgaatgtttac

SEQ ID NO: 1354032 - DNA, 22 bp, Artificial Sequence
  chemically synthesized
acataaatatgtaaacattcaa

SEQ ID NO: 1354033 - DNA, 22 bp, Artificial Sequence
  chemically synthesized
cataaatatgtaaacattcaaa

SEQ ID NO: 1354034 - DNA, 22 bp, Artificial Sequence
  chemically synthesized
aaacttgctcctcaatttgaat

SEQ ID NO: 1354035 - DNA, 22 bp, Artificial Sequence
  chemically synthesized
taaaacttgctcctcaatttga

SEQ ID NO: 1354036 - DNA, 22 bp, Artificial Sequence
  chemically synthesized
ctctaaaacttgctcctcaatt

SEQ ID NO: 1354037 - DNA, 22 bp, Artificial Sequence
  chemically synthesized
agccctactctaaaacttgctc

SEQ ID NO: 1354038 - DNA, 22 bp, Artificial Sequence
  chemically synthesized
gagccctactctaaaacttgct

SEQ ID NO: 1354039 - DNA, 22 bp, Artificial Sequence
  chemically synthesized
tgagccctactctaaaacttgc

SEQ ID NO: 1354040 - DNA, 22 bp, Artificial Sequence
  chemically synthesized
aaattgaggagcaagttttaga

SEQ ID NO: 1354041 - DNA, 22 bp, Artificial Sequence
  chemically synthesized
aggagcaagttttagagtaggg

SEQ ID NO: 1354042 - DNA, 22 bp, Artificial Sequence
  chemically synthesized
tagagtagggctcaaaatctca

SEQ ID NO: 1354043 - DNA, 22 bp, Artificial Sequence
  chemically synthesized
agagtagggctcaaaatctcat

SEQ ID NO: 1354044 - DNA, 22 bp, Artificial Sequence
  chemically synthesized
gagtagggctcaaaatctcata

SEQ ID NO: 1354045 - DNA, 22 bp, Artificial Sequence
  chemically synthesized
ataagtggcagatatgagattt

SEQ ID NO: 1354046 - DNA, 22 bp, Artificial Sequence
  chemically synthesized
aaaatctcatatctgccactta

SEQ ID NO: 1354047 - DNA, 22 bp, Artificial Sequence
  chemically synthesized
aaggccatataactaataagtg

SEQ ID NO: 1354048 - DNA, 22 bp, Artificial Sequence
  chemically synthesized
tcaaggccatataactaataag

SEQ ID NO: 1354049 - DNA, 22 bp, Artificial Sequence
  chemically synthesized
ctcaaggccatataactaataa

SEQ ID NO: 1354050 - DNA, 22 bp, Artificial Sequence
  chemically synthesized
atatctgccacttattagttat

SEQ ID NO: 1354051 - DNA, 22 bp, Artificial Sequence
  chemically synthesized
tctcaaggccatataactaata

SEQ ID NO: 1354052 - DNA, 22 bp, Artificial Sequence
  chemically synthesized
ccacttattagttatatggcct

SEQ ID NO: 1354053 - DNA, 22 bp, Artificial Sequence
  chemically synthesized
agtaactttctcaaggccatat

SEQ ID NO: 1354054 - DNA, 22 bp, Artificial Sequence
  chemically synthesized
aagtaactttctcaaggccata

SEQ ID NO: 1354055 - DNA, 22 bp, Artificial Sequence
  chemically synthesized
attagttatatggccttgagaa

SEQ ID NO: 1354056 - DNA, 22 bp, Artificial Sequence
  chemically synthesized
ttagttatatggccttgagaaa

SEQ ID NO: 1354057 - DNA, 22 bp, Artificial Sequence
  chemically synthesized
gttatatggccttgagaaagtt

SEQ ID NO: 1354058 - DNA, 22 bp, Artificial Sequence
  chemically synthesized
tatggccttgagaaagttactt

SEQ ID NO: 1354059 - DNA, 22 bp, Artificial Sequence
  chemically synthesized
gagaaagttacttaagcactgt

SEQ ID NO: 1354060 - DNA, 22 bp, Artificial Sequence
  chemically synthesized
agaaagttacttaagcactgtg

SEQ ID NO: 1354061 - DNA, 22 bp, Artificial Sequence
  chemically synthesized
aaaaacaaaaccgaagcacagt

SEQ ID NO: 1354062 - DNA, 22 bp, Artificial Sequence
  chemically synthesized
cttaagcactgtgcttcggttt

SEQ ID NO: 1354063 - DNA, 22 bp, Artificial Sequence
  chemically synthesized
gagattaaaaaacaaaaccgaa

SEQ ID NO: 1354064 - DNA, 22 bp, Artificial Sequence
  chemically synthesized
aagcactgtgcttcggttttgt

SEQ ID NO: 1354065 - DNA, 22 bp, Artificial Sequence
  chemically synthesized
agagattaaaaaacaaaaccga

SEQ ID NO: 1354066 - DNA, 22 bp, Artificial Sequence
  chemically synthesized
agcactgtgcttcggttttgtt

SEQ ID NO: 1354067 - DNA, 22 bp, Artificial Sequence
  chemically synthesized
tagagattaaaaaacaaaaccg

SEQ ID NO: 1354068 - DNA, 22 bp, Artificial Sequence
  chemically synthesized
ccattttagagattaaaaaaca

SEQ ID NO: 1354069 - DNA, 22 bp, Artificial Sequence
  chemically synthesized
tgcttcggttttgttttttaat

SEQ ID NO: 1354070 - DNA, 22 bp, Artificial Sequence
  chemically synthesized
cccattttagagattaaaaaac

SEQ ID NO: 1354071 - DNA, 22 bp, Artificial Sequence
  chemically synthesized
cggttttgttttttaatctcta

SEQ ID NO: 1354072 - DNA, 22 bp, Artificial Sequence
  chemically synthesized
ggttttgttttttaatctctaa

SEQ ID NO: 1354073 - DNA, 22 bp, Artificial Sequence
  chemically synthesized
tgttttttaatctctaaaatgg

SEQ ID NO: 1354074 - DNA, 22 bp, Artificial Sequence
  chemically synthesized
gttttttaatctctaaaatggg

SEQ ID NO: 1354075 - DNA, 22 bp, Artificial Sequence
  chemically synthesized
ttttttaatctctaaaatggga

SEQ ID NO: 1354076 - DNA, 22 bp, Artificial Sequence
  chemically synthesized
tttaatctctaaaatgggaagt

SEQ ID NO: 1354077 - DNA, 22 bp, Artificial Sequence
  chemically synthesized
ttaatctctaaaatgggaagta

SEQ ID NO: 1354078 - DNA, 22 bp, Artificial Sequence
  chemically synthesized
taatctctaaaatgggaagtat

SEQ ID NO: 1354079 - DNA, 22 bp, Artificial Sequence
  chemically synthesized
aatctctaaaatgggaagtatt

SEQ ID NO: 1354080 - DNA, 22 bp, Artificial Sequence
  chemically synthesized
atctctaaaatgggaagtattc

SEQ ID NO: 1354081 - DNA, 22 bp, Artificial Sequence
  chemically synthesized
taaaatgggaagtattctttcc

SEQ ID NO: 1354082 - DNA, 22 bp, Artificial Sequence
  chemically synthesized
aaatgggaagtattctttcctc

SEQ ID NO: 1354083 - DNA, 22 bp, Artificial Sequence
  chemically synthesized
agaaccagatcatgaggaaaga

SEQ ID NO: 1354084 - DNA, 22 bp, Artificial Sequence
  chemically synthesized
cagaaccagatcatgaggaaag

SEQ ID NO: 1354085 - DNA, 22 bp, Artificial Sequence
  chemically synthesized
tcagaaccagatcatgaggaaa

SEQ ID NO: 1354086 - DNA, 22 bp, Artificial Sequence
  chemically synthesized
attttcagaaccagatcatgag

SEQ ID NO: 1354087 - DNA, 22 bp, Artificial Sequence
  chemically synthesized
aattttcagaaccagatcatga

SEQ ID NO: 1354088 - DNA, 22 bp, Artificial Sequence
  chemically synthesized
atttaattttcagaaccagatc

SEQ ID NO: 1354089 - DNA, 22 bp, Artificial Sequence
  chemically synthesized
tttcctcatgatctggttctga

SEQ ID NO: 1354090 - DNA, 22 bp, Artificial Sequence
  chemically synthesized
tcctcatgatctggttctgaaa

SEQ ID NO: 1354091 - DNA, 22 bp, Artificial Sequence
  chemically synthesized
cctcatgatctggttctgaaaa

SEQ ID NO: 1354092 - DNA, 22 bp, Artificial Sequence
  chemically synthesized
tgcctcatttaattttcagaac

SEQ ID NO: 1354093 - DNA, 22 bp, Artificial Sequence
  chemically synthesized
ctcatgatctggttctgaaaat

SEQ ID NO: 1354094 - DNA, 22 bp, Artificial Sequence
  chemically synthesized
gtgcctcatttaattttcagaa

SEQ ID NO: 1354095 - DNA, 22 bp, Artificial Sequence
  chemically synthesized
atgatctggttctgaaaattaa

SEQ ID NO: 1354096 - DNA, 22 bp, Artificial Sequence
  chemically synthesized
gttctgaaaattaaatgaggca

SEQ ID NO: 1354097 - DNA, 22 bp, Artificial Sequence
  chemically synthesized
tgaaaattaaatgaggcacaaa

SEQ ID NO: 1354098 - DNA, 22 bp, Artificial Sequence
  chemically synthesized
aaaattaaatgaggcacaaata

SEQ ID NO: 1354099 - DNA, 22 bp, Artificial Sequence
  chemically synthesized
ggggagtgtgaatatttgtgcc

SEQ ID NO: 1354100 - DNA, 22 bp, Artificial Sequence
  chemically synthesized
aatgaggcacaaatattcacac

SEQ ID NO: 1354101 - DNA, 22 bp, Artificial Sequence
  chemically synthesized
gagaaccctgggggagtgtgaa

SEQ ID NO: 1354102 - DNA, 22 bp, Artificial Sequence
  chemically synthesized
acactcccccagggttctctaa

SEQ ID NO: 1354103 - DNA, 22 bp, Artificial Sequence
  chemically synthesized
tcaaggaaaggattagagaacc

SEQ ID NO: 1354104 - DNA, 22 bp, Artificial Sequence
  chemically synthesized
ccccagggttctctaatccttt

SEQ ID NO: 1354105 - DNA, 22 bp, Artificial Sequence
  chemically synthesized
tctaatcctttccttgatagtg

SEQ ID NO: 1354106 - DNA, 22 bp, Artificial Sequence
  chemically synthesized
acggagggaatacactatcaag

SEQ ID NO: 1354107 - DNA, 22 bp, Artificial Sequence
  chemically synthesized
taatcctttccttgatagtgta

SEQ ID NO: 1354108 - DNA, 22 bp, Artificial Sequence
  chemically synthesized
taacggagggaatacactatca

SEQ ID NO: 1354109 - DNA, 22 bp, Artificial Sequence
  chemically synthesized
ctaacggagggaatacactatc

SEQ ID NO: 1354110 - DNA, 22 bp, Artificial Sequence
  chemically synthesized
atcctttccttgatagtgtatt

SEQ ID NO: 1354111 - DNA, 22 bp, Artificial Sequence
  chemically synthesized
tccttgatagtgtattccctcc

SEQ ID NO: 1354112 - DNA, 22 bp, Artificial Sequence
  chemically synthesized
ccttgatagtgtattccctccg

SEQ ID NO: 1354113 - DNA, 22 bp, Artificial Sequence
  chemically synthesized
cttgatagtgtattccctccgt

SEQ ID NO: 1354114 - DNA, 22 bp, Artificial Sequence
  chemically synthesized
gatagtgtattccctccgttag

SEQ ID NO: 1354115 - DNA, 22 bp, Artificial Sequence
  chemically synthesized
atagtgtattccctccgttaga

SEQ ID NO: 1354116 - DNA, 22 bp, Artificial Sequence
  chemically synthesized
aagaagagaacgagatttctaa

SEQ ID NO: 1354117 - DNA, 22 bp, Artificial Sequence
  chemically synthesized
cctccgttagaaatctcgttct

SEQ ID NO: 1354118 - DNA, 22 bp, Artificial Sequence
  chemically synthesized
aagttaaagaagagaacgagat

SEQ ID NO: 1354119 - DNA, 22 bp, Artificial Sequence
  chemically synthesized
cgttagaaatctcgttctcttc

SEQ ID NO: 1354120 - DNA, 22 bp, Artificial Sequence
  chemically synthesized
gaaatctcgttctcttctttaa

SEQ ID NO: 1354121 - DNA, 22 bp, Artificial Sequence
  chemically synthesized
gttctcttctttaacttcaact

SEQ ID NO: 1354122 - DNA, 22 bp, Artificial Sequence
  chemically synthesized
tcttctttaacttcaactatca

SEQ ID NO: 1354123 - DNA, 22 bp, Artificial Sequence
  chemically synthesized
catggagatagatgatagttga

SEQ ID NO: 1354124 - DNA, 22 bp, Artificial Sequence
  chemically synthesized
acatggagatagatgatagttg

SEQ ID NO: 1354125 - DNA, 22 bp, Artificial Sequence
  chemically synthesized
ttctttaacttcaactatcatc

SEQ ID NO: 1354126 - DNA, 22 bp, Artificial Sequence
  chemically synthesized
ctttaacttcaactatcatcta

SEQ ID NO: 1354127 - DNA, 22 bp, Artificial Sequence
  chemically synthesized
tttaacttcaactatcatctat

SEQ ID NO: 1354128 - DNA, 22 bp, Artificial Sequence
  chemically synthesized
taacttcaactatcatctatct

SEQ ID NO: 1354129 - DNA, 22 bp, Artificial Sequence
  chemically synthesized
aacttcaactatcatctatctc

SEQ ID NO: 1354130 - DNA, 22 bp, Artificial Sequence
  chemically synthesized
acttcaactatcatctatctcc

SEQ ID NO: 1354131 - DNA, 22 bp, Artificial Sequence
  chemically synthesized
agaatcacttacatggagatag

SEQ ID NO: 1354132 - DNA, 22 bp, Artificial Sequence
  chemically synthesized
gagaatcacttacatggagata

SEQ ID NO: 1354133 - DNA, 22 bp, Artificial Sequence
  chemically synthesized
caactatcatctatctccatgt

SEQ ID NO: 1354134 - DNA, 22 bp, Artificial Sequence
  chemically synthesized
aactatcatctatctccatgta

SEQ ID NO: 1354135 - DNA, 22 bp, Artificial Sequence
  chemically synthesized
tcatctatctccatgtaagtga

SEQ ID NO: 1354136 - DNA, 22 bp, Artificial Sequence
  chemically synthesized
tctccatgtaagtgattctcaa

SEQ ID NO: 1354137 - DNA, 22 bp, Artificial Sequence
  chemically synthesized
agagagaaatacttgagaatca

SEQ ID NO: 1354138 - DNA, 22 bp, Artificial Sequence
  chemically synthesized
aagagagaaatacttgagaatc

SEQ ID NO: 1354139 - DNA, 22 bp, Artificial Sequence
  chemically synthesized
catgtaagtgattctcaagtat

SEQ ID NO: 1354140 - DNA, 22 bp, Artificial Sequence
  chemically synthesized
gacttaagagagaaatacttga

SEQ ID NO: 1354141 - DNA, 22 bp, Artificial Sequence
  chemically synthesized
aagagttagacttaagagagaa

SEQ ID NO: 1354142 - DNA, 22 bp, Artificial Sequence
  chemically synthesized
tcaagtatttctctcttaagtc

SEQ ID NO: 1354143 - DNA, 22 bp, Artificial Sequence
  chemically synthesized
aagtatttctctcttaagtcta

SEQ ID NO: 1354144 - DNA, 22 bp, Artificial Sequence
  chemically synthesized
aaactaaagagttagacttaag

SEQ ID NO: 1354145 - DNA, 22 bp, Artificial Sequence
  chemically synthesized
ctctcttaagtctaactcttta

SEQ ID NO: 1354146 - DNA, 22 bp, Artificial Sequence
  chemically synthesized
tctcttaagtctaactctttag

SEQ ID NO: 1354147 - DNA, 22 bp, Artificial Sequence
  chemically synthesized
tcttaagtctaactctttagtt

SEQ ID NO: 1354148 - DNA, 22 bp, Artificial Sequence
  chemically synthesized
ttaagtctaactctttagtttt

SEQ ID NO: 1354149 - DNA, 22 bp, Artificial Sequence
  chemically synthesized
tgggggaggactaaaactaaag

SEQ ID NO: 1354150 - DNA, 22 bp, Artificial Sequence
  chemically synthesized
gtgggggaggactaaaactaaa

SEQ ID NO: 1354151 - DNA, 22 bp, Artificial Sequence
  chemically synthesized
aagtctaactctttagttttag

SEQ ID NO: 1354152 - DNA, 22 bp, Artificial Sequence
  chemically synthesized
tgtgggggaggactaaaactaa

SEQ ID NO: 1354153 - DNA, 22 bp, Artificial Sequence
  chemically synthesized
agtctaactctttagttttagt

SEQ ID NO: 1354154 - DNA, 22 bp, Artificial Sequence
  chemically synthesized
ttgtgggggaggactaaaacta

SEQ ID NO: 1354155 - DNA, 22 bp, Artificial Sequence
  chemically synthesized
actctttagttttagtcctccc

SEQ ID NO: 1354156 - DNA, 22 bp, Artificial Sequence
  chemically synthesized
tttagttttagtcctcccccac

SEQ ID NO: 1354157 - DNA, 22 bp, Artificial Sequence
  chemically synthesized
tagttttagtcctcccccacaa

SEQ ID NO: 1354158 - DNA, 22 bp, Artificial Sequence
  chemically synthesized
agttttagtcctcccccacaaa

SEQ ID NO: 1354159 - DNA, 22 bp, Artificial Sequence
  chemically synthesized
gttttagtcctcccccacaaaa

SEQ ID NO: 1354160 - DNA, 22 bp, Artificial Sequence
  chemically synthesized
tagtcctcccccacaaaaactt

SEQ ID NO: 1354161 - DNA, 22 bp, Artificial Sequence
  chemically synthesized
agtcctcccccacaaaaacttt

SEQ ID NO: 1354162 - DNA, 22 bp, Artificial Sequence
  chemically synthesized
gtcctcccccacaaaaactttt

SEQ ID NO: 1354163 - DNA, 22 bp, Artificial Sequence
  chemically synthesized
ccccacaaaaacttttattatc

SEQ ID NO: 1354164 - DNA, 22 bp, Artificial Sequence
  chemically synthesized
tccaggtgggtagataataaaa

SEQ ID NO: 1354165 - DNA, 22 bp, Artificial Sequence
  chemically synthesized
atgggctatccaggtgggtaga

SEQ ID NO: 1354166 - DNA, 22 bp, Artificial Sequence
  chemically synthesized
ttgatgggctatccaggtgggt

SEQ ID NO: 1354167 - DNA, 22 bp, Artificial Sequence
  chemically synthesized
ttattatctacccacctggata

SEQ ID NO: 1354168 - DNA, 22 bp, Artificial Sequence
  chemically synthesized
tattatctacccacctggatag

SEQ ID NO: 1354169 - DNA, 22 bp, Artificial Sequence
  chemically synthesized
attatctacccacctggatagc

SEQ ID NO: 1354170 - DNA, 22 bp, Artificial Sequence
  chemically synthesized
ttatctacccacctggatagcc

SEQ ID NO: 1354171 - DNA, 22 bp, Artificial Sequence
  chemically synthesized
gaattgttgatgggctatccag

SEQ ID NO: 1354172 - DNA, 22 bp, Artificial Sequence
  chemically synthesized
agaattgttgatgggctatcca

SEQ ID NO: 1354173 - DNA, 22 bp, Artificial Sequence
  chemically synthesized
tctacccacctggatagcccat

SEQ ID NO: 1354174 - DNA, 22 bp, Artificial Sequence
  chemically synthesized
cccacctggatagcccatcaac

SEQ ID NO: 1354175 - DNA, 22 bp, Artificial Sequence
  chemically synthesized
agacatcaacttagaattgttg

SEQ ID NO: 1354176 - DNA, 22 bp, Artificial Sequence
  chemically synthesized
gagacatcaacttagaattgtt

SEQ ID NO: 1354177 - DNA, 22 bp, Artificial Sequence
  chemically synthesized
gatagcccatcaacaattctaa

SEQ ID NO: 1354178 - DNA, 22 bp, Artificial Sequence
  chemically synthesized
tgagacatcaacttagaattgt

SEQ ID NO: 1354179 - DNA, 22 bp, Artificial Sequence
  chemically synthesized
ttttgagacatcaacttagaat

SEQ ID NO: 1354180 - DNA, 22 bp, Artificial Sequence
  chemically synthesized
gttttgagacatcaacttagaa

SEQ ID NO: 1354181 - DNA, 22 bp, Artificial Sequence
  chemically synthesized
tgttttgagacatcaacttaga

SEQ ID NO: 1354182 - DNA, 22 bp, Artificial Sequence
  chemically synthesized
ttgttttgagacatcaacttag

SEQ ID NO: 1354183 - DNA, 22 bp, Artificial Sequence
  chemically synthesized
taagttgatgtctcaaaacaaa

SEQ ID NO: 1354184 - DNA, 22 bp, Artificial Sequence
  chemically synthesized
agttgatgtctcaaaacaaaag

SEQ ID NO: 1354185 - DNA, 22 bp, Artificial Sequence
  chemically synthesized
atgtctcaaaacaaaaggccct

SEQ ID NO: 1354186 - DNA, 22 bp, Artificial Sequence
  chemically synthesized
gaggggaaggggaaaagggcct

SEQ ID NO: 1354187 - DNA, 22 bp, Artificial Sequence
  chemically synthesized
aaaacaaaaggcccttttcccc

SEQ ID NO: 1354188 - DNA, 22 bp, Artificial Sequence
  chemically synthesized
ttccccttcccctccaattttg

SEQ ID NO: 1354189 - DNA, 22 bp, Artificial Sequence
  chemically synthesized
tccccttcccctccaattttga

SEQ ID NO: 1354190 - DNA, 22 bp, Artificial Sequence
  chemically synthesized
ccccttcccctccaattttgat

SEQ ID NO: 1354191 - DNA, 22 bp, Artificial Sequence
  chemically synthesized
cccttcccctccaattttgatc

SEQ ID NO: 1354192 - DNA, 22 bp, Artificial Sequence
  chemically synthesized
cccctccaattttgatcctatt

SEQ ID NO: 1354193 - DNA, 22 bp, Artificial Sequence
  chemically synthesized
ccctccaattttgatcctattc

SEQ ID NO: 1354194 - DNA, 22 bp, Artificial Sequence
  chemically synthesized
caattttgatcctattcctggt

SEQ ID NO: 1354195 - DNA, 22 bp, Artificial Sequence
  chemically synthesized
acagaagtagagaaaccaggaa

SEQ ID NO: 1354196 - DNA, 22 bp, Artificial Sequence
  chemically synthesized
tgatcctattcctggtttctct

SEQ ID NO: 1354197 - DNA, 22 bp, Artificial Sequence
  chemically synthesized
gatcctattcctggtttctcta

SEQ ID NO: 1354198 - DNA, 22 bp, Artificial Sequence
  chemically synthesized
atcctattcctggtttctctac

SEQ ID NO: 1354199 - DNA, 22 bp, Artificial Sequence
  chemically synthesized
ttcctggtttctctacttctgt

SEQ ID NO: 1354200 - DNA, 22 bp, Artificial Sequence
  chemically synthesized
ctggtttctctacttctgttaa

SEQ ID NO: 1354201 - DNA, 22 bp, Artificial Sequence
  chemically synthesized
gtttctctacttctgttaatgt

SEQ ID NO: 1354202 - DNA, 22 bp, Artificial Sequence
  chemically synthesized
gtgagatgatggtaacattaac

SEQ ID NO: 1354203 - DNA, 22 bp, Artificial Sequence
  chemically synthesized
ctctacttctgttaatgttacc

SEQ ID NO: 1354204 - DNA, 22 bp, Artificial Sequence
  chemically synthesized
tctacttctgttaatgttacca

SEQ ID NO: 1354205 - DNA, 22 bp, Artificial Sequence
  chemically synthesized
tacttctgttaatgttaccatc

SEQ ID NO: 1354206 - DNA, 22 bp, Artificial Sequence
  chemically synthesized
cttctgttaatgttaccatcat

SEQ ID NO: 1354207 - DNA, 22 bp, Artificial Sequence
  chemically synthesized
ctgttaatgttaccatcatctc

SEQ ID NO: 1354208 - DNA, 22 bp, Artificial Sequence
  chemically synthesized
tgttaatgttaccatcatctca

SEQ ID NO: 1354209 - DNA, 22 bp, Artificial Sequence
  chemically synthesized
ttaatgttaccatcatctcacc

SEQ ID NO: 1354210 - DNA, 22 bp, Artificial Sequence
  chemically synthesized
atgttaccatcatctcaccagt

SEQ ID NO: 1354211 - DNA, 22 bp, Artificial Sequence
  chemically synthesized
atcaccgtgaggaactggtgag

SEQ ID NO: 1354212 - DNA, 22 bp, Artificial Sequence
  chemically synthesized
ccatcatctcaccagttcctca

SEQ ID NO: 1354213 - DNA, 22 bp, Artificial Sequence
  chemically synthesized
atagctaatcaccgtgaggaac

SEQ ID NO: 1354214 - DNA, 22 bp, Artificial Sequence
  chemically synthesized
ttaatagctaatcaccgtgagg

SEQ ID NO: 1354215 - DNA, 22 bp, Artificial Sequence
  chemically synthesized
accagttcctcacggtgattag

SEQ ID NO: 1354216 - DNA, 22 bp, Artificial Sequence
  chemically synthesized
aaattgttaatagctaatcacc

SEQ ID NO: 1354217 - DNA, 22 bp, Artificial Sequence
  chemically synthesized
aaaattgttaatagctaatcac

SEQ ID NO: 1354218 - DNA, 22 bp, Artificial Sequence
  chemically synthesized
ttaaaattgttaatagctaatc

SEQ ID NO: 1354219 - DNA, 22 bp, Artificial Sequence
  chemically synthesized
ctcacggtgattagctattaac

SEQ ID NO: 1354220 - DNA, 22 bp, Artificial Sequence
  chemically synthesized
gaattcttaaaattgttaatag

SEQ ID NO: 1354221 - DNA, 22 bp, Artificial Sequence
  chemically synthesized
acggtgattagctattaacaat

SEQ ID NO: 1354222 - DNA, 22 bp, Artificial Sequence
  chemically synthesized
gctattaacaattttaagaatt

SEQ ID NO: 1354223 - DNA, 22 bp, Artificial Sequence
  chemically synthesized
ttaacaattttaagaattccaa

SEQ ID NO: 1354224 - DNA, 22 bp, Artificial Sequence
  chemically synthesized
atgaagcatatgttggaattct

SEQ ID NO: 1354225 - DNA, 22 bp, Artificial Sequence
  chemically synthesized
aatgaagcatatgttggaattc

SEQ ID NO: 1354226 - DNA, 22 bp, Artificial Sequence
  chemically synthesized
acaattttaagaattccaacat

SEQ ID NO: 1354227 - DNA, 22 bp, Artificial Sequence
  chemically synthesized
atgtttaatgaagcatatgttg

SEQ ID NO: 1354228 - DNA, 22 bp, Artificial Sequence
  chemically synthesized
taagaattccaacatatgcttc

SEQ ID NO: 1354229 - DNA, 22 bp, Artificial Sequence
  chemically synthesized
aagaattccaacatatgcttca

SEQ ID NO: 1354230 - DNA, 22 bp, Artificial Sequence
  chemically synthesized
tctaatgtttaatgaagcatat

SEQ ID NO: 1354231 - DNA, 22 bp, Artificial Sequence
  chemically synthesized
agaattccaacatatgcttcat

SEQ ID NO: 1354232 - DNA, 22 bp, Artificial Sequence
  chemically synthesized
atctaatgtttaatgaagcata

SEQ ID NO: 1354233 - DNA, 22 bp, Artificial Sequence
  chemically synthesized
caacatatgcttcattaaacat

SEQ ID NO: 1354234 - DNA, 22 bp, Artificial Sequence
  chemically synthesized
cattaaacattagataaatggg

SEQ ID NO: 1354235 - DNA, 22 bp, Artificial Sequence
  chemically synthesized
attaaacattagataaatgggc

SEQ ID NO: 1354236 - DNA, 22 bp, Artificial Sequence
  chemically synthesized
aacattagataaatgggcattt

SEQ ID NO: 1354237 - DNA, 22 bp, Artificial Sequence
  chemically synthesized
acatgcagtcaataaatgccca

SEQ ID NO: 1354238 - DNA, 22 bp, Artificial Sequence
  chemically synthesized
aacatgcagtcaataaatgccc

SEQ ID NO: 1354239 - DNA, 22 bp, Artificial Sequence
  chemically synthesized
taacatgcagtcaataaatgcc

SEQ ID NO: 1354240 - DNA, 22 bp, Artificial Sequence
  chemically synthesized
tttaacatgcagtcaataaatg

SEQ ID NO: 1354241 - DNA, 22 bp, Artificial Sequence
  chemically synthesized
ctttaacatgcagtcaataaat

SEQ ID NO: 1354242 - DNA, 22 bp, Artificial Sequence
  chemically synthesized
gataaatgggcatttattgact

SEQ ID NO: 1354243 - DNA, 22 bp, Artificial Sequence
  chemically synthesized
accatggaacttctttaacatg

SEQ ID NO: 1354244 - DNA, 22 bp, Artificial Sequence
  chemically synthesized
caccatggaacttctttaacat

SEQ ID NO: 1354245 - DNA, 22 bp, Artificial Sequence
  chemically synthesized
attgactgcatgttaaagaagt

SEQ ID NO: 1354246 - DNA, 22 bp, Artificial Sequence
  chemically synthesized
ttgactgcatgttaaagaagtt

SEQ ID NO: 1354247 - DNA, 22 bp, Artificial Sequence
  chemically synthesized
atttcaccatggaacttcttta

SEQ ID NO: 1354248 - DNA, 22 bp, Artificial Sequence
  chemically synthesized
actgcatgttaaagaagttcca

SEQ ID NO: 1354249 - DNA, 22 bp, Artificial Sequence
  chemically synthesized
catgttaaagaagttccatggt

SEQ ID NO: 1354250 - DNA, 22 bp, Artificial Sequence
  chemically synthesized
ccaaactcatttcaccatggaa

SEQ ID NO: 1354251 - DNA, 22 bp, Artificial Sequence
  chemically synthesized
cccaaactcatttcaccatgga

SEQ ID NO: 1354252 - DNA, 22 bp, Artificial Sequence
  chemically synthesized
gtttcccaaactcatttcacca

SEQ ID NO: 1354253 - DNA, 22 bp, Artificial Sequence
  chemically synthesized
aagaagttccatggtgaaatga

SEQ ID NO: 1354254 - DNA, 22 bp, Artificial Sequence
  chemically synthesized
acctagtttcccaaactcattt

SEQ ID NO: 1354255 - DNA, 22 bp, Artificial Sequence
  chemically synthesized
aacctagtttcccaaactcatt

SEQ ID NO: 1354256 - DNA, 22 bp, Artificial Sequence
  chemically synthesized
taacctagtttcccaaactcat

SEQ ID NO: 1354257 - DNA, 22 bp, Artificial Sequence
  chemically synthesized
ttaacctagtttcccaaactca

SEQ ID NO: 1354258 - DNA, 22 bp, Artificial Sequence
  chemically synthesized
catggtgaaatgagtttgggaa

SEQ ID NO: 1354259 - DNA, 22 bp, Artificial Sequence
  chemically synthesized
acttttaacctagtttcccaaa

SEQ ID NO: 1354260 - DNA, 22 bp, Artificial Sequence
  chemically synthesized
aacttttaacctagtttcccaa

SEQ ID NO: 1354261 - DNA, 22 bp, Artificial Sequence
  chemically synthesized
tttaacttttaacctagtttcc

SEQ ID NO: 1354262 - DNA, 22 bp, Artificial Sequence
  chemically synthesized
gggaaactaggttaaaagttaa

SEQ ID NO: 1354263 - DNA, 22 bp, Artificial Sequence
  chemically synthesized
ggaaactaggttaaaagttaaa

SEQ ID NO: 1354264 - DNA, 22 bp, Artificial Sequence
  chemically synthesized
caggaaagacagctgtttaact

SEQ ID NO: 1354265 - DNA, 22 bp, Artificial Sequence
  chemically synthesized
ggttaaaagttaaacagctgtc

SEQ ID NO: 1354266 - DNA, 22 bp, Artificial Sequence
  chemically synthesized
gaatcctgcaggaaagacagct

SEQ ID NO: 1354267 - DNA, 22 bp, Artificial Sequence
  chemically synthesized
aaagttaaacagctgtctttcc

SEQ ID NO: 1354268 - DNA, 22 bp, Artificial Sequence
  chemically synthesized
tggaatcctgcaggaaagacag

SEQ ID NO: 1354269 - DNA, 22 bp, Artificial Sequence
  chemically synthesized
aacagctgtctttcctgcagga

SEQ ID NO: 1354270 - DNA, 22 bp, Artificial Sequence
  chemically synthesized
tctttcctgcaggattccagag

SEQ ID NO: 1354271 - DNA, 22 bp, Artificial Sequence
  chemically synthesized
tcctgcaggattccagagcatc

SEQ ID NO: 1354272 - DNA, 22 bp, Artificial Sequence
  chemically synthesized
cctgcaggattccagagcatct

SEQ ID NO: 1354273 - DNA, 22 bp, Artificial Sequence
  chemically synthesized
ctgcaggattccagagcatctt

SEQ ID NO: 1354274 - DNA, 22 bp, Artificial Sequence
  chemically synthesized
caggattccagagcatctttgc

SEQ ID NO: 1354275 - DNA, 22 bp, Artificial Sequence
  chemically synthesized
aatgtaatgcatatgcaaagat

SEQ ID NO: 1354276 - DNA, 22 bp, Artificial Sequence
  chemically synthesized
tcaatgtaatgcatatgcaaag

SEQ ID NO: 1354277 - DNA, 22 bp, Artificial Sequence
  chemically synthesized
ctcaatgtaatgcatatgcaaa

SEQ ID NO: 1354278 - DNA, 22 bp, Artificial Sequence
  chemically synthesized
cagagcatctttgcatatgcat

SEQ ID NO: 1354279 - DNA, 22 bp, Artificial Sequence
  chemically synthesized
gagtttctcaatgtaatgcata

SEQ ID NO: 1354280 - DNA, 22 bp, Artificial Sequence
  chemically synthesized
agagtttctcaatgtaatgcat

SEQ ID NO: 1354281 - DNA, 22 bp, Artificial Sequence
  chemically synthesized
tgcatatgcattacattgagaa

SEQ ID NO: 1354282 - DNA, 22 bp, Artificial Sequence
  chemically synthesized
gcatatgcattacattgagaaa

SEQ ID NO: 1354283 - DNA, 22 bp, Artificial Sequence
  chemically synthesized
catatgcattacattgagaaac

SEQ ID NO: 1354284 - DNA, 22 bp, Artificial Sequence
  chemically synthesized
aatccccttagagtttctcaat

SEQ ID NO: 1354285 - DNA, 22 bp, Artificial Sequence
  chemically synthesized
catactaaatccccttagagtt

SEQ ID NO: 1354286 - DNA, 22 bp, Artificial Sequence
  chemically synthesized
cattgagaaactctaaggggat

SEQ ID NO: 1354287 - DNA, 22 bp, Artificial Sequence
  chemically synthesized
agaaactctaaggggatttagt

SEQ ID NO: 1354288 - DNA, 22 bp, Artificial Sequence
  chemically synthesized
aggggaatactacatactaaat

SEQ ID NO: 1354289 - DNA, 22 bp, Artificial Sequence
  chemically synthesized
taaggggatttagtatgtagta

SEQ ID NO: 1354290 - DNA, 22 bp, Artificial Sequence
  chemically synthesized
aggggatttagtatgtagtatt

SEQ ID NO: 1354291 - DNA, 22 bp, Artificial Sequence
  chemically synthesized
gtcataaaactgaggggaatac

SEQ ID NO: 1354292 - DNA, 22 bp, Artificial Sequence
  chemically synthesized
agtcataaaactgaggggaata

SEQ ID NO: 1354293 - DNA, 22 bp, Artificial Sequence
  chemically synthesized
tagtcataaaactgaggggaat

SEQ ID NO: 1354294 - DNA, 22 bp, Artificial Sequence
  chemically synthesized
agtatgtagtattcccctcagt

SEQ ID NO: 1354295 - DNA, 22 bp, Artificial Sequence
  chemically synthesized
tttagtcataaaactgagggga

SEQ ID NO: 1354296 - DNA, 22 bp, Artificial Sequence
  chemically synthesized
gtatgtagtattcccctcagtt

SEQ ID NO: 1354297 - DNA, 22 bp, Artificial Sequence
  chemically synthesized
ctttagtcataaaactgagggg

SEQ ID NO: 1354298 - DNA, 22 bp, Artificial Sequence
  chemically synthesized
ccctcagttttatgactaaaga

SEQ ID NO: 1354299 - DNA, 22 bp, Artificial Sequence
  chemically synthesized
agttttatgactaaagaagtct

SEQ ID NO: 1354300 - DNA, 22 bp, Artificial Sequence
  chemically synthesized
tatgactaaagaagtctttttt

SEQ ID NO: 1354301 - DNA, 22 bp, Artificial Sequence
  chemically synthesized
atgactaaagaagtcttttttg

SEQ ID NO: 1354302 - DNA, 22 bp, Artificial Sequence
  chemically synthesized
gccccacgcccccaaaaaagac

SEQ ID NO: 1354303 - DNA, 22 bp, Artificial Sequence
  chemically synthesized
tgactaaagaagtcttttttgg

SEQ ID NO: 1354304 - DNA, 22 bp, Artificial Sequence
  chemically synthesized
ggccccacgcccccaaaaaaga

SEQ ID NO: 1354305 - DNA, 22 bp, Artificial Sequence
  chemically synthesized
tttggccccacgcccccaaaaa

SEQ ID NO: 1354306 - DNA, 22 bp, Artificial Sequence
  chemically synthesized
tgtttggccccacgcccccaaa

SEQ ID NO: 1354307 - DNA, 22 bp, Artificial Sequence
  chemically synthesized
aagaagtcttttttgggggcgt

SEQ ID NO: 1354308 - DNA, 22 bp, Artificial Sequence
  chemically synthesized
ttttgggggcgtggggccaaac

SEQ ID NO: 1354309 - DNA, 22 bp, Artificial Sequence
  chemically synthesized
tgggccccctctgtttggcccc

SEQ ID NO: 1354310 - DNA, 22 bp, Artificial Sequence
  chemically synthesized
tttgggggcgtggggccaaaca

SEQ ID NO: 1354311 - DNA, 22 bp, Artificial Sequence
  chemically synthesized
ttgggggcgtggggccaaacag

SEQ ID NO: 1354312 - DNA, 22 bp, Artificial Sequence
  chemically synthesized
tgggggcgtggggccaaacaga

SEQ ID NO: 1354313 - DNA, 22 bp, Artificial Sequence
  chemically synthesized
gggggcgtggggccaaacagag

SEQ ID NO: 1354314 - DNA, 22 bp, Artificial Sequence
  chemically synthesized
attatgggccccctctgtttgg

SEQ ID NO: 1354315 - DNA, 22 bp, Artificial Sequence
  chemically synthesized
ggggcgtggggccaaacagagg

SEQ ID NO: 1354316 - DNA, 22 bp, Artificial Sequence
  chemically synthesized
ttcattatgggccccctctgtt

SEQ ID NO: 1354317 - DNA, 22 bp, Artificial Sequence
  chemically synthesized
tggcacagtaattattcattat

SEQ ID NO: 1354318 - DNA, 22 bp, Artificial Sequence
  chemically synthesized
tatggcacagtaattattcatt

SEQ ID NO: 1354319 - DNA, 22 bp, Artificial Sequence
  chemically synthesized
atcccccaagagtgctctatgg

SEQ ID NO: 1354320 - DNA, 22 bp, Artificial Sequence
  chemically synthesized
atattaatcccccaagagtgct

SEQ ID NO: 1354321 - DNA, 22 bp, Artificial Sequence
  chemically synthesized
ctgtgccatagagcactcttgg

SEQ ID NO: 1354322 - DNA, 22 bp, Artificial Sequence
  chemically synthesized
tgccatagagcactcttggggg

SEQ ID NO: 1354323 - DNA, 22 bp, Artificial Sequence
  chemically synthesized
cctgatattaatcccccaagag

SEQ ID NO: 1354324 - DNA, 22 bp, Artificial Sequence
  chemically synthesized
ttgggggattaatatcagggag

SEQ ID NO: 1354325 - DNA, 22 bp, Artificial Sequence
  chemically synthesized
gggggattaatatcagggagtc

SEQ ID NO: 1354326 - DNA, 22 bp, Artificial Sequence
  chemically synthesized
ggggattaatatcagggagtct

SEQ ID NO: 1354327 - DNA, 22 bp, Artificial Sequence
  chemically synthesized
atatcagggagtctgctatcat

SEQ ID NO: 1354328 - DNA, 22 bp, Artificial Sequence
  chemically synthesized
tgggagatgaggaaaagggaat

SEQ ID NO: 1354329 - DNA, 22 bp, Artificial Sequence
  chemically synthesized
ctatcattattcccttttcctc

SEQ ID NO: 1354330 - DNA, 22 bp, Artificial Sequence
  chemically synthesized
aattgtgggagatgaggaaaag

SEQ ID NO: 1354331 - DNA, 22 bp, Artificial Sequence
  chemically synthesized
tcattattcccttttcctcatc

SEQ ID NO: 1354332 - DNA, 22 bp, Artificial Sequence
  chemically synthesized
ctaaattgtgggagatgaggaa

SEQ ID NO: 1354333 - DNA, 22 bp, Artificial Sequence
  chemically synthesized
ttgctaaattgtgggagatgag

SEQ ID NO: 1354334 - DNA, 22 bp, Artificial Sequence
  chemically synthesized
ttcccttttcctcatctcccac

SEQ ID NO: 1354335 - DNA, 22 bp, Artificial Sequence
  chemically synthesized
ccttttcctcatctcccacaat

SEQ ID NO: 1354336 - DNA, 22 bp, Artificial Sequence
  chemically synthesized
ttcctcatctcccacaatttag

SEQ ID NO: 1354337 - DNA, 22 bp, Artificial Sequence
  chemically synthesized
tcctcatctcccacaatttagc

SEQ ID NO: 1354338 - DNA, 22 bp, Artificial Sequence
  chemically synthesized
cctcatctcccacaatttagca

SEQ ID NO: 1354339 - DNA, 22 bp, Artificial Sequence
  chemically synthesized
gtagtaagttgttgctaaattg

SEQ ID NO: 1354340 - DNA, 22 bp, Artificial Sequence
  chemically synthesized
ctcatctcccacaatttagcaa

SEQ ID NO: 1354341 - DNA, 22 bp, Artificial Sequence
  chemically synthesized
ggtagtaagttgttgctaaatt

SEQ ID NO: 1354342 - DNA, 22 bp, Artificial Sequence
  chemically synthesized
atctcccacaatttagcaacaa

SEQ ID NO: 1354343 - DNA, 22 bp, Artificial Sequence
  chemically synthesized
tttggtagtaagttgttgctaa

SEQ ID NO: 1354344 - DNA, 22 bp, Artificial Sequence
  chemically synthesized
ccacaatttagcaacaacttac

SEQ ID NO: 1354345 - DNA, 22 bp, Artificial Sequence
  chemically synthesized
agcaacaacttactaccaaata

SEQ ID NO: 1354346 - DNA, 22 bp, Artificial Sequence
  chemically synthesized
gcaacaacttactaccaaataa

SEQ ID NO: 1354347 - DNA, 22 bp, Artificial Sequence
  chemically synthesized
aacaaggagaaccaaattattt

SEQ ID NO: 1354348 - DNA, 22 bp, Artificial Sequence
  chemically synthesized
actaccaaataatttggttctc

SEQ ID NO: 1354349 - DNA, 22 bp, Artificial Sequence
  chemically synthesized
ctaccaaataatttggttctcc

SEQ ID NO: 1354350 - DNA, 22 bp, Artificial Sequence
  chemically synthesized
ccaaataatttggttctccttg

SEQ ID NO: 1354351 - DNA, 22 bp, Artificial Sequence
  chemically synthesized
agaatgagatagggattcaaca

SEQ ID NO: 1354352 - DNA, 22 bp, Artificial Sequence
  chemically synthesized
ggttctccttgttgaatcccta

SEQ ID NO: 1354353 - DNA, 22 bp, Artificial Sequence
  chemically synthesized
gttctccttgttgaatccctat

SEQ ID NO: 1354354 - DNA, 22 bp, Artificial Sequence
  chemically synthesized
tccttgttgaatccctatctca

SEQ ID NO: 1354355 - DNA, 22 bp, Artificial Sequence
  chemically synthesized
cttgttgaatccctatctcatt

SEQ ID NO: 1354356 - DNA, 22 bp, Artificial Sequence
  chemically synthesized
gttgaatccctatctcattctg

SEQ ID NO: 1354357 - DNA, 22 bp, Artificial Sequence
  chemically synthesized
ttgaatccctatctcattctga

SEQ ID NO: 1354358 - DNA, 22 bp, Artificial Sequence
  chemically synthesized
caaaagcagtagctcagaatga

SEQ ID NO: 1354359 - DNA, 22 bp, Artificial Sequence
  chemically synthesized
acaaaagcagtagctcagaatg

SEQ ID NO: 1354360 - DNA, 22 bp, Artificial Sequence
  chemically synthesized
aatccctatctcattctgagct

SEQ ID NO: 1354361 - DNA, 22 bp, Artificial Sequence
  chemically synthesized
tctcattctgagctactgcttt

SEQ ID NO: 1354362 - DNA, 22 bp, Artificial Sequence
  chemically synthesized
ggccagatttacaaaagcagta

SEQ ID NO: 1354363 - DNA, 22 bp, Artificial Sequence
  chemically synthesized
attctgagctactgcttttgta

SEQ ID NO: 1354364 - DNA, 22 bp, Artificial Sequence
  chemically synthesized
tgagctactgcttttgtaaatc

SEQ ID NO: 1354365 - DNA, 22 bp, Artificial Sequence
  chemically synthesized
agctactgcttttgtaaatctg

SEQ ID NO: 1354366 - DNA, 22 bp, Artificial Sequence
  chemically synthesized
catgtagcctaggccagattta

SEQ ID NO: 1354367 - DNA, 22 bp, Artificial Sequence
  chemically synthesized
ctgcttttgtaaatctggccta

SEQ ID NO: 1354368 - DNA, 22 bp, Artificial Sequence
  chemically synthesized
cttttgtaaatctggcctaggc

SEQ ID NO: 1354369 - DNA, 22 bp, Artificial Sequence
  chemically synthesized
ttgtaaatctggcctaggctac

SEQ ID NO: 1354370 - DNA, 22 bp, Artificial Sequence
  chemically synthesized
tgtaaatctggcctaggctaca

SEQ ID NO: 1354371 - DNA, 22 bp, Artificial Sequence
  chemically synthesized
gtaaatctggcctaggctacat

SEQ ID NO: 1354372 - DNA, 22 bp, Artificial Sequence
  chemically synthesized
taaatctggcctaggctacatg

SEQ ID NO: 1354373 - DNA, 22 bp, Artificial Sequence
  chemically synthesized
gcctaggctacatgtaggctct

SEQ ID NO: 1354374 - DNA, 22 bp, Artificial Sequence
  chemically synthesized
ggctacatgtaggctctccttt

SEQ ID NO: 1354375 - DNA, 22 bp, Artificial Sequence
  chemically synthesized
catgtaggctctcctttcactg

SEQ ID NO: 1354376 - DNA, 22 bp, Artificial Sequence
  chemically synthesized
gaataagaaaaggcagtgaaag

SEQ ID NO: 1354377 - DNA, 22 bp, Artificial Sequence
  chemically synthesized
agatgttagaataagaaaaggc

SEQ ID NO: 1354378 - DNA, 22 bp, Artificial Sequence
  chemically synthesized
gagatgttagaataagaaaagg

SEQ ID NO: 1354379 - DNA, 22 bp, Artificial Sequence
  chemically synthesized
tcctttcactgccttttcttat

SEQ ID NO: 1354380 - DNA, 22 bp, Artificial Sequence
  chemically synthesized
ctttcactgccttttcttattc

SEQ ID NO: 1354381 - DNA, 22 bp, Artificial Sequence
  chemically synthesized
tcactgccttttcttattctaa

SEQ ID NO: 1354382 - DNA, 22 bp, Artificial Sequence
  chemically synthesized
cactgccttttcttattctaac

SEQ ID NO: 1354383 - DNA, 22 bp, Artificial Sequence
  chemically synthesized
agagtttgagatgttagaataa

SEQ ID NO: 1354384 - DNA, 22 bp, Artificial Sequence
  chemically synthesized
actgccttttcttattctaaca

SEQ ID NO: 1354385 - DNA, 22 bp, Artificial Sequence
  chemically synthesized
ccttttcttattctaacatctc

SEQ ID NO: 1354386 - DNA, 22 bp, Artificial Sequence
  chemically synthesized
aattgagagtttgagatgttag

SEQ ID NO: 1354387 - DNA, 22 bp, Artificial Sequence
  chemically synthesized
ttcttattctaacatctcaaac

SEQ ID NO: 1354388 - DNA, 22 bp, Artificial Sequence
  chemically synthesized
tcttattctaacatctcaaact

SEQ ID NO: 1354389 - DNA, 22 bp, Artificial Sequence
  chemically synthesized
cttattctaacatctcaaactc

SEQ ID NO: 1354390 - DNA, 22 bp, Artificial Sequence
  chemically synthesized
ttattctaacatctcaaactct

SEQ ID NO: 1354391 - DNA, 22 bp, Artificial Sequence
  chemically synthesized
attctaacatctcaaactctca

SEQ ID NO: 1354392 - DNA, 22 bp, Artificial Sequence
  chemically synthesized
ttctaacatctcaaactctcaa

SEQ ID NO: 1354393 - DNA, 22 bp, Artificial Sequence
  chemically synthesized
cagaagatattgaattgagagt

SEQ ID NO: 1354394 - DNA, 22 bp, Artificial Sequence
  chemically synthesized
taacatctcaaactctcaattc

SEQ ID NO: 1354395 - DNA, 22 bp, Artificial Sequence
  chemically synthesized
tacagaagatattgaattgaga

SEQ ID NO: 1354396 - DNA, 22 bp, Artificial Sequence
  chemically synthesized
acatctcaaactctcaattcaa

SEQ ID NO: 1354397 - DNA, 22 bp, Artificial Sequence
  chemically synthesized
aaattctacagaagatattgaa

SEQ ID NO: 1354398 - DNA, 22 bp, Artificial Sequence
  chemically synthesized
aaactctcaattcaatatcttc

SEQ ID NO: 1354399 - DNA, 22 bp, Artificial Sequence
  chemically synthesized
tcaattcaatatcttctgtaga

SEQ ID NO: 1354400 - DNA, 22 bp, Artificial Sequence
  chemically synthesized
aattcaatatcttctgtagaat

SEQ ID NO: 1354401 - DNA, 22 bp, Artificial Sequence
  chemically synthesized
aatatcttctgtagaatttgag

SEQ ID NO: 1354402 - DNA, 22 bp, Artificial Sequence
  chemically synthesized
cagaaaatagatctcaaattct

SEQ ID NO: 1354403 - DNA, 22 bp, Artificial Sequence
  chemically synthesized
acagaaaatagatctcaaattc

SEQ ID NO: 1354404 - DNA, 22 bp, Artificial Sequence
  chemically synthesized
ttacagaaaatagatctcaaat

SEQ ID NO: 1354405 - DNA, 22 bp, Artificial Sequence
  chemically synthesized
ctgtagaatttgagatctattt

SEQ ID NO: 1354406 - DNA, 22 bp, Artificial Sequence
  chemically synthesized
tgtagaatttgagatctatttt

SEQ ID NO: 1354407 - DNA, 22 bp, Artificial Sequence
  chemically synthesized
tatctcttacagaaaatagatc

SEQ ID NO: 1354408 - DNA, 22 bp, Artificial Sequence
  chemically synthesized
gtatctcttacagaaaatagat

SEQ ID NO: 1354409 - DNA, 22 bp, Artificial Sequence
  chemically synthesized
tagaatttgagatctattttct

SEQ ID NO: 1354410 - DNA, 22 bp, Artificial Sequence
  chemically synthesized
tgtatctcttacagaaaataga

SEQ ID NO: 1354411 - DNA, 22 bp, Artificial Sequence
  chemically synthesized
gagatctattttctgtaagaga

SEQ ID NO: 1354412 - DNA, 22 bp, Artificial Sequence
  chemically synthesized
cccatctttgtatctcttacag

SEQ ID NO: 1354413 - DNA, 22 bp, Artificial Sequence
  chemically synthesized
agatctattttctgtaagagat

SEQ ID NO: 1354414 - DNA, 22 bp, Artificial Sequence
  chemically synthesized
acccatctttgtatctcttaca

SEQ ID NO: 1354415 - DNA, 22 bp, Artificial Sequence
  chemically synthesized
ttttctgtaagagatacaaaga

SEQ ID NO: 1354416 - DNA, 22 bp, Artificial Sequence
  chemically synthesized
tctgtaagagatacaaagatgg

SEQ ID NO: 1354417 - DNA, 22 bp, Artificial Sequence
  chemically synthesized
ctgtaagagatacaaagatggg

SEQ ID NO: 1354418 - DNA, 22 bp, Artificial Sequence
  chemically synthesized
tgtaagagatacaaagatgggt

SEQ ID NO: 1354419 - DNA, 22 bp, Artificial Sequence
  chemically synthesized
taagagatacaaagatgggtaa

SEQ ID NO: 1354420 - DNA, 22 bp, Artificial Sequence
  chemically synthesized
acagatcccaagacaatagaga

SEQ ID NO: 1354421 - DNA, 22 bp, Artificial Sequence
  chemically synthesized
tcacagatcccaagacaataga

SEQ ID NO: 1354422 - DNA, 22 bp, Artificial Sequence
  chemically synthesized
ccatctctcacagatcccaaga

SEQ ID NO: 1354423 - DNA, 22 bp, Artificial Sequence
  chemically synthesized
ttcccatctctcacagatccca

SEQ ID NO: 1354424 - DNA, 22 bp, Artificial Sequence
  chemically synthesized
tattgtcttgggatctgtgaga

SEQ ID NO: 1354425 - DNA, 22 bp, Artificial Sequence
  chemically synthesized
gcctattcccatctctcacaga

SEQ ID NO: 1354426 - DNA, 22 bp, Artificial Sequence
  chemically synthesized
ttgtcttgggatctgtgagaga

SEQ ID NO: 1354427 - DNA, 22 bp, Artificial Sequence
  chemically synthesized
ctggcctattcccatctctcac

SEQ ID NO: 1354428 - DNA, 22 bp, Artificial Sequence
  chemically synthesized
tcttgggatctgtgagagatgg

SEQ ID NO: 1354429 - DNA, 22 bp, Artificial Sequence
  chemically synthesized
tgctggcctattcccatctctc

SEQ ID NO: 1354430 - DNA, 22 bp, Artificial Sequence
  chemically synthesized
gggatctgtgagagatgggaat

SEQ ID NO: 1354431 - DNA, 22 bp, Artificial Sequence
  chemically synthesized
ggatctgtgagagatgggaata

SEQ ID NO: 1354432 - DNA, 22 bp, Artificial Sequence
  chemically synthesized
aactctgctggcctattcccat

SEQ ID NO: 1354433 - DNA, 22 bp, Artificial Sequence
  chemically synthesized
gaactctgctggcctattccca

SEQ ID NO: 1354434 - DNA, 22 bp, Artificial Sequence
  chemically synthesized
tgagagatgggaataggccagc

SEQ ID NO: 1354435 - DNA, 22 bp, Artificial Sequence
  chemically synthesized
aatatatatttgaactctgctg

SEQ ID NO: 1354436 - DNA, 22 bp, Artificial Sequence
  chemically synthesized
tggtattgaatatatatttgaa

SEQ ID NO: 1354437 - DNA, 22 bp, Artificial Sequence
  chemically synthesized
tgcctatggtattgaatatata

SEQ ID NO: 1354438 - DNA, 22 bp, Artificial Sequence
  chemically synthesized
aaatatatattcaataccatag

SEQ ID NO: 1354439 - DNA, 22 bp, Artificial Sequence
  chemically synthesized
tgtggtatgtctatgcctatgg

SEQ ID NO: 1354440 - DNA, 22 bp, Artificial Sequence
  chemically synthesized
atgtggtatgtctatgcctatg

SEQ ID NO: 1354441 - DNA, 22 bp, Artificial Sequence
  chemically synthesized
aataccataggcatagacatac

SEQ ID NO: 1354442 - DNA, 22 bp, Artificial Sequence
  chemically synthesized
acaacatttatgtggtatgtct

SEQ ID NO: 1354443 - DNA, 22 bp, Artificial Sequence
  chemically synthesized
cacaacatttatgtggtatgtc

SEQ ID NO: 1354444 - DNA, 22 bp, Artificial Sequence
  chemically synthesized
tttcacaacatttatgtggtat

SEQ ID NO: 1354445 - DNA, 22 bp, Artificial Sequence
  chemically synthesized
gtttcacaacatttatgtggta

SEQ ID NO: 1354446 - DNA, 22 bp, Artificial Sequence
  chemically synthesized
ttgtttcacaacatttatgtgg

SEQ ID NO: 1354447 - DNA, 22 bp, Artificial Sequence
  chemically synthesized
cttgtttcacaacatttatgtg

SEQ ID NO: 1354448 - DNA, 22 bp, Artificial Sequence
  chemically synthesized
tttcttgtttcacaacatttat

SEQ ID NO: 1354449 - DNA, 22 bp, Artificial Sequence
  chemically synthesized
ctatttcttgtttcacaacatt

SEQ ID NO: 1354450 - DNA, 22 bp, Artificial Sequence
  chemically synthesized
actgctatttcttgtttcacaa

SEQ ID NO: 1354451 - DNA, 22 bp, Artificial Sequence
  chemically synthesized
ccatataagcattgactgctat

SEQ ID NO: 1354452 - DNA, 22 bp, Artificial Sequence
  chemically synthesized
tgaaacaagaaatagcagtcaa

SEQ ID NO: 1354453 - DNA, 22 bp, Artificial Sequence
  chemically synthesized
cccatataagcattgactgcta

SEQ ID NO: 1354454 - DNA, 22 bp, Artificial Sequence
  chemically synthesized
tcccatataagcattgactgct

SEQ ID NO: 1354455 - DNA, 22 bp, Artificial Sequence
  chemically synthesized
atgtaacctttcccatataagc

SEQ ID NO: 1354456 - DNA, 22 bp, Artificial Sequence
  chemically synthesized
aaaaaacctaatgtaacctttc

SEQ ID NO: 1354457 - DNA, 22 bp, Artificial Sequence
  chemically synthesized
aaaaaaacctaatgtaaccttt

SEQ ID NO: 1354458 - DNA, 22 bp, Artificial Sequence
  chemically synthesized
cttaaaaaaacctaatgtaacc

SEQ ID NO: 1354459 - DNA, 22 bp, Artificial Sequence
  chemically synthesized
ccttaaaaaaacctaatgtaac

SEQ ID NO: 1354460 - DNA, 22 bp, Artificial Sequence
  chemically synthesized
atatgggaaaggttacattagg

SEQ ID NO: 1354461 - DNA, 22 bp, Artificial Sequence
  chemically synthesized
tatgggaaaggttacattaggt

SEQ ID NO: 1354462 - DNA, 22 bp, Artificial Sequence
  chemically synthesized
tccaggtcccacttccttaaaa

SEQ ID NO: 1354463 - DNA, 22 bp, Artificial Sequence
  chemically synthesized
cattaggtttttttaaggaagt

SEQ ID NO: 1354464 - DNA, 22 bp, Artificial Sequence
  chemically synthesized
atattatccaggtcccacttcc

SEQ ID NO: 1354465 - DNA, 22 bp, Artificial Sequence
  chemically synthesized
ggtttttttaaggaagtgggac

SEQ ID NO: 1354466 - DNA, 22 bp, Artificial Sequence
  chemically synthesized
gactaatattatccaggtccca

SEQ ID NO: 1354467 - DNA, 22 bp, Artificial Sequence
  chemically synthesized
ttttaaggaagtgggacctgga

SEQ ID NO: 1354468 - DNA, 22 bp, Artificial Sequence
  chemically synthesized
tttaaggaagtgggacctggat

SEQ ID NO: 1354469 - DNA, 22 bp, Artificial Sequence
  chemically synthesized
ttaaggaagtgggacctggata

SEQ ID NO: 1354470 - DNA, 22 bp, Artificial Sequence
  chemically synthesized
ctggactaatattatccaggtc

SEQ ID NO: 1354471 - DNA, 22 bp, Artificial Sequence
  chemically synthesized
taaggaagtgggacctggataa

SEQ ID NO: 1354472 - DNA, 22 bp, Artificial Sequence
  chemically synthesized
aaggaagtgggacctggataat

SEQ ID NO: 1354473 - DNA, 22 bp, Artificial Sequence
  chemically synthesized
aggaagtgggacctggataata

SEQ ID NO: 1354474 - DNA, 22 bp, Artificial Sequence
  chemically synthesized
gaagttcctggactaatattat

SEQ ID NO: 1354475 - DNA, 22 bp, Artificial Sequence
  chemically synthesized
agaagttcctggactaatatta

SEQ ID NO: 1354476 - DNA, 22 bp, Artificial Sequence
  chemically synthesized
atttagaagttcctggactaat

SEQ ID NO: 1354477 - DNA, 22 bp, Artificial Sequence
  chemically synthesized
catttagaagttcctggactaa

SEQ ID NO: 1354478 - DNA, 22 bp, Artificial Sequence
  chemically synthesized
tcatttagaagttcctggacta

SEQ ID NO: 1354479 - DNA, 22 bp, Artificial Sequence
  chemically synthesized
gataatattagtccaggaactt

SEQ ID NO: 1354480 - DNA, 22 bp, Artificial Sequence
  chemically synthesized
aatctttcatttagaagttcct

SEQ ID NO: 1354481 - DNA, 22 bp, Artificial Sequence
  chemically synthesized
aaatctttcatttagaagttcc

SEQ ID NO: 1354482 - DNA, 22 bp, Artificial Sequence
  chemically synthesized
taaatctttcatttagaagttc

SEQ ID NO: 1354483 - DNA, 22 bp, Artificial Sequence
  chemically synthesized
ttaaatctttcatttagaagtt

SEQ ID NO: 1354484 - DNA, 22 bp, Artificial Sequence
  chemically synthesized
gtccaggaacttctaaatgaaa

SEQ ID NO: 1354485 - DNA, 22 bp, Artificial Sequence
  chemically synthesized
gggtagataaatacttttaaat

SEQ ID NO: 1354486 - DNA, 22 bp, Artificial Sequence
  chemically synthesized
ctaaatgaaagatttaaaagta

SEQ ID NO: 1354487 - DNA, 22 bp, Artificial Sequence
  chemically synthesized
ggggtagataaatacttttaaa

SEQ ID NO: 1354488 - DNA, 22 bp, Artificial Sequence
  chemically synthesized
taaatgaaagatttaaaagtat

SEQ ID NO: 1354489 - DNA, 22 bp, Artificial Sequence
  chemically synthesized
tggggtagataaatacttttaa

SEQ ID NO: 1354490 - DNA, 22 bp, Artificial Sequence
  chemically synthesized
aatgaaagatttaaaagtattt

SEQ ID NO: 1354491 - DNA, 22 bp, Artificial Sequence
  chemically synthesized
aaaagtatttatctaccccaaa

SEQ ID NO: 1354492 - DNA, 22 bp, Artificial Sequence
  chemically synthesized
aaagtatttatctaccccaaag

SEQ ID NO: 1354493 - DNA, 22 bp, Artificial Sequence
  chemically synthesized
agatgagaagatagtctttggg

SEQ ID NO: 1354494 - DNA, 22 bp, Artificial Sequence
  chemically synthesized
aagatgagaagatagtctttgg

SEQ ID NO: 1354495 - DNA, 22 bp, Artificial Sequence
  chemically synthesized
gtttaagatgagaagatagtct

SEQ ID NO: 1354496 - DNA, 22 bp, Artificial Sequence
  chemically synthesized
atctaccccaaagactatcttc

SEQ ID NO: 1354497 - DNA, 22 bp, Artificial Sequence
  chemically synthesized
agtttaagatgagaagatagtc

SEQ ID NO: 1354498 - DNA, 22 bp, Artificial Sequence
  chemically synthesized
tctaccccaaagactatcttct

SEQ ID NO: 1354499 - DNA, 22 bp, Artificial Sequence
  chemically synthesized
tagtttaagatgagaagatagt

SEQ ID NO: 1354500 - DNA, 22 bp, Artificial Sequence
  chemically synthesized
ttagtttaagatgagaagatag

SEQ ID NO: 1354501 - DNA, 22 bp, Artificial Sequence
  chemically synthesized
ccccaaagactatcttctcatc

SEQ ID NO: 1354502 - DNA, 22 bp, Artificial Sequence
  chemically synthesized
tttttagtttaagatgagaaga

SEQ ID NO: 1354503 - DNA, 22 bp, Artificial Sequence
  chemically synthesized
atttttagtttaagatgagaag

SEQ ID NO: 1354504 - DNA, 22 bp, Artificial Sequence
  chemically synthesized
aacttatttttagtttaagatg

SEQ ID NO: 1354505 - DNA, 22 bp, Artificial Sequence
  chemically synthesized
aaacttatttttagtttaagat

SEQ ID NO: 1354506 - DNA, 22 bp, Artificial Sequence
  chemically synthesized
taaacttatttttagtttaaga

SEQ ID NO: 1354507 - DNA, 22 bp, Artificial Sequence
  chemically synthesized
tcttctcatcttaaactaaaaa

SEQ ID NO: 1354508 - DNA, 22 bp, Artificial Sequence
  chemically synthesized
tattttaaacttatttttagtt

SEQ ID NO: 1354509 - DNA, 22 bp, Artificial Sequence
  chemically synthesized
ctcatcttaaactaaaaataag

SEQ ID NO: 1354510 - DNA, 22 bp, Artificial Sequence
  chemically synthesized
tcatcttaaactaaaaataagt

SEQ ID NO: 1354511 - DNA, 22 bp, Artificial Sequence
  chemically synthesized
attatattttaaacttattttt

SEQ ID NO: 1354512 - DNA, 22 bp, Artificial Sequence
  chemically synthesized
atcttaaactaaaaataagttt

SEQ ID NO: 1354513 - DNA, 22 bp, Artificial Sequence
  chemically synthesized
aaactaaaaataagtttaaaat

SEQ ID NO: 1354514 - DNA, 22 bp, Artificial Sequence
  chemically synthesized
aactaaaaataagtttaaaata

SEQ ID NO: 1354515 - DNA, 22 bp, Artificial Sequence
  chemically synthesized
tgaaaatattaattatatttta

SEQ ID NO: 1354516 - DNA, 22 bp, Artificial Sequence
  chemically synthesized
aaaataagtttaaaatataatt

SEQ ID NO: 1354517 - DNA, 22 bp, Artificial Sequence
  chemically synthesized
ttgtgaaaatattaattatatt

SEQ ID NO: 1354518 - DNA, 22 bp, Artificial Sequence
  chemically synthesized
attgtgaaaatattaattatat

SEQ ID NO: 1354519 - DNA, 22 bp, Artificial Sequence
  chemically synthesized
tattgtgaaaatattaattata

SEQ ID NO: 1354520 - DNA, 22 bp, Artificial Sequence
  chemically synthesized
aaaatataattaatattttcac

SEQ ID NO: 1354521 - DNA, 22 bp, Artificial Sequence
  chemically synthesized
aaatataattaatattttcaca

SEQ ID NO: 1354522 - DNA, 22 bp, Artificial Sequence
  chemically synthesized
cagtgagcattttattgtgaaa

SEQ ID NO: 1354523 - DNA, 22 bp, Artificial Sequence
  chemically synthesized
tccagtgagcattttattgtga

SEQ ID NO: 1354524 - DNA, 22 bp, Artificial Sequence
  chemically synthesized
ctccagtgagcattttattgtg

SEQ ID NO: 1354525 - DNA, 22 bp, Artificial Sequence
  chemically synthesized
atattttcacaataaaatgctc

SEQ ID NO: 1354526 - DNA, 22 bp, Artificial Sequence
  chemically synthesized
aaagtttctccagtgagcattt

SEQ ID NO: 1354527 - DNA, 22 bp, Artificial Sequence
  chemically synthesized
caaagtttctccagtgagcatt

SEQ ID NO: 1354528 - DNA, 22 bp, Artificial Sequence
  chemically synthesized
tcaaagtttctccagtgagcat

SEQ ID NO: 1354529 - DNA, 22 bp, Artificial Sequence
  chemically synthesized
ttcaaagtttctccagtgagca

SEQ ID NO: 1354530 - DNA, 22 bp, Artificial Sequence
  chemically synthesized
tcacaataaaatgctcactgga

SEQ ID NO: 1354531 - DNA, 22 bp, Artificial Sequence
  chemically synthesized
tttcaaagtttctccagtgagc

SEQ ID NO: 1354532 - DNA, 22 bp, Artificial Sequence
  chemically synthesized
cacaataaaatgctcactggag

SEQ ID NO: 1354533 - DNA, 22 bp, Artificial Sequence
  chemically synthesized
ttttcaaagtttctccagtgag

SEQ ID NO: 1354534 - DNA, 22 bp, Artificial Sequence
  chemically synthesized
acaataaaatgctcactggaga

SEQ ID NO: 1354535 - DNA, 22 bp, Artificial Sequence
  chemically synthesized
tttttttcaaagtttctccagt

SEQ ID NO: 1354536 - DNA, 22 bp, Artificial Sequence
  chemically synthesized
atttttttcaaagtttctccag

SEQ ID NO: 1354537 - DNA, 22 bp, Artificial Sequence
  chemically synthesized
tatttttttcaaagtttctcca

SEQ ID NO: 1354538 - DNA, 22 bp, Artificial Sequence
  chemically synthesized
ttatttttttcaaagtttctcc

SEQ ID NO: 1354539 - DNA, 22 bp, Artificial Sequence
  chemically synthesized
catttttatttttttcaaagtt

SEQ ID NO: 1354540 - DNA, 22 bp, Artificial Sequence
  chemically synthesized
acatttttatttttttcaaagt

SEQ ID NO: 1354541 - DNA, 22 bp, Artificial Sequence
  chemically synthesized
actggagaaactttgaaaaaaa

SEQ ID NO: 1354542 - DNA, 22 bp, Artificial Sequence
  chemically synthesized
tatttacatttttatttttttc

SEQ ID NO: 1354543 - DNA, 22 bp, Artificial Sequence
  chemically synthesized
atatttacatttttattttttt

SEQ ID NO: 1354544 - DNA, 22 bp, Artificial Sequence
  chemically synthesized
gagaaactttgaaaaaaataaa

SEQ ID NO: 1354545 - DNA, 22 bp, Artificial Sequence
  chemically synthesized
ttatatttacatttttattttt

SEQ ID NO: 1354546 - DNA, 22 bp, Artificial Sequence
  chemically synthesized
aatattcttatatttacatttt

SEQ ID NO: 1354547 - DNA, 22 bp, Artificial Sequence
  chemically synthesized
tgaaaaaaataaaaatgtaaat

SEQ ID NO: 1354548 - DNA, 22 bp, Artificial Sequence
  chemically synthesized
caatattcttatatttacattt

SEQ ID NO: 1354549 - DNA, 22 bp, Artificial Sequence
  chemically synthesized
gaaaaaaataaaaatgtaaata

SEQ ID NO: 1354550 - DNA, 22 bp, Artificial Sequence
  chemically synthesized
aaaaaaataaaaatgtaaatat

SEQ ID NO: 1354551 - DNA, 22 bp, Artificial Sequence
  chemically synthesized
cttcaatattcttatatttaca

SEQ ID NO: 1354552 - DNA, 22 bp, Artificial Sequence
  chemically synthesized
gattacttcaatattcttatat

SEQ ID NO: 1354553 - DNA, 22 bp, Artificial Sequence
  chemically synthesized
cacgctggattacttcaatatt

SEQ ID NO: 1354554 - DNA, 22 bp, Artificial Sequence
  chemically synthesized
gggtgaaattacacgctggatt

SEQ ID NO: 1354555 - DNA, 22 bp, Artificial Sequence
  chemically synthesized
aagtaatccagcgtgtaatttc

SEQ ID NO: 1354556 - DNA, 22 bp, Artificial Sequence
  chemically synthesized
gcagtagatgtatctagggtga

SEQ ID NO: 1354557 - DNA, 22 bp, Artificial Sequence
  chemically synthesized
acccatcattagcagtagatgt

SEQ ID NO: 1354558 - DNA, 22 bp, Artificial Sequence
  chemically synthesized
cacccatcattagcagtagatg

SEQ ID NO: 1354559 - DNA, 22 bp, Artificial Sequence
  chemically synthesized
caccctagatacatctactgct

SEQ ID NO: 1354560 - DNA, 22 bp, Artificial Sequence
  chemically synthesized
accctagatacatctactgcta

SEQ ID NO: 1354561 - DNA, 22 bp, Artificial Sequence
  chemically synthesized
gatacatctactgctaatgatg

SEQ ID NO: 1354562 - DNA, 22 bp, Artificial Sequence
  chemically synthesized
ctgctaatgatgggtgaaattt

SEQ ID NO: 1354563 - DNA, 22 bp, Artificial Sequence
  chemically synthesized
ctaatgatgggtgaaattttat

SEQ ID NO: 1354564 - DNA, 22 bp, Artificial Sequence
  chemically synthesized
atgatgggtgaaattttatttt

SEQ ID NO: 1354565 - DNA, 22 bp, Artificial Sequence
  chemically synthesized
tagacaagtcaaatatccaaaa

SEQ ID NO: 1354566 - DNA, 22 bp, Artificial Sequence
  chemically synthesized
gtagacaagtcaaatatccaaa

SEQ ID NO: 1354567 - DNA, 22 bp, Artificial Sequence
  chemically synthesized
acttgtagacaagtcaaatatc

SEQ ID NO: 1354568 - DNA, 22 bp, Artificial Sequence
  chemically synthesized
ttgacttgtagacaagtcaaat

SEQ ID NO: 1354569 - DNA, 22 bp, Artificial Sequence
  chemically synthesized
tattttggatatttgacttgtc

SEQ ID NO: 1354570 - DNA, 22 bp, Artificial Sequence
  chemically synthesized
attttggatatttgacttgtct

SEQ ID NO: 1354571 - DNA, 22 bp, Artificial Sequence
  chemically synthesized
ttttggatatttgacttgtcta

SEQ ID NO: 1354572 - DNA, 22 bp, Artificial Sequence
  chemically synthesized
gaattgttgacttgtagacaag

SEQ ID NO: 1354573 - DNA, 22 bp, Artificial Sequence
  chemically synthesized
tggatatttgacttgtctacaa

SEQ ID NO: 1354574 - DNA, 22 bp, Artificial Sequence
  chemically synthesized
agaattgttgacttgtagacaa

SEQ ID NO: 1354575 - DNA, 22 bp, Artificial Sequence
  chemically synthesized
ggatatttgacttgtctacaag

SEQ ID NO: 1354576 - DNA, 22 bp, Artificial Sequence
  chemically synthesized
tagaattgttgacttgtagaca

SEQ ID NO: 1354577 - DNA, 22 bp, Artificial Sequence
  chemically synthesized
gatatttgacttgtctacaagt

SEQ ID NO: 1354578 - DNA, 22 bp, Artificial Sequence
  chemically synthesized
aatctttagaattgttgacttg

SEQ ID NO: 1354579 - DNA, 22 bp, Artificial Sequence
  chemically synthesized
gacttgtctacaagtcaacaat

SEQ ID NO: 1354580 - DNA, 22 bp, Artificial Sequence
  chemically synthesized
acttgtctacaagtcaacaatt

SEQ ID NO: 1354581 - DNA, 22 bp, Artificial Sequence
  chemically synthesized
gtctacaagtcaacaattctaa

SEQ ID NO: 1354582 - DNA, 22 bp, Artificial Sequence
  chemically synthesized
gaagctaaatctttagaattgt

SEQ ID NO: 1354583 - DNA, 22 bp, Artificial Sequence
  chemically synthesized
tctacaagtcaacaattctaaa

SEQ ID NO: 1354584 - DNA, 22 bp, Artificial Sequence
  chemically synthesized
tggaagctaaatctttagaatt

SEQ ID NO: 1354585 - DNA, 22 bp, Artificial Sequence
  chemically synthesized
caagtcaacaattctaaagatt

SEQ ID NO: 1354586 - DNA, 22 bp, Artificial Sequence
  chemically synthesized
gctctggaagctaaatctttag

SEQ ID NO: 1354587 - DNA, 22 bp, Artificial Sequence
  chemically synthesized
agctctggaagctaaatcttta

SEQ ID NO: 1354588 - DNA, 22 bp, Artificial Sequence
  chemically synthesized
tagctctggaagctaaatcttt

SEQ ID NO: 1354589 - DNA, 22 bp, Artificial Sequence
  chemically synthesized
gaaaactttagctctggaagct

SEQ ID NO: 1354590 - DNA, 22 bp, Artificial Sequence
  chemically synthesized
taaagatttagcttccagagct

SEQ ID NO: 1354591 - DNA, 22 bp, Artificial Sequence
  chemically synthesized
ttagaaaactttagctctggaa

SEQ ID NO: 1354592 - DNA, 22 bp, Artificial Sequence
  chemically synthesized
aagatttagcttccagagctaa

SEQ ID NO: 1354593 - DNA, 22 bp, Artificial Sequence
  chemically synthesized
ttgttagaaaactttagctctg

SEQ ID NO: 1354594 - DNA, 22 bp, Artificial Sequence
  chemically synthesized
agcttccagagctaaagttttc

SEQ ID NO: 1354595 - DNA, 22 bp, Artificial Sequence
  chemically synthesized
gcattattgttagaaaacttta

SEQ ID NO: 1354596 - DNA, 22 bp, Artificial Sequence
  chemically synthesized
gcttccagagctaaagttttct

SEQ ID NO: 1354597 - DNA, 22 bp, Artificial Sequence
  chemically synthesized
attggcattattgttagaaaac

SEQ ID NO: 1354598 - DNA, 22 bp, Artificial Sequence
  chemically synthesized
ccagagctaaagttttctaaca

SEQ ID NO: 1354599 - DNA, 22 bp, Artificial Sequence
  chemically synthesized
aattggcattattgttagaaaa

SEQ ID NO: 1354600 - DNA, 22 bp, Artificial Sequence
  chemically synthesized
cagagctaaagttttctaacaa

SEQ ID NO: 1354601 - DNA, 22 bp, Artificial Sequence
  chemically synthesized
aaacatttaattggcattattg

SEQ ID NO: 1354602 - DNA, 22 bp, Artificial Sequence
  chemically synthesized
aagttttctaacaataatgcca

SEQ ID NO: 1354603 - DNA, 22 bp, Artificial Sequence
  chemically synthesized
aaaacatttaattggcattatt

SEQ ID NO: 1354604 - DNA, 22 bp, Artificial Sequence
  chemically synthesized
taaaacatttaattggcattat

SEQ ID NO: 1354605 - DNA, 22 bp, Artificial Sequence
  chemically synthesized
ttaaaacatttaattggcatta

SEQ ID NO: 1354606 - DNA, 22 bp, Artificial Sequence
  chemically synthesized
tctaacaataatgccaattaaa

SEQ ID NO: 1354607 - DNA, 22 bp, Artificial Sequence
  chemically synthesized
ctaacaataatgccaattaaat

SEQ ID NO: 1354608 - DNA, 22 bp, Artificial Sequence
  chemically synthesized
accttttaaaacatttaattgg

SEQ ID NO: 1354609 - DNA, 22 bp, Artificial Sequence
  chemically synthesized
taacaataatgccaattaaatg

SEQ ID NO: 1354610 - DNA, 22 bp, Artificial Sequence
  chemically synthesized
acaataatgccaattaaatgtt

SEQ ID NO: 1354611 - DNA, 22 bp, Artificial Sequence
  chemically synthesized
taattaaccttttaaaacattt

SEQ ID NO: 1354612 - DNA, 22 bp, Artificial Sequence
  chemically synthesized
ataattaaccttttaaaacatt

SEQ ID NO: 1354613 - DNA, 22 bp, Artificial Sequence
  chemically synthesized
tataattaaccttttaaaacat

SEQ ID NO: 1354614 - DNA, 22 bp, Artificial Sequence
  chemically synthesized
ttataattaaccttttaaaaca

SEQ ID NO: 1354615 - DNA, 22 bp, Artificial Sequence
  chemically synthesized
aatgttttaaaaggttaattat

SEQ ID NO: 1354616 - DNA, 22 bp, Artificial Sequence
  chemically synthesized
atcatcatatcttttataatta

SEQ ID NO: 1354617 - DNA, 22 bp, Artificial Sequence
  chemically synthesized
aatcatcatatcttttataatt

SEQ ID NO: 1354618 - DNA, 22 bp, Artificial Sequence
  chemically synthesized
taaaaggttaattataaaagat

SEQ ID NO: 1354619 - DNA, 22 bp, Artificial Sequence
  chemically synthesized
aaaaggttaattataaaagata

SEQ ID NO: 1354620 - DNA, 22 bp, Artificial Sequence
  chemically synthesized
aaaggttaattataaaagatat

SEQ ID NO: 1354621 - DNA, 22 bp, Artificial Sequence
  chemically synthesized
aatttaatcatcatatctttta

SEQ ID NO: 1354622 - DNA, 22 bp, Artificial Sequence
  chemically synthesized
aaatttaatcatcatatctttt

SEQ ID NO: 1354623 - DNA, 22 bp, Artificial Sequence
  chemically synthesized
taaatttaatcatcatatcttt

SEQ ID NO: 1354624 - DNA, 22 bp, Artificial Sequence
  chemically synthesized
attataaaagatatgatgatta

SEQ ID NO: 1354625 - DNA, 22 bp, Artificial Sequence
  chemically synthesized
taaaagatatgatgattaaatt

SEQ ID NO: 1354626 - DNA, 22 bp, Artificial Sequence
  chemically synthesized
tgaacaggaggtgacaagatat

SEQ ID NO: 1354627 - DNA, 22 bp, Artificial Sequence
  chemically synthesized
aatttaaaatatcttgtcacct

SEQ ID NO: 1354628 - DNA, 22 bp, Artificial Sequence
  chemically synthesized
aaaatatcttgtcacctcctgt

SEQ ID NO: 1354629 - DNA, 22 bp, Artificial Sequence
  chemically synthesized
aaatatcttgtcacctcctgtt

SEQ ID NO: 1354630 - DNA, 22 bp, Artificial Sequence
  chemically synthesized
gtcacctcctgttcacaacatt

SEQ ID NO: 1354631 - DNA, 22 bp, Artificial Sequence
  chemically synthesized
tcacctcctgttcacaacattt

SEQ ID NO: 1354632 - DNA, 22 bp, Artificial Sequence
  chemically synthesized
ctgttcacaacattttgctttt

SEQ ID NO: 1354633 - DNA, 22 bp, Artificial Sequence
  chemically synthesized
ttcacaacattttgcttttcat

SEQ ID NO: 1354634 - DNA, 22 bp, Artificial Sequence
  chemically synthesized
agatatatggaaatgaaaagca

SEQ ID NO: 1354635 - DNA, 22 bp, Artificial Sequence
  chemically synthesized
aagatatatggaaatgaaaagc

SEQ ID NO: 1354636 - DNA, 22 bp, Artificial Sequence
  chemically synthesized
acaacattttgcttttcatttc

SEQ ID NO: 1354637 - DNA, 22 bp, Artificial Sequence
  chemically synthesized
tgcttttcatttccatatatct

SEQ ID NO: 1354638 - DNA, 22 bp, Artificial Sequence
  chemically synthesized
gcttttcatttccatatatctt

SEQ ID NO: 1354639 - DNA, 22 bp, Artificial Sequence
  chemically synthesized
agatgtatacttaagatatatg

SEQ ID NO: 1354640 - DNA, 22 bp, Artificial Sequence
  chemically synthesized
cttttcatttccatatatctta

SEQ ID NO: 1354641 - DNA, 22 bp, Artificial Sequence
  chemically synthesized
cagatgtatacttaagatatat

SEQ ID NO: 1354642 - DNA, 22 bp, Artificial Sequence
  chemically synthesized
tcagatgtatacttaagatata

SEQ ID NO: 1354643 - DNA, 22 bp, Artificial Sequence
  chemically synthesized
ttcatttccatatatcttaagt

SEQ ID NO: 1354644 - DNA, 22 bp, Artificial Sequence
  chemically synthesized
tcatttccatatatcttaagta

SEQ ID NO: 1354645 - DNA, 22 bp, Artificial Sequence
  chemically synthesized
catttccatatatcttaagtat

SEQ ID NO: 1354646 - DNA, 22 bp, Artificial Sequence
  chemically synthesized
atttccatatatcttaagtata

SEQ ID NO: 1354647 - DNA, 22 bp, Artificial Sequence
  chemically synthesized
ccatatatcttaagtatacatc

SEQ ID NO: 1354648 - DNA, 22 bp, Artificial Sequence
  chemically synthesized
acatagctttcagatgtatact

SEQ ID NO: 1354649 - DNA, 22 bp, Artificial Sequence
  chemically synthesized
catatatcttaagtatacatct

SEQ ID NO: 1354650 - DNA, 22 bp, Artificial Sequence
  chemically synthesized
caacgctcacatagctttcaga

SEQ ID NO: 1354651 - DNA, 22 bp, Artificial Sequence
  chemically synthesized
acaacgctcacatagctttcag

SEQ ID NO: 1354652 - DNA, 22 bp, Artificial Sequence
  chemically synthesized
aagtatacatctgaaagctatg

SEQ ID NO: 1354653 - DNA, 22 bp, Artificial Sequence
  chemically synthesized
agtatacatctgaaagctatgt

SEQ ID NO: 1354654 - DNA, 22 bp, Artificial Sequence
  chemically synthesized
acaatttacaacgctcacatag

SEQ ID NO: 1354655 - DNA, 22 bp, Artificial Sequence
  chemically synthesized
gacaatttacaacgctcacata

SEQ ID NO: 1354656 - DNA, 22 bp, Artificial Sequence
  chemically synthesized
aacttgacaatttacaacgctc

SEQ ID NO: 1354657 - DNA, 22 bp, Artificial Sequence
  chemically synthesized
aaagctatgtgagcgttgtaaa

SEQ ID NO: 1354658 - DNA, 22 bp, Artificial Sequence
  chemically synthesized
agttcaacttgacaatttacaa

SEQ ID NO: 1354659 - DNA, 22 bp, Artificial Sequence
  chemically synthesized
ttaagttcaacttgacaattta

SEQ ID NO: 1354660 - DNA, 22 bp, Artificial Sequence
  chemically synthesized
tgtgagcgttgtaaattgtcaa

SEQ ID NO: 1354661 - DNA, 22 bp, Artificial Sequence
  chemically synthesized
gttaagttcaacttgacaattt

SEQ ID NO: 1354662 - DNA, 22 bp, Artificial Sequence
  chemically synthesized
tgttaagttcaacttgacaatt

SEQ ID NO: 1354663 - DNA, 22 bp, Artificial Sequence
  chemically synthesized
tactttgttaagttcaacttga

SEQ ID NO: 1354664 - DNA, 22 bp, Artificial Sequence
  chemically synthesized
taaattgtcaagttgaacttaa

SEQ ID NO: 1354665 - DNA, 22 bp, Artificial Sequence
  chemically synthesized
tcaagttgaacttaacaaagta

SEQ ID NO: 1354666 - DNA, 22 bp, Artificial Sequence
  chemically synthesized
cccaacataaactatactttgt

SEQ ID NO: 1354667 - DNA, 22 bp, Artificial Sequence
  chemically synthesized
ccccaacataaactatactttg

SEQ ID NO: 1354668 - DNA, 22 bp, Artificial Sequence
  chemically synthesized
tccccaacataaactatacttt

SEQ ID NO: 1354669 - DNA, 22 bp, Artificial Sequence
  chemically synthesized
aacttaacaaagtatagtttat

SEQ ID NO: 1354670 - DNA, 22 bp, Artificial Sequence
  chemically synthesized
atgagttttccccaacataaac

SEQ ID NO: 1354671 - DNA, 22 bp, Artificial Sequence
  chemically synthesized
aacaaagtatagtttatgttgg

SEQ ID NO: 1354672 - DNA, 22 bp, Artificial Sequence
  chemically synthesized
aatgagttttccccaacataaa

SEQ ID NO: 1354673 - DNA, 22 bp, Artificial Sequence
  chemically synthesized
acaaagtatagtttatgttggg

SEQ ID NO: 1354674 - DNA, 22 bp, Artificial Sequence
  chemically synthesized
taatgagttttccccaacataa

SEQ ID NO: 1354675 - DNA, 22 bp, Artificial Sequence
  chemically synthesized
atgttggggaaaactcattaaa

SEQ ID NO: 1354676 - DNA, 22 bp, Artificial Sequence
  chemically synthesized
tgttggggaaaactcattaaaa

SEQ ID NO: 1354677 - DNA, 22 bp, Artificial Sequence
  chemically synthesized
agaaatggatcccattttaatg

SEQ ID NO: 1354678 - DNA, 22 bp, Artificial Sequence
  chemically synthesized
gggaaaactcattaaaatggga

SEQ ID NO: 1354679 - DNA, 22 bp, Artificial Sequence
  chemically synthesized
gaaattaagaaatggatcccat

SEQ ID NO: 1354680 - DNA, 22 bp, Artificial Sequence
  chemically synthesized
ggaaattaagaaatggatccca

SEQ ID NO: 1354681 - DNA, 22 bp, Artificial Sequence
  chemically synthesized
tggaaattaagaaatggatccc

SEQ ID NO: 1354682 - DNA, 22 bp, Artificial Sequence
  chemically synthesized
ttggaaattaagaaatggatcc

SEQ ID NO: 1354683 - DNA, 22 bp, Artificial Sequence
  chemically synthesized
ttttggaaattaagaaatggat

SEQ ID NO: 1354684 - DNA, 22 bp, Artificial Sequence
  chemically synthesized
attaaaatgggatccatttctt

SEQ ID NO: 1354685 - DNA, 22 bp, Artificial Sequence
  chemically synthesized
aaatgggatccatttcttaatt

SEQ ID NO: 1354686 - DNA, 22 bp, Artificial Sequence
  chemically synthesized
atatagatgattcttttggaaa

SEQ ID NO: 1354687 - DNA, 22 bp, Artificial Sequence
  chemically synthesized
aattcatatagatgattctttt

SEQ ID NO: 1354688 - DNA, 22 bp, Artificial Sequence
  chemically synthesized
cttaatttccaaaagaatcatc

SEQ ID NO: 1354689 - DNA, 22 bp, Artificial Sequence
  chemically synthesized
ttaatttccaaaagaatcatct

SEQ ID NO: 1354690 - DNA, 22 bp, Artificial Sequence
  chemically synthesized
aatttccaaaagaatcatctat

SEQ ID NO: 1354691 - DNA, 22 bp, Artificial Sequence
  chemically synthesized
atttccaaaagaatcatctata

SEQ ID NO: 1354692 - DNA, 22 bp, Artificial Sequence
  chemically synthesized
ccaaaagaatcatctatatgaa

SEQ ID NO: 1354693 - DNA, 22 bp, Artificial Sequence
  chemically synthesized
caaaagaatcatctatatgaat

SEQ ID NO: 1354694 - DNA, 22 bp, Artificial Sequence
  chemically synthesized
aatcaatgttcaattcatatag

SEQ ID NO: 1354695 - DNA, 22 bp, Artificial Sequence
  chemically synthesized
aatgatattaaatcaatgttca

SEQ ID NO: 1354696 - DNA, 22 bp, Artificial Sequence
  chemically synthesized
tatgaattgaacattgatttaa

SEQ ID NO: 1354697 - DNA, 22 bp, Artificial Sequence
  chemically synthesized
aatattcaatgatattaaatca

SEQ ID NO: 1354698 - DNA, 22 bp, Artificial Sequence
  chemically synthesized
aacattgatttaatatcattga

SEQ ID NO: 1354699 - DNA, 22 bp, Artificial Sequence
  chemically synthesized
atttaatatcattgaatattca

SEQ ID NO: 1354700 - DNA, 22 bp, Artificial Sequence
  chemically synthesized
aatatcattgaatattcaatac

SEQ ID NO: 1354701 - DNA, 22 bp, Artificial Sequence
  chemically synthesized
atgtgtatatgggtattgaata

SEQ ID NO: 1354702 - DNA, 22 bp, Artificial Sequence
  chemically synthesized
atatcattgaatattcaatacc

SEQ ID NO: 1354703 - DNA, 22 bp, Artificial Sequence
  chemically synthesized
taatgtgtatatgggtattgaa

SEQ ID NO: 1354704 - DNA, 22 bp, Artificial Sequence
  chemically synthesized
aatattcaatacccatatacac

SEQ ID NO: 1354705 - DNA, 22 bp, Artificial Sequence
  chemically synthesized
aatacccatatacacattagaa

SEQ ID NO: 1354706 - DNA, 22 bp, Artificial Sequence
  chemically synthesized
taagcaatgtaaatcataaaaa

SEQ ID NO: 1354707 - DNA, 22 bp, Artificial Sequence
  chemically synthesized
tgctgtaagcaatgtaaatcat

SEQ ID NO: 1354708 - DNA, 22 bp, Artificial Sequence
  chemically synthesized
gaatgtttttatgatttacatt

SEQ ID NO: 1354709 - DNA, 22 bp, Artificial Sequence
  chemically synthesized
tgtgctgtaagcaatgtaaatc

SEQ ID NO: 1354710 - DNA, 22 bp, Artificial Sequence
  chemically synthesized
ttatgatttacattgcttacag

SEQ ID NO: 1354711 - DNA, 22 bp, Artificial Sequence
  chemically synthesized
tatgatttacattgcttacagc

SEQ ID NO: 1354712 - DNA, 22 bp, Artificial Sequence
  chemically synthesized
atgatttacattgcttacagca

SEQ ID NO: 1354713 - DNA, 22 bp, Artificial Sequence
  chemically synthesized
gtgaatattctgtgctgtaagc

SEQ ID NO: 1354714 - DNA, 22 bp, Artificial Sequence
  chemically synthesized
tgatttacattgcttacagcac

SEQ ID NO: 1354715 - DNA, 22 bp, Artificial Sequence
  chemically synthesized
acattgcttacagcacagaata

SEQ ID NO: 1354716 - DNA, 22 bp, Artificial Sequence
  chemically synthesized
cattgcttacagcacagaatat

SEQ ID NO: 1354717 - DNA, 22 bp, Artificial Sequence
  chemically synthesized
gcaataatattggtgaatattc

SEQ ID NO: 1354718 - DNA, 22 bp, Artificial Sequence
  chemically synthesized
cttacagcacagaatattcacc

SEQ ID NO: 1354719 - DNA, 22 bp, Artificial Sequence
  chemically synthesized
agcaataatattggtgaatatt

SEQ ID NO: 1354720 - DNA, 22 bp, Artificial Sequence
  chemically synthesized
ttagcaataatattggtgaata

SEQ ID NO: 1354721 - DNA, 22 bp, Artificial Sequence
  chemically synthesized
acagcacagaatattcaccaat

SEQ ID NO: 1354722 - DNA, 22 bp, Artificial Sequence
  chemically synthesized
cagcacagaatattcaccaata

SEQ ID NO: 1354723 - DNA, 22 bp, Artificial Sequence
  chemically synthesized
ctcttagcaataatattggtga

SEQ ID NO: 1354724 - DNA, 22 bp, Artificial Sequence
  chemically synthesized
tactcttagcaataatattggt

SEQ ID NO: 1354725 - DNA, 22 bp, Artificial Sequence
  chemically synthesized
agtcatatctctactcttagca

SEQ ID NO: 1354726 - DNA, 22 bp, Artificial Sequence
  chemically synthesized
accaatattattgctaagagta

SEQ ID NO: 1354727 - DNA, 22 bp, Artificial Sequence
  chemically synthesized
gagtcatatctctactcttagc

SEQ ID NO: 1354728 - DNA, 22 bp, Artificial Sequence
  chemically synthesized
tgagtcatatctctactcttag

SEQ ID NO: 1354729 - DNA, 22 bp, Artificial Sequence
  chemically synthesized
ttgagtcatatctctactctta

SEQ ID NO: 1354730 - DNA, 22 bp, Artificial Sequence
  chemically synthesized
atacttttgagtcatatctcta

SEQ ID NO: 1354731 - DNA, 22 bp, Artificial Sequence
  chemically synthesized
ttgctaagagtagagatatgac

SEQ ID NO: 1354732 - DNA, 22 bp, Artificial Sequence
  chemically synthesized
ctaagagtagagatatgactca

SEQ ID NO: 1354733 - DNA, 22 bp, Artificial Sequence
  chemically synthesized
aatattgatacttttgagtcat

SEQ ID NO: 1354734 - DNA, 22 bp, Artificial Sequence
  chemically synthesized
agagtagagatatgactcaaaa

SEQ ID NO: 1354735 - DNA, 22 bp, Artificial Sequence
  chemically synthesized
gattaaatattgatacttttga

SEQ ID NO: 1354736 - DNA, 22 bp, Artificial Sequence
  chemically synthesized
ctggattaaatattgatacttt

SEQ ID NO: 1354737 - DNA, 22 bp, Artificial Sequence
  chemically synthesized
actggattaaatattgatactt

SEQ ID NO: 1354738 - DNA, 22 bp, Artificial Sequence
  chemically synthesized
atacttactggattaaatattg

SEQ ID NO: 1354739 - DNA, 22 bp, Artificial Sequence
  chemically synthesized
catacttactggattaaatatt

SEQ ID NO: 1354740 - DNA, 22 bp, Artificial Sequence
  chemically synthesized
aaaagtatcaatatttaatcca

SEQ ID NO: 1354741 - DNA, 22 bp, Artificial Sequence
  chemically synthesized
acatagagcttcatacttactg

SEQ ID NO: 1354742 - DNA, 22 bp, Artificial Sequence
  chemically synthesized
caattaacatagagcttcatac

SEQ ID NO: 1354743 - DNA, 22 bp, Artificial Sequence
  chemically synthesized
aatccagtaagtatgaagctct

SEQ ID NO: 1354744 - DNA, 22 bp, Artificial Sequence
  chemically synthesized
atccagtaagtatgaagctcta

SEQ ID NO: 1354745 - DNA, 22 bp, Artificial Sequence
  chemically synthesized
tgaatagtgattgcaattaaca

SEQ ID NO: 1354746 - DNA, 22 bp, Artificial Sequence
  chemically synthesized
atgaatagtgattgcaattaac

SEQ ID NO: 1354747 - DNA, 22 bp, Artificial Sequence
  chemically synthesized
tttatgaatagtgattgcaatt

SEQ ID NO: 1354748 - DNA, 22 bp, Artificial Sequence
  chemically synthesized
tatgttaattgcaatcactatt

SEQ ID NO: 1354749 - DNA, 22 bp, Artificial Sequence
  chemically synthesized
tgttaattgcaatcactattca

SEQ ID NO: 1354750 - DNA, 22 bp, Artificial Sequence
  chemically synthesized
ggcaaattgtttatgaatagtg

SEQ ID NO: 1354751 - DNA, 22 bp, Artificial Sequence
  chemically synthesized
attgcaatcactattcataaac

SEQ ID NO: 1354752 - DNA, 22 bp, Artificial Sequence
  chemically synthesized
caatcactattcataaacaatt

SEQ ID NO: 1354753 - DNA, 22 bp, Artificial Sequence
  chemically synthesized
ggcaatgttgggcaaattgttt

SEQ ID NO: 1354754 - DNA, 22 bp, Artificial Sequence
  chemically synthesized
aggcaatgttgggcaaattgtt

SEQ ID NO: 1354755 - DNA, 22 bp, Artificial Sequence
  chemically synthesized
ttcataaacaatttgcccaaca

SEQ ID NO: 1354756 - DNA, 22 bp, Artificial Sequence
  chemically synthesized
ataaacaatttgcccaacattg

SEQ ID NO: 1354757 - DNA, 22 bp, Artificial Sequence
  chemically synthesized
aatggcaagaaatgtttaggca

SEQ ID NO: 1354758 - DNA, 22 bp, Artificial Sequence
  chemically synthesized
gaatggcaagaaatgtttaggc

SEQ ID NO: 1354759 - DNA, 22 bp, Artificial Sequence
  chemically synthesized
gcccaacattgcctaaacattt

SEQ ID NO: 1354760 - DNA, 22 bp, Artificial Sequence
  chemically synthesized
cccaacattgcctaaacatttc

SEQ ID NO: 1354761 - DNA, 22 bp, Artificial Sequence
  chemically synthesized
cctaaacatttcttgccattca

SEQ ID NO: 1354762 - DNA, 22 bp, Artificial Sequence
  chemically synthesized
aacatttcttgccattcaaggg

SEQ ID NO: 1354763 - DNA, 22 bp, Artificial Sequence
  chemically synthesized
cttgccattcaagggtttattt

SEQ ID NO: 1354764 - DNA, 22 bp, Artificial Sequence
  chemically synthesized
acagaaggcaaaaaataaaccc

SEQ ID NO: 1354765 - DNA, 22 bp, Artificial Sequence
  chemically synthesized
ttgccattcaagggtttatttt

SEQ ID NO: 1354766 - DNA, 22 bp, Artificial Sequence
  chemically synthesized
gccattcaagggtttatttttt

SEQ ID NO: 1354767 - DNA, 22 bp, Artificial Sequence
  chemically synthesized
ccattcaagggtttattttttg

SEQ ID NO: 1354768 - DNA, 22 bp, Artificial Sequence
  chemically synthesized
attcacagaaggcaaaaaataa

SEQ ID NO: 1354769 - DNA, 22 bp, Artificial Sequence
  chemically synthesized
taattcacagaaggcaaaaaat

SEQ ID NO: 1354770 - DNA, 22 bp, Artificial Sequence
  chemically synthesized
aagggtttattttttgccttct

SEQ ID NO: 1354771 - DNA, 22 bp, Artificial Sequence
  chemically synthesized
tcatactctaattcacagaagg

SEQ ID NO: 1354772 - DNA, 22 bp, Artificial Sequence
  chemically synthesized
ctatcatactctaattcacaga

SEQ ID NO: 1354773 - DNA, 22 bp, Artificial Sequence
  chemically synthesized
attttttgccttctgtgaatta

SEQ ID NO: 1354774 - DNA, 22 bp, Artificial Sequence
  chemically synthesized
actatcatactctaattcacag

SEQ ID NO: 1354775 - DNA, 22 bp, Artificial Sequence
  chemically synthesized
ttttttgccttctgtgaattag

SEQ ID NO: 1354776 - DNA, 22 bp, Artificial Sequence
  chemically synthesized
tttgccttctgtgaattagagt

SEQ ID NO: 1354777 - DNA, 22 bp, Artificial Sequence
  chemically synthesized
ttgccttctgtgaattagagta

SEQ ID NO: 1354778 - DNA, 22 bp, Artificial Sequence
  chemically synthesized
tgccttctgtgaattagagtat

SEQ ID NO: 1354779 - DNA, 22 bp, Artificial Sequence
  chemically synthesized
ccatttactatcatactctaat

SEQ ID NO: 1354780 - DNA, 22 bp, Artificial Sequence
  chemically synthesized
gccttctgtgaattagagtatg

SEQ ID NO: 1354781 - DNA, 22 bp, Artificial Sequence
  chemically synthesized
ccttctgtgaattagagtatga

SEQ ID NO: 1354782 - DNA, 22 bp, Artificial Sequence
  chemically synthesized
ttaccatttactatcatactct

SEQ ID NO: 1354783 - DNA, 22 bp, Artificial Sequence
  chemically synthesized
attaccatttactatcatactc

SEQ ID NO: 1354784 - DNA, 22 bp, Artificial Sequence
  chemically synthesized
ctgtgaattagagtatgatagt

SEQ ID NO: 1354785 - DNA, 22 bp, Artificial Sequence
  chemically synthesized
tgtgaattagagtatgatagta

SEQ ID NO: 1354786 - DNA, 22 bp, Artificial Sequence
  chemically synthesized
tgaattagagtatgatagtaaa

SEQ ID NO: 1354787 - DNA, 22 bp, Artificial Sequence
  chemically synthesized
agatcatttattaccatttact

SEQ ID NO: 1354788 - DNA, 22 bp, Artificial Sequence
  chemically synthesized
aagatcatttattaccatttac

SEQ ID NO: 1354789 - DNA, 22 bp, Artificial Sequence
  chemically synthesized
gagtatgatagtaaatggtaat

SEQ ID NO: 1354790 - DNA, 22 bp, Artificial Sequence
  chemically synthesized
tcacttaagatcatttattacc

SEQ ID NO: 1354791 - DNA, 22 bp, Artificial Sequence
  chemically synthesized
ctatcacttaagatcatttatt

SEQ ID NO: 1354792 - DNA, 22 bp, Artificial Sequence
  chemically synthesized
actatcacttaagatcatttat

SEQ ID NO: 1354793 - DNA, 22 bp, Artificial Sequence
  chemically synthesized
tttactatcacttaagatcatt

SEQ ID NO: 1354794 - DNA, 22 bp, Artificial Sequence
  chemically synthesized
atttactatcacttaagatcat

SEQ ID NO: 1354795 - DNA, 22 bp, Artificial Sequence
  chemically synthesized
cttatttactatcacttaagat

SEQ ID NO: 1354796 - DNA, 22 bp, Artificial Sequence
  chemically synthesized
tagaaattacttatttactatc

SEQ ID NO: 1354797 - DNA, 22 bp, Artificial Sequence
  chemically synthesized
ttatagaaattacttatttact

SEQ ID NO: 1354798 - DNA, 22 bp, Artificial Sequence
  chemically synthesized
tgttatagaaattacttattta

SEQ ID NO: 1354799 - DNA, 22 bp, Artificial Sequence
  chemically synthesized
aagtgatagtaaataagtaatt

SEQ ID NO: 1354800 - DNA, 22 bp, Artificial Sequence
  chemically synthesized
ttctgttatagaaattacttat

SEQ ID NO: 1354801 - DNA, 22 bp, Artificial Sequence
  chemically synthesized
agtgatagtaaataagtaattt

SEQ ID NO: 1354802 - DNA, 22 bp, Artificial Sequence
  chemically synthesized
gaacaaaagttattctgttata

SEQ ID NO: 1354803 - DNA, 22 bp, Artificial Sequence
  chemically synthesized
tagaacaaaagttattctgtta

SEQ ID NO: 1354804 - DNA, 22 bp, Artificial Sequence
  chemically synthesized
ctataacagaataacttttgtt

SEQ ID NO: 1354805 - DNA, 22 bp, Artificial Sequence
  chemically synthesized
tataacagaataacttttgttc

SEQ ID NO: 1354806 - DNA, 22 bp, Artificial Sequence
  chemically synthesized
cacatatctctagaacaaaagt

SEQ ID NO: 1354807 - DNA, 22 bp, Artificial Sequence
  chemically synthesized
gcacatatctctagaacaaaag

SEQ ID NO: 1354808 - DNA, 22 bp, Artificial Sequence
  chemically synthesized
taacagaataacttttgttcta

SEQ ID NO: 1354809 - DNA, 22 bp, Artificial Sequence
  chemically synthesized
tgccttgcacatatctctagaa

SEQ ID NO: 1354810 - DNA, 22 bp, Artificial Sequence
  chemically synthesized
ttgttctagagatatgtgcaag

SEQ ID NO: 1354811 - DNA, 22 bp, Artificial Sequence
  chemically synthesized
tgttctagagatatgtgcaagg

SEQ ID NO: 1354812 - DNA, 22 bp, Artificial Sequence
  chemically synthesized
gttctagagatatgtgcaaggc

SEQ ID NO: 1354813 - DNA, 22 bp, Artificial Sequence
  chemically synthesized
ttctagagatatgtgcaaggca

SEQ ID NO: 1354814 - DNA, 22 bp, Artificial Sequence
  chemically synthesized
tagagatatgtgcaaggcacaa

SEQ ID NO: 1354815 - DNA, 22 bp, Artificial Sequence
  chemically synthesized
agtgtagtgatattgtgccttg

SEQ ID NO: 1354816 - DNA, 22 bp, Artificial Sequence
  chemically synthesized
gagatatgtgcaaggcacaata

SEQ ID NO: 1354817 - DNA, 22 bp, Artificial Sequence
  chemically synthesized
gatacagttgagtgtagtgata

SEQ ID NO: 1354818 - DNA, 22 bp, Artificial Sequence
  chemically synthesized
ggatacagttgagtgtagtgat

SEQ ID NO: 1354819 - DNA, 22 bp, Artificial Sequence
  chemically synthesized
tggatacagttgagtgtagtga

SEQ ID NO: 1354820 - DNA, 22 bp, Artificial Sequence
  chemically synthesized
ctttggatacagttgagtgtag

SEQ ID NO: 1354821 - DNA, 22 bp, Artificial Sequence
  chemically synthesized
tggcctgctttggatacagttg

SEQ ID NO: 1354822 - DNA, 22 bp, Artificial Sequence
  chemically synthesized
cactcaactgtatccaaagcag

SEQ ID NO: 1354823 - DNA, 22 bp, Artificial Sequence
  chemically synthesized
aggatctgtggcctgctttgga

SEQ ID NO: 1354824 - DNA, 22 bp, Artificial Sequence
  chemically synthesized
aaggatctgtggcctgctttgg

SEQ ID NO: 1354825 - DNA, 22 bp, Artificial Sequence
  chemically synthesized
taaggatctgtggcctgctttg

SEQ ID NO: 1354826 - DNA, 22 bp, Artificial Sequence
  chemically synthesized
tttaaggatctgtggcctgctt

SEQ ID NO: 1354827 - DNA, 22 bp, Artificial Sequence
  chemically synthesized
aactgtatccaaagcaggccac

SEQ ID NO: 1354828 - DNA, 22 bp, Artificial Sequence
  chemically synthesized
tctttaaggatctgtggcctgc

SEQ ID NO: 1354829 - DNA, 22 bp, Artificial Sequence
  chemically synthesized
ctctttaaggatctgtggcctg

SEQ ID NO: 1354830 - DNA, 22 bp, Artificial Sequence
  chemically synthesized
tctctttaaggatctgtggcct

SEQ ID NO: 1354831 - DNA, 22 bp, Artificial Sequence
  chemically synthesized
tatccaaagcaggccacagatc

SEQ ID NO: 1354832 - DNA, 22 bp, Artificial Sequence
  chemically synthesized
agttttctctttaaggatctgt

SEQ ID NO: 1354833 - DNA, 22 bp, Artificial Sequence
  chemically synthesized
ctaagttttctctttaaggatc

SEQ ID NO: 1354834 - DNA, 22 bp, Artificial Sequence
  chemically synthesized
ccacagtaaattcctaagtttt

SEQ ID NO: 1354835 - DNA, 22 bp, Artificial Sequence
  chemically synthesized
ttgccacagtaaattcctaagt

SEQ ID NO: 1354836 - DNA, 22 bp, Artificial Sequence
  chemically synthesized
aaagagaaaacttaggaattta

SEQ ID NO: 1354837 - DNA, 22 bp, Artificial Sequence
  chemically synthesized
ctgttgccacagtaaattccta

SEQ ID NO: 1354838 - DNA, 22 bp, Artificial Sequence
  chemically synthesized
aagagaaaacttaggaatttac

SEQ ID NO: 1354839 - DNA, 22 bp, Artificial Sequence
  chemically synthesized
tcctgttgccacagtaaattcc

SEQ ID NO: 1354840 - DNA, 22 bp, Artificial Sequence
  chemically synthesized
ctctcctgttgccacagtaaat

SEQ ID NO: 1354841 - DNA, 22 bp, Artificial Sequence
  chemically synthesized
cctctcctgttgccacagtaaa

SEQ ID NO: 1354842 - DNA, 22 bp, Artificial Sequence
  chemically synthesized
tcctctcctgttgccacagtaa

SEQ ID NO: 1354843 - DNA, 22 bp, Artificial Sequence
  chemically synthesized
ttcctctcctgttgccacagta

SEQ ID NO: 1354844 - DNA, 22 bp, Artificial Sequence
  chemically synthesized
tttcctctcctgttgccacagt

SEQ ID NO: 1354845 - DNA, 22 bp, Artificial Sequence
  chemically synthesized
ttttcctctcctgttgccacag

SEQ ID NO: 1354846 - DNA, 22 bp, Artificial Sequence
  chemically synthesized
aggaatttactgtggcaacagg

SEQ ID NO: 1354847 - DNA, 22 bp, Artificial Sequence
  chemically synthesized
cttttttcctctcctgttgcca

SEQ ID NO: 1354848 - DNA, 22 bp, Artificial Sequence
  chemically synthesized
ggaatttactgtggcaacagga

SEQ ID NO: 1354849 - DNA, 22 bp, Artificial Sequence
  chemically synthesized
gcttttttcctctcctgttgcc

SEQ ID NO: 1354850 - DNA, 22 bp, Artificial Sequence
  chemically synthesized
tttgcttttttcctctcctgtt

SEQ ID NO: 1354851 - DNA, 22 bp, Artificial Sequence
  chemically synthesized
atttgcttttttcctctcctgt

SEQ ID NO: 1354852 - DNA, 22 bp, Artificial Sequence
  chemically synthesized
tatttgcttttttcctctcctg

SEQ ID NO: 1354853 - DNA, 22 bp, Artificial Sequence
  chemically synthesized
ttatttgcttttttcctctcct

SEQ ID NO: 1354854 - DNA, 22 bp, Artificial Sequence
  chemically synthesized
actgtggcaacaggagaggaaa

SEQ ID NO: 1354855 - DNA, 22 bp, Artificial Sequence
  chemically synthesized
tttatttgcttttttcctctcc

SEQ ID NO: 1354856 - DNA, 22 bp, Artificial Sequence
  chemically synthesized
ctgtggcaacaggagaggaaaa

SEQ ID NO: 1354857 - DNA, 22 bp, Artificial Sequence
  chemically synthesized
ctttttatttgcttttttcctc

SEQ ID NO: 1354858 - DNA, 22 bp, Artificial Sequence
  chemically synthesized
tggcaacaggagaggaaaaaag

SEQ ID NO: 1354859 - DNA, 22 bp, Artificial Sequence
  chemically synthesized
cctttttatttgcttttttcct

SEQ ID NO: 1354860 - DNA, 22 bp, Artificial Sequence
  chemically synthesized
tacatttcctttttatttgctt

SEQ ID NO: 1354861 - DNA, 22 bp, Artificial Sequence
  chemically synthesized
gtacatttcctttttatttgct

SEQ ID NO: 1354862 - DNA, 22 bp, Artificial Sequence
  chemically synthesized
catttgtacatttcctttttat

SEQ ID NO: 1354863 - DNA, 22 bp, Artificial Sequence
  chemically synthesized
atacctacatttgtacatttcc

SEQ ID NO: 1354864 - DNA, 22 bp, Artificial Sequence
  chemically synthesized
ctcatacctacatttgtacatt

SEQ ID NO: 1354865 - DNA, 22 bp, Artificial Sequence
  chemically synthesized
gaaaaggacatcctcctcatac

SEQ ID NO: 1354866 - DNA, 22 bp, Artificial Sequence
  chemically synthesized
agaaaaggacatcctcctcata

SEQ ID NO: 1354867 - DNA, 22 bp, Artificial Sequence
  chemically synthesized
tagaaaaggacatcctcctcat

SEQ ID NO: 1354868 - DNA, 22 bp, Artificial Sequence
  chemically synthesized
ttagaaaaggacatcctcctca

SEQ ID NO: 1354869 - DNA, 22 bp, Artificial Sequence
  chemically synthesized
tttagaaaaggacatcctcctc

SEQ ID NO: 1354870 - DNA, 22 bp, Artificial Sequence
  chemically synthesized
ttttagaaaaggacatcctcct

SEQ ID NO: 1354871 - DNA, 22 bp, Artificial Sequence
  chemically synthesized
tttttagaaaaggacatcctcc

SEQ ID NO: 1354872 - DNA, 22 bp, Artificial Sequence
  chemically synthesized
ttttttttagaaaaggacatcc

SEQ ID NO: 1354873 - DNA, 22 bp, Artificial Sequence
  chemically synthesized
attttttttagaaaaggacatc

SEQ ID NO: 1354874 - DNA, 22 bp, Artificial Sequence
  chemically synthesized
ccttattttttttagaaaagga

SEQ ID NO: 1354875 - DNA, 22 bp, Artificial Sequence
  chemically synthesized
aactaccttattttttttagaa

SEQ ID NO: 1354876 - DNA, 22 bp, Artificial Sequence
  chemically synthesized
tgctaaactaccttattttttt

SEQ ID NO: 1354877 - DNA, 22 bp, Artificial Sequence
  chemically synthesized
caactatgctaaactaccttat

SEQ ID NO: 1354878 - DNA, 22 bp, Artificial Sequence
  chemically synthesized
ttctaaaaaaaataaggtagtt

SEQ ID NO: 1354879 - DNA, 22 bp, Artificial Sequence
  chemically synthesized
tctaaaaaaaataaggtagttt

SEQ ID NO: 1354880 - DNA, 22 bp, Artificial Sequence
  chemically synthesized
ctaaaaaaaataaggtagttta

SEQ ID NO: 1354881 - DNA, 22 bp, Artificial Sequence
  chemically synthesized
taaaaaaaataaggtagtttag

SEQ ID NO: 1354882 - DNA, 22 bp, Artificial Sequence
  chemically synthesized
aaaaaaataaggtagtttagca

SEQ ID NO: 1354883 - DNA, 22 bp, Artificial Sequence
  chemically synthesized
atataccacacattgcaactat

SEQ ID NO: 1354884 - DNA, 22 bp, Artificial Sequence
  chemically synthesized
ccccactcatataccacacatt

SEQ ID NO: 1354885 - DNA, 22 bp, Artificial Sequence
  chemically synthesized
agcatagttgcaatgtgtggta

SEQ ID NO: 1354886 - DNA, 22 bp, Artificial Sequence
  chemically synthesized
gccccactcatataccacacat

SEQ ID NO: 1354887 - DNA, 22 bp, Artificial Sequence
  chemically synthesized
gcatagttgcaatgtgtggtat

SEQ ID NO: 1354888 - DNA, 22 bp, Artificial Sequence
  chemically synthesized
tgccccactcatataccacaca

SEQ ID NO: 1354889 - DNA, 22 bp, Artificial Sequence
  chemically synthesized
ttgccccactcatataccacac

SEQ ID NO: 1354890 - DNA, 22 bp, Artificial Sequence
  chemically synthesized
tttgccccactcatataccaca

SEQ ID NO: 1354891 - DNA, 22 bp, Artificial Sequence
  chemically synthesized
attttttgccccactcatatac

SEQ ID NO: 1354892 - DNA, 22 bp, Artificial Sequence
  chemically synthesized
caatgtgtggtatatgagtggg

SEQ ID NO: 1354893 - DNA, 22 bp, Artificial Sequence
  chemically synthesized
cctcattttttgccccactcat

SEQ ID NO: 1354894 - DNA, 22 bp, Artificial Sequence
  chemically synthesized
ctacctcattttttgccccact

SEQ ID NO: 1354895 - DNA, 22 bp, Artificial Sequence
  chemically synthesized
cctacctcattttttgccccac

SEQ ID NO: 1354896 - DNA, 22 bp, Artificial Sequence
  chemically synthesized
tccttcctacctcattttttgc

SEQ ID NO: 1354897 - DNA, 22 bp, Artificial Sequence
  chemically synthesized
gtccttcctacctcattttttg

SEQ ID NO: 1354898 - DNA, 22 bp, Artificial Sequence
  chemically synthesized
tttgtccttcctacctcatttt

SEQ ID NO: 1354899 - DNA, 22 bp, Artificial Sequence
  chemically synthesized
atttgtccttcctacctcattt

SEQ ID NO: 1354900 - DNA, 22 bp, Artificial Sequence
  chemically synthesized
tatttgtccttcctacctcatt

SEQ ID NO: 1354901 - DNA, 22 bp, Artificial Sequence
  chemically synthesized
gtcctttatttgtccttcctac

SEQ ID NO: 1354902 - DNA, 22 bp, Artificial Sequence
  chemically synthesized
ctggtcctttatttgtccttcc

SEQ ID NO: 1354903 - DNA, 22 bp, Artificial Sequence
  chemically synthesized
gttactggtcctttatttgtcc

SEQ ID NO: 1354904 - DNA, 22 bp, Artificial Sequence
  chemically synthesized
cgttactggtcctttatttgtc

SEQ ID NO: 1354905 - DNA, 22 bp, Artificial Sequence
  chemically synthesized
ttcgttactggtcctttatttg

SEQ ID NO: 1354906 - DNA, 22 bp, Artificial Sequence
  chemically synthesized
aaaagctcttcgttactggtcc

SEQ ID NO: 1354907 - DNA, 22 bp, Artificial Sequence
  chemically synthesized
caaaagctcttcgttactggtc

SEQ ID NO: 1354908 - DNA, 22 bp, Artificial Sequence
  chemically synthesized
aaataaatttcaaaagctcttc

SEQ ID NO: 1354909 - DNA, 22 bp, Artificial Sequence
  chemically synthesized
ccagacctgaaataaatttcaa

SEQ ID NO: 1354910 - DNA, 22 bp, Artificial Sequence
  chemically synthesized
ttgaaatttatttcaggtctgg

SEQ ID NO: 1354911 - DNA, 22 bp, Artificial Sequence
  chemically synthesized
tgaaatttatttcaggtctggg

SEQ ID NO: 1354912 - DNA, 22 bp, Artificial Sequence
  chemically synthesized
gaaatttatttcaggtctggga

SEQ ID NO: 1354913 - DNA, 22 bp, Artificial Sequence
  chemically synthesized
aaatttatttcaggtctgggag

SEQ ID NO: 1354914 - DNA, 22 bp, Artificial Sequence
  chemically synthesized
agtcaaaatcatcactcccaga

SEQ ID NO: 1354915 - DNA, 22 bp, Artificial Sequence
  chemically synthesized
atttcaggtctgggagtgatga

SEQ ID NO: 1354916 - DNA, 22 bp, Artificial Sequence
  chemically synthesized
tttcaggtctgggagtgatgat

SEQ ID NO: 1354917 - DNA, 22 bp, Artificial Sequence
  chemically synthesized
caggtctgggagtgatgatttt

SEQ ID NO: 1354918 - DNA, 22 bp, Artificial Sequence
  chemically synthesized
aggtctgggagtgatgattttg

SEQ ID NO: 1354919 - DNA, 22 bp, Artificial Sequence
  chemically synthesized
ggagtgatgattttgacttaat

SEQ ID NO: 1354920 - DNA, 22 bp, Artificial Sequence
  chemically synthesized
gagaaaaccagggaattaagtc

SEQ ID NO: 1354921 - DNA, 22 bp, Artificial Sequence
  chemically synthesized
tgacttaattccctggttttct

SEQ ID NO: 1354922 - DNA, 22 bp, Artificial Sequence
  chemically synthesized
gacttaattccctggttttctc

SEQ ID NO: 1354923 - DNA, 22 bp, Artificial Sequence
  chemically synthesized
acttaattccctggttttctct

SEQ ID NO: 1354924 - DNA, 22 bp, Artificial Sequence
  chemically synthesized
aattccctggttttctctaata

SEQ ID NO: 1354925 - DNA, 22 bp, Artificial Sequence
  chemically synthesized
attccctggttttctctaatac

SEQ ID NO: 1354926 - DNA, 22 bp, Artificial Sequence
  chemically synthesized
cctggttttctctaatactgtt

SEQ ID NO: 1354927 - DNA, 22 bp, Artificial Sequence
  chemically synthesized
gttttctctaatactgtttgtt

SEQ ID NO: 1354928 - DNA, 22 bp, Artificial Sequence
  chemically synthesized
tctctaatactgtttgttgttg

SEQ ID NO: 1354929 - DNA, 22 bp, Artificial Sequence
  chemically synthesized
ctctaatactgtttgttgttgt

SEQ ID NO: 1354930 - DNA, 22 bp, Artificial Sequence
  chemically synthesized
tctaatactgtttgttgttgtt

SEQ ID NO: 1354931 - DNA, 22 bp, Artificial Sequence
  chemically synthesized
taatactgtttgttgttgttgt

SEQ ID NO: 1354932 - DNA, 22 bp, Artificial Sequence
  chemically synthesized
tatatgcagaaaacaacaacaa

SEQ ID NO: 1354933 - DNA, 22 bp, Artificial Sequence
  chemically synthesized
atactgtttgttgttgttgttt

SEQ ID NO: 1354934 - DNA, 22 bp, Artificial Sequence
  chemically synthesized
tatatatgcagaaaacaacaac

SEQ ID NO: 1354935 - DNA, 22 bp, Artificial Sequence
  chemically synthesized
ctatatatgcagaaaacaacaa

SEQ ID NO: 1354936 - DNA, 22 bp, Artificial Sequence
  chemically synthesized
tctatatatgcagaaaacaaca

SEQ ID NO: 1354937 - DNA, 22 bp, Artificial Sequence
  chemically synthesized
tttgttgttgttgttttctgca

SEQ ID NO: 1354938 - DNA, 22 bp, Artificial Sequence
  chemically synthesized
gttgttgttgttttctgcatat

SEQ ID NO: 1354939 - DNA, 22 bp, Artificial Sequence
  chemically synthesized
ccaattttctatatatgcagaa

SEQ ID NO: 1354940 - DNA, 22 bp, Artificial Sequence
  chemically synthesized
ttgttgttgttttctgcatata

SEQ ID NO: 1354941 - DNA, 22 bp, Artificial Sequence
  chemically synthesized
ttgttgttttctgcatatatag

SEQ ID NO: 1354942 - DNA, 22 bp, Artificial Sequence
  chemically synthesized
ttgttttctgcatatatagaaa

SEQ ID NO: 1354943 - DNA, 22 bp, Artificial Sequence
  chemically synthesized
ttttctgcatatatagaaaatt

SEQ ID NO: 1354944 - DNA, 22 bp, Artificial Sequence
  chemically synthesized
tctgcatatatagaaaattggt

SEQ ID NO: 1354945 - DNA, 22 bp, Artificial Sequence
  chemically synthesized
ctgcatatatagaaaattggta

SEQ ID NO: 1354946 - DNA, 22 bp, Artificial Sequence
  chemically synthesized
tgcatatatagaaaattggtag

SEQ ID NO: 1354947 - DNA, 22 bp, Artificial Sequence
  chemically synthesized
catatatagaaaattggtagat

SEQ ID NO: 1354948 - DNA, 22 bp, Artificial Sequence
  chemically synthesized
gtagattttatacatgtgcatt

SEQ ID NO: 1354949 - DNA, 22 bp, Artificial Sequence
  chemically synthesized
ccaatacatatgtaatgcacat

SEQ ID NO: 1354950 - DNA, 22 bp, Artificial Sequence
  chemically synthesized
tatacatgtgcattacatatgt

SEQ ID NO: 1354951 - DNA, 22 bp, Artificial Sequence
  chemically synthesized
atacatgtgcattacatatgta

SEQ ID NO: 1354952 - DNA, 22 bp, Artificial Sequence
  chemically synthesized
tacatgtgcattacatatgtat

SEQ ID NO: 1354953 - DNA, 22 bp, Artificial Sequence
  chemically synthesized
catatgtattggtagattttat

SEQ ID NO: 1354954 - DNA, 22 bp, Artificial Sequence
  chemically synthesized
tacatatatatgtgtatgtata

SEQ ID NO: 1354955 - DNA, 22 bp, Artificial Sequence
  chemically synthesized
gtagattttatacatacacata

SEQ ID NO: 1354956 - DNA, 22 bp, Artificial Sequence
  chemically synthesized
tatacatacacatatatatgta

SEQ ID NO: 1354957 - DNA, 22 bp, Artificial Sequence
  chemically synthesized
atacatacacatatatatgtat

SEQ ID NO: 1354958 - DNA, 22 bp, Artificial Sequence
  chemically synthesized
tacatacacatatatatgtata

SEQ ID NO: 1354959 - DNA, 22 bp, Artificial Sequence
  chemically synthesized
tatatgtatatacgtaattata

SEQ ID NO: 1354960 - DNA, 22 bp, Artificial Sequence
  chemically synthesized
aacaattgtatatgtatatacg

SEQ ID NO: 1354961 - DNA, 22 bp, Artificial Sequence
  chemically synthesized
atgattcaacaattgtatatgt

SEQ ID NO: 1354962 - DNA, 22 bp, Artificial Sequence
  chemically synthesized
aatgattcaacaattgtatatg

SEQ ID NO: 1354963 - DNA, 22 bp, Artificial Sequence
  chemically synthesized
cgtatatacatatacaattgtt

SEQ ID NO: 1354964 - DNA, 22 bp, Artificial Sequence
  chemically synthesized
caacttaatgattcaacaattg

SEQ ID NO: 1354965 - DNA, 22 bp, Artificial Sequence
  chemically synthesized
ttgcaacttaatgattcaacaa

SEQ ID NO: 1354966 - DNA, 22 bp, Artificial Sequence
  chemically synthesized
attattgcaacttaatgattca

SEQ ID NO: 1354967 - DNA, 22 bp, Artificial Sequence
  chemically synthesized
aattattgcaacttaatgattc

SEQ ID NO: 1354968 - DNA, 22 bp, Artificial Sequence
  chemically synthesized
ttgaatcattaagttgcaataa

SEQ ID NO: 1354969 - DNA, 22 bp, Artificial Sequence
  chemically synthesized
aatcattaagttgcaataatta

SEQ ID NO: 1354970 - DNA, 22 bp, Artificial Sequence
  chemically synthesized
agttgcaataattaaatttatt

SEQ ID NO: 1354971 - DNA, 22 bp, Artificial Sequence
  chemically synthesized
caataattaaatttattactct

SEQ ID NO: 1354972 - DNA, 22 bp, Artificial Sequence
  chemically synthesized
taatacccacagcatcataaag

SEQ ID NO: 1354973 - DNA, 22 bp, Artificial Sequence
  chemically synthesized
aatttattactctttatgatgc

SEQ ID NO: 1354974 - DNA, 22 bp, Artificial Sequence
  chemically synthesized
tgtaatacccacagcatcataa

SEQ ID NO: 1354975 - DNA, 22 bp, Artificial Sequence
  chemically synthesized
ctgtaatacccacagcatcata

SEQ ID NO: 1354976 - DNA, 22 bp, Artificial Sequence
  chemically synthesized
attactctttatgatgctgtgg

SEQ ID NO: 1354977 - DNA, 22 bp, Artificial Sequence
  chemically synthesized
ttactctttatgatgctgtggg

SEQ ID NO: 1354978 - DNA, 22 bp, Artificial Sequence
  chemically synthesized
ctctttatgatgctgtgggtat

SEQ ID NO: 1354979 - DNA, 22 bp, Artificial Sequence
  chemically synthesized
caatgcttctgtaatacccaca

SEQ ID NO: 1354980 - DNA, 22 bp, Artificial Sequence
  chemically synthesized
acaatgcttctgtaatacccac

SEQ ID NO: 1354981 - DNA, 22 bp, Artificial Sequence
  chemically synthesized
tttatgatgctgtgggtattac

SEQ ID NO: 1354982 - DNA, 22 bp, Artificial Sequence
  chemically synthesized
tatgatgctgtgggtattacag

SEQ ID NO: 1354983 - DNA, 22 bp, Artificial Sequence
  chemically synthesized
atgatgctgtgggtattacaga

SEQ ID NO: 1354984 - DNA, 22 bp, Artificial Sequence
  chemically synthesized
tgatgctgtgggtattacagaa

SEQ ID NO: 1354985 - DNA, 22 bp, Artificial Sequence
  chemically synthesized
tgggtattacagaagcattgta

SEQ ID NO: 1354986 - DNA, 22 bp, Artificial Sequence
  chemically synthesized
cagaagcattgtaaggtactac

SEQ ID NO: 1354987 - DNA, 22 bp, Artificial Sequence
  chemically synthesized
tggtataagaggaccatgtagt

SEQ ID NO: 1354988 - DNA, 22 bp, Artificial Sequence
  chemically synthesized
taaggtactacatggtcctctt

SEQ ID NO: 1354989 - DNA, 22 bp, Artificial Sequence
  chemically synthesized
gaaaaaatctatggtataagag

SEQ ID NO: 1354990 - DNA, 22 bp, Artificial Sequence
  chemically synthesized
agaaaaaatctatggtataaga

SEQ ID NO: 1354991 - DNA, 22 bp, Artificial Sequence
  chemically synthesized
catggtcctcttataccataga

SEQ ID NO: 1354992 - DNA, 22 bp, Artificial Sequence
  chemically synthesized
taggtttagaaaaaatctatgg

SEQ ID NO: 1354993 - DNA, 22 bp, Artificial Sequence
  chemically synthesized
ttataccatagattttttctaa

SEQ ID NO: 1354994 - DNA, 22 bp, Artificial Sequence
  chemically synthesized
tacagttgtaggtttagaaaaa

SEQ ID NO: 1354995 - DNA, 22 bp, Artificial Sequence
  chemically synthesized
ataccatagattttttctaaac

SEQ ID NO: 1354996 - DNA, 22 bp, Artificial Sequence
  chemically synthesized
taccatagattttttctaaacc

SEQ ID NO: 1354997 - DNA, 22 bp, Artificial Sequence
  chemically synthesized
tttctaaacctacaactgtata

SEQ ID NO: 1354998 - DNA, 22 bp, Artificial Sequence
  chemically synthesized
ttctaaacctacaactgtatag

SEQ ID NO: 1354999 - DNA, 22 bp, Artificial Sequence
  chemically synthesized
tctaaacctacaactgtatagc

SEQ ID NO: 1355000 - DNA, 22 bp, Artificial Sequence
  chemically synthesized
ctaaacctacaactgtatagcg

SEQ ID NO: 1355001 - DNA, 22 bp, Artificial Sequence
  chemically synthesized
taaacctacaactgtatagcgt

SEQ ID NO: 1355002 - DNA, 22 bp, Artificial Sequence
  chemically synthesized
atatcataccacacgctataca

SEQ ID NO: 1355003 - DNA, 22 bp, Artificial Sequence
  chemically synthesized
catatcataccacacgctatac

SEQ ID NO: 1355004 - DNA, 22 bp, Artificial Sequence
  chemically synthesized
aacctacaactgtatagcgtgt

SEQ ID NO: 1355005 - DNA, 22 bp, Artificial Sequence
  chemically synthesized
tcatatcataccacacgctata

SEQ ID NO: 1355006 - DNA, 22 bp, Artificial Sequence
  chemically synthesized
caactgtatagcgtgtggtatg

SEQ ID NO: 1355007 - DNA, 22 bp, Artificial Sequence
  chemically synthesized
tatagcgtgtggtatgatatga

SEQ ID NO: 1355008 - DNA, 22 bp, Artificial Sequence
  chemically synthesized
agccagtgattttcatatcata

SEQ ID NO: 1355009 - DNA, 22 bp, Artificial Sequence
  chemically synthesized
tcagccagtgattttcatatca

SEQ ID NO: 1355010 - DNA, 22 bp, Artificial Sequence
  chemically synthesized
gttctcagccagtgattttcat

SEQ ID NO: 1355011 - DNA, 22 bp, Artificial Sequence
  chemically synthesized
agacccagctagttctcagcca

SEQ ID NO: 1355012 - DNA, 22 bp, Artificial Sequence
  chemically synthesized
gatacaaaactaagacccagct

SEQ ID NO: 1355013 - DNA, 22 bp, Artificial Sequence
  chemically synthesized
gctgagaactagctgggtctta

SEQ ID NO: 1355014 - DNA, 22 bp, Artificial Sequence
  chemically synthesized
agaactagctgggtcttagttt

SEQ ID NO: 1355015 - DNA, 22 bp, Artificial Sequence
  chemically synthesized
agaaacagttagatacaaaact

SEQ ID NO: 1355016 - DNA, 22 bp, Artificial Sequence
  chemically synthesized
gctgggtcttagttttgtatct

SEQ ID NO: 1355017 - DNA, 22 bp, Artificial Sequence
  chemically synthesized
tcagaaacagttagatacaaaa

SEQ ID NO: 1355018 - DNA, 22 bp, Artificial Sequence
  chemically synthesized
ggtcttagttttgtatctaact

SEQ ID NO: 1355019 - DNA, 22 bp, Artificial Sequence
  chemically synthesized
cagttctcagaaacagttagat

SEQ ID NO: 1355020 - DNA, 22 bp, Artificial Sequence
  chemically synthesized
agttttgtatctaactgtttct

SEQ ID NO: 1355021 - DNA, 22 bp, Artificial Sequence
  chemically synthesized
gttttgtatctaactgtttctg

SEQ ID NO: 1355022 - DNA, 22 bp, Artificial Sequence
  chemically synthesized
tgtatctaactgtttctgagaa

SEQ ID NO: 1355023 - DNA, 22 bp, Artificial Sequence
  chemically synthesized
gtatctaactgtttctgagaac

SEQ ID NO: 1355024 - DNA, 22 bp, Artificial Sequence
  chemically synthesized
tatctaactgtttctgagaact

SEQ ID NO: 1355025 - DNA, 22 bp, Artificial Sequence
  chemically synthesized
actgtttctgagaactggagtc

SEQ ID NO: 1355026 - DNA, 22 bp, Artificial Sequence
  chemically synthesized
tttctgagaactggagtctcac

SEQ ID NO: 1355027 - DNA, 22 bp, Artificial Sequence
  chemically synthesized
tatagatgtggaaagtgagact

SEQ ID NO: 1355028 - DNA, 22 bp, Artificial Sequence
  chemically synthesized
ctgagaactggagtctcacttt

SEQ ID NO: 1355029 - DNA, 22 bp, Artificial Sequence
  chemically synthesized
tgagaactggagtctcactttc

SEQ ID NO: 1355030 - DNA, 22 bp, Artificial Sequence
  chemically synthesized
agaactggagtctcactttcca

SEQ ID NO: 1355031 - DNA, 22 bp, Artificial Sequence
  chemically synthesized
attatatagatgtggaaagtga

SEQ ID NO: 1355032 - DNA, 22 bp, Artificial Sequence
  chemically synthesized
ctcattatatagatgtggaaag

SEQ ID NO: 1355033 - DNA, 22 bp, Artificial Sequence
  chemically synthesized
cctcattatatagatgtggaaa

SEQ ID NO: 1355034 - DNA, 22 bp, Artificial Sequence
  chemically synthesized
gagtctcactttccacatctat

SEQ ID NO: 1355035 - DNA, 22 bp, Artificial Sequence
  chemically synthesized
catttcctcattatatagatgt

SEQ ID NO: 1355036 - DNA, 22 bp, Artificial Sequence
  chemically synthesized
ccatttcctcattatatagatg

SEQ ID NO: 1355037 - DNA, 22 bp, Artificial Sequence
  chemically synthesized
tccatttcctcattatatagat

SEQ ID NO: 1355038 - DNA, 22 bp, Artificial Sequence
  chemically synthesized
actttccacatctatataatga

SEQ ID NO: 1355039 - DNA, 22 bp, Artificial Sequence
  chemically synthesized
tccacatctatataatgaggaa

SEQ ID NO: 1355040 - DNA, 22 bp, Artificial Sequence
  chemically synthesized
ccacatctatataatgaggaaa

SEQ ID NO: 1355041 - DNA, 22 bp, Artificial Sequence
  chemically synthesized
cacatctatataatgaggaaat

SEQ ID NO: 1355042 - DNA, 22 bp, Artificial Sequence
  chemically synthesized
gagaatattttccatttcctca

SEQ ID NO: 1355043 - DNA, 22 bp, Artificial Sequence
  chemically synthesized
tataatgaggaaatggaaaata

SEQ ID NO: 1355044 - DNA, 22 bp, Artificial Sequence
  chemically synthesized
cagaaaacctggagaatatttt

SEQ ID NO: 1355045 - DNA, 22 bp, Artificial Sequence
  chemically synthesized
tccaggttttctgcagttgtga

SEQ ID NO: 1355046 - DNA, 22 bp, Artificial Sequence
  chemically synthesized
caggttttctgcagttgtgatg

SEQ ID NO: 1355047 - DNA, 22 bp, Artificial Sequence
  chemically synthesized
tctgcagttgtgatgatctatg

SEQ ID NO: 1355048 - DNA, 22 bp, Artificial Sequence
  chemically synthesized
ctgcagttgtgatgatctatga

SEQ ID NO: 1355049 - DNA, 22 bp, Artificial Sequence
  chemically synthesized
tgcagttgtgatgatctatgac

SEQ ID NO: 1355050 - DNA, 22 bp, Artificial Sequence
  chemically synthesized
cagttgtgatgatctatgacct

SEQ ID NO: 1355051 - DNA, 22 bp, Artificial Sequence
  chemically synthesized
cagtgaataacaaggtcataga

SEQ ID NO: 1355052 - DNA, 22 bp, Artificial Sequence
  chemically synthesized
tgatgatctatgaccttgttat

SEQ ID NO: 1355053 - DNA, 22 bp, Artificial Sequence
  chemically synthesized
acaccctacagtgaataacaag

SEQ ID NO: 1355054 - DNA, 22 bp, Artificial Sequence
  chemically synthesized
aacaccctacagtgaataacaa

SEQ ID NO: 1355055 - DNA, 22 bp, Artificial Sequence
  chemically synthesized
tgaccttgttattcactgtagg

SEQ ID NO: 1355056 - DNA, 22 bp, Artificial Sequence
  chemically synthesized
accagcttaacaccctacagtg

SEQ ID NO: 1355057 - DNA, 22 bp, Artificial Sequence
  chemically synthesized
caccagcttaacaccctacagt

SEQ ID NO: 1355058 - DNA, 22 bp, Artificial Sequence
  chemically synthesized
tttcaccagcttaacaccctac

SEQ ID NO: 1355059 - DNA, 22 bp, Artificial Sequence
  chemically synthesized
gttattcactgtagggtgttaa

SEQ ID NO: 1355060 - DNA, 22 bp, Artificial Sequence
  chemically synthesized
ttattcactgtagggtgttaag

SEQ ID NO: 1355061 - DNA, 22 bp, Artificial Sequence
  chemically synthesized
ctgtttcaccagcttaacaccc

SEQ ID NO: 1355062 - DNA, 22 bp, Artificial Sequence
  chemically synthesized
gctgtttcaccagcttaacacc

SEQ ID NO: 1355063 - DNA, 22 bp, Artificial Sequence
  chemically synthesized
tgctgtttcaccagcttaacac

SEQ ID NO: 1355064 - DNA, 22 bp, Artificial Sequence
  chemically synthesized
ttcactgtagggtgttaagctg

SEQ ID NO: 1355065 - DNA, 22 bp, Artificial Sequence
  chemically synthesized
actgtagggtgttaagctggtg

SEQ ID NO: 1355066 - DNA, 22 bp, Artificial Sequence
  chemically synthesized
cagttttgctgtttcaccagct

SEQ ID NO: 1355067 - DNA, 22 bp, Artificial Sequence
  chemically synthesized
tagggtgttaagctggtgaaac

SEQ ID NO: 1355068 - DNA, 22 bp, Artificial Sequence
  chemically synthesized
gtctgcagttttgctgtttcac

SEQ ID NO: 1355069 - DNA, 22 bp, Artificial Sequence
  chemically synthesized
ggtctgcagttttgctgtttca

SEQ ID NO: 1355070 - DNA, 22 bp, Artificial Sequence
  chemically synthesized
agctggtgaaacagcaaaactg

SEQ ID NO: 1355071 - DNA, 22 bp, Artificial Sequence
  chemically synthesized
gtatttggtctgcagttttgct

SEQ ID NO: 1355072 - DNA, 22 bp, Artificial Sequence
  chemically synthesized
gtgaaacagcaaaactgcagac

SEQ ID NO: 1355073 - DNA, 22 bp, Artificial Sequence
  chemically synthesized
aaggaaaactggtatttggtct

SEQ ID NO: 1355074 - DNA, 22 bp, Artificial Sequence
  chemically synthesized
cagaccaaataccagttttcct

SEQ ID NO: 1355075 - DNA, 22 bp, Artificial Sequence
  chemically synthesized
tcctttaaccatctctctctct

SEQ ID NO: 1355076 - DNA, 22 bp, Artificial Sequence
  chemically synthesized
cctttaaccatctctctctctc

SEQ ID NO: 1355077 - DNA, 22 bp, Artificial Sequence
  chemically synthesized
ctttaaccatctctctctctct

SEQ ID NO: 1355078 - DNA, 22 bp, Artificial Sequence
  chemically synthesized
taaccatctctctctctctctc

SEQ ID NO: 1355079 - DNA, 22 bp, Artificial Sequence
  chemically synthesized
aaccatctctctctctctctct

SEQ ID NO: 1355080 - DNA, 22 bp, Artificial Sequence
  chemically synthesized
accatctctctctctctctctc

SEQ ID NO: 1355081 - DNA, 22 bp, Artificial Sequence
  chemically synthesized
tctctctctctctctctctgtc

SEQ ID NO: 1355082 - DNA, 22 bp, Artificial Sequence
  chemically synthesized
tctctctctctctctctgtctc

SEQ ID NO: 1355083 - DNA, 22 bp, Artificial Sequence
  chemically synthesized
tctctctctctctctgtctctc

SEQ ID NO: 1355084 - DNA, 22 bp, Artificial Sequence
  chemically synthesized
gatagatgatgagagagacaga

SEQ ID NO: 1355085 - DNA, 22 bp, Artificial Sequence
  chemically synthesized
tctctctctctctgtctctctc

SEQ ID NO: 1355086 - DNA, 22 bp, Artificial Sequence
  chemically synthesized
tctctctctctgtctctctcat

SEQ ID NO: 1355087 - DNA, 22 bp, Artificial Sequence
  chemically synthesized
tctctctctgtctctctcatca

SEQ ID NO: 1355088 - DNA, 22 bp, Artificial Sequence
  chemically synthesized
tctctctgtctctctcatcatc

SEQ ID NO: 1355089 - DNA, 22 bp, Artificial Sequence
  chemically synthesized
tctctgtctctctcatcatcta

SEQ ID NO: 1355090 - DNA, 22 bp, Artificial Sequence
  chemically synthesized
tctgtctctctcatcatctatc

SEQ ID NO: 1355091 - DNA, 22 bp, Artificial Sequence
  chemically synthesized
tgtctctctcatcatctatcta

SEQ ID NO: 1355092 - DNA, 22 bp, Artificial Sequence
  chemically synthesized
aaatagtagatgttagatagat

SEQ ID NO: 1355093 - DNA, 22 bp, Artificial Sequence
  chemically synthesized
tctctctcatcatctatctaac

SEQ ID NO: 1355094 - DNA, 22 bp, Artificial Sequence
  chemically synthesized
aaaatagtagatgttagataga

SEQ ID NO: 1355095 - DNA, 22 bp, Artificial Sequence
  chemically synthesized
taaaatagtagatgttagatag

SEQ ID NO: 1355096 - DNA, 22 bp, Artificial Sequence
  chemically synthesized
ttaaaatagtagatgttagata

SEQ ID NO: 1355097 - DNA, 22 bp, Artificial Sequence
  chemically synthesized
tttaaaatagtagatgttagat

SEQ ID NO: 1355098 - DNA, 22 bp, Artificial Sequence
  chemically synthesized
tctcatcatctatctaacatct

SEQ ID NO: 1355099 - DNA, 22 bp, Artificial Sequence
  chemically synthesized
tcatcatctatctaacatctac

SEQ ID NO: 1355100 - DNA, 22 bp, Artificial Sequence
  chemically synthesized
atcatctatctaacatctacta

SEQ ID NO: 1355101 - DNA, 22 bp, Artificial Sequence
  chemically synthesized
atgattttttaaaatagtagat

SEQ ID NO: 1355102 - DNA, 22 bp, Artificial Sequence
  chemically synthesized
tctaacatctactattttaaaa

SEQ ID NO: 1355103 - DNA, 22 bp, Artificial Sequence
  chemically synthesized
agaagactgatgattttttaaa

SEQ ID NO: 1355104 - DNA, 22 bp, Artificial Sequence
  chemically synthesized
acatctactattttaaaaaatc

SEQ ID NO: 1355105 - DNA, 22 bp, Artificial Sequence
  chemically synthesized
ctattttaaaaaatcatcagtc

SEQ ID NO: 1355106 - DNA, 22 bp, Artificial Sequence
  chemically synthesized
ttttaaaaaatcatcagtcttc

SEQ ID NO: 1355107 - DNA, 22 bp, Artificial Sequence
  chemically synthesized
taaaaaatcatcagtcttctca

SEQ ID NO: 1355108 - DNA, 22 bp, Artificial Sequence
  chemically synthesized
aaaaaatcatcagtcttctcaa

SEQ ID NO: 1355109 - DNA, 22 bp, Artificial Sequence
  chemically synthesized
aaaaatcatcagtcttctcaat

SEQ ID NO: 1355110 - DNA, 22 bp, Artificial Sequence
  chemically synthesized
ctcaatgcatatcttactttct

SEQ ID NO: 1355111 - DNA, 22 bp, Artificial Sequence
  chemically synthesized
tcaatgcatatcttactttctc

SEQ ID NO: 1355112 - DNA, 22 bp, Artificial Sequence
  chemically synthesized
aatgcatatcttactttctcca

SEQ ID NO: 1355113 - DNA, 22 bp, Artificial Sequence
  chemically synthesized
gaagaatgggaaaatggagaaa

SEQ ID NO: 1355114 - DNA, 22 bp, Artificial Sequence
  chemically synthesized
actttctccattttcccattct

SEQ ID NO: 1355115 - DNA, 22 bp, Artificial Sequence
  chemically synthesized
ctttctccattttcccattctt

SEQ ID NO: 1355116 - DNA, 22 bp, Artificial Sequence
  chemically synthesized
tctccattttcccattcttcca

SEQ ID NO: 1355117 - DNA, 22 bp, Artificial Sequence
  chemically synthesized
ctccattttcccattcttccag

SEQ ID NO: 1355118 - DNA, 22 bp, Artificial Sequence
  chemically synthesized
tccattttcccattcttccagc

SEQ ID NO: 1355119 - DNA, 22 bp, Artificial Sequence
  chemically synthesized
cattttcccattcttccagccc

SEQ ID NO: 1355120 - DNA, 22 bp, Artificial Sequence
  chemically synthesized
tcccattcttccagccctttgc

SEQ ID NO: 1355121 - DNA, 22 bp, Artificial Sequence
  chemically synthesized
cccattcttccagccctttgct

SEQ ID NO: 1355122 - DNA, 22 bp, Artificial Sequence
  chemically synthesized
ccattcttccagccctttgctc

SEQ ID NO: 1355123 - DNA, 22 bp, Artificial Sequence
  chemically synthesized
ttccagccctttgctcttttcg

SEQ ID NO: 1355124 - DNA, 22 bp, Artificial Sequence
  chemically synthesized
ccagccctttgctcttttcgga

SEQ ID NO: 1355125 - DNA, 22 bp, Artificial Sequence
  chemically synthesized
cagccctttgctcttttcggac

SEQ ID NO: 1355126 - DNA, 22 bp, Artificial Sequence
  chemically synthesized
tgctcttttcggacacctttta

SEQ ID NO: 1355127 - DNA, 22 bp, Artificial Sequence
  chemically synthesized
tagacgggtaaataaaaggtgt

SEQ ID NO: 1355128 - DNA, 22 bp, Artificial Sequence
  chemically synthesized
gctcttttcggacaccttttat

SEQ ID NO: 1355129 - DNA, 22 bp, Artificial Sequence
  chemically synthesized
ctcttttcggacaccttttatt

SEQ ID NO: 1355130 - DNA, 22 bp, Artificial Sequence
  chemically synthesized
ttttcggacaccttttatttac

SEQ ID NO: 1355131 - DNA, 22 bp, Artificial Sequence
  chemically synthesized
ttcggacaccttttatttaccc

SEQ ID NO: 1355132 - DNA, 22 bp, Artificial Sequence
  chemically synthesized
tcggacaccttttatttacccg

SEQ ID NO: 1355133 - DNA, 22 bp, Artificial Sequence
  chemically synthesized
cggacaccttttatttacccgt

SEQ ID NO: 1355134 - DNA, 22 bp, Artificial Sequence
  chemically synthesized
ggacaccttttatttacccgtc

SEQ ID NO: 1355135 - DNA, 22 bp, Artificial Sequence
  chemically synthesized
ttatttacccgtctacagttct

SEQ ID NO: 1355136 - DNA, 22 bp, Artificial Sequence
  chemically synthesized
tatttacccgtctacagttctt

SEQ ID NO: 1355137 - DNA, 22 bp, Artificial Sequence
  chemically synthesized
atttacccgtctacagttcttt

SEQ ID NO: 1355138 - DNA, 22 bp, Artificial Sequence
  chemically synthesized
tttacccgtctacagttctttt

SEQ ID NO: 1355139 - DNA, 22 bp, Artificial Sequence
  chemically synthesized
acccgtctacagttcttttgcc

SEQ ID NO: 1355140 - DNA, 22 bp, Artificial Sequence
  chemically synthesized
cccgtctacagttcttttgccc

SEQ ID NO: 1355141 - DNA, 22 bp, Artificial Sequence
  chemically synthesized
gtaaccacaaagtaccagaggg

SEQ ID NO: 1355142 - DNA, 22 bp, Artificial Sequence
  chemically synthesized
cagttcttttgccctctggtac

SEQ ID NO: 1355143 - DNA, 22 bp, Artificial Sequence
  chemically synthesized
ttttgccctctggtactttgtg

SEQ ID NO: 1355144 - DNA, 22 bp, Artificial Sequence
  chemically synthesized
ttgccctctggtactttgtggt

SEQ ID NO: 1355145 - DNA, 22 bp, Artificial Sequence
  chemically synthesized
tgccctctggtactttgtggtt

SEQ ID NO: 1355146 - DNA, 22 bp, Artificial Sequence
  chemically synthesized
gccctctggtactttgtggtta

SEQ ID NO: 1355147 - DNA, 22 bp, Artificial Sequence
  chemically synthesized
ccctctggtactttgtggttac

SEQ ID NO: 1355148 - DNA, 22 bp, Artificial Sequence
  chemically synthesized
tggtactttgtggttaccagtt

SEQ ID NO: 1355149 - DNA, 22 bp, Artificial Sequence
  chemically synthesized
gtactttgtggttaccagttgc

SEQ ID NO: 1355150 - DNA, 22 bp, Artificial Sequence
  chemically synthesized
tgggaagtacaatagcaactgg

SEQ ID NO: 1355151 - DNA, 22 bp, Artificial Sequence
  chemically synthesized
gtgggaagtacaatagcaactg

SEQ ID NO: 1355152 - DNA, 22 bp, Artificial Sequence
  chemically synthesized
tgtgggaagtacaatagcaact

SEQ ID NO: 1355153 - DNA, 22 bp, Artificial Sequence
  chemically synthesized
tgtggttaccagttgctattgt

SEQ ID NO: 1355154 - DNA, 22 bp, Artificial Sequence
  chemically synthesized
gtggttaccagttgctattgta

SEQ ID NO: 1355155 - DNA, 22 bp, Artificial Sequence
  chemically synthesized
tggttaccagttgctattgtac

SEQ ID NO: 1355156 - DNA, 22 bp, Artificial Sequence
  chemically synthesized
atcctttgtgggaagtacaata

SEQ ID NO: 1355157 - DNA, 22 bp, Artificial Sequence
  chemically synthesized
ccagttgctattgtacttccca

SEQ ID NO: 1355158 - DNA, 22 bp, Artificial Sequence
  chemically synthesized
ctattgtacttcccacaaagga

SEQ ID NO: 1355159 - DNA, 22 bp, Artificial Sequence
  chemically synthesized
tagtgcaaattgatcctttgtg

SEQ ID NO: 1355160 - DNA, 22 bp, Artificial Sequence
  chemically synthesized
ttgtacttcccacaaaggatca

SEQ ID NO: 1355161 - DNA, 22 bp, Artificial Sequence
  chemically synthesized
tacttcccacaaaggatcaatt

SEQ ID NO: 1355162 - DNA, 22 bp, Artificial Sequence
  chemically synthesized
cccacaaaggatcaatttgcac

SEQ ID NO: 1355163 - DNA, 22 bp, Artificial Sequence
  chemically synthesized
ccacaaaggatcaatttgcact

SEQ ID NO: 1355164 - DNA, 22 bp, Artificial Sequence
  chemically synthesized
tcagtatgattgtagtgcaaat

SEQ ID NO: 1355165 - DNA, 22 bp, Artificial Sequence
  chemically synthesized
ctgtcagtatgattgtagtgca

SEQ ID NO: 1355166 - DNA, 22 bp, Artificial Sequence
  chemically synthesized
aggactgctgtcagtatgattg

SEQ ID NO: 1355167 - DNA, 22 bp, Artificial Sequence
  chemically synthesized
ctgaggactgctgtcagtatga

SEQ ID NO: 1355168 - DNA, 22 bp, Artificial Sequence
  chemically synthesized
gcactacaatcatactgacagc

SEQ ID NO: 1355169 - DNA, 22 bp, Artificial Sequence
  chemically synthesized
cactacaatcatactgacagca

SEQ ID NO: 1355170 - DNA, 22 bp, Artificial Sequence
  chemically synthesized
agttactgaggactgctgtcag

SEQ ID NO: 1355171 - DNA, 22 bp, Artificial Sequence
  chemically synthesized
caatcatactgacagcagtcct

SEQ ID NO: 1355172 - DNA, 22 bp, Artificial Sequence
  chemically synthesized
ccctgagttactgaggactgct

SEQ ID NO: 1355173 - DNA, 22 bp, Artificial Sequence
  chemically synthesized
cccctgagttactgaggactgc

SEQ ID NO: 1355174 - DNA, 22 bp, Artificial Sequence
  chemically synthesized
tcccctgagttactgaggactg

SEQ ID NO: 1355175 - DNA, 22 bp, Artificial Sequence
  chemically synthesized
ttcccctgagttactgaggact

SEQ ID NO: 1355176 - DNA, 22 bp, Artificial Sequence
  chemically synthesized
tttcccctgagttactgaggac

SEQ ID NO: 1355177 - DNA, 22 bp, Artificial Sequence
  chemically synthesized
ttttcccctgagttactgagga

SEQ ID NO: 1355178 - DNA, 22 bp, Artificial Sequence
  chemically synthesized
tttttcccctgagttactgagg

SEQ ID NO: 1355179 - DNA, 22 bp, Artificial Sequence
  chemically synthesized
ttttttttcccctgagttactg

SEQ ID NO: 1355180 - DNA, 22 bp, Artificial Sequence
  chemically synthesized
acagcagtcctcagtaactcag

SEQ ID NO: 1355181 - DNA, 22 bp, Artificial Sequence
  chemically synthesized
agagtctgttttttttcccctg

SEQ ID NO: 1355182 - DNA, 22 bp, Artificial Sequence
  chemically synthesized
aagagtctgttttttttcccct

SEQ ID NO: 1355183 - DNA, 22 bp, Artificial Sequence
  chemically synthesized
cttaagagtctgttttttttcc

SEQ ID NO: 1355184 - DNA, 22 bp, Artificial Sequence
  chemically synthesized
agtaactcaggggaaaaaaaac

SEQ ID NO: 1355185 - DNA, 22 bp, Artificial Sequence
  chemically synthesized
ctgcttaagagtctgttttttt

SEQ ID NO: 1355186 - DNA, 22 bp, Artificial Sequence
  chemically synthesized
aggggaaaaaaaacagactctt

SEQ ID NO: 1355187 - DNA, 22 bp, Artificial Sequence
  chemically synthesized
gatccccactgctgcttaagag

SEQ ID NO: 1355188 - DNA, 22 bp, Artificial Sequence
  chemically synthesized
ggatccccactgctgcttaaga

SEQ ID NO: 1355189 - DNA, 22 bp, Artificial Sequence
  chemically synthesized
tggatccccactgctgcttaag

SEQ ID NO: 1355190 - DNA, 22 bp, Artificial Sequence
  chemically synthesized
ggaaatggtctttggatcccca

SEQ ID NO: 1355191 - DNA, 22 bp, Artificial Sequence
  chemically synthesized
ttaagcagcagtggggatccaa

SEQ ID NO: 1355192 - DNA, 22 bp, Artificial Sequence
  chemically synthesized
aagcagcagtggggatccaaag

SEQ ID NO: 1355193 - DNA, 22 bp, Artificial Sequence
  chemically synthesized
agcagcagtggggatccaaaga

SEQ ID NO: 1355194 - DNA, 22 bp, Artificial Sequence
  chemically synthesized
cctgggaaatggtctttggatc

SEQ ID NO: 1355195 - DNA, 22 bp, Artificial Sequence
  chemically synthesized
gttccctgggaaatggtctttg

SEQ ID NO: 1355196 - DNA, 22 bp, Artificial Sequence
  chemically synthesized
tgacccgactggttccctggga

SEQ ID NO: 1355197 - DNA, 22 bp, Artificial Sequence
  chemically synthesized
ctgtgacccgactggttccctg

SEQ ID NO: 1355198 - DNA, 22 bp, Artificial Sequence
  chemically synthesized
cctgtgacccgactggttccct

SEQ ID NO: 1355199 - DNA, 22 bp, Artificial Sequence
  chemically synthesized
ttcctgtgacccgactggttcc

SEQ ID NO: 1355200 - DNA, 22 bp, Artificial Sequence
  chemically synthesized
ccactcttcctgtgacccgact

SEQ ID NO: 1355201 - DNA, 22 bp, Artificial Sequence
  chemically synthesized
cccagggaaccagtcgggtcac

SEQ ID NO: 1355202 - DNA, 22 bp, Artificial Sequence
  chemically synthesized
cccactcttcctgtgacccgac

SEQ ID NO: 1355203 - DNA, 22 bp, Artificial Sequence
  chemically synthesized
ccagggaaccagtcgggtcaca

SEQ ID NO: 1355204 - DNA, 22 bp, Artificial Sequence
  chemically synthesized
ttcccactcttcctgtgacccg

SEQ ID NO: 1355205 - DNA, 22 bp, Artificial Sequence
  chemically synthesized
tcttcccactcttcctgtgacc

SEQ ID NO: 1355206 - DNA, 22 bp, Artificial Sequence
  chemically synthesized
ttctcttcccactcttcctgtg

SEQ ID NO: 1355207 - DNA, 22 bp, Artificial Sequence
  chemically synthesized
ctgttctcttcccactcttcct

SEQ ID NO: 1355208 - DNA, 22 bp, Artificial Sequence
  chemically synthesized
gctgttctcttcccactcttcc

SEQ ID NO: 1355209 - DNA, 22 bp, Artificial Sequence
  chemically synthesized
tgctgttctcttcccactcttc

SEQ ID NO: 1355210 - DNA, 22 bp, Artificial Sequence
  chemically synthesized
gggctttgctgttctcttccca

SEQ ID NO: 1355211 - DNA, 22 bp, Artificial Sequence
  chemically synthesized
ggggctttgctgttctcttccc

SEQ ID NO: 1355212 - DNA, 22 bp, Artificial Sequence
  chemically synthesized
agtgaaatatgtgggaagagga

SEQ ID NO: 1355213 - DNA, 22 bp, Artificial Sequence
  chemically synthesized
gcatctgagtgaaatatgtggg

SEQ ID NO: 1355214 - DNA, 22 bp, Artificial Sequence
  chemically synthesized
ttttcctcttcccacatatttc

SEQ ID NO: 1355215 - DNA, 22 bp, Artificial Sequence
  chemically synthesized
tcctcttcccacatatttcact

SEQ ID NO: 1355216 - DNA, 22 bp, Artificial Sequence
  chemically synthesized
cctcttcccacatatttcactc

SEQ ID NO: 1355217 - DNA, 22 bp, Artificial Sequence
  chemically synthesized
ctcttcccacatatttcactca

SEQ ID NO: 1355218 - DNA, 22 bp, Artificial Sequence
  chemically synthesized
ttcccacatatttcactcagat

SEQ ID NO: 1355219 - DNA, 22 bp, Artificial Sequence
  chemically synthesized
cccacatatttcactcagatgc

SEQ ID NO: 1355220 - DNA, 22 bp, Artificial Sequence
  chemically synthesized
ccacatatttcactcagatgcc

SEQ ID NO: 1355221 - DNA, 22 bp, Artificial Sequence
  chemically synthesized
agagcaaacaaaaattggcatc

SEQ ID NO: 1355222 - DNA, 22 bp, Artificial Sequence
  chemically synthesized
gagagcaaacaaaaattggcat

SEQ ID NO: 1355223 - DNA, 22 bp, Artificial Sequence
  chemically synthesized
tgagagcaaacaaaaattggca

SEQ ID NO: 1355224 - DNA, 22 bp, Artificial Sequence
  chemically synthesized
cactcagatgccaatttttgtt

SEQ ID NO: 1355225 - DNA, 22 bp, Artificial Sequence
  chemically synthesized
actcagatgccaatttttgttt

SEQ ID NO: 1355226 - DNA, 22 bp, Artificial Sequence
  chemically synthesized
agatgccaatttttgtttgctc

SEQ ID NO: 1355227 - DNA, 22 bp, Artificial Sequence
  chemically synthesized
tcaaataaaacagctttgagag

SEQ ID NO: 1355228 - DNA, 22 bp, Artificial Sequence
  chemically synthesized
ttgtttgctctcaaagctgttt

SEQ ID NO: 1355229 - DNA, 22 bp, Artificial Sequence
  chemically synthesized
tgtttgctctcaaagctgtttt

SEQ ID NO: 1355230 - DNA, 22 bp, Artificial Sequence
  chemically synthesized
gtttgctctcaaagctgtttta

SEQ ID NO: 1355231 - DNA, 22 bp, Artificial Sequence
  chemically synthesized
tttgctctcaaagctgttttat

SEQ ID NO: 1355232 - DNA, 22 bp, Artificial Sequence
  chemically synthesized
gctctcaaagctgttttatttg

SEQ ID NO: 1355233 - DNA, 22 bp, Artificial Sequence
  chemically synthesized
ctctcaaagctgttttatttga

SEQ ID NO: 1355234 - DNA, 22 bp, Artificial Sequence
  chemically synthesized
tcaaagctgttttatttgacag

SEQ ID NO: 1355235 - DNA, 22 bp, Artificial Sequence
  chemically synthesized
aaagctgttttatttgacaggg

SEQ ID NO: 1355236 - DNA, 22 bp, Artificial Sequence
  chemically synthesized
gcccataacaaggagccctgtc

SEQ ID NO: 1355237 - DNA, 22 bp, Artificial Sequence
  chemically synthesized
agcccataacaaggagccctgt

SEQ ID NO: 1355238 - DNA, 22 bp, Artificial Sequence
  chemically synthesized
ttttatttgacagggctccttg

SEQ ID NO: 1355239 - DNA, 22 bp, Artificial Sequence
  chemically synthesized
tatttgacagggctccttgtta

SEQ ID NO: 1355240 - DNA, 22 bp, Artificial Sequence
  chemically synthesized
atttgacagggctccttgttat

SEQ ID NO: 1355241 - DNA, 22 bp, Artificial Sequence
  chemically synthesized
tttgacagggctccttgttatg

SEQ ID NO: 1355242 - DNA, 22 bp, Artificial Sequence
  chemically synthesized
gacagggctccttgttatgggc

SEQ ID NO: 1355243 - DNA, 22 bp, Artificial Sequence
  chemically synthesized
acagggctccttgttatgggct

SEQ ID NO: 1355244 - DNA, 22 bp, Artificial Sequence
  chemically synthesized
ggaaaggggcaatttagcccat

SEQ ID NO: 1355245 - DNA, 22 bp, Artificial Sequence
  chemically synthesized
gggaaaggggcaatttagccca

SEQ ID NO: 1355246 - DNA, 22 bp, Artificial Sequence
  chemically synthesized
cttgttatgggctaaattgccc

SEQ ID NO: 1355247 - DNA, 22 bp, Artificial Sequence
  chemically synthesized
gttatgggctaaattgcccctt

SEQ ID NO: 1355248 - DNA, 22 bp, Artificial Sequence
  chemically synthesized
ttatgggctaaattgccccttt

SEQ ID NO: 1355249 - DNA, 22 bp, Artificial Sequence
  chemically synthesized
tgggctaaattgcccctttccc

SEQ ID NO: 1355250 - DNA, 22 bp, Artificial Sequence
  chemically synthesized
aacagacgaatttgggaaaggg

SEQ ID NO: 1355251 - DNA, 22 bp, Artificial Sequence
  chemically synthesized
caacagacgaatttgggaaagg

SEQ ID NO: 1355252 - DNA, 22 bp, Artificial Sequence
  chemically synthesized
aattgcccctttcccaaattcg

SEQ ID NO: 1355253 - DNA, 22 bp, Artificial Sequence
  chemically synthesized
ggacttcaacagacgaatttgg

SEQ ID NO: 1355254 - DNA, 22 bp, Artificial Sequence
  chemically synthesized
cccctttcccaaattcgtctgt

SEQ ID NO: 1355255 - DNA, 22 bp, Artificial Sequence
  chemically synthesized
tcccaaattcgtctgttgaagt

SEQ ID NO: 1355256 - DNA, 22 bp, Artificial Sequence
  chemically synthesized
cccaaattcgtctgttgaagtc

SEQ ID NO: 1355257 - DNA, 22 bp, Artificial Sequence
  chemically synthesized
ccaaattcgtctgttgaagtcc

SEQ ID NO: 1355258 - DNA, 22 bp, Artificial Sequence
  chemically synthesized
agacaatgggggttaggacttc

SEQ ID NO: 1355259 - DNA, 22 bp, Artificial Sequence
  chemically synthesized
tgagacaatgggggttaggact

SEQ ID NO: 1355260 - DNA, 22 bp, Artificial Sequence
  chemically synthesized
gtctgttgaagtcctaaccccc

SEQ ID NO: 1355261 - DNA, 22 bp, Artificial Sequence
  chemically synthesized
ttgaagtcctaacccccattgt

SEQ ID NO: 1355262 - DNA, 22 bp, Artificial Sequence
  chemically synthesized
aagtcctaacccccattgtctc

SEQ ID NO: 1355263 - DNA, 22 bp, Artificial Sequence
  chemically synthesized
cagtcacattctgagacaatgg

SEQ ID NO: 1355264 - DNA, 22 bp, Artificial Sequence
  chemically synthesized
caactacagtcacattctgaga

SEQ ID NO: 1355265 - DNA, 22 bp, Artificial Sequence
  chemically synthesized
acccccattgtctcagaatgtg

SEQ ID NO: 1355266 - DNA, 22 bp, Artificial Sequence
  chemically synthesized
tctccaactacagtcacattct

SEQ ID NO: 1355267 - DNA, 22 bp, Artificial Sequence
  chemically synthesized
tctcagaatgtgactgtagttg

SEQ ID NO: 1355268 - DNA, 22 bp, Artificial Sequence
  chemically synthesized
aagaccctatctccaactacag

SEQ ID NO: 1355269 - DNA, 22 bp, Artificial Sequence
  chemically synthesized
aaagaccctatctccaactaca

SEQ ID NO: 1355270 - DNA, 22 bp, Artificial Sequence
  chemically synthesized
taaagaccctatctccaactac

SEQ ID NO: 1355271 - DNA, 22 bp, Artificial Sequence
  chemically synthesized
agaatgtgactgtagttggaga

SEQ ID NO: 1355272 - DNA, 22 bp, Artificial Sequence
  chemically synthesized
tttaaagaccctatctccaact

SEQ ID NO: 1355273 - DNA, 22 bp, Artificial Sequence
  chemically synthesized
aatacctctttaaagaccctat

SEQ ID NO: 1355274 - DNA, 22 bp, Artificial Sequence
  chemically synthesized
aaatacctctttaaagacccta

SEQ ID NO: 1355275 - DNA, 22 bp, Artificial Sequence
  chemically synthesized
tagttggagatagggtctttaa

SEQ ID NO: 1355276 - DNA, 22 bp, Artificial Sequence
  chemically synthesized
accttaaatacctctttaaaga

SEQ ID NO: 1355277 - DNA, 22 bp, Artificial Sequence
  chemically synthesized
aaccttaaatacctctttaaag

SEQ ID NO: 1355278 - DNA, 22 bp, Artificial Sequence
  chemically synthesized
gagatagggtctttaaagaggt

SEQ ID NO: 1355279 - DNA, 22 bp, Artificial Sequence
  chemically synthesized
atttaaccttaaatacctcttt

SEQ ID NO: 1355280 - DNA, 22 bp, Artificial Sequence
  chemically synthesized
gtgacctcatttaaccttaaat

SEQ ID NO: 1355281 - DNA, 22 bp, Artificial Sequence
  chemically synthesized
agtgacctcatttaaccttaaa

SEQ ID NO: 1355282 - DNA, 22 bp, Artificial Sequence
  chemically synthesized
taaagaggtatttaaggttaaa

SEQ ID NO: 1355283 - DNA, 22 bp, Artificial Sequence
  chemically synthesized
aaagaggtatttaaggttaaat

SEQ ID NO: 1355284 - DNA, 22 bp, Artificial Sequence
  chemically synthesized
aagaggtatttaaggttaaatg

SEQ ID NO: 1355285 - DNA, 22 bp, Artificial Sequence
  chemically synthesized
accttagtgacctcatttaacc

SEQ ID NO: 1355286 - DNA, 22 bp, Artificial Sequence
  chemically synthesized
gagctcaccttagtgacctcat

SEQ ID NO: 1355287 - DNA, 22 bp, Artificial Sequence
  chemically synthesized
aaggttaaatgaggtcactaag

SEQ ID NO: 1355288 - DNA, 22 bp, Artificial Sequence
  chemically synthesized
aggttaaatgaggtcactaagg

SEQ ID NO: 1355289 - DNA, 22 bp, Artificial Sequence
  chemically synthesized
gattagagctcaccttagtgac

SEQ ID NO: 1355290 - DNA, 22 bp, Artificial Sequence
  chemically synthesized
aatgaggtcactaaggtgagct

SEQ ID NO: 1355291 - DNA, 22 bp, Artificial Sequence
  chemically synthesized
atcagattggattagagctcac

SEQ ID NO: 1355292 - DNA, 22 bp, Artificial Sequence
  chemically synthesized
aggtgagctctaatccaatctg

SEQ ID NO: 1355293 - DNA, 22 bp, Artificial Sequence
  chemically synthesized
taaggatactaatcagattgga

SEQ ID NO: 1355294 - DNA, 22 bp, Artificial Sequence
  chemically synthesized
ataaggatactaatcagattgg

SEQ ID NO: 1355295 - DNA, 22 bp, Artificial Sequence
  chemically synthesized
tataaggatactaatcagattg

SEQ ID NO: 1355296 - DNA, 22 bp, Artificial Sequence
  chemically synthesized
ttataaggatactaatcagatt

SEQ ID NO: 1355297 - DNA, 22 bp, Artificial Sequence
  chemically synthesized
tttataaggatactaatcagat

SEQ ID NO: 1355298 - DNA, 22 bp, Artificial Sequence
  chemically synthesized
taatccaatctgattagtatcc

SEQ ID NO: 1355299 - DNA, 22 bp, Artificial Sequence
  chemically synthesized
atctttttataaggatactaat

SEQ ID NO: 1355300 - DNA, 22 bp, Artificial Sequence
  chemically synthesized
atccaatctgattagtatcctt

SEQ ID NO: 1355301 - DNA, 22 bp, Artificial Sequence
  chemically synthesized
atctcatctttttataaggata

SEQ ID NO: 1355302 - DNA, 22 bp, Artificial Sequence
  chemically synthesized
taatctcatctttttataagga

SEQ ID NO: 1355303 - DNA, 22 bp, Artificial Sequence
  chemically synthesized
attagtatccttataaaaagat

SEQ ID NO: 1355304 - DNA, 22 bp, Artificial Sequence
  chemically synthesized
tgttctaatctcatctttttat

SEQ ID NO: 1355305 - DNA, 22 bp, Artificial Sequence
  chemically synthesized
gtatccttataaaaagatgaga

SEQ ID NO: 1355306 - DNA, 22 bp, Artificial Sequence
  chemically synthesized
tctgtgttctaatctcatcttt

SEQ ID NO: 1355307 - DNA, 22 bp, Artificial Sequence
  chemically synthesized
ctgtctgtgttctaatctcatc

SEQ ID NO: 1355308 - DNA, 22 bp, Artificial Sequence
  chemically synthesized
ttcctgtctgtgttctaatctc

SEQ ID NO: 1355309 - DNA, 22 bp, Artificial Sequence
  chemically synthesized
ataaaaagatgagattagaaca

SEQ ID NO: 1355310 - DNA, 22 bp, Artificial Sequence
  chemically synthesized
tgttcctgtctgtgttctaatc

SEQ ID NO: 1355311 - DNA, 22 bp, Artificial Sequence
  chemically synthesized
taaaaagatgagattagaacac

SEQ ID NO: 1355312 - DNA, 22 bp, Artificial Sequence
  chemically synthesized
ctctgttcctgtctgtgttcta

SEQ ID NO: 1355313 - DNA, 22 bp, Artificial Sequence
  chemically synthesized
cctctgttcctgtctgtgttct

SEQ ID NO: 1355314 - DNA, 22 bp, Artificial Sequence
  chemically synthesized
tcctctgttcctgtctgtgttc

SEQ ID NO: 1355315 - DNA, 22 bp, Artificial Sequence
  chemically synthesized
atggtctttcctctgttcctgt

SEQ ID NO: 1355316 - DNA, 22 bp, Artificial Sequence
  chemically synthesized
tcatggtctttcctctgttcct

SEQ ID NO: 1355317 - DNA, 22 bp, Artificial Sequence
  chemically synthesized
ctcatggtctttcctctgttcc

SEQ ID NO: 1355318 - DNA, 22 bp, Artificial Sequence
  chemically synthesized
gaacacagacaggaacagagga

SEQ ID NO: 1355319 - DNA, 22 bp, Artificial Sequence
  chemically synthesized
tcttctcatggtctttcctctg

SEQ ID NO: 1355320 - DNA, 22 bp, Artificial Sequence
  chemically synthesized
catctgtcttctcatggtcttt

SEQ ID NO: 1355321 - DNA, 22 bp, Artificial Sequence
  chemically synthesized
tccatctgtcttctcatggtct

SEQ ID NO: 1355322 - DNA, 22 bp, Artificial Sequence
  chemically synthesized
ccctctccatctgtcttctcat

SEQ ID NO: 1355323 - DNA, 22 bp, Artificial Sequence
  chemically synthesized
cagaggctgccctctccatctg

SEQ ID NO: 1355324 - DNA, 22 bp, Artificial Sequence
  chemically synthesized
gcagaggctgccctctccatct

SEQ ID NO: 1355325 - DNA, 22 bp, Artificial Sequence
  chemically synthesized
gtttgcagaggctgccctctcc

SEQ ID NO: 1355326 - DNA, 22 bp, Artificial Sequence
  chemically synthesized
agtttgcagaggctgccctctc

SEQ ID NO: 1355327 - DNA, 22 bp, Artificial Sequence
  chemically synthesized
cttagtttgcagaggctgccct

SEQ ID NO: 1355328 - DNA, 22 bp, Artificial Sequence
  chemically synthesized
cctccttagtttgcagaggctg

SEQ ID NO: 1355329 - DNA, 22 bp, Artificial Sequence
  chemically synthesized
aagcctccctccttagtttgca

SEQ ID NO: 1355330 - DNA, 22 bp, Artificial Sequence
  chemically synthesized
tgaagcctccctccttagtttg

SEQ ID NO: 1355331 - DNA, 22 bp, Artificial Sequence
  chemically synthesized
ctgaagcctccctccttagttt

SEQ ID NO: 1355332 - DNA, 22 bp, Artificial Sequence
  chemically synthesized
ttctgaagcctccctccttagt

SEQ ID NO: 1355333 - DNA, 22 bp, Artificial Sequence
  chemically synthesized
cttctgaagcctccctccttag

SEQ ID NO: 1355334 - DNA, 22 bp, Artificial Sequence
  chemically synthesized
atttcttctgaagcctccctcc

SEQ ID NO: 1355335 - DNA, 22 bp, Artificial Sequence
  chemically synthesized
tgcaaactaaggagggaggctt

SEQ ID NO: 1355336 - DNA, 22 bp, Artificial Sequence
  chemically synthesized
caaactaaggagggaggcttca

SEQ ID NO: 1355337 - DNA, 22 bp, Artificial Sequence
  chemically synthesized
aggagggaggcttcagaagaaa

SEQ ID NO: 1355338 - DNA, 22 bp, Artificial Sequence
  chemically synthesized
ggtataatcagggctgatttct

SEQ ID NO: 1355339 - DNA, 22 bp, Artificial Sequence
  chemically synthesized
cagaagaaatcagccctgatta

SEQ ID NO: 1355340 - DNA, 22 bp, Artificial Sequence
  chemically synthesized
agaagaaatcagccctgattat

SEQ ID NO: 1355341 - DNA, 22 bp, Artificial Sequence
  chemically synthesized
cacagtagtaaaggctaggtat

SEQ ID NO: 1355342 - DNA, 22 bp, Artificial Sequence
  chemically synthesized
tccacagtagtaaaggctaggt

SEQ ID NO: 1355343 - DNA, 22 bp, Artificial Sequence
  chemically synthesized
ctccacagtagtaaaggctagg

SEQ ID NO: 1355344 - DNA, 22 bp, Artificial Sequence
  chemically synthesized
tctccacagtagtaaaggctag

SEQ ID NO: 1355345 - DNA, 22 bp, Artificial Sequence
  chemically synthesized
ttttctccacagtagtaaaggc

SEQ ID NO: 1355346 - DNA, 22 bp, Artificial Sequence
  chemically synthesized
attttctccacagtagtaaagg

SEQ ID NO: 1355347 - DNA, 22 bp, Artificial Sequence
  chemically synthesized
attatacctagcctttactact

SEQ ID NO: 1355348 - DNA, 22 bp, Artificial Sequence
  chemically synthesized
tacctagcctttactactgtgg

SEQ ID NO: 1355349 - DNA, 22 bp, Artificial Sequence
  chemically synthesized
gcctttactactgtggagaaaa

SEQ ID NO: 1355350 - DNA, 22 bp, Artificial Sequence
  chemically synthesized
aacagaaatttattttctccac

SEQ ID NO: 1355351 - DNA, 22 bp, Artificial Sequence
  chemically synthesized
aaacagaaatttattttctcca

SEQ ID NO: 1355352 - DNA, 22 bp, Artificial Sequence
  chemically synthesized
ttaaacagaaatttattttctc

SEQ ID NO: 1355353 - DNA, 22 bp, Artificial Sequence
  chemically synthesized
cttaaacagaaatttattttct

SEQ ID NO: 1355354 - DNA, 22 bp, Artificial Sequence
  chemically synthesized
tactactgtggagaaaataaat

SEQ ID NO: 1355355 - DNA, 22 bp, Artificial Sequence
  chemically synthesized
actactgtggagaaaataaatt

SEQ ID NO: 1355356 - DNA, 22 bp, Artificial Sequence
  chemically synthesized
ctactgtggagaaaataaattt

SEQ ID NO: 1355357 - DNA, 22 bp, Artificial Sequence
  chemically synthesized
ggtttcttaaacagaaatttat

SEQ ID NO: 1355358 - DNA, 22 bp, Artificial Sequence
  chemically synthesized
ctgtggagaaaataaatttctg

SEQ ID NO: 1355359 - DNA, 22 bp, Artificial Sequence
  chemically synthesized
tggagaaaataaatttctgttt

SEQ ID NO: 1355360 - DNA, 22 bp, Artificial Sequence
  chemically synthesized
ctgtttaagaaacccagtctac

SEQ ID NO: 1355361 - DNA, 22 bp, Artificial Sequence
  chemically synthesized
tgtttaagaaacccagtctact

SEQ ID NO: 1355362 - DNA, 22 bp, Artificial Sequence
  chemically synthesized
tttaagaaacccagtctactgt

SEQ ID NO: 1355363 - DNA, 22 bp, Artificial Sequence
  chemically synthesized
aagaaacccagtctactgtggt

SEQ ID NO: 1355364 - DNA, 22 bp, Artificial Sequence
  chemically synthesized
ccataacaaaataccacagtag

SEQ ID NO: 1355365 - DNA, 22 bp, Artificial Sequence
  chemically synthesized
agaaacccagtctactgtggta

SEQ ID NO: 1355366 - DNA, 22 bp, Artificial Sequence
  chemically synthesized
gcattgccataacaaaatacca

SEQ ID NO: 1355367 - DNA, 22 bp, Artificial Sequence
  chemically synthesized
ctagcattgccataacaaaata

SEQ ID NO: 1355368 - DNA, 22 bp, Artificial Sequence
  chemically synthesized
gctagcattgccataacaaaat

SEQ ID NO: 1355369 - DNA, 22 bp, Artificial Sequence
  chemically synthesized
tgctagcattgccataacaaaa

SEQ ID NO: 1355370 - DNA, 22 bp, Artificial Sequence
  chemically synthesized
ttttgctagcattgccataaca

SEQ ID NO: 1355371 - DNA, 22 bp, Artificial Sequence
  chemically synthesized
ctgtggtattttgttatggcaa

SEQ ID NO: 1355372 - DNA, 22 bp, Artificial Sequence
  chemically synthesized
tggtattttgttatggcaatgc

SEQ ID NO: 1355373 - DNA, 22 bp, Artificial Sequence
  chemically synthesized
tgttatggcaatgctagcaaaa

SEQ ID NO: 1355374 - DNA, 22 bp, Artificial Sequence
  chemically synthesized
gttatggcaatgctagcaaaat

SEQ ID NO: 1355375 - DNA, 22 bp, Artificial Sequence
  chemically synthesized
ttatggcaatgctagcaaaata

SEQ ID NO: 1355376 - DNA, 22 bp, Artificial Sequence
  chemically synthesized
tggcaatgctagcaaaataata

SEQ ID NO: 1355377 - DNA, 22 bp, Artificial Sequence
  chemically synthesized
caaatgaataaggaatgtatta

SEQ ID NO: 1355378 - DNA, 22 bp, Artificial Sequence
  chemically synthesized
gcaaaataatacattccttatt

SEQ ID NO: 1355379 - DNA, 22 bp, Artificial Sequence
  chemically synthesized
aaatataaaacattacaaatga

SEQ ID NO: 1355380 - DNA, 22 bp, Artificial Sequence
  chemically synthesized
aattcaaatataaaacattaca

SEQ ID NO: 1355381 - DNA, 22 bp, Artificial Sequence
  chemically synthesized
cttattcatttgtaatgtttta

SEQ ID NO: 1355382 - DNA, 22 bp, Artificial Sequence
  chemically synthesized
attcatttgtaatgttttatat

SEQ ID NO: 1355383 - DNA, 22 bp, Artificial Sequence
  chemically synthesized
ttcatttgtaatgttttatatt

SEQ ID NO: 1355384 - DNA, 22 bp, Artificial Sequence
  chemically synthesized
atttgtaatgttttatatttga

SEQ ID NO: 1355385 - DNA, 22 bp, Artificial Sequence
  chemically synthesized
gtaatgttttatatttgaattc

SEQ ID NO: 1355386 - DNA, 22 bp, Artificial Sequence
  chemically synthesized
taatgttttatatttgaattca

SEQ ID NO: 1355387 - DNA, 22 bp, Artificial Sequence
  chemically synthesized
tatatttgaattcagatcattc

SEQ ID NO: 1355388 - DNA, 22 bp, Artificial Sequence
  chemically synthesized
atatttgaattcagatcattct

SEQ ID NO: 1355389 - DNA, 22 bp, Artificial Sequence
  chemically synthesized
tatttgaattcagatcattctc

SEQ ID NO: 1355390 - DNA, 22 bp, Artificial Sequence
  chemically synthesized
gaattcagatcattctcattct

SEQ ID NO: 1355391 - DNA, 22 bp, Artificial Sequence
  chemically synthesized
aattcagatcattctcattctc

SEQ ID NO: 1355392 - DNA, 22 bp, Artificial Sequence
  chemically synthesized
agatcattctcattctcccctt

SEQ ID NO: 1355393 - DNA, 22 bp, Artificial Sequence
  chemically synthesized
tatatatatacaaaggggagaa

SEQ ID NO: 1355394 - DNA, 22 bp, Artificial Sequence
  chemically synthesized
tcattctcccctttgtatatat

SEQ ID NO: 1355395 - DNA, 22 bp, Artificial Sequence
  chemically synthesized
attctcccctttgtatatatat

SEQ ID NO: 1355396 - DNA, 22 bp, Artificial Sequence
  chemically synthesized
tcccctttgtatatatatatag

SEQ ID NO: 1355397 - DNA, 22 bp, Artificial Sequence
  chemically synthesized
ccctttgtatatatatatagat

SEQ ID NO: 1355398 - DNA, 22 bp, Artificial Sequence
  chemically synthesized
tgtatatatatatagatatata

SEQ ID NO: 1355399 - DNA, 22 bp, Artificial Sequence
  chemically synthesized
gtatatatatatagatatatat

SEQ ID NO: 1355400 - DNA, 22 bp, Artificial Sequence
  chemically synthesized
gcagcaagaaggatatatatct

SEQ ID NO: 1355401 - DNA, 22 bp, Artificial Sequence
  chemically synthesized
tatatatatatagatatatatc

SEQ ID NO: 1355402 - DNA, 22 bp, Artificial Sequence
  chemically synthesized
tagcagcaagaaggatatatat

SEQ ID NO: 1355403 - DNA, 22 bp, Artificial Sequence
  chemically synthesized
ttctagcagcaagaaggatata

SEQ ID NO: 1355404 - DNA, 22 bp, Artificial Sequence
  chemically synthesized
ttgttctagcagcaagaaggat

SEQ ID NO: 1355405 - DNA, 22 bp, Artificial Sequence
  chemically synthesized
ttattgttctagcagcaagaag

SEQ ID NO: 1355406 - DNA, 22 bp, Artificial Sequence
  chemically synthesized
gttattgttctagcagcaagaa

SEQ ID NO: 1355407 - DNA, 22 bp, Artificial Sequence
  chemically synthesized
tgttattgttctagcagcaaga

SEQ ID NO: 1355408 - DNA, 22 bp, Artificial Sequence
  chemically synthesized
ttgttattgttctagcagcaag

SEQ ID NO: 1355409 - DNA, 22 bp, Artificial Sequence
  chemically synthesized
tttgttattgttctagcagcaa

SEQ ID NO: 1355410 - DNA, 22 bp, Artificial Sequence
  chemically synthesized
atcatctttttgttattgttct

SEQ ID NO: 1355411 - DNA, 22 bp, Artificial Sequence
  chemically synthesized
cttgctgctagaacaataacaa

SEQ ID NO: 1355412 - DNA, 22 bp, Artificial Sequence
  chemically synthesized
ttgctgctagaacaataacaaa

SEQ ID NO: 1355413 - DNA, 22 bp, Artificial Sequence
  chemically synthesized
gctgctagaacaataacaaaaa

SEQ ID NO: 1355414 - DNA, 22 bp, Artificial Sequence
  chemically synthesized
cagttaatcatctttttgttat

SEQ ID NO: 1355415 - DNA, 22 bp, Artificial Sequence
  chemically synthesized
ctgctagaacaataacaaaaag

SEQ ID NO: 1355416 - DNA, 22 bp, Artificial Sequence
  chemically synthesized
acagttaatcatctttttgtta

SEQ ID NO: 1355417 - DNA, 22 bp, Artificial Sequence
  chemically synthesized
ctagaacaataacaaaaagatg

SEQ ID NO: 1355418 - DNA, 22 bp, Artificial Sequence
  chemically synthesized
tgcttacagttaatcatctttt

SEQ ID NO: 1355419 - DNA, 22 bp, Artificial Sequence
  chemically synthesized
gaacaataacaaaaagatgatt

SEQ ID NO: 1355420 - DNA, 22 bp, Artificial Sequence
  chemically synthesized
taacactatgcttacagttaat

SEQ ID NO: 1355421 - DNA, 22 bp, Artificial Sequence
  chemically synthesized
attgtaacactatgcttacagt

SEQ ID NO: 1355422 - DNA, 22 bp, Artificial Sequence
  chemically synthesized
actgtaagcatagtgttacaat

SEQ ID NO: 1355423 - DNA, 22 bp, Artificial Sequence
  chemically synthesized
taagcatagtgttacaatgaac

SEQ ID NO: 1355424 - DNA, 22 bp, Artificial Sequence
  chemically synthesized
agggcatgtgagcaacagagtt

SEQ ID NO: 1355425 - DNA, 22 bp, Artificial Sequence
  chemically synthesized
caatgaactctgttgctcacat

SEQ ID NO: 1355426 - DNA, 22 bp, Artificial Sequence
  chemically synthesized
tgttgctcacatgcccttagat

SEQ ID NO: 1355427 - DNA, 22 bp, Artificial Sequence
  chemically synthesized
ttgctcacatgcccttagatat

SEQ ID NO: 1355428 - DNA, 22 bp, Artificial Sequence
  chemically synthesized
aataaacaaatacatatctaag

SEQ ID NO: 1355429 - DNA, 22 bp, Artificial Sequence
  chemically synthesized
gaataaacaaatacatatctaa

SEQ ID NO: 1355430 - DNA, 22 bp, Artificial Sequence
  chemically synthesized
ctcacatgcccttagatatgta

SEQ ID NO: 1355431 - DNA, 22 bp, Artificial Sequence
  chemically synthesized
tgaataaacaaatacatatcta

SEQ ID NO: 1355432 - DNA, 22 bp, Artificial Sequence
  chemically synthesized
ttgaataaacaaatacatatct

SEQ ID NO: 1355433 - DNA, 22 bp, Artificial Sequence
  chemically synthesized
tttgaataaacaaatacatatc

SEQ ID NO: 1355434 - DNA, 22 bp, Artificial Sequence
  chemically synthesized
acatgcccttagatatgtattt

SEQ ID NO: 1355435 - DNA, 22 bp, Artificial Sequence
  chemically synthesized
ttttgaataaacaaatacatat

SEQ ID NO: 1355436 - DNA, 22 bp, Artificial Sequence
  chemically synthesized
tttttgaataaacaaatacata

SEQ ID NO: 1355437 - DNA, 22 bp, Artificial Sequence
  chemically synthesized
atgctttttttgaataaacaaa

SEQ ID NO: 1355438 - DNA, 22 bp, Artificial Sequence
  chemically synthesized
agatatgtatttgtttattcaa

SEQ ID NO: 1355439 - DNA, 22 bp, Artificial Sequence
  chemically synthesized
gatatgtatttgtttattcaaa

SEQ ID NO: 1355440 - DNA, 22 bp, Artificial Sequence
  chemically synthesized
gttaatgctttttttgaataaa

SEQ ID NO: 1355441 - DNA, 22 bp, Artificial Sequence
  chemically synthesized
ggttaatgctttttttgaataa

SEQ ID NO: 1355442 - DNA, 22 bp, Artificial Sequence
  chemically synthesized
tttggttaatgctttttttgaa

SEQ ID NO: 1355443 - DNA, 22 bp, Artificial Sequence
  chemically synthesized
gtttattcaaaaaaagcattaa

SEQ ID NO: 1355444 - DNA, 22 bp, Artificial Sequence
  chemically synthesized
tttattcaaaaaaagcattaac

SEQ ID NO: 1355445 - DNA, 22 bp, Artificial Sequence
  chemically synthesized
attcaaaaaaagcattaaccaa

SEQ ID NO: 1355446 - DNA, 22 bp, Artificial Sequence
  chemically synthesized
ttcaaaaaaagcattaaccaaa

SEQ ID NO: 1355447 - DNA, 22 bp, Artificial Sequence
  chemically synthesized
atatataaagttatttggttaa

SEQ ID NO: 1355448 - DNA, 22 bp, Artificial Sequence
  chemically synthesized
aatatataaagttatttggtta

SEQ ID NO: 1355449 - DNA, 22 bp, Artificial Sequence
  chemically synthesized
aaaaaaagcattaaccaaataa

SEQ ID NO: 1355450 - DNA, 22 bp, Artificial Sequence
  chemically synthesized
accaaataactttatatattaa

SEQ ID NO: 1355451 - DNA, 22 bp, Artificial Sequence
  chemically synthesized
gagatgagcataaggcttaata

SEQ ID NO: 1355452 - DNA, 22 bp, Artificial Sequence
  chemically synthesized
tatatattaagccttatgctca

SEQ ID NO: 1355453 - DNA, 22 bp, Artificial Sequence
  chemically synthesized
atatattaagccttatgctcat

SEQ ID NO: 1355454 - DNA, 22 bp, Artificial Sequence
  chemically synthesized
tatattaagccttatgctcatc

SEQ ID NO: 1355455 - DNA, 22 bp, Artificial Sequence
  chemically synthesized
ccccatacctagagatgagcat

SEQ ID NO: 1355456 - DNA, 22 bp, Artificial Sequence
  chemically synthesized
tcccccatacctagagatgagc

SEQ ID NO: 1355457 - DNA, 22 bp, Artificial Sequence
  chemically synthesized
agccttatgctcatctctaggt

SEQ ID NO: 1355458 - DNA, 22 bp, Artificial Sequence
  chemically synthesized
ccacctctcccccatacctaga

SEQ ID NO: 1355459 - DNA, 22 bp, Artificial Sequence
  chemically synthesized
cccacctctcccccatacctag

SEQ ID NO: 1355460 - DNA, 22 bp, Artificial Sequence
  chemically synthesized
atgctcatctctaggtatgggg

SEQ ID NO: 1355461 - DNA, 22 bp, Artificial Sequence
  chemically synthesized
tgctcatctctaggtatggggg

SEQ ID NO: 1355462 - DNA, 22 bp, Artificial Sequence
  chemically synthesized
atctctaggtatgggggagagg

SEQ ID NO: 1355463 - DNA, 22 bp, Artificial Sequence
  chemically synthesized
tcatcatgtttcccacctctcc

SEQ ID NO: 1355464 - DNA, 22 bp, Artificial Sequence
  chemically synthesized
atcatcatgtttcccacctctc

SEQ ID NO: 1355465 - DNA, 22 bp, Artificial Sequence
  chemically synthesized
taggtatgggggagaggtggga

SEQ ID NO: 1355466 - DNA, 22 bp, Artificial Sequence
  chemically synthesized
tatcatcatgtttcccacctct

SEQ ID NO: 1355467 - DNA, 22 bp, Artificial Sequence
  chemically synthesized
ggtatgggggagaggtgggaaa

SEQ ID NO: 1355468 - DNA, 22 bp, Artificial Sequence
  chemically synthesized
ttttatcatcatgtttcccacc

SEQ ID NO: 1355469 - DNA, 22 bp, Artificial Sequence
  chemically synthesized
ttattttatcatcatgtttccc

SEQ ID NO: 1355470 - DNA, 22 bp, Artificial Sequence
  chemically synthesized
cacggatactgttattttatca

SEQ ID NO: 1355471 - DNA, 22 bp, Artificial Sequence
  chemically synthesized
tcagtgttacacggatactgtt

SEQ ID NO: 1355472 - DNA, 22 bp, Artificial Sequence
  chemically synthesized
atcagtgttacacggatactgt

SEQ ID NO: 1355473 - DNA, 22 bp, Artificial Sequence
  chemically synthesized
gcatgtttatcagtgttacacg

SEQ ID NO: 1355474 - DNA, 22 bp, Artificial Sequence
  chemically synthesized
ggcatgtttatcagtgttacac

SEQ ID NO: 1355475 - DNA, 22 bp, Artificial Sequence
  chemically synthesized
atatgagaatacaaatatcttg

SEQ ID NO: 1355476 - DNA, 22 bp, Artificial Sequence
  chemically synthesized
aatatgagaatacaaatatctt

SEQ ID NO: 1355477 - DNA, 22 bp, Artificial Sequence
  chemically synthesized
ataaacatgccaagatatttgt

SEQ ID NO: 1355478 - DNA, 22 bp, Artificial Sequence
  chemically synthesized
taatatgagaatacaaatatct

SEQ ID NO: 1355479 - DNA, 22 bp, Artificial Sequence
  chemically synthesized
ctttaatatgagaatacaaata

SEQ ID NO: 1355480 - DNA, 22 bp, Artificial Sequence
  chemically synthesized
actttaatatgagaatacaaat

SEQ ID NO: 1355481 - DNA, 22 bp, Artificial Sequence
  chemically synthesized
tttactttaatatgagaataca

SEQ ID NO: 1355482 - DNA, 22 bp, Artificial Sequence
  chemically synthesized
atttactttaatatgagaatac

SEQ ID NO: 1355483 - DNA, 22 bp, Artificial Sequence
  chemically synthesized
tcaatttatttactttaatatg

SEQ ID NO: 1355484 - DNA, 22 bp, Artificial Sequence
  chemically synthesized
gtcaatttatttactttaatat

SEQ ID NO: 1355485 - DNA, 22 bp, Artificial Sequence
  chemically synthesized
tgtcaatttatttactttaata

SEQ ID NO: 1355486 - DNA, 22 bp, Artificial Sequence
  chemically synthesized
gtattctcatattaaagtaaat

SEQ ID NO: 1355487 - DNA, 22 bp, Artificial Sequence
  chemically synthesized
tattctcatattaaagtaaata

SEQ ID NO: 1355488 - DNA, 22 bp, Artificial Sequence
  chemically synthesized
tcatattaaagtaaataaattg

SEQ ID NO: 1355489 - DNA, 22 bp, Artificial Sequence
  chemically synthesized
accatattttgtcaatttattt

SEQ ID NO: 1355490 - DNA, 22 bp, Artificial Sequence
  chemically synthesized
caccatattttgtcaatttatt

SEQ ID NO: 1355491 - DNA, 22 bp, Artificial Sequence
  chemically synthesized
atattaaagtaaataaattgac

SEQ ID NO: 1355492 - DNA, 22 bp, Artificial Sequence
  chemically synthesized
tcaccatattttgtcaatttat

SEQ ID NO: 1355493 - DNA, 22 bp, Artificial Sequence
  chemically synthesized
aagtaaataaattgacaaaata

SEQ ID NO: 1355494 - DNA, 22 bp, Artificial Sequence
  chemically synthesized
acaaaatatggtgaaagatatt

SEQ ID NO: 1355495 - DNA, 22 bp, Artificial Sequence
  chemically synthesized
atcaaaatgcacaatatctttc

SEQ ID NO: 1355496 - DNA, 22 bp, Artificial Sequence
  chemically synthesized
atagcataagttcatcaaaatg

SEQ ID NO: 1355497 - DNA, 22 bp, Artificial Sequence
  chemically synthesized
tcatagcataagttcatcaaaa

SEQ ID NO: 1355498 - DNA, 22 bp, Artificial Sequence
  chemically synthesized
tgcattttgatgaacttatgct

SEQ ID NO: 1355499 - DNA, 22 bp, Artificial Sequence
  chemically synthesized
aagtgttctcatagcataagtt

SEQ ID NO: 1355500 - DNA, 22 bp, Artificial Sequence
  chemically synthesized
aaagtgttctcatagcataagt

SEQ ID NO: 1355501 - DNA, 22 bp, Artificial Sequence
  chemically synthesized
taaagtgttctcatagcataag

SEQ ID NO: 1355502 - DNA, 22 bp, Artificial Sequence
  chemically synthesized
tgatgaacttatgctatgagaa

SEQ ID NO: 1355503 - DNA, 22 bp, Artificial Sequence
  chemically synthesized
gatgaacttatgctatgagaac

SEQ ID NO: 1355504 - DNA, 22 bp, Artificial Sequence
  chemically synthesized
atgaacttatgctatgagaaca

SEQ ID NO: 1355505 - DNA, 22 bp, Artificial Sequence
  chemically synthesized
ggtatggttttaaagtgttctc

SEQ ID NO: 1355506 - DNA, 22 bp, Artificial Sequence
  chemically synthesized
atgctatgagaacactttaaaa

SEQ ID NO: 1355507 - DNA, 22 bp, Artificial Sequence
  chemically synthesized
tgctatgagaacactttaaaac

SEQ ID NO: 1355508 - DNA, 22 bp, Artificial Sequence
  chemically synthesized
tgagaacactttaaaaccatac

SEQ ID NO: 1355509 - DNA, 22 bp, Artificial Sequence
  chemically synthesized
cgccaatggaggttaggtatgg

SEQ ID NO: 1355510 - DNA, 22 bp, Artificial Sequence
  chemically synthesized
actccgccaatggaggttaggt

SEQ ID NO: 1355511 - DNA, 22 bp, Artificial Sequence
  chemically synthesized
taaaaccatacctaacctccat

SEQ ID NO: 1355512 - DNA, 22 bp, Artificial Sequence
  chemically synthesized
aaaaccatacctaacctccatt

SEQ ID NO: 1355513 - DNA, 22 bp, Artificial Sequence
  chemically synthesized
aaaccatacctaacctccattg

SEQ ID NO: 1355514 - DNA, 22 bp, Artificial Sequence
  chemically synthesized
cattgactccgccaatggaggt

SEQ ID NO: 1355515 - DNA, 22 bp, Artificial Sequence
  chemically synthesized
accaatctccattgactccgcc

SEQ ID NO: 1355516 - DNA, 22 bp, Artificial Sequence
  chemically synthesized
tcaccaatctccattgactccg

SEQ ID NO: 1355517 - DNA, 22 bp, Artificial Sequence
  chemically synthesized
acctccattggcggagtcaatg

SEQ ID NO: 1355518 - DNA, 22 bp, Artificial Sequence
  chemically synthesized
cattggcggagtcaatggagat

SEQ ID NO: 1355519 - DNA, 22 bp, Artificial Sequence
  chemically synthesized
acccctctcaccaatctccatt

SEQ ID NO: 1355520 - DNA, 22 bp, Artificial Sequence
  chemically synthesized
ctaacccctctcaccaatctcc

SEQ ID NO: 1355521 - DNA, 22 bp, Artificial Sequence
  chemically synthesized
gcggagtcaatggagattggtg

SEQ ID NO: 1355522 - DNA, 22 bp, Artificial Sequence
  chemically synthesized
cctaacccctctcaccaatctc

SEQ ID NO: 1355523 - DNA, 22 bp, Artificial Sequence
  chemically synthesized
tttcctaacccctctcaccaat

SEQ ID NO: 1355524 - DNA, 22 bp, Artificial Sequence
  chemically synthesized
aggaaaaattatttcctaaccc

SEQ ID NO: 1355525 - DNA, 22 bp, Artificial Sequence
  chemically synthesized
gtgagaggggttaggaaataat

SEQ ID NO: 1355526 - DNA, 22 bp, Artificial Sequence
  chemically synthesized
atctcaggaaaaattatttcct

SEQ ID NO: 1355527 - DNA, 22 bp, Artificial Sequence
  chemically synthesized
catctcaggaaaaattatttcc

SEQ ID NO: 1355528 - DNA, 22 bp, Artificial Sequence
  chemically synthesized
cacttcatctcaggaaaaatta

SEQ ID NO: 1355529 - DNA, 22 bp, Artificial Sequence
  chemically synthesized
ccacttcatctcaggaaaaatt

SEQ ID NO: 1355530 - DNA, 22 bp, Artificial Sequence
  chemically synthesized
gtttccacttcatctcaggaaa

SEQ ID NO: 1355531 - DNA, 22 bp, Artificial Sequence
  chemically synthesized
ggaaataatttttcctgagatg

SEQ ID NO: 1355532 - DNA, 22 bp, Artificial Sequence
  chemically synthesized
aagcctggtttccacttcatct

SEQ ID NO: 1355533 - DNA, 22 bp, Artificial Sequence
  chemically synthesized
attaaagcctggtttccacttc

SEQ ID NO: 1355534 - DNA, 22 bp, Artificial Sequence
  chemically synthesized
ttcctgagatgaagtggaaacc

SEQ ID NO: 1355535 - DNA, 22 bp, Artificial Sequence
  chemically synthesized
tcctgagatgaagtggaaacca

SEQ ID NO: 1355536 - DNA, 22 bp, Artificial Sequence
  chemically synthesized
cctgagatgaagtggaaaccag

SEQ ID NO: 1355537 - DNA, 22 bp, Artificial Sequence
  chemically synthesized
attaattaaagcctggtttcca

SEQ ID NO: 1355538 - DNA, 22 bp, Artificial Sequence
  chemically synthesized
ctgagatgaagtggaaaccagg

SEQ ID NO: 1355539 - DNA, 22 bp, Artificial Sequence
  chemically synthesized
aattaattaaagcctggtttcc

SEQ ID NO: 1355540 - DNA, 22 bp, Artificial Sequence
  chemically synthesized
agatgaagtggaaaccaggctt

SEQ ID NO: 1355541 - DNA, 22 bp, Artificial Sequence
  chemically synthesized
ccaatcacttaattaattaaag

SEQ ID NO: 1355542 - DNA, 22 bp, Artificial Sequence
  chemically synthesized
accaatcacttaattaattaaa

SEQ ID NO: 1355543 - DNA, 22 bp, Artificial Sequence
  chemically synthesized
cttaccaatcacttaattaatt

SEQ ID NO: 1355544 - DNA, 22 bp, Artificial Sequence
  chemically synthesized
tccttaccaatcacttaattaa

SEQ ID NO: 1355545 - DNA, 22 bp, Artificial Sequence
  chemically synthesized
ctccttaccaatcacttaatta

SEQ ID NO: 1355546 - DNA, 22 bp, Artificial Sequence
  chemically synthesized
cttctccttaccaatcacttaa

SEQ ID NO: 1355547 - DNA, 22 bp, Artificial Sequence
  chemically synthesized
taattaattaagtgattggtaa

SEQ ID NO: 1355548 - DNA, 22 bp, Artificial Sequence
  chemically synthesized
ccctccttctccttaccaatca

SEQ ID NO: 1355549 - DNA, 22 bp, Artificial Sequence
  chemically synthesized
aattaattaagtgattggtaag

SEQ ID NO: 1355550 - DNA, 22 bp, Artificial Sequence
  chemically synthesized
attaattaagtgattggtaagg

SEQ ID NO: 1355551 - DNA, 22 bp, Artificial Sequence
  chemically synthesized
attaagtgattggtaaggagaa

SEQ ID NO: 1355552 - DNA, 22 bp, Artificial Sequence
  chemically synthesized
aaattaccctccttctccttac

SEQ ID NO: 1355553 - DNA, 22 bp, Artificial Sequence
  chemically synthesized
ctgaaattaccctccttctcct

SEQ ID NO: 1355554 - DNA, 22 bp, Artificial Sequence
  chemically synthesized
agtgattggtaaggagaaggag

SEQ ID NO: 1355555 - DNA, 22 bp, Artificial Sequence
  chemically synthesized
cctgaaattaccctccttctcc

SEQ ID NO: 1355556 - DNA, 22 bp, Artificial Sequence
  chemically synthesized
gtaaggagaaggagggtaattt

SEQ ID NO: 1355557 - DNA, 22 bp, Artificial Sequence
  chemically synthesized
tcagggataagtcttcctgaaa

SEQ ID NO: 1355558 - DNA, 22 bp, Artificial Sequence
  chemically synthesized
gtgttgtcagggataagtcttc

SEQ ID NO: 1355559 - DNA, 22 bp, Artificial Sequence
  chemically synthesized
cgtgttgtcagggataagtctt

SEQ ID NO: 1355560 - DNA, 22 bp, Artificial Sequence
  chemically synthesized
tcgtgttgtcagggataagtct

SEQ ID NO: 1355561 - DNA, 22 bp, Artificial Sequence
  chemically synthesized
caggaagacttatccctgacaa

SEQ ID NO: 1355562 - DNA, 22 bp, Artificial Sequence
  chemically synthesized
aggaagacttatccctgacaac

SEQ ID NO: 1355563 - DNA, 22 bp, Artificial Sequence
  chemically synthesized
ccatgctttcgtgttgtcaggg

SEQ ID NO: 1355564 - DNA, 22 bp, Artificial Sequence
  chemically synthesized
atccctgacaacacgaaagcat

SEQ ID NO: 1355565 - DNA, 22 bp, Artificial Sequence
  chemically synthesized
tccctgacaacacgaaagcatg

SEQ ID NO: 1355566 - DNA, 22 bp, Artificial Sequence
  chemically synthesized
acaacacgaaagcatggtagtt

SEQ ID NO: 1355567 - DNA, 22 bp, Artificial Sequence
  chemically synthesized
tgtgcgggcccccaaactacca

SEQ ID NO: 1355568 - DNA, 22 bp, Artificial Sequence
  chemically synthesized
ctatgtgcgggcccccaaacta

SEQ ID NO: 1355569 - DNA, 22 bp, Artificial Sequence
  chemically synthesized
gccaaaggctcctatgtgcggg

SEQ ID NO: 1355570 - DNA, 22 bp, Artificial Sequence
  chemically synthesized
agccaaaggctcctatgtgcgg

SEQ ID NO: 1355571 - DNA, 22 bp, Artificial Sequence
  chemically synthesized
tagccaaaggctcctatgtgcg

SEQ ID NO: 1355572 - DNA, 22 bp, Artificial Sequence
  chemically synthesized
gggggcccgcacataggagcct

SEQ ID NO: 1355573 - DNA, 22 bp, Artificial Sequence
  chemically synthesized
ggggcccgcacataggagcctt

SEQ ID NO: 1355574 - DNA, 22 bp, Artificial Sequence
  chemically synthesized
accctttagccaaaggctccta

SEQ ID NO: 1355575 - DNA, 22 bp, Artificial Sequence
  chemically synthesized
ctaaccctttagccaaaggctc

SEQ ID NO: 1355576 - DNA, 22 bp, Artificial Sequence
  chemically synthesized
ctcctaaccctttagccaaagg

SEQ ID NO: 1355577 - DNA, 22 bp, Artificial Sequence
  chemically synthesized
actcctaaccctttagccaaag

SEQ ID NO: 1355578 - DNA, 22 bp, Artificial Sequence
  chemically synthesized
ttactcctaaccctttagccaa

SEQ ID NO: 1355579 - DNA, 22 bp, Artificial Sequence
  chemically synthesized
atctcttactcctaacccttta

SEQ ID NO: 1355580 - DNA, 22 bp, Artificial Sequence
  chemically synthesized
ctcatctcttactcctaaccct

SEQ ID NO: 1355581 - DNA, 22 bp, Artificial Sequence
  chemically synthesized
tcctcatctcttactcctaacc

SEQ ID NO: 1355582 - DNA, 22 bp, Artificial Sequence
  chemically synthesized
ctcctcatctcttactcctaac

SEQ ID NO: 1355583 - DNA, 22 bp, Artificial Sequence
  chemically synthesized
tggctaaagggttaggagtaag

SEQ ID NO: 1355584 - DNA, 22 bp, Artificial Sequence
  chemically synthesized
ggctaaagggttaggagtaaga

SEQ ID NO: 1355585 - DNA, 22 bp, Artificial Sequence
  chemically synthesized
gctaaagggttaggagtaagag

SEQ ID NO: 1355586 - DNA, 22 bp, Artificial Sequence
  chemically synthesized
cccttctcctcatctcttactc

SEQ ID NO: 1355587 - DNA, 22 bp, Artificial Sequence
  chemically synthesized
aagggttaggagtaagagatga

SEQ ID NO: 1355588 - DNA, 22 bp, Artificial Sequence
  chemically synthesized
ctacccttctcctcatctctta

SEQ ID NO: 1355589 - DNA, 22 bp, Artificial Sequence
  chemically synthesized
tcctacccttctcctcatctct

SEQ ID NO: 1355590 - DNA, 22 bp, Artificial Sequence
  chemically synthesized
ctctcctacccttctcctcatc

SEQ ID NO: 1355591 - DNA, 22 bp, Artificial Sequence
  chemically synthesized
ggagtaagagatgaggagaagg

SEQ ID NO: 1355592 - DNA, 22 bp, Artificial Sequence
  chemically synthesized
cctcctctcctacccttctcct

SEQ ID NO: 1355593 - DNA, 22 bp, Artificial Sequence
  chemically synthesized
ctacctcctctcctacccttct

SEQ ID NO: 1355594 - DNA, 22 bp, Artificial Sequence
  chemically synthesized
ctgctacctcctctcctaccct

SEQ ID NO: 1355595 - DNA, 22 bp, Artificial Sequence
  chemically synthesized
ttgctgctacctcctctcctac

SEQ ID NO: 1355596 - DNA, 22 bp, Artificial Sequence
  chemically synthesized
attgctgctacctcctctccta

SEQ ID NO: 1355597 - DNA, 22 bp, Artificial Sequence
  chemically synthesized
tcaggacccagcttattgctgc

SEQ ID NO: 1355598 - DNA, 22 bp, Artificial Sequence
  chemically synthesized
cgtgatgtatgtaaggtcatgt

SEQ ID NO: 1355599 - DNA, 22 bp, Artificial Sequence
  chemically synthesized
ggtcctgataacatgaccttac

SEQ ID NO: 1355600 - DNA, 22 bp, Artificial Sequence
  chemically synthesized
ataacatgaccttacatacatc

SEQ ID NO: 1355601 - DNA, 22 bp, Artificial Sequence
  chemically synthesized
atgccaactccgtgatgtatgt

SEQ ID NO: 1355602 - DNA, 22 bp, Artificial Sequence
  chemically synthesized
gagactaatgccaactccgtga

SEQ ID NO: 1355603 - DNA, 22 bp, Artificial Sequence
  chemically synthesized
ctagagactaatgccaactccg

SEQ ID NO: 1355604 - DNA, 22 bp, Artificial Sequence
  chemically synthesized
acatacatcacggagttggcat

SEQ ID NO: 1355605 - DNA, 22 bp, Artificial Sequence
  chemically synthesized
catacatcacggagttggcatt

SEQ ID NO: 1355606 - DNA, 22 bp, Artificial Sequence
  chemically synthesized
ctgctagagactaatgccaact

SEQ ID NO: 1355607 - DNA, 22 bp, Artificial Sequence
  chemically synthesized
cctgctagagactaatgccaac

SEQ ID NO: 1355608 - DNA, 22 bp, Artificial Sequence
  chemically synthesized
tcctgctagagactaatgccaa

SEQ ID NO: 1355609 - DNA, 22 bp, Artificial Sequence
  chemically synthesized
ttcctgctagagactaatgcca

SEQ ID NO: 1355610 - DNA, 22 bp, Artificial Sequence
  chemically synthesized
tttcctgctagagactaatgcc

SEQ ID NO: 1355611 - DNA, 22 bp, Artificial Sequence
  chemically synthesized
gaaaatattttttcctgctaga

SEQ ID NO: 1355612 - DNA, 22 bp, Artificial Sequence
  chemically synthesized
gcattagtctctagcaggaaaa

SEQ ID NO: 1355613 - DNA, 22 bp, Artificial Sequence
  chemically synthesized
aaagttggaaaatattttttcc

SEQ ID NO: 1355614 - DNA, 22 bp, Artificial Sequence
  chemically synthesized
aaaagttggaaaatattttttc

SEQ ID NO: 1355615 - DNA, 22 bp, Artificial Sequence
  chemically synthesized
gtctctagcaggaaaaaatatt

SEQ ID NO: 1355616 - DNA, 22 bp, Artificial Sequence
  chemically synthesized
acttaaaagttggaaaatattt

SEQ ID NO: 1355617 - DNA, 22 bp, Artificial Sequence
  chemically synthesized
aacttaaaagttggaaaatatt

SEQ ID NO: 1355618 - DNA, 22 bp, Artificial Sequence
  chemically synthesized
tagcaggaaaaaatattttcca

SEQ ID NO: 1355619 - DNA, 22 bp, Artificial Sequence
  chemically synthesized
gcaggaaaaaatattttccaac

SEQ ID NO: 1355620 - DNA, 22 bp, Artificial Sequence
  chemically synthesized
gccttaacttaaaagttggaaa

SEQ ID NO: 1355621 - DNA, 22 bp, Artificial Sequence
  chemically synthesized
aaattagccttaacttaaaagt

SEQ ID NO: 1355622 - DNA, 22 bp, Artificial Sequence
  chemically synthesized
aaaattagccttaacttaaaag

SEQ ID NO: 1355623 - DNA, 22 bp, Artificial Sequence
  chemically synthesized
tccaacttttaagttaaggcta

SEQ ID NO: 1355624 - DNA, 22 bp, Artificial Sequence
  chemically synthesized
ccaacttttaagttaaggctaa

SEQ ID NO: 1355625 - DNA, 22 bp, Artificial Sequence
  chemically synthesized
caacttttaagttaaggctaat

SEQ ID NO: 1355626 - DNA, 22 bp, Artificial Sequence
  chemically synthesized
caggtgacaagtttaaaattag

SEQ ID NO: 1355627 - DNA, 22 bp, Artificial Sequence
  chemically synthesized
ttaagttaaggctaattttaaa

SEQ ID NO: 1355628 - DNA, 22 bp, Artificial Sequence
  chemically synthesized
taagttaaggctaattttaaac

SEQ ID NO: 1355629 - DNA, 22 bp, Artificial Sequence
  chemically synthesized
aagttaaggctaattttaaact

SEQ ID NO: 1355630 - DNA, 22 bp, Artificial Sequence
  chemically synthesized
ctacaggtgacaagtttaaaat

SEQ ID NO: 1355631 - DNA, 22 bp, Artificial Sequence
  chemically synthesized
agttaaggctaattttaaactt

SEQ ID NO: 1355632 - DNA, 22 bp, Artificial Sequence
  chemically synthesized
aggctaattttaaacttgtcac

SEQ ID NO: 1355633 - DNA, 22 bp, Artificial Sequence
  chemically synthesized
aagagattactacaggtgacaa

SEQ ID NO: 1355634 - DNA, 22 bp, Artificial Sequence
  chemically synthesized
aaagagattactacaggtgaca

SEQ ID NO: 1355635 - DNA, 22 bp, Artificial Sequence
  chemically synthesized
attttaaacttgtcacctgtag

SEQ ID NO: 1355636 - DNA, 22 bp, Artificial Sequence
  chemically synthesized
atttaaagagattactacaggt

SEQ ID NO: 1355637 - DNA, 22 bp, Artificial Sequence
  chemically synthesized
taaacttgtcacctgtagtaat

SEQ ID NO: 1355638 - DNA, 22 bp, Artificial Sequence
  chemically synthesized
aaacttgtcacctgtagtaatc

SEQ ID NO: 1355639 - DNA, 22 bp, Artificial Sequence
  chemically synthesized
aacttgtcacctgtagtaatct

SEQ ID NO: 1355640 - DNA, 22 bp, Artificial Sequence
  chemically synthesized
attcatttaaagagattactac

SEQ ID NO: 1355641 - DNA, 22 bp, Artificial Sequence
  chemically synthesized
cattcatttaaagagattacta

SEQ ID NO: 1355642 - DNA, 22 bp, Artificial Sequence
  chemically synthesized
gtcacctgtagtaatctcttta

SEQ ID NO: 1355643 - DNA, 22 bp, Artificial Sequence
  chemically synthesized
tcacctgtagtaatctctttaa

SEQ ID NO: 1355644 - DNA, 22 bp, Artificial Sequence
  chemically synthesized
tagtaatctctttaaatgaatg

SEQ ID NO: 1355645 - DNA, 22 bp, Artificial Sequence
  chemically synthesized
taaatgaagacagggaaatttc

SEQ ID NO: 1355646 - DNA, 22 bp, Artificial Sequence
  chemically synthesized
tttaaatgaatgaaatttccct

SEQ ID NO: 1355647 - DNA, 22 bp, Artificial Sequence
  chemically synthesized
taaatgaatgaaatttccctgt

SEQ ID NO: 1355648 - DNA, 22 bp, Artificial Sequence
  chemically synthesized
ctataaatgaagacagggaaat

SEQ ID NO: 1355649 - DNA, 22 bp, Artificial Sequence
  chemically synthesized
aaatgaatgaaatttccctgtc

SEQ ID NO: 1355650 - DNA, 22 bp, Artificial Sequence
  chemically synthesized
aatgaatgaaatttccctgtct

SEQ ID NO: 1355651 - DNA, 22 bp, Artificial Sequence
  chemically synthesized
attactataaatgaagacaggg

SEQ ID NO: 1355652 - DNA, 22 bp, Artificial Sequence
  chemically synthesized
ccctgtcttcatttatagtaat

SEQ ID NO: 1355653 - DNA, 22 bp, Artificial Sequence
  chemically synthesized
cctgtcttcatttatagtaatc

SEQ ID NO: 1355654 - DNA, 22 bp, Artificial Sequence
  chemically synthesized
cagtgaaagatgctgattacta

SEQ ID NO: 1355655 - DNA, 22 bp, Artificial Sequence
  chemically synthesized
gcagtgaaagatgctgattact

SEQ ID NO: 1355656 - DNA, 22 bp, Artificial Sequence
  chemically synthesized
tcttcatttatagtaatcagca

SEQ ID NO: 1355657 - DNA, 22 bp, Artificial Sequence
  chemically synthesized
cttgcagtgaaagatgctgatt

SEQ ID NO: 1355658 - DNA, 22 bp, Artificial Sequence
  chemically synthesized
ccttgcagtgaaagatgctgat

SEQ ID NO: 1355659 - DNA, 22 bp, Artificial Sequence
  chemically synthesized
catttatagtaatcagcatctt

SEQ ID NO: 1355660 - DNA, 22 bp, Artificial Sequence
  chemically synthesized
atttatagtaatcagcatcttt

SEQ ID NO: 1355661 - DNA, 22 bp, Artificial Sequence
  chemically synthesized
atagtaatcagcatctttcact

SEQ ID NO: 1355662 - DNA, 22 bp, Artificial Sequence
  chemically synthesized
tagtaatcagcatctttcactg

SEQ ID NO: 1355663 - DNA, 22 bp, Artificial Sequence
  chemically synthesized
gaaatttccttgcagtgaaaga

SEQ ID NO: 1355664 - DNA, 22 bp, Artificial Sequence
  chemically synthesized
agaaatttccttgcagtgaaag

SEQ ID NO: 1355665 - DNA, 22 bp, Artificial Sequence
  chemically synthesized
acttagaaatttccttgcagtg

SEQ ID NO: 1355666 - DNA, 22 bp, Artificial Sequence
  chemically synthesized
tcactgcaaggaaatttctaag

SEQ ID NO: 1355667 - DNA, 22 bp, Artificial Sequence
  chemically synthesized
cactgcaaggaaatttctaagt

SEQ ID NO: 1355668 - DNA, 22 bp, Artificial Sequence
  chemically synthesized
actgcaaggaaatttctaagtg

SEQ ID NO: 1355669 - DNA, 22 bp, Artificial Sequence
  chemically synthesized
agtaaaatgtacattcacttag

SEQ ID NO: 1355670 - DNA, 22 bp, Artificial Sequence
  chemically synthesized
caaggaaatttctaagtgaatg

SEQ ID NO: 1355671 - DNA, 22 bp, Artificial Sequence
  chemically synthesized
gaagttgagtaaaatgtacatt

SEQ ID NO: 1355672 - DNA, 22 bp, Artificial Sequence
  chemically synthesized
ctaagtgaatgtacattttact

SEQ ID NO: 1355673 - DNA, 22 bp, Artificial Sequence
  chemically synthesized
taagtgaatgtacattttactc

SEQ ID NO: 1355674 - DNA, 22 bp, Artificial Sequence
  chemically synthesized
agtgaatgtacattttactcaa

SEQ ID NO: 1355675 - DNA, 22 bp, Artificial Sequence
  chemically synthesized
aaggaaattagaagttgagtaa

SEQ ID NO: 1355676 - DNA, 22 bp, Artificial Sequence
  chemically synthesized
ctaaaggaaattagaagttgag

SEQ ID NO: 1355677 - DNA, 22 bp, Artificial Sequence
  chemically synthesized
gattcctaaaggaaattagaag

SEQ ID NO: 1355678 - DNA, 22 bp, Artificial Sequence
  chemically synthesized
agattcctaaaggaaattagaa

SEQ ID NO: 1355679 - DNA, 22 bp, Artificial Sequence
  chemically synthesized
tactcaacttctaatttccttt

SEQ ID NO: 1355680 - DNA, 22 bp, Artificial Sequence
  chemically synthesized
actcaacttctaatttccttta

SEQ ID NO: 1355681 - DNA, 22 bp, Artificial Sequence
  chemically synthesized
ctcaacttctaatttcctttag

SEQ ID NO: 1355682 - DNA, 22 bp, Artificial Sequence
  chemically synthesized
aacttctaatttcctttaggaa

SEQ ID NO: 1355683 - DNA, 22 bp, Artificial Sequence
  chemically synthesized
aatgagtttagattcctaaagg

SEQ ID NO: 1355684 - DNA, 22 bp, Artificial Sequence
  chemically synthesized
ctaatttcctttaggaatctaa

SEQ ID NO: 1355685 - DNA, 22 bp, Artificial Sequence
  chemically synthesized
taatttcctttaggaatctaaa

SEQ ID NO: 1355686 - DNA, 22 bp, Artificial Sequence
  chemically synthesized
atttcctttaggaatctaaact

SEQ ID NO: 1355687 - DNA, 22 bp, Artificial Sequence
  chemically synthesized
tgaaaatattgaatgagtttag

SEQ ID NO: 1355688 - DNA, 22 bp, Artificial Sequence
  chemically synthesized
cctttaggaatctaaactcatt

SEQ ID NO: 1355689 - DNA, 22 bp, Artificial Sequence
  chemically synthesized
gtgaaaatattgaatgagttta

SEQ ID NO: 1355690 - DNA, 22 bp, Artificial Sequence
  chemically synthesized
ctttaggaatctaaactcattc

SEQ ID NO: 1355691 - DNA, 22 bp, Artificial Sequence
  chemically synthesized
tgtgaaaatattgaatgagttt

SEQ ID NO: 1355692 - DNA, 22 bp, Artificial Sequence
  chemically synthesized
taggaatctaaactcattcaat

SEQ ID NO: 1355693 - DNA, 22 bp, Artificial Sequence
  chemically synthesized
aggaatctaaactcattcaata

SEQ ID NO: 1355694 - DNA, 22 bp, Artificial Sequence
  chemically synthesized
ggaatctaaactcattcaatat

SEQ ID NO: 1355695 - DNA, 22 bp, Artificial Sequence
  chemically synthesized
tcattttgtgaaaatattgaat

SEQ ID NO: 1355696 - DNA, 22 bp, Artificial Sequence
  chemically synthesized
cagttatcattttgtgaaaata

SEQ ID NO: 1355697 - DNA, 22 bp, Artificial Sequence
  chemically synthesized
aactcattcaatattttcacaa

SEQ ID NO: 1355698 - DNA, 22 bp, Artificial Sequence
  chemically synthesized
attacagttatcattttgtgaa

SEQ ID NO: 1355699 - DNA, 22 bp, Artificial Sequence
  chemically synthesized
gattacagttatcattttgtga

SEQ ID NO: 1355700 - DNA, 22 bp, Artificial Sequence
  chemically synthesized
attcaatattttcacaaaatga

SEQ ID NO: 1355701 - DNA, 22 bp, Artificial Sequence
  chemically synthesized
ccttgattacagttatcatttt

SEQ ID NO: 1355702 - DNA, 22 bp, Artificial Sequence
  chemically synthesized
aatattttcacaaaatgataac

SEQ ID NO: 1355703 - DNA, 22 bp, Artificial Sequence
  chemically synthesized
tgccttgattacagttatcatt

SEQ ID NO: 1355704 - DNA, 22 bp, Artificial Sequence
  chemically synthesized
tctgccttgattacagttatca

SEQ ID NO: 1355705 - DNA, 22 bp, Artificial Sequence
  chemically synthesized
tcacaaaatgataactgtaatc

SEQ ID NO: 1355706 - DNA, 22 bp, Artificial Sequence
  chemically synthesized
cacaaaatgataactgtaatca

SEQ ID NO: 1355707 - DNA, 22 bp, Artificial Sequence
  chemically synthesized
acaaaatgataactgtaatcaa

SEQ ID NO: 1355708 - DNA, 22 bp, Artificial Sequence
  chemically synthesized
aaataaagctctctgccttgat

SEQ ID NO: 1355709 - DNA, 22 bp, Artificial Sequence
  chemically synthesized
gctgaaataaagctctctgcct

SEQ ID NO: 1355710 - DNA, 22 bp, Artificial Sequence
  chemically synthesized
ttagctgaaataaagctctctg

SEQ ID NO: 1355711 - DNA, 22 bp, Artificial Sequence
  chemically synthesized
gttagctgaaataaagctctct

SEQ ID NO: 1355712 - DNA, 22 bp, Artificial Sequence
  chemically synthesized
tgttagctgaaataaagctctc

SEQ ID NO: 1355713 - DNA, 22 bp, Artificial Sequence
  chemically synthesized
taatcaaggcagagagctttat

SEQ ID NO: 1355714 - DNA, 22 bp, Artificial Sequence
  chemically synthesized
tttgttagctgaaataaagctc

SEQ ID NO: 1355715 - DNA, 22 bp, Artificial Sequence
  chemically synthesized
ttctttgttagctgaaataaag

SEQ ID NO: 1355716 - DNA, 22 bp, Artificial Sequence
  chemically synthesized
tgtagggctattctttgttagc

SEQ ID NO: 1355717 - DNA, 22 bp, Artificial Sequence
  chemically synthesized
gtgtagggctattctttgttag

SEQ ID NO: 1355718 - DNA, 22 bp, Artificial Sequence
  chemically synthesized
tgtgtagggctattctttgtta

SEQ ID NO: 1355719 - DNA, 22 bp, Artificial Sequence
  chemically synthesized
tatttcagctaacaaagaatag

SEQ ID NO: 1355720 - DNA, 22 bp, Artificial Sequence
  chemically synthesized
ctttgtgtagggctattctttg

SEQ ID NO: 1355721 - DNA, 22 bp, Artificial Sequence
  chemically synthesized
atttcagctaacaaagaatagc

SEQ ID NO: 1355722 - DNA, 22 bp, Artificial Sequence
  chemically synthesized
tttcagctaacaaagaatagcc

SEQ ID NO: 1355723 - DNA, 22 bp, Artificial Sequence
  chemically synthesized
cagctaacaaagaatagcccta

SEQ ID NO: 1355724 - DNA, 22 bp, Artificial Sequence
  chemically synthesized
agctaacaaagaatagccctac

SEQ ID NO: 1355725 - DNA, 22 bp, Artificial Sequence
  chemically synthesized
caattcctttgtgtagggctat

SEQ ID NO: 1355726 - DNA, 22 bp, Artificial Sequence
  chemically synthesized
gcaattcctttgtgtagggcta

SEQ ID NO: 1355727 - DNA, 22 bp, Artificial Sequence
  chemically synthesized
acaaagaatagccctacacaaa

SEQ ID NO: 1355728 - DNA, 22 bp, Artificial Sequence
  chemically synthesized
gaatatttgcaattcctttgtg

SEQ ID NO: 1355729 - DNA, 22 bp, Artificial Sequence
  chemically synthesized
agaatatttgcaattcctttgt

SEQ ID NO: 1355730 - DNA, 22 bp, Artificial Sequence
  chemically synthesized
tttagaatatttgcaattcctt

SEQ ID NO: 1355731 - DNA, 22 bp, Artificial Sequence
  chemically synthesized
cacaaaggaattgcaaatattc

SEQ ID NO: 1355732 - DNA, 22 bp, Artificial Sequence
  chemically synthesized
taacagtcattatttagaatat

SEQ ID NO: 1355733 - DNA, 22 bp, Artificial Sequence
  chemically synthesized
caaatattctaaataatgactg

SEQ ID NO: 1355734 - DNA, 22 bp, Artificial Sequence
  chemically synthesized
taaataatgactgttataattt

SEQ ID NO: 1355735 - DNA, 22 bp, Artificial Sequence
  chemically synthesized
aacagagaagataaattataac

SEQ ID NO: 1355736 - DNA, 22 bp, Artificial Sequence
  chemically synthesized
caacagagaagataaattataa

SEQ ID NO: 1355737 - DNA, 22 bp, Artificial Sequence
  chemically synthesized
aataatgactgttataatttat

SEQ ID NO: 1355738 - DNA, 22 bp, Artificial Sequence
  chemically synthesized
ttataatttatcttctctgttg

SEQ ID NO: 1355739 - DNA, 22 bp, Artificial Sequence
  chemically synthesized
taatttatcttctctgttgaag

SEQ ID NO: 1355740 - DNA, 22 bp, Artificial Sequence
  chemically synthesized
atcttctctgttgaaggatact

SEQ ID NO: 1355741 - DNA, 22 bp, Artificial Sequence
  chemically synthesized
tcttctctgttgaaggatacta

SEQ ID NO: 1355742 - DNA, 22 bp, Artificial Sequence
  chemically synthesized
ctctgttgaaggatactacttc

SEQ ID NO: 1355743 - DNA, 22 bp, Artificial Sequence
  chemically synthesized
caaacagaacaggaagtagtat

SEQ ID NO: 1355744 - DNA, 22 bp, Artificial Sequence
  chemically synthesized
tctgttgaaggatactacttcc

SEQ ID NO: 1355745 - DNA, 22 bp, Artificial Sequence
  chemically synthesized
tgttgaaggatactacttcctg

SEQ ID NO: 1355746 - DNA, 22 bp, Artificial Sequence
  chemically synthesized
ttgaaggatactacttcctgtt

SEQ ID NO: 1355747 - DNA, 22 bp, Artificial Sequence
  chemically synthesized
aaggatactacttcctgttctg

SEQ ID NO: 1355748 - DNA, 22 bp, Artificial Sequence
  chemically synthesized
tcatggctacaaacagaacagg

SEQ ID NO: 1355749 - DNA, 22 bp, Artificial Sequence
  chemically synthesized
atcatggctacaaacagaacag

SEQ ID NO: 1355750 - DNA, 22 bp, Artificial Sequence
  chemically synthesized
tttatcatggctacaaacagaa

SEQ ID NO: 1355751 - DNA, 22 bp, Artificial Sequence
  chemically synthesized
gtttatcatggctacaaacaga

SEQ ID NO: 1355752 - DNA, 22 bp, Artificial Sequence
  chemically synthesized
cttcctgttctgtttgtagcca

SEQ ID NO: 1355753 - DNA, 22 bp, Artificial Sequence
  chemically synthesized
cctgttctgtttgtagccatga

SEQ ID NO: 1355754 - DNA, 22 bp, Artificial Sequence
  chemically synthesized
ctgttctgtttgtagccatgat

SEQ ID NO: 1355755 - DNA, 22 bp, Artificial Sequence
  chemically synthesized
ttctgtttgtagccatgataaa

SEQ ID NO: 1355756 - DNA, 22 bp, Artificial Sequence
  chemically synthesized
tgtttgtagccatgataaacaa

SEQ ID NO: 1355757 - DNA, 22 bp, Artificial Sequence
  chemically synthesized
tttgtagccatgataaacaaat

SEQ ID NO: 1355758 - DNA, 22 bp, Artificial Sequence
  chemically synthesized
gtagccatgataaacaaatggt

SEQ ID NO: 1355759 - DNA, 22 bp, Artificial Sequence
  chemically synthesized
tagccatgataaacaaatggta

SEQ ID NO: 1355760 - DNA, 22 bp, Artificial Sequence
  chemically synthesized
taaggatcatgataccatttgt

SEQ ID NO: 1355761 - DNA, 22 bp, Artificial Sequence
  chemically synthesized
gactataaggatcatgatacca

SEQ ID NO: 1355762 - DNA, 22 bp, Artificial Sequence
  chemically synthesized
ctggactataaggatcatgata

SEQ ID NO: 1355763 - DNA, 22 bp, Artificial Sequence
  chemically synthesized
cctggactataaggatcatgat

SEQ ID NO: 1355764 - DNA, 22 bp, Artificial Sequence
  chemically synthesized
cataaaacagtccatttcctgg

SEQ ID NO: 1355765 - DNA, 22 bp, Artificial Sequence
  chemically synthesized
atctacataaaacagtccattt

SEQ ID NO: 1355766 - DNA, 22 bp, Artificial Sequence
  chemically synthesized
catctacataaaacagtccatt

SEQ ID NO: 1355767 - DNA, 22 bp, Artificial Sequence
  chemically synthesized
atagtccaggaaatggactgtt

SEQ ID NO: 1355768 - DNA, 22 bp, Artificial Sequence
  chemically synthesized
tagtccaggaaatggactgttt

SEQ ID NO: 1355769 - DNA, 22 bp, Artificial Sequence
  chemically synthesized
taataataatatttcatctaca

SEQ ID NO: 1355770 - DNA, 22 bp, Artificial Sequence
  chemically synthesized
ataataataatatttcatctac

SEQ ID NO: 1355771 - DNA, 22 bp, Artificial Sequence
  chemically synthesized
tataataataatatttcatcta

SEQ ID NO: 1355772 - DNA, 22 bp, Artificial Sequence
  chemically synthesized
ttttatgtagatgaaatattat

SEQ ID NO: 1355773 - DNA, 22 bp, Artificial Sequence
  chemically synthesized
tatgtagatgaaatattattat

SEQ ID NO: 1355774 - DNA, 22 bp, Artificial Sequence
  chemically synthesized
atgtagatgaaatattattatt

SEQ ID NO: 1355775 - DNA, 22 bp, Artificial Sequence
  chemically synthesized
tgtagatgaaatattattatta

SEQ ID NO: 1355776 - DNA, 22 bp, Artificial Sequence
  chemically synthesized
gaatgtgagacagattttataa

SEQ ID NO: 1355777 - DNA, 22 bp, Artificial Sequence
  chemically synthesized
ggaatgtgagacagattttata

SEQ ID NO: 1355778 - DNA, 22 bp, Artificial Sequence
  chemically synthesized
ggtttggaatgtgagacagatt

SEQ ID NO: 1355779 - DNA, 22 bp, Artificial Sequence
  chemically synthesized
ttattataaaatctgtctcaca

SEQ ID NO: 1355780 - DNA, 22 bp, Artificial Sequence
  chemically synthesized
ggctgggtttggaatgtgagac

SEQ ID NO: 1355781 - DNA, 22 bp, Artificial Sequence
  chemically synthesized
ttataaaatctgtctcacattc

SEQ ID NO: 1355782 - DNA, 22 bp, Artificial Sequence
  chemically synthesized
taaaatctgtctcacattccaa

SEQ ID NO: 1355783 - DNA, 22 bp, Artificial Sequence
  chemically synthesized
tcctaggctgggtttggaatgt

SEQ ID NO: 1355784 - DNA, 22 bp, Artificial Sequence
  chemically synthesized
tctcacattccaaacccagcct

SEQ ID NO: 1355785 - DNA, 22 bp, Artificial Sequence
  chemically synthesized
acattccaaacccagcctagga

SEQ ID NO: 1355786 - DNA, 22 bp, Artificial Sequence
  chemically synthesized
tcataaatcctgtcctaggctg

SEQ ID NO: 1355787 - DNA, 22 bp, Artificial Sequence
  chemically synthesized
caaacccagcctaggacaggat

SEQ ID NO: 1355788 - DNA, 22 bp, Artificial Sequence
  chemically synthesized
ggacaggatttatgataactgc

SEQ ID NO: 1355789 - DNA, 22 bp, Artificial Sequence
  chemically synthesized
atgataactgccccccatctat

SEQ ID NO: 1355790 - DNA, 22 bp, Artificial Sequence
  chemically synthesized
tgataactgccccccatctatg

SEQ ID NO: 1355791 - DNA, 22 bp, Artificial Sequence
  chemically synthesized
ccccccatctatgctggatatc

SEQ ID NO: 1355792 - DNA, 22 bp, Artificial Sequence
  chemically synthesized
tgctggatatcacactatgatg

SEQ ID NO: 1355793 - DNA, 22 bp, Artificial Sequence
  chemically synthesized
gatatcacactatgatgacgtg

SEQ ID NO: 1355794 - DNA, 22 bp, Artificial Sequence
  chemically synthesized
acagaaatacaaatacacacgt

SEQ ID NO: 1355795 - DNA, 22 bp, Artificial Sequence
  chemically synthesized
agctcacagaaatacaaataca

SEQ ID NO: 1355796 - DNA, 22 bp, Artificial Sequence
  chemically synthesized
tgatgacgtgtgtatttgtatt

SEQ ID NO: 1355797 - DNA, 22 bp, Artificial Sequence
  chemically synthesized
tgaattgagctcacagaaatac

SEQ ID NO: 1355798 - DNA, 22 bp, Artificial Sequence
  chemically synthesized
catagttatgaattgagctcac

SEQ ID NO: 1355799 - DNA, 22 bp, Artificial Sequence
  chemically synthesized
gtatttctgtgagctcaattca

SEQ ID NO: 1355800 - DNA, 22 bp, Artificial Sequence
  chemically synthesized
tatttctgtgagctcaattcat

SEQ ID NO: 1355801 - DNA, 22 bp, Artificial Sequence
  chemically synthesized
ctgtgagctcaattcataacta

SEQ ID NO: 1355802 - DNA, 22 bp, Artificial Sequence
  chemically synthesized
aggagagttgcatagttatgaa

SEQ ID NO: 1355803 - DNA, 22 bp, Artificial Sequence
  chemically synthesized
tgtgagctcaattcataactat

SEQ ID NO: 1355804 - DNA, 22 bp, Artificial Sequence
  chemically synthesized
caggagagttgcatagttatga

SEQ ID NO: 1355805 - DNA, 22 bp, Artificial Sequence
  chemically synthesized
tgagctcaattcataactatgc

SEQ ID NO: 1355806 - DNA, 22 bp, Artificial Sequence
  chemically synthesized
tgcttcaggagagttgcatagt

SEQ ID NO: 1355807 - DNA, 22 bp, Artificial Sequence
  chemically synthesized
atgcttcaggagagttgcatag

SEQ ID NO: 1355808 - DNA, 22 bp, Artificial Sequence
  chemically synthesized
aattcataactatgcaactctc

SEQ ID NO: 1355809 - DNA, 22 bp, Artificial Sequence
  chemically synthesized
ataactatgcaactctcctgaa

SEQ ID NO: 1355810 - DNA, 22 bp, Artificial Sequence
  chemically synthesized
atgtagccaagtttatgcttca

SEQ ID NO: 1355811 - DNA, 22 bp, Artificial Sequence
  chemically synthesized
tgcaactctcctgaagcataaa

SEQ ID NO: 1355812 - DNA, 22 bp, Artificial Sequence
  chemically synthesized
gatgtagccaagtttatgcttc

SEQ ID NO: 1355813 - DNA, 22 bp, Artificial Sequence
  chemically synthesized
tgatgtagccaagtttatgctt

SEQ ID NO: 1355814 - DNA, 22 bp, Artificial Sequence
  chemically synthesized
tcctgaagcataaacttggcta

SEQ ID NO: 1355815 - DNA, 22 bp, Artificial Sequence
  chemically synthesized
gccattttgatgtagccaagtt

SEQ ID NO: 1355816 - DNA, 22 bp, Artificial Sequence
  chemically synthesized
agccattttgatgtagccaagt

SEQ ID NO: 1355817 - DNA, 22 bp, Artificial Sequence
  chemically synthesized
ctgaagcataaacttggctaca

SEQ ID NO: 1355818 - DNA, 22 bp, Artificial Sequence
  chemically synthesized
aagcataaacttggctacatca

SEQ ID NO: 1355819 - DNA, 22 bp, Artificial Sequence
  chemically synthesized
gaccaaatatttagccattttg

SEQ ID NO: 1355820 - DNA, 22 bp, Artificial Sequence
  chemically synthesized
ggctacatcaaaatggctaaat

SEQ ID NO: 1355821 - DNA, 22 bp, Artificial Sequence
  chemically synthesized
gctacatcaaaatggctaaata

SEQ ID NO: 1355822 - DNA, 22 bp, Artificial Sequence
  chemically synthesized
catcaaaatggctaaatatttg

SEQ ID NO: 1355823 - DNA, 22 bp, Artificial Sequence
  chemically synthesized
aagaaaaacattagaccaaata

SEQ ID NO: 1355824 - DNA, 22 bp, Artificial Sequence
  chemically synthesized
aaagaaaaacattagaccaaat

SEQ ID NO: 1355825 - DNA, 22 bp, Artificial Sequence
  chemically synthesized
agtttaaagaaaaacattagac

SEQ ID NO: 1355826 - DNA, 22 bp, Artificial Sequence
  chemically synthesized
aagtttaaagaaaaacattaga

SEQ ID NO: 1355827 - DNA, 22 bp, Artificial Sequence
  chemically synthesized
aatatttggtctaatgtttttc

SEQ ID NO: 1355828 - DNA, 22 bp, Artificial Sequence
  chemically synthesized
taatttaagtttaaagaaaaac

SEQ ID NO: 1355829 - DNA, 22 bp, Artificial Sequence
  chemically synthesized
ataatttaagtttaaagaaaaa

SEQ ID NO: 1355830 - DNA, 22 bp, Artificial Sequence
  chemically synthesized
ggtctaatgtttttctttaaac

SEQ ID NO: 1355831 - DNA, 22 bp, Artificial Sequence
  chemically synthesized
gtctaatgtttttctttaaact

SEQ ID NO: 1355832 - DNA, 22 bp, Artificial Sequence
  chemically synthesized
aacttataatttaagtttaaag

SEQ ID NO: 1355833 - DNA, 22 bp, Artificial Sequence
  chemically synthesized
atgtttttctttaaacttaaat

SEQ ID NO: 1355834 - DNA, 22 bp, Artificial Sequence
  chemically synthesized
ttctttaaacttaaattataag

SEQ ID NO: 1355835 - DNA, 22 bp, Artificial Sequence
  chemically synthesized
tctttaaacttaaattataagt

SEQ ID NO: 1355836 - DNA, 22 bp, Artificial Sequence
  chemically synthesized
ctttaaacttaaattataagtt

SEQ ID NO: 1355837 - DNA, 22 bp, Artificial Sequence
  chemically synthesized
tttaaacttaaattataagttt

SEQ ID NO: 1355838 - DNA, 22 bp, Artificial Sequence
  chemically synthesized
aggtatgtaatctaaacttata

SEQ ID NO: 1355839 - DNA, 22 bp, Artificial Sequence
  chemically synthesized
taaacttaaattataagtttag

SEQ ID NO: 1355840 - DNA, 22 bp, Artificial Sequence
  chemically synthesized
aaacttaaattataagtttaga

SEQ ID NO: 1355841 - DNA, 22 bp, Artificial Sequence
  chemically synthesized
aacttaaattataagtttagat

SEQ ID NO: 1355842 - DNA, 22 bp, Artificial Sequence
  chemically synthesized
aaattataagtttagattacat

SEQ ID NO: 1355843 - DNA, 22 bp, Artificial Sequence
  chemically synthesized
aattataagtttagattacata

SEQ ID NO: 1355844 - DNA, 22 bp, Artificial Sequence
  chemically synthesized
agtaagttaaggtatgtaatct

SEQ ID NO: 1355845 - DNA, 22 bp, Artificial Sequence
  chemically synthesized
aagtaagttaaggtatgtaatc

SEQ ID NO: 1355846 - DNA, 22 bp, Artificial Sequence
  chemically synthesized
tttaagtaagttaaggtatgta

SEQ ID NO: 1355847 - DNA, 22 bp, Artificial Sequence
  chemically synthesized
taagtttagattacatacctta

SEQ ID NO: 1355848 - DNA, 22 bp, Artificial Sequence
  chemically synthesized
agattacataccttaacttact

SEQ ID NO: 1355849 - DNA, 22 bp, Artificial Sequence
  chemically synthesized
gattacataccttaacttactt

SEQ ID NO: 1355850 - DNA, 22 bp, Artificial Sequence
  chemically synthesized
cataccttaacttacttaaaca

SEQ ID NO: 1355851 - DNA, 22 bp, Artificial Sequence
  chemically synthesized
aaatgtccagccaattgtttaa

SEQ ID NO: 1355852 - DNA, 22 bp, Artificial Sequence
  chemically synthesized
caaatgtccagccaattgttta

SEQ ID NO: 1355853 - DNA, 22 bp, Artificial Sequence
  chemically synthesized
tcaaatgtccagccaattgttt

SEQ ID NO: 1355854 - DNA, 22 bp, Artificial Sequence
  chemically synthesized
ttcaaatgtccagccaattgtt

SEQ ID NO: 1355855 - DNA, 22 bp, Artificial Sequence
  chemically synthesized
tttcaaatgtccagccaattgt

SEQ ID NO: 1355856 - DNA, 22 bp, Artificial Sequence
  chemically synthesized
aacttacttaaacaattggctg

SEQ ID NO: 1355857 - DNA, 22 bp, Artificial Sequence
  chemically synthesized
acttacttaaacaattggctgg

SEQ ID NO: 1355858 - DNA, 22 bp, Artificial Sequence
  chemically synthesized
acttaaacaattggctggacat

SEQ ID NO: 1355859 - DNA, 22 bp, Artificial Sequence
  chemically synthesized
cttaaacaattggctggacatt

SEQ ID NO: 1355860 - DNA, 22 bp, Artificial Sequence
  chemically synthesized
aaacaattggctggacatttga

SEQ ID NO: 1355861 - DNA, 22 bp, Artificial Sequence
  chemically synthesized
aacaattggctggacatttgaa

SEQ ID NO: 1355862 - DNA, 22 bp, Artificial Sequence
  chemically synthesized
gctggacatttgaaaaaatatt

SEQ ID NO: 1355863 - DNA, 22 bp, Artificial Sequence
  chemically synthesized
gacatttgaaaaaatattgatc

SEQ ID NO: 1355864 - DNA, 22 bp, Artificial Sequence
  chemically synthesized
gaaaaaatattgatctttcttt

SEQ ID NO: 1355865 - DNA, 22 bp, Artificial Sequence
  chemically synthesized
aaaaaatattgatctttctttc

SEQ ID NO: 1355866 - DNA, 22 bp, Artificial Sequence
  chemically synthesized
atctttctttcttttttttttt

SEQ ID NO: 1355867 - DNA, 22 bp, Artificial Sequence
  chemically synthesized
aaaaaaaaaaaaaaaaaaaaaa

SEQ ID NO: 1355868 - DNA, 22 bp, Artificial Sequence
  chemically synthesized
tctttctttttttttttttttt

SEQ ID NO: 1355869 - DNA, 22 bp, Artificial Sequence
  chemically synthesized
ctttcttttttttttttttttt

SEQ ID NO: 1355870 - DNA, 22 bp, Artificial Sequence
  chemically synthesized
cgtctcaaaaaaaaaaaaaaaa

SEQ ID NO: 1355871 - DNA, 22 bp, Artificial Sequence
  chemically synthesized
tttctttttttttttttttttt

SEQ ID NO: 1355872 - DNA, 22 bp, Artificial Sequence
  chemically synthesized
tctttttttttttttttttttt

SEQ ID NO: 1355873 - DNA, 22 bp, Artificial Sequence
  chemically synthesized
cttttttttttttttttttttt

SEQ ID NO: 1355874 - DNA, 22 bp, Artificial Sequence
  chemically synthesized
tttttttttttttttttttttt

SEQ ID NO: 1355875 - DNA, 22 bp, Artificial Sequence
  chemically synthesized
tttttttttttttttttttttg

SEQ ID NO: 1355876 - DNA, 22 bp, Artificial Sequence
  chemically synthesized
ttttttttttttttttttttga

SEQ ID NO: 1355877 - DNA, 22 bp, Artificial Sequence
  chemically synthesized
tttttttttttttttttttgag

SEQ ID NO: 1355878 - DNA, 22 bp, Artificial Sequence
  chemically synthesized
ttttttttttttttttttgaga

SEQ ID NO: 1355879 - DNA, 22 bp, Artificial Sequence
  chemically synthesized
tttttttttttttttttgagac

SEQ ID NO: 1355880 - DNA, 22 bp, Artificial Sequence
  chemically synthesized
ttttttttttttttttgagacg

SEQ ID NO: 1355881 - DNA, 22 bp, Artificial Sequence
  chemically synthesized
tttttttttttttttgagacgg

SEQ ID NO: 1355882 - DNA, 22 bp, Artificial Sequence
  chemically synthesized
ttttttttttttttgagacgga

SEQ ID NO: 1355883 - DNA, 22 bp, Artificial Sequence
  chemically synthesized
tttttttttttttgagacggag

SEQ ID NO: 1355884 - DNA, 22 bp, Artificial Sequence
  chemically synthesized
ttttttttttttgagacggagt

SEQ ID NO: 1355885 - DNA, 22 bp, Artificial Sequence
  chemically synthesized
tttttttttttgagacggagtc

SEQ ID NO: 1355886 - DNA, 22 bp, Artificial Sequence
  chemically synthesized
ttttttttttgagacggagtct

SEQ ID NO: 1355887 - DNA, 22 bp, Artificial Sequence
  chemically synthesized
ggcgacagagcgagactccgtc

SEQ ID NO: 1355888 - DNA, 22 bp, Artificial Sequence
  chemically synthesized
tttttttttgagacggagtctc

SEQ ID NO: 1355889 - DNA, 22 bp, Artificial Sequence
  chemically synthesized
ttttttttgagacggagtctcg

SEQ ID NO: 1355890 - DNA, 22 bp, Artificial Sequence
  chemically synthesized
tttttttgagacggagtctcgc

SEQ ID NO: 1355891 - DNA, 22 bp, Artificial Sequence
  chemically synthesized
ttttttgagacggagtctcgct

SEQ ID NO: 1355892 - DNA, 22 bp, Artificial Sequence
  chemically synthesized
tttttgagacggagtctcgctc

SEQ ID NO: 1355893 - DNA, 22 bp, Artificial Sequence
  chemically synthesized
ttttgagacggagtctcgctct

SEQ ID NO: 1355894 - DNA, 22 bp, Artificial Sequence
  chemically synthesized
tttgagacggagtctcgctctg

SEQ ID NO: 1355895 - DNA, 22 bp, Artificial Sequence
  chemically synthesized
ttgagacggagtctcgctctgt

SEQ ID NO: 1355896 - DNA, 22 bp, Artificial Sequence
  chemically synthesized
tgagacggagtctcgctctgtc

SEQ ID NO: 1355897 - DNA, 22 bp, Artificial Sequence
  chemically synthesized
gagacggagtctcgctctgtcg

SEQ ID NO: 1355898 - DNA, 22 bp, Artificial Sequence
  chemically synthesized
agacggagtctcgctctgtcgc

SEQ ID NO: 1355899 - DNA, 22 bp, Artificial Sequence
  chemically synthesized
cagtccgcagtccggcctgggc

SEQ ID NO: 1355900 - DNA, 22 bp, Artificial Sequence
  chemically synthesized
gctctgtcgcccaggccggact

SEQ ID NO: 1355901 - DNA, 22 bp, Artificial Sequence
  chemically synthesized
tgtcgcccaggccggactgcgg

SEQ ID NO: 1355902 - DNA, 22 bp, Artificial Sequence
  chemically synthesized
cgccactgcagtccgcagtccg

SEQ ID NO: 1355903 - DNA, 22 bp, Artificial Sequence
  chemically synthesized
tcgcccaggccggactgcggac

SEQ ID NO: 1355904 - DNA, 22 bp, Artificial Sequence
  chemically synthesized
cagtgagccgagattgcgccac

SEQ ID NO: 1355905 - DNA, 22 bp, Artificial Sequence
  chemically synthesized
gcagtgagccgagattgcgcca

SEQ ID NO: 1355906 - DNA, 22 bp, Artificial Sequence
  chemically synthesized
cggactgcagtggcgcaatctc

SEQ ID NO: 1355907 - DNA, 22 bp, Artificial Sequence
  chemically synthesized
cagtggcgcaatctcggctcac

SEQ ID NO: 1355908 - DNA, 22 bp, Artificial Sequence
  chemically synthesized
ggctcactgcaagctccgcttc

SEQ ID NO: 1355909 - DNA, 22 bp, Artificial Sequence
  chemically synthesized
actgcaagctccgcttcccggg

SEQ ID NO: 1355910 - DNA, 22 bp, Artificial Sequence
  chemically synthesized
caagctccgcttcccgggttca

SEQ ID NO: 1355911 - DNA, 22 bp, Artificial Sequence
  chemically synthesized
aggcaggagaatggcgtgaacc

SEQ ID NO: 1355912 - DNA, 22 bp, Artificial Sequence
  chemically synthesized
cgcttcccgggttcacgccatt

SEQ ID NO: 1355913 - DNA, 22 bp, Artificial Sequence
  chemically synthesized
cccgggttcacgccattctcct

SEQ ID NO: 1355914 - DNA, 22 bp, Artificial Sequence
  chemically synthesized
ccgggttcacgccattctcctg

SEQ ID NO: 1355915 - DNA, 22 bp, Artificial Sequence
  chemically synthesized
gggaggctgaggcaggagaatg

SEQ ID NO: 1355916 - DNA, 22 bp, Artificial Sequence
  chemically synthesized
ctcgggaggctgaggcaggaga

SEQ ID NO: 1355917 - DNA, 22 bp, Artificial Sequence
  chemically synthesized
acgccattctcctgcctcagcc

SEQ ID NO: 1355918 - DNA, 22 bp, Artificial Sequence
  chemically synthesized
tggtcccagctactcgggaggc

SEQ ID NO: 1355919 - DNA, 22 bp, Artificial Sequence
  chemically synthesized
tcctgcctcagcctcccgagta

SEQ ID NO: 1355920 - DNA, 22 bp, Artificial Sequence
  chemically synthesized
ctgcctcagcctcccgagtagc

SEQ ID NO: 1355921 - DNA, 22 bp, Artificial Sequence
  chemically synthesized
cctcagcctcccgagtagctgg

SEQ ID NO: 1355922 - DNA, 22 bp, Artificial Sequence
  chemically synthesized
agcctcccgagtagctgggacc

SEQ ID NO: 1355923 - DNA, 22 bp, Artificial Sequence
  chemically synthesized
ccgagtagctgggaccacaggc

SEQ ID NO: 1355924 - DNA, 22 bp, Artificial Sequence
  chemically synthesized
gccgggcgcggtggcgggcgcc

SEQ ID NO: 1355925 - DNA, 22 bp, Artificial Sequence
  chemically synthesized
ggaccacaggcgcccgccaccg

SEQ ID NO: 1355926 - DNA, 22 bp, Artificial Sequence
  chemically synthesized
aaaatacaaaaaattagccggg

SEQ ID NO: 1355927 - DNA, 22 bp, Artificial Sequence
  chemically synthesized
ctaaaaatacaaaaaattagcc

SEQ ID NO: 1355928 - DNA, 22 bp, Artificial Sequence
  chemically synthesized
tactaaaaatacaaaaaattag

SEQ ID NO: 1355929 - DNA, 22 bp, Artificial Sequence
  chemically synthesized
attttttgtatttttagtagag

SEQ ID NO: 1355930 - DNA, 22 bp, Artificial Sequence
  chemically synthesized
tttgtatttttagtagagacgg

SEQ ID NO: 1355931 - DNA, 22 bp, Artificial Sequence
  chemically synthesized
ttgtatttttagtagagacggg

SEQ ID NO: 1355932 - DNA, 22 bp, Artificial Sequence
  chemically synthesized
acaaggtgaaaccccgtctcta

SEQ ID NO: 1355933 - DNA, 22 bp, Artificial Sequence
  chemically synthesized
tgtatttttagtagagacgggg

SEQ ID NO: 1355934 - DNA, 22 bp, Artificial Sequence
  chemically synthesized
gtatttttagtagagacggggt

SEQ ID NO: 1355935 - DNA, 22 bp, Artificial Sequence
  chemically synthesized
tatttttagtagagacggggtt

SEQ ID NO: 1355936 - DNA, 22 bp, Artificial Sequence
  chemically synthesized
gctaacaaggtgaaaccccgtc

SEQ ID NO: 1355937 - DNA, 22 bp, Artificial Sequence
  chemically synthesized
ttagtagagacggggtttcacc

SEQ ID NO: 1355938 - DNA, 22 bp, Artificial Sequence
  chemically synthesized
tagtagagacggggtttcacct

SEQ ID NO: 1355939 - DNA, 22 bp, Artificial Sequence
  chemically synthesized
agtagagacggggtttcacctt

SEQ ID NO: 1355940 - DNA, 22 bp, Artificial Sequence
  chemically synthesized
gtagagacggggtttcaccttg

SEQ ID NO: 1355941 - DNA, 22 bp, Artificial Sequence
  chemically synthesized
caccttgttagccaggatggtc

SEQ ID NO: 1355942 - DNA, 22 bp, Artificial Sequence
  chemically synthesized
accttgttagccaggatggtct

SEQ ID NO: 1355943 - DNA, 22 bp, Artificial Sequence
  chemically synthesized
gttagccaggatggtctcgatc

SEQ ID NO: 1355944 - DNA, 22 bp, Artificial Sequence
  chemically synthesized
ttagccaggatggtctcgatct

SEQ ID NO: 1355945 - DNA, 22 bp, Artificial Sequence
  chemically synthesized
gccaggatggtctcgatctcct

SEQ ID NO: 1355946 - DNA, 22 bp, Artificial Sequence
  chemically synthesized
gatctcctgacctcatgatcca

SEQ ID NO: 1355947 - DNA, 22 bp, Artificial Sequence
  chemically synthesized
ggaggccgaggcgggtggatca

SEQ ID NO: 1355948 - DNA, 22 bp, Artificial Sequence
  chemically synthesized
gggaggccgaggcgggtggatc

SEQ ID NO: 1355949 - DNA, 22 bp, Artificial Sequence
  chemically synthesized
tgggaggccgaggcgggtggat

SEQ ID NO: 1355950 - DNA, 22 bp, Artificial Sequence
  chemically synthesized
ctgacctcatgatccacccgcc

SEQ ID NO: 1355951 - DNA, 22 bp, Artificial Sequence
  chemically synthesized
acctcatgatccacccgcctcg

SEQ ID NO: 1355952 - DNA, 22 bp, Artificial Sequence
  chemically synthesized
atgatccacccgcctcggcctc

SEQ ID NO: 1355953 - DNA, 22 bp, Artificial Sequence
  chemically synthesized
taatcccagcactttgggaggc

SEQ ID NO: 1355954 - DNA, 22 bp, Artificial Sequence
  chemically synthesized
acgcctgtaatcccagcacttt

SEQ ID NO: 1355955 - DNA, 22 bp, Artificial Sequence
  chemically synthesized
ggcctcccaaagtgctgggatt

SEQ ID NO: 1355956 - DNA, 22 bp, Artificial Sequence
  chemically synthesized
ccaaagtgctgggattacaggc

SEQ ID NO: 1355957 - DNA, 22 bp, Artificial Sequence
  chemically synthesized
ggcgcggtggctcacgcctgta

SEQ ID NO: 1355958 - DNA, 22 bp, Artificial Sequence
  chemically synthesized
ggattacaggcgtgagccaccg

SEQ ID NO: 1355959 - DNA, 22 bp, Artificial Sequence
  chemically synthesized
caggcgtgagccaccgcgccca

SEQ ID NO: 1355960 - DNA, 22 bp, Artificial Sequence
  chemically synthesized
tatgtatagaaagaaagatcag

SEQ ID NO: 1355961 - DNA, 22 bp, Artificial Sequence
  chemically synthesized
atatgtatagaaagaaagatca

SEQ ID NO: 1355962 - DNA, 22 bp, Artificial Sequence
  chemically synthesized
gacagaaagcttatatgtatag

SEQ ID NO: 1355963 - DNA, 22 bp, Artificial Sequence
  chemically synthesized
atctttctttctatacatataa

SEQ ID NO: 1355964 - DNA, 22 bp, Artificial Sequence
  chemically synthesized
tctttctatacatataagcttt

SEQ ID NO: 1355965 - DNA, 22 bp, Artificial Sequence
  chemically synthesized
taaattggacagaaagcttata

SEQ ID NO: 1355966 - DNA, 22 bp, Artificial Sequence
  chemically synthesized
ctttctatacatataagctttc

SEQ ID NO: 1355967 - DNA, 22 bp, Artificial Sequence
  chemically synthesized
ataaattggacagaaagcttat

SEQ ID NO: 1355968 - DNA, 22 bp, Artificial Sequence
  chemically synthesized
tttctatacatataagctttct

SEQ ID NO: 1355969 - DNA, 22 bp, Artificial Sequence
  chemically synthesized
tataaattggacagaaagctta

SEQ ID NO: 1355970 - DNA, 22 bp, Artificial Sequence
  chemically synthesized
ttataaattggacagaaagctt

SEQ ID NO: 1355971 - DNA, 22 bp, Artificial Sequence
  chemically synthesized
tctatacatataagctttctgt

SEQ ID NO: 1355972 - DNA, 22 bp, Artificial Sequence
  chemically synthesized
ctatacatataagctttctgtc

SEQ ID NO: 1355973 - DNA, 22 bp, Artificial Sequence
  chemically synthesized
tatacatataagctttctgtcc

SEQ ID NO: 1355974 - DNA, 22 bp, Artificial Sequence
  chemically synthesized
cttttataaattggacagaaag

SEQ ID NO: 1355975 - DNA, 22 bp, Artificial Sequence
  chemically synthesized
ccttttataaattggacagaaa

SEQ ID NO: 1355976 - DNA, 22 bp, Artificial Sequence
  chemically synthesized
tacatataagctttctgtccaa

SEQ ID NO: 1355977 - DNA, 22 bp, Artificial Sequence
  chemically synthesized
cttccttttataaattggacag

SEQ ID NO: 1355978 - DNA, 22 bp, Artificial Sequence
  chemically synthesized
gtactacttccttttataaatt

SEQ ID NO: 1355979 - DNA, 22 bp, Artificial Sequence
  chemically synthesized
tctgtccaatttataaaaggaa

SEQ ID NO: 1355980 - DNA, 22 bp, Artificial Sequence
  chemically synthesized
ctgtccaatttataaaaggaag

SEQ ID NO: 1355981 - DNA, 22 bp, Artificial Sequence
  chemically synthesized
tgtccaatttataaaaggaagt

SEQ ID NO: 1355982 - DNA, 22 bp, Artificial Sequence
  chemically synthesized
tatattagtactacttcctttt

SEQ ID NO: 1355983 - DNA, 22 bp, Artificial Sequence
  chemically synthesized
tccaatttataaaaggaagtag

SEQ ID NO: 1355984 - DNA, 22 bp, Artificial Sequence
  chemically synthesized
tatattatatattagtactact

SEQ ID NO: 1355985 - DNA, 22 bp, Artificial Sequence
  chemically synthesized
ataaaaggaagtagtactaata

SEQ ID NO: 1355986 - DNA, 22 bp, Artificial Sequence
  chemically synthesized
taaaaggaagtagtactaatat

SEQ ID NO: 1355987 - DNA, 22 bp, Artificial Sequence
  chemically synthesized
tatatatatatataatattata

SEQ ID NO: 1355988 - DNA, 22 bp, Artificial Sequence
  chemically synthesized
atatataatatataatattata

SEQ ID NO: 1355989 - DNA, 22 bp, Artificial Sequence
  chemically synthesized
tatattatatatatatatataa

SEQ ID NO: 1355990 - DNA, 22 bp, Artificial Sequence
  chemically synthesized
tatatatatatataatatataa

SEQ ID NO: 1355991 - DNA, 22 bp, Artificial Sequence
  chemically synthesized
tataatatataatattatatat

SEQ ID NO: 1355992 - DNA, 22 bp, Artificial Sequence
  chemically synthesized
tatattatataatatataatat

SEQ ID NO: 1355993 - DNA, 22 bp, Artificial Sequence
  chemically synthesized
tatatataatattatatattat

SEQ ID NO: 1355994 - DNA, 22 bp, Artificial Sequence
  chemically synthesized
tatattatataatatataatat

SEQ ID NO: 1355995 - DNA, 22 bp, Artificial Sequence
  chemically synthesized
tataatatataatattatatat

SEQ ID NO: 1355996 - DNA, 22 bp, Artificial Sequence
  chemically synthesized
tatatatatataatattatata

SEQ ID NO: 1355997 - DNA, 22 bp, Artificial Sequence
  chemically synthesized
tatattatatatatatataata

SEQ ID NO: 1355998 - DNA, 22 bp, Artificial Sequence
  chemically synthesized
tatatataatattatatatata

SEQ ID NO: 1355999 - DNA, 22 bp, Artificial Sequence
  chemically synthesized
tatatatatataatatataata

SEQ ID NO: 1356000 - DNA, 22 bp, Artificial Sequence
  chemically synthesized
tatatatatataatattatata

SEQ ID NO: 1356001 - DNA, 22 bp, Artificial Sequence
  chemically synthesized
tatattatatatatatataata

SEQ ID NO: 1356002 - DNA, 22 bp, Artificial Sequence
  chemically synthesized
tatatatatataatatataata

SEQ ID NO: 1356003 - DNA, 22 bp, Artificial Sequence
  chemically synthesized
tatatatatatataatattata

SEQ ID NO: 1356004 - DNA, 22 bp, Artificial Sequence
  chemically synthesized
tatattatatatatatatataa

SEQ ID NO: 1356005 - DNA, 22 bp, Artificial Sequence
  chemically synthesized
tatatatatatataatatataa

SEQ ID NO: 1356006 - DNA, 22 bp, Artificial Sequence
  chemically synthesized
tatatatatatataatattata

SEQ ID NO: 1356007 - DNA, 22 bp, Artificial Sequence
  chemically synthesized
gggcagtataggtgtacactat

SEQ ID NO: 1356008 - DNA, 22 bp, Artificial Sequence
  chemically synthesized
tatatatatatatagtgtacac

SEQ ID NO: 1356009 - DNA, 22 bp, Artificial Sequence
  chemically synthesized
ctagggcagtataggtgtacac

SEQ ID NO: 1356010 - DNA, 22 bp, Artificial Sequence
  chemically synthesized
actagggcagtataggtgtaca

SEQ ID NO: 1356011 - DNA, 22 bp, Artificial Sequence
  chemically synthesized
ttactagggcagtataggtgta

SEQ ID NO: 1356012 - DNA, 22 bp, Artificial Sequence
  chemically synthesized
cttactagggcagtataggtgt

SEQ ID NO: 1356013 - DNA, 22 bp, Artificial Sequence
  chemically synthesized
atttcttactagggcagtatag

SEQ ID NO: 1356014 - DNA, 22 bp, Artificial Sequence
  chemically synthesized
ctgatttcttactagggcagta

SEQ ID NO: 1356015 - DNA, 22 bp, Artificial Sequence
  chemically synthesized
cctgatttcttactagggcagt

SEQ ID NO: 1356016 - DNA, 22 bp, Artificial Sequence
  chemically synthesized
acttcctgatttcttactaggg

SEQ ID NO: 1356017 - DNA, 22 bp, Artificial Sequence
  chemically synthesized
tactgccctagtaagaaatcag

SEQ ID NO: 1356018 - DNA, 22 bp, Artificial Sequence
  chemically synthesized
ccctagtaagaaatcaggaagt

SEQ ID NO: 1356019 - DNA, 22 bp, Artificial Sequence
  chemically synthesized
gtaagaaatcaggaagtcagta

SEQ ID NO: 1356020 - DNA, 22 bp, Artificial Sequence
  chemically synthesized
atgatttgctctctactatttt

SEQ ID NO: 1356021 - DNA, 22 bp, Artificial Sequence
  chemically synthesized
gctctctactatttttgtctct

SEQ ID NO: 1356022 - DNA, 22 bp, Artificial Sequence
  chemically synthesized
ctctctactatttttgtctctc

SEQ ID NO: 1356023 - DNA, 22 bp, Artificial Sequence
  chemically synthesized
tctactatttttgtctctctcc

SEQ ID NO: 1356024 - DNA, 22 bp, Artificial Sequence
  chemically synthesized
cgcgggtaatgaggagagagac

SEQ ID NO: 1356025 - DNA, 22 bp, Artificial Sequence
  chemically synthesized
gcgcgggtaatgaggagagaga

SEQ ID NO: 1356026 - DNA, 22 bp, Artificial Sequence
  chemically synthesized
tactatttttgtctctctcctc

SEQ ID NO: 1356027 - DNA, 22 bp, Artificial Sequence
  chemically synthesized
ctatttttgtctctctcctcat

SEQ ID NO: 1356028 - DNA, 22 bp, Artificial Sequence
  chemically synthesized
tttgcgcgggtaatgaggagag

SEQ ID NO: 1356029 - DNA, 22 bp, Artificial Sequence
  chemically synthesized
atttgcgcgggtaatgaggaga

SEQ ID NO: 1356030 - DNA, 22 bp, Artificial Sequence
  chemically synthesized
tttttgtctctctcctcattac

SEQ ID NO: 1356031 - DNA, 22 bp, Artificial Sequence
  chemically synthesized
ttgtctctctcctcattacccg

SEQ ID NO: 1356032 - DNA, 22 bp, Artificial Sequence
  chemically synthesized
tgtctctctcctcattacccgc

SEQ ID NO: 1356033 - DNA, 22 bp, Artificial Sequence
  chemically synthesized
gtctctctcctcattacccgcg

SEQ ID NO: 1356034 - DNA, 22 bp, Artificial Sequence
  chemically synthesized
tctctctcctcattacccgcgc

SEQ ID NO: 1356035 - DNA, 22 bp, Artificial Sequence
  chemically synthesized
gtaaaacttatttgcgcgggta

SEQ ID NO: 1356036 - DNA, 22 bp, Artificial Sequence
  chemically synthesized
tctcctcattacccgcgcaaat

SEQ ID NO: 1356037 - DNA, 22 bp, Artificial Sequence
  chemically synthesized
attagtaaaacttatttgcgcg

SEQ ID NO: 1356038 - DNA, 22 bp, Artificial Sequence
  chemically synthesized
tcctcattacccgcgcaaataa

SEQ ID NO: 1356039 - DNA, 22 bp, Artificial Sequence
  chemically synthesized
aattagtaaaacttatttgcgc

SEQ ID NO: 1356040 - DNA, 22 bp, Artificial Sequence
  chemically synthesized
ctcattacccgcgcaaataagt

SEQ ID NO: 1356041 - DNA, 22 bp, Artificial Sequence
  chemically synthesized
attacccgcgcaaataagtttt

SEQ ID NO: 1356042 - DNA, 22 bp, Artificial Sequence
  chemically synthesized
gatatttaattagtaaaactta

SEQ ID NO: 1356043 - DNA, 22 bp, Artificial Sequence
  chemically synthesized
agatatttaattagtaaaactt

SEQ ID NO: 1356044 - DNA, 22 bp, Artificial Sequence
  chemically synthesized
cccgcgcaaataagttttacta

SEQ ID NO: 1356045 - DNA, 22 bp, Artificial Sequence
  chemically synthesized
tactaattaaatatctaaatat

SEQ ID NO: 1356046 - DNA, 22 bp, Artificial Sequence
  chemically synthesized
actaattaaatatctaaatatc

SEQ ID NO: 1356047 - DNA, 22 bp, Artificial Sequence
  chemically synthesized
ctaattaaatatctaaatatct

SEQ ID NO: 1356048 - DNA, 22 bp, Artificial Sequence
  chemically synthesized
attaaatatctaaatatctttt

SEQ ID NO: 1356049 - DNA, 22 bp, Artificial Sequence
  chemically synthesized
aatatctaaatatcttttgttt

SEQ ID NO: 1356050 - DNA, 22 bp, Artificial Sequence
  chemically synthesized
aatatcttttgtttgcattttg

SEQ ID NO: 1356051 - DNA, 22 bp, Artificial Sequence
  chemically synthesized
ggaatgaaaaagacaaaatgca

SEQ ID NO: 1356052 - DNA, 22 bp, Artificial Sequence
  chemically synthesized
ttgtttgcattttgtctttttc

SEQ ID NO: 1356053 - DNA, 22 bp, Artificial Sequence
  chemically synthesized
tgtttgcattttgtctttttca

SEQ ID NO: 1356054 - DNA, 22 bp, Artificial Sequence
  chemically synthesized
gggcattaggaatgaaaaagac

SEQ ID NO: 1356055 - DNA, 22 bp, Artificial Sequence
  chemically synthesized
gtttgcattttgtctttttcat

SEQ ID NO: 1356056 - DNA, 22 bp, Artificial Sequence
  chemically synthesized
agggcattaggaatgaaaaaga

SEQ ID NO: 1356057 - DNA, 22 bp, Artificial Sequence
  chemically synthesized
tttgcattttgtctttttcatt

SEQ ID NO: 1356058 - DNA, 22 bp, Artificial Sequence
  chemically synthesized
gcattttgtctttttcattcct

SEQ ID NO: 1356059 - DNA, 22 bp, Artificial Sequence
  chemically synthesized
cattttgtctttttcattccta

SEQ ID NO: 1356060 - DNA, 22 bp, Artificial Sequence
  chemically synthesized
tgtctttttcattcctaatgcc

SEQ ID NO: 1356061 - DNA, 22 bp, Artificial Sequence
  chemically synthesized
gtctttttcattcctaatgccc

SEQ ID NO: 1356062 - DNA, 22 bp, Artificial Sequence
  chemically synthesized
tctttttcattcctaatgccct

SEQ ID NO: 1356063 - DNA, 22 bp, Artificial Sequence
  chemically synthesized
tttcattcctaatgccctaagg

SEQ ID NO: 1356064 - DNA, 22 bp, Artificial Sequence
  chemically synthesized
ttcattcctaatgccctaaggc

SEQ ID NO: 1356065 - DNA, 22 bp, Artificial Sequence
  chemically synthesized
tcattcctaatgccctaaggct

SEQ ID NO: 1356066 - DNA, 22 bp, Artificial Sequence
  chemically synthesized
cattcctaatgccctaaggctc

SEQ ID NO: 1356067 - DNA, 22 bp, Artificial Sequence
  chemically synthesized
tatcccagataagagccttagg

SEQ ID NO: 1356068 - DNA, 22 bp, Artificial Sequence
  chemically synthesized
attcctaatgccctaaggctct

SEQ ID NO: 1356069 - DNA, 22 bp, Artificial Sequence
  chemically synthesized
ctaatgccctaaggctcttatc

SEQ ID NO: 1356070 - DNA, 22 bp, Artificial Sequence
  chemically synthesized
cagttatatcccagataagagc

SEQ ID NO: 1356071 - DNA, 22 bp, Artificial Sequence
  chemically synthesized
atgccctaaggctcttatctgg

SEQ ID NO: 1356072 - DNA, 22 bp, Artificial Sequence
  chemically synthesized
aggctcttatctgggatataac

SEQ ID NO: 1356073 - DNA, 22 bp, Artificial Sequence
  chemically synthesized
ttatctgggatataactgcaac

SEQ ID NO: 1356074 - DNA, 22 bp, Artificial Sequence
  chemically synthesized
atctgggatataactgcaaccc

SEQ ID NO: 1356075 - DNA, 22 bp, Artificial Sequence
  chemically synthesized
tctgggatataactgcaaccct

SEQ ID NO: 1356076 - DNA, 22 bp, Artificial Sequence
  chemically synthesized
aaagcaggtgtaagagggttgc

SEQ ID NO: 1356077 - DNA, 22 bp, Artificial Sequence
  chemically synthesized
ggatataactgcaaccctctta

SEQ ID NO: 1356078 - DNA, 22 bp, Artificial Sequence
  chemically synthesized
taaaagcaggtgtaagagggtt

SEQ ID NO: 1356079 - DNA, 22 bp, Artificial Sequence
  chemically synthesized
ttctaaaagcaggtgtaagagg

SEQ ID NO: 1356080 - DNA, 22 bp, Artificial Sequence
  chemically synthesized
caaccctcttacacctgctttt

SEQ ID NO: 1356081 - DNA, 22 bp, Artificial Sequence
  chemically synthesized
gagccactgttctaaaagcagg

SEQ ID NO: 1356082 - DNA, 22 bp, Artificial Sequence
  chemically synthesized
agagccactgttctaaaagcag

SEQ ID NO: 1356083 - DNA, 22 bp, Artificial Sequence
  chemically synthesized
tgtttagagccactgttctaaa

SEQ ID NO: 1356084 - DNA, 22 bp, Artificial Sequence
  chemically synthesized
ttacacctgcttttagaacagt

SEQ ID NO: 1356085 - DNA, 22 bp, Artificial Sequence
  chemically synthesized
acacctgcttttagaacagtgg

SEQ ID NO: 1356086 - DNA, 22 bp, Artificial Sequence
  chemically synthesized
cacctgcttttagaacagtggc

SEQ ID NO: 1356087 - DNA, 22 bp, Artificial Sequence
  chemically synthesized
cttttagaacagtggctctaaa

SEQ ID NO: 1356088 - DNA, 22 bp, Artificial Sequence
  chemically synthesized
ttagaacagtggctctaaacac

SEQ ID NO: 1356089 - DNA, 22 bp, Artificial Sequence
  chemically synthesized
tagaacagtggctctaaacaca

SEQ ID NO: 1356090 - DNA, 22 bp, Artificial Sequence
  chemically synthesized
agaacagtggctctaaacacaa

SEQ ID NO: 1356091 - DNA, 22 bp, Artificial Sequence
  chemically synthesized
gaacagtggctctaaacacaat

SEQ ID NO: 1356092 - DNA, 22 bp, Artificial Sequence
  chemically synthesized
taaacacaatctgcacttggtg

SEQ ID NO: 1356093 - DNA, 22 bp, Artificial Sequence
  chemically synthesized
aacacaatctgcacttggtgtg

SEQ ID NO: 1356094 - DNA, 22 bp, Artificial Sequence
  chemically synthesized
cacttggtgtgcctgtatgttc

SEQ ID NO: 1356095 - DNA, 22 bp, Artificial Sequence
  chemically synthesized
cagaccaatgaaatcagaacat

SEQ ID NO: 1356096 - DNA, 22 bp, Artificial Sequence
  chemically synthesized
ggtgtgcctgtatgttctgatt

SEQ ID NO: 1356097 - DNA, 22 bp, Artificial Sequence
  chemically synthesized
gcagaccaatgaaatcagaaca

SEQ ID NO: 1356098 - DNA, 22 bp, Artificial Sequence
  chemically synthesized
gtgtgcctgtatgttctgattt

SEQ ID NO: 1356099 - DNA, 22 bp, Artificial Sequence
  chemically synthesized
ttgcagaccaatgaaatcagaa

SEQ ID NO: 1356100 - DNA, 22 bp, Artificial Sequence
  chemically synthesized
tatgttctgatttcattggtct

SEQ ID NO: 1356101 - DNA, 22 bp, Artificial Sequence
  chemically synthesized
tgaaaactcttgcagaccaatg

SEQ ID NO: 1356102 - DNA, 22 bp, Artificial Sequence
  chemically synthesized
gtgaaaactcttgcagaccaat

SEQ ID NO: 1356103 - DNA, 22 bp, Artificial Sequence
  chemically synthesized
tgatttcattggtctgcaagag

SEQ ID NO: 1356104 - DNA, 22 bp, Artificial Sequence
  chemically synthesized
atttcattggtctgcaagagtt

SEQ ID NO: 1356105 - DNA, 22 bp, Artificial Sequence
  chemically synthesized
cattggtctgcaagagttttca

SEQ ID NO: 1356106 - DNA, 22 bp, Artificial Sequence
  chemically synthesized
attggtctgcaagagttttcac

SEQ ID NO: 1356107 - DNA, 22 bp, Artificial Sequence
  chemically synthesized
gatgacacagggtttgtgaaaa

SEQ ID NO: 1356108 - DNA, 22 bp, Artificial Sequence
  chemically synthesized
gtctgcaagagttttcacaaac

SEQ ID NO: 1356109 - DNA, 22 bp, Artificial Sequence
  chemically synthesized
ttagatgacacagggtttgtga

SEQ ID NO: 1356110 - DNA, 22 bp, Artificial Sequence
  chemically synthesized
gttagatgacacagggtttgtg

SEQ ID NO: 1356111 - DNA, 22 bp, Artificial Sequence
  chemically synthesized
caagagttttcacaaaccctgt

SEQ ID NO: 1356112 - DNA, 22 bp, Artificial Sequence
  chemically synthesized
tttgttagatgacacagggttt

SEQ ID NO: 1356113 - DNA, 22 bp, Artificial Sequence
  chemically synthesized
agatctatttgttagatgacac

SEQ ID NO: 1356114 - DNA, 22 bp, Artificial Sequence
  chemically synthesized
tcacaaaccctgtgtcatctaa

SEQ ID NO: 1356115 - DNA, 22 bp, Artificial Sequence
  chemically synthesized
cacaaaccctgtgtcatctaac

SEQ ID NO: 1356116 - DNA, 22 bp, Artificial Sequence
  chemically synthesized
acaaaccctgtgtcatctaaca

SEQ ID NO: 1356117 - DNA, 22 bp, Artificial Sequence
  chemically synthesized
tgtcatctaacaaatagatctg

SEQ ID NO: 1356118 - DNA, 22 bp, Artificial Sequence
  chemically synthesized
aaggaggaggttcagatctatt

SEQ ID NO: 1356119 - DNA, 22 bp, Artificial Sequence
  chemically synthesized
aaaggaggaggttcagatctat

SEQ ID NO: 1356120 - DNA, 22 bp, Artificial Sequence
  chemically synthesized
taaaggaggaggttcagatcta

SEQ ID NO: 1356121 - DNA, 22 bp, Artificial Sequence
  chemically synthesized
ttaaaggaggaggttcagatct

SEQ ID NO: 1356122 - DNA, 22 bp, Artificial Sequence
  chemically synthesized
aatttttaaaggaggaggttca

SEQ ID NO: 1356123 - DNA, 22 bp, Artificial Sequence
  chemically synthesized
acaaatagatctgaacctcctc

SEQ ID NO: 1356124 - DNA, 22 bp, Artificial Sequence
  chemically synthesized
gaatttttaaaggaggaggttc

SEQ ID NO: 1356125 - DNA, 22 bp, Artificial Sequence
  chemically synthesized
catcttgaatttttaaaggagg

SEQ ID NO: 1356126 - DNA, 22 bp, Artificial Sequence
  chemically synthesized
gcatcttgaatttttaaaggag

SEQ ID NO: 1356127 - DNA, 22 bp, Artificial Sequence
  chemically synthesized
tgcatcttgaatttttaaagga

SEQ ID NO: 1356128 - DNA, 22 bp, Artificial Sequence
  chemically synthesized
ttgcatcttgaatttttaaagg

SEQ ID NO: 1356129 - DNA, 22 bp, Artificial Sequence
  chemically synthesized
tttttgcatcttgaatttttaa

SEQ ID NO: 1356130 - DNA, 22 bp, Artificial Sequence
  chemically synthesized
aacctcctcctttaaaaattca

SEQ ID NO: 1356131 - DNA, 22 bp, Artificial Sequence
  chemically synthesized
atttttgcatcttgaattttta

SEQ ID NO: 1356132 - DNA, 22 bp, Artificial Sequence
  chemically synthesized
ctcctttaaaaattcaagatgc

SEQ ID NO: 1356133 - DNA, 22 bp, Artificial Sequence
  chemically synthesized
ctttaaaaattcaagatgcaaa

SEQ ID NO: 1356134 - DNA, 22 bp, Artificial Sequence
  chemically synthesized
taaaaattcaagatgcaaaaat

SEQ ID NO: 1356135 - DNA, 22 bp, Artificial Sequence
  chemically synthesized
aaaaattcaagatgcaaaaata

SEQ ID NO: 1356136 - DNA, 22 bp, Artificial Sequence
  chemically synthesized
tcaagaagtgtttatttttgca

SEQ ID NO: 1356137 - DNA, 22 bp, Artificial Sequence
  chemically synthesized
aaaattcaagatgcaaaaataa

SEQ ID NO: 1356138 - DNA, 22 bp, Artificial Sequence
  chemically synthesized
tgtgttgtcaagaagtgtttat

SEQ ID NO: 1356139 - DNA, 22 bp, Artificial Sequence
  chemically synthesized
aagatgcaaaaataaacacttc

SEQ ID NO: 1356140 - DNA, 22 bp, Artificial Sequence
  chemically synthesized
agaaagcaaactatgtgttgtc

SEQ ID NO: 1356141 - DNA, 22 bp, Artificial Sequence
  chemically synthesized
cttgacaacacatagtttgctt

SEQ ID NO: 1356142 - DNA, 22 bp, Artificial Sequence
  chemically synthesized
ttgacaacacatagtttgcttt

SEQ ID NO: 1356143 - DNA, 22 bp, Artificial Sequence
  chemically synthesized
gacaacacatagtttgctttct

SEQ ID NO: 1356144 - DNA, 22 bp, Artificial Sequence
  chemically synthesized
acaacacatagtttgctttctt

SEQ ID NO: 1356145 - DNA, 22 bp, Artificial Sequence
  chemically synthesized
gctttcttagcttttttacttt

SEQ ID NO: 1356146 - DNA, 22 bp, Artificial Sequence
  chemically synthesized
ctttcttagcttttttactttt

SEQ ID NO: 1356147 - DNA, 22 bp, Artificial Sequence
  chemically synthesized
tcttagcttttttacttttact

SEQ ID NO: 1356148 - DNA, 22 bp, Artificial Sequence
  chemically synthesized
cttagcttttttacttttactt

SEQ ID NO: 1356149 - DNA, 22 bp, Artificial Sequence
  chemically synthesized
ttagcttttttacttttacttt

SEQ ID NO: 1356150 - DNA, 22 bp, Artificial Sequence
  chemically synthesized
agcttttttacttttacttttt

SEQ ID NO: 1356151 - DNA, 22 bp, Artificial Sequence
  chemically synthesized
gcttttttacttttactttttt

SEQ ID NO: 1356152 - DNA, 22 bp, Artificial Sequence
  chemically synthesized
aaaaaaaacgaaaaaaaagtaa

SEQ ID NO: 1356153 - DNA, 22 bp, Artificial Sequence
  chemically synthesized
ttttacttttacttttttttcg

SEQ ID NO: 1356154 - DNA, 22 bp, Artificial Sequence
  chemically synthesized
tctcaaaaaaaacgaaaaaaaa

SEQ ID NO: 1356155 - DNA, 22 bp, Artificial Sequence
  chemically synthesized
tttacttttacttttttttcgt

SEQ ID NO: 1356156 - DNA, 22 bp, Artificial Sequence
  chemically synthesized
ttacttttacttttttttcgtt

SEQ ID NO: 1356157 - DNA, 22 bp, Artificial Sequence
  chemically synthesized
tatctcaaaaaaaacgaaaaaa

SEQ ID NO: 1356158 - DNA, 22 bp, Artificial Sequence
  chemically synthesized
tacttttacttttttttcgttt

SEQ ID NO: 1356159 - DNA, 22 bp, Artificial Sequence
  chemically synthesized
acttttacttttttttcgtttt

SEQ ID NO: 1356160 - DNA, 22 bp, Artificial Sequence
  chemically synthesized
cttttacttttttttcgttttt

SEQ ID NO: 1356161 - DNA, 22 bp, Artificial Sequence
  chemically synthesized
ttacttttttttcgtttttttt

SEQ ID NO: 1356162 - DNA, 22 bp, Artificial Sequence
  chemically synthesized
tacttttttttcgttttttttg

SEQ ID NO: 1356163 - DNA, 22 bp, Artificial Sequence
  chemically synthesized
acttttttttcgttttttttga

SEQ ID NO: 1356164 - DNA, 22 bp, Artificial Sequence
  chemically synthesized
cttttttttcgttttttttgag

SEQ ID NO: 1356165 - DNA, 22 bp, Artificial Sequence
  chemically synthesized
ttttttcgttttttttgagata

SEQ ID NO: 1356166 - DNA, 22 bp, Artificial Sequence
  chemically synthesized
tttttcgttttttttgagatag

SEQ ID NO: 1356167 - DNA, 22 bp, Artificial Sequence
  chemically synthesized
ttttcgttttttttgagataga

SEQ ID NO: 1356168 - DNA, 22 bp, Artificial Sequence
  chemically synthesized
tttcgttttttttgagatagag

SEQ ID NO: 1356169 - DNA, 22 bp, Artificial Sequence
  chemically synthesized
ttcgttttttttgagatagagt

SEQ ID NO: 1356170 - DNA, 22 bp, Artificial Sequence
  chemically synthesized
tcgttttttttgagatagagtc

SEQ ID NO: 1356171 - DNA, 22 bp, Artificial Sequence
  chemically synthesized
cgttttttttgagatagagtct

SEQ ID NO: 1356172 - DNA, 22 bp, Artificial Sequence
  chemically synthesized
ggtgacagagcgagactctatc

SEQ ID NO: 1356173 - DNA, 22 bp, Artificial Sequence
  chemically synthesized
gttttttttgagatagagtctc

SEQ ID NO: 1356174 - DNA, 22 bp, Artificial Sequence
  chemically synthesized
tttttgagatagagtctcgctc

SEQ ID NO: 1356175 - DNA, 22 bp, Artificial Sequence
  chemically synthesized
ttttgagatagagtctcgctct

SEQ ID NO: 1356176 - DNA, 22 bp, Artificial Sequence
  chemically synthesized
tttgagatagagtctcgctctg

SEQ ID NO: 1356177 - DNA, 22 bp, Artificial Sequence
  chemically synthesized
cagcctaggtgacagagcgaga

SEQ ID NO: 1356178 - DNA, 22 bp, Artificial Sequence
  chemically synthesized
ttgagatagagtctcgctctgt

SEQ ID NO: 1356179 - DNA, 22 bp, Artificial Sequence
  chemically synthesized
tgagatagagtctcgctctgtc

SEQ ID NO: 1356180 - DNA, 22 bp, Artificial Sequence
  chemically synthesized
gagatagagtctcgctctgtca

SEQ ID NO: 1356181 - DNA, 22 bp, Artificial Sequence
  chemically synthesized
agatagagtctcgctctgtcac

SEQ ID NO: 1356182 - DNA, 22 bp, Artificial Sequence
  chemically synthesized
cactccagcctaggtgacagag

SEQ ID NO: 1356183 - DNA, 22 bp, Artificial Sequence
  chemically synthesized
gtgccactgcactccagcctag

SEQ ID NO: 1356184 - DNA, 22 bp, Artificial Sequence
  chemically synthesized
gctctgtcacctaggctggagt

SEQ ID NO: 1356185 - DNA, 22 bp, Artificial Sequence
  chemically synthesized
tgtcacctaggctggagtgcag

SEQ ID NO: 1356186 - DNA, 22 bp, Artificial Sequence
  chemically synthesized
tcacctaggctggagtgcagtg

SEQ ID NO: 1356187 - DNA, 22 bp, Artificial Sequence
  chemically synthesized
ggctggagtgcagtggcacgaa

SEQ ID NO: 1356188 - DNA, 22 bp, Artificial Sequence
  chemically synthesized
cagtgagccaagttcgtgccac

SEQ ID NO: 1356189 - DNA, 22 bp, Artificial Sequence
  chemically synthesized
gagtgcagtggcacgaacttgg

SEQ ID NO: 1356190 - DNA, 22 bp, Artificial Sequence
  chemically synthesized
aacccaggaggcagaggttgca

SEQ ID NO: 1356191 - DNA, 22 bp, Artificial Sequence
  chemically synthesized
ggctcactgcaacctctgcctc

SEQ ID NO: 1356192 - DNA, 22 bp, Artificial Sequence
  chemically synthesized
gctcactgcaacctctgcctcc

SEQ ID NO: 1356193 - DNA, 22 bp, Artificial Sequence
  chemically synthesized
actgcaacctctgcctcctggg

SEQ ID NO: 1356194 - DNA, 22 bp, Artificial Sequence
  chemically synthesized
caacctctgcctcctgggttca

SEQ ID NO: 1356195 - DNA, 22 bp, Artificial Sequence
  chemically synthesized
aggcagaagaatccgttgaacc

SEQ ID NO: 1356196 - DNA, 22 bp, Artificial Sequence
  chemically synthesized
tgcctcctgggttcaacggatt

SEQ ID NO: 1356197 - DNA, 22 bp, Artificial Sequence
  chemically synthesized
cctcctgggttcaacggattct

SEQ ID NO: 1356198 - DNA, 22 bp, Artificial Sequence
  chemically synthesized
ggaggctgaggcagaagaatcc

SEQ ID NO: 1356199 - DNA, 22 bp, Artificial Sequence
  chemically synthesized
ctgggttcaacggattcttctg

SEQ ID NO: 1356200 - DNA, 22 bp, Artificial Sequence
  chemically synthesized
gggaggctgaggcagaagaatc

SEQ ID NO: 1356201 - DNA, 22 bp, Artificial Sequence
  chemically synthesized
ggttcaacggattcttctgcct

SEQ ID NO: 1356202 - DNA, 22 bp, Artificial Sequence
  chemically synthesized
cttgggaggctgaggcagaaga

SEQ ID NO: 1356203 - DNA, 22 bp, Artificial Sequence
  chemically synthesized
aacggattcttctgcctcagcc

SEQ ID NO: 1356204 - DNA, 22 bp, Artificial Sequence
  chemically synthesized
ttctgcctcagcctcccaagca

SEQ ID NO: 1356205 - DNA, 22 bp, Artificial Sequence
  chemically synthesized
ctgcctcagcctcccaagcagc

SEQ ID NO: 1356206 - DNA, 22 bp, Artificial Sequence
  chemically synthesized
tgcctcagcctcccaagcagct

SEQ ID NO: 1356207 - DNA, 22 bp, Artificial Sequence
  chemically synthesized
cctcagcctcccaagcagctgg

SEQ ID NO: 1356208 - DNA, 22 bp, Artificial Sequence
  chemically synthesized
agcctcccaagcagctgggatt

SEQ ID NO: 1356209 - DNA, 22 bp, Artificial Sequence
  chemically synthesized
ccaagcagctgggattacacgt

SEQ ID NO: 1356210 - DNA, 22 bp, Artificial Sequence
  chemically synthesized
gacgtggtggtgcacacgtgta

SEQ ID NO: 1356211 - DNA, 22 bp, Artificial Sequence
  chemically synthesized
gctggacgtggtggtgcacacg

SEQ ID NO: 1356212 - DNA, 22 bp, Artificial Sequence
  chemically synthesized
ggattacacgtgtgcaccacca

SEQ ID NO: 1356213 - DNA, 22 bp, Artificial Sequence
  chemically synthesized
cacgtgtgcaccaccacgtcca

SEQ ID NO: 1356214 - DNA, 22 bp, Artificial Sequence
  chemically synthesized
aaaagacaaacattagctggac

SEQ ID NO: 1356215 - DNA, 22 bp, Artificial Sequence
  chemically synthesized
ctaaaaagacaaacattagctg

SEQ ID NO: 1356216 - DNA, 22 bp, Artificial Sequence
  chemically synthesized
tactaaaaagacaaacattagc

SEQ ID NO: 1356217 - DNA, 22 bp, Artificial Sequence
  chemically synthesized
atgtttgtctttttagtagaga

SEQ ID NO: 1356218 - DNA, 22 bp, Artificial Sequence
  chemically synthesized
gtctttttagtagagacggggt

SEQ ID NO: 1356219 - DNA, 22 bp, Artificial Sequence
  chemically synthesized
tctttttagtagagacggggtt

SEQ ID NO: 1356220 - DNA, 22 bp, Artificial Sequence
  chemically synthesized
gccaacatggtgtaaccccgtc

SEQ ID NO: 1356221 - DNA, 22 bp, Artificial Sequence
  chemically synthesized
tttagtagagacggggttacac

SEQ ID NO: 1356222 - DNA, 22 bp, Artificial Sequence
  chemically synthesized
ttagtagagacggggttacacc

SEQ ID NO: 1356223 - DNA, 22 bp, Artificial Sequence
  chemically synthesized
tagtagagacggggttacacca

SEQ ID NO: 1356224 - DNA, 22 bp, Artificial Sequence
  chemically synthesized
agtagagacggggttacaccat

SEQ ID NO: 1356225 - DNA, 22 bp, Artificial Sequence
  chemically synthesized
gtagagacggggttacaccatg

SEQ ID NO: 1356226 - DNA, 22 bp, Artificial Sequence
  chemically synthesized
gagaccagcctggccaacatgg

SEQ ID NO: 1356227 - DNA, 22 bp, Artificial Sequence
  chemically synthesized
caccatgttggccaggctggtc

SEQ ID NO: 1356228 - DNA, 22 bp, Artificial Sequence
  chemically synthesized
aggccaggagttcgagaccagc

SEQ ID NO: 1356229 - DNA, 22 bp, Artificial Sequence
  chemically synthesized
gaggccaggagttcgagaccag

SEQ ID NO: 1356230 - DNA, 22 bp, Artificial Sequence
  chemically synthesized
gccaggctggtctcgaactcct

SEQ ID NO: 1356231 - DNA, 22 bp, Artificial Sequence
  chemically synthesized
gtctcgaactcctggcctcaag

SEQ ID NO: 1356232 - DNA, 22 bp, Artificial Sequence
  chemically synthesized
gaactcctggcctcaagtgatc

SEQ ID NO: 1356233 - DNA, 22 bp, Artificial Sequence
  chemically synthesized
ggaggccaaggcgggaagatca

SEQ ID NO: 1356234 - DNA, 22 bp, Artificial Sequence
  chemically synthesized
ctggcctcaagtgatcttcccg

SEQ ID NO: 1356235 - DNA, 22 bp, Artificial Sequence
  chemically synthesized
gggaggccaaggcgggaagatc

SEQ ID NO: 1356236 - DNA, 22 bp, Artificial Sequence
  chemically synthesized
tgggaggccaaggcgggaagat

SEQ ID NO: 1356237 - DNA, 22 bp, Artificial Sequence
  chemically synthesized
gcctcaagtgatcttcccgcct

SEQ ID NO: 1356238 - DNA, 22 bp, Artificial Sequence
  chemically synthesized
aagtgatcttcccgccttggcc

SEQ ID NO: 1356239 - DNA, 22 bp, Artificial Sequence
  chemically synthesized
cccgccttggcctcccaaagtg

SEQ ID NO: 1356240 - DNA, 22 bp, Artificial Sequence
  chemically synthesized
ccgccttggcctcccaaagtgt

SEQ ID NO: 1356241 - DNA, 22 bp, Artificial Sequence
  chemically synthesized
atgcaagtaatcccaacacttt

SEQ ID NO: 1356242 - DNA, 22 bp, Artificial Sequence
  chemically synthesized
ggcctcccaaagtgttgggatt

SEQ ID NO: 1356243 - DNA, 22 bp, Artificial Sequence
  chemically synthesized
gcctcccaaagtgttgggatta

SEQ ID NO: 1356244 - DNA, 22 bp, Artificial Sequence
  chemically synthesized
ccaaagtgttgggattacttgc

SEQ ID NO: 1356245 - DNA, 22 bp, Artificial Sequence
  chemically synthesized
ggattacttgcatgagccacca

SEQ ID NO: 1356246 - DNA, 22 bp, Artificial Sequence
  chemically synthesized
cttgcatgagccaccatgcctg

SEQ ID NO: 1356247 - DNA, 22 bp, Artificial Sequence
  chemically synthesized
gcatgagccaccatgcctggcc

SEQ ID NO: 1356248 - DNA, 22 bp, Artificial Sequence
  chemically synthesized
catgagccaccatgcctggcct

SEQ ID NO: 1356249 - DNA, 22 bp, Artificial Sequence
  chemically synthesized
gacagtgagcaaaataaaacca

SEQ ID NO: 1356250 - DNA, 22 bp, Artificial Sequence
  chemically synthesized
agacagtgagcaaaataaaacc

SEQ ID NO: 1356251 - DNA, 22 bp, Artificial Sequence
  chemically synthesized
gcctgctttatggttttatttt

SEQ ID NO: 1356252 - DNA, 22 bp, Artificial Sequence
  chemically synthesized
gcttagacagtgagcaaaataa

SEQ ID NO: 1356253 - DNA, 22 bp, Artificial Sequence
  chemically synthesized
ctttatggttttattttgctca

SEQ ID NO: 1356254 - DNA, 22 bp, Artificial Sequence
  chemically synthesized
tatggttttattttgctcactg

SEQ ID NO: 1356255 - DNA, 22 bp, Artificial Sequence
  chemically synthesized
atggttttattttgctcactgt

SEQ ID NO: 1356256 - DNA, 22 bp, Artificial Sequence
  chemically synthesized
gtactagcttagacagtgagca

SEQ ID NO: 1356257 - DNA, 22 bp, Artificial Sequence
  chemically synthesized
tggttttattttgctcactgtc

SEQ ID NO: 1356258 - DNA, 22 bp, Artificial Sequence
  chemically synthesized
acctagtactagcttagacagt

SEQ ID NO: 1356259 - DNA, 22 bp, Artificial Sequence
  chemically synthesized
tattttgctcactgtctaagct

SEQ ID NO: 1356260 - DNA, 22 bp, Artificial Sequence
  chemically synthesized
attttgctcactgtctaagcta

SEQ ID NO: 1356261 - DNA, 22 bp, Artificial Sequence
  chemically synthesized
ctcacctagtactagcttagac

SEQ ID NO: 1356262 - DNA, 22 bp, Artificial Sequence
  chemically synthesized
ttttgctcactgtctaagctag

SEQ ID NO: 1356263 - DNA, 22 bp, Artificial Sequence
  chemically synthesized
ctcctcacctagtactagctta

SEQ ID NO: 1356264 - DNA, 22 bp, Artificial Sequence
  chemically synthesized
tgctcactgtctaagctagtac

SEQ ID NO: 1356265 - DNA, 22 bp, Artificial Sequence
  chemically synthesized
gctcactgtctaagctagtact

SEQ ID NO: 1356266 - DNA, 22 bp, Artificial Sequence
  chemically synthesized
ctcactgtctaagctagtacta

SEQ ID NO: 1356267 - DNA, 22 bp, Artificial Sequence
  chemically synthesized
actgtctaagctagtactaggt

SEQ ID NO: 1356268 - DNA, 22 bp, Artificial Sequence
  chemically synthesized
gcatctactcctcacctagtac

SEQ ID NO: 1356269 - DNA, 22 bp, Artificial Sequence
  chemically synthesized
tagcatctactcctcacctagt

SEQ ID NO: 1356270 - DNA, 22 bp, Artificial Sequence
  chemically synthesized
tctaagctagtactaggtgagg

SEQ ID NO: 1356271 - DNA, 22 bp, Artificial Sequence
  chemically synthesized
ctagcatctactcctcacctag

SEQ ID NO: 1356272 - DNA, 22 bp, Artificial Sequence
  chemically synthesized
agctagtactaggtgaggagta

SEQ ID NO: 1356273 - DNA, 22 bp, Artificial Sequence
  chemically synthesized
gtactaggtgaggagtagatgc

SEQ ID NO: 1356274 - DNA, 22 bp, Artificial Sequence
  chemically synthesized
caatgggtttctagcatctact

SEQ ID NO: 1356275 - DNA, 22 bp, Artificial Sequence
  chemically synthesized
ggtgaggagtagatgctagaaa

SEQ ID NO: 1356276 - DNA, 22 bp, Artificial Sequence
  chemically synthesized
agcaacatattacaatgggttt

SEQ ID NO: 1356277 - DNA, 22 bp, Artificial Sequence
  chemically synthesized
tgagcaacatattacaatgggt

SEQ ID NO: 1356278 - DNA, 22 bp, Artificial Sequence
  chemically synthesized
gctctgagcaacatattacaat

SEQ ID NO: 1356279 - DNA, 22 bp, Artificial Sequence
  chemically synthesized
gaaacccattgtaatatgttgc

SEQ ID NO: 1356280 - DNA, 22 bp, Artificial Sequence
  chemically synthesized
taatatgttgctcagagccagc

SEQ ID NO: 1356281 - DNA, 22 bp, Artificial Sequence
  chemically synthesized
ctcagagccagccatttctctt

SEQ ID NO: 1356282 - DNA, 22 bp, Artificial Sequence
  chemically synthesized
agagccagccatttctctttcc

SEQ ID NO: 1356283 - DNA, 22 bp, Artificial Sequence
  chemically synthesized
ggtatgaatggtggaaagagaa

SEQ ID NO: 1356284 - DNA, 22 bp, Artificial Sequence
  chemically synthesized
gggtatgaatggtggaaagaga

SEQ ID NO: 1356285 - DNA, 22 bp, Artificial Sequence
  chemically synthesized
ggtttgggtatgaatggtggaa

SEQ ID NO: 1356286 - DNA, 22 bp, Artificial Sequence
  chemically synthesized
gggtttgggtatgaatggtgga

SEQ ID NO: 1356287 - DNA, 22 bp, Artificial Sequence
  chemically synthesized
gtttgggtttgggtatgaatgg

SEQ ID NO: 1356288 - DNA, 22 bp, Artificial Sequence
  chemically synthesized
ggtttgggtttgggtatgaatg

SEQ ID NO: 1356289 - DNA, 22 bp, Artificial Sequence
  chemically synthesized
ctctttccaccattcataccca

SEQ ID NO: 1356290 - DNA, 22 bp, Artificial Sequence
  chemically synthesized
tctttccaccattcatacccaa

SEQ ID NO: 1356291 - DNA, 22 bp, Artificial Sequence
  chemically synthesized
tttggtttgggtttgggtatga

SEQ ID NO: 1356292 - DNA, 22 bp, Artificial Sequence
  chemically synthesized
gtttggtttgggtttgggtatg

SEQ ID NO: 1356293 - DNA, 22 bp, Artificial Sequence
  chemically synthesized
tttccaccattcatacccaaac

SEQ ID NO: 1356294 - DNA, 22 bp, Artificial Sequence
  chemically synthesized
ttgtttggtttgggtttgggta

SEQ ID NO: 1356295 - DNA, 22 bp, Artificial Sequence
  chemically synthesized
tccaccattcatacccaaaccc

SEQ ID NO: 1356296 - DNA, 22 bp, Artificial Sequence
  chemically synthesized
ccaccattcatacccaaaccca

SEQ ID NO: 1356297 - DNA, 22 bp, Artificial Sequence
  chemically synthesized
caccattcatacccaaacccaa

SEQ ID NO: 1356298 - DNA, 22 bp, Artificial Sequence
  chemically synthesized
ttcttgtttggtttgggtttgg

SEQ ID NO: 1356299 - DNA, 22 bp, Artificial Sequence
  chemically synthesized
acattattcttgtttggtttgg

SEQ ID NO: 1356300 - DNA, 22 bp, Artificial Sequence
  chemically synthesized
atacccaaacccaaaccaaaca

SEQ ID NO: 1356301 - DNA, 22 bp, Artificial Sequence
  chemically synthesized
tcacattattcttgtttggttt

SEQ ID NO: 1356302 - DNA, 22 bp, Artificial Sequence
  chemically synthesized
atctctcacattattcttgttt

SEQ ID NO: 1356303 - DNA, 22 bp, Artificial Sequence
  chemically synthesized
gcatggctgatctctcacatta

SEQ ID NO: 1356304 - DNA, 22 bp, Artificial Sequence
  chemically synthesized
ataggtcctagcatggctgatc

SEQ ID NO: 1356305 - DNA, 22 bp, Artificial Sequence
  chemically synthesized
aattgataggtcctagcatggc

SEQ ID NO: 1356306 - DNA, 22 bp, Artificial Sequence
  chemically synthesized
acgatgactgaattgataggtc

SEQ ID NO: 1356307 - DNA, 22 bp, Artificial Sequence
  chemically synthesized
aacgatgactgaattgataggt

SEQ ID NO: 1356308 - DNA, 22 bp, Artificial Sequence
  chemically synthesized
cttaacgatgactgaattgata

SEQ ID NO: 1356309 - DNA, 22 bp, Artificial Sequence
  chemically synthesized
ttgcttaacgatgactgaattg

SEQ ID NO: 1356310 - DNA, 22 bp, Artificial Sequence
  chemically synthesized
ggacctatcaattcagtcatcg

SEQ ID NO: 1356311 - DNA, 22 bp, Artificial Sequence
  chemically synthesized
gtgattgttgcttaacgatgac

SEQ ID NO: 1356312 - DNA, 22 bp, Artificial Sequence
  chemically synthesized
tagtgattgttgcttaacgatg

SEQ ID NO: 1356313 - DNA, 22 bp, Artificial Sequence
  chemically synthesized
tcaattcagtcatcgttaagca

SEQ ID NO: 1356314 - DNA, 22 bp, Artificial Sequence
  chemically synthesized
agtctctagtgattgttgctta

SEQ ID NO: 1356315 - DNA, 22 bp, Artificial Sequence
  chemically synthesized
agtcatcgttaagcaacaatca

SEQ ID NO: 1356316 - DNA, 22 bp, Artificial Sequence
  chemically synthesized
agcaacaatcactagagactta

SEQ ID NO: 1356317 - DNA, 22 bp, Artificial Sequence
  chemically synthesized
catatcacatgtactaagtctc

SEQ ID NO: 1356318 - DNA, 22 bp, Artificial Sequence
  chemically synthesized
ttacatatcacatgtactaagt

SEQ ID NO: 1356319 - DNA, 22 bp, Artificial Sequence
  chemically synthesized
ctgttacatatcacatgtacta

SEQ ID NO: 1356320 - DNA, 22 bp, Artificial Sequence
  chemically synthesized
gagacttagtacatgtgatatg

SEQ ID NO: 1356321 - DNA, 22 bp, Artificial Sequence
  chemically synthesized
cacagtgactgctgttacatat

SEQ ID NO: 1356322 - DNA, 22 bp, Artificial Sequence
  chemically synthesized
acacagtgactgctgttacata

SEQ ID NO: 1356323 - DNA, 22 bp, Artificial Sequence
  chemically synthesized
agtacatgtgatatgtaacagc

SEQ ID NO: 1356324 - DNA, 22 bp, Artificial Sequence
  chemically synthesized
gtacatgtgatatgtaacagca

SEQ ID NO: 1356325 - DNA, 22 bp, Artificial Sequence
  chemically synthesized
tttacacagtgactgctgttac

SEQ ID NO: 1356326 - DNA, 22 bp, Artificial Sequence
  chemically synthesized
atttacacagtgactgctgtta

SEQ ID NO: 1356327 - DNA, 22 bp, Artificial Sequence
  chemically synthesized
acaataggcggtgagtttattt

SEQ ID NO: 1356328 - DNA, 22 bp, Artificial Sequence
  chemically synthesized
tcacaataggcggtgagtttat

SEQ ID NO: 1356329 - DNA, 22 bp, Artificial Sequence
  chemically synthesized
ctcacaataggcggtgagttta

SEQ ID NO: 1356330 - DNA, 22 bp, Artificial Sequence
  chemically synthesized
tttctcacaataggcggtgagt

SEQ ID NO: 1356331 - DNA, 22 bp, Artificial Sequence
  chemically synthesized
tgtaaataaactcaccgcctat

SEQ ID NO: 1356332 - DNA, 22 bp, Artificial Sequence
  chemically synthesized
caggtctgtttctcacaatagg

SEQ ID NO: 1356333 - DNA, 22 bp, Artificial Sequence
  chemically synthesized
acaggtctgtttctcacaatag

SEQ ID NO: 1356334 - DNA, 22 bp, Artificial Sequence
  chemically synthesized
tttacaggtctgtttctcacaa

SEQ ID NO: 1356335 - DNA, 22 bp, Artificial Sequence
  chemically synthesized
accgcctattgtgagaaacaga

SEQ ID NO: 1356336 - DNA, 22 bp, Artificial Sequence
  chemically synthesized
tccactgtttacaggtctgttt

SEQ ID NO: 1356337 - DNA, 22 bp, Artificial Sequence
  chemically synthesized
atccactgtttacaggtctgtt

SEQ ID NO: 1356338 - DNA, 22 bp, Artificial Sequence
  chemically synthesized
tatccactgtttacaggtctgt

SEQ ID NO: 1356339 - DNA, 22 bp, Artificial Sequence
  chemically synthesized
ttgtgagaaacagacctgtaaa

SEQ ID NO: 1356340 - DNA, 22 bp, Artificial Sequence
  chemically synthesized
tcctttatccactgtttacagg

SEQ ID NO: 1356341 - DNA, 22 bp, Artificial Sequence
  chemically synthesized
tgagaaacagacctgtaaacag

SEQ ID NO: 1356342 - DNA, 22 bp, Artificial Sequence
  chemically synthesized
gtcctttatccactgtttacag

SEQ ID NO: 1356343 - DNA, 22 bp, Artificial Sequence
  chemically synthesized
ttgtcctttatccactgtttac

SEQ ID NO: 1356344 - DNA, 22 bp, Artificial Sequence
  chemically synthesized
catgcaattcttgtcctttatc

SEQ ID NO: 1356345 - DNA, 22 bp, Artificial Sequence
  chemically synthesized
taaacagtggataaaggacaag

SEQ ID NO: 1356346 - DNA, 22 bp, Artificial Sequence
  chemically synthesized
actgcatgcaattcttgtcctt

SEQ ID NO: 1356347 - DNA, 22 bp, Artificial Sequence
  chemically synthesized
aactgcatgcaattcttgtcct

SEQ ID NO: 1356348 - DNA, 22 bp, Artificial Sequence
  chemically synthesized
taactgcatgcaattcttgtcc

SEQ ID NO: 1356349 - DNA, 22 bp, Artificial Sequence
  chemically synthesized
tttaactgcatgcaattcttgt

SEQ ID NO: 1356350 - DNA, 22 bp, Artificial Sequence
  chemically synthesized
ctttaactgcatgcaattcttg

SEQ ID NO: 1356351 - DNA, 22 bp, Artificial Sequence
  chemically synthesized
tctttaactgcatgcaattctt

SEQ ID NO: 1356352 - DNA, 22 bp, Artificial Sequence
  chemically synthesized
ttctttaactgcatgcaattct

SEQ ID NO: 1356353 - DNA, 22 bp, Artificial Sequence
  chemically synthesized
tttttctttaactgcatgcaat

SEQ ID NO: 1356354 - DNA, 22 bp, Artificial Sequence
  chemically synthesized
cctgtttttctttaactgcatg

SEQ ID NO: 1356355 - DNA, 22 bp, Artificial Sequence
  chemically synthesized
gcctgtttttctttaactgcat

SEQ ID NO: 1356356 - DNA, 22 bp, Artificial Sequence
  chemically synthesized
tgcctgtttttctttaactgca

SEQ ID NO: 1356357 - DNA, 22 bp, Artificial Sequence
  chemically synthesized
catgcagttaaagaaaaacagg

SEQ ID NO: 1356358 - DNA, 22 bp, Artificial Sequence
  chemically synthesized
ccagggtattttgcctgttttt

SEQ ID NO: 1356359 - DNA, 22 bp, Artificial Sequence
  chemically synthesized
aattcccagggtattttgcctg

SEQ ID NO: 1356360 - DNA, 22 bp, Artificial Sequence
  chemically synthesized
tgaattcccagggtattttgcc

SEQ ID NO: 1356361 - DNA, 22 bp, Artificial Sequence
  chemically synthesized
aagaaaaacaggcaaaataccc

SEQ ID NO: 1356362 - DNA, 22 bp, Artificial Sequence
  chemically synthesized
ctctgaattcccagggtatttt

SEQ ID NO: 1356363 - DNA, 22 bp, Artificial Sequence
  chemically synthesized
cctctgaattcccagggtattt

SEQ ID NO: 1356364 - DNA, 22 bp, Artificial Sequence
  chemically synthesized
cttcctctgaattcccagggta

SEQ ID NO: 1356365 - DNA, 22 bp, Artificial Sequence
  chemically synthesized
gcattccttcctctgaattccc

SEQ ID NO: 1356366 - DNA, 22 bp, Artificial Sequence
  chemically synthesized
ggcattccttcctctgaattcc

SEQ ID NO: 1356367 - DNA, 22 bp, Artificial Sequence
  chemically synthesized
ggtgatttggcattccttcctc

SEQ ID NO: 1356368 - DNA, 22 bp, Artificial Sequence
  chemically synthesized
ggaattcagaggaaggaatgcc

SEQ ID NO: 1356369 - DNA, 22 bp, Artificial Sequence
  chemically synthesized
agaggaaggaatgccaaatcac

SEQ ID NO: 1356370 - DNA, 22 bp, Artificial Sequence
  chemically synthesized
gatgtaggtgaactgggtgatt

SEQ ID NO: 1356371 - DNA, 22 bp, Artificial Sequence
  chemically synthesized
agatgtaggtgaactgggtgat

SEQ ID NO: 1356372 - DNA, 22 bp, Artificial Sequence
  chemically synthesized
tagatgtaggtgaactgggtga

SEQ ID NO: 1356373 - DNA, 22 bp, Artificial Sequence
  chemically synthesized
tttagatgtaggtgaactgggt

SEQ ID NO: 1356374 - DNA, 22 bp, Artificial Sequence
  chemically synthesized
ctttagatgtaggtgaactggg

SEQ ID NO: 1356375 - DNA, 22 bp, Artificial Sequence
  chemically synthesized
acctacatctaaagaaggcttt

SEQ ID NO: 1356376 - DNA, 22 bp, Artificial Sequence
  chemically synthesized
atgaacaagaaaaaaagccttc

SEQ ID NO: 1356377 - DNA, 22 bp, Artificial Sequence
  chemically synthesized
gatgaacaagaaaaaaagcctt

SEQ ID NO: 1356378 - DNA, 22 bp, Artificial Sequence
  chemically synthesized
tgatgaacaagaaaaaaagcct

SEQ ID NO: 1356379 - DNA, 22 bp, Artificial Sequence
  chemically synthesized
catctaaagaaggctttttttc

SEQ ID NO: 1356380 - DNA, 22 bp, Artificial Sequence
  chemically synthesized
aagaaggctttttttcttgttc

SEQ ID NO: 1356381 - DNA, 22 bp, Artificial Sequence
  chemically synthesized
caacacgagtattttgatgaac

SEQ ID NO: 1356382 - DNA, 22 bp, Artificial Sequence
  chemically synthesized
tttttcttgttcatcaaaatac

SEQ ID NO: 1356383 - DNA, 22 bp, Artificial Sequence
  chemically synthesized
gttccaacacgagtattttgat

SEQ ID NO: 1356384 - DNA, 22 bp, Artificial Sequence
  chemically synthesized
ttttcttgttcatcaaaatact

SEQ ID NO: 1356385 - DNA, 22 bp, Artificial Sequence
  chemically synthesized
tttcttgttcatcaaaatactc

SEQ ID NO: 1356386 - DNA, 22 bp, Artificial Sequence
  chemically synthesized
ttcttgttcatcaaaatactcg

SEQ ID NO: 1356387 - DNA, 22 bp, Artificial Sequence
  chemically synthesized
tcttgttcatcaaaatactcgt

SEQ ID NO: 1356388 - DNA, 22 bp, Artificial Sequence
  chemically synthesized
cttgttcatcaaaatactcgtg

SEQ ID NO: 1356389 - DNA, 22 bp, Artificial Sequence
  chemically synthesized
ttgttcatcaaaatactcgtgt

SEQ ID NO: 1356390 - DNA, 22 bp, Artificial Sequence
  chemically synthesized
atgctagttccaacacgagtat

SEQ ID NO: 1356391 - DNA, 22 bp, Artificial Sequence
  chemically synthesized
catgctagttccaacacgagta

SEQ ID NO: 1356392 - DNA, 22 bp, Artificial Sequence
  chemically synthesized
gttcatcaaaatactcgtgttg

SEQ ID NO: 1356393 - DNA, 22 bp, Artificial Sequence
  chemically synthesized
ttcatcaaaatactcgtgttgg

SEQ ID NO: 1356394 - DNA, 22 bp, Artificial Sequence
  chemically synthesized
ttcatgctagttccaacacgag

SEQ ID NO: 1356395 - DNA, 22 bp, Artificial Sequence
  chemically synthesized
atcaaaatactcgtgttggaac

SEQ ID NO: 1356396 - DNA, 22 bp, Artificial Sequence
  chemically synthesized
gtgttggaactagcatgaagag

SEQ ID NO: 1356397 - DNA, 22 bp, Artificial Sequence
  chemically synthesized
gaactagcatgaagagtgtcac

SEQ ID NO: 1356398 - DNA, 22 bp, Artificial Sequence
  chemically synthesized
gcatgaagagtgtcacttcacc

SEQ ID NO: 1356399 - DNA, 22 bp, Artificial Sequence
  chemically synthesized
cacaaaagggtaaaaaaggcca

SEQ ID NO: 1356400 - DNA, 22 bp, Artificial Sequence
  chemically synthesized
acacaaaagggtaaaaaaggcc

SEQ ID NO: 1356401 - DNA, 22 bp, Artificial Sequence
  chemically synthesized
tacacaaaagggtaaaaaaggc

SEQ ID NO: 1356402 - DNA, 22 bp, Artificial Sequence
  chemically synthesized
caccttctttggccttttttac

SEQ ID NO: 1356403 - DNA, 22 bp, Artificial Sequence
  chemically synthesized
ttacacaaaagggtaaaaaagg

SEQ ID NO: 1356404 - DNA, 22 bp, Artificial Sequence
  chemically synthesized
accttctttggccttttttacc

SEQ ID NO: 1356405 - DNA, 22 bp, Artificial Sequence
  chemically synthesized
ttttacacaaaagggtaaaaaa

SEQ ID NO: 1356406 - DNA, 22 bp, Artificial Sequence
  chemically synthesized
cttttacacaaaagggtaaaaa

SEQ ID NO: 1356407 - DNA, 22 bp, Artificial Sequence
  chemically synthesized
ctttggccttttttaccctttt

SEQ ID NO: 1356408 - DNA, 22 bp, Artificial Sequence
  chemically synthesized
tttggccttttttacccttttg

SEQ ID NO: 1356409 - DNA, 22 bp, Artificial Sequence
  chemically synthesized
tggccttttttacccttttgtg

SEQ ID NO: 1356410 - DNA, 22 bp, Artificial Sequence
  chemically synthesized
ggccttttttacccttttgtgt

SEQ ID NO: 1356411 - DNA, 22 bp, Artificial Sequence
  chemically synthesized
gccttttttacccttttgtgta

SEQ ID NO: 1356412 - DNA, 22 bp, Artificial Sequence
  chemically synthesized
ttttacccttttgtgtaaaaga

SEQ ID NO: 1356413 - DNA, 22 bp, Artificial Sequence
  chemically synthesized
tttacccttttgtgtaaaagaa

SEQ ID NO: 1356414 - DNA, 22 bp, Artificial Sequence
  chemically synthesized
ttacccttttgtgtaaaagaag

SEQ ID NO: 1356415 - DNA, 22 bp, Artificial Sequence
  chemically synthesized
aagatcaagaatcttcttttac

SEQ ID NO: 1356416 - DNA, 22 bp, Artificial Sequence
  chemically synthesized
tacccttttgtgtaaaagaaga

SEQ ID NO: 1356417 - DNA, 22 bp, Artificial Sequence
  chemically synthesized
gaagatcaagaatcttctttta

SEQ ID NO: 1356418 - DNA, 22 bp, Artificial Sequence
  chemically synthesized
acccttttgtgtaaaagaagat

SEQ ID NO: 1356419 - DNA, 22 bp, Artificial Sequence
  chemically synthesized
tgaagatcaagaatcttctttt

SEQ ID NO: 1356420 - DNA, 22 bp, Artificial Sequence
  chemically synthesized
cccttttgtgtaaaagaagatt

SEQ ID NO: 1356421 - DNA, 22 bp, Artificial Sequence
  chemically synthesized
tgctttgaagatcaagaatctt

SEQ ID NO: 1356422 - DNA, 22 bp, Artificial Sequence
  chemically synthesized
ttgtgtaaaagaagattcttga

SEQ ID NO: 1356423 - DNA, 22 bp, Artificial Sequence
  chemically synthesized
tgtgtaaaagaagattcttgat

SEQ ID NO: 1356424 - DNA, 22 bp, Artificial Sequence
  chemically synthesized
gtgtaaaagaagattcttgatc

SEQ ID NO: 1356425 - DNA, 22 bp, Artificial Sequence
  chemically synthesized
ttatgctttgaagatcaagaat

SEQ ID NO: 1356426 - DNA, 22 bp, Artificial Sequence
  chemically synthesized
tgtaaaagaagattcttgatct

SEQ ID NO: 1356427 - DNA, 22 bp, Artificial Sequence
  chemically synthesized
ttgatcttcaaagcataacagt

SEQ ID NO: 1356428 - DNA, 22 bp, Artificial Sequence
  chemically synthesized
gatcttcaaagcataacagtca

SEQ ID NO: 1356429 - DNA, 22 bp, Artificial Sequence
  chemically synthesized
atcttcaaagcataacagtcat

SEQ ID NO: 1356430 - DNA, 22 bp, Artificial Sequence
  chemically synthesized
caaagcataacagtcatgtttt

SEQ ID NO: 1356431 - DNA, 22 bp, Artificial Sequence
  chemically synthesized
atagagtaaaataaaacatgac

SEQ ID NO: 1356432 - DNA, 22 bp, Artificial Sequence
  chemically synthesized
aaagcataacagtcatgtttta

SEQ ID NO: 1356433 - DNA, 22 bp, Artificial Sequence
  chemically synthesized
ctcatagagtaaaataaaacat

SEQ ID NO: 1356434 - DNA, 22 bp, Artificial Sequence
  chemically synthesized
atgaatctgctcatagagtaaa

SEQ ID NO: 1356435 - DNA, 22 bp, Artificial Sequence
  chemically synthesized
aatgaatctgctcatagagtaa

SEQ ID NO: 1356436 - DNA, 22 bp, Artificial Sequence
  chemically synthesized
ttaatgaatctgctcatagagt

SEQ ID NO: 1356437 - DNA, 22 bp, Artificial Sequence
  chemically synthesized
tattttactctatgagcagatt

SEQ ID NO: 1356438 - DNA, 22 bp, Artificial Sequence
  chemically synthesized
acattcttaatgaatctgctca

SEQ ID NO: 1356439 - DNA, 22 bp, Artificial Sequence
  chemically synthesized
attttactctatgagcagattc

SEQ ID NO: 1356440 - DNA, 22 bp, Artificial Sequence
  chemically synthesized
cacattcttaatgaatctgctc

SEQ ID NO: 1356441 - DNA, 22 bp, Artificial Sequence
  chemically synthesized
ttttactctatgagcagattca

SEQ ID NO: 1356442 - DNA, 22 bp, Artificial Sequence
  chemically synthesized
tcacattcttaatgaatctgct

SEQ ID NO: 1356443 - DNA, 22 bp, Artificial Sequence
  chemically synthesized
tactctatgagcagattcatta

SEQ ID NO: 1356444 - DNA, 22 bp, Artificial Sequence
  chemically synthesized
actctatgagcagattcattaa

SEQ ID NO: 1356445 - DNA, 22 bp, Artificial Sequence
  chemically synthesized
ctctatgagcagattcattaag

SEQ ID NO: 1356446 - DNA, 22 bp, Artificial Sequence
  chemically synthesized
tatgagcagattcattaagaat

SEQ ID NO: 1356447 - DNA, 22 bp, Artificial Sequence
  chemically synthesized
tgagcagattcattaagaatgt

SEQ ID NO: 1356448 - DNA, 22 bp, Artificial Sequence
  chemically synthesized
aatgaatgggaatactttcaca

SEQ ID NO: 1356449 - DNA, 22 bp, Artificial Sequence
  chemically synthesized
gaatgaatgggaatactttcac

SEQ ID NO: 1356450 - DNA, 22 bp, Artificial Sequence
  chemically synthesized
attaagaatgtgaaagtattcc

SEQ ID NO: 1356451 - DNA, 22 bp, Artificial Sequence
  chemically synthesized
atttgaatgaatgggaatactt

SEQ ID NO: 1356452 - DNA, 22 bp, Artificial Sequence
  chemically synthesized
agaatgtgaaagtattcccatt

SEQ ID NO: 1356453 - DNA, 22 bp, Artificial Sequence
  chemically synthesized
atgttaatttgaatgaatggga

SEQ ID NO: 1356454 - DNA, 22 bp, Artificial Sequence
  chemically synthesized
aatgttaatttgaatgaatggg

SEQ ID NO: 1356455 - DNA, 22 bp, Artificial Sequence
  chemically synthesized
taatgttaatttgaatgaatgg

SEQ ID NO: 1356456 - DNA, 22 bp, Artificial Sequence
  chemically synthesized
ttaatgttaatttgaatgaatg

SEQ ID NO: 1356457 - DNA, 22 bp, Artificial Sequence
  chemically synthesized
ccattcattcaaattaacatta

SEQ ID NO: 1356458 - DNA, 22 bp, Artificial Sequence
  chemically synthesized
ggagagtgtcttttaatgttaa

SEQ ID NO: 1356459 - DNA, 22 bp, Artificial Sequence
  chemically synthesized
attgggagagtgtcttttaatg

SEQ ID NO: 1356460 - DNA, 22 bp, Artificial Sequence
  chemically synthesized
attcaaattaacattaaaagac

SEQ ID NO: 1356461 - DNA, 22 bp, Artificial Sequence
  chemically synthesized
ttcattgggagagtgtctttta

SEQ ID NO: 1356462 - DNA, 22 bp, Artificial Sequence
  chemically synthesized
attcattgggagagtgtctttt

SEQ ID NO: 1356463 - DNA, 22 bp, Artificial Sequence
  chemically synthesized
aaattaacattaaaagacactc

SEQ ID NO: 1356464 - DNA, 22 bp, Artificial Sequence
  chemically synthesized
acattaaaagacactctcccaa

SEQ ID NO: 1356465 - DNA, 22 bp, Artificial Sequence
  chemically synthesized
acatcttattcattgggagagt

SEQ ID NO: 1356466 - DNA, 22 bp, Artificial Sequence
  chemically synthesized
gacatcttattcattgggagag

SEQ ID NO: 1356467 - DNA, 22 bp, Artificial Sequence
  chemically synthesized
tgacatcttattcattgggaga

SEQ ID NO: 1356468 - DNA, 22 bp, Artificial Sequence
  chemically synthesized
ttgacatcttattcattgggag

SEQ ID NO: 1356469 - DNA, 22 bp, Artificial Sequence
  chemically synthesized
aaagacactctcccaatgaata

SEQ ID NO: 1356470 - DNA, 22 bp, Artificial Sequence
  chemically synthesized
acatgatttttgacatcttatt

SEQ ID NO: 1356471 - DNA, 22 bp, Artificial Sequence
  chemically synthesized
ctaacatgatttttgacatctt

SEQ ID NO: 1356472 - DNA, 22 bp, Artificial Sequence
  chemically synthesized
tcccaatgaataagatgtcaaa

SEQ ID NO: 1356473 - DNA, 22 bp, Artificial Sequence
  chemically synthesized
ccaatgaataagatgtcaaaaa

SEQ ID NO: 1356474 - DNA, 22 bp, Artificial Sequence
  chemically synthesized
caattactaacatgatttttga

SEQ ID NO: 1356475 - DNA, 22 bp, Artificial Sequence
  chemically synthesized
actgcaattactaacatgattt

SEQ ID NO: 1356476 - DNA, 22 bp, Artificial Sequence
  chemically synthesized
attgactgcaattactaacatg

SEQ ID NO: 1356477 - DNA, 22 bp, Artificial Sequence
  chemically synthesized
cattgactgcaattactaacat

SEQ ID NO: 1356478 - DNA, 22 bp, Artificial Sequence
  chemically synthesized
atttcattgactgcaattacta

SEQ ID NO: 1356479 - DNA, 22 bp, Artificial Sequence
  chemically synthesized
gtaattgcagtcaatgaaatga

SEQ ID NO: 1356480 - DNA, 22 bp, Artificial Sequence
  chemically synthesized
cagtcaatgaaatgaatgctct

SEQ ID NO: 1356481 - DNA, 22 bp, Artificial Sequence
  chemically synthesized
tgctctcatgctgcatgcctat

SEQ ID NO: 1356482 - DNA, 22 bp, Artificial Sequence
  chemically synthesized
ctctcatgctgcatgcctattt

SEQ ID NO: 1356483 - DNA, 22 bp, Artificial Sequence
  chemically synthesized
agtcgatgagtacaaataggca

SEQ ID NO: 1356484 - DNA, 22 bp, Artificial Sequence
  chemically synthesized
tcatgctgcatgcctatttgta

SEQ ID NO: 1356485 - DNA, 22 bp, Artificial Sequence
  chemically synthesized
atgctgcatgcctatttgtact

SEQ ID NO: 1356486 - DNA, 22 bp, Artificial Sequence
  chemically synthesized
gtgctcagtcgatgagtacaaa

SEQ ID NO: 1356487 - DNA, 22 bp, Artificial Sequence
  chemically synthesized
catgcctatttgtactcatcga

SEQ ID NO: 1356488 - DNA, 22 bp, Artificial Sequence
  chemically synthesized
gttagtgctcagtcgatgagta

SEQ ID NO: 1356489 - DNA, 22 bp, Artificial Sequence
  chemically synthesized
tcgttagtgctcagtcgatgag

SEQ ID NO: 1356490 - DNA, 22 bp, Artificial Sequence
  chemically synthesized
ctcgttagtgctcagtcgatga

SEQ ID NO: 1356491 - DNA, 22 bp, Artificial Sequence
  chemically synthesized
tttgtactcatcgactgagcac

SEQ ID NO: 1356492 - DNA, 22 bp, Artificial Sequence
  chemically synthesized
gtactcatcgactgagcactaa

SEQ ID NO: 1356493 - DNA, 22 bp, Artificial Sequence
  chemically synthesized
tactcatcgactgagcactaac

SEQ ID NO: 1356494 - DNA, 22 bp, Artificial Sequence
  chemically synthesized
ggtgtgtatttctcgttagtgc

SEQ ID NO: 1356495 - DNA, 22 bp, Artificial Sequence
  chemically synthesized
atcgactgagcactaacgagaa

SEQ ID NO: 1356496 - DNA, 22 bp, Artificial Sequence
  chemically synthesized
agttaggtgtgtatttctcgtt

SEQ ID NO: 1356497 - DNA, 22 bp, Artificial Sequence
  chemically synthesized
taagttaggtgtgtatttctcg

SEQ ID NO: 1356498 - DNA, 22 bp, Artificial Sequence
  chemically synthesized
ttctaagttaggtgtgtatttc

SEQ ID NO: 1356499 - DNA, 22 bp, Artificial Sequence
  chemically synthesized
agcactaacgagaaatacacac

SEQ ID NO: 1356500 - DNA, 22 bp, Artificial Sequence
  chemically synthesized
ctgttctaagttaggtgtgtat

SEQ ID NO: 1356501 - DNA, 22 bp, Artificial Sequence
  chemically synthesized
tgctgttctaagttaggtgtgt

SEQ ID NO: 1356502 - DNA, 22 bp, Artificial Sequence
  chemically synthesized
ctgctgttctaagttaggtgtg

SEQ ID NO: 1356503 - DNA, 22 bp, Artificial Sequence
  chemically synthesized
acgagaaatacacacctaactt

SEQ ID NO: 1356504 - DNA, 22 bp, Artificial Sequence
  chemically synthesized
cttctgctgttctaagttaggt

SEQ ID NO: 1356505 - DNA, 22 bp, Artificial Sequence
  chemically synthesized
ctccttctgctgttctaagtta

SEQ ID NO: 1356506 - DNA, 22 bp, Artificial Sequence
  chemically synthesized
aagcatctgctccttctgctgt

SEQ ID NO: 1356507 - DNA, 22 bp, Artificial Sequence
  chemically synthesized
aaagcatctgctccttctgctg

SEQ ID NO: 1356508 - DNA, 22 bp, Artificial Sequence
  chemically synthesized
acttagaacagcagaaggagca

SEQ ID NO: 1356509 - DNA, 22 bp, Artificial Sequence
  chemically synthesized
tcttaaagcatctgctccttct

SEQ ID NO: 1356510 - DNA, 22 bp, Artificial Sequence
  chemically synthesized
agaacagcagaaggagcagatg

SEQ ID NO: 1356511 - DNA, 22 bp, Artificial Sequence
  chemically synthesized
gaacagcagaaggagcagatgc

SEQ ID NO: 1356512 - DNA, 22 bp, Artificial Sequence
  chemically synthesized
agaaatattatcttaaagcatc

SEQ ID NO: 1356513 - DNA, 22 bp, Artificial Sequence
  chemically synthesized
ctgagaaatattatcttaaagc

SEQ ID NO: 1356514 - DNA, 22 bp, Artificial Sequence
  chemically synthesized
catattactgagaaatattatc

SEQ ID NO: 1356515 - DNA, 22 bp, Artificial Sequence
  chemically synthesized
ttgcatattactgagaaatatt

SEQ ID NO: 1356516 - DNA, 22 bp, Artificial Sequence
  chemically synthesized
aattgttgcatattactgagaa

SEQ ID NO: 1356517 - DNA, 22 bp, Artificial Sequence
  chemically synthesized
taagataatatttctcagtaat

SEQ ID NO: 1356518 - DNA, 22 bp, Artificial Sequence
  chemically synthesized
aagataatatttctcagtaata

SEQ ID NO: 1356519 - DNA, 22 bp, Artificial Sequence
  chemically synthesized
agataatatttctcagtaatat

SEQ ID NO: 1356520 - DNA, 22 bp, Artificial Sequence
  chemically synthesized
aaattaaattgttgcatattac

SEQ ID NO: 1356521 - DNA, 22 bp, Artificial Sequence
  chemically synthesized
gaaattaaattgttgcatatta

SEQ ID NO: 1356522 - DNA, 22 bp, Artificial Sequence
  chemically synthesized
ctcagtaatatgcaacaattta

SEQ ID NO: 1356523 - DNA, 22 bp, Artificial Sequence
  chemically synthesized
agtatttgaaattaaattgttg

SEQ ID NO: 1356524 - DNA, 22 bp, Artificial Sequence
  chemically synthesized
tcagtaatatgcaacaatttaa

SEQ ID NO: 1356525 - DNA, 22 bp, Artificial Sequence
  chemically synthesized
agtaatatgcaacaatttaatt

SEQ ID NO: 1356526 - DNA, 22 bp, Artificial Sequence
  chemically synthesized
caaggcccagaagttcagtatt

SEQ ID NO: 1356527 - DNA, 22 bp, Artificial Sequence
  chemically synthesized
ccaaggcccagaagttcagtat

SEQ ID NO: 1356528 - DNA, 22 bp, Artificial Sequence
  chemically synthesized
aatttcaaatactgaacttctg

SEQ ID NO: 1356529 - DNA, 22 bp, Artificial Sequence
  chemically synthesized
atttcaaatactgaacttctgg

SEQ ID NO: 1356530 - DNA, 22 bp, Artificial Sequence
  chemically synthesized
caaatactgaacttctgggcct

SEQ ID NO: 1356531 - DNA, 22 bp, Artificial Sequence
  chemically synthesized
aaatactgaacttctgggcctt

SEQ ID NO: 1356532 - DNA, 22 bp, Artificial Sequence
  chemically synthesized
tatatgtaatttccaaggccca

SEQ ID NO: 1356533 - DNA, 22 bp, Artificial Sequence
  chemically synthesized
aacttctgggccttggaaatta

SEQ ID NO: 1356534 - DNA, 22 bp, Artificial Sequence
  chemically synthesized
caaaacctgtatatgtaatttc

SEQ ID NO: 1356535 - DNA, 22 bp, Artificial Sequence
  chemically synthesized
ctgggccttggaaattacatat

SEQ ID NO: 1356536 - DNA, 22 bp, Artificial Sequence
  chemically synthesized
tgggccttggaaattacatata

SEQ ID NO: 1356537 - DNA, 22 bp, Artificial Sequence
  chemically synthesized
actgcaaaacctgtatatgtaa

SEQ ID NO: 1356538 - DNA, 22 bp, Artificial Sequence
  chemically synthesized
ggccttggaaattacatataca

SEQ ID NO: 1356539 - DNA, 22 bp, Artificial Sequence
  chemically synthesized
gactgcaaaacctgtatatgta

SEQ ID NO: 1356540 - DNA, 22 bp, Artificial Sequence
  chemically synthesized
atttgactgcaaaacctgtata

SEQ ID NO: 1356541 - DNA, 22 bp, Artificial Sequence
  chemically synthesized
ggaaattacatatacaggtttt

SEQ ID NO: 1356542 - DNA, 22 bp, Artificial Sequence
  chemically synthesized
gaaattacatatacaggttttg

SEQ ID NO: 1356543 - DNA, 22 bp, Artificial Sequence
  chemically synthesized
catatacaggttttgcagtcaa

SEQ ID NO: 1356544 - DNA, 22 bp, Artificial Sequence
  chemically synthesized
aacaatactcatttgactgcaa

SEQ ID NO: 1356545 - DNA, 22 bp, Artificial Sequence
  chemically synthesized
atatgtctaaacaatactcatt

SEQ ID NO: 1356546 - DNA, 22 bp, Artificial Sequence
  chemically synthesized
aatatgtctaaacaatactcat

SEQ ID NO: 1356547 - DNA, 22 bp, Artificial Sequence
  chemically synthesized
tgcagtcaaatgagtattgttt

SEQ ID NO: 1356548 - DNA, 22 bp, Artificial Sequence
  chemically synthesized
gcagtcaaatgagtattgttta

SEQ ID NO: 1356549 - DNA, 22 bp, Artificial Sequence
  chemically synthesized
cagtcaaatgagtattgtttag

SEQ ID NO: 1356550 - DNA, 22 bp, Artificial Sequence
  chemically synthesized
agcacatttaatatgtctaaac

SEQ ID NO: 1356551 - DNA, 22 bp, Artificial Sequence
  chemically synthesized
gatctcagcacatttaatatgt

SEQ ID NO: 1356552 - DNA, 22 bp, Artificial Sequence
  chemically synthesized
agatctcagcacatttaatatg

SEQ ID NO: 1356553 - DNA, 22 bp, Artificial Sequence
  chemically synthesized
tagatctcagcacatttaatat

SEQ ID NO: 1356554 - DNA, 22 bp, Artificial Sequence
  chemically synthesized
tttagacatattaaatgtgctg

SEQ ID NO: 1356555 - DNA, 22 bp, Artificial Sequence
  chemically synthesized
agacatattaaatgtgctgaga

SEQ ID NO: 1356556 - DNA, 22 bp, Artificial Sequence
  chemically synthesized
gacatattaaatgtgctgagat

SEQ ID NO: 1356557 - DNA, 22 bp, Artificial Sequence
  chemically synthesized
atgaaattttagatctcagcac

SEQ ID NO: 1356558 - DNA, 22 bp, Artificial Sequence
  chemically synthesized
aaaactgatgaaattttagatc

SEQ ID NO: 1356559 - DNA, 22 bp, Artificial Sequence
  chemically synthesized
gaaaactgatgaaattttagat

SEQ ID NO: 1356560 - DNA, 22 bp, Artificial Sequence
  chemically synthesized
aatgtgctgagatctaaaattt

SEQ ID NO: 1356561 - DNA, 22 bp, Artificial Sequence
  chemically synthesized
aatttgaaaactgatgaaattt

SEQ ID NO: 1356562 - DNA, 22 bp, Artificial Sequence
  chemically synthesized
aaatttgaaaactgatgaaatt

SEQ ID NO: 1356563 - DNA, 22 bp, Artificial Sequence
  chemically synthesized
agatctaaaatttcatcagttt

SEQ ID NO: 1356564 - DNA, 22 bp, Artificial Sequence
  chemically synthesized
gcttaaatttgaaaactgatga

SEQ ID NO: 1356565 - DNA, 22 bp, Artificial Sequence
  chemically synthesized
tggcttaaatttgaaaactgat

SEQ ID NO: 1356566 - DNA, 22 bp, Artificial Sequence
  chemically synthesized
aaatttcatcagttttcaaatt

SEQ ID NO: 1356567 - DNA, 22 bp, Artificial Sequence
  chemically synthesized
ccctctggcttaaatttgaaaa

SEQ ID NO: 1356568 - DNA, 22 bp, Artificial Sequence
  chemically synthesized
cccctctggcttaaatttgaaa

SEQ ID NO: 1356569 - DNA, 22 bp, Artificial Sequence
  chemically synthesized
catcagttttcaaatttaagcc

SEQ ID NO: 1356570 - DNA, 22 bp, Artificial Sequence
  chemically synthesized
atcagttttcaaatttaagcca

SEQ ID NO: 1356571 - DNA, 22 bp, Artificial Sequence
  chemically synthesized
gggtatatttcccctctggctt

SEQ ID NO: 1356572 - DNA, 22 bp, Artificial Sequence
  chemically synthesized
tcaaatttaagccagaggggaa

SEQ ID NO: 1356573 - DNA, 22 bp, Artificial Sequence
  chemically synthesized
caaatttaagccagaggggaaa

SEQ ID NO: 1356574 - DNA, 22 bp, Artificial Sequence
  chemically synthesized
aaatttaagccagaggggaaat

SEQ ID NO: 1356575 - DNA, 22 bp, Artificial Sequence
  chemically synthesized
aaccattagggtatatttcccc

SEQ ID NO: 1356576 - DNA, 22 bp, Artificial Sequence
  chemically synthesized
gaaccattagggtatatttccc

SEQ ID NO: 1356577 - DNA, 22 bp, Artificial Sequence
  chemically synthesized
tgaaccattagggtatatttcc

SEQ ID NO: 1356578 - DNA, 22 bp, Artificial Sequence
  chemically synthesized
ttgaaccattagggtatatttc

SEQ ID NO: 1356579 - DNA, 22 bp, Artificial Sequence
  chemically synthesized
aagccagaggggaaatataccc

SEQ ID NO: 1356580 - DNA, 22 bp, Artificial Sequence
  chemically synthesized
agccagaggggaaatataccct

SEQ ID NO: 1356581 - DNA, 22 bp, Artificial Sequence
  chemically synthesized
agggtttttgaaccattagggt

SEQ ID NO: 1356582 - DNA, 22 bp, Artificial Sequence
  chemically synthesized
aattgagggtttttgaaccatt

SEQ ID NO: 1356583 - DNA, 22 bp, Artificial Sequence
  chemically synthesized
aaattgagggtttttgaaccat

SEQ ID NO: 1356584 - DNA, 22 bp, Artificial Sequence
  chemically synthesized
atggttcaaaaaccctcaattt

SEQ ID NO: 1356585 - DNA, 22 bp, Artificial Sequence
  chemically synthesized
tataaaccagaatttaaattga

SEQ ID NO: 1356586 - DNA, 22 bp, Artificial Sequence
  chemically synthesized
ctatataaaccagaatttaaat

SEQ ID NO: 1356587 - DNA, 22 bp, Artificial Sequence
  chemically synthesized
aaaaaccctcaatttaaattct

SEQ ID NO: 1356588 - DNA, 22 bp, Artificial Sequence
  chemically synthesized
aatttaaattctggtttatata

SEQ ID NO: 1356589 - DNA, 22 bp, Artificial Sequence
  chemically synthesized
aaattctggtttatatagcaat

SEQ ID NO: 1356590 - DNA, 22 bp, Artificial Sequence
  chemically synthesized
aattctggtttatatagcaatg

SEQ ID NO: 1356591 - DNA, 22 bp, Artificial Sequence
  chemically synthesized
aagtaaccaagatcattgctat

SEQ ID NO: 1356592 - DNA, 22 bp, Artificial Sequence
  chemically synthesized
aaagtaaccaagatcattgcta

SEQ ID NO: 1356593 - DNA, 22 bp, Artificial Sequence
  chemically synthesized
tggtttatatagcaatgatctt

SEQ ID NO: 1356594 - DNA, 22 bp, Artificial Sequence
  chemically synthesized
gtttatatagcaatgatcttgg

SEQ ID NO: 1356595 - DNA, 22 bp, Artificial Sequence
  chemically synthesized
atatagcaatgatcttggttac

SEQ ID NO: 1356596 - DNA, 22 bp, Artificial Sequence
  chemically synthesized
tatagcaatgatcttggttact

SEQ ID NO: 1356597 - DNA, 22 bp, Artificial Sequence
  chemically synthesized
gaaataaatttaaagtaaccaa

SEQ ID NO: 1356598 - DNA, 22 bp, Artificial Sequence
  chemically synthesized
agaaataaatttaaagtaacca

SEQ ID NO: 1356599 - DNA, 22 bp, Artificial Sequence
  chemically synthesized
ggttactttaaatttatttcta

SEQ ID NO: 1356600 - DNA, 22 bp, Artificial Sequence
  chemically synthesized
gttactttaaatttatttctaa

SEQ ID NO: 1356601 - DNA, 22 bp, Artificial Sequence
  chemically synthesized
ctttaaatttatttctaagcca

SEQ ID NO: 1356602 - DNA, 22 bp, Artificial Sequence
  chemically synthesized
aaagaaaaaaatcatggcttag

SEQ ID NO: 1356603 - DNA, 22 bp, Artificial Sequence
  chemically synthesized
taaatttatttctaagccatga

SEQ ID NO: 1356604 - DNA, 22 bp, Artificial Sequence
  chemically synthesized
aaatttatttctaagccatgat

SEQ ID NO: 1356605 - DNA, 22 bp, Artificial Sequence
  chemically synthesized
aatttatttctaagccatgatt

SEQ ID NO: 1356606 - DNA, 22 bp, Artificial Sequence
  chemically synthesized
ccactaaaagaaaaaaatcatg

SEQ ID NO: 1356607 - DNA, 22 bp, Artificial Sequence
  chemically synthesized
gccactaaaagaaaaaaatcat

SEQ ID NO: 1356608 - DNA, 22 bp, Artificial Sequence
  chemically synthesized
atttctaagccatgattttttt

SEQ ID NO: 1356609 - DNA, 22 bp, Artificial Sequence
  chemically synthesized
tttctaagccatgatttttttc

SEQ ID NO: 1356610 - DNA, 22 bp, Artificial Sequence
  chemically synthesized
ctaagccatgatttttttcttt

SEQ ID NO: 1356611 - DNA, 22 bp, Artificial Sequence
  chemically synthesized
taagccatgatttttttctttt

SEQ ID NO: 1356612 - DNA, 22 bp, Artificial Sequence
  chemically synthesized
agccatgatttttttcttttag

SEQ ID NO: 1356613 - DNA, 22 bp, Artificial Sequence
  chemically synthesized
taatatttgccactaaaagaaa

SEQ ID NO: 1356614 - DNA, 22 bp, Artificial Sequence
  chemically synthesized
ttgtaatatttgccactaaaag

SEQ ID NO: 1356615 - DNA, 22 bp, Artificial Sequence
  chemically synthesized
ttattgtaatatttgccactaa

SEQ ID NO: 1356616 - DNA, 22 bp, Artificial Sequence
  chemically synthesized
attattgtaatatttgccacta

SEQ ID NO: 1356617 - DNA, 22 bp, Artificial Sequence
  chemically synthesized
ttttcttttagtggcaaatatt

SEQ ID NO: 1356618 - DNA, 22 bp, Artificial Sequence
  chemically synthesized
tttcttttagtggcaaatatta

SEQ ID NO: 1356619 - DNA, 22 bp, Artificial Sequence
  chemically synthesized
aatttattattgtaatatttgc

SEQ ID NO: 1356620 - DNA, 22 bp, Artificial Sequence
  chemically synthesized
ttcttttagtggcaaatattac

SEQ ID NO: 1356621 - DNA, 22 bp, Artificial Sequence
  chemically synthesized
gaatttattattgtaatatttg

SEQ ID NO: 1356622 - DNA, 22 bp, Artificial Sequence
  chemically synthesized
tcttttagtggcaaatattaca

SEQ ID NO: 1356623 - DNA, 22 bp, Artificial Sequence
  chemically synthesized
cttttagtggcaaatattacaa

SEQ ID NO: 1356624 - DNA, 22 bp, Artificial Sequence
  chemically synthesized
ttttagtggcaaatattacaat

SEQ ID NO: 1356625 - DNA, 22 bp, Artificial Sequence
  chemically synthesized
ccttgaatttattattgtaata

SEQ ID NO: 1356626 - DNA, 22 bp, Artificial Sequence
  chemically synthesized
ttagtggcaaatattacaataa

SEQ ID NO: 1356627 - DNA, 22 bp, Artificial Sequence
  chemically synthesized
tagtggcaaatattacaataat

SEQ ID NO: 1356628 - DNA, 22 bp, Artificial Sequence
  chemically synthesized
agtggcaaatattacaataata

SEQ ID NO: 1356629 - DNA, 22 bp, Artificial Sequence
  chemically synthesized
gtggcaaatattacaataataa

SEQ ID NO: 1356630 - DNA, 22 bp, Artificial Sequence
  chemically synthesized
acattcccttgaatttattatt

SEQ ID NO: 1356631 - DNA, 22 bp, Artificial Sequence
  chemically synthesized
aacattcccttgaatttattat

SEQ ID NO: 1356632 - DNA, 22 bp, Artificial Sequence
  chemically synthesized
taacattcccttgaatttatta

SEQ ID NO: 1356633 - DNA, 22 bp, Artificial Sequence
  chemically synthesized
caataataaattcaagggaatg

SEQ ID NO: 1356634 - DNA, 22 bp, Artificial Sequence
  chemically synthesized
gtgggtatgattttaacattcc

SEQ ID NO: 1356635 - DNA, 22 bp, Artificial Sequence
  chemically synthesized
ttggtgggtatgattttaacat

SEQ ID NO: 1356636 - DNA, 22 bp, Artificial Sequence
  chemically synthesized
gttggtgggtatgattttaaca

SEQ ID NO: 1356637 - DNA, 22 bp, Artificial Sequence
  chemically synthesized
tgttggtgggtatgattttaac

SEQ ID NO: 1356638 - DNA, 22 bp, Artificial Sequence
  chemically synthesized
ttgttggtgggtatgattttaa

SEQ ID NO: 1356639 - DNA, 22 bp, Artificial Sequence
  chemically synthesized
tttgttggtgggtatgatttta

SEQ ID NO: 1356640 - DNA, 22 bp, Artificial Sequence
  chemically synthesized
aagggaatgttaaaatcatacc

SEQ ID NO: 1356641 - DNA, 22 bp, Artificial Sequence
  chemically synthesized
ctttttgttggtgggtatgatt

SEQ ID NO: 1356642 - DNA, 22 bp, Artificial Sequence
  chemically synthesized
aaatcatacccaccaacaaaaa

SEQ ID NO: 1356643 - DNA, 22 bp, Artificial Sequence
  chemically synthesized
agaggtatgaattactttttgt

SEQ ID NO: 1356644 - DNA, 22 bp, Artificial Sequence
  chemically synthesized
cagaggtatgaattactttttg

SEQ ID NO: 1356645 - DNA, 22 bp, Artificial Sequence
  chemically synthesized
acttcagaggtatgaattactt

SEQ ID NO: 1356646 - DNA, 22 bp, Artificial Sequence
  chemically synthesized
aaatagctaacttcagaggtat

SEQ ID NO: 1356647 - DNA, 22 bp, Artificial Sequence
  chemically synthesized
tccaactaaaatagctaacttc

SEQ ID NO: 1356648 - DNA, 22 bp, Artificial Sequence
  chemically synthesized
atacctctgaagttagctattt

SEQ ID NO: 1356649 - DNA, 22 bp, Artificial Sequence
  chemically synthesized
tgaagttagctattttagttgg

SEQ ID NO: 1356650 - DNA, 22 bp, Artificial Sequence
  chemically synthesized
aagttagctattttagttggac

SEQ ID NO: 1356651 - DNA, 22 bp, Artificial Sequence
  chemically synthesized
gctattttagttggacaatact

SEQ ID NO: 1356652 - DNA, 22 bp, Artificial Sequence
  chemically synthesized
ttttagttggacaatactctta

SEQ ID NO: 1356653 - DNA, 22 bp, Artificial Sequence
  chemically synthesized
tagttggacaatactcttacct

SEQ ID NO: 1356654 - DNA, 22 bp, Artificial Sequence
  chemically synthesized
agttggacaatactcttacctt

SEQ ID NO: 1356655 - DNA, 22 bp, Artificial Sequence
  chemically synthesized
gttggacaatactcttaccttg

SEQ ID NO: 1356656 - DNA, 22 bp, Artificial Sequence
  chemically synthesized
atagcataagtcgcaaggtaag

SEQ ID NO: 1356657 - DNA, 22 bp, Artificial Sequence
  chemically synthesized
gacaatactcttaccttgcgac

SEQ ID NO: 1356658 - DNA, 22 bp, Artificial Sequence
  chemically synthesized
ttaccttgcgacttatgctatt

SEQ ID NO: 1356659 - DNA, 22 bp, Artificial Sequence
  chemically synthesized
accttgcgacttatgctattag

SEQ ID NO: 1356660 - DNA, 22 bp, Artificial Sequence
  chemically synthesized
ccttgcgacttatgctattaga

SEQ ID NO: 1356661 - DNA, 22 bp, Artificial Sequence
  chemically synthesized
gcgacttatgctattagattcc

SEQ ID NO: 1356662 - DNA, 22 bp, Artificial Sequence
  chemically synthesized
cgacttatgctattagattcct

SEQ ID NO: 1356663 - DNA, 22 bp, Artificial Sequence
  chemically synthesized
taaaaagatgaacacaggaatc

SEQ ID NO: 1356664 - DNA, 22 bp, Artificial Sequence
  chemically synthesized
atgctattagattcctgtgttc

SEQ ID NO: 1356665 - DNA, 22 bp, Artificial Sequence
  chemically synthesized
tgctattagattcctgtgttca

SEQ ID NO: 1356666 - DNA, 22 bp, Artificial Sequence
  chemically synthesized
tgtgctataaaaagatgaacac

SEQ ID NO: 1356667 - DNA, 22 bp, Artificial Sequence
  chemically synthesized
gtgtgctataaaaagatgaaca

SEQ ID NO: 1356668 - DNA, 22 bp, Artificial Sequence
  chemically synthesized
ttagattcctgtgttcatcttt

SEQ ID NO: 1356669 - DNA, 22 bp, Artificial Sequence
  chemically synthesized
gattcctgtgttcatcttttta

SEQ ID NO: 1356670 - DNA, 22 bp, Artificial Sequence
  chemically synthesized
tgtatttgtgtgctataaaaag

SEQ ID NO: 1356671 - DNA, 22 bp, Artificial Sequence
  chemically synthesized
ctgtgttcatctttttatagca

SEQ ID NO: 1356672 - DNA, 22 bp, Artificial Sequence
  chemically synthesized
tgttcatctttttatagcacac

SEQ ID NO: 1356673 - DNA, 22 bp, Artificial Sequence
  chemically synthesized
atctttttatagcacacaaata

SEQ ID NO: 1356674 - DNA, 22 bp, Artificial Sequence
  chemically synthesized
tttatagcacacaaatacacag

SEQ ID NO: 1356675 - DNA, 22 bp, Artificial Sequence
  chemically synthesized
ttatagcacacaaatacacagg

SEQ ID NO: 1356676 - DNA, 22 bp, Artificial Sequence
  chemically synthesized
tgtgagtgaacacctgtgtatt

SEQ ID NO: 1356677 - DNA, 22 bp, Artificial Sequence
  chemically synthesized
tatagcacacaaatacacaggt

SEQ ID NO: 1356678 - DNA, 22 bp, Artificial Sequence
  chemically synthesized
atagcacacaaatacacaggtg

SEQ ID NO: 1356679 - DNA, 22 bp, Artificial Sequence
  chemically synthesized
tagcacacaaatacacaggtgt

SEQ ID NO: 1356680 - DNA, 22 bp, Artificial Sequence
  chemically synthesized
atagtgtgtacgtgaatgcatc

SEQ ID NO: 1356681 - DNA, 22 bp, Artificial Sequence
  chemically synthesized
catagtgtgtacgtgaatgcat

SEQ ID NO: 1356682 - DNA, 22 bp, Artificial Sequence
  chemically synthesized
actcacacagatgcattcacgt

SEQ ID NO: 1356683 - DNA, 22 bp, Artificial Sequence
  chemically synthesized
acacagatgcattcacgtacac

SEQ ID NO: 1356684 - DNA, 22 bp, Artificial Sequence
  chemically synthesized
aagtttcatagtgtgtacgtga

SEQ ID NO: 1356685 - DNA, 22 bp, Artificial Sequence
  chemically synthesized
taaaactcaagtttcatagtgt

SEQ ID NO: 1356686 - DNA, 22 bp, Artificial Sequence
  chemically synthesized
ctgtaaaactcaagtttcatag

SEQ ID NO: 1356687 - DNA, 22 bp, Artificial Sequence
  chemically synthesized
cctgtaaaactcaagtttcata

SEQ ID NO: 1356688 - DNA, 22 bp, Artificial Sequence
  chemically synthesized
tcctgtaaaactcaagtttcat

SEQ ID NO: 1356689 - DNA, 22 bp, Artificial Sequence
  chemically synthesized
acgtacacactatgaaacttga

SEQ ID NO: 1356690 - DNA, 22 bp, Artificial Sequence
  chemically synthesized
ttcctgtaaaactcaagtttca

SEQ ID NO: 1356691 - DNA, 22 bp, Artificial Sequence
  chemically synthesized
tttcctgtaaaactcaagtttc

SEQ ID NO: 1356692 - DNA, 22 bp, Artificial Sequence
  chemically synthesized
ttttcctgtaaaactcaagttt

SEQ ID NO: 1356693 - DNA, 22 bp, Artificial Sequence
  chemically synthesized
gaaatttttttcctgtaaaact

SEQ ID NO: 1356694 - DNA, 22 bp, Artificial Sequence
  chemically synthesized
agaaatttttttcctgtaaaac

SEQ ID NO: 1356695 - DNA, 22 bp, Artificial Sequence
  chemically synthesized
tagaaatttttttcctgtaaaa

SEQ ID NO: 1356696 - DNA, 22 bp, Artificial Sequence
  chemically synthesized
tgaaacttgagttttacaggaa

SEQ ID NO: 1356697 - DNA, 22 bp, Artificial Sequence
  chemically synthesized
gagttttacaggaaaaaaattt

SEQ ID NO: 1356698 - DNA, 22 bp, Artificial Sequence
  chemically synthesized
gacacattttagaaattttttt

SEQ ID NO: 1356699 - DNA, 22 bp, Artificial Sequence
  chemically synthesized
agttttacaggaaaaaaatttc

SEQ ID NO: 1356700 - DNA, 22 bp, Artificial Sequence
  chemically synthesized
ggacacattttagaaatttttt

SEQ ID NO: 1356701 - DNA, 22 bp, Artificial Sequence
  chemically synthesized
tttggacacattttagaaattt

SEQ ID NO: 1356702 - DNA, 22 bp, Artificial Sequence
  chemically synthesized
atttggacacattttagaaatt

SEQ ID NO: 1356703 - DNA, 22 bp, Artificial Sequence
  chemically synthesized
tacaggaaaaaaatttctaaaa

SEQ ID NO: 1356704 - DNA, 22 bp, Artificial Sequence
  chemically synthesized
acaggaaaaaaatttctaaaat

SEQ ID NO: 1356705 - DNA, 22 bp, Artificial Sequence
  chemically synthesized
caggaaaaaaatttctaaaatg

SEQ ID NO: 1356706 - DNA, 22 bp, Artificial Sequence
  chemically synthesized
gaatttatttggacacatttta

SEQ ID NO: 1356707 - DNA, 22 bp, Artificial Sequence
  chemically synthesized
cagttagaatttatttggacac

SEQ ID NO: 1356708 - DNA, 22 bp, Artificial Sequence
  chemically synthesized
acagttagaatttatttggaca

SEQ ID NO: 1356709 - DNA, 22 bp, Artificial Sequence
  chemically synthesized
tacagttagaatttatttggac

SEQ ID NO: 1356710 - DNA, 22 bp, Artificial Sequence
  chemically synthesized
ctaaaatgtgtccaaataaatt

SEQ ID NO: 1356711 - DNA, 22 bp, Artificial Sequence
  chemically synthesized
taaaatgtgtccaaataaattc

SEQ ID NO: 1356712 - DNA, 22 bp, Artificial Sequence
  chemically synthesized
aaatgtgtccaaataaattcta

SEQ ID NO: 1356713 - DNA, 22 bp, Artificial Sequence
  chemically synthesized
taactgtaaaatttcttctctc

SEQ ID NO: 1356714 - DNA, 22 bp, Artificial Sequence
  chemically synthesized
actgtaaaatttcttctctcgg

SEQ ID NO: 1356715 - DNA, 22 bp, Artificial Sequence
  chemically synthesized
taaaatttcttctctcggctgg

SEQ ID NO: 1356716 - DNA, 22 bp, Artificial Sequence
  chemically synthesized
taggtgtgagccaccacaccca

SEQ ID NO: 1356717 - DNA, 22 bp, Artificial Sequence
  chemically synthesized
cttctctcggctgggtgtggtg

SEQ ID NO: 1356718 - DNA, 22 bp, Artificial Sequence
  chemically synthesized
ataggtgtgagccaccacaccc

SEQ ID NO: 1356719 - DNA, 22 bp, Artificial Sequence
  chemically synthesized
ttctctcggctgggtgtggtgg

SEQ ID NO: 1356720 - DNA, 22 bp, Artificial Sequence
  chemically synthesized
ctctcggctgggtgtggtggct

SEQ ID NO: 1356721 - DNA, 22 bp, Artificial Sequence
  chemically synthesized
tctcggctgggtgtggtggctc

SEQ ID NO: 1356722 - DNA, 22 bp, Artificial Sequence
  chemically synthesized
ggtttataggtgtgagccacca

SEQ ID NO: 1356723 - DNA, 22 bp, Artificial Sequence
  chemically synthesized
tcggctgggtgtggtggctcac

SEQ ID NO: 1356724 - DNA, 22 bp, Artificial Sequence
  chemically synthesized
ggctgggtgtggtggctcacac

SEQ ID NO: 1356725 - DNA, 22 bp, Artificial Sequence
  chemically synthesized
ggtgtggtggctcacacctata

SEQ ID NO: 1356726 - DNA, 22 bp, Artificial Sequence
  chemically synthesized
ccaaagtgctgggtttataggt

SEQ ID NO: 1356727 - DNA, 22 bp, Artificial Sequence
  chemically synthesized
agcctcccaaagtgctgggttt

SEQ ID NO: 1356728 - DNA, 22 bp, Artificial Sequence
  chemically synthesized
acacctataaacccagcacttt

SEQ ID NO: 1356729 - DNA, 22 bp, Artificial Sequence
  chemically synthesized
cccacctcagcctcccaaagtg

SEQ ID NO: 1356730 - DNA, 22 bp, Artificial Sequence
  chemically synthesized
taaacccagcactttgggaggc

SEQ ID NO: 1356731 - DNA, 22 bp, Artificial Sequence
  chemically synthesized
aggtgatctgcccacctcagcc

SEQ ID NO: 1356732 - DNA, 22 bp, Artificial Sequence
  chemically synthesized
acctcaggtgatctgcccacct

SEQ ID NO: 1356733 - DNA, 22 bp, Artificial Sequence
  chemically synthesized
tgggaggctgaggtgggcagat

SEQ ID NO: 1356734 - DNA, 22 bp, Artificial Sequence
  chemically synthesized
tgacctcaggtgatctgcccac

SEQ ID NO: 1356735 - DNA, 22 bp, Artificial Sequence
  chemically synthesized
gggaggctgaggtgggcagatc

SEQ ID NO: 1356736 - DNA, 22 bp, Artificial Sequence
  chemically synthesized
ctgacctcaggtgatctgccca

SEQ ID NO: 1356737 - DNA, 22 bp, Artificial Sequence
  chemically synthesized
ggaggctgaggtgggcagatca

SEQ ID NO: 1356738 - DNA, 22 bp, Artificial Sequence
  chemically synthesized
aacttctgacctcaggtgatct

SEQ ID NO: 1356739 - DNA, 22 bp, Artificial Sequence
  chemically synthesized
gaacttctgacctcaggtgatc

SEQ ID NO: 1356740 - DNA, 22 bp, Artificial Sequence
  chemically synthesized
aggtgggcagatcacctgaggt

SEQ ID NO: 1356741 - DNA, 22 bp, Artificial Sequence
  chemically synthesized
gtcttgaacttctgacctcagg

SEQ ID NO: 1356742 - DNA, 22 bp, Artificial Sequence
  chemically synthesized
gccaggctggtcttgaacttct

SEQ ID NO: 1356743 - DNA, 22 bp, Artificial Sequence
  chemically synthesized
aggtcagaagttcaagaccagc

SEQ ID NO: 1356744 - DNA, 22 bp, Artificial Sequence
  chemically synthesized
ccatgttggccaggctggtctt

SEQ ID NO: 1356745 - DNA, 22 bp, Artificial Sequence
  chemically synthesized
gccatgttggccaggctggtct

SEQ ID NO: 1356746 - DNA, 22 bp, Artificial Sequence
  chemically synthesized
tgccatgttggccaggctggtc

SEQ ID NO: 1356747 - DNA, 22 bp, Artificial Sequence
  chemically synthesized
aagaccagcctggccaacatgg

SEQ ID NO: 1356748 - DNA, 22 bp, Artificial Sequence
  chemically synthesized
gtagagacggggttttgccatg

SEQ ID NO: 1356749 - DNA, 22 bp, Artificial Sequence
  chemically synthesized
agtagagacggggttttgccat

SEQ ID NO: 1356750 - DNA, 22 bp, Artificial Sequence
  chemically synthesized
tagtagagacggggttttgcca

SEQ ID NO: 1356751 - DNA, 22 bp, Artificial Sequence
  chemically synthesized
ttagtagagacggggttttgcc

SEQ ID NO: 1356752 - DNA, 22 bp, Artificial Sequence
  chemically synthesized
gccaacatggcaaaaccccgtc

SEQ ID NO: 1356753 - DNA, 22 bp, Artificial Sequence
  chemically synthesized
tatttttagtagagacggggtt

SEQ ID NO: 1356754 - DNA, 22 bp, Artificial Sequence
  chemically synthesized
atatttttagtagagacggggt

SEQ ID NO: 1356755 - DNA, 22 bp, Artificial Sequence
  chemically synthesized
tatatttttagtagagacgggg

SEQ ID NO: 1356756 - DNA, 22 bp, Artificial Sequence
  chemically synthesized
ttatatttttagtagagacggg

SEQ ID NO: 1356757 - DNA, 22 bp, Artificial Sequence
  chemically synthesized
atttttatatttttagtagaga

SEQ ID NO: 1356758 - DNA, 22 bp, Artificial Sequence
  chemically synthesized
tactaaaaatataaaaattagg

SEQ ID NO: 1356759 - DNA, 22 bp, Artificial Sequence
  chemically synthesized
ctaaaaatataaaaattaggcg

SEQ ID NO: 1356760 - DNA, 22 bp, Artificial Sequence
  chemically synthesized
aaaatataaaaattaggcgggc

SEQ ID NO: 1356761 - DNA, 22 bp, Artificial Sequence
  chemically synthesized
caggcgggtcccaccatgcccg

SEQ ID NO: 1356762 - DNA, 22 bp, Artificial Sequence
  chemically synthesized
ggattacaggcgggtcccacca

SEQ ID NO: 1356763 - DNA, 22 bp, Artificial Sequence
  chemically synthesized
ggcgggcatggtgggacccgcc

SEQ ID NO: 1356764 - DNA, 22 bp, Artificial Sequence
  chemically synthesized
agtaactgggattacaggcggg

SEQ ID NO: 1356765 - DNA, 22 bp, Artificial Sequence
  chemically synthesized
ctgagtaactgggattacaggc

SEQ ID NO: 1356766 - DNA, 22 bp, Artificial Sequence
  chemically synthesized
agcctcctgagtaactgggatt

SEQ ID NO: 1356767 - DNA, 22 bp, Artificial Sequence
  chemically synthesized
tctcagcctcctgagtaactgg

SEQ ID NO: 1356768 - DNA, 22 bp, Artificial Sequence
  chemically synthesized
ctgtctcagcctcctgagtaac

SEQ ID NO: 1356769 - DNA, 22 bp, Artificial Sequence
  chemically synthesized
tcctgtctcagcctcctgagta

SEQ ID NO: 1356770 - DNA, 22 bp, Artificial Sequence
  chemically synthesized
taatcccagttactcaggaggc

SEQ ID NO: 1356771 - DNA, 22 bp, Artificial Sequence
  chemically synthesized
aagcgattctcctgtctcagcc

SEQ ID NO: 1356772 - DNA, 22 bp, Artificial Sequence
  chemically synthesized
ctcaggaggctgagacaggaga

SEQ ID NO: 1356773 - DNA, 22 bp, Artificial Sequence
  chemically synthesized
agttcaagcgattctcctgtct

SEQ ID NO: 1356774 - DNA, 22 bp, Artificial Sequence
  chemically synthesized
aggaggctgagacaggagaatc

SEQ ID NO: 1356775 - DNA, 22 bp, Artificial Sequence
  chemically synthesized
ctgagttcaagcgattctcctg

SEQ ID NO: 1356776 - DNA, 22 bp, Artificial Sequence
  chemically synthesized
acctcctgagttcaagcgattc

SEQ ID NO: 1356777 - DNA, 22 bp, Artificial Sequence
  chemically synthesized
cacctcctgagttcaagcgatt

SEQ ID NO: 1356778 - DNA, 22 bp, Artificial Sequence
  chemically synthesized
agacaggagaatcgcttgaact

SEQ ID NO: 1356779 - DNA, 22 bp, Artificial Sequence
  chemically synthesized
caaccttcacctcctgagttca

SEQ ID NO: 1356780 - DNA, 22 bp, Artificial Sequence
  chemically synthesized
actgcaaccttcacctcctgag

SEQ ID NO: 1356781 - DNA, 22 bp, Artificial Sequence
  chemically synthesized
ggctcactgcaaccttcacctc

SEQ ID NO: 1356782 - DNA, 22 bp, Artificial Sequence
  chemically synthesized
gaactcaggaggtgaaggttgc

SEQ ID NO: 1356783 - DNA, 22 bp, Artificial Sequence
  chemically synthesized
aactcaggaggtgaaggttgca

SEQ ID NO: 1356784 - DNA, 22 bp, Artificial Sequence
  chemically synthesized
tgtgatctcggctcactgcaac

SEQ ID NO: 1356785 - DNA, 22 bp, Artificial Sequence
  chemically synthesized
aggaggtgaaggttgcagtgag

SEQ ID NO: 1356786 - DNA, 22 bp, Artificial Sequence
  chemically synthesized
gaatgcagttgtgtgatctcgg

SEQ ID NO: 1356787 - DNA, 22 bp, Artificial Sequence
  chemically synthesized
cagtgagccgagatcacacaac

SEQ ID NO: 1356788 - DNA, 22 bp, Artificial Sequence
  chemically synthesized
cccaggctggaatgcagttgtg

SEQ ID NO: 1356789 - DNA, 22 bp, Artificial Sequence
  chemically synthesized
ttgcccaggctggaatgcagtt

SEQ ID NO: 1356790 - DNA, 22 bp, Artificial Sequence
  chemically synthesized
tgttgcccaggctggaatgcag

SEQ ID NO: 1356791 - DNA, 22 bp, Artificial Sequence
  chemically synthesized
gctctgttgcccaggctggaat

SEQ ID NO: 1356792 - DNA, 22 bp, Artificial Sequence
  chemically synthesized
cattccagcctgggcaacagag

SEQ ID NO: 1356793 - DNA, 22 bp, Artificial Sequence
  chemically synthesized
agacagagtctcgctctgttgc

SEQ ID NO: 1356794 - DNA, 22 bp, Artificial Sequence
  chemically synthesized
gagacagagtctcgctctgttg

SEQ ID NO: 1356795 - DNA, 22 bp, Artificial Sequence
  chemically synthesized
tgagacagagtctcgctctgtt

SEQ ID NO: 1356796 - DNA, 22 bp, Artificial Sequence
  chemically synthesized
ttgagacagagtctcgctctgt

SEQ ID NO: 1356797 - DNA, 22 bp, Artificial Sequence
  chemically synthesized
cagcctgggcaacagagcgaga

SEQ ID NO: 1356798 - DNA, 22 bp, Artificial Sequence
  chemically synthesized
tttgagacagagtctcgctctg

SEQ ID NO: 1356799 - DNA, 22 bp, Artificial Sequence
  chemically synthesized
ttttgagacagagtctcgctct

SEQ ID NO: 1356800 - DNA, 22 bp, Artificial Sequence
  chemically synthesized
tttttgagacagagtctcgctc

SEQ ID NO: 1356801 - DNA, 22 bp, Artificial Sequence
  chemically synthesized
ttttttgagacagagtctcgct

SEQ ID NO: 1356802 - DNA, 22 bp, Artificial Sequence
  chemically synthesized
ttttttttgagacagagtctcg

SEQ ID NO: 1356803 - DNA, 22 bp, Artificial Sequence
  chemically synthesized
cttttttttgagacagagtctc

SEQ ID NO: 1356804 - DNA, 22 bp, Artificial Sequence
  chemically synthesized
ggcaacagagcgagactctgtc

SEQ ID NO: 1356805 - DNA, 22 bp, Artificial Sequence
  chemically synthesized
tcttttttttgagacagagtct

SEQ ID NO: 1356806 - DNA, 22 bp, Artificial Sequence
  chemically synthesized
tgtctcaaaaaaaagaaaacat

SEQ ID NO: 1356807 - DNA, 22 bp, Artificial Sequence
  chemically synthesized
tctcaaaaaaaagaaaacattt

SEQ ID NO: 1356808 - DNA, 22 bp, Artificial Sequence
  chemically synthesized
tacataagagagaagaaatgtt

SEQ ID NO: 1356809 - DNA, 22 bp, Artificial Sequence
  chemically synthesized
aaaaaaaagaaaacatttcttc

SEQ ID NO: 1356810 - DNA, 22 bp, Artificial Sequence
  chemically synthesized
gtacataagagagaagaaatgt

SEQ ID NO: 1356811 - DNA, 22 bp, Artificial Sequence
  chemically synthesized
cttctctcttatgtacaaattt

SEQ ID NO: 1356812 - DNA, 22 bp, Artificial Sequence
  chemically synthesized
ttctctcttatgtacaaatttc

SEQ ID NO: 1356813 - DNA, 22 bp, Artificial Sequence
  chemically synthesized
ctctcttatgtacaaatttctc

SEQ ID NO: 1356814 - DNA, 22 bp, Artificial Sequence
  chemically synthesized
tctcttatgtacaaatttctca

SEQ ID NO: 1356815 - DNA, 22 bp, Artificial Sequence
  chemically synthesized
gagaaaaatggagtgagaaatt

SEQ ID NO: 1356816 - DNA, 22 bp, Artificial Sequence
  chemically synthesized
tcttatgtacaaatttctcact

SEQ ID NO: 1356817 - DNA, 22 bp, Artificial Sequence
  chemically synthesized
ttatgtacaaatttctcactcc

SEQ ID NO: 1356818 - DNA, 22 bp, Artificial Sequence
  chemically synthesized
atgtacaaatttctcactccat

SEQ ID NO: 1356819 - DNA, 22 bp, Artificial Sequence
  chemically synthesized
tgtacaaatttctcactccatt

SEQ ID NO: 1356820 - DNA, 22 bp, Artificial Sequence
  chemically synthesized
ccattggagaaaaatggagtga

SEQ ID NO: 1356821 - DNA, 22 bp, Artificial Sequence
  chemically synthesized
aattcccattggagaaaaatgg

SEQ ID NO: 1356822 - DNA, 22 bp, Artificial Sequence
  chemically synthesized
aaattcccattggagaaaaatg

SEQ ID NO: 1356823 - DNA, 22 bp, Artificial Sequence
  chemically synthesized
ctcactccatttttctccaatg

SEQ ID NO: 1356824 - DNA, 22 bp, Artificial Sequence
  chemically synthesized
tcactccatttttctccaatgg

SEQ ID NO: 1356825 - DNA, 22 bp, Artificial Sequence
  chemically synthesized
caaatttaaattcccattggag

SEQ ID NO: 1356826 - DNA, 22 bp, Artificial Sequence
  chemically synthesized
actccatttttctccaatggga

SEQ ID NO: 1356827 - DNA, 22 bp, Artificial Sequence
  chemically synthesized
catttttctccaatgggaattt

SEQ ID NO: 1356828 - DNA, 22 bp, Artificial Sequence
  chemically synthesized
ttctccaatgggaatttaaatt

SEQ ID NO: 1356829 - DNA, 22 bp, Artificial Sequence
  chemically synthesized
agagtggttccaaatttaaatt

SEQ ID NO: 1356830 - DNA, 22 bp, Artificial Sequence
  chemically synthesized
tctccaatgggaatttaaattt

SEQ ID NO: 1356831 - DNA, 22 bp, Artificial Sequence
  chemically synthesized
cagagtggttccaaatttaaat

SEQ ID NO: 1356832 - DNA, 22 bp, Artificial Sequence
  chemically synthesized
ctccaatgggaatttaaatttg

SEQ ID NO: 1356833 - DNA, 22 bp, Artificial Sequence
  chemically synthesized
tccaatgggaatttaaatttgg

SEQ ID NO: 1356834 - DNA, 22 bp, Artificial Sequence
  chemically synthesized
caatgggaatttaaatttggaa

SEQ ID NO: 1356835 - DNA, 22 bp, Artificial Sequence
  chemically synthesized
gcttcagagtggttccaaattt

SEQ ID NO: 1356836 - DNA, 22 bp, Artificial Sequence
  chemically synthesized
cattagcttcagagtggttcca

SEQ ID NO: 1356837 - DNA, 22 bp, Artificial Sequence
  chemically synthesized
aaatttggaaccactctgaagc

SEQ ID NO: 1356838 - DNA, 22 bp, Artificial Sequence
  chemically synthesized
aatttggaaccactctgaagct

SEQ ID NO: 1356839 - DNA, 22 bp, Artificial Sequence
  chemically synthesized
gtatgattacattagcttcaga

SEQ ID NO: 1356840 - DNA, 22 bp, Artificial Sequence
  chemically synthesized
ggaaccactctgaagctaatgt

SEQ ID NO: 1356841 - DNA, 22 bp, Artificial Sequence
  chemically synthesized
gaaccactctgaagctaatgta

SEQ ID NO: 1356842 - DNA, 22 bp, Artificial Sequence
  chemically synthesized
tgtatctggtatgattacatta

SEQ ID NO: 1356843 - DNA, 22 bp, Artificial Sequence
  chemically synthesized
atgtatctggtatgattacatt

SEQ ID NO: 1356844 - DNA, 22 bp, Artificial Sequence
  chemically synthesized
tgaagctaatgtaatcatacca

SEQ ID NO: 1356845 - DNA, 22 bp, Artificial Sequence
  chemically synthesized
aagctaatgtaatcataccaga

SEQ ID NO: 1356846 - DNA, 22 bp, Artificial Sequence
  chemically synthesized
aaatatttatgtatctggtatg

SEQ ID NO: 1356847 - DNA, 22 bp, Artificial Sequence
  chemically synthesized
atgtaatcataccagatacata

SEQ ID NO: 1356848 - DNA, 22 bp, Artificial Sequence
  chemically synthesized
tacatattgaaatatttatgta

SEQ ID NO: 1356849 - DNA, 22 bp, Artificial Sequence
  chemically synthesized
ctatacatattgaaatatttat

SEQ ID NO: 1356850 - DNA, 22 bp, Artificial Sequence
  chemically synthesized
taacaaaatcaattgctataca

SEQ ID NO: 1356851 - DNA, 22 bp, Artificial Sequence
  chemically synthesized
caatatgtatagcaattgattt

SEQ ID NO: 1356852 - DNA, 22 bp, Artificial Sequence
  chemically synthesized
aatatgtatagcaattgatttt

SEQ ID NO: 1356853 - DNA, 22 bp, Artificial Sequence
  chemically synthesized
tcaaagactgtaacaaaatcaa

SEQ ID NO: 1356854 - DNA, 22 bp, Artificial Sequence
  chemically synthesized
atcaaagactgtaacaaaatca

SEQ ID NO: 1356855 - DNA, 22 bp, Artificial Sequence
  chemically synthesized
tatcaaagactgtaacaaaatc

SEQ ID NO: 1356856 - DNA, 22 bp, Artificial Sequence
  chemically synthesized
ttatcaaagactgtaacaaaat

SEQ ID NO: 1356857 - DNA, 22 bp, Artificial Sequence
  chemically synthesized
ttttatcaaagactgtaacaaa

SEQ ID NO: 1356858 - DNA, 22 bp, Artificial Sequence
  chemically synthesized
tatctcttttatcaaagactgt

SEQ ID NO: 1356859 - DNA, 22 bp, Artificial Sequence
  chemically synthesized
attttgttacagtctttgataa

SEQ ID NO: 1356860 - DNA, 22 bp, Artificial Sequence
  chemically synthesized
tacactgtatctcttttatcaa

SEQ ID NO: 1356861 - DNA, 22 bp, Artificial Sequence
  chemically synthesized
tgttacagtctttgataaaaga

SEQ ID NO: 1356862 - DNA, 22 bp, Artificial Sequence
  chemically synthesized
gttacagtctttgataaaagag

SEQ ID NO: 1356863 - DNA, 22 bp, Artificial Sequence
  chemically synthesized
ttacagtctttgataaaagaga

SEQ ID NO: 1356864 - DNA, 22 bp, Artificial Sequence
  chemically synthesized
cagtctttgataaaagagatac

SEQ ID NO: 1356865 - DNA, 22 bp, Artificial Sequence
  chemically synthesized
tgtctatacactgtatctcttt

SEQ ID NO: 1356866 - DNA, 22 bp, Artificial Sequence
  chemically synthesized
aaattgtgtctatacactgtat

SEQ ID NO: 1356867 - DNA, 22 bp, Artificial Sequence
  chemically synthesized
tgataaaagagatacagtgtat

SEQ ID NO: 1356868 - DNA, 22 bp, Artificial Sequence
  chemically synthesized
gataaaagagatacagtgtata

SEQ ID NO: 1356869 - DNA, 22 bp, Artificial Sequence
  chemically synthesized
ataaaagagatacagtgtatag

SEQ ID NO: 1356870 - DNA, 22 bp, Artificial Sequence
  chemically synthesized
caggaaaccattaaaattgtgt

SEQ ID NO: 1356871 - DNA, 22 bp, Artificial Sequence
  chemically synthesized
caattgcaggaaaccattaaaa

SEQ ID NO: 1356872 - DNA, 22 bp, Artificial Sequence
  chemically synthesized
ccaattgcaggaaaccattaaa

SEQ ID NO: 1356873 - DNA, 22 bp, Artificial Sequence
  chemically synthesized
tccaattgcaggaaaccattaa

SEQ ID NO: 1356874 - DNA, 22 bp, Artificial Sequence
  chemically synthesized
taatggtttcctgcaattggaa

SEQ ID NO: 1356875 - DNA, 22 bp, Artificial Sequence
  chemically synthesized
aatggtttcctgcaattggaaa

SEQ ID NO: 1356876 - DNA, 22 bp, Artificial Sequence
  chemically synthesized
atggtttcctgcaattggaaag

SEQ ID NO: 1356877 - DNA, 22 bp, Artificial Sequence
  chemically synthesized
atgaatataccaagtatctttc

SEQ ID NO: 1356878 - DNA, 22 bp, Artificial Sequence
  chemically synthesized
cctgcaattggaaagatacttg

SEQ ID NO: 1356879 - DNA, 22 bp, Artificial Sequence
  chemically synthesized
ctgcaattggaaagatacttgg

SEQ ID NO: 1356880 - DNA, 22 bp, Artificial Sequence
  chemically synthesized
attgatgaatataccaagtatc

SEQ ID NO: 1356881 - DNA, 22 bp, Artificial Sequence
  chemically synthesized
caattggaaagatacttggtat

SEQ ID NO: 1356882 - DNA, 22 bp, Artificial Sequence
  chemically synthesized
gaaagatacttggtatattcat

SEQ ID NO: 1356883 - DNA, 22 bp, Artificial Sequence
  chemically synthesized
ggtatattcatcaattagtatc

SEQ ID NO: 1356884 - DNA, 22 bp, Artificial Sequence
  chemically synthesized
gtatattcatcaattagtatcc

SEQ ID NO: 1356885 - DNA, 22 bp, Artificial Sequence
  chemically synthesized
atagaagtataaaaaggatact

SEQ ID NO: 1356886 - DNA, 22 bp, Artificial Sequence
  chemically synthesized
taatagaagtataaaaaggata

SEQ ID NO: 1356887 - DNA, 22 bp, Artificial Sequence
  chemically synthesized
ctaatagaagtataaaaaggat

SEQ ID NO: 1356888 - DNA, 22 bp, Artificial Sequence
  chemically synthesized
tctaatagaagtataaaaagga

SEQ ID NO: 1356889 - DNA, 22 bp, Artificial Sequence
  chemically synthesized
atcaattagtatcctttttata

SEQ ID NO: 1356890 - DNA, 22 bp, Artificial Sequence
  chemically synthesized
gtatcctttttatacttctatt

SEQ ID NO: 1356891 - DNA, 22 bp, Artificial Sequence
  chemically synthesized
tttatacttctattagaaaggc

SEQ ID NO: 1356892 - DNA, 22 bp, Artificial Sequence
  chemically synthesized
aacaaaaacatagcctttctaa

SEQ ID NO: 1356893 - DNA, 22 bp, Artificial Sequence
  chemically synthesized
ttatacttctattagaaaggct

SEQ ID NO: 1356894 - DNA, 22 bp, Artificial Sequence
  chemically synthesized
aaacaaaaacatagcctttcta

SEQ ID NO: 1356895 - DNA, 22 bp, Artificial Sequence
  chemically synthesized
tatacttctattagaaaggcta

SEQ ID NO: 1356896 - DNA, 22 bp, Artificial Sequence
  chemically synthesized
atacttctattagaaaggctat

SEQ ID NO: 1356897 - DNA, 22 bp, Artificial Sequence
  chemically synthesized
tacttctattagaaaggctatg

SEQ ID NO: 1356898 - DNA, 22 bp, Artificial Sequence
  chemically synthesized
ggtacttaaacaaaaacatagc

SEQ ID NO: 1356899 - DNA, 22 bp, Artificial Sequence
  chemically synthesized
ctattagaaaggctatgttttt

SEQ ID NO: 1356900 - DNA, 22 bp, Artificial Sequence
  chemically synthesized
gggtacttaaacaaaaacatag

SEQ ID NO: 1356901 - DNA, 22 bp, Artificial Sequence
  chemically synthesized
tattagaaaggctatgtttttg

SEQ ID NO: 1356902 - DNA, 22 bp, Artificial Sequence
  chemically synthesized
ttagaaaggctatgtttttgtt

SEQ ID NO: 1356903 - DNA, 22 bp, Artificial Sequence
  chemically synthesized
gaaaggctatgtttttgtttaa

SEQ ID NO: 1356904 - DNA, 22 bp, Artificial Sequence
  chemically synthesized
gaatcttgggtacttaaacaaa

SEQ ID NO: 1356905 - DNA, 22 bp, Artificial Sequence
  chemically synthesized
ggaatcttgggtacttaaacaa

SEQ ID NO: 1356906 - DNA, 22 bp, Artificial Sequence
  chemically synthesized
tggaatcttgggtacttaaaca

SEQ ID NO: 1356907 - DNA, 22 bp, Artificial Sequence
  chemically synthesized
ttggaatcttgggtacttaaac

SEQ ID NO: 1356908 - DNA, 22 bp, Artificial Sequence
  chemically synthesized
acttttggaatcttgggtactt

SEQ ID NO: 1356909 - DNA, 22 bp, Artificial Sequence
  chemically synthesized
tgtttttgtttaagtacccaag

SEQ ID NO: 1356910 - DNA, 22 bp, Artificial Sequence
  chemically synthesized
ttgtttaagtacccaagattcc

SEQ ID NO: 1356911 - DNA, 22 bp, Artificial Sequence
  chemically synthesized
tgtttaagtacccaagattcca

SEQ ID NO: 1356912 - DNA, 22 bp, Artificial Sequence
  chemically synthesized
gtttaagtacccaagattccaa

SEQ ID NO: 1356913 - DNA, 22 bp, Artificial Sequence
  chemically synthesized
tttaagtacccaagattccaaa

SEQ ID NO: 1356914 - DNA, 22 bp, Artificial Sequence
  chemically synthesized
aagtacccaagattccaaaagt

SEQ ID NO: 1356915 - DNA, 22 bp, Artificial Sequence
  chemically synthesized
agtacccaagattccaaaagtg

SEQ ID NO: 1356916 - DNA, 22 bp, Artificial Sequence
  chemically synthesized
atagatacaaattcacttttgg

SEQ ID NO: 1356917 - DNA, 22 bp, Artificial Sequence
  chemically synthesized
tattcatagatacaaattcact

SEQ ID NO: 1356918 - DNA, 22 bp, Artificial Sequence
  chemically synthesized
aactgtattcatagatacaaat

SEQ ID NO: 1356919 - DNA, 22 bp, Artificial Sequence
  chemically synthesized
caaaagtgaatttgtatctatg

SEQ ID NO: 1356920 - DNA, 22 bp, Artificial Sequence
  chemically synthesized
acattaaactgtattcatagat

SEQ ID NO: 1356921 - DNA, 22 bp, Artificial Sequence
  chemically synthesized
ttcacattaaactgtattcata

SEQ ID NO: 1356922 - DNA, 22 bp, Artificial Sequence
  chemically synthesized
aattgttcacattaaactgtat

SEQ ID NO: 1356923 - DNA, 22 bp, Artificial Sequence
  chemically synthesized
caattgttcacattaaactgta

SEQ ID NO: 1356924 - DNA, 22 bp, Artificial Sequence
  chemically synthesized
gtatctatgaatacagtttaat

SEQ ID NO: 1356925 - DNA, 22 bp, Artificial Sequence
  chemically synthesized
tatctatgaatacagtttaatg

SEQ ID NO: 1356926 - DNA, 22 bp, Artificial Sequence
  chemically synthesized
tgaatacagtttaatgtgaaca

SEQ ID NO: 1356927 - DNA, 22 bp, Artificial Sequence
  chemically synthesized
catgcgcgtttcaattgttcac

SEQ ID NO: 1356928 - DNA, 22 bp, Artificial Sequence
  chemically synthesized
gcatgcgcgtttcaattgttca

SEQ ID NO: 1356929 - DNA, 22 bp, Artificial Sequence
  chemically synthesized
tgcatgcgcgtttcaattgttc

SEQ ID NO: 1356930 - DNA, 22 bp, Artificial Sequence
  chemically synthesized
agttttgcatgcgcgtttcaat

SEQ ID NO: 1356931 - DNA, 22 bp, Artificial Sequence
  chemically synthesized
gagttttgcatgcgcgtttcaa

SEQ ID NO: 1356932 - DNA, 22 bp, Artificial Sequence
  chemically synthesized
aatgtgaacaattgaaacgcgc

SEQ ID NO: 1356933 - DNA, 22 bp, Artificial Sequence
  chemically synthesized
atgtgaacaattgaaacgcgca

SEQ ID NO: 1356934 - DNA, 22 bp, Artificial Sequence
  chemically synthesized
atttgagttttgcatgcgcgtt

SEQ ID NO: 1356935 - DNA, 22 bp, Artificial Sequence
  chemically synthesized
aaacgcgcatgcaaaactcaaa

SEQ ID NO: 1356936 - DNA, 22 bp, Artificial Sequence
  chemically synthesized
ccaggtatacaattcatttgag

SEQ ID NO: 1356937 - DNA, 22 bp, Artificial Sequence
  chemically synthesized
cctgccaggtatacaattcatt

SEQ ID NO: 1356938 - DNA, 22 bp, Artificial Sequence
  chemically synthesized
atcctgcctgccaggtatacaa

SEQ ID NO: 1356939 - DNA, 22 bp, Artificial Sequence
  chemically synthesized
aaatgaattgtatacctggcag

SEQ ID NO: 1356940 - DNA, 22 bp, Artificial Sequence
  chemically synthesized
tcaattcatcctgcctgccagg

SEQ ID NO: 1356941 - DNA, 22 bp, Artificial Sequence
  chemically synthesized
tatacctggcaggcaggatgaa

SEQ ID NO: 1356942 - DNA, 22 bp, Artificial Sequence
  chemically synthesized
aaaataacatgctatcaattca

SEQ ID NO: 1356943 - DNA, 22 bp, Artificial Sequence
  chemically synthesized
gcaggcaggatgaattgatagc

SEQ ID NO: 1356944 - DNA, 22 bp, Artificial Sequence
  chemically synthesized
taaaaataacatgctatcaatt

SEQ ID NO: 1356945 - DNA, 22 bp, Artificial Sequence
  chemically synthesized
ctaaaaataacatgctatcaat

SEQ ID NO: 1356946 - DNA, 22 bp, Artificial Sequence
  chemically synthesized
agatttctaaaaataacatgct

SEQ ID NO: 1356947 - DNA, 22 bp, Artificial Sequence
  chemically synthesized
atagcatgttatttttagaaat

SEQ ID NO: 1356948 - DNA, 22 bp, Artificial Sequence
  chemically synthesized
tgcatacatacactcagatttc

SEQ ID NO: 1356949 - DNA, 22 bp, Artificial Sequence
  chemically synthesized
tttttagaaatctgagtgtatg

SEQ ID NO: 1356950 - DNA, 22 bp, Artificial Sequence
  chemically synthesized
gaattatgcatacatacactca

SEQ ID NO: 1356951 - DNA, 22 bp, Artificial Sequence
  chemically synthesized
ttagaaatctgagtgtatgtat

SEQ ID NO: 1356952 - DNA, 22 bp, Artificial Sequence
  chemically synthesized
tagaaatctgagtgtatgtatg

SEQ ID NO: 1356953 - DNA, 22 bp, Artificial Sequence
  chemically synthesized
agaaatctgagtgtatgtatgc

SEQ ID NO: 1356954 - DNA, 22 bp, Artificial Sequence
  chemically synthesized
gaaatctgagtgtatgtatgca

SEQ ID NO: 1356955 - DNA, 22 bp, Artificial Sequence
  chemically synthesized
aaaaactagaattatgcataca

SEQ ID NO: 1356956 - DNA, 22 bp, Artificial Sequence
  chemically synthesized
caaaaactagaattatgcatac

SEQ ID NO: 1356957 - DNA, 22 bp, Artificial Sequence
  chemically synthesized
agtgtatgtatgcataattcta

SEQ ID NO: 1356958 - DNA, 22 bp, Artificial Sequence
  chemically synthesized
agataacttcaaaaactagaat

SEQ ID NO: 1356959 - DNA, 22 bp, Artificial Sequence
  chemically synthesized
tcagataacttcaaaaactaga

SEQ ID NO: 1356960 - DNA, 22 bp, Artificial Sequence
  chemically synthesized
tagtttttgaagttatctgaga

SEQ ID NO: 1356961 - DNA, 22 bp, Artificial Sequence
  chemically synthesized
gtttttgaagttatctgagagt

SEQ ID NO: 1356962 - DNA, 22 bp, Artificial Sequence
  chemically synthesized
ttgaagttatctgagagtcttt

SEQ ID NO: 1356963 - DNA, 22 bp, Artificial Sequence
  chemically synthesized
tgaagttatctgagagtctttc

SEQ ID NO: 1356964 - DNA, 22 bp, Artificial Sequence
  chemically synthesized
gaagttatctgagagtctttcc

SEQ ID NO: 1356965 - DNA, 22 bp, Artificial Sequence
  chemically synthesized
aagttatctgagagtctttcca

SEQ ID NO: 1356966 - DNA, 22 bp, Artificial Sequence
  chemically synthesized
ggtataatatgatatggaaaga

SEQ ID NO: 1356967 - DNA, 22 bp, Artificial Sequence
  chemically synthesized
gggtataatatgatatggaaag

SEQ ID NO: 1356968 - DNA, 22 bp, Artificial Sequence
  chemically synthesized
tgggtataatatgatatggaaa

SEQ ID NO: 1356969 - DNA, 22 bp, Artificial Sequence
  chemically synthesized
ttgggtataatatgatatggaa

SEQ ID NO: 1356970 - DNA, 22 bp, Artificial Sequence
  chemically synthesized
tctgagagtctttccatatcat

SEQ ID NO: 1356971 - DNA, 22 bp, Artificial Sequence
  chemically synthesized
tttgggtataatatgatatgga

SEQ ID NO: 1356972 - DNA, 22 bp, Artificial Sequence
  chemically synthesized
agagtctttccatatcatatta

SEQ ID NO: 1356973 - DNA, 22 bp, Artificial Sequence
  chemically synthesized
attttttgggtataatatgata

SEQ ID NO: 1356974 - DNA, 22 bp, Artificial Sequence
  chemically synthesized
aattttttgggtataatatgat

SEQ ID NO: 1356975 - DNA, 22 bp, Artificial Sequence
  chemically synthesized
tccatatcatattatacccaaa

SEQ ID NO: 1356976 - DNA, 22 bp, Artificial Sequence
  chemically synthesized
ccatatcatattatacccaaaa

SEQ ID NO: 1356977 - DNA, 22 bp, Artificial Sequence
  chemically synthesized
catatcatattatacccaaaaa

SEQ ID NO: 1356978 - DNA, 22 bp, Artificial Sequence
  chemically synthesized
gatgatgacacttaattttttg

SEQ ID NO: 1356979 - DNA, 22 bp, Artificial Sequence
  chemically synthesized
tacccaaaaaattaagtgtcat

SEQ ID NO: 1356980 - DNA, 22 bp, Artificial Sequence
  chemically synthesized
aaaccattagatgatgacactt

SEQ ID NO: 1356981 - DNA, 22 bp, Artificial Sequence
  chemically synthesized
caaaccattagatgatgacact

SEQ ID NO: 1356982 - DNA, 22 bp, Artificial Sequence
  chemically synthesized
tttcaaaccattagatgatgac

SEQ ID NO: 1356983 - DNA, 22 bp, Artificial Sequence
  chemically synthesized
gtttcaaaccattagatgatga

SEQ ID NO: 1356984 - DNA, 22 bp, Artificial Sequence
  chemically synthesized
tgtttcaaaccattagatgatg

SEQ ID NO: 1356985 - DNA, 22 bp, Artificial Sequence
  chemically synthesized
ttgtttcaaaccattagatgat

SEQ ID NO: 1356986 - DNA, 22 bp, Artificial Sequence
  chemically synthesized
ttttgtttcaaaccattagatg

SEQ ID NO: 1356987 - DNA, 22 bp, Artificial Sequence
  chemically synthesized
cttttgtttcaaaccattagat

SEQ ID NO: 1356988 - DNA, 22 bp, Artificial Sequence
  chemically synthesized
agtgtcatcatctaatggtttg

SEQ ID NO: 1356989 - DNA, 22 bp, Artificial Sequence
  chemically synthesized
taaatttcttttgtttcaaacc

SEQ ID NO: 1356990 - DNA, 22 bp, Artificial Sequence
  chemically synthesized
ataaatttcttttgtttcaaac

SEQ ID NO: 1356991 - DNA, 22 bp, Artificial Sequence
  chemically synthesized
cttataaatttcttttgtttca

SEQ ID NO: 1356992 - DNA, 22 bp, Artificial Sequence
  chemically synthesized
atggtttgaaacaaaagaaatt

SEQ ID NO: 1356993 - DNA, 22 bp, Artificial Sequence
  chemically synthesized
taagttacttataaatttcttt

SEQ ID NO: 1356994 - DNA, 22 bp, Artificial Sequence
  chemically synthesized
gaaacaaaagaaatttataagt

SEQ ID NO: 1356995 - DNA, 22 bp, Artificial Sequence
  chemically synthesized
aaacaaaagaaatttataagta

SEQ ID NO: 1356996 - DNA, 22 bp, Artificial Sequence
  chemically synthesized
ataagtaacttataattctttc

SEQ ID NO: 1356997 - DNA, 22 bp, Artificial Sequence
  chemically synthesized
taagtaacttataattctttcc

SEQ ID NO: 1356998 - DNA, 22 bp, Artificial Sequence
  chemically synthesized
atatccaaaagtgatggaaaga

SEQ ID NO: 1356999 - DNA, 22 bp, Artificial Sequence
  chemically synthesized
attaatatccaaaagtgatgga

SEQ ID NO: 1357000 - DNA, 22 bp, Artificial Sequence
  chemically synthesized
ataattctttccatcacttttg

SEQ ID NO: 1357001 - DNA, 22 bp, Artificial Sequence
  chemically synthesized
taattctttccatcacttttgg

SEQ ID NO: 1357002 - DNA, 22 bp, Artificial Sequence
  chemically synthesized
aattaattaatatccaaaagtg

SEQ ID NO: 1357003 - DNA, 22 bp, Artificial Sequence
  chemically synthesized
gaattaattaatatccaaaagt

SEQ ID NO: 1357004 - DNA, 22 bp, Artificial Sequence
  chemically synthesized
tgaattaattaatatccaaaag

SEQ ID NO: 1357005 - DNA, 22 bp, Artificial Sequence
  chemically synthesized
tttccatcacttttggatatta

SEQ ID NO: 1357006 - DNA, 22 bp, Artificial Sequence
  chemically synthesized
tccatcacttttggatattaat

SEQ ID NO: 1357007 - DNA, 22 bp, Artificial Sequence
  chemically synthesized
ccatcacttttggatattaatt

SEQ ID NO: 1357008 - DNA, 22 bp, Artificial Sequence
  chemically synthesized
catcacttttggatattaatta

SEQ ID NO: 1357009 - DNA, 22 bp, Artificial Sequence
  chemically synthesized
taaatgtgttttgaattaatta

SEQ ID NO: 1357010 - DNA, 22 bp, Artificial Sequence
  chemically synthesized
ataaatgtgttttgaattaatt

SEQ ID NO: 1357011 - DNA, 22 bp, Artificial Sequence
  chemically synthesized
tataaatgtgttttgaattaat

SEQ ID NO: 1357012 - DNA, 22 bp, Artificial Sequence
  chemically synthesized
ttggatattaattaattcaaaa

SEQ ID NO: 1357013 - DNA, 22 bp, Artificial Sequence
  chemically synthesized
tggatattaattaattcaaaac

SEQ ID NO: 1357014 - DNA, 22 bp, Artificial Sequence
  chemically synthesized
ggatattaattaattcaaaaca

SEQ ID NO: 1357015 - DNA, 22 bp, Artificial Sequence
  chemically synthesized
gatattaattaattcaaaacac

SEQ ID NO: 1357016 - DNA, 22 bp, Artificial Sequence
  chemically synthesized
ggaagaagttttataaatgtgt

SEQ ID NO: 1357017 - DNA, 22 bp, Artificial Sequence
  chemically synthesized
attaattcaaaacacatttata

SEQ ID NO: 1357018 - DNA, 22 bp, Artificial Sequence
  chemically synthesized
attcaaaacacatttataaaac

SEQ ID NO: 1357019 - DNA, 22 bp, Artificial Sequence
  chemically synthesized
tactaggaagaagttttataaa

SEQ ID NO: 1357020 - DNA, 22 bp, Artificial Sequence
  chemically synthesized
gtactaggaagaagttttataa

SEQ ID NO: 1357021 - DNA, 22 bp, Artificial Sequence
  chemically synthesized
aaaacacatttataaaacttct

SEQ ID NO: 1357022 - DNA, 22 bp, Artificial Sequence
  chemically synthesized
cttgtactaggaagaagtttta

SEQ ID NO: 1357023 - DNA, 22 bp, Artificial Sequence
  chemically synthesized
ccttgtactaggaagaagtttt

SEQ ID NO: 1357024 - DNA, 22 bp, Artificial Sequence
  chemically synthesized
aatatttccttgtactaggaag

SEQ ID NO: 1357025 - DNA, 22 bp, Artificial Sequence
  chemically synthesized
gaatatttccttgtactaggaa

SEQ ID NO: 1357026 - DNA, 22 bp, Artificial Sequence
  chemically synthesized
tgaatatttccttgtactagga

SEQ ID NO: 1357027 - DNA, 22 bp, Artificial Sequence
  chemically synthesized
ataaaacttcttcctagtacaa

SEQ ID NO: 1357028 - DNA, 22 bp, Artificial Sequence
  chemically synthesized
taaaacttcttcctagtacaag

SEQ ID NO: 1357029 - DNA, 22 bp, Artificial Sequence
  chemically synthesized
atagagttttgaatatttcctt

SEQ ID NO: 1357030 - DNA, 22 bp, Artificial Sequence
  chemically synthesized
cttcctagtacaaggaaatatt

SEQ ID NO: 1357031 - DNA, 22 bp, Artificial Sequence
  chemically synthesized
ttcctagtacaaggaaatattc

SEQ ID NO: 1357032 - DNA, 22 bp, Artificial Sequence
  chemically synthesized
tcatagagttttgaatatttcc

SEQ ID NO: 1357033 - DNA, 22 bp, Artificial Sequence
  chemically synthesized
cctagtacaaggaaatattcaa

SEQ ID NO: 1357034 - DNA, 22 bp, Artificial Sequence
  chemically synthesized
ctagtacaaggaaatattcaaa

SEQ ID NO: 1357035 - DNA, 22 bp, Artificial Sequence
  chemically synthesized
tattctcatagagttttgaata

SEQ ID NO: 1357036 - DNA, 22 bp, Artificial Sequence
  chemically synthesized
gtacaaggaaatattcaaaact

SEQ ID NO: 1357037 - DNA, 22 bp, Artificial Sequence
  chemically synthesized
atattctcatagagttttgaat

SEQ ID NO: 1357038 - DNA, 22 bp, Artificial Sequence
  chemically synthesized
tgtgtttatattctcatagagt

SEQ ID NO: 1357039 - DNA, 22 bp, Artificial Sequence
  chemically synthesized
tatgtgtttatattctcataga

SEQ ID NO: 1357040 - DNA, 22 bp, Artificial Sequence
  chemically synthesized
ctatgtgtttatattctcatag

SEQ ID NO: 1357041 - DNA, 22 bp, Artificial Sequence
  chemically synthesized
aaaactctatgagaatataaac

SEQ ID NO: 1357042 - DNA, 22 bp, Artificial Sequence
  chemically synthesized
tatgagaatataaacacataga

SEQ ID NO: 1357043 - DNA, 22 bp, Artificial Sequence
  chemically synthesized
tgagaatataaacacatagaag

SEQ ID NO: 1357044 - DNA, 22 bp, Artificial Sequence
  chemically synthesized
gatgccgcaaaccacatcttct

SEQ ID NO: 1357045 - DNA, 22 bp, Artificial Sequence
  chemically synthesized
ctggatgccgcaaaccacatct

SEQ ID NO: 1357046 - DNA, 22 bp, Artificial Sequence
  chemically synthesized
tatactcctggatgccgcaaac

SEQ ID NO: 1357047 - DNA, 22 bp, Artificial Sequence
  chemically synthesized
gattatatactcctggatgccg

SEQ ID NO: 1357048 - DNA, 22 bp, Artificial Sequence
  chemically synthesized
ctagattatatactcctggatg

SEQ ID NO: 1357049 - DNA, 22 bp, Artificial Sequence
  chemically synthesized
cgctactagattatatactcct

SEQ ID NO: 1357050 - DNA, 22 bp, Artificial Sequence
  chemically synthesized
gcggcatccaggagtatataat

SEQ ID NO: 1357051 - DNA, 22 bp, Artificial Sequence
  chemically synthesized
cggcatccaggagtatataatc

SEQ ID NO: 1357052 - DNA, 22 bp, Artificial Sequence
  chemically synthesized
tctccgctactagattatatac

SEQ ID NO: 1357053 - DNA, 22 bp, Artificial Sequence
  chemically synthesized
tattatctccgctactagatta

SEQ ID NO: 1357054 - DNA, 22 bp, Artificial Sequence
  chemically synthesized
aaaattatattatctccgctac

SEQ ID NO: 1357055 - DNA, 22 bp, Artificial Sequence
  chemically synthesized
aaaaattatattatctccgcta

SEQ ID NO: 1357056 - DNA, 22 bp, Artificial Sequence
  chemically synthesized
taaaaattatattatctccgct

SEQ ID NO: 1357057 - DNA, 22 bp, Artificial Sequence
  chemically synthesized
gtagcggagataatataatttt

SEQ ID NO: 1357058 - DNA, 22 bp, Artificial Sequence
  chemically synthesized
aaatataactttaaaaattata

SEQ ID NO: 1357059 - DNA, 22 bp, Artificial Sequence
  chemically synthesized
gaaatataactttaaaaattat

SEQ ID NO: 1357060 - DNA, 22 bp, Artificial Sequence
  chemically synthesized
tttgaaatataactttaaaaat

SEQ ID NO: 1357061 - DNA, 22 bp, Artificial Sequence
  chemically synthesized
tattatttgaaatataacttta

SEQ ID NO: 1357062 - DNA, 22 bp, Artificial Sequence
  chemically synthesized
agtctatattatttgaaatata

SEQ ID NO: 1357063 - DNA, 22 bp, Artificial Sequence
  chemically synthesized
ttaaagttatatttcaaataat

SEQ ID NO: 1357064 - DNA, 22 bp, Artificial Sequence
  chemically synthesized
taaagttatatttcaaataata

SEQ ID NO: 1357065 - DNA, 22 bp, Artificial Sequence
  chemically synthesized
aaagttatatttcaaataatat

SEQ ID NO: 1357066 - DNA, 22 bp, Artificial Sequence
  chemically synthesized
aagttatatttcaaataatata

SEQ ID NO: 1357067 - DNA, 22 bp, Artificial Sequence
  chemically synthesized
tatttcaaataatatagactca

SEQ ID NO: 1357068 - DNA, 22 bp, Artificial Sequence
  chemically synthesized
tcagatgaggtaactgagtcta

SEQ ID NO: 1357069 - DNA, 22 bp, Artificial Sequence
  chemically synthesized
gtcagatgaggtaactgagtct

SEQ ID NO: 1357070 - DNA, 22 bp, Artificial Sequence
  chemically synthesized
caaataatatagactcagttac

SEQ ID NO: 1357071 - DNA, 22 bp, Artificial Sequence
  chemically synthesized
aaataatatagactcagttacc

SEQ ID NO: 1357072 - DNA, 22 bp, Artificial Sequence
  chemically synthesized
acttgtcagatgaggtaactga

SEQ ID NO: 1357073 - DNA, 22 bp, Artificial Sequence
  chemically synthesized
tcacttgtcagatgaggtaact

SEQ ID NO: 1357074 - DNA, 22 bp, Artificial Sequence
  chemically synthesized
ccattctcacttgtcagatgag

SEQ ID NO: 1357075 - DNA, 22 bp, Artificial Sequence
  chemically synthesized
agttacctcatctgacaagtga

SEQ ID NO: 1357076 - DNA, 22 bp, Artificial Sequence
  chemically synthesized
cctcatctgacaagtgagaatg

SEQ ID NO: 1357077 - DNA, 22 bp, Artificial Sequence
  chemically synthesized
atctgacaagtgagaatggtaa

SEQ ID NO: 1357078 - DNA, 22 bp, Artificial Sequence
  chemically synthesized
tggcaaaaaatatattaccatt

SEQ ID NO: 1357079 - DNA, 22 bp, Artificial Sequence
  chemically synthesized
acaagtgagaatggtaatatat

SEQ ID NO: 1357080 - DNA, 22 bp, Artificial Sequence
  chemically synthesized
taaaaactatggcaaaaaatat

SEQ ID NO: 1357081 - DNA, 22 bp, Artificial Sequence
  chemically synthesized
ataaaaactatggcaaaaaata

SEQ ID NO: 1357082 - DNA, 22 bp, Artificial Sequence
  chemically synthesized
tataaaaactatggcaaaaaat

SEQ ID NO: 1357083 - DNA, 22 bp, Artificial Sequence
  chemically synthesized
gttttataaaaactatggcaaa

SEQ ID NO: 1357084 - DNA, 22 bp, Artificial Sequence
  chemically synthesized
tttgccatagtttttataaaac

SEQ ID NO: 1357085 - DNA, 22 bp, Artificial Sequence
  chemically synthesized
ttgccatagtttttataaaacc

SEQ ID NO: 1357086 - DNA, 22 bp, Artificial Sequence
  chemically synthesized
tgccatagtttttataaaacca

SEQ ID NO: 1357087 - DNA, 22 bp, Artificial Sequence
  chemically synthesized
gccatagtttttataaaaccaa

SEQ ID NO: 1357088 - DNA, 22 bp, Artificial Sequence
  chemically synthesized
ccatagtttttataaaaccaat

SEQ ID NO: 1357089 - DNA, 22 bp, Artificial Sequence
  chemically synthesized
ttataaaaccaattatatgtat

SEQ ID NO: 1357090 - DNA, 22 bp, Artificial Sequence
  chemically synthesized
tataaaaccaattatatgtata

SEQ ID NO: 1357091 - DNA, 22 bp, Artificial Sequence
  chemically synthesized
ataaaaccaattatatgtatat

SEQ ID NO: 1357092 - DNA, 22 bp, Artificial Sequence
  chemically synthesized
taaaaccaattatatgtatatt

SEQ ID NO: 1357093 - DNA, 22 bp, Artificial Sequence
  chemically synthesized
tatgtatattatctttattgtc

SEQ ID NO: 1357094 - DNA, 22 bp, Artificial Sequence
  chemically synthesized
tctttattgtctttattatcat

SEQ ID NO: 1357095 - DNA, 22 bp, Artificial Sequence
  chemically synthesized
tagtgaatgataatgataataa

SEQ ID NO: 1357096 - DNA, 22 bp, Artificial Sequence
  chemically synthesized
atagtgaatgataatgataata

SEQ ID NO: 1357097 - DNA, 22 bp, Artificial Sequence
  chemically synthesized
tatagtgaatgataatgataat

SEQ ID NO: 1357098 - DNA, 22 bp, Artificial Sequence
  chemically synthesized
ttatagtgaatgataatgataa

SEQ ID NO: 1357099 - DNA, 22 bp, Artificial Sequence
  chemically synthesized
tattgtctttattatcattatc

SEQ ID NO: 1357100 - DNA, 22 bp, Artificial Sequence
  chemically synthesized
attgtctttattatcattatca

SEQ ID NO: 1357101 - DNA, 22 bp, Artificial Sequence
  chemically synthesized
ttgtctttattatcattatcat

SEQ ID NO: 1357102 - DNA, 22 bp, Artificial Sequence
  chemically synthesized
tcttttatagtgaatgataatg

SEQ ID NO: 1357103 - DNA, 22 bp, Artificial Sequence
  chemically synthesized
tctttattatcattatcattca

SEQ ID NO: 1357104 - DNA, 22 bp, Artificial Sequence
  chemically synthesized
attatcttttatagtgaatgat

SEQ ID NO: 1357105 - DNA, 22 bp, Artificial Sequence
  chemically synthesized
tattatcattatcattcactat

SEQ ID NO: 1357106 - DNA, 22 bp, Artificial Sequence
  chemically synthesized
attatcattatcattcactata

SEQ ID NO: 1357107 - DNA, 22 bp, Artificial Sequence
  chemically synthesized
ttatcattatcattcactataa

SEQ ID NO: 1357108 - DNA, 22 bp, Artificial Sequence
  chemically synthesized
tcattatcattcactataaaag

SEQ ID NO: 1357109 - DNA, 22 bp, Artificial Sequence
  chemically synthesized
catatattcattatcttttata

SEQ ID NO: 1357110 - DNA, 22 bp, Artificial Sequence
  chemically synthesized
gcatatattcattatcttttat

SEQ ID NO: 1357111 - DNA, 22 bp, Artificial Sequence
  chemically synthesized
tcattcactataaaagataatg

SEQ ID NO: 1357112 - DNA, 22 bp, Artificial Sequence
  chemically synthesized
atttgcatatattcattatctt

SEQ ID NO: 1357113 - DNA, 22 bp, Artificial Sequence
  chemically synthesized
actataaaagataatgaatata

SEQ ID NO: 1357114 - DNA, 22 bp, Artificial Sequence
  chemically synthesized
aaaaattaatttgcatatattc

SEQ ID NO: 1357115 - DNA, 22 bp, Artificial Sequence
  chemically synthesized
taaaagataatgaatatatgca

SEQ ID NO: 1357116 - DNA, 22 bp, Artificial Sequence
  chemically synthesized
ccactgaaaaattaatttgcat

SEQ ID NO: 1357117 - DNA, 22 bp, Artificial Sequence
  chemically synthesized
taccactgaaaaattaatttgc

SEQ ID NO: 1357118 - DNA, 22 bp, Artificial Sequence
  chemically synthesized
gaaatcaagttctaccactgaa

SEQ ID NO: 1357119 - DNA, 22 bp, Artificial Sequence
  chemically synthesized
atttttcagtggtagaacttga

SEQ ID NO: 1357120 - DNA, 22 bp, Artificial Sequence
  chemically synthesized
atgacatctagaaatcaagttc

SEQ ID NO: 1357121 - DNA, 22 bp, Artificial Sequence
  chemically synthesized
ttcagtggtagaacttgatttc

SEQ ID NO: 1357122 - DNA, 22 bp, Artificial Sequence
  chemically synthesized
tcagtggtagaacttgatttct

SEQ ID NO: 1357123 - DNA, 22 bp, Artificial Sequence
  chemically synthesized
cagtggtagaacttgatttcta

SEQ ID NO: 1357124 - DNA, 22 bp, Artificial Sequence
  chemically synthesized
attcatgacatctagaaatcaa

SEQ ID NO: 1357125 - DNA, 22 bp, Artificial Sequence
  chemically synthesized
agtggtagaacttgatttctag

SEQ ID NO: 1357126 - DNA, 22 bp, Artificial Sequence
  chemically synthesized
taattcatgacatctagaaatc

SEQ ID NO: 1357127 - DNA, 22 bp, Artificial Sequence
  chemically synthesized
gatttctagatgtcatgaatta

SEQ ID NO: 1357128 - DNA, 22 bp, Artificial Sequence
  chemically synthesized
atttctagatgtcatgaattag

SEQ ID NO: 1357129 - DNA, 22 bp, Artificial Sequence
  chemically synthesized
ctagatgtcatgaattagaact

SEQ ID NO: 1357130 - DNA, 22 bp, Artificial Sequence
  chemically synthesized
tagatgtcatgaattagaactc

SEQ ID NO: 1357131 - DNA, 22 bp, Artificial Sequence
  chemically synthesized
gatgtcatgaattagaactcta

SEQ ID NO: 1357132 - DNA, 22 bp, Artificial Sequence
  chemically synthesized
agaaatggaaaagagtagagtt

SEQ ID NO: 1357133 - DNA, 22 bp, Artificial Sequence
  chemically synthesized
attgagaaatggaaaagagtag

SEQ ID NO: 1357134 - DNA, 22 bp, Artificial Sequence
  chemically synthesized
tgattgagaaatggaaaagagt

SEQ ID NO: 1357135 - DNA, 22 bp, Artificial Sequence
  chemically synthesized
gaactctactcttttccatttc

SEQ ID NO: 1357136 - DNA, 22 bp, Artificial Sequence
  chemically synthesized
tactcttttccatttctcaatc

SEQ ID NO: 1357137 - DNA, 22 bp, Artificial Sequence
  chemically synthesized
ctcttttccatttctcaatcag

SEQ ID NO: 1357138 - DNA, 22 bp, Artificial Sequence
  chemically synthesized
aaaatatagactctgattgaga

SEQ ID NO: 1357139 - DNA, 22 bp, Artificial Sequence
  chemically synthesized
ttttccatttctcaatcagagt

SEQ ID NO: 1357140 - DNA, 22 bp, Artificial Sequence
  chemically synthesized
ttccatttctcaatcagagtct

SEQ ID NO: 1357141 - DNA, 22 bp, Artificial Sequence
  chemically synthesized
tccatttctcaatcagagtcta

SEQ ID NO: 1357142 - DNA, 22 bp, Artificial Sequence
  chemically synthesized
ccatttctcaatcagagtctat

SEQ ID NO: 1357143 - DNA, 22 bp, Artificial Sequence
  chemically synthesized
aaagttgaaaatatagactctg

SEQ ID NO: 1357144 - DNA, 22 bp, Artificial Sequence
  chemically synthesized
catttctcaatcagagtctata

SEQ ID NO: 1357145 - DNA, 22 bp, Artificial Sequence
  chemically synthesized
gaaagttgaaaatatagactct

SEQ ID NO: 1357146 - DNA, 22 bp, Artificial Sequence
  chemically synthesized
tgaaagttgaaaatatagactc

SEQ ID NO: 1357147 - DNA, 22 bp, Artificial Sequence
  chemically synthesized
ctcaatcagagtctatattttc

SEQ ID NO: 1357148 - DNA, 22 bp, Artificial Sequence
  chemically synthesized
tcaatcagagtctatattttca

SEQ ID NO: 1357149 - DNA, 22 bp, Artificial Sequence
  chemically synthesized
aatcagagtctatattttcaac

SEQ ID NO: 1357150 - DNA, 22 bp, Artificial Sequence
  chemically synthesized
tattttcaactttcaaaattgc

SEQ ID NO: 1357151 - DNA, 22 bp, Artificial Sequence
  chemically synthesized
tagaaatgtggtgtgcaatttt

SEQ ID NO: 1357152 - DNA, 22 bp, Artificial Sequence
  chemically synthesized
tcaactttcaaaattgcacacc

SEQ ID NO: 1357153 - DNA, 22 bp, Artificial Sequence
  chemically synthesized
caactttcaaaattgcacacca

SEQ ID NO: 1357154 - DNA, 22 bp, Artificial Sequence
  chemically synthesized
aactttcaaaattgcacaccac

SEQ ID NO: 1357155 - DNA, 22 bp, Artificial Sequence
  chemically synthesized
acattgtagaaatgtggtgtgc

SEQ ID NO: 1357156 - DNA, 22 bp, Artificial Sequence
  chemically synthesized
tcaaaattgcacaccacatttc

SEQ ID NO: 1357157 - DNA, 22 bp, Artificial Sequence
  chemically synthesized
caaaattgcacaccacatttct

SEQ ID NO: 1357158 - DNA, 22 bp, Artificial Sequence
  chemically synthesized
aaaattgcacaccacatttcta

SEQ ID NO: 1357159 - DNA, 22 bp, Artificial Sequence
  chemically synthesized
gggctcacattgtagaaatgtg

SEQ ID NO: 1357160 - DNA, 22 bp, Artificial Sequence
  chemically synthesized
cctggggctcacattgtagaaa

SEQ ID NO: 1357161 - DNA, 22 bp, Artificial Sequence
  chemically synthesized
tgcctggggctcacattgtaga

SEQ ID NO: 1357162 - DNA, 22 bp, Artificial Sequence
  chemically synthesized
cacaccacatttctacaatgtg

SEQ ID NO: 1357163 - DNA, 22 bp, Artificial Sequence
  chemically synthesized
ctgcctggggctcacattgtag

SEQ ID NO: 1357164 - DNA, 22 bp, Artificial Sequence
  chemically synthesized
ttctgcctggggctcacattgt

SEQ ID NO: 1357165 - DNA, 22 bp, Artificial Sequence
  chemically synthesized
taagcattcttctgcctggggc

SEQ ID NO: 1357166 - DNA, 22 bp, Artificial Sequence
  chemically synthesized
ctacaatgtgagccccaggcag

SEQ ID NO: 1357167 - DNA, 22 bp, Artificial Sequence
  chemically synthesized
ataagcattcttctgcctgggg

SEQ ID NO: 1357168 - DNA, 22 bp, Artificial Sequence
  chemically synthesized
tacaatgtgagccccaggcaga

SEQ ID NO: 1357169 - DNA, 22 bp, Artificial Sequence
  chemically synthesized
caatgtgagccccaggcagaag

SEQ ID NO: 1357170 - DNA, 22 bp, Artificial Sequence
  chemically synthesized
gatgaaagcttataagcattct

SEQ ID NO: 1357171 - DNA, 22 bp, Artificial Sequence
  chemically synthesized
tgcctagatgaaagcttataag

SEQ ID NO: 1357172 - DNA, 22 bp, Artificial Sequence
  chemically synthesized
tataatatattgtgcctagatg

SEQ ID NO: 1357173 - DNA, 22 bp, Artificial Sequence
  chemically synthesized
atataatatattgtgcctagat

SEQ ID NO: 1357174 - DNA, 22 bp, Artificial Sequence
  chemically synthesized
ataagctttcatctaggcacaa

SEQ ID NO: 1357175 - DNA, 22 bp, Artificial Sequence
  chemically synthesized
taagctttcatctaggcacaat

SEQ ID NO: 1357176 - DNA, 22 bp, Artificial Sequence
  chemically synthesized
tcatctaggcacaatatattat

SEQ ID NO: 1357177 - DNA, 22 bp, Artificial Sequence
  chemically synthesized
catctaggcacaatatattata

SEQ ID NO: 1357178 - DNA, 22 bp, Artificial Sequence
  chemically synthesized
atctaggcacaatatattatat

SEQ ID NO: 1357179 - DNA, 22 bp, Artificial Sequence
  chemically synthesized
ggcacaatatattatataaggc

SEQ ID NO: 1357180 - DNA, 22 bp, Artificial Sequence
  chemically synthesized
accagccagaaaaccatccagg

SEQ ID NO: 1357181 - DNA, 22 bp, Artificial Sequence
  chemically synthesized
tataaggcctggatggttttct

SEQ ID NO: 1357182 - DNA, 22 bp, Artificial Sequence
  chemically synthesized
gatggttttctggctggtcaat

SEQ ID NO: 1357183 - DNA, 22 bp, Artificial Sequence
  chemically synthesized
cgtatgccaaaagcagagaatt

SEQ ID NO: 1357184 - DNA, 22 bp, Artificial Sequence
  chemically synthesized
tctggctggtcaattctctgct

SEQ ID NO: 1357185 - DNA, 22 bp, Artificial Sequence
  chemically synthesized
ctggctggtcaattctctgctt

SEQ ID NO: 1357186 - DNA, 22 bp, Artificial Sequence
  chemically synthesized
tggctggtcaattctctgcttt

SEQ ID NO: 1357187 - DNA, 22 bp, Artificial Sequence
  chemically synthesized
gctggtcaattctctgcttttg

SEQ ID NO: 1357188 - DNA, 22 bp, Artificial Sequence
  chemically synthesized
atctccgtatgccaaaagcaga

SEQ ID NO: 1357189 - DNA, 22 bp, Artificial Sequence
  chemically synthesized
gatctccgtatgccaaaagcag

SEQ ID NO: 1357190 - DNA, 22 bp, Artificial Sequence
  chemically synthesized
tgatctccgtatgccaaaagca

SEQ ID NO: 1357191 - DNA, 22 bp, Artificial Sequence
  chemically synthesized
gtcaattctctgcttttggcat

SEQ ID NO: 1357192 - DNA, 22 bp, Artificial Sequence
  chemically synthesized
tctgcttttggcatacggagat

SEQ ID NO: 1357193 - DNA, 22 bp, Artificial Sequence
  chemically synthesized
tgcttttggcatacggagatca

SEQ ID NO: 1357194 - DNA, 22 bp, Artificial Sequence
  chemically synthesized
cttttggcatacggagatcaaa

SEQ ID NO: 1357195 - DNA, 22 bp, Artificial Sequence
  chemically synthesized
ttggcatacggagatcaaaatt

SEQ ID NO: 1357196 - DNA, 22 bp, Artificial Sequence
  chemically synthesized
tggcatacggagatcaaaattg

SEQ ID NO: 1357197 - DNA, 22 bp, Artificial Sequence
  chemically synthesized
gatcatataacccaattttgat

SEQ ID NO: 1357198 - DNA, 22 bp, Artificial Sequence
  chemically synthesized
ggcatacggagatcaaaattgg

SEQ ID NO: 1357199 - DNA, 22 bp, Artificial Sequence
  chemically synthesized
gcatacggagatcaaaattggg

SEQ ID NO: 1357200 - DNA, 22 bp, Artificial Sequence
  chemically synthesized
aattagatcatataacccaatt

SEQ ID NO: 1357201 - DNA, 22 bp, Artificial Sequence
  chemically synthesized
aactaaattagatcatataacc

SEQ ID NO: 1357202 - DNA, 22 bp, Artificial Sequence
  chemically synthesized
caactaaattagatcatataac

SEQ ID NO: 1357203 - DNA, 22 bp, Artificial Sequence
  chemically synthesized
tcttcaactaaattagatcata

SEQ ID NO: 1357204 - DNA, 22 bp, Artificial Sequence
  chemically synthesized
tattatcttcaactaaattaga

SEQ ID NO: 1357205 - DNA, 22 bp, Artificial Sequence
  chemically synthesized
ggttatatgatctaatttagtt

SEQ ID NO: 1357206 - DNA, 22 bp, Artificial Sequence
  chemically synthesized
ttgtattatcttcaactaaatt

SEQ ID NO: 1357207 - DNA, 22 bp, Artificial Sequence
  chemically synthesized
tatgatctaatttagttgaaga

SEQ ID NO: 1357208 - DNA, 22 bp, Artificial Sequence
  chemically synthesized
atttagttgaagataatacaat

SEQ ID NO: 1357209 - DNA, 22 bp, Artificial Sequence
  chemically synthesized
atgaaagtgtatattattgtat

SEQ ID NO: 1357210 - DNA, 22 bp, Artificial Sequence
  chemically synthesized
agttgaagataatacaataata

SEQ ID NO: 1357211 - DNA, 22 bp, Artificial Sequence
  chemically synthesized
aatgaaagtgtatattattgta

SEQ ID NO: 1357212 - DNA, 22 bp, Artificial Sequence
  chemically synthesized
gttgaagataatacaataatat

SEQ ID NO: 1357213 - DNA, 22 bp, Artificial Sequence
  chemically synthesized
ttaatgaaagtgtatattattg

SEQ ID NO: 1357214 - DNA, 22 bp, Artificial Sequence
  chemically synthesized
cttaatgaaagtgtatattatt

SEQ ID NO: 1357215 - DNA, 22 bp, Artificial Sequence
  chemically synthesized
tcttaatgaaagtgtatattat

SEQ ID NO: 1357216 - DNA, 22 bp, Artificial Sequence
  chemically synthesized
aagataatacaataatatacac

SEQ ID NO: 1357217 - DNA, 22 bp, Artificial Sequence
  chemically synthesized
ttcttaatgaaagtgtatatta

SEQ ID NO: 1357218 - DNA, 22 bp, Artificial Sequence
  chemically synthesized
tttcttaatgaaagtgtatatt

SEQ ID NO: 1357219 - DNA, 22 bp, Artificial Sequence
  chemically synthesized
aattttttcttaatgaaagtgt

SEQ ID NO: 1357220 - DNA, 22 bp, Artificial Sequence
  chemically synthesized
cataattaaattttttcttaat

SEQ ID NO: 1357221 - DNA, 22 bp, Artificial Sequence
  chemically synthesized
tcattaagaaaaaatttaatta

SEQ ID NO: 1357222 - DNA, 22 bp, Artificial Sequence
  chemically synthesized
cattaagaaaaaatttaattat

SEQ ID NO: 1357223 - DNA, 22 bp, Artificial Sequence
  chemically synthesized
attaagaaaaaatttaattatg

SEQ ID NO: 1357224 - DNA, 22 bp, Artificial Sequence
  chemically synthesized
tgatgatagttccataattaaa

SEQ ID NO: 1357225 - DNA, 22 bp, Artificial Sequence
  chemically synthesized
atgatgatagttccataattaa

SEQ ID NO: 1357226 - DNA, 22 bp, Artificial Sequence
  chemically synthesized
tatgatgatagttccataatta

SEQ ID NO: 1357227 - DNA, 22 bp, Artificial Sequence
  chemically synthesized
ttatgatgatagttccataatt

SEQ ID NO: 1357228 - DNA, 22 bp, Artificial Sequence
  chemically synthesized
agaaaaaatttaattatggaac

SEQ ID NO: 1357229 - DNA, 22 bp, Artificial Sequence
  chemically synthesized
tgacaatttttatgatgatagt

SEQ ID NO: 1357230 - DNA, 22 bp, Artificial Sequence
  chemically synthesized
aattatggaactatcatcataa

SEQ ID NO: 1357231 - DNA, 22 bp, Artificial Sequence
  chemically synthesized
attatggaactatcatcataaa

SEQ ID NO: 1357232 - DNA, 22 bp, Artificial Sequence
  chemically synthesized
tctatgacaatttttatgatga

SEQ ID NO: 1357233 - DNA, 22 bp, Artificial Sequence
  chemically synthesized
atctatgacaatttttatgatg

SEQ ID NO: 1357234 - DNA, 22 bp, Artificial Sequence
  chemically synthesized
ttatctatgacaatttttatga

SEQ ID NO: 1357235 - DNA, 22 bp, Artificial Sequence
  chemically synthesized
tggaactatcatcataaaaatt

SEQ ID NO: 1357236 - DNA, 22 bp, Artificial Sequence
  chemically synthesized
ttcttatctatgacaattttta

SEQ ID NO: 1357237 - DNA, 22 bp, Artificial Sequence
  chemically synthesized
gttcttatctatgacaattttt

SEQ ID NO: 1357238 - DNA, 22 bp, Artificial Sequence
  chemically synthesized
tgttcttatctatgacaatttt

SEQ ID NO: 1357239 - DNA, 22 bp, Artificial Sequence
  chemically synthesized
tcatcataaaaattgtcataga

SEQ ID NO: 1357240 - DNA, 22 bp, Artificial Sequence
  chemically synthesized
tcatagataagaacaaagatac

SEQ ID NO: 1357241 - DNA, 22 bp, Artificial Sequence
  chemically synthesized
aaccaaagaaaagatgcgatat

SEQ ID NO: 1357242 - DNA, 22 bp, Artificial Sequence
  chemically synthesized
caaccaaagaaaagatgcgata

SEQ ID NO: 1357243 - DNA, 22 bp, Artificial Sequence
  chemically synthesized
taaaatttcaaccaaagaaaag

SEQ ID NO: 1357244 - DNA, 22 bp, Artificial Sequence
  chemically synthesized
ataaaatttcaaccaaagaaaa

SEQ ID NO: 1357245 - DNA, 22 bp, Artificial Sequence
  chemically synthesized
tatcgcatcttttctttggttg

SEQ ID NO: 1357246 - DNA, 22 bp, Artificial Sequence
  chemically synthesized
acttataaaatttcaaccaaag

SEQ ID NO: 1357247 - DNA, 22 bp, Artificial Sequence
  chemically synthesized
gacttataaaatttcaaccaaa

SEQ ID NO: 1357248 - DNA, 22 bp, Artificial Sequence
  chemically synthesized
tgacttataaaatttcaaccaa

SEQ ID NO: 1357249 - DNA, 22 bp, Artificial Sequence
  chemically synthesized
ttttgacttataaaatttcaac

SEQ ID NO: 1357250 - DNA, 22 bp, Artificial Sequence
  chemically synthesized
ttctttggttgaaattttataa

SEQ ID NO: 1357251 - DNA, 22 bp, Artificial Sequence
  chemically synthesized
tctttggttgaaattttataag

SEQ ID NO: 1357252 - DNA, 22 bp, Artificial Sequence
  chemically synthesized
ctttggttgaaattttataagt

SEQ ID NO: 1357253 - DNA, 22 bp, Artificial Sequence
  chemically synthesized
tttggttgaaattttataagtc

SEQ ID NO: 1357254 - DNA, 22 bp, Artificial Sequence
  chemically synthesized
tggttgaaattttataagtcaa

SEQ ID NO: 1357255 - DNA, 22 bp, Artificial Sequence
  chemically synthesized
ggttgaaattttataagtcaaa

SEQ ID NO: 1357256 - DNA, 22 bp, Artificial Sequence
  chemically synthesized
gttgaaattttataagtcaaaa

SEQ ID NO: 1357257 - DNA, 22 bp, Artificial Sequence
  chemically synthesized
aaattttataagtcaaaataga

SEQ ID NO: 1357258 - DNA, 22 bp, Artificial Sequence
  chemically synthesized
tatgtgacatgacaatctattt

SEQ ID NO: 1357259 - DNA, 22 bp, Artificial Sequence
  chemically synthesized
gtatgtgacatgacaatctatt

SEQ ID NO: 1357260 - DNA, 22 bp, Artificial Sequence
  chemically synthesized
tataagtcaaaatagattgtca

SEQ ID NO: 1357261 - DNA, 22 bp, Artificial Sequence
  chemically synthesized
ataagtcaaaatagattgtcat

SEQ ID NO: 1357262 - DNA, 22 bp, Artificial Sequence
  chemically synthesized
taagtcaaaatagattgtcatg

SEQ ID NO: 1357263 - DNA, 22 bp, Artificial Sequence
  chemically synthesized
aagaggcttgtatgtgacatga

SEQ ID NO: 1357264 - DNA, 22 bp, Artificial Sequence
  chemically synthesized
ttaaagaggcttgtatgtgaca

SEQ ID NO: 1357265 - DNA, 22 bp, Artificial Sequence
  chemically synthesized
gttaaagaggcttgtatgtgac

SEQ ID NO: 1357266 - DNA, 22 bp, Artificial Sequence
  chemically synthesized
tcatgtcacatacaagcctctt

SEQ ID NO: 1357267 - DNA, 22 bp, Artificial Sequence
  chemically synthesized
aggagatttgttaaagaggctt

SEQ ID NO: 1357268 - DNA, 22 bp, Artificial Sequence
  chemically synthesized
gaggagatttgttaaagaggct

SEQ ID NO: 1357269 - DNA, 22 bp, Artificial Sequence
  chemically synthesized
tgaggagatttgttaaagaggc

SEQ ID NO: 1357270 - DNA, 22 bp, Artificial Sequence
  chemically synthesized
tctttgaggagatttgttaaag

SEQ ID NO: 1357271 - DNA, 22 bp, Artificial Sequence
  chemically synthesized
atctttgaggagatttgttaaa

SEQ ID NO: 1357272 - DNA, 22 bp, Artificial Sequence
  chemically synthesized
tatctttgaggagatttgttaa

SEQ ID NO: 1357273 - DNA, 22 bp, Artificial Sequence
  chemically synthesized
atattttatctttgaggagatt

SEQ ID NO: 1357274 - DNA, 22 bp, Artificial Sequence
  chemically synthesized
aatattttatctttgaggagat

SEQ ID NO: 1357275 - DNA, 22 bp, Artificial Sequence
  chemically synthesized
taatattttatctttgaggaga

SEQ ID NO: 1357276 - DNA, 22 bp, Artificial Sequence
  chemically synthesized
tttaatattttatctttgagga

SEQ ID NO: 1357277 - DNA, 22 bp, Artificial Sequence
  chemically synthesized
tttaacaaatctcctcaaagat

SEQ ID NO: 1357278 - DNA, 22 bp, Artificial Sequence
  chemically synthesized
ctttaatattttatctttgagg

SEQ ID NO: 1357279 - DNA, 22 bp, Artificial Sequence
  chemically synthesized
tctttaatattttatctttgag

SEQ ID NO: 1357280 - DNA, 22 bp, Artificial Sequence
  chemically synthesized
taacaaatctcctcaaagataa

SEQ ID NO: 1357281 - DNA, 22 bp, Artificial Sequence
  chemically synthesized
ttctttaatattttatctttga

SEQ ID NO: 1357282 - DNA, 22 bp, Artificial Sequence
  chemically synthesized
aacaaatctcctcaaagataaa

SEQ ID NO: 1357283 - DNA, 22 bp, Artificial Sequence
  chemically synthesized
tttctttaatattttatctttg

SEQ ID NO: 1357284 - DNA, 22 bp, Artificial Sequence
  chemically synthesized
acaaatctcctcaaagataaaa

SEQ ID NO: 1357285 - DNA, 22 bp, Artificial Sequence
  chemically synthesized
ctcaaagataaaatattaaaga

SEQ ID NO: 1357286 - DNA, 22 bp, Artificial Sequence
  chemically synthesized
aaagataaaatattaaagaaaa

SEQ ID NO: 1357287 - DNA, 22 bp, Artificial Sequence
  chemically synthesized
ataagaccatagtaactttttc

SEQ ID NO: 1357288 - DNA, 22 bp, Artificial Sequence
  chemically synthesized
taaactaataagaccatagtaa

SEQ ID NO: 1357289 - DNA, 22 bp, Artificial Sequence
  chemically synthesized
tgtaaactaataagaccatagt

SEQ ID NO: 1357290 - DNA, 22 bp, Artificial Sequence
  chemically synthesized
aagaaaaagttactatggtctt

SEQ ID NO: 1357291 - DNA, 22 bp, Artificial Sequence
  chemically synthesized
ctgtaaactaataagaccatag

SEQ ID NO: 1357292 - DNA, 22 bp, Artificial Sequence
  chemically synthesized
agtttctgtaaactaataagac

SEQ ID NO: 1357293 - DNA, 22 bp, Artificial Sequence
  chemically synthesized
ctatggtcttattagtttacag

SEQ ID NO: 1357294 - DNA, 22 bp, Artificial Sequence
  chemically synthesized
tggtcttattagtttacagaaa

SEQ ID NO: 1357295 - DNA, 22 bp, Artificial Sequence
  chemically synthesized
taataaaattaagtttctgtaa

SEQ ID NO: 1357296 - DNA, 22 bp, Artificial Sequence
  chemically synthesized
ataataaaattaagtttctgta

SEQ ID NO: 1357297 - DNA, 22 bp, Artificial Sequence
  chemically synthesized
tataataaaattaagtttctgt

SEQ ID NO: 1357298 - DNA, 22 bp, Artificial Sequence
  chemically synthesized
ttataataaaattaagtttctg

SEQ ID NO: 1357299 - DNA, 22 bp, Artificial Sequence
  chemically synthesized
attagtttacagaaacttaatt

SEQ ID NO: 1357300 - DNA, 22 bp, Artificial Sequence
  chemically synthesized
cttttataataaaattaagttt

SEQ ID NO: 1357301 - DNA, 22 bp, Artificial Sequence
  chemically synthesized
ttagtttacagaaacttaattt

SEQ ID NO: 1357302 - DNA, 22 bp, Artificial Sequence
  chemically synthesized
gtttacagaaacttaattttat

SEQ ID NO: 1357303 - DNA, 22 bp, Artificial Sequence
  chemically synthesized
acctgcttttataataaaatta

SEQ ID NO: 1357304 - DNA, 22 bp, Artificial Sequence
  chemically synthesized
tgacctgcttttataataaaat

SEQ ID NO: 1357305 - DNA, 22 bp, Artificial Sequence
  chemically synthesized
acagaaacttaattttattata

SEQ ID NO: 1357306 - DNA, 22 bp, Artificial Sequence
  chemically synthesized
cagaaacttaattttattataa

SEQ ID NO: 1357307 - DNA, 22 bp, Artificial Sequence
  chemically synthesized
aattttattataaaagcaggtc

SEQ ID NO: 1357308 - DNA, 22 bp, Artificial Sequence
  chemically synthesized
attttattataaaagcaggtca

SEQ ID NO: 1357309 - DNA, 22 bp, Artificial Sequence
  chemically synthesized
aagtagtaggccctctgacctg

SEQ ID NO: 1357310 - DNA, 22 bp, Artificial Sequence
  chemically synthesized
tattataaaagcaggtcagagg

SEQ ID NO: 1357311 - DNA, 22 bp, Artificial Sequence
  chemically synthesized
attataaaagcaggtcagaggg

SEQ ID NO: 1357312 - DNA, 22 bp, Artificial Sequence
  chemically synthesized
ttataaaagcaggtcagagggc

SEQ ID NO: 1357313 - DNA, 22 bp, Artificial Sequence
  chemically synthesized
ctgaagtagtaggccctctgac

SEQ ID NO: 1357314 - DNA, 22 bp, Artificial Sequence
  chemically synthesized
actgaagtagtaggccctctga

SEQ ID NO: 1357315 - DNA, 22 bp, Artificial Sequence
  chemically synthesized
taaaagcaggtcagagggccta

SEQ ID NO: 1357316 - DNA, 22 bp, Artificial Sequence
  chemically synthesized
atttactgaagtagtaggccct

SEQ ID NO: 1357317 - DNA, 22 bp, Artificial Sequence
  chemically synthesized
agtgatatcattaatttactga

SEQ ID NO: 1357318 - DNA, 22 bp, Artificial Sequence
  chemically synthesized
gagtgatatcattaatttactg

SEQ ID NO: 1357319 - DNA, 22 bp, Artificial Sequence
  chemically synthesized
gcttgagtgatatcattaattt

SEQ ID NO: 1357320 - DNA, 22 bp, Artificial Sequence
  chemically synthesized
agcttgagtgatatcattaatt

SEQ ID NO: 1357321 - DNA, 22 bp, Artificial Sequence
  chemically synthesized
ctacttcagtaaattaatgata

SEQ ID NO: 1357322 - DNA, 22 bp, Artificial Sequence
  chemically synthesized
cttcagtaaattaatgatatca

SEQ ID NO: 1357323 - DNA, 22 bp, Artificial Sequence
  chemically synthesized
cagtaaattaatgatatcactc

SEQ ID NO: 1357324 - DNA, 22 bp, Artificial Sequence
  chemically synthesized
agtaaattaatgatatcactca

SEQ ID NO: 1357325 - DNA, 22 bp, Artificial Sequence
  chemically synthesized
tgagaaaacttagcttgagtga

SEQ ID NO: 1357326 - DNA, 22 bp, Artificial Sequence
  chemically synthesized
atgagaaaacttagcttgagtg

SEQ ID NO: 1357327 - DNA, 22 bp, Artificial Sequence
  chemically synthesized
tatgagaaaacttagcttgagt

SEQ ID NO: 1357328 - DNA, 22 bp, Artificial Sequence
  chemically synthesized
atgatatcactcaagctaagtt

SEQ ID NO: 1357329 - DNA, 22 bp, Artificial Sequence
  chemically synthesized
aagctaagttttctcataaaat

SEQ ID NO: 1357330 - DNA, 22 bp, Artificial Sequence
  chemically synthesized
gtatgcacaggcattttatgag

SEQ ID NO: 1357331 - DNA, 22 bp, Artificial Sequence
  chemically synthesized
agttttctcataaaatgcctgt

SEQ ID NO: 1357332 - DNA, 22 bp, Artificial Sequence
  chemically synthesized
tctcataaaatgcctgtgcata

SEQ ID NO: 1357333 - DNA, 22 bp, Artificial Sequence
  chemically synthesized
ctcataaaatgcctgtgcatac

SEQ ID NO: 1357334 - DNA, 22 bp, Artificial Sequence
  chemically synthesized
tcataaaatgcctgtgcatacc

SEQ ID NO: 1357335 - DNA, 22 bp, Artificial Sequence
  chemically synthesized
ataaaatgcctgtgcataccag

SEQ ID NO: 1357336 - DNA, 22 bp, Artificial Sequence
  chemically synthesized
cagaaatccacagatctggtat

SEQ ID NO: 1357337 - DNA, 22 bp, Artificial Sequence
  chemically synthesized
tgcataccagatctgtggattt

SEQ ID NO: 1357338 - DNA, 22 bp, Artificial Sequence
  chemically synthesized
caaagtattacagaaatccaca

SEQ ID NO: 1357339 - DNA, 22 bp, Artificial Sequence
  chemically synthesized
ccaaagtattacagaaatccac

SEQ ID NO: 1357340 - DNA, 22 bp, Artificial Sequence
  chemically synthesized
aatttccaaagtattacagaaa

SEQ ID NO: 1357341 - DNA, 22 bp, Artificial Sequence
  chemically synthesized
caatttccaaagtattacagaa

SEQ ID NO: 1357342 - DNA, 22 bp, Artificial Sequence
  chemically synthesized
tcaatttccaaagtattacaga

SEQ ID NO: 1357343 - DNA, 22 bp, Artificial Sequence
  chemically synthesized
tggatttctgtaatactttgga

SEQ ID NO: 1357344 - DNA, 22 bp, Artificial Sequence
  chemically synthesized
aaccctttcaatttccaaagta

SEQ ID NO: 1357345 - DNA, 22 bp, Artificial Sequence
  chemically synthesized
gaaccctttcaatttccaaagt

SEQ ID NO: 1357346 - DNA, 22 bp, Artificial Sequence
  chemically synthesized
ctgtaatactttggaaattgaa

SEQ ID NO: 1357347 - DNA, 22 bp, Artificial Sequence
  chemically synthesized
tgtaatactttggaaattgaaa

SEQ ID NO: 1357348 - DNA, 22 bp, Artificial Sequence
  chemically synthesized
gtgtcttgaaccctttcaattt

SEQ ID NO: 1357349 - DNA, 22 bp, Artificial Sequence
  chemically synthesized
taatactttggaaattgaaagg

SEQ ID NO: 1357350 - DNA, 22 bp, Artificial Sequence
  chemically synthesized
aaaactggtgtcttgaaccctt

SEQ ID NO: 1357351 - DNA, 22 bp, Artificial Sequence
  chemically synthesized
aaaaactggtgtcttgaaccct

SEQ ID NO: 1357352 - DNA, 22 bp, Artificial Sequence
  chemically synthesized
tggaaattgaaagggttcaaga

SEQ ID NO: 1357353 - DNA, 22 bp, Artificial Sequence
  chemically synthesized
taaaaactggtgtcttgaaccc

SEQ ID NO: 1357354 - DNA, 22 bp, Artificial Sequence
  chemically synthesized
ggaaattgaaagggttcaagac

SEQ ID NO: 1357355 - DNA, 22 bp, Artificial Sequence
  chemically synthesized
ttaaaaactggtgtcttgaacc

SEQ ID NO: 1357356 - DNA, 22 bp, Artificial Sequence
  chemically synthesized
gaaattgaaagggttcaagaca

SEQ ID NO: 1357357 - DNA, 22 bp, Artificial Sequence
  chemically synthesized
aaagggttcaagacaccagttt

SEQ ID NO: 1357358 - DNA, 22 bp, Artificial Sequence
  chemically synthesized
atgtaataatgaatttttaaaa

SEQ ID NO: 1357359 - DNA, 22 bp, Artificial Sequence
  chemically synthesized
aagacaccagtttttaaaaatt

SEQ ID NO: 1357360 - DNA, 22 bp, Artificial Sequence
  chemically synthesized
ttcatgtaataatgaattttta

SEQ ID NO: 1357361 - DNA, 22 bp, Artificial Sequence
  chemically synthesized
acatattattcatgtaataatg

SEQ ID NO: 1357362 - DNA, 22 bp, Artificial Sequence
  chemically synthesized
ttaaaaattcattattacatga

SEQ ID NO: 1357363 - DNA, 22 bp, Artificial Sequence
  chemically synthesized
taaaaattcattattacatgaa

SEQ ID NO: 1357364 - DNA, 22 bp, Artificial Sequence
  chemically synthesized
aaaaattcattattacatgaat

SEQ ID NO: 1357365 - DNA, 22 bp, Artificial Sequence
  chemically synthesized
cgttaacatattattcatgtaa

SEQ ID NO: 1357366 - DNA, 22 bp, Artificial Sequence
  chemically synthesized
aaaattcattattacatgaata

SEQ ID NO: 1357367 - DNA, 22 bp, Artificial Sequence
  chemically synthesized
tatattacgttaacatattatt

SEQ ID NO: 1357368 - DNA, 22 bp, Artificial Sequence
  chemically synthesized
attattacatgaataatatgtt

SEQ ID NO: 1357369 - DNA, 22 bp, Artificial Sequence
  chemically synthesized
gtatattacgttaacatattat

SEQ ID NO: 1357370 - DNA, 22 bp, Artificial Sequence
  chemically synthesized
tgtatattacgttaacatatta

SEQ ID NO: 1357371 - DNA, 22 bp, Artificial Sequence
  chemically synthesized
ttacatgaataatatgttaacg

SEQ ID NO: 1357372 - DNA, 22 bp, Artificial Sequence
  chemically synthesized
tattttgtatattacgttaaca

SEQ ID NO: 1357373 - DNA, 22 bp, Artificial Sequence
  chemically synthesized
catgaataatatgttaacgtaa

SEQ ID NO: 1357374 - DNA, 22 bp, Artificial Sequence
  chemically synthesized
acgtaatatacaaaatatagtt

SEQ ID NO: 1357375 - DNA, 22 bp, Artificial Sequence
  chemically synthesized
accagtgaatatgaactatatt

SEQ ID NO: 1357376 - DNA, 22 bp, Artificial Sequence
  chemically synthesized
ttgaccagtgaatatgaactat

SEQ ID NO: 1357377 - DNA, 22 bp, Artificial Sequence
  chemically synthesized
attgaccagtgaatatgaacta

SEQ ID NO: 1357378 - DNA, 22 bp, Artificial Sequence
  chemically synthesized
tattgaccagtgaatatgaact

SEQ ID NO: 1357379 - DNA, 22 bp, Artificial Sequence
  chemically synthesized
taatattttattgaccagtgaa

SEQ ID NO: 1357380 - DNA, 22 bp, Artificial Sequence
  chemically synthesized
gtaatattttattgaccagtga

SEQ ID NO: 1357381 - DNA, 22 bp, Artificial Sequence
  chemically synthesized
aatgtttgtaatattttattga

SEQ ID NO: 1357382 - DNA, 22 bp, Artificial Sequence
  chemically synthesized
atattcactggtcaataaaata

SEQ ID NO: 1357383 - DNA, 22 bp, Artificial Sequence
  chemically synthesized
aaatgtttgtaatattttattg

SEQ ID NO: 1357384 - DNA, 22 bp, Artificial Sequence
  chemically synthesized
cacttaaatgtttgtaatattt

SEQ ID NO: 1357385 - DNA, 22 bp, Artificial Sequence
  chemically synthesized
actggtcaataaaatattacaa

SEQ ID NO: 1357386 - DNA, 22 bp, Artificial Sequence
  chemically synthesized
gcacttaaatgtttgtaatatt

SEQ ID NO: 1357387 - DNA, 22 bp, Artificial Sequence
  chemically synthesized
tgcacttaaatgtttgtaatat

SEQ ID NO: 1357388 - DNA, 22 bp, Artificial Sequence
  chemically synthesized
ttgcacttaaatgtttgtaata

SEQ ID NO: 1357389 - DNA, 22 bp, Artificial Sequence
  chemically synthesized
gtcaataaaatattacaaacat

SEQ ID NO: 1357390 - DNA, 22 bp, Artificial Sequence
  chemically synthesized
tttttgcacttaaatgtttgta

SEQ ID NO: 1357391 - DNA, 22 bp, Artificial Sequence
  chemically synthesized
ttatttttgcacttaaatgttt

SEQ ID NO: 1357392 - DNA, 22 bp, Artificial Sequence
  chemically synthesized
attatttttgcacttaaatgtt

SEQ ID NO: 1357393 - DNA, 22 bp, Artificial Sequence
  chemically synthesized
atatttattatttttgcactta

SEQ ID NO: 1357394 - DNA, 22 bp, Artificial Sequence
  chemically synthesized
ttcatatttattatttttgcac

SEQ ID NO: 1357395 - DNA, 22 bp, Artificial Sequence
  chemically synthesized
caaacatttaagtgcaaaaata

SEQ ID NO: 1357396 - DNA, 22 bp, Artificial Sequence
  chemically synthesized
acaacctattcatatttattat

SEQ ID NO: 1357397 - DNA, 22 bp, Artificial Sequence
  chemically synthesized
aagtgcaaaaataataaatatg

SEQ ID NO: 1357398 - DNA, 22 bp, Artificial Sequence
  chemically synthesized
agtgcaaaaataataaatatga

SEQ ID NO: 1357399 - DNA, 22 bp, Artificial Sequence
  chemically synthesized
cagagccagtctaacaacctat

SEQ ID NO: 1357400 - DNA, 22 bp, Artificial Sequence
  chemically synthesized
aaaacaaaaataggatctacag

SEQ ID NO: 1357401 - DNA, 22 bp, Artificial Sequence
  chemically synthesized
ttagactggctctgtagatcct

SEQ ID NO: 1357402 - DNA, 22 bp, Artificial Sequence
  chemically synthesized
tgaaaacaaaaataggatctac

SEQ ID NO: 1357403 - DNA, 22 bp, Artificial Sequence
  chemically synthesized
gactggctctgtagatcctatt

SEQ ID NO: 1357404 - DNA, 22 bp, Artificial Sequence
  chemically synthesized
gctctgtagatcctatttttgt

SEQ ID NO: 1357405 - DNA, 22 bp, Artificial Sequence
  chemically synthesized
aatggactctgaaaacaaaaat

SEQ ID NO: 1357406 - DNA, 22 bp, Artificial Sequence
  chemically synthesized
tgtagatcctatttttgttttc

SEQ ID NO: 1357407 - DNA, 22 bp, Artificial Sequence
  chemically synthesized
tagatcctatttttgttttcag

SEQ ID NO: 1357408 - DNA, 22 bp, Artificial Sequence
  chemically synthesized
tttttgttttcagagtccattc

SEQ ID NO: 1357409 - DNA, 22 bp, Artificial Sequence
  chemically synthesized
aaatacatggaattgaatggac

SEQ ID NO: 1357410 - DNA, 22 bp, Artificial Sequence
  chemically synthesized
ttgttttcagagtccattcaat

SEQ ID NO: 1357411 - DNA, 22 bp, Artificial Sequence
  chemically synthesized
tgttttcagagtccattcaatt

SEQ ID NO: 1357412 - DNA, 22 bp, Artificial Sequence
  chemically synthesized
gttttcagagtccattcaattc

SEQ ID NO: 1357413 - DNA, 22 bp, Artificial Sequence
  chemically synthesized
ttttcagagtccattcaattcc

SEQ ID NO: 1357414 - DNA, 22 bp, Artificial Sequence
  chemically synthesized
tcagagtccattcaattccatg

SEQ ID NO: 1357415 - DNA, 22 bp, Artificial Sequence
  chemically synthesized
cagagtccattcaattccatgt

SEQ ID NO: 1357416 - DNA, 22 bp, Artificial Sequence
  chemically synthesized
catgactcaaatacatggaatt

SEQ ID NO: 1357417 - DNA, 22 bp, Artificial Sequence
  chemically synthesized
agagtccattcaattccatgta

SEQ ID NO: 1357418 - DNA, 22 bp, Artificial Sequence
  chemically synthesized
ttgcatgactcaaatacatgga

SEQ ID NO: 1357419 - DNA, 22 bp, Artificial Sequence
  chemically synthesized
attgcatgactcaaatacatgg

SEQ ID NO: 1357420 - DNA, 22 bp, Artificial Sequence
  chemically synthesized
aattccatgtatttgagtcatg

SEQ ID NO: 1357421 - DNA, 22 bp, Artificial Sequence
  chemically synthesized
catgtatttgagtcatgcaata

SEQ ID NO: 1357422 - DNA, 22 bp, Artificial Sequence
  chemically synthesized
aaggtgagaaatgtttattgca

SEQ ID NO: 1357423 - DNA, 22 bp, Artificial Sequence
  chemically synthesized
gagtcatgcaataaacatttct

SEQ ID NO: 1357424 - DNA, 22 bp, Artificial Sequence
  chemically synthesized
agtcatgcaataaacatttctc

SEQ ID NO: 1357425 - DNA, 22 bp, Artificial Sequence
  chemically synthesized
ctcaccttgaatttgggcatac

SEQ ID NO: 1357426 - DNA, 22 bp, Artificial Sequence
  chemically synthesized
tcaccttgaatttgggcatact

SEQ ID NO: 1357427 - DNA, 22 bp, Artificial Sequence
  chemically synthesized
accttgaatttgggcatacttg

SEQ ID NO: 1357428 - DNA, 22 bp, Artificial Sequence
  chemically synthesized
gaatttgggcatacttgtatgg

SEQ ID NO: 1357429 - DNA, 22 bp, Artificial Sequence
  chemically synthesized
aatttgggcatacttgtatggg

SEQ ID NO: 1357430 - DNA, 22 bp, Artificial Sequence
  chemically synthesized
gggcatacttgtatggggctcc

SEQ ID NO: 1357431 - DNA, 22 bp, Artificial Sequence
  chemically synthesized
ggcatacttgtatggggctcca

SEQ ID NO: 1357432 - DNA, 22 bp, Artificial Sequence
  chemically synthesized
gtatggggctccatgcttgtgc

SEQ ID NO: 1357433 - DNA, 22 bp, Artificial Sequence
  chemically synthesized
tatggggctccatgcttgtgca

SEQ ID NO: 1357434 - DNA, 22 bp, Artificial Sequence
  chemically synthesized
gataaatatgtgtgcacaagca

SEQ ID NO: 1357435 - DNA, 22 bp, Artificial Sequence
  chemically synthesized
gtgtctggataaatatgtgtgc

SEQ ID NO: 1357436 - DNA, 22 bp, Artificial Sequence
  chemically synthesized
agtgtctggataaatatgtgtg

SEQ ID NO: 1357437 - DNA, 22 bp, Artificial Sequence
  chemically synthesized
catgcttgtgcacacatattta

SEQ ID NO: 1357438 - DNA, 22 bp, Artificial Sequence
  chemically synthesized
gtgcacacatatttatccagac

SEQ ID NO: 1357439 - DNA, 22 bp, Artificial Sequence
  chemically synthesized
tgcacacatatttatccagaca

SEQ ID NO: 1357440 - DNA, 22 bp, Artificial Sequence
  chemically synthesized
taaaaggaaacttagtgtctgg

SEQ ID NO: 1357441 - DNA, 22 bp, Artificial Sequence
  chemically synthesized
ataaaaggaaacttagtgtctg

SEQ ID NO: 1357442 - DNA, 22 bp, Artificial Sequence
  chemically synthesized
atttataaaaggaaacttagtg

SEQ ID NO: 1357443 - DNA, 22 bp, Artificial Sequence
  chemically synthesized
atccagacactaagtttccttt

SEQ ID NO: 1357444 - DNA, 22 bp, Artificial Sequence
  chemically synthesized
agctcatttataaaaggaaact

SEQ ID NO: 1357445 - DNA, 22 bp, Artificial Sequence
  chemically synthesized
tccagacactaagtttcctttt

SEQ ID NO: 1357446 - DNA, 22 bp, Artificial Sequence
  chemically synthesized
ggattgagctcatttataaaag

SEQ ID NO: 1357447 - DNA, 22 bp, Artificial Sequence
  chemically synthesized
atctgggattgagctcatttat

SEQ ID NO: 1357448 - DNA, 22 bp, Artificial Sequence
  chemically synthesized
agtttccttttataaatgagct

SEQ ID NO: 1357449 - DNA, 22 bp, Artificial Sequence
  chemically synthesized
aatctgggattgagctcattta

SEQ ID NO: 1357450 - DNA, 22 bp, Artificial Sequence
  chemically synthesized
taatctgggattgagctcattt

SEQ ID NO: 1357451 - DNA, 22 bp, Artificial Sequence
  chemically synthesized
ttttaatctgggattgagctca

SEQ ID NO: 1357452 - DNA, 22 bp, Artificial Sequence
  chemically synthesized
ccttttataaatgagctcaatc

SEQ ID NO: 1357453 - DNA, 22 bp, Artificial Sequence
  chemically synthesized
cttttataaatgagctcaatcc

SEQ ID NO: 1357454 - DNA, 22 bp, Artificial Sequence
  chemically synthesized
ttataaatgagctcaatcccag

SEQ ID NO: 1357455 - DNA, 22 bp, Artificial Sequence
  chemically synthesized
atctgttttaatctgggattga

SEQ ID NO: 1357456 - DNA, 22 bp, Artificial Sequence
  chemically synthesized
tataaatgagctcaatcccaga

SEQ ID NO: 1357457 - DNA, 22 bp, Artificial Sequence
  chemically synthesized
catctgttttaatctgggattg

SEQ ID NO: 1357458 - DNA, 22 bp, Artificial Sequence
  chemically synthesized
ataaatgagctcaatcccagat

SEQ ID NO: 1357459 - DNA, 22 bp, Artificial Sequence
  chemically synthesized
tcatctgttttaatctgggatt

SEQ ID NO: 1357460 - DNA, 22 bp, Artificial Sequence
  chemically synthesized
taaatgagctcaatcccagatt

SEQ ID NO: 1357461 - DNA, 22 bp, Artificial Sequence
  chemically synthesized
gaaatctttcatctgttttaat

SEQ ID NO: 1357462 - DNA, 22 bp, Artificial Sequence
  chemically synthesized
aatcccagattaaaacagatga

SEQ ID NO: 1357463 - DNA, 22 bp, Artificial Sequence
  chemically synthesized
gccacaatgattggaaatcttt

SEQ ID NO: 1357464 - DNA, 22 bp, Artificial Sequence
  chemically synthesized
aaacagatgaaagatttccaat

SEQ ID NO: 1357465 - DNA, 22 bp, Artificial Sequence
  chemically synthesized
ggagctggccacaatgattgga

SEQ ID NO: 1357466 - DNA, 22 bp, Artificial Sequence
  chemically synthesized
caccctgggagctggccacaat

SEQ ID NO: 1357467 - DNA, 22 bp, Artificial Sequence
  chemically synthesized
ccaccctgggagctggccacaa

SEQ ID NO: 1357468 - DNA, 22 bp, Artificial Sequence
  chemically synthesized
tccaccctgggagctggccaca

SEQ ID NO: 1357469 - DNA, 22 bp, Artificial Sequence
  chemically synthesized
ttttccaccctgggagctggcc

SEQ ID NO: 1357470 - DNA, 22 bp, Artificial Sequence
  chemically synthesized
ccaatcattgtggccagctccc

SEQ ID NO: 1357471 - DNA, 22 bp, Artificial Sequence
  chemically synthesized
attttccaccctgggagctggc

SEQ ID NO: 1357472 - DNA, 22 bp, Artificial Sequence
  chemically synthesized
caatcattgtggccagctccca

SEQ ID NO: 1357473 - DNA, 22 bp, Artificial Sequence
  chemically synthesized
agcttattttccaccctgggag

SEQ ID NO: 1357474 - DNA, 22 bp, Artificial Sequence
  chemically synthesized
ctaagcttattttccaccctgg

SEQ ID NO: 1357475 - DNA, 22 bp, Artificial Sequence
  chemically synthesized
tggccagctcccagggtggaaa

SEQ ID NO: 1357476 - DNA, 22 bp, Artificial Sequence
  chemically synthesized
cattcctaagcttattttccac

SEQ ID NO: 1357477 - DNA, 22 bp, Artificial Sequence
  chemically synthesized
ctgcattcctaagcttattttc

SEQ ID NO: 1357478 - DNA, 22 bp, Artificial Sequence
  chemically synthesized
gctgcattcctaagcttatttt

SEQ ID NO: 1357479 - DNA, 22 bp, Artificial Sequence
  chemically synthesized
ccagggtggaaaataagcttag

SEQ ID NO: 1357480 - DNA, 22 bp, Artificial Sequence
  chemically synthesized
agtttgctgcattcctaagctt

SEQ ID NO: 1357481 - DNA, 22 bp, Artificial Sequence
  chemically synthesized
cagtttgctgcattcctaagct

SEQ ID NO: 1357482 - DNA, 22 bp, Artificial Sequence
  chemically synthesized
agtttcagtttgctgcattcct

SEQ ID NO: 1357483 - DNA, 22 bp, Artificial Sequence
  chemically synthesized
aggaatgcagcaaactgaaact

SEQ ID NO: 1357484 - DNA, 22 bp, Artificial Sequence
  chemically synthesized
cagagagtattcagtttcagtt

SEQ ID NO: 1357485 - DNA, 22 bp, Artificial Sequence
  chemically synthesized
ggaatgcagcaaactgaaactg

SEQ ID NO: 1357486 - DNA, 22 bp, Artificial Sequence
  chemically synthesized
aaactgaatactctctggaatg

SEQ ID NO: 1357487 - DNA, 22 bp, Artificial Sequence
  chemically synthesized
gaacggaatgtccattccagag

SEQ ID NO: 1357488 - DNA, 22 bp, Artificial Sequence
  chemically synthesized
agaacggaatgtccattccaga

SEQ ID NO: 1357489 - DNA, 22 bp, Artificial Sequence
  chemically synthesized
aatactctctggaatggacatt

SEQ ID NO: 1357490 - DNA, 22 bp, Artificial Sequence
  chemically synthesized
aaggagacttagaacggaatgt

SEQ ID NO: 1357491 - DNA, 22 bp, Artificial Sequence
  chemically synthesized
tctggaatggacattccgttct

SEQ ID NO: 1357492 - DNA, 22 bp, Artificial Sequence
  chemically synthesized
ctgaaggagacttagaacggaa

SEQ ID NO: 1357493 - DNA, 22 bp, Artificial Sequence
  chemically synthesized
tggaatggacattccgttctaa

SEQ ID NO: 1357494 - DNA, 22 bp, Artificial Sequence
  chemically synthesized
cctgaaggagacttagaacgga

SEQ ID NO: 1357495 - DNA, 22 bp, Artificial Sequence
  chemically synthesized
gaatggacattccgttctaagt

SEQ ID NO: 1357496 - DNA, 22 bp, Artificial Sequence
  chemically synthesized
gaggtttcctgaaggagactta

SEQ ID NO: 1357497 - DNA, 22 bp, Artificial Sequence
  chemically synthesized
ttggaggtttcctgaaggagac

SEQ ID NO: 1357498 - DNA, 22 bp, Artificial Sequence
  chemically synthesized
ttgttggaggtttcctgaagga

SEQ ID NO: 1357499 - DNA, 22 bp, Artificial Sequence
  chemically synthesized
cgttctaagtctccttcaggaa

SEQ ID NO: 1357500 - DNA, 22 bp, Artificial Sequence
  chemically synthesized
agctattgttggaggtttcctg

SEQ ID NO: 1357501 - DNA, 22 bp, Artificial Sequence
  chemically synthesized
taagtctccttcaggaaacctc

SEQ ID NO: 1357502 - DNA, 22 bp, Artificial Sequence
  chemically synthesized
gagctattgttggaggtttcct

SEQ ID NO: 1357503 - DNA, 22 bp, Artificial Sequence
  chemically synthesized
agtctccttcaggaaacctcca

SEQ ID NO: 1357504 - DNA, 22 bp, Artificial Sequence
  chemically synthesized
cttgagctattgttggaggttt

SEQ ID NO: 1357505 - DNA, 22 bp, Artificial Sequence
  chemically synthesized
ctgcttgagctattgttggagg

SEQ ID NO: 1357506 - DNA, 22 bp, Artificial Sequence
  chemically synthesized
cttcaggaaacctccaacaata

SEQ ID NO: 1357507 - DNA, 22 bp, Artificial Sequence
  chemically synthesized
ctcctgcttgagctattgttgg

SEQ ID NO: 1357508 - DNA, 22 bp, Artificial Sequence
  chemically synthesized
gctcctgcttgagctattgttg

SEQ ID NO: 1357509 - DNA, 22 bp, Artificial Sequence
  chemically synthesized
caggaaacctccaacaatagct

SEQ ID NO: 1357510 - DNA, 22 bp, Artificial Sequence
  chemically synthesized
aggaaacctccaacaatagctc

SEQ ID NO: 1357511 - DNA, 22 bp, Artificial Sequence
  chemically synthesized
caacaatagctcaagcaggagc

SEQ ID NO: 1357512 - DNA, 22 bp, Artificial Sequence
  chemically synthesized
aaagacaagtgtttgctcctgc

SEQ ID NO: 1357513 - DNA, 22 bp, Artificial Sequence
  chemically synthesized
cctcaaagacaagtgtttgctc

SEQ ID NO: 1357514 - DNA, 22 bp, Artificial Sequence
  chemically synthesized
gactacctcaaagacaagtgtt

SEQ ID NO: 1357515 - DNA, 22 bp, Artificial Sequence
  chemically synthesized
aagcaggagcaaacacttgtct

SEQ ID NO: 1357516 - DNA, 22 bp, Artificial Sequence
  chemically synthesized
ggactacctcaaagacaagtgt

SEQ ID NO: 1357517 - DNA, 22 bp, Artificial Sequence
  chemically synthesized
gcttggactacctcaaagacaa

SEQ ID NO: 1357518 - DNA, 22 bp, Artificial Sequence
  chemically synthesized
gtctttgaggtagtccaagcca

SEQ ID NO: 1357519 - DNA, 22 bp, Artificial Sequence
  chemically synthesized
tctttgaggtagtccaagccaa

SEQ ID NO: 1357520 - DNA, 22 bp, Artificial Sequence
  chemically synthesized
agaaagtgaatggttggcttgg

SEQ ID NO: 1357521 - DNA, 22 bp, Artificial Sequence
  chemically synthesized
tgaggtagtccaagccaaccat

SEQ ID NO: 1357522 - DNA, 22 bp, Artificial Sequence
  chemically synthesized
ctgagaaagtgaatggttggct

SEQ ID NO: 1357523 - DNA, 22 bp, Artificial Sequence
  chemically synthesized
gaggtagtccaagccaaccatt

SEQ ID NO: 1357524 - DNA, 22 bp, Artificial Sequence
  chemically synthesized
aggtagtccaagccaaccattc

SEQ ID NO: 1357525 - DNA, 22 bp, Artificial Sequence
  chemically synthesized
aggacagattactgagaaagtg

SEQ ID NO: 1357526 - DNA, 22 bp, Artificial Sequence
  chemically synthesized
actttctcagtaatctgtcctc

SEQ ID NO: 1357527 - DNA, 22 bp, Artificial Sequence
  chemically synthesized
tctcagtaatctgtcctcagac

SEQ ID NO: 1357528 - DNA, 22 bp, Artificial Sequence
  chemically synthesized
agtccagtgggtgtctgaggac

SEQ ID NO: 1357529 - DNA, 22 bp, Artificial Sequence
  chemically synthesized
ctcagtaatctgtcctcagaca

SEQ ID NO: 1357530 - DNA, 22 bp, Artificial Sequence
  chemically synthesized
tcagtaatctgtcctcagacac

SEQ ID NO: 1357531 - DNA, 22 bp, Artificial Sequence
  chemically synthesized
taagtccagtgggtgtctgagg

SEQ ID NO: 1357532 - DNA, 22 bp, Artificial Sequence
  chemically synthesized
agtaatctgtcctcagacaccc

SEQ ID NO: 1357533 - DNA, 22 bp, Artificial Sequence
  chemically synthesized
tcctcagacacccactggactt

SEQ ID NO: 1357534 - DNA, 22 bp, Artificial Sequence
  chemically synthesized
agacacccactggacttagagc

SEQ ID NO: 1357535 - DNA, 22 bp, Artificial Sequence
  chemically synthesized
aggtgggcacaggagctctaag

SEQ ID NO: 1357536 - DNA, 22 bp, Artificial Sequence
  chemically synthesized
gaggtgggcacaggagctctaa

SEQ ID NO: 1357537 - DNA, 22 bp, Artificial Sequence
  chemically synthesized
tgaggtgggcacaggagctcta

SEQ ID NO: 1357538 - DNA, 22 bp, Artificial Sequence
  chemically synthesized
tcctttgaggtgggcacaggag

SEQ ID NO: 1357539 - DNA, 22 bp, Artificial Sequence
  chemically synthesized
gacttagagctcctgtgcccac

SEQ ID NO: 1357540 - DNA, 22 bp, Artificial Sequence
  chemically synthesized
ctgtcctttgaggtgggcacag

SEQ ID NO: 1357541 - DNA, 22 bp, Artificial Sequence
  chemically synthesized
agagctcctgtgcccacctcaa

SEQ ID NO: 1357542 - DNA, 22 bp, Artificial Sequence
  chemically synthesized
gagctcctgtgcccacctcaaa

SEQ ID NO: 1357543 - DNA, 22 bp, Artificial Sequence
  chemically synthesized
ctgtgcccacctcaaaggacag

SEQ ID NO: 1357544 - DNA, 22 bp, Artificial Sequence
  chemically synthesized
tgcccacctcaaaggacagcag

SEQ ID NO: 1357545 - DNA, 22 bp, Artificial Sequence
  chemically synthesized
tagtgcatgcatgccagggctg

SEQ ID NO: 1357546 - DNA, 22 bp, Artificial Sequence
  chemically synthesized
aaaggacagcagccctggcatg

SEQ ID NO: 1357547 - DNA, 22 bp, Artificial Sequence
  chemically synthesized
ctatagtgcatgcatgccaggg

SEQ ID NO: 1357548 - DNA, 22 bp, Artificial Sequence
  chemically synthesized
ctcctatagtgcatgcatgcca

SEQ ID NO: 1357549 - DNA, 22 bp, Artificial Sequence
  chemically synthesized
tgctcctatagtgcatgcatgc

SEQ ID NO: 1357550 - DNA, 22 bp, Artificial Sequence
  chemically synthesized
ctgctcctatagtgcatgcatg

SEQ ID NO: 1357551 - DNA, 22 bp, Artificial Sequence
  chemically synthesized
gcatgcatgcactataggagca

SEQ ID NO: 1357552 - DNA, 22 bp, Artificial Sequence
  chemically synthesized
gagaatcacttctgctcctata

SEQ ID NO: 1357553 - DNA, 22 bp, Artificial Sequence
  chemically synthesized
ggagaatcacttctgctcctat

SEQ ID NO: 1357554 - DNA, 22 bp, Artificial Sequence
  chemically synthesized
taggagcagaagtgattctcca

SEQ ID NO: 1357555 - DNA, 22 bp, Artificial Sequence
  chemically synthesized
tccaaatttctactctgctcac

SEQ ID NO: 1357556 - DNA, 22 bp, Artificial Sequence
  chemically synthesized
caaatttctactctgctcacct

SEQ ID NO: 1357557 - DNA, 22 bp, Artificial Sequence
  chemically synthesized
atgcaaagtggtggagaggtga

SEQ ID NO: 1357558 - DNA, 22 bp, Artificial Sequence
  chemically synthesized
ctactctgctcacctctccacc

SEQ ID NO: 1357559 - DNA, 22 bp, Artificial Sequence
  chemically synthesized
tactctgctcacctctccacca

SEQ ID NO: 1357560 - DNA, 22 bp, Artificial Sequence
  chemically synthesized
ctctgctcacctctccaccact

SEQ ID NO: 1357561 - DNA, 22 bp, Artificial Sequence
  chemically synthesized
tgctcacctctccaccactttg

SEQ ID NO: 1357562 - DNA, 22 bp, Artificial Sequence
  chemically synthesized
ctcacctctccaccactttgca

SEQ ID NO: 1357563 - DNA, 22 bp, Artificial Sequence
  chemically synthesized
acctctccaccactttgcatca

SEQ ID NO: 1357564 - DNA, 22 bp, Artificial Sequence
  chemically synthesized
ggagatgccaaattgatgcaaa

SEQ ID NO: 1357565 - DNA, 22 bp, Artificial Sequence
  chemically synthesized
aggagatgccaaattgatgcaa

SEQ ID NO: 1357566 - DNA, 22 bp, Artificial Sequence
  chemically synthesized
tccaccactttgcatcaatttg

SEQ ID NO: 1357567 - DNA, 22 bp, Artificial Sequence
  chemically synthesized
caccactttgcatcaatttggc

SEQ ID NO: 1357568 - DNA, 22 bp, Artificial Sequence
  chemically synthesized
agatatcttaggagatgccaaa

SEQ ID NO: 1357569 - DNA, 22 bp, Artificial Sequence
  chemically synthesized
tgcatcaatttggcatctccta

SEQ ID NO: 1357570 - DNA, 22 bp, Artificial Sequence
  chemically synthesized
gcatcaatttggcatctcctaa

SEQ ID NO: 1357571 - DNA, 22 bp, Artificial Sequence
  chemically synthesized
catcaatttggcatctcctaag

SEQ ID NO: 1357572 - DNA, 22 bp, Artificial Sequence
  chemically synthesized
caaagctgagatatcttaggag

SEQ ID NO: 1357573 - DNA, 22 bp, Artificial Sequence
  chemically synthesized
ggcatctcctaagatatctcag

SEQ ID NO: 1357574 - DNA, 22 bp, Artificial Sequence
  chemically synthesized
gcatctcctaagatatctcagc

SEQ ID NO: 1357575 - DNA, 22 bp, Artificial Sequence
  chemically synthesized
aggagttacaaagctgagatat

SEQ ID NO: 1357576 - DNA, 22 bp, Artificial Sequence
  chemically synthesized
gaggagttacaaagctgagata

SEQ ID NO: 1357577 - DNA, 22 bp, Artificial Sequence
  chemically synthesized
tgaggagttacaaagctgagat

SEQ ID NO: 1357578 - DNA, 22 bp, Artificial Sequence
  chemically synthesized
ctttgaggagttacaaagctga

SEQ ID NO: 1357579 - DNA, 22 bp, Artificial Sequence
  chemically synthesized
ctaagatatctcagctttgtaa

SEQ ID NO: 1357580 - DNA, 22 bp, Artificial Sequence
  chemically synthesized
agatatctcagctttgtaactc

SEQ ID NO: 1357581 - DNA, 22 bp, Artificial Sequence
  chemically synthesized
tggggattcctttgaggagtta

SEQ ID NO: 1357582 - DNA, 22 bp, Artificial Sequence
  chemically synthesized
gtggggattcctttgaggagtt

SEQ ID NO: 1357583 - DNA, 22 bp, Artificial Sequence
  chemically synthesized
agctttgtaactcctcaaagga

SEQ ID NO: 1357584 - DNA, 22 bp, Artificial Sequence
  chemically synthesized
tgtaactcctcaaaggaatccc

SEQ ID NO: 1357585 - DNA, 22 bp, Artificial Sequence
  chemically synthesized
gtaactcctcaaaggaatcccc

SEQ ID NO: 1357586 - DNA, 22 bp, Artificial Sequence
  chemically synthesized
taactcctcaaaggaatcccca

SEQ ID NO: 1357587 - DNA, 22 bp, Artificial Sequence
  chemically synthesized
ctcaaaggaatccccacaaatt

SEQ ID NO: 1357588 - DNA, 22 bp, Artificial Sequence
  chemically synthesized
aaaaagagccccaatttgtggg

SEQ ID NO: 1357589 - DNA, 22 bp, Artificial Sequence
  chemically synthesized
aaaggaatccccacaaattggg

SEQ ID NO: 1357590 - DNA, 22 bp, Artificial Sequence
  chemically synthesized
aaaggaaatgtccaagttaaaa

SEQ ID NO: 1357591 - DNA, 22 bp, Artificial Sequence
  chemically synthesized
gggctcttttttaacttggaca

SEQ ID NO: 1357592 - DNA, 22 bp, Artificial Sequence
  chemically synthesized
gtctcaaaggaaatgtccaagt

SEQ ID NO: 1357593 - DNA, 22 bp, Artificial Sequence
  chemically synthesized
agtctcaaaggaaatgtccaag

SEQ ID NO: 1357594 - DNA, 22 bp, Artificial Sequence
  chemically synthesized
ttagtctcaaaggaaatgtcca

SEQ ID NO: 1357595 - DNA, 22 bp, Artificial Sequence
  chemically synthesized
cttagtctcaaaggaaatgtcc

SEQ ID NO: 1357596 - DNA, 22 bp, Artificial Sequence
  chemically synthesized
ttttttaacttggacatttcct

SEQ ID NO: 1357597 - DNA, 22 bp, Artificial Sequence
  chemically synthesized
tcttagtctcaaaggaaatgtc

SEQ ID NO: 1357598 - DNA, 22 bp, Artificial Sequence
  chemically synthesized
ttttaacttggacatttccttt

SEQ ID NO: 1357599 - DNA, 22 bp, Artificial Sequence
  chemically synthesized
tttcttagtctcaaaggaaatg

SEQ ID NO: 1357600 - DNA, 22 bp, Artificial Sequence
  chemically synthesized
tttaacttggacatttcctttg

SEQ ID NO: 1357601 - DNA, 22 bp, Artificial Sequence
  chemically synthesized
ctttcttagtctcaaaggaaat

SEQ ID NO: 1357602 - DNA, 22 bp, Artificial Sequence
  chemically synthesized
ttaacttggacatttcctttga

SEQ ID NO: 1357603 - DNA, 22 bp, Artificial Sequence
  chemically synthesized
tctttcttagtctcaaaggaaa

SEQ ID NO: 1357604 - DNA, 22 bp, Artificial Sequence
  chemically synthesized
taacttggacatttcctttgag

SEQ ID NO: 1357605 - DNA, 22 bp, Artificial Sequence
  chemically synthesized
aacttggacatttcctttgaga

SEQ ID NO: 1357606 - DNA, 22 bp, Artificial Sequence
  chemically synthesized
tttctttcttagtctcaaagga

SEQ ID NO: 1357607 - DNA, 22 bp, Artificial Sequence
  chemically synthesized
acttggacatttcctttgagac

SEQ ID NO: 1357608 - DNA, 22 bp, Artificial Sequence
  chemically synthesized
tctttctttcttagtctcaaag

SEQ ID NO: 1357609 - DNA, 22 bp, Artificial Sequence
  chemically synthesized
ctctttctttcttagtctcaaa

SEQ ID NO: 1357610 - DNA, 22 bp, Artificial Sequence
  chemically synthesized
tctctttctttcttagtctcaa

SEQ ID NO: 1357611 - DNA, 22 bp, Artificial Sequence
  chemically synthesized
ggacatttcctttgagactaag
